United States Patent 11,801,313 (MATERIALS AND METHODS FOR TREATMENT OF PAIN RELATED DISORDERS) - sequence listing, part 3

SEQ ID NO: 23444 - DNA, 20 bp, Artificial Sequence
  Description of Artificial Sequence: Synthetic oligonucleotide
  Target: SCN10A; (-) strand; PAM type: NRG; PAM sequence: AAG
agaaagaacttcagagctcg

SEQ ID NO: 23445 - DNA, 20 bp, Artificial Sequence
  Description of Artificial Sequence: Synthetic oligonucleotide
  Target: SCN10A; (-) strand; PAM type: NRG; PAM sequence: GAG
aagtagaagaaagaacttca

SEQ ID NO: 23446 - DNA, 20 bp, Artificial Sequence
  Description of Artificial Sequence: Synthetic oligonucleotide
  Target: SCN10A; (-) strand; PAM type: NRG; PAM sequence: CAG
acaagtagaagaaagaactt

SEQ ID NO: 23447 - DNA, 20 bp, Artificial Sequence
  Description of Artificial Sequence: Synthetic oligonucleotide
  Target: SCN10A; (-) strand; PAM type: NRG; PAM sequence: AAG
agactagaacaagtagaaga

SEQ ID NO: 23448 - DNA, 20 bp, Artificial Sequence
  Description of Artificial Sequence: Synthetic oligonucleotide
  Target: SCN10A; (-) strand; PAM type: NRG; PAM sequence: AAG
caatagactagaacaagtag

SEQ ID NO: 23449 - DNA, 20 bp, Artificial Sequence
  Description of Artificial Sequence: Synthetic oligonucleotide
  Target: SCN10A; (-) strand; PAM type: NRG; PAM sequence: TAG
caacaatagactagaacaag

SEQ ID NO: 23450 - DNA, 20 bp, Artificial Sequence
  Description of Artificial Sequence: Synthetic oligonucleotide
  Target: SCN10A; (-) strand; PAM type: NRG; PAM sequence: AAG
tttcaacaatagactagaac

SEQ ID NO: 23451 - DNA, 20 bp, Artificial Sequence
  Description of Artificial Sequence: Synthetic oligonucleotide
  Target: SCN10A; (-) strand; PAM type: NRG; PAM sequence: TAG
ggaaagtttcaacaatagac

SEQ ID NO: 23452 - DNA, 20 bp, Artificial Sequence
  Description of Artificial Sequence: Synthetic oligonucleotide
  Target: SCN10A; (-) strand; PAM type: NRG; PAM sequence: TAG
gcagtggaaagtttcaacaa

SEQ ID NO: 23453 - DNA, 20 bp, Artificial Sequence
  Description of Artificial Sequence: Synthetic oligonucleotide
  Target: SCN10A; (-) strand; PAM type: NRG; PAM sequence: AAG
gaaatacaaaatgcagtgga

SEQ ID NO: 23454 - DNA, 20 bp, Artificial Sequence
  Description of Artificial Sequence: Synthetic oligonucleotide
  Target: SCN10A; (-) strand; PAM type: NRG; PAM sequence: TGG
tagagaaatacaaaatgcag

SEQ ID NO: 23455 - DNA, 20 bp, Artificial Sequence
  Description of Artificial Sequence: Synthetic oligonucleotide
  Target: SCN10A; (-) strand; PAM type: NRG; PAM sequence: CAG
acttagagaaatacaaaatg

SEQ ID NO: 23456 - DNA, 20 bp, Artificial Sequence
  Description of Artificial Sequence: Synthetic oligonucleotide
  Target: SCN10A; (-) strand; PAM type: NRG; PAM sequence: GAG
ggaaatggaagactcactta

SEQ ID NO: 23457 - DNA, 20 bp, Artificial Sequence
  Description of Artificial Sequence: Synthetic oligonucleotide
  Target: SCN10A; (-) strand; PAM type: NRG; PAM sequence: TAG
ctggaaatggaagactcact

SEQ ID NO: 23458 - DNA, 20 bp, Artificial Sequence
  Description of Artificial Sequence: Synthetic oligonucleotide
  Target: SCN10A; (-) strand; PAM type: NRG; PAM sequence: AAG
atcacaacttctggaaatgg

SEQ ID NO: 23459 - DNA, 20 bp, Artificial Sequence
  Description of Artificial Sequence: Synthetic oligonucleotide
  Target: SCN10A; (-) strand; PAM type: NRG; PAM sequence: TGG
acaatcacaacttctggaaa

SEQ ID NO: 23460 - DNA, 20 bp, Artificial Sequence
  Description of Artificial Sequence: Synthetic oligonucleotide
  Target: SCN10A; (-) strand; PAM type: NRG; PAM sequence: TGG
gaaaaaacaatcacaacttc

SEQ ID NO: 23461 - DNA, 20 bp, Artificial Sequence
  Description of Artificial Sequence: Synthetic oligonucleotide
  Target: SCN10A; (-) strand; PAM type: NRG; PAM sequence: AAG
tctccagagaaatagatata

SEQ ID NO: 23462 - DNA, 20 bp, Artificial Sequence
  Description of Artificial Sequence: Synthetic oligonucleotide
  Target: SCN10A; (-) strand; PAM type: NRG; PAM sequence: TAG
tggaaaattctccagagaaa

SEQ ID NO: 23463 - DNA, 20 bp, Artificial Sequence
  Description of Artificial Sequence: Synthetic oligonucleotide
  Target: SCN10A; (-) strand; PAM type: NRG; PAM sequence: GAG
tatggatggaaaattctcca

SEQ ID NO: 23464 - DNA, 20 bp, Artificial Sequence
  Description of Artificial Sequence: Synthetic oligonucleotide
  Target: SCN10A; (-) strand; PAM type: NRG; PAM sequence: CAG
gatatggatggaaaattctc

SEQ ID NO: 23465 - DNA, 20 bp, Artificial Sequence
  Description of Artificial Sequence: Synthetic oligonucleotide
  Target: SCN10A; (-) strand; PAM type: NRG; PAM sequence: TGG
ttaaaacaacaagatatgga

SEQ ID NO: 23466 - DNA, 20 bp, Artificial Sequence
  Description of Artificial Sequence: Synthetic oligonucleotide
  Target: SCN10A; (-) strand; PAM type: NRG; PAM sequence: TGG
atttttaaaacaacaagata

SEQ ID NO: 23467 - DNA, 20 bp, Artificial Sequence
  Description of Artificial Sequence: Synthetic oligonucleotide
  Target: SCN10A; (-) strand; PAM type: NRG; PAM sequence: AAG
aaagaaatttttaaaacaac

SEQ ID NO: 23468 - DNA, 20 bp, Artificial Sequence
  Description of Artificial Sequence: Synthetic oligonucleotide
  Target: SCN10A; (-) strand; PAM type: NRG; PAM sequence: AAG
gaaagataaaaaccaactta

SEQ ID NO: 23469 - DNA, 20 bp, Artificial Sequence
  Description of Artificial Sequence: Synthetic oligonucleotide
  Target: SCN10A; (-) strand; PAM type: NRG; PAM sequence: AAG
attcaaggagacaccagaga

SEQ ID NO: 23470 - DNA, 20 bp, Artificial Sequence
  Description of Artificial Sequence: Synthetic oligonucleotide
  Target: SCN10A; (-) strand; PAM type: NRG; PAM sequence: GAG
agtgattcaaggagacacca

SEQ ID NO: 23471 - DNA, 20 bp, Artificial Sequence
  Description of Artificial Sequence: Synthetic oligonucleotide
  Target: SCN10A; (-) strand; PAM type: NRG; PAM sequence: CAG
taagtgattcaaggagacac

SEQ ID NO: 23472 - DNA, 20 bp, Artificial Sequence
  Description of Artificial Sequence: Synthetic oligonucleotide
  Target: SCN10A; (-) strand; PAM type: NRG; PAM sequence: GAG
tgattattaagtgattcaag

SEQ ID NO: 23473 - DNA, 20 bp, Artificial Sequence
  Description of Artificial Sequence: Synthetic oligonucleotide
  Target: SCN10A; (-) strand; PAM type: NRG; PAM sequence: AGG
gctgattattaagtgattca

SEQ ID NO: 23474 - DNA, 20 bp, Artificial Sequence
  Description of Artificial Sequence: Synthetic oligonucleotide
  Target: SCN10A; (-) strand; PAM type: NRG; PAM sequence: AAG
ggctgattattaagtgattc

SEQ ID NO: 23475 - DNA, 20 bp, Artificial Sequence
  Description of Artificial Sequence: Synthetic oligonucleotide
  Target: SCN10A; (-) strand; PAM type: NRG; PAM sequence: AAG
aattcagaaggctgattatt

SEQ ID NO: 23476 - DNA, 20 bp, Artificial Sequence
  Description of Artificial Sequence: Synthetic oligonucleotide
  Target: SCN10A; (-) strand; PAM type: NRG; PAM sequence: AGG
aaaaaaaaaaagaattcaga

SEQ ID NO: 23477 - DNA, 20 bp, Artificial Sequence
  Description of Artificial Sequence: Synthetic oligonucleotide
  Target: SCN10A; (-) strand; PAM type: NRG; PAM sequence: AAG
aaaaaaaaaaaagaattcag

SEQ ID NO: 23478 - DNA, 20 bp, Artificial Sequence
  Description of Artificial Sequence: Synthetic oligonucleotide
  Target: SCN10A; (-) strand; PAM type: NRG; PAM sequence: CAG
aaaaaaaaaaaaaaagaatt

SEQ ID NO: 23479 - DNA, 20 bp, Artificial Sequence
  Description of Artificial Sequence: Synthetic oligonucleotide
  Target: SCN10A; (-) strand; PAM type: NRG; PAM sequence: AAG
catctcaaaaaaaaaaaaaa

SEQ ID NO: 23480 - DNA, 20 bp, Artificial Sequence
  Description of Artificial Sequence: Synthetic oligonucleotide
  Target: SCN10A; (-) strand; PAM type: NRG; PAM sequence: GAG
cactccagcctgggcaacaa

SEQ ID NO: 23481 - DNA, 20 bp, Artificial Sequence
  Description of Artificial Sequence: Synthetic oligonucleotide
  Target: SCN10A; (-) strand; PAM type: NRG; PAM sequence: AAG
tgcactccagcctgggcaac

SEQ ID NO: 23482 - DNA, 20 bp, Artificial Sequence
  Description of Artificial Sequence: Synthetic oligonucleotide
  Target: SCN10A; (-) strand; PAM type: NRG; PAM sequence: GGG
gcgccattgcactccagcct

SEQ ID NO: 23483 - DNA, 20 bp, Artificial Sequence
  Description of Artificial Sequence: Synthetic oligonucleotide
  Target: SCN10A; (-) strand; PAM type: NRG; PAM sequence: TGG
cgcgccattgcactccagcc

SEQ ID NO: 23484 - DNA, 20 bp, Artificial Sequence
  Description of Artificial Sequence: Synthetic oligonucleotide
  Target: SCN10A; (-) strand; PAM type: NRG; PAM sequence: CAG
gagatcgcgccattgcactc

SEQ ID NO: 23485 - DNA, 20 bp, Artificial Sequence
  Description of Artificial Sequence: Synthetic oligonucleotide
  Target: SCN10A; (-) strand; PAM type: NRG; PAM sequence: GAG
ggcagaggttgcggtgagct

SEQ ID NO: 23486 - DNA, 20 bp, Artificial Sequence
  Description of Artificial Sequence: Synthetic oligonucleotide
  Target: SCN10A; (-) strand; PAM type: NRG; PAM sequence: GAG
tgggaggcagaggttgcggt

SEQ ID NO: 23487 - DNA, 20 bp, Artificial Sequence
  Description of Artificial Sequence: Synthetic oligonucleotide
  Target: SCN10A; (-) strand; PAM type: NRG; PAM sequence: CGG
aacctgggaggcagaggttg

SEQ ID NO: 23488 - DNA, 20 bp, Artificial Sequence
  Description of Artificial Sequence: Synthetic oligonucleotide
  Target: SCN10A; (-) strand; PAM type: NRG; PAM sequence: AGG
tgcttgaacctgggaggcag

SEQ ID NO: 23489 - DNA, 20 bp, Artificial Sequence
  Description of Artificial Sequence: Synthetic oligonucleotide
  Target: SCN10A; (-) strand; PAM type: NRG; PAM sequence: GAG
ttgcttgaacctgggaggca

SEQ ID NO: 23490 - DNA, 20 bp, Artificial Sequence
  Description of Artificial Sequence: Synthetic oligonucleotide
  Target: SCN10A; (-) strand; PAM type: NRG; PAM sequence: CAG
aattgcttgaacctgggagg

SEQ ID NO: 23491 - DNA, 20 bp, Artificial Sequence
  Description of Artificial Sequence: Synthetic oligonucleotide
  Target: SCN10A; (-) strand; PAM type: NRG; PAM sequence: AGG
gagaattgcttgaacctggg

SEQ ID NO: 23492 - DNA, 20 bp, Artificial Sequence
  Description of Artificial Sequence: Synthetic oligonucleotide
  Target: SCN10A; (-) strand; PAM type: NRG; PAM sequence: GAG
ggagaattgcttgaacctgg

SEQ ID NO: 23493 - DNA, 20 bp, Artificial Sequence
  Description of Artificial Sequence: Synthetic oligonucleotide
  Target: SCN10A; (-) strand; PAM type: NRG; PAM sequence: GGG
caggagaattgcttgaacct

SEQ ID NO: 23494 - DNA, 20 bp, Artificial Sequence
  Description of Artificial Sequence: Synthetic oligonucleotide
  Target: SCN10A; (-) strand; PAM type: NRG; PAM sequence: TGG
gcaggagaattgcttgaacc

SEQ ID NO: 23495 - DNA, 20 bp, Artificial Sequence
  Description of Artificial Sequence: Synthetic oligonucleotide
  Target: SCN10A; (-) strand; PAM type: NRG; PAM sequence: GAG
tactcaggagactgaggcag

SEQ ID NO: 23496 - DNA, 20 bp, Artificial Sequence
  Description of Artificial Sequence: Synthetic oligonucleotide
  Target: SCN10A; (-) strand; PAM type: NRG; PAM sequence: AGG
gctactcaggagactgaggc

SEQ ID NO: 23497 - DNA, 20 bp, Artificial Sequence
  Description of Artificial Sequence: Synthetic oligonucleotide
  Target: SCN10A; (-) strand; PAM type: NRG; PAM sequence: CAG
agctactcaggagactgagg

SEQ ID NO: 23498 - DNA, 20 bp, Artificial Sequence
  Description of Artificial Sequence: Synthetic oligonucleotide
  Target: SCN10A; (-) strand; PAM type: NRG; PAM sequence: AGG
cccagctactcaggagactg

SEQ ID NO: 23499 - DNA, 20 bp, Artificial Sequence
  Description of Artificial Sequence: Synthetic oligonucleotide
  Target: SCN10A; (-) strand; PAM type: NRG; PAM sequence: GAG
tcccagctactcaggagact

SEQ ID NO: 23500 - DNA, 20 bp, Artificial Sequence
  Description of Artificial Sequence: Synthetic oligonucleotide
  Target: SCN10A; (-) strand; PAM type: NRG; PAM sequence: GAG
ctgtaatcccagctactcag

SEQ ID NO: 23501 - DNA, 20 bp, Artificial Sequence
  Description of Artificial Sequence: Synthetic oligonucleotide
  Target: SCN10A; (-) strand; PAM type: NRG; PAM sequence: AGG
gcctgtaatcccagctactc

SEQ ID NO: 23502 - DNA, 20 bp, Artificial Sequence
  Description of Artificial Sequence: Synthetic oligonucleotide
  Target: SCN10A; (-) strand; PAM type: NRG; PAM sequence: CAG
tgcctgtaatcccagctact

SEQ ID NO: 23503 - DNA, 20 bp, Artificial Sequence
  Description of Artificial Sequence: Synthetic oligonucleotide
  Target: SCN10A; (-) strand; PAM type: NRG; PAM sequence: CAG
gtggtgcatgcctgtaatcc

SEQ ID NO: 23504 - DNA, 20 bp, Artificial Sequence
  Description of Artificial Sequence: Synthetic oligonucleotide
  Target: SCN10A; (-) strand; PAM type: NRG; PAM sequence: TGG
acaaaattagctagatgtgg

SEQ ID NO: 23505 - DNA, 20 bp, Artificial Sequence
  Description of Artificial Sequence: Synthetic oligonucleotide
  Target: SCN10A; (-) strand; PAM type: NRG; PAM sequence: TGG
aatacaaaattagctagatg

SEQ ID NO: 23506 - DNA, 20 bp, Artificial Sequence
  Description of Artificial Sequence: Synthetic oligonucleotide
  Target: SCN10A; (-) strand; PAM type: NRG; PAM sequence: TAG
ctaaaaaatacaaaattagc

SEQ ID NO: 23507 - DNA, 20 bp, Artificial Sequence
  Description of Artificial Sequence: Synthetic oligonucleotide
  Target: SCN10A; (-) strand; PAM type: NRG; PAM sequence: TAG
tctactaaaaaatacaaaat

SEQ ID NO: 23508 - DNA, 20 bp, Artificial Sequence
  Description of Artificial Sequence: Synthetic oligonucleotide
  Target: SCN10A; (-) strand; PAM type: NRG; PAM sequence: GAG
accagcctgaagccaacatg

SEQ ID NO: 23509 - DNA, 20 bp, Artificial Sequence
  Description of Artificial Sequence: Synthetic oligonucleotide
  Target: SCN10A; (-) strand; PAM type: NRG; PAM sequence: TGG
agaccagcctgaagccaaca

SEQ ID NO: 23510 - DNA, 20 bp, Artificial Sequence
  Description of Artificial Sequence: Synthetic oligonucleotide
  Target: SCN10A; (-) strand; PAM type: NRG; PAM sequence: AAG
agaagttcaagaccagcctg

SEQ ID NO: 23511 - DNA, 20 bp, Artificial Sequence
  Description of Artificial Sequence: Synthetic oligonucleotide
  Target: SCN10A; (-) strand; PAM type: NRG; PAM sequence: CAG
tgaggtcagaagttcaagac

SEQ ID NO: 23512 - DNA, 20 bp, Artificial Sequence
  Description of Artificial Sequence: Synthetic oligonucleotide
  Target: SCN10A; (-) strand; PAM type: NRG; PAM sequence: AAG
tcacctgaggtcagaagttc

SEQ ID NO: 23513 - DNA, 20 bp, Artificial Sequence
  Description of Artificial Sequence: Synthetic oligonucleotide
  Target: SCN10A; (-) strand; PAM type: NRG; PAM sequence: AAG
ggcagatcacctgaggtcag

SEQ ID NO: 23514 - DNA, 20 bp, Artificial Sequence
  Description of Artificial Sequence: Synthetic oligonucleotide
  Target: SCN10A; (-) strand; PAM type: NRG; PAM sequence: CAG
gtgggcagatcacctgaggt

SEQ ID NO: 23515 - DNA, 20 bp, Artificial Sequence
  Description of Artificial Sequence: Synthetic oligonucleotide
  Target: SCN10A; (-) strand; PAM type: NRG; PAM sequence: AGG
caaggtgggcagatcacctg

SEQ ID NO: 23516 - DNA, 20 bp, Artificial Sequence
  Description of Artificial Sequence: Synthetic oligonucleotide
  Target: SCN10A; (-) strand; PAM type: NRG; PAM sequence: GAG
ccaaggtgggcagatcacct

SEQ ID NO: 23517 - DNA, 20 bp, Artificial Sequence
  Description of Artificial Sequence: Synthetic oligonucleotide
  Target: SCN10A; (-) strand; PAM type: NRG; PAM sequence: CAG
ctttgggaggccaaggtggg

SEQ ID NO: 23518 - DNA, 20 bp, Artificial Sequence
  Description of Artificial Sequence: Synthetic oligonucleotide
  Target: SCN10A; (-) strand; PAM type: NRG; PAM sequence: GGG
gcactttgggaggccaaggt

SEQ ID NO: 23519 - DNA, 20 bp, Artificial Sequence
  Description of Artificial Sequence: Synthetic oligonucleotide
  Target: SCN10A; (-) strand; PAM type: NRG; PAM sequence: TGG
agcactttgggaggccaagg

SEQ ID NO: 23520 - DNA, 20 bp, Artificial Sequence
  Description of Artificial Sequence: Synthetic oligonucleotide
  Target: SCN10A; (-) strand; PAM type: NRG; PAM sequence: AGG
ctcagcactttgggaggcca

SEQ ID NO: 23521 - DNA, 20 bp, Artificial Sequence
  Description of Artificial Sequence: Synthetic oligonucleotide
  Target: SCN10A; (-) strand; PAM type: NRG; PAM sequence: AAG
tctcagcactttgggaggcc

SEQ ID NO: 23522 - DNA, 20 bp, Artificial Sequence
  Description of Artificial Sequence: Synthetic oligonucleotide
  Target: SCN10A; (-) strand; PAM type: NRG; PAM sequence: AGG
tgtaatctcagcactttggg

SEQ ID NO: 23523 - DNA, 20 bp, Artificial Sequence
  Description of Artificial Sequence: Synthetic oligonucleotide
  Target: SCN10A; (-) strand; PAM type: NRG; PAM sequence: GAG
ctgtaatctcagcactttgg

SEQ ID NO: 23524 - DNA, 20 bp, Artificial Sequence
  Description of Artificial Sequence: Synthetic oligonucleotide
  Target: SCN10A; (-) strand; PAM type: NRG; PAM sequence: GGG
gcctgtaatctcagcacttt

SEQ ID NO: 23525 - DNA, 20 bp, Artificial Sequence
  Description of Artificial Sequence: Synthetic oligonucleotide
  Target: SCN10A; (-) strand; PAM type: NRG; PAM sequence: TGG
cgcctgtaatctcagcactt

SEQ ID NO: 23526 - DNA, 20 bp, Artificial Sequence
  Description of Artificial Sequence: Synthetic oligonucleotide
  Target: SCN10A; (-) strand; PAM type: NRG; PAM sequence: CAG
gtagctcacgcctgtaatct

SEQ ID NO: 23527 - DNA, 20 bp, Artificial Sequence
  Description of Artificial Sequence: Synthetic oligonucleotide
  Target: SCN10A; (-) strand; PAM type: NRG; PAM sequence: TAG
gaattcagggctgggcacag

SEQ ID NO: 23528 - DNA, 20 bp, Artificial Sequence
  Description of Artificial Sequence: Synthetic oligonucleotide
  Target: SCN10A; (-) strand; PAM type: NRG; PAM sequence: CAG
aaagaattcagggctgggca

SEQ ID NO: 23529 - DNA, 20 bp, Artificial Sequence
  Description of Artificial Sequence: Synthetic oligonucleotide
  Target: SCN10A; (-) strand; PAM type: NRG; PAM sequence: GGG
cagataaagaattcagggct

SEQ ID NO: 23530 - DNA, 20 bp, Artificial Sequence
  Description of Artificial Sequence: Synthetic oligonucleotide
  Target: SCN10A; (-) strand; PAM type: NRG; PAM sequence: TGG
ccagataaagaattcagggc

SEQ ID NO: 23531 - DNA, 20 bp, Artificial Sequence
  Description of Artificial Sequence: Synthetic oligonucleotide
  Target: SCN10A; (-) strand; PAM type: NRG; PAM sequence: GGG
attgccagataaagaattca

SEQ ID NO: 23532 - DNA, 20 bp, Artificial Sequence
  Description of Artificial Sequence: Synthetic oligonucleotide
  Target: SCN10A; (-) strand; PAM type: NRG; PAM sequence: AGG
aattgccagataaagaattc

SEQ ID NO: 23533 - DNA, 20 bp, Artificial Sequence
  Description of Artificial Sequence: Synthetic oligonucleotide
  Target: SCN10A; (-) strand; PAM type: NRG; PAM sequence: CAG
gaattgccagataaagaatt

SEQ ID NO: 23534 - DNA, 20 bp, Artificial Sequence
  Description of Artificial Sequence: Synthetic oligonucleotide
  Target: SCN10A; (-) strand; PAM type: NRG; PAM sequence: AAG
aatctctgaattgccagata

SEQ ID NO: 23535 - DNA, 20 bp, Artificial Sequence
  Description of Artificial Sequence: Synthetic oligonucleotide
  Target: SCN10A; (-) strand; PAM type: NRG; PAM sequence: CAG
agaagaaatctctgaattgc

SEQ ID NO: 23536 - DNA, 20 bp, Artificial Sequence
  Description of Artificial Sequence: Synthetic oligonucleotide
  Target: SCN10A; (-) strand; PAM type: NRG; PAM sequence: AAG
aacaatggatccaaactaag

SEQ ID NO: 23537 - DNA, 20 bp, Artificial Sequence
  Description of Artificial Sequence: Synthetic oligonucleotide
  Target: SCN10A; (-) strand; PAM type: NRG; PAM sequence: AAG
cccaacaatggatccaaact

SEQ ID NO: 23538 - DNA, 20 bp, Artificial Sequence
  Description of Artificial Sequence: Synthetic oligonucleotide
  Target: SCN10A; (-) strand; PAM type: NRG; PAM sequence: TGG
tcaaactagctccccaacaa

SEQ ID NO: 23539 - DNA, 20 bp, Artificial Sequence
  Description of Artificial Sequence: Synthetic oligonucleotide
  Target: SCN10A; (-) strand; PAM type: NRG; PAM sequence: TAG
cacccctcaaaagatcaaac

SEQ ID NO: 23540 - DNA, 20 bp, Artificial Sequence
  Description of Artificial Sequence: Synthetic oligonucleotide
  Target: SCN10A; (-) strand; PAM type: NRG; PAM sequence: AAG
ggttcaataacacccctcaa

SEQ ID NO: 23541 - DNA, 20 bp, Artificial Sequence
  Description of Artificial Sequence: Synthetic oligonucleotide
  Target: SCN10A; (-) strand; PAM type: NRG; PAM sequence: GGG
tctggtaatatgacaaaaga

SEQ ID NO: 23542 - DNA, 20 bp, Artificial Sequence
  Description of Artificial Sequence: Synthetic oligonucleotide
  Target: SCN10A; (-) strand; PAM type: NRG; PAM sequence: AGG
ttctggtaatatgacaaaag

SEQ ID NO: 23543 - DNA, 20 bp, Artificial Sequence
  Description of Artificial Sequence: Synthetic oligonucleotide
  Target: SCN10A; (-) strand; PAM type: NRG; PAM sequence: GAG
attctggtaatatgacaaaa

SEQ ID NO: 23544 - DNA, 20 bp, Artificial Sequence
  Description of Artificial Sequence: Synthetic oligonucleotide
  Target: SCN10A; (-) strand; PAM type: NRG; PAM sequence: AAG
caattctggtaatatgacaa

SEQ ID NO: 23545 - DNA, 20 bp, Artificial Sequence
  Description of Artificial Sequence: Synthetic oligonucleotide
  Target: SCN10A; (-) strand; PAM type: NRG; PAM sequence: TGG
aggaaccagaaaagcaattc

SEQ ID NO: 23546 - DNA, 20 bp, Artificial Sequence
  Description of Artificial Sequence: Synthetic oligonucleotide
  Target: SCN10A; (-) strand; PAM type: NRG; PAM sequence: AAG
caaatgagaaggaaccagaa

SEQ ID NO: 23547 - DNA, 20 bp, Artificial Sequence
  Description of Artificial Sequence: Synthetic oligonucleotide
  Target: SCN10A; (-) strand; PAM type: NRG; PAM sequence: CAG
ctactcaaatgagaaggaac

SEQ ID NO: 23548 - DNA, 20 bp, Artificial Sequence
  Description of Artificial Sequence: Synthetic oligonucleotide
  Target: SCN10A; (-) strand; PAM type: NRG; PAM sequence: AGG
aatagtctactcaaatgaga

SEQ ID NO: 23549 - DNA, 20 bp, Artificial Sequence
  Description of Artificial Sequence: Synthetic oligonucleotide
  Target: SCN10A; (-) strand; PAM type: NRG; PAM sequence: AAG
aaatagtctactcaaatgag

SEQ ID NO: 23550 - DNA, 20 bp, Artificial Sequence
  Description of Artificial Sequence: Synthetic oligonucleotide
  Target: SCN10A; (-) strand; PAM type: NRG; PAM sequence: GAG
ctgaaatagtctactcaaat

SEQ ID NO: 23551 - DNA, 20 bp, Artificial Sequence
  Description of Artificial Sequence: Synthetic oligonucleotide
  Target: SCN10A; (-) strand; PAM type: NRG; PAM sequence: TAG
tccagatcttttctctgaaa

SEQ ID NO: 23552 - DNA, 20 bp, Artificial Sequence
  Description of Artificial Sequence: Synthetic oligonucleotide
  Target: SCN10A; (-) strand; PAM type: NRG; PAM sequence: CAG
gcacaacagccattcagttc

SEQ ID NO: 23553 - DNA, 20 bp, Artificial Sequence
  Description of Artificial Sequence: Synthetic oligonucleotide
  Target: SCN10A; (-) strand; PAM type: NRG; PAM sequence: CAG
gaatctgcacaacagccatt

SEQ ID NO: 23554 - DNA, 20 bp, Artificial Sequence
  Description of Artificial Sequence: Synthetic oligonucleotide
  Target: SCN10A; (-) strand; PAM type: NRG; PAM sequence: CAG
aaacaaaagaatctgcacaa

SEQ ID NO: 23555 - DNA, 20 bp, Artificial Sequence
  Description of Artificial Sequence: Synthetic oligonucleotide
  Target: SCN10A; (-) strand; PAM type: NRG; PAM sequence: AAG
agagatcacccatgaaacaa

SEQ ID NO: 23556 - DNA, 20 bp, Artificial Sequence
  Description of Artificial Sequence: Synthetic oligonucleotide
  Target: SCN10A; (-) strand; PAM type: NRG; PAM sequence: GAG
tggggagagcaccacatcaa

SEQ ID NO: 23557 - DNA, 20 bp, Artificial Sequence
  Description of Artificial Sequence: Synthetic oligonucleotide
  Target: SCN10A; (-) strand; PAM type: NRG; PAM sequence: AAG
attggggagagcaccacatc

SEQ ID NO: 23558 - DNA, 20 bp, Artificial Sequence
  Description of Artificial Sequence: Synthetic oligonucleotide
  Target: SCN10A; (-) strand; PAM type: NRG; PAM sequence: GAG
catccccaggggattgggga

SEQ ID NO: 23559 - DNA, 20 bp, Artificial Sequence
  Description of Artificial Sequence: Synthetic oligonucleotide
  Target: SCN10A; (-) strand; PAM type: NRG; PAM sequence: GAG
cccatccccaggggattggg

SEQ ID NO: 23560 - DNA, 20 bp, Artificial Sequence
  Description of Artificial Sequence: Synthetic oligonucleotide
  Target: SCN10A; (-) strand; PAM type: NRG; PAM sequence: GGG
gccccatccccaggggattg

SEQ ID NO: 23561 - DNA, 20 bp, Artificial Sequence
  Description of Artificial Sequence: Synthetic oligonucleotide
  Target: SCN10A; (-) strand; PAM type: NRG; PAM sequence: GGG
agccccatccccaggggatt

SEQ ID NO: 23562 - DNA, 20 bp, Artificial Sequence
  Description of Artificial Sequence: Synthetic oligonucleotide
  Target: SCN10A; (-) strand; PAM type: NRG; PAM sequence: TGG
aagccccatccccaggggat

SEQ ID NO: 23563 - DNA, 20 bp, Artificial Sequence
  Description of Artificial Sequence: Synthetic oligonucleotide
  Target: SCN10A; (-) strand; PAM type: NRG; PAM sequence: GGG
tcaggaagccccatccccag

SEQ ID NO: 23564 - DNA, 20 bp, Artificial Sequence
  Description of Artificial Sequence: Synthetic oligonucleotide
  Target: SCN10A; (-) strand; PAM type: NRG; PAM sequence: GGG
ctcaggaagccccatcccca

SEQ ID NO: 23565 - DNA, 20 bp, Artificial Sequence
  Description of Artificial Sequence: Synthetic oligonucleotide
  Target: SCN10A; (-) strand; PAM type: NRG; PAM sequence: AGG
tctcaggaagccccatcccc

SEQ ID NO: 23566 - DNA, 20 bp, Artificial Sequence
  Description of Artificial Sequence: Synthetic oligonucleotide
  Target: SCN10A; (-) strand; PAM type: NRG; PAM sequence: CAG
ctctcaggaagccccatccc

SEQ ID NO: 23567 - DNA, 20 bp, Artificial Sequence
  Description of Artificial Sequence: Synthetic oligonucleotide
  Target: SCN10A; (-) strand; PAM type: NRG; PAM sequence: AAG
actgcagtccagctctcagg

SEQ ID NO: 23568 - DNA, 20 bp, Artificial Sequence
  Description of Artificial Sequence: Synthetic oligonucleotide
  Target: SCN10A; (-) strand; PAM type: NRG; PAM sequence: AGG
atcactgcagtccagctctc

SEQ ID NO: 23569 - DNA, 20 bp, Artificial Sequence
  Description of Artificial Sequence: Synthetic oligonucleotide
  Target: SCN10A; (-) strand; PAM type: NRG; PAM sequence: CAG
gatcactgcagtccagctct

SEQ ID NO: 23570 - DNA, 20 bp, Artificial Sequence
  Description of Artificial Sequence: Synthetic oligonucleotide
  Target: SCN10A; (-) strand; PAM type: NRG; PAM sequence: CAG
caataacgatcactgcagtc

SEQ ID NO: 23571 - DNA, 20 bp, Artificial Sequence
  Description of Artificial Sequence: Synthetic oligonucleotide
  Target: SCN10A; (-) strand; PAM type: NRG; PAM sequence: CAG
aagaacaataacgatcactg

SEQ ID NO: 23572 - DNA, 20 bp, Artificial Sequence
  Description of Artificial Sequence: Synthetic oligonucleotide
  Target: SCN10A; (-) strand; PAM type: NRG; PAM sequence: AAG
ctctgtgtggctaggcccag

SEQ ID NO: 23573 - DNA, 20 bp, Artificial Sequence
  Description of Artificial Sequence: Synthetic oligonucleotide
  Target: SCN10A; (-) strand; PAM type: NRG; PAM sequence: CAG
cccctctgtgtggctaggcc

SEQ ID NO: 23574 - DNA, 20 bp, Artificial Sequence
  Description of Artificial Sequence: Synthetic oligonucleotide
  Target: SCN10A; (-) strand; PAM type: NRG; PAM sequence: AGG
ggtagcccctctgtgtggct

SEQ ID NO: 23575 - DNA, 20 bp, Artificial Sequence
  Description of Artificial Sequence: Synthetic oligonucleotide
  Target: SCN10A; (-) strand; PAM type: NRG; PAM sequence: TAG
tggtagcccctctgtgtggc

SEQ ID NO: 23576 - DNA, 20 bp, Artificial Sequence
  Description of Artificial Sequence: Synthetic oligonucleotide
  Target: SCN10A; (-) strand; PAM type: NRG; PAM sequence: TGG
agcctggtagcccctctgtg

SEQ ID NO: 23577 - DNA, 20 bp, Artificial Sequence
  Description of Artificial Sequence: Synthetic oligonucleotide
  Target: SCN10A; (-) strand; PAM type: NRG; PAM sequence: TAG
agtactaccccagagcctgg

SEQ ID NO: 23578 - DNA, 20 bp, Artificial Sequence
  Description of Artificial Sequence: Synthetic oligonucleotide
  Target: SCN10A; (-) strand; PAM type: NRG; PAM sequence: TGG
cccagtactaccccagagcc

SEQ ID NO: 23579 - DNA, 20 bp, Artificial Sequence
  Description of Artificial Sequence: Synthetic oligonucleotide
  Target: SCN10A; (-) strand; PAM type: NRG; PAM sequence: GAG
catttcccagtactacccca

SEQ ID NO: 23580 - DNA, 20 bp, Artificial Sequence
  Description of Artificial Sequence: Synthetic oligonucleotide
  Target: SCN10A; (-) strand; PAM type: NRG; PAM sequence: CAG
ggcatttcccagtactaccc

SEQ ID NO: 23581 - DNA, 20 bp, Artificial Sequence
  Description of Artificial Sequence: Synthetic oligonucleotide
  Target: SCN10A; (-) strand; PAM type: NRG; PAM sequence: CAG
ggactcttgcaggcatttcc

SEQ ID NO: 23582 - DNA, 20 bp, Artificial Sequence
  Description of Artificial Sequence: Synthetic oligonucleotide
  Target: SCN10A; (-) strand; PAM type: NRG; PAM sequence: AGG
tcacatcacaggactcttgc

SEQ ID NO: 23583 - DNA, 20 bp, Artificial Sequence
  Description of Artificial Sequence: Synthetic oligonucleotide
  Target: SCN10A; (-) strand; PAM type: NRG; PAM sequence: CAG
atcacatcacaggactcttg

SEQ ID NO: 23584 - DNA, 20 bp, Artificial Sequence
  Description of Artificial Sequence: Synthetic oligonucleotide
  Target: SCN10A; (-) strand; PAM type: NRG; PAM sequence: AGG
ttcaagatcaatcacatcac

SEQ ID NO: 23585 - DNA, 20 bp, Artificial Sequence
  Description of Artificial Sequence: Synthetic oligonucleotide
  Target: SCN10A; (-) strand; PAM type: NRG; PAM sequence: CAG
cttcaagatcaatcacatca

SEQ ID NO: 23586 - DNA, 20 bp, Artificial Sequence
  Description of Artificial Sequence: Synthetic oligonucleotide
  Target: SCN10A; (-) strand; PAM type: NRG; PAM sequence: AAG
atccatggctgggagacttc

SEQ ID NO: 23587 - DNA, 20 bp, Artificial Sequence
  Description of Artificial Sequence: Synthetic oligonucleotide
  Target: SCN10A; (-) strand; PAM type: NRG; PAM sequence: GAG
atgctgatatccatggctgg

SEQ ID NO: 23588 - DNA, 20 bp, Artificial Sequence
  Description of Artificial Sequence: Synthetic oligonucleotide
  Target: SCN10A; (-) strand; PAM type: NRG; PAM sequence: GGG
agatgctgatatccatggct

SEQ ID NO: 23589 - DNA, 20 bp, Artificial Sequence
  Description of Artificial Sequence: Synthetic oligonucleotide
  Target: SCN10A; (-) strand; PAM type: NRG; PAM sequence: TGG
cagatgctgatatccatggc

SEQ ID NO: 23590 - DNA, 20 bp, Artificial Sequence
  Description of Artificial Sequence: Synthetic oligonucleotide
  Target: SCN10A; (-) strand; PAM type: NRG; PAM sequence: TGG
agaacagatgctgatatcca

SEQ ID NO: 23591 - DNA, 20 bp, Artificial Sequence
  Description of Artificial Sequence: Synthetic oligonucleotide
  Target: SCN10A; (-) strand; PAM type: NRG; PAM sequence: CAG
ctctgccaccttcaccagaa

SEQ ID NO: 23592 - DNA, 20 bp, Artificial Sequence
  Description of Artificial Sequence: Synthetic oligonucleotide
  Target: SCN10A; (-) strand; PAM type: NRG; PAM sequence: CAG
cattcctctgccaccttcac

SEQ ID NO: 23593 - DNA, 20 bp, Artificial Sequence
  Description of Artificial Sequence: Synthetic oligonucleotide
  Target: SCN10A; (-) strand; PAM type: NRG; PAM sequence: CAG
tctacagcctaggactctca

SEQ ID NO: 23594 - DNA, 20 bp, Artificial Sequence
  Description of Artificial Sequence: Synthetic oligonucleotide
  Target: SCN10A; (-) strand; PAM type: NRG; PAM sequence: AGG
actaaatctatctacagcct

SEQ ID NO: 23595 - DNA, 20 bp, Artificial Sequence
  Description of Artificial Sequence: Synthetic oligonucleotide
  Target: SCN10A; (-) strand; PAM type: NRG; PAM sequence: TAG
cactaaatctatctacagcc

SEQ ID NO: 23596 - DNA, 20 bp, Artificial Sequence
  Description of Artificial Sequence: Synthetic oligonucleotide
  Target: SCN10A; (-) strand; PAM type: NRG; PAM sequence: CAG
cagcacactaaatctatcta

SEQ ID NO: 23597 - DNA, 20 bp, Artificial Sequence
  Description of Artificial Sequence: Synthetic oligonucleotide
  Target: SCN10A; (-) strand; PAM type: NRG; PAM sequence: CAG
taactagcattcaagaaagc

SEQ ID NO: 23598 - DNA, 20 bp, Artificial Sequence
  Description of Artificial Sequence: Synthetic oligonucleotide
  Target: SCN10A; (-) strand; PAM type: NRG; PAM sequence: AAG
aacataactagcattcaaga

SEQ ID NO: 23599 - DNA, 20 bp, Artificial Sequence
  Description of Artificial Sequence: Synthetic oligonucleotide
  Target: SCN10A; (-) strand; PAM type: NRG; PAM sequence: AAG
tgctaacataactagcattc

SEQ ID NO: 23600 - DNA, 20 bp, Artificial Sequence
  Description of Artificial Sequence: Synthetic oligonucleotide
  Target: SCN10A; (-) strand; PAM type: NRG; PAM sequence: TAG
aacttcactgctaacataac

SEQ ID NO: 23601 - DNA, 20 bp, Artificial Sequence
  Description of Artificial Sequence: Synthetic oligonucleotide
  Target: SCN10A; (-) strand; PAM type: NRG; PAM sequence: GAG
cctggctaaccagacgtcct

SEQ ID NO: 23602 - DNA, 20 bp, Artificial Sequence
  Description of Artificial Sequence: Synthetic oligonucleotide
  Target: SCN10A; (-) strand; PAM type: NRG; PAM sequence: CAG
cctgcaacatcctggctaac

SEQ ID NO: 23603 - DNA, 20 bp, Artificial Sequence
  Description of Artificial Sequence: Synthetic oligonucleotide
  Target: SCN10A; (-) strand; PAM type: NRG; PAM sequence: TGG
ttgcactgcctgcaacatcc

SEQ ID NO: 23604 - DNA, 20 bp, Artificial Sequence
  Description of Artificial Sequence: Synthetic oligonucleotide
  Target: SCN10A; (-) strand; PAM type: NRG; PAM sequence: CAG
aggaaaaagaaaacaacaac

SEQ ID NO: 23605 - DNA, 20 bp, Artificial Sequence
  Description of Artificial Sequence: Synthetic oligonucleotide
  Target: SCN10A; (-) strand; PAM type: NRG; PAM sequence: AAG
ataactttgatcccaggaaa

SEQ ID NO: 23606 - DNA, 20 bp, Artificial Sequence
  Description of Artificial Sequence: Synthetic oligonucleotide
  Target: SCN10A; (-) strand; PAM type: NRG; PAM sequence: AGG
gacagaataactttgatccc

SEQ ID NO: 23607 - DNA, 20 bp, Artificial Sequence
  Description of Artificial Sequence: Synthetic oligonucleotide
  Target: SCN10A; (-) strand; PAM type: NRG; PAM sequence: CAG
tgacagaataactttgatcc

SEQ ID NO: 23608 - DNA, 20 bp, Artificial Sequence
  Description of Artificial Sequence: Synthetic oligonucleotide
  Target: SCN10A; (-) strand; PAM type: NRG; PAM sequence: CAG
gccattaaagcaactcatga

SEQ ID NO: 23609 - DNA, 20 bp, Artificial Sequence
  Description of Artificial Sequence: Synthetic oligonucleotide
  Target: SCN10A; (-) strand; PAM type: NRG; PAM sequence: AAG
tcaaacagctcaggccatta

SEQ ID NO: 23610 - DNA, 20 bp, Artificial Sequence
  Description of Artificial Sequence: Synthetic oligonucleotide
  Target: SCN10A; (-) strand; PAM type: NRG; PAM sequence: AGG
ggctggaggtcaaacagctc

SEQ ID NO: 23611 - DNA, 20 bp, Artificial Sequence
  Description of Artificial Sequence: Synthetic oligonucleotide
  Target: SCN10A; (-) strand; PAM type: NRG; PAM sequence: CAG
cggctggaggtcaaacagct

SEQ ID NO: 23612 - DNA, 20 bp, Artificial Sequence
  Description of Artificial Sequence: Synthetic oligonucleotide
  Target: SCN10A; (-) strand; PAM type: NRG; PAM sequence: CAG
cctaccggctggaggtcaaa

SEQ ID NO: 23613 - DNA, 20 bp, Artificial Sequence
  Description of Artificial Sequence: Synthetic oligonucleotide
  Target: SCN10A; (-) strand; PAM type: NRG; PAM sequence: AGG
aagcatcacctaccggctgg

SEQ ID NO: 23614 - DNA, 20 bp, Artificial Sequence
  Description of Artificial Sequence: Synthetic oligonucleotide
  Target: SCN10A; (-) strand; PAM type: NRG; PAM sequence: GAG
aaagcatcacctaccggctg

SEQ ID NO: 23615 - DNA, 20 bp, Artificial Sequence
  Description of Artificial Sequence: Synthetic oligonucleotide
  Target: SCN10A; (-) strand; PAM type: NRG; PAM sequence: TGG
tgaaagcatcacctaccggc

SEQ ID NO: 23616 - DNA, 20 bp, Artificial Sequence
  Description of Artificial Sequence: Synthetic oligonucleotide
  Target: SCN10A; (-) strand; PAM type: NRG; PAM sequence: CGG
ctcttgaaagcatcacctac

SEQ ID NO: 23617 - DNA, 20 bp, Artificial Sequence
  Description of Artificial Sequence: Synthetic oligonucleotide
  Target: SCN10A; (-) strand; PAM type: NRG; PAM sequence: AAG
atgcactagtgctctcttga

SEQ ID NO: 23618 - DNA, 20 bp, Artificial Sequence
  Description of Artificial Sequence: Synthetic oligonucleotide
  Target: SCN10A; (-) strand; PAM type: NRG; PAM sequence: TAG
tcccccttctactaatgcac

SEQ ID NO: 23619 - DNA, 20 bp, Artificial Sequence
  Description of Artificial Sequence: Synthetic oligonucleotide
  Target: SCN10A; (-) strand; PAM type: NRG; PAM sequence: TAG
tggccaacttagggtgagct

SEQ ID NO: 23620 - DNA, 20 bp, Artificial Sequence
  Description of Artificial Sequence: Synthetic oligonucleotide
  Target: SCN10A; (-) strand; PAM type: NRG; PAM sequence: GAG
taccctggccaacttagggt

SEQ ID NO: 23621 - DNA, 20 bp, Artificial Sequence
  Description of Artificial Sequence: Synthetic oligonucleotide
  Target: SCN10A; (-) strand; PAM type: NRG; PAM sequence: GGG
tatttaccctggccaactta

SEQ ID NO: 23622 - DNA, 20 bp, Artificial Sequence
  Description of Artificial Sequence: Synthetic oligonucleotide
  Target: SCN10A; (-) strand; PAM type: NRG; PAM sequence: AGG
atatttaccctggccaactt

SEQ ID NO: 23623 - DNA, 20 bp, Artificial Sequence
  Description of Artificial Sequence: Synthetic oligonucleotide
  Target: SCN10A; (-) strand; PAM type: NRG; PAM sequence: TAG
aatatttaccctggccaact

SEQ ID NO: 23624 - DNA, 20 bp, Artificial Sequence
  Description of Artificial Sequence: Synthetic oligonucleotide
  Target: SCN10A; (-) strand; PAM type: NRG; PAM sequence: TGG
agaaactaaaatatttaccc

SEQ ID NO: 23625 - DNA, 20 bp, Artificial Sequence
  Description of Artificial Sequence: Synthetic oligonucleotide
  Target: SCN10A; (-) strand; PAM type: NRG; PAM sequence: AAG
tatggccctgctcatcacct

SEQ ID NO: 23626 - DNA, 20 bp, Artificial Sequence
  Description of Artificial Sequence: Synthetic oligonucleotide
  Target: SCN10A; (-) strand; PAM type: NRG; PAM sequence: TGG
agaaactctcggaagcttta

SEQ ID NO: 23627 - DNA, 20 bp, Artificial Sequence
  Description of Artificial Sequence: Synthetic oligonucleotide
  Target: SCN10A; (-) strand; PAM type: NRG; PAM sequence: AAG
caaaacccagaaactctcgg

SEQ ID NO: 23628 - DNA, 20 bp, Artificial Sequence
  Description of Artificial Sequence: Synthetic oligonucleotide
  Target: SCN10A; (-) strand; PAM type: NRG; PAM sequence: CGG
acacaaaacccagaaactct

SEQ ID NO: 23629 - DNA, 20 bp, Artificial Sequence
  Description of Artificial Sequence: Synthetic oligonucleotide
  Target: SCN10A; (-) strand; PAM type: NRG; PAM sequence: CAG
tggtagctgaacacaaaacc

SEQ ID NO: 23630 - DNA, 20 bp, Artificial Sequence
  Description of Artificial Sequence: Synthetic oligonucleotide
  Target: SCN10A; (-) strand; PAM type: NRG; PAM sequence: TAG
tatttccctacctgccttgg

SEQ ID NO: 23631 - DNA, 20 bp, Artificial Sequence
  Description of Artificial Sequence: Synthetic oligonucleotide
  Target: SCN10A; (-) strand; PAM type: NRG; PAM sequence: TGG
tggtatttccctacctgcct

SEQ ID NO: 23632 - DNA, 20 bp, Artificial Sequence
  Description of Artificial Sequence: Synthetic oligonucleotide
  Target: SCN10A; (-) strand; PAM type: NRG; PAM sequence: TGG
ctacccctgcccccacctga

SEQ ID NO: 23633 - DNA, 20 bp, Artificial Sequence
  Description of Artificial Sequence: Synthetic oligonucleotide
  Target: SCN10A; (-) strand; PAM type: NRG; PAM sequence: TAG
acccaagaagggtctgagtc

SEQ ID NO: 23634 - DNA, 20 bp, Artificial Sequence
  Description of Artificial Sequence: Synthetic oligonucleotide
  Target: SCN10A; (-) strand; PAM type: NRG; PAM sequence: GAG
tccctacccaagaagggtct

SEQ ID NO: 23635 - DNA, 20 bp, Artificial Sequence
  Description of Artificial Sequence: Synthetic oligonucleotide
  Target: SCN10A; (-) strand; PAM type: NRG; PAM sequence: GGG
cagcaatccctacccaagaa

SEQ ID NO: 23636 - DNA, 20 bp, Artificial Sequence
  Description of Artificial Sequence: Synthetic oligonucleotide
  Target: SCN10A; (-) strand; PAM type: NRG; PAM sequence: AGG
acagcaatccctacccaaga

SEQ ID NO: 23637 - DNA, 20 bp, Artificial Sequence
  Description of Artificial Sequence: Synthetic oligonucleotide
  Target: SCN10A; (-) strand; PAM type: NRG; PAM sequence: AAG
cacagcaatccctacccaag

SEQ ID NO: 23638 - DNA, 20 bp, Artificial Sequence
  Description of Artificial Sequence: Synthetic oligonucleotide
  Target: SCN10A; (-) strand; PAM type: NRG; PAM sequence: AAG
ggccacagcaatccctaccc

SEQ ID NO: 23639 - DNA, 20 bp, Artificial Sequence
  Description of Artificial Sequence: Synthetic oligonucleotide
  Target: SCN10A; (-) strand; PAM type: NRG; PAM sequence: CAG
cccatccaccacagtggcca

SEQ ID NO: 23640 - DNA, 20 bp, Artificial Sequence
  Description of Artificial Sequence: Synthetic oligonucleotide
  Target: SCN10A; (-) strand; PAM type: NRG; PAM sequence: TGG
ccaacccccatccaccacag

SEQ ID NO: 23641 - DNA, 20 bp, Artificial Sequence
  Description of Artificial Sequence: Synthetic oligonucleotide
  Target: SCN10A; (-) strand; PAM type: NRG; PAM sequence: CAG
gaaccaacccccatccacca

SEQ ID NO: 23642 - DNA, 20 bp, Artificial Sequence
  Description of Artificial Sequence: Synthetic oligonucleotide
  Target: SCN10A; (-) strand; PAM type: NRG; PAM sequence: GAG
gaacacaaccccactggcct

SEQ ID NO: 23643 - DNA, 20 bp, Artificial Sequence
  Description of Artificial Sequence: Synthetic oligonucleotide
  Target: SCN10A; (-) strand; PAM type: NRG; PAM sequence: TGG
cctctggaacacaaccccac

SEQ ID NO: 23644 - DNA, 20 bp, Artificial Sequence
  Description of Artificial Sequence: Synthetic oligonucleotide
  Target: SCN10A; (-) strand; PAM type: NRG; PAM sequence: TGG
gaggcagccaaaattccctc

SEQ ID NO: 23645 - DNA, 20 bp, Artificial Sequence
  Description of Artificial Sequence: Synthetic oligonucleotide
  Target: SCN10A; (-) strand; PAM type: NRG; PAM sequence: CAG
actctatggcacagcagagg

SEQ ID NO: 23646 - DNA, 20 bp, Artificial Sequence
  Description of Artificial Sequence: Synthetic oligonucleotide
  Target: SCN10A; (-) strand; PAM type: NRG; PAM sequence: AGG
agaactctatggcacagcag

SEQ ID NO: 23647 - DNA, 20 bp, Artificial Sequence
  Description of Artificial Sequence: Synthetic oligonucleotide
  Target: SCN10A; (-) strand; PAM type: NRG; PAM sequence: GAG
gagaactctatggcacagca

SEQ ID NO: 23648 - DNA, 20 bp, Artificial Sequence
  Description of Artificial Sequence: Synthetic oligonucleotide
  Target: SCN10A; (-) strand; PAM type: NRG; PAM sequence: CAG
tggagaactctatggcacag

SEQ ID NO: 23649 - DNA, 20 bp, Artificial Sequence
  Description of Artificial Sequence: Synthetic oligonucleotide
  Target: SCN10A; (-) strand; PAM type: NRG; PAM sequence: CAG
ccctggagaactctatggca

SEQ ID NO: 23650 - DNA, 20 bp, Artificial Sequence
  Description of Artificial Sequence: Synthetic oligonucleotide
  Target: SCN10A; (-) strand; PAM type: NRG; PAM sequence: TGG
cacttccctggagaactcta

SEQ ID NO: 23651 - DNA, 20 bp, Artificial Sequence
  Description of Artificial Sequence: Synthetic oligonucleotide
  Target: SCN10A; (-) strand; PAM type: NRG; PAM sequence: GAG
agctatcccccacttccctg

SEQ ID NO: 23652 - DNA, 20 bp, Artificial Sequence
  Description of Artificial Sequence: Synthetic oligonucleotide
  Target: SCN10A; (-) strand; PAM type: NRG; PAM sequence: TGG
gcagctatcccccacttccc

SEQ ID NO: 23653 - DNA, 20 bp, Artificial Sequence
  Description of Artificial Sequence: Synthetic oligonucleotide
  Target: SCN10A; (-) strand; PAM type: NRG; PAM sequence: CAG
taggtgaggcctctcactag

SEQ ID NO: 23654 - DNA, 20 bp, Artificial Sequence
  Description of Artificial Sequence: Synthetic oligonucleotide
  Target: SCN10A; (-) strand; PAM type: NRG; PAM sequence: TAG
agctaggtgaggcctctcac

SEQ ID NO: 23655 - DNA, 20 bp, Artificial Sequence
  Description of Artificial Sequence: Synthetic oligonucleotide
  Target: SCN10A; (-) strand; PAM type: NRG; PAM sequence: AGG
aactacatgagagctaggtg

SEQ ID NO: 23656 - DNA, 20 bp, Artificial Sequence
  Description of Artificial Sequence: Synthetic oligonucleotide
  Target: SCN10A; (-) strand; PAM type: NRG; PAM sequence: GAG
caactacatgagagctaggt

SEQ ID NO: 23657 - DNA, 20 bp, Artificial Sequence
  Description of Artificial Sequence: Synthetic oligonucleotide
  Target: SCN10A; (-) strand; PAM type: NRG; PAM sequence: AGG
tcaccaactacatgagagct

SEQ ID NO: 23658 - DNA, 20 bp, Artificial Sequence
  Description of Artificial Sequence: Synthetic oligonucleotide
  Target: SCN10A; (-) strand; PAM type: NRG; PAM sequence: TAG
ctcaccaactacatgagagc

SEQ ID NO: 23659 - DNA, 20 bp, Artificial Sequence
  Description of Artificial Sequence: Synthetic oligonucleotide
  Target: SCN10A; (-) strand; PAM type: NRG; PAM sequence: GAG
cagcctcaccaactacatga

SEQ ID NO: 23660 - DNA, 20 bp, Artificial Sequence
  Description of Artificial Sequence: Synthetic oligonucleotide
  Target: SCN10A; (-) strand; PAM type: NRG; PAM sequence: GAG
accagcctcaccaactacat

SEQ ID NO: 23661 - DNA, 20 bp, Artificial Sequence
  Description of Artificial Sequence: Synthetic oligonucleotide
  Target: SCN10A; (-) strand; PAM type: NRG; PAM sequence: CAG
gggcactgcaggagcaagac

SEQ ID NO: 23662 - DNA, 20 bp, Artificial Sequence
  Description of Artificial Sequence: Synthetic oligonucleotide
  Target: SCN10A; (-) strand; PAM type: NRG; PAM sequence: AAG
gagtagggcactgcaggagc

SEQ ID NO: 23663 - DNA, 20 bp, Artificial Sequence
  Description of Artificial Sequence: Synthetic oligonucleotide
  Target: SCN10A; (-) strand; PAM type: NRG; PAM sequence: GAG
gtctgagtagggcactgcag

SEQ ID NO: 23664 - DNA, 20 bp, Artificial Sequence
  Description of Artificial Sequence: Synthetic oligonucleotide
  Target: SCN10A; (-) strand; PAM type: NRG; PAM sequence: AGG
aggtctgagtagggcactgc

SEQ ID NO: 23665 - DNA, 20 bp, Artificial Sequence
  Description of Artificial Sequence: Synthetic oligonucleotide
  Target: SCN10A; (-) strand; PAM type: NRG; PAM sequence: CAG
aaggtctgagtagggcactg

SEQ ID NO: 23666 - DNA, 20 bp, Artificial Sequence
  Description of Artificial Sequence: Synthetic oligonucleotide
  Target: SCN10A; (-) strand; PAM type: NRG; PAM sequence: GGG
cctggggcaaggtctgagta

SEQ ID NO: 23667 - DNA, 20 bp, Artificial Sequence
  Description of Artificial Sequence: Synthetic oligonucleotide
  Target: SCN10A; (-) strand; PAM type: NRG; PAM sequence: AGG
gcctggggcaaggtctgagt

SEQ ID NO: 23668 - DNA, 20 bp, Artificial Sequence
  Description of Artificial Sequence: Synthetic oligonucleotide
  Target: SCN10A; (-) strand; PAM type: NRG; PAM sequence: TAG
agcctggggcaaggtctgag

SEQ ID NO: 23669 - DNA, 20 bp, Artificial Sequence
  Description of Artificial Sequence: Synthetic oligonucleotide
  Target: SCN10A; (-) strand; PAM type: NRG; PAM sequence: GAG
cacagcctggggcaaggtct

SEQ ID NO: 23670 - DNA, 20 bp, Artificial Sequence
  Description of Artificial Sequence: Synthetic oligonucleotide
  Target: SCN10A; (-) strand; PAM type: NRG; PAM sequence: AGG
gaagctcacagcctggggca

SEQ ID NO: 23671 - DNA, 20 bp, Artificial Sequence
  Description of Artificial Sequence: Synthetic oligonucleotide
  Target: SCN10A; (-) strand; PAM type: NRG; PAM sequence: AAG
ggaagctcacagcctggggc

SEQ ID NO: 23672 - DNA, 20 bp, Artificial Sequence
  Description of Artificial Sequence: Synthetic oligonucleotide
  Target: SCN10A; (-) strand; PAM type: NRG; PAM sequence: GGG
gtggggaagctcacagcctg

SEQ ID NO: 23673 - DNA, 20 bp, Artificial Sequence
  Description of Artificial Sequence: Synthetic oligonucleotide
  Target: SCN10A; (-) strand; PAM type: NRG; PAM sequence: GGG
agtggggaagctcacagcct

SEQ ID NO: 23674 - DNA, 20 bp, Artificial Sequence
  Description of Artificial Sequence: Synthetic oligonucleotide
  Target: SCN10A; (-) strand; PAM type: NRG; PAM sequence: TGG
cagtggggaagctcacagcc

SEQ ID NO: 23675 - DNA, 20 bp, Artificial Sequence
  Description of Artificial Sequence: Synthetic oligonucleotide
  Target: SCN10A; (-) strand; PAM type: NRG; PAM sequence: CAG
tttctcagtggggaagctca

SEQ ID NO: 23676 - DNA, 20 bp, Artificial Sequence
  Description of Artificial Sequence: Synthetic oligonucleotide
  Target: SCN10A; (-) strand; PAM type: NRG; PAM sequence: AAG
tgctttctttctcagtgggg

SEQ ID NO: 23677 - DNA, 20 bp, Artificial Sequence
  Description of Artificial Sequence: Synthetic oligonucleotide
  Target: SCN10A; (-) strand; PAM type: NRG; PAM sequence: GGG
tcatgctttctttctcagtg

SEQ ID NO: 23678 - DNA, 20 bp, Artificial Sequence
  Description of Artificial Sequence: Synthetic oligonucleotide
  Target: SCN10A; (-) strand; PAM type: NRG; PAM sequence: GGG
gtcatgctttctttctcagt

SEQ ID NO: 23679 - DNA, 20 bp, Artificial Sequence
  Description of Artificial Sequence: Synthetic oligonucleotide
  Target: SCN10A; (-) strand; PAM type: NRG; PAM sequence: TGG
agtcatgctttctttctcag

SEQ ID NO: 23680 - DNA, 20 bp, Artificial Sequence
  Description of Artificial Sequence: Synthetic oligonucleotide
  Target: SCN10A; (-) strand; PAM type: NRG; PAM sequence: CAG
aaaagtcatgctttctttct

SEQ ID NO: 23681 - DNA, 20 bp, Artificial Sequence
  Description of Artificial Sequence: Synthetic oligonucleotide
  Target: SCN10A; (-) strand; PAM type: NRG; PAM sequence: AAG
cagtgagggatgcggtccaa

SEQ ID NO: 23682 - DNA, 20 bp, Artificial Sequence
  Description of Artificial Sequence: Synthetic oligonucleotide
  Target: SCN10A; (-) strand; PAM type: NRG; PAM sequence: CGG
caagcagacagtgagggatg

SEQ ID NO: 23683 - DNA, 20 bp, Artificial Sequence
  Description of Artificial Sequence: Synthetic oligonucleotide
  Target: SCN10A; (-) strand; PAM type: NRG; PAM sequence: GGG
gaactgcaagcagacagtga

SEQ ID NO: 23684 - DNA, 20 bp, Artificial Sequence
  Description of Artificial Sequence: Synthetic oligonucleotide
  Target: SCN10A; (-) strand; PAM type: NRG; PAM sequence: AGG
ggaactgcaagcagacagtg

SEQ ID NO: 23685 - DNA, 20 bp, Artificial Sequence
  Description of Artificial Sequence: Synthetic oligonucleotide
  Target: SCN10A; (-) strand; PAM type: NRG; PAM sequence: GAG
gggaactgcaagcagacagt

SEQ ID NO: 23686 - DNA, 20 bp, Artificial Sequence
  Description of Artificial Sequence: Synthetic oligonucleotide
  Target: SCN10A; (-) strand; PAM type: NRG; PAM sequence: CAG
aaatgggaactgcaagcaga

SEQ ID NO: 23687 - DNA, 20 bp, Artificial Sequence
  Description of Artificial Sequence: Synthetic oligonucleotide
  Target: SCN10A; (-) strand; PAM type: NRG; PAM sequence: CAG
gggcaaatgggaactgcaag

SEQ ID NO: 23688 - DNA, 20 bp, Artificial Sequence
  Description of Artificial Sequence: Synthetic oligonucleotide
  Target: SCN10A; (-) strand; PAM type: NRG; PAM sequence: AAG
agggggcaaatgggaactgc

SEQ ID NO: 23689 - DNA, 20 bp, Artificial Sequence
  Description of Artificial Sequence: Synthetic oligonucleotide
  Target: SCN10A; (-) strand; PAM type: NRG; PAM sequence: GGG
gcagaatccagggggcaaat

SEQ ID NO: 23690 - DNA, 20 bp, Artificial Sequence
  Description of Artificial Sequence: Synthetic oligonucleotide
  Target: SCN10A; (-) strand; PAM type: NRG; PAM sequence: TGG
agcagaatccagggggcaaa

SEQ ID NO: 23691 - DNA, 20 bp, Artificial Sequence
  Description of Artificial Sequence: Synthetic oligonucleotide
  Target: SCN10A; (-) strand; PAM type: NRG; PAM sequence: GGG
tttcttgagcagaatccagg

SEQ ID NO: 23692 - DNA, 20 bp, Artificial Sequence
  Description of Artificial Sequence: Synthetic oligonucleotide
  Target: SCN10A; (-) strand; PAM type: NRG; PAM sequence: GGG
ttttcttgagcagaatccag

SEQ ID NO: 23693 - DNA, 20 bp, Artificial Sequence
  Description of Artificial Sequence: Synthetic oligonucleotide
  Target: SCN10A; (-) strand; PAM type: NRG; PAM sequence: GGG
attttcttgagcagaatcca

SEQ ID NO: 23694 - DNA, 20 bp, Artificial Sequence
  Description of Artificial Sequence: Synthetic oligonucleotide
  Target: SCN10A; (-) strand; PAM type: NRG; PAM sequence: AGG
aattttcttgagcagaatcc

SEQ ID NO: 23695 - DNA, 20 bp, Artificial Sequence
  Description of Artificial Sequence: Synthetic oligonucleotide
  Target: SCN10A; (-) strand; PAM type: NRG; PAM sequence: CAG
aaattttcttgagcagaatc

SEQ ID NO: 23696 - DNA, 20 bp, Artificial Sequence
  Description of Artificial Sequence: Synthetic oligonucleotide
  Target: SCN10A; (-) strand; PAM type: NRG; PAM sequence: CAG
tgggcacaaattttcttgag

SEQ ID NO: 23697 - DNA, 20 bp, Artificial Sequence
  Description of Artificial Sequence: Synthetic oligonucleotide
  Target: SCN10A; (-) strand; PAM type: NRG; PAM sequence: GAG
aactgggcacaaattttctt

SEQ ID NO: 23698 - DNA, 20 bp, Artificial Sequence
  Description of Artificial Sequence: Synthetic oligonucleotide
  Target: SCN10A; (-) strand; PAM type: NRG; PAM sequence: GGG
aattagtaataatttcaact

SEQ ID NO: 23699 - DNA, 20 bp, Artificial Sequence
  Description of Artificial Sequence: Synthetic oligonucleotide
  Target: SCN10A; (-) strand; PAM type: NRG; PAM sequence: TGG
aaattagtaataatttcaac

SEQ ID NO: 23700 - DNA, 20 bp, Artificial Sequence
  Description of Artificial Sequence: Synthetic oligonucleotide
  Target: SCN10A; (-) strand; PAM type: NRG; PAM sequence: TAG
aaagaagtttcaactaaaat

SEQ ID NO: 23701 - DNA, 20 bp, Artificial Sequence
  Description of Artificial Sequence: Synthetic oligonucleotide
  Target: SCN10A; (-) strand; PAM type: NRG; PAM sequence: AAG
gaggggtcacaggatgaaag

SEQ ID NO: 23702 - DNA, 20 bp, Artificial Sequence
  Description of Artificial Sequence: Synthetic oligonucleotide
  Target: SCN10A; (-) strand; PAM type: NRG; PAM sequence: AAG
agggaggggtcacaggatga

SEQ ID NO: 23703 - DNA, 20 bp, Artificial Sequence
  Description of Artificial Sequence: Synthetic oligonucleotide
  Target: SCN10A; (-) strand; PAM type: NRG; PAM sequence: AGG
tggaatcagggaggggtcac

SEQ ID NO: 23704 - DNA, 20 bp, Artificial Sequence
  Description of Artificial Sequence: Synthetic oligonucleotide
  Target: SCN10A; (-) strand; PAM type: NRG; PAM sequence: CAG
gtggaatcagggaggggtca

SEQ ID NO: 23705 - DNA, 20 bp, Artificial Sequence
  Description of Artificial Sequence: Synthetic oligonucleotide
  Target: SCN10A; (-) strand; PAM type: NRG; PAM sequence: GGG
cagccagtggaatcagggag

SEQ ID NO: 23706 - DNA, 20 bp, Artificial Sequence
  Description of Artificial Sequence: Synthetic oligonucleotide
  Target: SCN10A; (-) strand; PAM type: NRG; PAM sequence: GGG
gcagccagtggaatcaggga

SEQ ID NO: 23707 - DNA, 20 bp, Artificial Sequence
  Description of Artificial Sequence: Synthetic oligonucleotide
  Target: SCN10A; (-) strand; PAM type: NRG; PAM sequence: AGG
ggcagccagtggaatcaggg

SEQ ID NO: 23708 - DNA, 20 bp, Artificial Sequence
  Description of Artificial Sequence: Synthetic oligonucleotide
  Target: SCN10A; (-) strand; PAM type: NRG; PAM sequence: GAG
aggcagccagtggaatcagg

SEQ ID NO: 23709 - DNA, 20 bp, Artificial Sequence
  Description of Artificial Sequence: Synthetic oligonucleotide
  Target: SCN10A; (-) strand; PAM type: NRG; PAM sequence: GGG
gaaggcagccagtggaatca

SEQ ID NO: 23710 - DNA, 20 bp, Artificial Sequence
  Description of Artificial Sequence: Synthetic oligonucleotide
  Target: SCN10A; (-) strand; PAM type: NRG; PAM sequence: AGG
ggaaggcagccagtggaatc

SEQ ID NO: 23711 - DNA, 20 bp, Artificial Sequence
  Description of Artificial Sequence: Synthetic oligonucleotide
  Target: SCN10A; (-) strand; PAM type: NRG; PAM sequence: CAG
gggaaggcagccagtggaat

SEQ ID NO: 23712 - DNA, 20 bp, Artificial Sequence
  Description of Artificial Sequence: Synthetic oligonucleotide
  Target: SCN10A; (-) strand; PAM type: NRG; PAM sequence: TGG
cccttggggaaggcagccag

SEQ ID NO: 23713 - DNA, 20 bp, Artificial Sequence
  Description of Artificial Sequence: Synthetic oligonucleotide
  Target: SCN10A; (-) strand; PAM type: NRG; PAM sequence: CAG
gcacccttggggaaggcagc

SEQ ID NO: 23714 - DNA, 20 bp, Artificial Sequence
  Description of Artificial Sequence: Synthetic oligonucleotide
  Target: SCN10A; (-) strand; PAM type: NRG; PAM sequence: CAG
acaggcacccttggggaagg

SEQ ID NO: 23715 - DNA, 20 bp, Artificial Sequence
  Description of Artificial Sequence: Synthetic oligonucleotide
  Target: SCN10A; (-) strand; PAM type: NRG; PAM sequence: AGG
ctcacaggcacccttgggga

SEQ ID NO: 23716 - DNA, 20 bp, Artificial Sequence
  Description of Artificial Sequence: Synthetic oligonucleotide
  Target: SCN10A; (-) strand; PAM type: NRG; PAM sequence: AAG
tctcacaggcacccttgggg

SEQ ID NO: 23717 - DNA, 20 bp, Artificial Sequence
  Description of Artificial Sequence: Synthetic oligonucleotide
  Target: SCN10A; (-) strand; PAM type: NRG; PAM sequence: GGG
atgtctcacaggcacccttg

SEQ ID NO: 23718 - DNA, 20 bp, Artificial Sequence
  Description of Artificial Sequence: Synthetic oligonucleotide
  Target: SCN10A; (-) strand; PAM type: NRG; PAM sequence: GGG
tatgtctcacaggcaccctt

SEQ ID NO: 23719 - DNA, 20 bp, Artificial Sequence
  Description of Artificial Sequence: Synthetic oligonucleotide
  Target: SCN10A; (-) strand; PAM type: NRG; PAM sequence: TGG
ctatgtctcacaggcaccct

SEQ ID NO: 23720 - DNA, 20 bp, Artificial Sequence
  Description of Artificial Sequence: Synthetic oligonucleotide
  Target: SCN10A; (-) strand; PAM type: NRG; PAM sequence: AGG
catccctgactatgtctcac

SEQ ID NO: 23721 - DNA, 20 bp, Artificial Sequence
  Description of Artificial Sequence: Synthetic oligonucleotide
  Target: SCN10A; (-) strand; PAM type: NRG; PAM sequence: CAG
ccatccctgactatgtctca

SEQ ID NO: 23722 - DNA, 20 bp, Artificial Sequence
  Description of Artificial Sequence: Synthetic oligonucleotide
  Target: SCN10A; (-) strand; PAM type: NRG; PAM sequence: GGG
cagtctccagcttgagacca

SEQ ID NO: 23723 - DNA, 20 bp, Artificial Sequence
  Description of Artificial Sequence: Synthetic oligonucleotide
  Target: SCN10A; (-) strand; PAM type: NRG; PAM sequence: AGG
ccagtctccagcttgagacc

SEQ ID NO: 23724 - DNA, 20 bp, Artificial Sequence
  Description of Artificial Sequence: Synthetic oligonucleotide
  Target: SCN10A; (-) strand; PAM type: NRG; PAM sequence: CAG
cccagtctccagcttgagac

SEQ ID NO: 23725 - DNA, 20 bp, Artificial Sequence
  Description of Artificial Sequence: Synthetic oligonucleotide
  Target: SCN10A; (-) strand; PAM type: NRG; PAM sequence: GAG
gcactcccagtctccagctt

SEQ ID NO: 23726 - DNA, 20 bp, Artificial Sequence
  Description of Artificial Sequence: Synthetic oligonucleotide
  Target: SCN10A; (-) strand; PAM type: NRG; PAM sequence: CAG
ttgtaggcactcccagtctc

SEQ ID NO: 23727 - DNA, 20 bp, Artificial Sequence
  Description of Artificial Sequence: Synthetic oligonucleotide
  Target: SCN10A; (-) strand; PAM type: NRG; PAM sequence: CAG
aagtgccttgtaggcactcc

SEQ ID NO: 23728 - DNA, 20 bp, Artificial Sequence
  Description of Artificial Sequence: Synthetic oligonucleotide
  Target: SCN10A; (-) strand; PAM type: NRG; PAM sequence: AGG
agcaaagggaagtgccttgt

SEQ ID NO: 23729 - DNA, 20 bp, Artificial Sequence
  Description of Artificial Sequence: Synthetic oligonucleotide
  Target: SCN10A; (-) strand; PAM type: NRG; PAM sequence: TAG
cagcaaagggaagtgccttg

SEQ ID NO: 23730 - DNA, 20 bp, Artificial Sequence
  Description of Artificial Sequence: Synthetic oligonucleotide
  Target: SCN10A; (-) strand; PAM type: NRG; PAM sequence: AAG
aaagtagaaacagcaaaggg

SEQ ID NO: 23731 - DNA, 20 bp, Artificial Sequence
  Description of Artificial Sequence: Synthetic oligonucleotide
  Target: SCN10A; (-) strand; PAM type: NRG; PAM sequence: GGG
ataaaagtagaaacagcaaa

SEQ ID NO: 23732 - DNA, 20 bp, Artificial Sequence
  Description of Artificial Sequence: Synthetic oligonucleotide
  Target: SCN10A; (-) strand; PAM type: NRG; PAM sequence: AGG
tataaaagtagaaacagcaa

SEQ ID NO: 23733 - DNA, 20 bp, Artificial Sequence
  Description of Artificial Sequence: Synthetic oligonucleotide
  Target: SCN10A; (-) strand; PAM type: NRG; PAM sequence: AAG
atataaaagtagaaacagca

SEQ ID NO: 23734 - DNA, 20 bp, Artificial Sequence
  Description of Artificial Sequence: Synthetic oligonucleotide
  Target: SCN10A; (-) strand; PAM type: NRG; PAM sequence: CAG
acaaaatataaaagtagaaa

SEQ ID NO: 23735 - DNA, 20 bp, Artificial Sequence
  Description of Artificial Sequence: Synthetic oligonucleotide
  Target: SCN10A; (-) strand; PAM type: NRG; PAM sequence: TAG
agccacacaaaatataaaag

SEQ ID NO: 23736 - DNA, 20 bp, Artificial Sequence
  Description of Artificial Sequence: Synthetic oligonucleotide
  Target: SCN10A; (-) strand; PAM type: NRG; PAM sequence: AAG
ggaagccacacaaaatataa

SEQ ID NO: 23737 - DNA, 20 bp, Artificial Sequence
  Description of Artificial Sequence: Synthetic oligonucleotide
  Target: SCN10A; (-) strand; PAM type: NRG; PAM sequence: AAG
ggaatgtaaataaatttagg

SEQ ID NO: 23738 - DNA, 20 bp, Artificial Sequence
  Description of Artificial Sequence: Synthetic oligonucleotide
  Target: SCN10A; (-) strand; PAM type: NRG; PAM sequence: AGG
cctggaatgtaaataaattt

SEQ ID NO: 23739 - DNA, 20 bp, Artificial Sequence
  Description of Artificial Sequence: Synthetic oligonucleotide
  Target: SCN10A; (-) strand; PAM type: NRG; PAM sequence: TAG
acctggaatgtaaataaatt

SEQ ID NO: 23740 - DNA, 20 bp, Artificial Sequence
  Description of Artificial Sequence: Synthetic oligonucleotide
  Target: SCN10A; (-) strand; PAM type: NRG; PAM sequence: TGG
gagaagaatttacccttacc

SEQ ID NO: 23741 - DNA, 20 bp, Artificial Sequence
  Description of Artificial Sequence: Synthetic oligonucleotide
  Target: SCN10A; (-) strand; PAM type: NRG; PAM sequence: AAG
gaaaatccagatcacaggag

SEQ ID NO: 23742 - DNA, 20 bp, Artificial Sequence
  Description of Artificial Sequence: Synthetic oligonucleotide
  Target: SCN10A; (-) strand; PAM type: NRG; PAM sequence: GAG
tctgaaaatccagatcacag

SEQ ID NO: 23743 - DNA, 20 bp, Artificial Sequence
  Description of Artificial Sequence: Synthetic oligonucleotide
  Target: SCN10A; (-) strand; PAM type: NRG; PAM sequence: AGG
aatctgaaaatccagatcac

SEQ ID NO: 23744 - DNA, 20 bp, Artificial Sequence
  Description of Artificial Sequence: Synthetic oligonucleotide
  Target: SCN10A; (-) strand; PAM type: NRG; PAM sequence: CAG
taatctgaaaatccagatca

SEQ ID NO: 23745 - DNA, 20 bp, Artificial Sequence
  Description of Artificial Sequence: Synthetic oligonucleotide
  Target: SCN10A; (-) strand; PAM type: NRG; PAM sequence: CAG
aactgggtaatctgaaaatc

SEQ ID NO: 23746 - DNA, 20 bp, Artificial Sequence
  Description of Artificial Sequence: Synthetic oligonucleotide
  Target: SCN10A; (-) strand; PAM type: NRG; PAM sequence: GGG
tccaaacatacatcccaact

SEQ ID NO: 23747 - DNA, 20 bp, Artificial Sequence
  Description of Artificial Sequence: Synthetic oligonucleotide
  Target: SCN10A; (-) strand; PAM type: NRG; PAM sequence: TGG
ctccaaacatacatcccaac

SEQ ID NO: 23748 - DNA, 20 bp, Artificial Sequence
  Description of Artificial Sequence: Synthetic oligonucleotide
  Target: SCN10A; (-) strand; PAM type: NRG; PAM sequence: GGG
agctcccaaagtgtgagggg

SEQ ID NO: 23749 - DNA, 20 bp, Artificial Sequence
  Description of Artificial Sequence: Synthetic oligonucleotide
  Target: SCN10A; (-) strand; PAM type: NRG; PAM sequence: GGG
gagctcccaaagtgtgaggg

SEQ ID NO: 23750 - DNA, 20 bp, Artificial Sequence
  Description of Artificial Sequence: Synthetic oligonucleotide
  Target: SCN10A; (-) strand; PAM type: NRG; PAM sequence: GGG
tgagctcccaaagtgtgagg

SEQ ID NO: 23751 - DNA, 20 bp, Artificial Sequence
  Description of Artificial Sequence: Synthetic oligonucleotide
  Target: SCN10A; (-) strand; PAM type: NRG; PAM sequence: GGG
gtgagctcccaaagtgtgag

SEQ ID NO: 23752 - DNA, 20 bp, Artificial Sequence
  Description of Artificial Sequence: Synthetic oligonucleotide
  Target: SCN10A; (-) strand; PAM type: NRG; PAM sequence: GGG
tgtgagctcccaaagtgtga

SEQ ID NO: 23753 - DNA, 20 bp, Artificial Sequence
  Description of Artificial Sequence: Synthetic oligonucleotide
  Target: SCN10A; (-) strand; PAM type: NRG; PAM sequence: AGG
ctgtgagctcccaaagtgtg

SEQ ID NO: 23754 - DNA, 20 bp, Artificial Sequence
  Description of Artificial Sequence: Synthetic oligonucleotide
  Target: SCN10A; (-) strand; PAM type: NRG; PAM sequence: GAG
actgtgagctcccaaagtgt

SEQ ID NO: 23755 - DNA, 20 bp, Artificial Sequence
  Description of Artificial Sequence: Synthetic oligonucleotide
  Target: SCN10A; (-) strand; PAM type: NRG; PAM sequence: AAG
tgaaaaactgtgagctccca

SEQ ID NO: 23756 - DNA, 20 bp, Artificial Sequence
  Description of Artificial Sequence: Synthetic oligonucleotide
  Target: SCN10A; (-) strand; PAM type: NRG; PAM sequence: GAG
caagacaggtgaaaaactgt

SEQ ID NO: 23757 - DNA, 20 bp, Artificial Sequence
  Description of Artificial Sequence: Synthetic oligonucleotide
  Target: SCN10A; (-) strand; PAM type: NRG; PAM sequence: AGG
tgctggaaattctgcaagac

SEQ ID NO: 23758 - DNA, 20 bp, Artificial Sequence
  Description of Artificial Sequence: Synthetic oligonucleotide
  Target: SCN10A; (-) strand; PAM type: NRG; PAM sequence: CAG
ctgctggaaattctgcaaga

SEQ ID NO: 23759 - DNA, 20 bp, Artificial Sequence
  Description of Artificial Sequence: Synthetic oligonucleotide
  Target: SCN10A; (-) strand; PAM type: NRG; PAM sequence: AAG
cacactgctggaaattctgc

SEQ ID NO: 23760 - DNA, 20 bp, Artificial Sequence
  Description of Artificial Sequence: Synthetic oligonucleotide
  Target: SCN10A; (-) strand; PAM type: NRG; PAM sequence: TGG
ttaaataagtggcacactgc

SEQ ID NO: 23761 - DNA, 20 bp, Artificial Sequence
  Description of Artificial Sequence: Synthetic oligonucleotide
  Target: SCN10A; (-) strand; PAM type: NRG; PAM sequence: TGG
catagatccttttaaataag

SEQ ID NO: 23762 - DNA, 20 bp, Artificial Sequence
  Description of Artificial Sequence: Synthetic oligonucleotide
  Target: SCN10A; (-) strand; PAM type: NRG; PAM sequence: AAG
attcatagatccttttaaat

SEQ ID NO: 23763 - DNA, 20 bp, Artificial Sequence
  Description of Artificial Sequence: Synthetic oligonucleotide
  Target: SCN10A; (-) strand; PAM type: NRG; PAM sequence: TAG
aggagaactgaaagaattca

SEQ ID NO: 23764 - DNA, 20 bp, Artificial Sequence
  Description of Artificial Sequence: Synthetic oligonucleotide
  Target: SCN10A; (-) strand; PAM type: NRG; PAM sequence: AAG
gaatataccaggagaactga

SEQ ID NO: 23765 - DNA, 20 bp, Artificial Sequence
  Description of Artificial Sequence: Synthetic oligonucleotide
  Target: SCN10A; (-) strand; PAM type: NRG; PAM sequence: GAG
ccactgcaggaatataccag

SEQ ID NO: 23766 - DNA, 20 bp, Artificial Sequence
  Description of Artificial Sequence: Synthetic oligonucleotide
  Target: SCN10A; (-) strand; PAM type: NRG; PAM sequence: AGG
aaccactgcaggaatatacc

SEQ ID NO: 23767 - DNA, 20 bp, Artificial Sequence
  Description of Artificial Sequence: Synthetic oligonucleotide
  Target: SCN10A; (-) strand; PAM type: NRG; PAM sequence: CAG
gaaccactgcaggaatatac

SEQ ID NO: 23768 - DNA, 20 bp, Artificial Sequence
  Description of Artificial Sequence: Synthetic oligonucleotide
  Target: SCN10A; (-) strand; PAM type: NRG; PAM sequence: AGG
tttgctccaagaaccactgc

SEQ ID NO: 23769 - DNA, 20 bp, Artificial Sequence
  Description of Artificial Sequence: Synthetic oligonucleotide
  Target: SCN10A; (-) strand; PAM type: NRG; PAM sequence: CAG
gtttgctccaagaaccactg

SEQ ID NO: 23770 - DNA, 20 bp, Artificial Sequence
  Description of Artificial Sequence: Synthetic oligonucleotide
  Target: SCN10A; (-) strand; PAM type: NRG; PAM sequence: AAG
acaccatgaacgtttgctcc

SEQ ID NO: 23771 - DNA, 20 bp, Artificial Sequence
  Description of Artificial Sequence: Synthetic oligonucleotide
  Target: SCN10A; (-) strand; PAM type: NRG; PAM sequence: GAG
tcccacttggacagagtgtg

SEQ ID NO: 23772 - DNA, 20 bp, Artificial Sequence
  Description of Artificial Sequence: Synthetic oligonucleotide
  Target: SCN10A; (-) strand; PAM type: NRG; PAM sequence: TGG
ggtcccacttggacagagtg

SEQ ID NO: 23773 - DNA, 20 bp, Artificial Sequence
  Description of Artificial Sequence: Synthetic oligonucleotide
  Target: SCN10A; (-) strand; PAM type: NRG; PAM sequence: GAG
atgcaggtcccacttggaca

SEQ ID NO: 23774 - DNA, 20 bp, Artificial Sequence
  Description of Artificial Sequence: Synthetic oligonucleotide
  Target: SCN10A; (-) strand; PAM type: NRG; PAM sequence: CAG
acatgcaggtcccacttgga

SEQ ID NO: 23775 - DNA, 20 bp, Artificial Sequence
  Description of Artificial Sequence: Synthetic oligonucleotide
  Target: SCN10A; (-) strand; PAM type: NRG; PAM sequence: TGG
gctaacatgcaggtcccact

SEQ ID NO: 23776 - DNA, 20 bp, Artificial Sequence
  Description of Artificial Sequence: Synthetic oligonucleotide
  Target: SCN10A; (-) strand; PAM type: NRG; PAM sequence: AGG
aggagacagggctaacatgc

SEQ ID NO: 23777 - DNA, 20 bp, Artificial Sequence
  Description of Artificial Sequence: Synthetic oligonucleotide
  Target: SCN10A; (-) strand; PAM type: NRG; PAM sequence: CAG
taggagacagggctaacatg

SEQ ID NO: 23778 - DNA, 20 bp, Artificial Sequence
  Description of Artificial Sequence: Synthetic oligonucleotide
  Target: SCN10A; (-) strand; PAM type: NRG; PAM sequence: GGG
aaaatggtgggtaggagaca

SEQ ID NO: 23779 - DNA, 20 bp, Artificial Sequence
  Description of Artificial Sequence: Synthetic oligonucleotide
  Target: SCN10A; (-) strand; PAM type: NRG; PAM sequence: AGG
caaaatggtgggtaggagac

SEQ ID NO: 23780 - DNA, 20 bp, Artificial Sequence
  Description of Artificial Sequence: Synthetic oligonucleotide
  Target: SCN10A; (-) strand; PAM type: NRG; PAM sequence: CAG
acaaaatggtgggtaggaga

SEQ ID NO: 23781 - DNA, 20 bp, Artificial Sequence
  Description of Artificial Sequence: Synthetic oligonucleotide
  Target: SCN10A; (-) strand; PAM type: NRG; PAM sequence: GAG
ggggacaaaatggtgggtag

SEQ ID NO: 23782 - DNA, 20 bp, Artificial Sequence
  Description of Artificial Sequence: Synthetic oligonucleotide
  Target: SCN10A; (-) strand; PAM type: NRG; PAM sequence: AGG
gaggggacaaaatggtgggt

SEQ ID NO: 23783 - DNA, 20 bp, Artificial Sequence
  Description of Artificial Sequence: Synthetic oligonucleotide
  Target: SCN10A; (-) strand; PAM type: NRG; PAM sequence: TAG
agaggggacaaaatggtggg

SEQ ID NO: 23784 - DNA, 20 bp, Artificial Sequence
  Description of Artificial Sequence: Synthetic oligonucleotide
  Target: SCN10A; (-) strand; PAM type: NRG; PAM sequence: GGG
aggagaggggacaaaatggt

SEQ ID NO: 23785 - DNA, 20 bp, Artificial Sequence
  Description of Artificial Sequence: Synthetic oligonucleotide
  Target: SCN10A; (-) strand; PAM type: NRG; PAM sequence: TGG
taggagaggggacaaaatgg

SEQ ID NO: 23786 - DNA, 20 bp, Artificial Sequence
  Description of Artificial Sequence: Synthetic oligonucleotide
  Target: SCN10A; (-) strand; PAM type: NRG; PAM sequence: TGG
tgataggagaggggacaaaa

SEQ ID NO: 23787 - DNA, 20 bp, Artificial Sequence
  Description of Artificial Sequence: Synthetic oligonucleotide
  Target: SCN10A; (-) strand; PAM type: NRG; PAM sequence: GGG
ctgcatgtgtgataggagag

SEQ ID NO: 23788 - DNA, 20 bp, Artificial Sequence
  Description of Artificial Sequence: Synthetic oligonucleotide
  Target: SCN10A; (-) strand; PAM type: NRG; PAM sequence: GGG
tctgcatgtgtgataggaga

SEQ ID NO: 23789 - DNA, 20 bp, Artificial Sequence
  Description of Artificial Sequence: Synthetic oligonucleotide
  Target: SCN10A; (-) strand; PAM type: NRG; PAM sequence: AGG
atctgcatgtgtgataggag

SEQ ID NO: 23790 - DNA, 20 bp, Artificial Sequence
  Description of Artificial Sequence: Synthetic oligonucleotide
  Target: SCN10A; (-) strand; PAM type: NRG; PAM sequence: GAG
gatctgcatgtgtgatagga

SEQ ID NO: 23791 - DNA, 20 bp, Artificial Sequence
  Description of Artificial Sequence: Synthetic oligonucleotide
  Target: SCN10A; (-) strand; PAM type: NRG; PAM sequence: GAG
cagatctgcatgtgtgatag

SEQ ID NO: 23792 - DNA, 20 bp, Artificial Sequence
  Description of Artificial Sequence: Synthetic oligonucleotide
  Target: SCN10A; (-) strand; PAM type: NRG; PAM sequence: AGG
tgcagatctgcatgtgtgat

SEQ ID NO: 23793 - DNA, 20 bp, Artificial Sequence
  Description of Artificial Sequence: Synthetic oligonucleotide
  Target: SCN10A; (-) strand; PAM type: NRG; PAM sequence: TAG
atgcagatctgcatgtgtga

SEQ ID NO: 23794 - DNA, 20 bp, Artificial Sequence
  Description of Artificial Sequence: Synthetic oligonucleotide
  Target: SCN10A; (-) strand; PAM type: NRG; PAM sequence: CAG
ggcgtgagtatatctctatg

SEQ ID NO: 23795 - DNA, 20 bp, Artificial Sequence
  Description of Artificial Sequence: Synthetic oligonucleotide
  Target: SCN10A; (-) strand; PAM type: NRG; PAM sequence: GAG
tagcgtcattaccctggcgt

SEQ ID NO: 23796 - DNA, 20 bp, Artificial Sequence
  Description of Artificial Sequence: Synthetic oligonucleotide
  Target: SCN10A; (-) strand; PAM type: NRG; PAM sequence: TGG
ggattttagcgtcattaccc

SEQ ID NO: 23797 - DNA, 20 bp, Artificial Sequence
  Description of Artificial Sequence: Synthetic oligonucleotide
  Target: SCN10A; (-) strand; PAM type: NRG; PAM sequence: TAG
ccttggaactggctggattt

SEQ ID NO: 23798 - DNA, 20 bp, Artificial Sequence
  Description of Artificial Sequence: Synthetic oligonucleotide
  Target: SCN10A; (-) strand; PAM type: NRG; PAM sequence: TGG
gagagatccttggaactggc

SEQ ID NO: 23799 - DNA, 20 bp, Artificial Sequence
  Description of Artificial Sequence: Synthetic oligonucleotide
  Target: SCN10A; (-) strand; PAM type: NRG; PAM sequence: TGG
acctgagagatccttggaac

SEQ ID NO: 23800 - DNA, 20 bp, Artificial Sequence
  Description of Artificial Sequence: Synthetic oligonucleotide
  Target: SCN10A; (-) strand; PAM type: NRG; PAM sequence: TGG
tcacgtacctgagagatcct

SEQ ID NO: 23801 - DNA, 20 bp, Artificial Sequence
  Description of Artificial Sequence: Synthetic oligonucleotide
  Target: SCN10A; (-) strand; PAM type: NRG; PAM sequence: GAG
aaatgagttcacgtacctga

SEQ ID NO: 23802 - DNA, 20 bp, Artificial Sequence
  Description of Artificial Sequence: Synthetic oligonucleotide
  Target: SCN10A; (-) strand; PAM type: NRG; PAM sequence: GAG
ctaaatgagttcacgtacct

SEQ ID NO: 23803 - DNA, 20 bp, Artificial Sequence
  Description of Artificial Sequence: Synthetic oligonucleotide
  Target: SCN10A; (-) strand; PAM type: NRG; PAM sequence: GAG
caagaggattttgtctaaat

SEQ ID NO: 23804 - DNA, 20 bp, Artificial Sequence
  Description of Artificial Sequence: Synthetic oligonucleotide
  Target: SCN10A; (-) strand; PAM type: NRG; PAM sequence: AGG
ttgataaagatactggcaag

SEQ ID NO: 23805 - DNA, 20 bp, Artificial Sequence
  Description of Artificial Sequence: Synthetic oligonucleotide
  Target: SCN10A; (-) strand; PAM type: NRG; PAM sequence: GAG
cttgataaagatactggcaa

SEQ ID NO: 23806 - DNA, 20 bp, Artificial Sequence
  Description of Artificial Sequence: Synthetic oligonucleotide
  Target: SCN10A; (-) strand; PAM type: NRG; PAM sequence: AAG
gccttgataaagatactggc

SEQ ID NO: 23807 - DNA, 20 bp, Artificial Sequence
  Description of Artificial Sequence: Synthetic oligonucleotide
  Target: SCN10A; (-) strand; PAM type: NRG; PAM sequence: TGG
tgaagccttgataaagatac

SEQ ID NO: 23808 - DNA, 20 bp, Artificial Sequence
  Description of Artificial Sequence: Synthetic oligonucleotide
  Target: SCN10A; (-) strand; PAM type: NRG; PAM sequence: AAG
acacctttgaagccttgata

SEQ ID NO: 23809 - DNA, 20 bp, Artificial Sequence
  Description of Artificial Sequence: Synthetic oligonucleotide
  Target: SCN10A; (-) strand; PAM type: NRG; PAM sequence: AAG
cactgtcatttacacctttg

SEQ ID NO: 23810 - DNA, 20 bp, Artificial Sequence
  Description of Artificial Sequence: Synthetic oligonucleotide
  Target: SCN10A; (-) strand; PAM type: NRG; PAM sequence: CAG
tccttttctaccctccttcc

SEQ ID NO: 23811 - DNA, 20 bp, Artificial Sequence
  Description of Artificial Sequence: Synthetic oligonucleotide
  Target: SCN10A; (-) strand; PAM type: NRG; PAM sequence: CAG
cctgagtacactccatggca

SEQ ID NO: 23812 - DNA, 20 bp, Artificial Sequence
  Description of Artificial Sequence: Synthetic oligonucleotide
  Target: SCN10A; (-) strand; PAM type: NRG; PAM sequence: TGG
aaccccctgagtacactcca

SEQ ID NO: 23813 - DNA, 20 bp, Artificial Sequence
  Description of Artificial Sequence: Synthetic oligonucleotide
  Target: SCN10A; (-) strand; PAM type: NRG; PAM sequence: GAG
cctggaagaaggaaccccct

SEQ ID NO: 23814 - DNA, 20 bp, Artificial Sequence
  Description of Artificial Sequence: Synthetic oligonucleotide
  Target: SCN10A; (-) strand; PAM type: NRG; PAM sequence: AGG
catccctccctcctggaaga

SEQ ID NO: 23815 - DNA, 20 bp, Artificial Sequence
  Description of Artificial Sequence: Synthetic oligonucleotide
  Target: SCN10A; (-) strand; PAM type: NRG; PAM sequence: AAG
tcatccctccctcctggaag

SEQ ID NO: 23816 - DNA, 20 bp, Artificial Sequence
  Description of Artificial Sequence: Synthetic oligonucleotide
  Target: SCN10A; (-) strand; PAM type: NRG; PAM sequence: AAG
aggtcatccctccctcctgg

SEQ ID NO: 23817 - DNA, 20 bp, Artificial Sequence
  Description of Artificial Sequence: Synthetic oligonucleotide
  Target: SCN10A; (-) strand; PAM type: NRG; PAM sequence: TGG
agcaggtcatccctccctcc

SEQ ID NO: 23818 - DNA, 20 bp, Artificial Sequence
  Description of Artificial Sequence: Synthetic oligonucleotide
  Target: SCN10A; (-) strand; PAM type: NRG; PAM sequence: AGG
tttcttggagcagtcagagc

SEQ ID NO: 23819 - DNA, 20 bp, Artificial Sequence
  Description of Artificial Sequence: Synthetic oligonucleotide
  Target: SCN10A; (-) strand; PAM type: NRG; PAM sequence: CAG
ttttcttggagcagtcagag

SEQ ID NO: 23820 - DNA, 20 bp, Artificial Sequence
  Description of Artificial Sequence: Synthetic oligonucleotide
  Target: SCN10A; (-) strand; PAM type: NRG; PAM sequence: GAG
gttttttcttggagcagtca

SEQ ID NO: 23821 - DNA, 20 bp, Artificial Sequence
  Description of Artificial Sequence: Synthetic oligonucleotide
  Target: SCN10A; (-) strand; PAM type: NRG; PAM sequence: CAG
atgttttttcttggagcagt

SEQ ID NO: 23822 - DNA, 20 bp, Artificial Sequence
  Description of Artificial Sequence: Synthetic oligonucleotide
  Target: SCN10A; (-) strand; PAM type: NRG; PAM sequence: CAG
ttgcatgttttttcttggag

SEQ ID NO: 23823 - DNA, 20 bp, Artificial Sequence
  Description of Artificial Sequence: Synthetic oligonucleotide
  Target: SCN10A; (-) strand; PAM type: NRG; PAM sequence: GAG
tctttgcatgttttttcttg

SEQ ID NO: 23824 - DNA, 20 bp, Artificial Sequence
  Description of Artificial Sequence: Synthetic oligonucleotide
  Target: SCN10A; (-) strand; PAM type: NRG; PAM sequence: TGG
attctttgcatgttttttct

SEQ ID NO: 23825 - DNA, 20 bp, Artificial Sequence
  Description of Artificial Sequence: Synthetic oligonucleotide
  Target: SCN10A; (-) strand; PAM type: NRG; PAM sequence: TGG
cttcttccccctcatcacct

SEQ ID NO: 23826 - DNA, 20 bp, Artificial Sequence
  Description of Artificial Sequence: Synthetic oligonucleotide
  Target: SCN10A; (-) strand; PAM type: NRG; PAM sequence: CAG
tgtggcccttctttttccct

SEQ ID NO: 23827 - DNA, 20 bp, Artificial Sequence
  Description of Artificial Sequence: Synthetic oligonucleotide
  Target: SCN10A; (-) strand; PAM type: NRG; PAM sequence: TGG
ccccactccatctatttgtg

SEQ ID NO: 23828 - DNA, 20 bp, Artificial Sequence
  Description of Artificial Sequence: Synthetic oligonucleotide
  Target: SCN10A; (-) strand; PAM type: NRG; PAM sequence: CAG
gcagaagctgctggctgtcc

SEQ ID NO: 23829 - DNA, 20 bp, Artificial Sequence
  Description of Artificial Sequence: Synthetic oligonucleotide
  Target: SCN10A; (-) strand; PAM type: NRG; PAM sequence: TGG
cccagaacagcagaagctgc

SEQ ID NO: 23830 - DNA, 20 bp, Artificial Sequence
  Description of Artificial Sequence: Synthetic oligonucleotide
  Target: SCN10A; (-) strand; PAM type: NRG; PAM sequence: AAG
gcctaaccccagaacagcag

SEQ ID NO: 23831 - DNA, 20 bp, Artificial Sequence
  Description of Artificial Sequence: Synthetic oligonucleotide
  Target: SCN10A; (-) strand; PAM type: NRG; PAM sequence: CAG
tctgcctaaccccagaacag

SEQ ID NO: 23832 - DNA, 20 bp, Artificial Sequence
  Description of Artificial Sequence: Synthetic oligonucleotide
  Target: SCN10A; (-) strand; PAM type: NRG; PAM sequence: CAG
ccctctgcctaaccccagaa

SEQ ID NO: 23833 - DNA, 20 bp, Artificial Sequence
  Description of Artificial Sequence: Synthetic oligonucleotide
  Target: SCN10A; (-) strand; PAM type: NRG; PAM sequence: CAG
tactgccctctgcctaaccc

SEQ ID NO: 23834 - DNA, 20 bp, Artificial Sequence
  Description of Artificial Sequence: Synthetic oligonucleotide
  Target: SCN10A; (-) strand; PAM type: NRG; PAM sequence: GAG
gccctggcagacataaacag

SEQ ID NO: 23835 - DNA, 20 bp, Artificial Sequence
  Description of Artificial Sequence: Synthetic oligonucleotide
  Target: SCN10A; (-) strand; PAM type: NRG; PAM sequence: AGG
aggccctggcagacataaac

SEQ ID NO: 23836 - DNA, 20 bp, Artificial Sequence
  Description of Artificial Sequence: Synthetic oligonucleotide
  Target: SCN10A; (-) strand; PAM type: NRG; PAM sequence: CAG
gaggccctggcagacataaa

SEQ ID NO: 23837 - DNA, 20 bp, Artificial Sequence
  Description of Artificial Sequence: Synthetic oligonucleotide
  Target: SCN10A; (-) strand; PAM type: NRG; PAM sequence: CAG
gcaggatagggaggccctgg

SEQ ID NO: 23838 - DNA, 20 bp, Artificial Sequence
  Description of Artificial Sequence: Synthetic oligonucleotide
  Target: SCN10A; (-) strand; PAM type: NRG; PAM sequence: TGG
cttgcaggatagggaggccc

SEQ ID NO: 23839 - DNA, 20 bp, Artificial Sequence
  Description of Artificial Sequence: Synthetic oligonucleotide
  Target: SCN10A; (-) strand; PAM type: NRG; PAM sequence: AGG
cagcttcttgcaggataggg

SEQ ID NO: 23840 - DNA, 20 bp, Artificial Sequence
  Description of Artificial Sequence: Synthetic oligonucleotide
  Target: SCN10A; (-) strand; PAM type: NRG; PAM sequence: GAG
ccagcttcttgcaggatagg

SEQ ID NO: 23841 - DNA, 20 bp, Artificial Sequence
  Description of Artificial Sequence: Synthetic oligonucleotide
  Target: SCN10A; (-) strand; PAM type: NRG; PAM sequence: GGG
ctccagcttcttgcaggata

SEQ ID NO: 23842 - DNA, 20 bp, Artificial Sequence
  Description of Artificial Sequence: Synthetic oligonucleotide
  Target: SCN10A; (-) strand; PAM type: NRG; PAM sequence: AGG
cctccagcttcttgcaggat

SEQ ID NO: 23843 - DNA, 20 bp, Artificial Sequence
  Description of Artificial Sequence: Synthetic oligonucleotide
  Target: SCN10A; (-) strand; PAM type: NRG; PAM sequence: TAG
gcctccagcttcttgcagga

SEQ ID NO: 23844 - DNA, 20 bp, Artificial Sequence
  Description of Artificial Sequence: Synthetic oligonucleotide
  Target: SCN10A; (-) strand; PAM type: NRG; PAM sequence: AGG
atgagcctccagcttcttgc

SEQ ID NO: 23845 - DNA, 20 bp, Artificial Sequence
  Description of Artificial Sequence: Synthetic oligonucleotide
  Target: SCN10A; (-) strand; PAM type: NRG; PAM sequence: CAG
gatgagcctccagcttcttg

SEQ ID NO: 23846 - DNA, 20 bp, Artificial Sequence
  Description of Artificial Sequence: Synthetic oligonucleotide
  Target: SCN10A; (-) strand; PAM type: NRG; PAM sequence: CAG
ggagtttttagatgagcctc

SEQ ID NO: 23847 - DNA, 20 bp, Artificial Sequence
  Description of Artificial Sequence: Synthetic oligonucleotide
  Target: SCN10A; (-) strand; PAM type: NRG; PAM sequence: GAG
aaaactgggagtttttagat

SEQ ID NO: 23848 - DNA, 20 bp, Artificial Sequence
  Description of Artificial Sequence: Synthetic oligonucleotide
  Target: SCN10A; (-) strand; PAM type: NRG; PAM sequence: TAG
ttctaaaaactgggagtttt

SEQ ID NO: 23849 - DNA, 20 bp, Artificial Sequence
  Description of Artificial Sequence: Synthetic oligonucleotide
  Target: SCN10A; (-) strand; PAM type: NRG; PAM sequence: GAG
ctccagtttctaaaaactgg

SEQ ID NO: 23850 - DNA, 20 bp, Artificial Sequence
  Description of Artificial Sequence: Synthetic oligonucleotide
  Target: SCN10A; (-) strand; PAM type: NRG; PAM sequence: GGG
cactccagtttctaaaaact

SEQ ID NO: 23851 - DNA, 20 bp, Artificial Sequence
  Description of Artificial Sequence: Synthetic oligonucleotide
  Target: SCN10A; (-) strand; PAM type: NRG; PAM sequence: TGG
gcactccagtttctaaaaac

SEQ ID NO: 23852 - DNA, 20 bp, Artificial Sequence
  Description of Artificial Sequence: Synthetic oligonucleotide
  Target: SCN10A; (-) strand; PAM type: NRG; PAM sequence: CAG
ccactcatcagtctgcactc

SEQ ID NO: 23853 - DNA, 20 bp, Artificial Sequence
  Description of Artificial Sequence: Synthetic oligonucleotide
  Target: SCN10A; (-) strand; PAM type: NRG; PAM sequence: CAG
ctctgtcagttaccactcat

SEQ ID NO: 23854 - DNA, 20 bp, Artificial Sequence
  Description of Artificial Sequence: Synthetic oligonucleotide
  Target: SCN10A; (-) strand; PAM type: NRG; PAM sequence: CAG
ctttcttaggtctgctctgt

SEQ ID NO: 23855 - DNA, 20 bp, Artificial Sequence
  Description of Artificial Sequence: Synthetic oligonucleotide
  Target: SCN10A; (-) strand; PAM type: NRG; PAM sequence: AGG
agccagttttcagctttctt

SEQ ID NO: 23856 - DNA, 20 bp, Artificial Sequence
  Description of Artificial Sequence: Synthetic oligonucleotide
  Target: SCN10A; (-) strand; PAM type: NRG; PAM sequence: TAG
cagccagttttcagctttct

SEQ ID NO: 23857 - DNA, 20 bp, Artificial Sequence
  Description of Artificial Sequence: Synthetic oligonucleotide
  Target: SCN10A; (-) strand; PAM type: NRG; PAM sequence: CAG
tccctgcttcagccagtttt

SEQ ID NO: 23858 - DNA, 20 bp, Artificial Sequence
  Description of Artificial Sequence: Synthetic oligonucleotide
  Target: SCN10A; (-) strand; PAM type: NRG; PAM sequence: CAG
tgggtattccctgcttcagc

SEQ ID NO: 23859 - DNA, 20 bp, Artificial Sequence
  Description of Artificial Sequence: Synthetic oligonucleotide
  Target: SCN10A; (-) strand; PAM type: NRG; PAM sequence: CAG
cttctgggtattccctgctt

SEQ ID NO: 23860 - DNA, 20 bp, Artificial Sequence
  Description of Artificial Sequence: Synthetic oligonucleotide
  Target: SCN10A; (-) strand; PAM type: NRG; PAM sequence: GGG
gcatagcttggcttgcttct

SEQ ID NO: 23861 - DNA, 20 bp, Artificial Sequence
  Description of Artificial Sequence: Synthetic oligonucleotide
  Target: SCN10A; (-) strand; PAM type: NRG; PAM sequence: TGG
agcatagcttggcttgcttc

SEQ ID NO: 23862 - DNA, 20 bp, Artificial Sequence
  Description of Artificial Sequence: Synthetic oligonucleotide
  Target: SCN10A; (-) strand; PAM type: NRG; PAM sequence: TGG
tggggctctgcagcatagct

SEQ ID NO: 23863 - DNA, 20 bp, Artificial Sequence
  Description of Artificial Sequence: Synthetic oligonucleotide
  Target: SCN10A; (-) strand; PAM type: NRG; PAM sequence: TAG
agttctggggctctgcagca

SEQ ID NO: 23864 - DNA, 20 bp, Artificial Sequence
  Description of Artificial Sequence: Synthetic oligonucleotide
  Target: SCN10A; (-) strand; PAM type: NRG; PAM sequence: CAG
caagcagttctggggctctg

SEQ ID NO: 23865 - DNA, 20 bp, Artificial Sequence
  Description of Artificial Sequence: Synthetic oligonucleotide
  Target: SCN10A; (-) strand; PAM type: NRG; PAM sequence: GGG
ctaagttccaagcagttctg

SEQ ID NO: 23866 - DNA, 20 bp, Artificial Sequence
  Description of Artificial Sequence: Synthetic oligonucleotide
  Target: SCN10A; (-) strand; PAM type: NRG; PAM sequence: GGG
tctaagttccaagcagttct

SEQ ID NO: 23867 - DNA, 20 bp, Artificial Sequence
  Description of Artificial Sequence: Synthetic oligonucleotide
  Target: SCN10A; (-) strand; PAM type: NRG; PAM sequence: TGG
ctctaagttccaagcagttc

SEQ ID NO: 23868 - DNA, 20 bp, Artificial Sequence
  Description of Artificial Sequence: Synthetic oligonucleotide
  Target: SCN10A; (-) strand; PAM type: NRG; PAM sequence: CAG
tagcatctctaagttccaag

SEQ ID NO: 23869 - DNA, 20 bp, Artificial Sequence
  Description of Artificial Sequence: Synthetic oligonucleotide
  Target: SCN10A; (-) strand; PAM type: NRG; PAM sequence: AAG
acttagcatctctaagttcc

SEQ ID NO: 23870 - DNA, 20 bp, Artificial Sequence
  Description of Artificial Sequence: Synthetic oligonucleotide
  Target: SCN10A; (-) strand; PAM type: NRG; PAM sequence: AAG
cagagatacttagcatctct

SEQ ID NO: 23871 - DNA, 20 bp, Artificial Sequence
  Description of Artificial Sequence: Synthetic oligonucleotide
  Target: SCN10A; (-) strand; PAM type: NRG; PAM sequence: TAG
accttgctttcagagatact

SEQ ID NO: 23872 - DNA, 20 bp, Artificial Sequence
  Description of Artificial Sequence: Synthetic oligonucleotide
  Target: SCN10A; (-) strand; PAM type: NRG; PAM sequence: GAG
tcccccaaaccttgctttca

SEQ ID NO: 23873 - DNA, 20 bp, Artificial Sequence
  Description of Artificial Sequence: Synthetic oligonucleotide
  Target: SCN10A; (-) strand; PAM type: NRG; PAM sequence: CAG
cctcccccaaaccttgcttt

SEQ ID NO: 23874 - DNA, 20 bp, Artificial Sequence
  Description of Artificial Sequence: Synthetic oligonucleotide
  Target: SCN10A; (-) strand; PAM type: NRG; PAM sequence: CAG
aaactttcaagcaattcttt

SEQ ID NO: 23875 - DNA, 20 bp, Artificial Sequence
  Description of Artificial Sequence: Synthetic oligonucleotide
  Target: SCN10A; (-) strand; PAM type: NRG; PAM sequence: AAG
ggttcctgtaaaaaactttc

SEQ ID NO: 23876 - DNA, 20 bp, Artificial Sequence
  Description of Artificial Sequence: Synthetic oligonucleotide
  Target: SCN10A; (-) strand; PAM type: NRG; PAM sequence: TGG
cagcatctagaaagctcaac

SEQ ID NO: 23877 - DNA, 20 bp, Artificial Sequence
  Description of Artificial Sequence: Synthetic oligonucleotide
  Target: SCN10A; (-) strand; PAM type: NRG; PAM sequence: AAG
ggcataaagcagcatctaga

SEQ ID NO: 23878 - DNA, 20 bp, Artificial Sequence
  Description of Artificial Sequence: Synthetic oligonucleotide
  Target: SCN10A; (-) strand; PAM type: NRG; PAM sequence: TAG
ggatggcataaagcagcatc

SEQ ID NO: 23879 - DNA, 20 bp, Artificial Sequence
  Description of Artificial Sequence: Synthetic oligonucleotide
  Target: SCN10A; (-) strand; PAM type: NRG; PAM sequence: CAG
attgaatggatggcataaag

SEQ ID NO: 23880 - DNA, 20 bp, Artificial Sequence
  Description of Artificial Sequence: Synthetic oligonucleotide
  Target: SCN10A; (-) strand; PAM type: NRG; PAM sequence: AAG
ctcattgaatggatggcata

SEQ ID NO: 23881 - DNA, 20 bp, Artificial Sequence
  Description of Artificial Sequence: Synthetic oligonucleotide
  Target: SCN10A; (-) strand; PAM type: NRG; PAM sequence: TGG
acagtttctcattgaatgga

SEQ ID NO: 23882 - DNA, 20 bp, Artificial Sequence
  Description of Artificial Sequence: Synthetic oligonucleotide
  Target: SCN10A; (-) strand; PAM type: NRG; PAM sequence: TGG
agaaacagtttctcattgaa

SEQ ID NO: 23883 - DNA, 20 bp, Artificial Sequence
  Description of Artificial Sequence: Synthetic oligonucleotide
  Target: SCN10A; (-) strand; PAM type: NRG; PAM sequence: CAG
atccatttctggagcagaaa

SEQ ID NO: 23884 - DNA, 20 bp, Artificial Sequence
  Description of Artificial Sequence: Synthetic oligonucleotide
  Target: SCN10A; (-) strand; PAM type: NRG; PAM sequence: CAG
catccaatccatttctggag

SEQ ID NO: 23885 - DNA, 20 bp, Artificial Sequence
  Description of Artificial Sequence: Synthetic oligonucleotide
  Target: SCN10A; (-) strand; PAM type: NRG; PAM sequence: GAG
gagcatccaatccatttctg

SEQ ID NO: 23886 - DNA, 20 bp, Artificial Sequence
  Description of Artificial Sequence: Synthetic oligonucleotide
  Target: SCN10A; (-) strand; PAM type: NRG; PAM sequence: TGG
atgagcatccaatccatttc

SEQ ID NO: 23887 - DNA, 20 bp, Artificial Sequence
  Description of Artificial Sequence: Synthetic oligonucleotide
  Target: SCN10A; (-) strand; PAM type: NRG; PAM sequence: GAG
tcttcaactcttaagaaaat

SEQ ID NO: 23888 - DNA, 20 bp, Artificial Sequence
  Description of Artificial Sequence: Synthetic oligonucleotide
  Target: SCN10A; (-) strand; PAM type: NRG; PAM sequence: AAG
ttccctcttcttcaactctt

SEQ ID NO: 23889 - DNA, 20 bp, Artificial Sequence
  Description of Artificial Sequence: Synthetic oligonucleotide
  Target: SCN10A; (-) strand; PAM type: NRG; PAM sequence: CAG
ttttctttatatgcattttt

SEQ ID NO: 23890 - DNA, 20 bp, Artificial Sequence
  Description of Artificial Sequence: Synthetic oligonucleotide
  Target: SCN10A; (-) strand; PAM type: NRG; PAM sequence: AGG
ggagttgtttgcctttcagt

SEQ ID NO: 23891 - DNA, 20 bp, Artificial Sequence
  Description of Artificial Sequence: Synthetic oligonucleotide
  Target: SCN10A; (-) strand; PAM type: NRG; PAM sequence: TAG
gggagttgtttgcctttcag

SEQ ID NO: 23892 - DNA, 20 bp, Artificial Sequence
  Description of Artificial Sequence: Synthetic oligonucleotide
  Target: SCN10A; (-) strand; PAM type: NRG; PAM sequence: CAG
gaggggagttgtttgccttt

SEQ ID NO: 23893 - DNA, 20 bp, Artificial Sequence
  Description of Artificial Sequence: Synthetic oligonucleotide
  Target: SCN10A; (-) strand; PAM type: NRG; PAM sequence: GAG
gcagaagtgaatagggaggg

SEQ ID NO: 23894 - DNA, 20 bp, Artificial Sequence
  Description of Artificial Sequence: Synthetic oligonucleotide
  Target: SCN10A; (-) strand; PAM type: NRG; PAM sequence: GGG
gagcagaagtgaatagggag

SEQ ID NO: 23895 - DNA, 20 bp, Artificial Sequence
  Description of Artificial Sequence: Synthetic oligonucleotide
  Target: SCN10A; (-) strand; PAM type: NRG; PAM sequence: GGG
ggagcagaagtgaataggga

SEQ ID NO: 23896 - DNA, 20 bp, Artificial Sequence
  Description of Artificial Sequence: Synthetic oligonucleotide
  Target: SCN10A; (-) strand; PAM type: NRG; PAM sequence: AGG
aggagcagaagtgaataggg

SEQ ID NO: 23897 - DNA, 20 bp, Artificial Sequence
  Description of Artificial Sequence: Synthetic oligonucleotide
  Target: SCN10A; (-) strand; PAM type: NRG; PAM sequence: GAG
gaggagcagaagtgaatagg

SEQ ID NO: 23898 - DNA, 20 bp, Artificial Sequence
  Description of Artificial Sequence: Synthetic oligonucleotide
  Target: SCN10A; (-) strand; PAM type: NRG; PAM sequence: GGG
acgaggagcagaagtgaata

SEQ ID NO: 23899 - DNA, 20 bp, Artificial Sequence
  Description of Artificial Sequence: Synthetic oligonucleotide
  Target: SCN10A; (-) strand; PAM type: NRG; PAM sequence: AGG
aacgaggagcagaagtgaat

SEQ ID NO: 23900 - DNA, 20 bp, Artificial Sequence
  Description of Artificial Sequence: Synthetic oligonucleotide
  Target: SCN10A; (-) strand; PAM type: NRG; PAM sequence: TAG
taacgaggagcagaagtgaa

SEQ ID NO: 23901 - DNA, 20 bp, Artificial Sequence
  Description of Artificial Sequence: Synthetic oligonucleotide
  Target: SCN10A; (-) strand; PAM type: NRG; PAM sequence: AAG
ggaaacttaacgaggagcag

SEQ ID NO: 23902 - DNA, 20 bp, Artificial Sequence
  Description of Artificial Sequence: Synthetic oligonucleotide
  Target: SCN10A; (-) strand; PAM type: NRG; PAM sequence: CAG
tctggaaacttaacgaggag

SEQ ID NO: 23903 - DNA, 20 bp, Artificial Sequence
  Description of Artificial Sequence: Synthetic oligonucleotide
  Target: SCN10A; (-) strand; PAM type: NRG; PAM sequence: GAG
tcttctggaaacttaacgag

SEQ ID NO: 23904 - DNA, 20 bp, Artificial Sequence
  Description of Artificial Sequence: Synthetic oligonucleotide
  Target: SCN10A; (-) strand; PAM type: NRG; PAM sequence: AGG
tatcttctggaaacttaacg

SEQ ID NO: 23905 - DNA, 20 bp, Artificial Sequence
  Description of Artificial Sequence: Synthetic oligonucleotide
  Target: SCN10A; (-) strand; PAM type: NRG; PAM sequence: GAG
ttatcttctggaaacttaac

SEQ ID NO: 23906 - DNA, 20 bp, Artificial Sequence
  Description of Artificial Sequence: Synthetic oligonucleotide
  Target: SCN10A; (-) strand; PAM type: NRG; PAM sequence: TGG
ctctaaaccagattatcttc

SEQ ID NO: 23907 - DNA, 20 bp, Artificial Sequence
  Description of Artificial Sequence: Synthetic oligonucleotide
  Target: SCN10A; (-) strand; PAM type: NRG; PAM sequence: CAG
catcttcatgggctctaaac

SEQ ID NO: 23908 - DNA, 20 bp, Artificial Sequence
  Description of Artificial Sequence: Synthetic oligonucleotide
  Target: SCN10A; (-) strand; PAM type: NRG; PAM sequence: GGG
taaaagtgcagcatcttcat

SEQ ID NO: 23909 - DNA, 20 bp, Artificial Sequence
  Description of Artificial Sequence: Synthetic oligonucleotide
  Target: SCN10A; (-) strand; PAM type: NRG; PAM sequence: TGG
ttaaaagtgcagcatcttca

SEQ ID NO: 23910 - DNA, 20 bp, Artificial Sequence
  Description of Artificial Sequence: Synthetic oligonucleotide
  Target: SCN10A; (-) strand; PAM type: NRG; PAM sequence: CAG
ggctgttcatgttaaaagtg

SEQ ID NO: 23911 - DNA, 20 bp, Artificial Sequence
  Description of Artificial Sequence: Synthetic oligonucleotide
  Target: SCN10A; (-) strand; PAM type: NRG; PAM sequence: AAG
tggctggctgttcatgttaa

SEQ ID NO: 23912 - DNA, 20 bp, Artificial Sequence
  Description of Artificial Sequence: Synthetic oligonucleotide
  Target: SCN10A; (-) strand; PAM type: NRG; PAM sequence: TGG
aattcctgatgctccttggc

SEQ ID NO: 23913 - DNA, 20 bp, Artificial Sequence
  Description of Artificial Sequence: Synthetic oligonucleotide
  Target: SCN10A; (-) strand; PAM type: NRG; PAM sequence: TGG
ttcaaattcctgatgctcct

SEQ ID NO: 23914 - DNA, 20 bp, Artificial Sequence
  Description of Artificial Sequence: Synthetic oligonucleotide
  Target: SCN10A; (-) strand; PAM type: NRG; PAM sequence: AAG
gctttggtttctggtgttag

SEQ ID NO: 23915 - DNA, 20 bp, Artificial Sequence
  Description of Artificial Sequence: Synthetic oligonucleotide
  Target: SCN10A; (-) strand; PAM type: NRG; PAM sequence: TAG
gttgctttggtttctggtgt

SEQ ID NO: 23916 - DNA, 20 bp, Artificial Sequence
  Description of Artificial Sequence: Synthetic oligonucleotide
  Target: SCN10A; (-) strand; PAM type: NRG; PAM sequence: TGG
tgtttggttgctttggtttc

SEQ ID NO: 23917 - DNA, 20 bp, Artificial Sequence
  Description of Artificial Sequence: Synthetic oligonucleotide
  Target: SCN10A; (-) strand; PAM type: NRG; PAM sequence: TGG
tttcagttgtttggttgctt

SEQ ID NO: 23918 - DNA, 20 bp, Artificial Sequence
  Description of Artificial Sequence: Synthetic oligonucleotide
  Target: SCN10A; (-) strand; PAM type: NRG; PAM sequence: TGG
ttttttttttttcagttgtt

SEQ ID NO: 23919 - DNA, 20 bp, Artificial Sequence
  Description of Artificial Sequence: Synthetic oligonucleotide
  Target: SCN10A; (-) strand; PAM type: NRG; PAM sequence: CAG
tttctttttttttttttttt

SEQ ID NO: 23920 - DNA, 20 bp, Artificial Sequence
  Description of Artificial Sequence: Synthetic oligonucleotide
  Target: SCN10A; (-) strand; PAM type: NRG; PAM sequence: CAG
gccacagcgcctggccaata

SEQ ID NO: 23921 - DNA, 20 bp, Artificial Sequence
  Description of Artificial Sequence: Synthetic oligonucleotide
  Target: SCN10A; (-) strand; PAM type: NRG; PAM sequence: TGG
caggcgtgagccacagcgcc

SEQ ID NO: 23922 - DNA, 20 bp, Artificial Sequence
  Description of Artificial Sequence: Synthetic oligonucleotide
  Target: SCN10A; (-) strand; PAM type: NRG; PAM sequence: CAG
gcgattacaggcgtgagcca

SEQ ID NO: 23923 - DNA, 20 bp, Artificial Sequence
  Description of Artificial Sequence: Synthetic oligonucleotide
  Target: SCN10A; (-) strand; PAM type: NRG; PAM sequence: GAG
agtgctgcgattacaggcgt

SEQ ID NO: 23924 - DNA, 20 bp, Artificial Sequence
  Description of Artificial Sequence: Synthetic oligonucleotide
  Target: SCN10A; (-) strand; PAM type: NRG; PAM sequence: AGG
tcccaaagtgctgcgattac

SEQ ID NO: 23925 - DNA, 20 bp, Artificial Sequence
  Description of Artificial Sequence: Synthetic oligonucleotide
  Target: SCN10A; (-) strand; PAM type: NRG; PAM sequence: CAG
ctcccaaagtgctgcgatta

SEQ ID NO: 23926 - DNA, 20 bp, Artificial Sequence
  Description of Artificial Sequence: Synthetic oligonucleotide
  Target: SCN10A; (-) strand; PAM type: NRG; PAM sequence: AAG
ctgcccgcctcggcctccca

SEQ ID NO: 23927 - DNA, 20 bp, Artificial Sequence
  Description of Artificial Sequence: Synthetic oligonucleotide
  Target: SCN10A; (-) strand; PAM type: NRG; PAM sequence: CGG
acctcgtaatctgcccgcct

SEQ ID NO: 23928 - DNA, 20 bp, Artificial Sequence
  Description of Artificial Sequence: Synthetic oligonucleotide
  Target: SCN10A; (-) strand; PAM type: NRG; PAM sequence: TGG
tttcaccgcgttagccagga

SEQ ID NO: 23929 - DNA, 20 bp, Artificial Sequence
  Description of Artificial Sequence: Synthetic oligonucleotide
  Target: SCN10A; (-) strand; PAM type: NRG; PAM sequence: AGG
ggggtttcaccgcgttagcc

SEQ ID NO: 23930 - DNA, 20 bp, Artificial Sequence
  Description of Artificial Sequence: Synthetic oligonucleotide
  Target: SCN10A; (-) strand; PAM type: NRG; PAM sequence: CAG
cggggtttcaccgcgttagc

SEQ ID NO: 23931 - DNA, 20 bp, Artificial Sequence
  Description of Artificial Sequence: Synthetic oligonucleotide
  Target: SCN10A; (-) strand; PAM type: NRG; PAM sequence: TAG
gagacggggtttcaccgcgt

SEQ ID NO: 23932 - DNA, 20 bp, Artificial Sequence
  Description of Artificial Sequence: Synthetic oligonucleotide
  Target: SCN10A; (-) strand; PAM type: NRG; PAM sequence: GGG
ttgtatttttagtagagacg

SEQ ID NO: 23933 - DNA, 20 bp, Artificial Sequence
  Description of Artificial Sequence: Synthetic oligonucleotide
  Target: SCN10A; (-) strand; PAM type: NRG; PAM sequence: GGG
tttgtatttttagtagagac

SEQ ID NO: 23934 - DNA, 20 bp, Artificial Sequence
  Description of Artificial Sequence: Synthetic oligonucleotide
  Target: SCN10A; (-) strand; PAM type: NRG; PAM sequence: CGG
ttttgtatttttagtagaga

SEQ ID NO: 23935 - DNA, 20 bp, Artificial Sequence
  Description of Artificial Sequence: Synthetic oligonucleotide
  Target: SCN10A; (-) strand; PAM type: NRG; PAM sequence: GAG
aattttttgtatttttagta

SEQ ID NO: 23936 - DNA, 20 bp, Artificial Sequence
  Description of Artificial Sequence: Synthetic oligonucleotide
  Target: SCN10A; (-) strand; PAM type: NRG; PAM sequence: TAG
ctaattttttgtatttttag

SEQ ID NO: 23937 - DNA, 20 bp, Artificial Sequence
  Description of Artificial Sequence: Synthetic oligonucleotide
  Target: SCN10A; (-) strand; PAM type: NRG; PAM sequence: TAG
cggctaattttttgtatttt

SEQ ID NO: 23938 - DNA, 20 bp, Artificial Sequence
  Description of Artificial Sequence: Synthetic oligonucleotide
  Target: SCN10A; (-) strand; PAM type: NRG; PAM sequence: CGG
caggtgcccgccaaggcgcc

SEQ ID NO: 23939 - DNA, 20 bp, Artificial Sequence
  Description of Artificial Sequence: Synthetic oligonucleotide
  Target: SCN10A; (-) strand; PAM type: NRG; PAM sequence: AGG
ggaactacaggtgcccgcca

SEQ ID NO: 23940 - DNA, 20 bp, Artificial Sequence
  Description of Artificial Sequence: Synthetic oligonucleotide
  Target: SCN10A; (-) strand; PAM type: NRG; PAM sequence: AAG
tggaactacaggtgcccgcc

SEQ ID NO: 23941 - DNA, 20 bp, Artificial Sequence
  Description of Artificial Sequence: Synthetic oligonucleotide
  Target: SCN10A; (-) strand; PAM type: NRG; PAM sequence: AGG
tccggagtagctggaactac

SEQ ID NO: 23942 - DNA, 20 bp, Artificial Sequence
  Description of Artificial Sequence: Synthetic oligonucleotide
  Target: SCN10A; (-) strand; PAM type: NRG; PAM sequence: CAG
ctccggagtagctggaacta

SEQ ID NO: 23943 - DNA, 20 bp, Artificial Sequence
  Description of Artificial Sequence: Synthetic oligonucleotide
  Target: SCN10A; (-) strand; PAM type: NRG; PAM sequence: TGG
gcctcagcctccggagtagc

SEQ ID NO: 23944 - DNA, 20 bp, Artificial Sequence
  Description of Artificial Sequence: Synthetic oligonucleotide
  Target: SCN10A; (-) strand; PAM type: NRG; PAM sequence: TAG
tcccgcctcagcctccggag

SEQ ID NO: 23945 - DNA, 20 bp, Artificial Sequence
  Description of Artificial Sequence: Synthetic oligonucleotide
  Target: SCN10A; (-) strand; PAM type: NRG; PAM sequence: GAG
ttctcccgcctcagcctccg

SEQ ID NO: 23946 - DNA, 20 bp, Artificial Sequence
  Description of Artificial Sequence: Synthetic oligonucleotide
  Target: SCN10A; (-) strand; PAM type: NRG; PAM sequence: CGG
cattctcccgcctcagcctc

SEQ ID NO: 23947 - DNA, 20 bp, Artificial Sequence
  Description of Artificial Sequence: Synthetic oligonucleotide
  Target: SCN10A; (-) strand; PAM type: NRG; PAM sequence: CAG
ttcacgccattctcccgcct

SEQ ID NO: 23948 - DNA, 20 bp, Artificial Sequence
  Description of Artificial Sequence: Synthetic oligonucleotide
  Target: SCN10A; (-) strand; PAM type: NRG; PAM sequence: GGG
cactgcaagctccgcctccc

SEQ ID NO: 23949 - DNA, 20 bp, Artificial Sequence
  Description of Artificial Sequence: Synthetic oligonucleotide
  Target: SCN10A; (-) strand; PAM type: NRG; PAM sequence: CGG
tcactgcaagctccgcctcc

SEQ ID NO: 23950 - DNA, 20 bp, Artificial Sequence
  Description of Artificial Sequence: Synthetic oligonucleotide
  Target: SCN10A; (-) strand; PAM type: NRG; PAM sequence: AAG
acgcgatctaggctcactgc

SEQ ID NO: 23951 - DNA, 20 bp, Artificial Sequence
  Description of Artificial Sequence: Synthetic oligonucleotide
  Target: SCN10A; (-) strand; PAM type: NRG; PAM sequence: AGG
ggagtgcagtgacgcgatct

SEQ ID NO: 23952 - DNA, 20 bp, Artificial Sequence
  Description of Artificial Sequence: Synthetic oligonucleotide
  Target: SCN10A; (-) strand; PAM type: NRG; PAM sequence: TAG
tggagtgcagtgacgcgatc

SEQ ID NO: 23953 - DNA, 20 bp, Artificial Sequence
  Description of Artificial Sequence: Synthetic oligonucleotide
  Target: SCN10A; (-) strand; PAM type: NRG; PAM sequence: CAG
ctgtcacccagactggagtg

SEQ ID NO: 23954 - DNA, 20 bp, Artificial Sequence
  Description of Artificial Sequence: Synthetic oligonucleotide
  Target: SCN10A; (-) strand; PAM type: NRG; PAM sequence: GAG
ttgctctgtcacccagactg

SEQ ID NO: 23955 - DNA, 20 bp, Artificial Sequence
  Description of Artificial Sequence: Synthetic oligonucleotide
  Target: SCN10A; (-) strand; PAM type: NRG; PAM sequence: TGG
tcttgctctgtcacccagac

SEQ ID NO: 23956 - DNA, 20 bp, Artificial Sequence
  Description of Artificial Sequence: Synthetic oligonucleotide
  Target: SCN10A; (-) strand; PAM type: NRG; PAM sequence: CAG
cgaagtcttgctctgtcacc

SEQ ID NO: 23957 - DNA, 20 bp, Artificial Sequence
  Description of Artificial Sequence: Synthetic oligonucleotide
  Target: SCN10A; (-) strand; PAM type: NRG; PAM sequence: AAG
ttgttgttgttttggagacg

SEQ ID NO: 23958 - DNA, 20 bp, Artificial Sequence
  Description of Artificial Sequence: Synthetic oligonucleotide
  Target: SCN10A; (-) strand; PAM type: NRG; PAM sequence: GAG
ctgttgttgttgttgttttg

SEQ ID NO: 23959 - DNA, 20 bp, Artificial Sequence
  Description of Artificial Sequence: Synthetic oligonucleotide
  Target: SCN10A; (-) strand; PAM type: NRG; PAM sequence: TGG
tgctgttgttgttgttgttt

SEQ ID NO: 23960 - DNA, 20 bp, Artificial Sequence
  Description of Artificial Sequence: Synthetic oligonucleotide
  Target: SCN10A; (-) strand; PAM type: NRG; PAM sequence: AGG
ctctctaaaaatattagtac

SEQ ID NO: 23961 - DNA, 20 bp, Artificial Sequence
  Description of Artificial Sequence: Synthetic oligonucleotide
  Target: SCN10A; (-) strand; PAM type: NRG; PAM sequence: CAG
actctctaaaaatattagta

SEQ ID NO: 23962 - DNA, 20 bp, Artificial Sequence
  Description of Artificial Sequence: Synthetic oligonucleotide
  Target: SCN10A; (-) strand; PAM type: NRG; PAM sequence: TAG
tcttaactctctaaaaatat

SEQ ID NO: 23963 - DNA, 20 bp, Artificial Sequence
  Description of Artificial Sequence: Synthetic oligonucleotide
  Target: SCN10A; (-) strand; PAM type: NRG; PAM sequence: GAG
ctgctcttgttctatacgtg

SEQ ID NO: 23964 - DNA, 20 bp, Artificial Sequence
  Description of Artificial Sequence: Synthetic oligonucleotide
  Target: SCN10A; (-) strand; PAM type: NRG; PAM sequence: TGG
ttctgctcttgttctatacg

SEQ ID NO: 23965 - DNA, 20 bp, Artificial Sequence
  Description of Artificial Sequence: Synthetic oligonucleotide
  Target: SCN10A; (-) strand; PAM type: NRG; PAM sequence: AGG
aaattccattttgtctttga

SEQ ID NO: 23966 - DNA, 20 bp, Artificial Sequence
  Description of Artificial Sequence: Synthetic oligonucleotide
  Target: SCN10A; (-) strand; PAM type: NRG; PAM sequence: AAG
aaaattccattttgtctttg

SEQ ID NO: 23967 - DNA, 20 bp, Artificial Sequence
  Description of Artificial Sequence: Synthetic oligonucleotide
  Target: SCN10A; (-) strand; PAM type: NRG; PAM sequence: TAG
ttatttacaagtccgcctat

SEQ ID NO: 23968 - DNA, 20 bp, Artificial Sequence
  Description of Artificial Sequence: Synthetic oligonucleotide
  Target: SCN10A; (-) strand; PAM type: NRG; PAM sequence: AAG
atttccaaaactttatttac

SEQ ID NO: 23969 - DNA, 20 bp, Artificial Sequence
  Description of Artificial Sequence: Synthetic oligonucleotide
  Target: SCN10A; (-) strand; PAM type: NRG; PAM sequence: GAG
ttttttgttccacttcctgt

SEQ ID NO: 23970 - DNA, 20 bp, Artificial Sequence
  Description of Artificial Sequence: Synthetic oligonucleotide
  Target: SCN10A; (-) strand; PAM type: NRG; PAM sequence: TAG
tagtcaaacaatatacctcc

SEQ ID NO: 23971 - DNA, 20 bp, Artificial Sequence
  Description of Artificial Sequence: Synthetic oligonucleotide
  Target: SCN10A; (-) strand; PAM type: NRG; PAM sequence: TAG
tttctttctagacctcctat

SEQ ID NO: 23972 - DNA, 20 bp, Artificial Sequence
  Description of Artificial Sequence: Synthetic oligonucleotide
  Target: SCN10A; (-) strand; PAM type: NRG; PAM sequence: TAG
attgtcttctaatttctttc

SEQ ID NO: 23973 - DNA, 20 bp, Artificial Sequence
  Description of Artificial Sequence: Synthetic oligonucleotide
  Target: SCN10A; (-) strand; PAM type: NRG; PAM sequence: AGG
tatttccctcttaattttga

SEQ ID NO: 23974 - DNA, 20 bp, Artificial Sequence
  Description of Artificial Sequence: Synthetic oligonucleotide
  Target: SCN10A; (-) strand; PAM type: NRG; PAM sequence: AAG
ttatttccctcttaattttg

SEQ ID NO: 23975 - DNA, 20 bp, Artificial Sequence
  Description of Artificial Sequence: Synthetic oligonucleotide
  Target: SCN10A; (-) strand; PAM type: NRG; PAM sequence: TAG
ctagggaaagacttctgtat

SEQ ID NO: 23976 - DNA, 20 bp, Artificial Sequence
  Description of Artificial Sequence: Synthetic oligonucleotide
  Target: SCN10A; (-) strand; PAM type: NRG; PAM sequence: AAG
tttgacagtttggctaggga

SEQ ID NO: 23977 - DNA, 20 bp, Artificial Sequence
  Description of Artificial Sequence: Synthetic oligonucleotide
  Target: SCN10A; (-) strand; PAM type: NRG; PAM sequence: GGG
cttctttgacagtttggcta

SEQ ID NO: 23978 - DNA, 20 bp, Artificial Sequence
  Description of Artificial Sequence: Synthetic oligonucleotide
  Target: SCN10A; (-) strand; PAM type: NRG; PAM sequence: AGG
ccttctttgacagtttggct

SEQ ID NO: 23979 - DNA, 20 bp, Artificial Sequence
  Description of Artificial Sequence: Synthetic oligonucleotide
  Target: SCN10A; (-) strand; PAM type: NRG; PAM sequence: TAG
accttctttgacagtttggc

SEQ ID NO: 23980 - DNA, 20 bp, Artificial Sequence
  Description of Artificial Sequence: Synthetic oligonucleotide
  Target: SCN10A; (-) strand; PAM type: NRG; PAM sequence: TGG
ttctaccttctttgacagtt

SEQ ID NO: 23981 - DNA, 20 bp, Artificial Sequence
  Description of Artificial Sequence: Synthetic oligonucleotide
  Target: SCN10A; (-) strand; PAM type: NRG; PAM sequence: CAG
atatattctaccttctttga

SEQ ID NO: 23982 - DNA, 20 bp, Artificial Sequence
  Description of Artificial Sequence: Synthetic oligonucleotide
  Target: SCN10A; (-) strand; PAM type: NRG; PAM sequence: AAG
aactaagaagtacatttccc

SEQ ID NO: 23983 - DNA, 20 bp, Artificial Sequence
  Description of Artificial Sequence: Synthetic oligonucleotide
  Target: SCN10A; (-) strand; PAM type: NRG; PAM sequence: AAG
ttattagaagggtaactaag

SEQ ID NO: 23984 - DNA, 20 bp, Artificial Sequence
  Description of Artificial Sequence: Synthetic oligonucleotide
  Target: SCN10A; (-) strand; PAM type: NRG; PAM sequence: AAG
actttattagaagggtaact

SEQ ID NO: 23985 - DNA, 20 bp, Artificial Sequence
  Description of Artificial Sequence: Synthetic oligonucleotide
  Target: SCN10A; (-) strand; PAM type: NRG; PAM sequence: GGG
ttctagtaactttattagaa

SEQ ID NO: 23986 - DNA, 20 bp, Artificial Sequence
  Description of Artificial Sequence: Synthetic oligonucleotide
  Target: SCN10A; (-) strand; PAM type: NRG; PAM sequence: AGG
cttctagtaactttattaga

SEQ ID NO: 23987 - DNA, 20 bp, Artificial Sequence
  Description of Artificial Sequence: Synthetic oligonucleotide
  Target: SCN10A; (-) strand; PAM type: NRG; PAM sequence: AAG
gcttctagtaactttattag

SEQ ID NO: 23988 - DNA, 20 bp, Artificial Sequence
  Description of Artificial Sequence: Synthetic oligonucleotide
  Target: SCN10A; (-) strand; PAM type: NRG; PAM sequence: TAG
ccagcttctagtaactttat

SEQ ID NO: 23989 - DNA, 20 bp, Artificial Sequence
  Description of Artificial Sequence: Synthetic oligonucleotide
  Target: SCN10A; (-) strand; PAM type: NRG; PAM sequence: TAG
ataccaccatgcccagcttc

SEQ ID NO: 23990 - DNA, 20 bp, Artificial Sequence
  Description of Artificial Sequence: Synthetic oligonucleotide
  Target: SCN10A; (-) strand; PAM type: NRG; PAM sequence: CAG
caggtacataccaccatgcc

SEQ ID NO: 23991 - DNA, 20 bp, Artificial Sequence
  Description of Artificial Sequence: Synthetic oligonucleotide
  Target: SCN10A; (-) strand; PAM type: NRG; PAM sequence: AGG
tcccaagtagttaggactac

SEQ ID NO: 23992 - DNA, 20 bp, Artificial Sequence
  Description of Artificial Sequence: Synthetic oligonucleotide
  Target: SCN10A; (-) strand; PAM type: NRG; PAM sequence: CAG
ctcccaagtagttaggacta

SEQ ID NO: 23993 - DNA, 20 bp, Artificial Sequence
  Description of Artificial Sequence: Synthetic oligonucleotide
  Target: SCN10A; (-) strand; PAM type: NRG; PAM sequence: AGG
cctcaacctcccaagtagtt

SEQ ID NO: 23994 - DNA, 20 bp, Artificial Sequence
  Description of Artificial Sequence: Synthetic oligonucleotide
  Target: SCN10A; (-) strand; PAM type: NRG; PAM sequence: TAG
gcctcaacctcccaagtagt

SEQ ID NO: 23995 - DNA, 20 bp, Artificial Sequence
  Description of Artificial Sequence: Synthetic oligonucleotide
  Target: SCN10A; (-) strand; PAM type: NRG; PAM sequence: TAG
tcctgcctcaacctcccaag

SEQ ID NO: 23996 - DNA, 20 bp, Artificial Sequence
  Description of Artificial Sequence: Synthetic oligonucleotide
  Target: SCN10A; (-) strand; PAM type: NRG; PAM sequence: AAG
tcctcctgcctcaacctccc

SEQ ID NO: 23997 - DNA, 20 bp, Artificial Sequence
  Description of Artificial Sequence: Synthetic oligonucleotide
  Target: SCN10A; (-) strand; PAM type: NRG; PAM sequence: AAG
ggcctcaaactcctgggttc

SEQ ID NO: 23998 - DNA, 20 bp, Artificial Sequence
  Description of Artificial Sequence: Synthetic oligonucleotide
  Target: SCN10A; (-) strand; PAM type: NRG; PAM sequence: GGG
gctgttggcctcaaactcct

SEQ ID NO: 23999 - DNA, 20 bp, Artificial Sequence
  Description of Artificial Sequence: Synthetic oligonucleotide
  Target: SCN10A; (-) strand; PAM type: NRG; PAM sequence: TGG
ggctgttggcctcaaactcc

SEQ ID NO: 24000 - DNA, 20 bp, Artificial Sequence
  Description of Artificial Sequence: Synthetic oligonucleotide
  Target: SCN10A; (-) strand; PAM type: NRG; PAM sequence: TGG
ctctatgctgcccaggctgt

SEQ ID NO: 24001 - DNA, 20 bp, Artificial Sequence
  Description of Artificial Sequence: Synthetic oligonucleotide
  Target: SCN10A; (-) strand; PAM type: NRG; PAM sequence: AGG
aaagtctctctatgctgccc

SEQ ID NO: 24002 - DNA, 20 bp, Artificial Sequence
  Description of Artificial Sequence: Synthetic oligonucleotide
  Target: SCN10A; (-) strand; PAM type: NRG; PAM sequence: CAG
caaagtctctctatgctgcc

SEQ ID NO: 24003 - DNA, 20 bp, Artificial Sequence
  Description of Artificial Sequence: Synthetic oligonucleotide
  Target: SCN10A; (-) strand; PAM type: NRG; PAM sequence: AAG
taacatttttttttaagaca

SEQ ID NO: 24004 - DNA, 20 bp, Artificial Sequence
  Description of Artificial Sequence: Synthetic oligonucleotide
  Target: SCN10A; (-) strand; PAM type: NRG; PAM sequence: AAG
ctctagtaacattttttttt

SEQ ID NO: 24005 - DNA, 20 bp, Artificial Sequence
  Description of Artificial Sequence: Synthetic oligonucleotide
  Target: SCN10A; (-) strand; PAM type: NRG; PAM sequence: TAG
tttgaatggagcatatcctc

SEQ ID NO: 24006 - DNA, 20 bp, Artificial Sequence
  Description of Artificial Sequence: Synthetic oligonucleotide
  Target: SCN10A; (-) strand; PAM type: NRG; PAM sequence: GAG
atatgtttcttgtttgaatg

SEQ ID NO: 24007 - DNA, 20 bp, Artificial Sequence
  Description of Artificial Sequence: Synthetic oligonucleotide
  Target: SCN10A; (-) strand; PAM type: NRG; PAM sequence: TGG
atatatgtttcttgtttgaa

SEQ ID NO: 24008 - DNA, 20 bp, Artificial Sequence
  Description of Artificial Sequence: Synthetic oligonucleotide
  Target: SCN10A; (-) strand; PAM type: NRG; PAM sequence: TGG
gattccttttgcctcttccc

SEQ ID NO: 24009 - DNA, 20 bp, Artificial Sequence
  Description of Artificial Sequence: Synthetic oligonucleotide
  Target: SCN10A; (-) strand; PAM type: NRG; PAM sequence: TGG
tttcttcttcattctttttt

SEQ ID NO: 24010 - DNA, 20 bp, Artificial Sequence
  Description of Artificial Sequence: Synthetic oligonucleotide
  Target: SCN10A; (-) strand; PAM type: NRG; PAM sequence: GAG
tgatgcacagctgttttcta

SEQ ID NO: 24011 - DNA, 20 bp, Artificial Sequence
  Description of Artificial Sequence: Synthetic oligonucleotide
  Target: SCN10A; (-) strand; PAM type: NRG; PAM sequence: TAG
cctgatgcacagctgttttc

SEQ ID NO: 24012 - DNA, 20 bp, Artificial Sequence
  Description of Artificial Sequence: Synthetic oligonucleotide
  Target: SCN10A; (-) strand; PAM type: NRG; PAM sequence: CAG
tgttttctaggcctgatgca

SEQ ID NO: 24013 - DNA, 20 bp, Artificial Sequence
  Description of Artificial Sequence: Synthetic oligonucleotide
  Target: SCN10A; (-) strand; PAM type: NRG; PAM sequence: AGG
ttctgacctagatgttttct

SEQ ID NO: 24014 - DNA, 20 bp, Artificial Sequence
  Description of Artificial Sequence: Synthetic oligonucleotide
  Target: SCN10A; (-) strand; PAM type: NRG; PAM sequence: TAG
attctgacctagatgttttc

SEQ ID NO: 24015 - DNA, 20 bp, Artificial Sequence
  Description of Artificial Sequence: Synthetic oligonucleotide
  Target: SCN10A; (-) strand; PAM type: NRG; PAM sequence: TAG
tcttctgcctcattctgacc

SEQ ID NO: 24016 - DNA, 20 bp, Artificial Sequence
  Description of Artificial Sequence: Synthetic oligonucleotide
  Target: SCN10A; (-) strand; PAM type: NRG; PAM sequence: GAG
tcctatgggaatcacagcta

SEQ ID NO: 24017 - DNA, 20 bp, Artificial Sequence
  Description of Artificial Sequence: Synthetic oligonucleotide
  Target: SCN10A; (-) strand; PAM type: NRG; PAM sequence: TAG
tttcctatgggaatcacagc

SEQ ID NO: 24018 - DNA, 20 bp, Artificial Sequence
  Description of Artificial Sequence: Synthetic oligonucleotide
  Target: SCN10A; (-) strand; PAM type: NRG; PAM sequence: CAG
tttttttcctatgggaatca

SEQ ID NO: 24019 - DNA, 20 bp, Artificial Sequence
  Description of Artificial Sequence: Synthetic oligonucleotide
  Target: SCN10A; (-) strand; PAM type: NRG; PAM sequence: GGG
gtgtatcatttttttcctat

SEQ ID NO: 24020 - DNA, 20 bp, Artificial Sequence
  Description of Artificial Sequence: Synthetic oligonucleotide
  Target: SCN10A; (-) strand; PAM type: NRG; PAM sequence: TGG
tgtgtatcatttttttccta

SEQ ID NO: 24021 - DNA, 20 bp, Artificial Sequence
  Description of Artificial Sequence: Synthetic oligonucleotide
  Target: SCN10A; (-) strand; PAM type: NRG; PAM sequence: AGG
tcaatttatttgcacacatc

SEQ ID NO: 24022 - DNA, 20 bp, Artificial Sequence
  Description of Artificial Sequence: Synthetic oligonucleotide
  Target: SCN10A; (-) strand; PAM type: NRG; PAM sequence: CAG
ttcaatttatttgcacacat

SEQ ID NO: 24023 - DNA, 20 bp, Artificial Sequence
  Description of Artificial Sequence: Synthetic oligonucleotide
  Target: SCN10A; (-) strand; PAM type: NRG; PAM sequence: CAG
tttgttcccaaactcttctc

SEQ ID NO: 24024 - DNA, 20 bp, Artificial Sequence
  Description of Artificial Sequence: Synthetic oligonucleotide
  Target: SCN10A; (-) strand; PAM type: NRG; PAM sequence: CAG
attttatttttttgtttgct

SEQ ID NO: 24025 - DNA, 20 bp, Artificial Sequence
  Description of Artificial Sequence: Synthetic oligonucleotide
  Target: SCN10A; (-) strand; PAM type: NRG; PAM sequence: AGG
tgctttccttggagttaata

SEQ ID NO: 24026 - DNA, 20 bp, Artificial Sequence
  Description of Artificial Sequence: Synthetic oligonucleotide
  Target: SCN10A; (-) strand; PAM type: NRG; PAM sequence: AAG
ttgctttccttggagttaat

SEQ ID NO: 24027 - DNA, 20 bp, Artificial Sequence
  Description of Artificial Sequence: Synthetic oligonucleotide
  Target: SCN10A; (-) strand; PAM type: NRG; PAM sequence: GAG
caatgtttttgctttccttg

SEQ ID NO: 24028 - DNA, 20 bp, Artificial Sequence
  Description of Artificial Sequence: Synthetic oligonucleotide
  Target: SCN10A; (-) strand; PAM type: NRG; PAM sequence: TGG
cacaatgtttttgctttcct

SEQ ID NO: 24029 - DNA, 20 bp, Artificial Sequence
  Description of Artificial Sequence: Synthetic oligonucleotide
  Target: SCN10A; (-) strand; PAM type: NRG; PAM sequence: CAG
ctgtttacagctgtgtcatg

SEQ ID NO: 24030 - DNA, 20 bp, Artificial Sequence
  Description of Artificial Sequence: Synthetic oligonucleotide
  Target: SCN10A; (-) strand; PAM type: NRG; PAM sequence: CAG
tgctaagtaaacactgttta

SEQ ID NO: 24031 - DNA, 20 bp, Artificial Sequence
  Description of Artificial Sequence: Synthetic oligonucleotide
  Target: SCN10A; (-) strand; PAM type: NRG; PAM sequence: AAG
tataattacattacattgct

SEQ ID NO: 24032 - DNA, 20 bp, Artificial Sequence
  Description of Artificial Sequence: Synthetic oligonucleotide
  Target: SCN10A; (-) strand; PAM type: NRG; PAM sequence: CAG
gtaatcttcagttagatcat

SEQ ID NO: 24033 - DNA, 20 bp, Artificial Sequence
  Description of Artificial Sequence: Synthetic oligonucleotide
  Target: SCN10A; (-) strand; PAM type: NRG; PAM sequence: TAG
gttatattgtaatcttcagt

SEQ ID NO: 24034 - DNA, 20 bp, Artificial Sequence
  Description of Artificial Sequence: Synthetic oligonucleotide
  Target: SCN10A; (-) strand; PAM type: NRG; PAM sequence: CAG
tacagttatattgtaatctt

SEQ ID NO: 24035 - DNA, 20 bp, Artificial Sequence
  Description of Artificial Sequence: Synthetic oligonucleotide
  Target: SCN10A; (-) strand; PAM type: NRG; PAM sequence: CAG
tcaccctcatcttcctgtta

SEQ ID NO: 24036 - DNA, 20 bp, Artificial Sequence
  Description of Artificial Sequence: Synthetic oligonucleotide
  Target: SCN10A; (-) strand; PAM type: NRG; PAM sequence: AGG
ctattatgagaaaaaactta

SEQ ID NO: 24037 - DNA, 20 bp, Artificial Sequence
  Description of Artificial Sequence: Synthetic oligonucleotide
  Target: SCN10A; (-) strand; PAM type: NRG; PAM sequence: AAG
cctattatgagaaaaaactt

SEQ ID NO: 24038 - DNA, 20 bp, Artificial Sequence
  Description of Artificial Sequence: Synthetic oligonucleotide
  Target: SCN10A; (-) strand; PAM type: NRG; PAM sequence: GAG
atttattggcttcctattat

SEQ ID NO: 24039 - DNA, 20 bp, Artificial Sequence
  Description of Artificial Sequence: Synthetic oligonucleotide
  Target: SCN10A; (-) strand; PAM type: NRG; PAM sequence: TGG
caatttctgatgttatttat

SEQ ID NO: 24040 - DNA, 20 bp, Artificial Sequence
  Description of Artificial Sequence: Synthetic oligonucleotide
  Target: SCN10A; (-) strand; PAM type: NRG; PAM sequence: TAG
tttccagaggccaccacttt

SEQ ID NO: 24041 - DNA, 20 bp, Artificial Sequence
  Description of Artificial Sequence: Synthetic oligonucleotide
  Target: SCN10A; (-) strand; PAM type: NRG; PAM sequence: AGG
ttctcatctcttctttccag

SEQ ID NO: 24042 - DNA, 20 bp, Artificial Sequence
  Description of Artificial Sequence: Synthetic oligonucleotide
  Target: SCN10A; (-) strand; PAM type: NRG; PAM sequence: GAG
tttctcatctcttctttcca

SEQ ID NO: 24043 - DNA, 20 bp, Artificial Sequence
  Description of Artificial Sequence: Synthetic oligonucleotide
  Target: SCN10A; (-) strand; PAM type: NRG; PAM sequence: CAG
tttttctcatctcttctttc

SEQ ID NO: 24044 - DNA, 20 bp, Artificial Sequence
  Description of Artificial Sequence: Synthetic oligonucleotide
  Target: SCN10A; (-) strand; PAM type: NRG; PAM sequence: CAG
aaagattctgacaaaaaaaa

SEQ ID NO: 24045 - DNA, 20 bp, Artificial Sequence
  Description of Artificial Sequence: Synthetic oligonucleotide
  Target: SCN10A; (-) strand; PAM type: NRG; PAM sequence: AAG
aaaggtcacagagttttata

SEQ ID NO: 24046 - DNA, 20 bp, Artificial Sequence
  Description of Artificial Sequence: Synthetic oligonucleotide
  Target: SCN10A; (-) strand; PAM type: NRG; PAM sequence: GAG
tcataatttaaaaggtcaca

SEQ ID NO: 24047 - DNA, 20 bp, Artificial Sequence
  Description of Artificial Sequence: Synthetic oligonucleotide
  Target: SCN10A; (-) strand; PAM type: NRG; PAM sequence: CAG
gttcataatttaaaaggtca

SEQ ID NO: 24048 - DNA, 20 bp, Artificial Sequence
  Description of Artificial Sequence: Synthetic oligonucleotide
  Target: SCN10A; (-) strand; PAM type: NRG; PAM sequence: AGG
atatatgttcataatttaaa

SEQ ID NO: 24049 - DNA, 20 bp, Artificial Sequence
  Description of Artificial Sequence: Synthetic oligonucleotide
  Target: SCN10A; (-) strand; PAM type: NRG; PAM sequence: AAG
catatatgttcataatttaa

SEQ ID NO: 24050 - DNA, 20 bp, Artificial Sequence
  Description of Artificial Sequence: Synthetic oligonucleotide
  Target: SCN10A; (-) strand; PAM type: NRG; PAM sequence: AAG
cttgacttttacttttattt

SEQ ID NO: 24051 - DNA, 20 bp, Artificial Sequence
  Description of Artificial Sequence: Synthetic oligonucleotide
  Target: SCN10A; (-) strand; PAM type: NRG; PAM sequence: CAG
aaacacgatttctcctctca

SEQ ID NO: 24052 - DNA, 20 bp, Artificial Sequence
  Description of Artificial Sequence: Synthetic oligonucleotide
  Target: SCN10A; (-) strand; PAM type: NRG; PAM sequence: TAG
agcagctatgcaaccagata

SEQ ID NO: 24053 - DNA, 20 bp, Artificial Sequence
  Description of Artificial Sequence: Synthetic oligonucleotide
  Target: SCN10A; (-) strand; PAM type: NRG; PAM sequence: CAG
agctcaagcagctatgcaac

SEQ ID NO: 24054 - DNA, 20 bp, Artificial Sequence
  Description of Artificial Sequence: Synthetic oligonucleotide
  Target: SCN10A; (-) strand; PAM type: NRG; PAM sequence: CAG
atggaagctgacagctcaag

SEQ ID NO: 24055 - DNA, 20 bp, Artificial Sequence
  Description of Artificial Sequence: Synthetic oligonucleotide
  Target: SCN10A; (-) strand; PAM type: NRG; PAM sequence: AAG
gatatggaagctgacagctc

SEQ ID NO: 24056 - DNA, 20 bp, Artificial Sequence
  Description of Artificial Sequence: Synthetic oligonucleotide
  Target: SCN10A; (-) strand; PAM type: NRG; PAM sequence: CAG
caacaagatatggaagctga

SEQ ID NO: 24057 - DNA, 20 bp, Artificial Sequence
  Description of Artificial Sequence: Synthetic oligonucleotide
  Target: SCN10A; (-) strand; PAM type: NRG; PAM sequence: AAG
gggaaaccaacaagatatgg

SEQ ID NO: 24058 - DNA, 20 bp, Artificial Sequence
  Description of Artificial Sequence: Synthetic oligonucleotide
  Target: SCN10A; (-) strand; PAM type: NRG; PAM sequence: TGG
ggggggaaaccaacaagata

SEQ ID NO: 24059 - DNA, 20 bp, Artificial Sequence
  Description of Artificial Sequence: Synthetic oligonucleotide
  Target: SCN10A; (-) strand; PAM type: NRG; PAM sequence: AAG
agtgtgggggggaaaccaac

SEQ ID NO: 24060 - DNA, 20 bp, Artificial Sequence
  Description of Artificial Sequence: Synthetic oligonucleotide
  Target: SCN10A; (-) strand; PAM type: NRG; PAM sequence: GGG
aaaacataaagagtgtgggg

SEQ ID NO: 24061 - DNA, 20 bp, Artificial Sequence
  Description of Artificial Sequence: Synthetic oligonucleotide
  Target: SCN10A; (-) strand; PAM type: NRG; PAM sequence: GGG
gaaaacataaagagtgtggg

SEQ ID NO: 24062 - DNA, 20 bp, Artificial Sequence
  Description of Artificial Sequence: Synthetic oligonucleotide
  Target: SCN10A; (-) strand; PAM type: NRG; PAM sequence: GGG
agaaaacataaagagtgtgg

SEQ ID NO: 24063 - DNA, 20 bp, Artificial Sequence
  Description of Artificial Sequence: Synthetic oligonucleotide
  Target: SCN10A; (-) strand; PAM type: NRG; PAM sequence: GGG
tagaaaacataaagagtgtg

SEQ ID NO: 24064 - DNA, 20 bp, Artificial Sequence
  Description of Artificial Sequence: Synthetic oligonucleotide
  Target: SCN10A; (-) strand; PAM type: NRG; PAM sequence: GGG
ttagaaaacataaagagtgt

SEQ ID NO: 24065 - DNA, 20 bp, Artificial Sequence
  Description of Artificial Sequence: Synthetic oligonucleotide
  Target: SCN10A; (-) strand; PAM type: NRG; PAM sequence: TGG
tttagaaaacataaagagtg

SEQ ID NO: 24066 - DNA, 20 bp, Artificial Sequence
  Description of Artificial Sequence: Synthetic oligonucleotide
  Target: SCN10A; (-) strand; PAM type: NRG; PAM sequence: GAG
tctaatttagaaaacataaa

SEQ ID NO: 24067 - DNA, 20 bp, Artificial Sequence
  Description of Artificial Sequence: Synthetic oligonucleotide
  Target: SCN10A; (-) strand; PAM type: NRG; PAM sequence: AAG
tttctaatttagaaaacata

SEQ ID NO: 24068 - DNA, 20 bp, Artificial Sequence
  Description of Artificial Sequence: Synthetic oligonucleotide
  Target: SCN10A; (-) strand; PAM type: NRG; PAM sequence: TAG
tgagttaagattttctaatt

SEQ ID NO: 24069 - DNA, 20 bp, Artificial Sequence
  Description of Artificial Sequence: Synthetic oligonucleotide
  Target: SCN10A; (-) strand; PAM type: NRG; PAM sequence: AAG
acaacctataattctgagtt

SEQ ID NO: 24070 - DNA, 20 bp, Artificial Sequence
  Description of Artificial Sequence: Synthetic oligonucleotide
  Target: SCN10A; (-) strand; PAM type: NRG; PAM sequence: GAG
tcccaacaacctataattct

SEQ ID NO: 24071 - DNA, 20 bp, Artificial Sequence
  Description of Artificial Sequence: Synthetic oligonucleotide
  Target: SCN10A; (-) strand; PAM type: NRG; PAM sequence: AAG
caaaccagaaatatccatca

SEQ ID NO: 24072 - DNA, 20 bp, Artificial Sequence
  Description of Artificial Sequence: Synthetic oligonucleotide
  Target: SCN10A; (-) strand; PAM type: NRG; PAM sequence: CAG
ctgtgtttgatttgacaaac

SEQ ID NO: 24073 - DNA, 20 bp, Artificial Sequence
  Description of Artificial Sequence: Synthetic oligonucleotide
  Target: SCN10A; (-) strand; PAM type: NRG; PAM sequence: GGG
gcactctctccataatttct

SEQ ID NO: 24074 - DNA, 20 bp, Artificial Sequence
  Description of Artificial Sequence: Synthetic oligonucleotide
  Target: SCN10A; (-) strand; PAM type: NRG; PAM sequence: TGG
agcactctctccataatttc

SEQ ID NO: 24075 - DNA, 20 bp, Artificial Sequence
  Description of Artificial Sequence: Synthetic oligonucleotide
  Target: SCN10A; (-) strand; PAM type: NRG; PAM sequence: GAG
cactgaaaatagtctttaga

SEQ ID NO: 24076 - DNA, 20 bp, Artificial Sequence
  Description of Artificial Sequence: Synthetic oligonucleotide
  Target: SCN10A; (-) strand; PAM type: NRG; PAM sequence: GAG
agcactgaaaatagtcttta

SEQ ID NO: 24077 - DNA, 20 bp, Artificial Sequence
  Description of Artificial Sequence: Synthetic oligonucleotide
  Target: SCN10A; (-) strand; PAM type: NRG; PAM sequence: TAG
gaagcactgaaaatagtctt

SEQ ID NO: 24078 - DNA, 20 bp, Artificial Sequence
  Description of Artificial Sequence: Synthetic oligonucleotide
  Target: SCN10A; (-) strand; PAM type: NRG; PAM sequence: TAG
ttctggtgaagcactgaaaa

SEQ ID NO: 24079 - DNA, 20 bp, Artificial Sequence
  Description of Artificial Sequence: Synthetic oligonucleotide
  Target: SCN10A; (-) strand; PAM type: NRG; PAM sequence: AAG
ggggcacttgccttctggtg

SEQ ID NO: 24080 - DNA, 20 bp, Artificial Sequence
  Description of Artificial Sequence: Synthetic oligonucleotide
  Target: SCN10A; (-) strand; PAM type: NRG; PAM sequence: TGG
gagctggggcacttgccttc

SEQ ID NO: 24081 - DNA, 20 bp, Artificial Sequence
  Description of Artificial Sequence: Synthetic oligonucleotide
  Target: SCN10A; (-) strand; PAM type: NRG; PAM sequence: GGG
cattagctgctgttgagctg

SEQ ID NO: 24082 - DNA, 20 bp, Artificial Sequence
  Description of Artificial Sequence: Synthetic oligonucleotide
  Target: SCN10A; (-) strand; PAM type: NRG; PAM sequence: GGG
ccattagctgctgttgagct

SEQ ID NO: 24083 - DNA, 20 bp, Artificial Sequence
  Description of Artificial Sequence: Synthetic oligonucleotide
  Target: SCN10A; (-) strand; PAM type: NRG; PAM sequence: TGG
tccattagctgctgttgagc

SEQ ID NO: 24084 - DNA, 20 bp, Artificial Sequence
  Description of Artificial Sequence: Synthetic oligonucleotide
  Target: SCN10A; (-) strand; PAM type: NRG; PAM sequence: GAG
caactccattagctgctgtt

SEQ ID NO: 24085 - DNA, 20 bp, Artificial Sequence
  Description of Artificial Sequence: Synthetic oligonucleotide
  Target: SCN10A; (-) strand; PAM type: NRG; PAM sequence: TAG
aagagaggatgcaactccat

SEQ ID NO: 24086 - DNA, 20 bp, Artificial Sequence
  Description of Artificial Sequence: Synthetic oligonucleotide
  Target: SCN10A; (-) strand; PAM type: NRG; PAM sequence: AGG
agccaaataccaccaaagag

SEQ ID NO: 24087 - DNA, 20 bp, Artificial Sequence
  Description of Artificial Sequence: Synthetic oligonucleotide
  Target: SCN10A; (-) strand; PAM type: NRG; PAM sequence: GAG
gagccaaataccaccaaaga

SEQ ID NO: 24088 - DNA, 20 bp, Artificial Sequence
  Description of Artificial Sequence: Synthetic oligonucleotide
  Target: SCN10A; (-) strand; PAM type: NRG; PAM sequence: GAG
cagagccaaataccaccaaa

SEQ ID NO: 24089 - DNA, 20 bp, Artificial Sequence
  Description of Artificial Sequence: Synthetic oligonucleotide
  Target: SCN10A; (-) strand; PAM type: NRG; PAM sequence: AAG
tgcagagccaaataccacca

SEQ ID NO: 24090 - DNA, 20 bp, Artificial Sequence
  Description of Artificial Sequence: Synthetic oligonucleotide
  Target: SCN10A; (-) strand; PAM type: NRG; PAM sequence: GAG
acatcaagaaataccttgca

SEQ ID NO: 24091 - DNA, 20 bp, Artificial Sequence
  Description of Artificial Sequence: Synthetic oligonucleotide
  Target: SCN10A; (-) strand; PAM type: NRG; PAM sequence: CAG
caacatcaagaaataccttg

SEQ ID NO: 24092 - DNA, 20 bp, Artificial Sequence
  Description of Artificial Sequence: Synthetic oligonucleotide
  Target: SCN10A; (-) strand; PAM type: NRG; PAM sequence: AAG
gaatgctgcaacccaacatc

SEQ ID NO: 24093 - DNA, 20 bp, Artificial Sequence
  Description of Artificial Sequence: Synthetic oligonucleotide
  Target: SCN10A; (-) strand; PAM type: NRG; PAM sequence: GGG
cacttaggaaataacacatt

SEQ ID NO: 24094 - DNA, 20 bp, Artificial Sequence
  Description of Artificial Sequence: Synthetic oligonucleotide
  Target: SCN10A; (-) strand; PAM type: NRG; PAM sequence: TGG
gcacttaggaaataacacat

SEQ ID NO: 24095 - DNA, 20 bp, Artificial Sequence
  Description of Artificial Sequence: Synthetic oligonucleotide
  Target: SCN10A; (-) strand; PAM type: NRG; PAM sequence: AGG
attcaccagaaaaagcactt

SEQ ID NO: 24096 - DNA, 20 bp, Artificial Sequence
  Description of Artificial Sequence: Synthetic oligonucleotide
  Target: SCN10A; (-) strand; PAM type: NRG; PAM sequence: TAG
cattcaccagaaaaagcact

SEQ ID NO: 24097 - DNA, 20 bp, Artificial Sequence
  Description of Artificial Sequence: Synthetic oligonucleotide
  Target: SCN10A; (-) strand; PAM type: NRG; PAM sequence: AAG
ttttcttcattcaccagaaa

SEQ ID NO: 24098 - DNA, 20 bp, Artificial Sequence
  Description of Artificial Sequence: Synthetic oligonucleotide
  Target: SCN10A; (-) strand; PAM type: NRG; PAM sequence: CAG
caatgattttcttcattcac

SEQ ID NO: 24099 - DNA, 20 bp, Artificial Sequence
  Description of Artificial Sequence: Synthetic oligonucleotide
  Target: SCN10A; (-) strand; PAM type: NRG; PAM sequence: GAG
gtgcaagtggctcaacggct

SEQ ID NO: 24100 - DNA, 20 bp, Artificial Sequence
  Description of Artificial Sequence: Synthetic oligonucleotide
  Target: SCN10A; (-) strand; PAM type: NRG; PAM sequence: CGG
cagtggtgcaagtggctcaa

SEQ ID NO: 24101 - DNA, 20 bp, Artificial Sequence
  Description of Artificial Sequence: Synthetic oligonucleotide
  Target: SCN10A; (-) strand; PAM type: NRG; PAM sequence: TGG
tcagacatcagtggtgcaag

SEQ ID NO: 24102 - DNA, 20 bp, Artificial Sequence
  Description of Artificial Sequence: Synthetic oligonucleotide
  Target: SCN10A; (-) strand; PAM type: NRG; PAM sequence: AAG
caatcagacatcagtggtgc

SEQ ID NO: 24103 - DNA, 20 bp, Artificial Sequence
  Description of Artificial Sequence: Synthetic oligonucleotide
  Target: SCN10A; (-) strand; PAM type: NRG; PAM sequence: TGG
ttgtaacaatcagacatcag

SEQ ID NO: 24104 - DNA, 20 bp, Artificial Sequence
  Description of Artificial Sequence: Synthetic oligonucleotide
  Target: SCN10A; (-) strand; PAM type: NRG; PAM sequence: CAG
gatttgtaacaatcagacat

SEQ ID NO: 24105 - DNA, 20 bp, Artificial Sequence
  Description of Artificial Sequence: Synthetic oligonucleotide
  Target: SCN10A; (-) strand; PAM type: NRG; PAM sequence: CAG
atatcgggatttgtaacaat

SEQ ID NO: 24106 - DNA, 20 bp, Artificial Sequence
  Description of Artificial Sequence: Synthetic oligonucleotide
  Target: SCN10A; (-) strand; PAM type: NRG; PAM sequence: GGG
gttttcagagcctgaatatc

SEQ ID NO: 24107 - DNA, 20 bp, Artificial Sequence
  Description of Artificial Sequence: Synthetic oligonucleotide
  Target: SCN10A; (-) strand; PAM type: NRG; PAM sequence: CGG
tgttttcagagcctgaatat

SEQ ID NO: 24108 - DNA, 20 bp, Artificial Sequence
  Description of Artificial Sequence: Synthetic oligonucleotide
  Target: SCN10A; (-) strand; PAM type: NRG; PAM sequence: GAG
attatgaatctttgttttca

SEQ ID NO: 24109 - DNA, 20 bp, Artificial Sequence
  Description of Artificial Sequence: Synthetic oligonucleotide
  Target: SCN10A; (-) strand; PAM type: NRG; PAM sequence: CAG
atattatgaatctttgtttt

SEQ ID NO: 24110 - DNA, 20 bp, Artificial Sequence
  Description of Artificial Sequence: Synthetic oligonucleotide
  Target: SCN10A; (-) strand; PAM type: NRG; PAM sequence: CAG
gggtatctcagtgatccatt

SEQ ID NO: 24111 - DNA, 20 bp, Artificial Sequence
  Description of Artificial Sequence: Synthetic oligonucleotide
  Target: SCN10A; (-) strand; PAM type: NRG; PAM sequence: CAG
tgaatacaagttgggtatct

SEQ ID NO: 24112 - DNA, 20 bp, Artificial Sequence
  Description of Artificial Sequence: Synthetic oligonucleotide
  Target: SCN10A; (-) strand; PAM type: NRG; PAM sequence: GGG
catttttatgaatacaagtt

SEQ ID NO: 24113 - DNA, 20 bp, Artificial Sequence
  Description of Artificial Sequence: Synthetic oligonucleotide
  Target: SCN10A; (-) strand; PAM type: NRG; PAM sequence: TGG
ccatttttatgaatacaagt

SEQ ID NO: 24114 - DNA, 20 bp, Artificial Sequence
  Description of Artificial Sequence: Synthetic oligonucleotide
  Target: SCN10A; (-) strand; PAM type: NRG; PAM sequence: AAG
attaccatttttatgaatac

SEQ ID NO: 24115 - DNA, 20 bp, Artificial Sequence
  Description of Artificial Sequence: Synthetic oligonucleotide
  Target: SCN10A; (-) strand; PAM type: NRG; PAM sequence: AGG
tacacagagttttaaaaata

SEQ ID NO: 24116 - DNA, 20 bp, Artificial Sequence
  Description of Artificial Sequence: Synthetic oligonucleotide
  Target: SCN10A; (-) strand; PAM type: NRG; PAM sequence: AAG
ttacacagagttttaaaaat

SEQ ID NO: 24117 - DNA, 20 bp, Artificial Sequence
  Description of Artificial Sequence: Synthetic oligonucleotide
  Target: SCN10A; (-) strand; PAM type: NRG; PAM sequence: GAG
aaatgggaagggcttacaca

SEQ ID NO: 24118 - DNA, 20 bp, Artificial Sequence
  Description of Artificial Sequence: Synthetic oligonucleotide
  Target: SCN10A; (-) strand; PAM type: NRG; PAM sequence: CAG
gcaaatgggaagggcttaca

SEQ ID NO: 24119 - DNA, 20 bp, Artificial Sequence
  Description of Artificial Sequence: Synthetic oligonucleotide
  Target: SCN10A; (-) strand; PAM type: NRG; PAM sequence: GGG
ctttggctggcaaatgggaa

SEQ ID NO: 24120 - DNA, 20 bp, Artificial Sequence
  Description of Artificial Sequence: Synthetic oligonucleotide
  Target: SCN10A; (-) strand; PAM type: NRG; PAM sequence: AGG
gctttggctggcaaatggga

SEQ ID NO: 24121 - DNA, 20 bp, Artificial Sequence
  Description of Artificial Sequence: Synthetic oligonucleotide
  Target: SCN10A; (-) strand; PAM type: NRG; PAM sequence: AAG
tgctttggctggcaaatggg

SEQ ID NO: 24122 - DNA, 20 bp, Artificial Sequence
  Description of Artificial Sequence: Synthetic oligonucleotide
  Target: SCN10A; (-) strand; PAM type: NRG; PAM sequence: GGG
aattgctttggctggcaaat

SEQ ID NO: 24123 - DNA, 20 bp, Artificial Sequence
  Description of Artificial Sequence: Synthetic oligonucleotide
  Target: SCN10A; (-) strand; PAM type: NRG; PAM sequence: TGG
gaattgctttggctggcaaa

SEQ ID NO: 24124 - DNA, 20 bp, Artificial Sequence
  Description of Artificial Sequence: Synthetic oligonucleotide
  Target: SCN10A; (-) strand; PAM type: NRG; PAM sequence: TGG
ccacactgaattgctttggc

SEQ ID NO: 24125 - DNA, 20 bp, Artificial Sequence
  Description of Artificial Sequence: Synthetic oligonucleotide
  Target: SCN10A; (-) strand; PAM type: NRG; PAM sequence: TGG
tctcccacactgaattgctt

SEQ ID NO: 24126 - DNA, 20 bp, Artificial Sequence
  Description of Artificial Sequence: Synthetic oligonucleotide
  Target: SCN10A; (-) strand; PAM type: NRG; PAM sequence: AGG
aaatgaaaagtgagtaagag

SEQ ID NO: 24127 - DNA, 20 bp, Artificial Sequence
  Description of Artificial Sequence: Synthetic oligonucleotide
  Target: SCN10A; (-) strand; PAM type: NRG; PAM sequence: GAG
gaaatgaaaagtgagtaaga

SEQ ID NO: 24128 - DNA, 20 bp, Artificial Sequence
  Description of Artificial Sequence: Synthetic oligonucleotide
  Target: SCN10A; (-) strand; PAM type: NRG; PAM sequence: GAG
ctgaaatgaaaagtgagtaa

SEQ ID NO: 24129 - DNA, 20 bp, Artificial Sequence
  Description of Artificial Sequence: Synthetic oligonucleotide
  Target: SCN10A; (-) strand; PAM type: NRG; PAM sequence: AAG
ggctgaaatgaaaagtgagt

SEQ ID NO: 24130 - DNA, 20 bp, Artificial Sequence
  Description of Artificial Sequence: Synthetic oligonucleotide
  Target: SCN10A; (-) strand; PAM type: NRG; PAM sequence: GAG
actgggctgaaatgaaaagt

SEQ ID NO: 24131 - DNA, 20 bp, Artificial Sequence
  Description of Artificial Sequence: Synthetic oligonucleotide
  Target: SCN10A; (-) strand; PAM type: NRG; PAM sequence: AAG
gcctactgggctgaaatgaa

SEQ ID NO: 24132 - DNA, 20 bp, Artificial Sequence
  Description of Artificial Sequence: Synthetic oligonucleotide
  Target: SCN10A; (-) strand; PAM type: NRG; PAM sequence: GGG
gtacatctctttggcctact

SEQ ID NO: 24133 - DNA, 20 bp, Artificial Sequence
  Description of Artificial Sequence: Synthetic oligonucleotide
  Target: SCN10A; (-) strand; PAM type: NRG; PAM sequence: TGG
tgtacatctctttggcctac

SEQ ID NO: 24134 - DNA, 20 bp, Artificial Sequence
  Description of Artificial Sequence: Synthetic oligonucleotide
  Target: SCN10A; (-) strand; PAM type: NRG; PAM sequence: TGG
tcacttagtgtacatctctt

SEQ ID NO: 24135 - DNA, 20 bp, Artificial Sequence
  Description of Artificial Sequence: Synthetic oligonucleotide
  Target: SCN10A; (-) strand; PAM type: NRG; PAM sequence: TAG
acaaactgattgtggtcact

SEQ ID NO: 24136 - DNA, 20 bp, Artificial Sequence
  Description of Artificial Sequence: Synthetic oligonucleotide
  Target: SCN10A; (-) strand; PAM type: NRG; PAM sequence: TGG
ttgtgaatacaaactgattg

SEQ ID NO: 24137 - DNA, 20 bp, Artificial Sequence
  Description of Artificial Sequence: Synthetic oligonucleotide
  Target: SCN10A; (-) strand; PAM type: NRG; PAM sequence: TGG
tttgctgttgaggtacacag

SEQ ID NO: 24138 - DNA, 20 bp, Artificial Sequence
  Description of Artificial Sequence: Synthetic oligonucleotide
  Target: SCN10A; (-) strand; PAM type: NRG; PAM sequence: CAG
tgatttgctgttgaggtaca

SEQ ID NO: 24139 - DNA, 20 bp, Artificial Sequence
  Description of Artificial Sequence: Synthetic oligonucleotide
  Target: SCN10A; (-) strand; PAM type: NRG; PAM sequence: AGG
cagattctgatttgctgttg

SEQ ID NO: 24140 - DNA, 20 bp, Artificial Sequence
  Description of Artificial Sequence: Synthetic oligonucleotide
  Target: SCN10A; (-) strand; PAM type: NRG; PAM sequence: GAG
ccagattctgatttgctgtt

SEQ ID NO: 24141 - DNA, 20 bp, Artificial Sequence
  Description of Artificial Sequence: Synthetic oligonucleotide
  Target: SCN10A; (-) strand; PAM type: NRG; PAM sequence: CAG
gggggtctgtaatatgcctc

SEQ ID NO: 24142 - DNA, 20 bp, Artificial Sequence
  Description of Artificial Sequence: Synthetic oligonucleotide
  Target: SCN10A; (-) strand; PAM type: NRG; PAM sequence: GGG
tattcacggaacgcagctgg

SEQ ID NO: 24143 - DNA, 20 bp, Artificial Sequence
  Description of Artificial Sequence: Synthetic oligonucleotide
  Target: SCN10A; (-) strand; PAM type: NRG; PAM sequence: GGG
ttattcacggaacgcagctg

SEQ ID NO: 24144 - DNA, 20 bp, Artificial Sequence
  Description of Artificial Sequence: Synthetic oligonucleotide
  Target: SCN10A; (-) strand; PAM type: NRG; PAM sequence: GGG
cttattcacggaacgcagct

SEQ ID NO: 24145 - DNA, 20 bp, Artificial Sequence
  Description of Artificial Sequence: Synthetic oligonucleotide
  Target: SCN10A; (-) strand; PAM type: NRG; PAM sequence: TGG
ccttattcacggaacgcagc

SEQ ID NO: 24146 - DNA, 20 bp, Artificial Sequence
  Description of Artificial Sequence: Synthetic oligonucleotide
  Target: SCN10A; (-) strand; PAM type: NRG; PAM sequence: CAG
cataccttattcacggaacg

SEQ ID NO: 24147 - DNA, 20 bp, Artificial Sequence
  Description of Artificial Sequence: Synthetic oligonucleotide
  Target: SCN10A; (-) strand; PAM type: NRG; PAM sequence: CGG
gctagtgcataccttattca

SEQ ID NO: 24148 - DNA, 20 bp, Artificial Sequence
  Description of Artificial Sequence: Synthetic oligonucleotide
  Target: SCN10A; (-) strand; PAM type: NRG; PAM sequence: TAG
ctgctcccagatcccaatgc

SEQ ID NO: 24149 - DNA, 20 bp, Artificial Sequence
  Description of Artificial Sequence: Synthetic oligonucleotide
  Target: SCN10A; (-) strand; PAM type: NRG; PAM sequence: CAG
cagatagaagatgctgctcc

SEQ ID NO: 24150 - DNA, 20 bp, Artificial Sequence
  Description of Artificial Sequence: Synthetic oligonucleotide
  Target: SCN10A; (-) strand; PAM type: NRG; PAM sequence: AAG
aggtatcactatccagatag

SEQ ID NO: 24151 - DNA, 20 bp, Artificial Sequence
  Description of Artificial Sequence: Synthetic oligonucleotide
  Target: SCN10A; (-) strand; PAM type: NRG; PAM sequence: TAG
gaaaggtatcactatccaga

SEQ ID NO: 24152 - DNA, 20 bp, Artificial Sequence
  Description of Artificial Sequence: Synthetic oligonucleotide
  Target: SCN10A; (-) strand; PAM type: NRG; PAM sequence: CAG
caaggaaaggtatcactatc

SEQ ID NO: 24153 - DNA, 20 bp, Artificial Sequence
  Description of Artificial Sequence: Synthetic oligonucleotide
  Target: SCN10A; (-) strand; PAM type: NRG; PAM sequence: AGG
gccacatggtcagcaaggaa

SEQ ID NO: 24154 - DNA, 20 bp, Artificial Sequence
  Description of Artificial Sequence: Synthetic oligonucleotide
  Target: SCN10A; (-) strand; PAM type: NRG; PAM sequence: AAG
agccacatggtcagcaagga

SEQ ID NO: 24155 - DNA, 20 bp, Artificial Sequence
  Description of Artificial Sequence: Synthetic oligonucleotide
  Target: SCN10A; (-) strand; PAM type: NRG; PAM sequence: AGG
ctccagccacatggtcagca

SEQ ID NO: 24156 - DNA, 20 bp, Artificial Sequence
  Description of Artificial Sequence: Synthetic oligonucleotide
  Target: SCN10A; (-) strand; PAM type: NRG; PAM sequence: AAG
actccagccacatggtcagc

SEQ ID NO: 24157 - DNA, 20 bp, Artificial Sequence
  Description of Artificial Sequence: Synthetic oligonucleotide
  Target: SCN10A; (-) strand; PAM type: NRG; PAM sequence: CAG
agaaactccagccacatggt

SEQ ID NO: 24158 - DNA, 20 bp, Artificial Sequence
  Description of Artificial Sequence: Synthetic oligonucleotide
  Target: SCN10A; (-) strand; PAM type: NRG; PAM sequence: TGG
ttgaagaaactccagccaca

SEQ ID NO: 24159 - DNA, 20 bp, Artificial Sequence
  Description of Artificial Sequence: Synthetic oligonucleotide
  Target: SCN10A; (-) strand; PAM type: NRG; PAM sequence: CAG
aattgccattgaagaaactc

SEQ ID NO: 24160 - DNA, 20 bp, Artificial Sequence
  Description of Artificial Sequence: Synthetic oligonucleotide
  Target: SCN10A; (-) strand; PAM type: NRG; PAM sequence: AAG
aaggtgttaaattgccattg

SEQ ID NO: 24161 - DNA, 20 bp, Artificial Sequence
  Description of Artificial Sequence: Synthetic oligonucleotide
  Target: SCN10A; (-) strand; PAM type: NRG; PAM sequence: AGG
acttttttttaaaagaggaa

SEQ ID NO: 24162 - DNA, 20 bp, Artificial Sequence
  Description of Artificial Sequence: Synthetic oligonucleotide
  Target: SCN10A; (-) strand; PAM type: NRG; PAM sequence: AAG
aacttttttttaaaagagga

SEQ ID NO: 24163 - DNA, 20 bp, Artificial Sequence
  Description of Artificial Sequence: Synthetic oligonucleotide
  Target: SCN10A; (-) strand; PAM type: NRG; PAM sequence: AGG
ccaaaacttttttttaaaag

SEQ ID NO: 24164 - DNA, 20 bp, Artificial Sequence
  Description of Artificial Sequence: Synthetic oligonucleotide
  Target: SCN10A; (-) strand; PAM type: NRG; PAM sequence: GAG
accaaaacttttttttaaaa

SEQ ID NO: 24165 - DNA, 20 bp, Artificial Sequence
  Description of Artificial Sequence: Synthetic oligonucleotide
  Target: SCN10A; (-) strand; PAM type: NRG; PAM sequence: AAG
ttaccaaaacttttttttaa

SEQ ID NO: 24166 - DNA, 20 bp, Artificial Sequence
  Description of Artificial Sequence: Synthetic oligonucleotide
  Target: SCN10A; (-) strand; PAM type: NRG; PAM sequence: TGG
gtacttaaaaatggtgaaag

SEQ ID NO: 24167 - DNA, 20 bp, Artificial Sequence
  Description of Artificial Sequence: Synthetic oligonucleotide
  Target: SCN10A; (-) strand; PAM type: NRG; PAM sequence: AAG
tgtgtacttaaaaatggtga

SEQ ID NO: 24168 - DNA, 20 bp, Artificial Sequence
  Description of Artificial Sequence: Synthetic oligonucleotide
  Target: SCN10A; (-) strand; PAM type: NRG; PAM sequence: TGG
ctaaattgtgtacttaaaaa

SEQ ID NO: 24169 - DNA, 20 bp, Artificial Sequence
  Description of Artificial Sequence: Synthetic oligonucleotide
  Target: SCN10A; (-) strand; PAM type: NRG; PAM sequence: TAG
ttggaaacagatagtggtga

SEQ ID NO: 24170 - DNA, 20 bp, Artificial Sequence
  Description of Artificial Sequence: Synthetic oligonucleotide
  Target: SCN10A; (-) strand; PAM type: NRG; PAM sequence: TGG
aaaagtttggaaacagatag

SEQ ID NO: 24171 - DNA, 20 bp, Artificial Sequence
  Description of Artificial Sequence: Synthetic oligonucleotide
  Target: SCN10A; (-) strand; PAM type: NRG; PAM sequence: TAG
taaaaaagtttggaaacaga

SEQ ID NO: 24172 - DNA, 20 bp, Artificial Sequence
  Description of Artificial Sequence: Synthetic oligonucleotide
  Target: SCN10A; (-) strand; PAM type: NRG; PAM sequence: CAG
attataaaaaagtttggaaa

SEQ ID NO: 24173 - DNA, 20 bp, Artificial Sequence
  Description of Artificial Sequence: Synthetic oligonucleotide
  Target: SCN10A; (-) strand; PAM type: NRG; PAM sequence: TGG
ttcgggattataaaaaagtt

SEQ ID NO: 24174 - DNA, 20 bp, Artificial Sequence
  Description of Artificial Sequence: Synthetic oligonucleotide
  Target: SCN10A; (-) strand; PAM type: NRG; PAM sequence: AAG
ttctgttcgggattataaaa

SEQ ID NO: 24175 - DNA, 20 bp, Artificial Sequence
  Description of Artificial Sequence: Synthetic oligonucleotide
  Target: SCN10A; (-) strand; PAM type: NRG; PAM sequence: GGG
taatgggtacatttctgttc

SEQ ID NO: 24176 - DNA, 20 bp, Artificial Sequence
  Description of Artificial Sequence: Synthetic oligonucleotide
  Target: SCN10A; (-) strand; PAM type: NRG; PAM sequence: CGG
ttaatgggtacatttctgtt

SEQ ID NO: 24177 - DNA, 20 bp, Artificial Sequence
  Description of Artificial Sequence: Synthetic oligonucleotide
  Target: SCN10A; (-) strand; PAM type: NRG; PAM sequence: GGG
atggggagttattatttaat

SEQ ID NO: 24178 - DNA, 20 bp, Artificial Sequence
  Description of Artificial Sequence: Synthetic oligonucleotide
  Target: SCN10A; (-) strand; PAM type: NRG; PAM sequence: TGG
aatggggagttattatttaa

SEQ ID NO: 24179 - DNA, 20 bp, Artificial Sequence
  Description of Artificial Sequence: Synthetic oligonucleotide
  Target: SCN10A; (-) strand; PAM type: NRG; PAM sequence: GAG
tgccagagagggggaatggg

SEQ ID NO: 24180 - DNA, 20 bp, Artificial Sequence
  Description of Artificial Sequence: Synthetic oligonucleotide
  Target: SCN10A; (-) strand; PAM type: NRG; PAM sequence: GGG
gttgccagagagggggaatg

SEQ ID NO: 24181 - DNA, 20 bp, Artificial Sequence
  Description of Artificial Sequence: Synthetic oligonucleotide
  Target: SCN10A; (-) strand; PAM type: NRG; PAM sequence: GGG
agttgccagagagggggaat

SEQ ID NO: 24182 - DNA, 20 bp, Artificial Sequence
  Description of Artificial Sequence: Synthetic oligonucleotide
  Target: SCN10A; (-) strand; PAM type: NRG; PAM sequence: TGG
aagttgccagagagggggaa

SEQ ID NO: 24183 - DNA, 20 bp, Artificial Sequence
  Description of Artificial Sequence: Synthetic oligonucleotide
  Target: SCN10A; (-) strand; PAM type: NRG; PAM sequence: GGG
aatggaagttgccagagagg

SEQ ID NO: 24184 - DNA, 20 bp, Artificial Sequence
  Description of Artificial Sequence: Synthetic oligonucleotide
  Target: SCN10A; (-) strand; PAM type: NRG; PAM sequence: GGG
gaatggaagttgccagagag

SEQ ID NO: 24185 - DNA, 20 bp, Artificial Sequence
  Description of Artificial Sequence: Synthetic oligonucleotide
  Target: SCN10A; (-) strand; PAM type: NRG; PAM sequence: GGG
agaatggaagttgccagaga

SEQ ID NO: 24186 - DNA, 20 bp, Artificial Sequence
  Description of Artificial Sequence: Synthetic oligonucleotide
  Target: SCN10A; (-) strand; PAM type: NRG; PAM sequence: AGG
tagaatggaagttgccagag

SEQ ID NO: 24187 - DNA, 20 bp, Artificial Sequence
  Description of Artificial Sequence: Synthetic oligonucleotide
  Target: SCN10A; (-) strand; PAM type: NRG; PAM sequence: GAG
gtagaatggaagttgccaga

SEQ ID NO: 24188 - DNA, 20 bp, Artificial Sequence
  Description of Artificial Sequence: Synthetic oligonucleotide
  Target: SCN10A; (-) strand; PAM type: NRG; PAM sequence: GAG
aagtagaatggaagttgcca

SEQ ID NO: 24189 - DNA, 20 bp, Artificial Sequence
  Description of Artificial Sequence: Synthetic oligonucleotide
  Target: SCN10A; (-) strand; PAM type: NRG; PAM sequence: CAG
gaaagtagaatggaagttgc

SEQ ID NO: 24190 - DNA, 20 bp, Artificial Sequence
  Description of Artificial Sequence: Synthetic oligonucleotide
  Target: SCN10A; (-) strand; PAM type: NRG; PAM sequence: AAG
ggagacagaaagtagaatgg

SEQ ID NO: 24191 - DNA, 20 bp, Artificial Sequence
  Description of Artificial Sequence: Synthetic oligonucleotide
  Target: SCN10A; (-) strand; PAM type: NRG; PAM sequence: TGG
catggagacagaaagtagaa

SEQ ID NO: 24192 - DNA, 20 bp, Artificial Sequence
  Description of Artificial Sequence: Synthetic oligonucleotide
  Target: SCN10A; (-) strand; PAM type: NRG; PAM sequence: TAG
aaattcatggagacagaaag

SEQ ID NO: 24193 - DNA, 20 bp, Artificial Sequence
  Description of Artificial Sequence: Synthetic oligonucleotide
  Target: SCN10A; (-) strand; PAM type: NRG; PAM sequence: AAG
ggcaaattcatggagacaga

SEQ ID NO: 24194 - DNA, 20 bp, Artificial Sequence
  Description of Artificial Sequence: Synthetic oligonucleotide
  Target: SCN10A; (-) strand; PAM type: NRG; PAM sequence: CAG
aacaggcaaattcatggaga

SEQ ID NO: 24195 - DNA, 20 bp, Artificial Sequence
  Description of Artificial Sequence: Synthetic oligonucleotide
  Target: SCN10A; (-) strand; PAM type: NRG; PAM sequence: GAG
ctagaacaggcaaattcatg

SEQ ID NO: 24196 - DNA, 20 bp, Artificial Sequence
  Description of Artificial Sequence: Synthetic oligonucleotide
  Target: SCN10A; (-) strand; PAM type: NRG; PAM sequence: TGG
acctagaacaggcaaattca

SEQ ID NO: 24197 - DNA, 20 bp, Artificial Sequence
  Description of Artificial Sequence: Synthetic oligonucleotide
  Target: SCN10A; (-) strand; PAM type: NRG; PAM sequence: AGG
ctttagtaggtacctagaac

SEQ ID NO: 24198 - DNA, 20 bp, Artificial Sequence
  Description of Artificial Sequence: Synthetic oligonucleotide
  Target: SCN10A; (-) strand; PAM type: NRG; PAM sequence: CAG
cctttagtaggtacctagaa

SEQ ID NO: 24199 - DNA, 20 bp, Artificial Sequence
  Description of Artificial Sequence: Synthetic oligonucleotide
  Target: SCN10A; (-) strand; PAM type: NRG; PAM sequence: TAG
ttccacctttagtaggtacc

SEQ ID NO: 24200 - DNA, 20 bp, Artificial Sequence
  Description of Artificial Sequence: Synthetic oligonucleotide
  Target: SCN10A; (-) strand; PAM type: NRG; PAM sequence: AGG
tgcatgattccacctttagt

SEQ ID NO: 24201 - DNA, 20 bp, Artificial Sequence
  Description of Artificial Sequence: Synthetic oligonucleotide
  Target: SCN10A; (-) strand; PAM type: NRG; PAM sequence: TAG
ttgcatgattccacctttag

SEQ ID NO: 24202 - DNA, 20 bp, Artificial Sequence
  Description of Artificial Sequence: Synthetic oligonucleotide
  Target: SCN10A; (-) strand; PAM type: NRG; PAM sequence: TAG
atgttgcatgattccacctt

SEQ ID NO: 24203 - DNA, 20 bp, Artificial Sequence
  Description of Artificial Sequence: Synthetic oligonucleotide
  Target: SCN10A; (-) strand; PAM type: NRG; PAM sequence: AAG
gtaaaataactcaaacgcaa

SEQ ID NO: 24204 - DNA, 20 bp, Artificial Sequence
  Description of Artificial Sequence: Synthetic oligonucleotide
  Target: SCN10A; (-) strand; PAM type: NRG; PAM sequence: AAG
cattgacaaagcattgtgct

SEQ ID NO: 24205 - DNA, 20 bp, Artificial Sequence
  Description of Artificial Sequence: Synthetic oligonucleotide
  Target: SCN10A; (-) strand; PAM type: NRG; PAM sequence: AAG
tacatgccacaacattgaca

SEQ ID NO: 24206 - DNA, 20 bp, Artificial Sequence
  Description of Artificial Sequence: Synthetic oligonucleotide
  Target: SCN10A; (-) strand; PAM type: NRG; PAM sequence: GAG
attcagttttaaaaatgaat

SEQ ID NO: 24207 - DNA, 20 bp, Artificial Sequence
  Description of Artificial Sequence: Synthetic oligonucleotide
  Target: SCN10A; (-) strand; PAM type: NRG; PAM sequence: CAG
gtaaacaattgaatatcatt

SEQ ID NO: 24208 - DNA, 20 bp, Artificial Sequence
  Description of Artificial Sequence: Synthetic oligonucleotide
  Target: SCN10A; (-) strand; PAM type: NRG; PAM sequence: TAG
agatgaatggataaaaaatg

SEQ ID NO: 24209 - DNA, 20 bp, Artificial Sequence
  Description of Artificial Sequence: Synthetic oligonucleotide
  Target: SCN10A; (-) strand; PAM type: NRG; PAM sequence: TGG
tatgtccatcaacagatgaa

SEQ ID NO: 24210 - DNA, 20 bp, Artificial Sequence
  Description of Artificial Sequence: Synthetic oligonucleotide
  Target: SCN10A; (-) strand; PAM type: NRG; PAM sequence: CAG
tagccaaatatgtccatcaa

SEQ ID NO: 24211 - DNA, 20 bp, Artificial Sequence
  Description of Artificial Sequence: Synthetic oligonucleotide
  Target: SCN10A; (-) strand; PAM type: NRG; PAM sequence: TAG
tgtagcagcgttattcacaa

SEQ ID NO: 24212 - DNA, 20 bp, Artificial Sequence
  Description of Artificial Sequence: Synthetic oligonucleotide
  Target: SCN10A; (-) strand; PAM type: NRG; PAM sequence: CAG
ttatgcactaatgtttgtag

SEQ ID NO: 24213 - DNA, 20 bp, Artificial Sequence
  Description of Artificial Sequence: Synthetic oligonucleotide
  Target: SCN10A; (-) strand; PAM type: NRG; PAM sequence: TAG
ggcttatgcactaatgtttg

SEQ ID NO: 24214 - DNA, 20 bp, Artificial Sequence
  Description of Artificial Sequence: Synthetic oligonucleotide
  Target: SCN10A; (-) strand; PAM type: NRG; PAM sequence: TGG
acagactttaaaaggtatgt

SEQ ID NO: 24215 - DNA, 20 bp, Artificial Sequence
  Description of Artificial Sequence: Synthetic oligonucleotide
  Target: SCN10A; (-) strand; PAM type: NRG; PAM sequence: AGG
cctatgaaacagactttaaa

SEQ ID NO: 24216 - DNA, 20 bp, Artificial Sequence
  Description of Artificial Sequence: Synthetic oligonucleotide
  Target: SCN10A; (-) strand; PAM type: NRG; PAM sequence: AAG
acctatgaaacagactttaa

SEQ ID NO: 24217 - DNA, 20 bp, Artificial Sequence
  Description of Artificial Sequence: Synthetic oligonucleotide
  Target: SCN10A; (-) strand; PAM type: NRG; PAM sequence: CAG
attagtttgaacctatgaaa

SEQ ID NO: 24218 - DNA, 20 bp, Artificial Sequence
  Description of Artificial Sequence: Synthetic oligonucleotide
  Target: SCN10A; (-) strand; PAM type: NRG; PAM sequence: TAG
tctctggtttaattaaaaat

SEQ ID NO: 24219 - DNA, 20 bp, Artificial Sequence
  Description of Artificial Sequence: Synthetic oligonucleotide
  Target: SCN10A; (-) strand; PAM type: NRG; PAM sequence: TGG
attttaaaagaagagctctc

SEQ ID NO: 24220 - DNA, 20 bp, Artificial Sequence
  Description of Artificial Sequence: Synthetic oligonucleotide
  Target: SCN10A; (-) strand; PAM type: NRG; PAM sequence: GAG
tgaagctaattttaaaagaa

SEQ ID NO: 24221 - DNA, 20 bp, Artificial Sequence
  Description of Artificial Sequence: Synthetic oligonucleotide
  Target: SCN10A; (-) strand; PAM type: NRG; PAM sequence: AAG
catgaagctaattttaaaag

SEQ ID NO: 24222 - DNA, 20 bp, Artificial Sequence
  Description of Artificial Sequence: Synthetic oligonucleotide
  Target: SCN10A; (-) strand; PAM type: NRG; PAM sequence: AAG
tatcatgaagctaattttaa

SEQ ID NO: 24223 - DNA, 20 bp, Artificial Sequence
  Description of Artificial Sequence: Synthetic oligonucleotide
  Target: SCN10A; (-) strand; PAM type: NRG; PAM sequence: AAG
tttttgttctatttatcatg

SEQ ID NO: 24224 - DNA, 20 bp, Artificial Sequence
  Description of Artificial Sequence: Synthetic oligonucleotide
  Target: SCN10A; (-) strand; PAM type: NRG; PAM sequence: CAG
ctatatatatgggaaagact

SEQ ID NO: 24225 - DNA, 20 bp, Artificial Sequence
  Description of Artificial Sequence: Synthetic oligonucleotide
  Target: SCN10A; (-) strand; PAM type: NRG; PAM sequence: AAG
tcttcactatatatatggga

SEQ ID NO: 24226 - DNA, 20 bp, Artificial Sequence
  Description of Artificial Sequence: Synthetic oligonucleotide
  Target: SCN10A; (-) strand; PAM type: NRG; PAM sequence: GGG
catatcttcactatatatat

SEQ ID NO: 24227 - DNA, 20 bp, Artificial Sequence
  Description of Artificial Sequence: Synthetic oligonucleotide
  Target: SCN10A; (-) strand; PAM type: NRG; PAM sequence: TGG
gcatatcttcactatatata

SEQ ID NO: 24228 - DNA, 20 bp, Artificial Sequence
  Description of Artificial Sequence: Synthetic oligonucleotide
  Target: SCN10A; (-) strand; PAM type: NRG; PAM sequence: CAG
actatgaataagtaagttgt

SEQ ID NO: 24229 - DNA, 20 bp, Artificial Sequence
  Description of Artificial Sequence: Synthetic oligonucleotide
  Target: SCN10A; (-) strand; PAM type: NRG; PAM sequence: AAG
gaacaaaactatgaataagt

SEQ ID NO: 24230 - DNA, 20 bp, Artificial Sequence
  Description of Artificial Sequence: Synthetic oligonucleotide
  Target: SCN10A; (-) strand; PAM type: NRG; PAM sequence: AAG
agttgaacaaaactatgaat

SEQ ID NO: 24231 - DNA, 20 bp, Artificial Sequence
  Description of Artificial Sequence: Synthetic oligonucleotide
  Target: SCN10A; (-) strand; PAM type: NRG; PAM sequence: TAG
cgagcagacattttatttta

SEQ ID NO: 24232 - DNA, 20 bp, Artificial Sequence
  Description of Artificial Sequence: Synthetic oligonucleotide
  Target: SCN10A; (-) strand; PAM type: NRG; PAM sequence: CAG
atgactgttaggtatacgag

SEQ ID NO: 24233 - DNA, 20 bp, Artificial Sequence
  Description of Artificial Sequence: Synthetic oligonucleotide
  Target: SCN10A; (-) strand; PAM type: NRG; PAM sequence: GAG
tcaatgactgttaggtatac

SEQ ID NO: 24234 - DNA, 20 bp, Artificial Sequence
  Description of Artificial Sequence: Synthetic oligonucleotide
  Target: SCN10A; (-) strand; PAM type: NRG; PAM sequence: AGG
atttaaagtcaatgactgtt

SEQ ID NO: 24235 - DNA, 20 bp, Artificial Sequence
  Description of Artificial Sequence: Synthetic oligonucleotide
  Target: SCN10A; (-) strand; PAM type: NRG; PAM sequence: TAG
catttaaagtcaatgactgt

SEQ ID NO: 24236 - DNA, 20 bp, Artificial Sequence
  Description of Artificial Sequence: Synthetic oligonucleotide
  Target: SCN10A; (-) strand; PAM type: NRG; PAM sequence: AAG
tataatgtgactggcattta

SEQ ID NO: 24237 - DNA, 20 bp, Artificial Sequence
  Description of Artificial Sequence: Synthetic oligonucleotide
  Target: SCN10A; (-) strand; PAM type: NRG; PAM sequence: TGG
tgcattccttataatgtgac

SEQ ID NO: 24238 - DNA, 20 bp, Artificial Sequence
  Description of Artificial Sequence: Synthetic oligonucleotide
  Target: SCN10A; (-) strand; PAM type: NRG; PAM sequence: AAG
tggtataattccttaattag

SEQ ID NO: 24239 - DNA, 20 bp, Artificial Sequence
  Description of Artificial Sequence: Synthetic oligonucleotide
  Target: SCN10A; (-) strand; PAM type: NRG; PAM sequence: TAG
aattggtataattccttaat

SEQ ID NO: 24240 - DNA, 20 bp, Artificial Sequence
  Description of Artificial Sequence: Synthetic oligonucleotide
  Target: SCN10A; (-) strand; PAM type: NRG; PAM sequence: TGG
gaagaaacaagaaaaacaat

SEQ ID NO: 24241 - DNA, 20 bp, Artificial Sequence
  Description of Artificial Sequence: Synthetic oligonucleotide
  Target: SCN10A; (-) strand; PAM type: NRG; PAM sequence: AAG
attgtggttggagaagaaac

SEQ ID NO: 24242 - DNA, 20 bp, Artificial Sequence
  Description of Artificial Sequence: Synthetic oligonucleotide
  Target: SCN10A; (-) strand; PAM type: NRG; PAM sequence: AAG
tacaaatattgtggttggag

SEQ ID NO: 24243 - DNA, 20 bp, Artificial Sequence
  Description of Artificial Sequence: Synthetic oligonucleotide
  Target: SCN10A; (-) strand; PAM type: NRG; PAM sequence: GAG
aattacaaatattgtggttg

SEQ ID NO: 24244 - DNA, 20 bp, Artificial Sequence
  Description of Artificial Sequence: Synthetic oligonucleotide
  Target: SCN10A; (-) strand; PAM type: NRG; PAM sequence: TGG
tcaattacaaatattgtggt

SEQ ID NO: 24245 - DNA, 20 bp, Artificial Sequence
  Description of Artificial Sequence: Synthetic oligonucleotide
  Target: SCN10A; (-) strand; PAM type: NRG; PAM sequence: TGG
caaatcaattacaaatattg

SEQ ID NO: 24246 - DNA, 20 bp, Artificial Sequence
  Description of Artificial Sequence: Synthetic oligonucleotide
  Target: SCN10A; (-) strand; PAM type: NRG; PAM sequence: CAG
ctgctggtaagatacaaaac

SEQ ID NO: 24247 - DNA, 20 bp, Artificial Sequence
  Description of Artificial Sequence: Synthetic oligonucleotide
  Target: SCN10A; (-) strand; PAM type: NRG; PAM sequence: AAG
acaattgcactcctgctggt

SEQ ID NO: 24248 - DNA, 20 bp, Artificial Sequence
  Description of Artificial Sequence: Synthetic oligonucleotide
  Target: SCN10A; (-) strand; PAM type: NRG; PAM sequence: TGG
aagcacaattgcactcctgc

SEQ ID NO: 24249 - DNA, 20 bp, Artificial Sequence
  Description of Artificial Sequence: Synthetic oligonucleotide
  Target: SCN10A; (-) strand; PAM type: NRG; PAM sequence: AAG
ttcatcctcatatcaaaaat

SEQ ID NO: 24250 - DNA, 20 bp, Artificial Sequence
  Description of Artificial Sequence: Synthetic oligonucleotide
  Target: SCN10A; (-) strand; PAM type: NRG; PAM sequence: GAG
gagaagacaacaaaactata

SEQ ID NO: 24251 - DNA, 20 bp, Artificial Sequence
  Description of Artificial Sequence: Synthetic oligonucleotide
  Target: SCN10A; (-) strand; PAM type: NRG; PAM sequence: TAG
ttgagaagacaacaaaacta

SEQ ID NO: 24252 - DNA, 20 bp, Artificial Sequence
  Description of Artificial Sequence: Synthetic oligonucleotide
  Target: SCN10A; (-) strand; PAM type: NRG; PAM sequence: AAG
attttatgttaaaggttgag

SEQ ID NO: 24253 - DNA, 20 bp, Artificial Sequence
  Description of Artificial Sequence: Synthetic oligonucleotide
  Target: SCN10A; (-) strand; PAM type: NRG; PAM sequence: GAG
aaaattttatgttaaaggtt

SEQ ID NO: 24254 - DNA, 20 bp, Artificial Sequence
  Description of Artificial Sequence: Synthetic oligonucleotide
  Target: SCN10A; (-) strand; PAM type: NRG; PAM sequence: AGG
ttgtgaaaattttatgttaa

SEQ ID NO: 24255 - DNA, 20 bp, Artificial Sequence
  Description of Artificial Sequence: Synthetic oligonucleotide
  Target: SCN10A; (-) strand; PAM type: NRG; PAM sequence: AAG
attgtgaaaattttatgtta

SEQ ID NO: 24256 - DNA, 20 bp, Artificial Sequence
  Description of Artificial Sequence: Synthetic oligonucleotide
  Target: SCN10A; (-) strand; PAM type: NRG; PAM sequence: CAG
agcacaaaataaggctttcc

SEQ ID NO: 24257 - DNA, 20 bp, Artificial Sequence
  Description of Artificial Sequence: Synthetic oligonucleotide
  Target: SCN10A; (-) strand; PAM type: NRG; PAM sequence: AGG
tctactacaagcacaaaata

SEQ ID NO: 24258 - DNA, 20 bp, Artificial Sequence
  Description of Artificial Sequence: Synthetic oligonucleotide
  Target: SCN10A; (-) strand; PAM type: NRG; PAM sequence: AAG
ctctactacaagcacaaaat

SEQ ID NO: 24259 - DNA, 20 bp, Artificial Sequence
  Description of Artificial Sequence: Synthetic oligonucleotide
  Target: SCN10A; (-) strand; PAM type: NRG; PAM sequence: AAG
caattgaatatctctactac

SEQ ID NO: 24260 - DNA, 20 bp, Artificial Sequence
  Description of Artificial Sequence: Synthetic oligonucleotide
  Target: SCN10A; (-) strand; PAM type: NRG; PAM sequence: AAG
ttccatattattttccaata

SEQ ID NO: 24261 - DNA, 20 bp, Artificial Sequence
  Description of Artificial Sequence: Synthetic oligonucleotide
  Target: SCN10A; (-) strand; PAM type: NRG; PAM sequence: AAG
ttttgtcaagtaatgatata

SEQ ID NO: 24262 - DNA, 20 bp, Artificial Sequence
  Description of Artificial Sequence: Synthetic oligonucleotide
  Target: SCN10A; (-) strand; PAM type: NRG; PAM sequence: AAG
tatctgctaacgtttttgtc

SEQ ID NO: 24263 - DNA, 20 bp, Artificial Sequence
  Description of Artificial Sequence: Synthetic oligonucleotide
  Target: SCN10A; (-) strand; PAM type: NRG; PAM sequence: TAG
gaccaatgatccttttgtcc

SEQ ID NO: 24264 - DNA, 20 bp, Artificial Sequence
  Description of Artificial Sequence: Synthetic oligonucleotide
  Target: SCN10A; (-) strand; PAM type: NRG; PAM sequence: TGG
taatgataattgaattttat

SEQ ID NO: 24265 - DNA, 20 bp, Artificial Sequence
  Description of Artificial Sequence: Synthetic oligonucleotide
  Target: SCN10A; (-) strand; PAM type: NRG; PAM sequence: GAG
aaaaatatataagaaaatgg

SEQ ID NO: 24266 - DNA, 20 bp, Artificial Sequence
  Description of Artificial Sequence: Synthetic oligonucleotide
  Target: SCN10A; (-) strand; PAM type: NRG; PAM sequence: GGG
acaaaaatatataagaaaat

SEQ ID NO: 24267 - DNA, 20 bp, Artificial Sequence
  Description of Artificial Sequence: Synthetic oligonucleotide
  Target: SCN10A; (-) strand; PAM type: NRG; PAM sequence: TGG
gacaaaaatatataagaaaa

SEQ ID NO: 24268 - DNA, 20 bp, Artificial Sequence
  Description of Artificial Sequence: Synthetic oligonucleotide
  Target: SCN10A; (-) strand; PAM type: NRG; PAM sequence: AAG
aaaaccagacaaaaatatat

SEQ ID NO: 24269 - DNA, 20 bp, Artificial Sequence
  Description of Artificial Sequence: Synthetic oligonucleotide
  Target: SCN10A; (-) strand; PAM type: NRG; PAM sequence: CAG
tgtggataatctcccaaaac

SEQ ID NO: 24270 - DNA, 20 bp, Artificial Sequence
  Description of Artificial Sequence: Synthetic oligonucleotide
  Target: SCN10A; (-) strand; PAM type: NRG; PAM sequence: TGG
agacaagtggataatggatg

SEQ ID NO: 24271 - DNA, 20 bp, Artificial Sequence
  Description of Artificial Sequence: Synthetic oligonucleotide
  Target: SCN10A; (-) strand; PAM type: NRG; PAM sequence: TGG
gtcatgagacaagtggataa

SEQ ID NO: 24272 - DNA, 20 bp, Artificial Sequence
  Description of Artificial Sequence: Synthetic oligonucleotide
  Target: SCN10A; (-) strand; PAM type: NRG; PAM sequence: TGG
tctgtttgtcatgagacaag

SEQ ID NO: 24273 - DNA, 20 bp, Artificial Sequence
  Description of Artificial Sequence: Synthetic oligonucleotide
  Target: SCN10A; (-) strand; PAM type: NRG; PAM sequence: AAG
gaatctgtttgtcatgagac

SEQ ID NO: 24274 - DNA, 20 bp, Artificial Sequence
  Description of Artificial Sequence: Synthetic oligonucleotide
  Target: SCN10A; (-) strand; PAM type: NRG; PAM sequence: GAG
agcatgaatctgtttgtcat

SEQ ID NO: 24275 - DNA, 20 bp, Artificial Sequence
  Description of Artificial Sequence: Synthetic oligonucleotide
  Target: SCN10A; (-) strand; PAM type: NRG; PAM sequence: AAG
gcctccattgtaaaaataca

SEQ ID NO: 24276 - DNA, 20 bp, Artificial Sequence
  Description of Artificial Sequence: Synthetic oligonucleotide
  Target: SCN10A; (-) strand; PAM type: NRG; PAM sequence: TGG
gtcacaatgtaagtaatgaa

SEQ ID NO: 24277 - DNA, 20 bp, Artificial Sequence
  Description of Artificial Sequence: Synthetic oligonucleotide
  Target: SCN10A; (-) strand; PAM type: NRG; PAM sequence: AAG
gtgaaataaggtcacaatgt

SEQ ID NO: 24278 - DNA, 20 bp, Artificial Sequence
  Description of Artificial Sequence: Synthetic oligonucleotide
  Target: SCN10A; (-) strand; PAM type: NRG; PAM sequence: AGG
aaatcctacaatgtgaaata

SEQ ID NO: 24279 - DNA, 20 bp, Artificial Sequence
  Description of Artificial Sequence: Synthetic oligonucleotide
  Target: SCN10A; (-) strand; PAM type: NRG; PAM sequence: AAG
taaatcctacaatgtgaaat

SEQ ID NO: 24280 - DNA, 20 bp, Artificial Sequence
  Description of Artificial Sequence: Synthetic oligonucleotide
  Target: SCN10A; (-) strand; PAM type: NRG; PAM sequence: TAG
cataacaataatgataaaaa

SEQ ID NO: 24281 - DNA, 20 bp, Artificial Sequence
  Description of Artificial Sequence: Synthetic oligonucleotide
  Target: SCN10A; (-) strand; PAM type: NRG; PAM sequence: AAG
acttcgaaagtggttttctg

SEQ ID NO: 24282 - DNA, 20 bp, Artificial Sequence
  Description of Artificial Sequence: Synthetic oligonucleotide
  Target: SCN10A; (-) strand; PAM type: NRG; PAM sequence: TGG
aagagtcatcacttcgaaag

SEQ ID NO: 24283 - DNA, 20 bp, Artificial Sequence
  Description of Artificial Sequence: Synthetic oligonucleotide
  Target: SCN10A; (-) strand; PAM type: NRG; PAM sequence: AAG
aaaaagagtcatcacttcga

SEQ ID NO: 24284 - DNA, 20 bp, Artificial Sequence
  Description of Artificial Sequence: Synthetic oligonucleotide
  Target: SCN10A; (-) strand; PAM type: NRG; PAM sequence: GAG
atatcacaattcaaaaaaaa

SEQ ID NO: 24285 - DNA, 20 bp, Artificial Sequence
  Description of Artificial Sequence: Synthetic oligonucleotide
  Target: SCN10A; (-) strand; PAM type: NRG; PAM sequence: AAG
taatatcacaattcaaaaaa

SEQ ID NO: 24286 - DNA, 20 bp, Artificial Sequence
  Description of Artificial Sequence: Synthetic oligonucleotide
  Target: SCN10A; (-) strand; PAM type: NRG; PAM sequence: CAG
tgacagttatttacacttgt

SEQ ID NO: 24287 - DNA, 20 bp, Artificial Sequence
  Description of Artificial Sequence: Synthetic oligonucleotide
  Target: SCN10A; (-) strand; PAM type: NRG; PAM sequence: CAG
tgtattttattgtcacctga

SEQ ID NO: 24288 - DNA, 20 bp, Artificial Sequence
  Description of Artificial Sequence: Synthetic oligonucleotide
  Target: SCN10A; (-) strand; PAM type: NRG; PAM sequence: CAG
aacatggagttaatcatagg

SEQ ID NO: 24289 - DNA, 20 bp, Artificial Sequence
  Description of Artificial Sequence: Synthetic oligonucleotide
  Target: SCN10A; (-) strand; PAM type: NRG; PAM sequence: AGG
gttaacatggagttaatcat

SEQ ID NO: 24290 - DNA, 20 bp, Artificial Sequence
  Description of Artificial Sequence: Synthetic oligonucleotide
  Target: SCN10A; (-) strand; PAM type: NRG; PAM sequence: TAG
ggttaacatggagttaatca

SEQ ID NO: 24291 - DNA, 20 bp, Artificial Sequence
  Description of Artificial Sequence: Synthetic oligonucleotide
  Target: SCN10A; (-) strand; PAM type: NRG; PAM sequence: GAG
cattcataatggttaacatg

SEQ ID NO: 24292 - DNA, 20 bp, Artificial Sequence
  Description of Artificial Sequence: Synthetic oligonucleotide
  Target: SCN10A; (-) strand; PAM type: NRG; PAM sequence: TGG
ttcattcataatggttaaca

SEQ ID NO: 24293 - DNA, 20 bp, Artificial Sequence
  Description of Artificial Sequence: Synthetic oligonucleotide
  Target: SCN10A; (-) strand; PAM type: NRG; PAM sequence: TGG
aaaactgatttcattcataa

SEQ ID NO: 24294 - DNA, 20 bp, Artificial Sequence
  Description of Artificial Sequence: Synthetic oligonucleotide
  Target: SCN10A; (-) strand; PAM type: NRG; PAM sequence: CAG
actttttatgttttcaaaaa

SEQ ID NO: 24295 - DNA, 20 bp, Artificial Sequence
  Description of Artificial Sequence: Synthetic oligonucleotide
  Target: SCN10A; (-) strand; PAM type: NRG; PAM sequence: TAG
aagattaattattatattca

SEQ ID NO: 24296 - DNA, 20 bp, Artificial Sequence
  Description of Artificial Sequence: Synthetic oligonucleotide
  Target: SCN10A; (-) strand; PAM type: NRG; PAM sequence: AAG
aattttaaaatctaacatgt

SEQ ID NO: 24297 - DNA, 20 bp, Artificial Sequence
  Description of Artificial Sequence: Synthetic oligonucleotide
  Target: SCN10A; (-) strand; PAM type: NRG; PAM sequence: AGG
gtttctcaacaagtgatcta

SEQ ID NO: 24298 - DNA, 20 bp, Artificial Sequence
  Description of Artificial Sequence: Synthetic oligonucleotide
  Target: SCN10A; (-) strand; PAM type: NRG; PAM sequence: AAG
tgtttctcaacaagtgatct

SEQ ID NO: 24299 - DNA, 20 bp, Artificial Sequence
  Description of Artificial Sequence: Synthetic oligonucleotide
  Target: SCN10A; (-) strand; PAM type: NRG; PAM sequence: AAG
ctcctacaatgtttctcaac

SEQ ID NO: 24300 - DNA, 20 bp, Artificial Sequence
  Description of Artificial Sequence: Synthetic oligonucleotide
  Target: SCN10A; (-) strand; PAM type: NRG; PAM sequence: GAG
tattcttactttgtttagca

SEQ ID NO: 24301 - DNA, 20 bp, Artificial Sequence
  Description of Artificial Sequence: Synthetic oligonucleotide
  Target: SCN10A; (-) strand; PAM type: NRG; PAM sequence: CAG
cttattcttactttgtttag

SEQ ID NO: 24302 - DNA, 20 bp, Artificial Sequence
  Description of Artificial Sequence: Synthetic oligonucleotide
  Target: SCN10A; (-) strand; PAM type: NRG; PAM sequence: TAG
caacttattcttactttgtt

SEQ ID NO: 24303 - DNA, 20 bp, Artificial Sequence
  Description of Artificial Sequence: Synthetic oligonucleotide
  Target: SCN10A; (-) strand; PAM type: NRG; PAM sequence: GGG
ctctctcctcaattgtccct

SEQ ID NO: 24304 - DNA, 20 bp, Artificial Sequence
  Description of Artificial Sequence: Synthetic oligonucleotide
  Target: SCN10A; (-) strand; PAM type: NRG; PAM sequence: TGG
actctctcctcaattgtccc

SEQ ID NO: 24305 - DNA, 20 bp, Artificial Sequence
  Description of Artificial Sequence: Synthetic oligonucleotide
  Target: SCN10A; (-) strand; PAM type: NRG; PAM sequence: GGG
ctttcataaactgtcccttt

SEQ ID NO: 24306 - DNA, 20 bp, Artificial Sequence
  Description of Artificial Sequence: Synthetic oligonucleotide
  Target: SCN10A; (-) strand; PAM type: NRG; PAM sequence: TGG
tctttcataaactgtccctt

SEQ ID NO: 24307 - DNA, 20 bp, Artificial Sequence
  Description of Artificial Sequence: Synthetic oligonucleotide
  Target: SCN10A; (-) strand; PAM type: NRG; PAM sequence: TGG
tctattttgctaaatgaggc

SEQ ID NO: 24308 - DNA, 20 bp, Artificial Sequence
  Description of Artificial Sequence: Synthetic oligonucleotide
  Target: SCN10A; (-) strand; PAM type: NRG; PAM sequence: AGG
tttatctattttgctaaatg

SEQ ID NO: 24309 - DNA, 20 bp, Artificial Sequence
  Description of Artificial Sequence: Synthetic oligonucleotide
  Target: SCN10A; (-) strand; PAM type: NRG; PAM sequence: GAG
ttttatctattttgctaaat

SEQ ID NO: 24310 - DNA, 20 bp, Artificial Sequence
  Description of Artificial Sequence: Synthetic oligonucleotide
  Target: SCN10A; (-) strand; PAM type: NRG; PAM sequence: AGG
tcattttgctggattcaatt

SEQ ID NO: 24311 - DNA, 20 bp, Artificial Sequence
  Description of Artificial Sequence: Synthetic oligonucleotide
  Target: SCN10A; (-) strand; PAM type: NRG; PAM sequence: TAG
atcattttgctggattcaat

SEQ ID NO: 24312 - DNA, 20 bp, Artificial Sequence
  Description of Artificial Sequence: Synthetic oligonucleotide
  Target: SCN10A; (-) strand; PAM type: NRG; PAM sequence: TGG
gttccagctgatcattttgc

SEQ ID NO: 24313 - DNA, 20 bp, Artificial Sequence
  Description of Artificial Sequence: Synthetic oligonucleotide
  Target: SCN10A; (-) strand; PAM type: NRG; PAM sequence: CAG
tagtctatttttaatggttc

SEQ ID NO: 24314 - DNA, 20 bp, Artificial Sequence
  Description of Artificial Sequence: Synthetic oligonucleotide
  Target: SCN10A; (-) strand; PAM type: NRG; PAM sequence: TGG
gtttgttagtctatttttaa

SEQ ID NO: 24315 - DNA, 20 bp, Artificial Sequence
  Description of Artificial Sequence: Synthetic oligonucleotide
  Target: SCN10A; (-) strand; PAM type: NRG; PAM sequence: TAG
ctgtaaactaacaggtttgt

SEQ ID NO: 24316 - DNA, 20 bp, Artificial Sequence
  Description of Artificial Sequence: Synthetic oligonucleotide
  Target: SCN10A; (-) strand; PAM type: NRG; PAM sequence: AGG
tagtaaatctgtaaactaac

SEQ ID NO: 24317 - DNA, 20 bp, Artificial Sequence
  Description of Artificial Sequence: Synthetic oligonucleotide
  Target: SCN10A; (-) strand; PAM type: NRG; PAM sequence: CAG
atagtaaatctgtaaactaa

SEQ ID NO: 24318 - DNA, 20 bp, Artificial Sequence
  Description of Artificial Sequence: Synthetic oligonucleotide
  Target: SCN10A; (-) strand; PAM type: NRG; PAM sequence: TAG
tagtctttcatctgttagta

SEQ ID NO: 24319 - DNA, 20 bp, Artificial Sequence
  Description of Artificial Sequence: Synthetic oligonucleotide
  Target: SCN10A; (-) strand; PAM type: NRG; PAM sequence: TAG
tcatatagtctttcatctgt

SEQ ID NO: 24320 - DNA, 20 bp, Artificial Sequence
  Description of Artificial Sequence: Synthetic oligonucleotide
  Target: SCN10A; (-) strand; PAM type: NRG; PAM sequence: TAG
tatttattgaggttatcata

SEQ ID NO: 24321 - DNA, 20 bp, Artificial Sequence
  Description of Artificial Sequence: Synthetic oligonucleotide
  Target: SCN10A; (-) strand; PAM type: NRG; PAM sequence: AGG
cagtatttttatatttattg

SEQ ID NO: 24322 - DNA, 20 bp, Artificial Sequence
  Description of Artificial Sequence: Synthetic oligonucleotide
  Target: SCN10A; (-) strand; PAM type: NRG; PAM sequence: GAG
tcagtatttttatatttatt

SEQ ID NO: 24323 - DNA, 20 bp, Artificial Sequence
  Description of Artificial Sequence: Synthetic oligonucleotide
  Target: SCN10A; (-) strand; PAM type: NRG; PAM sequence: CAG
gaatgggtgttggcttctat

SEQ ID NO: 24324 - DNA, 20 bp, Artificial Sequence
  Description of Artificial Sequence: Synthetic oligonucleotide
  Target: SCN10A; (-) strand; PAM type: NRG; PAM sequence: TGG
ctttcatcatgaatgggtgt

SEQ ID NO: 24325 - DNA, 20 bp, Artificial Sequence
  Description of Artificial Sequence: Synthetic oligonucleotide
  Target: SCN10A; (-) strand; PAM type: NRG; PAM sequence: GGG
ttgagactttcatcatgaat

SEQ ID NO: 24326 - DNA, 20 bp, Artificial Sequence
  Description of Artificial Sequence: Synthetic oligonucleotide
  Target: SCN10A; (-) strand; PAM type: NRG; PAM sequence: TGG
gttgagactttcatcatgaa

SEQ ID NO: 24327 - DNA, 20 bp, Artificial Sequence
  Description of Artificial Sequence: Synthetic oligonucleotide
  Target: SCN10A; (-) strand; PAM type: NRG; PAM sequence: GAG
ttttccatttcttgtttgtt

SEQ ID NO: 24328 - DNA, 20 bp, Artificial Sequence
  Description of Artificial Sequence: Synthetic oligonucleotide
  Target: SCN10A; (-) strand; PAM type: NRG; PAM sequence: GAG
cactattatgatgtttatga

SEQ ID NO: 24329 - DNA, 20 bp, Artificial Sequence
  Description of Artificial Sequence: Synthetic oligonucleotide
  Target: SCN10A; (-) strand; PAM type: NRG; PAM sequence: GAG
ttcactattatgatgtttat

SEQ ID NO: 24330 - DNA, 20 bp, Artificial Sequence
  Description of Artificial Sequence: Synthetic oligonucleotide
  Target: SCN10A; (-) strand; PAM type: NRG; PAM sequence: AAG
ttattttgctcttgatttta

SEQ ID NO: 24331 - DNA, 20 bp, Artificial Sequence
  Description of Artificial Sequence: Synthetic oligonucleotide
  Target: SCN10A; (-) strand; PAM type: NRG; PAM sequence: GAG
taattcaaagctatgacagt

SEQ ID NO: 24332 - DNA, 20 bp, Artificial Sequence
  Description of Artificial Sequence: Synthetic oligonucleotide
  Target: SCN10A; (-) strand; PAM type: NRG; PAM sequence: CAG
atggtaattcaaagctatga

SEQ ID NO: 24333 - DNA, 20 bp, Artificial Sequence
  Description of Artificial Sequence: Synthetic oligonucleotide
  Target: SCN10A; (-) strand; PAM type: NRG; PAM sequence: AAG
ttcaacaagatggtaattca

SEQ ID NO: 24334 - DNA, 20 bp, Artificial Sequence
  Description of Artificial Sequence: Synthetic oligonucleotide
  Target: SCN10A; (-) strand; PAM type: NRG; PAM sequence: TGG
ggccgggaccttcaacaaga

SEQ ID NO: 24335 - DNA, 20 bp, Artificial Sequence
  Description of Artificial Sequence: Synthetic oligonucleotide
  Target: SCN10A; (-) strand; PAM type: NRG; PAM sequence: AAG
aattggccgggaccttcaac

SEQ ID NO: 24336 - DNA, 20 bp, Artificial Sequence
  Description of Artificial Sequence: Synthetic oligonucleotide
  Target: SCN10A; (-) strand; PAM type: NRG; PAM sequence: GGG
cctgtcttattgaattggcc

SEQ ID NO: 24337 - DNA, 20 bp, Artificial Sequence
  Description of Artificial Sequence: Synthetic oligonucleotide
  Target: SCN10A; (-) strand; PAM type: NRG; PAM sequence: CGG
tcctgtcttattgaattggc

SEQ ID NO: 24338 - DNA, 20 bp, Artificial Sequence
  Description of Artificial Sequence: Synthetic oligonucleotide
  Target: SCN10A; (-) strand; PAM type: NRG; PAM sequence: TGG
tttttcctgtcttattgaat

SEQ ID NO: 24339 - DNA, 20 bp, Artificial Sequence
  Description of Artificial Sequence: Synthetic oligonucleotide
  Target: SCN10A; (-) strand; PAM type: NRG; PAM sequence: CAG
ccttggacttcctatttaga

SEQ ID NO: 24340 - DNA, 20 bp, Artificial Sequence
  Description of Artificial Sequence: Synthetic oligonucleotide
  Target: SCN10A; (-) strand; PAM type: NRG; PAM sequence: TAG
attcccttggacttcctatt

SEQ ID NO: 24341 - DNA, 20 bp, Artificial Sequence
  Description of Artificial Sequence: Synthetic oligonucleotide
  Target: SCN10A; (-) strand; PAM type: NRG; PAM sequence: TGG
aatttttctgtagattccct

SEQ ID NO: 24342 - DNA, 20 bp, Artificial Sequence
  Description of Artificial Sequence: Synthetic oligonucleotide
  Target: SCN10A; (-) strand; PAM type: NRG; PAM sequence: TAG
cttaaagttaaatttttctg

SEQ ID NO: 24343 - DNA, 20 bp, Artificial Sequence
  Description of Artificial Sequence: Synthetic oligonucleotide
  Target: SCN10A; (-) strand; PAM type: NRG; PAM sequence: AAG
caaccctgctgagctcctta

SEQ ID NO: 24344 - DNA, 20 bp, Artificial Sequence
  Description of Artificial Sequence: Synthetic oligonucleotide
  Target: SCN10A; (-) strand; PAM type: NRG; PAM sequence: GAG
ttgcatccagcaaccctgct

SEQ ID NO: 24345 - DNA, 20 bp, Artificial Sequence
  Description of Artificial Sequence: Synthetic oligonucleotide
  Target: SCN10A; (-) strand; PAM type: NRG; PAM sequence: CAG
ctatatagtgattttgcatc

SEQ ID NO: 24346 - DNA, 20 bp, Artificial Sequence
  Description of Artificial Sequence: Synthetic oligonucleotide
  Target: SCN10A; (-) strand; PAM type: NRG; PAM sequence: TAG
taatattattaatttctata

SEQ ID NO: 24347 - DNA, 20 bp, Artificial Sequence
  Description of Artificial Sequence: Synthetic oligonucleotide
  Target: SCN10A; (-) strand; PAM type: NRG; PAM sequence: TGG
tcctaggtacattgcaattt

SEQ ID NO: 24348 - DNA, 20 bp, Artificial Sequence
  Description of Artificial Sequence: Synthetic oligonucleotide
  Target: SCN10A; (-) strand; PAM type: NRG; PAM sequence: AGG
ttttataatgtctttttcct

SEQ ID NO: 24349 - DNA, 20 bp, Artificial Sequence
  Description of Artificial Sequence: Synthetic oligonucleotide
  Target: SCN10A; (-) strand; PAM type: NRG; PAM sequence: TAG
attttataatgtctttttcc

SEQ ID NO: 24350 - DNA, 20 bp, Artificial Sequence
  Description of Artificial Sequence: Synthetic oligonucleotide
  Target: SCN10A; (-) strand; PAM type: NRG; PAM sequence: AGG
gcagatctcttaatttatac

SEQ ID NO: 24351 - DNA, 20 bp, Artificial Sequence
  Description of Artificial Sequence: Synthetic oligonucleotide
  Target: SCN10A; (-) strand; PAM type: NRG; PAM sequence: CAG
ggcagatctcttaatttata

SEQ ID NO: 24352 - DNA, 20 bp, Artificial Sequence
  Description of Artificial Sequence: Synthetic oligonucleotide
  Target: SCN10A; (-) strand; PAM type: NRG; PAM sequence: CAG
cttcccacacatcagtatgg

SEQ ID NO: 24353 - DNA, 20 bp, Artificial Sequence
  Description of Artificial Sequence: Synthetic oligonucleotide
  Target: SCN10A; (-) strand; PAM type: NRG; PAM sequence: TGG
agccttcccacacatcagta

SEQ ID NO: 24354 - DNA, 20 bp, Artificial Sequence
  Description of Artificial Sequence: Synthetic oligonucleotide
  Target: SCN10A; (-) strand; PAM type: NRG; PAM sequence: CAG
tacgaagccttcccacacat

SEQ ID NO: 24355 - DNA, 20 bp, Artificial Sequence
  Description of Artificial Sequence: Synthetic oligonucleotide
  Target: SCN10A; (-) strand; PAM type: NRG; PAM sequence: AAG
atcgccacatttacaatacg

SEQ ID NO: 24356 - DNA, 20 bp, Artificial Sequence
  Description of Artificial Sequence: Synthetic oligonucleotide
  Target: SCN10A; (-) strand; PAM type: NRG; PAM sequence: AAG
aattgatttatcaccacagg

SEQ ID NO: 24357 - DNA, 20 bp, Artificial Sequence
  Description of Artificial Sequence: Synthetic oligonucleotide
  Target: SCN10A; (-) strand; PAM type: NRG; PAM sequence: AGG
ctgaattgatttatcaccac

SEQ ID NO: 24358 - DNA, 20 bp, Artificial Sequence
  Description of Artificial Sequence: Synthetic oligonucleotide
  Target: SCN10A; (-) strand; PAM type: NRG; PAM sequence: CAG
actgaattgatttatcacca

SEQ ID NO: 24359 - DNA, 20 bp, Artificial Sequence
  Description of Artificial Sequence: Synthetic oligonucleotide
  Target: SCN10A; (-) strand; PAM type: NRG; PAM sequence: TGG
aactctgtggaaactttgtt

SEQ ID NO: 24360 - DNA, 20 bp, Artificial Sequence
  Description of Artificial Sequence: Synthetic oligonucleotide
  Target: SCN10A; (-) strand; PAM type: NRG; PAM sequence: TGG
gctcttttcttacaactctg

SEQ ID NO: 24361 - DNA, 20 bp, Artificial Sequence
  Description of Artificial Sequence: Synthetic oligonucleotide
  Target: SCN10A; (-) strand; PAM type: NRG; PAM sequence: CAG
agtttaagggtcacattttc

SEQ ID NO: 24362 - DNA, 20 bp, Artificial Sequence
  Description of Artificial Sequence: Synthetic oligonucleotide
  Target: SCN10A; (-) strand; PAM type: NRG; PAM sequence: GGG
acttttccatatcagtttaa

SEQ ID NO: 24363 - DNA, 20 bp, Artificial Sequence
  Description of Artificial Sequence: Synthetic oligonucleotide
  Target: SCN10A; (-) strand; PAM type: NRG; PAM sequence: AGG
tacttttccatatcagttta

SEQ ID NO: 24364 - DNA, 20 bp, Artificial Sequence
  Description of Artificial Sequence: Synthetic oligonucleotide
  Target: SCN10A; (-) strand; PAM type: NRG; PAM sequence: AAG
ttacttttccatatcagttt

SEQ ID NO: 24365 - DNA, 20 bp, Artificial Sequence
  Description of Artificial Sequence: Synthetic oligonucleotide
  Target: SCN10A; (-) strand; PAM type: NRG; PAM sequence: CAG
gtttctttacttttccatat

SEQ ID NO: 24366 - DNA, 20 bp, Artificial Sequence
  Description of Artificial Sequence: Synthetic oligonucleotide
  Target: SCN10A; (-) strand; PAM type: NRG; PAM sequence: TGG
tgtcttcttgaaaattattt

SEQ ID NO: 24367 - DNA, 20 bp, Artificial Sequence
  Description of Artificial Sequence: Synthetic oligonucleotide
  Target: SCN10A; (-) strand; PAM type: NRG; PAM sequence: TGG
ctctatagtaagatttgacc

SEQ ID NO: 24368 - DNA, 20 bp, Artificial Sequence
  Description of Artificial Sequence: Synthetic oligonucleotide
  Target: SCN10A; (-) strand; PAM type: NRG; PAM sequence: AAG
ggatttaaatgctctatagt

SEQ ID NO: 24369 - DNA, 20 bp, Artificial Sequence
  Description of Artificial Sequence: Synthetic oligonucleotide
  Target: SCN10A; (-) strand; PAM type: NRG; PAM sequence: TAG
acgtggatttaaatgctcta

SEQ ID NO: 24370 - DNA, 20 bp, Artificial Sequence
  Description of Artificial Sequence: Synthetic oligonucleotide
  Target: SCN10A; (-) strand; PAM type: NRG; PAM sequence: TGG
catcctgagtcaacaccacg

SEQ ID NO: 24371 - DNA, 20 bp, Artificial Sequence
  Description of Artificial Sequence: Synthetic oligonucleotide
  Target: SCN10A; (-) strand; PAM type: NRG; PAM sequence: GAG
taatctcattgtcacatcct

SEQ ID NO: 24372 - DNA, 20 bp, Artificial Sequence
  Description of Artificial Sequence: Synthetic oligonucleotide
  Target: SCN10A; (-) strand; PAM type: NRG; PAM sequence: CAG
tctactgaatctgtttctcc

SEQ ID NO: 24373 - DNA, 20 bp, Artificial Sequence
  Description of Artificial Sequence: Synthetic oligonucleotide
  Target: SCN10A; (-) strand; PAM type: NRG; PAM sequence: CAG
ccactgcttctgccatgcac

SEQ ID NO: 24374 - DNA, 20 bp, Artificial Sequence
  Description of Artificial Sequence: Synthetic oligonucleotide
  Target: SCN10A; (-) strand; PAM type: NRG; PAM sequence: TGG
tcaatacatcatttcccaag

SEQ ID NO: 24375 - DNA, 20 bp, Artificial Sequence
  Description of Artificial Sequence: Synthetic oligonucleotide
  Target: SCN10A; (-) strand; PAM type: NRG; PAM sequence: AAG
ttttcaatacatcatttccc

SEQ ID NO: 24376 - DNA, 20 bp, Artificial Sequence
  Description of Artificial Sequence: Synthetic oligonucleotide
  Target: SCN10A; (-) strand; PAM type: NRG; PAM sequence: TGG
gcttccaatatttttccata

SEQ ID NO: 24377 - DNA, 20 bp, Artificial Sequence
  Description of Artificial Sequence: Synthetic oligonucleotide
  Target: SCN10A; (-) strand; PAM type: NRG; PAM sequence: AGG
gtatgtgtgtggtatgagat

SEQ ID NO: 24378 - DNA, 20 bp, Artificial Sequence
  Description of Artificial Sequence: Synthetic oligonucleotide
  Target: SCN10A; (-) strand; PAM type: NRG; PAM sequence: TAG
tgtatgtgtgtggtatgaga

SEQ ID NO: 24379 - DNA, 20 bp, Artificial Sequence
  Description of Artificial Sequence: Synthetic oligonucleotide
  Target: SCN10A; (-) strand; PAM type: NRG; PAM sequence: GAG
tttttgtatgtgtgtggtat

SEQ ID NO: 24380 - DNA, 20 bp, Artificial Sequence
  Description of Artificial Sequence: Synthetic oligonucleotide
  Target: SCN10A; (-) strand; PAM type: NRG; PAM sequence: TGG
aatttatttttgtatgtgtg

SEQ ID NO: 24381 - DNA, 20 bp, Artificial Sequence
  Description of Artificial Sequence: Synthetic oligonucleotide
  Target: SCN10A; (-) strand; PAM type: NRG; PAM sequence: TAG
atttaggtatttcaatctcc

SEQ ID NO: 24382 - DNA, 20 bp, Artificial Sequence
  Description of Artificial Sequence: Synthetic oligonucleotide
  Target: SCN10A; (-) strand; PAM type: NRG; PAM sequence: AGG
cagttttcctttctacattt

SEQ ID NO: 24383 - DNA, 20 bp, Artificial Sequence
  Description of Artificial Sequence: Synthetic oligonucleotide
  Target: SCN10A; (-) strand; PAM type: NRG; PAM sequence: TAG
acagttttcctttctacatt

SEQ ID NO: 24384 - DNA, 20 bp, Artificial Sequence
  Description of Artificial Sequence: Synthetic oligonucleotide
  Target: SCN10A; (-) strand; PAM type: NRG; PAM sequence: CAG
gtgttttctcctcaaagtta

SEQ ID NO: 24385 - DNA, 20 bp, Artificial Sequence
  Description of Artificial Sequence: Synthetic oligonucleotide
  Target: SCN10A; (-) strand; PAM type: NRG; PAM sequence: AAG
tatcctgtgttttctcctca

SEQ ID NO: 24386 - DNA, 20 bp, Artificial Sequence
  Description of Artificial Sequence: Synthetic oligonucleotide
  Target: SCN10A; (-) strand; PAM type: NRG; PAM sequence: AAG
ttgccatatagtattccata

SEQ ID NO: 24387 - DNA, 20 bp, Artificial Sequence
  Description of Artificial Sequence: Synthetic oligonucleotide
  Target: SCN10A; (-) strand; PAM type: NRG; PAM sequence: TAG
attcattttttattgccata

SEQ ID NO: 24388 - DNA, 20 bp, Artificial Sequence
  Description of Artificial Sequence: Synthetic oligonucleotide
  Target: SCN10A; (-) strand; PAM type: NRG; PAM sequence: TAG
tttgcccaaatggatacatg

SEQ ID NO: 24389 - DNA, 20 bp, Artificial Sequence
  Description of Artificial Sequence: Synthetic oligonucleotide
  Target: SCN10A; (-) strand; PAM type: NRG; PAM sequence: TGG
gtttttgggatttgcccaaa

SEQ ID NO: 24390 - DNA, 20 bp, Artificial Sequence
  Description of Artificial Sequence: Synthetic oligonucleotide
  Target: SCN10A; (-) strand; PAM type: NRG; PAM sequence: GGG
tgttttaaaattatgttttt

SEQ ID NO: 24391 - DNA, 20 bp, Artificial Sequence
  Description of Artificial Sequence: Synthetic oligonucleotide
  Target: SCN10A; (-) strand; PAM type: NRG; PAM sequence: TGG
atgttttaaaattatgtttt

SEQ ID NO: 24392 - DNA, 20 bp, Artificial Sequence
  Description of Artificial Sequence: Synthetic oligonucleotide
  Target: SCN10A; (-) strand; PAM type: NRG; PAM sequence: TGG
tttgtatcttttcaaattta

SEQ ID NO: 24393 - DNA, 20 bp, Artificial Sequence
  Description of Artificial Sequence: Synthetic oligonucleotide
  Target: SCN10A; (-) strand; PAM type: NRG; PAM sequence: AAG
tgtttaacactgcatgcata

SEQ ID NO: 24394 - DNA, 20 bp, Artificial Sequence
  Description of Artificial Sequence: Synthetic oligonucleotide
  Target: SCN10A; (-) strand; PAM type: NRG; PAM sequence: GGG
tctactgcaaacggggaagt

SEQ ID NO: 24395 - DNA, 20 bp, Artificial Sequence
  Description of Artificial Sequence: Synthetic oligonucleotide
  Target: SCN10A; (-) strand; PAM type: NRG; PAM sequence: TGG
atctactgcaaacggggaag

SEQ ID NO: 24396 - DNA, 20 bp, Artificial Sequence
  Description of Artificial Sequence: Synthetic oligonucleotide
  Target: SCN10A; (-) strand; PAM type: NRG; PAM sequence: AAG
tgaatctactgcaaacgggg

SEQ ID NO: 24397 - DNA, 20 bp, Artificial Sequence
  Description of Artificial Sequence: Synthetic oligonucleotide
  Target: SCN10A; (-) strand; PAM type: NRG; PAM sequence: GGG
agctgaatctactgcaaacg

SEQ ID NO: 24398 - DNA, 20 bp, Artificial Sequence
  Description of Artificial Sequence: Synthetic oligonucleotide
  Target: SCN10A; (-) strand; PAM type: NRG; PAM sequence: GGG
aagctgaatctactgcaaac

SEQ ID NO: 24399 - DNA, 20 bp, Artificial Sequence
  Description of Artificial Sequence: Synthetic oligonucleotide
  Target: SCN10A; (-) strand; PAM type: NRG; PAM sequence: CGG
gaagctgaatctactgcaaa

SEQ ID NO: 24400 - DNA, 20 bp, Artificial Sequence
  Description of Artificial Sequence: Synthetic oligonucleotide
  Target: SCN10A; (-) strand; PAM type: NRG; PAM sequence: AAG
ggcaaagaacatgtgaaatg

SEQ ID NO: 24401 - DNA, 20 bp, Artificial Sequence
  Description of Artificial Sequence: Synthetic oligonucleotide
  Target: SCN10A; (-) strand; PAM type: NRG; PAM sequence: AAG
aaatgttttctcacctggca

SEQ ID NO: 24402 - DNA, 20 bp, Artificial Sequence
  Description of Artificial Sequence: Synthetic oligonucleotide
  Target: SCN10A; (-) strand; PAM type: NRG; PAM sequence: TGG
aagataaatgttttctcacc

SEQ ID NO: 24403 - DNA, 20 bp, Artificial Sequence
  Description of Artificial Sequence: Synthetic oligonucleotide
  Target: SCN10A; (-) strand; PAM type: NRG; PAM sequence: AAG
atagcaatttggttgtagag

SEQ ID NO: 24404 - DNA, 20 bp, Artificial Sequence
  Description of Artificial Sequence: Synthetic oligonucleotide
  Target: SCN10A; (-) strand; PAM type: NRG; PAM sequence: GAG
attatagcaatttggttgta

SEQ ID NO: 24405 - DNA, 20 bp, Artificial Sequence
  Description of Artificial Sequence: Synthetic oligonucleotide
  Target: SCN10A; (-) strand; PAM type: NRG; PAM sequence: TAG
aaattatagcaatttggttg

SEQ ID NO: 24406 - DNA, 20 bp, Artificial Sequence
  Description of Artificial Sequence: Synthetic oligonucleotide
  Target: SCN10A; (-) strand; PAM type: NRG; PAM sequence: TGG
tttgacaaattatagcaatt

SEQ ID NO: 24407 - DNA, 20 bp, Artificial Sequence
  Description of Artificial Sequence: Synthetic oligonucleotide
  Target: SCN10A; (-) strand; PAM type: NRG; PAM sequence: TAG
ggaaaacctttgacaaatta

SEQ ID NO: 24408 - DNA, 20 bp, Artificial Sequence
  Description of Artificial Sequence: Synthetic oligonucleotide
  Target: SCN10A; (-) strand; PAM type: NRG; PAM sequence: TGG
ctctaagcataacaatattc

SEQ ID NO: 24409 - DNA, 20 bp, Artificial Sequence
  Description of Artificial Sequence: Synthetic oligonucleotide
  Target: SCN10A; (-) strand; PAM type: NRG; PAM sequence: AAG
accctaggacactcacctct

SEQ ID NO: 24410 - DNA, 20 bp, Artificial Sequence
  Description of Artificial Sequence: Synthetic oligonucleotide
  Target: SCN10A; (-) strand; PAM type: NRG; PAM sequence: AGG
aggggctctttgatgaccct

SEQ ID NO: 24411 - DNA, 20 bp, Artificial Sequence
  Description of Artificial Sequence: Synthetic oligonucleotide
  Target: SCN10A; (-) strand; PAM type: NRG; PAM sequence: TAG
aaggggctctttgatgaccc

SEQ ID NO: 24412 - DNA, 20 bp, Artificial Sequence
  Description of Artificial Sequence: Synthetic oligonucleotide
  Target: SCN10A; (-) strand; PAM type: NRG; PAM sequence: GGG
gtttcagagaatcattgaag

SEQ ID NO: 24413 - DNA, 20 bp, Artificial Sequence
  Description of Artificial Sequence: Synthetic oligonucleotide
  Target: SCN10A; (-) strand; PAM type: NRG; PAM sequence: GGG
ggtttcagagaatcattgaa

SEQ ID NO: 24414 - DNA, 20 bp, Artificial Sequence
  Description of Artificial Sequence: Synthetic oligonucleotide
  Target: SCN10A; (-) strand; PAM type: NRG; PAM sequence: AGG
tggtttcagagaatcattga

SEQ ID NO: 24415 - DNA, 20 bp, Artificial Sequence
  Description of Artificial Sequence: Synthetic oligonucleotide
  Target: SCN10A; (-) strand; PAM type: NRG; PAM sequence: AAG
ctggtttcagagaatcattg

SEQ ID NO: 24416 - DNA, 20 bp, Artificial Sequence
  Description of Artificial Sequence: Synthetic oligonucleotide
  Target: SCN10A; (-) strand; PAM type: NRG; PAM sequence: GAG
ctccccatgccctggtttca

SEQ ID NO: 24417 - DNA, 20 bp, Artificial Sequence
  Description of Artificial Sequence: Synthetic oligonucleotide
  Target: SCN10A; (-) strand; PAM type: NRG; PAM sequence: CAG
ctctccccatgccctggttt

SEQ ID NO: 24418 - DNA, 20 bp, Artificial Sequence
  Description of Artificial Sequence: Synthetic oligonucleotide
  Target: SCN10A; (-) strand; PAM type: NRG; PAM sequence: TGG
ttcctactctccccatgccc

SEQ ID NO: 24419 - DNA, 20 bp, Artificial Sequence
  Description of Artificial Sequence: Synthetic oligonucleotide
  Target: SCN10A; (-) strand; PAM type: NRG; PAM sequence: TAG
attgttaagaagggcaagac

SEQ ID NO: 24420 - DNA, 20 bp, Artificial Sequence
  Description of Artificial Sequence: Synthetic oligonucleotide
  Target: SCN10A; (-) strand; PAM type: NRG; PAM sequence: AAG
caaaaattgttaagaagggc

SEQ ID NO: 24421 - DNA, 20 bp, Artificial Sequence
  Description of Artificial Sequence: Synthetic oligonucleotide
  Target: SCN10A; (-) strand; PAM type: NRG; PAM sequence: GGG
gggtcaaaaattgttaagaa

SEQ ID NO: 24422 - DNA, 20 bp, Artificial Sequence
  Description of Artificial Sequence: Synthetic oligonucleotide
  Target: SCN10A; (-) strand; PAM type: NRG; PAM sequence: AGG
ggggtcaaaaattgttaaga

SEQ ID NO: 24423 - DNA, 20 bp, Artificial Sequence
  Description of Artificial Sequence: Synthetic oligonucleotide
  Target: SCN10A; (-) strand; PAM type: NRG; PAM sequence: AAG
gggggtcaaaaattgttaag

SEQ ID NO: 24424 - DNA, 20 bp, Artificial Sequence
  Description of Artificial Sequence: Synthetic oligonucleotide
  Target: SCN10A; (-) strand; PAM type: NRG; PAM sequence: AAG
gcagggggtcaaaaattgtt

SEQ ID NO: 24425 - DNA, 20 bp, Artificial Sequence
  Description of Artificial Sequence: Synthetic oligonucleotide
  Target: SCN10A; (-) strand; PAM type: NRG; PAM sequence: GGG
cagaaggtaaagagagcagg

SEQ ID NO: 24426 - DNA, 20 bp, Artificial Sequence
  Description of Artificial Sequence: Synthetic oligonucleotide
  Target: SCN10A; (-) strand; PAM type: NRG; PAM sequence: GGG
ccagaaggtaaagagagcag

SEQ ID NO: 24427 - DNA, 20 bp, Artificial Sequence
  Description of Artificial Sequence: Synthetic oligonucleotide
  Target: SCN10A; (-) strand; PAM type: NRG; PAM sequence: GGG
accagaaggtaaagagagca

SEQ ID NO: 24428 - DNA, 20 bp, Artificial Sequence
  Description of Artificial Sequence: Synthetic oligonucleotide
  Target: SCN10A; (-) strand; PAM type: NRG; PAM sequence: AGG
caccagaaggtaaagagagc

SEQ ID NO: 24429 - DNA, 20 bp, Artificial Sequence
  Description of Artificial Sequence: Synthetic oligonucleotide
  Target: SCN10A; (-) strand; PAM type: NRG; PAM sequence: CAG
gcaccagaaggtaaagagag

SEQ ID NO: 24430 - DNA, 20 bp, Artificial Sequence
  Description of Artificial Sequence: Synthetic oligonucleotide
  Target: SCN10A; (-) strand; PAM type: NRG; PAM sequence: GAG
tgggcaccagaaggtaaaga

SEQ ID NO: 24431 - DNA, 20 bp, Artificial Sequence
  Description of Artificial Sequence: Synthetic oligonucleotide
  Target: SCN10A; (-) strand; PAM type: NRG; PAM sequence: GAG
attgggcaccagaaggtaaa

SEQ ID NO: 24432 - DNA, 20 bp, Artificial Sequence
  Description of Artificial Sequence: Synthetic oligonucleotide
  Target: SCN10A; (-) strand; PAM type: NRG; PAM sequence: AAG
agattgggcaccagaaggta

SEQ ID NO: 24433 - DNA, 20 bp, Artificial Sequence
  Description of Artificial Sequence: Synthetic oligonucleotide
  Target: SCN10A; (-) strand; PAM type: NRG; PAM sequence: AGG
tcctcagattgggcaccaga

SEQ ID NO: 24434 - DNA, 20 bp, Artificial Sequence
  Description of Artificial Sequence: Synthetic oligonucleotide
  Target: SCN10A; (-) strand; PAM type: NRG; PAM sequence: AAG
ttcctcagattgggcaccag

SEQ ID NO: 24435 - DNA, 20 bp, Artificial Sequence
  Description of Artificial Sequence: Synthetic oligonucleotide
  Target: SCN10A; (-) strand; PAM type: NRG; PAM sequence: CAG
ttcttcctcagattgggcac

SEQ ID NO: 24436 - DNA, 20 bp, Artificial Sequence
  Description of Artificial Sequence: Synthetic oligonucleotide
  Target: SCN10A; (-) strand; PAM type: NRG; PAM sequence: GGG
tagaggttcttcctcagatt

SEQ ID NO: 24437 - DNA, 20 bp, Artificial Sequence
  Description of Artificial Sequence: Synthetic oligonucleotide
  Target: SCN10A; (-) strand; PAM type: NRG; PAM sequence: TGG
ctagaggttcttcctcagat

SEQ ID NO: 24438 - DNA, 20 bp, Artificial Sequence
  Description of Artificial Sequence: Synthetic oligonucleotide
  Target: SCN10A; (-) strand; PAM type: NRG; PAM sequence: CAG
agaaactagaggttcttcct

SEQ ID NO: 24439 - DNA, 20 bp, Artificial Sequence
  Description of Artificial Sequence: Synthetic oligonucleotide
  Target: SCN10A; (-) strand; PAM type: NRG; PAM sequence: AGG
tttgcttgggaagaaactag

SEQ ID NO: 24440 - DNA, 20 bp, Artificial Sequence
  Description of Artificial Sequence: Synthetic oligonucleotide
  Target: SCN10A; (-) strand; PAM type: NRG; PAM sequence: GAG
ttttgcttgggaagaaacta

SEQ ID NO: 24441 - DNA, 20 bp, Artificial Sequence
  Description of Artificial Sequence: Synthetic oligonucleotide
  Target: SCN10A; (-) strand; PAM type: NRG; PAM sequence: TAG
tcttttgcttgggaagaaac

SEQ ID NO: 24442 - DNA, 20 bp, Artificial Sequence
  Description of Artificial Sequence: Synthetic oligonucleotide
  Target: SCN10A; (-) strand; PAM type: NRG; PAM sequence: AAG
aatcccctcttttgcttggg

SEQ ID NO: 24443 - DNA, 20 bp, Artificial Sequence
  Description of Artificial Sequence: Synthetic oligonucleotide
  Target: SCN10A; (-) strand; PAM type: NRG; PAM sequence: GGG
tctaatcccctcttttgctt

SEQ ID NO: 24444 - DNA, 20 bp, Artificial Sequence
  Description of Artificial Sequence: Synthetic oligonucleotide
  Target: SCN10A; (-) strand; PAM type: NRG; PAM sequence: TGG
ttctaatcccctcttttgct

SEQ ID NO: 24445 - DNA, 20 bp, Artificial Sequence
  Description of Artificial Sequence: Synthetic oligonucleotide
  Target: SCN10A; (-) strand; PAM type: NRG; PAM sequence: TAG
tgcttgtggaaagataaaga

SEQ ID NO: 24446 - DNA, 20 bp, Artificial Sequence
  Description of Artificial Sequence: Synthetic oligonucleotide
  Target: SCN10A; (-) strand; PAM type: NRG; PAM sequence: AAG
tgtctgcttgtggaaagata

SEQ ID NO: 24447 - DNA, 20 bp, Artificial Sequence
  Description of Artificial Sequence: Synthetic oligonucleotide
  Target: SCN10A; (-) strand; PAM type: NRG; PAM sequence: AAG
cctatctgtctgcttgtgga

SEQ ID NO: 24448 - DNA, 20 bp, Artificial Sequence
  Description of Artificial Sequence: Synthetic oligonucleotide
  Target: SCN10A; (-) strand; PAM type: NRG; PAM sequence: TGG
cctgcctatctgtctgcttg

SEQ ID NO: 24449 - DNA, 20 bp, Artificial Sequence
  Description of Artificial Sequence: Synthetic oligonucleotide
  Target: SCN10A; (-) strand; PAM type: NRG; PAM sequence: TAG
caattacctgctgataatgg

SEQ ID NO: 24450 - DNA, 20 bp, Artificial Sequence
  Description of Artificial Sequence: Synthetic oligonucleotide
  Target: SCN10A; (-) strand; PAM type: NRG; PAM sequence: TGG
gcacaattacctgctgataa

SEQ ID NO: 24451 - DNA, 20 bp, Artificial Sequence
  Description of Artificial Sequence: Synthetic oligonucleotide
  Target: SCN10A; (-) strand; PAM type: NRG; PAM sequence: TAG
attattccttgctgaaacat

SEQ ID NO: 24452 - DNA, 20 bp, Artificial Sequence
  Description of Artificial Sequence: Synthetic oligonucleotide
  Target: SCN10A; (-) strand; PAM type: NRG; PAM sequence: CAG
aattgtagccagtgaggaat

SEQ ID NO: 24453 - DNA, 20 bp, Artificial Sequence
  Description of Artificial Sequence: Synthetic oligonucleotide
  Target: SCN10A; (-) strand; PAM type: NRG; PAM sequence: AGG
gcattaaattgtagccagtg

SEQ ID NO: 24454 - DNA, 20 bp, Artificial Sequence
  Description of Artificial Sequence: Synthetic oligonucleotide
  Target: SCN10A; (-) strand; PAM type: NRG; PAM sequence: GAG
agcattaaattgtagccagt

SEQ ID NO: 24455 - DNA, 20 bp, Artificial Sequence
  Description of Artificial Sequence: Synthetic oligonucleotide
  Target: SCN10A; (-) strand; PAM type: NRG; PAM sequence: CAG
aaaaagcattaaattgtagc

SEQ ID NO: 24456 - DNA, 20 bp, Artificial Sequence
  Description of Artificial Sequence: Synthetic oligonucleotide
  Target: SCN10A; (-) strand; PAM type: NRG; PAM sequence: TAG
tttgaaaaagcattaaattg

SEQ ID NO: 24457 - DNA, 20 bp, Artificial Sequence
  Description of Artificial Sequence: Synthetic oligonucleotide
  Target: SCN10A; (-) strand; PAM type: NRG; PAM sequence: AAG
catgctgtatacttttgaaa

SEQ ID NO: 24458 - DNA, 20 bp, Artificial Sequence
  Description of Artificial Sequence: Synthetic oligonucleotide
  Target: SCN10A; (-) strand; PAM type: NRG; PAM sequence: AAG
tgggatagactggggctcca

SEQ ID NO: 24459 - DNA, 20 bp, Artificial Sequence
  Description of Artificial Sequence: Synthetic oligonucleotide
  Target: SCN10A; (-) strand; PAM type: NRG; PAM sequence: GGG
aatgtccttgggatagactg

SEQ ID NO: 24460 - DNA, 20 bp, Artificial Sequence
  Description of Artificial Sequence: Synthetic oligonucleotide
  Target: SCN10A; (-) strand; PAM type: NRG; PAM sequence: GGG
aaatgtccttgggatagact

SEQ ID NO: 24461 - DNA, 20 bp, Artificial Sequence
  Description of Artificial Sequence: Synthetic oligonucleotide
  Target: SCN10A; (-) strand; PAM type: NRG; PAM sequence: TGG
taaatgtccttgggatagac

SEQ ID NO: 24462 - DNA, 20 bp, Artificial Sequence
  Description of Artificial Sequence: Synthetic oligonucleotide
  Target: SCN10A; (-) strand; PAM type: NRG; PAM sequence: TAG
gataataaatgtccttggga

SEQ ID NO: 24463 - DNA, 20 bp, Artificial Sequence
  Description of Artificial Sequence: Synthetic oligonucleotide
  Target: SCN10A; (-) strand; PAM type: NRG; PAM sequence: GGG
ggaagataataaatgtcctt

SEQ ID NO: 24464 - DNA, 20 bp, Artificial Sequence
  Description of Artificial Sequence: Synthetic oligonucleotide
  Target: SCN10A; (-) strand; PAM type: NRG; PAM sequence: TGG
aggaagataataaatgtcct

SEQ ID NO: 24465 - DNA, 20 bp, Artificial Sequence
  Description of Artificial Sequence: Synthetic oligonucleotide
  Target: SCN10A; (-) strand; PAM type: NRG; PAM sequence: AAG
tgttgctgagaacccagagg

SEQ ID NO: 24466 - DNA, 20 bp, Artificial Sequence
  Description of Artificial Sequence: Synthetic oligonucleotide
  Target: SCN10A; (-) strand; PAM type: NRG; PAM sequence: AGG
ctatgttgctgagaacccag

SEQ ID NO: 24467 - DNA, 20 bp, Artificial Sequence
  Description of Artificial Sequence: Synthetic oligonucleotide
  Target: SCN10A; (-) strand; PAM type: NRG; PAM sequence: GAG
cctatgttgctgagaaccca

SEQ ID NO: 24468 - DNA, 20 bp, Artificial Sequence
  Description of Artificial Sequence: Synthetic oligonucleotide
  Target: SCN10A; (-) strand; PAM type: NRG; PAM sequence: CAG
ttcctatgttgctgagaacc

SEQ ID NO: 24469 - DNA, 20 bp, Artificial Sequence
  Description of Artificial Sequence: Synthetic oligonucleotide
  Target: SCN10A; (-) strand; PAM type: NRG; PAM sequence: GAG
tagttgtttcctatgttgct

SEQ ID NO: 24470 - DNA, 20 bp, Artificial Sequence
  Description of Artificial Sequence: Synthetic oligonucleotide
  Target: SCN10A; (-) strand; PAM type: NRG; PAM sequence: TAG
tgcaaattgataatagccat

SEQ ID NO: 24471 - DNA, 20 bp, Artificial Sequence
  Description of Artificial Sequence: Synthetic oligonucleotide
  Target: SCN10A; (-) strand; PAM type: NRG; PAM sequence: TAG
tttgaaatgcaaattgataa

SEQ ID NO: 24472 - DNA, 20 bp, Artificial Sequence
  Description of Artificial Sequence: Synthetic oligonucleotide
  Target: SCN10A; (-) strand; PAM type: NRG; PAM sequence: TAG
cctcgtggaaataatcagac

SEQ ID NO: 24473 - DNA, 20 bp, Artificial Sequence
  Description of Artificial Sequence: Synthetic oligonucleotide
  Target: SCN10A; (-) strand; PAM type: NRG; PAM sequence: CAG
cttggcctcgtggaaataat

SEQ ID NO: 24474 - DNA, 20 bp, Artificial Sequence
  Description of Artificial Sequence: Synthetic oligonucleotide
  Target: SCN10A; (-) strand; PAM type: NRG; PAM sequence: TGG
gttcagcatccttggcctcg

SEQ ID NO: 24475 - DNA, 20 bp, Artificial Sequence
  Description of Artificial Sequence: Synthetic oligonucleotide
  Target: SCN10A; (-) strand; PAM type: NRG; PAM sequence: TGG
tggatgatgttcagcatcct

SEQ ID NO: 24476 - DNA, 20 bp, Artificial Sequence
  Description of Artificial Sequence: Synthetic oligonucleotide
  Target: SCN10A; (-) strand; PAM type: NRG; PAM sequence: CAG
gacaggtattggatgatgtt

SEQ ID NO: 24477 - DNA, 20 bp, Artificial Sequence
  Description of Artificial Sequence: Synthetic oligonucleotide
  Target: SCN10A; (-) strand; PAM type: NRG; PAM sequence: TGG
ggaatttatgtgacaggtat

SEQ ID NO: 24478 - DNA, 20 bp, Artificial Sequence
  Description of Artificial Sequence: Synthetic oligonucleotide
  Target: SCN10A; (-) strand; PAM type: NRG; PAM sequence: AGG
atcctgggaatttatgtgac

SEQ ID NO: 24479 - DNA, 20 bp, Artificial Sequence
  Description of Artificial Sequence: Synthetic oligonucleotide
  Target: SCN10A; (-) strand; PAM type: NRG; PAM sequence: CAG
aatcctgggaatttatgtga

SEQ ID NO: 24480 - DNA, 20 bp, Artificial Sequence
  Description of Artificial Sequence: Synthetic oligonucleotide
  Target: SCN10A; (-) strand; PAM type: NRG; PAM sequence: GGG
acctatatggtcacaatcct

SEQ ID NO: 24481 - DNA, 20 bp, Artificial Sequence
  Description of Artificial Sequence: Synthetic oligonucleotide
  Target: SCN10A; (-) strand; PAM type: NRG; PAM sequence: TGG
tacctatatggtcacaatcc

SEQ ID NO: 24482 - DNA, 20 bp, Artificial Sequence
  Description of Artificial Sequence: Synthetic oligonucleotide
  Target: SCN10A; (-) strand; PAM type: NRG; PAM sequence: TGG
catatacaaatctacctata

SEQ ID NO: 24483 - DNA, 20 bp, Artificial Sequence
  Description of Artificial Sequence: Synthetic oligonucleotide
  Target: SCN10A; (-) strand; PAM type: NRG; PAM sequence: AAG
ctttatatgcacactatgaa

SEQ ID NO: 24484 - DNA, 20 bp, Artificial Sequence
  Description of Artificial Sequence: Synthetic oligonucleotide
  Target: SCN10A; (-) strand; PAM type: NRG; PAM sequence: GAG
ttatcaaatccattctttag

SEQ ID NO: 24485 - DNA, 20 bp, Artificial Sequence
  Description of Artificial Sequence: Synthetic oligonucleotide
  Target: SCN10A; (-) strand; PAM type: NRG; PAM sequence: AGG
aattatcaaatccattcttt

SEQ ID NO: 24486 - DNA, 20 bp, Artificial Sequence
  Description of Artificial Sequence: Synthetic oligonucleotide
  Target: SCN10A; (-) strand; PAM type: NRG; PAM sequence: TAG
taattatcaaatccattctt

SEQ ID NO: 24487 - DNA, 20 bp, Artificial Sequence
  Description of Artificial Sequence: Synthetic oligonucleotide
  Target: SCN10A; (-) strand; PAM type: NRG; PAM sequence: CAG
agttggatcctttccattcc

SEQ ID NO: 24488 - DNA, 20 bp, Artificial Sequence
  Description of Artificial Sequence: Synthetic oligonucleotide
  Target: SCN10A; (-) strand; PAM type: NRG; PAM sequence: TGG
gccaaatcgtcttccaaagt

SEQ ID NO: 24489 - DNA, 20 bp, Artificial Sequence
  Description of Artificial Sequence: Synthetic oligonucleotide
  Target: SCN10A; (-) strand; PAM type: NRG; PAM sequence: AAG
tattgccaaatcgtcttcca

SEQ ID NO: 24490 - DNA, 20 bp, Artificial Sequence
  Description of Artificial Sequence: Synthetic oligonucleotide
  Target: SCN10A; (-) strand; PAM type: NRG; PAM sequence: GAG
gggtgtacattttaattttt

SEQ ID NO: 24491 - DNA, 20 bp, Artificial Sequence
  Description of Artificial Sequence: Synthetic oligonucleotide
  Target: SCN10A; (-) strand; PAM type: NRG; PAM sequence: GGG
gtagaattgccaggtcaaag

SEQ ID NO: 24492 - DNA, 20 bp, Artificial Sequence
  Description of Artificial Sequence: Synthetic oligonucleotide
  Target: SCN10A; (-) strand; PAM type: NRG; PAM sequence: GGG
agtagaattgccaggtcaaa

SEQ ID NO: 24493 - DNA, 20 bp, Artificial Sequence
  Description of Artificial Sequence: Synthetic oligonucleotide
  Target: SCN10A; (-) strand; PAM type: NRG; PAM sequence: AGG
aagtagaattgccaggtcaa

SEQ ID NO: 24494 - DNA, 20 bp, Artificial Sequence
  Description of Artificial Sequence: Synthetic oligonucleotide
  Target: SCN10A; (-) strand; PAM type: NRG; PAM sequence: AAG
gaagtagaattgccaggtca

SEQ ID NO: 24495 - DNA, 20 bp, Artificial Sequence
  Description of Artificial Sequence: Synthetic oligonucleotide
  Target: SCN10A; (-) strand; PAM type: NRG; PAM sequence: AGG
tttctagaagtagaattgcc

SEQ ID NO: 24496 - DNA, 20 bp, Artificial Sequence
  Description of Artificial Sequence: Synthetic oligonucleotide
  Target: SCN10A; (-) strand; PAM type: NRG; PAM sequence: CAG
atttctagaagtagaattgc

SEQ ID NO: 24497 - DNA, 20 bp, Artificial Sequence
  Description of Artificial Sequence: Synthetic oligonucleotide
  Target: SCN10A; (-) strand; PAM type: NRG; PAM sequence: TAG
taaggatgaatttctagaag

SEQ ID NO: 24498 - DNA, 20 bp, Artificial Sequence
  Description of Artificial Sequence: Synthetic oligonucleotide
  Target: SCN10A; (-) strand; PAM type: NRG; PAM sequence: AAG
aattaaggatgaatttctag

SEQ ID NO: 24499 - DNA, 20 bp, Artificial Sequence
  Description of Artificial Sequence: Synthetic oligonucleotide
  Target: SCN10A; (-) strand; PAM type: NRG; PAM sequence: TAG
taaaattaaggatgaatttc

SEQ ID NO: 24500 - DNA, 20 bp, Artificial Sequence
  Description of Artificial Sequence: Synthetic oligonucleotide
  Target: SCN10A; (-) strand; PAM type: NRG; PAM sequence: AGG
acataatatgagtaaaatta

SEQ ID NO: 24501 - DNA, 20 bp, Artificial Sequence
  Description of Artificial Sequence: Synthetic oligonucleotide
  Target: SCN10A; (-) strand; PAM type: NRG; PAM sequence: AAG
cacataatatgagtaaaatt

SEQ ID NO: 24502 - DNA, 20 bp, Artificial Sequence
  Description of Artificial Sequence: Synthetic oligonucleotide
  Target: SCN10A; (-) strand; PAM type: NRG; PAM sequence: GAG
tatctttgtacacataatat

SEQ ID NO: 24503 - DNA, 20 bp, Artificial Sequence
  Description of Artificial Sequence: Synthetic oligonucleotide
  Target: SCN10A; (-) strand; PAM type: NRG; PAM sequence: GAG
ccacatattaattttttggt

SEQ ID NO: 24504 - DNA, 20 bp, Artificial Sequence
  Description of Artificial Sequence: Synthetic oligonucleotide
  Target: SCN10A; (-) strand; PAM type: NRG; PAM sequence: TGG
gccaccacatattaattttt

SEQ ID NO: 24505 - DNA, 20 bp, Artificial Sequence
  Description of Artificial Sequence: Synthetic oligonucleotide
  Target: SCN10A; (-) strand; PAM type: NRG; PAM sequence: TAG
tttaactattttcctattga

SEQ ID NO: 24506 - DNA, 20 bp, Artificial Sequence
  Description of Artificial Sequence: Synthetic oligonucleotide
  Target: SCN10A; (-) strand; PAM type: NRG; PAM sequence: AAG
tcatttgcatggatgaagtg

SEQ ID NO: 24507 - DNA, 20 bp, Artificial Sequence
  Description of Artificial Sequence: Synthetic oligonucleotide
  Target: SCN10A; (-) strand; PAM type: NRG; PAM sequence: AAG
agatttcatttgcatggatg

SEQ ID NO: 24508 - DNA, 20 bp, Artificial Sequence
  Description of Artificial Sequence: Synthetic oligonucleotide
  Target: SCN10A; (-) strand; PAM type: NRG; PAM sequence: TGG
ctgaacagatttcatttgca

SEQ ID NO: 24509 - DNA, 20 bp, Artificial Sequence
  Description of Artificial Sequence: Synthetic oligonucleotide
  Target: SCN10A; (-) strand; PAM type: NRG; PAM sequence: CAG
ttttatagaaattagctgaa

SEQ ID NO: 24510 - DNA, 20 bp, Artificial Sequence
  Description of Artificial Sequence: Synthetic oligonucleotide
  Target: SCN10A; (-) strand; PAM type: NRG; PAM sequence: TAG
agcagctgttttatagaaat

SEQ ID NO: 24511 - DNA, 20 bp, Artificial Sequence
  Description of Artificial Sequence: Synthetic oligonucleotide
  Target: SCN10A; (-) strand; PAM type: NRG; PAM sequence: TAG
tcccagcagcagctgtttta

SEQ ID NO: 24512 - DNA, 20 bp, Artificial Sequence
  Description of Artificial Sequence: Synthetic oligonucleotide
  Target: SCN10A; (-) strand; PAM type: NRG; PAM sequence: CAG
ccccaaaaaaatcccagcag

SEQ ID NO: 24513 - DNA, 20 bp, Artificial Sequence
  Description of Artificial Sequence: Synthetic oligonucleotide
  Target: SCN10A; (-) strand; PAM type: NRG; PAM sequence: CAG
catccccaaaaaaatcccag

SEQ ID NO: 24514 - DNA, 20 bp, Artificial Sequence
  Description of Artificial Sequence: Synthetic oligonucleotide
  Target: SCN10A; (-) strand; PAM type: NRG; PAM sequence: CAG
tgacatccccaaaaaaatcc

SEQ ID NO: 24515 - DNA, 20 bp, Artificial Sequence
  Description of Artificial Sequence: Synthetic oligonucleotide
  Target: SCN10A; (-) strand; PAM type: NRG; PAM sequence: TAG
aatgtcagtgctgcccaaat

SEQ ID NO: 24516 - DNA, 20 bp, Artificial Sequence
  Description of Artificial Sequence: Synthetic oligonucleotide
  Target: SCN10A; (-) strand; PAM type: NRG; PAM sequence: CAG
attcataattgttagaatgt

SEQ ID NO: 24517 - DNA, 20 bp, Artificial Sequence
  Description of Artificial Sequence: Synthetic oligonucleotide
  Target: SCN10A; (-) strand; PAM type: NRG; PAM sequence: TAG
attagaagattcataattgt

SEQ ID NO: 24518 - DNA, 20 bp, Artificial Sequence
  Description of Artificial Sequence: Synthetic oligonucleotide
  Target: SCN10A; (-) strand; PAM type: NRG; PAM sequence: AAG
gtctcatgtgactggattag

SEQ ID NO: 24519 - DNA, 20 bp, Artificial Sequence
  Description of Artificial Sequence: Synthetic oligonucleotide
  Target: SCN10A; (-) strand; PAM type: NRG; PAM sequence: TAG
gatgtctcatgtgactggat

SEQ ID NO: 24520 - DNA, 20 bp, Artificial Sequence
  Description of Artificial Sequence: Synthetic oligonucleotide
  Target: SCN10A; (-) strand; PAM type: NRG; PAM sequence: TGG
taaaggatgtctcatgtgac

SEQ ID NO: 24521 - DNA, 20 bp, Artificial Sequence
  Description of Artificial Sequence: Synthetic oligonucleotide
  Target: SCN10A; (-) strand; PAM type: NRG; PAM sequence: AGG
aaagtacctaaatgaattaa

SEQ ID NO: 24522 - DNA, 20 bp, Artificial Sequence
  Description of Artificial Sequence: Synthetic oligonucleotide
  Target: SCN10A; (-) strand; PAM type: NRG; PAM sequence: AAG
taaagtacctaaatgaatta

SEQ ID NO: 24523 - DNA, 20 bp, Artificial Sequence
  Description of Artificial Sequence: Synthetic oligonucleotide
  Target: SCN10A; (-) strand; PAM type: NRG; PAM sequence: AAG
cattattgagagaaatttta

SEQ ID NO: 24524 - DNA, 20 bp, Artificial Sequence
  Description of Artificial Sequence: Synthetic oligonucleotide
  Target: SCN10A; (-) strand; PAM type: NRG; PAM sequence: GAG
aaataatacagcattattga

SEQ ID NO: 24525 - DNA, 20 bp, Artificial Sequence
  Description of Artificial Sequence: Synthetic oligonucleotide
  Target: SCN10A; (-) strand; PAM type: NRG; PAM sequence: GAG
aaaaataatacagcattatt

SEQ ID NO: 24526 - DNA, 20 bp, Artificial Sequence
  Description of Artificial Sequence: Synthetic oligonucleotide
  Target: SCN10A; (-) strand; PAM type: NRG; PAM sequence: CAG
ctttatactaaaaaataata

SEQ ID NO: 24527 - DNA, 20 bp, Artificial Sequence
  Description of Artificial Sequence: Synthetic oligonucleotide
  Target: SCN10A; (-) strand; PAM type: NRG; PAM sequence: AAG
gctgttgtaaaaatatgcac

SEQ ID NO: 24528 - DNA, 20 bp, Artificial Sequence
  Description of Artificial Sequence: Synthetic oligonucleotide
  Target: SCN10A; (-) strand; PAM type: NRG; PAM sequence: TAG
attacaaaatagaaaaacag

SEQ ID NO: 24529 - DNA, 20 bp, Artificial Sequence
  Description of Artificial Sequence: Synthetic oligonucleotide
  Target: SCN10A; (-) strand; PAM type: NRG; PAM sequence: CAG
taaattacaaaatagaaaaa

SEQ ID NO: 24530 - DNA, 20 bp, Artificial Sequence
  Description of Artificial Sequence: Synthetic oligonucleotide
  Target: SCN10A; (-) strand; PAM type: NRG; PAM sequence: TAG
aaaagcaataaattacaaaa

SEQ ID NO: 24531 - DNA, 20 bp, Artificial Sequence
  Description of Artificial Sequence: Synthetic oligonucleotide
  Target: SCN10A; (-) strand; PAM type: NRG; PAM sequence: AAG
aagaagttaataattataaa

SEQ ID NO: 24532 - DNA, 20 bp, Artificial Sequence
  Description of Artificial Sequence: Synthetic oligonucleotide
  Target: SCN10A; (-) strand; PAM type: NRG; PAM sequence: AAG
ggataacaaatgaaagaaag

SEQ ID NO: 24533 - DNA, 20 bp, Artificial Sequence
  Description of Artificial Sequence: Synthetic oligonucleotide
  Target: SCN10A; (-) strand; PAM type: NRG; PAM sequence: AAG
aaaggataacaaatgaaaga

SEQ ID NO: 24534 - DNA, 20 bp, Artificial Sequence
  Description of Artificial Sequence: Synthetic oligonucleotide
  Target: SCN10A; (-) strand; PAM type: NRG; PAM sequence: AAG
agaaaaaggataacaaatga

SEQ ID NO: 24535 - DNA, 20 bp, Artificial Sequence
  Description of Artificial Sequence: Synthetic oligonucleotide
  Target: SCN10A; (-) strand; PAM type: NRG; PAM sequence: AGG
gacctaacaaaactagaaaa

SEQ ID NO: 24536 - DNA, 20 bp, Artificial Sequence
  Description of Artificial Sequence: Synthetic oligonucleotide
  Target: SCN10A; (-) strand; PAM type: NRG; PAM sequence: AAG
agacctaacaaaactagaaa

SEQ ID NO: 24537 - DNA, 20 bp, Artificial Sequence
  Description of Artificial Sequence: Synthetic oligonucleotide
  Target: SCN10A; (-) strand; PAM type: NRG; PAM sequence: TAG
atttaaagacctaacaaaac

SEQ ID NO: 24538 - DNA, 20 bp, Artificial Sequence
  Description of Artificial Sequence: Synthetic oligonucleotide
  Target: SCN10A; (-) strand; PAM type: NRG; PAM sequence: AAG
agctgaaaagaaattattta

SEQ ID NO: 24539 - DNA, 20 bp, Artificial Sequence
  Description of Artificial Sequence: Synthetic oligonucleotide
  Target: SCN10A; (-) strand; PAM type: NRG; PAM sequence: AAG
ttatatcagtaaaagctgaa

SEQ ID NO: 24540 - DNA, 20 bp, Artificial Sequence
  Description of Artificial Sequence: Synthetic oligonucleotide
  Target: SCN10A; (-) strand; PAM type: NRG; PAM sequence: AAG
tagaatatttatatcagtaa

SEQ ID NO: 24541 - DNA, 20 bp, Artificial Sequence
  Description of Artificial Sequence: Synthetic oligonucleotide
  Target: SCN10A; (-) strand; PAM type: NRG; PAM sequence: CAG
gaagcatagaatatttatat

SEQ ID NO: 24542 - DNA, 20 bp, Artificial Sequence
  Description of Artificial Sequence: Synthetic oligonucleotide
  Target: SCN10A; (-) strand; PAM type: NRG; PAM sequence: TAG
taagtcacagcatggaagca

SEQ ID NO: 24543 - DNA, 20 bp, Artificial Sequence
  Description of Artificial Sequence: Synthetic oligonucleotide
  Target: SCN10A; (-) strand; PAM type: NRG; PAM sequence: AAG
gggaataagtcacagcatgg

SEQ ID NO: 24544 - DNA, 20 bp, Artificial Sequence
  Description of Artificial Sequence: Synthetic oligonucleotide
  Target: SCN10A; (-) strand; PAM type: NRG; PAM sequence: TGG
tcagggaataagtcacagca

SEQ ID NO: 24545 - DNA, 20 bp, Artificial Sequence
  Description of Artificial Sequence: Synthetic oligonucleotide
  Target: SCN10A; (-) strand; PAM type: NRG; PAM sequence: CAG
catattcagggaataagtca

SEQ ID NO: 24546 - DNA, 20 bp, Artificial Sequence
  Description of Artificial Sequence: Synthetic oligonucleotide
  Target: SCN10A; (-) strand; PAM type: NRG; PAM sequence: AAG
gacatacatattcagggaat

SEQ ID NO: 24547 - DNA, 20 bp, Artificial Sequence
  Description of Artificial Sequence: Synthetic oligonucleotide
  Target: SCN10A; (-) strand; PAM type: NRG; PAM sequence: GGG
gttaaagacatacatattca

SEQ ID NO: 24548 - DNA, 20 bp, Artificial Sequence
  Description of Artificial Sequence: Synthetic oligonucleotide
  Target: SCN10A; (-) strand; PAM type: NRG; PAM sequence: AGG
agttaaagacatacatattc

SEQ ID NO: 24549 - DNA, 20 bp, Artificial Sequence
  Description of Artificial Sequence: Synthetic oligonucleotide
  Target: SCN10A; (-) strand; PAM type: NRG; PAM sequence: CAG
cagttaaagacatacatatt

SEQ ID NO: 24550 - DNA, 20 bp, Artificial Sequence
  Description of Artificial Sequence: Synthetic oligonucleotide
  Target: SCN10A; (-) strand; PAM type: NRG; PAM sequence: AAG
gaacctagagagtgcagtta

SEQ ID NO: 24551 - DNA, 20 bp, Artificial Sequence
  Description of Artificial Sequence: Synthetic oligonucleotide
  Target: SCN10A; (-) strand; PAM type: NRG; PAM sequence: CAG
taatcagaacctagagagtg

SEQ ID NO: 24552 - DNA, 20 bp, Artificial Sequence
  Description of Artificial Sequence: Synthetic oligonucleotide
  Target: SCN10A; (-) strand; PAM type: NRG; PAM sequence: GAG
cagtttaatcagaacctaga

SEQ ID NO: 24553 - DNA, 20 bp, Artificial Sequence
  Description of Artificial Sequence: Synthetic oligonucleotide
  Target: SCN10A; (-) strand; PAM type: NRG; PAM sequence: GAG
aacagtttaatcagaaccta

SEQ ID NO: 24554 - DNA, 20 bp, Artificial Sequence
  Description of Artificial Sequence: Synthetic oligonucleotide
  Target: SCN10A; (-) strand; PAM type: NRG; PAM sequence: TAG
aaaacagtttaatcagaacc

SEQ ID NO: 24555 - DNA, 20 bp, Artificial Sequence
  Description of Artificial Sequence: Synthetic oligonucleotide
  Target: SCN10A; (-) strand; PAM type: NRG; PAM sequence: CAG
aagataaaaaacagtttaat

SEQ ID NO: 24556 - DNA, 20 bp, Artificial Sequence
  Description of Artificial Sequence: Synthetic oligonucleotide
  Target: SCN10A; (-) strand; PAM type: NRG; PAM sequence: CAG
agggaaggaaagataaaaaa

SEQ ID NO: 24557 - DNA, 20 bp, Artificial Sequence
  Description of Artificial Sequence: Synthetic oligonucleotide
  Target: SCN10A; (-) strand; PAM type: NRG; PAM sequence: AAG
atataatttcgagggaagga

SEQ ID NO: 24558 - DNA, 20 bp, Artificial Sequence
  Description of Artificial Sequence: Synthetic oligonucleotide
  Target: SCN10A; (-) strand; PAM type: NRG; PAM sequence: AGG
aattatataatttcgaggga

SEQ ID NO: 24559 - DNA, 20 bp, Artificial Sequence
  Description of Artificial Sequence: Synthetic oligonucleotide
  Target: SCN10A; (-) strand; PAM type: NRG; PAM sequence: AAG
aaattatataatttcgaggg

SEQ ID NO: 24560 - DNA, 20 bp, Artificial Sequence
  Description of Artificial Sequence: Synthetic oligonucleotide
  Target: SCN10A; (-) strand; PAM type: NRG; PAM sequence: GGG
ctaaaattatataatttcga

SEQ ID NO: 24561 - DNA, 20 bp, Artificial Sequence
  Description of Artificial Sequence: Synthetic oligonucleotide
  Target: SCN10A; (-) strand; PAM type: NRG; PAM sequence: AGG
actaaaattatataatttcg

SEQ ID NO: 24562 - DNA, 20 bp, Artificial Sequence
  Description of Artificial Sequence: Synthetic oligonucleotide
  Target: SCN10A; (-) strand; PAM type: NRG; PAM sequence: GAG
aactaaaattatataatttc

SEQ ID NO: 24563 - DNA, 20 bp, Artificial Sequence
  Description of Artificial Sequence: Synthetic oligonucleotide
  Target: SCN10A; (-) strand; PAM type: NRG; PAM sequence: AAG
cttaaagaattcttggacaa

SEQ ID NO: 24564 - DNA, 20 bp, Artificial Sequence
  Description of Artificial Sequence: Synthetic oligonucleotide
  Target: SCN10A; (-) strand; PAM type: NRG; PAM sequence: TGG
aatctctcttaaagaattct

SEQ ID NO: 24565 - DNA, 20 bp, Artificial Sequence
  Description of Artificial Sequence: Synthetic oligonucleotide
  Target: SCN10A; (-) strand; PAM type: NRG; PAM sequence: AAG
atttttaaaaatctctctta

SEQ ID NO: 24566 - DNA, 20 bp, Artificial Sequence
  Description of Artificial Sequence: Synthetic oligonucleotide
  Target: SCN10A; (-) strand; PAM type: NRG; PAM sequence: AGG
accaaatttaatgaaatgag

SEQ ID NO: 24567 - DNA, 20 bp, Artificial Sequence
  Description of Artificial Sequence: Synthetic oligonucleotide
  Target: SCN10A; (-) strand; PAM type: NRG; PAM sequence: GAG
aaccaaatttaatgaaatga

SEQ ID NO: 24568 - DNA, 20 bp, Artificial Sequence
  Description of Artificial Sequence: Synthetic oligonucleotide
  Target: SCN10A; (-) strand; PAM type: NRG; PAM sequence: GAG
ataaccaaatttaatgaaat

SEQ ID NO: 24569 - DNA, 20 bp, Artificial Sequence
  Description of Artificial Sequence: Synthetic oligonucleotide
  Target: SCN10A; (-) strand; PAM type: NRG; PAM sequence: GAG
tctctgatcataatgaaata

SEQ ID NO: 24570 - DNA, 20 bp, Artificial Sequence
  Description of Artificial Sequence: Synthetic oligonucleotide
  Target: SCN10A; (-) strand; PAM type: NRG; PAM sequence: TAG
attctctgatcataatgaaa

SEQ ID NO: 24571 - DNA, 20 bp, Artificial Sequence
  Description of Artificial Sequence: Synthetic oligonucleotide
  Target: SCN10A; (-) strand; PAM type: NRG; PAM sequence: TAG
tccagaaagtggaaataata

SEQ ID NO: 24572 - DNA, 20 bp, Artificial Sequence
  Description of Artificial Sequence: Synthetic oligonucleotide
  Target: SCN10A; (-) strand; PAM type: NRG; PAM sequence: TGG
cctcaataagctccagaaag

SEQ ID NO: 24573 - DNA, 20 bp, Artificial Sequence
  Description of Artificial Sequence: Synthetic oligonucleotide
  Target: SCN10A; (-) strand; PAM type: NRG; PAM sequence: AAG
aaacctcaataagctccaga

SEQ ID NO: 24574 - DNA, 20 bp, Artificial Sequence
  Description of Artificial Sequence: Synthetic oligonucleotide
  Target: SCN10A; (-) strand; PAM type: NRG; PAM sequence: CAG
acaaaaacctcaataagctc

SEQ ID NO: 24575 - DNA, 20 bp, Artificial Sequence
  Description of Artificial Sequence: Synthetic oligonucleotide
  Target: SCN10A; (-) strand; PAM type: NRG; PAM sequence: AAG
gccatgacaaaaacctcaat

SEQ ID NO: 24576 - DNA, 20 bp, Artificial Sequence
  Description of Artificial Sequence: Synthetic oligonucleotide
  Target: SCN10A; (-) strand; PAM type: NRG; PAM sequence: AAG
aacatatcaaaccaaatatt

SEQ ID NO: 24577 - DNA, 20 bp, Artificial Sequence
  Description of Artificial Sequence: Synthetic oligonucleotide
  Target: SCN10A; (-) strand; PAM type: NRG; PAM sequence: TAG
caaactaccttccctaacaa

SEQ ID NO: 24578 - DNA, 20 bp, Artificial Sequence
  Description of Artificial Sequence: Synthetic oligonucleotide
  Target: SCN10A; (-) strand; PAM type: NRG; PAM sequence: TAG
taatgtatctgattaatata

SEQ ID NO: 24579 - DNA, 20 bp, Artificial Sequence
  Description of Artificial Sequence: Synthetic oligonucleotide
  Target: SCN10A; (-) strand; PAM type: NRG; PAM sequence: TAG
atgtaaaattatagatgacc

SEQ ID NO: 24580 - DNA, 20 bp, Artificial Sequence
  Description of Artificial Sequence: Synthetic oligonucleotide
  Target: SCN10A; (-) strand; PAM type: NRG; PAM sequence: TAG
ttaaaaagtatgtaaaatta

SEQ ID NO: 24581 - DNA, 20 bp, Artificial Sequence
  Description of Artificial Sequence: Synthetic oligonucleotide
  Target: SCN10A; (-) strand; PAM type: NRG; PAM sequence: AAG
aacagatcaaatgtattaaa

SEQ ID NO: 24582 - DNA, 20 bp, Artificial Sequence
  Description of Artificial Sequence: Synthetic oligonucleotide
  Target: SCN10A; (-) strand; PAM type: NRG; PAM sequence: CAG
caattaattttagccaataa

SEQ ID NO: 24583 - DNA, 20 bp, Artificial Sequence
  Description of Artificial Sequence: Synthetic oligonucleotide
  Target: SCN10A; (-) strand; PAM type: NRG; PAM sequence: TAG
tagaaattttcaattaattt

SEQ ID NO: 24584 - DNA, 20 bp, Artificial Sequence
  Description of Artificial Sequence: Synthetic oligonucleotide
  Target: SCN10A; (-) strand; PAM type: NRG; PAM sequence: TAG
aaataaaaacattgtaggaa

SEQ ID NO: 24585 - DNA, 20 bp, Artificial Sequence
  Description of Artificial Sequence: Synthetic oligonucleotide
  Target: SCN10A; (-) strand; PAM type: NRG; PAM sequence: AGG
aggataaataaaaacattgt

SEQ ID NO: 24586 - DNA, 20 bp, Artificial Sequence
  Description of Artificial Sequence: Synthetic oligonucleotide
  Target: SCN10A; (-) strand; PAM type: NRG; PAM sequence: TAG
gaggataaataaaaacattg

SEQ ID NO: 24587 - DNA, 20 bp, Artificial Sequence
  Description of Artificial Sequence: Synthetic oligonucleotide
  Target: SCN10A; (-) strand; PAM type: NRG; PAM sequence: AGG
tcagaaattattagagtagg

SEQ ID NO: 24588 - DNA, 20 bp, Artificial Sequence
  Description of Artificial Sequence: Synthetic oligonucleotide
  Target: SCN10A; (-) strand; PAM type: NRG; PAM sequence: GAG
atcagaaattattagagtag

SEQ ID NO: 24589 - DNA, 20 bp, Artificial Sequence
  Description of Artificial Sequence: Synthetic oligonucleotide
  Target: SCN10A; (-) strand; PAM type: NRG; PAM sequence: AGG
aaatcagaaattattagagt

SEQ ID NO: 24590 - DNA, 20 bp, Artificial Sequence
  Description of Artificial Sequence: Synthetic oligonucleotide
  Target: SCN10A; (-) strand; PAM type: NRG; PAM sequence: TAG
taaatcagaaattattagag

SEQ ID NO: 24591 - DNA, 20 bp, Artificial Sequence
  Description of Artificial Sequence: Synthetic oligonucleotide
  Target: SCN10A; (-) strand; PAM type: NRG; PAM sequence: GAG
ttataaatcagaaattatta

SEQ ID NO: 24592 - DNA, 20 bp, Artificial Sequence
  Description of Artificial Sequence: Synthetic oligonucleotide
  Target: SCN10A; (-) strand; PAM type: NRG; PAM sequence: TAG
atttataaatcagaaattat

SEQ ID NO: 24593 - DNA, 20 bp, Artificial Sequence
  Description of Artificial Sequence: Synthetic oligonucleotide
  Target: SCN10A; (-) strand; PAM type: NRG; PAM sequence: CAG
tggcaacaatatttataaat

SEQ ID NO: 24594 - DNA, 20 bp, Artificial Sequence
  Description of Artificial Sequence: Synthetic oligonucleotide
  Target: SCN10A; (-) strand; PAM type: NRG; PAM sequence: TGG
tatctttgcaacaaataaga

SEQ ID NO: 24595 - DNA, 20 bp, Artificial Sequence
  Description of Artificial Sequence: Synthetic oligonucleotide
  Target: SCN10A; (-) strand; PAM type: NRG; PAM sequence: AAG
tctatatctttgcaacaaat

SEQ ID NO: 24596 - DNA, 20 bp, Artificial Sequence
  Description of Artificial Sequence: Synthetic oligonucleotide
  Target: SCN10A; (-) strand; PAM type: NRG; PAM sequence: TAG
catattaatattaaagacga

SEQ ID NO: 24597 - DNA, 20 bp, Artificial Sequence
  Description of Artificial Sequence: Synthetic oligonucleotide
  Target: SCN10A; (-) strand; PAM type: NRG; PAM sequence: AAG
gcacagacatattaatatta

SEQ ID NO: 24598 - DNA, 20 bp, Artificial Sequence
  Description of Artificial Sequence: Synthetic oligonucleotide
  Target: SCN10A; (-) strand; PAM type: NRG; PAM sequence: CAG
gaaataggacaaaaattgca

SEQ ID NO: 24599 - DNA, 20 bp, Artificial Sequence
  Description of Artificial Sequence: Synthetic oligonucleotide
  Target: SCN10A; (-) strand; PAM type: NRG; PAM sequence: AGG
tcggtcaaaaagcatgaaat

SEQ ID NO: 24600 - DNA, 20 bp, Artificial Sequence
  Description of Artificial Sequence: Synthetic oligonucleotide
  Target: SCN10A; (-) strand; PAM type: NRG; PAM sequence: TAG
ctcggtcaaaaagcatgaaa

SEQ ID NO: 24601 - DNA, 20 bp, Artificial Sequence
  Description of Artificial Sequence: Synthetic oligonucleotide
  Target: SCN10A; (-) strand; PAM type: NRG; PAM sequence: AAG
aaagtggaatctcggtcaaa

SEQ ID NO: 24602 - DNA, 20 bp, Artificial Sequence
  Description of Artificial Sequence: Synthetic oligonucleotide
  Target: SCN10A; (-) strand; PAM type: NRG; PAM sequence: CGG
tatcagagaaagtggaatct

SEQ ID NO: 24603 - DNA, 20 bp, Artificial Sequence
  Description of Artificial Sequence: Synthetic oligonucleotide
  Target: SCN10A; (-) strand; PAM type: NRG; PAM sequence: TGG
gattttaatatcagagaaag

SEQ ID NO: 24604 - DNA, 20 bp, Artificial Sequence
  Description of Artificial Sequence: Synthetic oligonucleotide
  Target: SCN10A; (-) strand; PAM type: NRG; PAM sequence: AAG
catgattttaatatcagaga

SEQ ID NO: 24605 - DNA, 20 bp, Artificial Sequence
  Description of Artificial Sequence: Synthetic oligonucleotide
  Target: SCN10A; (-) strand; PAM type: NRG; PAM sequence: GAG
gatccatgattttaatatca

SEQ ID NO: 24606 - DNA, 20 bp, Artificial Sequence
  Description of Artificial Sequence: Synthetic oligonucleotide
  Target: SCN10A; (-) strand; PAM type: NRG; PAM sequence: CAG
aggatccatgattttaatat

SEQ ID NO: 24607 - DNA, 20 bp, Artificial Sequence
  Description of Artificial Sequence: Synthetic oligonucleotide
  Target: SCN10A; (-) strand; PAM type: NRG; PAM sequence: AGG
caaaggcaaacaaagaaagc

SEQ ID NO: 24608 - DNA, 20 bp, Artificial Sequence
  Description of Artificial Sequence: Synthetic oligonucleotide
  Target: SCN10A; (-) strand; PAM type: NRG; PAM sequence: CAG
gcaaaggcaaacaaagaaag

SEQ ID NO: 24609 - DNA, 20 bp, Artificial Sequence
  Description of Artificial Sequence: Synthetic oligonucleotide
  Target: SCN10A; (-) strand; PAM type: NRG; PAM sequence: AAG
taagcaaaggcaaacaaaga

SEQ ID NO: 24610 - DNA, 20 bp, Artificial Sequence
  Description of Artificial Sequence: Synthetic oligonucleotide
  Target: SCN10A; (-) strand; PAM type: NRG; PAM sequence: AAG
gacataagcaaaggcaaaca

SEQ ID NO: 24611 - DNA, 20 bp, Artificial Sequence
  Description of Artificial Sequence: Synthetic oligonucleotide
  Target: SCN10A; (-) strand; PAM type: NRG; PAM sequence: AGG
aattcaaaagacataagcaa

SEQ ID NO: 24612 - DNA, 20 bp, Artificial Sequence
  Description of Artificial Sequence: Synthetic oligonucleotide
  Target: SCN10A; (-) strand; PAM type: NRG; PAM sequence: AAG
gaattcaaaagacataagca

SEQ ID NO: 24613 - DNA, 20 bp, Artificial Sequence
  Description of Artificial Sequence: Synthetic oligonucleotide
  Target: SCN10A; (-) strand; PAM type: NRG; PAM sequence: AAG
ttatagaattcaaaagacat

SEQ ID NO: 24614 - DNA, 20 bp, Artificial Sequence
  Description of Artificial Sequence: Synthetic oligonucleotide
  Target: SCN10A; (-) strand; PAM type: NRG; PAM sequence: AAG
gctaaaattatagaattcaa

SEQ ID NO: 24615 - DNA, 20 bp, Artificial Sequence
  Description of Artificial Sequence: Synthetic oligonucleotide
  Target: SCN10A; (-) strand; PAM type: NRG; PAM sequence: TAG
atacagaaaggctaaaatta

SEQ ID NO: 24616 - DNA, 20 bp, Artificial Sequence
  Description of Artificial Sequence: Synthetic oligonucleotide
  Target: SCN10A; (-) strand; PAM type: NRG; PAM sequence: AGG
ctcctcacggtgatacagaa

SEQ ID NO: 24617 - DNA, 20 bp, Artificial Sequence
  Description of Artificial Sequence: Synthetic oligonucleotide
  Target: SCN10A; (-) strand; PAM type: NRG; PAM sequence: AAG
actcctcacggtgatacaga

SEQ ID NO: 24618 - DNA, 20 bp, Artificial Sequence
  Description of Artificial Sequence: Synthetic oligonucleotide
  Target: SCN10A; (-) strand; PAM type: NRG; PAM sequence: CAG
aaatactcctcacggtgata

SEQ ID NO: 24619 - DNA, 20 bp, Artificial Sequence
  Description of Artificial Sequence: Synthetic oligonucleotide
  Target: SCN10A; (-) strand; PAM type: NRG; PAM sequence: CGG
aataaaaaaaatactcctca

SEQ ID NO: 24620 - DNA, 20 bp, Artificial Sequence
  Description of Artificial Sequence: Synthetic oligonucleotide
  Target: SCN10A; (-) strand; PAM type: NRG; PAM sequence: AAG
aaaatgcctattacattaca

SEQ ID NO: 24621 - DNA, 20 bp, Artificial Sequence
  Description of Artificial Sequence: Synthetic oligonucleotide
  Target: SCN10A; (-) strand; PAM type: NRG; PAM sequence: TGG
gtcatgtcactaaatataaa

SEQ ID NO: 24622 - DNA, 20 bp, Artificial Sequence
  Description of Artificial Sequence: Synthetic oligonucleotide
  Target: SCN10A; (-) strand; PAM type: NRG; PAM sequence: AAG
aatataaacaagctaagact

SEQ ID NO: 24623 - DNA, 20 bp, Artificial Sequence
  Description of Artificial Sequence: Synthetic oligonucleotide
  Target: SCN10A; (-) strand; PAM type: NRG; PAM sequence: AAG
tgaaataatataaacaagct

SEQ ID NO: 24624 - DNA, 20 bp, Artificial Sequence
  Description of Artificial Sequence: Synthetic oligonucleotide
  Target: SCN10A; (-) strand; PAM type: NRG; PAM sequence: AAG
tcatatgaaataatataaac

SEQ ID NO: 24625 - DNA, 20 bp, Artificial Sequence
  Description of Artificial Sequence: Synthetic oligonucleotide
  Target: SCN10A; (-) strand; PAM type: NRG; PAM sequence: CGG
gaatgtattccaatatcaaa

SEQ ID NO: 24626 - DNA, 20 bp, Artificial Sequence
  Description of Artificial Sequence: Synthetic oligonucleotide
  Target: SCN10A; (-) strand; PAM type: NRG; PAM sequence: AAG
taacatggtcacatttattt

SEQ ID NO: 24627 - DNA, 20 bp, Artificial Sequence
  Description of Artificial Sequence: Synthetic oligonucleotide
  Target: SCN10A; (-) strand; PAM type: NRG; PAM sequence: TGG
cattaaaatgatgtataaca

SEQ ID NO: 24628 - DNA, 20 bp, Artificial Sequence
  Description of Artificial Sequence: Synthetic oligonucleotide
  Target: SCN10A; (-) strand; PAM type: NRG; PAM sequence: GAG
tcattagcaaaaaaaaaagt

SEQ ID NO: 24629 - DNA, 20 bp, Artificial Sequence
  Description of Artificial Sequence: Synthetic oligonucleotide
  Target: SCN10A; (-) strand; PAM type: NRG; PAM sequence: AAG
taagtcattagcaaaaaaaa

SEQ ID NO: 24630 - DNA, 20 bp, Artificial Sequence
  Description of Artificial Sequence: Synthetic oligonucleotide
  Target: SCN10A; (-) strand; PAM type: NRG; PAM sequence: TAG
aacagcaagtaataagtcat

SEQ ID NO: 24631 - DNA, 20 bp, Artificial Sequence
  Description of Artificial Sequence: Synthetic oligonucleotide
  Target: SCN10A; (-) strand; PAM type: NRG; PAM sequence: AAG
taaaataaacagcaagtaat

SEQ ID NO: 24632 - DNA, 20 bp, Artificial Sequence
  Description of Artificial Sequence: Synthetic oligonucleotide
  Target: SCN10A; (-) strand; PAM type: NRG; PAM sequence: AAG
ataaatataaaataaacagc

SEQ ID NO: 24633 - DNA, 20 bp, Artificial Sequence
  Description of Artificial Sequence: Synthetic oligonucleotide
  Target: SCN10A; (-) strand; PAM type: NRG; PAM sequence: CAG
taaaataaatataaaataaa

SEQ ID NO: 24634 - DNA, 20 bp, Artificial Sequence
  Description of Artificial Sequence: Synthetic oligonucleotide
  Target: SCN10A; (-) strand; PAM type: NRG; PAM sequence: TAG
tttgtataacataatttcca

SEQ ID NO: 24635 - DNA, 20 bp, Artificial Sequence
  Description of Artificial Sequence: Synthetic oligonucleotide
  Target: SCN10A; (-) strand; PAM type: NRG; PAM sequence: AAG
aacccattttgaactcaaat

SEQ ID NO: 24636 - DNA, 20 bp, Artificial Sequence
  Description of Artificial Sequence: Synthetic oligonucleotide
  Target: SCN10A; (-) strand; PAM type: NRG; PAM sequence: GAG
ccaaatgcgttgttgatgtt

SEQ ID NO: 24637 - DNA, 20 bp, Artificial Sequence
  Description of Artificial Sequence: Synthetic oligonucleotide
  Target: SCN10A; (-) strand; PAM type: NRG; PAM sequence: GGG
tacctttgttagcaatccct

SEQ ID NO: 24638 - DNA, 20 bp, Artificial Sequence
  Description of Artificial Sequence: Synthetic oligonucleotide
  Target: SCN10A; (-) strand; PAM type: NRG; PAM sequence: TGG
gtacctttgttagcaatccc

SEQ ID NO: 24639 - DNA, 20 bp, Artificial Sequence
  Description of Artificial Sequence: Synthetic oligonucleotide
  Target: SCN10A; (-) strand; PAM type: NRG; PAM sequence: TAG
ccactgcactgtacctttgt

SEQ ID NO: 24640 - DNA, 20 bp, Artificial Sequence
  Description of Artificial Sequence: Synthetic oligonucleotide
  Target: SCN10A; (-) strand; PAM type: NRG; PAM sequence: AGG
cactactctcctcatcttca

SEQ ID NO: 24641 - DNA, 20 bp, Artificial Sequence
  Description of Artificial Sequence: Synthetic oligonucleotide
  Target: SCN10A; (-) strand; PAM type: NRG; PAM sequence: AAG
ccactactctcctcatcttc

SEQ ID NO: 24642 - DNA, 20 bp, Artificial Sequence
  Description of Artificial Sequence: Synthetic oligonucleotide
  Target: SCN10A; (-) strand; PAM type: NRG; PAM sequence: CAG
cattgtcaacttccaatggc

SEQ ID NO: 24643 - DNA, 20 bp, Artificial Sequence
  Description of Artificial Sequence: Synthetic oligonucleotide
  Target: SCN10A; (-) strand; PAM type: NRG; PAM sequence: TGG
tggtcattgtcaacttccaa

SEQ ID NO: 24644 - DNA, 20 bp, Artificial Sequence
  Description of Artificial Sequence: Synthetic oligonucleotide
  Target: SCN10A; (-) strand; PAM type: NRG; PAM sequence: TGG
cttcgatgattgctctcaat

SEQ ID NO: 24645 - DNA, 20 bp, Artificial Sequence
  Description of Artificial Sequence: Synthetic oligonucleotide
  Target: SCN10A; (-) strand; PAM type: NRG; PAM sequence: AGG
gcttcttgtgcagttgtaag

SEQ ID NO: 24646 - DNA, 20 bp, Artificial Sequence
  Description of Artificial Sequence: Synthetic oligonucleotide
  Target: SCN10A; (-) strand; PAM type: NRG; PAM sequence: GAG
agcttcttgtgcagttgtaa

SEQ ID NO: 24647 - DNA, 20 bp, Artificial Sequence
  Description of Artificial Sequence: Synthetic oligonucleotide
  Target: SCN10A; (-) strand; PAM type: NRG; PAM sequence: AAG
tcagcttcttgtgcagttgt

SEQ ID NO: 24648 - DNA, 20 bp, Artificial Sequence
  Description of Artificial Sequence: Synthetic oligonucleotide
  Target: SCN10A; (-) strand; PAM type: NRG; PAM sequence: CAG
ttcttcctcagcttcttgtg

SEQ ID NO: 24649 - DNA, 20 bp, Artificial Sequence
  Description of Artificial Sequence: Synthetic oligonucleotide
  Target: SCN10A; (-) strand; PAM type: NRG; PAM sequence: CAG
gtcaacgatgagttcttcct

SEQ ID NO: 24650 - DNA, 20 bp, Artificial Sequence
  Description of Artificial Sequence: Synthetic oligonucleotide
  Target: SCN10A; (-) strand; PAM type: NRG; PAM sequence: GAG
accgtagaatggtcaacgat

SEQ ID NO: 24651 - DNA, 20 bp, Artificial Sequence
  Description of Artificial Sequence: Synthetic oligonucleotide
  Target: SCN10A; (-) strand; PAM type: NRG; PAM sequence: TGG
actgccgaatgaccgtagaa

SEQ ID NO: 24652 - DNA, 20 bp, Artificial Sequence
  Description of Artificial Sequence: Synthetic oligonucleotide
  Target: SCN10A; (-) strand; PAM type: NRG; PAM sequence: TAG
cttcaactgccgaatgaccg

SEQ ID NO: 24653 - DNA, 20 bp, Artificial Sequence
  Description of Artificial Sequence: Synthetic oligonucleotide
  Target: SCN10A; (-) strand; PAM type: NRG; PAM sequence: GAG
ttatgaggcacccatttatg

SEQ ID NO: 24654 - DNA, 20 bp, Artificial Sequence
  Description of Artificial Sequence: Synthetic oligonucleotide
  Target: SCN10A; (-) strand; PAM type: NRG; PAM sequence: TGG
gcttatgaggcacccattta

SEQ ID NO: 24655 - DNA, 20 bp, Artificial Sequence
  Description of Artificial Sequence: Synthetic oligonucleotide
  Target: SCN10A; (-) strand; PAM type: NRG; PAM sequence: AGG
acatttttccttagcttatg

SEQ ID NO: 24656 - DNA, 20 bp, Artificial Sequence
  Description of Artificial Sequence: Synthetic oligonucleotide
  Target: SCN10A; (-) strand; PAM type: NRG; PAM sequence: GAG
aacatttttccttagcttat

SEQ ID NO: 24657 - DNA, 20 bp, Artificial Sequence
  Description of Artificial Sequence: Synthetic oligonucleotide
  Target: SCN10A; (-) strand; PAM type: NRG; PAM sequence: TAG
attttttaaacatttttcct

SEQ ID NO: 24658 - DNA, 20 bp, Artificial Sequence
  Description of Artificial Sequence: Synthetic oligonucleotide
  Target: SCN10A; (-) strand; PAM type: NRG; PAM sequence: GAG
atttttgttgcatagaataa

SEQ ID NO: 24659 - DNA, 20 bp, Artificial Sequence
  Description of Artificial Sequence: Synthetic oligonucleotide
  Target: SCN10A; (-) strand; PAM type: NRG; PAM sequence: AAG
tcatttttgttgcatagaat

SEQ ID NO: 24660 - DNA, 20 bp, Artificial Sequence
  Description of Artificial Sequence: Synthetic oligonucleotide
  Target: SCN10A; (-) strand; PAM type: NRG; PAM sequence: TAG
aatagttcatttttgttgca

SEQ ID NO: 24661 - DNA, 20 bp, Artificial Sequence
  Description of Artificial Sequence: Synthetic oligonucleotide
  Target: SCN10A; (-) strand; PAM type: NRG; PAM sequence: TAG
atcacaatctgattaagaaa

SEQ ID NO: 24662 - DNA, 20 bp, Artificial Sequence
  Description of Artificial Sequence: Synthetic oligonucleotide
  Target: SCN10A; (-) strand; PAM type: NRG; PAM sequence: AAG
tcgcacatcacaatctgatt

SEQ ID NO: 24663 - DNA, 20 bp, Artificial Sequence
  Description of Artificial Sequence: Synthetic oligonucleotide
  Target: SCN10A; (-) strand; PAM type: NRG; PAM sequence: AAG
gctggtcattgccagttgtc

SEQ ID NO: 24664 - DNA, 20 bp, Artificial Sequence
  Description of Artificial Sequence: Synthetic oligonucleotide
  Target: SCN10A; (-) strand; PAM type: NRG; PAM sequence: CAG
gccaccaagctggtcattgc

SEQ ID NO: 24665 - DNA, 20 bp, Artificial Sequence
  Description of Artificial Sequence: Synthetic oligonucleotide
  Target: SCN10A; (-) strand; PAM type: NRG; PAM sequence: TGG
tctcagtccagccaccaagc

SEQ ID NO: 24666 - DNA, 20 bp, Artificial Sequence
  Description of Artificial Sequence: Synthetic oligonucleotide
  Target: SCN10A; (-) strand; PAM type: NRG; PAM sequence: AAG
ttcttctcagtccagccacc

SEQ ID NO: 24667 - DNA, 20 bp, Artificial Sequence
  Description of Artificial Sequence: Synthetic oligonucleotide
  Target: SCN10A; (-) strand; PAM type: NRG; PAM sequence: CAG
tttggagcttcttctcagtc

SEQ ID NO: 24668 - DNA, 20 bp, Artificial Sequence
  Description of Artificial Sequence: Synthetic oligonucleotide
  Target: SCN10A; (-) strand; PAM type: NRG; PAM sequence: CAG
agtgctttggagcttcttct

SEQ ID NO: 24669 - DNA, 20 bp, Artificial Sequence
  Description of Artificial Sequence: Synthetic oligonucleotide
  Target: SCN10A; (-) strand; PAM type: NRG; PAM sequence: GAG
gggttttgggaagtgctttg

SEQ ID NO: 24670 - DNA, 20 bp, Artificial Sequence
  Description of Artificial Sequence: Synthetic oligonucleotide
  Target: SCN10A; (-) strand; PAM type: NRG; PAM sequence: TGG
ttgggttttgggaagtgctt

SEQ ID NO: 24671 - DNA, 20 bp, Artificial Sequence
  Description of Artificial Sequence: Synthetic oligonucleotide
  Target: SCN10A; (-) strand; PAM type: NRG; PAM sequence: AAG
ggtgcaagttgggttttggg

SEQ ID NO: 24672 - DNA, 20 bp, Artificial Sequence
  Description of Artificial Sequence: Synthetic oligonucleotide
  Target: SCN10A; (-) strand; PAM type: NRG; PAM sequence: GGG
tttggtgcaagttgggtttt

SEQ ID NO: 24673 - DNA, 20 bp, Artificial Sequence
  Description of Artificial Sequence: Synthetic oligonucleotide
  Target: SCN10A; (-) strand; PAM type: NRG; PAM sequence: TGG
ttttggtgcaagttgggttt

SEQ ID NO: 24674 - DNA, 20 bp, Artificial Sequence
  Description of Artificial Sequence: Synthetic oligonucleotide
  Target: SCN10A; (-) strand; PAM type: NRG; PAM sequence: GGG
gactttttttggtgcaagtt

SEQ ID NO: 24675 - DNA, 20 bp, Artificial Sequence
  Description of Artificial Sequence: Synthetic oligonucleotide
  Target: SCN10A; (-) strand; PAM type: NRG; PAM sequence: TGG
cgactttttttggtgcaagt

SEQ ID NO: 24676 - DNA, 20 bp, Artificial Sequence
  Description of Artificial Sequence: Synthetic oligonucleotide
  Target: SCN10A; (-) strand; PAM type: NRG; PAM sequence: AAG
accacgactttttttggtgc

SEQ ID NO: 24677 - DNA, 20 bp, Artificial Sequence
  Description of Artificial Sequence: Synthetic oligonucleotide
  Target: SCN10A; (-) strand; PAM type: NRG; PAM sequence: TGG
gcagtgaccacgactttttt

SEQ ID NO: 24678 - DNA, 20 bp, Artificial Sequence
  Description of Artificial Sequence: Synthetic oligonucleotide
  Target: SCN10A; (-) strand; PAM type: NRG; PAM sequence: CAG
accggcagcagaccaccaag

SEQ ID NO: 24679 - DNA, 20 bp, Artificial Sequence
  Description of Artificial Sequence: Synthetic oligonucleotide
  Target: SCN10A; (-) strand; PAM type: NRG; PAM sequence: AAG
cagaccggcagcagaccacc

SEQ ID NO: 24680 - DNA, 20 bp, Artificial Sequence
  Description of Artificial Sequence: Synthetic oligonucleotide
  Target: SCN10A; (-) strand; PAM type: NRG; PAM sequence: CAG
gtagtagatcagaccggcag

SEQ ID NO: 24681 - DNA, 20 bp, Artificial Sequence
  Description of Artificial Sequence: Synthetic oligonucleotide
  Target: SCN10A; (-) strand; PAM type: NRG; PAM sequence: CAG
gctgtagtagatcagaccgg

SEQ ID NO: 24682 - DNA, 20 bp, Artificial Sequence
  Description of Artificial Sequence: Synthetic oligonucleotide
  Target: SCN10A; (-) strand; PAM type: NRG; PAM sequence: CGG
aaagctgtagtagatcagac

SEQ ID NO: 24683 - DNA, 20 bp, Artificial Sequence
  Description of Artificial Sequence: Synthetic oligonucleotide
  Target: SCN10A; (-) strand; PAM type: NRG; PAM sequence: CAG
ttcagaaagctgtagtagat

SEQ ID NO: 24684 - DNA, 20 bp, Artificial Sequence
  Description of Artificial Sequence: Synthetic oligonucleotide
  Target: SCN10A; (-) strand; PAM type: NRG; PAM sequence: TAG
tgggattcagaaagctgtag

SEQ ID NO: 24685 - DNA, 20 bp, Artificial Sequence
  Description of Artificial Sequence: Synthetic oligonucleotide
  Target: SCN10A; (-) strand; PAM type: NRG; PAM sequence: TAG
tgctgggattcagaaagctg

SEQ ID NO: 24686 - DNA, 20 bp, Artificial Sequence
  Description of Artificial Sequence: Synthetic oligonucleotide
  Target: SCN10A; (-) strand; PAM type: NRG; PAM sequence: AAG
tggctttgctgggattcaga

SEQ ID NO: 24687 - DNA, 20 bp, Artificial Sequence
  Description of Artificial Sequence: Synthetic oligonucleotide
  Target: SCN10A; (-) strand; PAM type: NRG; PAM sequence: CAG
gtaatggctttgctgggatt

SEQ ID NO: 24688 - DNA, 20 bp, Artificial Sequence
  Description of Artificial Sequence: Synthetic oligonucleotide
  Target: SCN10A; (-) strand; PAM type: NRG; PAM sequence: GGG
tcagatgtaatggctttgct

SEQ ID NO: 24689 - DNA, 20 bp, Artificial Sequence
  Description of Artificial Sequence: Synthetic oligonucleotide
  Target: SCN10A; (-) strand; PAM type: NRG; PAM sequence: TGG
ctcagatgtaatggctttgc

SEQ ID NO: 24690 - DNA, 20 bp, Artificial Sequence
  Description of Artificial Sequence: Synthetic oligonucleotide
  Target: SCN10A; (-) strand; PAM type: NRG; PAM sequence: TGG
aacatatttctcagatgtaa

SEQ ID NO: 24691 - DNA, 20 bp, Artificial Sequence
  Description of Artificial Sequence: Synthetic oligonucleotide
  Target: SCN10A; (-) strand; PAM type: NRG; PAM sequence: CAG
gatttgctgaacatatttct

SEQ ID NO: 24692 - DNA, 20 bp, Artificial Sequence
  Description of Artificial Sequence: Synthetic oligonucleotide
  Target: SCN10A; (-) strand; PAM type: NRG; PAM sequence: CAG
aatgccagctgcaggccttg

SEQ ID NO: 24693 - DNA, 20 bp, Artificial Sequence
  Description of Artificial Sequence: Synthetic oligonucleotide
  Target: SCN10A; (-) strand; PAM type: NRG; PAM sequence: AGG
tgttgaccaatgccagctgc

SEQ ID NO: 24694 - DNA, 20 bp, Artificial Sequence
  Description of Artificial Sequence: Synthetic oligonucleotide
  Target: SCN10A; (-) strand; PAM type: NRG; PAM sequence: CAG
ctgttgaccaatgccagctg

SEQ ID NO: 24695 - DNA, 20 bp, Artificial Sequence
  Description of Artificial Sequence: Synthetic oligonucleotide
  Target: SCN10A; (-) strand; PAM type: NRG; PAM sequence: CAG
ccctttctgttgaccaatgc

SEQ ID NO: 24696 - DNA, 20 bp, Artificial Sequence
  Description of Artificial Sequence: Synthetic oligonucleotide
  Target: SCN10A; (-) strand; PAM type: NRG; PAM sequence: GGG
ggttgttgtggagaagaatt

SEQ ID NO: 24697 - DNA, 20 bp, Artificial Sequence
  Description of Artificial Sequence: Synthetic oligonucleotide
  Target: SCN10A; (-) strand; PAM type: NRG; PAM sequence: TGG
cggttgttgtggagaagaat

SEQ ID NO: 24698 - DNA, 20 bp, Artificial Sequence
  Description of Artificial Sequence: Synthetic oligonucleotide
  Target: SCN10A; (-) strand; PAM type: NRG; PAM sequence: AAG
tgcagtcggttgttgtggag

SEQ ID NO: 24699 - DNA, 20 bp, Artificial Sequence
  Description of Artificial Sequence: Synthetic oligonucleotide
  Target: SCN10A; (-) strand; PAM type: NRG; PAM sequence: GAG
acatgcagtcggttgttgtg

SEQ ID NO: 24700 - DNA, 20 bp, Artificial Sequence
  Description of Artificial Sequence: Synthetic oligonucleotide
  Target: SCN10A; (-) strand; PAM type: NRG; PAM sequence: TGG
tgacatgcagtcggttgttg

SEQ ID NO: 24701 - DNA, 20 bp, Artificial Sequence
  Description of Artificial Sequence: Synthetic oligonucleotide
  Target: SCN10A; (-) strand; PAM type: NRG; PAM sequence: CGG
ttggttgtgtgacatgcagt

SEQ ID NO: 24702 - DNA, 20 bp, Artificial Sequence
  Description of Artificial Sequence: Synthetic oligonucleotide
  Target: SCN10A; (-) strand; PAM type: NRG; PAM sequence: CAG
actgttggttgtgtgacatg

SEQ ID NO: 24703 - DNA, 20 bp, Artificial Sequence
  Description of Artificial Sequence: Synthetic oligonucleotide
  Target: SCN10A; (-) strand; PAM type: NRG; PAM sequence: TGG
tcaacttttgaagtaactgt

SEQ ID NO: 24704 - DNA, 20 bp, Artificial Sequence
  Description of Artificial Sequence: Synthetic oligonucleotide
  Target: SCN10A; (-) strand; PAM type: NRG; PAM sequence: AAG
cccaattcattcaacttttg

SEQ ID NO: 24705 - DNA, 20 bp, Artificial Sequence
  Description of Artificial Sequence: Synthetic oligonucleotide
  Target: SCN10A; (-) strand; PAM type: NRG; PAM sequence: TAG
gtggatgaggcaaaacttca

SEQ ID NO: 24706 - DNA, 20 bp, Artificial Sequence
  Description of Artificial Sequence: Synthetic oligonucleotide
  Target: SCN10A; (-) strand; PAM type: NRG; PAM sequence: AGG
tcaggtgaatatggtggatg

SEQ ID NO: 24707 - DNA, 20 bp, Artificial Sequence
  Description of Artificial Sequence: Synthetic oligonucleotide
  Target: SCN10A; (-) strand; PAM type: NRG; PAM sequence: GAG
gtcaggtgaatatggtggat

SEQ ID NO: 24708 - DNA, 20 bp, Artificial Sequence
  Description of Artificial Sequence: Synthetic oligonucleotide
  Target: SCN10A; (-) strand; PAM type: NRG; PAM sequence: TGG
gagaggtcaggtgaatatgg

SEQ ID NO: 24709 - DNA, 20 bp, Artificial Sequence
  Description of Artificial Sequence: Synthetic oligonucleotide
  Target: SCN10A; (-) strand; PAM type: NRG; PAM sequence: TGG
ggtgagaggtcaggtgaata

SEQ ID NO: 24710 - DNA, 20 bp, Artificial Sequence
  Description of Artificial Sequence: Synthetic oligonucleotide
  Target: SCN10A; (-) strand; PAM type: NRG; PAM sequence: AGG
tagttggttggtgagaggtc

SEQ ID NO: 24711 - DNA, 20 bp, Artificial Sequence
  Description of Artificial Sequence: Synthetic oligonucleotide
  Target: SCN10A; (-) strand; PAM type: NRG; PAM sequence: CAG
gtagttggttggtgagaggt

SEQ ID NO: 24712 - DNA, 20 bp, Artificial Sequence
  Description of Artificial Sequence: Synthetic oligonucleotide
  Target: SCN10A; (-) strand; PAM type: NRG; PAM sequence: AGG
agtggtagttggttggtgag

SEQ ID NO: 24713 - DNA, 20 bp, Artificial Sequence
  Description of Artificial Sequence: Synthetic oligonucleotide
  Target: SCN10A; (-) strand; PAM type: NRG; PAM sequence: GAG
aagtggtagttggttggtga

SEQ ID NO: 24714 - DNA, 20 bp, Artificial Sequence
  Description of Artificial Sequence: Synthetic oligonucleotide
  Target: SCN10A; (-) strand; PAM type: NRG; PAM sequence: GAG
agaagtggtagttggttggt

SEQ ID NO: 24715 - DNA, 20 bp, Artificial Sequence
  Description of Artificial Sequence: Synthetic oligonucleotide
  Target: SCN10A; (-) strand; PAM type: NRG; PAM sequence: TGG
ttgaagaagtggtagttggt

SEQ ID NO: 24716 - DNA, 20 bp, Artificial Sequence
  Description of Artificial Sequence: Synthetic oligonucleotide
  Target: SCN10A; (-) strand; PAM type: NRG; PAM sequence: TGG
atgcttgaagaagtggtagt

SEQ ID NO: 24717 - DNA, 20 bp, Artificial Sequence
  Description of Artificial Sequence: Synthetic oligonucleotide
  Target: SCN10A; (-) strand; PAM type: NRG; PAM sequence: TAG
tcagatgcttgaagaagtgg

SEQ ID NO: 24718 - DNA, 20 bp, Artificial Sequence
  Description of Artificial Sequence: Synthetic oligonucleotide
  Target: SCN10A; (-) strand; PAM type: NRG; PAM sequence: TGG
tgttcagatgcttgaagaag

SEQ ID NO: 24719 - DNA, 20 bp, Artificial Sequence
  Description of Artificial Sequence: Synthetic oligonucleotide
  Target: SCN10A; (-) strand; PAM type: NRG; PAM sequence: AAG
agttgttcagatgcttgaag

SEQ ID NO: 24720 - DNA, 20 bp, Artificial Sequence
  Description of Artificial Sequence: Synthetic oligonucleotide
  Target: SCN10A; (-) strand; PAM type: NRG; PAM sequence: AAG
aaaagttgttcagatgcttg

SEQ ID NO: 24721 - DNA, 20 bp, Artificial Sequence
  Description of Artificial Sequence: Synthetic oligonucleotide
  Target: SCN10A; (-) strand; PAM type: NRG; PAM sequence: CAG
ttcacctgcaaaaagttgtt

SEQ ID NO: 24722 - DNA, 20 bp, Artificial Sequence
  Description of Artificial Sequence: Synthetic oligonucleotide
  Target: SCN10A; (-) strand; PAM type: NRG; PAM sequence: AAG
ggaagtgtttcacctgcaaa

SEQ ID NO: 24723 - DNA, 20 bp, Artificial Sequence
  Description of Artificial Sequence: Synthetic oligonucleotide
  Target: SCN10A; (-) strand; PAM type: NRG; PAM sequence: AAG
ctgcatcccgctggttatgg

SEQ ID NO: 24724 - DNA, 20 bp, Artificial Sequence
  Description of Artificial Sequence: Synthetic oligonucleotide
  Target: SCN10A; (-) strand; PAM type: NRG; PAM sequence: TGG
tttctgcatcccgctggtta

SEQ ID NO: 24725 - DNA, 20 bp, Artificial Sequence
  Description of Artificial Sequence: Synthetic oligonucleotide
  Target: SCN10A; (-) strand; PAM type: NRG; PAM sequence: TGG
aggcattttctgcatcccgc

SEQ ID NO: 24726 - DNA, 20 bp, Artificial Sequence
  Description of Artificial Sequence: Synthetic oligonucleotide
  Target: SCN10A; (-) strand; PAM type: NRG; PAM sequence: AGG
ggattcaatgaactcttgga

SEQ ID NO: 24727 - DNA, 20 bp, Artificial Sequence
  Description of Artificial Sequence: Synthetic oligonucleotide
  Target: SCN10A; (-) strand; PAM type: NRG; PAM sequence: AAG
gggattcaatgaactcttgg

SEQ ID NO: 24728 - DNA, 20 bp, Artificial Sequence
  Description of Artificial Sequence: Synthetic oligonucleotide
  Target: SCN10A; (-) strand; PAM type: NRG; PAM sequence: TGG
tttgggattcaatgaactct

SEQ ID NO: 24729 - DNA, 20 bp, Artificial Sequence
  Description of Artificial Sequence: Synthetic oligonucleotide
  Target: SCN10A; (-) strand; PAM type: NRG; PAM sequence: GGG
agcataaaaatccatgcttt

SEQ ID NO: 24730 - DNA, 20 bp, Artificial Sequence
  Description of Artificial Sequence: Synthetic oligonucleotide
  Target: SCN10A; (-) strand; PAM type: NRG; PAM sequence: TGG
tagcataaaaatccatgctt

SEQ ID NO: 24731 - DNA, 20 bp, Artificial Sequence
  Description of Artificial Sequence: Synthetic oligonucleotide
  Target: SCN10A; (-) strand; PAM type: NRG; PAM sequence: TAG
aatgagtttgtttattcctg

SEQ ID NO: 24732 - DNA, 20 bp, Artificial Sequence
  Description of Artificial Sequence: Synthetic oligonucleotide
  Target: SCN10A; (-) strand; PAM type: NRG; PAM sequence: GAG
catttttgccaatgagaaat

SEQ ID NO: 24733 - DNA, 20 bp, Artificial Sequence
  Description of Artificial Sequence: Synthetic oligonucleotide
  Target: SCN10A; (-) strand; PAM type: NRG; PAM sequence: GAG
atcaacacatttttgccaat

SEQ ID NO: 24734 - DNA, 20 bp, Artificial Sequence
  Description of Artificial Sequence: Synthetic oligonucleotide
  Target: SCN10A; (-) strand; PAM type: NRG; PAM sequence: AGG
acatctttattaatcaaagt

SEQ ID NO: 24735 - DNA, 20 bp, Artificial Sequence
  Description of Artificial Sequence: Synthetic oligonucleotide
  Target: SCN10A; (-) strand; PAM type: NRG; PAM sequence: TAG
cacatctttattaatcaaag

SEQ ID NO: 24736 - DNA, 20 bp, Artificial Sequence
  Description of Artificial Sequence: Synthetic oligonucleotide
  Target: SCN10A; (-) strand; PAM type: NRG; PAM sequence: AAG
aaacacatctttattaatca

SEQ ID NO: 24737 - DNA, 20 bp, Artificial Sequence
  Description of Artificial Sequence: Synthetic oligonucleotide
  Target: SCN10A; (-) strand; PAM type: NRG; PAM sequence: AGG
aatattaaatcattataact

SEQ ID NO: 24738 - DNA, 20 bp, Artificial Sequence
  Description of Artificial Sequence: Synthetic oligonucleotide
  Target: SCN10A; (-) strand; PAM type: NRG; PAM sequence: TAG
aaatattaaatcattataac

SEQ ID NO: 24739 - DNA, 20 bp, Artificial Sequence
  Description of Artificial Sequence: Synthetic oligonucleotide
  Target: SCN10A; (-) strand; PAM type: NRG; PAM sequence: CAG
tacaaaagtaattggggttt

SEQ ID NO: 24740 - DNA, 20 bp, Artificial Sequence
  Description of Artificial Sequence: Synthetic oligonucleotide
  Target: SCN10A; (-) strand; PAM type: NRG; PAM sequence: GGG
aaaaggtacaaaagtaattg

SEQ ID NO: 24741 - DNA, 20 bp, Artificial Sequence
  Description of Artificial Sequence: Synthetic oligonucleotide
  Target: SCN10A; (-) strand; PAM type: NRG; PAM sequence: GGG
gaaaaggtacaaaagtaatt

SEQ ID NO: 24742 - DNA, 20 bp, Artificial Sequence
  Description of Artificial Sequence: Synthetic oligonucleotide
  Target: SCN10A; (-) strand; PAM type: NRG; PAM sequence: TGG
tgaaaaggtacaaaagtaat

SEQ ID NO: 24743 - DNA, 20 bp, Artificial Sequence
  Description of Artificial Sequence: Synthetic oligonucleotide
  Target: SCN10A; (-) strand; PAM type: NRG; PAM sequence: AAG
caaataatgaaaaggtacaa

SEQ ID NO: 24744 - DNA, 20 bp, Artificial Sequence
  Description of Artificial Sequence: Synthetic oligonucleotide
  Target: SCN10A; (-) strand; PAM type: NRG; PAM sequence: AGG
agagatgccaaataatgaaa

SEQ ID NO: 24745 - DNA, 20 bp, Artificial Sequence
  Description of Artificial Sequence: Synthetic oligonucleotide
  Target: SCN10A; (-) strand; PAM type: NRG; PAM sequence: AAG
aagagatgccaaataatgaa

SEQ ID NO: 24746 - DNA, 20 bp, Artificial Sequence
  Description of Artificial Sequence: Synthetic oligonucleotide
  Target: SCN10A; (-) strand; PAM type: NRG; PAM sequence: GAG
aaaaaataaaaagcaaataa

SEQ ID NO: 24747 - DNA, 20 bp, Artificial Sequence
  Description of Artificial Sequence: Synthetic oligonucleotide
  Target: SCN10A; (-) strand; PAM type: NRG; PAM sequence: AAG
tcaaaaaataaaaagcaaat

SEQ ID NO: 24748 - DNA, 20 bp, Artificial Sequence
  Description of Artificial Sequence: Synthetic oligonucleotide
  Target: SCN10A; (-) strand; PAM type: NRG; PAM sequence: AAG
attgtacatcaaaaaataaa

SEQ ID NO: 24749 - DNA, 20 bp, Artificial Sequence
  Description of Artificial Sequence: Synthetic oligonucleotide
  Target: SCN10A; (-) strand; PAM type: NRG; PAM sequence: AAG
tgacaaactctaaatactgg

SEQ ID NO: 24750 - DNA, 20 bp, Artificial Sequence
  Description of Artificial Sequence: Synthetic oligonucleotide
  Target: SCN10A; (-) strand; PAM type: NRG; PAM sequence: TGG
atatgacaaactctaaatac

SEQ ID NO: 24751 - DNA, 20 bp, Artificial Sequence
  Description of Artificial Sequence: Synthetic oligonucleotide
  Target: SCN10A; (-) strand; PAM type: NRG; PAM sequence: TAG
ggataaagatacaaactctt

SEQ ID NO: 24752 - DNA, 20 bp, Artificial Sequence
  Description of Artificial Sequence: Synthetic oligonucleotide
  Target: SCN10A; (-) strand; PAM type: NRG; PAM sequence: AAG
taaagacaaccactaggata

SEQ ID NO: 24753 - DNA, 20 bp, Artificial Sequence
  Description of Artificial Sequence: Synthetic oligonucleotide
  Target: SCN10A; (-) strand; PAM type: NRG; PAM sequence: AGG
tacttataaagacaaccact

SEQ ID NO: 24754 - DNA, 20 bp, Artificial Sequence
  Description of Artificial Sequence: Synthetic oligonucleotide
  Target: SCN10A; (-) strand; PAM type: NRG; PAM sequence: TAG
ttacttataaagacaaccac

SEQ ID NO: 24755 - DNA, 20 bp, Artificial Sequence
  Description of Artificial Sequence: Synthetic oligonucleotide
  Target: SCN10A; (-) strand; PAM type: NRG; PAM sequence: AAG
ataataagtttttacttata

SEQ ID NO: 24756 - DNA, 20 bp, Artificial Sequence
  Description of Artificial Sequence: Synthetic oligonucleotide
  Target: SCN10A; (-) strand; PAM type: NRG; PAM sequence: AAG
tataattataaatttataat

SEQ ID NO: 24757 - DNA, 20 bp, Artificial Sequence
  Description of Artificial Sequence: Synthetic oligonucleotide
  Target: SCN10A; (-) strand; PAM type: NRG; PAM sequence: CGG
actaaggacaatgtattaca

SEQ ID NO: 24758 - DNA, 20 bp, Artificial Sequence
  Description of Artificial Sequence: Synthetic oligonucleotide
  Target: SCN10A; (-) strand; PAM type: NRG; PAM sequence: AGG
attaaagaaatagtacacta

SEQ ID NO: 24759 - DNA, 20 bp, Artificial Sequence
  Description of Artificial Sequence: Synthetic oligonucleotide
  Target: SCN10A; (-) strand; PAM type: NRG; PAM sequence: AAG
gattaaagaaatagtacact

SEQ ID NO: 24760 - DNA, 20 bp, Artificial Sequence
  Description of Artificial Sequence: Synthetic oligonucleotide
  Target: SCN10A; (-) strand; PAM type: NRG; PAM sequence: TAG
agagattttgattaaagaaa

SEQ ID NO: 24761 - DNA, 20 bp, Artificial Sequence
  Description of Artificial Sequence: Synthetic oligonucleotide
  Target: SCN10A; (-) strand; PAM type: NRG; PAM sequence: AAG
gaaatgagagattttgatta

SEQ ID NO: 24762 - DNA, 20 bp, Artificial Sequence
  Description of Artificial Sequence: Synthetic oligonucleotide
  Target: SCN10A; (-) strand; PAM type: NRG; PAM sequence: GAG
gaatcaccaaatggaaatga

SEQ ID NO: 24763 - DNA, 20 bp, Artificial Sequence
  Description of Artificial Sequence: Synthetic oligonucleotide
  Target: SCN10A; (-) strand; PAM type: NRG; PAM sequence: GAG
aggaatcaccaaatggaaat

SEQ ID NO: 24764 - DNA, 20 bp, Artificial Sequence
  Description of Artificial Sequence: Synthetic oligonucleotide
  Target: SCN10A; (-) strand; PAM type: NRG; PAM sequence: TGG
agaggaaaggaatcaccaaa

SEQ ID NO: 24765 - DNA, 20 bp, Artificial Sequence
  Description of Artificial Sequence: Synthetic oligonucleotide
  Target: SCN10A; (-) strand; PAM type: NRG; PAM sequence: AGG
atggataaaacagagaggaa

SEQ ID NO: 24766 - DNA, 20 bp, Artificial Sequence
  Description of Artificial Sequence: Synthetic oligonucleotide
  Target: SCN10A; (-) strand; PAM type: NRG; PAM sequence: AAG
aatggataaaacagagagga

SEQ ID NO: 24767 - DNA, 20 bp, Artificial Sequence
  Description of Artificial Sequence: Synthetic oligonucleotide
  Target: SCN10A; (-) strand; PAM type: NRG; PAM sequence: AGG
agataatggataaaacagag

SEQ ID NO: 24768 - DNA, 20 bp, Artificial Sequence
  Description of Artificial Sequence: Synthetic oligonucleotide
  Target: SCN10A; (-) strand; PAM type: NRG; PAM sequence: GAG
cagataatggataaaacaga

SEQ ID NO: 24769 - DNA, 20 bp, Artificial Sequence
  Description of Artificial Sequence: Synthetic oligonucleotide
  Target: SCN10A; (-) strand; PAM type: NRG; PAM sequence: GAG
gtcagataatggataaaaca

SEQ ID NO: 24770 - DNA, 20 bp, Artificial Sequence
  Description of Artificial Sequence: Synthetic oligonucleotide
  Target: SCN10A; (-) strand; PAM type: NRG; PAM sequence: CAG
cagtcagataatggataaaa

SEQ ID NO: 24771 - DNA, 20 bp, Artificial Sequence
  Description of Artificial Sequence: Synthetic oligonucleotide
  Target: SCN10A; (-) strand; PAM type: NRG; PAM sequence: TGG
tattaaatacagtcagataa

SEQ ID NO: 24772 - DNA, 20 bp, Artificial Sequence
  Description of Artificial Sequence: Synthetic oligonucleotide
  Target: SCN10A; (-) strand; PAM type: NRG; PAM sequence: CAG
aagatattattaaatacagt

SEQ ID NO: 24773 - DNA, 20 bp, Artificial Sequence
  Description of Artificial Sequence: Synthetic oligonucleotide
  Target: SCN10A; (-) strand; PAM type: NRG; PAM sequence: CAG
caaaaagatattattaaata

SEQ ID NO: 24774 - DNA, 20 bp, Artificial Sequence
  Description of Artificial Sequence: Synthetic oligonucleotide
  Target: SCN10A; (-) strand; PAM type: NRG; PAM sequence: AAG
agtacaaaggtaagcacaaa

SEQ ID NO: 24775 - DNA, 20 bp, Artificial Sequence
  Description of Artificial Sequence: Synthetic oligonucleotide
  Target: SCN10A; (-) strand; PAM type: NRG; PAM sequence: AAG
acacttgacagtacaaaggt

SEQ ID NO: 24776 - DNA, 20 bp, Artificial Sequence
  Description of Artificial Sequence: Synthetic oligonucleotide
  Target: SCN10A; (-) strand; PAM type: NRG; PAM sequence: AGG
aattacacttgacagtacaa

SEQ ID NO: 24777 - DNA, 20 bp, Artificial Sequence
  Description of Artificial Sequence: Synthetic oligonucleotide
  Target: SCN10A; (-) strand; PAM type: NRG; PAM sequence: AAG
taattacacttgacagtaca

SEQ ID NO: 24778 - DNA, 20 bp, Artificial Sequence
  Description of Artificial Sequence: Synthetic oligonucleotide
  Target: SCN10A; (-) strand; PAM type: NRG; PAM sequence: CAG
gacaaaataattacacttga

SEQ ID NO: 24779 - DNA, 20 bp, Artificial Sequence
  Description of Artificial Sequence: Synthetic oligonucleotide
  Target: SCN10A; (-) strand; PAM type: NRG; PAM sequence: TGG
aaagttgacaaataaagaaa

SEQ ID NO: 24780 - DNA, 20 bp, Artificial Sequence
  Description of Artificial Sequence: Synthetic oligonucleotide
  Target: SCN10A; (-) strand; PAM type: NRG; PAM sequence: AAG
ttatttaaagttgacaaata

SEQ ID NO: 24781 - DNA, 20 bp, Artificial Sequence
  Description of Artificial Sequence: Synthetic oligonucleotide
  Target: SCN10A; (-) strand; PAM type: NRG; PAM sequence: AAG
aagttaaagagtattattta

SEQ ID NO: 24782 - DNA, 20 bp, Artificial Sequence
  Description of Artificial Sequence: Synthetic oligonucleotide
  Target: SCN10A; (-) strand; PAM type: NRG; PAM sequence: GAG
tataataacaagaagttaaa

SEQ ID NO: 24783 - DNA, 20 bp, Artificial Sequence
  Description of Artificial Sequence: Synthetic oligonucleotide
  Target: SCN10A; (-) strand; PAM type: NRG; PAM sequence: AAG
tctataataacaagaagtta

SEQ ID NO: 24784 - DNA, 20 bp, Artificial Sequence
  Description of Artificial Sequence: Synthetic oligonucleotide
  Target: SCN10A; (-) strand; PAM type: NRG; PAM sequence: AAG
gctgcttctataataacaag

SEQ ID NO: 24785 - DNA, 20 bp, Artificial Sequence
  Description of Artificial Sequence: Synthetic oligonucleotide
  Target: SCN10A; (-) strand; PAM type: NRG; PAM sequence: AAG
actgctgcttctataataac

SEQ ID NO: 24786 - DNA, 20 bp, Artificial Sequence
  Description of Artificial Sequence: Synthetic oligonucleotide
  Target: SCN10A; (-) strand; PAM type: NRG; PAM sequence: GAG
gaggaaagaacatgtgagca

SEQ ID NO: 24787 - DNA, 20 bp, Artificial Sequence
  Description of Artificial Sequence: Synthetic oligonucleotide
  Target: SCN10A; (-) strand; PAM type: NRG; PAM sequence: CAG
aagaggaaagaacatgtgag

SEQ ID NO: 24788 - DNA, 20 bp, Artificial Sequence
  Description of Artificial Sequence: Synthetic oligonucleotide
  Target: SCN10A; (-) strand; PAM type: NRG; PAM sequence: GAG
agaaagaggaaagaacatgt

SEQ ID NO: 24789 - DNA, 20 bp, Artificial Sequence
  Description of Artificial Sequence: Synthetic oligonucleotide
  Target: SCN10A; (-) strand; PAM type: NRG; PAM sequence: AAG
aaatggaagcagaaagagga

SEQ ID NO: 24790 - DNA, 20 bp, Artificial Sequence
  Description of Artificial Sequence: Synthetic oligonucleotide
  Target: SCN10A; (-) strand; PAM type: NRG; PAM sequence: AGG
caagaaatggaagcagaaag

SEQ ID NO: 24791 - DNA, 20 bp, Artificial Sequence
  Description of Artificial Sequence: Synthetic oligonucleotide
  Target: SCN10A; (-) strand; PAM type: NRG; PAM sequence: GAG
gcaagaaatggaagcagaaa

SEQ ID NO: 24792 - DNA, 20 bp, Artificial Sequence
  Description of Artificial Sequence: Synthetic oligonucleotide
  Target: SCN10A; (-) strand; PAM type: NRG; PAM sequence: AAG
tagcaagaaatggaagcaga

SEQ ID NO: 24793 - DNA, 20 bp, Artificial Sequence
  Description of Artificial Sequence: Synthetic oligonucleotide
  Target: SCN10A; (-) strand; PAM type: NRG; PAM sequence: CAG
caaatagcaagaaatggaag

SEQ ID NO: 24794 - DNA, 20 bp, Artificial Sequence
  Description of Artificial Sequence: Synthetic oligonucleotide
  Target: SCN10A; (-) strand; PAM type: NRG; PAM sequence: AAG
atacaaatagcaagaaatgg

SEQ ID NO: 24795 - DNA, 20 bp, Artificial Sequence
  Description of Artificial Sequence: Synthetic oligonucleotide
  Target: SCN10A; (-) strand; PAM type: NRG; PAM sequence: TGG
atgatacaaatagcaagaaa

SEQ ID NO: 24796 - DNA, 20 bp, Artificial Sequence
  Description of Artificial Sequence: Synthetic oligonucleotide
  Target: SCN10A; (-) strand; PAM type: NRG; PAM sequence: AAG
gttgacatgatacaaatagc

SEQ ID NO: 24797 - DNA, 20 bp, Artificial Sequence
  Description of Artificial Sequence: Synthetic oligonucleotide
  Target: SCN10A; (-) strand; PAM type: NRG; PAM sequence: TAG
aagtgttgacatgatacaaa

SEQ ID NO: 24798 - DNA, 20 bp, Artificial Sequence
  Description of Artificial Sequence: Synthetic oligonucleotide
  Target: SCN10A; (-) strand; PAM type: NRG; PAM sequence: AAG
acaagccccagaggccctgc

SEQ ID NO: 24799 - DNA, 20 bp, Artificial Sequence
  Description of Artificial Sequence: Synthetic oligonucleotide
  Target: SCN10A; (-) strand; PAM type: NRG; PAM sequence: AGG
cgctgcccaacaagccccag

SEQ ID NO: 24800 - DNA, 20 bp, Artificial Sequence
  Description of Artificial Sequence: Synthetic oligonucleotide
  Target: SCN10A; (-) strand; PAM type: NRG; PAM sequence: GAG
ccgctgcccaacaagcccca

SEQ ID NO: 24801 - DNA, 20 bp, Artificial Sequence
  Description of Artificial Sequence: Synthetic oligonucleotide
  Target: SCN10A; (-) strand; PAM type: NRG; PAM sequence: CAG
ccccgctgcccaacaagccc

SEQ ID NO: 24802 - DNA, 20 bp, Artificial Sequence
  Description of Artificial Sequence: Synthetic oligonucleotide
  Target: SCN10A; (-) strand; PAM type: NRG; PAM sequence: AAG
taccgcccccgctgcccaac

SEQ ID NO: 24803 - DNA, 20 bp, Artificial Sequence
  Description of Artificial Sequence: Synthetic oligonucleotide
  Target: SCN10A; (-) strand; PAM type: NRG; PAM sequence: AGG
ggggataaaaatgagaataa

SEQ ID NO: 24804 - DNA, 20 bp, Artificial Sequence
  Description of Artificial Sequence: Synthetic oligonucleotide
  Target: SCN10A; (-) strand; PAM type: NRG; PAM sequence: AAG
gggggataaaaatgagaata

SEQ ID NO: 24805 - DNA, 20 bp, Artificial Sequence
  Description of Artificial Sequence: Synthetic oligonucleotide
  Target: SCN10A; (-) strand; PAM type: NRG; PAM sequence: GAG
ctccagagggggataaaaat

SEQ ID NO: 24806 - DNA, 20 bp, Artificial Sequence
  Description of Artificial Sequence: Synthetic oligonucleotide
  Target: SCN10A; (-) strand; PAM type: NRG; PAM sequence: GGG
aaccacggtgcctccagagg

SEQ ID NO: 24807 - DNA, 20 bp, Artificial Sequence
  Description of Artificial Sequence: Synthetic oligonucleotide
  Target: SCN10A; (-) strand; PAM type: NRG; PAM sequence: GGG
aaaccacggtgcctccagag

SEQ ID NO: 24808 - DNA, 20 bp, Artificial Sequence
  Description of Artificial Sequence: Synthetic oligonucleotide
  Target: SCN10A; (-) strand; PAM type: NRG; PAM sequence: GGG
taaaccacggtgcctccaga

SEQ ID NO: 24809 - DNA, 20 bp, Artificial Sequence
  Description of Artificial Sequence: Synthetic oligonucleotide
  Target: SCN10A; (-) strand; PAM type: NRG; PAM sequence: AGG
ttaaaccacggtgcctccag

SEQ ID NO: 24810 - DNA, 20 bp, Artificial Sequence
  Description of Artificial Sequence: Synthetic oligonucleotide
  Target: SCN10A; (-) strand; PAM type: NRG; PAM sequence: GAG
gttaaaccacggtgcctcca

SEQ ID NO: 24811 - DNA, 20 bp, Artificial Sequence
  Description of Artificial Sequence: Synthetic oligonucleotide
  Target: SCN10A; (-) strand; PAM type: NRG; PAM sequence: CAG
ttgttaaaccacggtgcctc

SEQ ID NO: 24812 - DNA, 20 bp, Artificial Sequence
  Description of Artificial Sequence: Synthetic oligonucleotide
  Target: SCN10A; (-) strand; PAM type: NRG; PAM sequence: CGG
gatcagggtttgttaaacca

SEQ ID NO: 24813 - DNA, 20 bp, Artificial Sequence
  Description of Artificial Sequence: Synthetic oligonucleotide
  Target: SCN10A; (-) strand; PAM type: NRG; PAM sequence: GGG
gtaaatcacttagcagatca

SEQ ID NO: 24814 - DNA, 20 bp, Artificial Sequence
  Description of Artificial Sequence: Synthetic oligonucleotide
  Target: SCN10A; (-) strand; PAM type: NRG; PAM sequence: AGG
ggtaaatcacttagcagatc

SEQ ID NO: 24815 - DNA, 20 bp, Artificial Sequence
  Description of Artificial Sequence: Synthetic oligonucleotide
  Target: SCN10A; (-) strand; PAM type: NRG; PAM sequence: CAG
tggtaaatcacttagcagat

SEQ ID NO: 24816 - DNA, 20 bp, Artificial Sequence
  Description of Artificial Sequence: Synthetic oligonucleotide
  Target: SCN10A; (-) strand; PAM type: NRG; PAM sequence: CAG
agaagtggtaaatcacttag

SEQ ID NO: 24817 - DNA, 20 bp, Artificial Sequence
  Description of Artificial Sequence: Synthetic oligonucleotide
  Target: SCN10A; (-) strand; PAM type: NRG; PAM sequence: TAG
tggagaagtggtaaatcact

SEQ ID NO: 24818 - DNA, 20 bp, Artificial Sequence
  Description of Artificial Sequence: Synthetic oligonucleotide
  Target: SCN10A; (-) strand; PAM type: NRG; PAM sequence: TGG
accaaaagtgggtggagaag

SEQ ID NO: 24819 - DNA, 20 bp, Artificial Sequence
  Description of Artificial Sequence: Synthetic oligonucleotide
  Target: SCN10A; (-) strand; PAM type: NRG; PAM sequence: AAG
aagaccaaaagtgggtggag

SEQ ID NO: 24820 - DNA, 20 bp, Artificial Sequence
  Description of Artificial Sequence: Synthetic oligonucleotide
  Target: SCN10A; (-) strand; PAM type: NRG; PAM sequence: GAG
tggaagaccaaaagtgggtg

SEQ ID NO: 24821 - DNA, 20 bp, Artificial Sequence
  Description of Artificial Sequence: Synthetic oligonucleotide
  Target: SCN10A; (-) strand; PAM type: NRG; PAM sequence: TGG
cttggaagaccaaaagtggg

SEQ ID NO: 24822 - DNA, 20 bp, Artificial Sequence
  Description of Artificial Sequence: Synthetic oligonucleotide
  Target: SCN10A; (-) strand; PAM type: NRG; PAM sequence: GGG
acacttggaagaccaaaagt

SEQ ID NO: 24823 - DNA, 20 bp, Artificial Sequence
  Description of Artificial Sequence: Synthetic oligonucleotide
  Target: SCN10A; (-) strand; PAM type: NRG; PAM sequence: TGG
aacacttggaagaccaaaag

SEQ ID NO: 24824 - DNA, 20 bp, Artificial Sequence
  Description of Artificial Sequence: Synthetic oligonucleotide
  Target: SCN10A; (-) strand; PAM type: NRG; PAM sequence: AAG
caaaacacttggaagaccaa

SEQ ID NO: 24825 - DNA, 20 bp, Artificial Sequence
  Description of Artificial Sequence: Synthetic oligonucleotide
  Target: SCN10A; (-) strand; PAM type: NRG; PAM sequence: AAG
aatgatgtcaaaacacttgg

SEQ ID NO: 24826 - DNA, 20 bp, Artificial Sequence
  Description of Artificial Sequence: Synthetic oligonucleotide
  Target: SCN10A; (-) strand; PAM type: NRG; PAM sequence: TGG
acaaatgatgtcaaaacact

SEQ ID NO: 24827 - DNA, 20 bp, Artificial Sequence
  Description of Artificial Sequence: Synthetic oligonucleotide
  Target: SCN10A; (-) strand; PAM type: NRG; PAM sequence: AGG
aaagagaatggaaaacacag

SEQ ID NO: 24828 - DNA, 20 bp, Artificial Sequence
  Description of Artificial Sequence: Synthetic oligonucleotide
  Target: SCN10A; (-) strand; PAM type: NRG; PAM sequence: GAG
gaaagagaatggaaaacaca

SEQ ID NO: 24829 - DNA, 20 bp, Artificial Sequence
  Description of Artificial Sequence: Synthetic oligonucleotide
  Target: SCN10A; (-) strand; PAM type: NRG; PAM sequence: CAG
gagaaagagaatggaaaaca

SEQ ID NO: 24830 - DNA, 20 bp, Artificial Sequence
  Description of Artificial Sequence: Synthetic oligonucleotide
  Target: SCN10A; (-) strand; PAM type: NRG; PAM sequence: TGG
aagaacaaagagaaagagaa

SEQ ID NO: 24831 - DNA, 20 bp, Artificial Sequence
  Description of Artificial Sequence: Synthetic oligonucleotide
  Target: SCN10A; (-) strand; PAM type: NRG; PAM sequence: GAG
tatacaagaacaaagagaaa

SEQ ID NO: 24832 - DNA, 20 bp, Artificial Sequence
  Description of Artificial Sequence: Synthetic oligonucleotide
  Target: SCN10A; (-) strand; PAM type: NRG; PAM sequence: AAG
aatatacaagaacaaagaga

SEQ ID NO: 24833 - DNA, 20 bp, Artificial Sequence
  Description of Artificial Sequence: Synthetic oligonucleotide
  Target: SCN10A; (-) strand; PAM type: NRG; PAM sequence: GAG
tataaatatacaagaacaaa

SEQ ID NO: 24834 - DNA, 20 bp, Artificial Sequence
  Description of Artificial Sequence: Synthetic oligonucleotide
  Target: SCN10A; (-) strand; PAM type: NRG; PAM sequence: AAG
agtataaatatacaagaaca

SEQ ID NO: 24835 - DNA, 20 bp, Artificial Sequence
  Description of Artificial Sequence: Synthetic oligonucleotide
  Target: SCN10A; (-) strand; PAM type: NRG; PAM sequence: AAG
aaagaacagtataaatatac

SEQ ID NO: 24836 - DNA, 20 bp, Artificial Sequence
  Description of Artificial Sequence: Synthetic oligonucleotide
  Target: SCN10A; (-) strand; PAM type: NRG; PAM sequence: CAG
tgacagcacgggggaaagaa

SEQ ID NO: 24837 - DNA, 20 bp, Artificial Sequence
  Description of Artificial Sequence: Synthetic oligonucleotide
  Target: SCN10A; (-) strand; PAM type: NRG; PAM sequence: AAG
tagaatgacagcacggggga

SEQ ID NO: 24838 - DNA, 20 bp, Artificial Sequence
  Description of Artificial Sequence: Synthetic oligonucleotide
  Target: SCN10A; (-) strand; PAM type: NRG; PAM sequence: GGG
ccaatagaatgacagcacgg

SEQ ID NO: 24839 - DNA, 20 bp, Artificial Sequence
  Description of Artificial Sequence: Synthetic oligonucleotide
  Target: SCN10A; (-) strand; PAM type: NRG; PAM sequence: GGG
gccaatagaatgacagcacg

SEQ ID NO: 24840 - DNA, 20 bp, Artificial Sequence
  Description of Artificial Sequence: Synthetic oligonucleotide
  Target: SCN10A; (-) strand; PAM type: NRG; PAM sequence: GGG
tgccaatagaatgacagcac

SEQ ID NO: 24841 - DNA, 20 bp, Artificial Sequence
  Description of Artificial Sequence: Synthetic oligonucleotide
  Target: SCN10A; (-) strand; PAM type: NRG; PAM sequence: CGG
atgccaatagaatgacagca

SEQ ID NO: 24842 - DNA, 20 bp, Artificial Sequence
  Description of Artificial Sequence: Synthetic oligonucleotide
  Target: SCN10A; (-) strand; PAM type: NRG; PAM sequence: CAG
tcaaaatgccaatagaatga

SEQ ID NO: 24843 - DNA, 20 bp, Artificial Sequence
  Description of Artificial Sequence: Synthetic oligonucleotide
  Target: SCN10A; (-) strand; PAM type: NRG; PAM sequence: TAG
ccaccctctcaaaatgccaa

SEQ ID NO: 24844 - DNA, 20 bp, Artificial Sequence
  Description of Artificial Sequence: Synthetic oligonucleotide
  Target: SCN10A; (-) strand; PAM type: NRG; PAM sequence: TAG
ttgtggttaaatatggaaga

SEQ ID NO: 24845 - DNA, 20 bp, Artificial Sequence
  Description of Artificial Sequence: Synthetic oligonucleotide
  Target: SCN10A; (-) strand; PAM type: NRG; PAM sequence: AAG
gagattgtggttaaatatgg

SEQ ID NO: 24846 - DNA, 20 bp, Artificial Sequence
  Description of Artificial Sequence: Synthetic oligonucleotide
  Target: SCN10A; (-) strand; PAM type: NRG; PAM sequence: TGG
ttggagattgtggttaaata

SEQ ID NO: 24847 - DNA, 20 bp, Artificial Sequence
  Description of Artificial Sequence: Synthetic oligonucleotide
  Target: SCN10A; (-) strand; PAM type: NRG; PAM sequence: TGG
tgggagttatttggagattg

SEQ ID NO: 24848 - DNA, 20 bp, Artificial Sequence
  Description of Artificial Sequence: Synthetic oligonucleotide
  Target: SCN10A; (-) strand; PAM type: NRG; PAM sequence: GAG
agttatttgggagttatttg

SEQ ID NO: 24849 - DNA, 20 bp, Artificial Sequence
  Description of Artificial Sequence: Synthetic oligonucleotide
  Target: SCN10A; (-) strand; PAM type: NRG; PAM sequence: TGG
tgagttatttgggagttatt

SEQ ID NO: 24850 - DNA, 20 bp, Artificial Sequence
  Description of Artificial Sequence: Synthetic oligonucleotide
  Target: SCN10A; (-) strand; PAM type: NRG; PAM sequence: GAG
ttgcaaaatgagttatttgg

SEQ ID NO: 24851 - DNA, 20 bp, Artificial Sequence
  Description of Artificial Sequence: Synthetic oligonucleotide
  Target: SCN10A; (-) strand; PAM type: NRG; PAM sequence: GGG
ttttgcaaaatgagttattt

SEQ ID NO: 24852 - DNA, 20 bp, Artificial Sequence
  Description of Artificial Sequence: Synthetic oligonucleotide
  Target: SCN10A; (-) strand; PAM type: NRG; PAM sequence: TGG
tttttgcaaaatgagttatt

SEQ ID NO: 24853 - DNA, 20 bp, Artificial Sequence
  Description of Artificial Sequence: Synthetic oligonucleotide
  Target: SCN10A; (-) strand; PAM type: NRG; PAM sequence: GAG
aaaacatttttttgcaaaat

SEQ ID NO: 24854 - DNA, 20 bp, Artificial Sequence
  Description of Artificial Sequence: Synthetic oligonucleotide
  Target: SCN10A; (-) strand; PAM type: NRG; PAM sequence: GAG
aaatgtctatgcttcttttg

SEQ ID NO: 24855 - DNA, 20 bp, Artificial Sequence
  Description of Artificial Sequence: Synthetic oligonucleotide
  Target: SCN10A; (-) strand; PAM type: NRG; PAM sequence: TGG
taaaatgtctatgcttcttt

SEQ ID NO: 24856 - DNA, 20 bp, Artificial Sequence
  Description of Artificial Sequence: Synthetic oligonucleotide
  Target: SCN10A; (-) strand; PAM type: NRG; PAM sequence: TAG
ttaatattgttgagatcata

SEQ ID NO: 24857 - DNA, 20 bp, Artificial Sequence
  Description of Artificial Sequence: Synthetic oligonucleotide
  Target: SCN10A; (-) strand; PAM type: NRG; PAM sequence: GAG
aaattatatttaatattgtt

SEQ ID NO: 24858 - DNA, 20 bp, Artificial Sequence
  Description of Artificial Sequence: Synthetic oligonucleotide
  Target: SCN10A; (-) strand; PAM type: NRG; PAM sequence: GAG
cagaagatggttactaagta

SEQ ID NO: 24859 - DNA, 20 bp, Artificial Sequence
  Description of Artificial Sequence: Synthetic oligonucleotide
  Target: SCN10A; (-) strand; PAM type: NRG; PAM sequence: TAG
atcagaagatggttactaag

SEQ ID NO: 24860 - DNA, 20 bp, Artificial Sequence
  Description of Artificial Sequence: Synthetic oligonucleotide
  Target: SCN10A; (-) strand; PAM type: NRG; PAM sequence: AAG
taaatcagaagatggttact

SEQ ID NO: 24861 - DNA, 20 bp, Artificial Sequence
  Description of Artificial Sequence: Synthetic oligonucleotide
  Target: SCN10A; (-) strand; PAM type: NRG; PAM sequence: TGG
tgaaaatataaatcagaaga

SEQ ID NO: 24862 - DNA, 20 bp, Artificial Sequence
  Description of Artificial Sequence: Synthetic oligonucleotide
  Target: SCN10A; (-) strand; PAM type: NRG; PAM sequence: AAG
acactgaaaatataaatcag

SEQ ID NO: 24863 - DNA, 20 bp, Artificial Sequence
  Description of Artificial Sequence: Synthetic oligonucleotide
  Target: SCN10A; (-) strand; PAM type: NRG; PAM sequence: CAG
agaacactgaaaatataaat

SEQ ID NO: 24864 - DNA, 20 bp, Artificial Sequence
  Description of Artificial Sequence: Synthetic oligonucleotide
  Target: SCN10A; (-) strand; PAM type: NRG; PAM sequence: CAG
aatgaccattgcaaaaaatg

SEQ ID NO: 24865 - DNA, 20 bp, Artificial Sequence
  Description of Artificial Sequence: Synthetic oligonucleotide
  Target: SCN10A; (-) strand; PAM type: NRG; PAM sequence: AGG
gtattttgttaaggcaacaa

SEQ ID NO: 24866 - DNA, 20 bp, Artificial Sequence
  Description of Artificial Sequence: Synthetic oligonucleotide
  Target: SCN10A; (-) strand; PAM type: NRG; PAM sequence: AAG
ggtattttgttaaggcaaca

SEQ ID NO: 24867 - DNA, 20 bp, Artificial Sequence
  Description of Artificial Sequence: Synthetic oligonucleotide
  Target: SCN10A; (-) strand; PAM type: NRG; PAM sequence: AGG
cagtctatggtattttgtta

SEQ ID NO: 24868 - DNA, 20 bp, Artificial Sequence
  Description of Artificial Sequence: Synthetic oligonucleotide
  Target: SCN10A; (-) strand; PAM type: NRG; PAM sequence: AAG
ccagtctatggtattttgtt

SEQ ID NO: 24869 - DNA, 20 bp, Artificial Sequence
  Description of Artificial Sequence: Synthetic oligonucleotide
  Target: SCN10A; (-) strand; PAM type: NRG; PAM sequence: TGG
tgcataagccacccagtcta

SEQ ID NO: 24870 - DNA, 20 bp, Artificial Sequence
  Description of Artificial Sequence: Synthetic oligonucleotide
  Target: SCN10A; (-) strand; PAM type: NRG; PAM sequence: CAG
tttctgttgcataagccacc

SEQ ID NO: 24871 - DNA, 20 bp, Artificial Sequence
  Description of Artificial Sequence: Synthetic oligonucleotide
  Target: SCN10A; (-) strand; PAM type: NRG; PAM sequence: AAG
aaaataaatttctgttgcat

SEQ ID NO: 24872 - DNA, 20 bp, Artificial Sequence
  Description of Artificial Sequence: Synthetic oligonucleotide
  Target: SCN10A; (-) strand; PAM type: NRG; PAM sequence: GAG
gcttcaacctccagatttgt

SEQ ID NO: 24873 - DNA, 20 bp, Artificial Sequence
  Description of Artificial Sequence: Synthetic oligonucleotide
  Target: SCN10A; (-) strand; PAM type: NRG; PAM sequence: CAG
caatctcaggcttcaacctc

SEQ ID NO: 24874 - DNA, 20 bp, Artificial Sequence
  Description of Artificial Sequence: Synthetic oligonucleotide
  Target: SCN10A; (-) strand; PAM type: NRG; PAM sequence: AGG
tatgctgacatcccaatctc

SEQ ID NO: 24875 - DNA, 20 bp, Artificial Sequence
  Description of Artificial Sequence: Synthetic oligonucleotide
  Target: SCN10A; (-) strand; PAM type: NRG; PAM sequence: CAG
ctatgctgacatcccaatct

SEQ ID NO: 24876 - DNA, 20 bp, Artificial Sequence
  Description of Artificial Sequence: Synthetic oligonucleotide
  Target: SCN10A; (-) strand; PAM type: NRG; PAM sequence: CAG
gctagaaagagagtctttcc

SEQ ID NO: 24877 - DNA, 20 bp, Artificial Sequence
  Description of Artificial Sequence: Synthetic oligonucleotide
  Target: SCN10A; (-) strand; PAM type: NRG; PAM sequence: GAG
acatctataagctagaaaga

SEQ ID NO: 24878 - DNA, 20 bp, Artificial Sequence
  Description of Artificial Sequence: Synthetic oligonucleotide
  Target: SCN10A; (-) strand; PAM type: NRG; PAM sequence: GAG
agacatctataagctagaaa

SEQ ID NO: 24879 - DNA, 20 bp, Artificial Sequence
  Description of Artificial Sequence: Synthetic oligonucleotide
  Target: SCN10A; (-) strand; PAM type: NRG; PAM sequence: AAG
gtagacatctataagctaga

SEQ ID NO: 24880 - DNA, 20 bp, Artificial Sequence
  Description of Artificial Sequence: Synthetic oligonucleotide
  Target: SCN10A; (-) strand; PAM type: NRG; PAM sequence: TAG
caaggtagacatctataagc

SEQ ID NO: 24881 - DNA, 20 bp, Artificial Sequence
  Description of Artificial Sequence: Synthetic oligonucleotide
  Target: SCN10A; (-) strand; PAM type: NRG; PAM sequence: AAG
aggacaaggtagacatctat

SEQ ID NO: 24882 - DNA, 20 bp, Artificial Sequence
  Description of Artificial Sequence: Synthetic oligonucleotide
  Target: SCN10A; (-) strand; PAM type: NRG; PAM sequence: TAG
gtgagaacacaaggacaagg

SEQ ID NO: 24883 - DNA, 20 bp, Artificial Sequence
  Description of Artificial Sequence: Synthetic oligonucleotide
  Target: SCN10A; (-) strand; PAM type: NRG; PAM sequence: AGG
tgtgtgagaacacaaggaca

SEQ ID NO: 24884 - DNA, 20 bp, Artificial Sequence
  Description of Artificial Sequence: Synthetic oligonucleotide
  Target: SCN10A; (-) strand; PAM type: NRG; PAM sequence: AAG
ttgtgtgagaacacaaggac

SEQ ID NO: 24885 - DNA, 20 bp, Artificial Sequence
  Description of Artificial Sequence: Synthetic oligonucleotide
  Target: SCN10A; (-) strand; PAM type: NRG; PAM sequence: AGG
cccctttgtgtgagaacaca

SEQ ID NO: 24886 - DNA, 20 bp, Artificial Sequence
  Description of Artificial Sequence: Synthetic oligonucleotide
  Target: SCN10A; (-) strand; PAM type: NRG; PAM sequence: AAG
tcccctttgtgtgagaacac

SEQ ID NO: 24887 - DNA, 20 bp, Artificial Sequence
  Description of Artificial Sequence: Synthetic oligonucleotide
  Target: SCN10A; (-) strand; PAM type: NRG; PAM sequence: GAG
cagctttctcccctttgtgt

SEQ ID NO: 24888 - DNA, 20 bp, Artificial Sequence
  Description of Artificial Sequence: Synthetic oligonucleotide
  Target: SCN10A; (-) strand; PAM type: NRG; PAM sequence: CAG
gtccttataagagaaagaga

SEQ ID NO: 24889 - DNA, 20 bp, Artificial Sequence
  Description of Artificial Sequence: Synthetic oligonucleotide
  Target: SCN10A; (-) strand; PAM type: NRG; PAM sequence: GAG
tggtgtccttataagagaaa

SEQ ID NO: 24890 - DNA, 20 bp, Artificial Sequence
  Description of Artificial Sequence: Synthetic oligonucleotide
  Target: SCN10A; (-) strand; PAM type: NRG; PAM sequence: AAG
actggtgtccttataagaga

SEQ ID NO: 24891 - DNA, 20 bp, Artificial Sequence
  Description of Artificial Sequence: Synthetic oligonucleotide
  Target: SCN10A; (-) strand; PAM type: NRG; PAM sequence: GAG
tagaactggtgtccttataa

SEQ ID NO: 24892 - DNA, 20 bp, Artificial Sequence
  Description of Artificial Sequence: Synthetic oligonucleotide
  Target: SCN10A; (-) strand; PAM type: NRG; PAM sequence: AAG
ggtagaactggtgtccttat

SEQ ID NO: 24893 - DNA, 20 bp, Artificial Sequence
  Description of Artificial Sequence: Synthetic oligonucleotide
  Target: SCN10A; (-) strand; PAM type: NRG; PAM sequence: TGG
gagcccttaagtggtagaac

SEQ ID NO: 24894 - DNA, 20 bp, Artificial Sequence
  Description of Artificial Sequence: Synthetic oligonucleotide
  Target: SCN10A; (-) strand; PAM type: NRG; PAM sequence: TAG
agagtagagcccttaagtgg

SEQ ID NO: 24895 - DNA, 20 bp, Artificial Sequence
  Description of Artificial Sequence: Synthetic oligonucleotide
  Target: SCN10A; (-) strand; PAM type: NRG; PAM sequence: TGG
acaagagtagagcccttaag

SEQ ID NO: 24896 - DNA, 20 bp, Artificial Sequence
  Description of Artificial Sequence: Synthetic oligonucleotide
  Target: SCN10A; (-) strand; PAM type: NRG; PAM sequence: AAG
gtcacaagagtagagccctt

SEQ ID NO: 24897 - DNA, 20 bp, Artificial Sequence
  Description of Artificial Sequence: Synthetic oligonucleotide
  Target: SCN10A; (-) strand; PAM type: NRG; PAM sequence: GAG
taaatgaagtcacaagagta

SEQ ID NO: 24898 - DNA, 20 bp, Artificial Sequence
  Description of Artificial Sequence: Synthetic oligonucleotide
  Target: SCN10A; (-) strand; PAM type: NRG; PAM sequence: TAG
gttaaatgaagtcacaagag

SEQ ID NO: 24899 - DNA, 20 bp, Artificial Sequence
  Description of Artificial Sequence: Synthetic oligonucleotide
  Target: SCN10A; (-) strand; PAM type: NRG; PAM sequence: GAG
tgggttaaatgaagtcacaa

SEQ ID NO: 24900 - DNA, 20 bp, Artificial Sequence
  Description of Artificial Sequence: Synthetic oligonucleotide
  Target: SCN10A; (-) strand; PAM type: NRG; PAM sequence: AAG
attgggttaaatgaagtcac

SEQ ID NO: 24901 - DNA, 20 bp, Artificial Sequence
  Description of Artificial Sequence: Synthetic oligonucleotide
  Target: SCN10A; (-) strand; PAM type: NRG; PAM sequence: AAG
ggaggtgattgggttaaatg

SEQ ID NO: 24902 - DNA, 20 bp, Artificial Sequence
  Description of Artificial Sequence: Synthetic oligonucleotide
  Target: SCN10A; (-) strand; PAM type: NRG; PAM sequence: GGG
gggcctctaaggaggtgatt

SEQ ID NO: 24903 - DNA, 20 bp, Artificial Sequence
  Description of Artificial Sequence: Synthetic oligonucleotide
  Target: SCN10A; (-) strand; PAM type: NRG; PAM sequence: TGG
tgggcctctaaggaggtgat

SEQ ID NO: 24904 - DNA, 20 bp, Artificial Sequence
  Description of Artificial Sequence: Synthetic oligonucleotide
  Target: SCN10A; (-) strand; PAM type: NRG; PAM sequence: AGG
tggagattgggcctctaagg

SEQ ID NO: 24905 - DNA, 20 bp, Artificial Sequence
  Description of Artificial Sequence: Synthetic oligonucleotide
  Target: SCN10A; (-) strand; PAM type: NRG; PAM sequence: GAG
ttggagattgggcctctaag

SEQ ID NO: 24906 - DNA, 20 bp, Artificial Sequence
  Description of Artificial Sequence: Synthetic oligonucleotide
  Target: SCN10A; (-) strand; PAM type: NRG; PAM sequence: AGG
tgttggagattgggcctcta

SEQ ID NO: 24907 - DNA, 20 bp, Artificial Sequence
  Description of Artificial Sequence: Synthetic oligonucleotide
  Target: SCN10A; (-) strand; PAM type: NRG; PAM sequence: AAG
atgttggagattgggcctct

SEQ ID NO: 24908 - DNA, 20 bp, Artificial Sequence
  Description of Artificial Sequence: Synthetic oligonucleotide
  Target: SCN10A; (-) strand; PAM type: NRG; PAM sequence: GGG
atgttgctatgttggagatt

SEQ ID NO: 24909 - DNA, 20 bp, Artificial Sequence
  Description of Artificial Sequence: Synthetic oligonucleotide
  Target: SCN10A; (-) strand; PAM type: NRG; PAM sequence: TGG
catgttgctatgttggagat

SEQ ID NO: 24910 - DNA, 20 bp, Artificial Sequence
  Description of Artificial Sequence: Synthetic oligonucleotide
  Target: SCN10A; (-) strand; PAM type: NRG; PAM sequence: GAG
ccccccatgttgctatgttg

SEQ ID NO: 24911 - DNA, 20 bp, Artificial Sequence
  Description of Artificial Sequence: Synthetic oligonucleotide
  Target: SCN10A; (-) strand; PAM type: NRG; PAM sequence: TGG
aaccccccatgttgctatgt

SEQ ID NO: 24912 - DNA, 20 bp, Artificial Sequence
  Description of Artificial Sequence: Synthetic oligonucleotide
  Target: SCN10A; (-) strand; PAM type: NRG; PAM sequence: GAG
ttgtcacacaagctgctatg

SEQ ID NO: 24913 - DNA, 20 bp, Artificial Sequence
  Description of Artificial Sequence: Synthetic oligonucleotide
  Target: SCN10A; (-) strand; PAM type: NRG; PAM sequence: TGG
agttgtcacacaagctgcta

SEQ ID NO: 24914 - DNA, 20 bp, Artificial Sequence
  Description of Artificial Sequence: Synthetic oligonucleotide
  Target: SCN10A; (-) strand; PAM type: NRG; PAM sequence: AAG
ggcatgggtagttgtcacac

SEQ ID NO: 24915 - DNA, 20 bp, Artificial Sequence
  Description of Artificial Sequence: Synthetic oligonucleotide
  Target: SCN10A; (-) strand; PAM type: NRG; PAM sequence: TAG
gttccattttatggcatggg

SEQ ID NO: 24916 - DNA, 20 bp, Artificial Sequence
  Description of Artificial Sequence: Synthetic oligonucleotide
  Target: SCN10A; (-) strand; PAM type: NRG; PAM sequence: GGG
cacgttccattttatggcat

SEQ ID NO: 24917 - DNA, 20 bp, Artificial Sequence
  Description of Artificial Sequence: Synthetic oligonucleotide
  Target: SCN10A; (-) strand; PAM type: NRG; PAM sequence: TGG
tcacgttccattttatggca

SEQ ID NO: 24918 - DNA, 20 bp, Artificial Sequence
  Description of Artificial Sequence: Synthetic oligonucleotide
  Target: SCN10A; (-) strand; PAM type: NRG; PAM sequence: TGG
gctggtcacgttccatttta

SEQ ID NO: 24919 - DNA, 20 bp, Artificial Sequence
  Description of Artificial Sequence: Synthetic oligonucleotide
  Target: SCN10A; (-) strand; PAM type: NRG; PAM sequence: TGG
ggaaggagctggtgaagtgc

SEQ ID NO: 24920 - DNA, 20 bp, Artificial Sequence
  Description of Artificial Sequence: Synthetic oligonucleotide
  Target: SCN10A; (-) strand; PAM type: NRG; PAM sequence: AAG
taattgggaaggagctggtg

SEQ ID NO: 24921 - DNA, 20 bp, Artificial Sequence
  Description of Artificial Sequence: Synthetic oligonucleotide
  Target: SCN10A; (-) strand; PAM type: NRG; PAM sequence: TGG
ggatgtaattgggaaggagc

SEQ ID NO: 24922 - DNA, 20 bp, Artificial Sequence
  Description of Artificial Sequence: Synthetic oligonucleotide
  Target: SCN10A; (-) strand; PAM type: NRG; PAM sequence: GAG
gggaggatgtaattgggaag

SEQ ID NO: 24923 - DNA, 20 bp, Artificial Sequence
  Description of Artificial Sequence: Synthetic oligonucleotide
  Target: SCN10A; (-) strand; PAM type: NRG; PAM sequence: AGG
gagggaggatgtaattggga

SEQ ID NO: 24924 - DNA, 20 bp, Artificial Sequence
  Description of Artificial Sequence: Synthetic oligonucleotide
  Target: SCN10A; (-) strand; PAM type: NRG; PAM sequence: AAG
agagggaggatgtaattggg

SEQ ID NO: 24925 - DNA, 20 bp, Artificial Sequence
  Description of Artificial Sequence: Synthetic oligonucleotide
  Target: SCN10A; (-) strand; PAM type: NRG; PAM sequence: GGG
agaagagggaggatgtaatt

SEQ ID NO: 24926 - DNA, 20 bp, Artificial Sequence
  Description of Artificial Sequence: Synthetic oligonucleotide
  Target: SCN10A; (-) strand; PAM type: NRG; PAM sequence: TGG
cagaagagggaggatgtaat

SEQ ID NO: 24927 - DNA, 20 bp, Artificial Sequence
  Description of Artificial Sequence: Synthetic oligonucleotide
  Target: SCN10A; (-) strand; PAM type: NRG; PAM sequence: AGG
gcctccagggcagaagaggg

SEQ ID NO: 24928 - DNA, 20 bp, Artificial Sequence
  Description of Artificial Sequence: Synthetic oligonucleotide
  Target: SCN10A; (-) strand; PAM type: NRG; PAM sequence: GAG
ggcctccagggcagaagagg

SEQ ID NO: 24929 - DNA, 20 bp, Artificial Sequence
  Description of Artificial Sequence: Synthetic oligonucleotide
  Target: SCN10A; (-) strand; PAM type: NRG; PAM sequence: GGG
gtggcctccagggcagaaga

SEQ ID NO: 24930 - DNA, 20 bp, Artificial Sequence
  Description of Artificial Sequence: Synthetic oligonucleotide
  Target: SCN10A; (-) strand; PAM type: NRG; PAM sequence: AGG
agtggcctccagggcagaag

SEQ ID NO: 24931 - DNA, 20 bp, Artificial Sequence
  Description of Artificial Sequence: Synthetic oligonucleotide
  Target: SCN10A; (-) strand; PAM type: NRG; PAM sequence: GAG
tagtggcctccagggcagaa

SEQ ID NO: 24932 - DNA, 20 bp, Artificial Sequence
  Description of Artificial Sequence: Synthetic oligonucleotide
  Target: SCN10A; (-) strand; PAM type: NRG; PAM sequence: AAG
aatagtggcctccagggcag

SEQ ID NO: 24933 - DNA, 20 bp, Artificial Sequence
  Description of Artificial Sequence: Synthetic oligonucleotide
  Target: SCN10A; (-) strand; PAM type: NRG; PAM sequence: CAG
gagaatagtggcctccaggg

SEQ ID NO: 24934 - DNA, 20 bp, Artificial Sequence
  Description of Artificial Sequence: Synthetic oligonucleotide
  Target: SCN10A; (-) strand; PAM type: NRG; PAM sequence: GGG
taggagaatagtggcctcca

SEQ ID NO: 24935 - DNA, 20 bp, Artificial Sequence
  Description of Artificial Sequence: Synthetic oligonucleotide
  Target: SCN10A; (-) strand; PAM type: NRG; PAM sequence: AGG
ttaggagaatagtggcctcc

SEQ ID NO: 24936 - DNA, 20 bp, Artificial Sequence
  Description of Artificial Sequence: Synthetic oligonucleotide
  Target: SCN10A; (-) strand; PAM type: NRG; PAM sequence: CAG
attaggagaatagtggcctc

SEQ ID NO: 24937 - DNA, 20 bp, Artificial Sequence
  Description of Artificial Sequence: Synthetic oligonucleotide
  Target: SCN10A; (-) strand; PAM type: NRG; PAM sequence: TGG
accaaaaattaggagaatag

SEQ ID NO: 24938 - DNA, 20 bp, Artificial Sequence
  Description of Artificial Sequence: Synthetic oligonucleotide
  Target: SCN10A; (-) strand; PAM type: NRG; PAM sequence: TAG
agtaccaaaaattaggagaa

SEQ ID NO: 24939 - DNA, 20 bp, Artificial Sequence
  Description of Artificial Sequence: Synthetic oligonucleotide
  Target: SCN10A; (-) strand; PAM type: NRG; PAM sequence: GAG
gaaaaagtaccaaaaattag

SEQ ID NO: 24940 - DNA, 20 bp, Artificial Sequence
  Description of Artificial Sequence: Synthetic oligonucleotide
  Target: SCN10A; (-) strand; PAM type: NRG; PAM sequence: AGG
aagaaaaagtaccaaaaatt

SEQ ID NO: 24941 - DNA, 20 bp, Artificial Sequence
  Description of Artificial Sequence: Synthetic oligonucleotide
  Target: SCN10A; (-) strand; PAM type: NRG; PAM sequence: TAG
caagaaaaagtaccaaaaat

SEQ ID NO: 24942 - DNA, 20 bp, Artificial Sequence
  Description of Artificial Sequence: Synthetic oligonucleotide
  Target: SCN10A; (-) strand; PAM type: NRG; PAM sequence: AAG
caataaagtaaggcaagaaa

SEQ ID NO: 24943 - DNA, 20 bp, Artificial Sequence
  Description of Artificial Sequence: Synthetic oligonucleotide
  Target: SCN10A; (-) strand; PAM type: NRG; PAM sequence: AAG
aagcatcaataaagtaaggc

SEQ ID NO: 24944 - DNA, 20 bp, Artificial Sequence
  Description of Artificial Sequence: Synthetic oligonucleotide
  Target: SCN10A; (-) strand; PAM type: NRG; PAM sequence: AGG
taaaaagcatcaataaagta

SEQ ID NO: 24945 - DNA, 20 bp, Artificial Sequence
  Description of Artificial Sequence: Synthetic oligonucleotide
  Target: SCN10A; (-) strand; PAM type: NRG; PAM sequence: AAG
gtaaaaagcatcaataaagt

SEQ ID NO: 24946 - DNA, 20 bp, Artificial Sequence
  Description of Artificial Sequence: Synthetic oligonucleotide
  Target: SCN10A; (-) strand; PAM type: NRG; PAM sequence: AAG
tgaagtaaaaagcatcaata

SEQ ID NO: 24947 - DNA, 20 bp, Artificial Sequence
  Description of Artificial Sequence: Synthetic oligonucleotide
  Target: SCN10A; (-) strand; PAM type: NRG; PAM sequence: AAG
atgcatacttatgaagtaaa

SEQ ID NO: 24948 - DNA, 20 bp, Artificial Sequence
  Description of Artificial Sequence: Synthetic oligonucleotide
  Target: SCN10A; (-) strand; PAM type: NRG; PAM sequence: AAG
tttaggaatgcatacttatg

SEQ ID NO: 24949 - DNA, 20 bp, Artificial Sequence
  Description of Artificial Sequence: Synthetic oligonucleotide
  Target: SCN10A; (-) strand; PAM type: NRG; PAM sequence: AGG
aaaactaaactattttgttt

SEQ ID NO: 24950 - DNA, 20 bp, Artificial Sequence
  Description of Artificial Sequence: Synthetic oligonucleotide
  Target: SCN10A; (-) strand; PAM type: NRG; PAM sequence: TAG
caaaactaaactattttgtt

SEQ ID NO: 24951 - DNA, 20 bp, Artificial Sequence
  Description of Artificial Sequence: Synthetic oligonucleotide
  Target: SCN10A; (-) strand; PAM type: NRG; PAM sequence: AAG
tttatataaagtttgaaatc

SEQ ID NO: 24952 - DNA, 20 bp, Artificial Sequence
  Description of Artificial Sequence: Synthetic oligonucleotide
  Target: SCN10A; (-) strand; PAM type: NRG; PAM sequence: AAG
aaacaaggttcatttatata

SEQ ID NO: 24953 - DNA, 20 bp, Artificial Sequence
  Description of Artificial Sequence: Synthetic oligonucleotide
  Target: SCN10A; (-) strand; PAM type: NRG; PAM sequence: AGG
tgcaaaggattacataaaca

SEQ ID NO: 24954 - DNA, 20 bp, Artificial Sequence
  Description of Artificial Sequence: Synthetic oligonucleotide
  Target: SCN10A; (-) strand; PAM type: NRG; PAM sequence: AAG
atgcaaaggattacataaac

SEQ ID NO: 24955 - DNA, 20 bp, Artificial Sequence
  Description of Artificial Sequence: Synthetic oligonucleotide
  Target: SCN10A; (-) strand; PAM type: NRG; PAM sequence: AGG
acaaaaaaagccaaatgcaa

SEQ ID NO: 24956 - DNA, 20 bp, Artificial Sequence
  Description of Artificial Sequence: Synthetic oligonucleotide
  Target: SCN10A; (-) strand; PAM type: NRG; PAM sequence: AAG
aacaaaaaaagccaaatgca

SEQ ID NO: 24957 - DNA, 20 bp, Artificial Sequence
  Description of Artificial Sequence: Synthetic oligonucleotide
  Target: SCN10A; (-) strand; PAM type: NRG; PAM sequence: AAG
aaagtaatattgaacaaaaa

SEQ ID NO: 24958 - DNA, 20 bp, Artificial Sequence
  Description of Artificial Sequence: Synthetic oligonucleotide
  Target: SCN10A; (-) strand; PAM type: NRG; PAM sequence: AAG
aataaggatgagtcttaaga

SEQ ID NO: 24959 - DNA, 20 bp, Artificial Sequence
  Description of Artificial Sequence: Synthetic oligonucleotide
  Target: SCN10A; (-) strand; PAM type: NRG; PAM sequence: AAG
caacaataaggatgagtctt

SEQ ID NO: 24960 - DNA, 20 bp, Artificial Sequence
  Description of Artificial Sequence: Synthetic oligonucleotide
  Target: SCN10A; (-) strand; PAM type: NRG; PAM sequence: GAG
tgctgcacaacaataaggat

SEQ ID NO: 24961 - DNA, 20 bp, Artificial Sequence
  Description of Artificial Sequence: Synthetic oligonucleotide
  Target: SCN10A; (-) strand; PAM type: NRG; PAM sequence: AGG
tttagtgctgcacaacaata

SEQ ID NO: 24962 - DNA, 20 bp, Artificial Sequence
  Description of Artificial Sequence: Synthetic oligonucleotide
  Target: SCN10A; (-) strand; PAM type: NRG; PAM sequence: AAG
ctttagtgctgcacaacaat

SEQ ID NO: 24963 - DNA, 20 bp, Artificial Sequence
  Description of Artificial Sequence: Synthetic oligonucleotide
  Target: SCN10A; (-) strand; PAM type: NRG; PAM sequence: TAG
caataaaaattaataaactt

SEQ ID NO: 24964 - DNA, 20 bp, Artificial Sequence
  Description of Artificial Sequence: Synthetic oligonucleotide
  Target: SCN10A; (-) strand; PAM type: NRG; PAM sequence: CAG
ttctaaaatgagaaaactta

SEQ ID NO: 24965 - DNA, 20 bp, Artificial Sequence
  Description of Artificial Sequence: Synthetic oligonucleotide
  Target: SCN10A; (-) strand; PAM type: NRG; PAM sequence: GAG
tttctgttatattctaaaat

SEQ ID NO: 24966 - DNA, 20 bp, Artificial Sequence
  Description of Artificial Sequence: Synthetic oligonucleotide
  Target: SCN10A; (-) strand; PAM type: NRG; PAM sequence: GAG
ctcaaatgtccataaacttt

SEQ ID NO: 24967 - DNA, 20 bp, Artificial Sequence
  Description of Artificial Sequence: Synthetic oligonucleotide
  Target: SCN10A; (-) strand; PAM type: NRG; PAM sequence: CGG
tgcccataaaaaccccaaac

SEQ ID NO: 24968 - DNA, 20 bp, Artificial Sequence
  Description of Artificial Sequence: Synthetic oligonucleotide
  Target: SCN10A; (-) strand; PAM type: NRG; PAM sequence: AAG
accagattacagctacaaga

SEQ ID NO: 24969 - DNA, 20 bp, Artificial Sequence
  Description of Artificial Sequence: Synthetic oligonucleotide
  Target: SCN10A; (-) strand; PAM type: NRG; PAM sequence: AAG
ggacaccagattacagctac

SEQ ID NO: 24970 - DNA, 20 bp, Artificial Sequence
  Description of Artificial Sequence: Synthetic oligonucleotide
  Target: SCN10A; (-) strand; PAM type: NRG; PAM sequence: CAG
tacttgtggacaccagatta

SEQ ID NO: 24971 - DNA, 20 bp, Artificial Sequence
  Description of Artificial Sequence: Synthetic oligonucleotide
  Target: SCN10A; (-) strand; PAM type: NRG; PAM sequence: CAG
aaatatgtacttgtggacac

SEQ ID NO: 24972 - DNA, 20 bp, Artificial Sequence
  Description of Artificial Sequence: Synthetic oligonucleotide
  Target: SCN10A; (-) strand; PAM type: NRG; PAM sequence: TGG
ttaacagaaatatgtacttg

SEQ ID NO: 24973 - DNA, 20 bp, Artificial Sequence
  Description of Artificial Sequence: Synthetic oligonucleotide
  Target: SCN10A; (-) strand; PAM type: NRG; PAM sequence: CAG
ccttaggtacctatgtttaa

SEQ ID NO: 24974 - DNA, 20 bp, Artificial Sequence
  Description of Artificial Sequence: Synthetic oligonucleotide
  Target: SCN10A; (-) strand; PAM type: NRG; PAM sequence: AGG
tattcttctattacaccctt

SEQ ID NO: 24975 - DNA, 20 bp, Artificial Sequence
  Description of Artificial Sequence: Synthetic oligonucleotide
  Target: SCN10A; (-) strand; PAM type: NRG; PAM sequence: TAG
gtattcttctattacaccct

SEQ ID NO: 24976 - DNA, 20 bp, Artificial Sequence
  Description of Artificial Sequence: Synthetic oligonucleotide
  Target: SCN10A; (-) strand; PAM type: NRG; PAM sequence: AAG
gtattatctagtaaaggtgt

SEQ ID NO: 24977 - DNA, 20 bp, Artificial Sequence
  Description of Artificial Sequence: Synthetic oligonucleotide
  Target: SCN10A; (-) strand; PAM type: NRG; PAM sequence: AGG
caaggggtattatctagtaa

SEQ ID NO: 24978 - DNA, 20 bp, Artificial Sequence
  Description of Artificial Sequence: Synthetic oligonucleotide
  Target: SCN10A; (-) strand; PAM type: NRG; PAM sequence: AAG
gcaaggggtattatctagta

SEQ ID NO: 24979 - DNA, 20 bp, Artificial Sequence
  Description of Artificial Sequence: Synthetic oligonucleotide
  Target: SCN10A; (-) strand; PAM type: NRG; PAM sequence: TAG
ggaaagcaaggggtattatc

SEQ ID NO: 24980 - DNA, 20 bp, Artificial Sequence
  Description of Artificial Sequence: Synthetic oligonucleotide
  Target: SCN10A; (-) strand; PAM type: NRG; PAM sequence: GGG
caacctctttggaaagcaag

SEQ ID NO: 24981 - DNA, 20 bp, Artificial Sequence
  Description of Artificial Sequence: Synthetic oligonucleotide
  Target: SCN10A; (-) strand; PAM type: NRG; PAM sequence: GGG
acaacctctttggaaagcaa

SEQ ID NO: 24982 - DNA, 20 bp, Artificial Sequence
  Description of Artificial Sequence: Synthetic oligonucleotide
  Target: SCN10A; (-) strand; PAM type: NRG; PAM sequence: AGG
gacaacctctttggaaagca

SEQ ID NO: 24983 - DNA, 20 bp, Artificial Sequence
  Description of Artificial Sequence: Synthetic oligonucleotide
  Target: SCN10A; (-) strand; PAM type: NRG; PAM sequence: AAG
ggacaacctctttggaaagc

SEQ ID NO: 24984 - DNA, 20 bp, Artificial Sequence
  Description of Artificial Sequence: Synthetic oligonucleotide
  Target: SCN10A; (-) strand; PAM type: NRG; PAM sequence: AAG
atttggacaacctctttgga

SEQ ID NO: 24985 - DNA, 20 bp, Artificial Sequence
  Description of Artificial Sequence: Synthetic oligonucleotide
  Target: SCN10A; (-) strand; PAM type: NRG; PAM sequence: TGG
gtaaatttggacaacctctt

SEQ ID NO: 24986 - DNA, 20 bp, Artificial Sequence
  Description of Artificial Sequence: Synthetic oligonucleotide
  Target: SCN10A; (-) strand; PAM type: NRG; PAM sequence: TGG
tgctggtgggagtgtaaatt

SEQ ID NO: 24987 - DNA, 20 bp, Artificial Sequence
  Description of Artificial Sequence: Synthetic oligonucleotide
  Target: SCN10A; (-) strand; PAM type: NRG; PAM sequence: GAG
aactcacacactgctggtgg

SEQ ID NO: 24988 - DNA, 20 bp, Artificial Sequence
  Description of Artificial Sequence: Synthetic oligonucleotide
  Target: SCN10A; (-) strand; PAM type: NRG; PAM sequence: GGG
gaaactcacacactgctggt

SEQ ID NO: 24989 - DNA, 20 bp, Artificial Sequence
  Description of Artificial Sequence: Synthetic oligonucleotide
  Target: SCN10A; (-) strand; PAM type: NRG; PAM sequence: TGG
agaaactcacacactgctgg

SEQ ID NO: 24990 - DNA, 20 bp, Artificial Sequence
  Description of Artificial Sequence: Synthetic oligonucleotide
  Target: SCN10A; (-) strand; PAM type: NRG; PAM sequence: TGG
aacagaaactcacacactgc

SEQ ID NO: 24991 - DNA, 20 bp, Artificial Sequence
  Description of Artificial Sequence: Synthetic oligonucleotide
  Target: SCN10A; (-) strand; PAM type: NRG; PAM sequence: CAG
ttgggaatgacatggagcaa

SEQ ID NO: 24992 - DNA, 20 bp, Artificial Sequence
  Description of Artificial Sequence: Synthetic oligonucleotide
  Target: SCN10A; (-) strand; PAM type: NRG; PAM sequence: GAG
caagtattgggaatgacatg

SEQ ID NO: 24993 - DNA, 20 bp, Artificial Sequence
  Description of Artificial Sequence: Synthetic oligonucleotide
  Target: SCN10A; (-) strand; PAM type: NRG; PAM sequence: TGG
accaagtattgggaatgaca

SEQ ID NO: 24994 - DNA, 20 bp, Artificial Sequence
  Description of Artificial Sequence: Synthetic oligonucleotide
  Target: SCN10A; (-) strand; PAM type: NRG; PAM sequence: GGG
gtgtcacaataccaagtatt

SEQ ID NO: 24995 - DNA, 20 bp, Artificial Sequence
  Description of Artificial Sequence: Synthetic oligonucleotide
  Target: SCN10A; (-) strand; PAM type: NRG; PAM sequence: TGG
agtgtcacaataccaagtat

SEQ ID NO: 24996 - DNA, 20 bp, Artificial Sequence
  Description of Artificial Sequence: Synthetic oligonucleotide
  Target: SCN10A; (-) strand; PAM type: NRG; PAM sequence: AAG
ttttaaagtgtcacaatacc

SEQ ID NO: 24997 - DNA, 20 bp, Artificial Sequence
  Description of Artificial Sequence: Synthetic oligonucleotide
  Target: SCN10A; (-) strand; PAM type: NRG; PAM sequence: AAG
catagaagggaaatttttta

SEQ ID NO: 24998 - DNA, 20 bp, Artificial Sequence
  Description of Artificial Sequence: Synthetic oligonucleotide
  Target: SCN10A; (-) strand; PAM type: NRG; PAM sequence: GGG
attacatgttcatcatagaa

SEQ ID NO: 24999 - DNA, 20 bp, Artificial Sequence
  Description of Artificial Sequence: Synthetic oligonucleotide
  Target: SCN10A; (-) strand; PAM type: NRG; PAM sequence: AGG
tattacatgttcatcataga

SEQ ID NO: 25000 - DNA, 20 bp, Artificial Sequence
  Description of Artificial Sequence: Synthetic oligonucleotide
  Target: SCN10A; (-) strand; PAM type: NRG; PAM sequence: AAG
ttattacatgttcatcatag

SEQ ID NO: 25001 - DNA, 20 bp, Artificial Sequence
  Description of Artificial Sequence: Synthetic oligonucleotide
  Target: SCN10A; (-) strand; PAM type: NRG; PAM sequence: TAG
attttattacatgttcatca

SEQ ID NO: 25002 - DNA, 20 bp, Artificial Sequence
  Description of Artificial Sequence: Synthetic oligonucleotide
  Target: SCN10A; (-) strand; PAM type: NRG; PAM sequence: GAG
ttgcaaattaaaatcacact

SEQ ID NO: 25003 - DNA, 20 bp, Artificial Sequence
  Description of Artificial Sequence: Synthetic oligonucleotide
  Target: SCN10A; (-) strand; PAM type: NRG; PAM sequence: GAG
taacctttttttaaatcaaa

SEQ ID NO: 25004 - DNA, 20 bp, Artificial Sequence
  Description of Artificial Sequence: Synthetic oligonucleotide
  Target: SCN10A; (-) strand; PAM type: NRG; PAM sequence: AAG
cttaacctttttttaaatca

SEQ ID NO: 25005 - DNA, 20 bp, Artificial Sequence
  Description of Artificial Sequence: Synthetic oligonucleotide
  Target: SCN10A; (-) strand; PAM type: NRG; PAM sequence: AAG
aaatggccataaacatatga

SEQ ID NO: 25006 - DNA, 20 bp, Artificial Sequence
  Description of Artificial Sequence: Synthetic oligonucleotide
  Target: SCN10A; (-) strand; PAM type: NRG; PAM sequence: TGG
tacaaaagtggaaatccaaa

SEQ ID NO: 25007 - DNA, 20 bp, Artificial Sequence
  Description of Artificial Sequence: Synthetic oligonucleotide
  Target: SCN10A; (-) strand; PAM type: NRG; PAM sequence: TGG
gaataggcactttacaaaag

SEQ ID NO: 25008 - DNA, 20 bp, Artificial Sequence
  Description of Artificial Sequence: Synthetic oligonucleotide
  Target: SCN10A; (-) strand; PAM type: NRG; PAM sequence: AAG
tttgaataggcactttacaa

SEQ ID NO: 25009 - DNA, 20 bp, Artificial Sequence
  Description of Artificial Sequence: Synthetic oligonucleotide
  Target: SCN10A; (-) strand; PAM type: NRG; PAM sequence: AGG
aaatagcacaaaatttgaat

SEQ ID NO: 25010 - DNA, 20 bp, Artificial Sequence
  Description of Artificial Sequence: Synthetic oligonucleotide
  Target: SCN10A; (-) strand; PAM type: NRG; PAM sequence: TAG
aaaatagcacaaaatttgaa

SEQ ID NO: 25011 - DNA, 20 bp, Artificial Sequence
  Description of Artificial Sequence: Synthetic oligonucleotide
  Target: SCN10A; (-) strand; PAM type: NRG; PAM sequence: TAG
cagaacaaccacttgtaaaa

SEQ ID NO: 25012 - DNA, 20 bp, Artificial Sequence
  Description of Artificial Sequence: Synthetic oligonucleotide
  Target: SCN10A; (-) strand; PAM type: NRG; PAM sequence: CAG
caaatcaattagaaaaatgt

SEQ ID NO: 25013 - DNA, 20 bp, Artificial Sequence
  Description of Artificial Sequence: Synthetic oligonucleotide
  Target: SCN10A; (-) strand; PAM type: NRG; PAM sequence: TAG
aatgaactctacaaatcaat

SEQ ID NO: 25014 - DNA, 20 bp, Artificial Sequence
  Description of Artificial Sequence: Synthetic oligonucleotide
  Target: SCN10A; (-) strand; PAM type: NRG; PAM sequence: GAG
aaagcaagtgcttatattca

SEQ ID NO: 25015 - DNA, 20 bp, Artificial Sequence
  Description of Artificial Sequence: Synthetic oligonucleotide
  Target: SCN10A; (-) strand; PAM type: NRG; PAM sequence: CAG
aaaaagcaagtgcttatatt

SEQ ID NO: 25016 - DNA, 20 bp, Artificial Sequence
  Description of Artificial Sequence: Synthetic oligonucleotide
  Target: SCN10A; (-) strand; PAM type: NRG; PAM sequence: AAG
ctttaagagcatgaaaaagc

SEQ ID NO: 25017 - DNA, 20 bp, Artificial Sequence
  Description of Artificial Sequence: Synthetic oligonucleotide
  Target: SCN10A; (-) strand; PAM type: NRG; PAM sequence: AAG
acaactttaagagcatgaaa

SEQ ID NO: 25018 - DNA, 20 bp, Artificial Sequence
  Description of Artificial Sequence: Synthetic oligonucleotide
  Target: SCN10A; (-) strand; PAM type: NRG; PAM sequence: GAG
tcatcagaagacaactttaa

SEQ ID NO: 25019 - DNA, 20 bp, Artificial Sequence
  Description of Artificial Sequence: Synthetic oligonucleotide
  Target: SCN10A; (-) strand; PAM type: NRG; PAM sequence: AAG
gttcatcagaagacaacttt

SEQ ID NO: 25020 - DNA, 20 bp, Artificial Sequence
  Description of Artificial Sequence: Synthetic oligonucleotide
  Target: SCN10A; (-) strand; PAM type: NRG; PAM sequence: AAG
taattaagaatgttcatcag

SEQ ID NO: 25021 - DNA, 20 bp, Artificial Sequence
  Description of Artificial Sequence: Synthetic oligonucleotide
  Target: SCN10A; (-) strand; PAM type: NRG; PAM sequence: CAG
ctataattaagaatgttcat

SEQ ID NO: 25022 - DNA, 20 bp, Artificial Sequence
  Description of Artificial Sequence: Synthetic oligonucleotide
  Target: SCN10A; (-) strand; PAM type: NRG; PAM sequence: AAG
cattttagtatactataatt

SEQ ID NO: 25023 - DNA, 20 bp, Artificial Sequence
  Description of Artificial Sequence: Synthetic oligonucleotide
  Target: SCN10A; (-) strand; PAM type: NRG; PAM sequence: TAG
aggaaaaaactgatacattt

SEQ ID NO: 25024 - DNA, 20 bp, Artificial Sequence
  Description of Artificial Sequence: Synthetic oligonucleotide
  Target: SCN10A; (-) strand; PAM type: NRG; PAM sequence: AGG
acaagaagcactaactatac

SEQ ID NO: 25025 - DNA, 20 bp, Artificial Sequence
  Description of Artificial Sequence: Synthetic oligonucleotide
  Target: SCN10A; (-) strand; PAM type: NRG; PAM sequence: CAG
cacaagaagcactaactata

SEQ ID NO: 25026 - DNA, 20 bp, Artificial Sequence
  Description of Artificial Sequence: Synthetic oligonucleotide
  Target: SCN10A; (-) strand; PAM type: NRG; PAM sequence: AAG
tttattacatatgacacaag

SEQ ID NO: 25027 - DNA, 20 bp, Artificial Sequence
  Description of Artificial Sequence: Synthetic oligonucleotide
  Target: SCN10A; (-) strand; PAM type: NRG; PAM sequence: AAG
aactttattacatatgacac

SEQ ID NO: 25028 - DNA, 20 bp, Artificial Sequence
  Description of Artificial Sequence: Synthetic oligonucleotide
  Target: SCN10A; (-) strand; PAM type: NRG; PAM sequence: AAG
tatctttatgacctcagact

SEQ ID NO: 25029 - DNA, 20 bp, Artificial Sequence
  Description of Artificial Sequence: Synthetic oligonucleotide
  Target: SCN10A; (-) strand; PAM type: NRG; PAM sequence: CAG
gaggaatatctttatgacct

SEQ ID NO: 25030 - DNA, 20 bp, Artificial Sequence
  Description of Artificial Sequence: Synthetic oligonucleotide
  Target: SCN10A; (-) strand; PAM type: NRG; PAM sequence: AGG
tttgaaaggaaaaaacaaag

SEQ ID NO: 25031 - DNA, 20 bp, Artificial Sequence
  Description of Artificial Sequence: Synthetic oligonucleotide
  Target: SCN10A; (-) strand; PAM type: NRG; PAM sequence: GAG
ttttgaaaggaaaaaacaaa

SEQ ID NO: 25032 - DNA, 20 bp, Artificial Sequence
  Description of Artificial Sequence: Synthetic oligonucleotide
  Target: SCN10A; (-) strand; PAM type: NRG; PAM sequence: AAG
ctttttgaaaggaaaaaaca

SEQ ID NO: 25033 - DNA, 20 bp, Artificial Sequence
  Description of Artificial Sequence: Synthetic oligonucleotide
  Target: SCN10A; (-) strand; PAM type: NRG; PAM sequence: AGG
tggtggataagctttttgaa

SEQ ID NO: 25034 - DNA, 20 bp, Artificial Sequence
  Description of Artificial Sequence: Synthetic oligonucleotide
  Target: SCN10A; (-) strand; PAM type: NRG; PAM sequence: AAG
gtggtggataagctttttga

SEQ ID NO: 25035 - DNA, 20 bp, Artificial Sequence
  Description of Artificial Sequence: Synthetic oligonucleotide
  Target: SCN10A; (-) strand; PAM type: NRG; PAM sequence: AAG
ccgacttgatcgtggtggat

SEQ ID NO: 25036 - DNA, 20 bp, Artificial Sequence
  Description of Artificial Sequence: Synthetic oligonucleotide
  Target: SCN10A; (-) strand; PAM type: NRG; PAM sequence: TGG
tgaagccgacttgatcgtgg

SEQ ID NO: 25037 - DNA, 20 bp, Artificial Sequence
  Description of Artificial Sequence: Synthetic oligonucleotide
  Target: SCN10A; (-) strand; PAM type: NRG; PAM sequence: TGG
gtatgaagccgacttgatcg

SEQ ID NO: 25038 - DNA, 20 bp, Artificial Sequence
  Description of Artificial Sequence: Synthetic oligonucleotide
  Target: SCN10A; (-) strand; PAM type: NRG; PAM sequence: AAG
cagctttgatcccaggtatg

SEQ ID NO: 25039 - DNA, 20 bp, Artificial Sequence
  Description of Artificial Sequence: Synthetic oligonucleotide
  Target: SCN10A; (-) strand; PAM type: NRG; PAM sequence: AGG
gttgaaccagctttgatccc

SEQ ID NO: 25040 - DNA, 20 bp, Artificial Sequence
  Description of Artificial Sequence: Synthetic oligonucleotide
  Target: SCN10A; (-) strand; PAM type: NRG; PAM sequence: CAG
tgttgaaccagctttgatcc

SEQ ID NO: 25041 - DNA, 20 bp, Artificial Sequence
  Description of Artificial Sequence: Synthetic oligonucleotide
  Target: SCN10A; (-) strand; PAM type: NRG; PAM sequence: CAG
ttgacttgcgtatgttgaac

SEQ ID NO: 25042 - DNA, 20 bp, Artificial Sequence
  Description of Artificial Sequence: Synthetic oligonucleotide
  Target: SCN10A; (-) strand; PAM type: NRG; PAM sequence: TGG
cattggttctgtttgtgtga

SEQ ID NO: 25043 - DNA, 20 bp, Artificial Sequence
  Description of Artificial Sequence: Synthetic oligonucleotide
  Target: SCN10A; (-) strand; PAM type: NRG; PAM sequence: TGG
aatcacgtggtttttgtcat

SEQ ID NO: 25044 - DNA, 20 bp, Artificial Sequence
  Description of Artificial Sequence: Synthetic oligonucleotide
  Target: SCN10A; (-) strand; PAM type: NRG; PAM sequence: TGG
catctattgagataatcacg

SEQ ID NO: 25045 - DNA, 20 bp, Artificial Sequence
  Description of Artificial Sequence: Synthetic oligonucleotide
  Target: SCN10A; (-) strand; PAM type: NRG; PAM sequence: GAG
agaccttttctgcatctatt

SEQ ID NO: 25046 - DNA, 20 bp, Artificial Sequence
  Description of Artificial Sequence: Synthetic oligonucleotide
  Target: SCN10A; (-) strand; PAM type: NRG; PAM sequence: AAG
atgggtgttgaattttgtcg

SEQ ID NO: 25047 - DNA, 20 bp, Artificial Sequence
  Description of Artificial Sequence: Synthetic oligonucleotide
  Target: SCN10A; (-) strand; PAM type: NRG; PAM sequence: GGG
tgagagcttttagcatgaat

SEQ ID NO: 25048 - DNA, 20 bp, Artificial Sequence
  Description of Artificial Sequence: Synthetic oligonucleotide
  Target: SCN10A; (-) strand; PAM type: NRG; PAM sequence: TGG
ttgagagcttttagcatgaa

SEQ ID NO: 25049 - DNA, 20 bp, Artificial Sequence
  Description of Artificial Sequence: Synthetic oligonucleotide
  Target: SCN10A; (-) strand; PAM type: NRG; PAM sequence: TAG
cctagtttattgagagcttt

SEQ ID NO: 25050 - DNA, 20 bp, Artificial Sequence
  Description of Artificial Sequence: Synthetic oligonucleotide
  Target: SCN10A; (-) strand; PAM type: NRG; PAM sequence: GAG
atcaatacctagtttattga

SEQ ID NO: 25051 - DNA, 20 bp, Artificial Sequence
  Description of Artificial Sequence: Synthetic oligonucleotide
  Target: SCN10A; (-) strand; PAM type: NRG; PAM sequence: GAG
ccatcaatacctagtttatt

SEQ ID NO: 25052 - DNA, 20 bp, Artificial Sequence
  Description of Artificial Sequence: Synthetic oligonucleotide
  Target: SCN10A; (-) strand; PAM type: NRG; PAM sequence: TAG
agatacattccatcaatacc

SEQ ID NO: 25053 - DNA, 20 bp, Artificial Sequence
  Description of Artificial Sequence: Synthetic oligonucleotide
  Target: SCN10A; (-) strand; PAM type: NRG; PAM sequence: GAG
taaatagttcttattatttt

SEQ ID NO: 25054 - DNA, 20 bp, Artificial Sequence
  Description of Artificial Sequence: Synthetic oligonucleotide
  Target: SCN10A; (-) strand; PAM type: NRG; PAM sequence: TAG
ggctgggggcttgtcataaa

SEQ ID NO: 25055 - DNA, 20 bp, Artificial Sequence
  Description of Artificial Sequence: Synthetic oligonucleotide
  Target: SCN10A; (-) strand; PAM type: NRG; PAM sequence: GGG
ttcagtatgatattggctgg

SEQ ID NO: 25056 - DNA, 20 bp, Artificial Sequence
  Description of Artificial Sequence: Synthetic oligonucleotide
  Target: SCN10A; (-) strand; PAM type: NRG; PAM sequence: GGG
attcagtatgatattggctg

SEQ ID NO: 25057 - DNA, 20 bp, Artificial Sequence
  Description of Artificial Sequence: Synthetic oligonucleotide
  Target: SCN10A; (-) strand; PAM type: NRG; PAM sequence: GGG
cattcagtatgatattggct

SEQ ID NO: 25058 - DNA, 20 bp, Artificial Sequence
  Description of Artificial Sequence: Synthetic oligonucleotide
  Target: SCN10A; (-) strand; PAM type: NRG; PAM sequence: TGG
ccattcagtatgatattggc

SEQ ID NO: 25059 - DNA, 20 bp, Artificial Sequence
  Description of Artificial Sequence: Synthetic oligonucleotide
  Target: SCN10A; (-) strand; PAM type: NRG; PAM sequence: TGG
ttgcccattcagtatgatat

SEQ ID NO: 25060 - DNA, 20 bp, Artificial Sequence
  Description of Artificial Sequence: Synthetic oligonucleotide
  Target: SCN10A; (-) strand; PAM type: NRG; PAM sequence: CAG
gcttccagtttttgcccatt

SEQ ID NO: 25061 - DNA, 20 bp, Artificial Sequence
  Description of Artificial Sequence: Synthetic oligonucleotide
  Target: SCN10A; (-) strand; PAM type: NRG; PAM sequence: CAG
gttttcaaaggaaatgcttc

SEQ ID NO: 25062 - DNA, 20 bp, Artificial Sequence
  Description of Artificial Sequence: Synthetic oligonucleotide
  Target: SCN10A; (-) strand; PAM type: NRG; PAM sequence: AGG
tgtcttgtgctggttttcaa

SEQ ID NO: 25063 - DNA, 20 bp, Artificial Sequence
  Description of Artificial Sequence: Synthetic oligonucleotide
  Target: SCN10A; (-) strand; PAM type: NRG; PAM sequence: AAG
ttgtcttgtgctggttttca

SEQ ID NO: 25064 - DNA, 20 bp, Artificial Sequence
  Description of Artificial Sequence: Synthetic oligonucleotide
  Target: SCN10A; (-) strand; PAM type: NRG; PAM sequence: TGG
agggcattcttgtcttgtgc

SEQ ID NO: 25065 - DNA, 20 bp, Artificial Sequence
  Description of Artificial Sequence: Synthetic oligonucleotide
  Target: SCN10A; (-) strand; PAM type: NRG; PAM sequence: GGG
tgaataagagtggtgagata

SEQ ID NO: 25066 - DNA, 20 bp, Artificial Sequence
  Description of Artificial Sequence: Synthetic oligonucleotide
  Target: SCN10A; (-) strand; PAM type: NRG; PAM sequence: AGG
ttgaataagagtggtgagat

SEQ ID NO: 25067 - DNA, 20 bp, Artificial Sequence
  Description of Artificial Sequence: Synthetic oligonucleotide
  Target: SCN10A; (-) strand; PAM type: NRG; PAM sequence: TAG
gttgaataagagtggtgaga

SEQ ID NO: 25068 - DNA, 20 bp, Artificial Sequence
  Description of Artificial Sequence: Synthetic oligonucleotide
  Target: SCN10A; (-) strand; PAM type: NRG; PAM sequence: GAG
ctatgttgaataagagtggt

SEQ ID NO: 25069 - DNA, 20 bp, Artificial Sequence
  Description of Artificial Sequence: Synthetic oligonucleotide
  Target: SCN10A; (-) strand; PAM type: NRG; PAM sequence: TGG
aatactatgttgaataagag

SEQ ID NO: 25070 - DNA, 20 bp, Artificial Sequence
  Description of Artificial Sequence: Synthetic oligonucleotide
  Target: SCN10A; (-) strand; PAM type: NRG; PAM sequence: GAG
tccaatactatgttgaataa

SEQ ID NO: 25071 - DNA, 20 bp, Artificial Sequence
  Description of Artificial Sequence: Synthetic oligonucleotide
  Target: SCN10A; (-) strand; PAM type: NRG; PAM sequence: AAG
cttccaatactatgttgaat

SEQ ID NO: 25072 - DNA, 20 bp, Artificial Sequence
  Description of Artificial Sequence: Synthetic oligonucleotide
  Target: SCN10A; (-) strand; PAM type: NRG; PAM sequence: CAG
tcttgcctgatcgccctggc

SEQ ID NO: 25073 - DNA, 20 bp, Artificial Sequence
  Description of Artificial Sequence: Synthetic oligonucleotide
  Target: SCN10A; (-) strand; PAM type: NRG; PAM sequence: TGG
tttctcttgcctgatcgccc

SEQ ID NO: 25074 - DNA, 20 bp, Artificial Sequence
  Description of Artificial Sequence: Synthetic oligonucleotide
  Target: SCN10A; (-) strand; PAM type: NRG; PAM sequence: GAG
agtcatgtcatctgcaaaca

SEQ ID NO: 25075 - DNA, 20 bp, Artificial Sequence
  Description of Artificial Sequence: Synthetic oligonucleotide
  Target: SCN10A; (-) strand; PAM type: NRG; PAM sequence: CAG
acagtcatgtcatctgcaaa

SEQ ID NO: 25076 - DNA, 20 bp, Artificial Sequence
  Description of Artificial Sequence: Synthetic oligonucleotide
  Target: SCN10A; (-) strand; PAM type: NRG; PAM sequence: CAG
gatggggttttctaaatata

SEQ ID NO: 25077 - DNA, 20 bp, Artificial Sequence
  Description of Artificial Sequence: Synthetic oligonucleotide
  Target: SCN10A; (-) strand; PAM type: NRG; PAM sequence: GGG
gattttgggctgagatgatg

SEQ ID NO: 25078 - DNA, 20 bp, Artificial Sequence
  Description of Artificial Sequence: Synthetic oligonucleotide
  Target: SCN10A; (-) strand; PAM type: NRG; PAM sequence: GGG
agattttgggctgagatgat

SEQ ID NO: 25079 - DNA, 20 bp, Artificial Sequence
  Description of Artificial Sequence: Synthetic oligonucleotide
  Target: SCN10A; (-) strand; PAM type: NRG; PAM sequence: TGG
gagattttgggctgagatga

SEQ ID NO: 25080 - DNA, 20 bp, Artificial Sequence
  Description of Artificial Sequence: Synthetic oligonucleotide
  Target: SCN10A; (-) strand; PAM type: NRG; PAM sequence: GAG
gcttaaggagattttgggct

SEQ ID NO: 25081 - DNA, 20 bp, Artificial Sequence
  Description of Artificial Sequence: Synthetic oligonucleotide
  Target: SCN10A; (-) strand; PAM type: NRG; PAM sequence: GGG
tatcagcttaaggagatttt

SEQ ID NO: 25082 - DNA, 20 bp, Artificial Sequence
  Description of Artificial Sequence: Synthetic oligonucleotide
  Target: SCN10A; (-) strand; PAM type: NRG; PAM sequence: TGG
ttatcagcttaaggagattt

SEQ ID NO: 25083 - DNA, 20 bp, Artificial Sequence
  Description of Artificial Sequence: Synthetic oligonucleotide
  Target: SCN10A; (-) strand; PAM type: NRG; PAM sequence: GAG
aagttgcttatcagcttaag

SEQ ID NO: 25084 - DNA, 20 bp, Artificial Sequence
  Description of Artificial Sequence: Synthetic oligonucleotide
  Target: SCN10A; (-) strand; PAM type: NRG; PAM sequence: AGG
tgaagttgcttatcagctta

SEQ ID NO: 25085 - DNA, 20 bp, Artificial Sequence
  Description of Artificial Sequence: Synthetic oligonucleotide
  Target: SCN10A; (-) strand; PAM type: NRG; PAM sequence: AAG
ctgaagttgcttatcagctt

SEQ ID NO: 25086 - DNA, 20 bp, Artificial Sequence
  Description of Artificial Sequence: Synthetic oligonucleotide
  Target: SCN10A; (-) strand; PAM type: NRG; PAM sequence: CAG
actttgctgaagttgcttat

SEQ ID NO: 25087 - DNA, 20 bp, Artificial Sequence
  Description of Artificial Sequence: Synthetic oligonucleotide
  Target: SCN10A; (-) strand; PAM type: NRG; PAM sequence: AAG
tgtatcctgagactttgctg

SEQ ID NO: 25088 - DNA, 20 bp, Artificial Sequence
  Description of Artificial Sequence: Synthetic oligonucleotide
  Target: SCN10A; (-) strand; PAM type: NRG; PAM sequence: GAG
gcacattgattttgtatcct

SEQ ID NO: 25089 - DNA, 20 bp, Artificial Sequence
  Description of Artificial Sequence: Synthetic oligonucleotide
  Target: SCN10A; (-) strand; PAM type: NRG; PAM sequence: GGG
tttgtctgttattggtgtat

SEQ ID NO: 25090 - DNA, 20 bp, Artificial Sequence
  Description of Artificial Sequence: Synthetic oligonucleotide
  Target: SCN10A; (-) strand; PAM type: NRG; PAM sequence: TGG
gtttgtctgttattggtgta

SEQ ID NO: 25091 - DNA, 20 bp, Artificial Sequence
  Description of Artificial Sequence: Synthetic oligonucleotide
  Target: SCN10A; (-) strand; PAM type: NRG; PAM sequence: TGG
gctctcggtttgtctgttat

SEQ ID NO: 25092 - DNA, 20 bp, Artificial Sequence
  Description of Artificial Sequence: Synthetic oligonucleotide
  Target: SCN10A; (-) strand; PAM type: NRG; PAM sequence: CGG
ttcactcatgatttggctct

SEQ ID NO: 25093 - DNA, 20 bp, Artificial Sequence
  Description of Artificial Sequence: Synthetic oligonucleotide
  Target: SCN10A; (-) strand; PAM type: NRG; PAM sequence: TGG
atgggagttcactcatgatt

SEQ ID NO: 25094 - DNA, 20 bp, Artificial Sequence
  Description of Artificial Sequence: Synthetic oligonucleotide
  Target: SCN10A; (-) strand; PAM type: NRG; PAM sequence: GAG
tttgttgcaattgtgaatgg

SEQ ID NO: 25095 - DNA, 20 bp, Artificial Sequence
  Description of Artificial Sequence: Synthetic oligonucleotide
  Target: SCN10A; (-) strand; PAM type: NRG; PAM sequence: GGG
tctttgttgcaattgtgaat

SEQ ID NO: 25096 - DNA, 20 bp, Artificial Sequence
  Description of Artificial Sequence: Synthetic oligonucleotide
  Target: SCN10A; (-) strand; PAM type: NRG; PAM sequence: TGG
ctctttgttgcaattgtgaa

SEQ ID NO: 25097 - DNA, 20 bp, Artificial Sequence
  Description of Artificial Sequence: Synthetic oligonucleotide
  Target: SCN10A; (-) strand; PAM type: NRG; PAM sequence: TAG
tcccttgtaagttgtatttc

SEQ ID NO: 25098 - DNA, 20 bp, Artificial Sequence
  Description of Artificial Sequence: Synthetic oligonucleotide
  Target: SCN10A; (-) strand; PAM type: NRG; PAM sequence: AAG
aggtccttcacatcccttgt

SEQ ID NO: 25099 - DNA, 20 bp, Artificial Sequence
  Description of Artificial Sequence: Synthetic oligonucleotide
  Target: SCN10A; (-) strand; PAM type: NRG; PAM sequence: AGG
atttttagttctccttgaag

SEQ ID NO: 25100 - DNA, 20 bp, Artificial Sequence
  Description of Artificial Sequence: Synthetic oligonucleotide
  Target: SCN10A; (-) strand; PAM type: NRG; PAM sequence: GAG
gatttttagttctccttgaa

SEQ ID NO: 25101 - DNA, 20 bp, Artificial Sequence
  Description of Artificial Sequence: Synthetic oligonucleotide
  Target: SCN10A; (-) strand; PAM type: NRG; PAM sequence: AAG
gtgatttttagttctccttg

SEQ ID NO: 25102 - DNA, 20 bp, Artificial Sequence
  Description of Artificial Sequence: Synthetic oligonucleotide
  Target: SCN10A; (-) strand; PAM type: NRG; PAM sequence: TAG
tttccttgagcagtgatttt

SEQ ID NO: 25103 - DNA, 20 bp, Artificial Sequence
  Description of Artificial Sequence: Synthetic oligonucleotide
  Target: SCN10A; (-) strand; PAM type: NRG; PAM sequence: CAG
tcctctcttatttccttgag

SEQ ID NO: 25104 - DNA, 20 bp, Artificial Sequence
  Description of Artificial Sequence: Synthetic oligonucleotide
  Target: SCN10A; (-) strand; PAM type: NRG; PAM sequence: GAG
gtgtcctctcttatttcctt

SEQ ID NO: 25105 - DNA, 20 bp, Artificial Sequence
  Description of Artificial Sequence: Synthetic oligonucleotide
  Target: SCN10A; (-) strand; PAM type: NRG; PAM sequence: TGG
atttttcctatccatgagca

SEQ ID NO: 25106 - DNA, 20 bp, Artificial Sequence
  Description of Artificial Sequence: Synthetic oligonucleotide
  Target: SCN10A; (-) strand; PAM type: NRG; PAM sequence: GAG
tattgatttttcctatccat

SEQ ID NO: 25107 - DNA, 20 bp, Artificial Sequence
  Description of Artificial Sequence: Synthetic oligonucleotide
  Target: SCN10A; (-) strand; PAM type: NRG; PAM sequence: TGG
ataaattactttgggcagta

SEQ ID NO: 25108 - DNA, 20 bp, Artificial Sequence
  Description of Artificial Sequence: Synthetic oligonucleotide
  Target: SCN10A; (-) strand; PAM type: NRG; PAM sequence: CAG
aatctataaattactttggg

SEQ ID NO: 25109 - DNA, 20 bp, Artificial Sequence
  Description of Artificial Sequence: Synthetic oligonucleotide
  Target: SCN10A; (-) strand; PAM type: NRG; PAM sequence: GGG
ttgaatctataaattacttt

SEQ ID NO: 25110 - DNA, 20 bp, Artificial Sequence
  Description of Artificial Sequence: Synthetic oligonucleotide
  Target: SCN10A; (-) strand; PAM type: NRG; PAM sequence: TGG
attgaatctataaattactt

SEQ ID NO: 25111 - DNA, 20 bp, Artificial Sequence
  Description of Artificial Sequence: Synthetic oligonucleotide
  Target: SCN10A; (-) strand; PAM type: NRG; PAM sequence: GGG
aagtcagtggtagcttgatg

SEQ ID NO: 25112 - DNA, 20 bp, Artificial Sequence
  Description of Artificial Sequence: Synthetic oligonucleotide
  Target: SCN10A; (-) strand; PAM type: NRG; PAM sequence: GGG
aaagtcagtggtagcttgat

SEQ ID NO: 25113 - DNA, 20 bp, Artificial Sequence
  Description of Artificial Sequence: Synthetic oligonucleotide
  Target: SCN10A; (-) strand; PAM type: NRG; PAM sequence: TGG
gaaagtcagtggtagcttga

SEQ ID NO: 25114 - DNA, 20 bp, Artificial Sequence
  Description of Artificial Sequence: Synthetic oligonucleotide
  Target: SCN10A; (-) strand; PAM type: NRG; PAM sequence: TAG
tctgtgaagaaagtcagtgg

SEQ ID NO: 25115 - DNA, 20 bp, Artificial Sequence
  Description of Artificial Sequence: Synthetic oligonucleotide
  Target: SCN10A; (-) strand; PAM type: NRG; PAM sequence: TGG
aattctgtgaagaaagtcag

SEQ ID NO: 25116 - DNA, 20 bp, Artificial Sequence
  Description of Artificial Sequence: Synthetic oligonucleotide
  Target: SCN10A; (-) strand; PAM type: NRG; PAM sequence: CAG
tctaattctgtgaagaaagt

SEQ ID NO: 25117 - DNA, 20 bp, Artificial Sequence
  Description of Artificial Sequence: Synthetic oligonucleotide
  Target: SCN10A; (-) strand; PAM type: NRG; PAM sequence: AAG
tttttctaattctgtgaaga

SEQ ID NO: 25118 - DNA, 20 bp, Artificial Sequence
  Description of Artificial Sequence: Synthetic oligonucleotide
  Target: SCN10A; (-) strand; PAM type: NRG; PAM sequence: AAG
tagatttttctaattctgtg

SEQ ID NO: 25119 - DNA, 20 bp, Artificial Sequence
  Description of Artificial Sequence: Synthetic oligonucleotide
  Target: SCN10A; (-) strand; PAM type: NRG; PAM sequence: TAG
gttccacatgaaatttaaag

SEQ ID NO: 25120 - DNA, 20 bp, Artificial Sequence
  Description of Artificial Sequence: Synthetic oligonucleotide
  Target: SCN10A; (-) strand; PAM type: NRG; PAM sequence: AAG
tttgttccacatgaaattta

SEQ ID NO: 25121 - DNA, 20 bp, Artificial Sequence
  Description of Artificial Sequence: Synthetic oligonucleotide
  Target: SCN10A; (-) strand; PAM type: NRG; PAM sequence: GGG
tagaattgtcttgactatgc

SEQ ID NO: 25122 - DNA, 20 bp, Artificial Sequence
  Description of Artificial Sequence: Synthetic oligonucleotide
  Target: SCN10A; (-) strand; PAM type: NRG; PAM sequence: CGG
ttagaattgtcttgactatg

SEQ ID NO: 25123 - DNA, 20 bp, Artificial Sequence
  Description of Artificial Sequence: Synthetic oligonucleotide
  Target: SCN10A; (-) strand; PAM type: NRG; PAM sequence: TAG
ccaactttcttctttttgct

SEQ ID NO: 25124 - DNA, 20 bp, Artificial Sequence
  Description of Artificial Sequence: Synthetic oligonucleotide
  Target: SCN10A; (-) strand; PAM type: NRG; PAM sequence: TAG
tagtatagcttgaagtcagg

SEQ ID NO: 25125 - DNA, 20 bp, Artificial Sequence
  Description of Artificial Sequence: Synthetic oligonucleotide
  Target: SCN10A; (-) strand; PAM type: NRG; PAM sequence: AGG
ttgtagtatagcttgaagtc

SEQ ID NO: 25126 - DNA, 20 bp, Artificial Sequence
  Description of Artificial Sequence: Synthetic oligonucleotide
  Target: SCN10A; (-) strand; PAM type: NRG; PAM sequence: CAG
tttgtagtatagcttgaagt

SEQ ID NO: 25127 - DNA, 20 bp, Artificial Sequence
  Description of Artificial Sequence: Synthetic oligonucleotide
  Target: SCN10A; (-) strand; PAM type: NRG; PAM sequence: AAG
tagctttgtagtatagcttg

SEQ ID NO: 25128 - DNA, 20 bp, Artificial Sequence
  Description of Artificial Sequence: Synthetic oligonucleotide
  Target: SCN10A; (-) strand; PAM type: NRG; PAM sequence: TAG
gttactgtagctttgtagta

SEQ ID NO: 25129 - DNA, 20 bp, Artificial Sequence
  Description of Artificial Sequence: Synthetic oligonucleotide
  Target: SCN10A; (-) strand; PAM type: NRG; PAM sequence: TAG
ttttggttactgtagctttg

SEQ ID NO: 25130 - DNA, 20 bp, Artificial Sequence
  Description of Artificial Sequence: Synthetic oligonucleotide
  Target: SCN10A; (-) strand; PAM type: NRG; PAM sequence: TAG
cctcgctgttttggttactg

SEQ ID NO: 25131 - DNA, 20 bp, Artificial Sequence
  Description of Artificial Sequence: Synthetic oligonucleotide
  Target: SCN10A; (-) strand; PAM type: NRG; PAM sequence: TGG
gtaccagtacctcgctgttt

SEQ ID NO: 25132 - DNA, 20 bp, Artificial Sequence
  Description of Artificial Sequence: Synthetic oligonucleotide
  Target: SCN10A; (-) strand; PAM type: NRG; PAM sequence: CAG
ctagatatctgttttggtac

SEQ ID NO: 25133 - DNA, 20 bp, Artificial Sequence
  Description of Artificial Sequence: Synthetic oligonucleotide
  Target: SCN10A; (-) strand; PAM type: NRG; PAM sequence: TGG
attggtctagatatctgttt

SEQ ID NO: 25134 - DNA, 20 bp, Artificial Sequence
  Description of Artificial Sequence: Synthetic oligonucleotide
  Target: SCN10A; (-) strand; PAM type: NRG; PAM sequence: TAG
tctgttctgttccattggtc

SEQ ID NO: 25135 - DNA, 20 bp, Artificial Sequence
  Description of Artificial Sequence: Synthetic oligonucleotide
  Target: SCN10A; (-) strand; PAM type: NRG; PAM sequence: TGG
aggcctctgttctgttccat

SEQ ID NO: 25136 - DNA, 20 bp, Artificial Sequence
  Description of Artificial Sequence: Synthetic oligonucleotide
  Target: SCN10A; (-) strand; PAM type: NRG; PAM sequence: AGG
gatatgcggtgttacttctg

SEQ ID NO: 25137 - DNA, 20 bp, Artificial Sequence
  Description of Artificial Sequence: Synthetic oligonucleotide
  Target: SCN10A; (-) strand; PAM type: NRG; PAM sequence: GAG
agatatgcggtgttacttct

SEQ ID NO: 25138 - DNA, 20 bp, Artificial Sequence
  Description of Artificial Sequence: Synthetic oligonucleotide
  Target: SCN10A; (-) strand; PAM type: NRG; PAM sequence: CGG
atcagatggttgtagatatg

SEQ ID NO: 25139 - DNA, 20 bp, Artificial Sequence
  Description of Artificial Sequence: Synthetic oligonucleotide
  Target: SCN10A; (-) strand; PAM type: NRG; PAM sequence: TAG
tgtcaaagatcagatggttg

SEQ ID NO: 25140 - DNA, 20 bp, Artificial Sequence
  Description of Artificial Sequence: Synthetic oligonucleotide
  Target: SCN10A; (-) strand; PAM type: NRG; PAM sequence: TGG
caagtttgtcaaagatcaga

SEQ ID NO: 25141 - DNA, 20 bp, Artificial Sequence
  Description of Artificial Sequence: Synthetic oligonucleotide
  Target: SCN10A; (-) strand; PAM type: NRG; PAM sequence: CAG
ttgtcaagtttgtcaaagat

SEQ ID NO: 25142 - DNA, 20 bp, Artificial Sequence
  Description of Artificial Sequence: Synthetic oligonucleotide
  Target: SCN10A; (-) strand; PAM type: NRG; PAM sequence: AAG
tgcttttgtcaagtttgtca

SEQ ID NO: 25143 - DNA, 20 bp, Artificial Sequence
  Description of Artificial Sequence: Synthetic oligonucleotide
  Target: SCN10A; (-) strand; PAM type: NRG; PAM sequence: AAG
ccccattgcttgcttttgtc

SEQ ID NO: 25144 - DNA, 20 bp, Artificial Sequence
  Description of Artificial Sequence: Synthetic oligonucleotide
  Target: SCN10A; (-) strand; PAM type: NRG; PAM sequence: GGG
cccacaccatttattaaata

SEQ ID NO: 25145 - DNA, 20 bp, Artificial Sequence
  Description of Artificial Sequence: Synthetic oligonucleotide
  Target: SCN10A; (-) strand; PAM type: NRG; PAM sequence: AGG
ccccacaccatttattaaat

SEQ ID NO: 25146 - DNA, 20 bp, Artificial Sequence
  Description of Artificial Sequence: Synthetic oligonucleotide
  Target: SCN10A; (-) strand; PAM type: NRG; PAM sequence: TAG
tccccacaccatttattaaa

SEQ ID NO: 25147 - DNA, 20 bp, Artificial Sequence
  Description of Artificial Sequence: Synthetic oligonucleotide
  Target: SCN10A; (-) strand; PAM type: NRG; PAM sequence: CAG
attttctgcctaaggctagc

SEQ ID NO: 25148 - DNA, 20 bp, Artificial Sequence
  Description of Artificial Sequence: Synthetic oligonucleotide
  Target: SCN10A; (-) strand; PAM type: NRG; PAM sequence: TAG
ttcaattttctgcctaaggc

SEQ ID NO: 25149 - DNA, 20 bp, Artificial Sequence
  Description of Artificial Sequence: Synthetic oligonucleotide
  Target: SCN10A; (-) strand; PAM type: NRG; PAM sequence: AGG
tagtttcaattttctgccta

SEQ ID NO: 25150 - DNA, 20 bp, Artificial Sequence
  Description of Artificial Sequence: Synthetic oligonucleotide
  Target: SCN10A; (-) strand; PAM type: NRG; PAM sequence: AAG
ctagtttcaattttctgcct

SEQ ID NO: 25151 - DNA, 20 bp, Artificial Sequence
  Description of Artificial Sequence: Synthetic oligonucleotide
  Target: SCN10A; (-) strand; PAM type: NRG; PAM sequence: TAG
taaggtataaggaagggatc

SEQ ID NO: 25152 - DNA, 20 bp, Artificial Sequence
  Description of Artificial Sequence: Synthetic oligonucleotide
  Target: SCN10A; (-) strand; PAM type: NRG; PAM sequence: GGG
tttgtgtaaggtataaggaa

SEQ ID NO: 25153 - DNA, 20 bp, Artificial Sequence
  Description of Artificial Sequence: Synthetic oligonucleotide
  Target: SCN10A; (-) strand; PAM type: NRG; PAM sequence: AGG
ttttgtgtaaggtataagga

SEQ ID NO: 25154 - DNA, 20 bp, Artificial Sequence
  Description of Artificial Sequence: Synthetic oligonucleotide
  Target: SCN10A; (-) strand; PAM type: NRG; PAM sequence: AAG
tttttgtgtaaggtataagg

SEQ ID NO: 25155 - DNA, 20 bp, Artificial Sequence
  Description of Artificial Sequence: Synthetic oligonucleotide
  Target: SCN10A; (-) strand; PAM type: NRG; PAM sequence: AGG
taatttttgtgtaaggtata

SEQ ID NO: 25156 - DNA, 20 bp, Artificial Sequence
  Description of Artificial Sequence: Synthetic oligonucleotide
  Target: SCN10A; (-) strand; PAM type: NRG; PAM sequence: AAG
ttaatttttgtgtaaggtat

SEQ ID NO: 25157 - DNA, 20 bp, Artificial Sequence
  Description of Artificial Sequence: Synthetic oligonucleotide
  Target: SCN10A; (-) strand; PAM type: NRG; PAM sequence: AGG
cttgagttaatttttgtgta

SEQ ID NO: 25158 - DNA, 20 bp, Artificial Sequence
  Description of Artificial Sequence: Synthetic oligonucleotide
  Target: SCN10A; (-) strand; PAM type: NRG; PAM sequence: AAG
tcttgagttaatttttgtgt

SEQ ID NO: 25159 - DNA, 20 bp, Artificial Sequence
  Description of Artificial Sequence: Synthetic oligonucleotide
  Target: SCN10A; (-) strand; PAM type: NRG; PAM sequence: GAG
ttaagtctttaatctatctt

SEQ ID NO: 25160 - DNA, 20 bp, Artificial Sequence
  Description of Artificial Sequence: Synthetic oligonucleotide
  Target: SCN10A; (-) strand; PAM type: NRG; PAM sequence: AAG
tggttttaggtcttatgttt

SEQ ID NO: 25161 - DNA, 20 bp, Artificial Sequence
  Description of Artificial Sequence: Synthetic oligonucleotide
  Target: SCN10A; (-) strand; PAM type: NRG; PAM sequence: AGG
tctagggtttttatggtttt

SEQ ID NO: 25162 - DNA, 20 bp, Artificial Sequence
  Description of Artificial Sequence: Synthetic oligonucleotide
  Target: SCN10A; (-) strand; PAM type: NRG; PAM sequence: TAG
ttctagggtttttatggttt

SEQ ID NO: 25163 - DNA, 20 bp, Artificial Sequence
  Description of Artificial Sequence: Synthetic oligonucleotide
  Target: SCN10A; (-) strand; PAM type: NRG; PAM sequence: TGG
gttttcttctagggttttta

SEQ ID NO: 25164 - DNA, 20 bp, Artificial Sequence
  Description of Artificial Sequence: Synthetic oligonucleotide
  Target: SCN10A; (-) strand; PAM type: NRG; PAM sequence: GGG
attgcctaggttttcttcta

SEQ ID NO: 25165 - DNA, 20 bp, Artificial Sequence
  Description of Artificial Sequence: Synthetic oligonucleotide
  Target: SCN10A; (-) strand; PAM type: NRG; PAM sequence: AGG
tattgcctaggttttcttct

SEQ ID NO: 25166 - DNA, 20 bp, Artificial Sequence
  Description of Artificial Sequence: Synthetic oligonucleotide
  Target: SCN10A; (-) strand; PAM type: NRG; PAM sequence: TAG
gtattgcctaggttttcttc

SEQ ID NO: 25167 - DNA, 20 bp, Artificial Sequence
  Description of Artificial Sequence: Synthetic oligonucleotide
  Target: SCN10A; (-) strand; PAM type: NRG; PAM sequence: AGG
tgtcctgaagggtattgcct

SEQ ID NO: 25168 - DNA, 20 bp, Artificial Sequence
  Description of Artificial Sequence: Synthetic oligonucleotide
  Target: SCN10A; (-) strand; PAM type: NRG; PAM sequence: TAG
atgtcctgaagggtattgcc

SEQ ID NO: 25169 - DNA, 20 bp, Artificial Sequence
  Description of Artificial Sequence: Synthetic oligonucleotide
  Target: SCN10A; (-) strand; PAM type: NRG; PAM sequence: GGG
gcccatgcctatgtcctgaa

SEQ ID NO: 25170 - DNA, 20 bp, Artificial Sequence
  Description of Artificial Sequence: Synthetic oligonucleotide
  Target: SCN10A; (-) strand; PAM type: NRG; PAM sequence: AGG
tgcccatgcctatgtcctga

SEQ ID NO: 25171 - DNA, 20 bp, Artificial Sequence
  Description of Artificial Sequence: Synthetic oligonucleotide
  Target: SCN10A; (-) strand; PAM type: NRG; PAM sequence: AAG
ttgcccatgcctatgtcctg

SEQ ID NO: 25172 - DNA, 20 bp, Artificial Sequence
  Description of Artificial Sequence: Synthetic oligonucleotide
  Target: SCN10A; (-) strand; PAM type: NRG; PAM sequence: AAG
cttttgatgtgttagtcata

SEQ ID NO: 25173 - DNA, 20 bp, Artificial Sequence
  Description of Artificial Sequence: Synthetic oligonucleotide
  Target: SCN10A; (-) strand; PAM type: NRG; PAM sequence: TAG
caccattgcttttgatgtgt

SEQ ID NO: 25174 - DNA, 20 bp, Artificial Sequence
  Description of Artificial Sequence: Synthetic oligonucleotide
  Target: SCN10A; (-) strand; PAM type: NRG; PAM sequence: TGG
tggattccatttgtcaattt

SEQ ID NO: 25175 - DNA, 20 bp, Artificial Sequence
  Description of Artificial Sequence: Synthetic oligonucleotide
  Target: SCN10A; (-) strand; PAM type: NRG; PAM sequence: TGG
cagaagctctttagtttaat

SEQ ID NO: 25176 - DNA, 20 bp, Artificial Sequence
  Description of Artificial Sequence: Synthetic oligonucleotide
  Target: SCN10A; (-) strand; PAM type: NRG; PAM sequence: TAG
tttgctgtgcagaagctctt

SEQ ID NO: 25177 - DNA, 20 bp, Artificial Sequence
  Description of Artificial Sequence: Synthetic oligonucleotide
  Target: SCN10A; (-) strand; PAM type: NRG; PAM sequence: AAG
tagtttcttttgctgtgcag

SEQ ID NO: 25178 - DNA, 20 bp, Artificial Sequence
  Description of Artificial Sequence: Synthetic oligonucleotide
  Target: SCN10A; (-) strand; PAM type: NRG; PAM sequence: CAG
tgatagtttcttttgctgtg

SEQ ID NO: 25179 - DNA, 20 bp, Artificial Sequence
  Description of Artificial Sequence: Synthetic oligonucleotide
  Target: SCN10A; (-) strand; PAM type: NRG; PAM sequence: TAG
ttacctattcactctgatga

SEQ ID NO: 25180 - DNA, 20 bp, Artificial Sequence
  Description of Artificial Sequence: Synthetic oligonucleotide
  Target: SCN10A; (-) strand; PAM type: NRG; PAM sequence: AGG
aaaattttctcccattctgt

SEQ ID NO: 25181 - DNA, 20 bp, Artificial Sequence
  Description of Artificial Sequence: Synthetic oligonucleotide
  Target: SCN10A; (-) strand; PAM type: NRG; PAM sequence: TAG
aaaaattttctcccattctg

SEQ ID NO: 25182 - DNA, 20 bp, Artificial Sequence
  Description of Artificial Sequence: Synthetic oligonucleotide
  Target: SCN10A; (-) strand; PAM type: NRG; PAM sequence: TAG
ttagccctttgtcagattga

SEQ ID NO: 25183 - DNA, 20 bp, Artificial Sequence
  Description of Artificial Sequence: Synthetic oligonucleotide
  Target: SCN10A; (-) strand; PAM type: NRG; PAM sequence: CAG
tctggatattagccctttgt

SEQ ID NO: 25184 - DNA, 20 bp, Artificial Sequence
  Description of Artificial Sequence: Synthetic oligonucleotide
  Target: SCN10A; (-) strand; PAM type: NRG; PAM sequence: TAG
tttttgtagattctggatat

SEQ ID NO: 25185 - DNA, 20 bp, Artificial Sequence
  Description of Artificial Sequence: Synthetic oligonucleotide
  Target: SCN10A; (-) strand; PAM type: NRG; PAM sequence: TGG
tttaagttttttgtagattc

SEQ ID NO: 25186 - DNA, 20 bp, Artificial Sequence
  Description of Artificial Sequence: Synthetic oligonucleotide
  Target: SCN10A; (-) strand; PAM type: NRG; PAM sequence: TAG
aaatttgtttaagttttttg

SEQ ID NO: 25187 - DNA, 20 bp, Artificial Sequence
  Description of Artificial Sequence: Synthetic oligonucleotide
  Target: SCN10A; (-) strand; PAM type: NRG; PAM sequence: AAG
tttttcttgtaaatttgttt

SEQ ID NO: 25188 - DNA, 20 bp, Artificial Sequence
  Description of Artificial Sequence: Synthetic oligonucleotide
  Target: SCN10A; (-) strand; PAM type: NRG; PAM sequence: GAG
cctttgcccactttttgatg

SEQ ID NO: 25189 - DNA, 20 bp, Artificial Sequence
  Description of Artificial Sequence: Synthetic oligonucleotide
  Target: SCN10A; (-) strand; PAM type: NRG; PAM sequence: TGG
atcctttgcccactttttga

SEQ ID NO: 25190 - DNA, 20 bp, Artificial Sequence
  Description of Artificial Sequence: Synthetic oligonucleotide
  Target: SCN10A; (-) strand; PAM type: NRG; PAM sequence: AAG
cataaatgtcttcttttgag

SEQ ID NO: 25191 - DNA, 20 bp, Artificial Sequence
  Description of Artificial Sequence: Synthetic oligonucleotide
  Target: SCN10A; (-) strand; PAM type: NRG; PAM sequence: GAG
ctgcataaatgtcttctttt

SEQ ID NO: 25192 - DNA, 20 bp, Artificial Sequence
  Description of Artificial Sequence: Synthetic oligonucleotide
  Target: SCN10A; (-) strand; PAM type: NRG; PAM sequence: TGG
gctttttatcatatgtttat

SEQ ID NO: 25193 - DNA, 20 bp, Artificial Sequence
  Description of Artificial Sequence: Synthetic oligonucleotide
  Target: SCN10A; (-) strand; PAM type: NRG; PAM sequence: GAG
ctctaatgaccagtgatgat

SEQ ID NO: 25194 - DNA, 20 bp, Artificial Sequence
  Description of Artificial Sequence: Synthetic oligonucleotide
  Target: SCN10A; (-) strand; PAM type: NRG; PAM sequence: CAG
actggcatttctctaatgac

SEQ ID NO: 25195 - DNA, 20 bp, Artificial Sequence
  Description of Artificial Sequence: Synthetic oligonucleotide
  Target: SCN10A; (-) strand; PAM type: NRG; PAM sequence: TGG
catctcattgtggttttgac

SEQ ID NO: 25196 - DNA, 20 bp, Artificial Sequence
  Description of Artificial Sequence: Synthetic oligonucleotide
  Target: SCN10A; (-) strand; PAM type: NRG; PAM sequence: TGG
tatgagactccatctcattg

SEQ ID NO: 25197 - DNA, 20 bp, Artificial Sequence
  Description of Artificial Sequence: Synthetic oligonucleotide
  Target: SCN10A; (-) strand; PAM type: NRG; PAM sequence: GAG
atctccattctaactggtat

SEQ ID NO: 25198 - DNA, 20 bp, Artificial Sequence
  Description of Artificial Sequence: Synthetic oligonucleotide
  Target: SCN10A; (-) strand; PAM type: NRG; PAM sequence: TGG
ttaatgatctccattctaac

SEQ ID NO: 25199 - DNA, 20 bp, Artificial Sequence
  Description of Artificial Sequence: Synthetic oligonucleotide
  Target: SCN10A; (-) strand; PAM type: NRG; PAM sequence: CAG
ctatctctccacatcctctc

SEQ ID NO: 25200 - DNA, 20 bp, Artificial Sequence
  Description of Artificial Sequence: Synthetic oligonucleotide
  Target: SCN10A; (-) strand; PAM type: NRG; PAM sequence: AAG
cactcccaccaacagtgtaa

SEQ ID NO: 25201 - DNA, 20 bp, Artificial Sequence
  Description of Artificial Sequence: Synthetic oligonucleotide
  Target: SCN10A; (-) strand; PAM type: NRG; PAM sequence: CAG
ctaatttacactcccaccaa

SEQ ID NO: 25202 - DNA, 20 bp, Artificial Sequence
  Description of Artificial Sequence: Synthetic oligonucleotide
  Target: SCN10A; (-) strand; PAM type: NRG; PAM sequence: TGG
caccacactgtcttccacaa

SEQ ID NO: 25203 - DNA, 20 bp, Artificial Sequence
  Description of Artificial Sequence: Synthetic oligonucleotide
  Target: SCN10A; (-) strand; PAM type: NRG; PAM sequence: AGG
tttctggttctagatccttg

SEQ ID NO: 25204 - DNA, 20 bp, Artificial Sequence
  Description of Artificial Sequence: Synthetic oligonucleotide
  Target: SCN10A; (-) strand; PAM type: NRG; PAM sequence: GAG
gtttctggttctagatcctt

SEQ ID NO: 25205 - DNA, 20 bp, Artificial Sequence
  Description of Artificial Sequence: Synthetic oligonucleotide
  Target: SCN10A; (-) strand; PAM type: NRG; PAM sequence: TAG
tcaaatggtgtttctggttc

SEQ ID NO: 25206 - DNA, 20 bp, Artificial Sequence
  Description of Artificial Sequence: Synthetic oligonucleotide
  Target: SCN10A; (-) strand; PAM type: NRG; PAM sequence: TGG
gctgggtcaaatggtgtttc

SEQ ID NO: 25207 - DNA, 20 bp, Artificial Sequence
  Description of Artificial Sequence: Synthetic oligonucleotide
  Target: SCN10A; (-) strand; PAM type: NRG; PAM sequence: TGG
aatggaattgctgggtcaaa

SEQ ID NO: 25208 - DNA, 20 bp, Artificial Sequence
  Description of Artificial Sequence: Synthetic oligonucleotide
  Target: SCN10A; (-) strand; PAM type: NRG; PAM sequence: GGG
tacccagtaatggaattgct

SEQ ID NO: 25209 - DNA, 20 bp, Artificial Sequence
  Description of Artificial Sequence: Synthetic oligonucleotide
  Target: SCN10A; (-) strand; PAM type: NRG; PAM sequence: TGG
atacccagtaatggaattgc

SEQ ID NO: 25210 - DNA, 20 bp, Artificial Sequence
  Description of Artificial Sequence: Synthetic oligonucleotide
  Target: SCN10A; (-) strand; PAM type: NRG; PAM sequence: TGG
tttgggtatatacccagtaa

SEQ ID NO: 25211 - DNA, 20 bp, Artificial Sequence
  Description of Artificial Sequence: Synthetic oligonucleotide
  Target: SCN10A; (-) strand; PAM type: NRG; PAM sequence: CAG
taatcctttgggtatatacc

SEQ ID NO: 25212 - DNA, 20 bp, Artificial Sequence
  Description of Artificial Sequence: Synthetic oligonucleotide
  Target: SCN10A; (-) strand; PAM type: NRG; PAM sequence: GGG
agaataatttataatccttt

SEQ ID NO: 25213 - DNA, 20 bp, Artificial Sequence
  Description of Artificial Sequence: Synthetic oligonucleotide
  Target: SCN10A; (-) strand; PAM type: NRG; PAM sequence: TGG
tagaataatttataatcctt

SEQ ID NO: 25214 - DNA, 20 bp, Artificial Sequence
  Description of Artificial Sequence: Synthetic oligonucleotide
  Target: SCN10A; (-) strand; PAM type: NRG; PAM sequence: TAG
gcatgcttgtatctttatag

SEQ ID NO: 25215 - DNA, 20 bp, Artificial Sequence
  Description of Artificial Sequence: Synthetic oligonucleotide
  Target: SCN10A; (-) strand; PAM type: NRG; PAM sequence: TAG
tacgcatgcttgtatcttta

SEQ ID NO: 25216 - DNA, 20 bp, Artificial Sequence
  Description of Artificial Sequence: Synthetic oligonucleotide
  Target: SCN10A; (-) strand; PAM type: NRG; PAM sequence: TAG
caagtctttgctattgtcaa

SEQ ID NO: 25217 - DNA, 20 bp, Artificial Sequence
  Description of Artificial Sequence: Synthetic oligonucleotide
  Target: SCN10A; (-) strand; PAM type: NRG; PAM sequence: AAG
tgggcgtttgggttagttcc

SEQ ID NO: 25218 - DNA, 20 bp, Artificial Sequence
  Description of Artificial Sequence: Synthetic oligonucleotide
  Target: SCN10A; (-) strand; PAM type: NRG; PAM sequence: TAG
tcactgatgggcgtttgggt

SEQ ID NO: 25219 - DNA, 20 bp, Artificial Sequence
  Description of Artificial Sequence: Synthetic oligonucleotide
  Target: SCN10A; (-) strand; PAM type: NRG; PAM sequence: GGG
tctatcactgatgggcgttt

SEQ ID NO: 25220 - DNA, 20 bp, Artificial Sequence
  Description of Artificial Sequence: Synthetic oligonucleotide
  Target: SCN10A; (-) strand; PAM type: NRG; PAM sequence: TGG
gtctatcactgatgggcgtt

SEQ ID NO: 25221 - DNA, 20 bp, Artificial Sequence
  Description of Artificial Sequence: Synthetic oligonucleotide
  Target: SCN10A; (-) strand; PAM type: NRG; PAM sequence: GGG
ttatccagtctatcactgat

SEQ ID NO: 25222 - DNA, 20 bp, Artificial Sequence
  Description of Artificial Sequence: Synthetic oligonucleotide
  Target: SCN10A; (-) strand; PAM type: NRG; PAM sequence: TGG
tttatccagtctatcactga

SEQ ID NO: 25223 - DNA, 20 bp, Artificial Sequence
  Description of Artificial Sequence: Synthetic oligonucleotide
  Target: SCN10A; (-) strand; PAM type: NRG; PAM sequence: CAG
tgtgccatattttctttatc

SEQ ID NO: 25224 - DNA, 20 bp, Artificial Sequence
  Description of Artificial Sequence: Synthetic oligonucleotide
  Target: SCN10A; (-) strand; PAM type: NRG; PAM sequence: TGG
tatggctgcatagtattcca

SEQ ID NO: 25225 - DNA, 20 bp, Artificial Sequence
  Description of Artificial Sequence: Synthetic oligonucleotide
  Target: SCN10A; (-) strand; PAM type: NRG; PAM sequence: TAG
cacccttttttatggctgca

SEQ ID NO: 25226 - DNA, 20 bp, Artificial Sequence
  Description of Artificial Sequence: Synthetic oligonucleotide
  Target: SCN10A; (-) strand; PAM type: NRG; PAM sequence: TGG
catgaactcaccctttttta

SEQ ID NO: 25227 - DNA, 20 bp, Artificial Sequence
  Description of Artificial Sequence: Synthetic oligonucleotide
  Target: SCN10A; (-) strand; PAM type: NRG; PAM sequence: AAG
gcttcatccatgtccctgca

SEQ ID NO: 25228 - DNA, 20 bp, Artificial Sequence
  Description of Artificial Sequence: Synthetic oligonucleotide
  Target: SCN10A; (-) strand; PAM type: NRG; PAM sequence: CAG
ttgctgagaatgatggtttc

SEQ ID NO: 25229 - DNA, 20 bp, Artificial Sequence
  Description of Artificial Sequence: Synthetic oligonucleotide
  Target: SCN10A; (-) strand; PAM type: NRG; PAM sequence: TGG
tgtcagtttgctgagaatga

SEQ ID NO: 25230 - DNA, 20 bp, Artificial Sequence
  Description of Artificial Sequence: Synthetic oligonucleotide
  Target: SCN10A; (-) strand; PAM type: NRG; PAM sequence: GAG
tgttcttatgtcagtttgct

SEQ ID NO: 25231 - DNA, 20 bp, Artificial Sequence
  Description of Artificial Sequence: Synthetic oligonucleotide
  Target: SCN10A; (-) strand; PAM type: NRG; PAM sequence: CAG
ttggttttctgttcttatgt

SEQ ID NO: 25232 - DNA, 20 bp, Artificial Sequence
  Description of Artificial Sequence: Synthetic oligonucleotide
  Target: SCN10A; (-) strand; PAM type: NRG; PAM sequence: TGG
gagtgagaacatgcggtgtt

SEQ ID NO: 25233 - DNA, 20 bp, Artificial Sequence
  Description of Artificial Sequence: Synthetic oligonucleotide
  Target: SCN10A; (-) strand; PAM type: NRG; PAM sequence: CGG
cacctatgagtgagaacatg

SEQ ID NO: 25234 - DNA, 20 bp, Artificial Sequence
  Description of Artificial Sequence: Synthetic oligonucleotide
  Target: SCN10A; (-) strand; PAM type: NRG; PAM sequence: GAG
ttcatctcccacctatgagt

SEQ ID NO: 25235 - DNA, 20 bp, Artificial Sequence
  Description of Artificial Sequence: Synthetic oligonucleotide
  Target: SCN10A; (-) strand; PAM type: NRG; PAM sequence: GAG
attgttcatctcccacctat

SEQ ID NO: 25236 - DNA, 20 bp, Artificial Sequence
  Description of Artificial Sequence: Synthetic oligonucleotide
  Target: SCN10A; (-) strand; PAM type: NRG; PAM sequence: TGG
cccaacccctcaacaggccc

SEQ ID NO: 25237 - DNA, 20 bp, Artificial Sequence
  Description of Artificial Sequence: Synthetic oligonucleotide
  Target: SCN10A; (-) strand; PAM type: NRG; PAM sequence: AGG
ctagcccccaacccctcaac

SEQ ID NO: 25238 - DNA, 20 bp, Artificial Sequence
  Description of Artificial Sequence: Synthetic oligonucleotide
  Target: SCN10A; (-) strand; PAM type: NRG; PAM sequence: CAG
cctagcccccaacccctcaa

SEQ ID NO: 25239 - DNA, 20 bp, Artificial Sequence
  Description of Artificial Sequence: Synthetic oligonucleotide
  Target: SCN10A; (-) strand; PAM type: NRG; PAM sequence: TAG
tcctaatgctatccctcccc

SEQ ID NO: 25240 - DNA, 20 bp, Artificial Sequence
  Description of Artificial Sequence: Synthetic oligonucleotide
  Target: SCN10A; (-) strand; PAM type: NRG; PAM sequence: AGG
atcaacccatcatctacatt

SEQ ID NO: 25241 - DNA, 20 bp, Artificial Sequence
  Description of Artificial Sequence: Synthetic oligonucleotide
  Target: SCN10A; (-) strand; PAM type: NRG; PAM sequence: TAG
catcaacccatcatctacat

SEQ ID NO: 25242 - DNA, 20 bp, Artificial Sequence
  Description of Artificial Sequence: Synthetic oligonucleotide
  Target: SCN10A; (-) strand; PAM type: NRG; PAM sequence: TGG
taggtatacacatgtcatgg

SEQ ID NO: 25243 - DNA, 20 bp, Artificial Sequence
  Description of Artificial Sequence: Synthetic oligonucleotide
  Target: SCN10A; (-) strand; PAM type: NRG; PAM sequence: TGG
acataggtatacacatgtca

SEQ ID NO: 25244 - DNA, 20 bp, Artificial Sequence
  Description of Artificial Sequence: Synthetic oligonucleotide
  Target: SCN10A; (-) strand; PAM type: NRG; PAM sequence: AGG
aaagtgcaggtttgttacat

SEQ ID NO: 25245 - DNA, 20 bp, Artificial Sequence
  Description of Artificial Sequence: Synthetic oligonucleotide
  Target: SCN10A; (-) strand; PAM type: NRG; PAM sequence: TAG
gaaagtgcaggtttgttaca

SEQ ID NO: 25246 - DNA, 20 bp, Artificial Sequence
  Description of Artificial Sequence: Synthetic oligonucleotide
  Target: SCN10A; (-) strand; PAM type: NRG; PAM sequence: AGG
ggtacatgtgcagaaagtgc

SEQ ID NO: 25247 - DNA, 20 bp, Artificial Sequence
  Description of Artificial Sequence: Synthetic oligonucleotide
  Target: SCN10A; (-) strand; PAM type: NRG; PAM sequence: CAG
gggtacatgtgcagaaagtg

SEQ ID NO: 25248 - DNA, 20 bp, Artificial Sequence
  Description of Artificial Sequence: Synthetic oligonucleotide
  Target: SCN10A; (-) strand; PAM type: NRG; PAM sequence: AAG
ttctggggtacatgtgcaga

SEQ ID NO: 25249 - DNA, 20 bp, Artificial Sequence
  Description of Artificial Sequence: Synthetic oligonucleotide
  Target: SCN10A; (-) strand; PAM type: NRG; PAM sequence: CAG
taagttctggggtacatgtg

SEQ ID NO: 25250 - DNA, 20 bp, Artificial Sequence
  Description of Artificial Sequence: Synthetic oligonucleotide
  Target: SCN10A; (-) strand; PAM type: NRG; PAM sequence: GGG
aaattttactttaagttctg

SEQ ID NO: 25251 - DNA, 20 bp, Artificial Sequence
  Description of Artificial Sequence: Synthetic oligonucleotide
  Target: SCN10A; (-) strand; PAM type: NRG; PAM sequence: GGG
taaattttactttaagttct

SEQ ID NO: 25252 - DNA, 20 bp, Artificial Sequence
  Description of Artificial Sequence: Synthetic oligonucleotide
  Target: SCN10A; (-) strand; PAM type: NRG; PAM sequence: TGG
ttaaattttactttaagttc

SEQ ID NO: 25253 - DNA, 20 bp, Artificial Sequence
  Description of Artificial Sequence: Synthetic oligonucleotide
  Target: SCN10A; (-) strand; PAM type: NRG; PAM sequence: AAG
ccttttttaaattttacttt

SEQ ID NO: 25254 - DNA, 20 bp, Artificial Sequence
  Description of Artificial Sequence: Synthetic oligonucleotide
  Target: SCN10A; (-) strand; PAM type: NRG; PAM sequence: AAG
ttgtgaaatgcaaatatata

SEQ ID NO: 25255 - DNA, 20 bp, Artificial Sequence
  Description of Artificial Sequence: Synthetic oligonucleotide
  Target: SCN10A; (-) strand; PAM type: NRG; PAM sequence: TGG
acacaagaatcaattctagg

SEQ ID NO: 25256 - DNA, 20 bp, Artificial Sequence
  Description of Artificial Sequence: Synthetic oligonucleotide
  Target: SCN10A; (-) strand; PAM type: NRG; PAM sequence: AGG
cacacacaagaatcaattct

SEQ ID NO: 25257 - DNA, 20 bp, Artificial Sequence
  Description of Artificial Sequence: Synthetic oligonucleotide
  Target: SCN10A; (-) strand; PAM type: NRG; PAM sequence: TAG
ccacacacaagaatcaattc

SEQ ID NO: 25258 - DNA, 20 bp, Artificial Sequence
  Description of Artificial Sequence: Synthetic oligonucleotide
  Target: SCN10A; (-) strand; PAM type: NRG; PAM sequence: AAG
tccaactttgcaccacacac

SEQ ID NO: 25259 - DNA, 20 bp, Artificial Sequence
  Description of Artificial Sequence: Synthetic oligonucleotide
  Target: SCN10A; (-) strand; PAM type: NRG; PAM sequence: TGG
tgaagaattaggaatctcac

SEQ ID NO: 25260 - DNA, 20 bp, Artificial Sequence
  Description of Artificial Sequence: Synthetic oligonucleotide
  Target: SCN10A; (-) strand; PAM type: NRG; PAM sequence: AGG
aaaaatgatgctgaagaatt

SEQ ID NO: 25261 - DNA, 20 bp, Artificial Sequence
  Description of Artificial Sequence: Synthetic oligonucleotide
  Target: SCN10A; (-) strand; PAM type: NRG; PAM sequence: TAG
aaaaaatgatgctgaagaat

SEQ ID NO: 25262 - DNA, 20 bp, Artificial Sequence
  Description of Artificial Sequence: Synthetic oligonucleotide
  Target: SCN10A; (-) strand; PAM type: NRG; PAM sequence: AAG
gtcttcaaaaaatgatgctg

SEQ ID NO: 25263 - DNA, 20 bp, Artificial Sequence
  Description of Artificial Sequence: Synthetic oligonucleotide
  Target: SCN10A; (-) strand; PAM type: NRG; PAM sequence: CGG
ccagaacagcagggaaaagg

SEQ ID NO: 25264 - DNA, 20 bp, Artificial Sequence
  Description of Artificial Sequence: Synthetic oligonucleotide
  Target: SCN10A; (-) strand; PAM type: NRG; PAM sequence: AGG
accccagaacagcagggaaa

SEQ ID NO: 25265 - DNA, 20 bp, Artificial Sequence
  Description of Artificial Sequence: Synthetic oligonucleotide
  Target: SCN10A; (-) strand; PAM type: NRG; PAM sequence: AAG
caccccagaacagcagggaa

SEQ ID NO: 25266 - DNA, 20 bp, Artificial Sequence
  Description of Artificial Sequence: Synthetic oligonucleotide
  Target: SCN10A; (-) strand; PAM type: NRG; PAM sequence: GGG
ggtggcaccccagaacagca

SEQ ID NO: 25267 - DNA, 20 bp, Artificial Sequence
  Description of Artificial Sequence: Synthetic oligonucleotide
  Target: SCN10A; (-) strand; PAM type: NRG; PAM sequence: AGG
aggtggcaccccagaacagc

SEQ ID NO: 25268 - DNA, 20 bp, Artificial Sequence
  Description of Artificial Sequence: Synthetic oligonucleotide
  Target: SCN10A; (-) strand; PAM type: NRG; PAM sequence: CAG
aaggtggcaccccagaacag

SEQ ID NO: 25269 - DNA, 20 bp, Artificial Sequence
  Description of Artificial Sequence: Synthetic oligonucleotide
  Target: SCN10A; (-) strand; PAM type: NRG; PAM sequence: CAG
gaaaaggtggcaccccagaa

SEQ ID NO: 25270 - DNA, 20 bp, Artificial Sequence
  Description of Artificial Sequence: Synthetic oligonucleotide
  Target: SCN10A; (-) strand; PAM type: NRG; PAM sequence: CAG
tgtgtgaaaaggtggcaccc

SEQ ID NO: 25271 - DNA, 20 bp, Artificial Sequence
  Description of Artificial Sequence: Synthetic oligonucleotide
  Target: SCN10A; (-) strand; PAM type: NRG; PAM sequence: TGG
acatctaatgtgtgaaaagg

SEQ ID NO: 25272 - DNA, 20 bp, Artificial Sequence
  Description of Artificial Sequence: Synthetic oligonucleotide
  Target: SCN10A; (-) strand; PAM type: NRG; PAM sequence: AGG
taaacatctaatgtgtgaaa

SEQ ID NO: 25273 - DNA, 20 bp, Artificial Sequence
  Description of Artificial Sequence: Synthetic oligonucleotide
  Target: SCN10A; (-) strand; PAM type: NRG; PAM sequence: AAG
gtaaacatctaatgtgtgaa

SEQ ID NO: 25274 - DNA, 20 bp, Artificial Sequence
  Description of Artificial Sequence: Synthetic oligonucleotide
  Target: SCN10A; (-) strand; PAM type: NRG; PAM sequence: CAG
cagcatagacagtccataaa

SEQ ID NO: 25275 - DNA, 20 bp, Artificial Sequence
  Description of Artificial Sequence: Synthetic oligonucleotide
  Target: SCN10A; (-) strand; PAM type: NRG; PAM sequence: CAG
gaataatgtaacagcataga

SEQ ID NO: 25276 - DNA, 20 bp, Artificial Sequence
  Description of Artificial Sequence: Synthetic oligonucleotide
  Target: SCN10A; (-) strand; PAM type: NRG; PAM sequence: TAG
gtcagaataatgtaacagca

SEQ ID NO: 25277 - DNA, 20 bp, Artificial Sequence
  Description of Artificial Sequence: Synthetic oligonucleotide
  Target: SCN10A; (-) strand; PAM type: NRG; PAM sequence: CAG
gattggtcagaataatgtaa

SEQ ID NO: 25278 - DNA, 20 bp, Artificial Sequence
  Description of Artificial Sequence: Synthetic oligonucleotide
  Target: SCN10A; (-) strand; PAM type: NRG; PAM sequence: CAG
gccattggtgtaagattggt

SEQ ID NO: 25279 - DNA, 20 bp, Artificial Sequence
  Description of Artificial Sequence: Synthetic oligonucleotide
  Target: SCN10A; (-) strand; PAM type: NRG; PAM sequence: TGG
gtgtgccattggtgtaagat

SEQ ID NO: 25280 - DNA, 20 bp, Artificial Sequence
  Description of Artificial Sequence: Synthetic oligonucleotide
  Target: SCN10A; (-) strand; PAM type: NRG; PAM sequence: AAG
aagcagtgtgccattggtgt

SEQ ID NO: 25281 - DNA, 20 bp, Artificial Sequence
  Description of Artificial Sequence: Synthetic oligonucleotide
  Target: SCN10A; (-) strand; PAM type: NRG; PAM sequence: TGG
taattgaagcagtgtgccat

SEQ ID NO: 25282 - DNA, 20 bp, Artificial Sequence
  Description of Artificial Sequence: Synthetic oligonucleotide
  Target: SCN10A; (-) strand; PAM type: NRG; PAM sequence: CAG
ctataaagctctaattgaag

SEQ ID NO: 25283 - DNA, 20 bp, Artificial Sequence
  Description of Artificial Sequence: Synthetic oligonucleotide
  Target: SCN10A; (-) strand; PAM type: NRG; PAM sequence: AAG
ttactataaagctctaattg

SEQ ID NO: 25284 - DNA, 20 bp, Artificial Sequence
  Description of Artificial Sequence: Synthetic oligonucleotide
  Target: SCN10A; (-) strand; PAM type: NRG; PAM sequence: AAG
ggatgtcgagatttactata

SEQ ID NO: 25285 - DNA, 20 bp, Artificial Sequence
  Description of Artificial Sequence: Synthetic oligonucleotide
  Target: SCN10A; (-) strand; PAM type: NRG; PAM sequence: GAG
aactcattctactggatgtc

SEQ ID NO: 25286 - DNA, 20 bp, Artificial Sequence
  Description of Artificial Sequence: Synthetic oligonucleotide
  Target: SCN10A; (-) strand; PAM type: NRG; PAM sequence: TGG
agtgggagaactcattctac

SEQ ID NO: 25287 - DNA, 20 bp, Artificial Sequence
  Description of Artificial Sequence: Synthetic oligonucleotide
  Target: SCN10A; (-) strand; PAM type: NRG; PAM sequence: GAG
gaggaagaaatacaaagtgg

SEQ ID NO: 25288 - DNA, 20 bp, Artificial Sequence
  Description of Artificial Sequence: Synthetic oligonucleotide
  Target: SCN10A; (-) strand; PAM type: NRG; PAM sequence: GGG
ttgaggaagaaatacaaagt

SEQ ID NO: 25289 - DNA, 20 bp, Artificial Sequence
  Description of Artificial Sequence: Synthetic oligonucleotide
  Target: SCN10A; (-) strand; PAM type: NRG; PAM sequence: TGG
tttgaggaagaaatacaaag

SEQ ID NO: 25290 - DNA, 20 bp, Artificial Sequence
  Description of Artificial Sequence: Synthetic oligonucleotide
  Target: SCN10A; (-) strand; PAM type: NRG; PAM sequence: AAG
acttttgaggaagaaataca

SEQ ID NO: 25291 - DNA, 20 bp, Artificial Sequence
  Description of Artificial Sequence: Synthetic oligonucleotide
  Target: SCN10A; (-) strand; PAM type: NRG; PAM sequence: AAG
tagccaagaaacttttgagg

SEQ ID NO: 25292 - DNA, 20 bp, Artificial Sequence
  Description of Artificial Sequence: Synthetic oligonucleotide
  Target: SCN10A; (-) strand; PAM type: NRG; PAM sequence: AGG
ttatagccaagaaacttttg

SEQ ID NO: 25293 - DNA, 20 bp, Artificial Sequence
  Description of Artificial Sequence: Synthetic oligonucleotide
  Target: SCN10A; (-) strand; PAM type: NRG; PAM sequence: GAG
attatagccaagaaactttt

SEQ ID NO: 25294 - DNA, 20 bp, Artificial Sequence
  Description of Artificial Sequence: Synthetic oligonucleotide
  Target: SCN10A; (-) strand; PAM type: NRG; PAM sequence: AAG
ttaaagagcaaattatagcc

SEQ ID NO: 25295 - DNA, 20 bp, Artificial Sequence
  Description of Artificial Sequence: Synthetic oligonucleotide
  Target: SCN10A; (-) strand; PAM type: NRG; PAM sequence: TAG
aaattttaaagagcaaatta

SEQ ID NO: 25296 - DNA, 20 bp, Artificial Sequence
  Description of Artificial Sequence: Synthetic oligonucleotide
  Target: SCN10A; (-) strand; PAM type: NRG; PAM sequence: GAG
agtttacatgaaattttaaa

SEQ ID NO: 25297 - DNA, 20 bp, Artificial Sequence
  Description of Artificial Sequence: Synthetic oligonucleotide
  Target: SCN10A; (-) strand; PAM type: NRG; PAM sequence: AAG
aaagtttacatgaaatttta

SEQ ID NO: 25298 - DNA, 20 bp, Artificial Sequence
  Description of Artificial Sequence: Synthetic oligonucleotide
  Target: SCN10A; (-) strand; PAM type: NRG; PAM sequence: AAG
ctttaaattttcttcctcaa

SEQ ID NO: 25299 - DNA, 20 bp, Artificial Sequence
  Description of Artificial Sequence: Synthetic oligonucleotide
  Target: SCN10A; (-) strand; PAM type: NRG; PAM sequence: TGG
atatttcaacaggcttcttt

SEQ ID NO: 25300 - DNA, 20 bp, Artificial Sequence
  Description of Artificial Sequence: Synthetic oligonucleotide
  Target: SCN10A; (-) strand; PAM type: NRG; PAM sequence: AGG
cctcaaatcaatatttcaac

SEQ ID NO: 25301 - DNA, 20 bp, Artificial Sequence
  Description of Artificial Sequence: Synthetic oligonucleotide
  Target: SCN10A; (-) strand; PAM type: NRG; PAM sequence: CAG
tcctcaaatcaatatttcaa

SEQ ID NO: 25302 - DNA, 20 bp, Artificial Sequence
  Description of Artificial Sequence: Synthetic oligonucleotide
  Target: SCN10A; (-) strand; PAM type: NRG; PAM sequence: AAG
ttcaaagtctcaatattgta

SEQ ID NO: 25303 - DNA, 20 bp, Artificial Sequence
  Description of Artificial Sequence: Synthetic oligonucleotide
  Target: SCN10A; (-) strand; PAM type: NRG; PAM sequence: AAG
gagacatgttctcagattca

SEQ ID NO: 25304 - DNA, 20 bp, Artificial Sequence
  Description of Artificial Sequence: Synthetic oligonucleotide
  Target: SCN10A; (-) strand; PAM type: NRG; PAM sequence: CAG
tcagtggggagacatgttct

SEQ ID NO: 25305 - DNA, 20 bp, Artificial Sequence
  Description of Artificial Sequence: Synthetic oligonucleotide
  Target: SCN10A; (-) strand; PAM type: NRG; PAM sequence: GAG
aagaaaaccaaatcagtggg

SEQ ID NO: 25306 - DNA, 20 bp, Artificial Sequence
  Description of Artificial Sequence: Synthetic oligonucleotide
  Target: SCN10A; (-) strand; PAM type: NRG; PAM sequence: GGG
taaagaaaaccaaatcagtg

SEQ ID NO: 25307 - DNA, 20 bp, Artificial Sequence
  Description of Artificial Sequence: Synthetic oligonucleotide
  Target: SCN10A; (-) strand; PAM type: NRG; PAM sequence: GGG
ttaaagaaaaccaaatcagt

SEQ ID NO: 25308 - DNA, 20 bp, Artificial Sequence
  Description of Artificial Sequence: Synthetic oligonucleotide
  Target: SCN10A; (-) strand; PAM type: NRG; PAM sequence: TGG
tttaaagaaaaccaaatcag

SEQ ID NO: 25309 - DNA, 20 bp, Artificial Sequence
  Description of Artificial Sequence: Synthetic oligonucleotide
  Target: SCN10A; (-) strand; PAM type: NRG; PAM sequence: CAG
gtttttaaagaaaaccaaat

SEQ ID NO: 25310 - DNA, 20 bp, Artificial Sequence
  Description of Artificial Sequence: Synthetic oligonucleotide
  Target: SCN10A; (-) strand; PAM type: NRG; PAM sequence: AAG
agtattgtgtaaagttttta

SEQ ID NO: 25311 - DNA, 20 bp, Artificial Sequence
  Description of Artificial Sequence: Synthetic oligonucleotide
  Target: SCN10A; (-) strand; PAM type: NRG; PAM sequence: AAG
attataataagtattgtgta

SEQ ID NO: 25312 - DNA, 20 bp, Artificial Sequence
  Description of Artificial Sequence: Synthetic oligonucleotide
  Target: SCN10A; (-) strand; PAM type: NRG; PAM sequence: AAG
tctataaggaaaattataat

SEQ ID NO: 25313 - DNA, 20 bp, Artificial Sequence
  Description of Artificial Sequence: Synthetic oligonucleotide
  Target: SCN10A; (-) strand; PAM type: NRG; PAM sequence: AGG
gtataagtgagatctctata

SEQ ID NO: 25314 - DNA, 20 bp, Artificial Sequence
  Description of Artificial Sequence: Synthetic oligonucleotide
  Target: SCN10A; (-) strand; PAM type: NRG; PAM sequence: AAG
agtataagtgagatctctat

SEQ ID NO: 25315 - DNA, 20 bp, Artificial Sequence
  Description of Artificial Sequence: Synthetic oligonucleotide
  Target: SCN10A; (-) strand; PAM type: NRG; PAM sequence: GAG
aagattatcaaagtataagt

SEQ ID NO: 25316 - DNA, 20 bp, Artificial Sequence
  Description of Artificial Sequence: Synthetic oligonucleotide
  Target: SCN10A; (-) strand; PAM type: NRG; PAM sequence: AAG
gaataagattatcaaagtat

SEQ ID NO: 25317 - DNA, 20 bp, Artificial Sequence
  Description of Artificial Sequence: Synthetic oligonucleotide
  Target: SCN10A; (-) strand; PAM type: NRG; PAM sequence: AAG
atctaggaataagattatca

SEQ ID NO: 25318 - DNA, 20 bp, Artificial Sequence
  Description of Artificial Sequence: Synthetic oligonucleotide
  Target: SCN10A; (-) strand; PAM type: NRG; PAM sequence: AAG
aatgtcaagtatctaggaat

SEQ ID NO: 25319 - DNA, 20 bp, Artificial Sequence
  Description of Artificial Sequence: Synthetic oligonucleotide
  Target: SCN10A; (-) strand; PAM type: NRG; PAM sequence: AGG
ttttaaaatgtcaagtatct

SEQ ID NO: 25320 - DNA, 20 bp, Artificial Sequence
  Description of Artificial Sequence: Synthetic oligonucleotide
  Target: SCN10A; (-) strand; PAM type: NRG; PAM sequence: TAG
attttaaaatgtcaagtatc

SEQ ID NO: 25321 - DNA, 20 bp, Artificial Sequence
  Description of Artificial Sequence: Synthetic oligonucleotide
  Target: SCN10A; (-) strand; PAM type: NRG; PAM sequence: AAG
cactggcattttaaaatgtc

SEQ ID NO: 25322 - DNA, 20 bp, Artificial Sequence
  Description of Artificial Sequence: Synthetic oligonucleotide
  Target: SCN10A; (-) strand; PAM type: NRG; PAM sequence: TGG
tttaaaaataccatttacac

SEQ ID NO: 25323 - DNA, 20 bp, Artificial Sequence
  Description of Artificial Sequence: Synthetic oligonucleotide
  Target: SCN10A; (-) strand; PAM type: NRG; PAM sequence: TAG
cactagcaacaaacagaaaa

SEQ ID NO: 25324 - DNA, 20 bp, Artificial Sequence
  Description of Artificial Sequence: Synthetic oligonucleotide
  Target: SCN10A; (-) strand; PAM type: NRG; PAM sequence: CAG
gtatagacactagcaacaaa

SEQ ID NO: 25325 - DNA, 20 bp, Artificial Sequence
  Description of Artificial Sequence: Synthetic oligonucleotide
  Target: SCN10A; (-) strand; PAM type: NRG; PAM sequence: TAG
aatcaattgtgtatagacac

SEQ ID NO: 25326 - DNA, 20 bp, Artificial Sequence
  Description of Artificial Sequence: Synthetic oligonucleotide
  Target: SCN10A; (-) strand; PAM type: NRG; PAM sequence: TAG
atacataaatcaattgtgta

SEQ ID NO: 25327 - DNA, 20 bp, Artificial Sequence
  Description of Artificial Sequence: Synthetic oligonucleotide
  Target: SCN10A; (-) strand; PAM type: NRG; PAM sequence: GGG
aagagtatagtaaggtagct

SEQ ID NO: 25328 - DNA, 20 bp, Artificial Sequence
  Description of Artificial Sequence: Synthetic oligonucleotide
  Target: SCN10A; (-) strand; PAM type: NRG; PAM sequence: TGG
aaagagtatagtaaggtagc

SEQ ID NO: 25329 - DNA, 20 bp, Artificial Sequence
  Description of Artificial Sequence: Synthetic oligonucleotide
  Target: SCN10A; (-) strand; PAM type: NRG; PAM sequence: TAG
aataaaagagtatagtaagg

SEQ ID NO: 25330 - DNA, 20 bp, Artificial Sequence
  Description of Artificial Sequence: Synthetic oligonucleotide
  Target: SCN10A; (-) strand; PAM type: NRG; PAM sequence: AGG
attaataaaagagtatagta

SEQ ID NO: 25331 - DNA, 20 bp, Artificial Sequence
  Description of Artificial Sequence: Synthetic oligonucleotide
  Target: SCN10A; (-) strand; PAM type: NRG; PAM sequence: AAG
aattaataaaagagtatagt

SEQ ID NO: 25332 - DNA, 20 bp, Artificial Sequence
  Description of Artificial Sequence: Synthetic oligonucleotide
  Target: SCN10A; (-) strand; PAM type: NRG; PAM sequence: TAG
taagaattaataaaagagta

SEQ ID NO: 25333 - DNA, 20 bp, Artificial Sequence
  Description of Artificial Sequence: Synthetic oligonucleotide
  Target: SCN10A; (-) strand; PAM type: NRG; PAM sequence: GAG
aacagtaagaattaataaaa

SEQ ID NO: 25334 - DNA, 20 bp, Artificial Sequence
  Description of Artificial Sequence: Synthetic oligonucleotide
  Target: SCN10A; (-) strand; PAM type: NRG; PAM sequence: AAG
taaacagtaagaattaataa

SEQ ID NO: 25335 - DNA, 20 bp, Artificial Sequence
  Description of Artificial Sequence: Synthetic oligonucleotide
  Target: SCN10A; (-) strand; PAM type: NRG; PAM sequence: AAG
ataacctagagataaacagt

SEQ ID NO: 25336 - DNA, 20 bp, Artificial Sequence
  Description of Artificial Sequence: Synthetic oligonucleotide
  Target: SCN10A; (-) strand; PAM type: NRG; PAM sequence: CAG
caacataacctagagataaa

SEQ ID NO: 25337 - DNA, 20 bp, Artificial Sequence
  Description of Artificial Sequence: Synthetic oligonucleotide
  Target: SCN10A; (-) strand; PAM type: NRG; PAM sequence: GAG
aaaatatccaacataaccta

SEQ ID NO: 25338 - DNA, 20 bp, Artificial Sequence
  Description of Artificial Sequence: Synthetic oligonucleotide
  Target: SCN10A; (-) strand; PAM type: NRG; PAM sequence: TAG
ataaaatatccaacataacc

SEQ ID NO: 25339 - DNA, 20 bp, Artificial Sequence
  Description of Artificial Sequence: Synthetic oligonucleotide
  Target: SCN10A; (-) strand; PAM type: NRG; PAM sequence: AAG
agatgtaatttacagataat

SEQ ID NO: 25340 - DNA, 20 bp, Artificial Sequence
  Description of Artificial Sequence: Synthetic oligonucleotide
  Target: SCN10A; (-) strand; PAM type: NRG; PAM sequence: CAG
agtaccgaagatgtaattta

SEQ ID NO: 25341 - DNA, 20 bp, Artificial Sequence
  Description of Artificial Sequence: Synthetic oligonucleotide
  Target: SCN10A; (-) strand; PAM type: NRG; PAM sequence: AAG
gcaagaagaaaaaagtaccg

SEQ ID NO: 25342 - DNA, 20 bp, Artificial Sequence
  Description of Artificial Sequence: Synthetic oligonucleotide
  Target: SCN10A; (-) strand; PAM type: NRG; PAM sequence: AAG
aaaaaagtgcaagaagaaaa

SEQ ID NO: 25343 - DNA, 20 bp, Artificial Sequence
  Description of Artificial Sequence: Synthetic oligonucleotide
  Target: SCN10A; (-) strand; PAM type: NRG; PAM sequence: AAG
aaagaaaaaaaaagtgcaag

SEQ ID NO: 25344 - DNA, 20 bp, Artificial Sequence
  Description of Artificial Sequence: Synthetic oligonucleotide
  Target: SCN10A; (-) strand; PAM type: NRG; PAM sequence: AAG
agcaaagaaaaaaaaagtgc

SEQ ID NO: 25345 - DNA, 20 bp, Artificial Sequence
  Description of Artificial Sequence: Synthetic oligonucleotide
  Target: SCN10A; (-) strand; PAM type: NRG; PAM sequence: AAG
tagtaaagcaaagaaaaaaa

SEQ ID NO: 25346 - DNA, 20 bp, Artificial Sequence
  Description of Artificial Sequence: Synthetic oligonucleotide
  Target: SCN10A; (-) strand; PAM type: NRG; PAM sequence: AAG
tcagccagcatagtaaagca

SEQ ID NO: 25347 - DNA, 20 bp, Artificial Sequence
  Description of Artificial Sequence: Synthetic oligonucleotide
  Target: SCN10A; (-) strand; PAM type: NRG; PAM sequence: AAG
aggtctcagccagcatagta

SEQ ID NO: 25348 - DNA, 20 bp, Artificial Sequence
  Description of Artificial Sequence: Synthetic oligonucleotide
  Target: SCN10A; (-) strand; PAM type: NRG; PAM sequence: TAG
aaaggaggtctcagccagca

SEQ ID NO: 25349 - DNA, 20 bp, Artificial Sequence
  Description of Artificial Sequence: Synthetic oligonucleotide
  Target: SCN10A; (-) strand; PAM type: NRG; PAM sequence: CAG
tttgtaaaggaggtctcagc

SEQ ID NO: 25350 - DNA, 20 bp, Artificial Sequence
  Description of Artificial Sequence: Synthetic oligonucleotide
  Target: SCN10A; (-) strand; PAM type: NRG; PAM sequence: CAG
ccactttgtaaaggaggtct

SEQ ID NO: 25351 - DNA, 20 bp, Artificial Sequence
  Description of Artificial Sequence: Synthetic oligonucleotide
  Target: SCN10A; (-) strand; PAM type: NRG; PAM sequence: AGG
tcagttccactttgtaaagg

SEQ ID NO: 25352 - DNA, 20 bp, Artificial Sequence
  Description of Artificial Sequence: Synthetic oligonucleotide
  Target: SCN10A; (-) strand; PAM type: NRG; PAM sequence: GAG
ctcagttccactttgtaaag

SEQ ID NO: 25353 - DNA, 20 bp, Artificial Sequence
  Description of Artificial Sequence: Synthetic oligonucleotide
  Target: SCN10A; (-) strand; PAM type: NRG; PAM sequence: AGG
ttctcagttccactttgtaa

SEQ ID NO: 25354 - DNA, 20 bp, Artificial Sequence
  Description of Artificial Sequence: Synthetic oligonucleotide
  Target: SCN10A; (-) strand; PAM type: NRG; PAM sequence: AAG
cttctcagttccactttgta

SEQ ID NO: 25355 - DNA, 20 bp, Artificial Sequence
  Description of Artificial Sequence: Synthetic oligonucleotide
  Target: SCN10A; (-) strand; PAM type: NRG; PAM sequence: CAG
ccaaagatgtctgttcttct

SEQ ID NO: 25356 - DNA, 20 bp, Artificial Sequence
  Description of Artificial Sequence: Synthetic oligonucleotide
  Target: SCN10A; (-) strand; PAM type: NRG; PAM sequence: AAG
atcaaaagaaaaaaaaacca

SEQ ID NO: 25357 - DNA, 20 bp, Artificial Sequence
  Description of Artificial Sequence: Synthetic oligonucleotide
  Target: SCN10A; (-) strand; PAM type: NRG; PAM sequence: AAG
agctttccctttgagatcaa

SEQ ID NO: 25358 - DNA, 20 bp, Artificial Sequence
  Description of Artificial Sequence: Synthetic oligonucleotide
  Target: SCN10A; (-) strand; PAM type: NRG; PAM sequence: GAG
acatggaaagctttcccttt

SEQ ID NO: 25359 - DNA, 20 bp, Artificial Sequence
  Description of Artificial Sequence: Synthetic oligonucleotide
  Target: SCN10A; (-) strand; PAM type: NRG; PAM sequence: AAG
tacttaattgtgaacatgga

SEQ ID NO: 25360 - DNA, 20 bp, Artificial Sequence
  Description of Artificial Sequence: Synthetic oligonucleotide
  Target: SCN10A; (-) strand; PAM type: NRG; PAM sequence: TGG
gtcatacttaattgtgaaca

SEQ ID NO: 25361 - DNA, 20 bp, Artificial Sequence
  Description of Artificial Sequence: Synthetic oligonucleotide
  Target: SCN10A; (-) strand; PAM type: NRG; PAM sequence: AAG
attcattgttttaaagtatc

SEQ ID NO: 25362 - DNA, 20 bp, Artificial Sequence
  Description of Artificial Sequence: Synthetic oligonucleotide
  Target: SCN10A; (-) strand; PAM type: NRG; PAM sequence: AAG
aaagggtattcattgtttta

SEQ ID NO: 25363 - DNA, 20 bp, Artificial Sequence
  Description of Artificial Sequence: Synthetic oligonucleotide
  Target: SCN10A; (-) strand; PAM type: NRG; PAM sequence: GGG
gattgcatcactctgataaa

SEQ ID NO: 25364 - DNA, 20 bp, Artificial Sequence
  Description of Artificial Sequence: Synthetic oligonucleotide
  Target: SCN10A; (-) strand; PAM type: NRG; PAM sequence: AGG
ggattgcatcactctgataa

SEQ ID NO: 25365 - DNA, 20 bp, Artificial Sequence
  Description of Artificial Sequence: Synthetic oligonucleotide
  Target: SCN10A; (-) strand; PAM type: NRG; PAM sequence: AAG
gggattgcatcactctgata

SEQ ID NO: 25366 - DNA, 20 bp, Artificial Sequence
  Description of Artificial Sequence: Synthetic oligonucleotide
  Target: SCN10A; (-) strand; PAM type: NRG; PAM sequence: GGG
agtataataattttaaaaag

SEQ ID NO: 25367 - DNA, 20 bp, Artificial Sequence
  Description of Artificial Sequence: Synthetic oligonucleotide
  Target: SCN10A; (-) strand; PAM type: NRG; PAM sequence: GGG
aagtataataattttaaaaa

SEQ ID NO: 25368 - DNA, 20 bp, Artificial Sequence
  Description of Artificial Sequence: Synthetic oligonucleotide
  Target: SCN10A; (-) strand; PAM type: NRG; PAM sequence: AGG
aaagtataataattttaaaa

SEQ ID NO: 25369 - DNA, 20 bp, Artificial Sequence
  Description of Artificial Sequence: Synthetic oligonucleotide
  Target: SCN10A; (-) strand; PAM type: NRG; PAM sequence: AAG
taaagtataataattttaaa

SEQ ID NO: 25370 - DNA, 20 bp, Artificial Sequence
  Description of Artificial Sequence: Synthetic oligonucleotide
  Target: SCN10A; (-) strand; PAM type: NRG; PAM sequence: AAG
cacatgtaccccagaactta

SEQ ID NO: 25371 - DNA, 20 bp, Artificial Sequence
  Description of Artificial Sequence: Synthetic oligonucleotide
  Target: SCN10A; (-) strand; PAM type: NRG; PAM sequence: CAG
cacgttctgcacatgtaccc

SEQ ID NO: 25372 - DNA, 20 bp, Artificial Sequence
  Description of Artificial Sequence: Synthetic oligonucleotide
  Target: SCN10A; (-) strand; PAM type: NRG; PAM sequence: CGG
ggtacacctatgtaacaaac

SEQ ID NO: 25373 - DNA, 20 bp, Artificial Sequence
  Description of Artificial Sequence: Synthetic oligonucleotide
  Target: SCN10A; (-) strand; PAM type: NRG; PAM sequence: GGG
gcagcaaaccaccatggcac

SEQ ID NO: 25374 - DNA, 20 bp, Artificial Sequence
  Description of Artificial Sequence: Synthetic oligonucleotide
  Target: SCN10A; (-) strand; PAM type: NRG; PAM sequence: CGG
tgcagcaaaccaccatggca

SEQ ID NO: 25375 - DNA, 20 bp, Artificial Sequence
  Description of Artificial Sequence: Synthetic oligonucleotide
  Target: SCN10A; (-) strand; PAM type: NRG; PAM sequence: TGG
aagggtgcagcaaaccacca

SEQ ID NO: 25376 - DNA, 20 bp, Artificial Sequence
  Description of Artificial Sequence: Synthetic oligonucleotide
  Target: SCN10A; (-) strand; PAM type: NRG; PAM sequence: CAG
aaatgacgggttgaagggtg

SEQ ID NO: 25377 - DNA, 20 bp, Artificial Sequence
  Description of Artificial Sequence: Synthetic oligonucleotide
  Target: SCN10A; (-) strand; PAM type: NRG; PAM sequence: GGG
aatgtaaatgacgggttgaa

SEQ ID NO: 25378 - DNA, 20 bp, Artificial Sequence
  Description of Artificial Sequence: Synthetic oligonucleotide
  Target: SCN10A; (-) strand; PAM type: NRG; PAM sequence: AGG
taatgtaaatgacgggttga

SEQ ID NO: 25379 - DNA, 20 bp, Artificial Sequence
  Description of Artificial Sequence: Synthetic oligonucleotide
  Target: SCN10A; (-) strand; PAM type: NRG; PAM sequence: AAG
ctaatgtaaatgacgggttg

SEQ ID NO: 25380 - DNA, 20 bp, Artificial Sequence
  Description of Artificial Sequence: Synthetic oligonucleotide
  Target: SCN10A; (-) strand; PAM type: NRG; PAM sequence: GGG
aaatacctaatgtaaatgac

SEQ ID NO: 25381 - DNA, 20 bp, Artificial Sequence
  Description of Artificial Sequence: Synthetic oligonucleotide
  Target: SCN10A; (-) strand; PAM type: NRG; PAM sequence: CGG
gaaatacctaatgtaaatga

SEQ ID NO: 25382 - DNA, 20 bp, Artificial Sequence
  Description of Artificial Sequence: Synthetic oligonucleotide
  Target: SCN10A; (-) strand; PAM type: NRG; PAM sequence: GAG
taggggagggatagcattag

SEQ ID NO: 25383 - DNA, 20 bp, Artificial Sequence
  Description of Artificial Sequence: Synthetic oligonucleotide
  Target: SCN10A; (-) strand; PAM type: NRG; PAM sequence: AGG
gctaggggagggatagcatt

SEQ ID NO: 25384 - DNA, 20 bp, Artificial Sequence
  Description of Artificial Sequence: Synthetic oligonucleotide
  Target: SCN10A; (-) strand; PAM type: NRG; PAM sequence: TAG
ggctaggggagggatagcat

SEQ ID NO: 25385 - DNA, 20 bp, Artificial Sequence
  Description of Artificial Sequence: Synthetic oligonucleotide
  Target: SCN10A; (-) strand; PAM type: NRG; PAM sequence: TAG
gtggggggctaggggaggga

SEQ ID NO: 25386 - DNA, 20 bp, Artificial Sequence
  Description of Artificial Sequence: Synthetic oligonucleotide
  Target: SCN10A; (-) strand; PAM type: NRG; PAM sequence: GGG
aggggtggggggctagggga

SEQ ID NO: 25387 - DNA, 20 bp, Artificial Sequence
  Description of Artificial Sequence: Synthetic oligonucleotide
  Target: SCN10A; (-) strand; PAM type: NRG; PAM sequence: AGG
gaggggtggggggctagggg

SEQ ID NO: 25388 - DNA, 20 bp, Artificial Sequence
  Description of Artificial Sequence: Synthetic oligonucleotide
  Target: SCN10A; (-) strand; PAM type: NRG; PAM sequence: GAG
tgaggggtggggggctaggg

SEQ ID NO: 25389 - DNA, 20 bp, Artificial Sequence
  Description of Artificial Sequence: Synthetic oligonucleotide
  Target: SCN10A; (-) strand; PAM type: NRG; PAM sequence: GGG
gttgaggggtggggggctag

SEQ ID NO: 25390 - DNA, 20 bp, Artificial Sequence
  Description of Artificial Sequence: Synthetic oligonucleotide
  Target: SCN10A; (-) strand; PAM type: NRG; PAM sequence: GGG
tgttgaggggtggggggcta

SEQ ID NO: 25391 - DNA, 20 bp, Artificial Sequence
  Description of Artificial Sequence: Synthetic oligonucleotide
  Target: SCN10A; (-) strand; PAM type: NRG; PAM sequence: AGG
ctgttgaggggtggggggct

SEQ ID NO: 25392 - DNA, 20 bp, Artificial Sequence
  Description of Artificial Sequence: Synthetic oligonucleotide
  Target: SCN10A; (-) strand; PAM type: NRG; PAM sequence: TAG
cctgttgaggggtggggggc

SEQ ID NO: 25393 - DNA, 20 bp, Artificial Sequence
  Description of Artificial Sequence: Synthetic oligonucleotide
  Target: SCN10A; (-) strand; PAM type: NRG; PAM sequence: GGG
ggggcctgttgaggggtggg

SEQ ID NO: 25394 - DNA, 20 bp, Artificial Sequence
  Description of Artificial Sequence: Synthetic oligonucleotide
  Target: SCN10A; (-) strand; PAM type: NRG; PAM sequence: GGG
tggggcctgttgaggggtgg

SEQ ID NO: 25395 - DNA, 20 bp, Artificial Sequence
  Description of Artificial Sequence: Synthetic oligonucleotide
  Target: SCN10A; (-) strand; PAM type: NRG; PAM sequence: GGG
ctggggcctgttgaggggtg

SEQ ID NO: 25396 - DNA, 20 bp, Artificial Sequence
  Description of Artificial Sequence: Synthetic oligonucleotide
  Target: SCN10A; (-) strand; PAM type: NRG; PAM sequence: GGG
actggggcctgttgaggggt

SEQ ID NO: 25397 - DNA, 20 bp, Artificial Sequence
  Description of Artificial Sequence: Synthetic oligonucleotide
  Target: SCN10A; (-) strand; PAM type: NRG; PAM sequence: TGG
cactggggcctgttgagggg

SEQ ID NO: 25398 - DNA, 20 bp, Artificial Sequence
  Description of Artificial Sequence: Synthetic oligonucleotide
  Target: SCN10A; (-) strand; PAM type: NRG; PAM sequence: GGG
acacactggggcctgttgag

SEQ ID NO: 25399 - DNA, 20 bp, Artificial Sequence
  Description of Artificial Sequence: Synthetic oligonucleotide
  Target: SCN10A; (-) strand; PAM type: NRG; PAM sequence: GGG
aacacactggggcctgttga

SEQ ID NO: 25400 - DNA, 20 bp, Artificial Sequence
  Description of Artificial Sequence: Synthetic oligonucleotide
  Target: SCN10A; (-) strand; PAM type: NRG; PAM sequence: AGG
gaacacactggggcctgttg

SEQ ID NO: 25401 - DNA, 20 bp, Artificial Sequence
  Description of Artificial Sequence: Synthetic oligonucleotide
  Target: SCN10A; (-) strand; PAM type: NRG; PAM sequence: GAG
ggaacacactggggcctgtt

SEQ ID NO: 25402 - DNA, 20 bp, Artificial Sequence
  Description of Artificial Sequence: Synthetic oligonucleotide
  Target: SCN10A; (-) strand; PAM type: NRG; PAM sequence: GGG
acagggaggggaacacactg

SEQ ID NO: 25403 - DNA, 20 bp, Artificial Sequence
  Description of Artificial Sequence: Synthetic oligonucleotide
  Target: SCN10A; (-) strand; PAM type: NRG; PAM sequence: GGG
cacagggaggggaacacact

SEQ ID NO: 25404 - DNA, 20 bp, Artificial Sequence
  Description of Artificial Sequence: Synthetic oligonucleotide
  Target: SCN10A; (-) strand; PAM type: NRG; PAM sequence: TGG
acacagggaggggaacacac

SEQ ID NO: 25405 - DNA, 20 bp, Artificial Sequence
  Description of Artificial Sequence: Synthetic oligonucleotide
  Target: SCN10A; (-) strand; PAM type: NRG; PAM sequence: GGG
gaacacatggacacagggag

SEQ ID NO: 25406 - DNA, 20 bp, Artificial Sequence
  Description of Artificial Sequence: Synthetic oligonucleotide
  Target: SCN10A; (-) strand; PAM type: NRG; PAM sequence: GGG
agaacacatggacacaggga

SEQ ID NO: 25407 - DNA, 20 bp, Artificial Sequence
  Description of Artificial Sequence: Synthetic oligonucleotide
  Target: SCN10A; (-) strand; PAM type: NRG; PAM sequence: AGG
gagaacacatggacacaggg

SEQ ID NO: 25408 - DNA, 20 bp, Artificial Sequence
  Description of Artificial Sequence: Synthetic oligonucleotide
  Target: SCN10A; (-) strand; PAM type: NRG; PAM sequence: GAG
tgagaacacatggacacagg

SEQ ID NO: 25409 - DNA, 20 bp, Artificial Sequence
  Description of Artificial Sequence: Synthetic oligonucleotide
  Target: SCN10A; (-) strand; PAM type: NRG; PAM sequence: GGG
aatgagaacacatggacaca

SEQ ID NO: 25410 - DNA, 20 bp, Artificial Sequence
  Description of Artificial Sequence: Synthetic oligonucleotide
  Target: SCN10A; (-) strand; PAM type: NRG; PAM sequence: AGG
caatgagaacacatggacac

SEQ ID NO: 25411 - DNA, 20 bp, Artificial Sequence
  Description of Artificial Sequence: Synthetic oligonucleotide
  Target: SCN10A; (-) strand; PAM type: NRG; PAM sequence: CAG
acaatgagaacacatggaca

SEQ ID NO: 25412 - DNA, 20 bp, Artificial Sequence
  Description of Artificial Sequence: Synthetic oligonucleotide
  Target: SCN10A; (-) strand; PAM type: NRG; PAM sequence: TGG
agttgaacaatgagaacaca

SEQ ID NO: 25413 - DNA, 20 bp, Artificial Sequence
  Description of Artificial Sequence: Synthetic oligonucleotide
  Target: SCN10A; (-) strand; PAM type: NRG; PAM sequence: GAG
ataagtgggagttgaacaat

SEQ ID NO: 25414 - DNA, 20 bp, Artificial Sequence
  Description of Artificial Sequence: Synthetic oligonucleotide
  Target: SCN10A; (-) strand; PAM type: NRG; PAM sequence: GAG
atgttctcactcataagtgg

SEQ ID NO: 25415 - DNA, 20 bp, Artificial Sequence
  Description of Artificial Sequence: Synthetic oligonucleotide
  Target: SCN10A; (-) strand; PAM type: NRG; PAM sequence: GGG
gtatgttctcactcataagt

SEQ ID NO: 25416 - DNA, 20 bp, Artificial Sequence
  Description of Artificial Sequence: Synthetic oligonucleotide
  Target: SCN10A; (-) strand; PAM type: NRG; PAM sequence: TGG
cgtatgttctcactcataag

SEQ ID NO: 25417 - DNA, 20 bp, Artificial Sequence
  Description of Artificial Sequence: Synthetic oligonucleotide
  Target: SCN10A; (-) strand; PAM type: NRG; PAM sequence: AAG
caccgtatgttctcactcat

SEQ ID NO: 25418 - DNA, 20 bp, Artificial Sequence
  Description of Artificial Sequence: Synthetic oligonucleotide
  Target: SCN10A; (-) strand; PAM type: NRG; PAM sequence: CAG
tcagcaaactaacacaagaa

SEQ ID NO: 25419 - DNA, 20 bp, Artificial Sequence
  Description of Artificial Sequence: Synthetic oligonucleotide
  Target: SCN10A; (-) strand; PAM type: NRG; PAM sequence: AAG
cattctcagcaaactaacac

SEQ ID NO: 25420 - DNA, 20 bp, Artificial Sequence
  Description of Artificial Sequence: Synthetic oligonucleotide
  Target: SCN10A; (-) strand; PAM type: NRG; PAM sequence: CAG
aagctggaaaccatcattct

SEQ ID NO: 25421 - DNA, 20 bp, Artificial Sequence
  Description of Artificial Sequence: Synthetic oligonucleotide
  Target: SCN10A; (-) strand; PAM type: NRG; PAM sequence: TGG
tgcagggacatggatgaagc

SEQ ID NO: 25422 - DNA, 20 bp, Artificial Sequence
  Description of Artificial Sequence: Synthetic oligonucleotide
  Target: SCN10A; (-) strand; PAM type: NRG; PAM sequence: AAG
cctttgcagggacatggatg

SEQ ID NO: 25423 - DNA, 20 bp, Artificial Sequence
  Description of Artificial Sequence: Synthetic oligonucleotide
  Target: SCN10A; (-) strand; PAM type: NRG; PAM sequence: TGG
tcatgtcctttgcagggaca

SEQ ID NO: 25424 - DNA, 20 bp, Artificial Sequence
  Description of Artificial Sequence: Synthetic oligonucleotide
  Target: SCN10A; (-) strand; PAM type: NRG; PAM sequence: GGG
atgagttcatgtcctttgca

SEQ ID NO: 25425 - DNA, 20 bp, Artificial Sequence
  Description of Artificial Sequence: Synthetic oligonucleotide
  Target: SCN10A; (-) strand; PAM type: NRG; PAM sequence: AGG
gatgagttcatgtcctttgc

SEQ ID NO: 25426 - DNA, 20 bp, Artificial Sequence
  Description of Artificial Sequence: Synthetic oligonucleotide
  Target: SCN10A; (-) strand; PAM type: NRG; PAM sequence: CAG
ggatgagttcatgtcctttg

SEQ ID NO: 25427 - DNA, 20 bp, Artificial Sequence
  Description of Artificial Sequence: Synthetic oligonucleotide
  Target: SCN10A; (-) strand; PAM type: NRG; PAM sequence: GAG
atgcagtcataaaaaaggat

SEQ ID NO: 25428 - DNA, 20 bp, Artificial Sequence
  Description of Artificial Sequence: Synthetic oligonucleotide
  Target: SCN10A; (-) strand; PAM type: NRG; PAM sequence: AGG
atgctatgcagtcataaaaa

SEQ ID NO: 25429 - DNA, 20 bp, Artificial Sequence
  Description of Artificial Sequence: Synthetic oligonucleotide
  Target: SCN10A; (-) strand; PAM type: NRG; PAM sequence: AAG
aatgctatgcagtcataaaa

SEQ ID NO: 25430 - DNA, 20 bp, Artificial Sequence
  Description of Artificial Sequence: Synthetic oligonucleotide
  Target: SCN10A; (-) strand; PAM type: NRG; PAM sequence: CAG
atacaccatggaatgctatg

SEQ ID NO: 25431 - DNA, 20 bp, Artificial Sequence
  Description of Artificial Sequence: Synthetic oligonucleotide
  Target: SCN10A; (-) strand; PAM type: NRG; PAM sequence: TGG
aatgtggcacatatacacca

SEQ ID NO: 25432 - DNA, 20 bp, Artificial Sequence
  Description of Artificial Sequence: Synthetic oligonucleotide
  Target: SCN10A; (-) strand; PAM type: NRG; PAM sequence: TGG
gaaatagaagggaataaatg

SEQ ID NO: 25433 - DNA, 20 bp, Artificial Sequence
  Description of Artificial Sequence: Synthetic oligonucleotide
  Target: SCN10A; (-) strand; PAM type: NRG; PAM sequence: GGG
ttagaaaagttgaaatagaa

SEQ ID NO: 25434 - DNA, 20 bp, Artificial Sequence
  Description of Artificial Sequence: Synthetic oligonucleotide
  Target: SCN10A; (-) strand; PAM type: NRG; PAM sequence: AGG
cttagaaaagttgaaataga

SEQ ID NO: 25435 - DNA, 20 bp, Artificial Sequence
  Description of Artificial Sequence: Synthetic oligonucleotide
  Target: SCN10A; (-) strand; PAM type: NRG; PAM sequence: AAG
tcttagaaaagttgaaatag

SEQ ID NO: 25436 - DNA, 20 bp, Artificial Sequence
  Description of Artificial Sequence: Synthetic oligonucleotide
  Target: SCN10A; (-) strand; PAM type: NRG; PAM sequence: TAG
aattcttagaaaagttgaaa

SEQ ID NO: 25437 - DNA, 20 bp, Artificial Sequence
  Description of Artificial Sequence: Synthetic oligonucleotide
  Target: SCN10A; (-) strand; PAM type: NRG; PAM sequence: AAG
ataattttaaattcttagaa

SEQ ID NO: 25438 - DNA, 20 bp, Artificial Sequence
  Description of Artificial Sequence: Synthetic oligonucleotide
  Target: SCN10A; (-) strand; PAM type: NRG; PAM sequence: TAG
catttataattttaaattct

SEQ ID NO: 25439 - DNA, 20 bp, Artificial Sequence
  Description of Artificial Sequence: Synthetic oligonucleotide
  Target: SCN10A; (-) strand; PAM type: NRG; PAM sequence: AAG
gatgctaaaatcatttgata

SEQ ID NO: 25440 - DNA, 20 bp, Artificial Sequence
  Description of Artificial Sequence: Synthetic oligonucleotide
  Target: SCN10A; (-) strand; PAM type: NRG; PAM sequence: TAG
attaaaggaaaaggatcaca

SEQ ID NO: 25441 - DNA, 20 bp, Artificial Sequence
  Description of Artificial Sequence: Synthetic oligonucleotide
  Target: SCN10A; (-) strand; PAM type: NRG; PAM sequence: AGG
tattaatagattaaaggaaa

SEQ ID NO: 25442 - DNA, 20 bp, Artificial Sequence
  Description of Artificial Sequence: Synthetic oligonucleotide
  Target: SCN10A; (-) strand; PAM type: NRG; PAM sequence: AAG
ttattaatagattaaaggaa

SEQ ID NO: 25443 - DNA, 20 bp, Artificial Sequence
  Description of Artificial Sequence: Synthetic oligonucleotide
  Target: SCN10A; (-) strand; PAM type: NRG; PAM sequence: AGG
tatttttattaatagattaa

SEQ ID NO: 25444 - DNA, 20 bp, Artificial Sequence
  Description of Artificial Sequence: Synthetic oligonucleotide
  Target: SCN10A; (-) strand; PAM type: NRG; PAM sequence: AAG
atatttttattaatagatta

SEQ ID NO: 25445 - DNA, 20 bp, Artificial Sequence
  Description of Artificial Sequence: Synthetic oligonucleotide
  Target: SCN10A; (-) strand; PAM type: NRG; PAM sequence: TAG
atacgttatatttttattaa

SEQ ID NO: 25446 - DNA, 20 bp, Artificial Sequence
  Description of Artificial Sequence: Synthetic oligonucleotide
  Target: SCN10A; (-) strand; PAM type: NRG; PAM sequence: CAG
aacagtaatgcatgccacaa

SEQ ID NO: 25447 - DNA, 20 bp, Artificial Sequence
  Description of Artificial Sequence: Synthetic oligonucleotide
  Target: SCN10A; (-) strand; PAM type: NRG; PAM sequence: CAG
tttttttttgctaatcataa

SEQ ID NO: 25448 - DNA, 20 bp, Artificial Sequence
  Description of Artificial Sequence: Synthetic oligonucleotide
  Target: SCN10A; (-) strand; PAM type: NRG; PAM sequence: GAG
ataataacaggtgctttgca

SEQ ID NO: 25449 - DNA, 20 bp, Artificial Sequence
  Description of Artificial Sequence: Synthetic oligonucleotide
  Target: SCN10A; (-) strand; PAM type: NRG; PAM sequence: CAG
ttataataacaggtgctttg

SEQ ID NO: 25450 - DNA, 20 bp, Artificial Sequence
  Description of Artificial Sequence: Synthetic oligonucleotide
  Target: SCN10A; (-) strand; PAM type: NRG; PAM sequence: AGG
atacctttggttataataac

SEQ ID NO: 25451 - DNA, 20 bp, Artificial Sequence
  Description of Artificial Sequence: Synthetic oligonucleotide
  Target: SCN10A; (-) strand; PAM type: NRG; PAM sequence: CAG
catacctttggttataataa

SEQ ID NO: 25452 - DNA, 20 bp, Artificial Sequence
  Description of Artificial Sequence: Synthetic oligonucleotide
  Target: SCN10A; (-) strand; PAM type: NRG; PAM sequence: TGG
gcttgaacctaacatacctt

SEQ ID NO: 25453 - DNA, 20 bp, Artificial Sequence
  Description of Artificial Sequence: Synthetic oligonucleotide
  Target: SCN10A; (-) strand; PAM type: NRG; PAM sequence: CAG
tgggagggatgcttccactc

SEQ ID NO: 25454 - DNA, 20 bp, Artificial Sequence
  Description of Artificial Sequence: Synthetic oligonucleotide
  Target: SCN10A; (-) strand; PAM type: NRG; PAM sequence: GGG
ccatatccacacatctggga

SEQ ID NO: 25455 - DNA, 20 bp, Artificial Sequence
  Description of Artificial Sequence: Synthetic oligonucleotide
  Target: SCN10A; (-) strand; PAM type: NRG; PAM sequence: AGG
tccatatccacacatctggg

SEQ ID NO: 25456 - DNA, 20 bp, Artificial Sequence
  Description of Artificial Sequence: Synthetic oligonucleotide
  Target: SCN10A; (-) strand; PAM type: NRG; PAM sequence: GAG
ttccatatccacacatctgg

SEQ ID NO: 25457 - DNA, 20 bp, Artificial Sequence
  Description of Artificial Sequence: Synthetic oligonucleotide
  Target: SCN10A; (-) strand; PAM type: NRG; PAM sequence: GGG
cattccatatccacacatct

SEQ ID NO: 25458 - DNA, 20 bp, Artificial Sequence
  Description of Artificial Sequence: Synthetic oligonucleotide
  Target: SCN10A; (-) strand; PAM type: NRG; PAM sequence: TGG
acattccatatccacacatc

SEQ ID NO: 25459 - DNA, 20 bp, Artificial Sequence
  Description of Artificial Sequence: Synthetic oligonucleotide
  Target: SCN10A; (-) strand; PAM type: NRG; PAM sequence: GAG
cctatagtttcagaatctgg

SEQ ID NO: 25460 - DNA, 20 bp, Artificial Sequence
  Description of Artificial Sequence: Synthetic oligonucleotide
  Target: SCN10A; (-) strand; PAM type: NRG; PAM sequence: GGG
cccctatagtttcagaatct

SEQ ID NO: 25461 - DNA, 20 bp, Artificial Sequence
  Description of Artificial Sequence: Synthetic oligonucleotide
  Target: SCN10A; (-) strand; PAM type: NRG; PAM sequence: TGG
acccctatagtttcagaatc

SEQ ID NO: 25462 - DNA, 20 bp, Artificial Sequence
  Description of Artificial Sequence: Synthetic oligonucleotide
  Target: SCN10A; (-) strand; PAM type: NRG; PAM sequence: CAG
gggtgaaacccctatagttt

SEQ ID NO: 25463 - DNA, 20 bp, Artificial Sequence
  Description of Artificial Sequence: Synthetic oligonucleotide
  Target: SCN10A; (-) strand; PAM type: NRG; PAM sequence: TAG
gttagtgggtgaaaccccta

SEQ ID NO: 25464 - DNA, 20 bp, Artificial Sequence
  Description of Artificial Sequence: Synthetic oligonucleotide
  Target: SCN10A; (-) strand; PAM type: NRG; PAM sequence: GGG
ttctatttccctaggttagt

SEQ ID NO: 25465 - DNA, 20 bp, Artificial Sequence
  Description of Artificial Sequence: Synthetic oligonucleotide
  Target: SCN10A; (-) strand; PAM type: NRG; PAM sequence: TGG
attctatttccctaggttag

SEQ ID NO: 25466 - DNA, 20 bp, Artificial Sequence
  Description of Artificial Sequence: Synthetic oligonucleotide
  Target: SCN10A; (-) strand; PAM type: NRG; PAM sequence: TAG
gttattctatttccctaggt

SEQ ID NO: 25467 - DNA, 20 bp, Artificial Sequence
  Description of Artificial Sequence: Synthetic oligonucleotide
  Target: SCN10A; (-) strand; PAM type: NRG; PAM sequence: AGG
tgaagttattctatttccct

SEQ ID NO: 25468 - DNA, 20 bp, Artificial Sequence
  Description of Artificial Sequence: Synthetic oligonucleotide
  Target: SCN10A; (-) strand; PAM type: NRG; PAM sequence: TAG
ctgaagttattctatttccc

SEQ ID NO: 25469 - DNA, 20 bp, Artificial Sequence
  Description of Artificial Sequence: Synthetic oligonucleotide
  Target: SCN10A; (-) strand; PAM type: NRG; PAM sequence: AAG
aagtaaccttagtattcctg

SEQ ID NO: 25470 - DNA, 20 bp, Artificial Sequence
  Description of Artificial Sequence: Synthetic oligonucleotide
  Target: SCN10A; (-) strand; PAM type: NRG; PAM sequence: TAG
catatgcctcaaagtaacct

SEQ ID NO: 25471 - DNA, 20 bp, Artificial Sequence
  Description of Artificial Sequence: Synthetic oligonucleotide
  Target: SCN10A; (-) strand; PAM type: NRG; PAM sequence: AAG
atcatgcttcatatgcctca

SEQ ID NO: 25472 - DNA, 20 bp, Artificial Sequence
  Description of Artificial Sequence: Synthetic oligonucleotide
  Target: SCN10A; (-) strand; PAM type: NRG; PAM sequence: AAG
actcataaatgaagctgttt

SEQ ID NO: 25473 - DNA, 20 bp, Artificial Sequence
  Description of Artificial Sequence: Synthetic oligonucleotide
  Target: SCN10A; (-) strand; PAM type: NRG; PAM sequence: AAG
tagaaaataactcataaatg

SEQ ID NO: 25474 - DNA, 20 bp, Artificial Sequence
  Description of Artificial Sequence: Synthetic oligonucleotide
  Target: SCN10A; (-) strand; PAM type: NRG; PAM sequence: TAG
aaatggctctggagtatatt

SEQ ID NO: 25475 - DNA, 20 bp, Artificial Sequence
  Description of Artificial Sequence: Synthetic oligonucleotide
  Target: SCN10A; (-) strand; PAM type: NRG; PAM sequence: GAG
actaagaacaaatggctctg

SEQ ID NO: 25476 - DNA, 20 bp, Artificial Sequence
  Description of Artificial Sequence: Synthetic oligonucleotide
  Target: SCN10A; (-) strand; PAM type: NRG; PAM sequence: TGG
gaactaagaacaaatggctc

SEQ ID NO: 25477 - DNA, 20 bp, Artificial Sequence
  Description of Artificial Sequence: Synthetic oligonucleotide
  Target: SCN10A; (-) strand; PAM type: NRG; PAM sequence: TGG
gagacagaactaagaacaaa

SEQ ID NO: 25478 - DNA, 20 bp, Artificial Sequence
  Description of Artificial Sequence: Synthetic oligonucleotide
  Target: SCN10A; (-) strand; PAM type: NRG; PAM sequence: AAG
agcaaaactgagacagaact

SEQ ID NO: 25479 - DNA, 20 bp, Artificial Sequence
  Description of Artificial Sequence: Synthetic oligonucleotide
  Target: SCN10A; (-) strand; PAM type: NRG; PAM sequence: CAG
agacaggagcaaaactgaga

SEQ ID NO: 25480 - DNA, 20 bp, Artificial Sequence
  Description of Artificial Sequence: Synthetic oligonucleotide
  Target: SCN10A; (-) strand; PAM type: NRG; PAM sequence: GAG
agagagacaggagcaaaact

SEQ ID NO: 25481 - DNA, 20 bp, Artificial Sequence
  Description of Artificial Sequence: Synthetic oligonucleotide
  Target: SCN10A; (-) strand; PAM type: NRG; PAM sequence: GAG
ctgctatgaaagagagacag

SEQ ID NO: 25482 - DNA, 20 bp, Artificial Sequence
  Description of Artificial Sequence: Synthetic oligonucleotide
  Target: SCN10A; (-) strand; PAM type: NRG; PAM sequence: AGG
gcctgctatgaaagagagac

SEQ ID NO: 25483 - DNA, 20 bp, Artificial Sequence
  Description of Artificial Sequence: Synthetic oligonucleotide
  Target: SCN10A; (-) strand; PAM type: NRG; PAM sequence: CAG
ggcctgctatgaaagagaga

SEQ ID NO: 25484 - DNA, 20 bp, Artificial Sequence
  Description of Artificial Sequence: Synthetic oligonucleotide
  Target: SCN10A; (-) strand; PAM type: NRG; PAM sequence: GAG
agaaggcctgctatgaaaga

SEQ ID NO: 25485 - DNA, 20 bp, Artificial Sequence
  Description of Artificial Sequence: Synthetic oligonucleotide
  Target: SCN10A; (-) strand; PAM type: NRG; PAM sequence: GAG
tgagaaggcctgctatgaaa

SEQ ID NO: 25486 - DNA, 20 bp, Artificial Sequence
  Description of Artificial Sequence: Synthetic oligonucleotide
  Target: SCN10A; (-) strand; PAM type: NRG; PAM sequence: AAG
tttgagaaggcctgctatga

SEQ ID NO: 25487 - DNA, 20 bp, Artificial Sequence
  Description of Artificial Sequence: Synthetic oligonucleotide
  Target: SCN10A; (-) strand; PAM type: NRG; PAM sequence: AGG
gagaaggtatgcttttgaga

SEQ ID NO: 25488 - DNA, 20 bp, Artificial Sequence
  Description of Artificial Sequence: Synthetic oligonucleotide
  Target: SCN10A; (-) strand; PAM type: NRG; PAM sequence: AAG
agagaaggtatgcttttgag

SEQ ID NO: 25489 - DNA, 20 bp, Artificial Sequence
  Description of Artificial Sequence: Synthetic oligonucleotide
  Target: SCN10A; (-) strand; PAM type: NRG; PAM sequence: GAG
cttagagaaggtatgctttt

SEQ ID NO: 25490 - DNA, 20 bp, Artificial Sequence
  Description of Artificial Sequence: Synthetic oligonucleotide
  Target: SCN10A; (-) strand; PAM type: NRG; PAM sequence: AGG
acaaatgtatgccttagaga

SEQ ID NO: 25491 - DNA, 20 bp, Artificial Sequence
  Description of Artificial Sequence: Synthetic oligonucleotide
  Target: SCN10A; (-) strand; PAM type: NRG; PAM sequence: AAG
cacaaatgtatgccttagag

SEQ ID NO: 25492 - DNA, 20 bp, Artificial Sequence
  Description of Artificial Sequence: Synthetic oligonucleotide
  Target: SCN10A; (-) strand; PAM type: NRG; PAM sequence: GAG
acacacaaatgtatgcctta

SEQ ID NO: 25493 - DNA, 20 bp, Artificial Sequence
  Description of Artificial Sequence: Synthetic oligonucleotide
  Target: SCN10A; (-) strand; PAM type: NRG; PAM sequence: TAG
gcacacacaaatgtatgcct

SEQ ID NO: 25494 - DNA, 20 bp, Artificial Sequence
  Description of Artificial Sequence: Synthetic oligonucleotide
  Target: SCN10A; (-) strand; PAM type: NRG; PAM sequence: TAG
acacacactcactcacctgc

SEQ ID NO: 25495 - DNA, 20 bp, Artificial Sequence
  Description of Artificial Sequence: Synthetic oligonucleotide
  Target: SCN10A; (-) strand; PAM type: NRG; PAM sequence: GAG
ctaaggtggcctgggaagat

SEQ ID NO: 25496 - DNA, 20 bp, Artificial Sequence
  Description of Artificial Sequence: Synthetic oligonucleotide
  Target: SCN10A; (-) strand; PAM type: NRG; PAM sequence: AAG
aaagtctaaggtggcctggg

SEQ ID NO: 25497 - DNA, 20 bp, Artificial Sequence
  Description of Artificial Sequence: Synthetic oligonucleotide
  Target: SCN10A; (-) strand; PAM type: NRG; PAM sequence: GGG
cagaaagtctaaggtggcct

SEQ ID NO: 25498 - DNA, 20 bp, Artificial Sequence
  Description of Artificial Sequence: Synthetic oligonucleotide
  Target: SCN10A; (-) strand; PAM type: NRG; PAM sequence: TGG
ccagaaagtctaaggtggcc

SEQ ID NO: 25499 - DNA, 20 bp, Artificial Sequence
  Description of Artificial Sequence: Synthetic oligonucleotide
  Target: SCN10A; (-) strand; PAM type: NRG; PAM sequence: TGG
cagccccagaaagtctaagg

SEQ ID NO: 25500 - DNA, 20 bp, Artificial Sequence
  Description of Artificial Sequence: Synthetic oligonucleotide
  Target: SCN10A; (-) strand; PAM type: NRG; PAM sequence: AGG
tcccagccccagaaagtcta

SEQ ID NO: 25501 - DNA, 20 bp, Artificial Sequence
  Description of Artificial Sequence: Synthetic oligonucleotide
  Target: SCN10A; (-) strand; PAM type: NRG; PAM sequence: AAG
gtcccagccccagaaagtct

SEQ ID NO: 25502 - DNA, 20 bp, Artificial Sequence
  Description of Artificial Sequence: Synthetic oligonucleotide
  Target: SCN10A; (-) strand; PAM type: NRG; PAM sequence: AAG
gcctgagtcccagccccaga

SEQ ID NO: 25503 - DNA, 20 bp, Artificial Sequence
  Description of Artificial Sequence: Synthetic oligonucleotide
  Target: SCN10A; (-) strand; PAM type: NRG; PAM sequence: CAG
aaatgcctgagtcccagccc

SEQ ID NO: 25504 - DNA, 20 bp, Artificial Sequence
  Description of Artificial Sequence: Synthetic oligonucleotide
  Target: SCN10A; (-) strand; PAM type: NRG; PAM sequence: CAG
ttttttaaatgcctgagtcc

SEQ ID NO: 25505 - DNA, 20 bp, Artificial Sequence
  Description of Artificial Sequence: Synthetic oligonucleotide
  Target: SCN10A; (-) strand; PAM type: NRG; PAM sequence: GAG
gggagattttttaaatgcct

SEQ ID NO: 25506 - DNA, 20 bp, Artificial Sequence
  Description of Artificial Sequence: Synthetic oligonucleotide
  Target: SCN10A; (-) strand; PAM type: NRG; PAM sequence: GAG
tgcatattgcaatttttggg

SEQ ID NO: 25507 - DNA, 20 bp, Artificial Sequence
  Description of Artificial Sequence: Synthetic oligonucleotide
  Target: SCN10A; (-) strand; PAM type: NRG; PAM sequence: GGG
gctgcatattgcaatttttg

SEQ ID NO: 25508 - DNA, 20 bp, Artificial Sequence
  Description of Artificial Sequence: Synthetic oligonucleotide
  Target: SCN10A; (-) strand; PAM type: NRG; PAM sequence: GGG
ggctgcatattgcaattttt

SEQ ID NO: 25509 - DNA, 20 bp, Artificial Sequence
  Description of Artificial Sequence: Synthetic oligonucleotide
  Target: SCN10A; (-) strand; PAM type: NRG; PAM sequence: TGG
tggctgcatattgcaatttt

SEQ ID NO: 25510 - DNA, 20 bp, Artificial Sequence
  Description of Artificial Sequence: Synthetic oligonucleotide
  Target: SCN10A; (-) strand; PAM type: NRG; PAM sequence: TGG
agattagtggttctcaactt

SEQ ID NO: 25511 - DNA, 20 bp, Artificial Sequence
  Description of Artificial Sequence: Synthetic oligonucleotide
  Target: SCN10A; (-) strand; PAM type: NRG; PAM sequence: TGG
ttcaaagagatacagattag

SEQ ID NO: 25512 - DNA, 20 bp, Artificial Sequence
  Description of Artificial Sequence: Synthetic oligonucleotide
  Target: SCN10A; (-) strand; PAM type: NRG; PAM sequence: TAG
agtttcaaagagatacagat

SEQ ID NO: 25513 - DNA, 20 bp, Artificial Sequence
  Description of Artificial Sequence: Synthetic oligonucleotide
  Target: SCN10A; (-) strand; PAM type: NRG; PAM sequence: CAG
ttttcagtttcaaagagata

SEQ ID NO: 25514 - DNA, 20 bp, Artificial Sequence
  Description of Artificial Sequence: Synthetic oligonucleotide
  Target: SCN10A; (-) strand; PAM type: NRG; PAM sequence: GAG
acatgattttcagtttcaaa

SEQ ID NO: 25515 - DNA, 20 bp, Artificial Sequence
  Description of Artificial Sequence: Synthetic oligonucleotide
  Target: SCN10A; (-) strand; PAM type: NRG; PAM sequence: AAG
atacatgattttcagtttca

SEQ ID NO: 25516 - DNA, 20 bp, Artificial Sequence
  Description of Artificial Sequence: Synthetic oligonucleotide
  Target: SCN10A; (-) strand; PAM type: NRG; PAM sequence: CAG
tcataaacatacatgatttt

SEQ ID NO: 25517 - DNA, 20 bp, Artificial Sequence
  Description of Artificial Sequence: Synthetic oligonucleotide
  Target: SCN10A; (-) strand; PAM type: NRG; PAM sequence: GAG
aaccaggtctctccttctgt

SEQ ID NO: 25518 - DNA, 20 bp, Artificial Sequence
  Description of Artificial Sequence: Synthetic oligonucleotide
  Target: SCN10A; (-) strand; PAM type: NRG; PAM sequence: AGG
tatatgtctttgtaataacc

SEQ ID NO: 25519 - DNA, 20 bp, Artificial Sequence
  Description of Artificial Sequence: Synthetic oligonucleotide
  Target: SCN10A; (-) strand; PAM type: NRG; PAM sequence: CAG
ctatatgtctttgtaataac

SEQ ID NO: 25520 - DNA, 20 bp, Artificial Sequence
  Description of Artificial Sequence: Synthetic oligonucleotide
  Target: SCN10A; (-) strand; PAM type: NRG; PAM sequence: GGG
tatcctgccatgcctcatgt

SEQ ID NO: 25521 - DNA, 20 bp, Artificial Sequence
  Description of Artificial Sequence: Synthetic oligonucleotide
  Target: SCN10A; (-) strand; PAM type: NRG; PAM sequence: TGG
ttatcctgccatgcctcatg

SEQ ID NO: 25522 - DNA, 20 bp, Artificial Sequence
  Description of Artificial Sequence: Synthetic oligonucleotide
  Target: SCN10A; (-) strand; PAM type: NRG; PAM sequence: CAG
tcttttcttccttcacttgg

SEQ ID NO: 25523 - DNA, 20 bp, Artificial Sequence
  Description of Artificial Sequence: Synthetic oligonucleotide
  Target: SCN10A; (-) strand; PAM type: NRG; PAM sequence: TGG
ctttcttttcttccttcact

SEQ ID NO: 25524 - DNA, 20 bp, Artificial Sequence
  Description of Artificial Sequence: Synthetic oligonucleotide
  Target: SCN10A; (-) strand; PAM type: NRG; PAM sequence: TAG
tccagagaaaattgagtgag

SEQ ID NO: 25525 - DNA, 20 bp, Artificial Sequence
  Description of Artificial Sequence: Synthetic oligonucleotide
  Target: SCN10A; (-) strand; PAM type: NRG; PAM sequence: GAG
ccttccagagaaaattgagt

SEQ ID NO: 25526 - DNA, 20 bp, Artificial Sequence
  Description of Artificial Sequence: Synthetic oligonucleotide
  Target: SCN10A; (-) strand; PAM type: NRG; PAM sequence: GAG
ctgaccttccagagaaaatt

SEQ ID NO: 25527 - DNA, 20 bp, Artificial Sequence
  Description of Artificial Sequence: Synthetic oligonucleotide
  Target: SCN10A; (-) strand; PAM type: NRG; PAM sequence: GAG
tgacccgaactgaccttcca

SEQ ID NO: 25528 - DNA, 20 bp, Artificial Sequence
  Description of Artificial Sequence: Synthetic oligonucleotide
  Target: SCN10A; (-) strand; PAM type: NRG; PAM sequence: CAG
catgacccgaactgaccttc

SEQ ID NO: 25529 - DNA, 20 bp, Artificial Sequence
  Description of Artificial Sequence: Synthetic oligonucleotide
  Target: SCN10A; (-) strand; PAM type: NRG; PAM sequence: TGG
atttattacggtcactattt

SEQ ID NO: 25530 - DNA, 20 bp, Artificial Sequence
  Description of Artificial Sequence: Synthetic oligonucleotide
  Target: SCN10A; (-) strand; PAM type: NRG; PAM sequence: CGG
gtggttcagtttatttatta

SEQ ID NO: 25531 - DNA, 20 bp, Artificial Sequence
  Description of Artificial Sequence: Synthetic oligonucleotide
  Target: SCN10A; (-) strand; PAM type: NRG; PAM sequence: CAG
cacaggcctttcaggtggtt

SEQ ID NO: 25532 - DNA, 20 bp, Artificial Sequence
  Description of Artificial Sequence: Synthetic oligonucleotide
  Target: SCN10A; (-) strand; PAM type: NRG; PAM sequence: TGG
cttaacacaggcctttcagg

SEQ ID NO: 25533 - DNA, 20 bp, Artificial Sequence
  Description of Artificial Sequence: Synthetic oligonucleotide
  Target: SCN10A; (-) strand; PAM type: NRG; PAM sequence: AGG
ttccttaacacaggcctttc

SEQ ID NO: 25534 - DNA, 20 bp, Artificial Sequence
  Description of Artificial Sequence: Synthetic oligonucleotide
  Target: SCN10A; (-) strand; PAM type: NRG; PAM sequence: CAG
tttccttaacacaggccttt

SEQ ID NO: 25535 - DNA, 20 bp, Artificial Sequence
  Description of Artificial Sequence: Synthetic oligonucleotide
  Target: SCN10A; (-) strand; PAM type: NRG; PAM sequence: AGG
tctcagcttttccttaacac

SEQ ID NO: 25536 - DNA, 20 bp, Artificial Sequence
  Description of Artificial Sequence: Synthetic oligonucleotide
  Target: SCN10A; (-) strand; PAM type: NRG; PAM sequence: CAG
atctcagcttttccttaaca

SEQ ID NO: 25537 - DNA, 20 bp, Artificial Sequence
  Description of Artificial Sequence: Synthetic oligonucleotide
  Target: SCN10A; (-) strand; PAM type: NRG; PAM sequence: CAG
tcacagagacttggtgatct

SEQ ID NO: 25538 - DNA, 20 bp, Artificial Sequence
  Description of Artificial Sequence: Synthetic oligonucleotide
  Target: SCN10A; (-) strand; PAM type: NRG; PAM sequence: TGG
tagatgacatcacagagact

SEQ ID NO: 25539 - DNA, 20 bp, Artificial Sequence
  Description of Artificial Sequence: Synthetic oligonucleotide
  Target: SCN10A; (-) strand; PAM type: NRG; PAM sequence: GAG
tgatcctagatgacatcaca

SEQ ID NO: 25540 - DNA, 20 bp, Artificial Sequence
  Description of Artificial Sequence: Synthetic oligonucleotide
  Target: SCN10A; (-) strand; PAM type: NRG; PAM sequence: CAG
ggtgatcctagatgacatca

SEQ ID NO: 25541 - DNA, 20 bp, Artificial Sequence
  Description of Artificial Sequence: Synthetic oligonucleotide
  Target: SCN10A; (-) strand; PAM type: NRG; PAM sequence: TAG
attcagcatcaaggtgatcc

SEQ ID NO: 25542 - DNA, 20 bp, Artificial Sequence
  Description of Artificial Sequence: Synthetic oligonucleotide
  Target: SCN10A; (-) strand; PAM type: NRG; PAM sequence: AGG
aatgtaatcattcagcatca

SEQ ID NO: 25543 - DNA, 20 bp, Artificial Sequence
  Description of Artificial Sequence: Synthetic oligonucleotide
  Target: SCN10A; (-) strand; PAM type: NRG; PAM sequence: AAG
gaatgtaatcattcagcatc

SEQ ID NO: 25544 - DNA, 20 bp, Artificial Sequence
  Description of Artificial Sequence: Synthetic oligonucleotide
  Target: SCN10A; (-) strand; PAM type: NRG; PAM sequence: CAG
gatttatgaatgtaatcatt

SEQ ID NO: 25545 - DNA, 20 bp, Artificial Sequence
  Description of Artificial Sequence: Synthetic oligonucleotide
  Target: SCN10A; (-) strand; PAM type: NRG; PAM sequence: AAG
tcataaagctaatattggct

SEQ ID NO: 25546 - DNA, 20 bp, Artificial Sequence
  Description of Artificial Sequence: Synthetic oligonucleotide
  Target: SCN10A; (-) strand; PAM type: NRG; PAM sequence: TGG
caagatcataaagctaatat

SEQ ID NO: 25547 - DNA, 20 bp, Artificial Sequence
  Description of Artificial Sequence: Synthetic oligonucleotide
  Target: SCN10A; (-) strand; PAM type: NRG; PAM sequence: AAG
tattatgtgacaagatcata

SEQ ID NO: 25548 - DNA, 20 bp, Artificial Sequence
  Description of Artificial Sequence: Synthetic oligonucleotide
  Target: SCN10A; (-) strand; PAM type: NRG; PAM sequence: AAG
gttagtggttattatgtgac

SEQ ID NO: 25549 - DNA, 20 bp, Artificial Sequence
  Description of Artificial Sequence: Synthetic oligonucleotide
  Target: SCN10A; (-) strand; PAM type: NRG; PAM sequence: TGG
aggcactcagtaaatgttag

SEQ ID NO: 25550 - DNA, 20 bp, Artificial Sequence
  Description of Artificial Sequence: Synthetic oligonucleotide
  Target: SCN10A; (-) strand; PAM type: NRG; PAM sequence: TAG
cttaggcactcagtaaatgt

SEQ ID NO: 25551 - DNA, 20 bp, Artificial Sequence
  Description of Artificial Sequence: Synthetic oligonucleotide
  Target: SCN10A; (-) strand; PAM type: NRG; PAM sequence: CAG
ctcagcctagcttaggcact

SEQ ID NO: 25552 - DNA, 20 bp, Artificial Sequence
  Description of Artificial Sequence: Synthetic oligonucleotide
  Target: SCN10A; (-) strand; PAM type: NRG; PAM sequence: AGG
caaagtactcagcctagctt

SEQ ID NO: 25553 - DNA, 20 bp, Artificial Sequence
  Description of Artificial Sequence: Synthetic oligonucleotide
  Target: SCN10A; (-) strand; PAM type: NRG; PAM sequence: TAG
acaaagtactcagcctagct

SEQ ID NO: 25554 - DNA, 20 bp, Artificial Sequence
  Description of Artificial Sequence: Synthetic oligonucleotide
  Target: SCN10A; (-) strand; PAM type: NRG; PAM sequence: TAG
catggacaaagtactcagcc

SEQ ID NO: 25555 - DNA, 20 bp, Artificial Sequence
  Description of Artificial Sequence: Synthetic oligonucleotide
  Target: SCN10A; (-) strand; PAM type: NRG; PAM sequence: CAG
agtaacatggacaaagtact

SEQ ID NO: 25556 - DNA, 20 bp, Artificial Sequence
  Description of Artificial Sequence: Synthetic oligonucleotide
  Target: SCN10A; (-) strand; PAM type: NRG; PAM sequence: AAG
tattagaagtaacatggaca

SEQ ID NO: 25557 - DNA, 20 bp, Artificial Sequence
  Description of Artificial Sequence: Synthetic oligonucleotide
  Target: SCN10A; (-) strand; PAM type: NRG; PAM sequence: TGG
cagttgtattagaagtaaca

SEQ ID NO: 25558 - DNA, 20 bp, Artificial Sequence
  Description of Artificial Sequence: Synthetic oligonucleotide
  Target: SCN10A; (-) strand; PAM type: NRG; PAM sequence: AAG
ctgtagatcagttgtattag

SEQ ID NO: 25559 - DNA, 20 bp, Artificial Sequence
  Description of Artificial Sequence: Synthetic oligonucleotide
  Target: SCN10A; (-) strand; PAM type: NRG; PAM sequence: TAG
cacctgtagatcagttgtat

SEQ ID NO: 25560 - DNA, 20 bp, Artificial Sequence
  Description of Artificial Sequence: Synthetic oligonucleotide
  Target: SCN10A; (-) strand; PAM type: NRG; PAM sequence: CAG
atttatacccacctgtagat

SEQ ID NO: 25561 - DNA, 20 bp, Artificial Sequence
  Description of Artificial Sequence: Synthetic oligonucleotide
  Target: SCN10A; (-) strand; PAM type: NRG; PAM sequence: TAG
tagatatttatacccacctg

SEQ ID NO: 25562 - DNA, 20 bp, Artificial Sequence
  Description of Artificial Sequence: Synthetic oligonucleotide
  Target: SCN10A; (-) strand; PAM type: NRG; PAM sequence: TAG
tgtttctcagcttcaaaatg

SEQ ID NO: 25563 - DNA, 20 bp, Artificial Sequence
  Description of Artificial Sequence: Synthetic oligonucleotide
  Target: SCN10A; (-) strand; PAM type: NRG; PAM sequence: CAG
ttttttgtcagcctgtttct

SEQ ID NO: 25564 - DNA, 20 bp, Artificial Sequence
  Description of Artificial Sequence: Synthetic oligonucleotide
  Target: SCN10A; (-) strand; PAM type: NRG; PAM sequence: CAG
atttaacttttattttttgt

SEQ ID NO: 25565 - DNA, 20 bp, Artificial Sequence
  Description of Artificial Sequence: Synthetic oligonucleotide
  Target: SCN10A; (-) strand; PAM type: NRG; PAM sequence: AAG
ctagctgcatgacctgagaa

SEQ ID NO: 25566 - DNA, 20 bp, Artificial Sequence
  Description of Artificial Sequence: Synthetic oligonucleotide
  Target: SCN10A; (-) strand; PAM type: NRG; PAM sequence: GAG
gttgactagctgcatgacct

SEQ ID NO: 25567 - DNA, 20 bp, Artificial Sequence
  Description of Artificial Sequence: Synthetic oligonucleotide
  Target: SCN10A; (-) strand; PAM type: NRG; PAM sequence: TAG
atctctgcagcatggttgac

SEQ ID NO: 25568 - DNA, 20 bp, Artificial Sequence
  Description of Artificial Sequence: Synthetic oligonucleotide
  Target: SCN10A; (-) strand; PAM type: NRG; PAM sequence: TGG
gagttcacatctctgcagca

SEQ ID NO: 25569 - DNA, 20 bp, Artificial Sequence
  Description of Artificial Sequence: Synthetic oligonucleotide
  Target: SCN10A; (-) strand; PAM type: NRG; PAM sequence: CAG
gataagagttcacatctctg

SEQ ID NO: 25570 - DNA, 20 bp, Artificial Sequence
  Description of Artificial Sequence: Synthetic oligonucleotide
  Target: SCN10A; (-) strand; PAM type: NRG; PAM sequence: GAG
gtttgttatcaaacagataa

SEQ ID NO: 25571 - DNA, 20 bp, Artificial Sequence
  Description of Artificial Sequence: Synthetic oligonucleotide
  Target: SCN10A; (-) strand; PAM type: NRG; PAM sequence: AAG
gagtttgttatcaaacagat

SEQ ID NO: 25572 - DNA, 20 bp, Artificial Sequence
  Description of Artificial Sequence: Synthetic oligonucleotide
  Target: SCN10A; (-) strand; PAM type: NRG; PAM sequence: CAG
gctcagagtttgttatcaaa

SEQ ID NO: 25573 - DNA, 20 bp, Artificial Sequence
  Description of Artificial Sequence: Synthetic oligonucleotide
  Target: SCN10A; (-) strand; PAM type: NRG; PAM sequence: GAG
gtttccttctatcttgctca

SEQ ID NO: 25574 - DNA, 20 bp, Artificial Sequence
  Description of Artificial Sequence: Synthetic oligonucleotide
  Target: SCN10A; (-) strand; PAM type: NRG; PAM sequence: CAG
ctgtttccttctatcttgct

SEQ ID NO: 25575 - DNA, 20 bp, Artificial Sequence
  Description of Artificial Sequence: Synthetic oligonucleotide
  Target: SCN10A; (-) strand; PAM type: NRG; PAM sequence: GAG
gaaggacattttggaaaagg

SEQ ID NO: 25576 - DNA, 20 bp, Artificial Sequence
  Description of Artificial Sequence: Synthetic oligonucleotide
  Target: SCN10A; (-) strand; PAM type: NRG; PAM sequence: GGG
cagaaggacattttggaaaa

SEQ ID NO: 25577 - DNA, 20 bp, Artificial Sequence
  Description of Artificial Sequence: Synthetic oligonucleotide
  Target: SCN10A; (-) strand; PAM type: NRG; PAM sequence: AGG
gcagaaggacattttggaaa

SEQ ID NO: 25578 - DNA, 20 bp, Artificial Sequence
  Description of Artificial Sequence: Synthetic oligonucleotide
  Target: SCN10A; (-) strand; PAM type: NRG; PAM sequence: AAG
ggcagaaggacattttggaa

SEQ ID NO: 25579 - DNA, 20 bp, Artificial Sequence
  Description of Artificial Sequence: Synthetic oligonucleotide
  Target: SCN10A; (-) strand; PAM type: NRG; PAM sequence: TGG
ttcggggcagaaggacattt

SEQ ID NO: 25580 - DNA, 20 bp, Artificial Sequence
  Description of Artificial Sequence: Synthetic oligonucleotide
  Target: SCN10A; (-) strand; PAM type: NRG; PAM sequence: AGG
aatgaaggcttcggggcaga

SEQ ID NO: 25581 - DNA, 20 bp, Artificial Sequence
  Description of Artificial Sequence: Synthetic oligonucleotide
  Target: SCN10A; (-) strand; PAM type: NRG; PAM sequence: AAG
aaatgaaggcttcggggcag

SEQ ID NO: 25582 - DNA, 20 bp, Artificial Sequence
  Description of Artificial Sequence: Synthetic oligonucleotide
  Target: SCN10A; (-) strand; PAM type: NRG; PAM sequence: CAG
ctgaaatgaaggcttcgggg

SEQ ID NO: 25583 - DNA, 20 bp, Artificial Sequence
  Description of Artificial Sequence: Synthetic oligonucleotide
  Target: SCN10A; (-) strand; PAM type: NRG; PAM sequence: GGG
atactgaaatgaaggcttcg

SEQ ID NO: 25584 - DNA, 20 bp, Artificial Sequence
  Description of Artificial Sequence: Synthetic oligonucleotide
  Target: SCN10A; (-) strand; PAM type: NRG; PAM sequence: GGG
tatactgaaatgaaggcttc

SEQ ID NO: 25585 - DNA, 20 bp, Artificial Sequence
  Description of Artificial Sequence: Synthetic oligonucleotide
  Target: SCN10A; (-) strand; PAM type: NRG; PAM sequence: CGG
gtatactgaaatgaaggctt

SEQ ID NO: 25586 - DNA, 20 bp, Artificial Sequence
  Description of Artificial Sequence: Synthetic oligonucleotide
  Target: SCN10A; (-) strand; PAM type: NRG; PAM sequence: AGG
cattttgtatactgaaatga

SEQ ID NO: 25587 - DNA, 20 bp, Artificial Sequence
  Description of Artificial Sequence: Synthetic oligonucleotide
  Target: SCN10A; (-) strand; PAM type: NRG; PAM sequence: AAG
ccattttgtatactgaaatg

SEQ ID NO: 25588 - DNA, 20 bp, Artificial Sequence
  Description of Artificial Sequence: Synthetic oligonucleotide
  Target: SCN10A; (-) strand; PAM type: NRG; PAM sequence: AGG
catttgccagatgaaatttc

SEQ ID NO: 25589 - DNA, 20 bp, Artificial Sequence
  Description of Artificial Sequence: Synthetic oligonucleotide
  Target: SCN10A; (-) strand; PAM type: NRG; PAM sequence: CAG
acatttgccagatgaaattt

SEQ ID NO: 25590 - DNA, 20 bp, Artificial Sequence
  Description of Artificial Sequence: Synthetic oligonucleotide
  Target: SCN10A; (-) strand; PAM type: NRG; PAM sequence: CAG
agaataaaaaagacatttgc

SEQ ID NO: 25591 - DNA, 20 bp, Artificial Sequence
  Description of Artificial Sequence: Synthetic oligonucleotide
  Target: SCN10A; (-) strand; PAM type: NRG; PAM sequence: AAG
ctttgtcttttagaataaaa

SEQ ID NO: 25592 - DNA, 20 bp, Artificial Sequence
  Description of Artificial Sequence: Synthetic oligonucleotide
  Target: SCN10A; (-) strand; PAM type: NRG; PAM sequence: TAG
tctaacttttctttgtcttt

SEQ ID NO: 25593 - DNA, 20 bp, Artificial Sequence
  Description of Artificial Sequence: Synthetic oligonucleotide
  Target: SCN10A; (-) strand; PAM type: NRG; PAM sequence: AAG
gtacctcttcacttatctcc

SEQ ID NO: 25594 - DNA, 20 bp, Artificial Sequence
  Description of Artificial Sequence: Synthetic oligonucleotide
  Target: SCN10A; (-) strand; PAM type: NRG; PAM sequence: AAG
gatgaaactaattcccatga

SEQ ID NO: 25595 - DNA, 20 bp, Artificial Sequence
  Description of Artificial Sequence: Synthetic oligonucleotide
  Target: SCN10A; (-) strand; PAM type: NRG; PAM sequence: AAG
cggtggaactgatctcaact

SEQ ID NO: 25596 - DNA, 20 bp, Artificial Sequence
  Description of Artificial Sequence: Synthetic oligonucleotide
  Target: SCN10A; (-) strand; PAM type: NRG; PAM sequence: TGG
ccagaagaccatttcctcgg

SEQ ID NO: 25597 - DNA, 20 bp, Artificial Sequence
  Description of Artificial Sequence: Synthetic oligonucleotide
  Target: SCN10A; (-) strand; PAM type: NRG; PAM sequence: CGG
tacccagaagaccatttcct

SEQ ID NO: 25598 - DNA, 20 bp, Artificial Sequence
  Description of Artificial Sequence: Synthetic oligonucleotide
  Target: SCN10A; (-) strand; PAM type: NRG; PAM sequence: AAG
cctccaccgttcctacccag

SEQ ID NO: 25599 - DNA, 20 bp, Artificial Sequence
  Description of Artificial Sequence: Synthetic oligonucleotide
  Target: SCN10A; (-) strand; PAM type: NRG; PAM sequence: CAG
ctgcctccaccgttcctacc

SEQ ID NO: 25600 - DNA, 20 bp, Artificial Sequence
  Description of Artificial Sequence: Synthetic oligonucleotide
  Target: SCN10A; (-) strand; PAM type: NRG; PAM sequence: CAG
ttggggttttcttcctgagc

SEQ ID NO: 25601 - DNA, 20 bp, Artificial Sequence
  Description of Artificial Sequence: Synthetic oligonucleotide
  Target: SCN10A; (-) strand; PAM type: NRG; PAM sequence: GAG
ctacttggggttttcttcct

SEQ ID NO: 25602 - DNA, 20 bp, Artificial Sequence
  Description of Artificial Sequence: Synthetic oligonucleotide
  Target: SCN10A; (-) strand; PAM type: NRG; PAM sequence: GGG
ctccagcctaatcctacttg

SEQ ID NO: 25603 - DNA, 20 bp, Artificial Sequence
  Description of Artificial Sequence: Synthetic oligonucleotide
  Target: SCN10A; (-) strand; PAM type: NRG; PAM sequence: GGG
actccagcctaatcctactt

SEQ ID NO: 25604 - DNA, 20 bp, Artificial Sequence
  Description of Artificial Sequence: Synthetic oligonucleotide
  Target: SCN10A; (-) strand; PAM type: NRG; PAM sequence: TGG
cactccagcctaatcctact

SEQ ID NO: 25605 - DNA, 20 bp, Artificial Sequence
  Description of Artificial Sequence: Synthetic oligonucleotide
  Target: SCN10A; (-) strand; PAM type: NRG; PAM sequence: CAG
ctattcagagttctccactc

SEQ ID NO: 25606 - DNA, 20 bp, Artificial Sequence
  Description of Artificial Sequence: Synthetic oligonucleotide
  Target: SCN10A; (-) strand; PAM type: NRG; PAM sequence: GAG
ttctccactctagctattca

SEQ ID NO: 25607 - DNA, 20 bp, Artificial Sequence
  Description of Artificial Sequence: Synthetic oligonucleotide
  Target: SCN10A; (-) strand; PAM type: NRG; PAM sequence: CAG
tattctccactctagctatt

SEQ ID NO: 25608 - DNA, 20 bp, Artificial Sequence
  Description of Artificial Sequence: Synthetic oligonucleotide
  Target: SCN10A; (-) strand; PAM type: NRG; PAM sequence: TAG
gctgtcaatattctccactc

SEQ ID NO: 25609 - DNA, 20 bp, Artificial Sequence
  Description of Artificial Sequence: Synthetic oligonucleotide
  Target: SCN10A; (-) strand; PAM type: NRG; PAM sequence: TAG
tttgataatccctttgccca

SEQ ID NO: 25610 - DNA, 20 bp, Artificial Sequence
  Description of Artificial Sequence: Synthetic oligonucleotide
  Target: SCN10A; (-) strand; PAM type: NRG; PAM sequence: TAG
aagtgggaacaatttacctt

SEQ ID NO: 25611 - DNA, 20 bp, Artificial Sequence
  Description of Artificial Sequence: Synthetic oligonucleotide
  Target: SCN10A; (-) strand; PAM type: NRG; PAM sequence: GGG
cctaagaaaaatgtccaagt

SEQ ID NO: 25612 - DNA, 20 bp, Artificial Sequence
  Description of Artificial Sequence: Synthetic oligonucleotide
  Target: SCN10A; (-) strand; PAM type: NRG; PAM sequence: TGG
tcctaagaaaaatgtccaag

SEQ ID NO: 25613 - DNA, 20 bp, Artificial Sequence
  Description of Artificial Sequence: Synthetic oligonucleotide
  Target: SCN10A; (-) strand; PAM type: NRG; PAM sequence: AAG
tattcctaagaaaaatgtcc

SEQ ID NO: 25614 - DNA, 20 bp, Artificial Sequence
  Description of Artificial Sequence: Synthetic oligonucleotide
  Target: SCN10A; (-) strand; PAM type: NRG; PAM sequence: AAG
ttgggagcccagctattcct

SEQ ID NO: 25615 - DNA, 20 bp, Artificial Sequence
  Description of Artificial Sequence: Synthetic oligonucleotide
  Target: SCN10A; (-) strand; PAM type: NRG; PAM sequence: CAG
aggaagcactgttgggagcc

SEQ ID NO: 25616 - DNA, 20 bp, Artificial Sequence
  Description of Artificial Sequence: Synthetic oligonucleotide
  Target: SCN10A; (-) strand; PAM type: NRG; PAM sequence: GAG
tccttaggaagcactgttgg

SEQ ID NO: 25617 - DNA, 20 bp, Artificial Sequence
  Description of Artificial Sequence: Synthetic oligonucleotide
  Target: SCN10A; (-) strand; PAM type: NRG; PAM sequence: GGG
tttccttaggaagcactgtt

SEQ ID NO: 25618 - DNA, 20 bp, Artificial Sequence
  Description of Artificial Sequence: Synthetic oligonucleotide
  Target: SCN10A; (-) strand; PAM type: NRG; PAM sequence: TGG
ttttccttaggaagcactgt

SEQ ID NO: 25619 - DNA, 20 bp, Artificial Sequence
  Description of Artificial Sequence: Synthetic oligonucleotide
  Target: SCN10A; (-) strand; PAM type: NRG; PAM sequence: AAG
aagttttatttttccttagg

SEQ ID NO: 25620 - DNA, 20 bp, Artificial Sequence
  Description of Artificial Sequence: Synthetic oligonucleotide
  Target: SCN10A; (-) strand; PAM type: NRG; PAM sequence: AGG
ttcaagttttatttttcctt

SEQ ID NO: 25621 - DNA, 20 bp, Artificial Sequence
  Description of Artificial Sequence: Synthetic oligonucleotide
  Target: SCN10A; (-) strand; PAM type: NRG; PAM sequence: TAG
cttcaagttttatttttcct

SEQ ID NO: 25622 - DNA, 20 bp, Artificial Sequence
  Description of Artificial Sequence: Synthetic oligonucleotide
  Target: SCN10A; (-) strand; PAM type: NRG; PAM sequence: AAG
tgtaggtcaagtttatcttc

SEQ ID NO: 25623 - DNA, 20 bp, Artificial Sequence
  Description of Artificial Sequence: Synthetic oligonucleotide
  Target: SCN10A; (-) strand; PAM type: NRG; PAM sequence: AAG
ttgtactctctctgtaggtc

SEQ ID NO: 25624 - DNA, 20 bp, Artificial Sequence
  Description of Artificial Sequence: Synthetic oligonucleotide
  Target: SCN10A; (-) strand; PAM type: NRG; PAM sequence: AGG
gagtgttgtactctctctgt

SEQ ID NO: 25625 - DNA, 20 bp, Artificial Sequence
  Description of Artificial Sequence: Synthetic oligonucleotide
  Target: SCN10A; (-) strand; PAM type: NRG; PAM sequence: TAG
tgagtgttgtactctctctg

SEQ ID NO: 25626 - DNA, 20 bp, Artificial Sequence
  Description of Artificial Sequence: Synthetic oligonucleotide
  Target: SCN10A; (-) strand; PAM type: NRG; PAM sequence: GAG
ttctgctcaaattgaaaaat

SEQ ID NO: 25627 - DNA, 20 bp, Artificial Sequence
  Description of Artificial Sequence: Synthetic oligonucleotide
  Target: SCN10A; (-) strand; PAM type: NRG; PAM sequence: CAG
tagacacatcaaggcattta

SEQ ID NO: 25628 - DNA, 20 bp, Artificial Sequence
  Description of Artificial Sequence: Synthetic oligonucleotide
  Target: SCN10A; (-) strand; PAM type: NRG; PAM sequence: AGG
ctgtaaaactagacacatca

SEQ ID NO: 25629 - DNA, 20 bp, Artificial Sequence
  Description of Artificial Sequence: Synthetic oligonucleotide
  Target: SCN10A; (-) strand; PAM type: NRG; PAM sequence: AAG
actgtaaaactagacacatc

SEQ ID NO: 25630 - DNA, 20 bp, Artificial Sequence
  Description of Artificial Sequence: Synthetic oligonucleotide
  Target: SCN10A; (-) strand; PAM type: NRG; PAM sequence: TAG
ttcctaagtaactgtaaaac

SEQ ID NO: 25631 - DNA, 20 bp, Artificial Sequence
  Description of Artificial Sequence: Synthetic oligonucleotide
  Target: SCN10A; (-) strand; PAM type: NRG; PAM sequence: AAG
ttcataatagatgtgttcct

SEQ ID NO: 25632 - DNA, 20 bp, Artificial Sequence
  Description of Artificial Sequence: Synthetic oligonucleotide
  Target: SCN10A; (-) strand; PAM type: NRG; PAM sequence: TAG
tagaattttccttttcataa

SEQ ID NO: 25633 - DNA, 20 bp, Artificial Sequence
  Description of Artificial Sequence: Synthetic oligonucleotide
  Target: SCN10A; (-) strand; PAM type: NRG; PAM sequence: TAG
ggaaaatgtggtttaattaa

SEQ ID NO: 25634 - DNA, 20 bp, Artificial Sequence
  Description of Artificial Sequence: Synthetic oligonucleotide
  Target: SCN10A; (-) strand; PAM type: NRG; PAM sequence: TGG
tgtaagtcagcaggaaaatg

SEQ ID NO: 25635 - DNA, 20 bp, Artificial Sequence
  Description of Artificial Sequence: Synthetic oligonucleotide
  Target: SCN10A; (-) strand; PAM type: NRG; PAM sequence: AGG
taatttaattgtaagtcagc

SEQ ID NO: 25636 - DNA, 20 bp, Artificial Sequence
  Description of Artificial Sequence: Synthetic oligonucleotide
  Target: SCN10A; (-) strand; PAM type: NRG; PAM sequence: CAG
ttaatttaattgtaagtcag

SEQ ID NO: 25637 - DNA, 20 bp, Artificial Sequence
  Description of Artificial Sequence: Synthetic oligonucleotide
  Target: SCN10A; (-) strand; PAM type: NRG; PAM sequence: CAG
ttcttaatttaattgtaagt

SEQ ID NO: 25638 - DNA, 20 bp, Artificial Sequence
  Description of Artificial Sequence: Synthetic oligonucleotide
  Target: SCN10A; (-) strand; PAM type: NRG; PAM sequence: AAG
atatttcttaatttaattgt

SEQ ID NO: 25639 - DNA, 20 bp, Artificial Sequence
  Description of Artificial Sequence: Synthetic oligonucleotide
  Target: SCN10A; (-) strand; PAM type: NRG; PAM sequence: GAG
attaacatttccccccatgt

SEQ ID NO: 25640 - DNA, 20 bp, Artificial Sequence
  Description of Artificial Sequence: Synthetic oligonucleotide
  Target: SCN10A; (-) strand; PAM type: NRG; PAM sequence: TGG
cacgattttagtttaatcct

SEQ ID NO: 25641 - DNA, 20 bp, Artificial Sequence
  Description of Artificial Sequence: Synthetic oligonucleotide
  Target: SCN10A; (-) strand; PAM type: NRG; PAM sequence: TAG
tagaattggagacacgattt

SEQ ID NO: 25642 - DNA, 20 bp, Artificial Sequence
  Description of Artificial Sequence: Synthetic oligonucleotide
  Target: SCN10A; (-) strand; PAM type: NRG; PAM sequence: GAG
tttaaatatttgtagaattg

SEQ ID NO: 25643 - DNA, 20 bp, Artificial Sequence
  Description of Artificial Sequence: Synthetic oligonucleotide
  Target: SCN10A; (-) strand; PAM type: NRG; PAM sequence: TGG
cttttaaatatttgtagaat

SEQ ID NO: 25644 - DNA, 20 bp, Artificial Sequence
  Description of Artificial Sequence: Synthetic oligonucleotide
  Target: SCN10A; (-) strand; PAM type: NRG; PAM sequence: TAG
atattacttttaaatatttg

SEQ ID NO: 25645 - DNA, 20 bp, Artificial Sequence
  Description of Artificial Sequence: Synthetic oligonucleotide
  Target: SCN10A; (-) strand; PAM type: NRG; PAM sequence: AAG
tcataactaatattatacat

SEQ ID NO: 25646 - DNA, 20 bp, Artificial Sequence
  Description of Artificial Sequence: Synthetic oligonucleotide
  Target: SCN10A; (-) strand; PAM type: NRG; PAM sequence: GGG
aaaagatactagaattctca

SEQ ID NO: 25647 - DNA, 20 bp, Artificial Sequence
  Description of Artificial Sequence: Synthetic oligonucleotide
  Target: SCN10A; (-) strand; PAM type: NRG; PAM sequence: AGG
caaaagatactagaattctc

SEQ ID NO: 25648 - DNA, 20 bp, Artificial Sequence
  Description of Artificial Sequence: Synthetic oligonucleotide
  Target: SCN10A; (-) strand; PAM type: NRG; PAM sequence: CAG
ccaaaagatactagaattct

SEQ ID NO: 25649 - DNA, 20 bp, Artificial Sequence
  Description of Artificial Sequence: Synthetic oligonucleotide
  Target: SCN10A; (-) strand; PAM type: NRG; PAM sequence: TAG
actccagccccaaaagatac

SEQ ID NO: 25650 - DNA, 20 bp, Artificial Sequence
  Description of Artificial Sequence: Synthetic oligonucleotide
  Target: SCN10A; (-) strand; PAM type: NRG; PAM sequence: AAG
tttggtaactccagccccaa

SEQ ID NO: 25651 - DNA, 20 bp, Artificial Sequence
  Description of Artificial Sequence: Synthetic oligonucleotide
  Target: SCN10A; (-) strand; PAM type: NRG; PAM sequence: CAG
tctcataaatttggtaactc

SEQ ID NO: 25652 - DNA, 20 bp, Artificial Sequence
  Description of Artificial Sequence: Synthetic oligonucleotide
  Target: SCN10A; (-) strand; PAM type: NRG; PAM sequence: TGG
gcatttaaatctcataaatt

SEQ ID NO: 25653 - DNA, 20 bp, Artificial Sequence
  Description of Artificial Sequence: Synthetic oligonucleotide
  Target: SCN10A; (-) strand; PAM type: NRG; PAM sequence: AAG
agggggtctcttcctcacaa

SEQ ID NO: 25654 - DNA, 20 bp, Artificial Sequence
  Description of Artificial Sequence: Synthetic oligonucleotide
  Target: SCN10A; (-) strand; PAM type: NRG; PAM sequence: GGG
ggacagaaaagctgttgagg

SEQ ID NO: 25655 - DNA, 20 bp, Artificial Sequence
  Description of Artificial Sequence: Synthetic oligonucleotide
  Target: SCN10A; (-) strand; PAM type: NRG; PAM sequence: GGG
tggacagaaaagctgttgag

SEQ ID NO: 25656 - DNA, 20 bp, Artificial Sequence
  Description of Artificial Sequence: Synthetic oligonucleotide
  Target: SCN10A; (-) strand; PAM type: NRG; PAM sequence: GGG
ctggacagaaaagctgttga

SEQ ID NO: 25657 - DNA, 20 bp, Artificial Sequence
  Description of Artificial Sequence: Synthetic oligonucleotide
  Target: SCN10A; (-) strand; PAM type: NRG; PAM sequence: AGG
gctggacagaaaagctgttg

SEQ ID NO: 25658 - DNA, 20 bp, Artificial Sequence
  Description of Artificial Sequence: Synthetic oligonucleotide
  Target: SCN10A; (-) strand; PAM type: NRG; PAM sequence: GAG
agctggacagaaaagctgtt

SEQ ID NO: 25659 - DNA, 20 bp, Artificial Sequence
  Description of Artificial Sequence: Synthetic oligonucleotide
  Target: SCN10A; (-) strand; PAM type: NRG; PAM sequence: AAG
agagtcacagctggacagaa

SEQ ID NO: 25660 - DNA, 20 bp, Artificial Sequence
  Description of Artificial Sequence: Synthetic oligonucleotide
  Target: SCN10A; (-) strand; PAM type: NRG; PAM sequence: CAG
ttggtagagtcacagctgga

SEQ ID NO: 25661 - DNA, 20 bp, Artificial Sequence
  Description of Artificial Sequence: Synthetic oligonucleotide
  Target: SCN10A; (-) strand; PAM type: NRG; PAM sequence: TGG
ttgcttggtagagtcacagc

SEQ ID NO: 25662 - DNA, 20 bp, Artificial Sequence
  Description of Artificial Sequence: Synthetic oligonucleotide
  Target: SCN10A; (-) strand; PAM type: NRG; PAM sequence: CAG
ataattgcttggtagagtca

SEQ ID NO: 25663 - DNA, 20 bp, Artificial Sequence
  Description of Artificial Sequence: Synthetic oligonucleotide
  Target: SCN10A; (-) strand; PAM type: NRG; PAM sequence: GAG
gagtaaataattgcttggta

SEQ ID NO: 25664 - DNA, 20 bp, Artificial Sequence
  Description of Artificial Sequence: Synthetic oligonucleotide
  Target: SCN10A; (-) strand; PAM type: NRG; PAM sequence: TAG
atgagtaaataattgcttgg

SEQ ID NO: 25665 - DNA, 20 bp, Artificial Sequence
  Description of Artificial Sequence: Synthetic oligonucleotide
  Target: SCN10A; (-) strand; PAM type: NRG; PAM sequence: TGG
ttgatgagtaaataattgct

SEQ ID NO: 25666 - DNA, 20 bp, Artificial Sequence
  Description of Artificial Sequence: Synthetic oligonucleotide
  Target: SCN10A; (-) strand; PAM type: NRG; PAM sequence: GAG
tcttcatcttgagatttgat

SEQ ID NO: 25667 - DNA, 20 bp, Artificial Sequence
  Description of Artificial Sequence: Synthetic oligonucleotide
  Target: SCN10A; (-) strand; PAM type: NRG; PAM sequence: GAG
gtgaatattctcttcatctt

SEQ ID NO: 25668 - DNA, 20 bp, Artificial Sequence
  Description of Artificial Sequence: Synthetic oligonucleotide
  Target: SCN10A; (-) strand; PAM type: NRG; PAM sequence: CAG
cctaaaaagaaccaagtgac

SEQ ID NO: 25669 - DNA, 20 bp, Artificial Sequence
  Description of Artificial Sequence: Synthetic oligonucleotide
  Target: SCN10A; (-) strand; PAM type: NRG; PAM sequence: AAG
aaaatcccctaaaaagaacc

SEQ ID NO: 25670 - DNA, 20 bp, Artificial Sequence
  Description of Artificial Sequence: Synthetic oligonucleotide
  Target: SCN10A; (-) strand; PAM type: NRG; PAM sequence: AAG
tagaaataaaatcccctaaa

SEQ ID NO: 25671 - DNA, 20 bp, Artificial Sequence
  Description of Artificial Sequence: Synthetic oligonucleotide
  Target: SCN10A; (-) strand; PAM type: NRG; PAM sequence: TAG
ataagtaagaaacagctaat

SEQ ID NO: 25672 - DNA, 20 bp, Artificial Sequence
  Description of Artificial Sequence: Synthetic oligonucleotide
  Target: SCN10A; (-) strand; PAM type: NRG; PAM sequence: CAG
acatctggataagtaagaaa

SEQ ID NO: 25673 - DNA, 20 bp, Artificial Sequence
  Description of Artificial Sequence: Synthetic oligonucleotide
  Target: SCN10A; (-) strand; PAM type: NRG; PAM sequence: AAG
tgaattacatctggataagt

SEQ ID NO: 25674 - DNA, 20 bp, Artificial Sequence
  Description of Artificial Sequence: Synthetic oligonucleotide
  Target: SCN10A; (-) strand; PAM type: NRG; PAM sequence: AAG
tggttgaattacatctggat

SEQ ID NO: 25675 - DNA, 20 bp, Artificial Sequence
  Description of Artificial Sequence: Synthetic oligonucleotide
  Target: SCN10A; (-) strand; PAM type: NRG; PAM sequence: TGG
gattctggttgaattacatc

SEQ ID NO: 25676 - DNA, 20 bp, Artificial Sequence
  Description of Artificial Sequence: Synthetic oligonucleotide
  Target: SCN10A; (-) strand; PAM type: NRG; PAM sequence: TGG
aaactcctctttatggattc

SEQ ID NO: 25677 - DNA, 20 bp, Artificial Sequence
  Description of Artificial Sequence: Synthetic oligonucleotide
  Target: SCN10A; (-) strand; PAM type: NRG; PAM sequence: TGG
aacatacaaactcctcttta

SEQ ID NO: 25678 - DNA, 20 bp, Artificial Sequence
  Description of Artificial Sequence: Synthetic oligonucleotide
  Target: SCN10A; (-) strand; PAM type: NRG; PAM sequence: GAG
acatggaaattacaaataaa

SEQ ID NO: 25679 - DNA, 20 bp, Artificial Sequence
  Description of Artificial Sequence: Synthetic oligonucleotide
  Target: SCN10A; (-) strand; PAM type: NRG; PAM sequence: AAG
ttacatggaaattacaaata

SEQ ID NO: 25680 - DNA, 20 bp, Artificial Sequence
  Description of Artificial Sequence: Synthetic oligonucleotide
  Target: SCN10A; (-) strand; PAM type: NRG; PAM sequence: TGG
tcaaaatatatacaattaca

SEQ ID NO: 25681 - DNA, 20 bp, Artificial Sequence
  Description of Artificial Sequence: Synthetic oligonucleotide
  Target: SCN10A; (-) strand; PAM type: NRG; PAM sequence: TAG
atgtgtcgtctctgcttggg

SEQ ID NO: 25682 - DNA, 20 bp, Artificial Sequence
  Description of Artificial Sequence: Synthetic oligonucleotide
  Target: SCN10A; (-) strand; PAM type: NRG; PAM sequence: GGG
tcaatgtgtcgtctctgctt

SEQ ID NO: 25683 - DNA, 20 bp, Artificial Sequence
  Description of Artificial Sequence: Synthetic oligonucleotide
  Target: SCN10A; (-) strand; PAM type: NRG; PAM sequence: TGG
ctcaatgtgtcgtctctgct

SEQ ID NO: 25684 - DNA, 20 bp, Artificial Sequence
  Description of Artificial Sequence: Synthetic oligonucleotide
  Target: SCN10A; (-) strand; PAM type: NRG; PAM sequence: GGG
agtagggtggaaagtaatca

SEQ ID NO: 25685 - DNA, 20 bp, Artificial Sequence
  Description of Artificial Sequence: Synthetic oligonucleotide
  Target: SCN10A; (-) strand; PAM type: NRG; PAM sequence: AGG
aagtagggtggaaagtaatc

SEQ ID NO: 25686 - DNA, 20 bp, Artificial Sequence
  Description of Artificial Sequence: Synthetic oligonucleotide
  Target: SCN10A; (-) strand; PAM type: NRG; PAM sequence: CAG
gaagtagggtggaaagtaat

SEQ ID NO: 25687 - DNA, 20 bp, Artificial Sequence
  Description of Artificial Sequence: Synthetic oligonucleotide
  Target: SCN10A; (-) strand; PAM type: NRG; PAM sequence: AAG
cagtgaggaagtagggtgga

SEQ ID NO: 25688 - DNA, 20 bp, Artificial Sequence
  Description of Artificial Sequence: Synthetic oligonucleotide
  Target: SCN10A; (-) strand; PAM type: NRG; PAM sequence: TGG
tctacagtgaggaagtaggg

SEQ ID NO: 25689 - DNA, 20 bp, Artificial Sequence
  Description of Artificial Sequence: Synthetic oligonucleotide
  Target: SCN10A; (-) strand; PAM type: NRG; PAM sequence: GGG
gtatctacagtgaggaagta

SEQ ID NO: 25690 - DNA, 20 bp, Artificial Sequence
  Description of Artificial Sequence: Synthetic oligonucleotide
  Target: SCN10A; (-) strand; PAM type: NRG; PAM sequence: AGG
agtatctacagtgaggaagt

SEQ ID NO: 25691 - DNA, 20 bp, Artificial Sequence
  Description of Artificial Sequence: Synthetic oligonucleotide
  Target: SCN10A; (-) strand; PAM type: NRG; PAM sequence: TAG
cagtatctacagtgaggaag

SEQ ID NO: 25692 - DNA, 20 bp, Artificial Sequence
  Description of Artificial Sequence: Synthetic oligonucleotide
  Target: SCN10A; (-) strand; PAM type: NRG; PAM sequence: AAG
gagcagtatctacagtgagg

SEQ ID NO: 25693 - DNA, 20 bp, Artificial Sequence
  Description of Artificial Sequence: Synthetic oligonucleotide
  Target: SCN10A; (-) strand; PAM type: NRG; PAM sequence: AGG
gtagagcagtatctacagtg

SEQ ID NO: 25694 - DNA, 20 bp, Artificial Sequence
  Description of Artificial Sequence: Synthetic oligonucleotide
  Target: SCN10A; (-) strand; PAM type: NRG; PAM sequence: GAG
cgtagagcagtatctacagt

SEQ ID NO: 25695 - DNA, 20 bp, Artificial Sequence
  Description of Artificial Sequence: Synthetic oligonucleotide
  Target: SCN10A; (-) strand; PAM type: NRG; PAM sequence: CAG
cctgcgtagagcagtatcta

SEQ ID NO: 25696 - DNA, 20 bp, Artificial Sequence
  Description of Artificial Sequence: Synthetic oligonucleotide
  Target: SCN10A; (-) strand; PAM type: NRG; PAM sequence: CAG
agcctgcatcctgcgtagag

SEQ ID NO: 25697 - DNA, 20 bp, Artificial Sequence
  Description of Artificial Sequence: Synthetic oligonucleotide
  Target: SCN10A; (-) strand; PAM type: NRG; PAM sequence: GAG
tccagcctgcatcctgcgta

SEQ ID NO: 25698 - DNA, 20 bp, Artificial Sequence
  Description of Artificial Sequence: Synthetic oligonucleotide
  Target: SCN10A; (-) strand; PAM type: NRG; PAM sequence: TAG
agtccagcctgcatcctgcg

SEQ ID NO: 25699 - DNA, 20 bp, Artificial Sequence
  Description of Artificial Sequence: Synthetic oligonucleotide
  Target: SCN10A; (-) strand; PAM type: NRG; PAM sequence: CAG
atgtagctagttaagaagtc

SEQ ID NO: 25700 - DNA, 20 bp, Artificial Sequence
  Description of Artificial Sequence: Synthetic oligonucleotide
  Target: SCN10A; (-) strand; PAM type: NRG; PAM sequence: AAG
agaccatgtagctagttaag

SEQ ID NO: 25701 - DNA, 20 bp, Artificial Sequence
  Description of Artificial Sequence: Synthetic oligonucleotide
  Target: SCN10A; (-) strand; PAM type: NRG; PAM sequence: AAG
ccaagaccatgtagctagtt

SEQ ID NO: 25702 - DNA, 20 bp, Artificial Sequence
  Description of Artificial Sequence: Synthetic oligonucleotide
  Target: SCN10A; (-) strand; PAM type: NRG; PAM sequence: TAG
attatccaagaccatgtagc

SEQ ID NO: 25703 - DNA, 20 bp, Artificial Sequence
  Description of Artificial Sequence: Synthetic oligonucleotide
  Target: SCN10A; (-) strand; PAM type: NRG; PAM sequence: TAG
gtaaattatccaagaccatg

SEQ ID NO: 25704 - DNA, 20 bp, Artificial Sequence
  Description of Artificial Sequence: Synthetic oligonucleotide
  Target: SCN10A; (-) strand; PAM type: NRG; PAM sequence: AAG
aggcattaagtaaattatcc

SEQ ID NO: 25705 - DNA, 20 bp, Artificial Sequence
  Description of Artificial Sequence: Synthetic oligonucleotide
  Target: SCN10A; (-) strand; PAM type: NRG; PAM sequence: AAG
aactgacacacagaggcatt

SEQ ID NO: 25706 - DNA, 20 bp, Artificial Sequence
  Description of Artificial Sequence: Synthetic oligonucleotide
  Target: SCN10A; (-) strand; PAM type: NRG; PAM sequence: AGG
ataatgaaactgacacacag

SEQ ID NO: 25707 - DNA, 20 bp, Artificial Sequence
  Description of Artificial Sequence: Synthetic oligonucleotide
  Target: SCN10A; (-) strand; PAM type: NRG; PAM sequence: GAG
gataatgaaactgacacaca

SEQ ID NO: 25708 - DNA, 20 bp, Artificial Sequence
  Description of Artificial Sequence: Synthetic oligonucleotide
  Target: SCN10A; (-) strand; PAM type: NRG; PAM sequence: CAG
cagataatgaaactgacaca

SEQ ID NO: 25709 - DNA, 20 bp, Artificial Sequence
  Description of Artificial Sequence: Synthetic oligonucleotide
  Target: SCN10A; (-) strand; PAM type: NRG; PAM sequence: CAG
agattaccatccccatttta

SEQ ID NO: 25710 - DNA, 20 bp, Artificial Sequence
  Description of Artificial Sequence: Synthetic oligonucleotide
  Target: SCN10A; (-) strand; PAM type: NRG; PAM sequence: GAG
gttcaaaagcctctgaagta

SEQ ID NO: 25711 - DNA, 20 bp, Artificial Sequence
  Description of Artificial Sequence: Synthetic oligonucleotide
  Target: SCN10A; (-) strand; PAM type: NRG; PAM sequence: TAG
cagttcaaaagcctctgaag

SEQ ID NO: 25712 - DNA, 20 bp, Artificial Sequence
  Description of Artificial Sequence: Synthetic oligonucleotide
  Target: SCN10A; (-) strand; PAM type: NRG; PAM sequence: AAG
catcagttcaaaagcctctg

SEQ ID NO: 25713 - DNA, 20 bp, Artificial Sequence
  Description of Artificial Sequence: Synthetic oligonucleotide
  Target: SCN10A; (-) strand; PAM type: NRG; PAM sequence: AAG
caataccatcatcagttcaa

SEQ ID NO: 25714 - DNA, 20 bp, Artificial Sequence
  Description of Artificial Sequence: Synthetic oligonucleotide
  Target: SCN10A; (-) strand; PAM type: NRG; PAM sequence: CAG
ctaagtgtcaataccatcat

SEQ ID NO: 25715 - DNA, 20 bp, Artificial Sequence
  Description of Artificial Sequence: Synthetic oligonucleotide
  Target: SCN10A; (-) strand; PAM type: NRG; PAM sequence: AAG
tcacttgctaaatacttcct

SEQ ID NO: 25716 - DNA, 20 bp, Artificial Sequence
  Description of Artificial Sequence: Synthetic oligonucleotide
  Target: SCN10A; (-) strand; PAM type: NRG; PAM sequence: CAG
aaggatatttaatgacaata

SEQ ID NO: 25717 - DNA, 20 bp, Artificial Sequence
  Description of Artificial Sequence: Synthetic oligonucleotide
  Target: SCN10A; (-) strand; PAM type: NRG; PAM sequence: AGG
gaattttcagattctacaga

SEQ ID NO: 25718 - DNA, 20 bp, Artificial Sequence
  Description of Artificial Sequence: Synthetic oligonucleotide
  Target: SCN10A; (-) strand; PAM type: NRG; PAM sequence: AAG
tgaattttcagattctacag

SEQ ID NO: 25719 - DNA, 20 bp, Artificial Sequence
  Description of Artificial Sequence: Synthetic oligonucleotide
  Target: SCN10A; (-) strand; PAM type: NRG; PAM sequence: CAG
tcttgaattttcagattcta

SEQ ID NO: 25720 - DNA, 20 bp, Artificial Sequence
  Description of Artificial Sequence: Synthetic oligonucleotide
  Target: SCN10A; (-) strand; PAM type: NRG; PAM sequence: CAG
tgagctgaatcttgaatttt

SEQ ID NO: 25721 - DNA, 20 bp, Artificial Sequence
  Description of Artificial Sequence: Synthetic oligonucleotide
  Target: SCN10A; (-) strand; PAM type: NRG; PAM sequence: GAG
cagcaagaattacgttttct

SEQ ID NO: 25722 - DNA, 20 bp, Artificial Sequence
  Description of Artificial Sequence: Synthetic oligonucleotide
  Target: SCN10A; (-) strand; PAM type: NRG; PAM sequence: AAG
tttctttctggctggccagc

SEQ ID NO: 25723 - DNA, 20 bp, Artificial Sequence
  Description of Artificial Sequence: Synthetic oligonucleotide
  Target: SCN10A; (-) strand; PAM type: NRG; PAM sequence: CAG
tttttttctttctggctggc

SEQ ID NO: 25724 - DNA, 20 bp, Artificial Sequence
  Description of Artificial Sequence: Synthetic oligonucleotide
  Target: SCN10A; (-) strand; PAM type: NRG; PAM sequence: TGG
tacatttttttctttctggc

SEQ ID NO: 25725 - DNA, 20 bp, Artificial Sequence
  Description of Artificial Sequence: Synthetic oligonucleotide
  Target: SCN10A; (-) strand; PAM type: NRG; PAM sequence: TGG
tttttacatttttttctttc

SEQ ID NO: 25726 - DNA, 20 bp, Artificial Sequence
  Description of Artificial Sequence: Synthetic oligonucleotide
  Target: SCN10A; (-) strand; PAM type: NRG; PAM sequence: AAG
tgaagctgcacagcttgatg

SEQ ID NO: 25727 - DNA, 20 bp, Artificial Sequence
  Description of Artificial Sequence: Synthetic oligonucleotide
  Target: SCN10A; (-) strand; PAM type: NRG; PAM sequence: CAG
acactcaacatgaagctgca

SEQ ID NO: 25728 - DNA, 20 bp, Artificial Sequence
  Description of Artificial Sequence: Synthetic oligonucleotide
  Target: SCN10A; (-) strand; PAM type: NRG; PAM sequence: AAG
ctatctgcacactcaacatg

SEQ ID NO: 25729 - DNA, 20 bp, Artificial Sequence
  Description of Artificial Sequence: Synthetic oligonucleotide
  Target: SCN10A; (-) strand; PAM type: NRG; PAM sequence: CAG
ttgagctggtaaccttggca

SEQ ID NO: 25730 - DNA, 20 bp, Artificial Sequence
  Description of Artificial Sequence: Synthetic oligonucleotide
  Target: SCN10A; (-) strand; PAM type: NRG; PAM sequence: TGG
tgtcattgagctggtaacct

SEQ ID NO: 25731 - DNA, 20 bp, Artificial Sequence
  Description of Artificial Sequence: Synthetic oligonucleotide
  Target: SCN10A; (-) strand; PAM type: NRG; PAM sequence: TGG
ctggacagttgtcattgagc

SEQ ID NO: 25732 - DNA, 20 bp, Artificial Sequence
  Description of Artificial Sequence: Synthetic oligonucleotide
  Target: SCN10A; (-) strand; PAM type: NRG; PAM sequence: GAG
atttctggacagttgtcatt

SEQ ID NO: 25733 - DNA, 20 bp, Artificial Sequence
  Description of Artificial Sequence: Synthetic oligonucleotide
  Target: SCN10A; (-) strand; PAM type: NRG; PAM sequence: CAG
cagattgttggatttctgga

SEQ ID NO: 25734 - DNA, 20 bp, Artificial Sequence
  Description of Artificial Sequence: Synthetic oligonucleotide
  Target: SCN10A; (-) strand; PAM type: NRG; PAM sequence: TGG
gaggcagattgttggatttc

SEQ ID NO: 25735 - DNA, 20 bp, Artificial Sequence
  Description of Artificial Sequence: Synthetic oligonucleotide
  Target: SCN10A; (-) strand; PAM type: NRG; PAM sequence: TGG
ctaactctgaggcagattgt

SEQ ID NO: 25736 - DNA, 20 bp, Artificial Sequence
  Description of Artificial Sequence: Synthetic oligonucleotide
  Target: SCN10A; (-) strand; PAM type: NRG; PAM sequence: CAG
cctgctccctaactctgagg

SEQ ID NO: 25737 - DNA, 20 bp, Artificial Sequence
  Description of Artificial Sequence: Synthetic oligonucleotide
  Target: SCN10A; (-) strand; PAM type: NRG; PAM sequence: AGG
taccctgctccctaactctg

SEQ ID NO: 25738 - DNA, 20 bp, Artificial Sequence
  Description of Artificial Sequence: Synthetic oligonucleotide
  Target: SCN10A; (-) strand; PAM type: NRG; PAM sequence: GAG
ctaccctgctccctaactct

SEQ ID NO: 25739 - DNA, 20 bp, Artificial Sequence
  Description of Artificial Sequence: Synthetic oligonucleotide
  Target: SCN10A; (-) strand; PAM type: NRG; PAM sequence: GAG
tagaaggcttcagtaaaaaa

SEQ ID NO: 25740 - DNA, 20 bp, Artificial Sequence
  Description of Artificial Sequence: Synthetic oligonucleotide
  Target: SCN10A; (-) strand; PAM type: NRG; PAM sequence: AAG
cttagaaggcttcagtaaaa

SEQ ID NO: 25741 - DNA, 20 bp, Artificial Sequence
  Description of Artificial Sequence: Synthetic oligonucleotide
  Target: SCN10A; (-) strand; PAM type: NRG; PAM sequence: CAG
agccttttcttagaaggctt

SEQ ID NO: 25742 - DNA, 20 bp, Artificial Sequence
  Description of Artificial Sequence: Synthetic oligonucleotide
  Target: SCN10A; (-) strand; PAM type: NRG; PAM sequence: AGG
gtaaccagccttttcttaga

SEQ ID NO: 25743 - DNA, 20 bp, Artificial Sequence
  Description of Artificial Sequence: Synthetic oligonucleotide
  Target: SCN10A; (-) strand; PAM type: NRG; PAM sequence: AAG
ggtaaccagccttttcttag

SEQ ID NO: 25744 - DNA, 20 bp, Artificial Sequence
  Description of Artificial Sequence: Synthetic oligonucleotide
  Target: SCN10A; (-) strand; PAM type: NRG; PAM sequence: TAG
aatggtaaccagccttttct

SEQ ID NO: 25745 - DNA, 20 bp, Artificial Sequence
  Description of Artificial Sequence: Synthetic oligonucleotide
  Target: SCN10A; (-) strand; PAM type: NRG; PAM sequence: CAG
gttgcctgacaaatggtaac

SEQ ID NO: 25746 - DNA, 20 bp, Artificial Sequence
  Description of Artificial Sequence: Synthetic oligonucleotide
  Target: SCN10A; (-) strand; PAM type: NRG; PAM sequence: TGG
tgcctcagttgcctgacaaa

SEQ ID NO: 25747 - DNA, 20 bp, Artificial Sequence
  Description of Artificial Sequence: Synthetic oligonucleotide
  Target: SCN10A; (-) strand; PAM type: NRG; PAM sequence: CAG
gtacaagaatacacctgcct

SEQ ID NO: 25748 - DNA, 20 bp, Artificial Sequence
  Description of Artificial Sequence: Synthetic oligonucleotide
  Target: SCN10A; (-) strand; PAM type: NRG; PAM sequence: AAG
cttgcaggaggttgatgtac

SEQ ID NO: 25749 - DNA, 20 bp, Artificial Sequence
  Description of Artificial Sequence: Synthetic oligonucleotide
  Target: SCN10A; (-) strand; PAM type: NRG; PAM sequence: AGG
atttagccctggcttgcagg

SEQ ID NO: 25750 - DNA, 20 bp, Artificial Sequence
  Description of Artificial Sequence: Synthetic oligonucleotide
  Target: SCN10A; (-) strand; PAM type: NRG; PAM sequence: GAG
aatttagccctggcttgcag

SEQ ID NO: 25751 - DNA, 20 bp, Artificial Sequence
  Description of Artificial Sequence: Synthetic oligonucleotide
  Target: SCN10A; (-) strand; PAM type: NRG; PAM sequence: AGG
caaatttagccctggcttgc

SEQ ID NO: 25752 - DNA, 20 bp, Artificial Sequence
  Description of Artificial Sequence: Synthetic oligonucleotide
  Target: SCN10A; (-) strand; PAM type: NRG; PAM sequence: CAG
acaaatttagccctggcttg

SEQ ID NO: 25753 - DNA, 20 bp, Artificial Sequence
  Description of Artificial Sequence: Synthetic oligonucleotide
  Target: SCN10A; (-) strand; PAM type: NRG; PAM sequence: TGG
ctttatgacaaatttagccc

SEQ ID NO: 25754 - DNA, 20 bp, Artificial Sequence
  Description of Artificial Sequence: Synthetic oligonucleotide
  Target: SCN10A; (-) strand; PAM type: NRG; PAM sequence: TAG
gaagttctttatgacaaatt

SEQ ID NO: 25755 - DNA, 20 bp, Artificial Sequence
  Description of Artificial Sequence: Synthetic oligonucleotide
  Target: SCN10A; (-) strand; PAM type: NRG; PAM sequence: AAG
ttggtcatcggaaggattgg

SEQ ID NO: 25756 - DNA, 20 bp, Artificial Sequence
  Description of Artificial Sequence: Synthetic oligonucleotide
  Target: SCN10A; (-) strand; PAM type: NRG; PAM sequence: TGG
tccttggtcatcggaaggat

SEQ ID NO: 25757 - DNA, 20 bp, Artificial Sequence
  Description of Artificial Sequence: Synthetic oligonucleotide
  Target: SCN10A; (-) strand; PAM type: NRG; PAM sequence: AGG
taagatccttggtcatcgga

SEQ ID NO: 25758 - DNA, 20 bp, Artificial Sequence
  Description of Artificial Sequence: Synthetic oligonucleotide
  Target: SCN10A; (-) strand; PAM type: NRG; PAM sequence: AAG
ctaagatccttggtcatcgg

SEQ ID NO: 25759 - DNA, 20 bp, Artificial Sequence
  Description of Artificial Sequence: Synthetic oligonucleotide
  Target: SCN10A; (-) strand; PAM type: NRG; PAM sequence: CGG
gacctaagatccttggtcat

SEQ ID NO: 25760 - DNA, 20 bp, Artificial Sequence
  Description of Artificial Sequence: Synthetic oligonucleotide
  Target: SCN10A; (-) strand; PAM type: NRG; PAM sequence: TGG
tcctaatgacctaagatcct

SEQ ID NO: 25761 - DNA, 20 bp, Artificial Sequence
  Description of Artificial Sequence: Synthetic oligonucleotide
  Target: SCN10A; (-) strand; PAM type: NRG; PAM sequence: AAG
tggaaagatcctaatgacct

SEQ ID NO: 25762 - DNA, 20 bp, Artificial Sequence
  Description of Artificial Sequence: Synthetic oligonucleotide
  Target: SCN10A; (-) strand; PAM type: NRG; PAM sequence: AAG
tcctgggtgatcctaatgga

SEQ ID NO: 25763 - DNA, 20 bp, Artificial Sequence
  Description of Artificial Sequence: Synthetic oligonucleotide
  Target: SCN10A; (-) strand; PAM type: NRG; PAM sequence: TGG
atcttcctgggtgatcctaa

SEQ ID NO: 25764 - DNA, 20 bp, Artificial Sequence
  Description of Artificial Sequence: Synthetic oligonucleotide
  Target: SCN10A; (-) strand; PAM type: NRG; PAM sequence: GGG
tggtttcctaagatcttcct

SEQ ID NO: 25765 - DNA, 20 bp, Artificial Sequence
  Description of Artificial Sequence: Synthetic oligonucleotide
  Target: SCN10A; (-) strand; PAM type: NRG; PAM sequence: TGG
ttggtttcctaagatcttcc

SEQ ID NO: 25766 - DNA, 20 bp, Artificial Sequence
  Description of Artificial Sequence: Synthetic oligonucleotide
  Target: SCN10A; (-) strand; PAM type: NRG; PAM sequence: AAG
atactttggtttggtttcct

SEQ ID NO: 25767 - DNA, 20 bp, Artificial Sequence
  Description of Artificial Sequence: Synthetic oligonucleotide
  Target: SCN10A; (-) strand; PAM type: NRG; PAM sequence: TGG
agaaaaaagatactttggtt

SEQ ID NO: 25768 - DNA, 20 bp, Artificial Sequence
  Description of Artificial Sequence: Synthetic oligonucleotide
  Target: SCN10A; (-) strand; PAM type: NRG; PAM sequence: TGG
ctagtagaaaaaagatactt

SEQ ID NO: 25769 - DNA, 20 bp, Artificial Sequence
  Description of Artificial Sequence: Synthetic oligonucleotide
  Target: SCN10A; (-) strand; PAM type: NRG; PAM sequence: AAG
caagccaaactagtagaaaa

SEQ ID NO: 25770 - DNA, 20 bp, Artificial Sequence
  Description of Artificial Sequence: Synthetic oligonucleotide
  Target: SCN10A; (-) strand; PAM type: NRG; PAM sequence: TAG
tgcaaggcaagccaaactag

SEQ ID NO: 25771 - DNA, 20 bp, Artificial Sequence
  Description of Artificial Sequence: Synthetic oligonucleotide
  Target: SCN10A; (-) strand; PAM type: NRG; PAM sequence: TAG
ttttgcaaggcaagccaaac

SEQ ID NO: 25772 - DNA, 20 bp, Artificial Sequence
  Description of Artificial Sequence: Synthetic oligonucleotide
  Target: SCN10A; (-) strand; PAM type: NRG; PAM sequence: AAG
ttcaggggattttgcaaggc

SEQ ID NO: 25773 - DNA, 20 bp, Artificial Sequence
  Description of Artificial Sequence: Synthetic oligonucleotide
  Target: SCN10A; (-) strand; PAM type: NRG; PAM sequence: AGG
tgctttcaggggattttgca

SEQ ID NO: 25774 - DNA, 20 bp, Artificial Sequence
  Description of Artificial Sequence: Synthetic oligonucleotide
  Target: SCN10A; (-) strand; PAM type: NRG; PAM sequence: AAG
ctgctttcaggggattttgc

SEQ ID NO: 25775 - DNA, 20 bp, Artificial Sequence
  Description of Artificial Sequence: Synthetic oligonucleotide
  Target: SCN10A; (-) strand; PAM type: NRG; PAM sequence: GGG
atgtcagaagctgctttcag

SEQ ID NO: 25776 - DNA, 20 bp, Artificial Sequence
  Description of Artificial Sequence: Synthetic oligonucleotide
  Target: SCN10A; (-) strand; PAM type: NRG; PAM sequence: GGG
aatgtcagaagctgctttca

SEQ ID NO: 25777 - DNA, 20 bp, Artificial Sequence
  Description of Artificial Sequence: Synthetic oligonucleotide
  Target: SCN10A; (-) strand; PAM type: NRG; PAM sequence: AGG
taatgtcagaagctgctttc

SEQ ID NO: 25778 - DNA, 20 bp, Artificial Sequence
  Description of Artificial Sequence: Synthetic oligonucleotide
  Target: SCN10A; (-) strand; PAM type: NRG; PAM sequence: CAG
gtaatgtcagaagctgcttt

SEQ ID NO: 25779 - DNA, 20 bp, Artificial Sequence
  Description of Artificial Sequence: Synthetic oligonucleotide
  Target: SCN10A; (-) strand; PAM type: NRG; PAM sequence: AAG
attgttttaggtaatgtcag

SEQ ID NO: 25780 - DNA, 20 bp, Artificial Sequence
  Description of Artificial Sequence: Synthetic oligonucleotide
  Target: SCN10A; (-) strand; PAM type: NRG; PAM sequence: CAG
tgaattgttttaggtaatgt

SEQ ID NO: 25781 - DNA, 20 bp, Artificial Sequence
  Description of Artificial Sequence: Synthetic oligonucleotide
  Target: SCN10A; (-) strand; PAM type: NRG; PAM sequence: AGG
tctactatatgaattgtttt

SEQ ID NO: 25782 - DNA, 20 bp, Artificial Sequence
  Description of Artificial Sequence: Synthetic oligonucleotide
  Target: SCN10A; (-) strand; PAM type: NRG; PAM sequence: TAG
gtctactatatgaattgttt

SEQ ID NO: 25783 - DNA, 20 bp, Artificial Sequence
  Description of Artificial Sequence: Synthetic oligonucleotide
  Target: SCN10A; (-) strand; PAM type: NRG; PAM sequence: TGG
tgtaatgattagagacacat

SEQ ID NO: 25784 - DNA, 20 bp, Artificial Sequence
  Description of Artificial Sequence: Synthetic oligonucleotide
  Target: SCN10A; (-) strand; PAM type: NRG; PAM sequence: GAG
atacaagactgtaatgatta

SEQ ID NO: 25785 - DNA, 20 bp, Artificial Sequence
  Description of Artificial Sequence: Synthetic oligonucleotide
  Target: SCN10A; (-) strand; PAM type: NRG; PAM sequence: TAG
ccatacaagactgtaatgat

SEQ ID NO: 25786 - DNA, 20 bp, Artificial Sequence
  Description of Artificial Sequence: Synthetic oligonucleotide
  Target: SCN10A; (-) strand; PAM type: NRG; PAM sequence: AAG
atctgatgttcatgccatac

SEQ ID NO: 25787 - DNA, 20 bp, Artificial Sequence
  Description of Artificial Sequence: Synthetic oligonucleotide
  Target: SCN10A; (-) strand; PAM type: NRG; PAM sequence: AGG
attactcaaaaactactagc

SEQ ID NO: 25788 - DNA, 20 bp, Artificial Sequence
  Description of Artificial Sequence: Synthetic oligonucleotide
  Target: SCN10A; (-) strand; PAM type: NRG; PAM sequence: CAG
aattactcaaaaactactag

SEQ ID NO: 25789 - DNA, 20 bp, Artificial Sequence
  Description of Artificial Sequence: Synthetic oligonucleotide
  Target: SCN10A; (-) strand; PAM type: NRG; PAM sequence: TAG
acaaattactcaaaaactac

SEQ ID NO: 25790 - DNA, 20 bp, Artificial Sequence
  Description of Artificial Sequence: Synthetic oligonucleotide
  Target: SCN10A; (-) strand; PAM type: NRG; PAM sequence: GGG
atgggacctcattggtcatg

SEQ ID NO: 25791 - DNA, 20 bp, Artificial Sequence
  Description of Artificial Sequence: Synthetic oligonucleotide
  Target: SCN10A; (-) strand; PAM type: NRG; PAM sequence: GGG
aatgggacctcattggtcat

SEQ ID NO: 25792 - DNA, 20 bp, Artificial Sequence
  Description of Artificial Sequence: Synthetic oligonucleotide
  Target: SCN10A; (-) strand; PAM type: NRG; PAM sequence: TGG
caatgggacctcattggtca

SEQ ID NO: 25793 - DNA, 20 bp, Artificial Sequence
  Description of Artificial Sequence: Synthetic oligonucleotide
  Target: SCN10A; (-) strand; PAM type: NRG; PAM sequence: TGG
tagtctcaatgggacctcat

SEQ ID NO: 25794 - DNA, 20 bp, Artificial Sequence
  Description of Artificial Sequence: Synthetic oligonucleotide
  Target: SCN10A; (-) strand; PAM type: NRG; PAM sequence: GGG
agagcacacatagtctcaat

SEQ ID NO: 25795 - DNA, 20 bp, Artificial Sequence
  Description of Artificial Sequence: Synthetic oligonucleotide
  Target: SCN10A; (-) strand; PAM type: NRG; PAM sequence: TGG
aagagcacacatagtctcaa

SEQ ID NO: 25796 - DNA, 20 bp, Artificial Sequence
  Description of Artificial Sequence: Synthetic oligonucleotide
  Target: SCN10A; (-) strand; PAM type: NRG; PAM sequence: TAG
catgatgggaagagcacaca

SEQ ID NO: 25797 - DNA, 20 bp, Artificial Sequence
  Description of Artificial Sequence: Synthetic oligonucleotide
  Target: SCN10A; (-) strand; PAM type: NRG; PAM sequence: GAG
aaaacagaccatgatgggaa

SEQ ID NO: 25798 - DNA, 20 bp, Artificial Sequence
  Description of Artificial Sequence: Synthetic oligonucleotide
  Target: SCN10A; (-) strand; PAM type: NRG; PAM sequence: AAG
ggaaaacagaccatgatggg

SEQ ID NO: 25799 - DNA, 20 bp, Artificial Sequence
  Description of Artificial Sequence: Synthetic oligonucleotide
  Target: SCN10A; (-) strand; PAM type: NRG; PAM sequence: GGG
caaggaaaacagaccatgat

SEQ ID NO: 25800 - DNA, 20 bp, Artificial Sequence
  Description of Artificial Sequence: Synthetic oligonucleotide
  Target: SCN10A; (-) strand; PAM type: NRG; PAM sequence: TGG
gcaaggaaaacagaccatga

SEQ ID NO: 25801 - DNA, 20 bp, Artificial Sequence
  Description of Artificial Sequence: Synthetic oligonucleotide
  Target: SCN10A; (-) strand; PAM type: NRG; PAM sequence: CAG
ctcccagagggcaaggaaaa

SEQ ID NO: 25802 - DNA, 20 bp, Artificial Sequence
  Description of Artificial Sequence: Synthetic oligonucleotide
  Target: SCN10A; (-) strand; PAM type: NRG; PAM sequence: AGG
gcagcacctcccagagggca

SEQ ID NO: 25803 - DNA, 20 bp, Artificial Sequence
  Description of Artificial Sequence: Synthetic oligonucleotide
  Target: SCN10A; (-) strand; PAM type: NRG; PAM sequence: AAG
agcagcacctcccagagggc

SEQ ID NO: 25804 - DNA, 20 bp, Artificial Sequence
  Description of Artificial Sequence: Synthetic oligonucleotide
  Target: SCN10A; (-) strand; PAM type: NRG; PAM sequence: GGG
aaagagcagcacctcccaga

SEQ ID NO: 25805 - DNA, 20 bp, Artificial Sequence
  Description of Artificial Sequence: Synthetic oligonucleotide
  Target: SCN10A; (-) strand; PAM type: NRG; PAM sequence: AGG
aaaagagcagcacctcccag

SEQ ID NO: 25806 - DNA, 20 bp, Artificial Sequence
  Description of Artificial Sequence: Synthetic oligonucleotide
  Target: SCN10A; (-) strand; PAM type: NRG; PAM sequence: GAG
caaaagagcagcacctccca

SEQ ID NO: 25807 - DNA, 20 bp, Artificial Sequence
  Description of Artificial Sequence: Synthetic oligonucleotide
  Target: SCN10A; (-) strand; PAM type: NRG; PAM sequence: CAG
ggcaaaagagcagcacctcc

SEQ ID NO: 25808 - DNA, 20 bp, Artificial Sequence
  Description of Artificial Sequence: Synthetic oligonucleotide
  Target: SCN10A; (-) strand; PAM type: NRG; PAM sequence: CAG
ctgcttactgggcaaaagag

SEQ ID NO: 25809 - DNA, 20 bp, Artificial Sequence
  Description of Artificial Sequence: Synthetic oligonucleotide
  Target: SCN10A; (-) strand; PAM type: NRG; PAM sequence: GAG
tggctgcttactgggcaaaa

SEQ ID NO: 25810 - DNA, 20 bp, Artificial Sequence
  Description of Artificial Sequence: Synthetic oligonucleotide
  Target: SCN10A; (-) strand; PAM type: NRG; PAM sequence: AAG
agtggctgcttactgggcaa

SEQ ID NO: 25811 - DNA, 20 bp, Artificial Sequence
  Description of Artificial Sequence: Synthetic oligonucleotide
  Target: SCN10A; (-) strand; PAM type: NRG; PAM sequence: GGG
ctgagaagtggctgcttact

SEQ ID NO: 25812 - DNA, 20 bp, Artificial Sequence
  Description of Artificial Sequence: Synthetic oligonucleotide
  Target: SCN10A; (-) strand; PAM type: NRG; PAM sequence: TGG
gctgagaagtggctgcttac

SEQ ID NO: 25813 - DNA, 20 bp, Artificial Sequence
  Description of Artificial Sequence: Synthetic oligonucleotide
  Target: SCN10A; (-) strand; PAM type: NRG; PAM sequence: TGG
gccatagccatgctgagaag

SEQ ID NO: 25814 - DNA, 20 bp, Artificial Sequence
  Description of Artificial Sequence: Synthetic oligonucleotide
  Target: SCN10A; (-) strand; PAM type: NRG; PAM sequence: AAG
tgtgccatagccatgctgag

SEQ ID NO: 25815 - DNA, 20 bp, Artificial Sequence
  Description of Artificial Sequence: Synthetic oligonucleotide
  Target: SCN10A; (-) strand; PAM type: NRG; PAM sequence: GAG
ctctgtgccatagccatgct

SEQ ID NO: 25816 - DNA, 20 bp, Artificial Sequence
  Description of Artificial Sequence: Synthetic oligonucleotide
  Target: SCN10A; (-) strand; PAM type: NRG; PAM sequence: TAG
tgagttgttgctctgtgcca

SEQ ID NO: 25817 - DNA, 20 bp, Artificial Sequence
  Description of Artificial Sequence: Synthetic oligonucleotide
  Target: SCN10A; (-) strand; PAM type: NRG; PAM sequence: GAG
tgggcagatgagataggcat

SEQ ID NO: 25818 - DNA, 20 bp, Artificial Sequence
  Description of Artificial Sequence: Synthetic oligonucleotide
  Target: SCN10A; (-) strand; PAM type: NRG; PAM sequence: AGG
cttctttgggcagatgagat

SEQ ID NO: 25819 - DNA, 20 bp, Artificial Sequence
  Description of Artificial Sequence: Synthetic oligonucleotide
  Target: SCN10A; (-) strand; PAM type: NRG; PAM sequence: TAG
ccttctttgggcagatgaga

SEQ ID NO: 25820 - DNA, 20 bp, Artificial Sequence
  Description of Artificial Sequence: Synthetic oligonucleotide
  Target: SCN10A; (-) strand; PAM type: NRG; PAM sequence: GAG
caagccttctttgggcagat

SEQ ID NO: 25821 - DNA, 20 bp, Artificial Sequence
  Description of Artificial Sequence: Synthetic oligonucleotide
  Target: SCN10A; (-) strand; PAM type: NRG; PAM sequence: CAG
gggcccaagccttctttggg

SEQ ID NO: 25822 - DNA, 20 bp, Artificial Sequence
  Description of Artificial Sequence: Synthetic oligonucleotide
  Target: SCN10A; (-) strand; PAM type: NRG; PAM sequence: GGG
agagggcccaagccttcttt

SEQ ID NO: 25823 - DNA, 20 bp, Artificial Sequence
  Description of Artificial Sequence: Synthetic oligonucleotide
  Target: SCN10A; (-) strand; PAM type: NRG; PAM sequence: TGG
aagagggcccaagccttctt

SEQ ID NO: 25824 - DNA, 20 bp, Artificial Sequence
  Description of Artificial Sequence: Synthetic oligonucleotide
  Target: SCN10A; (-) strand; PAM type: NRG; PAM sequence: AAG
aacaggcagtaagagggccc

SEQ ID NO: 25825 - DNA, 20 bp, Artificial Sequence
  Description of Artificial Sequence: Synthetic oligonucleotide
  Target: SCN10A; (-) strand; PAM type: NRG; PAM sequence: GGG
caacacaacaggcagtaaga

SEQ ID NO: 25826 - DNA, 20 bp, Artificial Sequence
  Description of Artificial Sequence: Synthetic oligonucleotide
  Target: SCN10A; (-) strand; PAM type: NRG; PAM sequence: AGG
acaacacaacaggcagtaag

SEQ ID NO: 25827 - DNA, 20 bp, Artificial Sequence
  Description of Artificial Sequence: Synthetic oligonucleotide
  Target: SCN10A; (-) strand; PAM type: NRG; PAM sequence: GAG
cacaacacaacaggcagtaa

SEQ ID NO: 25828 - DNA, 20 bp, Artificial Sequence
  Description of Artificial Sequence: Synthetic oligonucleotide
  Target: SCN10A; (-) strand; PAM type: NRG; PAM sequence: AAG
cccacaacacaacaggcagt

SEQ ID NO: 25829 - DNA, 20 bp, Artificial Sequence
  Description of Artificial Sequence: Synthetic oligonucleotide
  Target: SCN10A; (-) strand; PAM type: NRG; PAM sequence: CAG
tttccccacaacacaacagg

SEQ ID NO: 25830 - DNA, 20 bp, Artificial Sequence
  Description of Artificial Sequence: Synthetic oligonucleotide
  Target: SCN10A; (-) strand; PAM type: NRG; PAM sequence: AGG
cgctttccccacaacacaac

SEQ ID NO: 25831 - DNA, 20 bp, Artificial Sequence
  Description of Artificial Sequence: Synthetic oligonucleotide
  Target: SCN10A; (-) strand; PAM type: NRG; PAM sequence: CAG
ccgctttccccacaacacaa

SEQ ID NO: 25832 - DNA, 20 bp, Artificial Sequence
  Description of Artificial Sequence: Synthetic oligonucleotide
  Target: SCN10A; (-) strand; PAM type: NRG; PAM sequence: TGG
cacattctcaccacggtgtg

SEQ ID NO: 25833 - DNA, 20 bp, Artificial Sequence
  Description of Artificial Sequence: Synthetic oligonucleotide
  Target: SCN10A; (-) strand; PAM type: NRG; PAM sequence: CGG
ccccagacacattctcacca

SEQ ID NO: 25834 - DNA, 20 bp, Artificial Sequence
  Description of Artificial Sequence: Synthetic oligonucleotide
  Target: SCN10A; (-) strand; PAM type: NRG; PAM sequence: CAG
gggaggtttgctgatgcccc

SEQ ID NO: 25835 - DNA, 20 bp, Artificial Sequence
  Description of Artificial Sequence: Synthetic oligonucleotide
  Target: SCN10A; (-) strand; PAM type: NRG; PAM sequence: AGG
aacatcctctttatgagggg

SEQ ID NO: 25836 - DNA, 20 bp, Artificial Sequence
  Description of Artificial Sequence: Synthetic oligonucleotide
  Target: SCN10A; (-) strand; PAM type: NRG; PAM sequence: GAG
aaacatcctctttatgaggg

SEQ ID NO: 25837 - DNA, 20 bp, Artificial Sequence
  Description of Artificial Sequence: Synthetic oligonucleotide
  Target: SCN10A; (-) strand; PAM type: NRG; PAM sequence: GGG
aaaaacatcctctttatgag

SEQ ID NO: 25838 - DNA, 20 bp, Artificial Sequence
  Description of Artificial Sequence: Synthetic oligonucleotide
  Target: SCN10A; (-) strand; PAM type: NRG; PAM sequence: GGG
gaaaaacatcctctttatga

SEQ ID NO: 25839 - DNA, 20 bp, Artificial Sequence
  Description of Artificial Sequence: Synthetic oligonucleotide
  Target: SCN10A; (-) strand; PAM type: NRG; PAM sequence: AGG
tgaaaaacatcctctttatg

SEQ ID NO: 25840 - DNA, 20 bp, Artificial Sequence
  Description of Artificial Sequence: Synthetic oligonucleotide
  Target: SCN10A; (-) strand; PAM type: NRG; PAM sequence: GAG
ttgaaaaacatcctctttat

SEQ ID NO: 25841 - DNA, 20 bp, Artificial Sequence
  Description of Artificial Sequence: Synthetic oligonucleotide
  Target: SCN10A; (-) strand; PAM type: NRG; PAM sequence: TGG
gactaatctagacacacctg

SEQ ID NO: 25842 - DNA, 20 bp, Artificial Sequence
  Description of Artificial Sequence: Synthetic oligonucleotide
  Target: SCN10A; (-) strand; PAM type: NRG; PAM sequence: TAG
ggattcacctcagactaatc

SEQ ID NO: 25843 - DNA, 20 bp, Artificial Sequence
  Description of Artificial Sequence: Synthetic oligonucleotide
  Target: SCN10A; (-) strand; PAM type: NRG; PAM sequence: CAG
caggtggtttggattcacct

SEQ ID NO: 25844 - DNA, 20 bp, Artificial Sequence
  Description of Artificial Sequence: Synthetic oligonucleotide
  Target: SCN10A; (-) strand; PAM type: NRG; PAM sequence: TGG
tatgcaacacacaggtggtt

SEQ ID NO: 25845 - DNA, 20 bp, Artificial Sequence
  Description of Artificial Sequence: Synthetic oligonucleotide
  Target: SCN10A; (-) strand; PAM type: NRG; PAM sequence: TGG
gtgtttatgcaacacacagg

SEQ ID NO: 25846 - DNA, 20 bp, Artificial Sequence
  Description of Artificial Sequence: Synthetic oligonucleotide
  Target: SCN10A; (-) strand; PAM type: NRG; PAM sequence: AGG
gaagtgtttatgcaacacac

SEQ ID NO: 25847 - DNA, 20 bp, Artificial Sequence
  Description of Artificial Sequence: Synthetic oligonucleotide
  Target: SCN10A; (-) strand; PAM type: NRG; PAM sequence: CAG
agaagtgtttatgcaacaca

SEQ ID NO: 25848 - DNA, 20 bp, Artificial Sequence
  Description of Artificial Sequence: Synthetic oligonucleotide
  Target: SCN10A; (-) strand; PAM type: NRG; PAM sequence: AAG
gcagtcccaagacacagaag

SEQ ID NO: 25849 - DNA, 20 bp, Artificial Sequence
  Description of Artificial Sequence: Synthetic oligonucleotide
  Target: SCN10A; (-) strand; PAM type: NRG; PAM sequence: AAG
aaagcagtcccaagacacag

SEQ ID NO: 25850 - DNA, 20 bp, Artificial Sequence
  Description of Artificial Sequence: Synthetic oligonucleotide
  Target: SCN10A; (-) strand; PAM type: NRG; PAM sequence: CAG
cccaaagcagtcccaagaca

SEQ ID NO: 25851 - DNA, 20 bp, Artificial Sequence
  Description of Artificial Sequence: Synthetic oligonucleotide
  Target: SCN10A; (-) strand; PAM type: NRG; PAM sequence: AAG
ccacaccccaaagcagtccc

SEQ ID NO: 25852 - DNA, 20 bp, Artificial Sequence
  Description of Artificial Sequence: Synthetic oligonucleotide
  Target: SCN10A; (-) strand; PAM type: NRG; PAM sequence: CAG
atgtgtcccacaccccaaag

SEQ ID NO: 25853 - DNA, 20 bp, Artificial Sequence
  Description of Artificial Sequence: Synthetic oligonucleotide
  Target: SCN10A; (-) strand; PAM type: NRG; PAM sequence: AAG
ttaatgtgtcccacacccca

SEQ ID NO: 25854 - DNA, 20 bp, Artificial Sequence
  Description of Artificial Sequence: Synthetic oligonucleotide
  Target: SCN10A; (-) strand; PAM type: NRG; PAM sequence: GGG
ttagattgaaaaaatggctt

SEQ ID NO: 25855 - DNA, 20 bp, Artificial Sequence
  Description of Artificial Sequence: Synthetic oligonucleotide
  Target: SCN10A; (-) strand; PAM type: NRG; PAM sequence: TGG
attagattgaaaaaatggct

SEQ ID NO: 25856 - DNA, 20 bp, Artificial Sequence
  Description of Artificial Sequence: Synthetic oligonucleotide
  Target: SCN10A; (-) strand; PAM type: NRG; PAM sequence: TGG
aggtcattagattgaaaaaa

SEQ ID NO: 25857 - DNA, 20 bp, Artificial Sequence
  Description of Artificial Sequence: Synthetic oligonucleotide
  Target: SCN10A; (-) strand; PAM type: NRG; PAM sequence: TAG
caaaagtacaatgaggtcat

SEQ ID NO: 25858 - DNA, 20 bp, Artificial Sequence
  Description of Artificial Sequence: Synthetic oligonucleotide
  Target: SCN10A; (-) strand; PAM type: NRG; PAM sequence: AGG
tgaatcccaaaagtacaatg

SEQ ID NO: 25859 - DNA, 20 bp, Artificial Sequence
  Description of Artificial Sequence: Synthetic oligonucleotide
  Target: SCN10A; (-) strand; PAM type: NRG; PAM sequence: GAG
ttgaatcccaaaagtacaat

SEQ ID NO: 25860 - DNA, 20 bp, Artificial Sequence
  Description of Artificial Sequence: Synthetic oligonucleotide
  Target: SCN10A; (-) strand; PAM type: NRG; PAM sequence: AAG
cttatccaattgaatcccaa

SEQ ID NO: 25861 - DNA, 20 bp, Artificial Sequence
  Description of Artificial Sequence: Synthetic oligonucleotide
  Target: SCN10A; (-) strand; PAM type: NRG; PAM sequence: GAG
ttctttagaggttagcaaca

SEQ ID NO: 25862 - DNA, 20 bp, Artificial Sequence
  Description of Artificial Sequence: Synthetic oligonucleotide
  Target: SCN10A; (-) strand; PAM type: NRG; PAM sequence: CAG
ccttctttagaggttagcaa

SEQ ID NO: 25863 - DNA, 20 bp, Artificial Sequence
  Description of Artificial Sequence: Synthetic oligonucleotide
  Target: SCN10A; (-) strand; PAM type: NRG; PAM sequence: TAG
ccagtaccttctttagaggt

SEQ ID NO: 25864 - DNA, 20 bp, Artificial Sequence
  Description of Artificial Sequence: Synthetic oligonucleotide
  Target: SCN10A; (-) strand; PAM type: NRG; PAM sequence: AGG
gtgtccagtaccttctttag

SEQ ID NO: 25865 - DNA, 20 bp, Artificial Sequence
  Description of Artificial Sequence: Synthetic oligonucleotide
  Target: SCN10A; (-) strand; PAM type: NRG; PAM sequence: GAG
tgtgtccagtaccttcttta

SEQ ID NO: 25866 - DNA, 20 bp, Artificial Sequence
  Description of Artificial Sequence: Synthetic oligonucleotide
  Target: SCN10A; (-) strand; PAM type: NRG; PAM sequence: TAG
actgtgtccagtaccttctt

SEQ ID NO: 25867 - DNA, 20 bp, Artificial Sequence
  Description of Artificial Sequence: Synthetic oligonucleotide
  Target: SCN10A; (-) strand; PAM type: NRG; PAM sequence: CAG
tagaccttgcctactgtgtc

SEQ ID NO: 25868 - DNA, 20 bp, Artificial Sequence
  Description of Artificial Sequence: Synthetic oligonucleotide
  Target: SCN10A; (-) strand; PAM type: NRG; PAM sequence: TAG
cctcttccacgtgttacaat

SEQ ID NO: 25869 - DNA, 20 bp, Artificial Sequence
  Description of Artificial Sequence: Synthetic oligonucleotide
  Target: SCN10A; (-) strand; PAM type: NRG; PAM sequence: AAG
gatcagaagaacggccatca

SEQ ID NO: 25870 - DNA, 20 bp, Artificial Sequence
  Description of Artificial Sequence: Synthetic oligonucleotide
  Target: SCN10A; (-) strand; PAM type: NRG; PAM sequence: CGG
tttcaacctgatcagaagaa

SEQ ID NO: 25871 - DNA, 20 bp, Artificial Sequence
  Description of Artificial Sequence: Synthetic oligonucleotide
  Target: SCN10A; (-) strand; PAM type: NRG; PAM sequence: AAG
agtcctttcaacctgatcag

SEQ ID NO: 25872 - DNA, 20 bp, Artificial Sequence
  Description of Artificial Sequence: Synthetic oligonucleotide
  Target: SCN10A; (-) strand; PAM type: NRG; PAM sequence: CAG
ttcagtcctttcaacctgat

SEQ ID NO: 25873 - DNA, 20 bp, Artificial Sequence
  Description of Artificial Sequence: Synthetic oligonucleotide
  Target: SCN10A; (-) strand; PAM type: NRG; PAM sequence: CAG
actcgggccctgtggctatt

SEQ ID NO: 25874 - DNA, 20 bp, Artificial Sequence
  Description of Artificial Sequence: Synthetic oligonucleotide
  Target: SCN10A; (-) strand; PAM type: NRG; PAM sequence: TGG
ttagtgccactcgggccctg

SEQ ID NO: 25875 - DNA, 20 bp, Artificial Sequence
  Description of Artificial Sequence: Synthetic oligonucleotide
  Target: SCN10A; (-) strand; PAM type: NRG; PAM sequence: GGG
ttcccggtttagtgccactc

SEQ ID NO: 25876 - DNA, 20 bp, Artificial Sequence
  Description of Artificial Sequence: Synthetic oligonucleotide
  Target: SCN10A; (-) strand; PAM type: NRG; PAM sequence: CGG
tttcccggtttagtgccact

SEQ ID NO: 25877 - DNA, 20 bp, Artificial Sequence
  Description of Artificial Sequence: Synthetic oligonucleotide
  Target: SCN10A; (-) strand; PAM type: NRG; PAM sequence: TAG
gggaggaccatttcccggtt

SEQ ID NO: 25878 - DNA, 20 bp, Artificial Sequence
  Description of Artificial Sequence: Synthetic oligonucleotide
  Target: SCN10A; (-) strand; PAM type: NRG; PAM sequence: CGG
acaaagggaggaccatttcc

SEQ ID NO: 25879 - DNA, 20 bp, Artificial Sequence
  Description of Artificial Sequence: Synthetic oligonucleotide
  Target: SCN10A; (-) strand; PAM type: NRG; PAM sequence: AGG
ttatggtgctgaacaaaggg

SEQ ID NO: 25880 - DNA, 20 bp, Artificial Sequence
  Description of Artificial Sequence: Synthetic oligonucleotide
  Target: SCN10A; (-) strand; PAM type: NRG; PAM sequence: GAG
tttatggtgctgaacaaagg

SEQ ID NO: 25881 - DNA, 20 bp, Artificial Sequence
  Description of Artificial Sequence: Synthetic oligonucleotide
  Target: SCN10A; (-) strand; PAM type: NRG; PAM sequence: GGG
catttatggtgctgaacaaa

SEQ ID NO: 25882 - DNA, 20 bp, Artificial Sequence
  Description of Artificial Sequence: Synthetic oligonucleotide
  Target: SCN10A; (-) strand; PAM type: NRG; PAM sequence: AGG
acatttatggtgctgaacaa

SEQ ID NO: 25883 - DNA, 20 bp, Artificial Sequence
  Description of Artificial Sequence: Synthetic oligonucleotide
  Target: SCN10A; (-) strand; PAM type: NRG; PAM sequence: AAG
gacatttatggtgctgaaca

SEQ ID NO: 25884 - DNA, 20 bp, Artificial Sequence
  Description of Artificial Sequence: Synthetic oligonucleotide
  Target: SCN10A; (-) strand; PAM type: NRG; PAM sequence: TGG
tgttttgtttcagacattta

SEQ ID NO: 25885 - DNA, 20 bp, Artificial Sequence
  Description of Artificial Sequence: Synthetic oligonucleotide
  Target: SCN10A; (-) strand; PAM type: NRG; PAM sequence: CAG
ctttctgttttgttttgttt

SEQ ID NO: 25886 - DNA, 20 bp, Artificial Sequence
  Description of Artificial Sequence: Synthetic oligonucleotide
  Target: SCN10A; (-) strand; PAM type: NRG; PAM sequence: AGG
ggaatcttgtttctcattgg

SEQ ID NO: 25887 - DNA, 20 bp, Artificial Sequence
  Description of Artificial Sequence: Synthetic oligonucleotide
  Target: SCN10A; (-) strand; PAM type: NRG; PAM sequence: GAG
aggaatcttgtttctcattg

SEQ ID NO: 25888 - DNA, 20 bp, Artificial Sequence
  Description of Artificial Sequence: Synthetic oligonucleotide
  Target: SCN10A; (-) strand; PAM type: NRG; PAM sequence: TGG
taaggaatcttgtttctcat

SEQ ID NO: 25889 - DNA, 20 bp, Artificial Sequence
  Description of Artificial Sequence: Synthetic oligonucleotide
  Target: SCN10A; (-) strand; PAM type: NRG; PAM sequence: AGG
tttaaaaacatggttgtata

SEQ ID NO: 25890 - DNA, 20 bp, Artificial Sequence
  Description of Artificial Sequence: Synthetic oligonucleotide
  Target: SCN10A; (-) strand; PAM type: NRG; PAM sequence: AAG
gtttaaaaacatggttgtat

SEQ ID NO: 25891 - DNA, 20 bp, Artificial Sequence
  Description of Artificial Sequence: Synthetic oligonucleotide
  Target: SCN10A; (-) strand; PAM type: NRG; PAM sequence: TGG
gcctctcatgtttaaaaaca

SEQ ID NO: 25892 - DNA, 20 bp, Artificial Sequence
  Description of Artificial Sequence: Synthetic oligonucleotide
  Target: SCN10A; (-) strand; PAM type: NRG; PAM sequence: GAG
cccttcttgctcataagcct

SEQ ID NO: 25893 - DNA, 20 bp, Artificial Sequence
  Description of Artificial Sequence: Synthetic oligonucleotide
  Target: SCN10A; (-) strand; PAM type: NRG; PAM sequence: AAG
ccagagcccttcttgctcat

SEQ ID NO: 25894 - DNA, 20 bp, Artificial Sequence
  Description of Artificial Sequence: Synthetic oligonucleotide
  Target: SCN10A; (-) strand; PAM type: NRG; PAM sequence: GAG
tcattgacctgtagttccca

SEQ ID NO: 25895 - DNA, 20 bp, Artificial Sequence
  Description of Artificial Sequence: Synthetic oligonucleotide
  Target: SCN10A; (-) strand; PAM type: NRG; PAM sequence: CAG
tctcattgacctgtagttcc

SEQ ID NO: 25896 - DNA, 20 bp, Artificial Sequence
  Description of Artificial Sequence: Synthetic oligonucleotide
  Target: SCN10A; (-) strand; PAM type: NRG; PAM sequence: TAG
atttgactctcattgacctg

SEQ ID NO: 25897 - DNA, 20 bp, Artificial Sequence
  Description of Artificial Sequence: Synthetic oligonucleotide
  Target: SCN10A; (-) strand; PAM type: NRG; PAM sequence: TAG
gagggtgaggatatggcttt

SEQ ID NO: 25898 - DNA, 20 bp, Artificial Sequence
  Description of Artificial Sequence: Synthetic oligonucleotide
  Target: SCN10A; (-) strand; PAM type: NRG; PAM sequence: TGG
ttgctgagagggtgaggata

SEQ ID NO: 25899 - DNA, 20 bp, Artificial Sequence
  Description of Artificial Sequence: Synthetic oligonucleotide
  Target: SCN10A; (-) strand; PAM type: NRG; PAM sequence: AGG
aggatcttgctgagagggtg

SEQ ID NO: 25900 - DNA, 20 bp, Artificial Sequence
  Description of Artificial Sequence: Synthetic oligonucleotide
  Target: SCN10A; (-) strand; PAM type: NRG; PAM sequence: GAG
gaggatcttgctgagagggt

SEQ ID NO: 25901 - DNA, 20 bp, Artificial Sequence
  Description of Artificial Sequence: Synthetic oligonucleotide
  Target: SCN10A; (-) strand; PAM type: NRG; PAM sequence: GGG
agatgaggatcttgctgaga

SEQ ID NO: 25902 - DNA, 20 bp, Artificial Sequence
  Description of Artificial Sequence: Synthetic oligonucleotide
  Target: SCN10A; (-) strand; PAM type: NRG; PAM sequence: AGG
gagatgaggatcttgctgag

SEQ ID NO: 25903 - DNA, 20 bp, Artificial Sequence
  Description of Artificial Sequence: Synthetic oligonucleotide
  Target: SCN10A; (-) strand; PAM type: NRG; PAM sequence: GAG
agagatgaggatcttgctga

SEQ ID NO: 25904 - DNA, 20 bp, Artificial Sequence
  Description of Artificial Sequence: Synthetic oligonucleotide
  Target: SCN10A; (-) strand; PAM type: NRG; PAM sequence: GAG
ccagagatgaggatcttgct

SEQ ID NO: 25905 - DNA, 20 bp, Artificial Sequence
  Description of Artificial Sequence: Synthetic oligonucleotide
  Target: SCN10A; (-) strand; PAM type: NRG; PAM sequence: AGG
cactgtcagtcccagagatg

SEQ ID NO: 25906 - DNA, 20 bp, Artificial Sequence
  Description of Artificial Sequence: Synthetic oligonucleotide
  Target: SCN10A; (-) strand; PAM type: NRG; PAM sequence: GAG
gcactgtcagtcccagagat

SEQ ID NO: 25907 - DNA, 20 bp, Artificial Sequence
  Description of Artificial Sequence: Synthetic oligonucleotide
  Target: SCN10A; (-) strand; PAM type: NRG; PAM sequence: GAG
ttggtgcactgtcagtccca

SEQ ID NO: 25908 - DNA, 20 bp, Artificial Sequence
  Description of Artificial Sequence: Synthetic oligonucleotide
  Target: SCN10A; (-) strand; PAM type: NRG; PAM sequence: CAG
tcttggtgcactgtcagtcc

SEQ ID NO: 25909 - DNA, 20 bp, Artificial Sequence
  Description of Artificial Sequence: Synthetic oligonucleotide
  Target: SCN10A; (-) strand; PAM type: NRG; PAM sequence: CAG
ggctcatcttggtgcactgt

SEQ ID NO: 25910 - DNA, 20 bp, Artificial Sequence
  Description of Artificial Sequence: Synthetic oligonucleotide
  Target: SCN10A; (-) strand; PAM type: NRG; PAM sequence: TGG
taccctcagtgggctcatct

SEQ ID NO: 25911 - DNA, 20 bp, Artificial Sequence
  Description of Artificial Sequence: Synthetic oligonucleotide
  Target: SCN10A; (-) strand; PAM type: NRG; PAM sequence: GGG
tccattaaagtaccctcagt

SEQ ID NO: 25912 - DNA, 20 bp, Artificial Sequence
  Description of Artificial Sequence: Synthetic oligonucleotide
  Target: SCN10A; (-) strand; PAM type: NRG; PAM sequence: TGG
gtccattaaagtaccctcag

SEQ ID NO: 25913 - DNA, 20 bp, Artificial Sequence
  Description of Artificial Sequence: Synthetic oligonucleotide
  Target: SCN10A; (-) strand; PAM type: NRG; PAM sequence: CAG
tctgtccattaaagtaccct

SEQ ID NO: 25914 - DNA, 20 bp, Artificial Sequence
  Description of Artificial Sequence: Synthetic oligonucleotide
  Target: SCN10A; (-) strand; PAM type: NRG; PAM sequence: AAG
gattggctgtctgtccatta

SEQ ID NO: 25915 - DNA, 20 bp, Artificial Sequence
  Description of Artificial Sequence: Synthetic oligonucleotide
  Target: SCN10A; (-) strand; PAM type: NRG; PAM sequence: TGG
cctcttaccagcctgaggat

SEQ ID NO: 25916 - DNA, 20 bp, Artificial Sequence
  Description of Artificial Sequence: Synthetic oligonucleotide
  Target: SCN10A; (-) strand; PAM type: NRG; PAM sequence: AGG
taacacctcttaccagcctg

SEQ ID NO: 25917 - DNA, 20 bp, Artificial Sequence
  Description of Artificial Sequence: Synthetic oligonucleotide
  Target: SCN10A; (-) strand; PAM type: NRG; PAM sequence: GAG
ataacacctcttaccagcct

SEQ ID NO: 25918 - DNA, 20 bp, Artificial Sequence
  Description of Artificial Sequence: Synthetic oligonucleotide
  Target: SCN10A; (-) strand; PAM type: NRG; PAM sequence: CAG
ctgggcataacacctcttac

SEQ ID NO: 25919 - DNA, 20 bp, Artificial Sequence
  Description of Artificial Sequence: Synthetic oligonucleotide
  Target: SCN10A; (-) strand; PAM type: NRG; PAM sequence: GGG
tgttgccagagtcctcccct

SEQ ID NO: 25920 - DNA, 20 bp, Artificial Sequence
  Description of Artificial Sequence: Synthetic oligonucleotide
  Target: SCN10A; (-) strand; PAM type: NRG; PAM sequence: TGG
ctgttgccagagtcctcccc

SEQ ID NO: 25921 - DNA, 20 bp, Artificial Sequence
  Description of Artificial Sequence: Synthetic oligonucleotide
  Target: SCN10A; (-) strand; PAM type: NRG; PAM sequence: GAG
acttcaccatcctgttgcca

SEQ ID NO: 25922 - DNA, 20 bp, Artificial Sequence
  Description of Artificial Sequence: Synthetic oligonucleotide
  Target: SCN10A; (-) strand; PAM type: NRG; PAM sequence: CAG
taacttcaccatcctgttgc

SEQ ID NO: 25923 - DNA, 20 bp, Artificial Sequence
  Description of Artificial Sequence: Synthetic oligonucleotide
  Target: SCN10A; (-) strand; PAM type: NRG; PAM sequence: GAG
ggatggttctcttgtcagaa

SEQ ID NO: 25924 - DNA, 20 bp, Artificial Sequence
  Description of Artificial Sequence: Synthetic oligonucleotide
  Target: SCN10A; (-) strand; PAM type: NRG; PAM sequence: AAG
aaggatggttctcttgtcag

SEQ ID NO: 25925 - DNA, 20 bp, Artificial Sequence
  Description of Artificial Sequence: Synthetic oligonucleotide
  Target: SCN10A; (-) strand; PAM type: NRG; PAM sequence: CAG
aacaaggatggttctcttgt

SEQ ID NO: 25926 - DNA, 20 bp, Artificial Sequence
  Description of Artificial Sequence: Synthetic oligonucleotide
  Target: SCN10A; (-) strand; PAM type: NRG; PAM sequence: TGG
gaaacattacaaaacaagga

SEQ ID NO: 25927 - DNA, 20 bp, Artificial Sequence
  Description of Artificial Sequence: Synthetic oligonucleotide
  Target: SCN10A; (-) strand; PAM type: NRG; PAM sequence: AGG
agaagaaacattacaaaaca

SEQ ID NO: 25928 - DNA, 20 bp, Artificial Sequence
  Description of Artificial Sequence: Synthetic oligonucleotide
  Target: SCN10A; (-) strand; PAM type: NRG; PAM sequence: AAG
cagaagaaacattacaaaac

SEQ ID NO: 25929 - DNA, 20 bp, Artificial Sequence
  Description of Artificial Sequence: Synthetic oligonucleotide
  Target: SCN10A; (-) strand; PAM type: NRG; PAM sequence: AAG
gatgtagaaggtggagacag

SEQ ID NO: 25930 - DNA, 20 bp, Artificial Sequence
  Description of Artificial Sequence: Synthetic oligonucleotide
  Target: SCN10A; (-) strand; PAM type: NRG; PAM sequence: CAG
agagatgtagaaggtggaga

SEQ ID NO: 25931 - DNA, 20 bp, Artificial Sequence
  Description of Artificial Sequence: Synthetic oligonucleotide
  Target: SCN10A; (-) strand; PAM type: NRG; PAM sequence: GAG
agacagagatgtagaaggtg

SEQ ID NO: 25932 - DNA, 20 bp, Artificial Sequence
  Description of Artificial Sequence: Synthetic oligonucleotide
  Target: SCN10A; (-) strand; PAM type: NRG; PAM sequence: TGG
agagacagagatgtagaagg

SEQ ID NO: 25933 - DNA, 20 bp, Artificial Sequence
  Description of Artificial Sequence: Synthetic oligonucleotide
  Target: SCN10A; (-) strand; PAM type: NRG; PAM sequence: AGG
ttaagagacagagatgtaga

SEQ ID NO: 25934 - DNA, 20 bp, Artificial Sequence
  Description of Artificial Sequence: Synthetic oligonucleotide
  Target: SCN10A; (-) strand; PAM type: NRG; PAM sequence: AAG
tttaagagacagagatgtag

SEQ ID NO: 25935 - DNA, 20 bp, Artificial Sequence
  Description of Artificial Sequence: Synthetic oligonucleotide
  Target: SCN10A; (-) strand; PAM type: NRG; PAM sequence: TAG
ggatttaagagacagagatg

SEQ ID NO: 25936 - DNA, 20 bp, Artificial Sequence
  Description of Artificial Sequence: Synthetic oligonucleotide
  Target: SCN10A; (-) strand; PAM type: NRG; PAM sequence: GAG
aggagaggatttaagagaca

SEQ ID NO: 25937 - DNA, 20 bp, Artificial Sequence
  Description of Artificial Sequence: Synthetic oligonucleotide
  Target: SCN10A; (-) strand; PAM type: NRG; PAM sequence: CAG
ccaggagaggatttaagaga

SEQ ID NO: 25938 - DNA, 20 bp, Artificial Sequence
  Description of Artificial Sequence: Synthetic oligonucleotide
  Target: SCN10A; (-) strand; PAM type: NRG; PAM sequence: GAG
gaaaccaggagaggatttaa

SEQ ID NO: 25939 - DNA, 20 bp, Artificial Sequence
  Description of Artificial Sequence: Synthetic oligonucleotide
  Target: SCN10A; (-) strand; PAM type: NRG; PAM sequence: AAG
gagaaaccaggagaggattt

SEQ ID NO: 25940 - DNA, 20 bp, Artificial Sequence
  Description of Artificial Sequence: Synthetic oligonucleotide
  Target: SCN10A; (-) strand; PAM type: NRG; PAM sequence: AGG
tcagagggagaaaccaggag

SEQ ID NO: 25941 - DNA, 20 bp, Artificial Sequence
  Description of Artificial Sequence: Synthetic oligonucleotide
  Target: SCN10A; (-) strand; PAM type: NRG; PAM sequence: GAG
ctcagagggagaaaccagga

SEQ ID NO: 25942 - DNA, 20 bp, Artificial Sequence
  Description of Artificial Sequence: Synthetic oligonucleotide
  Target: SCN10A; (-) strand; PAM type: NRG; PAM sequence: GAG
tcctcagagggagaaaccag

SEQ ID NO: 25943 - DNA, 20 bp, Artificial Sequence
  Description of Artificial Sequence: Synthetic oligonucleotide
  Target: SCN10A; (-) strand; PAM type: NRG; PAM sequence: AGG
aatcctcagagggagaaacc

SEQ ID NO: 25944 - DNA, 20 bp, Artificial Sequence
  Description of Artificial Sequence: Synthetic oligonucleotide
  Target: SCN10A; (-) strand; PAM type: NRG; PAM sequence: CAG
aaatcctcagagggagaaac

SEQ ID NO: 25945 - DNA, 20 bp, Artificial Sequence
  Description of Artificial Sequence: Synthetic oligonucleotide
  Target: SCN10A; (-) strand; PAM type: NRG; PAM sequence: GAG
tcctcctaaatcctcagagg

SEQ ID NO: 25946 - DNA, 20 bp, Artificial Sequence
  Description of Artificial Sequence: Synthetic oligonucleotide
  Target: SCN10A; (-) strand; PAM type: NRG; PAM sequence: GGG
tatcctcctaaatcctcaga

SEQ ID NO: 25947 - DNA, 20 bp, Artificial Sequence
  Description of Artificial Sequence: Synthetic oligonucleotide
  Target: SCN10A; (-) strand; PAM type: NRG; PAM sequence: AGG
atatcctcctaaatcctcag

SEQ ID NO: 25948 - DNA, 20 bp, Artificial Sequence
  Description of Artificial Sequence: Synthetic oligonucleotide
  Target: SCN10A; (-) strand; PAM type: NRG; PAM sequence: GAG
catatcctcctaaatcctca

SEQ ID NO: 25949 - DNA, 20 bp, Artificial Sequence
  Description of Artificial Sequence: Synthetic oligonucleotide
  Target: SCN10A; (-) strand; PAM type: NRG; PAM sequence: CAG
ttcatatcctcctaaatcct

SEQ ID NO: 25950 - DNA, 20 bp, Artificial Sequence
  Description of Artificial Sequence: Synthetic oligonucleotide
  Target: SCN10A; (-) strand; PAM type: NRG; PAM sequence: GAG
ttcctcctctcccatgccaa

SEQ ID NO: 25951 - DNA, 20 bp, Artificial Sequence
  Description of Artificial Sequence: Synthetic oligonucleotide
  Target: SCN10A; (-) strand; PAM type: NRG; PAM sequence: AAG
tcttcctcctctcccatgcc

SEQ ID NO: 25952 - DNA, 20 bp, Artificial Sequence
  Description of Artificial Sequence: Synthetic oligonucleotide
  Target: SCN10A; (-) strand; PAM type: NRG; PAM sequence: AGG
ggctagcagagtaaataaaa

SEQ ID NO: 25953 - DNA, 20 bp, Artificial Sequence
  Description of Artificial Sequence: Synthetic oligonucleotide
  Target: SCN10A; (-) strand; PAM type: NRG; PAM sequence: AAG
tggctagcagagtaaataaa

SEQ ID NO: 25954 - DNA, 20 bp, Artificial Sequence
  Description of Artificial Sequence: Synthetic oligonucleotide
  Target: SCN10A; (-) strand; PAM type: NRG; PAM sequence: GAG
catctcaaatatggctagca

SEQ ID NO: 25955 - DNA, 20 bp, Artificial Sequence
  Description of Artificial Sequence: Synthetic oligonucleotide
  Target: SCN10A; (-) strand; PAM type: NRG; PAM sequence: CAG
gccatctcaaatatggctag

SEQ ID NO: 25956 - DNA, 20 bp, Artificial Sequence
  Description of Artificial Sequence: Synthetic oligonucleotide
  Target: SCN10A; (-) strand; PAM type: NRG; PAM sequence: TAG
tcagccatctcaaatatggc

SEQ ID NO: 25957 - DNA, 20 bp, Artificial Sequence
  Description of Artificial Sequence: Synthetic oligonucleotide
  Target: SCN10A; (-) strand; PAM type: NRG; PAM sequence: TGG
ggaatcagccatctcaaata

SEQ ID NO: 25958 - DNA, 20 bp, Artificial Sequence
  Description of Artificial Sequence: Synthetic oligonucleotide
  Target: SCN10A; (-) strand; PAM type: NRG; PAM sequence: CAG
ggagttaggaggacaggaat

SEQ ID NO: 25959 - DNA, 20 bp, Artificial Sequence
  Description of Artificial Sequence: Synthetic oligonucleotide
  Target: SCN10A; (-) strand; PAM type: NRG; PAM sequence: AGG
tgtttgggagttaggaggac

SEQ ID NO: 25960 - DNA, 20 bp, Artificial Sequence
  Description of Artificial Sequence: Synthetic oligonucleotide
  Target: SCN10A; (-) strand; PAM type: NRG; PAM sequence: CAG
atgtttgggagttaggagga

SEQ ID NO: 25961 - DNA, 20 bp, Artificial Sequence
  Description of Artificial Sequence: Synthetic oligonucleotide
  Target: SCN10A; (-) strand; PAM type: NRG; PAM sequence: AGG
atgcatgtttgggagttagg

SEQ ID NO: 25962 - DNA, 20 bp, Artificial Sequence
  Description of Artificial Sequence: Synthetic oligonucleotide
  Target: SCN10A; (-) strand; PAM type: NRG; PAM sequence: GAG
aatgcatgtttgggagttag

SEQ ID NO: 25963 - DNA, 20 bp, Artificial Sequence
  Description of Artificial Sequence: Synthetic oligonucleotide
  Target: SCN10A; (-) strand; PAM type: NRG; PAM sequence: AGG
tgaatgcatgtttgggagtt

SEQ ID NO: 25964 - DNA, 20 bp, Artificial Sequence
  Description of Artificial Sequence: Synthetic oligonucleotide
  Target: SCN10A; (-) strand; PAM type: NRG; PAM sequence: TAG
gtgaatgcatgtttgggagt

SEQ ID NO: 25965 - DNA, 20 bp, Artificial Sequence
  Description of Artificial Sequence: Synthetic oligonucleotide
  Target: SCN10A; (-) strand; PAM type: NRG; PAM sequence: GAG
aatggtgaatgcatgtttgg

SEQ ID NO: 25966 - DNA, 20 bp, Artificial Sequence
  Description of Artificial Sequence: Synthetic oligonucleotide
  Target: SCN10A; (-) strand; PAM type: NRG; PAM sequence: GGG
aaaatggtgaatgcatgttt

SEQ ID NO: 25967 - DNA, 20 bp, Artificial Sequence
  Description of Artificial Sequence: Synthetic oligonucleotide
  Target: SCN10A; (-) strand; PAM type: NRG; PAM sequence: TGG
aaaaatggtgaatgcatgtt

SEQ ID NO: 25968 - DNA, 20 bp, Artificial Sequence
  Description of Artificial Sequence: Synthetic oligonucleotide
  Target: SCN10A; (-) strand; PAM type: NRG; PAM sequence: TGG
atgttctacgagccaaaaaa

SEQ ID NO: 25969 - DNA, 20 bp, Artificial Sequence
  Description of Artificial Sequence: Synthetic oligonucleotide
  Target: SCN10A; (-) strand; PAM type: NRG; PAM sequence: GAG
ttgtatttttgatgttctac

SEQ ID NO: 25970 - DNA, 20 bp, Artificial Sequence
  Description of Artificial Sequence: Synthetic oligonucleotide
  Target: SCN10A; (-) strand; PAM type: NRG; PAM sequence: GAG
agaatcagtagtttaaacaa

SEQ ID NO: 25971 - DNA, 20 bp, Artificial Sequence
  Description of Artificial Sequence: Synthetic oligonucleotide
  Target: SCN10A; (-) strand; PAM type: NRG; PAM sequence: AAG
tgagaatcagtagtttaaac

SEQ ID NO: 25972 - DNA, 20 bp, Artificial Sequence
  Description of Artificial Sequence: Synthetic oligonucleotide
  Target: SCN10A; (-) strand; PAM type: NRG; PAM sequence: TAG
tcaaaaagtttgagaatcag

SEQ ID NO: 25973 - DNA, 20 bp, Artificial Sequence
  Description of Artificial Sequence: Synthetic oligonucleotide
  Target: SCN10A; (-) strand; PAM type: NRG; PAM sequence: CAG
aaatcaaaaagtttgagaat

SEQ ID NO: 25974 - DNA, 20 bp, Artificial Sequence
  Description of Artificial Sequence: Synthetic oligonucleotide
  Target: SCN10A; (-) strand; PAM type: NRG; PAM sequence: GAG
tccctgaaatcaaaaagttt

SEQ ID NO: 25975 - DNA, 20 bp, Artificial Sequence
  Description of Artificial Sequence: Synthetic oligonucleotide
  Target: SCN10A; (-) strand; PAM type: NRG; PAM sequence: AAG
taataatccctgaaatcaaa

SEQ ID NO: 25976 - DNA, 20 bp, Artificial Sequence
  Description of Artificial Sequence: Synthetic oligonucleotide
  Target: SCN10A; (-) strand; PAM type: NRG; PAM sequence: GAG
gggtcctcaataaggtttga

SEQ ID NO: 25977 - DNA, 20 bp, Artificial Sequence
  Description of Artificial Sequence: Synthetic oligonucleotide
  Target: SCN10A; (-) strand; PAM type: NRG; PAM sequence: GAG
tggggtcctcaataaggttt

SEQ ID NO: 25978 - DNA, 20 bp, Artificial Sequence
  Description of Artificial Sequence: Synthetic oligonucleotide
  Target: SCN10A; (-) strand; PAM type: NRG; PAM sequence: AGG
gttatttggggtcctcaata

SEQ ID NO: 25979 - DNA, 20 bp, Artificial Sequence
  Description of Artificial Sequence: Synthetic oligonucleotide
  Target: SCN10A; (-) strand; PAM type: NRG; PAM sequence: AAG
agttatttggggtcctcaat

SEQ ID NO: 25980 - DNA, 20 bp, Artificial Sequence
  Description of Artificial Sequence: Synthetic oligonucleotide
  Target: SCN10A; (-) strand; PAM type: NRG; PAM sequence: GGG
acataaacaaaagttatttg

SEQ ID NO: 25981 - DNA, 20 bp, Artificial Sequence
  Description of Artificial Sequence: Synthetic oligonucleotide
  Target: SCN10A; (-) strand; PAM type: NRG; PAM sequence: GGG
aacataaacaaaagttattt

SEQ ID NO: 25982 - DNA, 20 bp, Artificial Sequence
  Description of Artificial Sequence: Synthetic oligonucleotide
  Target: SCN10A; (-) strand; PAM type: NRG; PAM sequence: TGG
caacataaacaaaagttatt

SEQ ID NO: 25983 - DNA, 20 bp, Artificial Sequence
  Description of Artificial Sequence: Synthetic oligonucleotide
  Target: SCN10A; (-) strand; PAM type: NRG; PAM sequence: AAG
aaaggtatcaacataaacaa

SEQ ID NO: 25984 - DNA, 20 bp, Artificial Sequence
  Description of Artificial Sequence: Synthetic oligonucleotide
  Target: SCN10A; (-) strand; PAM type: NRG; PAM sequence: AGG
tatatctggcataaacaaaa

SEQ ID NO: 25985 - DNA, 20 bp, Artificial Sequence
  Description of Artificial Sequence: Synthetic oligonucleotide
  Target: SCN10A; (-) strand; PAM type: NRG; PAM sequence: AAG
atatatctggcataaacaaa

SEQ ID NO: 25986 - DNA, 20 bp, Artificial Sequence
  Description of Artificial Sequence: Synthetic oligonucleotide
  Target: SCN10A; (-) strand; PAM type: NRG; PAM sequence: TGG
taatatgatatacatatatc

SEQ ID NO: 25987 - DNA, 20 bp, Artificial Sequence
  Description of Artificial Sequence: Synthetic oligonucleotide
  Target: SCN10A; (-) strand; PAM type: NRG; PAM sequence: AAG
ttatgtatatataggtatat

SEQ ID NO: 25988 - DNA, 20 bp, Artificial Sequence
  Description of Artificial Sequence: Synthetic oligonucleotide
  Target: SCN10A; (-) strand; PAM type: NRG; PAM sequence: AGG
gtagctagttatgtatatat

SEQ ID NO: 25989 - DNA, 20 bp, Artificial Sequence
  Description of Artificial Sequence: Synthetic oligonucleotide
  Target: SCN10A; (-) strand; PAM type: NRG; PAM sequence: TAG
tgtagctagttatgtatata

SEQ ID NO: 25990 - DNA, 20 bp, Artificial Sequence
  Description of Artificial Sequence: Synthetic oligonucleotide
  Target: SCN10A; (-) strand; PAM type: NRG; PAM sequence: TAG
atacaactagaccatgtagc

SEQ ID NO: 25991 - DNA, 20 bp, Artificial Sequence
  Description of Artificial Sequence: Synthetic oligonucleotide
  Target: SCN10A; (-) strand; PAM type: NRG; PAM sequence: TAG
atacatacaactagaccatg

SEQ ID NO: 25992 - DNA, 20 bp, Artificial Sequence
  Description of Artificial Sequence: Synthetic oligonucleotide
  Target: SCN10A; (-) strand; PAM type: NRG; PAM sequence: TAG
actatgtatatacatacaac

SEQ ID NO: 25993 - DNA, 20 bp, Artificial Sequence
  Description of Artificial Sequence: Synthetic oligonucleotide
  Target: SCN10A; (-) strand; PAM type: NRG; PAM sequence: GAG
gagttttgaatttctaatat

SEQ ID NO: 25994 - DNA, 20 bp, Artificial Sequence
  Description of Artificial Sequence: Synthetic oligonucleotide
  Target: SCN10A; (-) strand; PAM type: NRG; PAM sequence: GAG
cccgtgttttaaaatttcct

SEQ ID NO: 25995 - DNA, 20 bp, Artificial Sequence
  Description of Artificial Sequence: Synthetic oligonucleotide
  Target: SCN10A; (-) strand; PAM type: NRG; PAM sequence: TGG
gtcatcactctaaaagctac

SEQ ID NO: 25996 - DNA, 20 bp, Artificial Sequence
  Description of Artificial Sequence: Synthetic oligonucleotide
  Target: SCN10A; (-) strand; PAM type: NRG; PAM sequence: AAG
ggatgatgtcatcactctaa

SEQ ID NO: 25997 - DNA, 20 bp, Artificial Sequence
  Description of Artificial Sequence: Synthetic oligonucleotide
  Target: SCN10A; (-) strand; PAM type: NRG; PAM sequence: GGG
aatatagaggctattgatgg

SEQ ID NO: 25998 - DNA, 20 bp, Artificial Sequence
  Description of Artificial Sequence: Synthetic oligonucleotide
  Target: SCN10A; (-) strand; PAM type: NRG; PAM sequence: GGG
gaatatagaggctattgatg

SEQ ID NO: 25999 - DNA, 20 bp, Artificial Sequence
  Description of Artificial Sequence: Synthetic oligonucleotide
  Target: SCN10A; (-) strand; PAM type: NRG; PAM sequence: GGG
tgaatatagaggctattgat

SEQ ID NO: 26000 - DNA, 20 bp, Artificial Sequence
  Description of Artificial Sequence: Synthetic oligonucleotide
  Target: SCN10A; (-) strand; PAM type: NRG; PAM sequence: TGG
gtgaatatagaggctattga

SEQ ID NO: 26001 - DNA, 20 bp, Artificial Sequence
  Description of Artificial Sequence: Synthetic oligonucleotide
  Target: SCN10A; (-) strand; PAM type: NRG; PAM sequence: AGG
tcatacattggtgaatatag

SEQ ID NO: 26002 - DNA, 20 bp, Artificial Sequence
  Description of Artificial Sequence: Synthetic oligonucleotide
  Target: SCN10A; (-) strand; PAM type: NRG; PAM sequence: GAG
atcatacattggtgaatata

SEQ ID NO: 26003 - DNA, 20 bp, Artificial Sequence
  Description of Artificial Sequence: Synthetic oligonucleotide
  Target: SCN10A; (-) strand; PAM type: NRG; PAM sequence: TAG
tgatcatacattggtgaata

SEQ ID NO: 26004 - DNA, 20 bp, Artificial Sequence
  Description of Artificial Sequence: Synthetic oligonucleotide
  Target: SCN10A; (-) strand; PAM type: NRG; PAM sequence: TGG
tttctcttatgatcatacat

SEQ ID NO: 26005 - DNA, 20 bp, Artificial Sequence
  Description of Artificial Sequence: Synthetic oligonucleotide
  Target: SCN10A; (-) strand; PAM type: NRG; PAM sequence: TGG
aactattgtataacaatact

SEQ ID NO: 26006 - DNA, 20 bp, Artificial Sequence
  Description of Artificial Sequence: Synthetic oligonucleotide
  Target: SCN10A; (-) strand; PAM type: NRG; PAM sequence: GGG
gtccccaaaactgttttagt

SEQ ID NO: 26007 - DNA, 20 bp, Artificial Sequence
  Description of Artificial Sequence: Synthetic oligonucleotide
  Target: SCN10A; (-) strand; PAM type: NRG; PAM sequence: TGG
tgtccccaaaactgttttag

SEQ ID NO: 26008 - DNA, 20 bp, Artificial Sequence
  Description of Artificial Sequence: Synthetic oligonucleotide
  Target: SCN10A; (-) strand; PAM type: NRG; PAM sequence: TAG
tggtgtccccaaaactgttt

SEQ ID NO: 26009 - DNA, 20 bp, Artificial Sequence
  Description of Artificial Sequence: Synthetic oligonucleotide
  Target: SCN10A; (-) strand; PAM type: NRG; PAM sequence: TGG
aactatgatcttggaacccc

SEQ ID NO: 26010 - DNA, 20 bp, Artificial Sequence
  Description of Artificial Sequence: Synthetic oligonucleotide
  Target: SCN10A; (-) strand; PAM type: NRG; PAM sequence: TGG
gtggtcctcaactatgatct

SEQ ID NO: 26011 - DNA, 20 bp, Artificial Sequence
  Description of Artificial Sequence: Synthetic oligonucleotide
  Target: SCN10A; (-) strand; PAM type: NRG; PAM sequence: TGG
gcaggatgaatttaagccag

SEQ ID NO: 26012 - DNA, 20 bp, Artificial Sequence
  Description of Artificial Sequence: Synthetic oligonucleotide
  Target: SCN10A; (-) strand; PAM type: NRG; PAM sequence: CAG
aaagcaggatgaatttaagc

SEQ ID NO: 26013 - DNA, 20 bp, Artificial Sequence
  Description of Artificial Sequence: Synthetic oligonucleotide
  Target: SCN10A; (-) strand; PAM type: NRG; PAM sequence: AAG
acagaaagcaggatgaattt

SEQ ID NO: 26014 - DNA, 20 bp, Artificial Sequence
  Description of Artificial Sequence: Synthetic oligonucleotide
  Target: SCN10A; (-) strand; PAM type: NRG; PAM sequence: AGG
tggcggtgaggacagaaagc

SEQ ID NO: 26015 - DNA, 20 bp, Artificial Sequence
  Description of Artificial Sequence: Synthetic oligonucleotide
  Target: SCN10A; (-) strand; PAM type: NRG; PAM sequence: CAG
atggcggtgaggacagaaag

SEQ ID NO: 26016 - DNA, 20 bp, Artificial Sequence
  Description of Artificial Sequence: Synthetic oligonucleotide
  Target: SCN10A; (-) strand; PAM type: NRG; PAM sequence: AAG
agcatggcggtgaggacaga

SEQ ID NO: 26017 - DNA, 20 bp, Artificial Sequence
  Description of Artificial Sequence: Synthetic oligonucleotide
  Target: SCN10A; (-) strand; PAM type: NRG; PAM sequence: CAG
gaggagcatggcggtgagga

SEQ ID NO: 26018 - DNA, 20 bp, Artificial Sequence
  Description of Artificial Sequence: Synthetic oligonucleotide
  Target: SCN10A; (-) strand; PAM type: NRG; PAM sequence: AGG
gggggaggagcatggcggtg

SEQ ID NO: 26019 - DNA, 20 bp, Artificial Sequence
  Description of Artificial Sequence: Synthetic oligonucleotide
  Target: SCN10A; (-) strand; PAM type: NRG; PAM sequence: GAG
tgggggaggagcatggcggt

SEQ ID NO: 26020 - DNA, 20 bp, Artificial Sequence
  Description of Artificial Sequence: Synthetic oligonucleotide
  Target: SCN10A; (-) strand; PAM type: NRG; PAM sequence: CGG
aggttgggggaggagcatgg

SEQ ID NO: 26021 - DNA, 20 bp, Artificial Sequence
  Description of Artificial Sequence: Synthetic oligonucleotide
  Target: SCN10A; (-) strand; PAM type: NRG; PAM sequence: TGG
ttgaggttgggggaggagca

SEQ ID NO: 26022 - DNA, 20 bp, Artificial Sequence
  Description of Artificial Sequence: Synthetic oligonucleotide
  Target: SCN10A; (-) strand; PAM type: NRG; PAM sequence: GAG
acatcttgaggttgggggag

SEQ ID NO: 26023 - DNA, 20 bp, Artificial Sequence
  Description of Artificial Sequence: Synthetic oligonucleotide
  Target: SCN10A; (-) strand; PAM type: NRG; PAM sequence: AGG
agacatcttgaggttggggg

SEQ ID NO: 26024 - DNA, 20 bp, Artificial Sequence
  Description of Artificial Sequence: Synthetic oligonucleotide
  Target: SCN10A; (-) strand; PAM type: NRG; PAM sequence: GAG
cagacatcttgaggttgggg

SEQ ID NO: 26025 - DNA, 20 bp, Artificial Sequence
  Description of Artificial Sequence: Synthetic oligonucleotide
  Target: SCN10A; (-) strand; PAM type: NRG; PAM sequence: GGG
agcagacatcttgaggttgg

SEQ ID NO: 26026 - DNA, 20 bp, Artificial Sequence
  Description of Artificial Sequence: Synthetic oligonucleotide
  Target: SCN10A; (-) strand; PAM type: NRG; PAM sequence: GGG
gagcagacatcttgaggttg

SEQ ID NO: 26027 - DNA, 20 bp, Artificial Sequence
  Description of Artificial Sequence: Synthetic oligonucleotide
  Target: SCN10A; (-) strand; PAM type: NRG; PAM sequence: GGG
agagcagacatcttgaggtt

SEQ ID NO: 26028 - DNA, 20 bp, Artificial Sequence
  Description of Artificial Sequence: Synthetic oligonucleotide
  Target: SCN10A; (-) strand; PAM type: NRG; PAM sequence: TGG
gagagcagacatcttgaggt

SEQ ID NO: 26029 - DNA, 20 bp, Artificial Sequence
  Description of Artificial Sequence: Synthetic oligonucleotide
  Target: SCN10A; (-) strand; PAM type: NRG; PAM sequence: AGG
ggtggagagcagacatcttg

SEQ ID NO: 26030 - DNA, 20 bp, Artificial Sequence
  Description of Artificial Sequence: Synthetic oligonucleotide
  Target: SCN10A; (-) strand; PAM type: NRG; PAM sequence: GAG
aggtggagagcagacatctt

SEQ ID NO: 26031 - DNA, 20 bp, Artificial Sequence
  Description of Artificial Sequence: Synthetic oligonucleotide
  Target: SCN10A; (-) strand; PAM type: NRG; PAM sequence: CAG
gtctctttgcaggtggagag

SEQ ID NO: 26032 - DNA, 20 bp, Artificial Sequence
  Description of Artificial Sequence: Synthetic oligonucleotide
  Target: SCN10A; (-) strand; PAM type: NRG; PAM sequence: GAG
tgggtctctttgcaggtgga

SEQ ID NO: 26033 - DNA, 20 bp, Artificial Sequence
  Description of Artificial Sequence: Synthetic oligonucleotide
  Target: SCN10A; (-) strand; PAM type: NRG; PAM sequence: GAG
gttgggtctctttgcaggtg

SEQ ID NO: 26034 - DNA, 20 bp, Artificial Sequence
  Description of Artificial Sequence: Synthetic oligonucleotide
  Target: SCN10A; (-) strand; PAM type: NRG; PAM sequence: TGG
gagttgggtctctttgcagg

SEQ ID NO: 26035 - DNA, 20 bp, Artificial Sequence
  Description of Artificial Sequence: Synthetic oligonucleotide
  Target: SCN10A; (-) strand; PAM type: NRG; PAM sequence: AGG
gaggagttgggtctctttgc

SEQ ID NO: 26036 - DNA, 20 bp, Artificial Sequence
  Description of Artificial Sequence: Synthetic oligonucleotide
  Target: SCN10A; (-) strand; PAM type: NRG; PAM sequence: CAG
agaggagttgggtctctttg

SEQ ID NO: 26037 - DNA, 20 bp, Artificial Sequence
  Description of Artificial Sequence: Synthetic oligonucleotide
  Target: SCN10A; (-) strand; PAM type: NRG; PAM sequence: GGG
ctggggcctccagaggagtt

SEQ ID NO: 26038 - DNA, 20 bp, Artificial Sequence
  Description of Artificial Sequence: Synthetic oligonucleotide
  Target: SCN10A; (-) strand; PAM type: NRG; PAM sequence: TGG
cctggggcctccagaggagt

SEQ ID NO: 26039 - DNA, 20 bp, Artificial Sequence
  Description of Artificial Sequence: Synthetic oligonucleotide
  Target: SCN10A; (-) strand; PAM type: NRG; PAM sequence: GAG
ctggcctggggcctccagag

SEQ ID NO: 26040 - DNA, 20 bp, Artificial Sequence
  Description of Artificial Sequence: Synthetic oligonucleotide
  Target: SCN10A; (-) strand; PAM type: NRG; PAM sequence: AGG
ctctggcctggggcctccag

SEQ ID NO: 26041 - DNA, 20 bp, Artificial Sequence
  Description of Artificial Sequence: Synthetic oligonucleotide
  Target: SCN10A; (-) strand; PAM type: NRG; PAM sequence: GAG
cctctggcctggggcctcca

SEQ ID NO: 26042 - DNA, 20 bp, Artificial Sequence
  Description of Artificial Sequence: Synthetic oligonucleotide
  Target: SCN10A; (-) strand; PAM type: NRG; PAM sequence: CAG
gacctctggcctggggcctc

SEQ ID NO: 26043 - DNA, 20 bp, Artificial Sequence
  Description of Artificial Sequence: Synthetic oligonucleotide
  Target: SCN10A; (-) strand; PAM type: NRG; PAM sequence: GGG
cttggatgacctctggcctg

SEQ ID NO: 26044 - DNA, 20 bp, Artificial Sequence
  Description of Artificial Sequence: Synthetic oligonucleotide
  Target: SCN10A; (-) strand; PAM type: NRG; PAM sequence: GGG
ccttggatgacctctggcct

SEQ ID NO: 26045 - DNA, 20 bp, Artificial Sequence
  Description of Artificial Sequence: Synthetic oligonucleotide
  Target: SCN10A; (-) strand; PAM type: NRG; PAM sequence: TGG
cccttggatgacctctggcc

SEQ ID NO: 26046 - DNA, 20 bp, Artificial Sequence
  Description of Artificial Sequence: Synthetic oligonucleotide
  Target: SCN10A; (-) strand; PAM type: NRG; PAM sequence: TGG
ctgttcccttggatgacctc

SEQ ID NO: 26047 - DNA, 20 bp, Artificial Sequence
  Description of Artificial Sequence: Synthetic oligonucleotide
  Target: SCN10A; (-) strand; PAM type: NRG; PAM sequence: TGG
gggaaagttggctgttccct

SEQ ID NO: 26048 - DNA, 20 bp, Artificial Sequence
  Description of Artificial Sequence: Synthetic oligonucleotide
  Target: SCN10A; (-) strand; PAM type: NRG; PAM sequence: TGG
gcagagctttcagggaaagt

SEQ ID NO: 26049 - DNA, 20 bp, Artificial Sequence
  Description of Artificial Sequence: Synthetic oligonucleotide
  Target: SCN10A; (-) strand; PAM type: NRG; PAM sequence: AAG
tgctgcagagctttcaggga

SEQ ID NO: 26050 - DNA, 20 bp, Artificial Sequence
  Description of Artificial Sequence: Synthetic oligonucleotide
  Target: SCN10A; (-) strand; PAM type: NRG; PAM sequence: GGG
taactgctgcagagctttca

SEQ ID NO: 26051 - DNA, 20 bp, Artificial Sequence
  Description of Artificial Sequence: Synthetic oligonucleotide
  Target: SCN10A; (-) strand; PAM type: NRG; PAM sequence: AGG
ataactgctgcagagctttc

SEQ ID NO: 26052 - DNA, 20 bp, Artificial Sequence
  Description of Artificial Sequence: Synthetic oligonucleotide
  Target: SCN10A; (-) strand; PAM type: NRG; PAM sequence: CAG
gataactgctgcagagcttt

SEQ ID NO: 26053 - DNA, 20 bp, Artificial Sequence
  Description of Artificial Sequence: Synthetic oligonucleotide
  Target: SCN10A; (-) strand; PAM type: NRG; PAM sequence: GAG
aaaagcagataactgctgca

SEQ ID NO: 26054 - DNA, 20 bp, Artificial Sequence
  Description of Artificial Sequence: Synthetic oligonucleotide
  Target: SCN10A; (-) strand; PAM type: NRG; PAM sequence: CAG
tcaaaagcagataactgctg

SEQ ID NO: 26055 - DNA, 20 bp, Artificial Sequence
  Description of Artificial Sequence: Synthetic oligonucleotide
  Target: SCN10A; (-) strand; PAM type: NRG; PAM sequence: CAG
taaacccacatcttcaaaag

SEQ ID NO: 26056 - DNA, 20 bp, Artificial Sequence
  Description of Artificial Sequence: Synthetic oligonucleotide
  Target: SCN10A; (-) strand; PAM type: NRG; PAM sequence: AAG
aactaaacccacatcttcaa

SEQ ID NO: 26057 - DNA, 20 bp, Artificial Sequence
  Description of Artificial Sequence: Synthetic oligonucleotide
  Target: SCN10A; (-) strand; PAM type: NRG; PAM sequence: TAG
aatttttatgacatttatga

SEQ ID NO: 26058 - DNA, 20 bp, Artificial Sequence
  Description of Artificial Sequence: Synthetic oligonucleotide
  Target: SCN10A; (-) strand; PAM type: NRG; PAM sequence: AAG
ggtgatgtggcagtctgcta

SEQ ID NO: 26059 - DNA, 20 bp, Artificial Sequence
  Description of Artificial Sequence: Synthetic oligonucleotide
  Target: SCN10A; (-) strand; PAM type: NRG; PAM sequence: CAG
cttggccctgggtgatgtgg

SEQ ID NO: 26060 - DNA, 20 bp, Artificial Sequence
  Description of Artificial Sequence: Synthetic oligonucleotide
  Target: SCN10A; (-) strand; PAM type: NRG; PAM sequence: TGG
ctccttggccctgggtgatg

SEQ ID NO: 26061 - DNA, 20 bp, Artificial Sequence
  Description of Artificial Sequence: Synthetic oligonucleotide
  Target: SCN10A; (-) strand; PAM type: NRG; PAM sequence: GGG
agaaagtcctccttggccct

SEQ ID NO: 26062 - DNA, 20 bp, Artificial Sequence
  Description of Artificial Sequence: Synthetic oligonucleotide
  Target: SCN10A; (-) strand; PAM type: NRG; PAM sequence: TGG
cagaaagtcctccttggccc

SEQ ID NO: 26063 - DNA, 20 bp, Artificial Sequence
  Description of Artificial Sequence: Synthetic oligonucleotide
  Target: SCN10A; (-) strand; PAM type: NRG; PAM sequence: TGG
ccagcccagaaagtcctcct

SEQ ID NO: 26064 - DNA, 20 bp, Artificial Sequence
  Description of Artificial Sequence: Synthetic oligonucleotide
  Target: SCN10A; (-) strand; PAM type: NRG; PAM sequence: AAG
tcggtcccacccagcccaga

SEQ ID NO: 26065 - DNA, 20 bp, Artificial Sequence
  Description of Artificial Sequence: Synthetic oligonucleotide
  Target: SCN10A; (-) strand; PAM type: NRG; PAM sequence: CAG
agtctcggtcccacccagcc

SEQ ID NO: 26066 - DNA, 20 bp, Artificial Sequence
  Description of Artificial Sequence: Synthetic oligonucleotide
  Target: SCN10A; (-) strand; PAM type: NRG; PAM sequence: CAG
gaggaagtctcggtcccacc

SEQ ID NO: 26067 - DNA, 20 bp, Artificial Sequence
  Description of Artificial Sequence: Synthetic oligonucleotide
  Target: SCN10A; (-) strand; PAM type: NRG; PAM sequence: CGG
agctcttggagaggaagtct

SEQ ID NO: 26068 - DNA, 20 bp, Artificial Sequence
  Description of Artificial Sequence: Synthetic oligonucleotide
  Target: SCN10A; (-) strand; PAM type: NRG; PAM sequence: AAG
gctctcagctcttggagagg

SEQ ID NO: 26069 - DNA, 20 bp, Artificial Sequence
  Description of Artificial Sequence: Synthetic oligonucleotide
  Target: SCN10A; (-) strand; PAM type: NRG; PAM sequence: AGG
tctgctctcagctcttggag

SEQ ID NO: 26070 - DNA, 20 bp, Artificial Sequence
  Description of Artificial Sequence: Synthetic oligonucleotide
  Target: SCN10A; (-) strand; PAM type: NRG; PAM sequence: GAG
gtctgctctcagctcttgga

SEQ ID NO: 26071 - DNA, 20 bp, Artificial Sequence
  Description of Artificial Sequence: Synthetic oligonucleotide
  Target: SCN10A; (-) strand; PAM type: NRG; PAM sequence: GAG
atgtctgctctcagctcttg

SEQ ID NO: 26072 - DNA, 20 bp, Artificial Sequence
  Description of Artificial Sequence: Synthetic oligonucleotide
  Target: SCN10A; (-) strand; PAM type: NRG; PAM sequence: TGG
gaatgtctgctctcagctct

SEQ ID NO: 26073 - DNA, 20 bp, Artificial Sequence
  Description of Artificial Sequence: Synthetic oligonucleotide
  Target: SCN10A; (-) strand; PAM type: NRG; PAM sequence: CAG
ctagtaggaatgtctgctct

SEQ ID NO: 26074 - DNA, 20 bp, Artificial Sequence
  Description of Artificial Sequence: Synthetic oligonucleotide
  Target: SCN10A; (-) strand; PAM type: NRG; PAM sequence: AGG
accgggtaagagctactagt

SEQ ID NO: 26075 - DNA, 20 bp, Artificial Sequence
  Description of Artificial Sequence: Synthetic oligonucleotide
  Target: SCN10A; (-) strand; PAM type: NRG; PAM sequence: TAG
caccgggtaagagctactag

SEQ ID NO: 26076 - DNA, 20 bp, Artificial Sequence
  Description of Artificial Sequence: Synthetic oligonucleotide
  Target: SCN10A; (-) strand; PAM type: NRG; PAM sequence: TAG
acacaccgggtaagagctac

SEQ ID NO: 26077 - DNA, 20 bp, Artificial Sequence
  Description of Artificial Sequence: Synthetic oligonucleotide
  Target: SCN10A; (-) strand; PAM type: NRG; PAM sequence: GAG
ctacagcacacaccgggtaa

SEQ ID NO: 26078 - DNA, 20 bp, Artificial Sequence
  Description of Artificial Sequence: Synthetic oligonucleotide
  Target: SCN10A; (-) strand; PAM type: NRG; PAM sequence: AAG
ttctacagcacacaccgggt

SEQ ID NO: 26079 - DNA, 20 bp, Artificial Sequence
  Description of Artificial Sequence: Synthetic oligonucleotide
  Target: SCN10A; (-) strand; PAM type: NRG; PAM sequence: GGG
tccgttctacagcacacacc

SEQ ID NO: 26080 - DNA, 20 bp, Artificial Sequence
  Description of Artificial Sequence: Synthetic oligonucleotide
  Target: SCN10A; (-) strand; PAM type: NRG; PAM sequence: CGG
atccgttctacagcacacac

SEQ ID NO: 26081 - DNA, 20 bp, Artificial Sequence
  Description of Artificial Sequence: Synthetic oligonucleotide
  Target: SCN10A; (-) strand; PAM type: NRG; PAM sequence: CAG
gaggatctagatccgttcta

SEQ ID NO: 26082 - DNA, 20 bp, Artificial Sequence
  Description of Artificial Sequence: Synthetic oligonucleotide
  Target: SCN10A; (-) strand; PAM type: NRG; PAM sequence: TAG
cggggagcccctggaggatc

SEQ ID NO: 26083 - DNA, 20 bp, Artificial Sequence
  Description of Artificial Sequence: Synthetic oligonucleotide
  Target: SCN10A; (-) strand; PAM type: NRG; PAM sequence: AGG
actgatcggggagcccctgg

SEQ ID NO: 26084 - DNA, 20 bp, Artificial Sequence
  Description of Artificial Sequence: Synthetic oligonucleotide
  Target: SCN10A; (-) strand; PAM type: NRG; PAM sequence: GAG
aactgatcggggagcccctg

SEQ ID NO: 26085 - DNA, 20 bp, Artificial Sequence
  Description of Artificial Sequence: Synthetic oligonucleotide
  Target: SCN10A; (-) strand; PAM type: NRG; PAM sequence: TGG
agaactgatcggggagcccc

SEQ ID NO: 26086 - DNA, 20 bp, Artificial Sequence
  Description of Artificial Sequence: Synthetic oligonucleotide
  Target: SCN10A; (-) strand; PAM type: NRG; PAM sequence: GAG
tcccagcagaactgatcggg

SEQ ID NO: 26087 - DNA, 20 bp, Artificial Sequence
  Description of Artificial Sequence: Synthetic oligonucleotide
  Target: SCN10A; (-) strand; PAM type: NRG; PAM sequence: GGG
gctcccagcagaactgatcg

SEQ ID NO: 26088 - DNA, 20 bp, Artificial Sequence
  Description of Artificial Sequence: Synthetic oligonucleotide
  Target: SCN10A; (-) strand; PAM type: NRG; PAM sequence: GGG
agctcccagcagaactgatc

SEQ ID NO: 26089 - DNA, 20 bp, Artificial Sequence
  Description of Artificial Sequence: Synthetic oligonucleotide
  Target: SCN10A; (-) strand; PAM type: NRG; PAM sequence: CGG
gagctcccagcagaactgat

SEQ ID NO: 26090 - DNA, 20 bp, Artificial Sequence
  Description of Artificial Sequence: Synthetic oligonucleotide
  Target: SCN10A; (-) strand; PAM type: NRG; PAM sequence: CAG
gttctatggtgagctcccag

SEQ ID NO: 26091 - DNA, 20 bp, Artificial Sequence
  Description of Artificial Sequence: Synthetic oligonucleotide
  Target: SCN10A; (-) strand; PAM type: NRG; PAM sequence: CAG
caagttctatggtgagctcc

SEQ ID NO: 26092 - DNA, 20 bp, Artificial Sequence
  Description of Artificial Sequence: Synthetic oligonucleotide
  Target: SCN10A; (-) strand; PAM type: NRG; PAM sequence: GAG
agctgcccaagttctatggt

SEQ ID NO: 26093 - DNA, 20 bp, Artificial Sequence
  Description of Artificial Sequence: Synthetic oligonucleotide
  Target: SCN10A; (-) strand; PAM type: NRG; PAM sequence: TGG
aaccagctgcccaagttcta

SEQ ID NO: 26094 - DNA, 20 bp, Artificial Sequence
  Description of Artificial Sequence: Synthetic oligonucleotide
  Target: SCN10A; (-) strand; PAM type: NRG; PAM sequence: AAG
aagcctgcaaccagctgccc

SEQ ID NO: 26095 - DNA, 20 bp, Artificial Sequence
  Description of Artificial Sequence: Synthetic oligonucleotide
  Target: SCN10A; (-) strand; PAM type: NRG; PAM sequence: CAG
tggacttgaaagcctgcaac

SEQ ID NO: 26096 - DNA, 20 bp, Artificial Sequence
  Description of Artificial Sequence: Synthetic oligonucleotide
  Target: SCN10A; (-) strand; PAM type: NRG; PAM sequence: AAG
tcggccccagctggacttga

SEQ ID NO: 26097 - DNA, 20 bp, Artificial Sequence
  Description of Artificial Sequence: Synthetic oligonucleotide
  Target: SCN10A; (-) strand; PAM type: NRG; PAM sequence: TGG
agagaagcctcggccccagc

SEQ ID NO: 26098 - DNA, 20 bp, Artificial Sequence
  Description of Artificial Sequence: Synthetic oligonucleotide
  Target: SCN10A; (-) strand; PAM type: NRG; PAM sequence: CAG
aagaagagaagcctcggccc

SEQ ID NO: 26099 - DNA, 20 bp, Artificial Sequence
  Description of Artificial Sequence: Synthetic oligonucleotide
  Target: SCN10A; (-) strand; PAM type: NRG; PAM sequence: CGG
aggaccaagaagagaagcct

SEQ ID NO: 26100 - DNA, 20 bp, Artificial Sequence
  Description of Artificial Sequence: Synthetic oligonucleotide
  Target: SCN10A; (-) strand; PAM type: NRG; PAM sequence: AAG
agcagaaggaccaagaagag

SEQ ID NO: 26101 - DNA, 20 bp, Artificial Sequence
  Description of Artificial Sequence: Synthetic oligonucleotide
  Target: SCN10A; (-) strand; PAM type: NRG; PAM sequence: GAG
gggagcagaaggaccaagaa

SEQ ID NO: 26102 - DNA, 20 bp, Artificial Sequence
  Description of Artificial Sequence: Synthetic oligonucleotide
  Target: SCN10A; (-) strand; PAM type: NRG; PAM sequence: AAG
tagggagcagaaggaccaag

SEQ ID NO: 26103 - DNA, 20 bp, Artificial Sequence
  Description of Artificial Sequence: Synthetic oligonucleotide
  Target: SCN10A; (-) strand; PAM type: NRG; PAM sequence: AAG
gcatagggagcagaaggacc

SEQ ID NO: 26104 - DNA, 20 bp, Artificial Sequence
  Description of Artificial Sequence: Synthetic oligonucleotide
  Target: SCN10A; (-) strand; PAM type: NRG; PAM sequence: AGG
agagaagcatagggagcaga

SEQ ID NO: 26105 - DNA, 20 bp, Artificial Sequence
  Description of Artificial Sequence: Synthetic oligonucleotide
  Target: SCN10A; (-) strand; PAM type: NRG; PAM sequence: AAG
gagagaagcatagggagcag

SEQ ID NO: 26106 - DNA, 20 bp, Artificial Sequence
  Description of Artificial Sequence: Synthetic oligonucleotide
  Target: SCN10A; (-) strand; PAM type: NRG; PAM sequence: CAG
ccagagagaagcatagggag

SEQ ID NO: 26107 - DNA, 20 bp, Artificial Sequence
  Description of Artificial Sequence: Synthetic oligonucleotide
  Target: SCN10A; (-) strand; PAM type: NRG; PAM sequence: GAG
aagccagagagaagcatagg

SEQ ID NO: 26108 - DNA, 20 bp, Artificial Sequence
  Description of Artificial Sequence: Synthetic oligonucleotide
  Target: SCN10A; (-) strand; PAM type: NRG; PAM sequence: GGG
gaaagccagagagaagcata

SEQ ID NO: 26109 - DNA, 20 bp, Artificial Sequence
  Description of Artificial Sequence: Synthetic oligonucleotide
  Target: SCN10A; (-) strand; PAM type: NRG; PAM sequence: AGG
agaaagccagagagaagcat

SEQ ID NO: 26110 - DNA, 20 bp, Artificial Sequence
  Description of Artificial Sequence: Synthetic oligonucleotide
  Target: SCN10A; (-) strand; PAM type: NRG; PAM sequence: TAG
aagaaagccagagagaagca

SEQ ID NO: 26111 - DNA, 20 bp, Artificial Sequence
  Description of Artificial Sequence: Synthetic oligonucleotide
  Target: SCN10A; (-) strand; PAM type: NRG; PAM sequence: AAG
gaacaaagaaagccagagag

SEQ ID NO: 26112 - DNA, 20 bp, Artificial Sequence
  Description of Artificial Sequence: Synthetic oligonucleotide
  Target: SCN10A; (-) strand; PAM type: NRG; PAM sequence: GAG
agggaacaaagaaagccaga

SEQ ID NO: 26113 - DNA, 20 bp, Artificial Sequence
  Description of Artificial Sequence: Synthetic oligonucleotide
  Target: SCN10A; (-) strand; PAM type: NRG; PAM sequence: GAG
gcagggaacaaagaaagcca

SEQ ID NO: 26114 - DNA, 20 bp, Artificial Sequence
  Description of Artificial Sequence: Synthetic oligonucleotide
  Target: SCN10A; (-) strand; PAM type: NRG; PAM sequence: CAG
aagcagggaacaaagaaagc

SEQ ID NO: 26115 - DNA, 20 bp, Artificial Sequence
  Description of Artificial Sequence: Synthetic oligonucleotide
  Target: SCN10A; (-) strand; PAM type: NRG; PAM sequence: AAG
tgccaagcagggaacaaaga

SEQ ID NO: 26116 - DNA, 20 bp, Artificial Sequence
  Description of Artificial Sequence: Synthetic oligonucleotide
  Target: SCN10A; (-) strand; PAM type: NRG; PAM sequence: AAG
ttgctgccaagcagggaaca

SEQ ID NO: 26117 - DNA, 20 bp, Artificial Sequence
  Description of Artificial Sequence: Synthetic oligonucleotide
  Target: SCN10A; (-) strand; PAM type: NRG; PAM sequence: GGG
aagcaaattgctgccaagca

SEQ ID NO: 26118 - DNA, 20 bp, Artificial Sequence
  Description of Artificial Sequence: Synthetic oligonucleotide
  Target: SCN10A; (-) strand; PAM type: NRG; PAM sequence: AGG
gaagcaaattgctgccaagc

SEQ ID NO: 26119 - DNA, 20 bp, Artificial Sequence
  Description of Artificial Sequence: Synthetic oligonucleotide
  Target: SCN10A; (-) strand; PAM type: NRG; PAM sequence: CAG
agaagcaaattgctgccaag

SEQ ID NO: 26120 - DNA, 20 bp, Artificial Sequence
  Description of Artificial Sequence: Synthetic oligonucleotide
  Target: SCN10A; (-) strand; PAM type: NRG; PAM sequence: AAG
tagagaagcaaattgctgcc

SEQ ID NO: 26121 - DNA, 20 bp, Artificial Sequence
  Description of Artificial Sequence: Synthetic oligonucleotide
  Target: SCN10A; (-) strand; PAM type: NRG; PAM sequence: AAG
agtcactggtggagatagag

SEQ ID NO: 26122 - DNA, 20 bp, Artificial Sequence
  Description of Artificial Sequence: Synthetic oligonucleotide
  Target: SCN10A; (-) strand; PAM type: NRG; PAM sequence: GAG
cggagtcactggtggagata

SEQ ID NO: 26123 - DNA, 20 bp, Artificial Sequence
  Description of Artificial Sequence: Synthetic oligonucleotide
  Target: SCN10A; (-) strand; PAM type: NRG; PAM sequence: TAG
tccggagtcactggtggaga

SEQ ID NO: 26124 - DNA, 20 bp, Artificial Sequence
  Description of Artificial Sequence: Synthetic oligonucleotide
  Target: SCN10A; (-) strand; PAM type: NRG; PAM sequence: GAG
ttactccggagtcactggtg

SEQ ID NO: 26125 - DNA, 20 bp, Artificial Sequence
  Description of Artificial Sequence: Synthetic oligonucleotide
  Target: SCN10A; (-) strand; PAM type: NRG; PAM sequence: TGG
ctttactccggagtcactgg

SEQ ID NO: 26126 - DNA, 20 bp, Artificial Sequence
  Description of Artificial Sequence: Synthetic oligonucleotide
  Target: SCN10A; (-) strand; PAM type: NRG; PAM sequence: TGG
tcgctttactccggagtcac

SEQ ID NO: 26127 - DNA, 20 bp, Artificial Sequence
  Description of Artificial Sequence: Synthetic oligonucleotide
  Target: SCN10A; (-) strand; PAM type: NRG; PAM sequence: GAG
acttccgtcgctttactccg

SEQ ID NO: 26128 - DNA, 20 bp, Artificial Sequence
  Description of Artificial Sequence: Synthetic oligonucleotide
  Target: SCN10A; (-) strand; PAM type: NRG; PAM sequence: CGG
caacttccgtcgctttactc

SEQ ID NO: 26129 - DNA, 20 bp, Artificial Sequence
  Description of Artificial Sequence: Synthetic oligonucleotide
  Target: SCN10A; (-) strand; PAM type: NRG; PAM sequence: TGG
gagaagatggaattccccat

SEQ ID NO: 26130 - DNA, 20 bp, Artificial Sequence
  Description of Artificial Sequence: Synthetic oligonucleotide
  Target: SCN10A; (-) strand; PAM type: NRG; PAM sequence: TGG
cctgaagaagaatgagaaga

SEQ ID NO: 26131 - DNA, 20 bp, Artificial Sequence
  Description of Artificial Sequence: Synthetic oligonucleotide
  Target: SCN10A; (-) strand; PAM type: NRG; PAM sequence: AAG
acttcctgaagaagaatgag

SEQ ID NO: 26132 - DNA, 20 bp, Artificial Sequence
  Description of Artificial Sequence: Synthetic oligonucleotide
  Target: SCN10A; (-) strand; PAM type: NRG; PAM sequence: GAG
aatacttcctgaagaagaat

SEQ ID NO: 26133 - DNA, 20 bp, Artificial Sequence
  Description of Artificial Sequence: Synthetic oligonucleotide
  Target: SCN10A; (-) strand; PAM type: NRG; PAM sequence: AAG
agtataaatacttcctgaag

SEQ ID NO: 26134 - DNA, 20 bp, Artificial Sequence
  Description of Artificial Sequence: Synthetic oligonucleotide
  Target: SCN10A; (-) strand; PAM type: NRG; PAM sequence: AAG
aagagtataaatacttcctg

SEQ ID NO: 26135 - DNA, 20 bp, Artificial Sequence
  Description of Artificial Sequence: Synthetic oligonucleotide
  Target: SCN10A; (-) strand; PAM type: NRG; PAM sequence: GAG
ggttatgtccactcttataa

SEQ ID NO: 26136 - DNA, 20 bp, Artificial Sequence
  Description of Artificial Sequence: Synthetic oligonucleotide
  Target: SCN10A; (-) strand; PAM type: NRG; PAM sequence: AAG
gtggttatgtccactcttat

SEQ ID NO: 26137 - DNA, 20 bp, Artificial Sequence
  Description of Artificial Sequence: Synthetic oligonucleotide
  Target: SCN10A; (-) strand; PAM type: NRG; PAM sequence: TGG
ggcaagctgtcacctctctg

SEQ ID NO: 26138 - DNA, 20 bp, Artificial Sequence
  Description of Artificial Sequence: Synthetic oligonucleotide
  Target: SCN10A; (-) strand; PAM type: NRG; PAM sequence: AAG
gagggacagggccagtgggc

SEQ ID NO: 26139 - DNA, 20 bp, Artificial Sequence
  Description of Artificial Sequence: Synthetic oligonucleotide
  Target: SCN10A; (-) strand; PAM type: NRG; PAM sequence: GGG
atgagagggacagggccagt

SEQ ID NO: 26140 - DNA, 20 bp, Artificial Sequence
  Description of Artificial Sequence: Synthetic oligonucleotide
  Target: SCN10A; (-) strand; PAM type: NRG; PAM sequence: TGG
gatgagagggacagggccag

SEQ ID NO: 26141 - DNA, 20 bp, Artificial Sequence
  Description of Artificial Sequence: Synthetic oligonucleotide
  Target: SCN10A; (-) strand; PAM type: NRG; PAM sequence: CAG
acagatgagagggacagggc

SEQ ID NO: 26142 - DNA, 20 bp, Artificial Sequence
  Description of Artificial Sequence: Synthetic oligonucleotide
  Target: SCN10A; (-) strand; PAM type: NRG; PAM sequence: GGG
tgggacagatgagagggaca

SEQ ID NO: 26143 - DNA, 20 bp, Artificial Sequence
  Description of Artificial Sequence: Synthetic oligonucleotide
  Target: SCN10A; (-) strand; PAM type: NRG; PAM sequence: AGG
atgggacagatgagagggac

SEQ ID NO: 26144 - DNA, 20 bp, Artificial Sequence
  Description of Artificial Sequence: Synthetic oligonucleotide
  Target: SCN10A; (-) strand; PAM type: NRG; PAM sequence: CAG
gatgggacagatgagaggga

SEQ ID NO: 26145 - DNA, 20 bp, Artificial Sequence
  Description of Artificial Sequence: Synthetic oligonucleotide
  Target: SCN10A; (-) strand; PAM type: NRG; PAM sequence: GGG
tcaagatgggacagatgaga

SEQ ID NO: 26146 - DNA, 20 bp, Artificial Sequence
  Description of Artificial Sequence: Synthetic oligonucleotide
  Target: SCN10A; (-) strand; PAM type: NRG; PAM sequence: AGG
atcaagatgggacagatgag

SEQ ID NO: 26147 - DNA, 20 bp, Artificial Sequence
  Description of Artificial Sequence: Synthetic oligonucleotide
  Target: SCN10A; (-) strand; PAM type: NRG; PAM sequence: GAG
aatcaagatgggacagatga

SEQ ID NO: 26148 - DNA, 20 bp, Artificial Sequence
  Description of Artificial Sequence: Synthetic oligonucleotide
  Target: SCN10A; (-) strand; PAM type: NRG; PAM sequence: GAG
acaatcaagatgggacagat

SEQ ID NO: 26149 - DNA, 20 bp, Artificial Sequence
  Description of Artificial Sequence: Synthetic oligonucleotide
  Target: SCN10A; (-) strand; PAM type: NRG; PAM sequence: CAG
ttctgacaatcaagatggga

SEQ ID NO: 26150 - DNA, 20 bp, Artificial Sequence
  Description of Artificial Sequence: Synthetic oligonucleotide
  Target: SCN10A; (-) strand; PAM type: NRG; PAM sequence: GGG
gctgttctgacaatcaagat

SEQ ID NO: 26151 - DNA, 20 bp, Artificial Sequence
  Description of Artificial Sequence: Synthetic oligonucleotide
  Target: SCN10A; (-) strand; PAM type: NRG; PAM sequence: TGG
ggctgttctgacaatcaaga

SEQ ID NO: 26152 - DNA, 20 bp, Artificial Sequence
  Description of Artificial Sequence: Synthetic oligonucleotide
  Target: SCN10A; (-) strand; PAM type: NRG; PAM sequence: AAG
gaagggctgttctgacaatc

SEQ ID NO: 26153 - DNA, 20 bp, Artificial Sequence
  Description of Artificial Sequence: Synthetic oligonucleotide
  Target: SCN10A; (-) strand; PAM type: NRG; PAM sequence: GGG
cagatatgagggtgggagaa

SEQ ID NO: 26154 - DNA, 20 bp, Artificial Sequence
  Description of Artificial Sequence: Synthetic oligonucleotide
  Target: SCN10A; (-) strand; PAM type: NRG; PAM sequence: AGG
ccagatatgagggtgggaga

SEQ ID NO: 26155 - DNA, 20 bp, Artificial Sequence
  Description of Artificial Sequence: Synthetic oligonucleotide
  Target: SCN10A; (-) strand; PAM type: NRG; PAM sequence: AAG
gccagatatgagggtgggag

SEQ ID NO: 26156 - DNA, 20 bp, Artificial Sequence
  Description of Artificial Sequence: Synthetic oligonucleotide
  Target: SCN10A; (-) strand; PAM type: NRG; PAM sequence: GAG
ggggccagatatgagggtgg

SEQ ID NO: 26157 - DNA, 20 bp, Artificial Sequence
  Description of Artificial Sequence: Synthetic oligonucleotide
  Target: SCN10A; (-) strand; PAM type: NRG; PAM sequence: GGG
gaggggccagatatgagggt

SEQ ID NO: 26158 - DNA, 20 bp, Artificial Sequence
  Description of Artificial Sequence: Synthetic oligonucleotide
  Target: SCN10A; (-) strand; PAM type: NRG; PAM sequence: TGG
ggaggggccagatatgaggg

SEQ ID NO: 26159 - DNA, 20 bp, Artificial Sequence
  Description of Artificial Sequence: Synthetic oligonucleotide
  Target: SCN10A; (-) strand; PAM type: NRG; PAM sequence: GGG
cagggaggggccagatatga

SEQ ID NO: 26160 - DNA, 20 bp, Artificial Sequence
  Description of Artificial Sequence: Synthetic oligonucleotide
  Target: SCN10A; (-) strand; PAM type: NRG; PAM sequence: AGG
tcagggaggggccagatatg

SEQ ID NO: 26161 - DNA, 20 bp, Artificial Sequence
  Description of Artificial Sequence: Synthetic oligonucleotide
  Target: SCN10A; (-) strand; PAM type: NRG; PAM sequence: GAG
ttcagggaggggccagatat

SEQ ID NO: 26162 - DNA, 20 bp, Artificial Sequence
  Description of Artificial Sequence: Synthetic oligonucleotide
  Target: SCN10A; (-) strand; PAM type: NRG; PAM sequence: CAG
gtgtgagttcagggaggggc

SEQ ID NO: 26163 - DNA, 20 bp, Artificial Sequence
  Description of Artificial Sequence: Synthetic oligonucleotide
  Target: SCN10A; (-) strand; PAM type: NRG; PAM sequence: GGG
ccaagtgtgagttcagggag

SEQ ID NO: 26164 - DNA, 20 bp, Artificial Sequence
  Description of Artificial Sequence: Synthetic oligonucleotide
  Target: SCN10A; (-) strand; PAM type: NRG; PAM sequence: GGG
gccaagtgtgagttcaggga

SEQ ID NO: 26165 - DNA, 20 bp, Artificial Sequence
  Description of Artificial Sequence: Synthetic oligonucleotide
  Target: SCN10A; (-) strand; PAM type: NRG; PAM sequence: AGG
agccaagtgtgagttcaggg

SEQ ID NO: 26166 - DNA, 20 bp, Artificial Sequence
  Description of Artificial Sequence: Synthetic oligonucleotide
  Target: SCN10A; (-) strand; PAM type: NRG; PAM sequence: GAG
gagccaagtgtgagttcagg

SEQ ID NO: 26167 - DNA, 20 bp, Artificial Sequence
  Description of Artificial Sequence: Synthetic oligonucleotide
  Target: SCN10A; (-) strand; PAM type: NRG; PAM sequence: GGG
aggagccaagtgtgagttca

SEQ ID NO: 26168 - DNA, 20 bp, Artificial Sequence
  Description of Artificial Sequence: Synthetic oligonucleotide
  Target: SCN10A; (-) strand; PAM type: NRG; PAM sequence: AGG
gaggagccaagtgtgagttc

SEQ ID NO: 26169 - DNA, 20 bp, Artificial Sequence
  Description of Artificial Sequence: Synthetic oligonucleotide
  Target: SCN10A; (-) strand; PAM type: NRG; PAM sequence: CAG
ggaggagccaagtgtgagtt

SEQ ID NO: 26170 - DNA, 20 bp, Artificial Sequence
  Description of Artificial Sequence: Synthetic oligonucleotide
  Target: SCN10A; (-) strand; PAM type: NRG; PAM sequence: GAG
tcctgggaggagccaagtgt

SEQ ID NO: 26171 - DNA, 20 bp, Artificial Sequence
  Description of Artificial Sequence: Synthetic oligonucleotide
  Target: SCN10A; (-) strand; PAM type: NRG; PAM sequence: AAG
atgggttcctgggaggagcc

SEQ ID NO: 26172 - DNA, 20 bp, Artificial Sequence
  Description of Artificial Sequence: Synthetic oligonucleotide
  Target: SCN10A; (-) strand; PAM type: NRG; PAM sequence: GAG
ggggaatgggttcctgggag

SEQ ID NO: 26173 - DNA, 20 bp, Artificial Sequence
  Description of Artificial Sequence: Synthetic oligonucleotide
  Target: SCN10A; (-) strand; PAM type: NRG; PAM sequence: AGG
caggggaatgggttcctggg

SEQ ID NO: 26174 - DNA, 20 bp, Artificial Sequence
  Description of Artificial Sequence: Synthetic oligonucleotide
  Target: SCN10A; (-) strand; PAM type: NRG; PAM sequence: GAG
gcaggggaatgggttcctgg

SEQ ID NO: 26175 - DNA, 20 bp, Artificial Sequence
  Description of Artificial Sequence: Synthetic oligonucleotide
  Target: SCN10A; (-) strand; PAM type: NRG; PAM sequence: GGG
ttgcaggggaatgggttcct

SEQ ID NO: 26176 - DNA, 20 bp, Artificial Sequence
  Description of Artificial Sequence: Synthetic oligonucleotide
  Target: SCN10A; (-) strand; PAM type: NRG; PAM sequence: TGG
cttgcaggggaatgggttcc

SEQ ID NO: 26177 - DNA, 20 bp, Artificial Sequence
  Description of Artificial Sequence: Synthetic oligonucleotide
  Target: SCN10A; (-) strand; PAM type: NRG; PAM sequence: GGG
tgaatgccttgcaggggaat

SEQ ID NO: 26178 - DNA, 20 bp, Artificial Sequence
  Description of Artificial Sequence: Synthetic oligonucleotide
  Target: SCN10A; (-) strand; PAM type: NRG; PAM sequence: TGG
ctgaatgccttgcaggggaa

SEQ ID NO: 26179 - DNA, 20 bp, Artificial Sequence
  Description of Artificial Sequence: Synthetic oligonucleotide
  Target: SCN10A; (-) strand; PAM type: NRG; PAM sequence: GGG
ctcccctgaatgccttgcag

SEQ ID NO: 26180 - DNA, 20 bp, Artificial Sequence
  Description of Artificial Sequence: Synthetic oligonucleotide
  Target: SCN10A; (-) strand; PAM type: NRG; PAM sequence: GGG
cctcccctgaatgccttgca

SEQ ID NO: 26181 - DNA, 20 bp, Artificial Sequence
  Description of Artificial Sequence: Synthetic oligonucleotide
  Target: SCN10A; (-) strand; PAM type: NRG; PAM sequence: AGG
gcctcccctgaatgccttgc

SEQ ID NO: 26182 - DNA, 20 bp, Artificial Sequence
  Description of Artificial Sequence: Synthetic oligonucleotide
  Target: SCN10A; (-) strand; PAM type: NRG; PAM sequence: CAG
agcctcccctgaatgccttg

SEQ ID NO: 26183 - DNA, 20 bp, Artificial Sequence
  Description of Artificial Sequence: Synthetic oligonucleotide
  Target: SCN10A; (-) strand; PAM type: NRG; PAM sequence: CAG
ctggaggagggttgaataaa

SEQ ID NO: 26184 - DNA, 20 bp, Artificial Sequence
  Description of Artificial Sequence: Synthetic oligonucleotide
  Target: SCN10A; (-) strand; PAM type: NRG; PAM sequence: GGG
accctgaggcacctggagga

SEQ ID NO: 26185 - DNA, 20 bp, Artificial Sequence
  Description of Artificial Sequence: Synthetic oligonucleotide
  Target: SCN10A; (-) strand; PAM type: NRG; PAM sequence: AGG
aaccctgaggcacctggagg

SEQ ID NO: 26186 - DNA, 20 bp, Artificial Sequence
  Description of Artificial Sequence: Synthetic oligonucleotide
  Target: SCN10A; (-) strand; PAM type: NRG; PAM sequence: GAG
taaccctgaggcacctggag

SEQ ID NO: 26187 - DNA, 20 bp, Artificial Sequence
  Description of Artificial Sequence: Synthetic oligonucleotide
  Target: SCN10A; (-) strand; PAM type: NRG; PAM sequence: AGG
cataaccctgaggcacctgg

SEQ ID NO: 26188 - DNA, 20 bp, Artificial Sequence
  Description of Artificial Sequence: Synthetic oligonucleotide
  Target: SCN10A; (-) strand; PAM type: NRG; PAM sequence: GAG
acataaccctgaggcacctg

SEQ ID NO: 26189 - DNA, 20 bp, Artificial Sequence
  Description of Artificial Sequence: Synthetic oligonucleotide
  Target: SCN10A; (-) strand; PAM type: NRG; PAM sequence: TGG
agacataaccctgaggcacc

SEQ ID NO: 26190 - DNA, 20 bp, Artificial Sequence
  Description of Artificial Sequence: Synthetic oligonucleotide
  Target: SCN10A; (-) strand; PAM type: NRG; PAM sequence: AGG
ggagcaaagacataaccctg

SEQ ID NO: 26191 - DNA, 20 bp, Artificial Sequence
  Description of Artificial Sequence: Synthetic oligonucleotide
  Target: SCN10A; (-) strand; PAM type: NRG; PAM sequence: GAG
gggagcaaagacataaccct

SEQ ID NO: 26192 - DNA, 20 bp, Artificial Sequence
  Description of Artificial Sequence: Synthetic oligonucleotide
  Target: SCN10A; (-) strand; PAM type: NRG; PAM sequence: AAG
atagaagcacatggggagca

SEQ ID NO: 26193 - DNA, 20 bp, Artificial Sequence
  Description of Artificial Sequence: Synthetic oligonucleotide
  Target: SCN10A; (-) strand; PAM type: NRG; PAM sequence: GAG
atgacatagaagcacatggg

SEQ ID NO: 26194 - DNA, 20 bp, Artificial Sequence
  Description of Artificial Sequence: Synthetic oligonucleotide
  Target: SCN10A; (-) strand; PAM type: NRG; PAM sequence: GGG
caatgacatagaagcacatg

SEQ ID NO: 26195 - DNA, 20 bp, Artificial Sequence
  Description of Artificial Sequence: Synthetic oligonucleotide
  Target: SCN10A; (-) strand; PAM type: NRG; PAM sequence: GGG
gcaatgacatagaagcacat

SEQ ID NO: 26196 - DNA, 20 bp, Artificial Sequence
  Description of Artificial Sequence: Synthetic oligonucleotide
  Target: SCN10A; (-) strand; PAM type: NRG; PAM sequence: TGG
agcaatgacatagaagcaca

SEQ ID NO: 26197 - DNA, 20 bp, Artificial Sequence
  Description of Artificial Sequence: Synthetic oligonucleotide
  Target: SCN10A; (-) strand; PAM type: NRG; PAM sequence: AAG
gtgaagaagcaatgacatag

SEQ ID NO: 26198 - DNA, 20 bp, Artificial Sequence
  Description of Artificial Sequence: Synthetic oligonucleotide
  Target: SCN10A; (-) strand; PAM type: NRG; PAM sequence: TAG
gtggtgaagaagcaatgaca

SEQ ID NO: 26199 - DNA, 20 bp, Artificial Sequence
  Description of Artificial Sequence: Synthetic oligonucleotide
  Target: SCN10A; (-) strand; PAM type: NRG; PAM sequence: AAG
gatggtacaaagtggtgaag

SEQ ID NO: 26200 - DNA, 20 bp, Artificial Sequence
  Description of Artificial Sequence: Synthetic oligonucleotide
  Target: SCN10A; (-) strand; PAM type: NRG; PAM sequence: AAG
taggatggtacaaagtggtg

SEQ ID NO: 26201 - DNA, 20 bp, Artificial Sequence
  Description of Artificial Sequence: Synthetic oligonucleotide
  Target: SCN10A; (-) strand; PAM type: NRG; PAM sequence: TGG
ggtggtaggatggtacaaag

SEQ ID NO: 26202 - DNA, 20 bp, Artificial Sequence
  Description of Artificial Sequence: Synthetic oligonucleotide
  Target: SCN10A; (-) strand; PAM type: NRG; PAM sequence: AAG
ggtggtggtaggatggtaca

SEQ ID NO: 26203 - DNA, 20 bp, Artificial Sequence
  Description of Artificial Sequence: Synthetic oligonucleotide
  Target: SCN10A; (-) strand; PAM type: NRG; PAM sequence: TGG
atctggtggtggtggtagga

SEQ ID NO: 26204 - DNA, 20 bp, Artificial Sequence
  Description of Artificial Sequence: Synthetic oligonucleotide
  Target: SCN10A; (-) strand; PAM type: NRG; PAM sequence: AGG
ctaaatctggtggtggtggt

SEQ ID NO: 26205 - DNA, 20 bp, Artificial Sequence
  Description of Artificial Sequence: Synthetic oligonucleotide
  Target: SCN10A; (-) strand; PAM type: NRG; PAM sequence: TAG
gctaaatctggtggtggtgg

SEQ ID NO: 26206 - DNA, 20 bp, Artificial Sequence
  Description of Artificial Sequence: Synthetic oligonucleotide
  Target: SCN10A; (-) strand; PAM type: NRG; PAM sequence: TGG
atggctaaatctggtggtgg

SEQ ID NO: 26207 - DNA, 20 bp, Artificial Sequence
  Description of Artificial Sequence: Synthetic oligonucleotide
  Target: SCN10A; (-) strand; PAM type: NRG; PAM sequence: TGG
agcatggctaaatctggtgg

SEQ ID NO: 26208 - DNA, 20 bp, Artificial Sequence
  Description of Artificial Sequence: Synthetic oligonucleotide
  Target: SCN10A; (-) strand; PAM type: NRG; PAM sequence: TGG
ggcagcatggctaaatctgg

SEQ ID NO: 26209 - DNA, 20 bp, Artificial Sequence
  Description of Artificial Sequence: Synthetic oligonucleotide
  Target: SCN10A; (-) strand; PAM type: NRG; PAM sequence: TGG
gagggcagcatggctaaatc

SEQ ID NO: 26210 - DNA, 20 bp, Artificial Sequence
  Description of Artificial Sequence: Synthetic oligonucleotide
  Target: SCN10A; (-) strand; PAM type: NRG; PAM sequence: TGG
aatgaggagagagggcagca

SEQ ID NO: 26211 - DNA, 20 bp, Artificial Sequence
  Description of Artificial Sequence: Synthetic oligonucleotide
  Target: SCN10A; (-) strand; PAM type: NRG; PAM sequence: CAG
ctggaaatgaggagagaggg

SEQ ID NO: 26212 - DNA, 20 bp, Artificial Sequence
  Description of Artificial Sequence: Synthetic oligonucleotide
  Target: SCN10A; (-) strand; PAM type: NRG; PAM sequence: GGG
gtcctggaaatgaggagaga

SEQ ID NO: 26213 - DNA, 20 bp, Artificial Sequence
  Description of Artificial Sequence: Synthetic oligonucleotide
  Target: SCN10A; (-) strand; PAM type: NRG; PAM sequence: AGG
ggtcctggaaatgaggagag

SEQ ID NO: 26214 - DNA, 20 bp, Artificial Sequence
  Description of Artificial Sequence: Synthetic oligonucleotide
  Target: SCN10A; (-) strand; PAM type: NRG; PAM sequence: GAG
tggtcctggaaatgaggaga

SEQ ID NO: 26215 - DNA, 20 bp, Artificial Sequence
  Description of Artificial Sequence: Synthetic oligonucleotide
  Target: SCN10A; (-) strand; PAM type: NRG; PAM sequence: GAG
agtggtcctggaaatgagga

SEQ ID NO: 26216 - DNA, 20 bp, Artificial Sequence
  Description of Artificial Sequence: Synthetic oligonucleotide
  Target: SCN10A; (-) strand; PAM type: NRG; PAM sequence: GAG
tcagtggtcctggaaatgag

SEQ ID NO: 26217 - DNA, 20 bp, Artificial Sequence
  Description of Artificial Sequence: Synthetic oligonucleotide
  Target: SCN10A; (-) strand; PAM type: NRG; PAM sequence: AGG
actcagtggtcctggaaatg

SEQ ID NO: 26218 - DNA, 20 bp, Artificial Sequence
  Description of Artificial Sequence: Synthetic oligonucleotide
  Target: SCN10A; (-) strand; PAM type: NRG; PAM sequence: GAG
aactcagtggtcctggaaat

SEQ ID NO: 26219 - DNA, 20 bp, Artificial Sequence
  Description of Artificial Sequence: Synthetic oligonucleotide
  Target: SCN10A; (-) strand; PAM type: NRG; PAM sequence: TGG
tgcctggaactcagtggtcc

SEQ ID NO: 26220 - DNA, 20 bp, Artificial Sequence
  Description of Artificial Sequence: Synthetic oligonucleotide
  Target: SCN10A; (-) strand; PAM type: NRG; PAM sequence: TGG
ggagagtgcctggaactcag

SEQ ID NO: 26221 - DNA, 20 bp, Artificial Sequence
  Description of Artificial Sequence: Synthetic oligonucleotide
  Target: SCN10A; (-) strand; PAM type: NRG; PAM sequence: CAG
atgggagagtgcctggaact

SEQ ID NO: 26222 - DNA, 20 bp, Artificial Sequence
  Description of Artificial Sequence: Synthetic oligonucleotide
  Target: SCN10A; (-) strand; PAM type: NRG; PAM sequence: TGG
gatgaatatgggagagtgcc

SEQ ID NO: 26223 - DNA, 20 bp, Artificial Sequence
  Description of Artificial Sequence: Synthetic oligonucleotide
  Target: SCN10A; (-) strand; PAM type: NRG; PAM sequence: GAG
agtctttgatgaatatggga

SEQ ID NO: 26224 - DNA, 20 bp, Artificial Sequence
  Description of Artificial Sequence: Synthetic oligonucleotide
  Target: SCN10A; (-) strand; PAM type: NRG; PAM sequence: GAG
aaagtctttgatgaatatgg

SEQ ID NO: 26225 - DNA, 20 bp, Artificial Sequence
  Description of Artificial Sequence: Synthetic oligonucleotide
  Target: SCN10A; (-) strand; PAM type: NRG; PAM sequence: GGG
ccaaagtctttgatgaatat

SEQ ID NO: 26226 - DNA, 20 bp, Artificial Sequence
  Description of Artificial Sequence: Synthetic oligonucleotide
  Target: SCN10A; (-) strand; PAM type: NRG; PAM sequence: TGG
accaaagtctttgatgaata

SEQ ID NO: 26227 - DNA, 20 bp, Artificial Sequence
  Description of Artificial Sequence: Synthetic oligonucleotide
  Target: SCN10A; (-) strand; PAM type: NRG; PAM sequence: AAG
ataaagtagactataaacca

SEQ ID NO: 26228 - DNA, 20 bp, Artificial Sequence
  Description of Artificial Sequence: Synthetic oligonucleotide
  Target: SCN10A; (-) strand; PAM type: NRG; PAM sequence: TAG
gcatgagacttaagataaag

SEQ ID NO: 26229 - DNA, 20 bp, Artificial Sequence
  Description of Artificial Sequence: Synthetic oligonucleotide
  Target: SCN10A; (-) strand; PAM type: NRG; PAM sequence: AAG
gtagcatgagacttaagata

SEQ ID NO: 26230 - DNA, 20 bp, Artificial Sequence
  Description of Artificial Sequence: Synthetic oligonucleotide
  Target: SCN10A; (-) strand; PAM type: NRG; PAM sequence: AAG
aagaaagtagcatgagactt

SEQ ID NO: 26231 - DNA, 20 bp, Artificial Sequence
  Description of Artificial Sequence: Synthetic oligonucleotide
  Target: SCN10A; (-) strand; PAM type: NRG; PAM sequence: GAG
ttgtgataagaaagtagcat

SEQ ID NO: 26232 - DNA, 20 bp, Artificial Sequence
  Description of Artificial Sequence: Synthetic oligonucleotide
  Target: SCN10A; (-) strand; PAM type: NRG; PAM sequence: TAG
aaaagattgtgataagaaag

SEQ ID NO: 26233 - DNA, 20 bp, Artificial Sequence
  Description of Artificial Sequence: Synthetic oligonucleotide
  Target: SCN10A; (-) strand; PAM type: NRG; PAM sequence: AAG
aataaaagattgtgataaga

SEQ ID NO: 26234 - DNA, 20 bp, Artificial Sequence
  Description of Artificial Sequence: Synthetic oligonucleotide
  Target: SCN10A; (-) strand; PAM type: NRG; PAM sequence: AAG
aataaataaaagattgtgat

SEQ ID NO: 26235 - DNA, 20 bp, Artificial Sequence
  Description of Artificial Sequence: Synthetic oligonucleotide
  Target: SCN10A; (-) strand; PAM type: NRG; PAM sequence: AAG
ttgacaatgtcaataaataa

SEQ ID NO: 26236 - DNA, 20 bp, Artificial Sequence
  Description of Artificial Sequence: Synthetic oligonucleotide
  Target: SCN10A; (-) strand; PAM type: NRG; PAM sequence: GAG
aaatgaaattcaaacaggtg

SEQ ID NO: 26237 - DNA, 20 bp, Artificial Sequence
  Description of Artificial Sequence: Synthetic oligonucleotide
  Target: SCN10A; (-) strand; PAM type: NRG; PAM sequence: TGG
ccaaatgaaattcaaacagg

SEQ ID NO: 26238 - DNA, 20 bp, Artificial Sequence
  Description of Artificial Sequence: Synthetic oligonucleotide
  Target: SCN10A; (-) strand; PAM type: NRG; PAM sequence: AGG
ggtccaaatgaaattcaaac

SEQ ID NO: 26239 - DNA, 20 bp, Artificial Sequence
  Description of Artificial Sequence: Synthetic oligonucleotide
  Target: SCN10A; (-) strand; PAM type: NRG; PAM sequence: CAG
aggtccaaatgaaattcaaa

SEQ ID NO: 26240 - DNA, 20 bp, Artificial Sequence
  Description of Artificial Sequence: Synthetic oligonucleotide
  Target: SCN10A; (-) strand; PAM type: NRG; PAM sequence: AGG
ggagttctccagtaacttgg

SEQ ID NO: 26241 - DNA, 20 bp, Artificial Sequence
  Description of Artificial Sequence: Synthetic oligonucleotide
  Target: SCN10A; (-) strand; PAM type: NRG; PAM sequence: GAG
tggagttctccagtaacttg

SEQ ID NO: 26242 - DNA, 20 bp, Artificial Sequence
  Description of Artificial Sequence: Synthetic oligonucleotide
  Target: SCN10A; (-) strand; PAM type: NRG; PAM sequence: TGG
tctggagttctccagtaact

SEQ ID NO: 26243 - DNA, 20 bp, Artificial Sequence
  Description of Artificial Sequence: Synthetic oligonucleotide
  Target: SCN10A; (-) strand; PAM type: NRG; PAM sequence: CAG
tccaataatctggagttctc

SEQ ID NO: 26244 - DNA, 20 bp, Artificial Sequence
  Description of Artificial Sequence: Synthetic oligonucleotide
  Target: SCN10A; (-) strand; PAM type: NRG; PAM sequence: GAG
tgaaattctccaataatctg

SEQ ID NO: 26245 - DNA, 20 bp, Artificial Sequence
  Description of Artificial Sequence: Synthetic oligonucleotide
  Target: SCN10A; (-) strand; PAM type: NRG; PAM sequence: TGG
aatgaaattctccaataatc

SEQ ID NO: 26246 - DNA, 20 bp, Artificial Sequence
  Description of Artificial Sequence: Synthetic oligonucleotide
  Target: SCN10A; (-) strand; PAM type: NRG; PAM sequence: AGG
ggaggtcccagagaaattgg

SEQ ID NO: 26247 - DNA, 20 bp, Artificial Sequence
  Description of Artificial Sequence: Synthetic oligonucleotide
  Target: SCN10A; (-) strand; PAM type: NRG; PAM sequence: GAG
tggaggtcccagagaaattg

SEQ ID NO: 26248 - DNA, 20 bp, Artificial Sequence
  Description of Artificial Sequence: Synthetic oligonucleotide
  Target: SCN10A; (-) strand; PAM type: NRG; PAM sequence: TGG
cctggaggtcccagagaaat

SEQ ID NO: 26249 - DNA, 20 bp, Artificial Sequence
  Description of Artificial Sequence: Synthetic oligonucleotide
  Target: SCN10A; (-) strand; PAM type: NRG; PAM sequence: GAG
gactgaacctggaggtccca

SEQ ID NO: 26250 - DNA, 20 bp, Artificial Sequence
  Description of Artificial Sequence: Synthetic oligonucleotide
  Target: SCN10A; (-) strand; PAM type: NRG; PAM sequence: CAG
cagactgaacctggaggtcc

SEQ ID NO: 26251 - DNA, 20 bp, Artificial Sequence
  Description of Artificial Sequence: Synthetic oligonucleotide
  Target: SCN10A; (-) strand; PAM type: NRG; PAM sequence: AGG
cagccacagactgaacctgg

SEQ ID NO: 26252 - DNA, 20 bp, Artificial Sequence
  Description of Artificial Sequence: Synthetic oligonucleotide
  Target: SCN10A; (-) strand; PAM type: NRG; PAM sequence: GAG
tcagccacagactgaacctg

SEQ ID NO: 26253 - DNA, 20 bp, Artificial Sequence
  Description of Artificial Sequence: Synthetic oligonucleotide
  Target: SCN10A; (-) strand; PAM type: NRG; PAM sequence: TGG
gttcagccacagactgaacc

SEQ ID NO: 26254 - DNA, 20 bp, Artificial Sequence
  Description of Artificial Sequence: Synthetic oligonucleotide
  Target: SCN10A; (-) strand; PAM type: NRG; PAM sequence: CAG
tggggaaaagtgttcagcca

SEQ ID NO: 26255 - DNA, 20 bp, Artificial Sequence
  Description of Artificial Sequence: Synthetic oligonucleotide
  Target: SCN10A; (-) strand; PAM type: NRG; PAM sequence: CAG
tggttatggggaaaagtgtt

SEQ ID NO: 26256 - DNA, 20 bp, Artificial Sequence
  Description of Artificial Sequence: Synthetic oligonucleotide
  Target: SCN10A; (-) strand; PAM type: NRG; PAM sequence: AAG
tctaatctggttatggggaa

SEQ ID NO: 26257 - DNA, 20 bp, Artificial Sequence
  Description of Artificial Sequence: Synthetic oligonucleotide
  Target: SCN10A; (-) strand; PAM type: NRG; PAM sequence: GGG
acaggtctaatctggttatg

SEQ ID NO: 26258 - DNA, 20 bp, Artificial Sequence
  Description of Artificial Sequence: Synthetic oligonucleotide
  Target: SCN10A; (-) strand; PAM type: NRG; PAM sequence: GGG
cacaggtctaatctggttat

SEQ ID NO: 26259 - DNA, 20 bp, Artificial Sequence
  Description of Artificial Sequence: Synthetic oligonucleotide
  Target: SCN10A; (-) strand; PAM type: NRG; PAM sequence: TGG
ccacaggtctaatctggtta

SEQ ID NO: 26260 - DNA, 20 bp, Artificial Sequence
  Description of Artificial Sequence: Synthetic oligonucleotide
  Target: SCN10A; (-) strand; PAM type: NRG; PAM sequence: TGG
tgtggaccacaggtctaatc

SEQ ID NO: 26261 - DNA, 20 bp, Artificial Sequence
  Description of Artificial Sequence: Synthetic oligonucleotide
  Target: SCN10A; (-) strand; PAM type: NRG; PAM sequence: AGG
gtggcaaaattgtggaccac

SEQ ID NO: 26262 - DNA, 20 bp, Artificial Sequence
  Description of Artificial Sequence: Synthetic oligonucleotide
  Target: SCN10A; (-) strand; PAM type: NRG; PAM sequence: CAG
agtggcaaaattgtggacca

SEQ ID NO: 26263 - DNA, 20 bp, Artificial Sequence
  Description of Artificial Sequence: Synthetic oligonucleotide
  Target: SCN10A; (-) strand; PAM type: NRG; PAM sequence: TGG
gtgagggagtggcaaaattg

SEQ ID NO: 26264 - DNA, 20 bp, Artificial Sequence
  Description of Artificial Sequence: Synthetic oligonucleotide
  Target: SCN10A; (-) strand; PAM type: NRG; PAM sequence: TGG
ttaggataagggtgagggag

SEQ ID NO: 26265 - DNA, 20 bp, Artificial Sequence
  Description of Artificial Sequence: Synthetic oligonucleotide
  Target: SCN10A; (-) strand; PAM type: NRG; PAM sequence: GAG
gatttaggataagggtgagg

SEQ ID NO: 26266 - DNA, 20 bp, Artificial Sequence
  Description of Artificial Sequence: Synthetic oligonucleotide
  Target: SCN10A; (-) strand; PAM type: NRG; PAM sequence: GGG
gggatttaggataagggtga

SEQ ID NO: 26267 - DNA, 20 bp, Artificial Sequence
  Description of Artificial Sequence: Synthetic oligonucleotide
  Target: SCN10A; (-) strand; PAM type: NRG; PAM sequence: AGG
tgggatttaggataagggtg

SEQ ID NO: 26268 - DNA, 20 bp, Artificial Sequence
  Description of Artificial Sequence: Synthetic oligonucleotide
  Target: SCN10A; (-) strand; PAM type: NRG; PAM sequence: GAG
ttgggatttaggataagggt

SEQ ID NO: 26269 - DNA, 20 bp, Artificial Sequence
  Description of Artificial Sequence: Synthetic oligonucleotide
  Target: SCN10A; (-) strand; PAM type: NRG; PAM sequence: GGG
agccttgggatttaggataa

SEQ ID NO: 26270 - DNA, 20 bp, Artificial Sequence
  Description of Artificial Sequence: Synthetic oligonucleotide
  Target: SCN10A; (-) strand; PAM type: NRG; PAM sequence: AGG
tagccttgggatttaggata

SEQ ID NO: 26271 - DNA, 20 bp, Artificial Sequence
  Description of Artificial Sequence: Synthetic oligonucleotide
  Target: SCN10A; (-) strand; PAM type: NRG; PAM sequence: AAG
ttagccttgggatttaggat

SEQ ID NO: 26272 - DNA, 20 bp, Artificial Sequence
  Description of Artificial Sequence: Synthetic oligonucleotide
  Target: SCN10A; (-) strand; PAM type: NRG; PAM sequence: AGG
ttgacttagccttgggattt

SEQ ID NO: 26273 - DNA, 20 bp, Artificial Sequence
  Description of Artificial Sequence: Synthetic oligonucleotide
  Target: SCN10A; (-) strand; PAM type: NRG; PAM sequence: TAG
attgacttagccttgggatt

SEQ ID NO: 26274 - DNA, 20 bp, Artificial Sequence
  Description of Artificial Sequence: Synthetic oligonucleotide
  Target: SCN10A; (-) strand; PAM type: NRG; PAM sequence: GGG
ttctagattgacttagcctt

SEQ ID NO: 26275 - DNA, 20 bp, Artificial Sequence
  Description of Artificial Sequence: Synthetic oligonucleotide
  Target: SCN10A; (-) strand; PAM type: NRG; PAM sequence: TGG
gttctagattgacttagcct

SEQ ID NO: 26276 - DNA, 20 bp, Artificial Sequence
  Description of Artificial Sequence: Synthetic oligonucleotide
  Target: SCN10A; (-) strand; PAM type: NRG; PAM sequence: TAG
ggaactgttctagattgact

SEQ ID NO: 26277 - DNA, 20 bp, Artificial Sequence
  Description of Artificial Sequence: Synthetic oligonucleotide
  Target: SCN10A; (-) strand; PAM type: NRG; PAM sequence: TAG
gcagttcaggggaactgttc

SEQ ID NO: 26278 - DNA, 20 bp, Artificial Sequence
  Description of Artificial Sequence: Synthetic oligonucleotide
  Target: SCN10A; (-) strand; PAM type: NRG; PAM sequence: GGG
ataacccctcagcagttcag

SEQ ID NO: 26279 - DNA, 20 bp, Artificial Sequence
  Description of Artificial Sequence: Synthetic oligonucleotide
  Target: SCN10A; (-) strand; PAM type: NRG; PAM sequence: GGG
cataacccctcagcagttca

SEQ ID NO: 26280 - DNA, 20 bp, Artificial Sequence
  Description of Artificial Sequence: Synthetic oligonucleotide
  Target: SCN10A; (-) strand; PAM type: NRG; PAM sequence: AGG
ccataacccctcagcagttc

SEQ ID NO: 26281 - DNA, 20 bp, Artificial Sequence
  Description of Artificial Sequence: Synthetic oligonucleotide
  Target: SCN10A; (-) strand; PAM type: NRG; PAM sequence: CAG
cccataacccctcagcagtt

SEQ ID NO: 26282 - DNA, 20 bp, Artificial Sequence
  Description of Artificial Sequence: Synthetic oligonucleotide
  Target: SCN10A; (-) strand; PAM type: NRG; PAM sequence: CAG
ggttccccataacccctcag

SEQ ID NO: 26283 - DNA, 20 bp, Artificial Sequence
  Description of Artificial Sequence: Synthetic oligonucleotide
  Target: SCN10A; (-) strand; PAM type: NRG; PAM sequence: CAG
tgaggttccccataacccct

SEQ ID NO: 26284 - DNA, 20 bp, Artificial Sequence
  Description of Artificial Sequence: Synthetic oligonucleotide
  Target: SCN10A; (-) strand; PAM type: NRG; PAM sequence: AGG
atgattcccaggcaatactg

SEQ ID NO: 26285 - DNA, 20 bp, Artificial Sequence
  Description of Artificial Sequence: Synthetic oligonucleotide
  Target: SCN10A; (-) strand; PAM type: NRG; PAM sequence: GAG
tatgattcccaggcaatact

SEQ ID NO: 26286 - DNA, 20 bp, Artificial Sequence
  Description of Artificial Sequence: Synthetic oligonucleotide
  Target: SCN10A; (-) strand; PAM type: NRG; PAM sequence: AGG
agggataccatatgattccc

SEQ ID NO: 26287 - DNA, 20 bp, Artificial Sequence
  Description of Artificial Sequence: Synthetic oligonucleotide
  Target: SCN10A; (-) strand; PAM type: NRG; PAM sequence: CAG
tagggataccatatgattcc

SEQ ID NO: 26288 - DNA, 20 bp, Artificial Sequence
  Description of Artificial Sequence: Synthetic oligonucleotide
  Target: SCN10A; (-) strand; PAM type: NRG; PAM sequence: GGG
ctagaagaaactgctgacta

SEQ ID NO: 26289 - DNA, 20 bp, Artificial Sequence
  Description of Artificial Sequence: Synthetic oligonucleotide
  Target: SCN10A; (-) strand; PAM type: NRG; PAM sequence: AGG
actagaagaaactgctgact

SEQ ID NO: 26290 - DNA, 20 bp, Artificial Sequence
  Description of Artificial Sequence: Synthetic oligonucleotide
  Target: SCN10A; (-) strand; PAM type: NRG; PAM sequence: TAG
gactagaagaaactgctgac

SEQ ID NO: 26291 - DNA, 20 bp, Artificial Sequence
  Description of Artificial Sequence: Synthetic oligonucleotide
  Target: SCN10A; (-) strand; PAM type: NRG; PAM sequence: AAG
tatttgaaacctcagactag

SEQ ID NO: 26292 - DNA, 20 bp, Artificial Sequence
  Description of Artificial Sequence: Synthetic oligonucleotide
  Target: SCN10A; (-) strand; PAM type: NRG; PAM sequence: TAG
gtgtatttgaaacctcagac

SEQ ID NO: 26293 - DNA, 20 bp, Artificial Sequence
  Description of Artificial Sequence: Synthetic oligonucleotide
  Target: SCN10A; (-) strand; PAM type: NRG; PAM sequence: CAG
aaagagtgtatttgaaacct

SEQ ID NO: 26294 - DNA, 20 bp, Artificial Sequence
  Description of Artificial Sequence: Synthetic oligonucleotide
  Target: SCN10A; (-) strand; PAM type: NRG; PAM sequence: GAG
gacagggaatagtgagaaaa

SEQ ID NO: 26295 - DNA, 20 bp, Artificial Sequence
  Description of Artificial Sequence: Synthetic oligonucleotide
  Target: SCN10A; (-) strand; PAM type: NRG; PAM sequence: AAG
aagacagggaatagtgagaa

SEQ ID NO: 26296 - DNA, 20 bp, Artificial Sequence
  Description of Artificial Sequence: Synthetic oligonucleotide
  Target: SCN10A; (-) strand; PAM type: NRG; PAM sequence: GAG
aagggaagacagggaatagt

SEQ ID NO: 26297 - DNA, 20 bp, Artificial Sequence
  Description of Artificial Sequence: Synthetic oligonucleotide
  Target: SCN10A; (-) strand; PAM type: NRG; PAM sequence: TAG
ctgcaagggaagacagggaa

SEQ ID NO: 26298 - DNA, 20 bp, Artificial Sequence
  Description of Artificial Sequence: Synthetic oligonucleotide
  Target: SCN10A; (-) strand; PAM type: NRG; PAM sequence: GGG
gcttactgcaagggaagaca

SEQ ID NO: 26299 - DNA, 20 bp, Artificial Sequence
  Description of Artificial Sequence: Synthetic oligonucleotide
  Target: SCN10A; (-) strand; PAM type: NRG; PAM sequence: AGG
ggcttactgcaagggaagac

SEQ ID NO: 26300 - DNA, 20 bp, Artificial Sequence
  Description of Artificial Sequence: Synthetic oligonucleotide
  Target: SCN10A; (-) strand; PAM type: NRG; PAM sequence: CAG
tggcttactgcaagggaaga

SEQ ID NO: 26301 - DNA, 20 bp, Artificial Sequence
  Description of Artificial Sequence: Synthetic oligonucleotide
  Target: SCN10A; (-) strand; PAM type: NRG; PAM sequence: AAG
tcattggcttactgcaaggg

SEQ ID NO: 26302 - DNA, 20 bp, Artificial Sequence
  Description of Artificial Sequence: Synthetic oligonucleotide
  Target: SCN10A; (-) strand; PAM type: NRG; PAM sequence: GGG
tggtcattggcttactgcaa

SEQ ID NO: 26303 - DNA, 20 bp, Artificial Sequence
  Description of Artificial Sequence: Synthetic oligonucleotide
  Target: SCN10A; (-) strand; PAM type: NRG; PAM sequence: AGG
atggtcattggcttactgca

SEQ ID NO: 26304 - DNA, 20 bp, Artificial Sequence
  Description of Artificial Sequence: Synthetic oligonucleotide
  Target: SCN10A; (-) strand; PAM type: NRG; PAM sequence: AAG
tatggtcattggcttactgc

SEQ ID NO: 26305 - DNA, 20 bp, Artificial Sequence
  Description of Artificial Sequence: Synthetic oligonucleotide
  Target: SCN10A; (-) strand; PAM type: NRG; PAM sequence: TGG
gaactaggaaatatggtcat

SEQ ID NO: 26306 - DNA, 20 bp, Artificial Sequence
  Description of Artificial Sequence: Synthetic oligonucleotide
  Target: SCN10A; (-) strand; PAM type: NRG; PAM sequence: TGG
tctccatgaactaggaaata

SEQ ID NO: 26307 - DNA, 20 bp, Artificial Sequence
  Description of Artificial Sequence: Synthetic oligonucleotide
  Target: SCN10A; (-) strand; PAM type: NRG; PAM sequence: AGG
tctgtttttctccatgaact

SEQ ID NO: 26308 - DNA, 20 bp, Artificial Sequence
  Description of Artificial Sequence: Synthetic oligonucleotide
  Target: SCN10A; (-) strand; PAM type: NRG; PAM sequence: TAG
ttctgtttttctccatgaac

SEQ ID NO: 26309 - DNA, 20 bp, Artificial Sequence
  Description of Artificial Sequence: Synthetic oligonucleotide
  Target: SCN10A; (-) strand; PAM type: NRG; PAM sequence: GAG
ttgatggtatgaagttggca

SEQ ID NO: 26310 - DNA, 20 bp, Artificial Sequence
  Description of Artificial Sequence: Synthetic oligonucleotide
  Target: SCN10A; (-) strand; PAM type: NRG; PAM sequence: CAG
gtttgatggtatgaagttgg

SEQ ID NO: 26311 - DNA, 20 bp, Artificial Sequence
  Description of Artificial Sequence: Synthetic oligonucleotide
  Target: SCN10A; (-) strand; PAM type: NRG; PAM sequence: TGG
gaggtttgatggtatgaagt

SEQ ID NO: 26312 - DNA, 20 bp, Artificial Sequence
  Description of Artificial Sequence: Synthetic oligonucleotide
  Target: SCN10A; (-) strand; PAM type: NRG; PAM sequence: AAG
gttggaggtttgatggtatg

SEQ ID NO: 26313 - DNA, 20 bp, Artificial Sequence
  Description of Artificial Sequence: Synthetic oligonucleotide
  Target: SCN10A; (-) strand; PAM type: NRG; PAM sequence: TGG
caggtgagttggaggtttga

SEQ ID NO: 26314 - DNA, 20 bp, Artificial Sequence
  Description of Artificial Sequence: Synthetic oligonucleotide
  Target: SCN10A; (-) strand; PAM type: NRG; PAM sequence: AGG
tgcagacacaggtgagttgg

SEQ ID NO: 26315 - DNA, 20 bp, Artificial Sequence
  Description of Artificial Sequence: Synthetic oligonucleotide
  Target: SCN10A; (-) strand; PAM type: NRG; PAM sequence: GAG
ctgcagacacaggtgagttg

SEQ ID NO: 26316 - DNA, 20 bp, Artificial Sequence
  Description of Artificial Sequence: Synthetic oligonucleotide
  Target: SCN10A; (-) strand; PAM type: NRG; PAM sequence: TGG
ggctgcagacacaggtgagt

SEQ ID NO: 26317 - DNA, 20 bp, Artificial Sequence
  Description of Artificial Sequence: Synthetic oligonucleotide
  Target: SCN10A; (-) strand; PAM type: NRG; PAM sequence: GAG
agaaggctgcagacacaggt

SEQ ID NO: 26318 - DNA, 20 bp, Artificial Sequence
  Description of Artificial Sequence: Synthetic oligonucleotide
  Target: SCN10A; (-) strand; PAM type: NRG; PAM sequence: AGG
ggaaagaaggctgcagacac

SEQ ID NO: 26319 - DNA, 20 bp, Artificial Sequence
  Description of Artificial Sequence: Synthetic oligonucleotide
  Target: SCN10A; (-) strand; PAM type: NRG; PAM sequence: CAG
aggaaagaaggctgcagaca

SEQ ID NO: 26320 - DNA, 20 bp, Artificial Sequence
  Description of Artificial Sequence: Synthetic oligonucleotide
  Target: SCN10A; (-) strand; PAM type: NRG; PAM sequence: CAG
ggaaggaggaaagaaggctg

SEQ ID NO: 26321 - DNA, 20 bp, Artificial Sequence
  Description of Artificial Sequence: Synthetic oligonucleotide
  Target: SCN10A; (-) strand; PAM type: NRG; PAM sequence: AGG
gagaagggaaggaggaaaga

SEQ ID NO: 26322 - DNA, 20 bp, Artificial Sequence
  Description of Artificial Sequence: Synthetic oligonucleotide
  Target: SCN10A; (-) strand; PAM type: NRG; PAM sequence: AAG
agagaagggaaggaggaaag

SEQ ID NO: 26323 - DNA, 20 bp, Artificial Sequence
  Description of Artificial Sequence: Synthetic oligonucleotide
  Target: SCN10A; (-) strand; PAM type: NRG; PAM sequence: AAG
gtaagagaagggaaggagga

SEQ ID NO: 26324 - DNA, 20 bp, Artificial Sequence
  Description of Artificial Sequence: Synthetic oligonucleotide
  Target: SCN10A; (-) strand; PAM type: NRG; PAM sequence: AGG
tgttgtaagagaagggaagg

SEQ ID NO: 26325 - DNA, 20 bp, Artificial Sequence
  Description of Artificial Sequence: Synthetic oligonucleotide
  Target: SCN10A; (-) strand; PAM type: NRG; PAM sequence: GAG
atgttgtaagagaagggaag

SEQ ID NO: 26326 - DNA, 20 bp, Artificial Sequence
  Description of Artificial Sequence: Synthetic oligonucleotide
  Target: SCN10A; (-) strand; PAM type: NRG; PAM sequence: AGG
tcatgttgtaagagaaggga

SEQ ID NO: 26327 - DNA, 20 bp, Artificial Sequence
  Description of Artificial Sequence: Synthetic oligonucleotide
  Target: SCN10A; (-) strand; PAM type: NRG; PAM sequence: AAG
ctcatgttgtaagagaaggg

SEQ ID NO: 26328 - DNA, 20 bp, Artificial Sequence
  Description of Artificial Sequence: Synthetic oligonucleotide
  Target: SCN10A; (-) strand; PAM type: NRG; PAM sequence: GGG
cctctcatgttgtaagagaa

SEQ ID NO: 26329 - DNA, 20 bp, Artificial Sequence
  Description of Artificial Sequence: Synthetic oligonucleotide
  Target: SCN10A; (-) strand; PAM type: NRG; PAM sequence: AGG
acctctcatgttgtaagaga

SEQ ID NO: 26330 - DNA, 20 bp, Artificial Sequence
  Description of Artificial Sequence: Synthetic oligonucleotide
  Target: SCN10A; (-) strand; PAM type: NRG; PAM sequence: AAG
tacctctcatgttgtaagag

SEQ ID NO: 26331 - DNA, 20 bp, Artificial Sequence
  Description of Artificial Sequence: Synthetic oligonucleotide
  Target: SCN10A; (-) strand; PAM type: NRG; PAM sequence: GAG
agatacctctcatgttgtaa

SEQ ID NO: 26332 - DNA, 20 bp, Artificial Sequence
  Description of Artificial Sequence: Synthetic oligonucleotide
  Target: SCN10A; (-) strand; PAM type: NRG; PAM sequence: AAG
gaagatacctctcatgttgt

SEQ ID NO: 26333 - DNA, 20 bp, Artificial Sequence
  Description of Artificial Sequence: Synthetic oligonucleotide
  Target: SCN10A; (-) strand; PAM type: NRG; PAM sequence: AAG
aatggtccttagaatgtagg

SEQ ID NO: 26334 - DNA, 20 bp, Artificial Sequence
  Description of Artificial Sequence: Synthetic oligonucleotide
  Target: SCN10A; (-) strand; PAM type: NRG; PAM sequence: AGG
aggaatggtccttagaatgt

SEQ ID NO: 26335 - DNA, 20 bp, Artificial Sequence
  Description of Artificial Sequence: Synthetic oligonucleotide
  Target: SCN10A; (-) strand; PAM type: NRG; PAM sequence: TAG
aaggaatggtccttagaatg

SEQ ID NO: 26336 - DNA, 20 bp, Artificial Sequence
  Description of Artificial Sequence: Synthetic oligonucleotide
  Target: SCN10A; (-) strand; PAM type: NRG; PAM sequence: TAG
agagggaaaggaatggtcct

SEQ ID NO: 26337 - DNA, 20 bp, Artificial Sequence
  Description of Artificial Sequence: Synthetic oligonucleotide
  Target: SCN10A; (-) strand; PAM type: NRG; PAM sequence: TGG
cctaagcagagggaaaggaa

SEQ ID NO: 26338 - DNA, 20 bp, Artificial Sequence
  Description of Artificial Sequence: Synthetic oligonucleotide
  Target: SCN10A; (-) strand; PAM type: NRG; PAM sequence: AGG
aagatcctaagcagagggaa

SEQ ID NO: 26339 - DNA, 20 bp, Artificial Sequence
  Description of Artificial Sequence: Synthetic oligonucleotide
  Target: SCN10A; (-) strand; PAM type: NRG; PAM sequence: AAG
taagatcctaagcagaggga

SEQ ID NO: 26340 - DNA, 20 bp, Artificial Sequence
  Description of Artificial Sequence: Synthetic oligonucleotide
  Target: SCN10A; (-) strand; PAM type: NRG; PAM sequence: GGG
gagataagatcctaagcaga

SEQ ID NO: 26341 - DNA, 20 bp, Artificial Sequence
  Description of Artificial Sequence: Synthetic oligonucleotide
  Target: SCN10A; (-) strand; PAM type: NRG; PAM sequence: AGG
tgagataagatcctaagcag

SEQ ID NO: 26342 - DNA, 20 bp, Artificial Sequence
  Description of Artificial Sequence: Synthetic oligonucleotide
  Target: SCN10A; (-) strand; PAM type: NRG; PAM sequence: GAG
atgagataagatcctaagca

SEQ ID NO: 26343 - DNA, 20 bp, Artificial Sequence
  Description of Artificial Sequence: Synthetic oligonucleotide
  Target: SCN10A; (-) strand; PAM type: NRG; PAM sequence: CAG
atatgagataagatcctaag

SEQ ID NO: 26344 - DNA, 20 bp, Artificial Sequence
  Description of Artificial Sequence: Synthetic oligonucleotide
  Target: SCN10A; (-) strand; PAM type: NRG; PAM sequence: AAG
tagatatgagataagatcct

SEQ ID NO: 26345 - DNA, 20 bp, Artificial Sequence
  Description of Artificial Sequence: Synthetic oligonucleotide
  Target: SCN10A; (-) strand; PAM type: NRG; PAM sequence: AAG
aaatgaggtagatatgagat

SEQ ID NO: 26346 - DNA, 20 bp, Artificial Sequence
  Description of Artificial Sequence: Synthetic oligonucleotide
  Target: SCN10A; (-) strand; PAM type: NRG; PAM sequence: GAG
gaaaaaaatgaggtagatat

SEQ ID NO: 26347 - DNA, 20 bp, Artificial Sequence
  Description of Artificial Sequence: Synthetic oligonucleotide
  Target: SCN10A; (-) strand; PAM type: NRG; PAM sequence: TAG
ggagagagaaaaaaatgagg

SEQ ID NO: 26348 - DNA, 20 bp, Artificial Sequence
  Description of Artificial Sequence: Synthetic oligonucleotide
  Target: SCN10A; (-) strand; PAM type: NRG; PAM sequence: AGG
caaggagagagaaaaaaatg

SEQ ID NO: 26349 - DNA, 20 bp, Artificial Sequence
  Description of Artificial Sequence: Synthetic oligonucleotide
  Target: SCN10A; (-) strand; PAM type: NRG; PAM sequence: GAG
acaaggagagagaaaaaaat

SEQ ID NO: 26350 - DNA, 20 bp, Artificial Sequence
  Description of Artificial Sequence: Synthetic oligonucleotide
  Target: SCN10A; (-) strand; PAM type: NRG; PAM sequence: GAG
agagctggcagacaaggaga

SEQ ID NO: 26351 - DNA, 20 bp, Artificial Sequence
  Description of Artificial Sequence: Synthetic oligonucleotide
  Target: SCN10A; (-) strand; PAM type: NRG; PAM sequence: GAG
aaagagctggcagacaagga

SEQ ID NO: 26352 - DNA, 20 bp, Artificial Sequence
  Description of Artificial Sequence: Synthetic oligonucleotide
  Target: SCN10A; (-) strand; PAM type: NRG; PAM sequence: GAG
ggaaagagctggcagacaag

SEQ ID NO: 26353 - DNA, 20 bp, Artificial Sequence
  Description of Artificial Sequence: Synthetic oligonucleotide
  Target: SCN10A; (-) strand; PAM type: NRG; PAM sequence: AGG
taggaaagagctggcagaca

SEQ ID NO: 26354 - DNA, 20 bp, Artificial Sequence
  Description of Artificial Sequence: Synthetic oligonucleotide
  Target: SCN10A; (-) strand; PAM type: NRG; PAM sequence: AAG
ataggaaagagctggcagac

SEQ ID NO: 26355 - DNA, 20 bp, Artificial Sequence
  Description of Artificial Sequence: Synthetic oligonucleotide
  Target: SCN10A; (-) strand; PAM type: NRG; PAM sequence: CAG
tgctgataggaaagagctgg

SEQ ID NO: 26356 - DNA, 20 bp, Artificial Sequence
  Description of Artificial Sequence: Synthetic oligonucleotide
  Target: SCN10A; (-) strand; PAM type: NRG; PAM sequence: TGG
aaatgctgataggaaagagc

SEQ ID NO: 26357 - DNA, 20 bp, Artificial Sequence
  Description of Artificial Sequence: Synthetic oligonucleotide
  Target: SCN10A; (-) strand; PAM type: NRG; PAM sequence: GAG
ctttaaatgctgataggaaa

SEQ ID NO: 26358 - DNA, 20 bp, Artificial Sequence
  Description of Artificial Sequence: Synthetic oligonucleotide
  Target: SCN10A; (-) strand; PAM type: NRG; PAM sequence: AAG
atctttaaatgctgatagga

SEQ ID NO: 26359 - DNA, 20 bp, Artificial Sequence
  Description of Artificial Sequence: Synthetic oligonucleotide
  Target: SCN10A; (-) strand; PAM type: NRG; PAM sequence: AGG
aagcatctttaaatgctgat

SEQ ID NO: 26360 - DNA, 20 bp, Artificial Sequence
  Description of Artificial Sequence: Synthetic oligonucleotide
  Target: SCN10A; (-) strand; PAM type: NRG; PAM sequence: TAG
taagcatctttaaatgctga

SEQ ID NO: 26361 - DNA, 20 bp, Artificial Sequence
  Description of Artificial Sequence: Synthetic oligonucleotide
  Target: SCN10A; (-) strand; PAM type: NRG; PAM sequence: AAG
tttaaagttggaggaaagtt

SEQ ID NO: 26362 - DNA, 20 bp, Artificial Sequence
  Description of Artificial Sequence: Synthetic oligonucleotide
  Target: SCN10A; (-) strand; PAM type: NRG; PAM sequence: AAG
aagtttttaaagttggagga

SEQ ID NO: 26363 - DNA, 20 bp, Artificial Sequence
  Description of Artificial Sequence: Synthetic oligonucleotide
  Target: SCN10A; (-) strand; PAM type: NRG; PAM sequence: AGG
gggaaagtttttaaagttgg

SEQ ID NO: 26364 - DNA, 20 bp, Artificial Sequence
  Description of Artificial Sequence: Synthetic oligonucleotide
  Target: SCN10A; (-) strand; PAM type: NRG; PAM sequence: GAG
agggaaagtttttaaagttg

SEQ ID NO: 26365 - DNA, 20 bp, Artificial Sequence
  Description of Artificial Sequence: Synthetic oligonucleotide
  Target: SCN10A; (-) strand; PAM type: NRG; PAM sequence: TGG
caagggaaagtttttaaagt

SEQ ID NO: 26366 - DNA, 20 bp, Artificial Sequence
  Description of Artificial Sequence: Synthetic oligonucleotide
  Target: SCN10A; (-) strand; PAM type: NRG; PAM sequence: AAG
gcatcaagggaaagttttta

SEQ ID NO: 26367 - DNA, 20 bp, Artificial Sequence
  Description of Artificial Sequence: Synthetic oligonucleotide
  Target: SCN10A; (-) strand; PAM type: NRG; PAM sequence: AAG
atgggctctgcatcaaggga

SEQ ID NO: 26368 - DNA, 20 bp, Artificial Sequence
  Description of Artificial Sequence: Synthetic oligonucleotide
  Target: SCN10A; (-) strand; PAM type: NRG; PAM sequence: GGG
ctggatgggctctgcatcaa

SEQ ID NO: 26369 - DNA, 20 bp, Artificial Sequence
  Description of Artificial Sequence: Synthetic oligonucleotide
  Target: SCN10A; (-) strand; PAM type: NRG; PAM sequence: AGG
cctggatgggctctgcatca

SEQ ID NO: 26370 - DNA, 20 bp, Artificial Sequence
  Description of Artificial Sequence: Synthetic oligonucleotide
  Target: SCN10A; (-) strand; PAM type: NRG; PAM sequence: AAG
acctggatgggctctgcatc

SEQ ID NO: 26371 - DNA, 20 bp, Artificial Sequence
  Description of Artificial Sequence: Synthetic oligonucleotide
  Target: SCN10A; (-) strand; PAM type: NRG; PAM sequence: GGG
agaggagggaagacctggat

SEQ ID NO: 26372 - DNA, 20 bp, Artificial Sequence
  Description of Artificial Sequence: Synthetic oligonucleotide
  Target: SCN10A; (-) strand; PAM type: NRG; PAM sequence: TGG
gagaggagggaagacctgga

SEQ ID NO: 26373 - DNA, 20 bp, Artificial Sequence
  Description of Artificial Sequence: Synthetic oligonucleotide
  Target: SCN10A; (-) strand; PAM type: NRG; PAM sequence: TGG
aggagagaggagggaagacc

SEQ ID NO: 26374 - DNA, 20 bp, Artificial Sequence
  Description of Artificial Sequence: Synthetic oligonucleotide
  Target: SCN10A; (-) strand; PAM type: NRG; PAM sequence: AAG
gagaacaggagagaggaggg

SEQ ID NO: 26375 - DNA, 20 bp, Artificial Sequence
  Description of Artificial Sequence: Synthetic oligonucleotide
  Target: SCN10A; (-) strand; PAM type: NRG; PAM sequence: GGG
atagagaacaggagagagga

SEQ ID NO: 26376 - DNA, 20 bp, Artificial Sequence
  Description of Artificial Sequence: Synthetic oligonucleotide
  Target: SCN10A; (-) strand; PAM type: NRG; PAM sequence: AGG
aatagagaacaggagagagg

SEQ ID NO: 26377 - DNA, 20 bp, Artificial Sequence
  Description of Artificial Sequence: Synthetic oligonucleotide
  Target: SCN10A; (-) strand; PAM type: NRG; PAM sequence: GAG
caatagagaacaggagagag

SEQ ID NO: 26378 - DNA, 20 bp, Artificial Sequence
  Description of Artificial Sequence: Synthetic oligonucleotide
  Target: SCN10A; (-) strand; PAM type: NRG; PAM sequence: AGG
gccaatagagaacaggagag

SEQ ID NO: 26379 - DNA, 20 bp, Artificial Sequence
  Description of Artificial Sequence: Synthetic oligonucleotide
  Target: SCN10A; (-) strand; PAM type: NRG; PAM sequence: GAG
agccaatagagaacaggaga

SEQ ID NO: 26380 - DNA, 20 bp, Artificial Sequence
  Description of Artificial Sequence: Synthetic oligonucleotide
  Target: SCN10A; (-) strand; PAM type: NRG; PAM sequence: GAG
aaagccaatagagaacagga

SEQ ID NO: 26381 - DNA, 20 bp, Artificial Sequence
  Description of Artificial Sequence: Synthetic oligonucleotide
  Target: SCN10A; (-) strand; PAM type: NRG; PAM sequence: GAG
taaaagccaatagagaacag

SEQ ID NO: 26382 - DNA, 20 bp, Artificial Sequence
  Description of Artificial Sequence: Synthetic oligonucleotide
  Target: SCN10A; (-) strand; PAM type: NRG; PAM sequence: AGG
attaaaagccaatagagaac

SEQ ID NO: 26383 - DNA, 20 bp, Artificial Sequence
  Description of Artificial Sequence: Synthetic oligonucleotide
  Target: SCN10A; (-) strand; PAM type: NRG; PAM sequence: CAG
tattaaaagccaatagagaa

SEQ ID NO: 26384 - DNA, 20 bp, Artificial Sequence
  Description of Artificial Sequence: Synthetic oligonucleotide
  Target: SCN10A; (-) strand; PAM type: NRG; PAM sequence: GAG
tcctttattaaaagccaata

SEQ ID NO: 26385 - DNA, 20 bp, Artificial Sequence
  Description of Artificial Sequence: Synthetic oligonucleotide
  Target: SCN10A; (-) strand; PAM type: NRG; PAM sequence: TAG
agtcctttattaaaagccaa

SEQ ID NO: 26386 - DNA, 20 bp, Artificial Sequence
  Description of Artificial Sequence: Synthetic oligonucleotide
  Target: SCN10A; (-) strand; PAM type: NRG; PAM sequence: AAG
agaagtaagtcctttattaa

SEQ ID NO: 26387 - DNA, 20 bp, Artificial Sequence
  Description of Artificial Sequence: Synthetic oligonucleotide
  Target: SCN10A; (-) strand; PAM type: NRG; PAM sequence: AAG
tggaaacagtgagtagaagt

SEQ ID NO: 26388 - DNA, 20 bp, Artificial Sequence
  Description of Artificial Sequence: Synthetic oligonucleotide
  Target: SCN10A; (-) strand; PAM type: NRG; PAM sequence: AAG
tgactggaaacagtgagtag

SEQ ID NO: 26389 - DNA, 20 bp, Artificial Sequence
  Description of Artificial Sequence: Synthetic oligonucleotide
  Target: SCN10A; (-) strand; PAM type: NRG; PAM sequence: TAG
aagtgactggaaacagtgag

SEQ ID NO: 26390 - DNA, 20 bp, Artificial Sequence
  Description of Artificial Sequence: Synthetic oligonucleotide
  Target: SCN10A; (-) strand; PAM type: NRG; PAM sequence: GAG
gaaaagtgactggaaacagt

SEQ ID NO: 26391 - DNA, 20 bp, Artificial Sequence
  Description of Artificial Sequence: Synthetic oligonucleotide
  Target: SCN10A; (-) strand; PAM type: NRG; PAM sequence: CAG
gactgaaaagtgactggaaa

SEQ ID NO: 26392 - DNA, 20 bp, Artificial Sequence
  Description of Artificial Sequence: Synthetic oligonucleotide
  Target: SCN10A; (-) strand; PAM type: NRG; PAM sequence: TGG
ttcaaagactgaaaagtgac

SEQ ID NO: 26393 - DNA, 20 bp, Artificial Sequence
  Description of Artificial Sequence: Synthetic oligonucleotide
  Target: SCN10A; (-) strand; PAM type: NRG; PAM sequence: AAG
tccaagcttcaaagactgaa

SEQ ID NO: 26394 - DNA, 20 bp, Artificial Sequence
  Description of Artificial Sequence: Synthetic oligonucleotide
  Target: SCN10A; (-) strand; PAM type: NRG; PAM sequence: AAG
agggcaaaatccaagcttca

SEQ ID NO: 26395 - DNA, 20 bp, Artificial Sequence
  Description of Artificial Sequence: Synthetic oligonucleotide
  Target: SCN10A; (-) strand; PAM type: NRG; PAM sequence: AAG
gagataggagggcaaaatcc

SEQ ID NO: 26396 - DNA, 20 bp, Artificial Sequence
  Description of Artificial Sequence: Synthetic oligonucleotide
  Target: SCN10A; (-) strand; PAM type: NRG; PAM sequence: GGG
agcattttagtgagatagga

SEQ ID NO: 26397 - DNA, 20 bp, Artificial Sequence
  Description of Artificial Sequence: Synthetic oligonucleotide
  Target: SCN10A; (-) strand; PAM type: NRG; PAM sequence: AGG
aagcattttagtgagatagg

SEQ ID NO: 26398 - DNA, 20 bp, Artificial Sequence
  Description of Artificial Sequence: Synthetic oligonucleotide
  Target: SCN10A; (-) strand; PAM type: NRG; PAM sequence: GAG
gaagcattttagtgagatag

SEQ ID NO: 26399 - DNA, 20 bp, Artificial Sequence
  Description of Artificial Sequence: Synthetic oligonucleotide
  Target: SCN10A; (-) strand; PAM type: NRG; PAM sequence: AGG
aggaagcattttagtgagat

SEQ ID NO: 26400 - DNA, 20 bp, Artificial Sequence
  Description of Artificial Sequence: Synthetic oligonucleotide
  Target: SCN10A; (-) strand; PAM type: NRG; PAM sequence: TAG
aaggaagcattttagtgaga

SEQ ID NO: 26401 - DNA, 20 bp, Artificial Sequence
  Description of Artificial Sequence: Synthetic oligonucleotide
  Target: SCN10A; (-) strand; PAM type: NRG; PAM sequence: GAG
ctgcaaggaagcattttagt

SEQ ID NO: 26402 - DNA, 20 bp, Artificial Sequence
  Description of Artificial Sequence: Synthetic oligonucleotide
  Target: SCN10A; (-) strand; PAM type: NRG; PAM sequence: TAG
atccctgcaaggaagcattt

SEQ ID NO: 26403 - DNA, 20 bp, Artificial Sequence
  Description of Artificial Sequence: Synthetic oligonucleotide
  Target: SCN10A; (-) strand; PAM type: NRG; PAM sequence: AAG
tctcttgtatccctgcaagg

SEQ ID NO: 26404 - DNA, 20 bp, Artificial Sequence
  Description of Artificial Sequence: Synthetic oligonucleotide
  Target: SCN10A; (-) strand; PAM type: NRG; PAM sequence: AGG
caatctcttgtatccctgca

SEQ ID NO: 26405 - DNA, 20 bp, Artificial Sequence
  Description of Artificial Sequence: Synthetic oligonucleotide
  Target: SCN10A; (-) strand; PAM type: NRG; PAM sequence: AAG
gcaatctcttgtatccctgc

SEQ ID NO: 26406 - DNA, 20 bp, Artificial Sequence
  Description of Artificial Sequence: Synthetic oligonucleotide
  Target: SCN10A; (-) strand; PAM type: NRG; PAM sequence: AGG
gccccctgactttagccaca

SEQ ID NO: 26407 - DNA, 20 bp, Artificial Sequence
  Description of Artificial Sequence: Synthetic oligonucleotide
  Target: SCN10A; (-) strand; PAM type: NRG; PAM sequence: AAG
ggccccctgactttagccac

SEQ ID NO: 26408 - DNA, 20 bp, Artificial Sequence
  Description of Artificial Sequence: Synthetic oligonucleotide
  Target: SCN10A; (-) strand; PAM type: NRG; PAM sequence: TAG
tgagaagggccccctgactt

SEQ ID NO: 26409 - DNA, 20 bp, Artificial Sequence
  Description of Artificial Sequence: Synthetic oligonucleotide
  Target: SCN10A; (-) strand; PAM type: NRG; PAM sequence: GGG
aaaaagacaagaactgagaa

SEQ ID NO: 26410 - DNA, 20 bp, Artificial Sequence
  Description of Artificial Sequence: Synthetic oligonucleotide
  Target: SCN10A; (-) strand; PAM type: NRG; PAM sequence: AGG
aaaaaagacaagaactgaga

SEQ ID NO: 26411 - DNA, 20 bp, Artificial Sequence
  Description of Artificial Sequence: Synthetic oligonucleotide
  Target: SCN10A; (-) strand; PAM type: NRG; PAM sequence: AAG
caaaaaagacaagaactgag

SEQ ID NO: 26412 - DNA, 20 bp, Artificial Sequence
  Description of Artificial Sequence: Synthetic oligonucleotide
  Target: SCN10A; (-) strand; PAM type: NRG; PAM sequence: GAG
aaacaaaaaagacaagaact

SEQ ID NO: 26413 - DNA, 20 bp, Artificial Sequence
  Description of Artificial Sequence: Synthetic oligonucleotide
  Target: SCN10A; (-) strand; PAM type: NRG; PAM sequence: AAG
aagaaaaaaacaaaaaagac

SEQ ID NO: 26414 - DNA, 20 bp, Artificial Sequence
  Description of Artificial Sequence: Synthetic oligonucleotide
  Target: SCN10A; (-) strand; PAM type: NRG; PAM sequence: AAG
agaaaaagaaaaaaacaaaa

SEQ ID NO: 26415 - DNA, 20 bp, Artificial Sequence
  Description of Artificial Sequence: Synthetic oligonucleotide
  Target: SCN10A; (-) strand; PAM type: NRG; PAM sequence: AAG
aaaaaaaaaagaaaaagaaa

SEQ ID NO: 26416 - DNA, 20 bp, Artificial Sequence
  Description of Artificial Sequence: Synthetic oligonucleotide
  Target: SCN10A; (-) strand; PAM type: NRG; PAM sequence: AAG
ctcaaaaaaaaaaaaagaaa

SEQ ID NO: 26417 - DNA, 20 bp, Artificial Sequence
  Description of Artificial Sequence: Synthetic oligonucleotide
  Target: SCN10A; (-) strand; PAM type: NRG; PAM sequence: AAG
ccctgtctcaaaaaaaaaaa

SEQ ID NO: 26418 - DNA, 20 bp, Artificial Sequence
  Description of Artificial Sequence: Synthetic oligonucleotide
  Target: SCN10A; (-) strand; PAM type: NRG; PAM sequence: CAG
ctgcactctagtccgggtga

SEQ ID NO: 26419 - DNA, 20 bp, Artificial Sequence
  Description of Artificial Sequence: Synthetic oligonucleotide
  Target: SCN10A; (-) strand; PAM type: NRG; PAM sequence: GGG
gcaccactgcactctagtcc

SEQ ID NO: 26420 - DNA, 20 bp, Artificial Sequence
  Description of Artificial Sequence: Synthetic oligonucleotide
  Target: SCN10A; (-) strand; PAM type: NRG; PAM sequence: CGG
tgcaccactgcactctagtc

SEQ ID NO: 26421 - DNA, 20 bp, Artificial Sequence
  Description of Artificial Sequence: Synthetic oligonucleotide
  Target: SCN10A; (-) strand; PAM type: NRG; PAM sequence: TAG
gagattgcaccactgcactc

SEQ ID NO: 26422 - DNA, 20 bp, Artificial Sequence
  Description of Artificial Sequence: Synthetic oligonucleotide
  Target: SCN10A; (-) strand; PAM type: NRG; PAM sequence: GAG
gacagaggttgcagtgagca

SEQ ID NO: 26423 - DNA, 20 bp, Artificial Sequence
  Description of Artificial Sequence: Synthetic oligonucleotide
  Target: SCN10A; (-) strand; PAM type: NRG; PAM sequence: CAG
gagacagaggttgcagtgag

SEQ ID NO: 26424 - DNA, 20 bp, Artificial Sequence
  Description of Artificial Sequence: Synthetic oligonucleotide
  Target: SCN10A; (-) strand; PAM type: NRG; PAM sequence: GAG
caggagacagaggttgcagt

SEQ ID NO: 26425 - DNA, 20 bp, Artificial Sequence
  Description of Artificial Sequence: Synthetic oligonucleotide
  Target: SCN10A; (-) strand; PAM type: NRG; PAM sequence: CAG
agcccaggagacagaggttg

SEQ ID NO: 26426 - DNA, 20 bp, Artificial Sequence
  Description of Artificial Sequence: Synthetic oligonucleotide
  Target: SCN10A; (-) strand; PAM type: NRG; PAM sequence: AGG
tgcttgagcccaggagacag

SEQ ID NO: 26427 - DNA, 20 bp, Artificial Sequence
  Description of Artificial Sequence: Synthetic oligonucleotide
  Target: SCN10A; (-) strand; PAM type: NRG; PAM sequence: GAG
ttgcttgagcccaggagaca

SEQ ID NO: 26428 - DNA, 20 bp, Artificial Sequence
  Description of Artificial Sequence: Synthetic oligonucleotide
  Target: SCN10A; (-) strand; PAM type: NRG; PAM sequence: CAG
aattgcttgagcccaggaga

SEQ ID NO: 26429 - DNA, 20 bp, Artificial Sequence
  Description of Artificial Sequence: Synthetic oligonucleotide
  Target: SCN10A; (-) strand; PAM type: NRG; PAM sequence: GAG
ggagaattgcttgagcccag

SEQ ID NO: 26430 - DNA, 20 bp, Artificial Sequence
  Description of Artificial Sequence: Synthetic oligonucleotide
  Target: SCN10A; (-) strand; PAM type: NRG; PAM sequence: AGG
tgggagaattgcttgagccc

SEQ ID NO: 26431 - DNA, 20 bp, Artificial Sequence
  Description of Artificial Sequence: Synthetic oligonucleotide
  Target: SCN10A; (-) strand; PAM type: NRG; PAM sequence: CAG
gtgggagaattgcttgagcc

SEQ ID NO: 26432 - DNA, 20 bp, Artificial Sequence
  Description of Artificial Sequence: Synthetic oligonucleotide
  Target: SCN10A; (-) strand; PAM type: NRG; PAM sequence: GAG
ctgaggtgggagaattgctt

SEQ ID NO: 26433 - DNA, 20 bp, Artificial Sequence
  Description of Artificial Sequence: Synthetic oligonucleotide
  Target: SCN10A; (-) strand; PAM type: NRG; PAM sequence: GAG
tattcgggaggctgaggtgg

SEQ ID NO: 26434 - DNA, 20 bp, Artificial Sequence
  Description of Artificial Sequence: Synthetic oligonucleotide
  Target: SCN10A; (-) strand; PAM type: NRG; PAM sequence: GGG
gctattcgggaggctgaggt

SEQ ID NO: 26435 - DNA, 20 bp, Artificial Sequence
  Description of Artificial Sequence: Synthetic oligonucleotide
  Target: SCN10A; (-) strand; PAM type: NRG; PAM sequence: TGG
agctattcgggaggctgagg

SEQ ID NO: 26436 - DNA, 20 bp, Artificial Sequence
  Description of Artificial Sequence: Synthetic oligonucleotide
  Target: SCN10A; (-) strand; PAM type: NRG; PAM sequence: AGG
cccagctattcgggaggctg

SEQ ID NO: 26437 - DNA, 20 bp, Artificial Sequence
  Description of Artificial Sequence: Synthetic oligonucleotide
  Target: SCN10A; (-) strand; PAM type: NRG; PAM sequence: GAG
gcccagctattcgggaggct

SEQ ID NO: 26438 - DNA, 20 bp, Artificial Sequence
  Description of Artificial Sequence: Synthetic oligonucleotide
  Target: SCN10A; (-) strand; PAM type: NRG; PAM sequence: AGG
ctatagcccagctattcggg

SEQ ID NO: 26439 - DNA, 20 bp, Artificial Sequence
  Description of Artificial Sequence: Synthetic oligonucleotide
  Target: SCN10A; (-) strand; PAM type: NRG; PAM sequence: GAG
cctatagcccagctattcgg

SEQ ID NO: 26440 - DNA, 20 bp, Artificial Sequence
  Description of Artificial Sequence: Synthetic oligonucleotide
  Target: SCN10A; (-) strand; PAM type: NRG; PAM sequence: GGG
tgcctatagcccagctattc

SEQ ID NO: 26441 - DNA, 20 bp, Artificial Sequence
  Description of Artificial Sequence: Synthetic oligonucleotide
  Target: SCN10A; (-) strand; PAM type: NRG; PAM sequence: CGG
gtgcctatagcccagctatt

SEQ ID NO: 26442 - DNA, 20 bp, Artificial Sequence
  Description of Artificial Sequence: Synthetic oligonucleotide
  Target: SCN10A; (-) strand; PAM type: NRG; PAM sequence: CAG
ggtgacatgtgcctatagcc

SEQ ID NO: 26443 - DNA, 20 bp, Artificial Sequence
  Description of Artificial Sequence: Synthetic oligonucleotide
  Target: SCN10A; (-) strand; PAM type: NRG; PAM sequence: TAG
agtgtggtgacatgtgccta

SEQ ID NO: 26444 - DNA, 20 bp, Artificial Sequence
  Description of Artificial Sequence: Synthetic oligonucleotide
  Target: SCN10A; (-) strand; PAM type: NRG; PAM sequence: TGG
ttttcaaaactagccgagtg

SEQ ID NO: 26445 - DNA, 20 bp, Artificial Sequence
  Description of Artificial Sequence: Synthetic oligonucleotide
  Target: SCN10A; (-) strand; PAM type: NRG; PAM sequence: GAG
aaattttttcaaaactagcc

SEQ ID NO: 26446 - DNA, 20 bp, Artificial Sequence
  Description of Artificial Sequence: Synthetic oligonucleotide
  Target: SCN10A; (-) strand; PAM type: NRG; PAM sequence: TAG
caaaaaaattttttcaaaac

SEQ ID NO: 26447 - DNA, 20 bp, Artificial Sequence
  Description of Artificial Sequence: Synthetic oligonucleotide
  Target: SCN10A; (-) strand; PAM type: NRG; PAM sequence: TGG
gatgggcctggacaatatag

SEQ ID NO: 26448 - DNA, 20 bp, Artificial Sequence
  Description of Artificial Sequence: Synthetic oligonucleotide
  Target: SCN10A; (-) strand; PAM type: NRG; PAM sequence: TAG
tgagatgggcctggacaata

SEQ ID NO: 26449 - DNA, 20 bp, Artificial Sequence
  Description of Artificial Sequence: Synthetic oligonucleotide
  Target: SCN10A; (-) strand; PAM type: NRG; PAM sequence: TGG
gataagaactgagatgggcc

SEQ ID NO: 26450 - DNA, 20 bp, Artificial Sequence
  Description of Artificial Sequence: Synthetic oligonucleotide
  Target: SCN10A; (-) strand; PAM type: NRG; PAM sequence: GGG
atcaagataagaactgagat

SEQ ID NO: 26451 - DNA, 20 bp, Artificial Sequence
  Description of Artificial Sequence: Synthetic oligonucleotide
  Target: SCN10A; (-) strand; PAM type: NRG; PAM sequence: TGG
catcaagataagaactgaga

SEQ ID NO: 26452 - DNA, 20 bp, Artificial Sequence
  Description of Artificial Sequence: Synthetic oligonucleotide
  Target: SCN10A; (-) strand; PAM type: NRG; PAM sequence: GAG
ggaccatcaagataagaact

SEQ ID NO: 26453 - DNA, 20 bp, Artificial Sequence
  Description of Artificial Sequence: Synthetic oligonucleotide
  Target: SCN10A; (-) strand; PAM type: NRG; PAM sequence: AAG
gccaataggaccatcaagat

SEQ ID NO: 26454 - DNA, 20 bp, Artificial Sequence
  Description of Artificial Sequence: Synthetic oligonucleotide
  Target: SCN10A; (-) strand; PAM type: NRG; PAM sequence: AAG
aaacagccaataggaccatc

SEQ ID NO: 26455 - DNA, 20 bp, Artificial Sequence
  Description of Artificial Sequence: Synthetic oligonucleotide
  Target: SCN10A; (-) strand; PAM type: NRG; PAM sequence: AGG
aaattgtcaaaacagccaat

SEQ ID NO: 26456 - DNA, 20 bp, Artificial Sequence
  Description of Artificial Sequence: Synthetic oligonucleotide
  Target: SCN10A; (-) strand; PAM type: NRG; PAM sequence: TAG
gaaattgtcaaaacagccaa

SEQ ID NO: 26457 - DNA, 20 bp, Artificial Sequence
  Description of Artificial Sequence: Synthetic oligonucleotide
  Target: SCN10A; (-) strand; PAM type: NRG; PAM sequence: CAG
taaggaggaaattgtcaaaa

SEQ ID NO: 26458 - DNA, 20 bp, Artificial Sequence
  Description of Artificial Sequence: Synthetic oligonucleotide
  Target: SCN10A; (-) strand; PAM type: NRG; PAM sequence: AGG
aaatatacagtattttaagg

SEQ ID NO: 26459 - DNA, 20 bp, Artificial Sequence
  Description of Artificial Sequence: Synthetic oligonucleotide
  Target: SCN10A; (-) strand; PAM type: NRG; PAM sequence: GAG
aaaatatacagtattttaag

SEQ ID NO: 26460 - DNA, 20 bp, Artificial Sequence
  Description of Artificial Sequence: Synthetic oligonucleotide
  Target: SCN10A; (-) strand; PAM type: NRG; PAM sequence: AGG
ccaaaatatacagtatttta

SEQ ID NO: 26461 - DNA, 20 bp, Artificial Sequence
  Description of Artificial Sequence: Synthetic oligonucleotide
  Target: SCN10A; (-) strand; PAM type: NRG; PAM sequence: AAG
gccaaaatatacagtatttt

SEQ ID NO: 26462 - DNA, 20 bp, Artificial Sequence
  Description of Artificial Sequence: Synthetic oligonucleotide
  Target: SCN10A; (-) strand; PAM type: NRG; PAM sequence: CAG
gtcatggtagccaaaatata

SEQ ID NO: 26463 - DNA, 20 bp, Artificial Sequence
  Description of Artificial Sequence: Synthetic oligonucleotide
  Target: SCN10A; (-) strand; PAM type: NRG; PAM sequence: TAG
aaaccaagagagtgtcatgg

SEQ ID NO: 26464 - DNA, 20 bp, Artificial Sequence
  Description of Artificial Sequence: Synthetic oligonucleotide
  Target: SCN10A; (-) strand; PAM type: NRG; PAM sequence: TGG
ggaaaaccaagagagtgtca

SEQ ID NO: 26465 - DNA, 20 bp, Artificial Sequence
  Description of Artificial Sequence: Synthetic oligonucleotide
  Target: SCN10A; (-) strand; PAM type: NRG; PAM sequence: GAG
gaaagttaggaaaaccaaga

SEQ ID NO: 26466 - DNA, 20 bp, Artificial Sequence
  Description of Artificial Sequence: Synthetic oligonucleotide
  Target: SCN10A; (-) strand; PAM type: NRG; PAM sequence: GAG
gagaaagttaggaaaaccaa

SEQ ID NO: 26467 - DNA, 20 bp, Artificial Sequence
  Description of Artificial Sequence: Synthetic oligonucleotide
  Target: SCN10A; (-) strand; PAM type: NRG; PAM sequence: AAG
gagagaaagttaggaaaacc

SEQ ID NO: 26468 - DNA, 20 bp, Artificial Sequence
  Description of Artificial Sequence: Synthetic oligonucleotide
  Target: SCN10A; (-) strand; PAM type: NRG; PAM sequence: AGG
gaaggagaagagagaaagtt

SEQ ID NO: 26469 - DNA, 20 bp, Artificial Sequence
  Description of Artificial Sequence: Synthetic oligonucleotide
  Target: SCN10A; (-) strand; PAM type: NRG; PAM sequence: TAG
agaaggagaagagagaaagt

SEQ ID NO: 26470 - DNA, 20 bp, Artificial Sequence
  Description of Artificial Sequence: Synthetic oligonucleotide
  Target: SCN10A; (-) strand; PAM type: NRG; PAM sequence: AAG
actgagaaggagaagagaga

SEQ ID NO: 26471 - DNA, 20 bp, Artificial Sequence
  Description of Artificial Sequence: Synthetic oligonucleotide
  Target: SCN10A; (-) strand; PAM type: NRG; PAM sequence: GAG
agagactgagaaggagaaga

SEQ ID NO: 26472 - DNA, 20 bp, Artificial Sequence
  Description of Artificial Sequence: Synthetic oligonucleotide
  Target: SCN10A; (-) strand; PAM type: NRG; PAM sequence: GAG
ggagagactgagaaggagaa

SEQ ID NO: 26473 - DNA, 20 bp, Artificial Sequence
  Description of Artificial Sequence: Synthetic oligonucleotide
  Target: SCN10A; (-) strand; PAM type: NRG; PAM sequence: AAG
aaggagagactgagaaggag

SEQ ID NO: 26474 - DNA, 20 bp, Artificial Sequence
  Description of Artificial Sequence: Synthetic oligonucleotide
  Target: SCN10A; (-) strand; PAM type: NRG; PAM sequence: GAG
agaaaggagagactgagaag

SEQ ID NO: 26475 - DNA, 20 bp, Artificial Sequence
  Description of Artificial Sequence: Synthetic oligonucleotide
  Target: SCN10A; (-) strand; PAM type: NRG; PAM sequence: AGG
tgagaaaggagagactgaga

SEQ ID NO: 26476 - DNA, 20 bp, Artificial Sequence
  Description of Artificial Sequence: Synthetic oligonucleotide
  Target: SCN10A; (-) strand; PAM type: NRG; PAM sequence: AAG
ctgagaaaggagagactgag

SEQ ID NO: 26477 - DNA, 20 bp, Artificial Sequence
  Description of Artificial Sequence: Synthetic oligonucleotide
  Target: SCN10A; (-) strand; PAM type: NRG; PAM sequence: GAG
aagctgagaaaggagagact

SEQ ID NO: 26478 - DNA, 20 bp, Artificial Sequence
  Description of Artificial Sequence: Synthetic oligonucleotide
  Target: SCN10A; (-) strand; PAM type: NRG; PAM sequence: GAG
tgggaaaagctgagaaagga

SEQ ID NO: 26479 - DNA, 20 bp, Artificial Sequence
  Description of Artificial Sequence: Synthetic oligonucleotide
  Target: SCN10A; (-) strand; PAM type: NRG; PAM sequence: GAG
tatgggaaaagctgagaaag

SEQ ID NO: 26480 - DNA, 20 bp, Artificial Sequence
  Description of Artificial Sequence: Synthetic oligonucleotide
  Target: SCN10A; (-) strand; PAM type: NRG; PAM sequence: AGG
tgtatgggaaaagctgagaa

SEQ ID NO: 26481 - DNA, 20 bp, Artificial Sequence
  Description of Artificial Sequence: Synthetic oligonucleotide
  Target: SCN10A; (-) strand; PAM type: NRG; PAM sequence: AAG
atgtatgggaaaagctgaga

SEQ ID NO: 26482 - DNA, 20 bp, Artificial Sequence
  Description of Artificial Sequence: Synthetic oligonucleotide
  Target: SCN10A; (-) strand; PAM type: NRG; PAM sequence: GAG
aatcatgtatgggaaaagct

SEQ ID NO: 26483 - DNA, 20 bp, Artificial Sequence
  Description of Artificial Sequence: Synthetic oligonucleotide
  Target: SCN10A; (-) strand; PAM type: NRG; PAM sequence: AAG
ttcacaatcatgtatgggaa

SEQ ID NO: 26484 - DNA, 20 bp, Artificial Sequence
  Description of Artificial Sequence: Synthetic oligonucleotide
  Target: SCN10A; (-) strand; PAM type: NRG; PAM sequence: GGG
cattattcacaatcatgtat

SEQ ID NO: 26485 - DNA, 20 bp, Artificial Sequence
  Description of Artificial Sequence: Synthetic oligonucleotide
  Target: SCN10A; (-) strand; PAM type: NRG; PAM sequence: TGG
ccattattcacaatcatgta

SEQ ID NO: 26486 - DNA, 20 bp, Artificial Sequence
  Description of Artificial Sequence: Synthetic oligonucleotide
  Target: SCN10A; (-) strand; PAM type: NRG; PAM sequence: GAG
tattctgaaaacaaaagata

SEQ ID NO: 26487 - DNA, 20 bp, Artificial Sequence
  Description of Artificial Sequence: Synthetic oligonucleotide
  Target: SCN10A; (-) strand; PAM type: NRG; PAM sequence: TAG
attattctgaaaacaaaaga

SEQ ID NO: 26488 - DNA, 20 bp, Artificial Sequence
  Description of Artificial Sequence: Synthetic oligonucleotide
  Target: SCN10A; (-) strand; PAM type: NRG; PAM sequence: AAG
tgttattattctgaaaacaa

SEQ ID NO: 26489 - DNA, 20 bp, Artificial Sequence
  Description of Artificial Sequence: Synthetic oligonucleotide
  Target: SCN10A; (-) strand; PAM type: NRG; PAM sequence: AAG
agtaaatgctagcgctgttg

SEQ ID NO: 26490 - DNA, 20 bp, Artificial Sequence
  Description of Artificial Sequence: Synthetic oligonucleotide
  Target: SCN10A; (-) strand; PAM type: NRG; PAM sequence: TAG
agtggaatctcagtaaatgc

SEQ ID NO: 26491 - DNA, 20 bp, Artificial Sequence
  Description of Artificial Sequence: Synthetic oligonucleotide
  Target: SCN10A; (-) strand; PAM type: NRG; PAM sequence: CAG
tctgaaatacagtggaatct

SEQ ID NO: 26492 - DNA, 20 bp, Artificial Sequence
  Description of Artificial Sequence: Synthetic oligonucleotide
  Target: SCN10A; (-) strand; PAM type: NRG; PAM sequence: TGG
atccagagtctgaaatacag

SEQ ID NO: 26493 - DNA, 20 bp, Artificial Sequence
  Description of Artificial Sequence: Synthetic oligonucleotide
  Target: SCN10A; (-) strand; PAM type: NRG; PAM sequence: CAG
ttaatccagagtctgaaata

SEQ ID NO: 26494 - DNA, 20 bp, Artificial Sequence
  Description of Artificial Sequence: Synthetic oligonucleotide
  Target: SCN10A; (-) strand; PAM type: NRG; PAM sequence: GAG
catgaaaattgcttaatcca

SEQ ID NO: 26495 - DNA, 20 bp, Artificial Sequence
  Description of Artificial Sequence: Synthetic oligonucleotide
  Target: SCN10A; (-) strand; PAM type: NRG; PAM sequence: CAG
tgcatgaaaattgcttaatc

SEQ ID NO: 26496 - DNA, 20 bp, Artificial Sequence
  Description of Artificial Sequence: Synthetic oligonucleotide
  Target: SCN10A; (-) strand; PAM type: NRG; PAM sequence: TAG
atacttcacaggtacagtga

SEQ ID NO: 26497 - DNA, 20 bp, Artificial Sequence
  Description of Artificial Sequence: Synthetic oligonucleotide
  Target: SCN10A; (-) strand; PAM type: NRG; PAM sequence: CAG
gagataatacttcacaggta

SEQ ID NO: 26498 - DNA, 20 bp, Artificial Sequence
  Description of Artificial Sequence: Synthetic oligonucleotide
  Target: SCN10A; (-) strand; PAM type: NRG; PAM sequence: AGG
tattagagataatacttcac

SEQ ID NO: 26499 - DNA, 20 bp, Artificial Sequence
  Description of Artificial Sequence: Synthetic oligonucleotide
  Target: SCN10A; (-) strand; PAM type: NRG; PAM sequence: CAG
atattagagataatacttca

SEQ ID NO: 26500 - DNA, 20 bp, Artificial Sequence
  Description of Artificial Sequence: Synthetic oligonucleotide
  Target: SCN10A; (-) strand; PAM type: NRG; PAM sequence: GAG
ggtatcttatttatatatta

SEQ ID NO: 26501 - DNA, 20 bp, Artificial Sequence
  Description of Artificial Sequence: Synthetic oligonucleotide
  Target: SCN10A; (-) strand; PAM type: NRG; PAM sequence: TAG
ctggtatcttatttatatat

SEQ ID NO: 26502 - DNA, 20 bp, Artificial Sequence
  Description of Artificial Sequence: Synthetic oligonucleotide
  Target: SCN10A; (-) strand; PAM type: NRG; PAM sequence: TGG
aaattttaactttgctgctc

SEQ ID NO: 26503 - DNA, 20 bp, Artificial Sequence
  Description of Artificial Sequence: Synthetic oligonucleotide
  Target: SCN10A; (-) strand; PAM type: NRG; PAM sequence: TGG
actcattagtaatgtgatct

SEQ ID NO: 26504 - DNA, 20 bp, Artificial Sequence
  Description of Artificial Sequence: Synthetic oligonucleotide
  Target: SCN10A; (-) strand; PAM type: NRG; PAM sequence: TAG
agtaccgttctgccactcat

SEQ ID NO: 26505 - DNA, 20 bp, Artificial Sequence
  Description of Artificial Sequence: Synthetic oligonucleotide
  Target: SCN10A; (-) strand; PAM type: NRG; PAM sequence: AAG
tggcaaacatacctgagttt

SEQ ID NO: 26506 - DNA, 20 bp, Artificial Sequence
  Description of Artificial Sequence: Synthetic oligonucleotide
  Target: SCN10A; (-) strand; PAM type: NRG; PAM sequence: GAG
agattgtggcaaacatacct

SEQ ID NO: 26507 - DNA, 20 bp, Artificial Sequence
  Description of Artificial Sequence: Synthetic oligonucleotide
  Target: SCN10A; (-) strand; PAM type: NRG; PAM sequence: TGG
gagatgtttccaagagattg

SEQ ID NO: 26508 - DNA, 20 bp, Artificial Sequence
  Description of Artificial Sequence: Synthetic oligonucleotide
  Target: SCN10A; (-) strand; PAM type: NRG; PAM sequence: GAG
gaatgatgagatgtttccaa

SEQ ID NO: 26509 - DNA, 20 bp, Artificial Sequence
  Description of Artificial Sequence: Synthetic oligonucleotide
  Target: SCN10A; (-) strand; PAM type: NRG; PAM sequence: AAG
gggaatgatgagatgtttcc

SEQ ID NO: 26510 - DNA, 20 bp, Artificial Sequence
  Description of Artificial Sequence: Synthetic oligonucleotide
  Target: SCN10A; (-) strand; PAM type: NRG; PAM sequence: GAG
agtgaagatatgggaatgat

SEQ ID NO: 26511 - DNA, 20 bp, Artificial Sequence
  Description of Artificial Sequence: Synthetic oligonucleotide
  Target: SCN10A; (-) strand; PAM type: NRG; PAM sequence: GGG
taaatgagaagtgaagatat

SEQ ID NO: 26512 - DNA, 20 bp, Artificial Sequence
  Description of Artificial Sequence: Synthetic oligonucleotide
  Target: SCN10A; (-) strand; PAM type: NRG; PAM sequence: TGG
ataaatgagaagtgaagata

SEQ ID NO: 26513 - DNA, 20 bp, Artificial Sequence
  Description of Artificial Sequence: Synthetic oligonucleotide
  Target: SCN10A; (-) strand; PAM type: NRG; PAM sequence: AAG
ctgcatataaatgagaagtg

SEQ ID NO: 26514 - DNA, 20 bp, Artificial Sequence
  Description of Artificial Sequence: Synthetic oligonucleotide
  Target: SCN10A; (-) strand; PAM type: NRG; PAM sequence: AAG
gtcatctgcatataaatgag

SEQ ID NO: 26515 - DNA, 20 bp, Artificial Sequence
  Description of Artificial Sequence: Synthetic oligonucleotide
  Target: SCN10A; (-) strand; PAM type: NRG; PAM sequence: GAG
tcagtcatctgcatataaat

SEQ ID NO: 26516 - DNA, 20 bp, Artificial Sequence
  Description of Artificial Sequence: Synthetic oligonucleotide
  Target: SCN10A; (-) strand; PAM type: NRG; PAM sequence: CAG
gagagctacagataaagact

SEQ ID NO: 26517 - DNA, 20 bp, Artificial Sequence
  Description of Artificial Sequence: Synthetic oligonucleotide
  Target: SCN10A; (-) strand; PAM type: NRG; PAM sequence: AAG
acttctgagagctacagata

SEQ ID NO: 26518 - DNA, 20 bp, Artificial Sequence
  Description of Artificial Sequence: Synthetic oligonucleotide
  Target: SCN10A; (-) strand; PAM type: NRG; PAM sequence: CAG
ccatggacttctgagagcta

SEQ ID NO: 26519 - DNA, 20 bp, Artificial Sequence
  Description of Artificial Sequence: Synthetic oligonucleotide
  Target: SCN10A; (-) strand; PAM type: NRG; PAM sequence: GAG
tgagccccatggacttctga

SEQ ID NO: 26520 - DNA, 20 bp, Artificial Sequence
  Description of Artificial Sequence: Synthetic oligonucleotide
  Target: SCN10A; (-) strand; PAM type: NRG; PAM sequence: GAG
tctgagccccatggacttct

SEQ ID NO: 26521 - DNA, 20 bp, Artificial Sequence
  Description of Artificial Sequence: Synthetic oligonucleotide
  Target: SCN10A; (-) strand; PAM type: NRG; PAM sequence: TGG
aaatgaagatctgagcccca

SEQ ID NO: 26522 - DNA, 20 bp, Artificial Sequence
  Description of Artificial Sequence: Synthetic oligonucleotide
  Target: SCN10A; (-) strand; PAM type: NRG; PAM sequence: GAG
gagagatcaaatgaagatct

SEQ ID NO: 26523 - DNA, 20 bp, Artificial Sequence
  Description of Artificial Sequence: Synthetic oligonucleotide
  Target: SCN10A; (-) strand; PAM type: NRG; PAM sequence: AAG
tgaagtggagagatcaaatg

SEQ ID NO: 26524 - DNA, 20 bp, Artificial Sequence
  Description of Artificial Sequence: Synthetic oligonucleotide
  Target: SCN10A; (-) strand; PAM type: NRG; PAM sequence: GAG
tcatgagacactgaagtgga

SEQ ID NO: 26525 - DNA, 20 bp, Artificial Sequence
  Description of Artificial Sequence: Synthetic oligonucleotide
  Target: SCN10A; (-) strand; PAM type: NRG; PAM sequence: GAG
gctcatgagacactgaagtg

SEQ ID NO: 26526 - DNA, 20 bp, Artificial Sequence
  Description of Artificial Sequence: Synthetic oligonucleotide
  Target: SCN10A; (-) strand; PAM type: NRG; PAM sequence: TGG
gtgctcatgagacactgaag

SEQ ID NO: 26527 - DNA, 20 bp, Artificial Sequence
  Description of Artificial Sequence: Synthetic oligonucleotide
  Target: SCN10A; (-) strand; PAM type: NRG; PAM sequence: AAG
gaggtgctcatgagacactg

SEQ ID NO: 26528 - DNA, 20 bp, Artificial Sequence
  Description of Artificial Sequence: Synthetic oligonucleotide
  Target: SCN10A; (-) strand; PAM type: NRG; PAM sequence: GAG
gctgagcttgaggtgctcat

SEQ ID NO: 26529 - DNA, 20 bp, Artificial Sequence
  Description of Artificial Sequence: Synthetic oligonucleotide
  Target: SCN10A; (-) strand; PAM type: NRG; PAM sequence: AGG
tttggggcatgctgagcttg

SEQ ID NO: 26530 - DNA, 20 bp, Artificial Sequence
  Description of Artificial Sequence: Synthetic oligonucleotide
  Target: SCN10A; (-) strand; PAM type: NRG; PAM sequence: GAG
gtttggggcatgctgagctt

SEQ ID NO: 26531 - DNA, 20 bp, Artificial Sequence
  Description of Artificial Sequence: Synthetic oligonucleotide
  Target: SCN10A; (-) strand; PAM type: NRG; PAM sequence: GAG
agtttagtttggggcatgct

SEQ ID NO: 26532 - DNA, 20 bp, Artificial Sequence
  Description of Artificial Sequence: Synthetic oligonucleotide
  Target: SCN10A; (-) strand; PAM type: NRG; PAM sequence: GGG
ataattatgagtttagtttg

SEQ ID NO: 26533 - DNA, 20 bp, Artificial Sequence
  Description of Artificial Sequence: Synthetic oligonucleotide
  Target: SCN10A; (-) strand; PAM type: NRG; PAM sequence: GGG
gataattatgagtttagttt

SEQ ID NO: 26534 - DNA, 20 bp, Artificial Sequence
  Description of Artificial Sequence: Synthetic oligonucleotide
  Target: SCN10A; (-) strand; PAM type: NRG; PAM sequence: TGG
agataattatgagtttagtt

SEQ ID NO: 26535 - DNA, 20 bp, Artificial Sequence
  Description of Artificial Sequence: Synthetic oligonucleotide
  Target: SCN10A; (-) strand; PAM type: NRG; PAM sequence: TAG
tgaggagataattatgagtt

SEQ ID NO: 26536 - DNA, 20 bp, Artificial Sequence
  Description of Artificial Sequence: Synthetic oligonucleotide
  Target: SCN10A; (-) strand; PAM type: NRG; PAM sequence: GAG
agaagtgaggagataattat

SEQ ID NO: 26537 - DNA, 20 bp, Artificial Sequence
  Description of Artificial Sequence: Synthetic oligonucleotide
  Target: SCN10A; (-) strand; PAM type: NRG; PAM sequence: GAG
aggtattagaaagaagtgag

SEQ ID NO: 26538 - DNA, 20 bp, Artificial Sequence
  Description of Artificial Sequence: Synthetic oligonucleotide
  Target: SCN10A; (-) strand; PAM type: NRG; PAM sequence: AGG
gcaggtattagaaagaagtg

SEQ ID NO: 26539 - DNA, 20 bp, Artificial Sequence
  Description of Artificial Sequence: Synthetic oligonucleotide
  Target: SCN10A; (-) strand; PAM type: NRG; PAM sequence: GAG
ggcaggtattagaaagaagt

SEQ ID NO: 26540 - DNA, 20 bp, Artificial Sequence
  Description of Artificial Sequence: Synthetic oligonucleotide
  Target: SCN10A; (-) strand; PAM type: NRG; PAM sequence: AAG
gagaggcaggtattagaaag

SEQ ID NO: 26541 - DNA, 20 bp, Artificial Sequence
  Description of Artificial Sequence: Synthetic oligonucleotide
  Target: SCN10A; (-) strand; PAM type: NRG; PAM sequence: AAG
gaagagaggcaggtattaga

SEQ ID NO: 26542 - DNA, 20 bp, Artificial Sequence
  Description of Artificial Sequence: Synthetic oligonucleotide
  Target: SCN10A; (-) strand; PAM type: NRG; PAM sequence: TAG
catagaagagaggcaggtat

SEQ ID NO: 26543 - DNA, 20 bp, Artificial Sequence
  Description of Artificial Sequence: Synthetic oligonucleotide
  Target: SCN10A; (-) strand; PAM type: NRG; PAM sequence: AGG
aaaagacatagaagagaggc

SEQ ID NO: 26544 - DNA, 20 bp, Artificial Sequence
  Description of Artificial Sequence: Synthetic oligonucleotide
  Target: SCN10A; (-) strand; PAM type: NRG; PAM sequence: CAG
aaaaagacatagaagagagg

SEQ ID NO: 26545 - DNA, 20 bp, Artificial Sequence
  Description of Artificial Sequence: Synthetic oligonucleotide
  Target: SCN10A; (-) strand; PAM type: NRG; PAM sequence: AGG
agtaaaaagacatagaagag

SEQ ID NO: 26546 - DNA, 20 bp, Artificial Sequence
  Description of Artificial Sequence: Synthetic oligonucleotide
  Target: SCN10A; (-) strand; PAM type: NRG; PAM sequence: GAG
cagtaaaaagacatagaaga

SEQ ID NO: 26547 - DNA, 20 bp, Artificial Sequence
  Description of Artificial Sequence: Synthetic oligonucleotide
  Target: SCN10A; (-) strand; PAM type: NRG; PAM sequence: GAG
ggcagtaaaaagacatagaa

SEQ ID NO: 26548 - DNA, 20 bp, Artificial Sequence
  Description of Artificial Sequence: Synthetic oligonucleotide
  Target: SCN10A; (-) strand; PAM type: NRG; PAM sequence: AAG
atggcagtaaaaagacatag

SEQ ID NO: 26549 - DNA, 20 bp, Artificial Sequence
  Description of Artificial Sequence: Synthetic oligonucleotide
  Target: SCN10A; (-) strand; PAM type: NRG; PAM sequence: TAG
ctaatggcagtaaaaagaca

SEQ ID NO: 26550 - DNA, 20 bp, Artificial Sequence
  Description of Artificial Sequence: Synthetic oligonucleotide
  Target: SCN10A; (-) strand; PAM type: NRG; PAM sequence: AAG
ttggggctaatggcagtaaa

SEQ ID NO: 26551 - DNA, 20 bp, Artificial Sequence
  Description of Artificial Sequence: Synthetic oligonucleotide
  Target: SCN10A; (-) strand; PAM type: NRG; PAM sequence: CAG
aggctatttggggctaatgg

SEQ ID NO: 26552 - DNA, 20 bp, Artificial Sequence
  Description of Artificial Sequence: Synthetic oligonucleotide
  Target: SCN10A; (-) strand; PAM type: NRG; PAM sequence: TGG
aacaggctatttggggctaa

SEQ ID NO: 26553 - DNA, 20 bp, Artificial Sequence
  Description of Artificial Sequence: Synthetic oligonucleotide
  Target: SCN10A; (-) strand; PAM type: NRG; PAM sequence: GGG
acacagaaacaggctatttg

SEQ ID NO: 26554 - DNA, 20 bp, Artificial Sequence
  Description of Artificial Sequence: Synthetic oligonucleotide
  Target: SCN10A; (-) strand; PAM type: NRG; PAM sequence: GGG
gacacagaaacaggctattt

SEQ ID NO: 26555 - DNA, 20 bp, Artificial Sequence
  Description of Artificial Sequence: Synthetic oligonucleotide
  Target: SCN10A; (-) strand; PAM type: NRG; PAM sequence: TGG
agacacagaaacaggctatt

SEQ ID NO: 26556 - DNA, 20 bp, Artificial Sequence
  Description of Artificial Sequence: Synthetic oligonucleotide
  Target: SCN10A; (-) strand; PAM type: NRG; PAM sequence: AGG
ttgtggacagacacagaaac

SEQ ID NO: 26557 - DNA, 20 bp, Artificial Sequence
  Description of Artificial Sequence: Synthetic oligonucleotide
  Target: SCN10A; (-) strand; PAM type: NRG; PAM sequence: CAG
gttgtggacagacacagaaa

SEQ ID NO: 26558 - DNA, 20 bp, Artificial Sequence
  Description of Artificial Sequence: Synthetic oligonucleotide
  Target: SCN10A; (-) strand; PAM type: NRG; PAM sequence: CAG
acccaggttgtggacagaca

SEQ ID NO: 26559 - DNA, 20 bp, Artificial Sequence
  Description of Artificial Sequence: Synthetic oligonucleotide
  Target: SCN10A; (-) strand; PAM type: NRG; PAM sequence: CAG
tatggtacccaggttgtgga

SEQ ID NO: 26560 - DNA, 20 bp, Artificial Sequence
  Description of Artificial Sequence: Synthetic oligonucleotide
  Target: SCN10A; (-) strand; PAM type: NRG; PAM sequence: TGG
taattatggtacccaggttg

SEQ ID NO: 26561 - DNA, 20 bp, Artificial Sequence
  Description of Artificial Sequence: Synthetic oligonucleotide
  Target: SCN10A; (-) strand; PAM type: NRG; PAM sequence: AGG
agagcataattatggtaccc

SEQ ID NO: 26562 - DNA, 20 bp, Artificial Sequence
  Description of Artificial Sequence: Synthetic oligonucleotide
  Target: SCN10A; (-) strand; PAM type: NRG; PAM sequence: CAG
aagagcataattatggtacc

SEQ ID NO: 26563 - DNA, 20 bp, Artificial Sequence
  Description of Artificial Sequence: Synthetic oligonucleotide
  Target: SCN10A; (-) strand; PAM type: NRG; PAM sequence: TGG
aaatagaaagagcataatta

SEQ ID NO: 26564 - DNA, 20 bp, Artificial Sequence
  Description of Artificial Sequence: Synthetic oligonucleotide
  Target: SCN10A; (-) strand; PAM type: NRG; PAM sequence: GAG
tatgtggaatgaaatagaaa

SEQ ID NO: 26565 - DNA, 20 bp, Artificial Sequence
  Description of Artificial Sequence: Synthetic oligonucleotide
  Target: SCN10A; (-) strand; PAM type: NRG; PAM sequence: AAG
tgtatgtggaatgaaataga

SEQ ID NO: 26566 - DNA, 20 bp, Artificial Sequence
  Description of Artificial Sequence: Synthetic oligonucleotide
  Target: SCN10A; (-) strand; PAM type: NRG; PAM sequence: TAG
tgattgtatgtggaatgaaa

SEQ ID NO: 26567 - DNA, 20 bp, Artificial Sequence
  Description of Artificial Sequence: Synthetic oligonucleotide
  Target: SCN10A; (-) strand; PAM type: NRG; PAM sequence: TGG
actagatgtttgattgtatg

SEQ ID NO: 26568 - DNA, 20 bp, Artificial Sequence
  Description of Artificial Sequence: Synthetic oligonucleotide
  Target: SCN10A; (-) strand; PAM type: NRG; PAM sequence: TAG
ggaggcagaagcaacagcac

SEQ ID NO: 26569 - DNA, 20 bp, Artificial Sequence
  Description of Artificial Sequence: Synthetic oligonucleotide
  Target: SCN10A; (-) strand; PAM type: NRG; PAM sequence: CAG
tattaaggaggcagaagcaa

SEQ ID NO: 26570 - DNA, 20 bp, Artificial Sequence
  Description of Artificial Sequence: Synthetic oligonucleotide
  Target: SCN10A; (-) strand; PAM type: NRG; PAM sequence: AAG
agaagatattaaggaggcag

SEQ ID NO: 26571 - DNA, 20 bp, Artificial Sequence
  Description of Artificial Sequence: Synthetic oligonucleotide
  Target: SCN10A; (-) strand; PAM type: NRG; PAM sequence: CAG
aagagaagatattaaggagg

SEQ ID NO: 26572 - DNA, 20 bp, Artificial Sequence
  Description of Artificial Sequence: Synthetic oligonucleotide
  Target: SCN10A; (-) strand; PAM type: NRG; PAM sequence: AGG
atgaagagaagatattaagg

SEQ ID NO: 26573 - DNA, 20 bp, Artificial Sequence
  Description of Artificial Sequence: Synthetic oligonucleotide
  Target: SCN10A; (-) strand; PAM type: NRG; PAM sequence: GAG
tatgaagagaagatattaag

SEQ ID NO: 26574 - DNA, 20 bp, Artificial Sequence
  Description of Artificial Sequence: Synthetic oligonucleotide
  Target: SCN10A; (-) strand; PAM type: NRG; PAM sequence: AGG
gatatgaagagaagatatta

SEQ ID NO: 26575 - DNA, 20 bp, Artificial Sequence
  Description of Artificial Sequence: Synthetic oligonucleotide
  Target: SCN10A; (-) strand; PAM type: NRG; PAM sequence: AAG
agatatgaagagaagatatt

SEQ ID NO: 26576 - DNA, 20 bp, Artificial Sequence
  Description of Artificial Sequence: Synthetic oligonucleotide
  Target: SCN10A; (-) strand; PAM type: NRG; PAM sequence: AAG
ggttagagagatatgaagag

SEQ ID NO: 26577 - DNA, 20 bp, Artificial Sequence
  Description of Artificial Sequence: Synthetic oligonucleotide
  Target: SCN10A; (-) strand; PAM type: NRG; PAM sequence: GAG
agaggttagagagatatgaa

SEQ ID NO: 26578 - DNA, 20 bp, Artificial Sequence
  Description of Artificial Sequence: Synthetic oligonucleotide
  Target: SCN10A; (-) strand; PAM type: NRG; PAM sequence: AAG
ggagaggttagagagatatg

SEQ ID NO: 26579 - DNA, 20 bp, Artificial Sequence
  Description of Artificial Sequence: Synthetic oligonucleotide
  Target: SCN10A; (-) strand; PAM type: NRG; PAM sequence: GAG
agtatgatggagaggttaga

SEQ ID NO: 26580 - DNA, 20 bp, Artificial Sequence
  Description of Artificial Sequence: Synthetic oligonucleotide
  Target: SCN10A; (-) strand; PAM type: NRG; PAM sequence: GAG
gcagtatgatggagaggtta

SEQ ID NO: 26581 - DNA, 20 bp, Artificial Sequence
  Description of Artificial Sequence: Synthetic oligonucleotide
  Target: SCN10A; (-) strand; PAM type: NRG; PAM sequence: TAG
cagcagtatgatggagaggt

SEQ ID NO: 26582 - DNA, 20 bp, Artificial Sequence
  Description of Artificial Sequence: Synthetic oligonucleotide
  Target: SCN10A; (-) strand; PAM type: NRG; PAM sequence: AGG
ggaccagcagtatgatggag

SEQ ID NO: 26583 - DNA, 20 bp, Artificial Sequence
  Description of Artificial Sequence: Synthetic oligonucleotide
  Target: SCN10A; (-) strand; PAM type: NRG; PAM sequence: GAG
tggaccagcagtatgatgga

SEQ ID NO: 26584 - DNA, 20 bp, Artificial Sequence
  Description of Artificial Sequence: Synthetic oligonucleotide
  Target: SCN10A; (-) strand; PAM type: NRG; PAM sequence: GAG
attggaccagcagtatgatg

SEQ ID NO: 26585 - DNA, 20 bp, Artificial Sequence
  Description of Artificial Sequence: Synthetic oligonucleotide
  Target: SCN10A; (-) strand; PAM type: NRG; PAM sequence: TGG
tgattggaccagcagtatga

SEQ ID NO: 26586 - DNA, 20 bp, Artificial Sequence
  Description of Artificial Sequence: Synthetic oligonucleotide
  Target: SCN10A; (-) strand; PAM type: NRG; PAM sequence: CAG
gatgacagtgattggaccag

SEQ ID NO: 26587 - DNA, 20 bp, Artificial Sequence
  Description of Artificial Sequence: Synthetic oligonucleotide
  Target: SCN10A; (-) strand; PAM type: NRG; PAM sequence: CAG
tgagatgacagtgattggac

SEQ ID NO: 26588 - DNA, 20 bp, Artificial Sequence
  Description of Artificial Sequence: Synthetic oligonucleotide
  Target: SCN10A; (-) strand; PAM type: NRG; PAM sequence: TGG
gccagtgagatgacagtgat

SEQ ID NO: 26589 - DNA, 20 bp, Artificial Sequence
  Description of Artificial Sequence: Synthetic oligonucleotide
  Target: SCN10A; (-) strand; PAM type: NRG; PAM sequence: CAG
atacgaggccagtgagatga

SEQ ID NO: 26590 - DNA, 20 bp, Artificial Sequence
  Description of Artificial Sequence: Synthetic oligonucleotide
  Target: SCN10A; (-) strand; PAM type: NRG; PAM sequence: GAG
atgacacatacgaggccagt

SEQ ID NO: 26591 - DNA, 20 bp, Artificial Sequence
  Description of Artificial Sequence: Synthetic oligonucleotide
  Target: SCN10A; (-) strand; PAM type: NRG; PAM sequence: CAG
caaaatgacacatacgaggc

SEQ ID NO: 26592 - DNA, 20 bp, Artificial Sequence
  Description of Artificial Sequence: Synthetic oligonucleotide
  Target: SCN10A; (-) strand; PAM type: NRG; PAM sequence: AGG
gaatcaaaatgacacatacg

SEQ ID NO: 26593 - DNA, 20 bp, Artificial Sequence
  Description of Artificial Sequence: Synthetic oligonucleotide
  Target: SCN10A; (-) strand; PAM type: NRG; PAM sequence: GAG
ggaatcaaaatgacacatac

SEQ ID NO: 26594 - DNA, 20 bp, Artificial Sequence
  Description of Artificial Sequence: Synthetic oligonucleotide
  Target: SCN10A; (-) strand; PAM type: NRG; PAM sequence: GGG
taggttagaaaggactaaag

SEQ ID NO: 26595 - DNA, 20 bp, Artificial Sequence
  Description of Artificial Sequence: Synthetic oligonucleotide
  Target: SCN10A; (-) strand; PAM type: NRG; PAM sequence: GGG
ataggttagaaaggactaaa

SEQ ID NO: 26596 - DNA, 20 bp, Artificial Sequence
  Description of Artificial Sequence: Synthetic oligonucleotide
  Target: SCN10A; (-) strand; PAM type: NRG; PAM sequence: AGG
aataggttagaaaggactaa

SEQ ID NO: 26597 - DNA, 20 bp, Artificial Sequence
  Description of Artificial Sequence: Synthetic oligonucleotide
  Target: SCN10A; (-) strand; PAM type: NRG; PAM sequence: AAG
gaataggttagaaaggacta

SEQ ID NO: 26598 - DNA, 20 bp, Artificial Sequence
  Description of Artificial Sequence: Synthetic oligonucleotide
  Target: SCN10A; (-) strand; PAM type: NRG; PAM sequence: AGG
tgttggagaataggttagaa

SEQ ID NO: 26599 - DNA, 20 bp, Artificial Sequence
  Description of Artificial Sequence: Synthetic oligonucleotide
  Target: SCN10A; (-) strand; PAM type: NRG; PAM sequence: AAG
ctgttggagaataggttaga

SEQ ID NO: 26600 - DNA, 20 bp, Artificial Sequence
  Description of Artificial Sequence: Synthetic oligonucleotide
  Target: SCN10A; (-) strand; PAM type: NRG; PAM sequence: TAG
gccactgttggagaataggt

SEQ ID NO: 26601 - DNA, 20 bp, Artificial Sequence
  Description of Artificial Sequence: Synthetic oligonucleotide
  Target: SCN10A; (-) strand; PAM type: NRG; PAM sequence: AGG
tttggccactgttggagaat

SEQ ID NO: 26602 - DNA, 20 bp, Artificial Sequence
  Description of Artificial Sequence: Synthetic oligonucleotide
  Target: SCN10A; (-) strand; PAM type: NRG; PAM sequence: TAG
atttggccactgttggagaa

SEQ ID NO: 26603 - DNA, 20 bp, Artificial Sequence
  Description of Artificial Sequence: Synthetic oligonucleotide
  Target: SCN10A; (-) strand; PAM type: NRG; PAM sequence: GAG
atatcatttggccactgttg

SEQ ID NO: 26604 - DNA, 20 bp, Artificial Sequence
  Description of Artificial Sequence: Synthetic oligonucleotide
  Target: SCN10A; (-) strand; PAM type: NRG; PAM sequence: TGG
aaatatcatttggccactgt

SEQ ID NO: 26605 - DNA, 20 bp, Artificial Sequence
  Description of Artificial Sequence: Synthetic oligonucleotide
  Target: SCN10A; (-) strand; PAM type: NRG; PAM sequence: TGG
ttcattttagaaatatcatt

SEQ ID NO: 26606 - DNA, 20 bp, Artificial Sequence
  Description of Artificial Sequence: Synthetic oligonucleotide
  Target: SCN10A; (-) strand; PAM type: NRG; PAM sequence: TAG
acataaccagattttcattt

SEQ ID NO: 26607 - DNA, 20 bp, Artificial Sequence
  Description of Artificial Sequence: Synthetic oligonucleotide
  Target: SCN10A; (-) strand; PAM type: NRG; PAM sequence: CAG
aaataaagatatcacataac

SEQ ID NO: 26608 - DNA, 20 bp, Artificial Sequence
  Description of Artificial Sequence: Synthetic oligonucleotide
  Target: SCN10A; (-) strand; PAM type: NRG; PAM sequence: AAG
ctttagaatgattttaaata

SEQ ID NO: 26609 - DNA, 20 bp, Artificial Sequence
  Description of Artificial Sequence: Synthetic oligonucleotide
  Target: SCN10A; (-) strand; PAM type: NRG; PAM sequence: TAG
ttgagtgctatggagagctt

SEQ ID NO: 26610 - DNA, 20 bp, Artificial Sequence
  Description of Artificial Sequence: Synthetic oligonucleotide
  Target: SCN10A; (-) strand; PAM type: NRG; PAM sequence: GAG
gttatcttgagtgctatgga

SEQ ID NO: 26611 - DNA, 20 bp, Artificial Sequence
  Description of Artificial Sequence: Synthetic oligonucleotide
  Target: SCN10A; (-) strand; PAM type: NRG; PAM sequence: GAG
gggttatcttgagtgctatg

SEQ ID NO: 26612 - DNA, 20 bp, Artificial Sequence
  Description of Artificial Sequence: Synthetic oligonucleotide
  Target: SCN10A; (-) strand; PAM type: NRG; PAM sequence: TGG
ttgggttatcttgagtgcta

SEQ ID NO: 26613 - DNA, 20 bp, Artificial Sequence
  Description of Artificial Sequence: Synthetic oligonucleotide
  Target: SCN10A; (-) strand; PAM type: NRG; PAM sequence: GAG
cgcacagtttgggttatctt

SEQ ID NO: 26614 - DNA, 20 bp, Artificial Sequence
  Description of Artificial Sequence: Synthetic oligonucleotide
  Target: SCN10A; (-) strand; PAM type: NRG; PAM sequence: GGG
gagaggtcagcgcacagttt

SEQ ID NO: 26615 - DNA, 20 bp, Artificial Sequence
  Description of Artificial Sequence: Synthetic oligonucleotide
  Target: SCN10A; (-) strand; PAM type: NRG; PAM sequence: TGG
ggagaggtcagcgcacagtt

SEQ ID NO: 26616 - DNA, 20 bp, Artificial Sequence
  Description of Artificial Sequence: Synthetic oligonucleotide
  Target: SCN10A; (-) strand; PAM type: NRG; PAM sequence: CAG
atgctggagaggtcagcgca

SEQ ID NO: 26617 - DNA, 20 bp, Artificial Sequence
  Description of Artificial Sequence: Synthetic oligonucleotide
  Target: SCN10A; (-) strand; PAM type: NRG; PAM sequence: CAG
gactaccatgctggagaggt

SEQ ID NO: 26618 - DNA, 20 bp, Artificial Sequence
  Description of Artificial Sequence: Synthetic oligonucleotide
  Target: SCN10A; (-) strand; PAM type: NRG; PAM sequence: AGG
tggggactaccatgctggag

SEQ ID NO: 26619 - DNA, 20 bp, Artificial Sequence
  Description of Artificial Sequence: Synthetic oligonucleotide
  Target: SCN10A; (-) strand; PAM type: NRG; PAM sequence: GAG
ctggggactaccatgctgga

SEQ ID NO: 26620 - DNA, 20 bp, Artificial Sequence
  Description of Artificial Sequence: Synthetic oligonucleotide
  Target: SCN10A; (-) strand; PAM type: NRG; PAM sequence: GAG
ggctggggactaccatgctg

SEQ ID NO: 26621 - DNA, 20 bp, Artificial Sequence
  Description of Artificial Sequence: Synthetic oligonucleotide
  Target: SCN10A; (-) strand; PAM type: NRG; PAM sequence: TGG
gtggctggggactaccatgc

SEQ ID NO: 26622 - DNA, 20 bp, Artificial Sequence
  Description of Artificial Sequence: Synthetic oligonucleotide
  Target: SCN10A; (-) strand; PAM type: NRG; PAM sequence: GGG
ttataaaagtagtgtggctg

SEQ ID NO: 26623 - DNA, 20 bp, Artificial Sequence
  Description of Artificial Sequence: Synthetic oligonucleotide
  Target: SCN10A; (-) strand; PAM type: NRG; PAM sequence: GGG
cttataaaagtagtgtggct

SEQ ID NO: 26624 - DNA, 20 bp, Artificial Sequence
  Description of Artificial Sequence: Synthetic oligonucleotide
  Target: SCN10A; (-) strand; PAM type: NRG; PAM sequence: TGG
acttataaaagtagtgtggc

SEQ ID NO: 26625 - DNA, 20 bp, Artificial Sequence
  Description of Artificial Sequence: Synthetic oligonucleotide
  Target: SCN10A; (-) strand; PAM type: NRG; PAM sequence: TGG
ataaacttataaaagtagtg

SEQ ID NO: 26626 - DNA, 20 bp, Artificial Sequence
  Description of Artificial Sequence: Synthetic oligonucleotide
  Target: SCN10A; (-) strand; PAM type: NRG; PAM sequence: TAG
caaggataaacttataaaag

SEQ ID NO: 26627 - DNA, 20 bp, Artificial Sequence
  Description of Artificial Sequence: Synthetic oligonucleotide
  Target: SCN10A; (-) strand; PAM type: NRG; PAM sequence: AAG
attcaaggataaacttataa

SEQ ID NO: 26628 - DNA, 20 bp, Artificial Sequence
  Description of Artificial Sequence: Synthetic oligonucleotide
  Target: SCN10A; (-) strand; PAM type: NRG; PAM sequence: AGG
aaaagaatgggtcaaattca

SEQ ID NO: 26629 - DNA, 20 bp, Artificial Sequence
  Description of Artificial Sequence: Synthetic oligonucleotide
  Target: SCN10A; (-) strand; PAM type: NRG; PAM sequence: AAG
aaaaagaatgggtcaaattc

SEQ ID NO: 26630 - DNA, 20 bp, Artificial Sequence
  Description of Artificial Sequence: Synthetic oligonucleotide
  Target: SCN10A; (-) strand; PAM type: NRG; PAM sequence: GGG
gccttaacataaaaaagaat

SEQ ID NO: 26631 - DNA, 20 bp, Artificial Sequence
  Description of Artificial Sequence: Synthetic oligonucleotide
  Target: SCN10A; (-) strand; PAM type: NRG; PAM sequence: TGG
agccttaacataaaaaagaa

SEQ ID NO: 26632 - DNA, 20 bp, Artificial Sequence
  Description of Artificial Sequence: Synthetic oligonucleotide
  Target: SCN10A; (-) strand; PAM type: NRG; PAM sequence: AAG
ggaaaagccttaacataaaa

SEQ ID NO: 26633 - DNA, 20 bp, Artificial Sequence
  Description of Artificial Sequence: Synthetic oligonucleotide
  Target: SCN10A; (-) strand; PAM type: NRG; PAM sequence: AAG
aaaggaaggggaatatggaa

SEQ ID NO: 26634 - DNA, 20 bp, Artificial Sequence
  Description of Artificial Sequence: Synthetic oligonucleotide
  Target: SCN10A; (-) strand; PAM type: NRG; PAM sequence: TGG
taggcaaaggaaggggaata

SEQ ID NO: 26635 - DNA, 20 bp, Artificial Sequence
  Description of Artificial Sequence: Synthetic oligonucleotide
  Target: SCN10A; (-) strand; PAM type: NRG; PAM sequence: GGG
ataattttaggcaaaggaag

SEQ ID NO: 26636 - DNA, 20 bp, Artificial Sequence
  Description of Artificial Sequence: Synthetic oligonucleotide
  Target: SCN10A; (-) strand; PAM type: NRG; PAM sequence: GGG
gataattttaggcaaaggaa

SEQ ID NO: 26637 - DNA, 20 bp, Artificial Sequence
  Description of Artificial Sequence: Synthetic oligonucleotide
  Target: SCN10A; (-) strand; PAM type: NRG; PAM sequence: AGG
agataattttaggcaaagga

SEQ ID NO: 26638 - DNA, 20 bp, Artificial Sequence
  Description of Artificial Sequence: Synthetic oligonucleotide
  Target: SCN10A; (-) strand; PAM type: NRG; PAM sequence: AAG
aagataattttaggcaaagg

SEQ ID NO: 26639 - DNA, 20 bp, Artificial Sequence
  Description of Artificial Sequence: Synthetic oligonucleotide
  Target: SCN10A; (-) strand; PAM type: NRG; PAM sequence: AGG
ggaaagataattttaggcaa

SEQ ID NO: 26640 - DNA, 20 bp, Artificial Sequence
  Description of Artificial Sequence: Synthetic oligonucleotide
  Target: SCN10A; (-) strand; PAM type: NRG; PAM sequence: AAG
tggaaagataattttaggca

SEQ ID NO: 26641 - DNA, 20 bp, Artificial Sequence
  Description of Artificial Sequence: Synthetic oligonucleotide
  Target: SCN10A; (-) strand; PAM type: NRG; PAM sequence: AGG
taaagtggaaagataatttt

SEQ ID NO: 26642 - DNA, 20 bp, Artificial Sequence
  Description of Artificial Sequence: Synthetic oligonucleotide
  Target: SCN10A; (-) strand; PAM type: NRG; PAM sequence: TAG
ataaagtggaaagataattt

SEQ ID NO: 26643 - DNA, 20 bp, Artificial Sequence
  Description of Artificial Sequence: Synthetic oligonucleotide
  Target: SCN10A; (-) strand; PAM type: NRG; PAM sequence: AAG
gccagacaaaataaagtgga

SEQ ID NO: 26644 - DNA, 20 bp, Artificial Sequence
  Description of Artificial Sequence: Synthetic oligonucleotide
  Target: SCN10A; (-) strand; PAM type: NRG; PAM sequence: TGG
attagccagacaaaataaag

SEQ ID NO: 26645 - DNA, 20 bp, Artificial Sequence
  Description of Artificial Sequence: Synthetic oligonucleotide
  Target: SCN10A; (-) strand; PAM type: NRG; PAM sequence: AAG
aggattagccagacaaaata

SEQ ID NO: 26646 - DNA, 20 bp, Artificial Sequence
  Description of Artificial Sequence: Synthetic oligonucleotide
  Target: SCN10A; (-) strand; PAM type: NRG; PAM sequence: CAG
aagaataagagaggattagc

SEQ ID NO: 26647 - DNA, 20 bp, Artificial Sequence
  Description of Artificial Sequence: Synthetic oligonucleotide
  Target: SCN10A; (-) strand; PAM type: NRG; PAM sequence: TAG
gtacaagaataagagaggat

SEQ ID NO: 26648 - DNA, 20 bp, Artificial Sequence
  Description of Artificial Sequence: Synthetic oligonucleotide
  Target: SCN10A; (-) strand; PAM type: NRG; PAM sequence: AGG
caagagtacaagaataagag

SEQ ID NO: 26649 - DNA, 20 bp, Artificial Sequence
  Description of Artificial Sequence: Synthetic oligonucleotide
  Target: SCN10A; (-) strand; PAM type: NRG; PAM sequence: GAG
ccaagagtacaagaataaga

SEQ ID NO: 26650 - DNA, 20 bp, Artificial Sequence
  Description of Artificial Sequence: Synthetic oligonucleotide
  Target: SCN10A; (-) strand; PAM type: NRG; PAM sequence: GAG
agccaagagtacaagaataa

SEQ ID NO: 26651 - DNA, 20 bp, Artificial Sequence
  Description of Artificial Sequence: Synthetic oligonucleotide
  Target: SCN10A; (-) strand; PAM type: NRG; PAM sequence: AAG
aaagccaagagtacaagaat

SEQ ID NO: 26652 - DNA, 20 bp, Artificial Sequence
  Description of Artificial Sequence: Synthetic oligonucleotide
  Target: SCN10A; (-) strand; PAM type: NRG; PAM sequence: AAG
tgtctcaaagccaagagtac

SEQ ID NO: 26653 - DNA, 20 bp, Artificial Sequence
  Description of Artificial Sequence: Synthetic oligonucleotide
  Target: SCN10A; (-) strand; PAM type: NRG; PAM sequence: GAG
agaaattgtctcaaagccaa

SEQ ID NO: 26654 - DNA, 20 bp, Artificial Sequence
  Description of Artificial Sequence: Synthetic oligonucleotide
  Target: SCN10A; (-) strand; PAM type: NRG; PAM sequence: AAG
gaagaaattgtctcaaagcc

SEQ ID NO: 26655 - DNA, 20 bp, Artificial Sequence
  Description of Artificial Sequence: Synthetic oligonucleotide
  Target: SCN10A; (-) strand; PAM type: NRG; PAM sequence: AAG
aaatggaagaaattgtctca

SEQ ID NO: 26656 - DNA, 20 bp, Artificial Sequence
  Description of Artificial Sequence: Synthetic oligonucleotide
  Target: SCN10A; (-) strand; PAM type: NRG; PAM sequence: AAG
ttcatataggtcagaaatgg

SEQ ID NO: 26657 - DNA, 20 bp, Artificial Sequence
  Description of Artificial Sequence: Synthetic oligonucleotide
  Target: SCN10A; (-) strand; PAM type: NRG; PAM sequence: TGG
gacttcatataggtcagaaa

SEQ ID NO: 26658 - DNA, 20 bp, Artificial Sequence
  Description of Artificial Sequence: Synthetic oligonucleotide
  Target: SCN10A; (-) strand; PAM type: NRG; PAM sequence: CAG
aacatagacttcatataggt

SEQ ID NO: 26659 - DNA, 20 bp, Artificial Sequence
  Description of Artificial Sequence: Synthetic oligonucleotide
  Target: SCN10A; (-) strand; PAM type: NRG; PAM sequence: AGG
tcctaacatagacttcatat

SEQ ID NO: 26660 - DNA, 20 bp, Artificial Sequence
  Description of Artificial Sequence: Synthetic oligonucleotide
  Target: SCN10A; (-) strand; PAM type: NRG; PAM sequence: TAG
atcctaacatagacttcata

SEQ ID NO: 26661 - DNA, 20 bp, Artificial Sequence
  Description of Artificial Sequence: Synthetic oligonucleotide
  Target: SCN10A; (-) strand; PAM type: NRG; PAM sequence: TAG
atgaaacaggaatcctaaca

SEQ ID NO: 26662 - DNA, 20 bp, Artificial Sequence
  Description of Artificial Sequence: Synthetic oligonucleotide
  Target: SCN10A; (-) strand; PAM type: NRG; PAM sequence: AGG
gagttatgggaacatgaaac

SEQ ID NO: 26663 - DNA, 20 bp, Artificial Sequence
  Description of Artificial Sequence: Synthetic oligonucleotide
  Target: SCN10A; (-) strand; PAM type: NRG; PAM sequence: CAG
agagttatgggaacatgaaa

SEQ ID NO: 26664 - DNA, 20 bp, Artificial Sequence
  Description of Artificial Sequence: Synthetic oligonucleotide
  Target: SCN10A; (-) strand; PAM type: NRG; PAM sequence: GGG
gagaaagtgcagagagttat

SEQ ID NO: 26665 - DNA, 20 bp, Artificial Sequence
  Description of Artificial Sequence: Synthetic oligonucleotide
  Target: SCN10A; (-) strand; PAM type: NRG; PAM sequence: TGG
agagaaagtgcagagagtta

SEQ ID NO: 26666 - DNA, 20 bp, Artificial Sequence
  Description of Artificial Sequence: Synthetic oligonucleotide
  Target: SCN10A; (-) strand; PAM type: NRG; PAM sequence: GAG
gtttatagagaaagtgcaga

SEQ ID NO: 26667 - DNA, 20 bp, Artificial Sequence
  Description of Artificial Sequence: Synthetic oligonucleotide
  Target: SCN10A; (-) strand; PAM type: NRG; PAM sequence: GAG
atgtttatagagaaagtgca

SEQ ID NO: 26668 - DNA, 20 bp, Artificial Sequence
  Description of Artificial Sequence: Synthetic oligonucleotide
  Target: SCN10A; (-) strand; PAM type: NRG; PAM sequence: CAG
agatgtttatagagaaagtg

SEQ ID NO: 26669 - DNA, 20 bp, Artificial Sequence
  Description of Artificial Sequence: Synthetic oligonucleotide
  Target: SCN10A; (-) strand; PAM type: NRG; PAM sequence: AAG
aaatcagatgtttatagaga

SEQ ID NO: 26670 - DNA, 20 bp, Artificial Sequence
  Description of Artificial Sequence: Synthetic oligonucleotide
  Target: SCN10A; (-) strand; PAM type: NRG; PAM sequence: GAG
ttacaaatcagatgtttata

SEQ ID NO: 26671 - DNA, 20 bp, Artificial Sequence
  Description of Artificial Sequence: Synthetic oligonucleotide
  Target: SCN10A; (-) strand; PAM type: NRG; PAM sequence: TAG
aattacaaatcagatgttta

SEQ ID NO: 26672 - DNA, 20 bp, Artificial Sequence
  Description of Artificial Sequence: Synthetic oligonucleotide
  Target: SCN10A; (-) strand; PAM type: NRG; PAM sequence: CAG
ggcaaacagaaattacaaat

SEQ ID NO: 26673 - DNA, 20 bp, Artificial Sequence
  Description of Artificial Sequence: Synthetic oligonucleotide
  Target: SCN10A; (-) strand; PAM type: NRG; PAM sequence: CAG
agaaacaatagaaaggcaaa

SEQ ID NO: 26674 - DNA, 20 bp, Artificial Sequence
  Description of Artificial Sequence: Synthetic oligonucleotide
  Target: SCN10A; (-) strand; PAM type: NRG; PAM sequence: AGG
atttggtagaaacaatagaa

SEQ ID NO: 26675 - DNA, 20 bp, Artificial Sequence
  Description of Artificial Sequence: Synthetic oligonucleotide
  Target: SCN10A; (-) strand; PAM type: NRG; PAM sequence: AAG
aatttggtagaaacaataga

SEQ ID NO: 26676 - DNA, 20 bp, Artificial Sequence
  Description of Artificial Sequence: Synthetic oligonucleotide
  Target: SCN10A; (-) strand; PAM type: NRG; PAM sequence: TAG
ttacaatttggtagaaacaa

SEQ ID NO: 26677 - DNA, 20 bp, Artificial Sequence
  Description of Artificial Sequence: Synthetic oligonucleotide
  Target: SCN10A; (-) strand; PAM type: NRG; PAM sequence: TAG
tcactgagcttacaatttgg

SEQ ID NO: 26678 - DNA, 20 bp, Artificial Sequence
  Description of Artificial Sequence: Synthetic oligonucleotide
  Target: SCN10A; (-) strand; PAM type: NRG; PAM sequence: TGG
ctctcactgagcttacaatt

SEQ ID NO: 26679 - DNA, 20 bp, Artificial Sequence
  Description of Artificial Sequence: Synthetic oligonucleotide
  Target: SCN10A; (-) strand; PAM type: NRG; PAM sequence: GAG
atgtgagtccagctctcact

SEQ ID NO: 26680 - DNA, 20 bp, Artificial Sequence
  Description of Artificial Sequence: Synthetic oligonucleotide
  Target: SCN10A; (-) strand; PAM type: NRG; PAM sequence: CAG
gaacaaaatagatgtgagtc

SEQ ID NO: 26681 - DNA, 20 bp, Artificial Sequence
  Description of Artificial Sequence: Synthetic oligonucleotide
  Target: SCN10A; (-) strand; PAM type: NRG; PAM sequence: GAG
atgctgaacaaaatagatgt

SEQ ID NO: 26682 - DNA, 20 bp, Artificial Sequence
  Description of Artificial Sequence: Synthetic oligonucleotide
  Target: SCN10A; (-) strand; PAM type: NRG; PAM sequence: TAG
aaaatcaatgctgaacaaaa

SEQ ID NO: 26683 - DNA, 20 bp, Artificial Sequence
  Description of Artificial Sequence: Synthetic oligonucleotide
  Target: SCN10A; (-) strand; PAM type: NRG; PAM sequence: TGG
ccaggcactgtactaggttc

SEQ ID NO: 26684 - DNA, 20 bp, Artificial Sequence
  Description of Artificial Sequence: Synthetic oligonucleotide
  Target: SCN10A; (-) strand; PAM type: NRG; PAM sequence: AGG
ttagttccaggcactgtact

SEQ ID NO: 26685 - DNA, 20 bp, Artificial Sequence
  Description of Artificial Sequence: Synthetic oligonucleotide
  Target: SCN10A; (-) strand; PAM type: NRG; PAM sequence: TAG
gttagttccaggcactgtac

SEQ ID NO: 26686 - DNA, 20 bp, Artificial Sequence
  Description of Artificial Sequence: Synthetic oligonucleotide
  Target: SCN10A; (-) strand; PAM type: NRG; PAM sequence: AGG
ttctgtatctagttagttcc

SEQ ID NO: 26687 - DNA, 20 bp, Artificial Sequence
  Description of Artificial Sequence: Synthetic oligonucleotide
  Target: SCN10A; (-) strand; PAM type: NRG; PAM sequence: CAG
attctgtatctagttagttc

SEQ ID NO: 26688 - DNA, 20 bp, Artificial Sequence
  Description of Artificial Sequence: Synthetic oligonucleotide
  Target: SCN10A; (-) strand; PAM type: NRG; PAM sequence: TAG
ctatctattctgtatctagt

SEQ ID NO: 26689 - DNA, 20 bp, Artificial Sequence
  Description of Artificial Sequence: Synthetic oligonucleotide
  Target: SCN10A; (-) strand; PAM type: NRG; PAM sequence: TAG
acaactatctattctgtatc

SEQ ID NO: 26690 - DNA, 20 bp, Artificial Sequence
  Description of Artificial Sequence: Synthetic oligonucleotide
  Target: SCN10A; (-) strand; PAM type: NRG; PAM sequence: AAG
tctttagtttttcagctatt

SEQ ID NO: 26691 - DNA, 20 bp, Artificial Sequence
  Description of Artificial Sequence: Synthetic oligonucleotide
  Target: SCN10A; (-) strand; PAM type: NRG; PAM sequence: CAG
caaaatgttctttagttttt

SEQ ID NO: 26692 - DNA, 20 bp, Artificial Sequence
  Description of Artificial Sequence: Synthetic oligonucleotide
  Target: SCN10A; (-) strand; PAM type: NRG; PAM sequence: TAG
tttctgaacaaaatgttctt

SEQ ID NO: 26693 - DNA, 20 bp, Artificial Sequence
  Description of Artificial Sequence: Synthetic oligonucleotide
  Target: SCN10A; (-) strand; PAM type: NRG; PAM sequence: TGG
gttccttatattcctattat

SEQ ID NO: 26694 - DNA, 20 bp, Artificial Sequence
  Description of Artificial Sequence: Synthetic oligonucleotide
  Target: SCN10A; (-) strand; PAM type: NRG; PAM sequence: TGG
aatagactcaataatctctt

SEQ ID NO: 26695 - DNA, 20 bp, Artificial Sequence
  Description of Artificial Sequence: Synthetic oligonucleotide
  Target: SCN10A; (-) strand; PAM type: NRG; PAM sequence: TAG
tgtgagctttaaaatgtcaa

SEQ ID NO: 26696 - DNA, 20 bp, Artificial Sequence
  Description of Artificial Sequence: Synthetic oligonucleotide
  Target: SCN10A; (-) strand; PAM type: NRG; PAM sequence: GAG
tgcttgactttggggtgtgt

SEQ ID NO: 26697 - DNA, 20 bp, Artificial Sequence
  Description of Artificial Sequence: Synthetic oligonucleotide
  Target: SCN10A; (-) strand; PAM type: NRG; PAM sequence: GGG
ccaccatctgcttgactttg

SEQ ID NO: 26698 - DNA, 20 bp, Artificial Sequence
  Description of Artificial Sequence: Synthetic oligonucleotide
  Target: SCN10A; (-) strand; PAM type: NRG; PAM sequence: GGG
gccaccatctgcttgacttt

SEQ ID NO: 26699 - DNA, 20 bp, Artificial Sequence
  Description of Artificial Sequence: Synthetic oligonucleotide
  Target: SCN10A; (-) strand; PAM type: NRG; PAM sequence: TGG
tgccaccatctgcttgactt

SEQ ID NO: 26700 - DNA, 20 bp, Artificial Sequence
  Description of Artificial Sequence: Synthetic oligonucleotide
  Target: SCN10A; (-) strand; PAM type: NRG; PAM sequence: AAG
atcataggggtatttgattt

SEQ ID NO: 26701 - DNA, 20 bp, Artificial Sequence
  Description of Artificial Sequence: Synthetic oligonucleotide
  Target: SCN10A; (-) strand; PAM type: NRG; PAM sequence: GGG
aagcaggatctccatcatag

SEQ ID NO: 26702 - DNA, 20 bp, Artificial Sequence
  Description of Artificial Sequence: Synthetic oligonucleotide
  Target: SCN10A; (-) strand; PAM type: NRG; PAM sequence: GGG
caagcaggatctccatcata

SEQ ID NO: 26703 - DNA, 20 bp, Artificial Sequence
  Description of Artificial Sequence: Synthetic oligonucleotide
  Target: SCN10A; (-) strand; PAM type: NRG; PAM sequence: AGG
gcaagcaggatctccatcat

SEQ ID NO: 26704 - DNA, 20 bp, Artificial Sequence
  Description of Artificial Sequence: Synthetic oligonucleotide
  Target: SCN10A; (-) strand; PAM type: NRG; PAM sequence: TAG
agcaagcaggatctccatca

SEQ ID NO: 26705 - DNA, 20 bp, Artificial Sequence
  Description of Artificial Sequence: Synthetic oligonucleotide
  Target: SCN10A; (-) strand; PAM type: NRG; PAM sequence: AGG
taggtatggtgggagcaagc

SEQ ID NO: 26706 - DNA, 20 bp, Artificial Sequence
  Description of Artificial Sequence: Synthetic oligonucleotide
  Target: SCN10A; (-) strand; PAM type: NRG; PAM sequence: CAG
ctaggtatggtgggagcaag

SEQ ID NO: 26707 - DNA, 20 bp, Artificial Sequence
  Description of Artificial Sequence: Synthetic oligonucleotide
  Target: SCN10A; (-) strand; PAM type: NRG; PAM sequence: AAG
cctctaggtatggtgggagc

SEQ ID NO: 26708 - DNA, 20 bp, Artificial Sequence
  Description of Artificial Sequence: Synthetic oligonucleotide
  Target: SCN10A; (-) strand; PAM type: NRG; PAM sequence: GAG
aatacctctaggtatggtgg

SEQ ID NO: 26709 - DNA, 20 bp, Artificial Sequence
  Description of Artificial Sequence: Synthetic oligonucleotide
  Target: SCN10A; (-) strand; PAM type: NRG; PAM sequence: GGG
gaaatacctctaggtatggt

SEQ ID NO: 26710 - DNA, 20 bp, Artificial Sequence
  Description of Artificial Sequence: Synthetic oligonucleotide
  Target: SCN10A; (-) strand; PAM type: NRG; PAM sequence: TGG
agaaatacctctaggtatgg

SEQ ID NO: 26711 - DNA, 20 bp, Artificial Sequence
  Description of Artificial Sequence: Synthetic oligonucleotide
  Target: SCN10A; (-) strand; PAM type: NRG; PAM sequence: TGG
tcaagaaatacctctaggta

SEQ ID NO: 26712 - DNA, 20 bp, Artificial Sequence
  Description of Artificial Sequence: Synthetic oligonucleotide
  Target: SCN10A; (-) strand; PAM type: NRG; PAM sequence: AGG
tggattcaagaaatacctct

SEQ ID NO: 26713 - DNA, 20 bp, Artificial Sequence
  Description of Artificial Sequence: Synthetic oligonucleotide
  Target: SCN10A; (-) strand; PAM type: NRG; PAM sequence: TAG
ttggattcaagaaatacctc

SEQ ID NO: 26714 - DNA, 20 bp, Artificial Sequence
  Description of Artificial Sequence: Synthetic oligonucleotide
  Target: SCN10A; (-) strand; PAM type: NRG; PAM sequence: AAG
atcacagaggtattggattc

SEQ ID NO: 26715 - DNA, 20 bp, Artificial Sequence
  Description of Artificial Sequence: Synthetic oligonucleotide
  Target: SCN10A; (-) strand; PAM type: NRG; PAM sequence: TGG
tgtctatatcacagaggtat

SEQ ID NO: 26716 - DNA, 20 bp, Artificial Sequence
  Description of Artificial Sequence: Synthetic oligonucleotide
  Target: SCN10A; (-) strand; PAM type: NRG; PAM sequence: AGG
aagcagtgtctatatcacag

SEQ ID NO: 26717 - DNA, 20 bp, Artificial Sequence
  Description of Artificial Sequence: Synthetic oligonucleotide
  Target: SCN10A; (-) strand; PAM type: NRG; PAM sequence: GAG
taagcagtgtctatatcaca

SEQ ID NO: 26718 - DNA, 20 bp, Artificial Sequence
  Description of Artificial Sequence: Synthetic oligonucleotide
  Target: SCN10A; (-) strand; PAM type: NRG; PAM sequence: CAG
aataagcagtgtctatatca

SEQ ID NO: 26719 - DNA, 20 bp, Artificial Sequence
  Description of Artificial Sequence: Synthetic oligonucleotide
  Target: SCN10A; (-) strand; PAM type: NRG; PAM sequence: CAG
ctagggctggtgacaataag

SEQ ID NO: 26720 - DNA, 20 bp, Artificial Sequence
  Description of Artificial Sequence: Synthetic oligonucleotide
  Target: SCN10A; (-) strand; PAM type: NRG; PAM sequence: AAG
cctctagggctggtgacaat

SEQ ID NO: 26721 - DNA, 20 bp, Artificial Sequence
  Description of Artificial Sequence: Synthetic oligonucleotide
  Target: SCN10A; (-) strand; PAM type: NRG; PAM sequence: TGG
accagagctgcctctagggc

SEQ ID NO: 26722 - DNA, 20 bp, Artificial Sequence
  Description of Artificial Sequence: Synthetic oligonucleotide
  Target: SCN10A; (-) strand; PAM type: NRG; PAM sequence: GGG
gggtaccagagctgcctcta

SEQ ID NO: 26723 - DNA, 20 bp, Artificial Sequence
  Description of Artificial Sequence: Synthetic oligonucleotide
  Target: SCN10A; (-) strand; PAM type: NRG; PAM sequence: AGG
tgggtaccagagctgcctct

SEQ ID NO: 26724 - DNA, 20 bp, Artificial Sequence
  Description of Artificial Sequence: Synthetic oligonucleotide
  Target: SCN10A; (-) strand; PAM type: NRG; PAM sequence: TAG
ttgggtaccagagctgcctc

SEQ ID NO: 26725 - DNA, 20 bp, Artificial Sequence
  Description of Artificial Sequence: Synthetic oligonucleotide
  Target: SCN10A; (-) strand; PAM type: NRG; PAM sequence: GAG
catatgggtattgggtacca

SEQ ID NO: 26726 - DNA, 20 bp, Artificial Sequence
  Description of Artificial Sequence: Synthetic oligonucleotide
  Target: SCN10A; (-) strand; PAM type: NRG; PAM sequence: CAG
tacatatgggtattgggtac

SEQ ID NO: 26727 - DNA, 20 bp, Artificial Sequence
  Description of Artificial Sequence: Synthetic oligonucleotide
  Target: SCN10A; (-) strand; PAM type: NRG; PAM sequence: GGG
gcctcctacatatgggtatt

SEQ ID NO: 26728 - DNA, 20 bp, Artificial Sequence
  Description of Artificial Sequence: Synthetic oligonucleotide
  Target: SCN10A; (-) strand; PAM type: NRG; PAM sequence: TGG
agcctcctacatatgggtat

SEQ ID NO: 26729 - DNA, 20 bp, Artificial Sequence
  Description of Artificial Sequence: Synthetic oligonucleotide
  Target: SCN10A; (-) strand; PAM type: NRG; PAM sequence: GGG
cagcagagcctcctacatat

SEQ ID NO: 26730 - DNA, 20 bp, Artificial Sequence
  Description of Artificial Sequence: Synthetic oligonucleotide
  Target: SCN10A; (-) strand; PAM type: NRG; PAM sequence: TGG
ccagcagagcctcctacata

SEQ ID NO: 26731 - DNA, 20 bp, Artificial Sequence
  Description of Artificial Sequence: Synthetic oligonucleotide
  Target: SCN10A; (-) strand; PAM type: NRG; PAM sequence: GAG
aggactggtgacaaccagca

SEQ ID NO: 26732 - DNA, 20 bp, Artificial Sequence
  Description of Artificial Sequence: Synthetic oligonucleotide
  Target: SCN10A; (-) strand; PAM type: NRG; PAM sequence: CAG
gaaggactggtgacaaccag

SEQ ID NO: 26733 - DNA, 20 bp, Artificial Sequence
  Description of Artificial Sequence: Synthetic oligonucleotide
  Target: SCN10A; (-) strand; PAM type: NRG; PAM sequence: CAG
atggaaggactggtgacaac

SEQ ID NO: 26734 - DNA, 20 bp, Artificial Sequence
  Description of Artificial Sequence: Synthetic oligonucleotide
  Target: SCN10A; (-) strand; PAM type: NRG; PAM sequence: TGG
acttcaatgcatggaaggac

SEQ ID NO: 26735 - DNA, 20 bp, Artificial Sequence
  Description of Artificial Sequence: Synthetic oligonucleotide
  Target: SCN10A; (-) strand; PAM type: NRG; PAM sequence: AGG
ccaggacttcaatgcatgga

SEQ ID NO: 26736 - DNA, 20 bp, Artificial Sequence
  Description of Artificial Sequence: Synthetic oligonucleotide
  Target: SCN10A; (-) strand; PAM type: NRG; PAM sequence: AAG
cccaggacttcaatgcatgg

SEQ ID NO: 26737 - DNA, 20 bp, Artificial Sequence
  Description of Artificial Sequence: Synthetic oligonucleotide
  Target: SCN10A; (-) strand; PAM type: NRG; PAM sequence: TGG
cctcccaggacttcaatgca

SEQ ID NO: 26738 - DNA, 20 bp, Artificial Sequence
  Description of Artificial Sequence: Synthetic oligonucleotide
  Target: SCN10A; (-) strand; PAM type: NRG; PAM sequence: AGG
gagcagtgagtgctcctccc

SEQ ID NO: 26739 - DNA, 20 bp, Artificial Sequence
  Description of Artificial Sequence: Synthetic oligonucleotide
  Target: SCN10A; (-) strand; PAM type: NRG; PAM sequence: CAG
agagcagtgagtgctcctcc

SEQ ID NO: 26740 - DNA, 20 bp, Artificial Sequence
  Description of Artificial Sequence: Synthetic oligonucleotide
  Target: SCN10A; (-) strand; PAM type: NRG; PAM sequence: GAG
aggaatggtgtcagagcagt

SEQ ID NO: 26741 - DNA, 20 bp, Artificial Sequence
  Description of Artificial Sequence: Synthetic oligonucleotide
  Target: SCN10A; (-) strand; PAM type: NRG; PAM sequence: CAG
gaagaggaatggtgtcagag

SEQ ID NO: 26742 - DNA, 20 bp, Artificial Sequence
  Description of Artificial Sequence: Synthetic oligonucleotide
  Target: SCN10A; (-) strand; PAM type: NRG; PAM sequence: GAG
aaggaagaggaatggtgtca

SEQ ID NO: 26743 - DNA, 20 bp, Artificial Sequence
  Description of Artificial Sequence: Synthetic oligonucleotide
  Target: SCN10A; (-) strand; PAM type: NRG; PAM sequence: CAG
ttaaggaagaggaatggtgt

SEQ ID NO: 26744 - DNA, 20 bp, Artificial Sequence
  Description of Artificial Sequence: Synthetic oligonucleotide
  Target: SCN10A; (-) strand; PAM type: NRG; PAM sequence: TGG
aggacattaaggaagaggaa

SEQ ID NO: 26745 - DNA, 20 bp, Artificial Sequence
  Description of Artificial Sequence: Synthetic oligonucleotide
  Target: SCN10A; (-) strand; PAM type: NRG; PAM sequence: AGG
aatggaggacattaaggaag

SEQ ID NO: 26746 - DNA, 20 bp, Artificial Sequence
  Description of Artificial Sequence: Synthetic oligonucleotide
  Target: SCN10A; (-) strand; PAM type: NRG; PAM sequence: GAG
taatggaggacattaaggaa

SEQ ID NO: 26747 - DNA, 20 bp, Artificial Sequence
  Description of Artificial Sequence: Synthetic oligonucleotide
  Target: SCN10A; (-) strand; PAM type: NRG; PAM sequence: AAG
agtaatggaggacattaagg

SEQ ID NO: 26748 - DNA, 20 bp, Artificial Sequence
  Description of Artificial Sequence: Synthetic oligonucleotide
  Target: SCN10A; (-) strand; PAM type: NRG; PAM sequence: AGG
gaaagtaatggaggacatta

SEQ ID NO: 26749 - DNA, 20 bp, Artificial Sequence
  Description of Artificial Sequence: Synthetic oligonucleotide
  Target: SCN10A; (-) strand; PAM type: NRG; PAM sequence: AAG
agaaagtaatggaggacatt

SEQ ID NO: 26750 - DNA, 20 bp, Artificial Sequence
  Description of Artificial Sequence: Synthetic oligonucleotide
  Target: SCN10A; (-) strand; PAM type: NRG; PAM sequence: AGG
ctctcagaagaaagtaatgg

SEQ ID NO: 26751 - DNA, 20 bp, Artificial Sequence
  Description of Artificial Sequence: Synthetic oligonucleotide
  Target: SCN10A; (-) strand; PAM type: NRG; PAM sequence: GAG
gctctcagaagaaagtaatg

SEQ ID NO: 26752 - DNA, 20 bp, Artificial Sequence
  Description of Artificial Sequence: Synthetic oligonucleotide
  Target: SCN10A; (-) strand; PAM type: NRG; PAM sequence: TGG
aagctctcagaagaaagtaa

SEQ ID NO: 26753 - DNA, 20 bp, Artificial Sequence
  Description of Artificial Sequence: Synthetic oligonucleotide
  Target: SCN10A; (-) strand; PAM type: NRG; PAM sequence: AAG
gagggaaagctctcagaaga

SEQ ID NO: 26754 - DNA, 20 bp, Artificial Sequence
  Description of Artificial Sequence: Synthetic oligonucleotide
  Target: SCN10A; (-) strand; PAM type: NRG; PAM sequence: AAG
gggtgagggaaagctctcag

SEQ ID NO: 26755 - DNA, 20 bp, Artificial Sequence
  Description of Artificial Sequence: Synthetic oligonucleotide
  Target: SCN10A; (-) strand; PAM type: NRG; PAM sequence: CAG
agagggtgagggaaagctct

SEQ ID NO: 26756 - DNA, 20 bp, Artificial Sequence
  Description of Artificial Sequence: Synthetic oligonucleotide
  Target: SCN10A; (-) strand; PAM type: NRG; PAM sequence: AAG
gagaggaagagggtgaggga

SEQ ID NO: 26757 - DNA, 20 bp, Artificial Sequence
  Description of Artificial Sequence: Synthetic oligonucleotide
  Target: SCN10A; (-) strand; PAM type: NRG; PAM sequence: GGG
ggaggagaggaagagggtga

SEQ ID NO: 26758 - DNA, 20 bp, Artificial Sequence
  Description of Artificial Sequence: Synthetic oligonucleotide
  Target: SCN10A; (-) strand; PAM type: NRG; PAM sequence: AGG
aggaggagaggaagagggtg

SEQ ID NO: 26759 - DNA, 20 bp, Artificial Sequence
  Description of Artificial Sequence: Synthetic oligonucleotide
  Target: SCN10A; (-) strand; PAM type: NRG; PAM sequence: GAG
caggaggagaggaagagggt

SEQ ID NO: 26760 - DNA, 20 bp, Artificial Sequence
  Description of Artificial Sequence: Synthetic oligonucleotide
  Target: SCN10A; (-) strand; PAM type: NRG; PAM sequence: GGG
taggcaggaggagaggaaga

SEQ ID NO: 26761 - DNA, 20 bp, Artificial Sequence
  Description of Artificial Sequence: Synthetic oligonucleotide
  Target: SCN10A; (-) strand; PAM type: NRG; PAM sequence: AGG
ataggcaggaggagaggaag

SEQ ID NO: 26762 - DNA, 20 bp, Artificial Sequence
  Description of Artificial Sequence: Synthetic oligonucleotide
  Target: SCN10A; (-) strand; PAM type: NRG; PAM sequence: GAG
aataggcaggaggagaggaa

SEQ ID NO: 26763 - DNA, 20 bp, Artificial Sequence
  Description of Artificial Sequence: Synthetic oligonucleotide
  Target: SCN10A; (-) strand; PAM type: NRG; PAM sequence: AAG
caaataggcaggaggagagg

SEQ ID NO: 26764 - DNA, 20 bp, Artificial Sequence
  Description of Artificial Sequence: Synthetic oligonucleotide
  Target: SCN10A; (-) strand; PAM type: NRG; PAM sequence: AGG
ctacaaataggcaggaggag

SEQ ID NO: 26765 - DNA, 20 bp, Artificial Sequence
  Description of Artificial Sequence: Synthetic oligonucleotide
  Target: SCN10A; (-) strand; PAM type: NRG; PAM sequence: GAG
actacaaataggcaggagga

SEQ ID NO: 26766 - DNA, 20 bp, Artificial Sequence
  Description of Artificial Sequence: Synthetic oligonucleotide
  Target: SCN10A; (-) strand; PAM type: NRG; PAM sequence: GAG
caactacaaataggcaggag

SEQ ID NO: 26767 - DNA, 20 bp, Artificial Sequence
  Description of Artificial Sequence: Synthetic oligonucleotide
  Target: SCN10A; (-) strand; PAM type: NRG; PAM sequence: AGG
atcaactacaaataggcagg

SEQ ID NO: 26768 - DNA, 20 bp, Artificial Sequence
  Description of Artificial Sequence: Synthetic oligonucleotide
  Target: SCN10A; (-) strand; PAM type: NRG; PAM sequence: GAG
gatcaactacaaataggcag

SEQ ID NO: 26769 - DNA, 20 bp, Artificial Sequence
  Description of Artificial Sequence: Synthetic oligonucleotide
  Target: SCN10A; (-) strand; PAM type: NRG; PAM sequence: AGG
cagatcaactacaaataggc

SEQ ID NO: 26770 - DNA, 20 bp, Artificial Sequence
  Description of Artificial Sequence: Synthetic oligonucleotide
  Target: SCN10A; (-) strand; PAM type: NRG; PAM sequence: CAG
acagatcaactacaaatagg

SEQ ID NO: 26771 - DNA, 20 bp, Artificial Sequence
  Description of Artificial Sequence: Synthetic oligonucleotide
  Target: SCN10A; (-) strand; PAM type: NRG; PAM sequence: AGG
gaaacagatcaactacaaat

SEQ ID NO: 26772 - DNA, 20 bp, Artificial Sequence
  Description of Artificial Sequence: Synthetic oligonucleotide
  Target: SCN10A; (-) strand; PAM type: NRG; PAM sequence: TAG
agaaacagatcaactacaaa

SEQ ID NO: 26773 - DNA, 20 bp, Artificial Sequence
  Description of Artificial Sequence: Synthetic oligonucleotide
  Target: SCN10A; (-) strand; PAM type: NRG; PAM sequence: CAG
ttgaaaagttccgtaagaaa

SEQ ID NO: 26774 - DNA, 20 bp, Artificial Sequence
  Description of Artificial Sequence: Synthetic oligonucleotide
  Target: SCN10A; (-) strand; PAM type: NRG; PAM sequence: AAG
ttgactttgaaaagttccgt

SEQ ID NO: 26775 - DNA, 20 bp, Artificial Sequence
  Description of Artificial Sequence: Synthetic oligonucleotide
  Target: SCN10A; (-) strand; PAM type: NRG; PAM sequence: AAG
taatgtaggttgactttgaa

SEQ ID NO: 26776 - DNA, 20 bp, Artificial Sequence
  Description of Artificial Sequence: Synthetic oligonucleotide
  Target: SCN10A; (-) strand; PAM type: NRG; PAM sequence: AGG
gatgttcaattatgtaatgt

SEQ ID NO: 26777 - DNA, 20 bp, Artificial Sequence
  Description of Artificial Sequence: Synthetic oligonucleotide
  Target: SCN10A; (-) strand; PAM type: NRG; PAM sequence: TAG
agatgttcaattatgtaatg

SEQ ID NO: 26778 - DNA, 20 bp, Artificial Sequence
  Description of Artificial Sequence: Synthetic oligonucleotide
  Target: SCN10A; (-) strand; PAM type: NRG; PAM sequence: CAG
agttagaagaaaatagaaga

SEQ ID NO: 26779 - DNA, 20 bp, Artificial Sequence
  Description of Artificial Sequence: Synthetic oligonucleotide
  Target: SCN10A; (-) strand; PAM type: NRG; PAM sequence: AAG
tctaagttagaagaaaatag

SEQ ID NO: 26780 - DNA, 20 bp, Artificial Sequence
  Description of Artificial Sequence: Synthetic oligonucleotide
  Target: SCN10A; (-) strand; PAM type: NRG; PAM sequence: TAG
acttctaagttagaagaaaa

SEQ ID NO: 26781 - DNA, 20 bp, Artificial Sequence
  Description of Artificial Sequence: Synthetic oligonucleotide
  Target: SCN10A; (-) strand; PAM type: NRG; PAM sequence: AAG
acatagaacttctaagttag

SEQ ID NO: 26782 - DNA, 20 bp, Artificial Sequence
  Description of Artificial Sequence: Synthetic oligonucleotide
  Target: SCN10A; (-) strand; PAM type: NRG; PAM sequence: TAG
aacacatagaacttctaagt

SEQ ID NO: 26783 - DNA, 20 bp, Artificial Sequence
  Description of Artificial Sequence: Synthetic oligonucleotide
  Target: SCN10A; (-) strand; PAM type: NRG; PAM sequence: AAG
acacaacacatagaacttct

SEQ ID NO: 26784 - DNA, 20 bp, Artificial Sequence
  Description of Artificial Sequence: Synthetic oligonucleotide
  Target: SCN10A; (-) strand; PAM type: NRG; PAM sequence: TAG
gaatttgggcacacaacaca

SEQ ID NO: 26785 - DNA, 20 bp, Artificial Sequence
  Description of Artificial Sequence: Synthetic oligonucleotide
  Target: SCN10A; (-) strand; PAM type: NRG; PAM sequence: GGG
caccatgttaatcagaattt

SEQ ID NO: 26786 - DNA, 20 bp, Artificial Sequence
  Description of Artificial Sequence: Synthetic oligonucleotide
  Target: SCN10A; (-) strand; PAM type: NRG; PAM sequence: TGG
acaccatgttaatcagaatt

SEQ ID NO: 26787 - DNA, 20 bp, Artificial Sequence
  Description of Artificial Sequence: Synthetic oligonucleotide
  Target: SCN10A; (-) strand; PAM type: NRG; PAM sequence: CAG
cataaatacaccatgttaat

SEQ ID NO: 26788 - DNA, 20 bp, Artificial Sequence
  Description of Artificial Sequence: Synthetic oligonucleotide
  Target: SCN10A; (-) strand; PAM type: NRG; PAM sequence: TGG
tgaagtcaacagtgtttgaa

SEQ ID NO: 26789 - DNA, 20 bp, Artificial Sequence
  Description of Artificial Sequence: Synthetic oligonucleotide
  Target: SCN10A; (-) strand; PAM type: NRG; PAM sequence: CAG
attaaagacactgaagtcaa

SEQ ID NO: 26790 - DNA, 20 bp, Artificial Sequence
  Description of Artificial Sequence: Synthetic oligonucleotide
  Target: SCN10A; (-) strand; PAM type: NRG; PAM sequence: AAG
gggaagaattaaagacactg

SEQ ID NO: 26791 - DNA, 20 bp, Artificial Sequence
  Description of Artificial Sequence: Synthetic oligonucleotide
  Target: SCN10A; (-) strand; PAM type: NRG; PAM sequence: AAG
ttctcagaagggaagaatta

SEQ ID NO: 26792 - DNA, 20 bp, Artificial Sequence
  Description of Artificial Sequence: Synthetic oligonucleotide
  Target: SCN10A; (-) strand; PAM type: NRG; PAM sequence: AAG
atctttgtttctcagaaggg

SEQ ID NO: 26793 - DNA, 20 bp, Artificial Sequence
  Description of Artificial Sequence: Synthetic oligonucleotide
  Target: SCN10A; (-) strand; PAM type: NRG; PAM sequence: GGG
ttaatctttgtttctcagaa

SEQ ID NO: 26794 - DNA, 20 bp, Artificial Sequence
  Description of Artificial Sequence: Synthetic oligonucleotide
  Target: SCN10A; (-) strand; PAM type: NRG; PAM sequence: AGG
cttaatctttgtttctcaga

SEQ ID NO: 26795 - DNA, 20 bp, Artificial Sequence
  Description of Artificial Sequence: Synthetic oligonucleotide
  Target: SCN10A; (-) strand; PAM type: NRG; PAM sequence: AAG
acttaatctttgtttctcag

SEQ ID NO: 26796 - DNA, 20 bp, Artificial Sequence
  Description of Artificial Sequence: Synthetic oligonucleotide
  Target: SCN10A; (-) strand; PAM type: NRG; PAM sequence: CAG
ttaacttaatctttgtttct

SEQ ID NO: 26797 - DNA, 20 bp, Artificial Sequence
  Description of Artificial Sequence: Synthetic oligonucleotide
  Target: SCN10A; (-) strand; PAM type: NRG; PAM sequence: AAG
tcccctagacaaggaagaga

SEQ ID NO: 26798 - DNA, 20 bp, Artificial Sequence
  Description of Artificial Sequence: Synthetic oligonucleotide
  Target: SCN10A; (-) strand; PAM type: NRG; PAM sequence: GAG
cttctcccctagacaaggaa

SEQ ID NO: 26799 - DNA, 20 bp, Artificial Sequence
  Description of Artificial Sequence: Synthetic oligonucleotide
  Target: SCN10A; (-) strand; PAM type: NRG; PAM sequence: AAG
ctcttctcccctagacaagg

SEQ ID NO: 26800 - DNA, 20 bp, Artificial Sequence
  Description of Artificial Sequence: Synthetic oligonucleotide
  Target: SCN10A; (-) strand; PAM type: NRG; PAM sequence: AGG
tatctcttctcccctagaca

SEQ ID NO: 26801 - DNA, 20 bp, Artificial Sequence
  Description of Artificial Sequence: Synthetic oligonucleotide
  Target: SCN10A; (-) strand; PAM type: NRG; PAM sequence: AAG
gtatctcttctcccctagac

SEQ ID NO: 26802 - DNA, 20 bp, Artificial Sequence
  Description of Artificial Sequence: Synthetic oligonucleotide
  Target: SCN10A; (-) strand; PAM type: NRG; PAM sequence: TAG
tataagtatctcttctcccc

SEQ ID NO: 26803 - DNA, 20 bp, Artificial Sequence
  Description of Artificial Sequence: Synthetic oligonucleotide
  Target: SCN10A; (-) strand; PAM type: NRG; PAM sequence: AAG
caaatttggttccaaactat

SEQ ID NO: 26804 - DNA, 20 bp, Artificial Sequence
  Description of Artificial Sequence: Synthetic oligonucleotide
  Target: SCN10A; (-) strand; PAM type: NRG; PAM sequence: TGG
tgagtcctgggattcaaatt

SEQ ID NO: 26805 - DNA, 20 bp, Artificial Sequence
  Description of Artificial Sequence: Synthetic oligonucleotide
  Target: SCN10A; (-) strand; PAM type: NRG; PAM sequence: GGG
ttactaaacaactgagtcct

SEQ ID NO: 26806 - DNA, 20 bp, Artificial Sequence
  Description of Artificial Sequence: Synthetic oligonucleotide
  Target: SCN10A; (-) strand; PAM type: NRG; PAM sequence: TGG
gttactaaacaactgagtcc

SEQ ID NO: 26807 - DNA, 20 bp, Artificial Sequence
  Description of Artificial Sequence: Synthetic oligonucleotide
  Target: SCN10A; (-) strand; PAM type: NRG; PAM sequence: GAG
tgcattgttactaaacaact

SEQ ID NO: 26808 - DNA, 20 bp, Artificial Sequence
  Description of Artificial Sequence: Synthetic oligonucleotide
  Target: SCN10A; (-) strand; PAM type: NRG; PAM sequence: GAG
ttgcattccagtgtcactga

SEQ ID NO: 26809 - DNA, 20 bp, Artificial Sequence
  Description of Artificial Sequence: Synthetic oligonucleotide
  Target: SCN10A; (-) strand; PAM type: NRG; PAM sequence: GAG
cattgcattccagtgtcact

SEQ ID NO: 26810 - DNA, 20 bp, Artificial Sequence
  Description of Artificial Sequence: Synthetic oligonucleotide
  Target: SCN10A; (-) strand; PAM type: NRG; PAM sequence: CAG
caatcctcaacattgcattc

SEQ ID NO: 26811 - DNA, 20 bp, Artificial Sequence
  Description of Artificial Sequence: Synthetic oligonucleotide
  Target: SCN10A; (-) strand; PAM type: NRG; PAM sequence: TAG
caggacctggaattctggct

SEQ ID NO: 26812 - DNA, 20 bp, Artificial Sequence
  Description of Artificial Sequence: Synthetic oligonucleotide
  Target: SCN10A; (-) strand; PAM type: NRG; PAM sequence: TGG
agctccaggacctggaattc

SEQ ID NO: 26813 - DNA, 20 bp, Artificial Sequence
  Description of Artificial Sequence: Synthetic oligonucleotide
  Target: SCN10A; (-) strand; PAM type: NRG; PAM sequence: TGG
caagctccagctccaggacc

SEQ ID NO: 26814 - DNA, 20 bp, Artificial Sequence
  Description of Artificial Sequence: Synthetic oligonucleotide
  Target: SCN10A; (-) strand; PAM type: NRG; PAM sequence: AGG
tgacctcaagctccagctcc

SEQ ID NO: 26815 - DNA, 20 bp, Artificial Sequence
  Description of Artificial Sequence: Synthetic oligonucleotide
  Target: SCN10A; (-) strand; PAM type: NRG; PAM sequence: CAG
ttgacctcaagctccagctc

SEQ ID NO: 26816 - DNA, 20 bp, Artificial Sequence
  Description of Artificial Sequence: Synthetic oligonucleotide
  Target: SCN10A; (-) strand; PAM type: NRG; PAM sequence: CAG
tctgctttgacctcaagctc

SEQ ID NO: 26817 - DNA, 20 bp, Artificial Sequence
  Description of Artificial Sequence: Synthetic oligonucleotide
  Target: SCN10A; (-) strand; PAM type: NRG; PAM sequence: AAG
gctgagtctgctttgacctc

SEQ ID NO: 26818 - DNA, 20 bp, Artificial Sequence
  Description of Artificial Sequence: Synthetic oligonucleotide
  Target: SCN10A; (-) strand; PAM type: NRG; PAM sequence: GAG
atgaagtcagtctcatagct

SEQ ID NO: 26819 - DNA, 20 bp, Artificial Sequence
  Description of Artificial Sequence: Synthetic oligonucleotide
  Target: SCN10A; (-) strand; PAM type: NRG; PAM sequence: TAG
ttggcatgaagtcagtctca

SEQ ID NO: 26820 - DNA, 20 bp, Artificial Sequence
  Description of Artificial Sequence: Synthetic oligonucleotide
  Target: SCN10A; (-) strand; PAM type: NRG; PAM sequence: CAG
atggtcatttggcatgaagt

SEQ ID NO: 26821 - DNA, 20 bp, Artificial Sequence
  Description of Artificial Sequence: Synthetic oligonucleotide
  Target: SCN10A; (-) strand; PAM type: NRG; PAM sequence: AAG
aattatggtcatttggcatg

SEQ ID NO: 26822 - DNA, 20 bp, Artificial Sequence
  Description of Artificial Sequence: Synthetic oligonucleotide
  Target: SCN10A; (-) strand; PAM type: NRG; PAM sequence: TGG
ccagaataattatggtcatt

SEQ ID NO: 26823 - DNA, 20 bp, Artificial Sequence
  Description of Artificial Sequence: Synthetic oligonucleotide
  Target: SCN10A; (-) strand; PAM type: NRG; PAM sequence: TGG
atggtagcccagaataatta

SEQ ID NO: 26824 - DNA, 20 bp, Artificial Sequence
  Description of Artificial Sequence: Synthetic oligonucleotide
  Target: SCN10A; (-) strand; PAM type: NRG; PAM sequence: CAG
tggagggatttatggtagcc

SEQ ID NO: 26825 - DNA, 20 bp, Artificial Sequence
  Description of Artificial Sequence: Synthetic oligonucleotide
  Target: SCN10A; (-) strand; PAM type: NRG; PAM sequence: TAG
ttagctggagggatttatgg

SEQ ID NO: 26826 - DNA, 20 bp, Artificial Sequence
  Description of Artificial Sequence: Synthetic oligonucleotide
  Target: SCN10A; (-) strand; PAM type: NRG; PAM sequence: TGG
tccttagctggagggattta

SEQ ID NO: 26827 - DNA, 20 bp, Artificial Sequence
  Description of Artificial Sequence: Synthetic oligonucleotide
  Target: SCN10A; (-) strand; PAM type: NRG; PAM sequence: GGG
caattttgtccttagctgga

SEQ ID NO: 26828 - DNA, 20 bp, Artificial Sequence
  Description of Artificial Sequence: Synthetic oligonucleotide
  Target: SCN10A; (-) strand; PAM type: NRG; PAM sequence: AGG
acaattttgtccttagctgg

SEQ ID NO: 26829 - DNA, 20 bp, Artificial Sequence
  Description of Artificial Sequence: Synthetic oligonucleotide
  Target: SCN10A; (-) strand; PAM type: NRG; PAM sequence: GAG
aacaattttgtccttagctg

SEQ ID NO: 26830 - DNA, 20 bp, Artificial Sequence
  Description of Artificial Sequence: Synthetic oligonucleotide
  Target: SCN10A; (-) strand; PAM type: NRG; PAM sequence: TGG
aaaacaattttgtccttagc

SEQ ID NO: 26831 - DNA, 20 bp, Artificial Sequence
  Description of Artificial Sequence: Synthetic oligonucleotide
  Target: SCN10A; (-) strand; PAM type: NRG; PAM sequence: TAG
gttgaaaacaattttgtcct

SEQ ID NO: 26832 - DNA, 20 bp, Artificial Sequence
  Description of Artificial Sequence: Synthetic oligonucleotide
  Target: SCN10A; (-) strand; PAM type: NRG; PAM sequence: TGG
gaaagtcttaaaagaaggac

SEQ ID NO: 26833 - DNA, 20 bp, Artificial Sequence
  Description of Artificial Sequence: Synthetic oligonucleotide
  Target: SCN10A; (-) strand; PAM type: NRG; PAM sequence: AGG
gatgggaaagtcttaaaaga

SEQ ID NO: 26834 - DNA, 20 bp, Artificial Sequence
  Description of Artificial Sequence: Synthetic oligonucleotide
  Target: SCN10A; (-) strand; PAM type: NRG; PAM sequence: AAG
tgatgggaaagtcttaaaag

SEQ ID NO: 26835 - DNA, 20 bp, Artificial Sequence
  Description of Artificial Sequence: Synthetic oligonucleotide
  Target: SCN10A; (-) strand; PAM type: NRG; PAM sequence: AAG
ttctgatgggaaagtcttaa

SEQ ID NO: 26836 - DNA, 20 bp, Artificial Sequence
  Description of Artificial Sequence: Synthetic oligonucleotide
  Target: SCN10A; (-) strand; PAM type: NRG; PAM sequence: AAG
agctatcacttctgatggga

SEQ ID NO: 26837 - DNA, 20 bp, Artificial Sequence
  Description of Artificial Sequence: Synthetic oligonucleotide
  Target: SCN10A; (-) strand; PAM type: NRG; PAM sequence: GGG
ccagagctatcacttctgat

SEQ ID NO: 26838 - DNA, 20 bp, Artificial Sequence
  Description of Artificial Sequence: Synthetic oligonucleotide
  Target: SCN10A; (-) strand; PAM type: NRG; PAM sequence: TGG
tccagagctatcacttctga

SEQ ID NO: 26839 - DNA, 20 bp, Artificial Sequence
  Description of Artificial Sequence: Synthetic oligonucleotide
  Target: SCN10A; (-) strand; PAM type: NRG; PAM sequence: GAG
atcaagggatcccaagtcca

SEQ ID NO: 26840 - DNA, 20 bp, Artificial Sequence
  Description of Artificial Sequence: Synthetic oligonucleotide
  Target: SCN10A; (-) strand; PAM type: NRG; PAM sequence: CAG
caatcaagggatcccaagtc

SEQ ID NO: 26841 - DNA, 20 bp, Artificial Sequence
  Description of Artificial Sequence: Synthetic oligonucleotide
  Target: SCN10A; (-) strand; PAM type: NRG; PAM sequence: AAG
cacttcaatcaagggatccc

SEQ ID NO: 26842 - DNA, 20 bp, Artificial Sequence
  Description of Artificial Sequence: Synthetic oligonucleotide
  Target: SCN10A; (-) strand; PAM type: NRG; PAM sequence: GGG
tagagaaccacttcaatcaa

SEQ ID NO: 26843 - DNA, 20 bp, Artificial Sequence
  Description of Artificial Sequence: Synthetic oligonucleotide
  Target: SCN10A; (-) strand; PAM type: NRG; PAM sequence: AGG
atagagaaccacttcaatca

SEQ ID NO: 26844 - DNA, 20 bp, Artificial Sequence
  Description of Artificial Sequence: Synthetic oligonucleotide
  Target: SCN10A; (-) strand; PAM type: NRG; PAM sequence: AAG
tatagagaaccacttcaatc

SEQ ID NO: 26845 - DNA, 20 bp, Artificial Sequence
  Description of Artificial Sequence: Synthetic oligonucleotide
  Target: SCN10A; (-) strand; PAM type: NRG; PAM sequence: GAG
gggtaatagatgggaatata

SEQ ID NO: 26846 - DNA, 20 bp, Artificial Sequence
  Description of Artificial Sequence: Synthetic oligonucleotide
  Target: SCN10A; (-) strand; PAM type: NRG; PAM sequence: TAG
ctgggtaatagatgggaata

SEQ ID NO: 26847 - DNA, 20 bp, Artificial Sequence
  Description of Artificial Sequence: Synthetic oligonucleotide
  Target: SCN10A; (-) strand; PAM type: NRG; PAM sequence: GGG
aaagacactgggtaatagat

SEQ ID NO: 26848 - DNA, 20 bp, Artificial Sequence
  Description of Artificial Sequence: Synthetic oligonucleotide
  Target: SCN10A; (-) strand; PAM type: NRG; PAM sequence: TGG
taaagacactgggtaataga

SEQ ID NO: 26849 - DNA, 20 bp, Artificial Sequence
  Description of Artificial Sequence: Synthetic oligonucleotide
  Target: SCN10A; (-) strand; PAM type: NRG; PAM sequence: TAG
catgtaaagacactgggtaa

SEQ ID NO: 26850 - DNA, 20 bp, Artificial Sequence
  Description of Artificial Sequence: Synthetic oligonucleotide
  Target: SCN10A; (-) strand; PAM type: NRG; PAM sequence: GGG
gaatgtcatgtaaagacact

SEQ ID NO: 26851 - DNA, 20 bp, Artificial Sequence
  Description of Artificial Sequence: Synthetic oligonucleotide
  Target: SCN10A; (-) strand; PAM type: NRG; PAM sequence: TGG
agaatgtcatgtaaagacac

SEQ ID NO: 26852 - DNA, 20 bp, Artificial Sequence
  Description of Artificial Sequence: Synthetic oligonucleotide
  Target: SCN10A; (-) strand; PAM type: NRG; PAM sequence: AAG
ttttctcagaatgtcatgta

SEQ ID NO: 26853 - DNA, 20 bp, Artificial Sequence
  Description of Artificial Sequence: Synthetic oligonucleotide
  Target: SCN10A; (-) strand; PAM type: NRG; PAM sequence: CAG
ttgcaccccaatagttttct

SEQ ID NO: 26854 - DNA, 20 bp, Artificial Sequence
  Description of Artificial Sequence: Synthetic oligonucleotide
  Target: SCN10A; (-) strand; PAM type: NRG; PAM sequence: TAG
ataaactacttgcaccccaa

SEQ ID NO: 26855 - DNA, 20 bp, Artificial Sequence
  Description of Artificial Sequence: Synthetic oligonucleotide
  Target: SCN10A; (-) strand; PAM type: NRG; PAM sequence: CAG
acattcctagaaatagctct

SEQ ID NO: 26856 - DNA, 20 bp, Artificial Sequence
  Description of Artificial Sequence: Synthetic oligonucleotide
  Target: SCN10A; (-) strand; PAM type: NRG; PAM sequence: TAG
ttctatgacattcctagaaa

SEQ ID NO: 26857 - DNA, 20 bp, Artificial Sequence
  Description of Artificial Sequence: Synthetic oligonucleotide
  Target: SCN10A; (-) strand; PAM type: NRG; PAM sequence: TAG
cctctcttctatgacattcc

SEQ ID NO: 26858 - DNA, 20 bp, Artificial Sequence
  Description of Artificial Sequence: Synthetic oligonucleotide
  Target: SCN10A; (-) strand; PAM type: NRG; PAM sequence: TGG
agtttgcccataagagtaaa

SEQ ID NO: 26859 - DNA, 20 bp, Artificial Sequence
  Description of Artificial Sequence: Synthetic oligonucleotide
  Target: SCN10A; (-) strand; PAM type: NRG; PAM sequence: GAG
tgagcccagtttgcccataa

SEQ ID NO: 26860 - DNA, 20 bp, Artificial Sequence
  Description of Artificial Sequence: Synthetic oligonucleotide
  Target: SCN10A; (-) strand; PAM type: NRG; PAM sequence: AAG
tctgagcccagtttgcccat

SEQ ID NO: 26861 - DNA, 20 bp, Artificial Sequence
  Description of Artificial Sequence: Synthetic oligonucleotide
  Target: SCN10A; (-) strand; PAM type: NRG; PAM sequence: CAG
cagtgaaacaattctgagcc

SEQ ID NO: 26862 - DNA, 20 bp, Artificial Sequence
  Description of Artificial Sequence: Synthetic oligonucleotide
  Target: SCN10A; (-) strand; PAM type: NRG; PAM sequence: GAG
cccctcagtgaaacaattct

SEQ ID NO: 26863 - DNA, 20 bp, Artificial Sequence
  Description of Artificial Sequence: Synthetic oligonucleotide
  Target: SCN10A; (-) strand; PAM type: NRG; PAM sequence: CAG
accctagtatccttacccct

SEQ ID NO: 26864 - DNA, 20 bp, Artificial Sequence
  Description of Artificial Sequence: Synthetic oligonucleotide
  Target: SCN10A; (-) strand; PAM type: NRG; PAM sequence: TAG
aggactggtagataaaaccc

SEQ ID NO: 26865 - DNA, 20 bp, Artificial Sequence
  Description of Artificial Sequence: Synthetic oligonucleotide
  Target: SCN10A; (-) strand; PAM type: NRG; PAM sequence: TAG
ccaataagggacaggactgg

SEQ ID NO: 26866 - DNA, 20 bp, Artificial Sequence
  Description of Artificial Sequence: Synthetic oligonucleotide
  Target: SCN10A; (-) strand; PAM type: NRG; PAM sequence: TGG
caaccaataagggacaggac

SEQ ID NO: 26867 - DNA, 20 bp, Artificial Sequence
  Description of Artificial Sequence: Synthetic oligonucleotide
  Target: SCN10A; (-) strand; PAM type: NRG; PAM sequence: AGG
accgtcaaccaataagggac

SEQ ID NO: 26868 - DNA, 20 bp, Artificial Sequence
  Description of Artificial Sequence: Synthetic oligonucleotide
  Target: SCN10A; (-) strand; PAM type: NRG; PAM sequence: CAG
aaccgtcaaccaataaggga

SEQ ID NO: 26869 - DNA, 20 bp, Artificial Sequence
  Description of Artificial Sequence: Synthetic oligonucleotide
  Target: SCN10A; (-) strand; PAM type: NRG; PAM sequence: GGG
ggacaaccgtcaaccaataa

SEQ ID NO: 26870 - DNA, 20 bp, Artificial Sequence
  Description of Artificial Sequence: Synthetic oligonucleotide
  Target: SCN10A; (-) strand; PAM type: NRG; PAM sequence: AGG
aggacaaccgtcaaccaata

SEQ ID NO: 26871 - DNA, 20 bp, Artificial Sequence
  Description of Artificial Sequence: Synthetic oligonucleotide
  Target: SCN10A; (-) strand; PAM type: NRG; PAM sequence: AAG
caggacaaccgtcaaccaat

SEQ ID NO: 26872 - DNA, 20 bp, Artificial Sequence
  Description of Artificial Sequence: Synthetic oligonucleotide
  Target: SCN10A; (-) strand; PAM type: NRG; PAM sequence: AGG
ttctgtagagttaaaatccc

SEQ ID NO: 26873 - DNA, 20 bp, Artificial Sequence
  Description of Artificial Sequence: Synthetic oligonucleotide
  Target: SCN10A; (-) strand; PAM type: NRG; PAM sequence: CAG
gttctgtagagttaaaatcc

SEQ ID NO: 26874 - DNA, 20 bp, Artificial Sequence
  Description of Artificial Sequence: Synthetic oligonucleotide
  Target: SCN10A; (-) strand; PAM type: NRG; PAM sequence: GAG
ccactgaagtaagttctgta

SEQ ID NO: 26875 - DNA, 20 bp, Artificial Sequence
  Description of Artificial Sequence: Synthetic oligonucleotide
  Target: SCN10A; (-) strand; PAM type: NRG; PAM sequence: TAG
ggccactgaagtaagttctg

SEQ ID NO: 26876 - DNA, 20 bp, Artificial Sequence
  Description of Artificial Sequence: Synthetic oligonucleotide
  Target: SCN10A; (-) strand; PAM type: NRG; PAM sequence: AAG
ctttctctggccactgaagt

SEQ ID NO: 26877 - DNA, 20 bp, Artificial Sequence
  Description of Artificial Sequence: Synthetic oligonucleotide
  Target: SCN10A; (-) strand; PAM type: NRG; PAM sequence: AAG
agggctttctctggccactg

SEQ ID NO: 26878 - DNA, 20 bp, Artificial Sequence
  Description of Artificial Sequence: Synthetic oligonucleotide
  Target: SCN10A; (-) strand; PAM type: NRG; PAM sequence: TGG
tgtctgcccagggctttctc

SEQ ID NO: 26879 - DNA, 20 bp, Artificial Sequence
  Description of Artificial Sequence: Synthetic oligonucleotide
  Target: SCN10A; (-) strand; PAM type: NRG; PAM sequence: GGG
ttcctgcctctgtctgccca

SEQ ID NO: 26880 - DNA, 20 bp, Artificial Sequence
  Description of Artificial Sequence: Synthetic oligonucleotide
  Target: SCN10A; (-) strand; PAM type: NRG; PAM sequence: AGG
cttcctgcctctgtctgccc

SEQ ID NO: 26881 - DNA, 20 bp, Artificial Sequence
  Description of Artificial Sequence: Synthetic oligonucleotide
  Target: SCN10A; (-) strand; PAM type: NRG; PAM sequence: CAG
acttcctgcctctgtctgcc

SEQ ID NO: 26882 - DNA, 20 bp, Artificial Sequence
  Description of Artificial Sequence: Synthetic oligonucleotide
  Target: SCN10A; (-) strand; PAM type: NRG; PAM sequence: CAG
tctagaccagaggtcaccag

SEQ ID NO: 26883 - DNA, 20 bp, Artificial Sequence
  Description of Artificial Sequence: Synthetic oligonucleotide
  Target: SCN10A; (-) strand; PAM type: NRG; PAM sequence: CAG
ggatctagaccagaggtcac

SEQ ID NO: 26884 - DNA, 20 bp, Artificial Sequence
  Description of Artificial Sequence: Synthetic oligonucleotide
  Target: SCN10A; (-) strand; PAM type: NRG; PAM sequence: AGG
ttcccagggatctagaccag

SEQ ID NO: 26885 - DNA, 20 bp, Artificial Sequence
  Description of Artificial Sequence: Synthetic oligonucleotide
  Target: SCN10A; (-) strand; PAM type: NRG; PAM sequence: GAG
tttcccagggatctagacca

SEQ ID NO: 26886 - DNA, 20 bp, Artificial Sequence
  Description of Artificial Sequence: Synthetic oligonucleotide
  Target: SCN10A; (-) strand; PAM type: NRG; PAM sequence: CAG
catttcccagggatctagac

SEQ ID NO: 26887 - DNA, 20 bp, Artificial Sequence
  Description of Artificial Sequence: Synthetic oligonucleotide
  Target: SCN10A; (-) strand; PAM type: NRG; PAM sequence: TAG
ttgctcatttcccagggatc

SEQ ID NO: 26888 - DNA, 20 bp, Artificial Sequence
  Description of Artificial Sequence: Synthetic oligonucleotide
  Target: SCN10A; (-) strand; PAM type: NRG; PAM sequence: GGG
tgcaccttgctcatttccca

SEQ ID NO: 26889 - DNA, 20 bp, Artificial Sequence
  Description of Artificial Sequence: Synthetic oligonucleotide
  Target: SCN10A; (-) strand; PAM type: NRG; PAM sequence: AGG
ctgcaccttgctcatttccc

SEQ ID NO: 26890 - DNA, 20 bp, Artificial Sequence
  Description of Artificial Sequence: Synthetic oligonucleotide
  Target: SCN10A; (-) strand; PAM type: NRG; PAM sequence: CAG
tctgcaccttgctcatttcc

SEQ ID NO: 26891 - DNA, 20 bp, Artificial Sequence
  Description of Artificial Sequence: Synthetic oligonucleotide
  Target: SCN10A; (-) strand; PAM type: NRG; PAM sequence: TAG
aattaaggttgcaaggacta

SEQ ID NO: 26892 - DNA, 20 bp, Artificial Sequence
  Description of Artificial Sequence: Synthetic oligonucleotide
  Target: SCN10A; (-) strand; PAM type: NRG; PAM sequence: AGG
gattcccaattaaggttgca

SEQ ID NO: 26893 - DNA, 20 bp, Artificial Sequence
  Description of Artificial Sequence: Synthetic oligonucleotide
  Target: SCN10A; (-) strand; PAM type: NRG; PAM sequence: AAG
ggattcccaattaaggttgc

SEQ ID NO: 26894 - DNA, 20 bp, Artificial Sequence
  Description of Artificial Sequence: Synthetic oligonucleotide
  Target: SCN10A; (-) strand; PAM type: NRG; PAM sequence: AGG
aaaatagggattcccaatta

SEQ ID NO: 26895 - DNA, 20 bp, Artificial Sequence
  Description of Artificial Sequence: Synthetic oligonucleotide
  Target: SCN10A; (-) strand; PAM type: NRG; PAM sequence: AAG
taaaatagggattcccaatt

SEQ ID NO: 26896 - DNA, 20 bp, Artificial Sequence
  Description of Artificial Sequence: Synthetic oligonucleotide
  Target: SCN10A; (-) strand; PAM type: NRG; PAM sequence: GGG
ttcaactagactctaaaata

SEQ ID NO: 26897 - DNA, 20 bp, Artificial Sequence
  Description of Artificial Sequence: Synthetic oligonucleotide
  Target: SCN10A; (-) strand; PAM type: NRG; PAM sequence: AGG
attcaactagactctaaaat

SEQ ID NO: 26898 - DNA, 20 bp, Artificial Sequence
  Description of Artificial Sequence: Synthetic oligonucleotide
  Target: SCN10A; (-) strand; PAM type: NRG; PAM sequence: TAG
cattcaactagactctaaaa

SEQ ID NO: 26899 - DNA, 20 bp, Artificial Sequence
  Description of Artificial Sequence: Synthetic oligonucleotide
  Target: SCN10A; (-) strand; PAM type: NRG; PAM sequence: TAG
ctttccccactacattcaac

SEQ ID NO: 26900 - DNA, 20 bp, Artificial Sequence
  Description of Artificial Sequence: Synthetic oligonucleotide
  Target: SCN10A; (-) strand; PAM type: NRG; PAM sequence: AGG
ttgatatggctacctcacaa

SEQ ID NO: 26901 - DNA, 20 bp, Artificial Sequence
  Description of Artificial Sequence: Synthetic oligonucleotide
  Target: SCN10A; (-) strand; PAM type: NRG; PAM sequence: AAG
tttgatatggctacctcaca

SEQ ID NO: 26902 - DNA, 20 bp, Artificial Sequence
  Description of Artificial Sequence: Synthetic oligonucleotide
  Target: SCN10A; (-) strand; PAM type: NRG; PAM sequence: TGG
tataacacatacatttgata

SEQ ID NO: 26903 - DNA, 20 bp, Artificial Sequence
  Description of Artificial Sequence: Synthetic oligonucleotide
  Target: SCN10A; (-) strand; PAM type: NRG; PAM sequence: CAG
caagaagtgagtatcaggcc

SEQ ID NO: 26904 - DNA, 20 bp, Artificial Sequence
  Description of Artificial Sequence: Synthetic oligonucleotide
  Target: SCN10A; (-) strand; PAM type: NRG; PAM sequence: AGG
taatccaagaagtgagtatc

SEQ ID NO: 26905 - DNA, 20 bp, Artificial Sequence
  Description of Artificial Sequence: Synthetic oligonucleotide
  Target: SCN10A; (-) strand; PAM type: NRG; PAM sequence: CAG
ttaatccaagaagtgagtat

SEQ ID NO: 26906 - DNA, 20 bp, Artificial Sequence
  Description of Artificial Sequence: Synthetic oligonucleotide
  Target: SCN10A; (-) strand; PAM type: NRG; PAM sequence: GAG
cagccattaatccaagaagt

SEQ ID NO: 26907 - DNA, 20 bp, Artificial Sequence
  Description of Artificial Sequence: Synthetic oligonucleotide
  Target: SCN10A; (-) strand; PAM type: NRG; PAM sequence: AAG
tcctcagccattaatccaag

SEQ ID NO: 26908 - DNA, 20 bp, Artificial Sequence
  Description of Artificial Sequence: Synthetic oligonucleotide
  Target: SCN10A; (-) strand; PAM type: NRG; PAM sequence: AAG
tcctcctcagccattaatcc

SEQ ID NO: 26909 - DNA, 20 bp, Artificial Sequence
  Description of Artificial Sequence: Synthetic oligonucleotide
  Target: SCN10A; (-) strand; PAM type: NRG; PAM sequence: CAG
ttcttggattgtctcctcct

SEQ ID NO: 26910 - DNA, 20 bp, Artificial Sequence
  Description of Artificial Sequence: Synthetic oligonucleotide
  Target: SCN10A; (-) strand; PAM type: NRG; PAM sequence: TGG
aaactagaatagatatttct

SEQ ID NO: 26911 - DNA, 20 bp, Artificial Sequence
  Description of Artificial Sequence: Synthetic oligonucleotide
  Target: SCN10A; (-) strand; PAM type: NRG; PAM sequence: TAG
agcttggagctaaactagaa

SEQ ID NO: 26912 - DNA, 20 bp, Artificial Sequence
  Description of Artificial Sequence: Synthetic oligonucleotide
  Target: SCN10A; (-) strand; PAM type: NRG; PAM sequence: TAG
ggccgagcttggagctaaac

SEQ ID NO: 26913 - DNA, 20 bp, Artificial Sequence
  Description of Artificial Sequence: Synthetic oligonucleotide
  Target: SCN10A; (-) strand; PAM type: NRG; PAM sequence: GAG
gaaagccagggccgagcttg

SEQ ID NO: 26914 - DNA, 20 bp, Artificial Sequence
  Description of Artificial Sequence: Synthetic oligonucleotide
  Target: SCN10A; (-) strand; PAM type: NRG; PAM sequence: TGG
ttgaaagccagggccgagct

SEQ ID NO: 26915 - DNA, 20 bp, Artificial Sequence
  Description of Artificial Sequence: Synthetic oligonucleotide
  Target: SCN10A; (-) strand; PAM type: NRG; PAM sequence: GAG
actgtttgaaagccagggcc

SEQ ID NO: 26916 - DNA, 20 bp, Artificial Sequence
  Description of Artificial Sequence: Synthetic oligonucleotide
  Target: SCN10A; (-) strand; PAM type: NRG; PAM sequence: GGG
tgcagactgtttgaaagcca

SEQ ID NO: 26917 - DNA, 20 bp, Artificial Sequence
  Description of Artificial Sequence: Synthetic oligonucleotide
  Target: SCN10A; (-) strand; PAM type: NRG; PAM sequence: AGG
atgcagactgtttgaaagcc

SEQ ID NO: 26918 - DNA, 20 bp, Artificial Sequence
  Description of Artificial Sequence: Synthetic oligonucleotide
  Target: SCN10A; (-) strand; PAM type: NRG; PAM sequence: CAG
catgcagactgtttgaaagc

SEQ ID NO: 26919 - DNA, 20 bp, Artificial Sequence
  Description of Artificial Sequence: Synthetic oligonucleotide
  Target: SCN10A; (-) strand; PAM type: NRG; PAM sequence: AAG
aactcatgcagactgtttga

SEQ ID NO: 26920 - DNA, 20 bp, Artificial Sequence
  Description of Artificial Sequence: Synthetic oligonucleotide
  Target: SCN10A; (-) strand; PAM type: NRG; PAM sequence: CAG
tatacctgcaaaaactcatg

SEQ ID NO: 26921 - DNA, 20 bp, Artificial Sequence
  Description of Artificial Sequence: Synthetic oligonucleotide
  Target: SCN10A; (-) strand; PAM type: NRG; PAM sequence: GGG
ggaacagctattaaacttaa

SEQ ID NO: 26922 - DNA, 20 bp, Artificial Sequence
  Description of Artificial Sequence: Synthetic oligonucleotide
  Target: SCN10A; (-) strand; PAM type: NRG; PAM sequence: AGG
aggaacagctattaaactta

SEQ ID NO: 26923 - DNA, 20 bp, Artificial Sequence
  Description of Artificial Sequence: Synthetic oligonucleotide
  Target: SCN10A; (-) strand; PAM type: NRG; PAM sequence: AAG
caggaacagctattaaactt

SEQ ID NO: 26924 - DNA, 20 bp, Artificial Sequence
  Description of Artificial Sequence: Synthetic oligonucleotide
  Target: SCN10A; (-) strand; PAM type: NRG; PAM sequence: CAG
aaaggcttgcttagcaggaa

SEQ ID NO: 26925 - DNA, 20 bp, Artificial Sequence
  Description of Artificial Sequence: Synthetic oligonucleotide
  Target: SCN10A; (-) strand; PAM type: NRG; PAM sequence: AGG
aatagaaaggcttgcttagc

SEQ ID NO: 26926 - DNA, 20 bp, Artificial Sequence
  Description of Artificial Sequence: Synthetic oligonucleotide
  Target: SCN10A; (-) strand; PAM type: NRG; PAM sequence: CAG
gaatagaaaggcttgcttag

SEQ ID NO: 26927 - DNA, 20 bp, Artificial Sequence
  Description of Artificial Sequence: Synthetic oligonucleotide
  Target: SCN10A; (-) strand; PAM type: NRG; PAM sequence: TAG
accgaatagaaaggcttgct

SEQ ID NO: 26928 - DNA, 20 bp, Artificial Sequence
  Description of Artificial Sequence: Synthetic oligonucleotide
  Target: SCN10A; (-) strand; PAM type: NRG; PAM sequence: AGG
tgaatgcccaccgaatagaa

SEQ ID NO: 26929 - DNA, 20 bp, Artificial Sequence
  Description of Artificial Sequence: Synthetic oligonucleotide
  Target: SCN10A; (-) strand; PAM type: NRG; PAM sequence: AAG
ctgaatgcccaccgaataga

SEQ ID NO: 26930 - DNA, 20 bp, Artificial Sequence
  Description of Artificial Sequence: Synthetic oligonucleotide
  Target: SCN10A; (-) strand; PAM type: NRG; PAM sequence: TAG
agggctgaatgcccaccgaa

SEQ ID NO: 26931 - DNA, 20 bp, Artificial Sequence
  Description of Artificial Sequence: Synthetic oligonucleotide
  Target: SCN10A; (-) strand; PAM type: NRG; PAM sequence: GGG
gctgttggttcatcttggga

SEQ ID NO: 26932 - DNA, 20 bp, Artificial Sequence
  Description of Artificial Sequence: Synthetic oligonucleotide
  Target: SCN10A; (-) strand; PAM type: NRG; PAM sequence: AGG
cgctgttggttcatcttggg

SEQ ID NO: 26933 - DNA, 20 bp, Artificial Sequence
  Description of Artificial Sequence: Synthetic oligonucleotide
  Target: SCN10A; (-) strand; PAM type: NRG; PAM sequence: GAG
tcgctgttggttcatcttgg

SEQ ID NO: 26934 - DNA, 20 bp, Artificial Sequence
  Description of Artificial Sequence: Synthetic oligonucleotide
  Target: SCN10A; (-) strand; PAM type: NRG; PAM sequence: GGG
tatcgctgttggttcatctt

SEQ ID NO: 26935 - DNA, 20 bp, Artificial Sequence
  Description of Artificial Sequence: Synthetic oligonucleotide
  Target: SCN10A; (-) strand; PAM type: NRG; PAM sequence: TGG
atatcgctgttggttcatct

SEQ ID NO: 26936 - DNA, 20 bp, Artificial Sequence
  Description of Artificial Sequence: Synthetic oligonucleotide
  Target: SCN10A; (-) strand; PAM type: NRG; PAM sequence: TGG
ggggaaccaaatatcgctgt

SEQ ID NO: 26937 - DNA, 20 bp, Artificial Sequence
  Description of Artificial Sequence: Synthetic oligonucleotide
  Target: SCN10A; (-) strand; PAM type: NRG; PAM sequence: GGG
aaaaaaaaaaaggaggcaag

SEQ ID NO: 26938 - DNA, 20 bp, Artificial Sequence
  Description of Artificial Sequence: Synthetic oligonucleotide
  Target: SCN10A; (-) strand; PAM type: NRG; PAM sequence: GGG
aaaaaaaaaaaaggaggcaa

SEQ ID NO: 26939 - DNA, 20 bp, Artificial Sequence
  Description of Artificial Sequence: Synthetic oligonucleotide
  Target: SCN10A; (-) strand; PAM type: NRG; PAM sequence: AGG
aaaaaaaaaaaaaggaggca

SEQ ID NO: 26940 - DNA, 20 bp, Artificial Sequence
  Description of Artificial Sequence: Synthetic oligonucleotide
  Target: SCN10A; (-) strand; PAM type: NRG; PAM sequence: AAG
aaaaaaaaaaaaaaggaggc

SEQ ID NO: 26941 - DNA, 20 bp, Artificial Sequence
  Description of Artificial Sequence: Synthetic oligonucleotide
  Target: SCN10A; (-) strand; PAM type: NRG; PAM sequence: AGG
aaaaaaaaaaaaaaaaaagg

SEQ ID NO: 26942 - DNA, 20 bp, Artificial Sequence
  Description of Artificial Sequence: Synthetic oligonucleotide
  Target: SCN10A; (-) strand; PAM type: NRG; PAM sequence: GAG
aaaaaaaaaaaaaaaaaaag

SEQ ID NO: 26943 - DNA, 20 bp, Artificial Sequence
  Description of Artificial Sequence: Synthetic oligonucleotide
  Target: SCN10A; (-) strand; PAM type: NRG; PAM sequence: AGG
aaaaaaaaaaaaaaaaaaaa

SEQ ID NO: 26944 - DNA, 20 bp, Artificial Sequence
  Description of Artificial Sequence: Synthetic oligonucleotide
  Target: SCN10A; (-) strand; PAM type: NRG; PAM sequence: AAG
caaaaaaaaaaaaaaaaaaa

SEQ ID NO: 26945 - DNA, 20 bp, Artificial Sequence
  Description of Artificial Sequence: Synthetic oligonucleotide
  Target: SCN10A; (-) strand; PAM type: NRG; PAM sequence: GAG
tccagcctggacaacagagt

SEQ ID NO: 26946 - DNA, 20 bp, Artificial Sequence
  Description of Artificial Sequence: Synthetic oligonucleotide
  Target: SCN10A; (-) strand; PAM type: NRG; PAM sequence: GAG
gcactccagcctggacaaca

SEQ ID NO: 26947 - DNA, 20 bp, Artificial Sequence
  Description of Artificial Sequence: Synthetic oligonucleotide
  Target: SCN10A; (-) strand; PAM type: NRG; PAM sequence: CAG
ctgcactccagcctggacaa

SEQ ID NO: 26948 - DNA, 20 bp, Artificial Sequence
  Description of Artificial Sequence: Synthetic oligonucleotide
  Target: SCN10A; (-) strand; PAM type: NRG; PAM sequence: TGG
tgtgccactgcactccagcc

SEQ ID NO: 26949 - DNA, 20 bp, Artificial Sequence
  Description of Artificial Sequence: Synthetic oligonucleotide
  Target: SCN10A; (-) strand; PAM type: NRG; PAM sequence: CAG
gtgattgtgccactgcactc

SEQ ID NO: 26950 - DNA, 20 bp, Artificial Sequence
  Description of Artificial Sequence: Synthetic oligonucleotide
  Target: SCN10A; (-) strand; PAM type: NRG; PAM sequence: GAG
tgggaggtcaaggctgcaat

SEQ ID NO: 26951 - DNA, 20 bp, Artificial Sequence
  Description of Artificial Sequence: Synthetic oligonucleotide
  Target: SCN10A; (-) strand; PAM type: NRG; PAM sequence: AGG
cacttgaacatgggaggtca

SEQ ID NO: 26952 - DNA, 20 bp, Artificial Sequence
  Description of Artificial Sequence: Synthetic oligonucleotide
  Target: SCN10A; (-) strand; PAM type: NRG; PAM sequence: AAG
tcacttgaacatgggaggtc

SEQ ID NO: 26953 - DNA, 20 bp, Artificial Sequence
  Description of Artificial Sequence: Synthetic oligonucleotide
  Target: SCN10A; (-) strand; PAM type: NRG; PAM sequence: AGG
gaggatcacttgaacatggg

SEQ ID NO: 26954 - DNA, 20 bp, Artificial Sequence
  Description of Artificial Sequence: Synthetic oligonucleotide
  Target: SCN10A; (-) strand; PAM type: NRG; PAM sequence: GAG
ggaggatcacttgaacatgg

SEQ ID NO: 26955 - DNA, 20 bp, Artificial Sequence
  Description of Artificial Sequence: Synthetic oligonucleotide
  Target: SCN10A; (-) strand; PAM type: NRG; PAM sequence: GGG
tgggaggatcacttgaacat

SEQ ID NO: 26956 - DNA, 20 bp, Artificial Sequence
  Description of Artificial Sequence: Synthetic oligonucleotide
  Target: SCN10A; (-) strand; PAM type: NRG; PAM sequence: TGG
gtgggaggatcacttgaaca

SEQ ID NO: 26957 - DNA, 20 bp, Artificial Sequence
  Description of Artificial Sequence: Synthetic oligonucleotide
  Target: SCN10A; (-) strand; PAM type: NRG; PAM sequence: AGG
acttgggaggctgaggtggg

SEQ ID NO: 26958 - DNA, 20 bp, Artificial Sequence
  Description of Artificial Sequence: Synthetic oligonucleotide
  Target: SCN10A; (-) strand; PAM type: NRG; PAM sequence: GAG
tacttgggaggctgaggtgg

SEQ ID NO: 26959 - DNA, 20 bp, Artificial Sequence
  Description of Artificial Sequence: Synthetic oligonucleotide
  Target: SCN10A; (-) strand; PAM type: NRG; PAM sequence: GGG
actacttgggaggctgaggt

SEQ ID NO: 26960 - DNA, 20 bp, Artificial Sequence
  Description of Artificial Sequence: Synthetic oligonucleotide
  Target: SCN10A; (-) strand; PAM type: NRG; PAM sequence: TGG
cactacttgggaggctgagg

SEQ ID NO: 26961 - DNA, 20 bp, Artificial Sequence
  Description of Artificial Sequence: Synthetic oligonucleotide
  Target: SCN10A; (-) strand; PAM type: NRG; PAM sequence: AGG
ttccactacttgggaggctg

SEQ ID NO: 26962 - DNA, 20 bp, Artificial Sequence
  Description of Artificial Sequence: Synthetic oligonucleotide
  Target: SCN10A; (-) strand; PAM type: NRG; PAM sequence: GAG
gttccactacttgggaggct

SEQ ID NO: 26963 - DNA, 20 bp, Artificial Sequence
  Description of Artificial Sequence: Synthetic oligonucleotide
  Target: SCN10A; (-) strand; PAM type: NRG; PAM sequence: AGG
ctgtagttccactacttggg

SEQ ID NO: 26964 - DNA, 20 bp, Artificial Sequence
  Description of Artificial Sequence: Synthetic oligonucleotide
  Target: SCN10A; (-) strand; PAM type: NRG; PAM sequence: GAG
cctgtagttccactacttgg

SEQ ID NO: 26965 - DNA, 20 bp, Artificial Sequence
  Description of Artificial Sequence: Synthetic oligonucleotide
  Target: SCN10A; (-) strand; PAM type: NRG; PAM sequence: GGG
tacctgtagttccactactt

SEQ ID NO: 26966 - DNA, 20 bp, Artificial Sequence
  Description of Artificial Sequence: Synthetic oligonucleotide
  Target: SCN10A; (-) strand; PAM type: NRG; PAM sequence: TGG
atacctgtagttccactact

SEQ ID NO: 26967 - DNA, 20 bp, Artificial Sequence
  Description of Artificial Sequence: Synthetic oligonucleotide
  Target: SCN10A; (-) strand; PAM type: NRG; PAM sequence: TAG
ggcgtggtggcacatacctg

SEQ ID NO: 26968 - DNA, 20 bp, Artificial Sequence
  Description of Artificial Sequence: Synthetic oligonucleotide
  Target: SCN10A; (-) strand; PAM type: NRG; PAM sequence: TGG
tgaagattagccaggcgtgg

SEQ ID NO: 26969 - DNA, 20 bp, Artificial Sequence
  Description of Artificial Sequence: Synthetic oligonucleotide
  Target: SCN10A; (-) strand; PAM type: NRG; PAM sequence: TGG
atatgaagattagccaggcg

SEQ ID NO: 26970 - DNA, 20 bp, Artificial Sequence
  Description of Artificial Sequence: Synthetic oligonucleotide
  Target: SCN10A; (-) strand; PAM type: NRG; PAM sequence: AGG
caaaaatatgaagattagcc

SEQ ID NO: 26971 - DNA, 20 bp, Artificial Sequence
  Description of Artificial Sequence: Synthetic oligonucleotide
  Target: SCN10A; (-) strand; PAM type: NRG; PAM sequence: CAG
tcaaaaatatgaagattagc

SEQ ID NO: 26972 - DNA, 20 bp, Artificial Sequence
  Description of Artificial Sequence: Synthetic oligonucleotide
  Target: SCN10A; (-) strand; PAM type: NRG; PAM sequence: TAG
cccatcaaaaatatgaagat

SEQ ID NO: 26973 - DNA, 20 bp, Artificial Sequence
  Description of Artificial Sequence: Synthetic oligonucleotide
  Target: SCN10A; (-) strand; PAM type: NRG; PAM sequence: AAG
aaaaccccatcaaaaatatg

SEQ ID NO: 26974 - DNA, 20 bp, Artificial Sequence
  Description of Artificial Sequence: Synthetic oligonucleotide
  Target: SCN10A; (-) strand; PAM type: NRG; PAM sequence: TGG
tgagaccagcctggggaaca

SEQ ID NO: 26975 - DNA, 20 bp, Artificial Sequence
  Description of Artificial Sequence: Synthetic oligonucleotide
  Target: SCN10A; (-) strand; PAM type: NRG; PAM sequence: GGG
aggagtttgagaccagcctg

SEQ ID NO: 26976 - DNA, 20 bp, Artificial Sequence
  Description of Artificial Sequence: Synthetic oligonucleotide
  Target: SCN10A; (+) strand; PAM type: NRG; PAM sequence: TGG
attgtttgaattttattcta

SEQ ID NO: 26977 - DNA, 20 bp, Artificial Sequence
  Description of Artificial Sequence: Synthetic oligonucleotide
  Target: SCN10A; (+) strand; PAM type: NRG; PAM sequence: CAG
tttgaattttattctatggc

SEQ ID NO: 26978 - DNA, 20 bp, Artificial Sequence
  Description of Artificial Sequence: Synthetic oligonucleotide
  Target: SCN10A; (+) strand; PAM type: NRG; PAM sequence: AGG
ttgaattttattctatggcc

SEQ ID NO: 26979 - DNA, 20 bp, Artificial Sequence
  Description of Artificial Sequence: Synthetic oligonucleotide
  Target: SCN10A; (+) strand; PAM type: NRG; PAM sequence: CGG
ttattctatggccaggcata

SEQ ID NO: 26980 - DNA, 20 bp, Artificial Sequence
  Description of Artificial Sequence: Synthetic oligonucleotide
  Target: SCN10A; (+) strand; PAM type: NRG; PAM sequence: TGG
tacttgtatttgtacccttt

SEQ ID NO: 26981 - DNA, 20 bp, Artificial Sequence
  Description of Artificial Sequence: Synthetic oligonucleotide
  Target: SCN10A; (+) strand; PAM type: NRG; PAM sequence: TAG
ttgtacccttttggtaacct

SEQ ID NO: 26982 - DNA, 20 bp, Artificial Sequence
  Description of Artificial Sequence: Synthetic oligonucleotide
  Target: SCN10A; (+) strand; PAM type: NRG; PAM sequence: AGG
tgtacccttttggtaacctt

SEQ ID NO: 26983 - DNA, 20 bp, Artificial Sequence
  Description of Artificial Sequence: Synthetic oligonucleotide
  Target: SCN10A; (+) strand; PAM type: NRG; PAM sequence: TGG
tggtaaccttaggttttgtg

SEQ ID NO: 26984 - DNA, 20 bp, Artificial Sequence
  Description of Artificial Sequence: Synthetic oligonucleotide
  Target: SCN10A; (+) strand; PAM type: NRG; PAM sequence: CAG
tttgtgtggctttctgtaaa

SEQ ID NO: 26985 - DNA, 20 bp, Artificial Sequence
  Description of Artificial Sequence: Synthetic oligonucleotide
  Target: SCN10A; (+) strand; PAM type: NRG; PAM sequence: CAG
ttgactgacactctttttcc

SEQ ID NO: 26986 - DNA, 20 bp, Artificial Sequence
  Description of Artificial Sequence: Synthetic oligonucleotide
  Target: SCN10A; (+) strand; PAM type: NRG; PAM sequence: GAG
gactgacactctttttccca

SEQ ID NO: 26987 - DNA, 20 bp, Artificial Sequence
  Description of Artificial Sequence: Synthetic oligonucleotide
  Target: SCN10A; (+) strand; PAM type: NRG; PAM sequence: CGG
ttctgtatgtctctatatcc

SEQ ID NO: 26988 - DNA, 20 bp, Artificial Sequence
  Description of Artificial Sequence: Synthetic oligonucleotide
  Target: SCN10A; (+) strand; PAM type: NRG; PAM sequence: GGG
tctgtatgtctctatatccc

SEQ ID NO: 26989 - DNA, 20 bp, Artificial Sequence
  Description of Artificial Sequence: Synthetic oligonucleotide
  Target: SCN10A; (+) strand; PAM type: NRG; PAM sequence: AAG
tttaattattattatacttt

SEQ ID NO: 26990 - DNA, 20 bp, Artificial Sequence
  Description of Artificial Sequence: Synthetic oligonucleotide
  Target: SCN10A; (+) strand; PAM type: NRG; PAM sequence: TAG
tattattatactttaagttt

SEQ ID NO: 26991 - DNA, 20 bp, Artificial Sequence
  Description of Artificial Sequence: Synthetic oligonucleotide
  Target: SCN10A; (+) strand; PAM type: NRG; PAM sequence: AGG
attattatactttaagtttt

SEQ ID NO: 26992 - DNA, 20 bp, Artificial Sequence
  Description of Artificial Sequence: Synthetic oligonucleotide
  Target: SCN10A; (+) strand; PAM type: NRG; PAM sequence: GAG
ctttaagttttaggatacat

SEQ ID NO: 26993 - DNA, 20 bp, Artificial Sequence
  Description of Artificial Sequence: Synthetic oligonucleotide
  Target: SCN10A; (+) strand; PAM type: NRG; PAM sequence: CAG
ggatacatgagcacaacgtg

SEQ ID NO: 26994 - DNA, 20 bp, Artificial Sequence
  Description of Artificial Sequence: Synthetic oligonucleotide
  Target: SCN10A; (+) strand; PAM type: NRG; PAM sequence: AGG
gatacatgagcacaacgtgc

SEQ ID NO: 26995 - DNA, 20 bp, Artificial Sequence
  Description of Artificial Sequence: Synthetic oligonucleotide
  Target: SCN10A; (+) strand; PAM type: NRG; PAM sequence: TGG
tatgtatacatgtgccatgt

SEQ ID NO: 26996 - DNA, 20 bp, Artificial Sequence
  Description of Artificial Sequence: Synthetic oligonucleotide
  Target: SCN10A; (+) strand; PAM type: NRG; PAM sequence: TAG
cattaacttgtcatttacat

SEQ ID NO: 26997 - DNA, 20 bp, Artificial Sequence
  Description of Artificial Sequence: Synthetic oligonucleotide
  Target: SCN10A; (+) strand; PAM type: NRG; PAM sequence: AGG
attaacttgtcatttacatt

SEQ ID NO: 26998 - DNA, 20 bp, Artificial Sequence
  Description of Artificial Sequence: Synthetic oligonucleotide
  Target: SCN10A; (+) strand; PAM type: NRG; PAM sequence: CGG
ctccaccccacaactgtccc

SEQ ID NO: 26999 - DNA, 20 bp, Artificial Sequence
  Description of Artificial Sequence: Synthetic oligonucleotide
  Target: SCN10A; (+) strand; PAM type: NRG; PAM sequence: GAG
attgttcaattcccacctat

SEQ ID NO: 27000 - DNA, 20 bp, Artificial Sequence
  Description of Artificial Sequence: Synthetic oligonucleotide
  Target: SCN10A; (+) strand; PAM type: NRG; PAM sequence: GAG
ttcaattcccacctatgagt

SEQ ID NO: 27001 - DNA, 20 bp, Artificial Sequence
  Description of Artificial Sequence: Synthetic oligonucleotide
  Target: SCN10A; (+) strand; PAM type: NRG; PAM sequence: CGG
cacctatgagtgagaacatg

SEQ ID NO: 27002 - DNA, 20 bp, Artificial Sequence
  Description of Artificial Sequence: Synthetic oligonucleotide
  Target: SCN10A; (+) strand; PAM type: NRG; PAM sequence: TGG
gagtgagaacatgcggtgtt

SEQ ID NO: 27003 - DNA, 20 bp, Artificial Sequence
  Description of Artificial Sequence: Synthetic oligonucleotide
  Target: SCN10A; (+) strand; PAM type: NRG; PAM sequence: TAG
ggttttttttgtccttgcga

SEQ ID NO: 27004 - DNA, 20 bp, Artificial Sequence
  Description of Artificial Sequence: Synthetic oligonucleotide
  Target: SCN10A; (+) strand; PAM type: NRG; PAM sequence: GAG
tgtccttgcgatagtttgct

SEQ ID NO: 27005 - DNA, 20 bp, Artificial Sequence
  Description of Artificial Sequence: Synthetic oligonucleotide
  Target: SCN10A; (+) strand; PAM type: NRG; PAM sequence: TGG
cgatagtttgctgagaatga

SEQ ID NO: 27006 - DNA, 20 bp, Artificial Sequence
  Description of Artificial Sequence: Synthetic oligonucleotide
  Target: SCN10A; (+) strand; PAM type: NRG; PAM sequence: CAG
ttgctgagaatgatggtttc

SEQ ID NO: 27007 - DNA, 20 bp, Artificial Sequence
  Description of Artificial Sequence: Synthetic oligonucleotide
  Target: SCN10A; (+) strand; PAM type: NRG; PAM sequence: AAG
gcttcatccatgtccctgca

SEQ ID NO: 27008 - DNA, 20 bp, Artificial Sequence
  Description of Artificial Sequence: Synthetic oligonucleotide
  Target: SCN10A; (+) strand; PAM type: NRG; PAM sequence: AGG
cttcatccatgtccctgcaa

SEQ ID NO: 27009 - DNA, 20 bp, Artificial Sequence
  Description of Artificial Sequence: Synthetic oligonucleotide
  Target: SCN10A; (+) strand; PAM type: NRG; PAM sequence: TGG
catgaactcatcatttttta

SEQ ID NO: 27010 - DNA, 20 bp, Artificial Sequence
  Description of Artificial Sequence: Synthetic oligonucleotide
  Target: SCN10A; (+) strand; PAM type: NRG; PAM sequence: TAG
catcattttttatggctgca

SEQ ID NO: 27011 - DNA, 20 bp, Artificial Sequence
  Description of Artificial Sequence: Synthetic oligonucleotide
  Target: SCN10A; (+) strand; PAM type: NRG; PAM sequence: TGG
tatggctgcatagtattcca

SEQ ID NO: 27012 - DNA, 20 bp, Artificial Sequence
  Description of Artificial Sequence: Synthetic oligonucleotide
  Target: SCN10A; (+) strand; PAM type: NRG; PAM sequence: CAG
tgtgccacattttcttaatc

SEQ ID NO: 27013 - DNA, 20 bp, Artificial Sequence
  Description of Artificial Sequence: Synthetic oligonucleotide
  Target: SCN10A; (+) strand; PAM type: NRG; PAM sequence: TGG
ttaatccagtctatcactgt

SEQ ID NO: 27014 - DNA, 20 bp, Artificial Sequence
  Description of Artificial Sequence: Synthetic oligonucleotide
  Target: SCN10A; (+) strand; PAM type: NRG; PAM sequence: TGG
gtctatcactgttggacatt

SEQ ID NO: 27015 - DNA, 20 bp, Artificial Sequence
  Description of Artificial Sequence: Synthetic oligonucleotide
  Target: SCN10A; (+) strand; PAM type: NRG; PAM sequence: GGG
tctatcactgttggacattt

SEQ ID NO: 27016 - DNA, 20 bp, Artificial Sequence
  Description of Artificial Sequence: Synthetic oligonucleotide
  Target: SCN10A; (+) strand; PAM type: NRG; PAM sequence: TGG
tcactgttggacatttgggt

SEQ ID NO: 27017 - DNA, 20 bp, Artificial Sequence
  Description of Artificial Sequence: Synthetic oligonucleotide
  Target: SCN10A; (+) strand; PAM type: NRG; PAM sequence: AAG
tggacatttgggttggttcc

SEQ ID NO: 27018 - DNA, 20 bp, Artificial Sequence
  Description of Artificial Sequence: Synthetic oligonucleotide
  Target: SCN10A; (+) strand; PAM type: NRG; PAM sequence: TAG
caagtctttgctattgtgaa

SEQ ID NO: 27019 - DNA, 20 bp, Artificial Sequence
  Description of Artificial Sequence: Synthetic oligonucleotide
  Target: SCN10A; (+) strand; PAM type: NRG; PAM sequence: TAG
tacgtgtgcatgtgtcttta

SEQ ID NO: 27020 - DNA, 20 bp, Artificial Sequence
  Description of Artificial Sequence: Synthetic oligonucleotide
  Target: SCN10A; (+) strand; PAM type: NRG; PAM sequence: CAG
gtgtgcatgtgtctttatag

SEQ ID NO: 27021 - DNA, 20 bp, Artificial Sequence
  Description of Artificial Sequence: Synthetic oligonucleotide
  Target: SCN10A; (+) strand; PAM type: NRG; PAM sequence: TGG
cagtatgatttataatcctt

SEQ ID NO: 27022 - DNA, 20 bp, Artificial Sequence
  Description of Artificial Sequence: Synthetic oligonucleotide
  Target: SCN10A; (+) strand; PAM type: NRG; PAM sequence: GGG
agtatgatttataatccttt

SEQ ID NO: 27023 - DNA, 20 bp, Artificial Sequence
  Description of Artificial Sequence: Synthetic oligonucleotide
  Target: SCN10A; (+) strand; PAM type: NRG; PAM sequence: CAG
taatcctttgggtatatacc

SEQ ID NO: 27024 - DNA, 20 bp, Artificial Sequence
  Description of Artificial Sequence: Synthetic oligonucleotide
  Target: SCN10A; (+) strand; PAM type: NRG; PAM sequence: TGG
tttgggtatatacccagtaa

SEQ ID NO: 27025 - DNA, 20 bp, Artificial Sequence
  Description of Artificial Sequence: Synthetic oligonucleotide
  Target: SCN10A; (+) strand; PAM type: NRG; PAM sequence: GGG
ttgggtatatacccagtaat

SEQ ID NO: 27026 - DNA, 20 bp, Artificial Sequence
  Description of Artificial Sequence: Synthetic oligonucleotide
  Target: SCN10A; (+) strand; PAM type: NRG; PAM sequence: TGG
gtatatacccagtaatggga

SEQ ID NO: 27027 - DNA, 20 bp, Artificial Sequence
  Description of Artificial Sequence: Synthetic oligonucleotide
  Target: SCN10A; (+) strand; PAM type: NRG; PAM sequence: TGG
atacccagtaatgggatggc

SEQ ID NO: 27028 - DNA, 20 bp, Artificial Sequence
  Description of Artificial Sequence: Synthetic oligonucleotide
  Target: SCN10A; (+) strand; PAM type: NRG; PAM sequence: GGG
tacccagtaatgggatggct

SEQ ID NO: 27029 - DNA, 20 bp, Artificial Sequence
  Description of Artificial Sequence: Synthetic oligonucleotide
  Target: SCN10A; (+) strand; PAM type: NRG; PAM sequence: TGG
aatgggatggctgggtcaaa

SEQ ID NO: 27030 - DNA, 20 bp, Artificial Sequence
  Description of Artificial Sequence: Synthetic oligonucleotide
  Target: SCN10A; (+) strand; PAM type: NRG; PAM sequence: TGG
gctgggtcaaatggtatttc

SEQ ID NO: 27031 - DNA, 20 bp, Artificial Sequence
  Description of Artificial Sequence: Synthetic oligonucleotide
  Target: SCN10A; (+) strand; PAM type: NRG; PAM sequence: TAG
tcaaatggtatttctggttc

SEQ ID NO: 27032 - DNA, 20 bp, Artificial Sequence
  Description of Artificial Sequence: Synthetic oligonucleotide
  Target: SCN10A; (+) strand; PAM type: NRG; PAM sequence: GAG
atttctggttctagatccct

SEQ ID NO: 27033 - DNA, 20 bp, Artificial Sequence
  Description of Artificial Sequence: Synthetic oligonucleotide
  Target: SCN10A; (+) strand; PAM type: NRG; PAM sequence: AGG
tttctggttctagatccctg

SEQ ID NO: 27034 - DNA, 20 bp, Artificial Sequence
  Description of Artificial Sequence: Synthetic oligonucleotide
  Target: SCN10A; (+) strand; PAM type: NRG; PAM sequence: TAG
gacttccacaatgattgaac

SEQ ID NO: 27035 - DNA, 20 bp, Artificial Sequence
  Description of Artificial Sequence: Synthetic oligonucleotide
  Target: SCN10A; (+) strand; PAM type: NRG; PAM sequence: CAG
acaatgattgaactagttta

SEQ ID NO: 27036 - DNA, 20 bp, Artificial Sequence
  Description of Artificial Sequence: Synthetic oligonucleotide
  Target: SCN10A; (+) strand; PAM type: NRG; PAM sequence: CAG
ctagtttacagacccaccaa

SEQ ID NO: 27037 - DNA, 20 bp, Artificial Sequence
  Description of Artificial Sequence: Synthetic oligonucleotide
  Target: SCN10A; (+) strand; PAM type: NRG; PAM sequence: AAG
cagacccaccaacagtgtaa

SEQ ID NO: 27038 - DNA, 20 bp, Artificial Sequence
  Description of Artificial Sequence: Synthetic oligonucleotide
  Target: SCN10A; (+) strand; PAM type: NRG; PAM sequence: CAG
ctatttctccacatcctctc

SEQ ID NO: 27039 - DNA, 20 bp, Artificial Sequence
  Description of Artificial Sequence: Synthetic oligonucleotide
  Target: SCN10A; (+) strand; PAM type: NRG; PAM sequence: TGG
ttaatgatcgccattctaac

SEQ ID NO: 27040 - DNA, 20 bp, Artificial Sequence
  Description of Artificial Sequence: Synthetic oligonucleotide
  Target: SCN10A; (+) strand; PAM type: NRG; PAM sequence: GAG
atcgccattctaactggtgt

SEQ ID NO: 27041 - DNA, 20 bp, Artificial Sequence
  Description of Artificial Sequence: Synthetic oligonucleotide
  Target: SCN10A; (+) strand; PAM type: NRG; PAM sequence: TGG
ccattctaactggtgtgaga

SEQ ID NO: 27042 - DNA, 20 bp, Artificial Sequence
  Description of Artificial Sequence: Synthetic oligonucleotide
  Target: SCN10A; (+) strand; PAM type: NRG; PAM sequence: TGG
tgtgagatggtatctcattg

SEQ ID NO: 27043 - DNA, 20 bp, Artificial Sequence
  Description of Artificial Sequence: Synthetic oligonucleotide
  Target: SCN10A; (+) strand; PAM type: NRG; PAM sequence: TGG
tttgatttgcatttctctga

SEQ ID NO: 27044 - DNA, 20 bp, Artificial Sequence
  Description of Artificial Sequence: Synthetic oligonucleotide
  Target: SCN10A; (+) strand; PAM type: NRG; PAM sequence: CAG
atttgcatttctctgatggc

SEQ ID NO: 27045 - DNA, 20 bp, Artificial Sequence
  Description of Artificial Sequence: Synthetic oligonucleotide
  Target: SCN10A; (+) strand; PAM type: NRG; PAM sequence: GAG
ctctgatggccagtgatgat

SEQ ID NO: 27046 - DNA, 20 bp, Artificial Sequence
  Description of Artificial Sequence: Synthetic oligonucleotide
  Target: SCN10A; (+) strand; PAM type: NRG; PAM sequence: TGG
gcattttttcatgtgttttt

SEQ ID NO: 27047 - DNA, 20 bp, Artificial Sequence
  Description of Artificial Sequence: Synthetic oligonucleotide
  Target: SCN10A; (+) strand; PAM type: NRG; PAM sequence: GAG
ctgcataaatgtcttctttt

SEQ ID NO: 27048 - DNA, 20 bp, Artificial Sequence
  Description of Artificial Sequence: Synthetic oligonucleotide
  Target: SCN10A; (+) strand; PAM type: NRG; PAM sequence: AAG
cataaatgtcttcttttgag

SEQ ID NO: 27049 - DNA, 20 bp, Artificial Sequence
  Description of Artificial Sequence: Synthetic oligonucleotide
  Target: SCN10A; (+) strand; PAM type: NRG; PAM sequence: TGG
atccttcgcccactttttga

SEQ ID NO: 27050 - DNA, 20 bp, Artificial Sequence
  Description of Artificial Sequence: Synthetic oligonucleotide
  Target: SCN10A; (+) strand; PAM type: NRG; PAM sequence: GGG
tccttcgcccactttttgat

SEQ ID NO: 27051 - DNA, 20 bp, Artificial Sequence
  Description of Artificial Sequence: Synthetic oligonucleotide
  Target: SCN10A; (+) strand; PAM type: NRG; PAM sequence: GAG
ttttccttgtaaatttgttt

SEQ ID NO: 27052 - DNA, 20 bp, Artificial Sequence
  Description of Artificial Sequence: Synthetic oligonucleotide
  Target: SCN10A; (+) strand; PAM type: NRG; PAM sequence: TAG
aaatttgtttgagttcattg

SEQ ID NO: 27053 - DNA, 20 bp, Artificial Sequence
  Description of Artificial Sequence: Synthetic oligonucleotide
  Target: SCN10A; (+) strand; PAM type: NRG; PAM sequence: TGG
tttgagttcattgtagattc

SEQ ID NO: 27054 - DNA, 20 bp, Artificial Sequence
  Description of Artificial Sequence: Synthetic oligonucleotide
  Target: SCN10A; (+) strand; PAM type: NRG; PAM sequence: TAG
tcattgtagattctggatat

SEQ ID NO: 27055 - DNA, 20 bp, Artificial Sequence
  Description of Artificial Sequence: Synthetic oligonucleotide
  Target: SCN10A; (+) strand; PAM type: NRG; PAM sequence: CAG
tctggatattagcccttcgt

SEQ ID NO: 27056 - DNA, 20 bp, Artificial Sequence
  Description of Artificial Sequence: Synthetic oligonucleotide
  Target: SCN10A; (+) strand; PAM type: NRG; PAM sequence: GAG
atattagcccttcgtcagat

SEQ ID NO: 27057 - DNA, 20 bp, Artificial Sequence
  Description of Artificial Sequence: Synthetic oligonucleotide
  Target: SCN10A; (+) strand; PAM type: NRG; PAM sequence: TAG
ttagcccttcgtcagatgag

SEQ ID NO: 27058 - DNA, 20 bp, Artificial Sequence
  Description of Artificial Sequence: Synthetic oligonucleotide
  Target: SCN10A; (+) strand; PAM type: NRG; PAM sequence: AGG
tagcccttcgtcagatgagt

SEQ ID NO: 27059 - DNA, 20 bp, Artificial Sequence
  Description of Artificial Sequence: Synthetic oligonucleotide
  Target: SCN10A; (+) strand; PAM type: NRG; PAM sequence: TAG
aaaaattttctcccatcctg

SEQ ID NO: 27060 - DNA, 20 bp, Artificial Sequence
  Description of Artificial Sequence: Synthetic oligonucleotide
  Target: SCN10A; (+) strand; PAM type: NRG; PAM sequence: AGG
aaaattttctcccatcctgt

SEQ ID NO: 27061 - DNA, 20 bp, Artificial Sequence
  Description of Artificial Sequence: Synthetic oligonucleotide
  Target: SCN10A; (+) strand; PAM type: NRG; PAM sequence: TGG
taggtttctgttcactctga

SEQ ID NO: 27062 - DNA, 20 bp, Artificial Sequence
  Description of Artificial Sequence: Synthetic oligonucleotide
  Target: SCN10A; (+) strand; PAM type: NRG; PAM sequence: TGG
gtttctgttcactctgatgg

SEQ ID NO: 27063 - DNA, 20 bp, Artificial Sequence
  Description of Artificial Sequence: Synthetic oligonucleotide
  Target: SCN10A; (+) strand; PAM type: NRG; PAM sequence: CAG
tggtggtttcttttgctgct

SEQ ID NO: 27064 - DNA, 20 bp, Artificial Sequence
  Description of Artificial Sequence: Synthetic oligonucleotide
  Target: SCN10A; (+) strand; PAM type: NRG; PAM sequence: AAG
tggtttcttttgctgctcag

SEQ ID NO: 27065 - DNA, 20 bp, Artificial Sequence
  Description of Artificial Sequence: Synthetic oligonucleotide
  Target: SCN10A; (+) strand; PAM type: NRG; PAM sequence: TAG
tttgctgctcagaagctctt

SEQ ID NO: 27066 - DNA, 20 bp, Artificial Sequence
  Description of Artificial Sequence: Synthetic oligonucleotide
  Target: SCN10A; (+) strand; PAM type: NRG; PAM sequence: GAG
cagaagctctttagtttaat

SEQ ID NO: 27067 - DNA, 20 bp, Artificial Sequence
  Description of Artificial Sequence: Synthetic oligonucleotide
  Target: SCN10A; (+) strand; PAM type: NRG; PAM sequence: TGG
acttttgttgccattgcttt

SEQ ID NO: 27068 - DNA, 20 bp, Artificial Sequence
  Description of Artificial Sequence: Synthetic oligonucleotide
  Target: SCN10A; (+) strand; PAM type: NRG; PAM sequence: TAG
tgccattgcttttggtgttt

SEQ ID NO: 27069 - DNA, 20 bp, Artificial Sequence
  Description of Artificial Sequence: Synthetic oligonucleotide
  Target: SCN10A; (+) strand; PAM type: NRG; PAM sequence: AAG
cttttggtgttttagacatg

SEQ ID NO: 27070 - DNA, 20 bp, Artificial Sequence
  Description of Artificial Sequence: Synthetic oligonucleotide
  Target: SCN10A; (+) strand; PAM type: NRG; PAM sequence: TGG
gcccatgcctatgtcctgaa

SEQ ID NO: 27071 - DNA, 20 bp, Artificial Sequence
  Description of Artificial Sequence: Synthetic oligonucleotide
  Target: SCN10A; (+) strand; PAM type: NRG; PAM sequence: TAG
atgtcctgaatggtattgcc

SEQ ID NO: 27072 - DNA, 20 bp, Artificial Sequence
  Description of Artificial Sequence: Synthetic oligonucleotide
  Target: SCN10A; (+) strand; PAM type: NRG; PAM sequence: AGG
tgtcctgaatggtattgcct

SEQ ID NO: 27073 - DNA, 20 bp, Artificial Sequence
  Description of Artificial Sequence: Synthetic oligonucleotide
  Target: SCN10A; (+) strand; PAM type: NRG; PAM sequence: TAG
gtattgcctaggttctcttc

SEQ ID NO: 27074 - DNA, 20 bp, Artificial Sequence
  Description of Artificial Sequence: Synthetic oligonucleotide
  Target: SCN10A; (+) strand; PAM type: NRG; PAM sequence: AGG
tattgcctaggttctcttct

SEQ ID NO: 27075 - DNA, 20 bp, Artificial Sequence
  Description of Artificial Sequence: Synthetic oligonucleotide
  Target: SCN10A; (+) strand; PAM type: NRG; PAM sequence: GGG
attgcctaggttctcttcta

SEQ ID NO: 27076 - DNA, 20 bp, Artificial Sequence
  Description of Artificial Sequence: Synthetic oligonucleotide
  Target: SCN10A; (+) strand; PAM type: NRG; PAM sequence: TGG
gttctcttctagggttttta

SEQ ID NO: 27077 - DNA, 20 bp, Artificial Sequence
  Description of Artificial Sequence: Synthetic oligonucleotide
  Target: SCN10A; (+) strand; PAM type: NRG; PAM sequence: TAG
ttctagggtttttatggttt

SEQ ID NO: 27078 - DNA, 20 bp, Artificial Sequence
  Description of Artificial Sequence: Synthetic oligonucleotide
  Target: SCN10A; (+) strand; PAM type: NRG; PAM sequence: AGG
tctagggtttttatggtttt

SEQ ID NO: 27079 - DNA, 20 bp, Artificial Sequence
  Description of Artificial Sequence: Synthetic oligonucleotide
  Target: SCN10A; (+) strand; PAM type: NRG; PAM sequence: AAG
tggttttaggtctaacattt

SEQ ID NO: 27080 - DNA, 20 bp, Artificial Sequence
  Description of Artificial Sequence: Synthetic oligonucleotide
  Target: SCN10A; (+) strand; PAM type: NRG; PAM sequence: AAG
tcttgaattaatttttgtat

SEQ ID NO: 27081 - DNA, 20 bp, Artificial Sequence
  Description of Artificial Sequence: Synthetic oligonucleotide
  Target: SCN10A; (+) strand; PAM type: NRG; PAM sequence: AGG
cttgaattaatttttgtata

SEQ ID NO: 27082 - DNA, 20 bp, Artificial Sequence
  Description of Artificial Sequence: Synthetic oligonucleotide
  Target: SCN10A; (+) strand; PAM type: NRG; PAM sequence: AAG
ttaatttttgtataaggtgt

SEQ ID NO: 27083 - DNA, 20 bp, Artificial Sequence
  Description of Artificial Sequence: Synthetic oligonucleotide
  Target: SCN10A; (+) strand; PAM type: NRG; PAM sequence: AGG
taatttttgtataaggtgta

SEQ ID NO: 27084 - DNA, 20 bp, Artificial Sequence
  Description of Artificial Sequence: Synthetic oligonucleotide
  Target: SCN10A; (+) strand; PAM type: NRG; PAM sequence: AAG
tttttgtataaggtgtaagg

SEQ ID NO: 27085 - DNA, 20 bp, Artificial Sequence
  Description of Artificial Sequence: Synthetic oligonucleotide
  Target: SCN10A; (+) strand; PAM type: NRG; PAM sequence: AGG
ttttgtataaggtgtaagga

SEQ ID NO: 27086 - DNA, 20 bp, Artificial Sequence
  Description of Artificial Sequence: Synthetic oligonucleotide
  Target: SCN10A; (+) strand; PAM type: NRG; PAM sequence: GGG
tttgtataaggtgtaaggaa

SEQ ID NO: 27087 - DNA, 20 bp, Artificial Sequence
  Description of Artificial Sequence: Synthetic oligonucleotide
  Target: SCN10A; (+) strand; PAM type: NRG; PAM sequence: CAG
taaggtgtaaggaagggatc

SEQ ID NO: 27088 - DNA, 20 bp, Artificial Sequence
  Description of Artificial Sequence: Synthetic oligonucleotide
  Target: SCN10A; (+) strand; PAM type: NRG; PAM sequence: CAG
gtaaggaagggatccagttt

SEQ ID NO: 27089 - DNA, 20 bp, Artificial Sequence
  Description of Artificial Sequence: Synthetic oligonucleotide
  Target: SCN10A; (+) strand; PAM type: NRG; PAM sequence: TGG
cagtttcagctttctccata

SEQ ID NO: 27090 - DNA, 20 bp, Artificial Sequence
  Description of Artificial Sequence: Synthetic oligonucleotide
  Target: SCN10A; (+) strand; PAM type: NRG; PAM sequence: TAG
ttcagctttctccatatggc

SEQ ID NO: 27091 - DNA, 20 bp, Artificial Sequence
  Description of Artificial Sequence: Synthetic oligonucleotide
  Target: SCN10A; (+) strand; PAM type: NRG; PAM sequence: CAG
gctttctccatatggctagc

SEQ ID NO: 27092 - DNA, 20 bp, Artificial Sequence
  Description of Artificial Sequence: Synthetic oligonucleotide
  Target: SCN10A; (+) strand; PAM type: NRG; PAM sequence: CAG
atatggctagccagttttcc

SEQ ID NO: 27093 - DNA, 20 bp, Artificial Sequence
  Description of Artificial Sequence: Synthetic oligonucleotide
  Target: SCN10A; (+) strand; PAM type: NRG; PAM sequence: TAG
tcccagcaccatttattaaa

SEQ ID NO: 27094 - DNA, 20 bp, Artificial Sequence
  Description of Artificial Sequence: Synthetic oligonucleotide
  Target: SCN10A; (+) strand; PAM type: NRG; PAM sequence: AGG
cccagcaccatttattaaat

SEQ ID NO: 27095 - DNA, 20 bp, Artificial Sequence
  Description of Artificial Sequence: Synthetic oligonucleotide
  Target: SCN10A; (+) strand; PAM type: NRG; PAM sequence: GGG
ccagcaccatttattaaata

SEQ ID NO: 27096 - DNA, 20 bp, Artificial Sequence
  Description of Artificial Sequence: Synthetic oligonucleotide
  Target: SCN10A; (+) strand; PAM type: NRG; PAM sequence: CAG
tccccatttcttgtttttgt

SEQ ID NO: 27097 - DNA, 20 bp, Artificial Sequence
  Description of Artificial Sequence: Synthetic oligonucleotide
  Target: SCN10A; (+) strand; PAM type: NRG; PAM sequence: AGG
ccccatttcttgtttttgtc

SEQ ID NO: 27098 - DNA, 20 bp, Artificial Sequence
  Description of Artificial Sequence: Synthetic oligonucleotide
  Target: SCN10A; (+) strand; PAM type: NRG; PAM sequence: AAG
tgtttttgtcaggtttgtca

SEQ ID NO: 27099 - DNA, 20 bp, Artificial Sequence
  Description of Artificial Sequence: Synthetic oligonucleotide
  Target: SCN10A; (+) strand; PAM type: NRG; PAM sequence: CAG
ttgtcaggtttgtcaaagat

SEQ ID NO: 27100 - DNA, 20 bp, Artificial Sequence
  Description of Artificial Sequence: Synthetic oligonucleotide
  Target: SCN10A; (+) strand; PAM type: NRG; PAM sequence: TAG
caggtttgtcaaagatcaga

SEQ ID NO: 27101 - DNA, 20 bp, Artificial Sequence
  Description of Artificial Sequence: Synthetic oligonucleotide
  Target: SCN10A; (+) strand; PAM type: NRG; PAM sequence: TAG
tgtcaaagatcagatagttg

SEQ ID NO: 27102 - DNA, 20 bp, Artificial Sequence
  Description of Artificial Sequence: Synthetic oligonucleotide
  Target: SCN10A; (+) strand; PAM type: NRG; PAM sequence: CGG
atcagatagttgtagatatg

SEQ ID NO: 27103 - DNA, 20 bp, Artificial Sequence
  Description of Artificial Sequence: Synthetic oligonucleotide
  Target: SCN10A; (+) strand; PAM type: NRG; PAM sequence: GAG
agatatgcggcattatttct

SEQ ID NO: 27104 - DNA, 20 bp, Artificial Sequence
  Description of Artificial Sequence: Synthetic oligonucleotide
  Target: SCN10A; (+) strand; PAM type: NRG; PAM sequence: AGG
gatatgcggcattatttctg

SEQ ID NO: 27105 - DNA, 20 bp, Artificial Sequence
  Description of Artificial Sequence: Synthetic oligonucleotide
  Target: SCN10A; (+) strand; PAM type: NRG; PAM sequence: GGG
atatgcggcattatttctga

SEQ ID NO: 27106 - DNA, 20 bp, Artificial Sequence
  Description of Artificial Sequence: Synthetic oligonucleotide
  Target: SCN10A; (+) strand; PAM type: NRG; PAM sequence: TGG
agggctctgttctgttccat

SEQ ID NO: 27107 - DNA, 20 bp, Artificial Sequence
  Description of Artificial Sequence: Synthetic oligonucleotide
  Target: SCN10A; (+) strand; PAM type: NRG; PAM sequence: TGG
attggtctatatctctgttt

SEQ ID NO: 27108 - DNA, 20 bp, Artificial Sequence
  Description of Artificial Sequence: Synthetic oligonucleotide
  Target: SCN10A; (+) strand; PAM type: NRG; PAM sequence: CAG
ctatatctctgttttggtac

SEQ ID NO: 27109 - DNA, 20 bp, Artificial Sequence
  Description of Artificial Sequence: Synthetic oligonucleotide
  Target: SCN10A; (+) strand; PAM type: NRG; PAM sequence: TGG
gtaccagtaccatgctgttt

SEQ ID NO: 27110 - DNA, 20 bp, Artificial Sequence
  Description of Artificial Sequence: Synthetic oligonucleotide
  Target: SCN10A; (+) strand; PAM type: NRG; PAM sequence: TAG
ccatgctgttttggttactg

SEQ ID NO: 27111 - DNA, 20 bp, Artificial Sequence
  Description of Artificial Sequence: Synthetic oligonucleotide
  Target: SCN10A; (+) strand; PAM type: NRG; PAM sequence: TAG
gttactgtagccttgtaata

SEQ ID NO: 27112 - DNA, 20 bp, Artificial Sequence
  Description of Artificial Sequence: Synthetic oligonucleotide
  Target: SCN10A; (+) strand; PAM type: NRG; PAM sequence: AAG
tagccttgtaatatagtttg

SEQ ID NO: 27113 - DNA, 20 bp, Artificial Sequence
  Description of Artificial Sequence: Synthetic oligonucleotide
  Target: SCN10A; (+) strand; PAM type: NRG; PAM sequence: CAG
cttgtaatatagtttgaagt

SEQ ID NO: 27114 - DNA, 20 bp, Artificial Sequence
  Description of Artificial Sequence: Synthetic oligonucleotide
  Target: SCN10A; (+) strand; PAM type: NRG; PAM sequence: AGG
ttgtaatatagtttgaagtc

SEQ ID NO: 27115 - DNA, 20 bp, Artificial Sequence
  Description of Artificial Sequence: Synthetic oligonucleotide
  Target: SCN10A; (+) strand; PAM type: NRG; PAM sequence: TAG
taatatagtttgaagtcagg

SEQ ID NO: 27116 - DNA, 20 bp, Artificial Sequence
  Description of Artificial Sequence: Synthetic oligonucleotide
  Target: SCN10A; (+) strand; PAM type: NRG; PAM sequence: CAG
gtcaggtagcgtgatgcctc

SEQ ID NO: 27117 - DNA, 20 bp, Artificial Sequence
  Description of Artificial Sequence: Synthetic oligonucleotide
  Target: SCN10A; (+) strand; PAM type: NRG; PAM sequence: CAG
gctttgttatacaccaataa

SEQ ID NO: 27118 - DNA, 20 bp, Artificial Sequence
  Description of Artificial Sequence: Synthetic oligonucleotide
  Target: SCN10A; (+) strand; PAM type: NRG; PAM sequence: CAG
atacaccaataacagacaaa

SEQ ID NO: 27119 - DNA, 20 bp, Artificial Sequence
  Description of Artificial Sequence: Synthetic oligonucleotide
  Target: SCN10A; (+) strand; PAM type: NRG; PAM sequence: GAG
acaccaataacagacaaaca

SEQ ID NO: 27120 - DNA, 20 bp, Artificial Sequence
  Description of Artificial Sequence: Synthetic oligonucleotide
  Target: SCN10A; (+) strand; PAM type: NRG; PAM sequence: GAG
accaataacagacaaacaga

SEQ ID NO: 27121 - DNA, 20 bp, Artificial Sequence
  Description of Artificial Sequence: Synthetic oligonucleotide
  Target: SCN10A; (+) strand; PAM type: NRG; PAM sequence: GAG
caaacagagagccaaatcat

SEQ ID NO: 27122 - DNA, 20 bp, Artificial Sequence
  Description of Artificial Sequence: Synthetic oligonucleotide
  Target: SCN10A; (+) strand; PAM type: NRG; PAM sequence: AAG
tcccattcacaattgcttca

SEQ ID NO: 27123 - DNA, 20 bp, Artificial Sequence
  Description of Artificial Sequence: Synthetic oligonucleotide
  Target: SCN10A; (+) strand; PAM type: NRG; PAM sequence: GAG
ccattcacaattgcttcaaa

SEQ ID NO: 27124 - DNA, 20 bp, Artificial Sequence
  Description of Artificial Sequence: Synthetic oligonucleotide
  Target: SCN10A; (+) strand; PAM type: NRG; PAM sequence: TAG
ttcaaagagaataaaatacc

SEQ ID NO: 27125 - DNA, 20 bp, Artificial Sequence
  Description of Artificial Sequence: Synthetic oligonucleotide
  Target: SCN10A; (+) strand; PAM type: NRG; PAM sequence: AGG
tcaaagagaataaaatacct

SEQ ID NO: 27126 - DNA, 20 bp, Artificial Sequence
  Description of Artificial Sequence: Synthetic oligonucleotide
  Target: SCN10A; (+) strand; PAM type: NRG; PAM sequence: AAG
tacctaggaatgcaacttac

SEQ ID NO: 27127 - DNA, 20 bp, Artificial Sequence
  Description of Artificial Sequence: Synthetic oligonucleotide
  Target: SCN10A; (+) strand; PAM type: NRG; PAM sequence: AGG
acctaggaatgcaacttaca

SEQ ID NO: 27128 - DNA, 20 bp, Artificial Sequence
  Description of Artificial Sequence: Synthetic oligonucleotide
  Target: SCN10A; (+) strand; PAM type: NRG; PAM sequence: GGG
cctaggaatgcaacttacaa

SEQ ID NO: 27129 - DNA, 20 bp, Artificial Sequence
  Description of Artificial Sequence: Synthetic oligonucleotide
  Target: SCN10A; (+) strand; PAM type: NRG; PAM sequence: AAG
tgcaacttacaagggatgtg

SEQ ID NO: 27130 - DNA, 20 bp, Artificial Sequence
  Description of Artificial Sequence: Synthetic oligonucleotide
  Target: SCN10A; (+) strand; PAM type: NRG; PAM sequence: AGG
gcaacttacaagggatgtga

SEQ ID NO: 27131 - DNA, 20 bp, Artificial Sequence
  Description of Artificial Sequence: Synthetic oligonucleotide
  Target: SCN10A; (+) strand; PAM type: NRG; PAM sequence: AAG
gggatgtgaaggacctcttc

SEQ ID NO: 27132 - DNA, 20 bp, Artificial Sequence
  Description of Artificial Sequence: Synthetic oligonucleotide
  Target: SCN10A; (+) strand; PAM type: NRG; PAM sequence: AGG
ggatgtgaaggacctcttca

SEQ ID NO: 27133 - DNA, 20 bp, Artificial Sequence
  Description of Artificial Sequence: Synthetic oligonucleotide
  Target: SCN10A; (+) strand; PAM type: NRG; PAM sequence: GAG
atgtgaaggacctcttcaag

SEQ ID NO: 27134 - DNA, 20 bp, Artificial Sequence
  Description of Artificial Sequence: Synthetic oligonucleotide
  Target: SCN10A; (+) strand; PAM type: NRG; PAM sequence: CAG
gagaactacaaaccactgct

SEQ ID NO: 27135 - DNA, 20 bp, Artificial Sequence
  Description of Artificial Sequence: Synthetic oligonucleotide
  Target: SCN10A; (+) strand; PAM type: NRG; PAM sequence: AAG
accactgctcagtgaaataa

SEQ ID NO: 27136 - DNA, 20 bp, Artificial Sequence
  Description of Artificial Sequence: Synthetic oligonucleotide
  Target: SCN10A; (+) strand; PAM type: NRG; PAM sequence: GAG
cactgctcagtgaaataaaa

SEQ ID NO: 27137 - DNA, 20 bp, Artificial Sequence
  Description of Artificial Sequence: Synthetic oligonucleotide
  Target: SCN10A; (+) strand; PAM type: NRG; PAM sequence: AGG
actgctcagtgaaataaaag

SEQ ID NO: 27138 - DNA, 20 bp, Artificial Sequence
  Description of Artificial Sequence: Synthetic oligonucleotide
  Target: SCN10A; (+) strand; PAM type: NRG; PAM sequence: TGG
taaaagaggatacaaacaaa

SEQ ID NO: 27139 - DNA, 20 bp, Artificial Sequence
  Description of Artificial Sequence: Synthetic oligonucleotide
  Target: SCN10A; (+) strand; PAM type: NRG; PAM sequence: AAG
aagaggatacaaacaaatgg

SEQ ID NO: 27140 - DNA, 20 bp, Artificial Sequence
  Description of Artificial Sequence: Synthetic oligonucleotide
  Target: SCN10A; (+) strand; PAM type: NRG; PAM sequence: TGG
ggaagaatactccatgctca

SEQ ID NO: 27141 - DNA, 20 bp, Artificial Sequence
  Description of Artificial Sequence: Synthetic oligonucleotide
  Target: SCN10A; (+) strand; PAM type: NRG; PAM sequence: GGG
gaagaatactccatgctcat

SEQ ID NO: 27142 - DNA, 20 bp, Artificial Sequence
  Description of Artificial Sequence: Synthetic oligonucleotide
  Target: SCN10A; (+) strand; PAM type: NRG; PAM sequence: TAG
gaatactccatgctcatggg

SEQ ID NO: 27143 - DNA, 20 bp, Artificial Sequence
  Description of Artificial Sequence: Synthetic oligonucleotide
  Target: SCN10A; (+) strand; PAM type: NRG; PAM sequence: AGG
aatactccatgctcatgggt

SEQ ID NO: 27144 - DNA, 20 bp, Artificial Sequence
  Description of Artificial Sequence: Synthetic oligonucleotide
  Target: SCN10A; (+) strand; PAM type: NRG; PAM sequence: AAG
actccatgctcatgggtagg

SEQ ID NO: 27145 - DNA, 20 bp, Artificial Sequence
  Description of Artificial Sequence: Synthetic oligonucleotide
  Target: SCN10A; (+) strand; PAM type: NRG; PAM sequence: TGG
aagaatcaatatcttgaaaa

SEQ ID NO: 27146 - DNA, 20 bp, Artificial Sequence
  Description of Artificial Sequence: Synthetic oligonucleotide
  Target: SCN10A; (+) strand; PAM type: NRG; PAM sequence: AAG
tgaaaatggccatactgccc

SEQ ID NO: 27147 - DNA, 20 bp, Artificial Sequence
  Description of Artificial Sequence: Synthetic oligonucleotide
  Target: SCN10A; (+) strand; PAM type: NRG; PAM sequence: AGG
gaaaatggccatactgccca

SEQ ID NO: 27148 - DNA, 20 bp, Artificial Sequence
  Description of Artificial Sequence: Synthetic oligonucleotide
  Target: SCN10A; (+) strand; PAM type: NRG; PAM sequence: TAG
atactgcccaaggtaattta

SEQ ID NO: 27149 - DNA, 20 bp, Artificial Sequence
  Description of Artificial Sequence: Synthetic oligonucleotide
  Target: SCN10A; (+) strand; PAM type: NRG; PAM sequence: AAG
gattcaatgccatccccatc

SEQ ID NO: 27150 - DNA, 20 bp, Artificial Sequence
  Description of Artificial Sequence: Synthetic oligonucleotide
  Target: SCN10A; (+) strand; PAM type: NRG; PAM sequence: CAG
gctaccaatgactttcttct

SEQ ID NO: 27151 - DNA, 20 bp, Artificial Sequence
  Description of Artificial Sequence: Synthetic oligonucleotide
  Target: SCN10A; (+) strand; PAM type: NRG; PAM sequence: TGG
aatgactttcttctcagaat

SEQ ID NO: 27152 - DNA, 20 bp, Artificial Sequence
  Description of Artificial Sequence: Synthetic oligonucleotide
  Target: SCN10A; (+) strand; PAM type: NRG; PAM sequence: AAG
aattggaaaaaactacttta

SEQ ID NO: 27153 - DNA, 20 bp, Artificial Sequence
  Description of Artificial Sequence: Synthetic oligonucleotide
  Target: SCN10A; (+) strand; PAM type: NRG; PAM sequence: CGG
aaactactttaaagttcata

SEQ ID NO: 27154 - DNA, 20 bp, Artificial Sequence
  Description of Artificial Sequence: Synthetic oligonucleotide
  Target: SCN10A; (+) strand; PAM type: NRG; PAM sequence: AAG
aagttcatacggaaccaaaa

SEQ ID NO: 27155 - DNA, 20 bp, Artificial Sequence
  Description of Artificial Sequence: Synthetic oligonucleotide
  Target: SCN10A; (+) strand; PAM type: NRG; PAM sequence: GAG
gttcatacggaaccaaaaaa

SEQ ID NO: 27156 - DNA, 20 bp, Artificial Sequence
  Description of Artificial Sequence: Synthetic oligonucleotide
  Target: SCN10A; (+) strand; PAM type: NRG; PAM sequence: AAG
aaaaaagagcccacattgcc

SEQ ID NO: 27157 - DNA, 20 bp, Artificial Sequence
  Description of Artificial Sequence: Synthetic oligonucleotide
  Target: SCN10A; (+) strand; PAM type: NRG; PAM sequence: TGG
tttaaccttacttttttgat

SEQ ID NO: 27158 - DNA, 20 bp, Artificial Sequence
  Description of Artificial Sequence: Synthetic oligonucleotide
  Target: SCN10A; (+) strand; PAM type: NRG; PAM sequence: TAG
ttgattggctaattgtttct

SEQ ID NO: 27159 - DNA, 20 bp, Artificial Sequence
  Description of Artificial Sequence: Synthetic oligonucleotide
  Target: SCN10A; (+) strand; PAM type: NRG; PAM sequence: TAG
tggctaattgtttcttagca

SEQ ID NO: 27160 - DNA, 20 bp, Artificial Sequence
  Description of Artificial Sequence: Synthetic oligonucleotide
  Target: SCN10A; (+) strand; PAM type: NRG; PAM sequence: TGG
agttcccccttgtcctactt

SEQ ID NO: 27161 - DNA, 20 bp, Artificial Sequence
  Description of Artificial Sequence: Synthetic oligonucleotide
  Target: SCN10A; (+) strand; PAM type: NRG; PAM sequence: TGG
ctctatttctgatttgttac

SEQ ID NO: 27162 - DNA, 20 bp, Artificial Sequence
  Description of Artificial Sequence: Synthetic oligonucleotide
  Target: SCN10A; (+) strand; PAM type: NRG; PAM sequence: AAG
tactggcaaccctaataatt

SEQ ID NO: 27163 - DNA, 20 bp, Artificial Sequence
  Description of Artificial Sequence: Synthetic oligonucleotide
  Target: SCN10A; (+) strand; PAM type: NRG; PAM sequence: AAG
taattaagtcattcattctt

SEQ ID NO: 27164 - DNA, 20 bp, Artificial Sequence
  Description of Artificial Sequence: Synthetic oligonucleotide
  Target: SCN10A; (+) strand; PAM type: NRG; PAM sequence: CAG
tcattcattcttaagttaca

SEQ ID NO: 27165 - DNA, 20 bp, Artificial Sequence
  Description of Artificial Sequence: Synthetic oligonucleotide
  Target: SCN10A; (+) strand; PAM type: NRG; PAM sequence: TAG
ctttacttttttttactttt

SEQ ID NO: 27166 - DNA, 20 bp, Artificial Sequence
  Description of Artificial Sequence: Synthetic oligonucleotide
  Target: SCN10A; (+) strand; PAM type: NRG; PAM sequence: TAG
ttttttttactttttagcat

SEQ ID NO: 27167 - DNA, 20 bp, Artificial Sequence
  Description of Artificial Sequence: Synthetic oligonucleotide
  Target: SCN10A; (+) strand; PAM type: NRG; PAM sequence: AGG
tttttttactttttagcatt

SEQ ID NO: 27168 - DNA, 20 bp, Artificial Sequence
  Description of Artificial Sequence: Synthetic oligonucleotide
  Target: SCN10A; (+) strand; PAM type: NRG; PAM sequence: GAG
tttttactttttagcattag

SEQ ID NO: 27169 - DNA, 20 bp, Artificial Sequence
  Description of Artificial Sequence: Synthetic oligonucleotide
  Target: SCN10A; (+) strand; PAM type: NRG; PAM sequence: TAG
attaggagaaatacctaatg

SEQ ID NO: 27170 - DNA, 20 bp, Artificial Sequence
  Description of Artificial Sequence: Synthetic oligonucleotide
  Target: SCN10A; (+) strand; PAM type: NRG; PAM sequence: CGG
gaaatacctaatgtagatga

SEQ ID NO: 27171 - DNA, 20 bp, Artificial Sequence
  Description of Artificial Sequence: Synthetic oligonucleotide
  Target: SCN10A; (+) strand; PAM type: NRG; PAM sequence: GGG
aaatacctaatgtagatgac

SEQ ID NO: 27172 - DNA, 20 bp, Artificial Sequence
  Description of Artificial Sequence: Synthetic oligonucleotide
  Target: SCN10A; (+) strand; PAM type: NRG; PAM sequence: TGG
taatgtagatgacgggttga

SEQ ID NO: 27173 - DNA, 20 bp, Artificial Sequence
  Description of Artificial Sequence: Synthetic oligonucleotide
  Target: SCN10A; (+) strand; PAM type: NRG; PAM sequence: GGG
aatgtagatgacgggttgat

SEQ ID NO: 27174 - DNA, 20 bp, Artificial Sequence
  Description of Artificial Sequence: Synthetic oligonucleotide
  Target: SCN10A; (+) strand; PAM type: NRG; PAM sequence: CAG
agatgacgggttgatgggtg

SEQ ID NO: 27175 - DNA, 20 bp, Artificial Sequence
  Description of Artificial Sequence: Synthetic oligonucleotide
  Target: SCN10A; (+) strand; PAM type: NRG; PAM sequence: TGG
atgggtgcagcaaaccaaca

SEQ ID NO: 27176 - DNA, 20 bp, Artificial Sequence
  Description of Artificial Sequence: Synthetic oligonucleotide
  Target: SCN10A; (+) strand; PAM type: NRG; PAM sequence: TAG
tacattgtgcacatgtaccc

SEQ ID NO: 27177 - DNA, 20 bp, Artificial Sequence
  Description of Artificial Sequence: Synthetic oligonucleotide
  Target: SCN10A; (+) strand; PAM type: NRG; PAM sequence: AAG
cacatgtaccctagaattta

SEQ ID NO: 27178 - DNA, 20 bp, Artificial Sequence
  Description of Artificial Sequence: Synthetic oligonucleotide
  Target: SCN10A; (+) strand; PAM type: NRG; PAM sequence: AAG
ttaaagtataattttaaaaa

SEQ ID NO: 27179 - DNA, 20 bp, Artificial Sequence
  Description of Artificial Sequence: Synthetic oligonucleotide
  Target: SCN10A; (+) strand; PAM type: NRG; PAM sequence: AAG
aattttaaaaaaagaaaaaa

SEQ ID NO: 27180 - DNA, 20 bp, Artificial Sequence
  Description of Artificial Sequence: Synthetic oligonucleotide
  Target: SCN10A; (+) strand; PAM type: NRG; PAM sequence: AGG
attttaaaaaaagaaaaaaa

SEQ ID NO: 27181 - DNA, 20 bp, Artificial Sequence
  Description of Artificial Sequence: Synthetic oligonucleotide
  Target: SCN10A; (+) strand; PAM type: NRG; PAM sequence: CAG
ttaatttatttgtaaacctt

SEQ ID NO: 27182 - DNA, 20 bp, Artificial Sequence
  Description of Artificial Sequence: Synthetic oligonucleotide
  Target: SCN10A; (+) strand; PAM type: NRG; PAM sequence: CAG
gtaaaccttcagcctgtgtt

SEQ ID NO: 27183 - DNA, 20 bp, Artificial Sequence
  Description of Artificial Sequence: Synthetic oligonucleotide
  Target: SCN10A; (+) strand; PAM type: NRG; PAM sequence: CAG
cttcagcctgtgttcagctc

SEQ ID NO: 27184 - DNA, 20 bp, Artificial Sequence
  Description of Artificial Sequence: Synthetic oligonucleotide
  Target: SCN10A; (+) strand; PAM type: NRG; PAM sequence: AAG
ctgtgttcagctccagactg

SEQ ID NO: 27185 - DNA, 20 bp, Artificial Sequence
  Description of Artificial Sequence: Synthetic oligonucleotide
  Target: SCN10A; (+) strand; PAM type: NRG; PAM sequence: TAG
tatcttgcatccctaacact

SEQ ID NO: 27186 - DNA, 20 bp, Artificial Sequence
  Description of Artificial Sequence: Synthetic oligonucleotide
  Target: SCN10A; (+) strand; PAM type: NRG; PAM sequence: AGG
atcttgcatccctaacactt

SEQ ID NO: 27187 - DNA, 20 bp, Artificial Sequence
  Description of Artificial Sequence: Synthetic oligonucleotide
  Target: SCN10A; (+) strand; PAM type: NRG; PAM sequence: AAG
tgcatccctaacacttagga

SEQ ID NO: 27188 - DNA, 20 bp, Artificial Sequence
  Description of Artificial Sequence: Synthetic oligonucleotide
  Target: SCN10A; (+) strand; PAM type: NRG; PAM sequence: AAG
agtgacttcacttttgtctt

SEQ ID NO: 27189 - DNA, 20 bp, Artificial Sequence
  Description of Artificial Sequence: Synthetic oligonucleotide
  Target: SCN10A; (+) strand; PAM type: NRG; PAM sequence: CAG
tttgtcttaagcaaatgctc

SEQ ID NO: 27190 - DNA, 20 bp, Artificial Sequence
  Description of Artificial Sequence: Synthetic oligonucleotide
  Target: SCN10A; (+) strand; PAM type: NRG; PAM sequence: CAG
aagcaaatgctccagcacac

SEQ ID NO: 27191 - DNA, 20 bp, Artificial Sequence
  Description of Artificial Sequence: Synthetic oligonucleotide
  Target: SCN10A; (+) strand; PAM type: NRG; PAM sequence: AGG
agcaaatgctccagcacacc

SEQ ID NO: 27192 - DNA, 20 bp, Artificial Sequence
  Description of Artificial Sequence: Synthetic oligonucleotide
  Target: SCN10A; (+) strand; PAM type: NRG; PAM sequence: GGG
gcaaatgctccagcacacca

SEQ ID NO: 27193 - DNA, 20 bp, Artificial Sequence
  Description of Artificial Sequence: Synthetic oligonucleotide
  Target: SCN10A; (+) strand; PAM type: NRG; PAM sequence: AAG
gatacctactattctgtgtt

SEQ ID NO: 27194 - DNA, 20 bp, Artificial Sequence
  Description of Artificial Sequence: Synthetic oligonucleotide
  Target: SCN10A; (+) strand; PAM type: NRG; PAM sequence: TGG
acctactattctgtgttaag

SEQ ID NO: 27195 - DNA, 20 bp, Artificial Sequence
  Description of Artificial Sequence: Synthetic oligonucleotide
  Target: SCN10A; (+) strand; PAM type: NRG; PAM sequence: CAG
atctgtgtctatgtgttatg

SEQ ID NO: 27196 - DNA, 20 bp, Artificial Sequence
  Description of Artificial Sequence: Synthetic oligonucleotide
  Target: SCN10A; (+) strand; PAM type: NRG; PAM sequence: TGG
ctatgtgttatgcagtttaa

SEQ ID NO: 27197 - DNA, 20 bp, Artificial Sequence
  Description of Artificial Sequence: Synthetic oligonucleotide
  Target: SCN10A; (+) strand; PAM type: NRG; PAM sequence: AAG
atgcagtttaatggtataaa

SEQ ID NO: 27198 - DNA, 20 bp, Artificial Sequence
  Description of Artificial Sequence: Synthetic oligonucleotide
  Target: SCN10A; (+) strand; PAM type: NRG; PAM sequence: TAG
agtttaatggtataaaaagt

SEQ ID NO: 27199 - DNA, 20 bp, Artificial Sequence
  Description of Artificial Sequence: Synthetic oligonucleotide
  Target: SCN10A; (+) strand; PAM type: NRG; PAM sequence: AGG
gtttaatggtataaaaagtt

SEQ ID NO: 27200 - DNA, 20 bp, Artificial Sequence
  Description of Artificial Sequence: Synthetic oligonucleotide
  Target: SCN10A; (+) strand; PAM type: NRG; PAM sequence: GGG
tttaatggtataaaaagtta

SEQ ID NO: 27201 - DNA, 20 bp, Artificial Sequence
  Description of Artificial Sequence: Synthetic oligonucleotide
  Target: SCN10A; (+) strand; PAM type: NRG; PAM sequence: CGG
aatggtataaaaagttaggg

SEQ ID NO: 27202 - DNA, 20 bp, Artificial Sequence
  Description of Artificial Sequence: Synthetic oligonucleotide
  Target: SCN10A; (+) strand; PAM type: NRG; PAM sequence: TGG
aaaagttagggcggtgttta

SEQ ID NO: 27203 - DNA, 20 bp, Artificial Sequence
  Description of Artificial Sequence: Synthetic oligonucleotide
  Target: SCN10A; (+) strand; PAM type: NRG; PAM sequence: TGG
agttagggcggtgtttatgg

SEQ ID NO: 27204 - DNA, 20 bp, Artificial Sequence
  Description of Artificial Sequence: Synthetic oligonucleotide
  Target: SCN10A; (+) strand; PAM type: NRG; PAM sequence: GAG
ttagggcggtgtttatggtg

SEQ ID NO: 27205 - DNA, 20 bp, Artificial Sequence
  Description of Artificial Sequence: Synthetic oligonucleotide
  Target: SCN10A; (+) strand; PAM type: NRG; PAM sequence: AGG
tagggcggtgtttatggtgg

SEQ ID NO: 27206 - DNA, 20 bp, Artificial Sequence
  Description of Artificial Sequence: Synthetic oligonucleotide
  Target: SCN10A; (+) strand; PAM type: NRG; PAM sequence: GAG
tatggtggaggcatactttt

SEQ ID NO: 27207 - DNA, 20 bp, Artificial Sequence
  Description of Artificial Sequence: Synthetic oligonucleotide
  Target: SCN10A; (+) strand; PAM type: NRG; PAM sequence: CAG
ggcatacttttgagaacttg

SEQ ID NO: 27208 - DNA, 20 bp, Artificial Sequence
  Description of Artificial Sequence: Synthetic oligonucleotide
  Target: SCN10A; (+) strand; PAM type: NRG; PAM sequence: AGG
gcatacttttgagaacttgc

SEQ ID NO: 27209 - DNA, 20 bp, Artificial Sequence
  Description of Artificial Sequence: Synthetic oligonucleotide
  Target: SCN10A; (+) strand; PAM type: NRG; PAM sequence: CAG
ttttgagaacttgcaggttc

SEQ ID NO: 27210 - DNA, 20 bp, Artificial Sequence
  Description of Artificial Sequence: Synthetic oligonucleotide
  Target: SCN10A; (+) strand; PAM type: NRG; PAM sequence: CAG
gcaggttccagatatttgta

SEQ ID NO: 27211 - DNA, 20 bp, Artificial Sequence
  Description of Artificial Sequence: Synthetic oligonucleotide
  Target: SCN10A; (+) strand; PAM type: NRG; PAM sequence: CAG
gttccagatatttgtacagt

SEQ ID NO: 27212 - DNA, 20 bp, Artificial Sequence
  Description of Artificial Sequence: Synthetic oligonucleotide
  Target: SCN10A; (+) strand; PAM type: NRG; PAM sequence: CAG
tcctgtctcttatctccctt

SEQ ID NO: 27213 - DNA, 20 bp, Artificial Sequence
  Description of Artificial Sequence: Synthetic oligonucleotide
  Target: SCN10A; (+) strand; PAM type: NRG; PAM sequence: AAG
tcttatctcccttcagtgct

SEQ ID NO: 27214 - DNA, 20 bp, Artificial Sequence
  Description of Artificial Sequence: Synthetic oligonucleotide
  Target: SCN10A; (+) strand; PAM type: NRG; PAM sequence: AGG
cttatctcccttcagtgcta

SEQ ID NO: 27215 - DNA, 20 bp, Artificial Sequence
  Description of Artificial Sequence: Synthetic oligonucleotide
  Target: SCN10A; (+) strand; PAM type: NRG; PAM sequence: TGG
gctaaggtatcctcacattc

SEQ ID NO: 27216 - DNA, 20 bp, Artificial Sequence
  Description of Artificial Sequence: Synthetic oligonucleotide
  Target: SCN10A; (+) strand; PAM type: NRG; PAM sequence: GGG
ctaaggtatcctcacattct

SEQ ID NO: 27217 - DNA, 20 bp, Artificial Sequence
  Description of Artificial Sequence: Synthetic oligonucleotide
  Target: SCN10A; (+) strand; PAM type: NRG; PAM sequence: CAG
ggtatcctcacattctgggc

SEQ ID NO: 27218 - DNA, 20 bp, Artificial Sequence
  Description of Artificial Sequence: Synthetic oligonucleotide
  Target: SCN10A; (+) strand; PAM type: NRG; PAM sequence: GAG
tatcctcacattctgggcca

SEQ ID NO: 27219 - DNA, 20 bp, Artificial Sequence
  Description of Artificial Sequence: Synthetic oligonucleotide
  Target: SCN10A; (+) strand; PAM type: NRG; PAM sequence: GAG
tcctcacattctgggccaga

SEQ ID NO: 27220 - DNA, 20 bp, Artificial Sequence
  Description of Artificial Sequence: Synthetic oligonucleotide
  Target: SCN10A; (+) strand; PAM type: NRG; PAM sequence: TAG
attctgggccagagagattc

SEQ ID NO: 27221 - DNA, 20 bp, Artificial Sequence
  Description of Artificial Sequence: Synthetic oligonucleotide
  Target: SCN10A; (+) strand; PAM type: NRG; PAM sequence: TGG
gattctagttttacctcttg

SEQ ID NO: 27222 - DNA, 20 bp, Artificial Sequence
  Description of Artificial Sequence: Synthetic oligonucleotide
  Target: SCN10A; (+) strand; PAM type: NRG; PAM sequence: GGG
attctagttttacctcttgt

SEQ ID NO: 27223 - DNA, 20 bp, Artificial Sequence
  Description of Artificial Sequence: Synthetic oligonucleotide
  Target: SCN10A; (+) strand; PAM type: NRG; PAM sequence: TGG
ctagttttacctcttgtggg

SEQ ID NO: 27224 - DNA, 20 bp, Artificial Sequence
  Description of Artificial Sequence: Synthetic oligonucleotide
  Target: SCN10A; (+) strand; PAM type: NRG; PAM sequence: GGG
tagttttacctcttgtgggt

SEQ ID NO: 27225 - DNA, 20 bp, Artificial Sequence
  Description of Artificial Sequence: Synthetic oligonucleotide
  Target: SCN10A; (+) strand; PAM type: NRG; PAM sequence: GGG
agttttacctcttgtgggtg

SEQ ID NO: 27226 - DNA, 20 bp, Artificial Sequence
  Description of Artificial Sequence: Synthetic oligonucleotide
  Target: SCN10A; (+) strand; PAM type: NRG; PAM sequence: GAG
tacctcttgtgggtggggtt

SEQ ID NO: 27227 - DNA, 20 bp, Artificial Sequence
  Description of Artificial Sequence: Synthetic oligonucleotide
  Target: SCN10A; (+) strand; PAM type: NRG; PAM sequence: AAG
ctcttgtgggtggggttgag

SEQ ID NO: 27228 - DNA, 20 bp, Artificial Sequence
  Description of Artificial Sequence: Synthetic oligonucleotide
  Target: SCN10A; (+) strand; PAM type: NRG; PAM sequence: AGG
tcttgtgggtggggttgaga

SEQ ID NO: 27229 - DNA, 20 bp, Artificial Sequence
  Description of Artificial Sequence: Synthetic oligonucleotide
  Target: SCN10A; (+) strand; PAM type: NRG; PAM sequence: TAG
tgtgggtggggttgagaagg

SEQ ID NO: 27230 - DNA, 20 bp, Artificial Sequence
  Description of Artificial Sequence: Synthetic oligonucleotide
  Target: SCN10A; (+) strand; PAM type: NRG; PAM sequence: TGG
tggggttgagaaggtagctc

SEQ ID NO: 27231 - DNA, 20 bp, Artificial Sequence
  Description of Artificial Sequence: Synthetic oligonucleotide
  Target: SCN10A; (+) strand; PAM type: NRG; PAM sequence: CAG
gagaaggtagctctggttct

SEQ ID NO: 27232 - DNA, 20 bp, Artificial Sequence
  Description of Artificial Sequence: Synthetic oligonucleotide
  Target: SCN10A; (+) strand; PAM type: NRG; PAM sequence: AGG
agaaggtagctctggttctc

SEQ ID NO: 27233 - DNA, 20 bp, Artificial Sequence
  Description of Artificial Sequence: Synthetic oligonucleotide
  Target: SCN10A; (+) strand; PAM type: NRG; PAM sequence: TGG
ggtagctctggttctcaggt

SEQ ID NO: 27234 - DNA, 20 bp, Artificial Sequence
  Description of Artificial Sequence: Synthetic oligonucleotide
  Target: SCN10A; (+) strand; PAM type: NRG; PAM sequence: TGG
ggttctcaggttggctccca

SEQ ID NO: 27235 - DNA, 20 bp, Artificial Sequence
  Description of Artificial Sequence: Synthetic oligonucleotide
  Target: SCN10A; (+) strand; PAM type: NRG; PAM sequence: TAG
ggttggctcccatggaaatc

SEQ ID NO: 27236 - DNA, 20 bp, Artificial Sequence
  Description of Artificial Sequence: Synthetic oligonucleotide
  Target: SCN10A; (+) strand; PAM type: NRG; PAM sequence: CAG
ctaccttgtaattgtaccac

SEQ ID NO: 27237 - DNA, 20 bp, Artificial Sequence
  Description of Artificial Sequence: Synthetic oligonucleotide
  Target: SCN10A; (+) strand; PAM type: NRG; PAM sequence: AGG
taccttgtaattgtaccacc

SEQ ID NO: 27238 - DNA, 20 bp, Artificial Sequence
  Description of Artificial Sequence: Synthetic oligonucleotide
  Target: SCN10A; (+) strand; PAM type: NRG; PAM sequence: TGG
attgtaccaccaggtgaact

SEQ ID NO: 27239 - DNA, 20 bp, Artificial Sequence
  Description of Artificial Sequence: Synthetic oligonucleotide
  Target: SCN10A; (+) strand; PAM type: NRG; PAM sequence: TGG
caccaggtgaacttggaaac

SEQ ID NO: 27240 - DNA, 20 bp, Artificial Sequence
  Description of Artificial Sequence: Synthetic oligonucleotide
  Target: SCN10A; (+) strand; PAM type: NRG; PAM sequence: TAG
gtgaacttggaaactggctc

SEQ ID NO: 27241 - DNA, 20 bp, Artificial Sequence
  Description of Artificial Sequence: Synthetic oligonucleotide
  Target: SCN10A; (+) strand; PAM type: NRG; PAM sequence: AAG
ggctctagtgaaattttcaa

SEQ ID NO: 27242 - DNA, 20 bp, Artificial Sequence
  Description of Artificial Sequence: Synthetic oligonucleotide
  Target: SCN10A; (+) strand; PAM type: NRG; PAM sequence: TGG
tcaaaagataatcttgcatt

SEQ ID NO: 27243 - DNA, 20 bp, Artificial Sequence
  Description of Artificial Sequence: Synthetic oligonucleotide
  Target: SCN10A; (+) strand; PAM type: NRG; PAM sequence: AAG
ccaaaaactccgtgtcatgc

SEQ ID NO: 27244 - DNA, 20 bp, Artificial Sequence
  Description of Artificial Sequence: Synthetic oligonucleotide
  Target: SCN10A; (+) strand; PAM type: NRG; PAM sequence: TAG
caatgtttcccattacaatt

SEQ ID NO: 27245 - DNA, 20 bp, Artificial Sequence
  Description of Artificial Sequence: Synthetic oligonucleotide
  Target: SCN10A; (+) strand; PAM type: NRG; PAM sequence: AGG
aatgtttcccattacaattt

SEQ ID NO: 27246 - DNA, 20 bp, Artificial Sequence
  Description of Artificial Sequence: Synthetic oligonucleotide
  Target: SCN10A; (+) strand; PAM type: NRG; PAM sequence: CAG
atttaggaaatgcatttgtg

SEQ ID NO: 27247 - DNA, 20 bp, Artificial Sequence
  Description of Artificial Sequence: Synthetic oligonucleotide
  Target: SCN10A; (+) strand; PAM type: NRG; PAM sequence: GAG
tgcatttgtgcagaaaaaat

SEQ ID NO: 27248 - DNA, 20 bp, Artificial Sequence
  Description of Artificial Sequence: Synthetic oligonucleotide
  Target: SCN10A; (+) strand; PAM type: NRG; PAM sequence: TGG
tgtgcagaaaaaatgagaaa

SEQ ID NO: 27249 - DNA, 20 bp, Artificial Sequence
  Description of Artificial Sequence: Synthetic oligonucleotide
  Target: SCN10A; (+) strand; PAM type: NRG; PAM sequence: TAG
agaaaaaatgagaaatggat

SEQ ID NO: 27250 - DNA, 20 bp, Artificial Sequence
  Description of Artificial Sequence: Synthetic oligonucleotide
  Target: SCN10A; (+) strand; PAM type: NRG; PAM sequence: TGG
gagaaatggattagtttccc

SEQ ID NO: 27251 - DNA, 20 bp, Artificial Sequence
  Description of Artificial Sequence: Synthetic oligonucleotide
  Target: SCN10A; (+) strand; PAM type: NRG; PAM sequence: GGG
agaaatggattagtttccct

SEQ ID NO: 27252 - DNA, 20 bp, Artificial Sequence
  Description of Artificial Sequence: Synthetic oligonucleotide
  Target: SCN10A; (+) strand; PAM type: NRG; PAM sequence: CAG
gggatgctgtaacaaattac

SEQ ID NO: 27253 - DNA, 20 bp, Artificial Sequence
  Description of Artificial Sequence: Synthetic oligonucleotide
  Target: SCN10A; (+) strand; PAM type: NRG; PAM sequence: TAG
tgtaacaaattaccagaaac

SEQ ID NO: 27254 - DNA, 20 bp, Artificial Sequence
  Description of Artificial Sequence: Synthetic oligonucleotide
  Target: SCN10A; (+) strand; PAM type: NRG; PAM sequence: AGG
gtaacaaattaccagaaact

SEQ ID NO: 27255 - DNA, 20 bp, Artificial Sequence
  Description of Artificial Sequence: Synthetic oligonucleotide
  Target: SCN10A; (+) strand; PAM type: NRG; PAM sequence: TAG
acaaattaccagaaactagg

SEQ ID NO: 27256 - DNA, 20 bp, Artificial Sequence
  Description of Artificial Sequence: Synthetic oligonucleotide
  Target: SCN10A; (+) strand; PAM type: NRG; PAM sequence: TAG
aactaggtagatgacaataa

SEQ ID NO: 27257 - DNA, 20 bp, Artificial Sequence
  Description of Artificial Sequence: Synthetic oligonucleotide
  Target: SCN10A; (+) strand; PAM type: NRG; PAM sequence: GAG
atttattctcttacacttct

SEQ ID NO: 27258 - DNA, 20 bp, Artificial Sequence
  Description of Artificial Sequence: Synthetic oligonucleotide
  Target: SCN10A; (+) strand; PAM type: NRG; PAM sequence: AGG
tttattctcttacacttctg

SEQ ID NO: 27259 - DNA, 20 bp, Artificial Sequence
  Description of Artificial Sequence: Synthetic oligonucleotide
  Target: SCN10A; (+) strand; PAM type: NRG; PAM sequence: TAG
ttctcttacacttctgaggc

SEQ ID NO: 27260 - DNA, 20 bp, Artificial Sequence
  Description of Artificial Sequence: Synthetic oligonucleotide
  Target: SCN10A; (+) strand; PAM type: NRG; PAM sequence: AAG
gaggctagatgtctaaaatc

SEQ ID NO: 27261 - DNA, 20 bp, Artificial Sequence
  Description of Artificial Sequence: Synthetic oligonucleotide
  Target: SCN10A; (+) strand; PAM type: NRG; PAM sequence: AGG
aggctagatgtctaaaatca

SEQ ID NO: 27262 - DNA, 20 bp, Artificial Sequence
  Description of Artificial Sequence: Synthetic oligonucleotide
  Target: SCN10A; (+) strand; PAM type: NRG; PAM sequence: TGG
gatgtctaaaatcaaggtat

SEQ ID NO: 27263 - DNA, 20 bp, Artificial Sequence
  Description of Artificial Sequence: Synthetic oligonucleotide
  Target: SCN10A; (+) strand; PAM type: NRG; PAM sequence: CAG
gtctaaaatcaaggtattgg

SEQ ID NO: 27264 - DNA, 20 bp, Artificial Sequence
  Description of Artificial Sequence: Synthetic oligonucleotide
  Target: SCN10A; (+) strand; PAM type: NRG; PAM sequence: GAG
ctaaaatcaaggtattggca

SEQ ID NO: 27265 - DNA, 20 bp, Artificial Sequence
  Description of Artificial Sequence: Synthetic oligonucleotide
  Target: SCN10A; (+) strand; PAM type: NRG; PAM sequence: AAG
gcagagccatgttccctctg

SEQ ID NO: 27266 - DNA, 20 bp, Artificial Sequence
  Description of Artificial Sequence: Synthetic oligonucleotide
  Target: SCN10A; (+) strand; PAM type: NRG; PAM sequence: CAG
catgttccctctgaagcccg

SEQ ID NO: 27267 - DNA, 20 bp, Artificial Sequence
  Description of Artificial Sequence: Synthetic oligonucleotide
  Target: SCN10A; (+) strand; PAM type: NRG; PAM sequence: AGG
atgttccctctgaagcccgc

SEQ ID NO: 27268 - DNA, 20 bp, Artificial Sequence
  Description of Artificial Sequence: Synthetic oligonucleotide
  Target: SCN10A; (+) strand; PAM type: NRG; PAM sequence: GAG
tccctctgaagcccgcaggt

SEQ ID NO: 27269 - DNA, 20 bp, Artificial Sequence
  Description of Artificial Sequence: Synthetic oligonucleotide
  Target: SCN10A; (+) strand; PAM type: NRG; PAM sequence: TAG
ttgccttccatgtctcctcc

SEQ ID NO: 27270 - DNA, 20 bp, Artificial Sequence
  Description of Artificial Sequence: Synthetic oligonucleotide
  Target: SCN10A; (+) strand; PAM type: NRG; PAM sequence: CAG
tccatgtctcctcctagctt

SEQ ID NO: 27271 - DNA, 20 bp, Artificial Sequence
  Description of Artificial Sequence: Synthetic oligonucleotide
  Target: SCN10A; (+) strand; PAM type: NRG; PAM sequence: TGG
cagcaatctttgccattcct

SEQ ID NO: 27272 - DNA, 20 bp, Artificial Sequence
  Description of Artificial Sequence: Synthetic oligonucleotide
  Target: SCN10A; (+) strand; PAM type: NRG; PAM sequence: CAG
tttcttcctgtgtctccata

SEQ ID NO: 27273 - DNA, 20 bp, Artificial Sequence
  Description of Artificial Sequence: Synthetic oligonucleotide
  Target: SCN10A; (+) strand; PAM type: NRG; PAM sequence: TGG
tttttttctgcatcttccca

SEQ ID NO: 27274 - DNA, 20 bp, Artificial Sequence
  Description of Artificial Sequence: Synthetic oligonucleotide
  Target: SCN10A; (+) strand; PAM type: NRG; PAM sequence: TAG
ttcaaattcccctcatattt

SEQ ID NO: 27275 - DNA, 20 bp, Artificial Sequence
  Description of Artificial Sequence: Synthetic oligonucleotide
  Target: SCN10A; (+) strand; PAM type: NRG; PAM sequence: CAG
ccctcatattttagcaacac

SEQ ID NO: 27276 - DNA, 20 bp, Artificial Sequence
  Description of Artificial Sequence: Synthetic oligonucleotide
  Target: SCN10A; (+) strand; PAM type: NRG; PAM sequence: TGG
attttagcaacaccagtcat

SEQ ID NO: 27277 - DNA, 20 bp, Artificial Sequence
  Description of Artificial Sequence: Synthetic oligonucleotide
  Target: SCN10A; (+) strand; PAM type: NRG; PAM sequence: TAG
agcaacaccagtcattggat

SEQ ID NO: 27278 - DNA, 20 bp, Artificial Sequence
  Description of Artificial Sequence: Synthetic oligonucleotide
  Target: SCN10A; (+) strand; PAM type: NRG; PAM sequence: AGG
gcaacaccagtcattggatt

SEQ ID NO: 27279 - DNA, 20 bp, Artificial Sequence
  Description of Artificial Sequence: Synthetic oligonucleotide
  Target: SCN10A; (+) strand; PAM type: NRG; PAM sequence: GGG
caacaccagtcattggatta

SEQ ID NO: 27280 - DNA, 20 bp, Artificial Sequence
  Description of Artificial Sequence: Synthetic oligonucleotide
  Target: SCN10A; (+) strand; PAM type: NRG; PAM sequence: AAG
caaaaaccttaatgtcaaat

SEQ ID NO: 27281 - DNA, 20 bp, Artificial Sequence
  Description of Artificial Sequence: Synthetic oligonucleotide
  Target: SCN10A; (+) strand; PAM type: NRG; PAM sequence: AGG
aaaaaccttaatgtcaaata

SEQ ID NO: 27282 - DNA, 20 bp, Artificial Sequence
  Description of Artificial Sequence: Synthetic oligonucleotide
  Target: SCN10A; (+) strand; PAM type: NRG; PAM sequence: CAG
gtcaaataaggtcacaatca

SEQ ID NO: 27283 - DNA, 20 bp, Artificial Sequence
  Description of Artificial Sequence: Synthetic oligonucleotide
  Target: SCN10A; (+) strand; PAM type: NRG; PAM sequence: AGG
tcaaataaggtcacaatcac

SEQ ID NO: 27284 - DNA, 20 bp, Artificial Sequence
  Description of Artificial Sequence: Synthetic oligonucleotide
  Target: SCN10A; (+) strand; PAM type: NRG; PAM sequence: TGG
gtcacaatcacaggtactat

SEQ ID NO: 27285 - DNA, 20 bp, Artificial Sequence
  Description of Artificial Sequence: Synthetic oligonucleotide
  Target: SCN10A; (+) strand; PAM type: NRG; PAM sequence: TAG
caatcacaggtactattggt

SEQ ID NO: 27286 - DNA, 20 bp, Artificial Sequence
  Description of Artificial Sequence: Synthetic oligonucleotide
  Target: SCN10A; (+) strand; PAM type: NRG; PAM sequence: TAG
agaacttcaacatacccttt

SEQ ID NO: 27287 - DNA, 20 bp, Artificial Sequence
  Description of Artificial Sequence: Synthetic oligonucleotide
  Target: SCN10A; (+) strand; PAM type: NRG; PAM sequence: AGG
gaacttcaacataccctttt

SEQ ID NO: 27288 - DNA, 20 bp, Artificial Sequence
  Description of Artificial Sequence: Synthetic oligonucleotide
  Target: SCN10A; (+) strand; PAM type: NRG; PAM sequence: GGG
aacttcaacataccctttta

SEQ ID NO: 27289 - DNA, 20 bp, Artificial Sequence
  Description of Artificial Sequence: Synthetic oligonucleotide
  Target: SCN10A; (+) strand; PAM type: NRG; PAM sequence: AAG
agggaacattattcaaccca

SEQ ID NO: 27290 - DNA, 20 bp, Artificial Sequence
  Description of Artificial Sequence: Synthetic oligonucleotide
  Target: SCN10A; (+) strand; PAM type: NRG; PAM sequence: AAG
ccaaagcataattcaacata

SEQ ID NO: 27291 - DNA, 20 bp, Artificial Sequence
  Description of Artificial Sequence: Synthetic oligonucleotide
  Target: SCN10A; (+) strand; PAM type: NRG; PAM sequence: TAG
ttgaattatgttcctatgtt

SEQ ID NO: 27292 - DNA, 20 bp, Artificial Sequence
  Description of Artificial Sequence: Synthetic oligonucleotide
  Target: SCN10A; (+) strand; PAM type: NRG; PAM sequence: AGG
tgaattatgttcctatgttt

SEQ ID NO: 27293 - DNA, 20 bp, Artificial Sequence
  Description of Artificial Sequence: Synthetic oligonucleotide
  Target: SCN10A; (+) strand; PAM type: NRG; PAM sequence: GGG
gaattatgttcctatgttta

SEQ ID NO: 27294 - DNA, 20 bp, Artificial Sequence
  Description of Artificial Sequence: Synthetic oligonucleotide
  Target: SCN10A; (+) strand; PAM type: NRG; PAM sequence: GAG
attatgttcctatgtttagg

SEQ ID NO: 27295 - DNA, 20 bp, Artificial Sequence
  Description of Artificial Sequence: Synthetic oligonucleotide
  Target: SCN10A; (+) strand; PAM type: NRG; PAM sequence: AAG
agggagcataattcaactca

SEQ ID NO: 27296 - DNA, 20 bp, Artificial Sequence
  Description of Artificial Sequence: Synthetic oligonucleotide
  Target: SCN10A; (+) strand; PAM type: NRG; PAM sequence: GAG
ctcaaagtaaaaatactttt

SEQ ID NO: 27297 - DNA, 20 bp, Artificial Sequence
  Description of Artificial Sequence: Synthetic oligonucleotide
  Target: SCN10A; (+) strand; PAM type: NRG; PAM sequence: TAG
agtaaaaatacttttgagaa

SEQ ID NO: 27298 - DNA, 20 bp, Artificial Sequence
  Description of Artificial Sequence: Synthetic oligonucleotide
  Target: SCN10A; (+) strand; PAM type: NRG; PAM sequence: TAG
aatagtatcatctgctttaa

SEQ ID NO: 27299 - DNA, 20 bp, Artificial Sequence
  Description of Artificial Sequence: Synthetic oligonucleotide
  Target: SCN10A; (+) strand; PAM type: NRG; PAM sequence: CAG
atcatctgctttaatagaac

SEQ ID NO: 27300 - DNA, 20 bp, Artificial Sequence
  Description of Artificial Sequence: Synthetic oligonucleotide
  Target: SCN10A; (+) strand; PAM type: NRG; PAM sequence: TGG
ctttaatagaaccagtctga

SEQ ID NO: 27301 - DNA, 20 bp, Artificial Sequence
  Description of Artificial Sequence: Synthetic oligonucleotide
  Target: SCN10A; (+) strand; PAM type: NRG; PAM sequence: TGG
atagaaccagtctgatggtt

SEQ ID NO: 27302 - DNA, 20 bp, Artificial Sequence
  Description of Artificial Sequence: Synthetic oligonucleotide
  Target: SCN10A; (+) strand; PAM type: NRG; PAM sequence: TAG
gcccaaactctctgtccact

SEQ ID NO: 27303 - DNA, 20 bp, Artificial Sequence
  Description of Artificial Sequence: Synthetic oligonucleotide
  Target: SCN10A; (+) strand; PAM type: NRG; PAM sequence: TGG
ttagctgtcttataaacact

SEQ ID NO: 27304 - DNA, 20 bp, Artificial Sequence
  Description of Artificial Sequence: Synthetic oligonucleotide
  Target: SCN10A; (+) strand; PAM type: NRG; PAM sequence: GGG
tagctgtcttataaacactt

SEQ ID NO: 27305 - DNA, 20 bp, Artificial Sequence
  Description of Artificial Sequence: Synthetic oligonucleotide
  Target: SCN10A; (+) strand; PAM type: NRG; PAM sequence: TAG
tgtcttataaacacttgggc

SEQ ID NO: 27306 - DNA, 20 bp, Artificial Sequence
  Description of Artificial Sequence: Synthetic oligonucleotide
  Target: SCN10A; (+) strand; PAM type: NRG; PAM sequence: CAG
aaacacttgggctagtatct

SEQ ID NO: 27307 - DNA, 20 bp, Artificial Sequence
  Description of Artificial Sequence: Synthetic oligonucleotide
  Target: SCN10A; (+) strand; PAM type: NRG; PAM sequence: TGG
acttgggctagtatctcaga

SEQ ID NO: 27308 - DNA, 20 bp, Artificial Sequence
  Description of Artificial Sequence: Synthetic oligonucleotide
  Target: SCN10A; (+) strand; PAM type: NRG; PAM sequence: TGG
tggctttttcatcatccaca

SEQ ID NO: 27309 - DNA, 20 bp, Artificial Sequence
  Description of Artificial Sequence: Synthetic oligonucleotide
  Target: SCN10A; (+) strand; PAM type: NRG; PAM sequence: GGG
ggctttttcatcatccacat

SEQ ID NO: 27310 - DNA, 20 bp, Artificial Sequence
  Description of Artificial Sequence: Synthetic oligonucleotide
  Target: SCN10A; (+) strand; PAM type: NRG; PAM sequence: TAG
ttcatcatccacatgggatt

SEQ ID NO: 27311 - DNA, 20 bp, Artificial Sequence
  Description of Artificial Sequence: Synthetic oligonucleotide
  Target: SCN10A; (+) strand; PAM type: NRG; PAM sequence: AAG
cacatgggatttagacgttg

SEQ ID NO: 27312 - DNA, 20 bp, Artificial Sequence
  Description of Artificial Sequence: Synthetic oligonucleotide
  Target: SCN10A; (+) strand; PAM type: NRG; PAM sequence: AAG
atgggatttagacgttgaag

SEQ ID NO: 27313 - DNA, 20 bp, Artificial Sequence
  Description of Artificial Sequence: Synthetic oligonucleotide
  Target: SCN10A; (+) strand; PAM type: NRG; PAM sequence: CAG
tagacgttgaagaagctgca

SEQ ID NO: 27314 - DNA, 20 bp, Artificial Sequence
  Description of Artificial Sequence: Synthetic oligonucleotide
  Target: SCN10A; (+) strand; PAM type: NRG; PAM sequence: CAG
cgttgaagaagctgcacagt

SEQ ID NO: 27315 - DNA, 20 bp, Artificial Sequence
  Description of Artificial Sequence: Synthetic oligonucleotide
  Target: SCN10A; (+) strand; PAM type: NRG; PAM sequence: CGG
acagtcagtatctgtgctcc

SEQ ID NO: 27316 - DNA, 20 bp, Artificial Sequence
  Description of Artificial Sequence: Synthetic oligonucleotide
  Target: SCN10A; (+) strand; PAM type: NRG; PAM sequence: GGG
cagtcagtatctgtgctccc

SEQ ID NO: 27317 - DNA, 20 bp, Artificial Sequence
  Description of Artificial Sequence: Synthetic oligonucleotide
  Target: SCN10A; (+) strand; PAM type: NRG; PAM sequence: CAG
agtatctgtgctcccgggtt

SEQ ID NO: 27318 - DNA, 20 bp, Artificial Sequence
  Description of Artificial Sequence: Synthetic oligonucleotide
  Target: SCN10A; (+) strand; PAM type: NRG; PAM sequence: TGG
atctgtgctcccgggttcag

SEQ ID NO: 27319 - DNA, 20 bp, Artificial Sequence
  Description of Artificial Sequence: Synthetic oligonucleotide
  Target: SCN10A; (+) strand; PAM type: NRG; PAM sequence: GAG
gctcccgggttcagtggtac

SEQ ID NO: 27320 - DNA, 20 bp, Artificial Sequence
  Description of Artificial Sequence: Synthetic oligonucleotide
  Target: SCN10A; (+) strand; PAM type: NRG; PAM sequence: GAG
tcccgggttcagtggtacga

SEQ ID NO: 27321 - DNA, 20 bp, Artificial Sequence
  Description of Artificial Sequence: Synthetic oligonucleotide
  Target: SCN10A; (+) strand; PAM type: NRG; PAM sequence: GAG
ccgggttcagtggtacgaga

SEQ ID NO: 27322 - DNA, 20 bp, Artificial Sequence
  Description of Artificial Sequence: Synthetic oligonucleotide
  Target: SCN10A; (+) strand; PAM type: NRG; PAM sequence: AGG
cgggttcagtggtacgagag

SEQ ID NO: 27323 - DNA, 20 bp, Artificial Sequence
  Description of Artificial Sequence: Synthetic oligonucleotide
  Target: SCN10A; (+) strand; PAM type: NRG; PAM sequence: AAG
gttcagtggtacgagagagg

SEQ ID NO: 27324 - DNA, 20 bp, Artificial Sequence
  Description of Artificial Sequence: Synthetic oligonucleotide
  Target: SCN10A; (+) strand; PAM type: NRG; PAM sequence: GAG
tcagtggtacgagagaggaa

SEQ ID NO: 27325 - DNA, 20 bp, Artificial Sequence
  Description of Artificial Sequence: Synthetic oligonucleotide
  Target: SCN10A; (+) strand; PAM type: NRG; PAM sequence: TGG
acgagagaggaagagttatt

SEQ ID NO: 27326 - DNA, 20 bp, Artificial Sequence
  Description of Artificial Sequence: Synthetic oligonucleotide
  Target: SCN10A; (+) strand; PAM type: NRG; PAM sequence: TAG
atttggttgaactcatcttt

SEQ ID NO: 27327 - DNA, 20 bp, Artificial Sequence
  Description of Artificial Sequence: Synthetic oligonucleotide
  Target: SCN10A; (+) strand; PAM type: NRG; PAM sequence: CAG
actcatcttttagaataaat

SEQ ID NO: 27328 - DNA, 20 bp, Artificial Sequence
  Description of Artificial Sequence: Synthetic oligonucleotide
  Target: SCN10A; (+) strand; PAM type: NRG; PAM sequence: AGG
ctcatcttttagaataaatc

SEQ ID NO: 27329 - DNA, 20 bp, Artificial Sequence
  Description of Artificial Sequence: Synthetic oligonucleotide
  Target: SCN10A; (+) strand; PAM type: NRG; PAM sequence: CAG
tttagaataaatcaggcatt

SEQ ID NO: 27330 - DNA, 20 bp, Artificial Sequence
  Description of Artificial Sequence: Synthetic oligonucleotide
  Target: SCN10A; (+) strand; PAM type: NRG; PAM sequence: GAG
tagaataaatcaggcattca

SEQ ID NO: 27331 - DNA, 20 bp, Artificial Sequence
  Description of Artificial Sequence: Synthetic oligonucleotide
  Target: SCN10A; (+) strand; PAM type: NRG; PAM sequence: TAG
taaatcaggcattcagagaa

SEQ ID NO: 27332 - DNA, 20 bp, Artificial Sequence
  Description of Artificial Sequence: Synthetic oligonucleotide
  Target: SCN10A; (+) strand; PAM type: NRG; PAM sequence: GAG
attcagagaatagctgattt

SEQ ID NO: 27333 - DNA, 20 bp, Artificial Sequence
  Description of Artificial Sequence: Synthetic oligonucleotide
  Target: SCN10A; (+) strand; PAM type: NRG; PAM sequence: TGG
agagaatagctgatttgaga

SEQ ID NO: 27334 - DNA, 20 bp, Artificial Sequence
  Description of Artificial Sequence: Synthetic oligonucleotide
  Target: SCN10A; (+) strand; PAM type: NRG; PAM sequence: TGG
atagctgatttgagatggct

SEQ ID NO: 27335 - DNA, 20 bp, Artificial Sequence
  Description of Artificial Sequence: Synthetic oligonucleotide
  Target: SCN10A; (+) strand; PAM type: NRG; PAM sequence: TGG
atcttattaacctgcatctg

SEQ ID NO: 27336 - DNA, 20 bp, Artificial Sequence
  Description of Artificial Sequence: Synthetic oligonucleotide
  Target: SCN10A; (+) strand; PAM type: NRG; PAM sequence: CAG
ctgtggatgctgccaactcc

SEQ ID NO: 27337 - DNA, 20 bp, Artificial Sequence
  Description of Artificial Sequence: Synthetic oligonucleotide
  Target: SCN10A; (+) strand; PAM type: NRG; PAM sequence: AAG
ggatgctgccaactcccagt

SEQ ID NO: 27338 - DNA, 20 bp, Artificial Sequence
  Description of Artificial Sequence: Synthetic oligonucleotide
  Target: SCN10A; (+) strand; PAM type: NRG; PAM sequence: GAG
caactcccagtaagcatctt

SEQ ID NO: 27339 - DNA, 20 bp, Artificial Sequence
  Description of Artificial Sequence: Synthetic oligonucleotide
  Target: SCN10A; (+) strand; PAM type: NRG; PAM sequence: GAG
actcccagtaagcatcttga

SEQ ID NO: 27340 - DNA, 20 bp, Artificial Sequence
  Description of Artificial Sequence: Synthetic oligonucleotide
  Target: SCN10A; (+) strand; PAM type: NRG; PAM sequence: TGG
agagcctctttgacttctta

SEQ ID NO: 27341 - DNA, 20 bp, Artificial Sequence
  Description of Artificial Sequence: Synthetic oligonucleotide
  Target: SCN10A; (+) strand; PAM type: NRG; PAM sequence: GGG
gagcctctttgacttcttat

SEQ ID NO: 27342 - DNA, 20 bp, Artificial Sequence
  Description of Artificial Sequence: Synthetic oligonucleotide
  Target: SCN10A; (+) strand; PAM type: NRG; PAM sequence: TAG
tttgacttcttatgggctaa

SEQ ID NO: 27343 - DNA, 20 bp, Artificial Sequence
  Description of Artificial Sequence: Synthetic oligonucleotide
  Target: SCN10A; (+) strand; PAM type: NRG; PAM sequence: CAG
ttcttatgggctaatagtga

SEQ ID NO: 27344 - DNA, 20 bp, Artificial Sequence
  Description of Artificial Sequence: Synthetic oligonucleotide
  Target: SCN10A; (+) strand; PAM type: NRG; PAM sequence: AAG
atgggctaatagtgacagaa

SEQ ID NO: 27345 - DNA, 20 bp, Artificial Sequence
  Description of Artificial Sequence: Synthetic oligonucleotide
  Target: SCN10A; (+) strand; PAM type: NRG; PAM sequence: AGG
tgggctaatagtgacagaaa

SEQ ID NO: 27346 - DNA, 20 bp, Artificial Sequence
  Description of Artificial Sequence: Synthetic oligonucleotide
  Target: SCN10A; (+) strand; PAM type: NRG; PAM sequence: GGG
gggctaatagtgacagaaaa

SEQ ID NO: 27347 - DNA, 20 bp, Artificial Sequence
  Description of Artificial Sequence: Synthetic oligonucleotide
  Target: SCN10A; (+) strand; PAM type: NRG; PAM sequence: GAG
gctaatagtgacagaaaagg

SEQ ID NO: 27348 - DNA, 20 bp, Artificial Sequence
  Description of Artificial Sequence: Synthetic oligonucleotide
  Target: SCN10A; (+) strand; PAM type: NRG; PAM sequence: GAG
taatagtgacagaaaaggga

SEQ ID NO: 27349 - DNA, 20 bp, Artificial Sequence
  Description of Artificial Sequence: Synthetic oligonucleotide
  Target: SCN10A; (+) strand; PAM type: NRG; PAM sequence: AAG
agtgacagaaaagggagagc

SEQ ID NO: 27350 - DNA, 20 bp, Artificial Sequence
  Description of Artificial Sequence: Synthetic oligonucleotide
  Target: SCN10A; (+) strand; PAM type: NRG; PAM sequence: AGG
gtgacagaaaagggagagca

SEQ ID NO: 27351 - DNA, 20 bp, Artificial Sequence
  Description of Artificial Sequence: Synthetic oligonucleotide
  Target: SCN10A; (+) strand; PAM type: NRG; PAM sequence: CGG
gaaaagggagagcaaggcct

SEQ ID NO: 27352 - DNA, 20 bp, Artificial Sequence
  Description of Artificial Sequence: Synthetic oligonucleotide
  Target: SCN10A; (+) strand; PAM type: NRG; PAM sequence: GAG
ctcggcaaatctgtattctt

SEQ ID NO: 27353 - DNA, 20 bp, Artificial Sequence
  Description of Artificial Sequence: Synthetic oligonucleotide
  Target: SCN10A; (+) strand; PAM type: NRG; PAM sequence: AGG
tcggcaaatctgtattcttg

SEQ ID NO: 27354 - DNA, 20 bp, Artificial Sequence
  Description of Artificial Sequence: Synthetic oligonucleotide
  Target: SCN10A; (+) strand; PAM type: NRG; PAM sequence: GAG
tctgtattcttgaggcatgt

SEQ ID NO: 27355 - DNA, 20 bp, Artificial Sequence
  Description of Artificial Sequence: Synthetic oligonucleotide
  Target: SCN10A; (+) strand; PAM type: NRG; PAM sequence: CAG
ttgaggcatgtgagatgtat

SEQ ID NO: 27356 - DNA, 20 bp, Artificial Sequence
  Description of Artificial Sequence: Synthetic oligonucleotide
  Target: SCN10A; (+) strand; PAM type: NRG; PAM sequence: TGG
gtgctttgtaattatacaaa

SEQ ID NO: 27357 - DNA, 20 bp, Artificial Sequence
  Description of Artificial Sequence: Synthetic oligonucleotide
  Target: SCN10A; (+) strand; PAM type: NRG; PAM sequence: TAG
ttatgaaatgatcaaatata

SEQ ID NO: 27358 - DNA, 20 bp, Artificial Sequence
  Description of Artificial Sequence: Synthetic oligonucleotide
  Target: SCN10A; (+) strand; PAM type: NRG; PAM sequence: TGG
caaatatatagacaatgaat

SEQ ID NO: 27359 - DNA, 20 bp, Artificial Sequence
  Description of Artificial Sequence: Synthetic oligonucleotide
  Target: SCN10A; (+) strand; PAM type: NRG; PAM sequence: TGG
tatttgaatctttgtgattg

SEQ ID NO: 27360 - DNA, 20 bp, Artificial Sequence
  Description of Artificial Sequence: Synthetic oligonucleotide
  Target: SCN10A; (+) strand; PAM type: NRG; PAM sequence: TGG
tgaatctttgtgattgtggc

SEQ ID NO: 27361 - DNA, 20 bp, Artificial Sequence
  Description of Artificial Sequence: Synthetic oligonucleotide
  Target: SCN10A; (+) strand; PAM type: NRG; PAM sequence: GGG
gaatctttgtgattgtggct

SEQ ID NO: 27362 - DNA, 20 bp, Artificial Sequence
  Description of Artificial Sequence: Synthetic oligonucleotide
  Target: SCN10A; (+) strand; PAM type: NRG; PAM sequence: TGG
tttgtgattgtggctgggaa

SEQ ID NO: 27363 - DNA, 20 bp, Artificial Sequence
  Description of Artificial Sequence: Synthetic oligonucleotide
  Target: SCN10A; (+) strand; PAM type: NRG; PAM sequence: GGG
ttgtgattgtggctgggaat

SEQ ID NO: 27364 - DNA, 20 bp, Artificial Sequence
  Description of Artificial Sequence: Synthetic oligonucleotide
  Target: SCN10A; (+) strand; PAM type: NRG; PAM sequence: AAG
attgtggctgggaatgggcc

SEQ ID NO: 27365 - DNA, 20 bp, Artificial Sequence
  Description of Artificial Sequence: Synthetic oligonucleotide
  Target: SCN10A; (+) strand; PAM type: NRG; PAM sequence: GAG
tgtggctgggaatgggccaa

SEQ ID NO: 27366 - DNA, 20 bp, Artificial Sequence
  Description of Artificial Sequence: Synthetic oligonucleotide
  Target: SCN10A; (+) strand; PAM type: NRG; PAM sequence: TGG
gggaatgggccaagagttaa

SEQ ID NO: 27367 - DNA, 20 bp, Artificial Sequence
  Description of Artificial Sequence: Synthetic oligonucleotide
  Target: SCN10A; (+) strand; PAM type: NRG; PAM sequence: AAG
aatgggccaagagttaatgg

SEQ ID NO: 27368 - DNA, 20 bp, Artificial Sequence
  Description of Artificial Sequence: Synthetic oligonucleotide
  Target: SCN10A; (+) strand; PAM type: NRG; PAM sequence: TAG
ccctatgtcctatgttgtta

SEQ ID NO: 27369 - DNA, 20 bp, Artificial Sequence
  Description of Artificial Sequence: Synthetic oligonucleotide
  Target: SCN10A; (+) strand; PAM type: NRG; PAM sequence: AGG
cctatgtcctatgttgttat

SEQ ID NO: 27370 - DNA, 20 bp, Artificial Sequence
  Description of Artificial Sequence: Synthetic oligonucleotide
  Target: SCN10A; (+) strand; PAM type: NRG; PAM sequence: GGG
ctatgtcctatgttgttata

SEQ ID NO: 27371 - DNA, 20 bp, Artificial Sequence
  Description of Artificial Sequence: Synthetic oligonucleotide
  Target: SCN10A; (+) strand; PAM type: NRG; PAM sequence: GAG
atgtcctatgttgttatagg

SEQ ID NO: 27372 - DNA, 20 bp, Artificial Sequence
  Description of Artificial Sequence: Synthetic oligonucleotide
  Target: SCN10A; (+) strand; PAM type: NRG; PAM sequence: TGG
caaaatctgcaacatgcctt

SEQ ID NO: 27373 - DNA, 20 bp, Artificial Sequence
  Description of Artificial Sequence: Synthetic oligonucleotide
  Target: SCN10A; (+) strand; PAM type: NRG; PAM sequence: CAG
ctgacaattcttactccatt

SEQ ID NO: 27374 - DNA, 20 bp, Artificial Sequence
  Description of Artificial Sequence: Synthetic oligonucleotide
  Target: SCN10A; (+) strand; PAM type: NRG; PAM sequence: TGG
agttcatacaattaatcttt

SEQ ID NO: 27375 - DNA, 20 bp, Artificial Sequence
  Description of Artificial Sequence: Synthetic oligonucleotide
  Target: SCN10A; (+) strand; PAM type: NRG; PAM sequence: GGG
gttcatacaattaatctttt

SEQ ID NO: 27376 - DNA, 20 bp, Artificial Sequence
  Description of Artificial Sequence: Synthetic oligonucleotide
  Target: SCN10A; (+) strand; PAM type: NRG; PAM sequence: GGG
ttcatacaattaatcttttg

SEQ ID NO: 27377 - DNA, 20 bp, Artificial Sequence
  Description of Artificial Sequence: Synthetic oligonucleotide
  Target: SCN10A; (+) strand; PAM type: NRG; PAM sequence: GGG
tcatacaattaatcttttgg

SEQ ID NO: 27378 - DNA, 20 bp, Artificial Sequence
  Description of Artificial Sequence: Synthetic oligonucleotide
  Target: SCN10A; (+) strand; PAM type: NRG; PAM sequence: TGG
cctattttatctcttgttct

SEQ ID NO: 27379 - DNA, 20 bp, Artificial Sequence
  Description of Artificial Sequence: Synthetic oligonucleotide
  Target: SCN10A; (+) strand; PAM type: NRG; PAM sequence: GAG
tattttatctcttgttcttg

SEQ ID NO: 27380 - DNA, 20 bp, Artificial Sequence
  Description of Artificial Sequence: Synthetic oligonucleotide
  Target: SCN10A; (+) strand; PAM type: NRG; PAM sequence: CAG
tttatctcttgttcttggag

SEQ ID NO: 27381 - DNA, 20 bp, Artificial Sequence
  Description of Artificial Sequence: Synthetic oligonucleotide
  Target: SCN10A; (+) strand; PAM type: NRG; PAM sequence: TAG
ttggagcagtgcccatcata

SEQ ID NO: 27382 - DNA, 20 bp, Artificial Sequence
  Description of Artificial Sequence: Synthetic oligonucleotide
  Target: SCN10A; (+) strand; PAM type: NRG; PAM sequence: CAG
tacgtaattaataacatttg

SEQ ID NO: 27383 - DNA, 20 bp, Artificial Sequence
  Description of Artificial Sequence: Synthetic oligonucleotide
  Target: SCN10A; (+) strand; PAM type: NRG; PAM sequence: AGG
acgtaattaataacatttgc

SEQ ID NO: 27384 - DNA, 20 bp, Artificial Sequence
  Description of Artificial Sequence: Synthetic oligonucleotide
  Target: SCN10A; (+) strand; PAM type: NRG; PAM sequence: AAG
aacatttgcaggatgaatga

SEQ ID NO: 27385 - DNA, 20 bp, Artificial Sequence
  Description of Artificial Sequence: Synthetic oligonucleotide
  Target: SCN10A; (+) strand; PAM type: NRG; PAM sequence: TGG
ggatgaatgaaagaaactac

SEQ ID NO: 27386 - DNA, 20 bp, Artificial Sequence
  Description of Artificial Sequence: Synthetic oligonucleotide
  Target: SCN10A; (+) strand; PAM type: NRG; PAM sequence: TGG
tggccataccttttatctac

SEQ ID NO: 27387 - DNA, 20 bp, Artificial Sequence
  Description of Artificial Sequence: Synthetic oligonucleotide
  Target: SCN10A; (+) strand; PAM type: NRG; PAM sequence: TGG
tcttctgattatattaacta

SEQ ID NO: 27388 - DNA, 20 bp, Artificial Sequence
  Description of Artificial Sequence: Synthetic oligonucleotide
  Target: SCN10A; (+) strand; PAM type: NRG; PAM sequence: GAG
ttctgattatattaactatg

SEQ ID NO: 27389 - DNA, 20 bp, Artificial Sequence
  Description of Artificial Sequence: Synthetic oligonucleotide
  Target: SCN10A; (+) strand; PAM type: NRG; PAM sequence: TGG
ttatattaactatggagttc

SEQ ID NO: 27390 - DNA, 20 bp, Artificial Sequence
  Description of Artificial Sequence: Synthetic oligonucleotide
  Target: SCN10A; (+) strand; PAM type: NRG; PAM sequence: CAG
aactatggagttctggacgc

SEQ ID NO: 27391 - DNA, 20 bp, Artificial Sequence
  Description of Artificial Sequence: Synthetic oligonucleotide
  Target: SCN10A; (+) strand; PAM type: NRG; PAM sequence: AGG
actatggagttctggacgcc

SEQ ID NO: 27392 - DNA, 20 bp, Artificial Sequence
  Description of Artificial Sequence: Synthetic oligonucleotide
  Target: SCN10A; (+) strand; PAM type: NRG; PAM sequence: GAG
cctccttaatgtctgattat

SEQ ID NO: 27393 - DNA, 20 bp, Artificial Sequence
  Description of Artificial Sequence: Synthetic oligonucleotide
  Target: SCN10A; (+) strand; PAM type: NRG; PAM sequence: CAG
gtctgattatgagatgtgaa

SEQ ID NO: 27394 - DNA, 20 bp, Artificial Sequence
  Description of Artificial Sequence: Synthetic oligonucleotide
  Target: SCN10A; (+) strand; PAM type: NRG; PAM sequence: TGG
tatgagatgtgaacagactc

SEQ ID NO: 27395 - DNA, 20 bp, Artificial Sequence
  Description of Artificial Sequence: Synthetic oligonucleotide
  Target: SCN10A; (+) strand; PAM type: NRG; PAM sequence: AAG
agactctggaatgtattcaa

SEQ ID NO: 27396 - DNA, 20 bp, Artificial Sequence
  Description of Artificial Sequence: Synthetic oligonucleotide
  Target: SCN10A; (+) strand; PAM type: NRG; PAM sequence: TAG
gtattcaaaagctgcctctt

SEQ ID NO: 27397 - DNA, 20 bp, Artificial Sequence
  Description of Artificial Sequence: Synthetic oligonucleotide
  Target: SCN10A; (+) strand; PAM type: NRG; PAM sequence: CAG
ctgcctctttagctacacaa

SEQ ID NO: 27398 - DNA, 20 bp, Artificial Sequence
  Description of Artificial Sequence: Synthetic oligonucleotide
  Target: SCN10A; (+) strand; PAM type: NRG; PAM sequence: AAG
ctctttagctacacaacaga

SEQ ID NO: 27399 - DNA, 20 bp, Artificial Sequence
  Description of Artificial Sequence: Synthetic oligonucleotide
  Target: SCN10A; (+) strand; PAM type: NRG; PAM sequence: AGG
tctttagctacacaacagaa

SEQ ID NO: 27400 - DNA, 20 bp, Artificial Sequence
  Description of Artificial Sequence: Synthetic oligonucleotide
  Target: SCN10A; (+) strand; PAM type: NRG; PAM sequence: CAG
agctacacaacagaaaggtc

SEQ ID NO: 27401 - DNA, 20 bp, Artificial Sequence
  Description of Artificial Sequence: Synthetic oligonucleotide
  Target: SCN10A; (+) strand; PAM type: NRG; PAM sequence: CAG
acagaaaggtccagccattt

SEQ ID NO: 27402 - DNA, 20 bp, Artificial Sequence
  Description of Artificial Sequence: Synthetic oligonucleotide
  Target: SCN10A; (+) strand; PAM type: NRG; PAM sequence: CAG
aggtccagccatttcagcct

SEQ ID NO: 27403 - DNA, 20 bp, Artificial Sequence
  Description of Artificial Sequence: Synthetic oligonucleotide
  Target: SCN10A; (+) strand; PAM type: NRG; PAM sequence: AAG
cagccatttcagcctcagaa

SEQ ID NO: 27404 - DNA, 20 bp, Artificial Sequence
  Description of Artificial Sequence: Synthetic oligonucleotide
  Target: SCN10A; (+) strand; PAM type: NRG; PAM sequence: GAG
gccatttcagcctcagaaaa

SEQ ID NO: 27405 - DNA, 20 bp, Artificial Sequence
  Description of Artificial Sequence: Synthetic oligonucleotide
  Target: SCN10A; (+) strand; PAM type: NRG; PAM sequence: TGG
gagtgcttttcccatataaa

SEQ ID NO: 27406 - DNA, 20 bp, Artificial Sequence
  Description of Artificial Sequence: Synthetic oligonucleotide
  Target: SCN10A; (+) strand; PAM type: NRG; PAM sequence: GGG
agtgcttttcccatataaat

SEQ ID NO: 27407 - DNA, 20 bp, Artificial Sequence
  Description of Artificial Sequence: Synthetic oligonucleotide
  Target: SCN10A; (+) strand; PAM type: NRG; PAM sequence: GGG
gtgcttttcccatataaatg

SEQ ID NO: 27408 - DNA, 20 bp, Artificial Sequence
  Description of Artificial Sequence: Synthetic oligonucleotide
  Target: SCN10A; (+) strand; PAM type: NRG; PAM sequence: CAG
cttttcccatataaatgggg

SEQ ID NO: 27409 - DNA, 20 bp, Artificial Sequence
  Description of Artificial Sequence: Synthetic oligonucleotide
  Target: SCN10A; (+) strand; PAM type: NRG; PAM sequence: AGG
ttttcccatataaatggggc

SEQ ID NO: 27410 - DNA, 20 bp, Artificial Sequence
  Description of Artificial Sequence: Synthetic oligonucleotide
  Target: SCN10A; (+) strand; PAM type: NRG; PAM sequence: TGG
tataaatggggcaggcacca

SEQ ID NO: 27411 - DNA, 20 bp, Artificial Sequence
  Description of Artificial Sequence: Synthetic oligonucleotide
  Target: SCN10A; (+) strand; PAM type: NRG; PAM sequence: GAG
taaatggggcaggcaccatg

SEQ ID NO: 27412 - DNA, 20 bp, Artificial Sequence
  Description of Artificial Sequence: Synthetic oligonucleotide
  Target: SCN10A; (+) strand; PAM type: NRG; PAM sequence: CAG
gcaggcaccatggagttcta

SEQ ID NO: 27413 - DNA, 20 bp, Artificial Sequence
  Description of Artificial Sequence: Synthetic oligonucleotide
  Target: SCN10A; (+) strand; PAM type: NRG; PAM sequence: GAG
accatggagttctacagcac

SEQ ID NO: 27414 - DNA, 20 bp, Artificial Sequence
  Description of Artificial Sequence: Synthetic oligonucleotide
  Target: SCN10A; (+) strand; PAM type: NRG; PAM sequence: AAG
gttctacagcacgagatgcg

SEQ ID NO: 27415 - DNA, 20 bp, Artificial Sequence
  Description of Artificial Sequence: Synthetic oligonucleotide
  Target: SCN10A; (+) strand; PAM type: NRG; PAM sequence: TAG
agcacgagatgcgaagtcta

SEQ ID NO: 27416 - DNA, 20 bp, Artificial Sequence
  Description of Artificial Sequence: Synthetic oligonucleotide
  Target: SCN10A; (+) strand; PAM type: NRG; PAM sequence: AAG
cgagatgcgaagtctataga

SEQ ID NO: 27417 - DNA, 20 bp, Artificial Sequence
  Description of Artificial Sequence: Synthetic oligonucleotide
  Target: SCN10A; (+) strand; PAM type: NRG; PAM sequence: AAG
tcccttcccaccaattttac

SEQ ID NO: 27418 - DNA, 20 bp, Artificial Sequence
  Description of Artificial Sequence: Synthetic oligonucleotide
  Target: SCN10A; (+) strand; PAM type: NRG; PAM sequence: GAG
ttcccaccaattttacaagt

SEQ ID NO: 27419 - DNA, 20 bp, Artificial Sequence
  Description of Artificial Sequence: Synthetic oligonucleotide
  Target: SCN10A; (+) strand; PAM type: NRG; PAM sequence: AGG
tcccaccaattttacaagtg

SEQ ID NO: 27420 - DNA, 20 bp, Artificial Sequence
  Description of Artificial Sequence: Synthetic oligonucleotide
  Target: SCN10A; (+) strand; PAM type: NRG; PAM sequence: AAG
ttttacaagtgaggaaattg

SEQ ID NO: 27421 - DNA, 20 bp, Artificial Sequence
  Description of Artificial Sequence: Synthetic oligonucleotide
  Target: SCN10A; (+) strand; PAM type: NRG; PAM sequence: AAG
caagtgaggaaattgaagtt

SEQ ID NO: 27422 - DNA, 20 bp, Artificial Sequence
  Description of Artificial Sequence: Synthetic oligonucleotide
  Target: SCN10A; (+) strand; PAM type: NRG; PAM sequence: GAG
agtgaggaaattgaagttaa

SEQ ID NO: 27423 - DNA, 20 bp, Artificial Sequence
  Description of Artificial Sequence: Synthetic oligonucleotide
  Target: SCN10A; (+) strand; PAM type: NRG; PAM sequence: AGG
gtgaggaaattgaagttaag

SEQ ID NO: 27424 - DNA, 20 bp, Artificial Sequence
  Description of Artificial Sequence: Synthetic oligonucleotide
  Target: SCN10A; (+) strand; PAM type: NRG; PAM sequence: GGG
tgaggaaattgaagttaaga

SEQ ID NO: 27425 - DNA, 20 bp, Artificial Sequence
  Description of Artificial Sequence: Synthetic oligonucleotide
  Target: SCN10A; (+) strand; PAM type: NRG; PAM sequence: GGG
gaggaaattgaagttaagag

SEQ ID NO: 27426 - DNA, 20 bp, Artificial Sequence
  Description of Artificial Sequence: Synthetic oligonucleotide
  Target: SCN10A; (+) strand; PAM type: NRG; PAM sequence: AAG
aaattgaagttaagagggga

SEQ ID NO: 27427 - DNA, 20 bp, Artificial Sequence
  Description of Artificial Sequence: Synthetic oligonucleotide
  Target: SCN10A; (+) strand; PAM type: NRG; PAM sequence: TAG
agttaagaggggaaagactt

SEQ ID NO: 27428 - DNA, 20 bp, Artificial Sequence
  Description of Artificial Sequence: Synthetic oligonucleotide
  Target: SCN10A; (+) strand; PAM type: NRG; PAM sequence: TGG
gaggggaaagactttagccc

SEQ ID NO: 27429 - DNA, 20 bp, Artificial Sequence
  Description of Artificial Sequence: Synthetic oligonucleotide
  Target: SCN10A; (+) strand; PAM type: NRG; PAM sequence: CAG
ggaaagactttagccctggt

SEQ ID NO: 27430 - DNA, 20 bp, Artificial Sequence
  Description of Artificial Sequence: Synthetic oligonucleotide
  Target: SCN10A; (+) strand; PAM type: NRG; PAM sequence: CAG
agactttagccctggtcagc

SEQ ID NO: 27431 - DNA, 20 bp, Artificial Sequence
  Description of Artificial Sequence: Synthetic oligonucleotide
  Target: SCN10A; (+) strand; PAM type: NRG; PAM sequence: TGG
gccctggtcagccagacaat

SEQ ID NO: 27432 - DNA, 20 bp, Artificial Sequence
  Description of Artificial Sequence: Synthetic oligonucleotide
  Target: SCN10A; (+) strand; PAM type: NRG; PAM sequence: TGG
ctggtcagccagacaattgg

SEQ ID NO: 27433 - DNA, 20 bp, Artificial Sequence
  Description of Artificial Sequence: Synthetic oligonucleotide
  Target: SCN10A; (+) strand; PAM type: NRG; PAM sequence: AAG
cagccagacaattggtggaa

SEQ ID NO: 27434 - DNA, 20 bp, Artificial Sequence
  Description of Artificial Sequence: Synthetic oligonucleotide
  Target: SCN10A; (+) strand; PAM type: NRG; PAM sequence: TAG
cagacaattggtggaaaagt

SEQ ID NO: 27435 - DNA, 20 bp, Artificial Sequence
  Description of Artificial Sequence: Synthetic oligonucleotide
  Target: SCN10A; (+) strand; PAM type: NRG; PAM sequence: AGG
agacaattggtggaaaagtt

SEQ ID NO: 27436 - DNA, 20 bp, Artificial Sequence
  Description of Artificial Sequence: Synthetic oligonucleotide
  Target: SCN10A; (+) strand; PAM type: NRG; PAM sequence: TGG
ggaaaagttaggattccaac

SEQ ID NO: 27437 - DNA, 20 bp, Artificial Sequence
  Description of Artificial Sequence: Synthetic oligonucleotide
  Target: SCN10A; (+) strand; PAM type: NRG; PAM sequence: CAG
aggattccaactggcatttc

SEQ ID NO: 27438 - DNA, 20 bp, Artificial Sequence
  Description of Artificial Sequence: Synthetic oligonucleotide
  Target: SCN10A; (+) strand; PAM type: NRG; PAM sequence: CAG
caactggcatttccagatcc

SEQ ID NO: 27439 - DNA, 20 bp, Artificial Sequence
  Description of Artificial Sequence: Synthetic oligonucleotide
  Target: SCN10A; (+) strand; PAM type: NRG; PAM sequence: AGG
aactggcatttccagatccc

SEQ ID NO: 27440 - DNA, 20 bp, Artificial Sequence
  Description of Artificial Sequence: Synthetic oligonucleotide
  Target: SCN10A; (+) strand; PAM type: NRG; PAM sequence: CAG
ggcatttccagatcccagga

SEQ ID NO: 27441 - DNA, 20 bp, Artificial Sequence
  Description of Artificial Sequence: Synthetic oligonucleotide
  Target: SCN10A; (+) strand; PAM type: NRG; PAM sequence: CAG
gtgctctttcctgctccacc

SEQ ID NO: 27442 - DNA, 20 bp, Artificial Sequence
  Description of Artificial Sequence: Synthetic oligonucleotide
  Target: SCN10A; (+) strand; PAM type: NRG; PAM sequence: CAG
aatctcaaactgaaaaatat

SEQ ID NO: 27443 - DNA, 20 bp, Artificial Sequence
  Description of Artificial Sequence: Synthetic oligonucleotide
  Target: SCN10A; (+) strand; PAM type: NRG; PAM sequence: AGG
atctcaaactgaaaaatatc

SEQ ID NO: 27444 - DNA, 20 bp, Artificial Sequence
  Description of Artificial Sequence: Synthetic oligonucleotide
  Target: SCN10A; (+) strand; PAM type: NRG; PAM sequence: CAG
actgaaaaatatcaggatcc

SEQ ID NO: 27445 - DNA, 20 bp, Artificial Sequence
  Description of Artificial Sequence: Synthetic oligonucleotide
  Target: SCN10A; (+) strand; PAM type: NRG; PAM sequence: AAG
aaaaatatcaggatcccaga

SEQ ID NO: 27446 - DNA, 20 bp, Artificial Sequence
  Description of Artificial Sequence: Synthetic oligonucleotide
  Target: SCN10A; (+) strand; PAM type: NRG; PAM sequence: GAG
atatcaggatcccagaaagt

SEQ ID NO: 27447 - DNA, 20 bp, Artificial Sequence
  Description of Artificial Sequence: Synthetic oligonucleotide
  Target: SCN10A; (+) strand; PAM type: NRG; PAM sequence: AGG
tatcaggatcccagaaagtg

SEQ ID NO: 27448 - DNA, 20 bp, Artificial Sequence
  Description of Artificial Sequence: Synthetic oligonucleotide
  Target: SCN10A; (+) strand; PAM type: NRG; PAM sequence: GGG
atcaggatcccagaaagtga

SEQ ID NO: 27449 - DNA, 20 bp, Artificial Sequence
  Description of Artificial Sequence: Synthetic oligonucleotide
  Target: SCN10A; (+) strand; PAM type: NRG; PAM sequence: GGG
tcaggatcccagaaagtgag

SEQ ID NO: 27450 - DNA, 20 bp, Artificial Sequence
  Description of Artificial Sequence: Synthetic oligonucleotide
  Target: SCN10A; (+) strand; PAM type: NRG; PAM sequence: AAG
gatcccagaaagtgaggggt

SEQ ID NO: 27451 - DNA, 20 bp, Artificial Sequence
  Description of Artificial Sequence: Synthetic oligonucleotide
  Target: SCN10A; (+) strand; PAM type: NRG; PAM sequence: CAG
ggggtaagtgactcatgata

SEQ ID NO: 27452 - DNA, 20 bp, Artificial Sequence
  Description of Artificial Sequence: Synthetic oligonucleotide
  Target: SCN10A; (+) strand; PAM type: NRG; PAM sequence: AGG
gggtaagtgactcatgatac

SEQ ID NO: 27453 - DNA, 20 bp, Artificial Sequence
  Description of Artificial Sequence: Synthetic oligonucleotide
  Target: SCN10A; (+) strand; PAM type: NRG; PAM sequence: CAG
aagtgactcatgatacaggt

SEQ ID NO: 27454 - DNA, 20 bp, Artificial Sequence
  Description of Artificial Sequence: Synthetic oligonucleotide
  Target: SCN10A; (+) strand; PAM type: NRG; PAM sequence: CAG
catgatacaggtcagcatca

SEQ ID NO: 27455 - DNA, 20 bp, Artificial Sequence
  Description of Artificial Sequence: Synthetic oligonucleotide
  Target: SCN10A; (+) strand; PAM type: NRG; PAM sequence: AAG
caggtcagcatcacagaaat

SEQ ID NO: 27456 - DNA, 20 bp, Artificial Sequence
  Description of Artificial Sequence: Synthetic oligonucleotide
  Target: SCN10A; (+) strand; PAM type: NRG; PAM sequence: GAG
ggtcagcatcacagaaataa

SEQ ID NO: 27457 - DNA, 20 bp, Artificial Sequence
  Description of Artificial Sequence: Synthetic oligonucleotide
  Target: SCN10A; (+) strand; PAM type: NRG; PAM sequence: TGG
gatgctttatgatataacgc

SEQ ID NO: 27458 - DNA, 20 bp, Artificial Sequence
  Description of Artificial Sequence: Synthetic oligonucleotide
  Target: SCN10A; (+) strand; PAM type: NRG; PAM sequence: TGG
tttatgatataacgctggtg

SEQ ID NO: 27459 - DNA, 20 bp, Artificial Sequence
  Description of Artificial Sequence: Synthetic oligonucleotide
  Target: SCN10A; (+) strand; PAM type: NRG; PAM sequence: TGG
tttaaaaatattaattttaa

SEQ ID NO: 27460 - DNA, 20 bp, Artificial Sequence
  Description of Artificial Sequence: Synthetic oligonucleotide
  Target: SCN10A; (+) strand; PAM type: NRG; PAM sequence: AAG
taattttaatggatatctca

SEQ ID NO: 27461 - DNA, 20 bp, Artificial Sequence
  Description of Artificial Sequence: Synthetic oligonucleotide
  Target: SCN10A; (+) strand; PAM type: NRG; PAM sequence: AGG
aattttaatggatatctcaa

SEQ ID NO: 27462 - DNA, 20 bp, Artificial Sequence
  Description of Artificial Sequence: Synthetic oligonucleotide
  Target: SCN10A; (+) strand; PAM type: NRG; PAM sequence: TAG
ctcaaaggcttttcatgaca

SEQ ID NO: 27463 - DNA, 20 bp, Artificial Sequence
  Description of Artificial Sequence: Synthetic oligonucleotide
  Target: SCN10A; (+) strand; PAM type: NRG; PAM sequence: AGG
tcaaaggcttttcatgacat

SEQ ID NO: 27464 - DNA, 20 bp, Artificial Sequence
  Description of Artificial Sequence: Synthetic oligonucleotide
  Target: SCN10A; (+) strand; PAM type: NRG; PAM sequence: CAG
gcttttcatgacataggcca

SEQ ID NO: 27465 - DNA, 20 bp, Artificial Sequence
  Description of Artificial Sequence: Synthetic oligonucleotide
  Target: SCN10A; (+) strand; PAM type: NRG; PAM sequence: AGG
cttttcatgacataggccac

SEQ ID NO: 27466 - DNA, 20 bp, Artificial Sequence
  Description of Artificial Sequence: Synthetic oligonucleotide
  Target: SCN10A; (+) strand; PAM type: NRG; PAM sequence: TGG
ataggccacaggtgttaccc

SEQ ID NO: 27467 - DNA, 20 bp, Artificial Sequence
  Description of Artificial Sequence: Synthetic oligonucleotide
  Target: SCN10A; (+) strand; PAM type: NRG; PAM sequence: GGG
taggccacaggtgttaccct

SEQ ID NO: 27468 - DNA, 20 bp, Artificial Sequence
  Description of Artificial Sequence: Synthetic oligonucleotide
  Target: SCN10A; (+) strand; PAM type: NRG; PAM sequence: CAG
ccacaggtgttaccctgggt

SEQ ID NO: 27469 - DNA, 20 bp, Artificial Sequence
  Description of Artificial Sequence: Synthetic oligonucleotide
  Target: SCN10A; (+) strand; PAM type: NRG; PAM sequence: GAG
acaggtgttaccctgggtca

SEQ ID NO: 27470 - DNA, 20 bp, Artificial Sequence
  Description of Artificial Sequence: Synthetic oligonucleotide
  Target: SCN10A; (+) strand; PAM type: NRG; PAM sequence: CAG
ggtgttaccctgggtcagag

SEQ ID NO: 27471 - DNA, 20 bp, Artificial Sequence
  Description of Artificial Sequence: Synthetic oligonucleotide
  Target: SCN10A; (+) strand; PAM type: NRG; PAM sequence: CAG
gggtcagagcagttgtccga

SEQ ID NO: 27472 - DNA, 20 bp, Artificial Sequence
  Description of Artificial Sequence: Synthetic oligonucleotide
  Target: SCN10A; (+) strand; PAM type: NRG; PAM sequence: CAG
tgtccgacagctctcacatg

SEQ ID NO: 27473 - DNA, 20 bp, Artificial Sequence
  Description of Artificial Sequence: Synthetic oligonucleotide
  Target: SCN10A; (+) strand; PAM type: NRG; PAM sequence: TGG
taatattgccaatctctgta

SEQ ID NO: 27474 - DNA, 20 bp, Artificial Sequence
  Description of Artificial Sequence: Synthetic oligonucleotide
  Target: SCN10A; (+) strand; PAM type: NRG; PAM sequence: CAG
aatctctgtatggtgctcca

SEQ ID NO: 27475 - DNA, 20 bp, Artificial Sequence
  Description of Artificial Sequence: Synthetic oligonucleotide
  Target: SCN10A; (+) strand; PAM type: NRG; PAM sequence: GAG
tctctgtatggtgctccaca

SEQ ID NO: 27476 - DNA, 20 bp, Artificial Sequence
  Description of Artificial Sequence: Synthetic oligonucleotide
  Target: SCN10A; (+) strand; PAM type: NRG; PAM sequence: AGG
ctctgtatggtgctccacag

SEQ ID NO: 27477 - DNA, 20 bp, Artificial Sequence
  Description of Artificial Sequence: Synthetic oligonucleotide
  Target: SCN10A; (+) strand; PAM type: NRG; PAM sequence: TGG
tgctccacagaggactacct

SEQ ID NO: 27478 - DNA, 20 bp, Artificial Sequence
  Description of Artificial Sequence: Synthetic oligonucleotide
  Target: SCN10A; (+) strand; PAM type: NRG; PAM sequence: CAG
agaggactaccttggacctt

SEQ ID NO: 27479 - DNA, 20 bp, Artificial Sequence
  Description of Artificial Sequence: Synthetic oligonucleotide
  Target: SCN10A; (+) strand; PAM type: NRG; PAM sequence: TGG
atgttcttgttctatatctt

SEQ ID NO: 27480 - DNA, 20 bp, Artificial Sequence
  Description of Artificial Sequence: Synthetic oligonucleotide
  Target: SCN10A; (+) strand; PAM type: NRG; PAM sequence: AAG
ttcttgttctatatctttgg

SEQ ID NO: 27481 - DNA, 20 bp, Artificial Sequence
  Description of Artificial Sequence: Synthetic oligonucleotide
  Target: SCN10A; (+) strand; PAM type: NRG; PAM sequence: TGG
ttctatatctttggaagttc

SEQ ID NO: 27482 - DNA, 20 bp, Artificial Sequence
  Description of Artificial Sequence: Synthetic oligonucleotide
  Target: SCN10A; (+) strand; PAM type: NRG; PAM sequence: GAG
tctttggaagttctggtcct

SEQ ID NO: 27483 - DNA, 20 bp, Artificial Sequence
  Description of Artificial Sequence: Synthetic oligonucleotide
  Target: SCN10A; (+) strand; PAM type: NRG; PAM sequence: AAG
ttggaagttctggtcctgag

SEQ ID NO: 27484 - DNA, 20 bp, Artificial Sequence
  Description of Artificial Sequence: Synthetic oligonucleotide
  Target: SCN10A; (+) strand; PAM type: NRG; PAM sequence: CAG
tggtcctgagaagtttgtct

SEQ ID NO: 27485 - DNA, 20 bp, Artificial Sequence
  Description of Artificial Sequence: Synthetic oligonucleotide
  Target: SCN10A; (+) strand; PAM type: NRG; PAM sequence: AAG
tctgattacaacaaaaataa

SEQ ID NO: 27486 - DNA, 20 bp, Artificial Sequence
  Description of Artificial Sequence: Synthetic oligonucleotide
  Target: SCN10A; (+) strand; PAM type: NRG; PAM sequence: AGG
ctgattacaacaaaaataaa

SEQ ID NO: 27487 - DNA, 20 bp, Artificial Sequence
  Description of Artificial Sequence: Synthetic oligonucleotide
  Target: SCN10A; (+) strand; PAM type: NRG; PAM sequence: AAG
tacaacaaaaataaaaggac

SEQ ID NO: 27488 - DNA, 20 bp, Artificial Sequence
  Description of Artificial Sequence: Synthetic oligonucleotide
  Target: SCN10A; (+) strand; PAM type: NRG; PAM sequence: AGG
acaacaaaaataaaaggaca

SEQ ID NO: 27489 - DNA, 20 bp, Artificial Sequence
  Description of Artificial Sequence: Synthetic oligonucleotide
  Target: SCN10A; (+) strand; PAM type: NRG; PAM sequence: GGG
caacaaaaataaaaggacaa

SEQ ID NO: 27490 - DNA, 20 bp, Artificial Sequence
  Description of Artificial Sequence: Synthetic oligonucleotide
  Target: SCN10A; (+) strand; PAM type: NRG; PAM sequence: TGG
aaaggacaagggatattttc

SEQ ID NO: 27491 - DNA, 20 bp, Artificial Sequence
  Description of Artificial Sequence: Synthetic oligonucleotide
  Target: SCN10A; (+) strand; PAM type: NRG; PAM sequence: GAG
aggacaagggatattttctg

SEQ ID NO: 27492 - DNA, 20 bp, Artificial Sequence
  Description of Artificial Sequence: Synthetic oligonucleotide
  Target: SCN10A; (+) strand; PAM type: NRG; PAM sequence: GAG
gacaagggatattttctgga

SEQ ID NO: 27493 - DNA, 20 bp, Artificial Sequence
  Description of Artificial Sequence: Synthetic oligonucleotide
  Target: SCN10A; (+) strand; PAM type: NRG; PAM sequence: AAG
agggatattttctggagagt

SEQ ID NO: 27494 - DNA, 20 bp, Artificial Sequence
  Description of Artificial Sequence: Synthetic oligonucleotide
  Target: SCN10A; (+) strand; PAM type: NRG; PAM sequence: GAG
ggatattttctggagagtaa

SEQ ID NO: 27495 - DNA, 20 bp, Artificial Sequence
  Description of Artificial Sequence: Synthetic oligonucleotide
  Target: SCN10A; (+) strand; PAM type: NRG; PAM sequence: CAG
catgatctgatattgaaatt

SEQ ID NO: 27496 - DNA, 20 bp, Artificial Sequence
  Description of Artificial Sequence: Synthetic oligonucleotide
  Target: SCN10A; (+) strand; PAM type: NRG; PAM sequence: AAG
gatctgatattgaaattcag

SEQ ID NO: 27497 - DNA, 20 bp, Artificial Sequence
  Description of Artificial Sequence: Synthetic oligonucleotide
  Target: SCN10A; (+) strand; PAM type: NRG; PAM sequence: AGG
atctgatattgaaattcaga

SEQ ID NO: 27498 - DNA, 20 bp, Artificial Sequence
  Description of Artificial Sequence: Synthetic oligonucleotide
  Target: SCN10A; (+) strand; PAM type: NRG; PAM sequence: GGG
tctgatattgaaattcagaa

SEQ ID NO: 27499 - DNA, 20 bp, Artificial Sequence
  Description of Artificial Sequence: Synthetic oligonucleotide
  Target: SCN10A; (+) strand; PAM type: NRG; PAM sequence: CAG
gaaattcagaagggaaatca

SEQ ID NO: 27500 - DNA, 20 bp, Artificial Sequence
  Description of Artificial Sequence: Synthetic oligonucleotide
  Target: SCN10A; (+) strand; PAM type: NRG; PAM sequence: TGG
attcagaagggaaatcacag

SEQ ID NO: 27501 - DNA, 20 bp, Artificial Sequence
  Description of Artificial Sequence: Synthetic oligonucleotide
  Target: SCN10A; (+) strand; PAM type: NRG; PAM sequence: AAG
cagaagggaaatcacagtgg

SEQ ID NO: 27502 - DNA, 20 bp, Artificial Sequence
  Description of Artificial Sequence: Synthetic oligonucleotide
  Target: SCN10A; (+) strand; PAM type: NRG; PAM sequence: TAG
aatcacagtggaagtgctct

SEQ ID NO: 27503 - DNA, 20 bp, Artificial Sequence
  Description of Artificial Sequence: Synthetic oligonucleotide
  Target: SCN10A; (+) strand; PAM type: NRG; PAM sequence: TGG
tgactcctatttgtgtatga

SEQ ID NO: 27504 - DNA, 20 bp, Artificial Sequence
  Description of Artificial Sequence: Synthetic oligonucleotide
  Target: SCN10A; (+) strand; PAM type: NRG; PAM sequence: AAG
tgtgtatgatggttttttca

SEQ ID NO: 27505 - DNA, 20 bp, Artificial Sequence
  Description of Artificial Sequence: Synthetic oligonucleotide
  Target: SCN10A; (+) strand; PAM type: NRG; PAM sequence: AGG
gtgtatgatggttttttcaa

SEQ ID NO: 27506 - DNA, 20 bp, Artificial Sequence
  Description of Artificial Sequence: Synthetic oligonucleotide
  Target: SCN10A; (+) strand; PAM type: NRG; PAM sequence: TGG
tatgatggttttttcaaagg

SEQ ID NO: 27507 - DNA, 20 bp, Artificial Sequence
  Description of Artificial Sequence: Synthetic oligonucleotide
  Target: SCN10A; (+) strand; PAM type: NRG; PAM sequence: CAG
gttttttcaaaggtggttac

SEQ ID NO: 27508 - DNA, 20 bp, Artificial Sequence
  Description of Artificial Sequence: Synthetic oligonucleotide
  Target: SCN10A; (+) strand; PAM type: NRG; PAM sequence: CAG
taccagttgcattccctgcc

SEQ ID NO: 27509 - DNA, 20 bp, Artificial Sequence
  Description of Artificial Sequence: Synthetic oligonucleotide
  Target: SCN10A; (+) strand; PAM type: NRG; PAM sequence: CAG
cccagttctgacattgtgac

SEQ ID NO: 27510 - DNA, 20 bp, Artificial Sequence
  Description of Artificial Sequence: Synthetic oligonucleotide
  Target: SCN10A; (+) strand; PAM type: NRG; PAM sequence: TGG
agttctgacattgtgaccag

SEQ ID NO: 27511 - DNA, 20 bp, Artificial Sequence
  Description of Artificial Sequence: Synthetic oligonucleotide
  Target: SCN10A; (+) strand; PAM type: NRG; PAM sequence: TGG
ttgtgaccagtggcatgcat

SEQ ID NO: 27512 - DNA, 20 bp, Artificial Sequence
  Description of Artificial Sequence: Synthetic oligonucleotide
  Target: SCN10A; (+) strand; PAM type: NRG; PAM sequence: GAG
gaccagtggcatgcattggt

SEQ ID NO: 27513 - DNA, 20 bp, Artificial Sequence
  Description of Artificial Sequence: Synthetic oligonucleotide
  Target: SCN10A; (+) strand; PAM type: NRG; PAM sequence: AGG
accagtggcatgcattggtg

SEQ ID NO: 27514 - DNA, 20 bp, Artificial Sequence
  Description of Artificial Sequence: Synthetic oligonucleotide
  Target: SCN10A; (+) strand; PAM type: NRG; PAM sequence: TAG
ggcatgcattggtgaggctg

SEQ ID NO: 27515 - DNA, 20 bp, Artificial Sequence
  Description of Artificial Sequence: Synthetic oligonucleotide
  Target: SCN10A; (+) strand; PAM type: NRG; PAM sequence: TGG
tgcattggtgaggctgtagc

SEQ ID NO: 27516 - DNA, 20 bp, Artificial Sequence
  Description of Artificial Sequence: Synthetic oligonucleotide
  Target: SCN10A; (+) strand; PAM type: NRG; PAM sequence: GGG
gcattggtgaggctgtagct

SEQ ID NO: 27517 - DNA, 20 bp, Artificial Sequence
  Description of Artificial Sequence: Synthetic oligonucleotide
  Target: SCN10A; (+) strand; PAM type: NRG; PAM sequence: TGG
tagctgggtgtgatctgcaa

SEQ ID NO: 27518 - DNA, 20 bp, Artificial Sequence
  Description of Artificial Sequence: Synthetic oligonucleotide
  Target: SCN10A; (+) strand; PAM type: NRG; PAM sequence: GGG
agctgggtgtgatctgcaat

SEQ ID NO: 27519 - DNA, 20 bp, Artificial Sequence
  Description of Artificial Sequence: Synthetic oligonucleotide
  Target: SCN10A; (+) strand; PAM type: NRG; PAM sequence: AAG
gggtgtgatctgcaatggga

SEQ ID NO: 27520 - DNA, 20 bp, Artificial Sequence
  Description of Artificial Sequence: Synthetic oligonucleotide
  Target: SCN10A; (+) strand; PAM type: NRG; PAM sequence: GAG
gtgtgatctgcaatgggaaa

SEQ ID NO: 27521 - DNA, 20 bp, Artificial Sequence
  Description of Artificial Sequence: Synthetic oligonucleotide
  Target: SCN10A; (+) strand; PAM type: NRG; PAM sequence: CAG
gcaatgggaaagagttaaca

SEQ ID NO: 27522 - DNA, 20 bp, Artificial Sequence
  Description of Artificial Sequence: Synthetic oligonucleotide
  Target: SCN10A; (+) strand; PAM type: NRG; PAM sequence: GAG
aatgggaaagagttaacaca

SEQ ID NO: 27523 - DNA, 20 bp, Artificial Sequence
  Description of Artificial Sequence: Synthetic oligonucleotide
  Target: SCN10A; (+) strand; PAM type: NRG; PAM sequence: CAG
gggaaagagttaacacagag

SEQ ID NO: 27524 - DNA, 20 bp, Artificial Sequence
  Description of Artificial Sequence: Synthetic oligonucleotide
  Target: SCN10A; (+) strand; PAM type: NRG; PAM sequence: AAG
aaagagttaacacagagcag

SEQ ID NO: 27525 - DNA, 20 bp, Artificial Sequence
  Description of Artificial Sequence: Synthetic oligonucleotide
  Target: SCN10A; (+) strand; PAM type: NRG; PAM sequence: AGG
aagagttaacacagagcaga

SEQ ID NO: 27526 - DNA, 20 bp, Artificial Sequence
  Description of Artificial Sequence: Synthetic oligonucleotide
  Target: SCN10A; (+) strand; PAM type: NRG; PAM sequence: CAG
gcatcataactgaacatatc

SEQ ID NO: 27527 - DNA, 20 bp, Artificial Sequence
  Description of Artificial Sequence: Synthetic oligonucleotide
  Target: SCN10A; (+) strand; PAM type: NRG; PAM sequence: AGG
catcataactgaacatatcc

SEQ ID NO: 27528 - DNA, 20 bp, Artificial Sequence
  Description of Artificial Sequence: Synthetic oligonucleotide
  Target: SCN10A; (+) strand; PAM type: NRG; PAM sequence: TGG
ataactgaacatatccaggc

SEQ ID NO: 27529 - DNA, 20 bp, Artificial Sequence
  Description of Artificial Sequence: Synthetic oligonucleotide
  Target: SCN10A; (+) strand; PAM type: NRG; PAM sequence: GAG
aactgaacatatccaggctg

SEQ ID NO: 27530 - DNA, 20 bp, Artificial Sequence
  Description of Artificial Sequence: Synthetic oligonucleotide
  Target: SCN10A; (+) strand; PAM type: NRG; PAM sequence: TAG
ccaggctggagtgttctcac

SEQ ID NO: 27531 - DNA, 20 bp, Artificial Sequence
  Description of Artificial Sequence: Synthetic oligonucleotide
  Target: SCN10A; (+) strand; PAM type: NRG; PAM sequence: AGG
caggctggagtgttctcact

SEQ ID NO: 27532 - DNA, 20 bp, Artificial Sequence
  Description of Artificial Sequence: Synthetic oligonucleotide
  Target: SCN10A; (+) strand; PAM type: NRG; PAM sequence: GGG
aggctggagtgttctcacta

SEQ ID NO: 27533 - DNA, 20 bp, Artificial Sequence
  Description of Artificial Sequence: Synthetic oligonucleotide
  Target: SCN10A; (+) strand; PAM type: NRG; PAM sequence: CAG
ggagtgttctcactagggcc

SEQ ID NO: 27534 - DNA, 20 bp, Artificial Sequence
  Description of Artificial Sequence: Synthetic oligonucleotide
  Target: SCN10A; (+) strand; PAM type: NRG; PAM sequence: AGG
gagtgttctcactagggccc

SEQ ID NO: 27535 - DNA, 20 bp, Artificial Sequence
  Description of Artificial Sequence: Synthetic oligonucleotide
  Target: SCN10A; (+) strand; PAM type: NRG; PAM sequence: GGG
agtgttctcactagggccca

SEQ ID NO: 27536 - DNA, 20 bp, Artificial Sequence
  Description of Artificial Sequence: Synthetic oligonucleotide
  Target: SCN10A; (+) strand; PAM type: NRG; PAM sequence: GGG
gtgttctcactagggcccag

SEQ ID NO: 27537 - DNA, 20 bp, Artificial Sequence
  Description of Artificial Sequence: Synthetic oligonucleotide
  Target: SCN10A; (+) strand; PAM type: NRG; PAM sequence: CAG
cactagggcccaggggcaat

SEQ ID NO: 27538 - DNA, 20 bp, Artificial Sequence
  Description of Artificial Sequence: Synthetic oligonucleotide
  Target: SCN10A; (+) strand; PAM type: NRG; PAM sequence: TGG
aggggcaatcagctccatac

SEQ ID NO: 27539 - DNA, 20 bp, Artificial Sequence
  Description of Artificial Sequence: Synthetic oligonucleotide
  Target: SCN10A; (+) strand; PAM type: NRG; PAM sequence: TGG
ggcaatcagctccatactgg

SEQ ID NO: 27540 - DNA, 20 bp, Artificial Sequence
  Description of Artificial Sequence: Synthetic oligonucleotide
  Target: SCN10A; (+) strand; PAM type: NRG; PAM sequence: GAG
cttcatcttcattttgtatt

SEQ ID NO: 27541 - DNA, 20 bp, Artificial Sequence
  Description of Artificial Sequence: Synthetic oligonucleotide
  Target: SCN10A; (+) strand; PAM type: NRG; PAM sequence: TAG
atcttcattttgtattgagc

SEQ ID NO: 27542 - DNA, 20 bp, Artificial Sequence
  Description of Artificial Sequence: Synthetic oligonucleotide
  Target: SCN10A; (+) strand; PAM type: NRG; PAM sequence: AAG
ctcatgttgactctatcact

SEQ ID NO: 27543 - DNA, 20 bp, Artificial Sequence
  Description of Artificial Sequence: Synthetic oligonucleotide
  Target: SCN10A; (+) strand; PAM type: NRG; PAM sequence: AGG
tcatgttgactctatcacta

SEQ ID NO: 27544 - DNA, 20 bp, Artificial Sequence
  Description of Artificial Sequence: Synthetic oligonucleotide
  Target: SCN10A; (+) strand; PAM type: NRG; PAM sequence: TAG
gactctatcactaaggcctc

SEQ ID NO: 27545 - DNA, 20 bp, Artificial Sequence
  Description of Artificial Sequence: Synthetic oligonucleotide
  Target: SCN10A; (+) strand; PAM type: NRG; PAM sequence: TAG
ggcctctagtgacactctca

SEQ ID NO: 27546 - DNA, 20 bp, Artificial Sequence
  Description of Artificial Sequence: Synthetic oligonucleotide
  Target: SCN10A; (+) strand; PAM type: NRG; PAM sequence: AGG
gcctctagtgacactctcat

SEQ ID NO: 27547 - DNA, 20 bp, Artificial Sequence
  Description of Artificial Sequence: Synthetic oligonucleotide
  Target: SCN10A; (+) strand; PAM type: NRG; PAM sequence: CGG
ctagtgacactctcatagga

SEQ ID NO: 27548 - DNA, 20 bp, Artificial Sequence
  Description of Artificial Sequence: Synthetic oligonucleotide
  Target: SCN10A; (+) strand; PAM type: NRG; PAM sequence: TGG
gtgacactctcataggacgg

SEQ ID NO: 27549 - DNA, 20 bp, Artificial Sequence
  Description of Artificial Sequence: Synthetic oligonucleotide
  Target: SCN10A; (+) strand; PAM type: NRG; PAM sequence: GGG
tgacactctcataggacggt

SEQ ID NO: 27550 - DNA, 20 bp, Artificial Sequence
  Description of Artificial Sequence: Synthetic oligonucleotide
  Target: SCN10A; (+) strand; PAM type: NRG; PAM sequence: TGG
ataggacggtgggaatgatg

SEQ ID NO: 27551 - DNA, 20 bp, Artificial Sequence
  Description of Artificial Sequence: Synthetic oligonucleotide
  Target: SCN10A; (+) strand; PAM type: NRG; PAM sequence: CAG
ggacggtgggaatgatgtgg

SEQ ID NO: 27552 - DNA, 20 bp, Artificial Sequence
  Description of Artificial Sequence: Synthetic oligonucleotide
  Target: SCN10A; (+) strand; PAM type: NRG; PAM sequence: AAG
cggtgggaatgatgtggcag

SEQ ID NO: 27553 - DNA, 20 bp, Artificial Sequence
  Description of Artificial Sequence: Synthetic oligonucleotide
  Target: SCN10A; (+) strand; PAM type: NRG; PAM sequence: CAG
tgggaatgatgtggcagaag

SEQ ID NO: 27554 - DNA, 20 bp, Artificial Sequence
  Description of Artificial Sequence: Synthetic oligonucleotide
  Target: SCN10A; (+) strand; PAM type: NRG; PAM sequence: CAG
tgatgtggcagaagcagttt

SEQ ID NO: 27555 - DNA, 20 bp, Artificial Sequence
  Description of Artificial Sequence: Synthetic oligonucleotide
  Target: SCN10A; (+) strand; PAM type: NRG; PAM sequence: TGG
gaagcagtttcagatttgtc

SEQ ID NO: 27556 - DNA, 20 bp, Artificial Sequence
  Description of Artificial Sequence: Synthetic oligonucleotide
  Target: SCN10A; (+) strand; PAM type: NRG; PAM sequence: GGG
aagcagtttcagatttgtct

SEQ ID NO: 27557 - DNA, 20 bp, Artificial Sequence
  Description of Artificial Sequence: Synthetic oligonucleotide
  Target: SCN10A; (+) strand; PAM type: NRG; PAM sequence: GAG
gcagtttcagatttgtctgg

SEQ ID NO: 27558 - DNA, 20 bp, Artificial Sequence
  Description of Artificial Sequence: Synthetic oligonucleotide
  Target: SCN10A; (+) strand; PAM type: NRG; PAM sequence: TGG
aatgcaacaaaaccttcatc

SEQ ID NO: 27559 - DNA, 20 bp, Artificial Sequence
  Description of Artificial Sequence: Synthetic oligonucleotide
  Target: SCN10A; (+) strand; PAM type: NRG; PAM sequence: GGG
atgcaacaaaaccttcatct

SEQ ID NO: 27560 - DNA, 20 bp, Artificial Sequence
  Description of Artificial Sequence: Synthetic oligonucleotide
  Target: SCN10A; (+) strand; PAM type: NRG; PAM sequence: GAG
gcaacaaaaccttcatctgg

SEQ ID NO: 27561 - DNA, 20 bp, Artificial Sequence
  Description of Artificial Sequence: Synthetic oligonucleotide
  Target: SCN10A; (+) strand; PAM type: NRG; PAM sequence: CAG
accttcatctgggagtgatg

SEQ ID NO: 27562 - DNA, 20 bp, Artificial Sequence
  Description of Artificial Sequence: Synthetic oligonucleotide
  Target: SCN10A; (+) strand; PAM type: NRG; PAM sequence: CAG
gagtgatgcagcctcctcct

SEQ ID NO: 27563 - DNA, 20 bp, Artificial Sequence
  Description of Artificial Sequence: Synthetic oligonucleotide
  Target: SCN10A; (+) strand; PAM type: NRG; PAM sequence: TGG
tgcagcctcctcctcagctc

SEQ ID NO: 27564 - DNA, 20 bp, Artificial Sequence
  Description of Artificial Sequence: Synthetic oligonucleotide
  Target: SCN10A; (+) strand; PAM type: NRG; PAM sequence: GGG
gcagcctcctcctcagctct

SEQ ID NO: 27565 - DNA, 20 bp, Artificial Sequence
  Description of Artificial Sequence: Synthetic oligonucleotide
  Target: SCN10A; (+) strand; PAM type: NRG; PAM sequence: TGG
tcctcagctctgggcacaca

SEQ ID NO: 27566 - DNA, 20 bp, Artificial Sequence
  Description of Artificial Sequence: Synthetic oligonucleotide
  Target: SCN10A; (+) strand; PAM type: NRG; PAM sequence: GGG
cctcagctctgggcacacat

SEQ ID NO: 27567 - DNA, 20 bp, Artificial Sequence
  Description of Artificial Sequence: Synthetic oligonucleotide
  Target: SCN10A; (+) strand; PAM type: NRG; PAM sequence: GGG
ctcagctctgggcacacatg

SEQ ID NO: 27568 - DNA, 20 bp, Artificial Sequence
  Description of Artificial Sequence: Synthetic oligonucleotide
  Target: SCN10A; (+) strand; PAM type: NRG; PAM sequence: TAG
tctgggcacacatggggtgt

SEQ ID NO: 27569 - DNA, 20 bp, Artificial Sequence
  Description of Artificial Sequence: Synthetic oligonucleotide
  Target: SCN10A; (+) strand; PAM type: NRG; PAM sequence: GAG
tgggcacacatggggtgtta

SEQ ID NO: 27570 - DNA, 20 bp, Artificial Sequence
  Description of Artificial Sequence: Synthetic oligonucleotide
  Target: SCN10A; (+) strand; PAM type: NRG; PAM sequence: GAG
ggcacacatggggtgttaga

SEQ ID NO: 27571 - DNA, 20 bp, Artificial Sequence
  Description of Artificial Sequence: Synthetic oligonucleotide
  Target: SCN10A; (+) strand; PAM type: NRG; PAM sequence: TGG
tggggtgttagagagtgcca

SEQ ID NO: 27572 - DNA, 20 bp, Artificial Sequence
  Description of Artificial Sequence: Synthetic oligonucleotide
  Target: SCN10A; (+) strand; PAM type: NRG; PAM sequence: GAG
gggtgttagagagtgccatg

SEQ ID NO: 27573 - DNA, 20 bp, Artificial Sequence
  Description of Artificial Sequence: Synthetic oligonucleotide
  Target: SCN10A; (+) strand; PAM type: NRG; PAM sequence: CGG
tgttagagagtgccatggag

SEQ ID NO: 27574 - DNA, 20 bp, Artificial Sequence
  Description of Artificial Sequence: Synthetic oligonucleotide
  Target: SCN10A; (+) strand; PAM type: NRG; PAM sequence: CAG
gagagtgccatggagcggtg

SEQ ID NO: 27575 - DNA, 20 bp, Artificial Sequence
  Description of Artificial Sequence: Synthetic oligonucleotide
  Target: SCN10A; (+) strand; PAM type: NRG; PAM sequence: TAG
ccatggagcggtgcagcaca

SEQ ID NO: 27576 - DNA, 20 bp, Artificial Sequence
  Description of Artificial Sequence: Synthetic oligonucleotide
  Target: SCN10A; (+) strand; PAM type: NRG; PAM sequence: TAG
ggtgcagcacatagctccga

SEQ ID NO: 27577 - DNA, 20 bp, Artificial Sequence
  Description of Artificial Sequence: Synthetic oligonucleotide
  Target: SCN10A; (+) strand; PAM type: NRG; PAM sequence: AGG
gtgcagcacatagctccgat

SEQ ID NO: 27578 - DNA, 20 bp, Artificial Sequence
  Description of Artificial Sequence: Synthetic oligonucleotide
  Target: SCN10A; (+) strand; PAM type: NRG; PAM sequence: CAG
ccgataggccttttgaatga

SEQ ID NO: 27579 - DNA, 20 bp, Artificial Sequence
  Description of Artificial Sequence: Synthetic oligonucleotide
  Target: SCN10A; (+) strand; PAM type: NRG; PAM sequence: TGG
ataggccttttgaatgacag

SEQ ID NO: 27580 - DNA, 20 bp, Artificial Sequence
  Description of Artificial Sequence: Synthetic oligonucleotide
  Target: SCN10A; (+) strand; PAM type: NRG; PAM sequence: CGG
aaatgtcttcttgcttccat

SEQ ID NO: 27581 - DNA, 20 bp, Artificial Sequence
  Description of Artificial Sequence: Synthetic oligonucleotide
  Target: SCN10A; (+) strand; PAM type: NRG; PAM sequence: GAG
atgtcttcttgcttccatcg

SEQ ID NO: 27582 - DNA, 20 bp, Artificial Sequence
  Description of Artificial Sequence: Synthetic oligonucleotide
  Target: SCN10A; (+) strand; PAM type: NRG; PAM sequence: GAG
gtcttcttgcttccatcgga

SEQ ID NO: 27583 - DNA, 20 bp, Artificial Sequence
  Description of Artificial Sequence: Synthetic oligonucleotide
  Target: SCN10A; (+) strand; PAM type: NRG; PAM sequence: TGG
ttcttgcttccatcggagag

SEQ ID NO: 27584 - DNA, 20 bp, Artificial Sequence
  Description of Artificial Sequence: Synthetic oligonucleotide
  Target: SCN10A; (+) strand; PAM type: NRG; PAM sequence: TGG
catcggagagtggttgctat

SEQ ID NO: 27585 - DNA, 20 bp, Artificial Sequence
  Description of Artificial Sequence: Synthetic oligonucleotide
  Target: SCN10A; (+) strand; PAM type: NRG; PAM sequence: TAG
gagtggttgctattggttca

SEQ ID NO: 27586 - DNA, 20 bp, Artificial Sequence
  Description of Artificial Sequence: Synthetic oligonucleotide
  Target: SCN10A; (+) strand; PAM type: NRG; PAM sequence: AGG
agtggttgctattggttcat

SEQ ID NO: 27587 - DNA, 20 bp, Artificial Sequence
  Description of Artificial Sequence: Synthetic oligonucleotide
  Target: SCN10A; (+) strand; PAM type: NRG; PAM sequence: AAG
ggttcataggatgattttga

SEQ ID NO: 27588 - DNA, 20 bp, Artificial Sequence
  Description of Artificial Sequence: Synthetic oligonucleotide
  Target: SCN10A; (+) strand; PAM type: NRG; PAM sequence: TAG
ataggatgattttgaaagat

SEQ ID NO: 27589 - DNA, 20 bp, Artificial Sequence
  Description of Artificial Sequence: Synthetic oligonucleotide
  Target: SCN10A; (+) strand; PAM type: NRG; PAM sequence: CAG
ttctcctccatatttgcctt

SEQ ID NO: 27590 - DNA, 20 bp, Artificial Sequence
  Description of Artificial Sequence: Synthetic oligonucleotide
  Target: SCN10A; (+) strand; PAM type: NRG; PAM sequence: GAG
ctcctccatatttgccttca

SEQ ID NO: 27591 - DNA, 20 bp, Artificial Sequence
  Description of Artificial Sequence: Synthetic oligonucleotide
  Target: SCN10A; (+) strand; PAM type: NRG; PAM sequence: CGG
cttcagagaatccaactccc

SEQ ID NO: 27592 - DNA, 20 bp, Artificial Sequence
  Description of Artificial Sequence: Synthetic oligonucleotide
  Target: SCN10A; (+) strand; PAM type: NRG; PAM sequence: TAG
tccaactccccggattctcc

SEQ ID NO: 27593 - DNA, 20 bp, Artificial Sequence
  Description of Artificial Sequence: Synthetic oligonucleotide
  Target: SCN10A; (+) strand; PAM type: NRG; PAM sequence: AGG
ccaactccccggattctcct

SEQ ID NO: 27594 - DNA, 20 bp, Artificial Sequence
  Description of Artificial Sequence: Synthetic oligonucleotide
  Target: SCN10A; (+) strand; PAM type: NRG; PAM sequence: TGG
ggattctcctaggacattct

SEQ ID NO: 27595 - DNA, 20 bp, Artificial Sequence
  Description of Artificial Sequence: Synthetic oligonucleotide
  Target: SCN10A; (+) strand; PAM type: NRG; PAM sequence: AAG
tcctaggacattcttggtga

SEQ ID NO: 27596 - DNA, 20 bp, Artificial Sequence
  Description of Artificial Sequence: Synthetic oligonucleotide
  Target: SCN10A; (+) strand; PAM type: NRG; PAM sequence: AAG
acattcttggtgaaagcaaa

SEQ ID NO: 27597 - DNA, 20 bp, Artificial Sequence
  Description of Artificial Sequence: Synthetic oligonucleotide
  Target: SCN10A; (+) strand; PAM type: NRG; PAM sequence: AGG
cattcttggtgaaagcaaaa

SEQ ID NO: 27598 - DNA, 20 bp, Artificial Sequence
  Description of Artificial Sequence: Synthetic oligonucleotide
  Target: SCN10A; (+) strand; PAM type: NRG; PAM sequence: AAG
tgaaagcaaaaaggatgtcc

SEQ ID NO: 27599 - DNA, 20 bp, Artificial Sequence
  Description of Artificial Sequence: Synthetic oligonucleotide
  Target: SCN10A; (+) strand; PAM type: NRG; PAM sequence: CAG
aagcaaaaaggatgtccaag

SEQ ID NO: 27600 - DNA, 20 bp, Artificial Sequence
  Description of Artificial Sequence: Synthetic oligonucleotide
  Target: SCN10A; (+) strand; PAM type: NRG; PAM sequence: TGG
caaaaaggatgtccaagcag

SEQ ID NO: 27601 - DNA, 20 bp, Artificial Sequence
  Description of Artificial Sequence: Synthetic oligonucleotide
  Target: SCN10A; (+) strand; PAM type: NRG; PAM sequence: CAG
caagcagtggatcttatctc

SEQ ID NO: 27602 - DNA, 20 bp, Artificial Sequence
  Description of Artificial Sequence: Synthetic oligonucleotide
  Target: SCN10A; (+) strand; PAM type: NRG; PAM sequence: AGG
aagcagtggatcttatctcc

SEQ ID NO: 27603 - DNA, 20 bp, Artificial Sequence
  Description of Artificial Sequence: Synthetic oligonucleotide
  Target: SCN10A; (+) strand; PAM type: NRG; PAM sequence: GGG
agcagtggatcttatctcca

SEQ ID NO: 27604 - DNA, 20 bp, Artificial Sequence
  Description of Artificial Sequence: Synthetic oligonucleotide
  Target: SCN10A; (+) strand; PAM type: NRG; PAM sequence: AAG
gatcttatctccagggacca

SEQ ID NO: 27605 - DNA, 20 bp, Artificial Sequence
  Description of Artificial Sequence: Synthetic oligonucleotide
  Target: SCN10A; (+) strand; PAM type: NRG; PAM sequence: AGG
atcttatctccagggaccaa

SEQ ID NO: 27606 - DNA, 20 bp, Artificial Sequence
  Description of Artificial Sequence: Synthetic oligonucleotide
  Target: SCN10A; (+) strand; PAM type: NRG; PAM sequence: CAG
ttatctccagggaccaaagg

SEQ ID NO: 27607 - DNA, 20 bp, Artificial Sequence
  Description of Artificial Sequence: Synthetic oligonucleotide
  Target: SCN10A; (+) strand; PAM type: NRG; PAM sequence: AGG
tatctccagggaccaaaggc

SEQ ID NO: 27608 - DNA, 20 bp, Artificial Sequence
  Description of Artificial Sequence: Synthetic oligonucleotide
  Target: SCN10A; (+) strand; PAM type: NRG; PAM sequence: TGG
ggaccaaaggcaggtccatc

SEQ ID NO: 27609 - DNA, 20 bp, Artificial Sequence
  Description of Artificial Sequence: Synthetic oligonucleotide
  Target: SCN10A; (+) strand; PAM type: NRG; PAM sequence: CAG
aaaggcaggtccatctggat

SEQ ID NO: 27610 - DNA, 20 bp, Artificial Sequence
  Description of Artificial Sequence: Synthetic oligonucleotide
  Target: SCN10A; (+) strand; PAM type: NRG; PAM sequence: TGG
ctggatcagtatatttcgat

SEQ ID NO: 27611 - DNA, 20 bp, Artificial Sequence
  Description of Artificial Sequence: Synthetic oligonucleotide
  Target: SCN10A; (+) strand; PAM type: NRG; PAM sequence: GGG
tggatcagtatatttcgatt

SEQ ID NO: 27612 - DNA, 20 bp, Artificial Sequence
  Description of Artificial Sequence: Synthetic oligonucleotide
  Target: SCN10A; (+) strand; PAM type: NRG; PAM sequence: TGG
agtatatttcgattgggttt

SEQ ID NO: 27613 - DNA, 20 bp, Artificial Sequence
  Description of Artificial Sequence: Synthetic oligonucleotide
  Target: SCN10A; (+) strand; PAM type: NRG; PAM sequence: GGG
gtatatttcgattgggtttt

SEQ ID NO: 27614 - DNA, 20 bp, Artificial Sequence
  Description of Artificial Sequence: Synthetic oligonucleotide
  Target: SCN10A; (+) strand; PAM type: NRG; PAM sequence: CAG
cgattgggttttgggattct

SEQ ID NO: 27615 - DNA, 20 bp, Artificial Sequence
  Description of Artificial Sequence: Synthetic oligonucleotide
  Target: SCN10A; (+) strand; PAM type: NRG; PAM sequence: AGG
gattgggttttgggattctc

SEQ ID NO: 27616 - DNA, 20 bp, Artificial Sequence
  Description of Artificial Sequence: Synthetic oligonucleotide
  Target: SCN10A; (+) strand; PAM type: NRG; PAM sequence: GGG
attgggttttgggattctca

SEQ ID NO: 27617 - DNA, 20 bp, Artificial Sequence
  Description of Artificial Sequence: Synthetic oligonucleotide
  Target: SCN10A; (+) strand; PAM type: NRG; PAM sequence: GGG
ttgggttttgggattctcag

SEQ ID NO: 27618 - DNA, 20 bp, Artificial Sequence
  Description of Artificial Sequence: Synthetic oligonucleotide
  Target: SCN10A; (+) strand; PAM type: NRG; PAM sequence: CAG
ttttgggattctcaggggac

SEQ ID NO: 27619 - DNA, 20 bp, Artificial Sequence
  Description of Artificial Sequence: Synthetic oligonucleotide
  Target: SCN10A; (+) strand; PAM type: NRG; PAM sequence: GAG
ttgggattctcaggggacca

SEQ ID NO: 27620 - DNA, 20 bp, Artificial Sequence
  Description of Artificial Sequence: Synthetic oligonucleotide
  Target: SCN10A; (+) strand; PAM type: NRG; PAM sequence: GAG
gggattctcaggggaccaga

SEQ ID NO: 27621 - DNA, 20 bp, Artificial Sequence
  Description of Artificial Sequence: Synthetic oligonucleotide
  Target: SCN10A; (+) strand; PAM type: NRG; PAM sequence: GAG
gattctcaggggaccagaga

SEQ ID NO: 27622 - DNA, 20 bp, Artificial Sequence
  Description of Artificial Sequence: Synthetic oligonucleotide
  Target: SCN10A; (+) strand; PAM type: NRG; PAM sequence: AAG
gaccagagagagtgtctgca

SEQ ID NO: 27623 - DNA, 20 bp, Artificial Sequence
  Description of Artificial Sequence: Synthetic oligonucleotide
  Target: SCN10A; (+) strand; PAM type: NRG; PAM sequence: GAG
agagagtgtctgcaaagtcc

SEQ ID NO: 27624 - DNA, 20 bp, Artificial Sequence
  Description of Artificial Sequence: Synthetic oligonucleotide
  Target: SCN10A; (+) strand; PAM type: NRG; PAM sequence: GAG
agagtgtctgcaaagtccga

SEQ ID NO: 27625 - DNA, 20 bp, Artificial Sequence
  Description of Artificial Sequence: Synthetic oligonucleotide
  Target: SCN10A; (+) strand; PAM type: NRG; PAM sequence: GAG
agtgtctgcaaagtccgaga

SEQ ID NO: 27626 - DNA, 20 bp, Artificial Sequence
  Description of Artificial Sequence: Synthetic oligonucleotide
  Target: SCN10A; (+) strand; PAM type: NRG; PAM sequence: CAG
gtctgcaaagtccgagagag

SEQ ID NO: 27627 - DNA, 20 bp, Artificial Sequence
  Description of Artificial Sequence: Synthetic oligonucleotide
  Target: SCN10A; (+) strand; PAM type: NRG; PAM sequence: AAG
caaagtccgagagagcagaa

SEQ ID NO: 27628 - DNA, 20 bp, Artificial Sequence
  Description of Artificial Sequence: Synthetic oligonucleotide
  Target: SCN10A; (+) strand; PAM type: NRG; PAM sequence: AGG
aaagtccgagagagcagaaa

SEQ ID NO: 27629 - DNA, 20 bp, Artificial Sequence
  Description of Artificial Sequence: Synthetic oligonucleotide
  Target: SCN10A; (+) strand; PAM type: NRG; PAM sequence: GAG
agcagaaaaggtaataaact

SEQ ID NO: 27630 - DNA, 20 bp, Artificial Sequence
  Description of Artificial Sequence: Synthetic oligonucleotide
  Target: SCN10A; (+) strand; PAM type: NRG; PAM sequence: TGG
agaaaaggtaataaactgag

SEQ ID NO: 27631 - DNA, 20 bp, Artificial Sequence
  Description of Artificial Sequence: Synthetic oligonucleotide
  Target: SCN10A; (+) strand; PAM type: NRG; PAM sequence: TGG
gtaataaactgagtggcctc

SEQ ID NO: 27632 - DNA, 20 bp, Artificial Sequence
  Description of Artificial Sequence: Synthetic oligonucleotide
  Target: SCN10A; (+) strand; PAM type: NRG; PAM sequence: GGG
taataaactgagtggcctct

SEQ ID NO: 27633 - DNA, 20 bp, Artificial Sequence
  Description of Artificial Sequence: Synthetic oligonucleotide
  Target: SCN10A; (+) strand; PAM type: NRG; PAM sequence: CAG
cctctgggtcaaacttctcc

SEQ ID NO: 27634 - DNA, 20 bp, Artificial Sequence
  Description of Artificial Sequence: Synthetic oligonucleotide
  Target: SCN10A; (+) strand; PAM type: NRG; PAM sequence: AGG
ctctgggtcaaacttctccc

SEQ ID NO: 27635 - DNA, 20 bp, Artificial Sequence
  Description of Artificial Sequence: Synthetic oligonucleotide
  Target: SCN10A; (+) strand; PAM type: NRG; PAM sequence: TAG
caaacttctcccaggtctca

SEQ ID NO: 27636 - DNA, 20 bp, Artificial Sequence
  Description of Artificial Sequence: Synthetic oligonucleotide
  Target: SCN10A; (+) strand; PAM type: NRG; PAM sequence: AAG
aggtctcatagaacatgtca

SEQ ID NO: 27637 - DNA, 20 bp, Artificial Sequence
  Description of Artificial Sequence: Synthetic oligonucleotide
  Target: SCN10A; (+) strand; PAM type: NRG; PAM sequence: CAG
atgtcaaagtcgtcctcact

SEQ ID NO: 27638 - DNA, 20 bp, Artificial Sequence
  Description of Artificial Sequence: Synthetic oligonucleotide
  Target: SCN10A; (+) strand; PAM type: NRG; PAM sequence: AGG
tgtcaaagtcgtcctcactc

SEQ ID NO: 27639 - DNA, 20 bp, Artificial Sequence
  Description of Artificial Sequence: Synthetic oligonucleotide
  Target: SCN10A; (+) strand; PAM type: NRG; PAM sequence: GGG
gtcaaagtcgtcctcactca

SEQ ID NO: 27640 - DNA, 20 bp, Artificial Sequence
  Description of Artificial Sequence: Synthetic oligonucleotide
  Target: SCN10A; (+) strand; PAM type: NRG; PAM sequence: GGG
tcaaagtcgtcctcactcag

SEQ ID NO: 27641 - DNA, 20 bp, Artificial Sequence
  Description of Artificial Sequence: Synthetic oligonucleotide
  Target: SCN10A; (+) strand; PAM type: NRG; PAM sequence: CAG
gtcgtcctcactcaggggct

SEQ ID NO: 27642 - DNA, 20 bp, Artificial Sequence
  Description of Artificial Sequence: Synthetic oligonucleotide
  Target: SCN10A; (+) strand; PAM type: NRG; PAM sequence: TGG
gggctcagtgctctcctccg

SEQ ID NO: 27643 - DNA, 20 bp, Artificial Sequence
  Description of Artificial Sequence: Synthetic oligonucleotide
  Target: SCN10A; (+) strand; PAM type: NRG; PAM sequence: AAG
tctcctccgtggccacattg

SEQ ID NO: 27644 - DNA, 20 bp, Artificial Sequence
  Description of Artificial Sequence: Synthetic oligonucleotide
  Target: SCN10A; (+) strand; PAM type: NRG; PAM sequence: CAG
gtggccacattgaagttctc

SEQ ID NO: 27645 - DNA, 20 bp, Artificial Sequence
  Description of Artificial Sequence: Synthetic oligonucleotide
  Target: SCN10A; (+) strand; PAM type: NRG; PAM sequence: GAG
atgtacatgttgaccatgat

SEQ ID NO: 27646 - DNA, 20 bp, Artificial Sequence
  Description of Artificial Sequence: Synthetic oligonucleotide
  Target: SCN10A; (+) strand; PAM type: NRG; PAM sequence: AGG
tgtacatgttgaccatgatg

SEQ ID NO: 27647 - DNA, 20 bp, Artificial Sequence
  Description of Artificial Sequence: Synthetic oligonucleotide
  Target: SCN10A; (+) strand; PAM type: NRG; PAM sequence: AAG
acatgttgaccatgatgagg

SEQ ID NO: 27648 - DNA, 20 bp, Artificial Sequence
  Description of Artificial Sequence: Synthetic oligonucleotide
  Target: SCN10A; (+) strand; PAM type: NRG; PAM sequence: AGG
catgttgaccatgatgagga

SEQ ID NO: 27649 - DNA, 20 bp, Artificial Sequence
  Description of Artificial Sequence: Synthetic oligonucleotide
  Target: SCN10A; (+) strand; PAM type: NRG; PAM sequence: GAG
tgttgaccatgatgaggaag

SEQ ID NO: 27650 - DNA, 20 bp, Artificial Sequence
  Description of Artificial Sequence: Synthetic oligonucleotide
  Target: SCN10A; (+) strand; PAM type: NRG; PAM sequence: TAG
tgaggaaggagatgatgatg

SEQ ID NO: 27651 - DNA, 20 bp, Artificial Sequence
  Description of Artificial Sequence: Synthetic oligonucleotide
  Target: SCN10A; (+) strand; PAM type: NRG; PAM sequence: AGG
gaggaaggagatgatgatgt

SEQ ID NO: 27652 - DNA, 20 bp, Artificial Sequence
  Description of Artificial Sequence: Synthetic oligonucleotide
  Target: SCN10A; (+) strand; PAM type: NRG; PAM sequence: TGG
gaaggagatgatgatgtagg

SEQ ID NO: 27653 - DNA, 20 bp, Artificial Sequence
  Description of Artificial Sequence: Synthetic oligonucleotide
  Target: SCN10A; (+) strand; PAM type: NRG; PAM sequence: AAG
agatgatgatgtaggtggtg

SEQ ID NO: 27654 - DNA, 20 bp, Artificial Sequence
  Description of Artificial Sequence: Synthetic oligonucleotide
  Target: SCN10A; (+) strand; PAM type: NRG; PAM sequence: AAG
tgatgatgtaggtggtgaag

SEQ ID NO: 27655 - DNA, 20 bp, Artificial Sequence
  Description of Artificial Sequence: Synthetic oligonucleotide
  Target: SCN10A; (+) strand; PAM type: NRG; PAM sequence: CGG
ggtgaagaagatgatgccta

SEQ ID NO: 27656 - DNA, 20 bp, Artificial Sequence
  Description of Artificial Sequence: Synthetic oligonucleotide
  Target: SCN10A; (+) strand; PAM type: NRG; PAM sequence: TGG
aagaagatgatgcctacggc

SEQ ID NO: 27657 - DNA, 20 bp, Artificial Sequence
  Description of Artificial Sequence: Synthetic oligonucleotide
  Target: SCN10A; (+) strand; PAM type: NRG; PAM sequence: GGG
agaagatgatgcctacggct

SEQ ID NO: 27658 - DNA, 20 bp, Artificial Sequence
  Description of Artificial Sequence: Synthetic oligonucleotide
  Target: SCN10A; (+) strand; PAM type: NRG; PAM sequence: CAG
tgcctacggctgggctccca

SEQ ID NO: 27659 - DNA, 20 bp, Artificial Sequence
  Description of Artificial Sequence: Synthetic oligonucleotide
  Target: SCN10A; (+) strand; PAM type: NRG; PAM sequence: TGG
tgggctcccacagtcccctc

SEQ ID NO: 27660 - DNA, 20 bp, Artificial Sequence
  Description of Artificial Sequence: Synthetic oligonucleotide
  Target: SCN10A; (+) strand; PAM type: NRG; PAM sequence: TGG
ccctctggtgccattgctgt

SEQ ID NO: 27661 - DNA, 20 bp, Artificial Sequence
  Description of Artificial Sequence: Synthetic oligonucleotide
  Target: SCN10A; (+) strand; PAM type: NRG; PAM sequence: GGG
cctctggtgccattgctgtt

SEQ ID NO: 27662 - DNA, 20 bp, Artificial Sequence
  Description of Artificial Sequence: Synthetic oligonucleotide
  Target: SCN10A; (+) strand; PAM type: NRG; PAM sequence: CAG
ctggtgccattgctgttggg

SEQ ID NO: 27663 - DNA, 20 bp, Artificial Sequence
  Description of Artificial Sequence: Synthetic oligonucleotide
  Target: SCN10A; (+) strand; PAM type: NRG; PAM sequence: TGG
gccattgctgttgggcagat

SEQ ID NO: 27664 - DNA, 20 bp, Artificial Sequence
  Description of Artificial Sequence: Synthetic oligonucleotide
  Target: SCN10A; (+) strand; PAM type: NRG; PAM sequence: GGG
ccattgctgttgggcagatt

SEQ ID NO: 27665 - DNA, 20 bp, Artificial Sequence
  Description of Artificial Sequence: Synthetic oligonucleotide
  Target: SCN10A; (+) strand; PAM type: NRG; PAM sequence: GGG
cattgctgttgggcagattg

SEQ ID NO: 27666 - DNA, 20 bp, Artificial Sequence
  Description of Artificial Sequence: Synthetic oligonucleotide
  Target: SCN10A; (+) strand; PAM type: NRG; PAM sequence: CAG
tgttgggcagattggggtca

SEQ ID NO: 27667 - DNA, 20 bp, Artificial Sequence
  Description of Artificial Sequence: Synthetic oligonucleotide
  Target: SCN10A; (+) strand; PAM type: NRG; PAM sequence: TAG
tgggcagattggggtcacag

SEQ ID NO: 27668 - DNA, 20 bp, Artificial Sequence
  Description of Artificial Sequence: Synthetic oligonucleotide
  Target: SCN10A; (+) strand; PAM type: NRG; PAM sequence: AGG
gggcagattggggtcacagt

SEQ ID NO: 27669 - DNA, 20 bp, Artificial Sequence
  Description of Artificial Sequence: Synthetic oligonucleotide
  Target: SCN10A; (+) strand; PAM type: NRG; PAM sequence: GGG
ggcagattggggtcacagta

SEQ ID NO: 27670 - DNA, 20 bp, Artificial Sequence
  Description of Artificial Sequence: Synthetic oligonucleotide
  Target: SCN10A; (+) strand; PAM type: NRG; PAM sequence: GGG
gcagattggggtcacagtag

SEQ ID NO: 27671 - DNA, 20 bp, Artificial Sequence
  Description of Artificial Sequence: Synthetic oligonucleotide
  Target: SCN10A; (+) strand; PAM type: NRG; PAM sequence: GGG
cagattggggtcacagtagg

SEQ ID NO: 27672 - DNA, 20 bp, Artificial Sequence
  Description of Artificial Sequence: Synthetic oligonucleotide
  Target: SCN10A; (+) strand; PAM type: NRG; PAM sequence: GGG
agattggggtcacagtaggg

SEQ ID NO: 27673 - DNA, 20 bp, Artificial Sequence
  Description of Artificial Sequence: Synthetic oligonucleotide
  Target: SCN10A; (+) strand; PAM type: NRG; PAM sequence: GAG
cagtaggggggccctgtgtt

SEQ ID NO: 27674 - DNA, 20 bp, Artificial Sequence
  Description of Artificial Sequence: Synthetic oligonucleotide
  Target: SCN10A; (+) strand; PAM type: NRG; PAM sequence: AGG
agtaggggggccctgtgttg

SEQ ID NO: 27675 - DNA, 20 bp, Artificial Sequence
  Description of Artificial Sequence: Synthetic oligonucleotide
  Target: SCN10A; (+) strand; PAM type: NRG; PAM sequence: TGG
ggggggccctgtgttgagga

SEQ ID NO: 27676 - DNA, 20 bp, Artificial Sequence
  Description of Artificial Sequence: Synthetic oligonucleotide
  Target: SCN10A; (+) strand; PAM type: NRG; PAM sequence: GGG
gggggccctgtgttgaggat

SEQ ID NO: 27677 - DNA, 20 bp, Artificial Sequence
  Description of Artificial Sequence: Synthetic oligonucleotide
  Target: SCN10A; (+) strand; PAM type: NRG; PAM sequence: GGG
ggggccctgtgttgaggatg

SEQ ID NO: 27678 - DNA, 20 bp, Artificial Sequence
  Description of Artificial Sequence: Synthetic oligonucleotide
  Target: SCN10A; (+) strand; PAM type: NRG; PAM sequence: GAG
cctgtgttgaggatggggct

SEQ ID NO: 27679 - DNA, 20 bp, Artificial Sequence
  Description of Artificial Sequence: Synthetic oligonucleotide
  Target: SCN10A; (+) strand; PAM type: NRG; PAM sequence: AGG
ctgtgttgaggatggggctg

SEQ ID NO: 27680 - DNA, 20 bp, Artificial Sequence
  Description of Artificial Sequence: Synthetic oligonucleotide
  Target: SCN10A; (+) strand; PAM type: NRG; PAM sequence: GAG
gtgttgaggatggggctgag

SEQ ID NO: 27681 - DNA, 20 bp, Artificial Sequence
  Description of Artificial Sequence: Synthetic oligonucleotide
  Target: SCN10A; (+) strand; PAM type: NRG; PAM sequence: AGG
tgttgaggatggggctgagg

SEQ ID NO: 27682 - DNA, 20 bp, Artificial Sequence
  Description of Artificial Sequence: Synthetic oligonucleotide
  Target: SCN10A; (+) strand; PAM type: NRG; PAM sequence: CAG
tggggctgaggaggccatcc

SEQ ID NO: 27683 - DNA, 20 bp, Artificial Sequence
  Description of Artificial Sequence: Synthetic oligonucleotide
  Target: SCN10A; (+) strand; PAM type: NRG; PAM sequence: CGG
gctgaggaggccatcccagc

SEQ ID NO: 27684 - DNA, 20 bp, Artificial Sequence
  Description of Artificial Sequence: Synthetic oligonucleotide
  Target: SCN10A; (+) strand; PAM type: NRG; PAM sequence: TGG
gccatcccagccggccgacg

SEQ ID NO: 27685 - DNA, 20 bp, Artificial Sequence
  Description of Artificial Sequence: Synthetic oligonucleotide
  Target: SCN10A; (+) strand; PAM type: NRG; PAM sequence: TGG
agccggccgacgtggtaatc

SEQ ID NO: 27686 - DNA, 20 bp, Artificial Sequence
  Description of Artificial Sequence: Synthetic oligonucleotide
  Target: SCN10A; (+) strand; PAM type: NRG; PAM sequence: AAG
cggccgacgtggtaatctgg

SEQ ID NO: 27687 - DNA, 20 bp, Artificial Sequence
  Description of Artificial Sequence: Synthetic oligonucleotide
  Target: SCN10A; (+) strand; PAM type: NRG; PAM sequence: GAG
gccgacgtggtaatctggaa

SEQ ID NO: 27688 - DNA, 20 bp, Artificial Sequence
  Description of Artificial Sequence: Synthetic oligonucleotide
  Target: SCN10A; (+) strand; PAM type: NRG; PAM sequence: AGG
ccgacgtggtaatctggaag

SEQ ID NO: 27689 - DNA, 20 bp, Artificial Sequence
  Description of Artificial Sequence: Synthetic oligonucleotide
  Target: SCN10A; (+) strand; PAM type: NRG; PAM sequence: CAG
gtggtaatctggaagaggca

SEQ ID NO: 27690 - DNA, 20 bp, Artificial Sequence
  Description of Artificial Sequence: Synthetic oligonucleotide
  Target: SCN10A; (+) strand; PAM type: NRG; PAM sequence: TGG
gaagaggcacagcatgctgt

SEQ ID NO: 27691 - DNA, 20 bp, Artificial Sequence
  Description of Artificial Sequence: Synthetic oligonucleotide
  Target: SCN10A; (+) strand; PAM type: NRG; PAM sequence: AAG
ggcacagcatgctgttggcg

SEQ ID NO: 27692 - DNA, 20 bp, Artificial Sequence
  Description of Artificial Sequence: Synthetic oligonucleotide
  Target: SCN10A; (+) strand; PAM type: NRG; PAM sequence: AGG
gcacagcatgctgttggcga

SEQ ID NO: 27693 - DNA, 20 bp, Artificial Sequence
  Description of Artificial Sequence: Synthetic oligonucleotide
  Target: SCN10A; (+) strand; PAM type: NRG; PAM sequence: TGG
gcatgctgttggcgaaggtc

SEQ ID NO: 27694 - DNA, 20 bp, Artificial Sequence
  Description of Artificial Sequence: Synthetic oligonucleotide
  Target: SCN10A; (+) strand; PAM type: NRG; PAM sequence: AAG
tgctgttggcgaaggtctgg

SEQ ID NO: 27695 - DNA, 20 bp, Artificial Sequence
  Description of Artificial Sequence: Synthetic oligonucleotide
  Target: SCN10A; (+) strand; PAM type: NRG; PAM sequence: CAG
gttgaacatgtcgtcgatgc

SEQ ID NO: 27696 - DNA, 20 bp, Artificial Sequence
  Description of Artificial Sequence: Synthetic oligonucleotide
  Target: SCN10A; (+) strand; PAM type: NRG; PAM sequence: TGG
tgccagcctcccacctcaca

SEQ ID NO: 27697 - DNA, 20 bp, Artificial Sequence
  Description of Artificial Sequence: Synthetic oligonucleotide
  Target: SCN10A; (+) strand; PAM type: NRG; PAM sequence: GGG
gccagcctcccacctcacat

SEQ ID NO: 27698 - DNA, 20 bp, Artificial Sequence
  Description of Artificial Sequence: Synthetic oligonucleotide
  Target: SCN10A; (+) strand; PAM type: NRG; PAM sequence: GGG
ccagcctcccacctcacatg

SEQ ID NO: 27699 - DNA, 20 bp, Artificial Sequence
  Description of Artificial Sequence: Synthetic oligonucleotide
  Target: SCN10A; (+) strand; PAM type: NRG; PAM sequence: AAG
cctcccacctcacatgggga

SEQ ID NO: 27700 - DNA, 20 bp, Artificial Sequence
  Description of Artificial Sequence: Synthetic oligonucleotide
  Target: SCN10A; (+) strand; PAM type: NRG; PAM sequence: TGG
ccacctcacatggggaaagc

SEQ ID NO: 27701 - DNA, 20 bp, Artificial Sequence
  Description of Artificial Sequence: Synthetic oligonucleotide
  Target: SCN10A; (+) strand; PAM type: NRG; PAM sequence: AAG
ggggaaagctggacataccg

SEQ ID NO: 27702 - DNA, 20 bp, Artificial Sequence
  Description of Artificial Sequence: Synthetic oligonucleotide
  Target: SCN10A; (+) strand; PAM type: NRG; PAM sequence: TAG
aaagctggacataccgaaga

SEQ ID NO: 27703 - DNA, 20 bp, Artificial Sequence
  Description of Artificial Sequence: Synthetic oligonucleotide
  Target: SCN10A; (+) strand; PAM type: NRG; PAM sequence: GAG
agctggacataccgaagata

SEQ ID NO: 27704 - DNA, 20 bp, Artificial Sequence
  Description of Artificial Sequence: Synthetic oligonucleotide
  Target: SCN10A; (+) strand; PAM type: NRG; PAM sequence: TAG
tggacataccgaagatagag

SEQ ID NO: 27705 - DNA, 20 bp, Artificial Sequence
  Description of Artificial Sequence: Synthetic oligonucleotide
  Target: SCN10A; (+) strand; PAM type: NRG; PAM sequence: AAG
atagagtagatgaacatgac

SEQ ID NO: 27706 - DNA, 20 bp, Artificial Sequence
  Description of Artificial Sequence: Synthetic oligonucleotide
  Target: SCN10A; (+) strand; PAM type: NRG; PAM sequence: AGG
tagagtagatgaacatgaca

SEQ ID NO: 27707 - DNA, 20 bp, Artificial Sequence
  Description of Artificial Sequence: Synthetic oligonucleotide
  Target: SCN10A; (+) strand; PAM type: NRG; PAM sequence: TAG
tagatgaacatgacaaggaa

SEQ ID NO: 27708 - DNA, 20 bp, Artificial Sequence
  Description of Artificial Sequence: Synthetic oligonucleotide
  Target: SCN10A; (+) strand; PAM type: NRG; PAM sequence: CAG
aacatgacaaggaatagcaa

SEQ ID NO: 27709 - DNA, 20 bp, Artificial Sequence
  Description of Artificial Sequence: Synthetic oligonucleotide
  Target: SCN10A; (+) strand; PAM type: NRG; PAM sequence: AAG
atagcaacagcccgatgttg

SEQ ID NO: 27710 - DNA, 20 bp, Artificial Sequence
  Description of Artificial Sequence: Synthetic oligonucleotide
  Target: SCN10A; (+) strand; PAM type: NRG; PAM sequence: GAG
agcaacagcccgatgttgaa

SEQ ID NO: 27711 - DNA, 20 bp, Artificial Sequence
  Description of Artificial Sequence: Synthetic oligonucleotide
  Target: SCN10A; (+) strand; PAM type: NRG; PAM sequence: AGG
gcaacagcccgatgttgaag

SEQ ID NO: 27712 - DNA, 20 bp, Artificial Sequence
  Description of Artificial Sequence: Synthetic oligonucleotide
  Target: SCN10A; (+) strand; PAM type: NRG; PAM sequence: GGG
caacagcccgatgttgaaga

SEQ ID NO: 27713 - DNA, 20 bp, Artificial Sequence
  Description of Artificial Sequence: Synthetic oligonucleotide
  Target: SCN10A; (+) strand; PAM type: NRG; PAM sequence: CAG
cagcccgatgttgaagaggg

SEQ ID NO: 27714 - DNA, 20 bp, Artificial Sequence
  Description of Artificial Sequence: Synthetic oligonucleotide
  Target: SCN10A; (+) strand; PAM type: NRG; PAM sequence: AGG
agcccgatgttgaagagggc

SEQ ID NO: 27715 - DNA, 20 bp, Artificial Sequence
  Description of Artificial Sequence: Synthetic oligonucleotide
  Target: SCN10A; (+) strand; PAM type: NRG; PAM sequence: CAG
ccgatgttgaagagggcagg

SEQ ID NO: 27716 - DNA, 20 bp, Artificial Sequence
  Description of Artificial Sequence: Synthetic oligonucleotide
  Target: SCN10A; (+) strand; PAM type: NRG; PAM sequence: AGG
cgatgttgaagagggcaggc

SEQ ID NO: 27717 - DNA, 20 bp, Artificial Sequence
  Description of Artificial Sequence: Synthetic oligonucleotide
  Target: SCN10A; (+) strand; PAM type: NRG; PAM sequence: GGG
gatgttgaagagggcaggca

SEQ ID NO: 27718 - DNA, 20 bp, Artificial Sequence
  Description of Artificial Sequence: Synthetic oligonucleotide
  Target: SCN10A; (+) strand; PAM type: NRG; PAM sequence: GAG
agggcaggcagggacatcat

SEQ ID NO: 27719 - DNA, 20 bp, Artificial Sequence
  Description of Artificial Sequence: Synthetic oligonucleotide
  Target: SCN10A; (+) strand; PAM type: NRG; PAM sequence: AGG
gggcaggcagggacatcatg

SEQ ID NO: 27720 - DNA, 20 bp, Artificial Sequence
  Description of Artificial Sequence: Synthetic oligonucleotide
  Target: SCN10A; (+) strand; PAM type: NRG; PAM sequence: GGG
ggcaggcagggacatcatga

SEQ ID NO: 27721 - DNA, 20 bp, Artificial Sequence
  Description of Artificial Sequence: Synthetic oligonucleotide
  Target: SCN10A; (+) strand; PAM type: NRG; PAM sequence: AAG
gcagggacatcatgagggca

SEQ ID NO: 27722 - DNA, 20 bp, Artificial Sequence
  Description of Artificial Sequence: Synthetic oligonucleotide
  Target: SCN10A; (+) strand; PAM type: NRG; PAM sequence: GAG
agggacatcatgagggcaaa

SEQ ID NO: 27723 - DNA, 20 bp, Artificial Sequence
  Description of Artificial Sequence: Synthetic oligonucleotide
  Target: SCN10A; (+) strand; PAM type: NRG; PAM sequence: CAG
gacatcatgagggcaaagag

SEQ ID NO: 27724 - DNA, 20 bp, Artificial Sequence
  Description of Artificial Sequence: Synthetic oligonucleotide
  Target: SCN10A; (+) strand; PAM type: NRG; PAM sequence: CGG
tgagggcaaagagcagtgtg

SEQ ID NO: 27725 - DNA, 20 bp, Artificial Sequence
  Description of Artificial Sequence: Synthetic oligonucleotide
  Target: SCN10A; (+) strand; PAM type: NRG; PAM sequence: TGG
gagcagtgtgcggatcccct

SEQ ID NO: 27726 - DNA, 20 bp, Artificial Sequence
  Description of Artificial Sequence: Synthetic oligonucleotide
  Target: SCN10A; (+) strand; PAM type: NRG; PAM sequence: CGG
tgcggatccccttggccgct

SEQ ID NO: 27727 - DNA, 20 bp, Artificial Sequence
  Description of Artificial Sequence: Synthetic oligonucleotide
  Target: SCN10A; (+) strand; PAM type: NRG; PAM sequence: CAG
atccccttggccgctcggat

SEQ ID NO: 27728 - DNA, 20 bp, Artificial Sequence
  Description of Artificial Sequence: Synthetic oligonucleotide
  Target: SCN10A; (+) strand; PAM type: NRG; PAM sequence: GAG
ttggccgctcggatcagtct

SEQ ID NO: 27729 - DNA, 20 bp, Artificial Sequence
  Description of Artificial Sequence: Synthetic oligonucleotide
  Target: SCN10A; (+) strand; PAM type: NRG; PAM sequence: AGG
tggccgctcggatcagtctg

SEQ ID NO: 27730 - DNA, 20 bp, Artificial Sequence
  Description of Artificial Sequence: Synthetic oligonucleotide
  Target: SCN10A; (+) strand; PAM type: NRG; PAM sequence: CGG
ctcggatcagtctgaggatg

SEQ ID NO: 27731 - DNA, 20 bp, Artificial Sequence
  Description of Artificial Sequence: Synthetic oligonucleotide
  Target: SCN10A; (+) strand; PAM type: NRG; PAM sequence: CGG
gtctgaggatgcggccaatt

SEQ ID NO: 27732 - DNA, 20 bp, Artificial Sequence
  Description of Artificial Sequence: Synthetic oligonucleotide
  Target: SCN10A; (+) strand; PAM type: NRG; PAM sequence: GGG
tctgaggatgcggccaattc

SEQ ID NO: 27733 - DNA, 20 bp, Artificial Sequence
  Description of Artificial Sequence: Synthetic oligonucleotide
  Target: SCN10A; (+) strand; PAM type: NRG; PAM sequence: CAG
aggatgcggccaattcgggc

SEQ ID NO: 27734 - DNA, 20 bp, Artificial Sequence
  Description of Artificial Sequence: Synthetic oligonucleotide
  Target: SCN10A; (+) strand; PAM type: NRG; PAM sequence: AGG
ggatgcggccaattcgggcc

SEQ ID NO: 27735 - DNA, 20 bp, Artificial Sequence
  Description of Artificial Sequence: Synthetic oligonucleotide
  Target: SCN10A; (+) strand; PAM type: NRG; PAM sequence: CGG
tgcggccaattcgggccagg

SEQ ID NO: 27736 - DNA, 20 bp, Artificial Sequence
  Description of Artificial Sequence: Synthetic oligonucleotide
  Target: SCN10A; (+) strand; PAM type: NRG; PAM sequence: AAG
gggccaggcggatgactctg

SEQ ID NO: 27737 - DNA, 20 bp, Artificial Sequence
  Description of Artificial Sequence: Synthetic oligonucleotide
  Target: SCN10A; (+) strand; PAM type: NRG; PAM sequence: GAG
gccaggcggatgactctgaa

SEQ ID NO: 27738 - DNA, 20 bp, Artificial Sequence
  Description of Artificial Sequence: Synthetic oligonucleotide
  Target: SCN10A; (+) strand; PAM type: NRG; PAM sequence: TGG
cggatgactctgaagagcgt

SEQ ID NO: 27739 - DNA, 20 bp, Artificial Sequence
  Description of Artificial Sequence: Synthetic oligonucleotide
  Target: SCN10A; (+) strand; PAM type: NRG; PAM sequence: GGG
ggatgactctgaagagcgtt

SEQ ID NO: 27740 - DNA, 20 bp, Artificial Sequence
  Description of Artificial Sequence: Synthetic oligonucleotide
  Target: SCN10A; (+) strand; PAM type: NRG; PAM sequence: GGG
gatgactctgaagagcgttg

SEQ ID NO: 27741 - DNA, 20 bp, Artificial Sequence
  Description of Artificial Sequence: Synthetic oligonucleotide
  Target: SCN10A; (+) strand; PAM type: NRG; PAM sequence: GAG
tgactctgaagagcgttggg

SEQ ID NO: 27742 - DNA, 20 bp, Artificial Sequence
  Description of Artificial Sequence: Synthetic oligonucleotide
  Target: SCN10A; (+) strand; PAM type: NRG; PAM sequence: AAG
ctctgaagagcgttggggag

SEQ ID NO: 27743 - DNA, 20 bp, Artificial Sequence
  Description of Artificial Sequence: Synthetic oligonucleotide
  Target: SCN10A; (+) strand; PAM type: NRG; PAM sequence: AAG
gttggggagaagtaactttg

SEQ ID NO: 27744 - DNA, 20 bp, Artificial Sequence
  Description of Artificial Sequence: Synthetic oligonucleotide
  Target: SCN10A; (+) strand; PAM type: NRG; PAM sequence: AAG
aagtaactttgaagtgactt

SEQ ID NO: 27745 - DNA, 20 bp, Artificial Sequence
  Description of Artificial Sequence: Synthetic oligonucleotide
  Target: SCN10A; (+) strand; PAM type: NRG; PAM sequence: CAG
ttgaagtgacttaagaattg

SEQ ID NO: 27746 - DNA, 20 bp, Artificial Sequence
  Description of Artificial Sequence: Synthetic oligonucleotide
  Target: SCN10A; (+) strand; PAM type: NRG; PAM sequence: CAG
ttaagaattgcagaaaaaat

SEQ ID NO: 27747 - DNA, 20 bp, Artificial Sequence
  Description of Artificial Sequence: Synthetic oligonucleotide
  Target: SCN10A; (+) strand; PAM type: NRG; PAM sequence: AGG
taagaattgcagaaaaaatc

SEQ ID NO: 27748 - DNA, 20 bp, Artificial Sequence
  Description of Artificial Sequence: Synthetic oligonucleotide
  Target: SCN10A; (+) strand; PAM type: NRG; PAM sequence: AAG
agaaaaaatcaggcctttaa

SEQ ID NO: 27749 - DNA, 20 bp, Artificial Sequence
  Description of Artificial Sequence: Synthetic oligonucleotide
  Target: SCN10A; (+) strand; PAM type: NRG; PAM sequence: AAG
aaaaatcaggcctttaaaag

SEQ ID NO: 27750 - DNA, 20 bp, Artificial Sequence
  Description of Artificial Sequence: Synthetic oligonucleotide
  Target: SCN10A; (+) strand; PAM type: NRG; PAM sequence: AGG
aaaatcaggcctttaaaaga

SEQ ID NO: 27751 - DNA, 20 bp, Artificial Sequence
  Description of Artificial Sequence: Synthetic oligonucleotide
  Target: SCN10A; (+) strand; PAM type: NRG; PAM sequence: AAG
atcaggcctttaaaagaagg

SEQ ID NO: 27752 - DNA, 20 bp, Artificial Sequence
  Description of Artificial Sequence: Synthetic oligonucleotide
  Target: SCN10A; (+) strand; PAM type: NRG; PAM sequence: TAG
gaaggaagaaattatctaat

SEQ ID NO: 27753 - DNA, 20 bp, Artificial Sequence
  Description of Artificial Sequence: Synthetic oligonucleotide
  Target: SCN10A; (+) strand; PAM type: NRG; PAM sequence: CAG
aattatctaattagtatctc

SEQ ID NO: 27754 - DNA, 20 bp, Artificial Sequence
  Description of Artificial Sequence: Synthetic oligonucleotide
  Target: SCN10A; (+) strand; PAM type: NRG; PAM sequence: GAG
taattagtatctccagccat

SEQ ID NO: 27755 - DNA, 20 bp, Artificial Sequence
  Description of Artificial Sequence: Synthetic oligonucleotide
  Target: SCN10A; (+) strand; PAM type: NRG; PAM sequence: AAG
tccagccatgagacgtgaca

SEQ ID NO: 27756 - DNA, 20 bp, Artificial Sequence
  Description of Artificial Sequence: Synthetic oligonucleotide
  Target: SCN10A; (+) strand; PAM type: NRG; PAM sequence: TGG
gccatgagacgtgacaaagt

SEQ ID NO: 27757 - DNA, 20 bp, Artificial Sequence
  Description of Artificial Sequence: Synthetic oligonucleotide
  Target: SCN10A; (+) strand; PAM type: NRG; PAM sequence: TGG
tgatgacactctgctttgct

SEQ ID NO: 27758 - DNA, 20 bp, Artificial Sequence
  Description of Artificial Sequence: Synthetic oligonucleotide
  Target: SCN10A; (+) strand; PAM type: NRG; PAM sequence: TAG
acactctgctttgcttggta

SEQ ID NO: 27759 - DNA, 20 bp, Artificial Sequence
  Description of Artificial Sequence: Synthetic oligonucleotide
  Target: SCN10A; (+) strand; PAM type: NRG; PAM sequence: TGG
gcttggtatagactgccact

SEQ ID NO: 27760 - DNA, 20 bp, Artificial Sequence
  Description of Artificial Sequence: Synthetic oligonucleotide
  Target: SCN10A; (+) strand; PAM type: NRG; PAM sequence: GGG
cttggtatagactgccactt

SEQ ID NO: 27761 - DNA, 20 bp, Artificial Sequence
  Description of Artificial Sequence: Synthetic oligonucleotide
  Target: SCN10A; (+) strand; PAM type: NRG; PAM sequence: GAG
ccacttgggcatccacattt

SEQ ID NO: 27762 - DNA, 20 bp, Artificial Sequence
  Description of Artificial Sequence: Synthetic oligonucleotide
  Target: SCN10A; (+) strand; PAM type: NRG; PAM sequence: AGG
cacttgggcatccacatttg

SEQ ID NO: 27763 - DNA, 20 bp, Artificial Sequence
  Description of Artificial Sequence: Synthetic oligonucleotide
  Target: SCN10A; (+) strand; PAM type: NRG; PAM sequence: TGG
gcatccacatttgaggactc

SEQ ID NO: 27764 - DNA, 20 bp, Artificial Sequence
  Description of Artificial Sequence: Synthetic oligonucleotide
  Target: SCN10A; (+) strand; PAM type: NRG; PAM sequence: GGG
catccacatttgaggactct

SEQ ID NO: 27765 - DNA, 20 bp, Artificial Sequence
  Description of Artificial Sequence: Synthetic oligonucleotide
  Target: SCN10A; (+) strand; PAM type: NRG; PAM sequence: CAG
atttgaggactctgggccct

SEQ ID NO: 27766 - DNA, 20 bp, Artificial Sequence
  Description of Artificial Sequence: Synthetic oligonucleotide
  Target: SCN10A; (+) strand; PAM type: NRG; PAM sequence: GAG
ttgaggactctgggccctca

SEQ ID NO: 27767 - DNA, 20 bp, Artificial Sequence
  Description of Artificial Sequence: Synthetic oligonucleotide
  Target: SCN10A; (+) strand; PAM type: NRG; PAM sequence: TGG
gactctgggccctcagagcc

SEQ ID NO: 27768 - DNA, 20 bp, Artificial Sequence
  Description of Artificial Sequence: Synthetic oligonucleotide
  Target: SCN10A; (+) strand; PAM type: NRG; PAM sequence: TGG
tgggccctcagagcctggca

SEQ ID NO: 27769 - DNA, 20 bp, Artificial Sequence
  Description of Artificial Sequence: Synthetic oligonucleotide
  Target: SCN10A; (+) strand; PAM type: NRG; PAM sequence: TAG
gccctcagagcctggcatgg

SEQ ID NO: 27770 - DNA, 20 bp, Artificial Sequence
  Description of Artificial Sequence: Synthetic oligonucleotide
  Target: SCN10A; (+) strand; PAM type: NRG; PAM sequence: AGG
ccctcagagcctggcatggt

SEQ ID NO: 27771 - DNA, 20 bp, Artificial Sequence
  Description of Artificial Sequence: Synthetic oligonucleotide
  Target: SCN10A; (+) strand; PAM type: NRG; PAM sequence: TAG
tcagagcctggcatggtagg

SEQ ID NO: 27772 - DNA, 20 bp, Artificial Sequence
  Description of Artificial Sequence: Synthetic oligonucleotide
  Target: SCN10A; (+) strand; PAM type: NRG; PAM sequence: AAG
ctggcatggtaggtagcaca

SEQ ID NO: 27773 - DNA, 20 bp, Artificial Sequence
  Description of Artificial Sequence: Synthetic oligonucleotide
  Target: SCN10A; (+) strand; PAM type: NRG; PAM sequence: TAG
gcatggtaggtagcacaaag

SEQ ID NO: 27774 - DNA, 20 bp, Artificial Sequence
  Description of Artificial Sequence: Synthetic oligonucleotide
  Target: SCN10A; (+) strand; PAM type: NRG; PAM sequence: AGG
catggtaggtagcacaaagt

SEQ ID NO: 27775 - DNA, 20 bp, Artificial Sequence
  Description of Artificial Sequence: Synthetic oligonucleotide
  Target: SCN10A; (+) strand; PAM type: NRG; PAM sequence: GGG
atggtaggtagcacaaagta

SEQ ID NO: 27776 - DNA, 20 bp, Artificial Sequence
  Description of Artificial Sequence: Synthetic oligonucleotide
  Target: SCN10A; (+) strand; PAM type: NRG; PAM sequence: GGG
tggtaggtagcacaaagtag

SEQ ID NO: 27777 - DNA, 20 bp, Artificial Sequence
  Description of Artificial Sequence: Synthetic oligonucleotide
  Target: SCN10A; (+) strand; PAM type: NRG; PAM sequence: CAG
ggtagcacaaagtaggggct

SEQ ID NO: 27778 - DNA, 20 bp, Artificial Sequence
  Description of Artificial Sequence: Synthetic oligonucleotide
  Target: SCN10A; (+) strand; PAM type: NRG; PAM sequence: AAG
tcagtaaatgcccattgcat

SEQ ID NO: 27779 - DNA, 20 bp, Artificial Sequence
  Description of Artificial Sequence: Synthetic oligonucleotide
  Target: SCN10A; (+) strand; PAM type: NRG; PAM sequence: TAG
atgttatctttgcctccgcc

SEQ ID NO: 27780 - DNA, 20 bp, Artificial Sequence
  Description of Artificial Sequence: Synthetic oligonucleotide
  Target: SCN10A; (+) strand; PAM type: NRG; PAM sequence: TGG
ctccgcctagaatatcctct

SEQ ID NO: 27781 - DNA, 20 bp, Artificial Sequence
  Description of Artificial Sequence: Synthetic oligonucleotide
  Target: SCN10A; (+) strand; PAM type: NRG; PAM sequence: CAG
atcctcttggtcaacctcca

SEQ ID NO: 27782 - DNA, 20 bp, Artificial Sequence
  Description of Artificial Sequence: Synthetic oligonucleotide
  Target: SCN10A; (+) strand; PAM type: NRG; PAM sequence: CAG
agtcaaaaacttatcttctg

SEQ ID NO: 27783 - DNA, 20 bp, Artificial Sequence
  Description of Artificial Sequence: Synthetic oligonucleotide
  Target: SCN10A; (+) strand; PAM type: NRG; PAM sequence: AAG
aaaacttatcttctgcagcc

SEQ ID NO: 27784 - DNA, 20 bp, Artificial Sequence
  Description of Artificial Sequence: Synthetic oligonucleotide
  Target: SCN10A; (+) strand; PAM type: NRG; PAM sequence: CAG
ttatcttctgcagccaagtt

SEQ ID NO: 27785 - DNA, 20 bp, Artificial Sequence
  Description of Artificial Sequence: Synthetic oligonucleotide
  Target: SCN10A; (+) strand; PAM type: NRG; PAM sequence: TGG
cttctgcagccaagttcagc

SEQ ID NO: 27786 - DNA, 20 bp, Artificial Sequence
  Description of Artificial Sequence: Synthetic oligonucleotide
  Target: SCN10A; (+) strand; PAM type: NRG; PAM sequence: AAG
ctgcagccaagttcagctgg

SEQ ID NO: 27787 - DNA, 20 bp, Artificial Sequence
  Description of Artificial Sequence: Synthetic oligonucleotide
  Target: SCN10A; (+) strand; PAM type: NRG; PAM sequence: CAG
agttcagctggaagtgactg

SEQ ID NO: 27788 - DNA, 20 bp, Artificial Sequence
  Description of Artificial Sequence: Synthetic oligonucleotide
  Target: SCN10A; (+) strand; PAM type: NRG; PAM sequence: CAG
agtgactgcagtttattcca

SEQ ID NO: 27789 - DNA, 20 bp, Artificial Sequence
  Description of Artificial Sequence: Synthetic oligonucleotide
  Target: SCN10A; (+) strand; PAM type: NRG; PAM sequence: AGG
gtgactgcagtttattccac

SEQ ID NO: 27790 - DNA, 20 bp, Artificial Sequence
  Description of Artificial Sequence: Synthetic oligonucleotide
  Target: SCN10A; (+) strand; PAM type: NRG; PAM sequence: CAG
cagtttattccacaggctca

SEQ ID NO: 27791 - DNA, 20 bp, Artificial Sequence
  Description of Artificial Sequence: Synthetic oligonucleotide
  Target: SCN10A; (+) strand; PAM type: NRG; PAM sequence: TGG
ttccacaggctcacagtctt

SEQ ID NO: 27792 - DNA, 20 bp, Artificial Sequence
  Description of Artificial Sequence: Synthetic oligonucleotide
  Target: SCN10A; (+) strand; PAM type: NRG; PAM sequence: CAG
gcctgttttttcctatgaca

SEQ ID NO: 27793 - DNA, 20 bp, Artificial Sequence
  Description of Artificial Sequence: Synthetic oligonucleotide
  Target: SCN10A; (+) strand; PAM type: NRG; PAM sequence: CAG
cctgctcctccctgatactg

SEQ ID NO: 27794 - DNA, 20 bp, Artificial Sequence
  Description of Artificial Sequence: Synthetic oligonucleotide
  Target: SCN10A; (+) strand; PAM type: NRG; PAM sequence: TGG
ctccctgatactgcagcctt

SEQ ID NO: 27795 - DNA, 20 bp, Artificial Sequence
  Description of Artificial Sequence: Synthetic oligonucleotide
  Target: SCN10A; (+) strand; PAM type: NRG; PAM sequence: GGG
tccctgatactgcagccttt

SEQ ID NO: 27796 - DNA, 20 bp, Artificial Sequence
  Description of Artificial Sequence: Synthetic oligonucleotide
  Target: SCN10A; (+) strand; PAM type: NRG; PAM sequence: TGG
tcatgccctttcctccaccc

SEQ ID NO: 27797 - DNA, 20 bp, Artificial Sequence
  Description of Artificial Sequence: Synthetic oligonucleotide
  Target: SCN10A; (+) strand; PAM type: NRG; PAM sequence: AAG
ccctggtcctgtgctctgtg

SEQ ID NO: 27798 - DNA, 20 bp, Artificial Sequence
  Description of Artificial Sequence: Synthetic oligonucleotide
  Target: SCN10A; (+) strand; PAM type: NRG; PAM sequence: AGG
cctggtcctgtgctctgtga

SEQ ID NO: 27799 - DNA, 20 bp, Artificial Sequence
  Description of Artificial Sequence: Synthetic oligonucleotide
  Target: SCN10A; (+) strand; PAM type: NRG; PAM sequence: CAG
gtcctgtgctctgtgaaggc

SEQ ID NO: 27800 - DNA, 20 bp, Artificial Sequence
  Description of Artificial Sequence: Synthetic oligonucleotide
  Target: SCN10A; (+) strand; PAM type: NRG; PAM sequence: AGG
tcctgtgctctgtgaaggcc

SEQ ID NO: 27801 - DNA, 20 bp, Artificial Sequence
  Description of Artificial Sequence: Synthetic oligonucleotide
  Target: SCN10A; (+) strand; PAM type: NRG; PAM sequence: AAG
tctccctacctcctactgtg

SEQ ID NO: 27802 - DNA, 20 bp, Artificial Sequence
  Description of Artificial Sequence: Synthetic oligonucleotide
  Target: SCN10A; (+) strand; PAM type: NRG; PAM sequence: TGG
gtgaagattgactctgtttc

SEQ ID NO: 27803 - DNA, 20 bp, Artificial Sequence
  Description of Artificial Sequence: Synthetic oligonucleotide
  Target: SCN10A; (+) strand; PAM type: NRG; PAM sequence: CGG
ttgactctgtttctggcacc

SEQ ID NO: 27804 - DNA, 20 bp, Artificial Sequence
  Description of Artificial Sequence: Synthetic oligonucleotide
  Target: SCN10A; (+) strand; PAM type: NRG; PAM sequence: TGG
gtttctggcacccggtcctg

SEQ ID NO: 27805 - DNA, 20 bp, Artificial Sequence
  Description of Artificial Sequence: Synthetic oligonucleotide
  Target: SCN10A; (+) strand; PAM type: NRG; PAM sequence: CGG
cggtcctgtggctaattgta

SEQ ID NO: 27806 - DNA, 20 bp, Artificial Sequence
  Description of Artificial Sequence: Synthetic oligonucleotide
  Target: SCN10A; (+) strand; PAM type: NRG; PAM sequence: GAG
gtcctgtggctaattgtacg

SEQ ID NO: 27807 - DNA, 20 bp, Artificial Sequence
  Description of Artificial Sequence: Synthetic oligonucleotide
  Target: SCN10A; (+) strand; PAM type: NRG; PAM sequence: TGG
gtggctaattgtacggagcc

SEQ ID NO: 27808 - DNA, 20 bp, Artificial Sequence
  Description of Artificial Sequence: Synthetic oligonucleotide
  Target: SCN10A; (+) strand; PAM type: NRG; PAM sequence: AAG
cggagcctggtgttaattac

SEQ ID NO: 27809 - DNA, 20 bp, Artificial Sequence
  Description of Artificial Sequence: Synthetic oligonucleotide
  Target: SCN10A; (+) strand; PAM type: NRG; PAM sequence: AGG
ggagcctggtgttaattaca

SEQ ID NO: 27810 - DNA, 20 bp, Artificial Sequence
  Description of Artificial Sequence: Synthetic oligonucleotide
  Target: SCN10A; (+) strand; PAM type: NRG; PAM sequence: GGG
gagcctggtgttaattacaa

SEQ ID NO: 27811 - DNA, 20 bp, Artificial Sequence
  Description of Artificial Sequence: Synthetic oligonucleotide
  Target: SCN10A; (+) strand; PAM type: NRG; PAM sequence: GGG
agcctggtgttaattacaag

SEQ ID NO: 27812 - DNA, 20 bp, Artificial Sequence
  Description of Artificial Sequence: Synthetic oligonucleotide
  Target: SCN10A; (+) strand; PAM type: NRG; PAM sequence: GGG
gcctggtgttaattacaagg

SEQ ID NO: 27813 - DNA, 20 bp, Artificial Sequence
  Description of Artificial Sequence: Synthetic oligonucleotide
  Target: SCN10A; (+) strand; PAM type: NRG; PAM sequence: GAG
tgttaattacaagggggcct

SEQ ID NO: 27814 - DNA, 20 bp, Artificial Sequence
  Description of Artificial Sequence: Synthetic oligonucleotide
  Target: SCN10A; (+) strand; PAM type: NRG; PAM sequence: AGG
gttaattacaagggggcctg

SEQ ID NO: 27815 - DNA, 20 bp, Artificial Sequence
  Description of Artificial Sequence: Synthetic oligonucleotide
  Target: SCN10A; (+) strand; PAM type: NRG; PAM sequence: CGG
tacaagggggcctgaggatt

SEQ ID NO: 27816 - DNA, 20 bp, Artificial Sequence
  Description of Artificial Sequence: Synthetic oligonucleotide
  Target: SCN10A; (+) strand; PAM type: NRG; PAM sequence: GGG
acaagggggcctgaggattc

SEQ ID NO: 27817 - DNA, 20 bp, Artificial Sequence
  Description of Artificial Sequence: Synthetic oligonucleotide
  Target: SCN10A; (+) strand; PAM type: NRG; PAM sequence: TGG
ggcctgaggattcgggcaac

SEQ ID NO: 27818 - DNA, 20 bp, Artificial Sequence
  Description of Artificial Sequence: Synthetic oligonucleotide
  Target: SCN10A; (+) strand; PAM type: NRG; PAM sequence: CAG
ggattcgggcaactggctga

SEQ ID NO: 27819 - DNA, 20 bp, Artificial Sequence
  Description of Artificial Sequence: Synthetic oligonucleotide
  Target: SCN10A; (+) strand; PAM type: NRG; PAM sequence: AAG
gggcaactggctgacagcta

SEQ ID NO: 27820 - DNA, 20 bp, Artificial Sequence
  Description of Artificial Sequence: Synthetic oligonucleotide
  Target: SCN10A; (+) strand; PAM type: NRG; PAM sequence: AAG
ctggctgacagctaaagcat

SEQ ID NO: 27821 - DNA, 20 bp, Artificial Sequence
  Description of Artificial Sequence: Synthetic oligonucleotide
  Target: SCN10A; (+) strand; PAM type: NRG; PAM sequence: AGG
tggctgacagctaaagcata

SEQ ID NO: 27822 - DNA, 20 bp, Artificial Sequence
  Description of Artificial Sequence: Synthetic oligonucleotide
  Target: SCN10A; (+) strand; PAM type: NRG; PAM sequence: GGG
ggctgacagctaaagcataa

SEQ ID NO: 27823 - DNA, 20 bp, Artificial Sequence
  Description of Artificial Sequence: Synthetic oligonucleotide
  Target: SCN10A; (+) strand; PAM type: NRG; PAM sequence: CAG
gcataagggatttgaatgac

SEQ ID NO: 27824 - DNA, 20 bp, Artificial Sequence
  Description of Artificial Sequence: Synthetic oligonucleotide
  Target: SCN10A; (+) strand; PAM type: NRG; PAM sequence: CGG
tgtttttttttttttttttt

SEQ ID NO: 27825 - DNA, 20 bp, Artificial Sequence
  Description of Artificial Sequence: Synthetic oligonucleotide
  Target: SCN10A; (+) strand; PAM type: NRG; PAM sequence: CAG
ttttttttttttttcggttc

SEQ ID NO: 27826 - DNA, 20 bp, Artificial Sequence
  Description of Artificial Sequence: Synthetic oligonucleotide
  Target: SCN10A; (+) strand; PAM type: NRG; PAM sequence: TAG
gctgtttttgaactttatgt

SEQ ID NO: 27827 - DNA, 20 bp, Artificial Sequence
  Description of Artificial Sequence: Synthetic oligonucleotide
  Target: SCN10A; (+) strand; PAM type: NRG; PAM sequence: AGG
ctgtttttgaactttatgtt

SEQ ID NO: 27828 - DNA, 20 bp, Artificial Sequence
  Description of Artificial Sequence: Synthetic oligonucleotide
  Target: SCN10A; (+) strand; PAM type: NRG; PAM sequence: GGG
tgtttttgaactttatgtta

SEQ ID NO: 27829 - DNA, 20 bp, Artificial Sequence
  Description of Artificial Sequence: Synthetic oligonucleotide
  Target: SCN10A; (+) strand; PAM type: NRG; PAM sequence: TGG
ttgaactttatgttagggcc

SEQ ID NO: 27830 - DNA, 20 bp, Artificial Sequence
  Description of Artificial Sequence: Synthetic oligonucleotide
  Target: SCN10A; (+) strand; PAM type: NRG; PAM sequence: GAG
gaactttatgttagggcctg

SEQ ID NO: 27831 - DNA, 20 bp, Artificial Sequence
  Description of Artificial Sequence: Synthetic oligonucleotide
  Target: SCN10A; (+) strand; PAM type: NRG; PAM sequence: TAG
tttatgttagggcctggaga

SEQ ID NO: 27832 - DNA, 20 bp, Artificial Sequence
  Description of Artificial Sequence: Synthetic oligonucleotide
  Target: SCN10A; (+) strand; PAM type: NRG; PAM sequence: AGG
ttatgttagggcctggagat

SEQ ID NO: 27833 - DNA, 20 bp, Artificial Sequence
  Description of Artificial Sequence: Synthetic oligonucleotide
  Target: SCN10A; (+) strand; PAM type: NRG; PAM sequence: TGG
ggcctggagataggtttttt

SEQ ID NO: 27834 - DNA, 20 bp, Artificial Sequence
  Description of Artificial Sequence: Synthetic oligonucleotide
  Target: SCN10A; (+) strand; PAM type: NRG; PAM sequence: GGG
gcctggagataggttttttt

SEQ ID NO: 27835 - DNA, 20 bp, Artificial Sequence
  Description of Artificial Sequence: Synthetic oligonucleotide
  Target: SCN10A; (+) strand; PAM type: NRG; PAM sequence: GGG
cctggagataggtttttttg

SEQ ID NO: 27836 - DNA, 20 bp, Artificial Sequence
  Description of Artificial Sequence: Synthetic oligonucleotide
  Target: SCN10A; (+) strand; PAM type: NRG; PAM sequence: GGG
ctggagataggtttttttgg

SEQ ID NO: 27837 - DNA, 20 bp, Artificial Sequence
  Description of Artificial Sequence: Synthetic oligonucleotide
  Target: SCN10A; (+) strand; PAM type: NRG; PAM sequence: GAG
ggagataggtttttttgggg

SEQ ID NO: 27838 - DNA, 20 bp, Artificial Sequence
  Description of Artificial Sequence: Synthetic oligonucleotide
  Target: SCN10A; (+) strand; PAM type: NRG; PAM sequence: CAG
ataggtttttttgggggagt

SEQ ID NO: 27839 - DNA, 20 bp, Artificial Sequence
  Description of Artificial Sequence: Synthetic oligonucleotide
  Target: SCN10A; (+) strand; PAM type: NRG; PAM sequence: AAG
cccaactccaactatgaaca

SEQ ID NO: 27840 - DNA, 20 bp, Artificial Sequence
  Description of Artificial Sequence: Synthetic oligonucleotide
  Target: SCN10A; (+) strand; PAM type: NRG; PAM sequence: TGG
actccaactatgaacaaagt

SEQ ID NO: 27841 - DNA, 20 bp, Artificial Sequence
  Description of Artificial Sequence: Synthetic oligonucleotide
  Target: SCN10A; (+) strand; PAM type: NRG; PAM sequence: AAG
tgaacaaagttggaaatata

SEQ ID NO: 27842 - DNA, 20 bp, Artificial Sequence
  Description of Artificial Sequence: Synthetic oligonucleotide
  Target: SCN10A; (+) strand; PAM type: NRG; PAM sequence: AAG
tctatatgatgtctaacttg

SEQ ID NO: 27843 - DNA, 20 bp, Artificial Sequence
  Description of Artificial Sequence: Synthetic oligonucleotide
  Target: SCN10A; (+) strand; PAM type: NRG; PAM sequence: TGG
acttgaagatgtttgatttt

SEQ ID NO: 27844 - DNA, 20 bp, Artificial Sequence
  Description of Artificial Sequence: Synthetic oligonucleotide
  Target: SCN10A; (+) strand; PAM type: NRG; PAM sequence: TGG
agatgtttgatttttggtct

SEQ ID NO: 27845 - DNA, 20 bp, Artificial Sequence
  Description of Artificial Sequence: Synthetic oligonucleotide
  Target: SCN10A; (+) strand; PAM type: NRG; PAM sequence: GGG
gatgtttgatttttggtctt

SEQ ID NO: 27846 - DNA, 20 bp, Artificial Sequence
  Description of Artificial Sequence: Synthetic oligonucleotide
  Target: SCN10A; (+) strand; PAM type: NRG; PAM sequence: GGG
atgtttgatttttggtcttg

SEQ ID NO: 27847 - DNA, 20 bp, Artificial Sequence
  Description of Artificial Sequence: Synthetic oligonucleotide
  Target: SCN10A; (+) strand; PAM type: NRG; PAM sequence: TGG
gatttttggtcttggggacc

SEQ ID NO: 27848 - DNA, 20 bp, Artificial Sequence
  Description of Artificial Sequence: Synthetic oligonucleotide
  Target: SCN10A; (+) strand; PAM type: NRG; PAM sequence: GGG
atttttggtcttggggacct

SEQ ID NO: 27849 - DNA, 20 bp, Artificial Sequence
  Description of Artificial Sequence: Synthetic oligonucleotide
  Target: SCN10A; (+) strand; PAM type: NRG; PAM sequence: GGG
tttttggtcttggggacctg

SEQ ID NO: 27850 - DNA, 20 bp, Artificial Sequence
  Description of Artificial Sequence: Synthetic oligonucleotide
  Target: SCN10A; (+) strand; PAM type: NRG; PAM sequence: GAG
tttggtcttggggacctggg

SEQ ID NO: 27851 - DNA, 20 bp, Artificial Sequence
  Description of Artificial Sequence: Synthetic oligonucleotide
  Target: SCN10A; (+) strand; PAM type: NRG; PAM sequence: AAG
ggggagccttatttgtacca

SEQ ID NO: 27852 - DNA, 20 bp, Artificial Sequence
  Description of Artificial Sequence: Synthetic oligonucleotide
  Target: SCN10A; (+) strand; PAM type: NRG; PAM sequence: AGG
gggagccttatttgtaccaa

SEQ ID NO: 27853 - DNA, 20 bp, Artificial Sequence
  Description of Artificial Sequence: Synthetic oligonucleotide
  Target: SCN10A; (+) strand; PAM type: NRG; PAM sequence: AAG
tgtaccaaaggcctccacca

SEQ ID NO: 27854 - DNA, 20 bp, Artificial Sequence
  Description of Artificial Sequence: Synthetic oligonucleotide
  Target: SCN10A; (+) strand; PAM type: NRG; PAM sequence: GAG
caaaggcctccaccaaagat

SEQ ID NO: 27855 - DNA, 20 bp, Artificial Sequence
  Description of Artificial Sequence: Synthetic oligonucleotide
  Target: SCN10A; (+) strand; PAM type: NRG; PAM sequence: AGG
aaaggcctccaccaaagatg

SEQ ID NO: 27856 - DNA, 20 bp, Artificial Sequence
  Description of Artificial Sequence: Synthetic oligonucleotide
  Target: SCN10A; (+) strand; PAM type: NRG; PAM sequence: AAG
gcctccaccaaagatgaggc

SEQ ID NO: 27857 - DNA, 20 bp, Artificial Sequence
  Description of Artificial Sequence: Synthetic oligonucleotide
  Target: SCN10A; (+) strand; PAM type: NRG; PAM sequence: AGG
cctccaccaaagatgaggca

SEQ ID NO: 27858 - DNA, 20 bp, Artificial Sequence
  Description of Artificial Sequence: Synthetic oligonucleotide
  Target: SCN10A; (+) strand; PAM type: NRG; PAM sequence: TAG
caaagatgaggcaaggcctt

SEQ ID NO: 27859 - DNA, 20 bp, Artificial Sequence
  Description of Artificial Sequence: Synthetic oligonucleotide
  Target: SCN10A; (+) strand; PAM type: NRG; PAM sequence: AGG
aaagatgaggcaaggccttt

SEQ ID NO: 27860 - DNA, 20 bp, Artificial Sequence
  Description of Artificial Sequence: Synthetic oligonucleotide
  Target: SCN10A; (+) strand; PAM type: NRG; PAM sequence: AAG
atgaggcaaggcctttaggt

SEQ ID NO: 27861 - DNA, 20 bp, Artificial Sequence
  Description of Artificial Sequence: Synthetic oligonucleotide
  Target: SCN10A; (+) strand; PAM type: NRG; PAM sequence: GAG
gaggcaaggcctttaggtaa

SEQ ID NO: 27862 - DNA, 20 bp, Artificial Sequence
  Description of Artificial Sequence: Synthetic oligonucleotide
  Target: SCN10A; (+) strand; PAM type: NRG; PAM sequence: GAG
ggcaaggcctttaggtaaga

SEQ ID NO: 27863 - DNA, 20 bp, Artificial Sequence
  Description of Artificial Sequence: Synthetic oligonucleotide
  Target: SCN10A; (+) strand; PAM type: NRG; PAM sequence: AGG
gcaaggcctttaggtaagag

SEQ ID NO: 27864 - DNA, 20 bp, Artificial Sequence
  Description of Artificial Sequence: Synthetic oligonucleotide
  Target: SCN10A; (+) strand; PAM type: NRG; PAM sequence: GGG
caaggcctttaggtaagaga

SEQ ID NO: 27865 - DNA, 20 bp, Artificial Sequence
  Description of Artificial Sequence: Synthetic oligonucleotide
  Target: SCN10A; (+) strand; PAM type: NRG; PAM sequence: CAG
agagagggttcaacatctca

SEQ ID NO: 27866 - DNA, 20 bp, Artificial Sequence
  Description of Artificial Sequence: Synthetic oligonucleotide
  Target: SCN10A; (+) strand; PAM type: NRG; PAM sequence: AGG
gagagggttcaacatctcac

SEQ ID NO: 27867 - DNA, 20 bp, Artificial Sequence
  Description of Artificial Sequence: Synthetic oligonucleotide
  Target: SCN10A; (+) strand; PAM type: NRG; PAM sequence: TGG
tcaacatctcacaggaaaaa

SEQ ID NO: 27868 - DNA, 20 bp, Artificial Sequence
  Description of Artificial Sequence: Synthetic oligonucleotide
  Target: SCN10A; (+) strand; PAM type: NRG; PAM sequence: GAG
catctcacaggaaaaatggt

SEQ ID NO: 27869 - DNA, 20 bp, Artificial Sequence
  Description of Artificial Sequence: Synthetic oligonucleotide
  Target: SCN10A; (+) strand; PAM type: NRG; PAM sequence: AGG
atctcacaggaaaaatggtg

SEQ ID NO: 27870 - DNA, 20 bp, Artificial Sequence
  Description of Artificial Sequence: Synthetic oligonucleotide
  Target: SCN10A; (+) strand; PAM type: NRG; PAM sequence: GGG
tctcacaggaaaaatggtga

SEQ ID NO: 27871 - DNA, 20 bp, Artificial Sequence
  Description of Artificial Sequence: Synthetic oligonucleotide
  Target: SCN10A; (+) strand; PAM type: NRG; PAM sequence: TAG
aggaaaaatggtgagggatg

SEQ ID NO: 27872 - DNA, 20 bp, Artificial Sequence
  Description of Artificial Sequence: Synthetic oligonucleotide
  Target: SCN10A; (+) strand; PAM type: NRG; PAM sequence: CAG
aaaaatggtgagggatgtag

SEQ ID NO: 27873 - DNA, 20 bp, Artificial Sequence
  Description of Artificial Sequence: Synthetic oligonucleotide
  Target: SCN10A; (+) strand; PAM type: NRG; PAM sequence: AAG
atggtgagggatgtagcagc

SEQ ID NO: 27874 - DNA, 20 bp, Artificial Sequence
  Description of Artificial Sequence: Synthetic oligonucleotide
  Target: SCN10A; (+) strand; PAM type: NRG; PAM sequence: CAG
agcaagctctcgctccttgc

SEQ ID NO: 27875 - DNA, 20 bp, Artificial Sequence
  Description of Artificial Sequence: Synthetic oligonucleotide
  Target: SCN10A; (+) strand; PAM type: NRG; PAM sequence: AGG
gcaagctctcgctccttgcc

SEQ ID NO: 27876 - DNA, 20 bp, Artificial Sequence
  Description of Artificial Sequence: Synthetic oligonucleotide
  Target: SCN10A; (+) strand; PAM type: NRG; PAM sequence: TGG
tcgctccttgccaggttccc

SEQ ID NO: 27877 - DNA, 20 bp, Artificial Sequence
  Description of Artificial Sequence: Synthetic oligonucleotide
  Target: SCN10A; (+) strand; PAM type: NRG; PAM sequence: GGG
cgctccttgccaggttccct

SEQ ID NO: 27878 - DNA, 20 bp, Artificial Sequence
  Description of Artificial Sequence: Synthetic oligonucleotide
  Target: SCN10A; (+) strand; PAM type: NRG; PAM sequence: TGG
gctctttgttgttatgcaca

SEQ ID NO: 27879 - DNA, 20 bp, Artificial Sequence
  Description of Artificial Sequence: Synthetic oligonucleotide
  Target: SCN10A; (+) strand; PAM type: NRG; PAM sequence: GGG
ctctttgttgttatgcacat

SEQ ID NO: 27880 - DNA, 20 bp, Artificial Sequence
  Description of Artificial Sequence: Synthetic oligonucleotide
  Target: SCN10A; (+) strand; PAM type: NRG; PAM sequence: TGG
catgggtcacaatattgtgt

SEQ ID NO: 27881 - DNA, 20 bp, Artificial Sequence
  Description of Artificial Sequence: Synthetic oligonucleotide
  Target: SCN10A; (+) strand; PAM type: NRG; PAM sequence: AAG
ggtcacaatattgtgttgga

SEQ ID NO: 27882 - DNA, 20 bp, Artificial Sequence
  Description of Artificial Sequence: Synthetic oligonucleotide
  Target: SCN10A; (+) strand; PAM type: NRG; PAM sequence: GAG
tcacaatattgtgttggaaa

SEQ ID NO: 27883 - DNA, 20 bp, Artificial Sequence
  Description of Artificial Sequence: Synthetic oligonucleotide
  Target: SCN10A; (+) strand; PAM type: NRG; PAM sequence: AGG
cacaatattgtgttggaaag

SEQ ID NO: 27884 - DNA, 20 bp, Artificial Sequence
  Description of Artificial Sequence: Synthetic oligonucleotide
  Target: SCN10A; (+) strand; PAM type: NRG; PAM sequence: AAG
aatattgtgttggaaagagg

SEQ ID NO: 27885 - DNA, 20 bp, Artificial Sequence
  Description of Artificial Sequence: Synthetic oligonucleotide
  Target: SCN10A; (+) strand; PAM type: NRG; PAM sequence: AAG
ttgtgttggaaagaggaaga

SEQ ID NO: 27886 - DNA, 20 bp, Artificial Sequence
  Description of Artificial Sequence: Synthetic oligonucleotide
  Target: SCN10A; (+) strand; PAM type: NRG; PAM sequence: TAG
tgttggaaagaggaagaaag

SEQ ID NO: 27887 - DNA, 20 bp, Artificial Sequence
  Description of Artificial Sequence: Synthetic oligonucleotide
  Target: SCN10A; (+) strand; PAM type: NRG; PAM sequence: AAG
tggaaagaggaagaaagtag

SEQ ID NO: 27888 - DNA, 20 bp, Artificial Sequence
  Description of Artificial Sequence: Synthetic oligonucleotide
  Target: SCN10A; (+) strand; PAM type: NRG; PAM sequence: AGG
ggaaagaggaagaaagtaga

SEQ ID NO: 27889 - DNA, 20 bp, Artificial Sequence
  Description of Artificial Sequence: Synthetic oligonucleotide
  Target: SCN10A; (+) strand; PAM type: NRG; PAM sequence: GGG
gaaagaggaagaaagtagaa

SEQ ID NO: 27890 - DNA, 20 bp, Artificial Sequence
  Description of Artificial Sequence: Synthetic oligonucleotide
  Target: SCN10A; (+) strand; PAM type: NRG; PAM sequence: GGG
aaagaggaagaaagtagaag

SEQ ID NO: 27891 - DNA, 20 bp, Artificial Sequence
  Description of Artificial Sequence: Synthetic oligonucleotide
  Target: SCN10A; (+) strand; PAM type: NRG; PAM sequence: TGG
gaagaaagtagaaggggact

SEQ ID NO: 27892 - DNA, 20 bp, Artificial Sequence
  Description of Artificial Sequence: Synthetic oligonucleotide
  Target: SCN10A; (+) strand; PAM type: NRG; PAM sequence: GGG
aagaaagtagaaggggactt

SEQ ID NO: 27893 - DNA, 20 bp, Artificial Sequence
  Description of Artificial Sequence: Synthetic oligonucleotide
  Target: SCN10A; (+) strand; PAM type: NRG; PAM sequence: TGG
ttgggaaataattataattt

SEQ ID NO: 27894 - DNA, 20 bp, Artificial Sequence
  Description of Artificial Sequence: Synthetic oligonucleotide
  Target: SCN10A; (+) strand; PAM type: NRG; PAM sequence: TGG
tttggattataaaatctttg

SEQ ID NO: 27895 - DNA, 20 bp, Artificial Sequence
  Description of Artificial Sequence: Synthetic oligonucleotide
  Target: SCN10A; (+) strand; PAM type: NRG; PAM sequence: AAG
ggattataaaatctttgtgg

SEQ ID NO: 27896 - DNA, 20 bp, Artificial Sequence
  Description of Artificial Sequence: Synthetic oligonucleotide
  Target: SCN10A; (+) strand; PAM type: NRG; PAM sequence: CAG
gaagaccttctgtgaatttc

SEQ ID NO: 27897 - DNA, 20 bp, Artificial Sequence
  Description of Artificial Sequence: Synthetic oligonucleotide
  Target: SCN10A; (+) strand; PAM type: NRG; PAM sequence: TAG
ctgtgaatttccagtttaac

SEQ ID NO: 27898 - DNA, 20 bp, Artificial Sequence
  Description of Artificial Sequence: Synthetic oligonucleotide
  Target: SCN10A; (+) strand; PAM type: NRG; PAM sequence: AGG
tgtgaatttccagtttaact

SEQ ID NO: 27899 - DNA, 20 bp, Artificial Sequence
  Description of Artificial Sequence: Synthetic oligonucleotide
  Target: SCN10A; (+) strand; PAM type: NRG; PAM sequence: TAG
taggacatgttcccatcgtg

SEQ ID NO: 27900 - DNA, 20 bp, Artificial Sequence
  Description of Artificial Sequence: Synthetic oligonucleotide
  Target: SCN10A; (+) strand; PAM type: NRG; PAM sequence: AGG
aggacatgttcccatcgtgt

SEQ ID NO: 27901 - DNA, 20 bp, Artificial Sequence
  Description of Artificial Sequence: Synthetic oligonucleotide
  Target: SCN10A; (+) strand; PAM type: NRG; PAM sequence: GGG
ggacatgttcccatcgtgta

SEQ ID NO: 27902 - DNA, 20 bp, Artificial Sequence
  Description of Artificial Sequence: Synthetic oligonucleotide
  Target: SCN10A; (+) strand; PAM type: NRG; PAM sequence: TGG
cattatttgtctacatactc

SEQ ID NO: 27903 - DNA, 20 bp, Artificial Sequence
  Description of Artificial Sequence: Synthetic oligonucleotide
  Target: SCN10A; (+) strand; PAM type: NRG; PAM sequence: CAG
actctggtaaaattttctgc

SEQ ID NO: 27904 - DNA, 20 bp, Artificial Sequence
  Description of Artificial Sequence: Synthetic oligonucleotide
  Target: SCN10A; (+) strand; PAM type: NRG; PAM sequence: TGG
aaaattttctgccagacaac

SEQ ID NO: 27905 - DNA, 20 bp, Artificial Sequence
  Description of Artificial Sequence: Synthetic oligonucleotide
  Target: SCN10A; (+) strand; PAM type: NRG; PAM sequence: CAG
tctgccagacaactggtcta

SEQ ID NO: 27906 - DNA, 20 bp, Artificial Sequence
  Description of Artificial Sequence: Synthetic oligonucleotide
  Target: SCN10A; (+) strand; PAM type: NRG; PAM sequence: CAG
cagcacattttaatttgctc

SEQ ID NO: 27907 - DNA, 20 bp, Artificial Sequence
  Description of Artificial Sequence: Synthetic oligonucleotide
  Target: SCN10A; (+) strand; PAM type: NRG; PAM sequence: AGG
agcacattttaatttgctcc

SEQ ID NO: 27908 - DNA, 20 bp, Artificial Sequence
  Description of Artificial Sequence: Synthetic oligonucleotide
  Target: SCN10A; (+) strand; PAM type: NRG; PAM sequence: AAG
ttgctccaggatcttatttt

SEQ ID NO: 27909 - DNA, 20 bp, Artificial Sequence
  Description of Artificial Sequence: Synthetic oligonucleotide
  Target: SCN10A; (+) strand; PAM type: NRG; PAM sequence: AGG
tgctccaggatcttatttta

SEQ ID NO: 27910 - DNA, 20 bp, Artificial Sequence
  Description of Artificial Sequence: Synthetic oligonucleotide
  Target: SCN10A; (+) strand; PAM type: NRG; PAM sequence: GGG
gctccaggatcttattttaa

SEQ ID NO: 27911 - DNA, 20 bp, Artificial Sequence
  Description of Artificial Sequence: Synthetic oligonucleotide
  Target: SCN10A; (+) strand; PAM type: NRG; PAM sequence: GAG
tccaggatcttattttaagg

SEQ ID NO: 27912 - DNA, 20 bp, Artificial Sequence
  Description of Artificial Sequence: Synthetic oligonucleotide
  Target: SCN10A; (+) strand; PAM type: NRG; PAM sequence: TGG
gatcttattttaagggagaa

SEQ ID NO: 27913 - DNA, 20 bp, Artificial Sequence
  Description of Artificial Sequence: Synthetic oligonucleotide
  Target: SCN10A; (+) strand; PAM type: NRG; PAM sequence: TAG
ttcctcgtacttgtaacaat

SEQ ID NO: 27914 - DNA, 20 bp, Artificial Sequence
  Description of Artificial Sequence: Synthetic oligonucleotide
  Target: SCN10A; (+) strand; PAM type: NRG; PAM sequence: TGG
gatactcaatcacctcttgt

SEQ ID NO: 27915 - DNA, 20 bp, Artificial Sequence
  Description of Artificial Sequence: Synthetic oligonucleotide
  Target: SCN10A; (+) strand; PAM type: NRG; PAM sequence: TGG
actcaatcacctcttgttgg

SEQ ID NO: 27916 - DNA, 20 bp, Artificial Sequence
  Description of Artificial Sequence: Synthetic oligonucleotide
  Target: SCN10A; (+) strand; PAM type: NRG; PAM sequence: GGG
ctcaatcacctcttgttggt

SEQ ID NO: 27917 - DNA, 20 bp, Artificial Sequence
  Description of Artificial Sequence: Synthetic oligonucleotide
  Target: SCN10A; (+) strand; PAM type: NRG; PAM sequence: AAG
atcacctcttgttggtggga

SEQ ID NO: 27918 - DNA, 20 bp, Artificial Sequence
  Description of Artificial Sequence: Synthetic oligonucleotide
  Target: SCN10A; (+) strand; PAM type: NRG; PAM sequence: AAG
acctcttgttggtgggaaag

SEQ ID NO: 27919 - DNA, 20 bp, Artificial Sequence
  Description of Artificial Sequence: Synthetic oligonucleotide
  Target: SCN10A; (+) strand; PAM type: NRG; PAM sequence: AAG
cttgttggtgggaaagaaga

SEQ ID NO: 27920 - DNA, 20 bp, Artificial Sequence
  Description of Artificial Sequence: Synthetic oligonucleotide
  Target: SCN10A; (+) strand; PAM type: NRG; PAM sequence: AGG
ttgttggtgggaaagaagaa

SEQ ID NO: 27921 - DNA, 20 bp, Artificial Sequence
  Description of Artificial Sequence: Synthetic oligonucleotide
  Target: SCN10A; (+) strand; PAM type: NRG; PAM sequence: GGG
tgttggtgggaaagaagaaa

SEQ ID NO: 27922 - DNA, 20 bp, Artificial Sequence
  Description of Artificial Sequence: Synthetic oligonucleotide
  Target: SCN10A; (+) strand; PAM type: NRG; PAM sequence: GAG
ttggtgggaaagaagaaagg

SEQ ID NO: 27923 - DNA, 20 bp, Artificial Sequence
  Description of Artificial Sequence: Synthetic oligonucleotide
  Target: SCN10A; (+) strand; PAM type: NRG; PAM sequence: AGG
tggtgggaaagaagaaaggg

SEQ ID NO: 27924 - DNA, 20 bp, Artificial Sequence
  Description of Artificial Sequence: Synthetic oligonucleotide
  Target: SCN10A; (+) strand; PAM type: NRG; PAM sequence: AAG
gggaaagaagaaagggaggt

SEQ ID NO: 27925 - DNA, 20 bp, Artificial Sequence
  Description of Artificial Sequence: Synthetic oligonucleotide
  Target: SCN10A; (+) strand; PAM type: NRG; PAM sequence: AGG
ggaaagaagaaagggaggta

SEQ ID NO: 27926 - DNA, 20 bp, Artificial Sequence
  Description of Artificial Sequence: Synthetic oligonucleotide
  Target: SCN10A; (+) strand; PAM type: NRG; PAM sequence: GAG
aaagaagaaagggaggtaag

SEQ ID NO: 27927 - DNA, 20 bp, Artificial Sequence
  Description of Artificial Sequence: Synthetic oligonucleotide
  Target: SCN10A; (+) strand; PAM type: NRG; PAM sequence: GAG
agaagaaagggaggtaagga

SEQ ID NO: 27928 - DNA, 20 bp, Artificial Sequence
  Description of Artificial Sequence: Synthetic oligonucleotide
  Target: SCN10A; (+) strand; PAM type: NRG; PAM sequence: GAG
aagaaagggaggtaaggaga

SEQ ID NO: 27929 - DNA, 20 bp, Artificial Sequence
  Description of Artificial Sequence: Synthetic oligonucleotide
  Target: SCN10A; (+) strand; PAM type: NRG; PAM sequence: AGG
agaaagggaggtaaggagag

SEQ ID NO: 27930 - DNA, 20 bp, Artificial Sequence
  Description of Artificial Sequence: Synthetic oligonucleotide
  Target: SCN10A; (+) strand; PAM type: NRG; PAM sequence: GGG
gaaagggaggtaaggagaga

SEQ ID NO: 27931 - DNA, 20 bp, Artificial Sequence
  Description of Artificial Sequence: Synthetic oligonucleotide
  Target: SCN10A; (+) strand; PAM type: NRG; PAM sequence: TAG
agggaggtaaggagagaggg

SEQ ID NO: 27932 - DNA, 20 bp, Artificial Sequence
  Description of Artificial Sequence: Synthetic oligonucleotide
  Target: SCN10A; (+) strand; PAM type: NRG; PAM sequence: AAG
aggtaaggagagagggtaga

SEQ ID NO: 27933 - DNA, 20 bp, Artificial Sequence
  Description of Artificial Sequence: Synthetic oligonucleotide
  Target: SCN10A; (+) strand; PAM type: NRG; PAM sequence: TGG
agggtagaaagattgatatg

SEQ ID NO: 27934 - DNA, 20 bp, Artificial Sequence
  Description of Artificial Sequence: Synthetic oligonucleotide
  Target: SCN10A; (+) strand; PAM type: NRG; PAM sequence: GGG
gggtagaaagattgatatgt

SEQ ID NO: 27935 - DNA, 20 bp, Artificial Sequence
  Description of Artificial Sequence: Synthetic oligonucleotide
  Target: SCN10A; (+) strand; PAM type: NRG; PAM sequence: CAG
ggttttttctgcttattttc

SEQ ID NO: 27936 - DNA, 20 bp, Artificial Sequence
  Description of Artificial Sequence: Synthetic oligonucleotide
  Target: SCN10A; (+) strand; PAM type: NRG; PAM sequence: AAG
tgcttattttccagctctat

SEQ ID NO: 27937 - DNA, 20 bp, Artificial Sequence
  Description of Artificial Sequence: Synthetic oligonucleotide
  Target: SCN10A; (+) strand; PAM type: NRG; PAM sequence: AGG
gcttattttccagctctata

SEQ ID NO: 27938 - DNA, 20 bp, Artificial Sequence
  Description of Artificial Sequence: Synthetic oligonucleotide
  Target: SCN10A; (+) strand; PAM type: NRG; PAM sequence: GGG
cttattttccagctctataa

SEQ ID NO: 27939 - DNA, 20 bp, Artificial Sequence
  Description of Artificial Sequence: Synthetic oligonucleotide
  Target: SCN10A; (+) strand; PAM type: NRG; PAM sequence: CAG
tctataagggattcctgccc

SEQ ID NO: 27940 - DNA, 20 bp, Artificial Sequence
  Description of Artificial Sequence: Synthetic oligonucleotide
  Target: SCN10A; (+) strand; PAM type: NRG; PAM sequence: CGG
ataagggattcctgccccag

SEQ ID NO: 27941 - DNA, 20 bp, Artificial Sequence
  Description of Artificial Sequence: Synthetic oligonucleotide
  Target: SCN10A; (+) strand; PAM type: NRG; PAM sequence: TGG
gggattcctgccccagcgga

SEQ ID NO: 27942 - DNA, 20 bp, Artificial Sequence
  Description of Artificial Sequence: Synthetic oligonucleotide
  Target: SCN10A; (+) strand; PAM type: NRG; PAM sequence: AAG
agcggatggtgctaccctgt

SEQ ID NO: 27943 - DNA, 20 bp, Artificial Sequence
  Description of Artificial Sequence: Synthetic oligonucleotide
  Target: SCN10A; (+) strand; PAM type: NRG; PAM sequence: CAG
tggtgctaccctgtaagcca

SEQ ID NO: 27944 - DNA, 20 bp, Artificial Sequence
  Description of Artificial Sequence: Synthetic oligonucleotide
  Target: SCN10A; (+) strand; PAM type: NRG; PAM sequence: AGG
ggtgctaccctgtaagccac

SEQ ID NO: 27945 - DNA, 20 bp, Artificial Sequence
  Description of Artificial Sequence: Synthetic oligonucleotide
  Target: SCN10A; (+) strand; PAM type: NRG; PAM sequence: TGG
accctgtaagccacaggaac

SEQ ID NO: 27946 - DNA, 20 bp, Artificial Sequence
  Description of Artificial Sequence: Synthetic oligonucleotide
  Target: SCN10A; (+) strand; PAM type: NRG; PAM sequence: TAG
ctgtaagccacaggaactgg

SEQ ID NO: 27947 - DNA, 20 bp, Artificial Sequence
  Description of Artificial Sequence: Synthetic oligonucleotide
  Target: SCN10A; (+) strand; PAM type: NRG; PAM sequence: AAG
agccacaggaactggtagtt

SEQ ID NO: 27948 - DNA, 20 bp, Artificial Sequence
  Description of Artificial Sequence: Synthetic oligonucleotide
  Target: SCN10A; (+) strand; PAM type: NRG; PAM sequence: TAG
tagttaagatatccccatca

SEQ ID NO: 27949 - DNA, 20 bp, Artificial Sequence
  Description of Artificial Sequence: Synthetic oligonucleotide
  Target: SCN10A; (+) strand; PAM type: NRG; PAM sequence: AAG
gatatccccatcatagaact

SEQ ID NO: 27950 - DNA, 20 bp, Artificial Sequence
  Description of Artificial Sequence: Synthetic oligonucleotide
  Target: SCN10A; (+) strand; PAM type: NRG; PAM sequence: TGG
ccatcatagaactaagtact

SEQ ID NO: 27951 - DNA, 20 bp, Artificial Sequence
  Description of Artificial Sequence: Synthetic oligonucleotide
  Target: SCN10A; (+) strand; PAM type: NRG; PAM sequence: AAG
tatattactgatacacaaac

SEQ ID NO: 27952 - DNA, 20 bp, Artificial Sequence
  Description of Artificial Sequence: Synthetic oligonucleotide
  Target: SCN10A; (+) strand; PAM type: NRG; PAM sequence: TAG
tctttaatataaaatcaaaa

SEQ ID NO: 27953 - DNA, 20 bp, Artificial Sequence
  Description of Artificial Sequence: Synthetic oligonucleotide
  Target: SCN10A; (+) strand; PAM type: NRG; PAM sequence: TGG
tataaaatcaaaatagcctt

SEQ ID NO: 27954 - DNA, 20 bp, Artificial Sequence
  Description of Artificial Sequence: Synthetic oligonucleotide
  Target: SCN10A; (+) strand; PAM type: NRG; PAM sequence: TGG
gcctttggaatctttcattt

SEQ ID NO: 27955 - DNA, 20 bp, Artificial Sequence
  Description of Artificial Sequence: Synthetic oligonucleotide
  Target: SCN10A; (+) strand; PAM type: NRG; PAM sequence: AAG
tttggaatctttcattttgg

SEQ ID NO: 27956 - DNA, 20 bp, Artificial Sequence
  Description of Artificial Sequence: Synthetic oligonucleotide
  Target: SCN10A; (+) strand; PAM type: NRG; PAM sequence: AAG
acaaaaactcctattatgct

SEQ ID NO: 27957 - DNA, 20 bp, Artificial Sequence
  Description of Artificial Sequence: Synthetic oligonucleotide
  Target: SCN10A; (+) strand; PAM type: NRG; PAM sequence: GAG
aaactcctattatgctaagt

SEQ ID NO: 27958 - DNA, 20 bp, Artificial Sequence
  Description of Artificial Sequence: Synthetic oligonucleotide
  Target: SCN10A; (+) strand; PAM type: NRG; PAM sequence: AAG
cctattatgctaagtgagat

SEQ ID NO: 27959 - DNA, 20 bp, Artificial Sequence
  Description of Artificial Sequence: Synthetic oligonucleotide
  Target: SCN10A; (+) strand; PAM type: NRG; PAM sequence: CAG
ttatgctaagtgagataagc

SEQ ID NO: 27960 - DNA, 20 bp, Artificial Sequence
  Description of Artificial Sequence: Synthetic oligonucleotide
  Target: SCN10A; (+) strand; PAM type: NRG; PAM sequence: CAG
taagtgagataagccagaca

SEQ ID NO: 27961 - DNA, 20 bp, Artificial Sequence
  Description of Artificial Sequence: Synthetic oligonucleotide
  Target: SCN10A; (+) strand; PAM type: NRG; PAM sequence: AAG
gtgagataagccagacacag

SEQ ID NO: 27962 - DNA, 20 bp, Artificial Sequence
  Description of Artificial Sequence: Synthetic oligonucleotide
  Target: SCN10A; (+) strand; PAM type: NRG; PAM sequence: AGG
tgagataagccagacacaga

SEQ ID NO: 27963 - DNA, 20 bp, Artificial Sequence
  Description of Artificial Sequence: Synthetic oligonucleotide
  Target: SCN10A; (+) strand; PAM type: NRG; PAM sequence: AAG
cgacatgattgcatttatat

SEQ ID NO: 27964 - DNA, 20 bp, Artificial Sequence
  Description of Artificial Sequence: Synthetic oligonucleotide
  Target: SCN10A; (+) strand; PAM type: NRG; PAM sequence: AGG
gacatgattgcatttatata

SEQ ID NO: 27965 - DNA, 20 bp, Artificial Sequence
  Description of Artificial Sequence: Synthetic oligonucleotide
  Target: SCN10A; (+) strand; PAM type: NRG; PAM sequence: TAG
tttatataaggaatctaaaa

SEQ ID NO: 27966 - DNA, 20 bp, Artificial Sequence
  Description of Artificial Sequence: Synthetic oligonucleotide
  Target: SCN10A; (+) strand; PAM type: NRG; PAM sequence: TGG
atctaaaatagtcaaactca

SEQ ID NO: 27967 - DNA, 20 bp, Artificial Sequence
  Description of Artificial Sequence: Synthetic oligonucleotide
  Target: SCN10A; (+) strand; PAM type: NRG; PAM sequence: GGG
tctaaaatagtcaaactcat

SEQ ID NO: 27968 - DNA, 20 bp, Artificial Sequence
  Description of Artificial Sequence: Synthetic oligonucleotide
  Target: SCN10A; (+) strand; PAM type: NRG; PAM sequence: GAG
taaaatagtcaaactcatgg

SEQ ID NO: 27969 - DNA, 20 bp, Artificial Sequence
  Description of Artificial Sequence: Synthetic oligonucleotide
  Target: SCN10A; (+) strand; PAM type: NRG; PAM sequence: CAG
aatagtcaaactcatgggag

SEQ ID NO: 27970 - DNA, 20 bp, Artificial Sequence
  Description of Artificial Sequence: Synthetic oligonucleotide
  Target: SCN10A; (+) strand; PAM type: NRG; PAM sequence: GAG
tagtcaaactcatgggagca

SEQ ID NO: 27971 - DNA, 20 bp, Artificial Sequence
  Description of Artificial Sequence: Synthetic oligonucleotide
  Target: SCN10A; (+) strand; PAM type: NRG; PAM sequence: TAG
aaactcatgggagcagagaa

SEQ ID NO: 27972 - DNA, 20 bp, Artificial Sequence
  Description of Artificial Sequence: Synthetic oligonucleotide
  Target: SCN10A; (+) strand; PAM type: NRG; PAM sequence: TGG
catgggagcagagaatagaa

SEQ ID NO: 27973 - DNA, 20 bp, Artificial Sequence
  Description of Artificial Sequence: Synthetic oligonucleotide
  Target: SCN10A; (+) strand; PAM type: NRG; PAM sequence: TGG
gggagcagagaatagaatgg

SEQ ID NO: 27974 - DNA, 20 bp, Artificial Sequence
  Description of Artificial Sequence: Synthetic oligonucleotide
  Target: SCN10A; (+) strand; PAM type: NRG; PAM sequence: CAG
gagaatagaatggtggtttc

SEQ ID NO: 27975 - DNA, 20 bp, Artificial Sequence
  Description of Artificial Sequence: Synthetic oligonucleotide
  Target: SCN10A; (+) strand; PAM type: NRG; PAM sequence: AGG
agaatagaatggtggtttcc

SEQ ID NO: 27976 - DNA, 20 bp, Artificial Sequence
  Description of Artificial Sequence: Synthetic oligonucleotide
  Target: SCN10A; (+) strand; PAM type: NRG; PAM sequence: GAG
aatagaatggtggtttccag

SEQ ID NO: 27977 - DNA, 20 bp, Artificial Sequence
  Description of Artificial Sequence: Synthetic oligonucleotide
  Target: SCN10A; (+) strand; PAM type: NRG; PAM sequence: TGG
gaatggtggtttccaggagc

SEQ ID NO: 27978 - DNA, 20 bp, Artificial Sequence
  Description of Artificial Sequence: Synthetic oligonucleotide
  Target: SCN10A; (+) strand; PAM type: NRG; PAM sequence: GGG
aatggtggtttccaggagct

SEQ ID NO: 27979 - DNA, 20 bp, Artificial Sequence
  Description of Artificial Sequence: Synthetic oligonucleotide
  Target: SCN10A; (+) strand; PAM type: NRG; PAM sequence: GAG
tggtggtttccaggagctgg

SEQ ID NO: 27980 - DNA, 20 bp, Artificial Sequence
  Description of Artificial Sequence: Synthetic oligonucleotide
  Target: SCN10A; (+) strand; PAM type: NRG; PAM sequence: AGG
ggtggtttccaggagctggg

SEQ ID NO: 27981 - DNA, 20 bp, Artificial Sequence
  Description of Artificial Sequence: Synthetic oligonucleotide
  Target: SCN10A; (+) strand; PAM type: NRG; PAM sequence: GAG
tggtttccaggagctgggag

SEQ ID NO: 27982 - DNA, 20 bp, Artificial Sequence
  Description of Artificial Sequence: Synthetic oligonucleotide
  Target: SCN10A; (+) strand; PAM type: NRG; PAM sequence: AGG
ggtttccaggagctgggagg

SEQ ID NO: 27983 - DNA, 20 bp, Artificial Sequence
  Description of Artificial Sequence: Synthetic oligonucleotide
  Target: SCN10A; (+) strand; PAM type: NRG; PAM sequence: GGG
gtttccaggagctgggagga

SEQ ID NO: 27984 - DNA, 20 bp, Artificial Sequence
  Description of Artificial Sequence: Synthetic oligonucleotide
  Target: SCN10A; (+) strand; PAM type: NRG; PAM sequence: GGG
tttccaggagctgggaggag

SEQ ID NO: 27985 - DNA, 20 bp, Artificial Sequence
  Description of Artificial Sequence: Synthetic oligonucleotide
  Target: SCN10A; (+) strand; PAM type: NRG; PAM sequence: TGG
gagctgggaggaggggaaat

SEQ ID NO: 27986 - DNA, 20 bp, Artificial Sequence
  Description of Artificial Sequence: Synthetic oligonucleotide
  Target: SCN10A; (+) strand; PAM type: NRG; PAM sequence: GGG
agctgggaggaggggaaatt

SEQ ID NO: 27987 - DNA, 20 bp, Artificial Sequence
  Description of Artificial Sequence: Synthetic oligonucleotide
  Target: SCN10A; (+) strand; PAM type: NRG; PAM sequence: GGG
gctgggaggaggggaaattg

SEQ ID NO: 27988 - DNA, 20 bp, Artificial Sequence
  Description of Artificial Sequence: Synthetic oligonucleotide
  Target: SCN10A; (+) strand; PAM type: NRG; PAM sequence: GAG
tgggaggaggggaaattggg

SEQ ID NO: 27989 - DNA, 20 bp, Artificial Sequence
  Description of Artificial Sequence: Synthetic oligonucleotide
  Target: SCN10A; (+) strand; PAM type: NRG; PAM sequence: AGG
gggaggaggggaaattgggg

SEQ ID NO: 27990 - DNA, 20 bp, Artificial Sequence
  Description of Artificial Sequence: Synthetic oligonucleotide
  Target: SCN10A; (+) strand; PAM type: NRG; PAM sequence: AAG
aattggggaggtacttgtca

SEQ ID NO: 27991 - DNA, 20 bp, Artificial Sequence
  Description of Artificial Sequence: Synthetic oligonucleotide
  Target: SCN10A; (+) strand; PAM type: NRG; PAM sequence: CAG
tgtcaaagtgtacaaacttc

SEQ ID NO: 27992 - DNA, 20 bp, Artificial Sequence
  Description of Artificial Sequence: Synthetic oligonucleotide
  Target: SCN10A; (+) strand; PAM type: NRG; PAM sequence: TAG
tatgtgacatgaataaatcc

SEQ ID NO: 27993 - DNA, 20 bp, Artificial Sequence
  Description of Artificial Sequence: Synthetic oligonucleotide
  Target: SCN10A; (+) strand; PAM type: NRG; PAM sequence: GAG
tgtgacatgaataaatccta

SEQ ID NO: 27994 - DNA, 20 bp, Artificial Sequence
  Description of Artificial Sequence: Synthetic oligonucleotide
  Target: SCN10A; (+) strand; PAM type: NRG; PAM sequence: TAG
aaatcctagagctctactta

SEQ ID NO: 27995 - DNA, 20 bp, Artificial Sequence
  Description of Artificial Sequence: Synthetic oligonucleotide
  Target: SCN10A; (+) strand; PAM type: NRG; PAM sequence: TAG
ctagagctctacttatagca

SEQ ID NO: 27996 - DNA, 20 bp, Artificial Sequence
  Description of Artificial Sequence: Synthetic oligonucleotide
  Target: SCN10A; (+) strand; PAM type: NRG; PAM sequence: TAG
tacttatagcatagtcccta

SEQ ID NO: 27997 - DNA, 20 bp, Artificial Sequence
  Description of Artificial Sequence: Synthetic oligonucleotide
  Target: SCN10A; (+) strand; PAM type: NRG; PAM sequence: TAG
tatagcatagtccctatagt

SEQ ID NO: 27998 - DNA, 20 bp, Artificial Sequence
  Description of Artificial Sequence: Synthetic oligonucleotide
  Target: SCN10A; (+) strand; PAM type: NRG; PAM sequence: AAG
tgtctacctaaaaatttgcc

SEQ ID NO: 27999 - DNA, 20 bp, Artificial Sequence
  Description of Artificial Sequence: Synthetic oligonucleotide
  Target: SCN10A; (+) strand; PAM type: NRG; PAM sequence: GAG
tctacctaaaaatttgccaa

SEQ ID NO: 28000 - DNA, 20 bp, Artificial Sequence
  Description of Artificial Sequence: Synthetic oligonucleotide
  Target: SCN10A; (+) strand; PAM type: NRG; PAM sequence: AAG
ttgccaagagaataaatctt

SEQ ID NO: 28001 - DNA, 20 bp, Artificial Sequence
  Description of Artificial Sequence: Synthetic oligonucleotide
  Target: SCN10A; (+) strand; PAM type: NRG; PAM sequence: TAG
gaataaatcttaagtgttcc

SEQ ID NO: 28002 - DNA, 20 bp, Artificial Sequence
  Description of Artificial Sequence: Synthetic oligonucleotide
  Target: SCN10A; (+) strand; PAM type: NRG; PAM sequence: TAG
gcacccaataaataaataaa

SEQ ID NO: 28003 - DNA, 20 bp, Artificial Sequence
  Description of Artificial Sequence: Synthetic oligonucleotide
  Target: SCN10A; (+) strand; PAM type: NRG; PAM sequence: AGG
cacccaataaataaataaat

SEQ ID NO: 28004 - DNA, 20 bp, Artificial Sequence
  Description of Artificial Sequence: Synthetic oligonucleotide
  Target: SCN10A; (+) strand; PAM type: NRG; PAM sequence: CAG
ccaataaataaataaatagg

SEQ ID NO: 28005 - DNA, 20 bp, Artificial Sequence
  Description of Artificial Sequence: Synthetic oligonucleotide
  Target: SCN10A; (+) strand; PAM type: NRG; PAM sequence: AGG
caataaataaataaataggc

SEQ ID NO: 28006 - DNA, 20 bp, Artificial Sequence
  Description of Artificial Sequence: Synthetic oligonucleotide
  Target: SCN10A; (+) strand; PAM type: NRG; PAM sequence: GAG
ataaataaataaataggcag

SEQ ID NO: 28007 - DNA, 20 bp, Artificial Sequence
  Description of Artificial Sequence: Synthetic oligonucleotide
  Target: SCN10A; (+) strand; PAM type: NRG; PAM sequence: AGG
taaataaataaataggcagg

SEQ ID NO: 28008 - DNA, 20 bp, Artificial Sequence
  Description of Artificial Sequence: Synthetic oligonucleotide
  Target: SCN10A; (+) strand; PAM type: NRG; PAM sequence: TGG
aataggcaggaggaaatatt

SEQ ID NO: 28009 - DNA, 20 bp, Artificial Sequence
  Description of Artificial Sequence: Synthetic oligonucleotide
  Target: SCN10A; (+) strand; PAM type: NRG; PAM sequence: GAG
taggcaggaggaaatatttg

SEQ ID NO: 28010 - DNA, 20 bp, Artificial Sequence
  Description of Artificial Sequence: Synthetic oligonucleotide
  Target: SCN10A; (+) strand; PAM type: NRG; PAM sequence: AGG
aggcaggaggaaatatttgg

SEQ ID NO: 28011 - DNA, 20 bp, Artificial Sequence
  Description of Artificial Sequence: Synthetic oligonucleotide
  Target: SCN10A; (+) strand; PAM type: NRG; PAM sequence: TGG
gaggaaatatttggaggtta

SEQ ID NO: 28012 - DNA, 20 bp, Artificial Sequence
  Description of Artificial Sequence: Synthetic oligonucleotide
  Target: SCN10A; (+) strand; PAM type: NRG; PAM sequence: TGG
ggaggttatggacatgtttc

SEQ ID NO: 28013 - DNA, 20 bp, Artificial Sequence
  Description of Artificial Sequence: Synthetic oligonucleotide
  Target: SCN10A; (+) strand; PAM type: NRG; PAM sequence: TGG
ggacatgtttctggcattga

SEQ ID NO: 28014 - DNA, 20 bp, Artificial Sequence
  Description of Artificial Sequence: Synthetic oligonucleotide
  Target: SCN10A; (+) strand; PAM type: NRG; PAM sequence: TGG
catgtttctggcattgatgg

SEQ ID NO: 28015 - DNA, 20 bp, Artificial Sequence
  Description of Artificial Sequence: Synthetic oligonucleotide
  Target: SCN10A; (+) strand; PAM type: NRG; PAM sequence: TGG
tctggcattgatggtggtga

SEQ ID NO: 28016 - DNA, 20 bp, Artificial Sequence
  Description of Artificial Sequence: Synthetic oligonucleotide
  Target: SCN10A; (+) strand; PAM type: NRG; PAM sequence: TGG
tgatggtggtgatggtttca

SEQ ID NO: 28017 - DNA, 20 bp, Artificial Sequence
  Description of Artificial Sequence: Synthetic oligonucleotide
  Target: SCN10A; (+) strand; PAM type: NRG; PAM sequence: GGG
gatggtggtgatggtttcat

SEQ ID NO: 28018 - DNA, 20 bp, Artificial Sequence
  Description of Artificial Sequence: Synthetic oligonucleotide
  Target: SCN10A; (+) strand; PAM type: NRG; PAM sequence: AAG
tacttatctccaaactcata

SEQ ID NO: 28019 - DNA, 20 bp, Artificial Sequence
  Description of Artificial Sequence: Synthetic oligonucleotide
  Target: SCN10A; (+) strand; PAM type: NRG; PAM sequence: TAG
ttgtgtacattaaacatgta

SEQ ID NO: 28020 - DNA, 20 bp, Artificial Sequence
  Description of Artificial Sequence: Synthetic oligonucleotide
  Target: SCN10A; (+) strand; PAM type: NRG; PAM sequence: TGG
catgtatagctttttacatg

SEQ ID NO: 28021 - DNA, 20 bp, Artificial Sequence
  Description of Artificial Sequence: Synthetic oligonucleotide
  Target: SCN10A; (+) strand; PAM type: NRG; PAM sequence: AAG
atgtggatcatacctcaata

SEQ ID NO: 28022 - DNA, 20 bp, Artificial Sequence
  Description of Artificial Sequence: Synthetic oligonucleotide
  Target: SCN10A; (+) strand; PAM type: NRG; PAM sequence: CAG
ctcaataaagtgttaaaaaa

SEQ ID NO: 28023 - DNA, 20 bp, Artificial Sequence
  Description of Artificial Sequence: Synthetic oligonucleotide
  Target: SCN10A; (+) strand; PAM type: NRG; PAM sequence: GAG
caataaagtgttaaaaaaca

SEQ ID NO: 28024 - DNA, 20 bp, Artificial Sequence
  Description of Artificial Sequence: Synthetic oligonucleotide
  Target: SCN10A; (+) strand; PAM type: NRG; PAM sequence: CAG
taaagtgttaaaaaacagag

SEQ ID NO: 28025 - DNA, 20 bp, Artificial Sequence
  Description of Artificial Sequence: Synthetic oligonucleotide
  Target: SCN10A; (+) strand; PAM type: NRG; PAM sequence: AAG
cagcaatatcaaaataaaac

SEQ ID NO: 28026 - DNA, 20 bp, Artificial Sequence
  Description of Artificial Sequence: Synthetic oligonucleotide
  Target: SCN10A; (+) strand; PAM type: NRG; PAM sequence: CGG
caaaaacaaactgaaatccc

SEQ ID NO: 28027 - DNA, 20 bp, Artificial Sequence
  Description of Artificial Sequence: Synthetic oligonucleotide
  Target: SCN10A; (+) strand; PAM type: NRG; PAM sequence: AAG
cccggaaatacacgcaaccc

SEQ ID NO: 28028 - DNA, 20 bp, Artificial Sequence
  Description of Artificial Sequence: Synthetic oligonucleotide
  Target: SCN10A; (+) strand; PAM type: NRG; PAM sequence: AGG
ccggaaatacacgcaaccca

SEQ ID NO: 28029 - DNA, 20 bp, Artificial Sequence
  Description of Artificial Sequence: Synthetic oligonucleotide
  Target: SCN10A; (+) strand; PAM type: NRG; PAM sequence: CAG
cgcaacccaaggctgtgttt

SEQ ID NO: 28030 - DNA, 20 bp, Artificial Sequence
  Description of Artificial Sequence: Synthetic oligonucleotide
  Target: SCN10A; (+) strand; PAM type: NRG; PAM sequence: AAG
caaggctgtgtttcagcacc

SEQ ID NO: 28031 - DNA, 20 bp, Artificial Sequence
  Description of Artificial Sequence: Synthetic oligonucleotide
  Target: SCN10A; (+) strand; PAM type: NRG; PAM sequence: AGG
aaggctgtgtttcagcacca

SEQ ID NO: 28032 - DNA, 20 bp, Artificial Sequence
  Description of Artificial Sequence: Synthetic oligonucleotide
  Target: SCN10A; (+) strand; PAM type: NRG; PAM sequence: TGG
gctgtgtttcagcaccaagg

SEQ ID NO: 28033 - DNA, 20 bp, Artificial Sequence
  Description of Artificial Sequence: Synthetic oligonucleotide
  Target: SCN10A; (+) strand; PAM type: NRG; PAM sequence: GGG
ctgtgtttcagcaccaaggt

SEQ ID NO: 28034 - DNA, 20 bp, Artificial Sequence
  Description of Artificial Sequence: Synthetic oligonucleotide
  Target: SCN10A; (+) strand; PAM type: NRG; PAM sequence: GGG
tgtgtttcagcaccaaggtg

SEQ ID NO: 28035 - DNA, 20 bp, Artificial Sequence
  Description of Artificial Sequence: Synthetic oligonucleotide
  Target: SCN10A; (+) strand; PAM type: NRG; PAM sequence: GAG
tgtttcagcaccaaggtggg

SEQ ID NO: 28036 - DNA, 20 bp, Artificial Sequence
  Description of Artificial Sequence: Synthetic oligonucleotide
  Target: SCN10A; (+) strand; PAM type: NRG; PAM sequence: AGG
gtttcagcaccaaggtgggg

SEQ ID NO: 28037 - DNA, 20 bp, Artificial Sequence
  Description of Artificial Sequence: Synthetic oligonucleotide
  Target: SCN10A; (+) strand; PAM type: NRG; PAM sequence: AAG
gaggttgatgaaatgctgtt

SEQ ID NO: 28038 - DNA, 20 bp, Artificial Sequence
  Description of Artificial Sequence: Synthetic oligonucleotide
  Target: SCN10A; (+) strand; PAM type: NRG; PAM sequence: TAG
aaatgctgttaagttgtatt

SEQ ID NO: 28039 - DNA, 20 bp, Artificial Sequence
  Description of Artificial Sequence: Synthetic oligonucleotide
  Target: SCN10A; (+) strand; PAM type: NRG; PAM sequence: CAG
aagttgtatttagatactct

SEQ ID NO: 28040 - DNA, 20 bp, Artificial Sequence
  Description of Artificial Sequence: Synthetic oligonucleotide
  Target: SCN10A; (+) strand; PAM type: NRG; PAM sequence: CAG
ctcagctcttgttactaaat

SEQ ID NO: 28041 - DNA, 20 bp, Artificial Sequence
  Description of Artificial Sequence: Synthetic oligonucleotide
  Target: SCN10A; (+) strand; PAM type: NRG; PAM sequence: TGG
agctcttgttactaaatcag

SEQ ID NO: 28042 - DNA, 20 bp, Artificial Sequence
  Description of Artificial Sequence: Synthetic oligonucleotide
  Target: SCN10A; (+) strand; PAM type: NRG; PAM sequence: CAG
tcagtggcaaattaaatcta

SEQ ID NO: 28043 - DNA, 20 bp, Artificial Sequence
  Description of Artificial Sequence: Synthetic oligonucleotide
  Target: SCN10A; (+) strand; PAM type: NRG; PAM sequence: AAG
cagctacaccccgacatgaa

SEQ ID NO: 28044 - DNA, 20 bp, Artificial Sequence
  Description of Artificial Sequence: Synthetic oligonucleotide
  Target: SCN10A; (+) strand; PAM type: NRG; PAM sequence: AAG
tacaccccgacatgaaaagt

SEQ ID NO: 28045 - DNA, 20 bp, Artificial Sequence
  Description of Artificial Sequence: Synthetic oligonucleotide
  Target: SCN10A; (+) strand; PAM type: NRG; PAM sequence: CAG
accccgacatgaaaagtaag

SEQ ID NO: 28046 - DNA, 20 bp, Artificial Sequence
  Description of Artificial Sequence: Synthetic oligonucleotide
  Target: SCN10A; (+) strand; PAM type: NRG; PAM sequence: AGG
ccccgacatgaaaagtaagc

SEQ ID NO: 28047 - DNA, 20 bp, Artificial Sequence
  Description of Artificial Sequence: Synthetic oligonucleotide
  Target: SCN10A; (+) strand; PAM type: NRG; PAM sequence: CAG
gacatgaaaagtaagcaggt

SEQ ID NO: 28048 - DNA, 20 bp, Artificial Sequence
  Description of Artificial Sequence: Synthetic oligonucleotide
  Target: SCN10A; (+) strand; PAM type: NRG; PAM sequence: AGG
acatgaaaagtaagcaggtc

SEQ ID NO: 28049 - DNA, 20 bp, Artificial Sequence
  Description of Artificial Sequence: Synthetic oligonucleotide
  Target: SCN10A; (+) strand; PAM type: NRG; PAM sequence: AAG
aggtcaggatataaccaatc

SEQ ID NO: 28050 - DNA, 20 bp, Artificial Sequence
  Description of Artificial Sequence: Synthetic oligonucleotide
  Target: SCN10A; (+) strand; PAM type: NRG; PAM sequence: CAG
tcaagatacatttataatgc

SEQ ID NO: 28051 - DNA, 20 bp, Artificial Sequence
  Description of Artificial Sequence: Synthetic oligonucleotide
  Target: SCN10A; (+) strand; PAM type: NRG; PAM sequence: AGG
caagatacatttataatgcc

SEQ ID NO: 28052 - DNA, 20 bp, Artificial Sequence
  Description of Artificial Sequence: Synthetic oligonucleotide
  Target: SCN10A; (+) strand; PAM type: NRG; PAM sequence: AAG
tacatttataatgccaggtg

SEQ ID NO: 28053 - DNA, 20 bp, Artificial Sequence
  Description of Artificial Sequence: Synthetic oligonucleotide
  Target: SCN10A; (+) strand; PAM type: NRG; PAM sequence: TGG
tttataatgccaggtgaagc

SEQ ID NO: 28054 - DNA, 20 bp, Artificial Sequence
  Description of Artificial Sequence: Synthetic oligonucleotide
  Target: SCN10A; (+) strand; PAM type: NRG; PAM sequence: GAG
taatgccaggtgaagctggt

SEQ ID NO: 28055 - DNA, 20 bp, Artificial Sequence
  Description of Artificial Sequence: Synthetic oligonucleotide
  Target: SCN10A; (+) strand; PAM type: NRG; PAM sequence: TGG
tgaagctggtgagcatgatt

SEQ ID NO: 28056 - DNA, 20 bp, Artificial Sequence
  Description of Artificial Sequence: Synthetic oligonucleotide
  Target: SCN10A; (+) strand; PAM type: NRG; PAM sequence: TAG
tgagcatgatttggccttta

SEQ ID NO: 28057 - DNA, 20 bp, Artificial Sequence
  Description of Artificial Sequence: Synthetic oligonucleotide
  Target: SCN10A; (+) strand; PAM type: NRG; PAM sequence: AGG
gagcatgatttggcctttat

SEQ ID NO: 28058 - DNA, 20 bp, Artificial Sequence
  Description of Artificial Sequence: Synthetic oligonucleotide
  Target: SCN10A; (+) strand; PAM type: NRG; PAM sequence: GGG
agcatgatttggcctttata

SEQ ID NO: 28059 - DNA, 20 bp, Artificial Sequence
  Description of Artificial Sequence: Synthetic oligonucleotide
  Target: SCN10A; (+) strand; PAM type: NRG; PAM sequence: CAG
gcctttatagggtcaaactt

SEQ ID NO: 28060 - DNA, 20 bp, Artificial Sequence
  Description of Artificial Sequence: Synthetic oligonucleotide
  Target: SCN10A; (+) strand; PAM type: NRG; PAM sequence: AAG
tcaaacttcagctaacccat

SEQ ID NO: 28061 - DNA, 20 bp, Artificial Sequence
  Description of Artificial Sequence: Synthetic oligonucleotide
  Target: SCN10A; (+) strand; PAM type: NRG; PAM sequence: CAG
cttcagctaacccataagcc

SEQ ID NO: 28062 - DNA, 20 bp, Artificial Sequence
  Description of Artificial Sequence: Synthetic oligonucleotide
  Target: SCN10A; (+) strand; PAM type: NRG; PAM sequence: AGG
ttcagctaacccataagccc

SEQ ID NO: 28063 - DNA, 20 bp, Artificial Sequence
  Description of Artificial Sequence: Synthetic oligonucleotide
  Target: SCN10A; (+) strand; PAM type: NRG; PAM sequence: GGG
tcagctaacccataagccca

SEQ ID NO: 28064 - DNA, 20 bp, Artificial Sequence
  Description of Artificial Sequence: Synthetic oligonucleotide
  Target: SCN10A; (+) strand; PAM type: NRG; PAM sequence: CAG
ctaacccataagcccaggga

SEQ ID NO: 28065 - DNA, 20 bp, Artificial Sequence
  Description of Artificial Sequence: Synthetic oligonucleotide
  Target: SCN10A; (+) strand; PAM type: NRG; PAM sequence: TGG
taagcccagggacagtctct

SEQ ID NO: 28066 - DNA, 20 bp, Artificial Sequence
  Description of Artificial Sequence: Synthetic oligonucleotide
  Target: SCN10A; (+) strand; PAM type: NRG; PAM sequence: TGG
agggacagtctcttggctgt

SEQ ID NO: 28067 - DNA, 20 bp, Artificial Sequence
  Description of Artificial Sequence: Synthetic oligonucleotide
  Target: SCN10A; (+) strand; PAM type: NRG; PAM sequence: CAG
agtctcttggctgttggtga

SEQ ID NO: 28068 - DNA, 20 bp, Artificial Sequence
  Description of Artificial Sequence: Synthetic oligonucleotide
  Target: SCN10A; (+) strand; PAM type: NRG; PAM sequence: AGG
gtctcttggctgttggtgac

SEQ ID NO: 28069 - DNA, 20 bp, Artificial Sequence
  Description of Artificial Sequence: Synthetic oligonucleotide
  Target: SCN10A; (+) strand; PAM type: NRG; PAM sequence: CAG
tcttggctgttggtgacagg

SEQ ID NO: 28070 - DNA, 20 bp, Artificial Sequence
  Description of Artificial Sequence: Synthetic oligonucleotide
  Target: SCN10A; (+) strand; PAM type: NRG; PAM sequence: AAG
ggctgttggtgacaggcagc

SEQ ID NO: 28071 - DNA, 20 bp, Artificial Sequence
  Description of Artificial Sequence: Synthetic oligonucleotide
  Target: SCN10A; (+) strand; PAM type: NRG; PAM sequence: TAG
gtgacaggcagcaagttcat

SEQ ID NO: 28072 - DNA, 20 bp, Artificial Sequence
  Description of Artificial Sequence: Synthetic oligonucleotide
  Target: SCN10A; (+) strand; PAM type: NRG; PAM sequence: AAG
acaggcagcaagttcattag

SEQ ID NO: 28073 - DNA, 20 bp, Artificial Sequence
  Description of Artificial Sequence: Synthetic oligonucleotide
  Target: SCN10A; (+) strand; PAM type: NRG; PAM sequence: TGG
cagcaagttcattagaagat

SEQ ID NO: 28074 - DNA, 20 bp, Artificial Sequence
  Description of Artificial Sequence: Synthetic oligonucleotide
  Target: SCN10A; (+) strand; PAM type: NRG; PAM sequence: GAG
gcaagttcattagaagattg

SEQ ID NO: 28075 - DNA, 20 bp, Artificial Sequence
  Description of Artificial Sequence: Synthetic oligonucleotide
  Target: SCN10A; (+) strand; PAM type: NRG; PAM sequence: CAG
attggagcctgttctaaact

SEQ ID NO: 28076 - DNA, 20 bp, Artificial Sequence
  Description of Artificial Sequence: Synthetic oligonucleotide
  Target: SCN10A; (+) strand; PAM type: NRG; PAM sequence: TGG
ctaaactcagcttcaaccct

SEQ ID NO: 28077 - DNA, 20 bp, Artificial Sequence
  Description of Artificial Sequence: Synthetic oligonucleotide
  Target: SCN10A; (+) strand; PAM type: NRG; PAM sequence: GAG
gcataatattcttgatctct

SEQ ID NO: 28078 - DNA, 20 bp, Artificial Sequence
  Description of Artificial Sequence: Synthetic oligonucleotide
  Target: SCN10A; (+) strand; PAM type: NRG; PAM sequence: AAG
caattttaaatgtataaaat

SEQ ID NO: 28079 - DNA, 20 bp, Artificial Sequence
  Description of Artificial Sequence: Synthetic oligonucleotide
  Target: SCN10A; (+) strand; PAM type: NRG; PAM sequence: AGG
aattttaaatgtataaaata

SEQ ID NO: 28080 - DNA, 20 bp, Artificial Sequence
  Description of Artificial Sequence: Synthetic oligonucleotide
  Target: SCN10A; (+) strand; PAM type: NRG; PAM sequence: CAG
ggataataacacctgcttga

SEQ ID NO: 28081 - DNA, 20 bp, Artificial Sequence
  Description of Artificial Sequence: Synthetic oligonucleotide
  Target: SCN10A; (+) strand; PAM type: NRG; PAM sequence: AGG
gataataacacctgcttgac

SEQ ID NO: 28082 - DNA, 20 bp, Artificial Sequence
  Description of Artificial Sequence: Synthetic oligonucleotide
  Target: SCN10A; (+) strand; PAM type: NRG; PAM sequence: GGG
ataataacacctgcttgaca

SEQ ID NO: 28083 - DNA, 20 bp, Artificial Sequence
  Description of Artificial Sequence: Synthetic oligonucleotide
  Target: SCN10A; (+) strand; PAM type: NRG; PAM sequence: TGG
agggctgctgtgaacattca

SEQ ID NO: 28084 - DNA, 20 bp, Artificial Sequence
  Description of Artificial Sequence: Synthetic oligonucleotide
  Target: SCN10A; (+) strand; PAM type: NRG; PAM sequence: GAG
ggctgctgtgaacattcatg

SEQ ID NO: 28085 - DNA, 20 bp, Artificial Sequence
  Description of Artificial Sequence: Synthetic oligonucleotide
  Target: SCN10A; (+) strand; PAM type: NRG; PAM sequence: CAG
ctgtgaacattcatggagcc

SEQ ID NO: 28086 - DNA, 20 bp, Artificial Sequence
  Description of Artificial Sequence: Synthetic oligonucleotide
  Target: SCN10A; (+) strand; PAM type: NRG; PAM sequence: CAG
aacattcatggagcccagct

SEQ ID NO: 28087 - DNA, 20 bp, Artificial Sequence
  Description of Artificial Sequence: Synthetic oligonucleotide
  Target: SCN10A; (+) strand; PAM type: NRG; PAM sequence: CAG
atggagcccagctcagtgct

SEQ ID NO: 28088 - DNA, 20 bp, Artificial Sequence
  Description of Artificial Sequence: Synthetic oligonucleotide
  Target: SCN10A; (+) strand; PAM type: NRG; PAM sequence: TAG
ccagctcagtgctcagaact

SEQ ID NO: 28089 - DNA, 20 bp, Artificial Sequence
  Description of Artificial Sequence: Synthetic oligonucleotide
  Target: SCN10A; (+) strand; PAM type: NRG; PAM sequence: AGG
cagctcagtgctcagaactt

SEQ ID NO: 28090 - DNA, 20 bp, Artificial Sequence
  Description of Artificial Sequence: Synthetic oligonucleotide
  Target: SCN10A; (+) strand; PAM type: NRG; PAM sequence: AAG
ctcagtgctcagaacttagg

SEQ ID NO: 28091 - DNA, 20 bp, Artificial Sequence
  Description of Artificial Sequence: Synthetic oligonucleotide
  Target: SCN10A; (+) strand; PAM type: NRG; PAM sequence: CAG
ctcagaacttaggaagtatt

SEQ ID NO: 28092 - DNA, 20 bp, Artificial Sequence
  Description of Artificial Sequence: Synthetic oligonucleotide
  Target: SCN10A; (+) strand; PAM type: NRG; PAM sequence: AAG
aacttaggaagtattcagtc

SEQ ID NO: 28093 - DNA, 20 bp, Artificial Sequence
  Description of Artificial Sequence: Synthetic oligonucleotide
  Target: SCN10A; (+) strand; PAM type: NRG; PAM sequence: AGG
acttaggaagtattcagtca

SEQ ID NO: 28094 - DNA, 20 bp, Artificial Sequence
  Description of Artificial Sequence: Synthetic oligonucleotide
  Target: SCN10A; (+) strand; PAM type: NRG; PAM sequence: CAG
taggaagtattcagtcaagg

SEQ ID NO: 28095 - DNA, 20 bp, Artificial Sequence
  Description of Artificial Sequence: Synthetic oligonucleotide
  Target: SCN10A; (+) strand; PAM type: NRG; PAM sequence: TAG
gcagctccatttccccatgt

SEQ ID NO: 28096 - DNA, 20 bp, Artificial Sequence
  Description of Artificial Sequence: Synthetic oligonucleotide
  Target: SCN10A; (+) strand; PAM type: NRG; PAM sequence: TAG
cccatgttagcctctaactc

SEQ ID NO: 28097 - DNA, 20 bp, Artificial Sequence
  Description of Artificial Sequence: Synthetic oligonucleotide
  Target: SCN10A; (+) strand; PAM type: NRG; PAM sequence: TGG
taattttctctgaacaccac

SEQ ID NO: 28098 - DNA, 20 bp, Artificial Sequence
  Description of Artificial Sequence: Synthetic oligonucleotide
  Target: SCN10A; (+) strand; PAM type: NRG; PAM sequence: TGG
caccactggacccaaaatac

SEQ ID NO: 28099 - DNA, 20 bp, Artificial Sequence
  Description of Artificial Sequence: Synthetic oligonucleotide
  Target: SCN10A; (+) strand; PAM type: NRG; PAM sequence: GGG
accactggacccaaaatact

SEQ ID NO: 28100 - DNA, 20 bp, Artificial Sequence
  Description of Artificial Sequence: Synthetic oligonucleotide
  Target: SCN10A; (+) strand; PAM type: NRG; PAM sequence: CAG
gcctgtcattcaacaacacc

SEQ ID NO: 28101 - DNA, 20 bp, Artificial Sequence
  Description of Artificial Sequence: Synthetic oligonucleotide
  Target: SCN10A; (+) strand; PAM type: NRG; PAM sequence: TGG
tcattcaacaacacccagac

SEQ ID NO: 28102 - DNA, 20 bp, Artificial Sequence
  Description of Artificial Sequence: Synthetic oligonucleotide
  Target: SCN10A; (+) strand; PAM type: NRG; PAM sequence: GGG
cattcaacaacacccagact

SEQ ID NO: 28103 - DNA, 20 bp, Artificial Sequence
  Description of Artificial Sequence: Synthetic oligonucleotide
  Target: SCN10A; (+) strand; PAM type: NRG; PAM sequence: CAG
acacccagactgggccttaa

SEQ ID NO: 28104 - DNA, 20 bp, Artificial Sequence
  Description of Artificial Sequence: Synthetic oligonucleotide
  Target: SCN10A; (+) strand; PAM type: NRG; PAM sequence: TGG
ccttaacagtattaatttct

SEQ ID NO: 28105 - DNA, 20 bp, Artificial Sequence
  Description of Artificial Sequence: Synthetic oligonucleotide
  Target: SCN10A; (+) strand; PAM type: NRG; PAM sequence: TAG
ctatcactcatgttccctaa

SEQ ID NO: 28106 - DNA, 20 bp, Artificial Sequence
  Description of Artificial Sequence: Synthetic oligonucleotide
  Target: SCN10A; (+) strand; PAM type: NRG; PAM sequence: CAG
actcatgttccctaatagaa

SEQ ID NO: 28107 - DNA, 20 bp, Artificial Sequence
  Description of Artificial Sequence: Synthetic oligonucleotide
  Target: SCN10A; (+) strand; PAM type: NRG; PAM sequence: TAG
tccctaatagaacagttgtg

SEQ ID NO: 28108 - DNA, 20 bp, Artificial Sequence
  Description of Artificial Sequence: Synthetic oligonucleotide
  Target: SCN10A; (+) strand; PAM type: NRG; PAM sequence: GAG
cctaatagaacagttgtgta

SEQ ID NO: 28109 - DNA, 20 bp, Artificial Sequence
  Description of Artificial Sequence: Synthetic oligonucleotide
  Target: SCN10A; (+) strand; PAM type: NRG; PAM sequence: CAG
gttgtgtagagatttaattc

SEQ ID NO: 28110 - DNA, 20 bp, Artificial Sequence
  Description of Artificial Sequence: Synthetic oligonucleotide
  Target: SCN10A; (+) strand; PAM type: NRG; PAM sequence: TAG
agagatttaattccagaccc

SEQ ID NO: 28111 - DNA, 20 bp, Artificial Sequence
  Description of Artificial Sequence: Synthetic oligonucleotide
  Target: SCN10A; (+) strand; PAM type: NRG; PAM sequence: GAG
taattccagaccctagactt

SEQ ID NO: 28112 - DNA, 20 bp, Artificial Sequence
  Description of Artificial Sequence: Synthetic oligonucleotide
  Target: SCN10A; (+) strand; PAM type: NRG; PAM sequence: CAG
tcctttgaacaatctcctcc

SEQ ID NO: 28113 - DNA, 20 bp, Artificial Sequence
  Description of Artificial Sequence: Synthetic oligonucleotide
  Target: SCN10A; (+) strand; PAM type: NRG; PAM sequence: TGG
ccagtctttcctcactttga

SEQ ID NO: 28114 - DNA, 20 bp, Artificial Sequence
  Description of Artificial Sequence: Synthetic oligonucleotide
  Target: SCN10A; (+) strand; PAM type: NRG; PAM sequence: CAG
tggcaatccatctccttttc

SEQ ID NO: 28115 - DNA, 20 bp, Artificial Sequence
  Description of Artificial Sequence: Synthetic oligonucleotide
  Target: SCN10A; (+) strand; PAM type: NRG; PAM sequence: CAG
atccatctccttttccagaa

SEQ ID NO: 28116 - DNA, 20 bp, Artificial Sequence
  Description of Artificial Sequence: Synthetic oligonucleotide
  Target: SCN10A; (+) strand; PAM type: NRG; PAM sequence: AAG
ccttttccagaacagatttt

SEQ ID NO: 28117 - DNA, 20 bp, Artificial Sequence
  Description of Artificial Sequence: Synthetic oligonucleotide
  Target: SCN10A; (+) strand; PAM type: NRG; PAM sequence: AAG
accacctgccccctgctttc

SEQ ID NO: 28118 - DNA, 20 bp, Artificial Sequence
  Description of Artificial Sequence: Synthetic oligonucleotide
  Target: SCN10A; (+) strand; PAM type: NRG; PAM sequence: AAG
ccctgctttcaagaccataa

SEQ ID NO: 28119 - DNA, 20 bp, Artificial Sequence
  Description of Artificial Sequence: Synthetic oligonucleotide
  Target: SCN10A; (+) strand; PAM type: NRG; PAM sequence: AAG
gctttcaagaccataaaagt

SEQ ID NO: 28120 - DNA, 20 bp, Artificial Sequence
  Description of Artificial Sequence: Synthetic oligonucleotide
  Target: SCN10A; (+) strand; PAM type: NRG; PAM sequence: AGG
ctttcaagaccataaaagta

SEQ ID NO: 28121 - DNA, 20 bp, Artificial Sequence
  Description of Artificial Sequence: Synthetic oligonucleotide
  Target: SCN10A; (+) strand; PAM type: NRG; PAM sequence: TGG
accataaaagtaaggtctgc

SEQ ID NO: 28122 - DNA, 20 bp, Artificial Sequence
  Description of Artificial Sequence: Synthetic oligonucleotide
  Target: SCN10A; (+) strand; PAM type: NRG; PAM sequence: GAG
cataaaagtaaggtctgctg

SEQ ID NO: 28123 - DNA, 20 bp, Artificial Sequence
  Description of Artificial Sequence: Synthetic oligonucleotide
  Target: SCN10A; (+) strand; PAM type: NRG; PAM sequence: CGG
ctggagactccatcatctta

SEQ ID NO: 28124 - DNA, 20 bp, Artificial Sequence
  Description of Artificial Sequence: Synthetic oligonucleotide
  Target: SCN10A; (+) strand; PAM type: NRG; PAM sequence: GAG
actccatcatcttacggtct

SEQ ID NO: 28125 - DNA, 20 bp, Artificial Sequence
  Description of Artificial Sequence: Synthetic oligonucleotide
  Target: SCN10A; (+) strand; PAM type: NRG; PAM sequence: AGG
ctccatcatcttacggtctg

SEQ ID NO: 28126 - DNA, 20 bp, Artificial Sequence
  Description of Artificial Sequence: Synthetic oligonucleotide
  Target: SCN10A; (+) strand; PAM type: NRG; PAM sequence: CAG
atcttacggtctgaggttct

SEQ ID NO: 28127 - DNA, 20 bp, Artificial Sequence
  Description of Artificial Sequence: Synthetic oligonucleotide
  Target: SCN10A; (+) strand; PAM type: NRG; PAM sequence: AGG
tcttacggtctgaggttctc

SEQ ID NO: 28128 - DNA, 20 bp, Artificial Sequence
  Description of Artificial Sequence: Synthetic oligonucleotide
  Target: SCN10A; (+) strand; PAM type: NRG; PAM sequence: GAG
ttacggtctgaggttctcag

SEQ ID NO: 28129 - DNA, 20 bp, Artificial Sequence
  Description of Artificial Sequence: Synthetic oligonucleotide
  Target: SCN10A; (+) strand; PAM type: NRG; PAM sequence: AGG
tacggtctgaggttctcagg

SEQ ID NO: 28130 - DNA, 20 bp, Artificial Sequence
  Description of Artificial Sequence: Synthetic oligonucleotide
  Target: SCN10A; (+) strand; PAM type: NRG; PAM sequence: GAG
cggtctgaggttctcaggag

SEQ ID NO: 28131 - DNA, 20 bp, Artificial Sequence
  Description of Artificial Sequence: Synthetic oligonucleotide
  Target: SCN10A; (+) strand; PAM type: NRG; PAM sequence: CAG
gaggagtgattattccctgt

SEQ ID NO: 28132 - DNA, 20 bp, Artificial Sequence
  Description of Artificial Sequence: Synthetic oligonucleotide
  Target: SCN10A; (+) strand; PAM type: NRG; PAM sequence: GAG
attattccctgtcagcccct

SEQ ID NO: 28133 - DNA, 20 bp, Artificial Sequence
  Description of Artificial Sequence: Synthetic oligonucleotide
  Target: SCN10A; (+) strand; PAM type: NRG; PAM sequence: AGG
ttattccctgtcagcccctg

SEQ ID NO: 28134 - DNA, 20 bp, Artificial Sequence
  Description of Artificial Sequence: Synthetic oligonucleotide
  Target: SCN10A; (+) strand; PAM type: NRG; PAM sequence: TAG
cctgtcagcccctgaggttc

SEQ ID NO: 28135 - DNA, 20 bp, Artificial Sequence
  Description of Artificial Sequence: Synthetic oligonucleotide
  Target: SCN10A; (+) strand; PAM type: NRG; PAM sequence: TGG
agcccctgaggttctagcca

SEQ ID NO: 28136 - DNA, 20 bp, Artificial Sequence
  Description of Artificial Sequence: Synthetic oligonucleotide
  Target: SCN10A; (+) strand; PAM type: NRG; PAM sequence: GGG
gcccctgaggttctagccat

SEQ ID NO: 28137 - DNA, 20 bp, Artificial Sequence
  Description of Artificial Sequence: Synthetic oligonucleotide
  Target: SCN10A; (+) strand; PAM type: NRG; PAM sequence: CAG
ctagccatgggctgtgcaca

SEQ ID NO: 28138 - DNA, 20 bp, Artificial Sequence
  Description of Artificial Sequence: Synthetic oligonucleotide
  Target: SCN10A; (+) strand; PAM type: NRG; PAM sequence: TAG
gccatgggctgtgcacacag

SEQ ID NO: 28139 - DNA, 20 bp, Artificial Sequence
  Description of Artificial Sequence: Synthetic oligonucleotide
  Target: SCN10A; (+) strand; PAM type: NRG; PAM sequence: AGG
ccatgggctgtgcacacagt

SEQ ID NO: 28140 - DNA, 20 bp, Artificial Sequence
  Description of Artificial Sequence: Synthetic oligonucleotide
  Target: SCN10A; (+) strand; PAM type: NRG; PAM sequence: GAG
tgcctgaaaacacttcgtgt

SEQ ID NO: 28141 - DNA, 20 bp, Artificial Sequence
  Description of Artificial Sequence: Synthetic oligonucleotide
  Target: SCN10A; (+) strand; PAM type: NRG; PAM sequence: TGG
gaaaacacttcgtgtgagca

SEQ ID NO: 28142 - DNA, 20 bp, Artificial Sequence
  Description of Artificial Sequence: Synthetic oligonucleotide
  Target: SCN10A; (+) strand; PAM type: NRG; PAM sequence: GAG
aaacacttcgtgtgagcatg

SEQ ID NO: 28143 - DNA, 20 bp, Artificial Sequence
  Description of Artificial Sequence: Synthetic oligonucleotide
  Target: SCN10A; (+) strand; PAM type: NRG; PAM sequence: AAG
cacttcgtgtgagcatggag

SEQ ID NO: 28144 - DNA, 20 bp, Artificial Sequence
  Description of Artificial Sequence: Synthetic oligonucleotide
  Target: SCN10A; (+) strand; PAM type: NRG; PAM sequence: AGG
acttcgtgtgagcatggaga

SEQ ID NO: 28145 - DNA, 20 bp, Artificial Sequence
  Description of Artificial Sequence: Synthetic oligonucleotide
  Target: SCN10A; (+) strand; PAM type: NRG; PAM sequence: AAG
gtgtgagcatggagaaggcc

SEQ ID NO: 28146 - DNA, 20 bp, Artificial Sequence
  Description of Artificial Sequence: Synthetic oligonucleotide
  Target: SCN10A; (+) strand; PAM type: NRG; PAM sequence: GAG
gtgagcatggagaaggccaa

SEQ ID NO: 28147 - DNA, 20 bp, Artificial Sequence
  Description of Artificial Sequence: Synthetic oligonucleotide
  Target: SCN10A; (+) strand; PAM type: NRG; PAM sequence: GAG
gagaacctcttcatttcact

SEQ ID NO: 28148 - DNA, 20 bp, Artificial Sequence
  Description of Artificial Sequence: Synthetic oligonucleotide
  Target: SCN10A; (+) strand; PAM type: NRG; PAM sequence: GAG
gaacctcttcatttcactga

SEQ ID NO: 28149 - DNA, 20 bp, Artificial Sequence
  Description of Artificial Sequence: Synthetic oligonucleotide
  Target: SCN10A; (+) strand; PAM type: NRG; PAM sequence: GAG
acctcttcatttcactgaga

SEQ ID NO: 28150 - DNA, 20 bp, Artificial Sequence
  Description of Artificial Sequence: Synthetic oligonucleotide
  Target: SCN10A; (+) strand; PAM type: NRG; PAM sequence: CAG
tcttcatttcactgagagag

SEQ ID NO: 28151 - DNA, 20 bp, Artificial Sequence
  Description of Artificial Sequence: Synthetic oligonucleotide
  Target: SCN10A; (+) strand; PAM type: NRG; PAM sequence: AAG
tttcactgagagagcagccc

SEQ ID NO: 28152 - DNA, 20 bp, Artificial Sequence
  Description of Artificial Sequence: Synthetic oligonucleotide
  Target: SCN10A; (+) strand; PAM type: NRG; PAM sequence: AGG
ttcactgagagagcagccca

SEQ ID NO: 28153 - DNA, 20 bp, Artificial Sequence
  Description of Artificial Sequence: Synthetic oligonucleotide
  Target: SCN10A; (+) strand; PAM type: NRG; PAM sequence: TGG
catttaaaacttgctactct

SEQ ID NO: 28154 - DNA, 20 bp, Artificial Sequence
  Description of Artificial Sequence: Synthetic oligonucleotide
  Target: SCN10A; (+) strand; PAM type: NRG; PAM sequence: AAG
taaaacttgctactcttgga

SEQ ID NO: 28155 - DNA, 20 bp, Artificial Sequence
  Description of Artificial Sequence: Synthetic oligonucleotide
  Target: SCN10A; (+) strand; PAM type: NRG; PAM sequence: CAG
ctcttggaaagctgcaaata

SEQ ID NO: 28156 - DNA, 20 bp, Artificial Sequence
  Description of Artificial Sequence: Synthetic oligonucleotide
  Target: SCN10A; (+) strand; PAM type: NRG; PAM sequence: AGG
tcttggaaagctgcaaatac

SEQ ID NO: 28157 - DNA, 20 bp, Artificial Sequence
  Description of Artificial Sequence: Synthetic oligonucleotide
  Target: SCN10A; (+) strand; PAM type: NRG; PAM sequence: GGG
cttggaaagctgcaaataca

SEQ ID NO: 28158 - DNA, 20 bp, Artificial Sequence
  Description of Artificial Sequence: Synthetic oligonucleotide
  Target: SCN10A; (+) strand; PAM type: NRG; PAM sequence: AAG
acataaacacgtatttcaaa

SEQ ID NO: 28159 - DNA, 20 bp, Artificial Sequence
  Description of Artificial Sequence: Synthetic oligonucleotide
  Target: SCN10A; (+) strand; PAM type: NRG; PAM sequence: TGG
aaacacgtatttcaaaaagt

SEQ ID NO: 28160 - DNA, 20 bp, Artificial Sequence
  Description of Artificial Sequence: Synthetic oligonucleotide
  Target: SCN10A; (+) strand; PAM type: NRG; PAM sequence: TGG
acgtatttcaaaaagttggt

SEQ ID NO: 28161 - DNA, 20 bp, Artificial Sequence
  Description of Artificial Sequence: Synthetic oligonucleotide
  Target: SCN10A; (+) strand; PAM type: NRG; PAM sequence: TGG
aagttggttggttatttcct

SEQ ID NO: 28162 - DNA, 20 bp, Artificial Sequence
  Description of Artificial Sequence: Synthetic oligonucleotide
  Target: SCN10A; (+) strand; PAM type: NRG; PAM sequence: TAG
gttggttatttccttggttt

SEQ ID NO: 28163 - DNA, 20 bp, Artificial Sequence
  Description of Artificial Sequence: Synthetic oligonucleotide
  Target: SCN10A; (+) strand; PAM type: NRG; PAM sequence: AAG
ggttatttccttggttttag

SEQ ID NO: 28164 - DNA, 20 bp, Artificial Sequence
  Description of Artificial Sequence: Synthetic oligonucleotide
  Target: SCN10A; (+) strand; PAM type: NRG; PAM sequence: GAG
ttatttccttggttttagaa

SEQ ID NO: 28165 - DNA, 20 bp, Artificial Sequence
  Description of Artificial Sequence: Synthetic oligonucleotide
  Target: SCN10A; (+) strand; PAM type: NRG; PAM sequence: AAG
ggttttagaagagcatccca

SEQ ID NO: 28166 - DNA, 20 bp, Artificial Sequence
  Description of Artificial Sequence: Synthetic oligonucleotide
  Target: SCN10A; (+) strand; PAM type: NRG; PAM sequence: CAG
gcatcccaaagacccccaaa

SEQ ID NO: 28167 - DNA, 20 bp, Artificial Sequence
  Description of Artificial Sequence: Synthetic oligonucleotide
  Target: SCN10A; (+) strand; PAM type: NRG; PAM sequence: GAG
atcccaaagacccccaaaca

SEQ ID NO: 28168 - DNA, 20 bp, Artificial Sequence
  Description of Artificial Sequence: Synthetic oligonucleotide
  Target: SCN10A; (+) strand; PAM type: NRG; PAM sequence: AGG
tcccaaagacccccaaacag

SEQ ID NO: 28169 - DNA, 20 bp, Artificial Sequence
  Description of Artificial Sequence: Synthetic oligonucleotide
  Target: SCN10A; (+) strand; PAM type: NRG; PAM sequence: TGG
caaagacccccaaacagagg

SEQ ID NO: 28170 - DNA, 20 bp, Artificial Sequence
  Description of Artificial Sequence: Synthetic oligonucleotide
  Target: SCN10A; (+) strand; PAM type: NRG; PAM sequence: GGG
aaagacccccaaacagaggt

SEQ ID NO: 28171 - DNA, 20 bp, Artificial Sequence
  Description of Artificial Sequence: Synthetic oligonucleotide
  Target: SCN10A; (+) strand; PAM type: NRG; PAM sequence: GGG
aagacccccaaacagaggtg

SEQ ID NO: 28172 - DNA, 20 bp, Artificial Sequence
  Description of Artificial Sequence: Synthetic oligonucleotide
  Target: SCN10A; (+) strand; PAM type: NRG; PAM sequence: TGG
ggtggggcttccccaccacg

SEQ ID NO: 28173 - DNA, 20 bp, Artificial Sequence
  Description of Artificial Sequence: Synthetic oligonucleotide
  Target: SCN10A; (+) strand; PAM type: NRG; PAM sequence: TGG
ggctgcccacttactcgcaa

SEQ ID NO: 28174 - DNA, 20 bp, Artificial Sequence
  Description of Artificial Sequence: Synthetic oligonucleotide
  Target: SCN10A; (+) strand; PAM type: NRG; PAM sequence: GAG
ctgcccacttactcgcaatg

SEQ ID NO: 28175 - DNA, 20 bp, Artificial Sequence
  Description of Artificial Sequence: Synthetic oligonucleotide
  Target: SCN10A; (+) strand; PAM type: NRG; PAM sequence: GAG
gcccacttactcgcaatgga

SEQ ID NO: 28176 - DNA, 20 bp, Artificial Sequence
  Description of Artificial Sequence: Synthetic oligonucleotide
  Target: SCN10A; (+) strand; PAM type: NRG; PAM sequence: AAG
tggagagaaccaccacaatg

SEQ ID NO: 28177 - DNA, 20 bp, Artificial Sequence
  Description of Artificial Sequence: Synthetic oligonucleotide
  Target: SCN10A; (+) strand; PAM type: NRG; PAM sequence: CAG
caatgaagtcaaacacattc

SEQ ID NO: 28178 - DNA, 20 bp, Artificial Sequence
  Description of Artificial Sequence: Synthetic oligonucleotide
  Target: SCN10A; (+) strand; PAM type: NRG; PAM sequence: AAG
acacattccagccatttgtg

SEQ ID NO: 28179 - DNA, 20 bp, Artificial Sequence
  Description of Artificial Sequence: Synthetic oligonucleotide
  Target: SCN10A; (+) strand; PAM type: NRG; PAM sequence: TAG
cattccagccatttgtgaag

SEQ ID NO: 28180 - DNA, 20 bp, Artificial Sequence
  Description of Artificial Sequence: Synthetic oligonucleotide
  Target: SCN10A; (+) strand; PAM type: NRG; PAM sequence: AAG
tgtgaagtagtactgcctca

SEQ ID NO: 28181 - DNA, 20 bp, Artificial Sequence
  Description of Artificial Sequence: Synthetic oligonucleotide
  Target: SCN10A; (+) strand; PAM type: NRG; PAM sequence: AAG
tcatgacacattcgcctgtg

SEQ ID NO: 28182 - DNA, 20 bp, Artificial Sequence
  Description of Artificial Sequence: Synthetic oligonucleotide
  Target: SCN10A; (+) strand; PAM type: NRG; PAM sequence: CGG
gacacattcgcctgtgaaga

SEQ ID NO: 28183 - DNA, 20 bp, Artificial Sequence
  Description of Artificial Sequence: Synthetic oligonucleotide
  Target: SCN10A; (+) strand; PAM type: NRG; PAM sequence: AAG
cgcctgtgaagacggccaca

SEQ ID NO: 28184 - DNA, 20 bp, Artificial Sequence
  Description of Artificial Sequence: Synthetic oligonucleotide
  Target: SCN10A; (+) strand; PAM type: NRG; PAM sequence: TGG
tgaagacggccacaaagaac

SEQ ID NO: 28185 - DNA, 20 bp, Artificial Sequence
  Description of Artificial Sequence: Synthetic oligonucleotide
  Target: SCN10A; (+) strand; PAM type: NRG; PAM sequence: CAG
aagaactggttgattttgcc

SEQ ID NO: 28186 - DNA, 20 bp, Artificial Sequence
  Description of Artificial Sequence: Synthetic oligonucleotide
  Target: SCN10A; (+) strand; PAM type: NRG; PAM sequence: TGG
ttttcgtcttttcttcactt

SEQ ID NO: 28187 - DNA, 20 bp, Artificial Sequence
  Description of Artificial Sequence: Synthetic oligonucleotide
  Target: SCN10A; (+) strand; PAM type: NRG; PAM sequence: CAG
cttttcttcactttggtcat

SEQ ID NO: 28188 - DNA, 20 bp, Artificial Sequence
  Description of Artificial Sequence: Synthetic oligonucleotide
  Target: SCN10A; (+) strand; PAM type: NRG; PAM sequence: TGG
gtcatcagtctccaccatca

SEQ ID NO: 28189 - DNA, 20 bp, Artificial Sequence
  Description of Artificial Sequence: Synthetic oligonucleotide
  Target: SCN10A; (+) strand; PAM type: NRG; PAM sequence: GAG
accatcatggtgatcatgtt

SEQ ID NO: 28190 - DNA, 20 bp, Artificial Sequence
  Description of Artificial Sequence: Synthetic oligonucleotide
  Target: SCN10A; (+) strand; PAM type: NRG; PAM sequence: AGG
ccatcatggtgatcatgttg

SEQ ID NO: 28191 - DNA, 20 bp, Artificial Sequence
  Description of Artificial Sequence: Synthetic oligonucleotide
  Target: SCN10A; (+) strand; PAM type: NRG; PAM sequence: CAG
tcatggtgatcatgttgagg

SEQ ID NO: 28192 - DNA, 20 bp, Artificial Sequence
  Description of Artificial Sequence: Synthetic oligonucleotide
  Target: SCN10A; (+) strand; PAM type: NRG; PAM sequence: GAG
gtgatcatgttgaggcagat

SEQ ID NO: 28193 - DNA, 20 bp, Artificial Sequence
  Description of Artificial Sequence: Synthetic oligonucleotide
  Target: SCN10A; (+) strand; PAM type: NRG; PAM sequence: AGG
tgatcatgttgaggcagatg

SEQ ID NO: 28194 - DNA, 20 bp, Artificial Sequence
  Description of Artificial Sequence: Synthetic oligonucleotide
  Target: SCN10A; (+) strand; PAM type: NRG; PAM sequence: TGG
gaggcagatgaggaccatga

SEQ ID NO: 28195 - DNA, 20 bp, Artificial Sequence
  Description of Artificial Sequence: Synthetic oligonucleotide
  Target: SCN10A; (+) strand; PAM type: NRG; PAM sequence: AAG
gaccatgatggtgatgtcaa

SEQ ID NO: 28196 - DNA, 20 bp, Artificial Sequence
  Description of Artificial Sequence: Synthetic oligonucleotide
  Target: SCN10A; (+) strand; PAM type: NRG; PAM sequence: TGG
ggtgatgtcaaaagcttgtc

SEQ ID NO: 28197 - DNA, 20 bp, Artificial Sequence
  Description of Artificial Sequence: Synthetic oligonucleotide
  Target: SCN10A; (+) strand; PAM type: NRG; PAM sequence: AAG
cttgtctggtcacgatgtca

SEQ ID NO: 28198 - DNA, 20 bp, Artificial Sequence
  Description of Artificial Sequence: Synthetic oligonucleotide
  Target: SCN10A; (+) strand; PAM type: NRG; PAM sequence: TGG
cgatgtcaaagacaaaaccc

SEQ ID NO: 28199 - DNA, 20 bp, Artificial Sequence
  Description of Artificial Sequence: Synthetic oligonucleotide
  Target: SCN10A; (+) strand; PAM type: NRG; PAM sequence: GAG
aaaaccctggaacttgttct

SEQ ID NO: 28200 - DNA, 20 bp, Artificial Sequence
  Description of Artificial Sequence: Synthetic oligonucleotide
  Target: SCN10A; (+) strand; PAM type: NRG; PAM sequence: AAG
ggaacttgttctgagaaaac

SEQ ID NO: 28201 - DNA, 20 bp, Artificial Sequence
  Description of Artificial Sequence: Synthetic oligonucleotide
  Target: SCN10A; (+) strand; PAM type: NRG; PAM sequence: GAG
aacttgttctgagaaaacaa

SEQ ID NO: 28202 - DNA, 20 bp, Artificial Sequence
  Description of Artificial Sequence: Synthetic oligonucleotide
  Target: SCN10A; (+) strand; PAM type: NRG; PAM sequence: TAG
tgttctgagaaaacaagaga

SEQ ID NO: 28203 - DNA, 20 bp, Artificial Sequence
  Description of Artificial Sequence: Synthetic oligonucleotide
  Target: SCN10A; (+) strand; PAM type: NRG; PAM sequence: TGG
tctgagaaaacaagagatag

SEQ ID NO: 28204 - DNA, 20 bp, Artificial Sequence
  Description of Artificial Sequence: Synthetic oligonucleotide
  Target: SCN10A; (+) strand; PAM type: NRG; PAM sequence: CAG
aaaacaagagatagtggcat

SEQ ID NO: 28205 - DNA, 20 bp, Artificial Sequence
  Description of Artificial Sequence: Synthetic oligonucleotide
  Target: SCN10A; (+) strand; PAM type: NRG; PAM sequence: AGG
aaacaagagatagtggcatc

SEQ ID NO: 28206 - DNA, 20 bp, Artificial Sequence
  Description of Artificial Sequence: Synthetic oligonucleotide
  Target: SCN10A; (+) strand; PAM type: NRG; PAM sequence: GGG
aacaagagatagtggcatca

SEQ ID NO: 28207 - DNA, 20 bp, Artificial Sequence
  Description of Artificial Sequence: Synthetic oligonucleotide
  Target: SCN10A; (+) strand; PAM type: NRG; PAM sequence: TGG
gatagtggcatcagggcctt

SEQ ID NO: 28208 - DNA, 20 bp, Artificial Sequence
  Description of Artificial Sequence: Synthetic oligonucleotide
  Target: SCN10A; (+) strand; PAM type: NRG; PAM sequence: GGG
atagtggcatcagggccttt

SEQ ID NO: 28209 - DNA, 20 bp, Artificial Sequence
  Description of Artificial Sequence: Synthetic oligonucleotide
  Target: SCN10A; (+) strand; PAM type: NRG; PAM sequence: CAG
tggcatcagggcctttgggc

SEQ ID NO: 28210 - DNA, 20 bp, Artificial Sequence
  Description of Artificial Sequence: Synthetic oligonucleotide
  Target: SCN10A; (+) strand; PAM type: NRG; PAM sequence: CAG
gcctttgggccagcacaaac

SEQ ID NO: 28211 - DNA, 20 bp, Artificial Sequence
  Description of Artificial Sequence: Synthetic oligonucleotide
  Target: SCN10A; (+) strand; PAM type: NRG; PAM sequence: AGG
cctttgggccagcacaaacc

SEQ ID NO: 28212 - DNA, 20 bp, Artificial Sequence
  Description of Artificial Sequence: Synthetic oligonucleotide
  Target: SCN10A; (+) strand; PAM type: NRG; PAM sequence: TAG
ccaggcatctgtgttatctg

SEQ ID NO: 28213 - DNA, 20 bp, Artificial Sequence
  Description of Artificial Sequence: Synthetic oligonucleotide
  Target: SCN10A; (+) strand; PAM type: NRG; PAM sequence: GAG
catctgtgttatctgtagat

SEQ ID NO: 28214 - DNA, 20 bp, Artificial Sequence
  Description of Artificial Sequence: Synthetic oligonucleotide
  Target: SCN10A; (+) strand; PAM type: NRG; PAM sequence: CAG
catcacactccacatcttaa

SEQ ID NO: 28215 - DNA, 20 bp, Artificial Sequence
  Description of Artificial Sequence: Synthetic oligonucleotide
  Target: SCN10A; (+) strand; PAM type: NRG; PAM sequence: AAG
cacactccacatcttaacag

SEQ ID NO: 28216 - DNA, 20 bp, Artificial Sequence
  Description of Artificial Sequence: Synthetic oligonucleotide
  Target: SCN10A; (+) strand; PAM type: NRG; PAM sequence: TAG
ctcttccaaaatttcacttt

SEQ ID NO: 28217 - DNA, 20 bp, Artificial Sequence
  Description of Artificial Sequence: Synthetic oligonucleotide
  Target: SCN10A; (+) strand; PAM type: NRG; PAM sequence: CAG
ttgactctacctcattgccc

SEQ ID NO: 28218 - DNA, 20 bp, Artificial Sequence
  Description of Artificial Sequence: Synthetic oligonucleotide
  Target: SCN10A; (+) strand; PAM type: NRG; PAM sequence: AAG
ctacctcattgccccagttc

SEQ ID NO: 28219 - DNA, 20 bp, Artificial Sequence
  Description of Artificial Sequence: Synthetic oligonucleotide
  Target: SCN10A; (+) strand; PAM type: NRG; PAM sequence: TGG
caagtccttaatacctctcc

SEQ ID NO: 28220 - DNA, 20 bp, Artificial Sequence
  Description of Artificial Sequence: Synthetic oligonucleotide
  Target: SCN10A; (+) strand; PAM type: NRG; PAM sequence: CAG
tcctggccctttgatgccac

SEQ ID NO: 28221 - DNA, 20 bp, Artificial Sequence
  Description of Artificial Sequence: Synthetic oligonucleotide
  Target: SCN10A; (+) strand; PAM type: NRG; PAM sequence: AGG
cctggccctttgatgccacc

SEQ ID NO: 28222 - DNA, 20 bp, Artificial Sequence
  Description of Artificial Sequence: Synthetic oligonucleotide
  Target: SCN10A; (+) strand; PAM type: NRG; PAM sequence: TGG
accaggcccttcttttgtcc

SEQ ID NO: 28223 - DNA, 20 bp, Artificial Sequence
  Description of Artificial Sequence: Synthetic oligonucleotide
  Target: SCN10A; (+) strand; PAM type: NRG; PAM sequence: TGG
tgccctcctatctcctctct

SEQ ID NO: 28224 - DNA, 20 bp, Artificial Sequence
  Description of Artificial Sequence: Synthetic oligonucleotide
  Target: SCN10A; (+) strand; PAM type: NRG; PAM sequence: CAG
cttggctgtctaaattccaa

SEQ ID NO: 28225 - DNA, 20 bp, Artificial Sequence
  Description of Artificial Sequence: Synthetic oligonucleotide
  Target: SCN10A; (+) strand; PAM type: NRG; PAM sequence: GAG
gtctaaattccaacagtctt

SEQ ID NO: 28226 - DNA, 20 bp, Artificial Sequence
  Description of Artificial Sequence: Synthetic oligonucleotide
  Target: SCN10A; (+) strand; PAM type: NRG; PAM sequence: AAG
ttgagtaatccatctctttt

SEQ ID NO: 28227 - DNA, 20 bp, Artificial Sequence
  Description of Artificial Sequence: Synthetic oligonucleotide
  Target: SCN10A; (+) strand; PAM type: NRG; PAM sequence: TGG
tttaagctccacttactgca

SEQ ID NO: 28228 - DNA, 20 bp, Artificial Sequence
  Description of Artificial Sequence: Synthetic oligonucleotide
  Target: SCN10A; (+) strand; PAM type: NRG; PAM sequence: GAG
taagctccacttactgcatg

SEQ ID NO: 28229 - DNA, 20 bp, Artificial Sequence
  Description of Artificial Sequence: Synthetic oligonucleotide
  Target: SCN10A; (+) strand; PAM type: NRG; PAM sequence: TAG
ttactgcatggagtgtccct

SEQ ID NO: 28230 - DNA, 20 bp, Artificial Sequence
  Description of Artificial Sequence: Synthetic oligonucleotide
  Target: SCN10A; (+) strand; PAM type: NRG; PAM sequence: TGG
aacacactaccctgtccctt

SEQ ID NO: 28231 - DNA, 20 bp, Artificial Sequence
  Description of Artificial Sequence: Synthetic oligonucleotide
  Target: SCN10A; (+) strand; PAM type: NRG; PAM sequence: GGG
acacactaccctgtcccttt

SEQ ID NO: 28232 - DNA, 20 bp, Artificial Sequence
  Description of Artificial Sequence: Synthetic oligonucleotide
  Target: SCN10A; (+) strand; PAM type: NRG; PAM sequence: GGG
cacactaccctgtccctttg

SEQ ID NO: 28233 - DNA, 20 bp, Artificial Sequence
  Description of Artificial Sequence: Synthetic oligonucleotide
  Target: SCN10A; (+) strand; PAM type: NRG; PAM sequence: CAG
cctttggggatcccactttt

SEQ ID NO: 28234 - DNA, 20 bp, Artificial Sequence
  Description of Artificial Sequence: Synthetic oligonucleotide
  Target: SCN10A; (+) strand; PAM type: NRG; PAM sequence: CAG
tggggatcccacttttcagt

SEQ ID NO: 28235 - DNA, 20 bp, Artificial Sequence
  Description of Artificial Sequence: Synthetic oligonucleotide
  Target: SCN10A; (+) strand; PAM type: NRG; PAM sequence: GAG
cccacttttcagtcagcctc

SEQ ID NO: 28236 - DNA, 20 bp, Artificial Sequence
  Description of Artificial Sequence: Synthetic oligonucleotide
  Target: SCN10A; (+) strand; PAM type: NRG; PAM sequence: TAG
tttcagtcagcctcgagttc

SEQ ID NO: 28237 - DNA, 20 bp, Artificial Sequence
  Description of Artificial Sequence: Synthetic oligonucleotide
  Target: SCN10A; (+) strand; PAM type: NRG; PAM sequence: TAG
tgtatatgcgtcttctctac

SEQ ID NO: 28238 - DNA, 20 bp, Artificial Sequence
  Description of Artificial Sequence: Synthetic oligonucleotide
  Target: SCN10A; (+) strand; PAM type: NRG; PAM sequence: GAG
cgtcttctctactagacaat

SEQ ID NO: 28239 - DNA, 20 bp, Artificial Sequence
  Description of Artificial Sequence: Synthetic oligonucleotide
  Target: SCN10A; (+) strand; PAM type: NRG; PAM sequence: GAG
tactagacaatgagctgttt

SEQ ID NO: 28240 - DNA, 20 bp, Artificial Sequence
  Description of Artificial Sequence: Synthetic oligonucleotide
  Target: SCN10A; (+) strand; PAM type: NRG; PAM sequence: AGG
actagacaatgagctgtttg

SEQ ID NO: 28241 - DNA, 20 bp, Artificial Sequence
  Description of Artificial Sequence: Synthetic oligonucleotide
  Target: SCN10A; (+) strand; PAM type: NRG; PAM sequence: AAG
acaatgagctgtttgaggac

SEQ ID NO: 28242 - DNA, 20 bp, Artificial Sequence
  Description of Artificial Sequence: Synthetic oligonucleotide
  Target: SCN10A; (+) strand; PAM type: NRG; PAM sequence: AGG
caatgagctgtttgaggaca

SEQ ID NO: 28243 - DNA, 20 bp, Artificial Sequence
  Description of Artificial Sequence: Synthetic oligonucleotide
  Target: SCN10A; (+) strand; PAM type: NRG; PAM sequence: GGG
aatgagctgtttgaggacaa

SEQ ID NO: 28244 - DNA, 20 bp, Artificial Sequence
  Description of Artificial Sequence: Synthetic oligonucleotide
  Target: SCN10A; (+) strand; PAM type: NRG; PAM sequence: CAG
tccttaactttgtttccctg

SEQ ID NO: 28245 - DNA, 20 bp, Artificial Sequence
  Description of Artificial Sequence: Synthetic oligonucleotide
  Target: SCN10A; (+) strand; PAM type: NRG; PAM sequence: AAG
tgcagtgccctgcacattgc

SEQ ID NO: 28246 - DNA, 20 bp, Artificial Sequence
  Description of Artificial Sequence: Synthetic oligonucleotide
  Target: SCN10A; (+) strand; PAM type: NRG; PAM sequence: GAG
cagtgccctgcacattgcaa

SEQ ID NO: 28247 - DNA, 20 bp, Artificial Sequence
  Description of Artificial Sequence: Synthetic oligonucleotide
  Target: SCN10A; (+) strand; PAM type: NRG; PAM sequence: AAG
cctgcacattgcaagagttc

SEQ ID NO: 28248 - DNA, 20 bp, Artificial Sequence
  Description of Artificial Sequence: Synthetic oligonucleotide
  Target: SCN10A; (+) strand; PAM type: NRG; PAM sequence: GAG
tgcacattgcaagagttcaa

SEQ ID NO: 28249 - DNA, 20 bp, Artificial Sequence
  Description of Artificial Sequence: Synthetic oligonucleotide
  Target: SCN10A; (+) strand; PAM type: NRG; PAM sequence: GAG
gctgcttgaaatattaattt

SEQ ID NO: 28250 - DNA, 20 bp, Artificial Sequence
  Description of Artificial Sequence: Synthetic oligonucleotide
  Target: SCN10A; (+) strand; PAM type: NRG; PAM sequence: GAG
ttaatttgagctactttgct

SEQ ID NO: 28251 - DNA, 20 bp, Artificial Sequence
  Description of Artificial Sequence: Synthetic oligonucleotide
  Target: SCN10A; (+) strand; PAM type: NRG; PAM sequence: GAG
aatttgagctactttgctga

SEQ ID NO: 28252 - DNA, 20 bp, Artificial Sequence
  Description of Artificial Sequence: Synthetic oligonucleotide
  Target: SCN10A; (+) strand; PAM type: NRG; PAM sequence: AAG
gagctactttgctgagagta

SEQ ID NO: 28253 - DNA, 20 bp, Artificial Sequence
  Description of Artificial Sequence: Synthetic oligonucleotide
  Target: SCN10A; (+) strand; PAM type: NRG; PAM sequence: AAG
actttgctgagagtaaagtc

SEQ ID NO: 28254 - DNA, 20 bp, Artificial Sequence
  Description of Artificial Sequence: Synthetic oligonucleotide
  Target: SCN10A; (+) strand; PAM type: NRG; PAM sequence: AAG
tgagagtaaagtcaagtgca

SEQ ID NO: 28255 - DNA, 20 bp, Artificial Sequence
  Description of Artificial Sequence: Synthetic oligonucleotide
  Target: SCN10A; (+) strand; PAM type: NRG; PAM sequence: AGG
gagagtaaagtcaagtgcaa

SEQ ID NO: 28256 - DNA, 20 bp, Artificial Sequence
  Description of Artificial Sequence: Synthetic oligonucleotide
  Target: SCN10A; (+) strand; PAM type: NRG; PAM sequence: GGG
agagtaaagtcaagtgcaaa

SEQ ID NO: 28257 - DNA, 20 bp, Artificial Sequence
  Description of Artificial Sequence: Synthetic oligonucleotide
  Target: SCN10A; (+) strand; PAM type: NRG; PAM sequence: GGG
gagtaaagtcaagtgcaaag

SEQ ID NO: 28258 - DNA, 20 bp, Artificial Sequence
  Description of Artificial Sequence: Synthetic oligonucleotide
  Target: SCN10A; (+) strand; PAM type: NRG; PAM sequence: TGG
gcaaaggggaaacttattct

SEQ ID NO: 28259 - DNA, 20 bp, Artificial Sequence
  Description of Artificial Sequence: Synthetic oligonucleotide
  Target: SCN10A; (+) strand; PAM type: NRG; PAM sequence: TGG
ggaaatgttccctctgttcc

SEQ ID NO: 28260 - DNA, 20 bp, Artificial Sequence
  Description of Artificial Sequence: Synthetic oligonucleotide
  Target: SCN10A; (+) strand; PAM type: NRG; PAM sequence: AAG
ctggtgctgtgcaaatgcct

SEQ ID NO: 28261 - DNA, 20 bp, Artificial Sequence
  Description of Artificial Sequence: Synthetic oligonucleotide
  Target: SCN10A; (+) strand; PAM type: NRG; PAM sequence: CAG
tgcaaatgcctaagcaaatg

SEQ ID NO: 28262 - DNA, 20 bp, Artificial Sequence
  Description of Artificial Sequence: Synthetic oligonucleotide
  Target: SCN10A; (+) strand; PAM type: NRG; PAM sequence: AGG
gcaaatgcctaagcaaatgc

SEQ ID NO: 28263 - DNA, 20 bp, Artificial Sequence
  Description of Artificial Sequence: Synthetic oligonucleotide
  Target: SCN10A; (+) strand; PAM type: NRG; PAM sequence: TAG
tgcctaagcaaatgcaggta

SEQ ID NO: 28264 - DNA, 20 bp, Artificial Sequence
  Description of Artificial Sequence: Synthetic oligonucleotide
  Target: SCN10A; (+) strand; PAM type: NRG; PAM sequence: AGG
gcctaagcaaatgcaggtat

SEQ ID NO: 28265 - DNA, 20 bp, Artificial Sequence
  Description of Artificial Sequence: Synthetic oligonucleotide
  Target: SCN10A; (+) strand; PAM type: NRG; PAM sequence: GGG
cctaagcaaatgcaggtata

SEQ ID NO: 28266 - DNA, 20 bp, Artificial Sequence
  Description of Artificial Sequence: Synthetic oligonucleotide
  Target: SCN10A; (+) strand; PAM type: NRG; PAM sequence: TAG
gcaaatgcaggtatagggcg

SEQ ID NO: 28267 - DNA, 20 bp, Artificial Sequence
  Description of Artificial Sequence: Synthetic oligonucleotide
  Target: SCN10A; (+) strand; PAM type: NRG; PAM sequence: AGG
caaatgcaggtatagggcgt

SEQ ID NO: 28268 - DNA, 20 bp, Artificial Sequence
  Description of Artificial Sequence: Synthetic oligonucleotide
  Target: SCN10A; (+) strand; PAM type: NRG; PAM sequence: GGG
aaatgcaggtatagggcgta

SEQ ID NO: 28269 - DNA, 20 bp, Artificial Sequence
  Description of Artificial Sequence: Synthetic oligonucleotide
  Target: SCN10A; (+) strand; PAM type: NRG; PAM sequence: AAG
caggtatagggcgtagggtc

SEQ ID NO: 28270 - DNA, 20 bp, Artificial Sequence
  Description of Artificial Sequence: Synthetic oligonucleotide
  Target: SCN10A; (+) strand; PAM type: NRG; PAM sequence: TGG
tagggcgtagggtcaagtct

SEQ ID NO: 28271 - DNA, 20 bp, Artificial Sequence
  Description of Artificial Sequence: Synthetic oligonucleotide
  Target: SCN10A; (+) strand; PAM type: NRG; PAM sequence: TGG
agtcttggttgtttgcatct

SEQ ID NO: 28272 - DNA, 20 bp, Artificial Sequence
  Description of Artificial Sequence: Synthetic oligonucleotide
  Target: SCN10A; (+) strand; PAM type: NRG; PAM sequence: AAG
cttggttgtttgcatcttgg

SEQ ID NO: 28273 - DNA, 20 bp, Artificial Sequence
  Description of Artificial Sequence: Synthetic oligonucleotide
  Target: SCN10A; (+) strand; PAM type: NRG; PAM sequence: AGG
ttggttgtttgcatcttgga

SEQ ID NO: 28274 - DNA, 20 bp, Artificial Sequence
  Description of Artificial Sequence: Synthetic oligonucleotide
  Target: SCN10A; (+) strand; PAM type: NRG; PAM sequence: GAG
ggttgtttgcatcttggaag

SEQ ID NO: 28275 - DNA, 20 bp, Artificial Sequence
  Description of Artificial Sequence: Synthetic oligonucleotide
  Target: SCN10A; (+) strand; PAM type: NRG; PAM sequence: AGG
gttgtttgcatcttggaagg

SEQ ID NO: 28276 - DNA, 20 bp, Artificial Sequence
  Description of Artificial Sequence: Synthetic oligonucleotide
  Target: SCN10A; (+) strand; PAM type: NRG; PAM sequence: CAG
gtttgcatcttggaaggagg

SEQ ID NO: 28277 - DNA, 20 bp, Artificial Sequence
  Description of Artificial Sequence: Synthetic oligonucleotide
  Target: SCN10A; (+) strand; PAM type: NRG; PAM sequence: GAG
ttgcatcttggaaggaggca

SEQ ID NO: 28278 - DNA, 20 bp, Artificial Sequence
  Description of Artificial Sequence: Synthetic oligonucleotide
  Target: SCN10A; (+) strand; PAM type: NRG; PAM sequence: TGG
catcttggaaggaggcagag

SEQ ID NO: 28279 - DNA, 20 bp, Artificial Sequence
  Description of Artificial Sequence: Synthetic oligonucleotide
  Target: SCN10A; (+) strand; PAM type: NRG; PAM sequence: TGG
tggaaggaggcagagtggcc

SEQ ID NO: 28280 - DNA, 20 bp, Artificial Sequence
  Description of Artificial Sequence: Synthetic oligonucleotide
  Target: SCN10A; (+) strand; PAM type: NRG; PAM sequence: AAG
gcagagtggcctggataacc

SEQ ID NO: 28281 - DNA, 20 bp, Artificial Sequence
  Description of Artificial Sequence: Synthetic oligonucleotide
  Target: SCN10A; (+) strand; PAM type: NRG; PAM sequence: GAG
agagtggcctggataaccaa

SEQ ID NO: 28282 - DNA, 20 bp, Artificial Sequence
  Description of Artificial Sequence: Synthetic oligonucleotide
  Target: SCN10A; (+) strand; PAM type: NRG; PAM sequence: TGG
accaagagatcatttatatc

SEQ ID NO: 28283 - DNA, 20 bp, Artificial Sequence
  Description of Artificial Sequence: Synthetic oligonucleotide
  Target: SCN10A; (+) strand; PAM type: NRG; PAM sequence: TGG
tttatatctggttattttta

SEQ ID NO: 28284 - DNA, 20 bp, Artificial Sequence
  Description of Artificial Sequence: Synthetic oligonucleotide
  Target: SCN10A; (+) strand; PAM type: NRG; PAM sequence: AAG
atttttatggtgtctttaaa

SEQ ID NO: 28285 - DNA, 20 bp, Artificial Sequence
  Description of Artificial Sequence: Synthetic oligonucleotide
  Target: SCN10A; (+) strand; PAM type: NRG; PAM sequence: TAG
actgtgatcttctcttcttt

SEQ ID NO: 28286 - DNA, 20 bp, Artificial Sequence
  Description of Artificial Sequence: Synthetic oligonucleotide
  Target: SCN10A; (+) strand; PAM type: NRG; PAM sequence: GAG
tgaacatcttactgctctgt

SEQ ID NO: 28287 - DNA, 20 bp, Artificial Sequence
  Description of Artificial Sequence: Synthetic oligonucleotide
  Target: SCN10A; (+) strand; PAM type: NRG; PAM sequence: TGG
aaaacttctcctgacctcta

SEQ ID NO: 28288 - DNA, 20 bp, Artificial Sequence
  Description of Artificial Sequence: Synthetic oligonucleotide
  Target: SCN10A; (+) strand; PAM type: NRG; PAM sequence: GAG
aacttctcctgacctctatg

SEQ ID NO: 28289 - DNA, 20 bp, Artificial Sequence
  Description of Artificial Sequence: Synthetic oligonucleotide
  Target: SCN10A; (+) strand; PAM type: NRG; PAM sequence: AAG
cacatatctccccctattca

SEQ ID NO: 28290 - DNA, 20 bp, Artificial Sequence
  Description of Artificial Sequence: Synthetic oligonucleotide
  Target: SCN10A; (+) strand; PAM type: NRG; PAM sequence: AGG
acatatctccccctattcaa

SEQ ID NO: 28291 - DNA, 20 bp, Artificial Sequence
  Description of Artificial Sequence: Synthetic oligonucleotide
  Target: SCN10A; (+) strand; PAM type: NRG; PAM sequence: CAG
ctcccctaccccatgtacct

SEQ ID NO: 28292 - DNA, 20 bp, Artificial Sequence
  Description of Artificial Sequence: Synthetic oligonucleotide
  Target: SCN10A; (+) strand; PAM type: NRG; PAM sequence: AGG
tcccctaccccatgtacctc

SEQ ID NO: 28293 - DNA, 20 bp, Artificial Sequence
  Description of Artificial Sequence: Synthetic oligonucleotide
  Target: SCN10A; (+) strand; PAM type: NRG; PAM sequence: GGG
cccctaccccatgtacctca

SEQ ID NO: 28294 - DNA, 20 bp, Artificial Sequence
  Description of Artificial Sequence: Synthetic oligonucleotide
  Target: SCN10A; (+) strand; PAM type: NRG; PAM sequence: GGG
ccctaccccatgtacctcag

SEQ ID NO: 28295 - DNA, 20 bp, Artificial Sequence
  Description of Artificial Sequence: Synthetic oligonucleotide
  Target: SCN10A; (+) strand; PAM type: NRG; PAM sequence: TAG
accccatgtacctcaggggt

SEQ ID NO: 28296 - DNA, 20 bp, Artificial Sequence
  Description of Artificial Sequence: Synthetic oligonucleotide
  Target: SCN10A; (+) strand; PAM type: NRG; PAM sequence: AGG
ccccatgtacctcaggggtt

SEQ ID NO: 28297 - DNA, 20 bp, Artificial Sequence
  Description of Artificial Sequence: Synthetic oligonucleotide
  Target: SCN10A; (+) strand; PAM type: NRG; PAM sequence: TGG
tgtacctcaggggttaggcc

SEQ ID NO: 28298 - DNA, 20 bp, Artificial Sequence
  Description of Artificial Sequence: Synthetic oligonucleotide
  Target: SCN10A; (+) strand; PAM type: NRG; PAM sequence: AAG
taaaaccccttcttgctttg

SEQ ID NO: 28299 - DNA, 20 bp, Artificial Sequence
  Description of Artificial Sequence: Synthetic oligonucleotide
  Target: SCN10A; (+) strand; PAM type: NRG; PAM sequence: TAG
tgctttgaagctttgccacc

SEQ ID NO: 28300 - DNA, 20 bp, Artificial Sequence
  Description of Artificial Sequence: Synthetic oligonucleotide
  Target: SCN10A; (+) strand; PAM type: NRG; PAM sequence: TGG
actgccgcttgccaaactct

SEQ ID NO: 28301 - DNA, 20 bp, Artificial Sequence
  Description of Artificial Sequence: Synthetic oligonucleotide
  Target: SCN10A; (+) strand; PAM type: NRG; PAM sequence: CAG
aactcttggtccctctgcct

SEQ ID NO: 28302 - DNA, 20 bp, Artificial Sequence
  Description of Artificial Sequence: Synthetic oligonucleotide
  Target: SCN10A; (+) strand; PAM type: NRG; PAM sequence: TGG
tccctctgcctcagtaatga

SEQ ID NO: 28303 - DNA, 20 bp, Artificial Sequence
  Description of Artificial Sequence: Synthetic oligonucleotide
  Target: SCN10A; (+) strand; PAM type: NRG; PAM sequence: GGG
ccctctgcctcagtaatgat

SEQ ID NO: 28304 - DNA, 20 bp, Artificial Sequence
  Description of Artificial Sequence: Synthetic oligonucleotide
  Target: SCN10A; (+) strand; PAM type: NRG; PAM sequence: GAG
ctgcctcagtaatgatgggt

SEQ ID NO: 28305 - DNA, 20 bp, Artificial Sequence
  Description of Artificial Sequence: Synthetic oligonucleotide
  Target: SCN10A; (+) strand; PAM type: NRG; PAM sequence: AGG
tgcctcagtaatgatgggtg

SEQ ID NO: 28306 - DNA, 20 bp, Artificial Sequence
  Description of Artificial Sequence: Synthetic oligonucleotide
  Target: SCN10A; (+) strand; PAM type: NRG; PAM sequence: TGG
gtaatgatgggtgaggctct

SEQ ID NO: 28307 - DNA, 20 bp, Artificial Sequence
  Description of Artificial Sequence: Synthetic oligonucleotide
  Target: SCN10A; (+) strand; PAM type: NRG; PAM sequence: TGG
tggccatatttgcccactct

SEQ ID NO: 28308 - DNA, 20 bp, Artificial Sequence
  Description of Artificial Sequence: Synthetic oligonucleotide
  Target: SCN10A; (+) strand; PAM type: NRG; PAM sequence: TAG
cccactcttggctattatcc

SEQ ID NO: 28309 - DNA, 20 bp, Artificial Sequence
  Description of Artificial Sequence: Synthetic oligonucleotide
  Target: SCN10A; (+) strand; PAM type: NRG; PAM sequence: AGG
ccactcttggctattatcct

SEQ ID NO: 28310 - DNA, 20 bp, Artificial Sequence
  Description of Artificial Sequence: Synthetic oligonucleotide
  Target: SCN10A; (+) strand; PAM type: NRG; PAM sequence: TGG
gtgcattactctttgtctct

SEQ ID NO: 28311 - DNA, 20 bp, Artificial Sequence
  Description of Artificial Sequence: Synthetic oligonucleotide
  Target: SCN10A; (+) strand; PAM type: NRG; PAM sequence: TAG
tgcacaaatctctaatgacc

SEQ ID NO: 28312 - DNA, 20 bp, Artificial Sequence
  Description of Artificial Sequence: Synthetic oligonucleotide
  Target: SCN10A; (+) strand; PAM type: NRG; PAM sequence: AAG
acctagtttctcctaactta

SEQ ID NO: 28313 - DNA, 20 bp, Artificial Sequence
  Description of Artificial Sequence: Synthetic oligonucleotide
  Target: SCN10A; (+) strand; PAM type: NRG; PAM sequence: CAG
tagtttctcctaacttaaag

SEQ ID NO: 28314 - DNA, 20 bp, Artificial Sequence
  Description of Artificial Sequence: Synthetic oligonucleotide
  Target: SCN10A; (+) strand; PAM type: NRG; PAM sequence: CAG
taacttaaagcagaatattt

SEQ ID NO: 28315 - DNA, 20 bp, Artificial Sequence
  Description of Artificial Sequence: Synthetic oligonucleotide
  Target: SCN10A; (+) strand; PAM type: NRG; PAM sequence: CAG
cagaaacttacatctccctc

SEQ ID NO: 28316 - DNA, 20 bp, Artificial Sequence
  Description of Artificial Sequence: Synthetic oligonucleotide
  Target: SCN10A; (+) strand; PAM type: NRG; PAM sequence: TAG
tctccctccagctaccatct

SEQ ID NO: 28317 - DNA, 20 bp, Artificial Sequence
  Description of Artificial Sequence: Synthetic oligonucleotide
  Target: SCN10A; (+) strand; PAM type: NRG; PAM sequence: AAG
tagatctcttcccaccttca

SEQ ID NO: 28318 - DNA, 20 bp, Artificial Sequence
  Description of Artificial Sequence: Synthetic oligonucleotide
  Target: SCN10A; (+) strand; PAM type: NRG; PAM sequence: AAG
ttcaaagcaaaatttcttga

SEQ ID NO: 28319 - DNA, 20 bp, Artificial Sequence
  Description of Artificial Sequence: Synthetic oligonucleotide
  Target: SCN10A; (+) strand; PAM type: NRG; PAM sequence: GAG
caaagcaaaatttcttgaaa

SEQ ID NO: 28320 - DNA, 20 bp, Artificial Sequence
  Description of Artificial Sequence: Synthetic oligonucleotide
  Target: SCN10A; (+) strand; PAM type: NRG; PAM sequence: CAG
ttgaaagagttgtgtacaat

SEQ ID NO: 28321 - DNA, 20 bp, Artificial Sequence
  Description of Artificial Sequence: Synthetic oligonucleotide
  Target: SCN10A; (+) strand; PAM type: NRG; PAM sequence: CAG
agtgtccctcattcactcct

SEQ ID NO: 28322 - DNA, 20 bp, Artificial Sequence
  Description of Artificial Sequence: Synthetic oligonucleotide
  Target: SCN10A; (+) strand; PAM type: NRG; PAM sequence: CAG
cactcctcagcccacatcaa

SEQ ID NO: 28323 - DNA, 20 bp, Artificial Sequence
  Description of Artificial Sequence: Synthetic oligonucleotide
  Target: SCN10A; (+) strand; PAM type: NRG; PAM sequence: GAG
ctcctcagcccacatcaaca

SEQ ID NO: 28324 - DNA, 20 bp, Artificial Sequence
  Description of Artificial Sequence: Synthetic oligonucleotide
  Target: SCN10A; (+) strand; PAM type: NRG; PAM sequence: CAG
agcttttgcctctatcctga

SEQ ID NO: 28325 - DNA, 20 bp, Artificial Sequence
  Description of Artificial Sequence: Synthetic oligonucleotide
  Target: SCN10A; (+) strand; PAM type: NRG; PAM sequence: GAG
cttttgcctctatcctgaca

SEQ ID NO: 28326 - DNA, 20 bp, Artificial Sequence
  Description of Artificial Sequence: Synthetic oligonucleotide
  Target: SCN10A; (+) strand; PAM type: NRG; PAM sequence: AAG
tgacagagattgttctcact

SEQ ID NO: 28327 - DNA, 20 bp, Artificial Sequence
  Description of Artificial Sequence: Synthetic oligonucleotide
  Target: SCN10A; (+) strand; PAM type: NRG; PAM sequence: TAG
tgaatgacttcccataatat

SEQ ID NO: 28328 - DNA, 20 bp, Artificial Sequence
  Description of Artificial Sequence: Synthetic oligonucleotide
  Target: SCN10A; (+) strand; PAM type: NRG; PAM sequence: AAG
cttcccataatattagatcc

SEQ ID NO: 28329 - DNA, 20 bp, Artificial Sequence
  Description of Artificial Sequence: Synthetic oligonucleotide
  Target: SCN10A; (+) strand; PAM type: NRG; PAM sequence: AGG
ttcccataatattagatcca

SEQ ID NO: 28330 - DNA, 20 bp, Artificial Sequence
  Description of Artificial Sequence: Synthetic oligonucleotide
  Target: SCN10A; (+) strand; PAM type: NRG; PAM sequence: TAG
gacgcttgtctgatattgcc

SEQ ID NO: 28331 - DNA, 20 bp, Artificial Sequence
  Description of Artificial Sequence: Synthetic oligonucleotide
  Target: SCN10A; (+) strand; PAM type: NRG; PAM sequence: TGG
accttgaaatgttgctttct

SEQ ID NO: 28332 - DNA, 20 bp, Artificial Sequence
  Description of Artificial Sequence: Synthetic oligonucleotide
  Target: SCN10A; (+) strand; PAM type: NRG; PAM sequence: TAG
ccatttgtgatgctctttta

SEQ ID NO: 28333 - DNA, 20 bp, Artificial Sequence
  Description of Artificial Sequence: Synthetic oligonucleotide
  Target: SCN10A; (+) strand; PAM type: NRG; PAM sequence: TAG
agtctcctttacccaacttt

SEQ ID NO: 28334 - DNA, 20 bp, Artificial Sequence
  Description of Artificial Sequence: Synthetic oligonucleotide
  Target: SCN10A; (+) strand; PAM type: NRG; PAM sequence: CAG
tttacccaacttttagacat

SEQ ID NO: 28335 - DNA, 20 bp, Artificial Sequence
  Description of Artificial Sequence: Synthetic oligonucleotide
  Target: SCN10A; (+) strand; PAM type: NRG; PAM sequence: GAG
tacccaacttttagacatca

SEQ ID NO: 28336 - DNA, 20 bp, Artificial Sequence
  Description of Artificial Sequence: Synthetic oligonucleotide
  Target: SCN10A; (+) strand; PAM type: NRG; PAM sequence: GAG
tttagacatcagagttcttc

SEQ ID NO: 28337 - DNA, 20 bp, Artificial Sequence
  Description of Artificial Sequence: Synthetic oligonucleotide
  Target: SCN10A; (+) strand; PAM type: NRG; PAM sequence: AGG
ttagacatcagagttcttcg

SEQ ID NO: 28338 - DNA, 20 bp, Artificial Sequence
  Description of Artificial Sequence: Synthetic oligonucleotide
  Target: SCN10A; (+) strand; PAM type: NRG; PAM sequence: CAG
catcagagttcttcgaggct

SEQ ID NO: 28339 - DNA, 20 bp, Artificial Sequence
  Description of Artificial Sequence: Synthetic oligonucleotide
  Target: SCN10A; (+) strand; PAM type: NRG; PAM sequence: GAG
gttcttcgaggctcagtctt

SEQ ID NO: 28340 - DNA, 20 bp, Artificial Sequence
  Description of Artificial Sequence: Synthetic oligonucleotide
  Target: SCN10A; (+) strand; PAM type: NRG; PAM sequence: CAG
ttctcccttgacaatttatc

SEQ ID NO: 28341 - DNA, 20 bp, Artificial Sequence
  Description of Artificial Sequence: Synthetic oligonucleotide
  Target: SCN10A; (+) strand; PAM type: NRG; PAM sequence: CAG
cccttgacaatttatccagc

SEQ ID NO: 28342 - DNA, 20 bp, Artificial Sequence
  Description of Artificial Sequence: Synthetic oligonucleotide
  Target: SCN10A; (+) strand; PAM type: NRG; PAM sequence: AGG
ccttgacaatttatccagcc

SEQ ID NO: 28343 - DNA, 20 bp, Artificial Sequence
  Description of Artificial Sequence: Synthetic oligonucleotide
  Target: SCN10A; (+) strand; PAM type: NRG; PAM sequence: TGG
taacatatatgtgcaacttt

SEQ ID NO: 28344 - DNA, 20 bp, Artificial Sequence
  Description of Artificial Sequence: Synthetic oligonucleotide
  Target: SCN10A; (+) strand; PAM type: NRG; PAM sequence: TGG
caactgtttgcctctgtcac

SEQ ID NO: 28345 - DNA, 20 bp, Artificial Sequence
  Description of Artificial Sequence: Synthetic oligonucleotide
  Target: SCN10A; (+) strand; PAM type: NRG; PAM sequence: AAG
gtcactggactgtaaactgt

SEQ ID NO: 28346 - DNA, 20 bp, Artificial Sequence
  Description of Artificial Sequence: Synthetic oligonucleotide
  Target: SCN10A; (+) strand; PAM type: NRG; PAM sequence: GAG
cactggactgtaaactgtaa

SEQ ID NO: 28347 - DNA, 20 bp, Artificial Sequence
  Description of Artificial Sequence: Synthetic oligonucleotide
  Target: SCN10A; (+) strand; PAM type: NRG; PAM sequence: TAG
tggactgtaaactgtaagag

SEQ ID NO: 28348 - DNA, 20 bp, Artificial Sequence
  Description of Artificial Sequence: Synthetic oligonucleotide
  Target: SCN10A; (+) strand; PAM type: NRG; PAM sequence: AGG
ggactgtaaactgtaagagt

SEQ ID NO: 28349 - DNA, 20 bp, Artificial Sequence
  Description of Artificial Sequence: Synthetic oligonucleotide
  Target: SCN10A; (+) strand; PAM type: NRG; PAM sequence: TGG
cttgctcactgctctaaccc

SEQ ID NO: 28350 - DNA, 20 bp, Artificial Sequence
  Description of Artificial Sequence: Synthetic oligonucleotide
  Target: SCN10A; (+) strand; PAM type: NRG; PAM sequence: TAG
ctctaaccctggtgtctgca

SEQ ID NO: 28351 - DNA, 20 bp, Artificial Sequence
  Description of Artificial Sequence: Synthetic oligonucleotide
  Target: SCN10A; (+) strand; PAM type: NRG; PAM sequence: TGG
cctggtgtctgcatagtgcc

SEQ ID NO: 28352 - DNA, 20 bp, Artificial Sequence
  Description of Artificial Sequence: Synthetic oligonucleotide
  Target: SCN10A; (+) strand; PAM type: NRG; PAM sequence: CAG
tgcatagtgcctggctgcaa

SEQ ID NO: 28353 - DNA, 20 bp, Artificial Sequence
  Description of Artificial Sequence: Synthetic oligonucleotide
  Target: SCN10A; (+) strand; PAM type: NRG; PAM sequence: TGG
tctgcaaatttgtaaatgaa

SEQ ID NO: 28354 - DNA, 20 bp, Artificial Sequence
  Description of Artificial Sequence: Synthetic oligonucleotide
  Target: SCN10A; (+) strand; PAM type: NRG; PAM sequence: AAG
gcaaatttgtaaatgaatgg

SEQ ID NO: 28355 - DNA, 20 bp, Artificial Sequence
  Description of Artificial Sequence: Synthetic oligonucleotide
  Target: SCN10A; (+) strand; PAM type: NRG; PAM sequence: CAG
atttgtaaatgaatggaaga

SEQ ID NO: 28356 - DNA, 20 bp, Artificial Sequence
  Description of Artificial Sequence: Synthetic oligonucleotide
  Target: SCN10A; (+) strand; PAM type: NRG; PAM sequence: TGG
taaatgaatggaagacagaa

SEQ ID NO: 28357 - DNA, 20 bp, Artificial Sequence
  Description of Artificial Sequence: Synthetic oligonucleotide
  Target: SCN10A; (+) strand; PAM type: NRG; PAM sequence: GGG
aaatgaatggaagacagaat

SEQ ID NO: 28358 - DNA, 20 bp, Artificial Sequence
  Description of Artificial Sequence: Synthetic oligonucleotide
  Target: SCN10A; (+) strand; PAM type: NRG; PAM sequence: CAG
tgaatggaagacagaatggg

SEQ ID NO: 28359 - DNA, 20 bp, Artificial Sequence
  Description of Artificial Sequence: Synthetic oligonucleotide
  Target: SCN10A; (+) strand; PAM type: NRG; PAM sequence: GAG
aagacagaatgggcagctct

SEQ ID NO: 28360 - DNA, 20 bp, Artificial Sequence
  Description of Artificial Sequence: Synthetic oligonucleotide
  Target: SCN10A; (+) strand; PAM type: NRG; PAM sequence: TAG
gggcagctctgagttaacca

SEQ ID NO: 28361 - DNA, 20 bp, Artificial Sequence
  Description of Artificial Sequence: Synthetic oligonucleotide
  Target: SCN10A; (+) strand; PAM type: NRG; PAM sequence: AAG
atagctcaaatgaaaattta

SEQ ID NO: 28362 - DNA, 20 bp, Artificial Sequence
  Description of Artificial Sequence: Synthetic oligonucleotide
  Target: SCN10A; (+) strand; PAM type: NRG; PAM sequence: AAG
actaaattcaattctgtacc

SEQ ID NO: 28363 - DNA, 20 bp, Artificial Sequence
  Description of Artificial Sequence: Synthetic oligonucleotide
  Target: SCN10A; (+) strand; PAM type: NRG; PAM sequence: AGG
ctaaattcaattctgtacca

SEQ ID NO: 28364 - DNA, 20 bp, Artificial Sequence
  Description of Artificial Sequence: Synthetic oligonucleotide
  Target: SCN10A; (+) strand; PAM type: NRG; PAM sequence: GGG
taaattcaattctgtaccaa

SEQ ID NO: 28365 - DNA, 20 bp, Artificial Sequence
  Description of Artificial Sequence: Synthetic oligonucleotide
  Target: SCN10A; (+) strand; PAM type: NRG; PAM sequence: TGG
aagggtacatactgaatgta

SEQ ID NO: 28366 - DNA, 20 bp, Artificial Sequence
  Description of Artificial Sequence: Synthetic oligonucleotide
  Target: SCN10A; (+) strand; PAM type: NRG; PAM sequence: GGG
agggtacatactgaatgtat

SEQ ID NO: 28367 - DNA, 20 bp, Artificial Sequence
  Description of Artificial Sequence: Synthetic oligonucleotide
  Target: SCN10A; (+) strand; PAM type: NRG; PAM sequence: AAG
actgaatgtatgggatgtgc

SEQ ID NO: 28368 - DNA, 20 bp, Artificial Sequence
  Description of Artificial Sequence: Synthetic oligonucleotide
  Target: SCN10A; (+) strand; PAM type: NRG; PAM sequence: GAG
ggatgtgcaagcctctgcat

SEQ ID NO: 28369 - DNA, 20 bp, Artificial Sequence
  Description of Artificial Sequence: Synthetic oligonucleotide
  Target: SCN10A; (+) strand; PAM type: NRG; PAM sequence: TGG
tgtgcaagcctctgcatgag

SEQ ID NO: 28370 - DNA, 20 bp, Artificial Sequence
  Description of Artificial Sequence: Synthetic oligonucleotide
  Target: SCN10A; (+) strand; PAM type: NRG; PAM sequence: GAG
gcctctgcatgagtggctat

SEQ ID NO: 28371 - DNA, 20 bp, Artificial Sequence
  Description of Artificial Sequence: Synthetic oligonucleotide
  Target: SCN10A; (+) strand; PAM type: NRG; PAM sequence: AGG
cctctgcatgagtggctatg

SEQ ID NO: 28372 - DNA, 20 bp, Artificial Sequence
  Description of Artificial Sequence: Synthetic oligonucleotide
  Target: SCN10A; (+) strand; PAM type: NRG; PAM sequence: GGG
ctctgcatgagtggctatga

SEQ ID NO: 28373 - DNA, 20 bp, Artificial Sequence
  Description of Artificial Sequence: Synthetic oligonucleotide
  Target: SCN10A; (+) strand; PAM type: NRG; PAM sequence: GAG
ctgcatgagtggctatgagg

SEQ ID NO: 28374 - DNA, 20 bp, Artificial Sequence
  Description of Artificial Sequence: Synthetic oligonucleotide
  Target: SCN10A; (+) strand; PAM type: NRG; PAM sequence: AGG
tgcatgagtggctatgaggg

SEQ ID NO: 28375 - DNA, 20 bp, Artificial Sequence
  Description of Artificial Sequence: Synthetic oligonucleotide
  Target: SCN10A; (+) strand; PAM type: NRG; PAM sequence: AAG
atgagtggctatgagggagg

SEQ ID NO: 28376 - DNA, 20 bp, Artificial Sequence
  Description of Artificial Sequence: Synthetic oligonucleotide
  Target: SCN10A; (+) strand; PAM type: NRG; PAM sequence: GAG
gagtggctatgagggaggaa

SEQ ID NO: 28377 - DNA, 20 bp, Artificial Sequence
  Description of Artificial Sequence: Synthetic oligonucleotide
  Target: SCN10A; (+) strand; PAM type: NRG; PAM sequence: AAG
tggctatgagggaggaagag

SEQ ID NO: 28378 - DNA, 20 bp, Artificial Sequence
  Description of Artificial Sequence: Synthetic oligonucleotide
  Target: SCN10A; (+) strand; PAM type: NRG; PAM sequence: CAG
agaacctgtctgatcccttc

SEQ ID NO: 28379 - DNA, 20 bp, Artificial Sequence
  Description of Artificial Sequence: Synthetic oligonucleotide
  Target: SCN10A; (+) strand; PAM type: NRG; PAM sequence: AGG
gaacctgtctgatcccttcc

SEQ ID NO: 28380 - DNA, 20 bp, Artificial Sequence
  Description of Artificial Sequence: Synthetic oligonucleotide
  Target: SCN10A; (+) strand; PAM type: NRG; PAM sequence: GGG
aacctgtctgatcccttcca

SEQ ID NO: 28381 - DNA, 20 bp, Artificial Sequence
  Description of Artificial Sequence: Synthetic oligonucleotide
  Target: SCN10A; (+) strand; PAM type: NRG; PAM sequence: GAG
cctgtctgatcccttccagg

SEQ ID NO: 28382 - DNA, 20 bp, Artificial Sequence
  Description of Artificial Sequence: Synthetic oligonucleotide
  Target: SCN10A; (+) strand; PAM type: NRG; PAM sequence: CGG
gatcccttccagggagccca

SEQ ID NO: 28383 - DNA, 20 bp, Artificial Sequence
  Description of Artificial Sequence: Synthetic oligonucleotide
  Target: SCN10A; (+) strand; PAM type: NRG; PAM sequence: GGG
atcccttccagggagcccac

SEQ ID NO: 28384 - DNA, 20 bp, Artificial Sequence
  Description of Artificial Sequence: Synthetic oligonucleotide
  Target: SCN10A; (+) strand; PAM type: NRG; PAM sequence: GAG
cccttccagggagcccacgg

SEQ ID NO: 28385 - DNA, 20 bp, Artificial Sequence
  Description of Artificial Sequence: Synthetic oligonucleotide
  Target: SCN10A; (+) strand; PAM type: NRG; PAM sequence: CAG
gggagcccacgggagctgca

SEQ ID NO: 28386 - DNA, 20 bp, Artificial Sequence
  Description of Artificial Sequence: Synthetic oligonucleotide
  Target: SCN10A; (+) strand; PAM type: NRG; PAM sequence: AAG
gcccacgggagctgcacagc

SEQ ID NO: 28387 - DNA, 20 bp, Artificial Sequence
  Description of Artificial Sequence: Synthetic oligonucleotide
  Target: SCN10A; (+) strand; PAM type: NRG; PAM sequence: CAG
cacgggagctgcacagcaag

SEQ ID NO: 28388 - DNA, 20 bp, Artificial Sequence
  Description of Artificial Sequence: Synthetic oligonucleotide
  Target: SCN10A; (+) strand; PAM type: NRG; PAM sequence: GAG
cgggagctgcacagcaagca

SEQ ID NO: 28389 - DNA, 20 bp, Artificial Sequence
  Description of Artificial Sequence: Synthetic oligonucleotide
  Target: SCN10A; (+) strand; PAM type: NRG; PAM sequence: AGG
gggagctgcacagcaagcag

SEQ ID NO: 28390 - DNA, 20 bp, Artificial Sequence
  Description of Artificial Sequence: Synthetic oligonucleotide
  Target: SCN10A; (+) strand; PAM type: NRG; PAM sequence: GGG
ggagctgcacagcaagcaga

SEQ ID NO: 28391 - DNA, 20 bp, Artificial Sequence
  Description of Artificial Sequence: Synthetic oligonucleotide
  Target: SCN10A; (+) strand; PAM type: NRG; PAM sequence: GGG
gagctgcacagcaagcagag

SEQ ID NO: 28392 - DNA, 20 bp, Artificial Sequence
  Description of Artificial Sequence: Synthetic oligonucleotide
  Target: SCN10A; (+) strand; PAM type: NRG; PAM sequence: GGG
agctgcacagcaagcagagg

SEQ ID NO: 28393 - DNA, 20 bp, Artificial Sequence
  Description of Artificial Sequence: Synthetic oligonucleotide
  Target: SCN10A; (+) strand; PAM type: NRG; PAM sequence: AAG
tgcacagcaagcagaggggg

SEQ ID NO: 28394 - DNA, 20 bp, Artificial Sequence
  Description of Artificial Sequence: Synthetic oligonucleotide
  Target: SCN10A; (+) strand; PAM type: NRG; PAM sequence: GAG
agagggggaagtgctgtgat

SEQ ID NO: 28395 - DNA, 20 bp, Artificial Sequence
  Description of Artificial Sequence: Synthetic oligonucleotide
  Target: SCN10A; (+) strand; PAM type: NRG; PAM sequence: AGG
gagggggaagtgctgtgatg

SEQ ID NO: 28396 - DNA, 20 bp, Artificial Sequence
  Description of Artificial Sequence: Synthetic oligonucleotide
  Target: SCN10A; (+) strand; PAM type: NRG; PAM sequence: TGG
gatccttgccttctgcttca

SEQ ID NO: 28397 - DNA, 20 bp, Artificial Sequence
  Description of Artificial Sequence: Synthetic oligonucleotide
  Target: SCN10A; (+) strand; PAM type: NRG; PAM sequence: TGG
ccttgccttctgcttcatgg

SEQ ID NO: 28398 - DNA, 20 bp, Artificial Sequence
  Description of Artificial Sequence: Synthetic oligonucleotide
  Target: SCN10A; (+) strand; PAM type: NRG; PAM sequence: GGG
cttgccttctgcttcatggt

SEQ ID NO: 28399 - DNA, 20 bp, Artificial Sequence
  Description of Artificial Sequence: Synthetic oligonucleotide
  Target: SCN10A; (+) strand; PAM type: NRG; PAM sequence: GGG
ttgccttctgcttcatggtg

SEQ ID NO: 28400 - DNA, 20 bp, Artificial Sequence
  Description of Artificial Sequence: Synthetic oligonucleotide
  Target: SCN10A; (+) strand; PAM type: NRG; PAM sequence: TGG
cttctgcttcatggtgggga

SEQ ID NO: 28401 - DNA, 20 bp, Artificial Sequence
  Description of Artificial Sequence: Synthetic oligonucleotide
  Target: SCN10A; (+) strand; PAM type: NRG; PAM sequence: GGG
ttctgcttcatggtggggat

SEQ ID NO: 28402 - DNA, 20 bp, Artificial Sequence
  Description of Artificial Sequence: Synthetic oligonucleotide
  Target: SCN10A; (+) strand; PAM type: NRG; PAM sequence: TGG
gggatgggttgctatcctgt

SEQ ID NO: 28403 - DNA, 20 bp, Artificial Sequence
  Description of Artificial Sequence: Synthetic oligonucleotide
  Target: SCN10A; (+) strand; PAM type: NRG; PAM sequence: GGG
ggatgggttgctatcctgtt

SEQ ID NO: 28404 - DNA, 20 bp, Artificial Sequence
  Description of Artificial Sequence: Synthetic oligonucleotide
  Target: SCN10A; (+) strand; PAM type: NRG; PAM sequence: TAG
gggttgctatcctgttgggt

SEQ ID NO: 28405 - DNA, 20 bp, Artificial Sequence
  Description of Artificial Sequence: Synthetic oligonucleotide
  Target: SCN10A; (+) strand; PAM type: NRG; PAM sequence: GAG
gttgctatcctgttgggtta

SEQ ID NO: 28406 - DNA, 20 bp, Artificial Sequence
  Description of Artificial Sequence: Synthetic oligonucleotide
  Target: SCN10A; (+) strand; PAM type: NRG; PAM sequence: AAG
tatcctgttgggttagagca

SEQ ID NO: 28407 - DNA, 20 bp, Artificial Sequence
  Description of Artificial Sequence: Synthetic oligonucleotide
  Target: SCN10A; (+) strand; PAM type: NRG; PAM sequence: CAG
gttgggttagagcaaagaat

SEQ ID NO: 28408 - DNA, 20 bp, Artificial Sequence
  Description of Artificial Sequence: Synthetic oligonucleotide
  Target: SCN10A; (+) strand; PAM type: NRG; PAM sequence: AAG
tagagcaaagaatcagacca

SEQ ID NO: 28409 - DNA, 20 bp, Artificial Sequence
  Description of Artificial Sequence: Synthetic oligonucleotide
  Target: SCN10A; (+) strand; PAM type: NRG; PAM sequence: TGG
agcaaagaatcagaccaaag

SEQ ID NO: 28410 - DNA, 20 bp, Artificial Sequence
  Description of Artificial Sequence: Synthetic oligonucleotide
  Target: SCN10A; (+) strand; PAM type: NRG; PAM sequence: TGG
accaaagtggcctttgctca

SEQ ID NO: 28411 - DNA, 20 bp, Artificial Sequence
  Description of Artificial Sequence: Synthetic oligonucleotide
  Target: SCN10A; (+) strand; PAM type: NRG; PAM sequence: CAG
aaagtggcctttgctcatgg

SEQ ID NO: 28412 - DNA, 20 bp, Artificial Sequence
  Description of Artificial Sequence: Synthetic oligonucleotide
  Target: SCN10A; (+) strand; PAM type: NRG; PAM sequence: TGG
tttgctcatggcagaactgc

SEQ ID NO: 28413 - DNA, 20 bp, Artificial Sequence
  Description of Artificial Sequence: Synthetic oligonucleotide
  Target: SCN10A; (+) strand; PAM type: NRG; PAM sequence: TGG
ctgctggctcacatctttcc

SEQ ID NO: 28414 - DNA, 20 bp, Artificial Sequence
  Description of Artificial Sequence: Synthetic oligonucleotide
  Target: SCN10A; (+) strand; PAM type: NRG; PAM sequence: GGG
tgctggctcacatctttcct

SEQ ID NO: 28415 - DNA, 20 bp, Artificial Sequence
  Description of Artificial Sequence: Synthetic oligonucleotide
  Target: SCN10A; (+) strand; PAM type: NRG; PAM sequence: GGG
gctggctcacatctttcctg

SEQ ID NO: 28416 - DNA, 20 bp, Artificial Sequence
  Description of Artificial Sequence: Synthetic oligonucleotide
  Target: SCN10A; (+) strand; PAM type: NRG; PAM sequence: CAG
ggctcacatctttcctgggg

SEQ ID NO: 28417 - DNA, 20 bp, Artificial Sequence
  Description of Artificial Sequence: Synthetic oligonucleotide
  Target: SCN10A; (+) strand; PAM type: NRG; PAM sequence: AGG
gctcacatctttcctggggc

SEQ ID NO: 28418 - DNA, 20 bp, Artificial Sequence
  Description of Artificial Sequence: Synthetic oligonucleotide
  Target: SCN10A; (+) strand; PAM type: NRG; PAM sequence: GAG
tcacatctttcctggggcag

SEQ ID NO: 28419 - DNA, 20 bp, Artificial Sequence
  Description of Artificial Sequence: Synthetic oligonucleotide
  Target: SCN10A; (+) strand; PAM type: NRG; PAM sequence: AGG
cacatctttcctggggcagg

SEQ ID NO: 28420 - DNA, 20 bp, Artificial Sequence
  Description of Artificial Sequence: Synthetic oligonucleotide
  Target: SCN10A; (+) strand; PAM type: NRG; PAM sequence: GGG
acatctttcctggggcagga

SEQ ID NO: 28421 - DNA, 20 bp, Artificial Sequence
  Description of Artificial Sequence: Synthetic oligonucleotide
  Target: SCN10A; (+) strand; PAM type: NRG; PAM sequence: GGG
catctttcctggggcaggag

SEQ ID NO: 28422 - DNA, 20 bp, Artificial Sequence
  Description of Artificial Sequence: Synthetic oligonucleotide
  Target: SCN10A; (+) strand; PAM type: NRG; PAM sequence: GGG
atctttcctggggcaggagg

SEQ ID NO: 28423 - DNA, 20 bp, Artificial Sequence
  Description of Artificial Sequence: Synthetic oligonucleotide
  Target: SCN10A; (+) strand; PAM type: NRG; PAM sequence: GAG
ggggcaggagggggattgct

SEQ ID NO: 28424 - DNA, 20 bp, Artificial Sequence
  Description of Artificial Sequence: Synthetic oligonucleotide
  Target: SCN10A; (+) strand; PAM type: NRG; PAM sequence: TGG
ttccatttcatcactgaaaa

SEQ ID NO: 28425 - DNA, 20 bp, Artificial Sequence
  Description of Artificial Sequence: Synthetic oligonucleotide
  Target: SCN10A; (+) strand; PAM type: NRG; PAM sequence: CAG
ctgaaaatggtgaaaaaata

SEQ ID NO: 28426 - DNA, 20 bp, Artificial Sequence
  Description of Artificial Sequence: Synthetic oligonucleotide
  Target: SCN10A; (+) strand; PAM type: NRG; PAM sequence: AGG
tgaaaatggtgaaaaaatac

SEQ ID NO: 28427 - DNA, 20 bp, Artificial Sequence
  Description of Artificial Sequence: Synthetic oligonucleotide
  Target: SCN10A; (+) strand; PAM type: NRG; PAM sequence: TGG
aaaaaatacaggcccattca

SEQ ID NO: 28428 - DNA, 20 bp, Artificial Sequence
  Description of Artificial Sequence: Synthetic oligonucleotide
  Target: SCN10A; (+) strand; PAM type: NRG; PAM sequence: CAG
tcacatgacttctaattaaa

SEQ ID NO: 28429 - DNA, 20 bp, Artificial Sequence
  Description of Artificial Sequence: Synthetic oligonucleotide
  Target: SCN10A; (+) strand; PAM type: NRG; PAM sequence: GAG
acatgacttctaattaaaca

SEQ ID NO: 28430 - DNA, 20 bp, Artificial Sequence
  Description of Artificial Sequence: Synthetic oligonucleotide
  Target: SCN10A; (+) strand; PAM type: NRG; PAM sequence: CAG
tgacttctaattaaacagag

SEQ ID NO: 28431 - DNA, 20 bp, Artificial Sequence
  Description of Artificial Sequence: Synthetic oligonucleotide
  Target: SCN10A; (+) strand; PAM type: NRG; PAM sequence: AGG
gacttctaattaaacagagc

SEQ ID NO: 28432 - DNA, 20 bp, Artificial Sequence
  Description of Artificial Sequence: Synthetic oligonucleotide
  Target: SCN10A; (+) strand; PAM type: NRG; PAM sequence: CGG
taattaaacagagcaggcaa

SEQ ID NO: 28433 - DNA, 20 bp, Artificial Sequence
  Description of Artificial Sequence: Synthetic oligonucleotide
  Target: SCN10A; (+) strand; PAM type: NRG; PAM sequence: AAG
gagcaggcaacggcatcgtt

SEQ ID NO: 28434 - DNA, 20 bp, Artificial Sequence
  Description of Artificial Sequence: Synthetic oligonucleotide
  Target: SCN10A; (+) strand; PAM type: NRG; PAM sequence: TGG
caggcaacggcatcgttaag

SEQ ID NO: 28435 - DNA, 20 bp, Artificial Sequence
  Description of Artificial Sequence: Synthetic oligonucleotide
  Target: SCN10A; (+) strand; PAM type: NRG; PAM sequence: TGG
caacggcatcgttaagtggc

SEQ ID NO: 28436 - DNA, 20 bp, Artificial Sequence
  Description of Artificial Sequence: Synthetic oligonucleotide
  Target: SCN10A; (+) strand; PAM type: NRG; PAM sequence: GGG
aacggcatcgttaagtggct

SEQ ID NO: 28437 - DNA, 20 bp, Artificial Sequence
  Description of Artificial Sequence: Synthetic oligonucleotide
  Target: SCN10A; (+) strand; PAM type: NRG; PAM sequence: AAG
tcgttaagtggctgggtgtg

SEQ ID NO: 28438 - DNA, 20 bp, Artificial Sequence
  Description of Artificial Sequence: Synthetic oligonucleotide
  Target: SCN10A; (+) strand; PAM type: NRG; PAM sequence: TGG
gctgggtgtgaagtttgccc

SEQ ID NO: 28439 - DNA, 20 bp, Artificial Sequence
  Description of Artificial Sequence: Synthetic oligonucleotide
  Target: SCN10A; (+) strand; PAM type: NRG; PAM sequence: TAG
tgccctggatattctgactt

SEQ ID NO: 28440 - DNA, 20 bp, Artificial Sequence
  Description of Artificial Sequence: Synthetic oligonucleotide
  Target: SCN10A; (+) strand; PAM type: NRG; PAM sequence: AGG
gccctggatattctgacttt

SEQ ID NO: 28441 - DNA, 20 bp, Artificial Sequence
  Description of Artificial Sequence: Synthetic oligonucleotide
  Target: SCN10A; (+) strand; PAM type: NRG; PAM sequence: GGG
ccctggatattctgacttta

SEQ ID NO: 28442 - DNA, 20 bp, Artificial Sequence
  Description of Artificial Sequence: Synthetic oligonucleotide
  Target: SCN10A; (+) strand; PAM type: NRG; PAM sequence: TGG
gatattctgactttagggaa

SEQ ID NO: 28443 - DNA, 20 bp, Artificial Sequence
  Description of Artificial Sequence: Synthetic oligonucleotide
  Target: SCN10A; (+) strand; PAM type: NRG; PAM sequence: GAG
tattctgactttagggaatg

SEQ ID NO: 28444 - DNA, 20 bp, Artificial Sequence
  Description of Artificial Sequence: Synthetic oligonucleotide
  Target: SCN10A; (+) strand; PAM type: NRG; PAM sequence: TAG
tctgactttagggaatggag

SEQ ID NO: 28445 - DNA, 20 bp, Artificial Sequence
  Description of Artificial Sequence: Synthetic oligonucleotide
  Target: SCN10A; (+) strand; PAM type: NRG; PAM sequence: TAG
tagggaatggagtagcttgc

SEQ ID NO: 28446 - DNA, 20 bp, Artificial Sequence
  Description of Artificial Sequence: Synthetic oligonucleotide
  Target: SCN10A; (+) strand; PAM type: NRG; PAM sequence: TGG
agtagcttgctagctgctct

SEQ ID NO: 28447 - DNA, 20 bp, Artificial Sequence
  Description of Artificial Sequence: Synthetic oligonucleotide
  Target: SCN10A; (+) strand; PAM type: NRG; PAM sequence: TAG
cttgctagctgctcttggat

SEQ ID NO: 28448 - DNA, 20 bp, Artificial Sequence
  Description of Artificial Sequence: Synthetic oligonucleotide
  Target: SCN10A; (+) strand; PAM type: NRG; PAM sequence: CGG
gctgctcttggattagccca

SEQ ID NO: 28449 - DNA, 20 bp, Artificial Sequence
  Description of Artificial Sequence: Synthetic oligonucleotide
  Target: SCN10A; (+) strand; PAM type: NRG; PAM sequence: CAG
ctcttggattagcccacggt

SEQ ID NO: 28450 - DNA, 20 bp, Artificial Sequence
  Description of Artificial Sequence: Synthetic oligonucleotide
  Target: SCN10A; (+) strand; PAM type: NRG; PAM sequence: AGG
tcttggattagcccacggtc

SEQ ID NO: 28451 - DNA, 20 bp, Artificial Sequence
  Description of Artificial Sequence: Synthetic oligonucleotide
  Target: SCN10A; (+) strand; PAM type: NRG; PAM sequence: GGG
cttggattagcccacggtca

SEQ ID NO: 28452 - DNA, 20 bp, Artificial Sequence
  Description of Artificial Sequence: Synthetic oligonucleotide
  Target: SCN10A; (+) strand; PAM type: NRG; PAM sequence: TGG
gatcatacctttgcaaccct

SEQ ID NO: 28453 - DNA, 20 bp, Artificial Sequence
  Description of Artificial Sequence: Synthetic oligonucleotide
  Target: SCN10A; (+) strand; PAM type: NRG; PAM sequence: CAG
tttgcaacccttggtgctct

SEQ ID NO: 28454 - DNA, 20 bp, Artificial Sequence
  Description of Artificial Sequence: Synthetic oligonucleotide
  Target: SCN10A; (+) strand; PAM type: NRG; PAM sequence: GAG
tgcaacccttggtgctctca

SEQ ID NO: 28455 - DNA, 20 bp, Artificial Sequence
  Description of Artificial Sequence: Synthetic oligonucleotide
  Target: SCN10A; (+) strand; PAM type: NRG; PAM sequence: AAG
tggtgctctcagagacgatg

SEQ ID NO: 28456 - DNA, 20 bp, Artificial Sequence
  Description of Artificial Sequence: Synthetic oligonucleotide
  Target: SCN10A; (+) strand; PAM type: NRG; PAM sequence: TGG
tgctctcagagacgatgaag

SEQ ID NO: 28457 - DNA, 20 bp, Artificial Sequence
  Description of Artificial Sequence: Synthetic oligonucleotide
  Target: SCN10A; (+) strand; PAM type: NRG; PAM sequence: GGG
gctctcagagacgatgaagt

SEQ ID NO: 28458 - DNA, 20 bp, Artificial Sequence
  Description of Artificial Sequence: Synthetic oligonucleotide
  Target: SCN10A; (+) strand; PAM type: NRG; PAM sequence: TAG
attgattatgtgatattctc

SEQ ID NO: 28459 - DNA, 20 bp, Artificial Sequence
  Description of Artificial Sequence: Synthetic oligonucleotide
  Target: SCN10A; (+) strand; PAM type: NRG; PAM sequence: GAG
tgattatgtgatattctcta

SEQ ID NO: 28460 - DNA, 20 bp, Artificial Sequence
  Description of Artificial Sequence: Synthetic oligonucleotide
  Target: SCN10A; (+) strand; PAM type: NRG; PAM sequence: AAG
gagcctattatatttctata

SEQ ID NO: 28461 - DNA, 20 bp, Artificial Sequence
  Description of Artificial Sequence: Synthetic oligonucleotide
  Target: SCN10A; (+) strand; PAM type: NRG; PAM sequence: TGG
cctattatatttctataaag

SEQ ID NO: 28462 - DNA, 20 bp, Artificial Sequence
  Description of Artificial Sequence: Synthetic oligonucleotide
  Target: SCN10A; (+) strand; PAM type: NRG; PAM sequence: GAG
tattatatttctataaagtg

SEQ ID NO: 28463 - DNA, 20 bp, Artificial Sequence
  Description of Artificial Sequence: Synthetic oligonucleotide
  Target: SCN10A; (+) strand; PAM type: NRG; PAM sequence: GAG
ttctataaagtggagtatgt

SEQ ID NO: 28464 - DNA, 20 bp, Artificial Sequence
  Description of Artificial Sequence: Synthetic oligonucleotide
  Target: SCN10A; (+) strand; PAM type: NRG; PAM sequence: GAG
ctataaagtggagtatgtga

SEQ ID NO: 28465 - DNA, 20 bp, Artificial Sequence
  Description of Artificial Sequence: Synthetic oligonucleotide
  Target: SCN10A; (+) strand; PAM type: NRG; PAM sequence: TAG
gctgcttttattgatttctg

SEQ ID NO: 28466 - DNA, 20 bp, Artificial Sequence
  Description of Artificial Sequence: Synthetic oligonucleotide
  Target: SCN10A; (+) strand; PAM type: NRG; PAM sequence: CAG
gcttttattgatttctgtag

SEQ ID NO: 28467 - DNA, 20 bp, Artificial Sequence
  Description of Artificial Sequence: Synthetic oligonucleotide
  Target: SCN10A; (+) strand; PAM type: NRG; PAM sequence: AGG
cttttattgatttctgtagc

SEQ ID NO: 28468 - DNA, 20 bp, Artificial Sequence
  Description of Artificial Sequence: Synthetic oligonucleotide
  Target: SCN10A; (+) strand; PAM type: NRG; PAM sequence: GGG
ttttattgatttctgtagca

SEQ ID NO: 28469 - DNA, 20 bp, Artificial Sequence
  Description of Artificial Sequence: Synthetic oligonucleotide
  Target: SCN10A; (+) strand; PAM type: NRG; PAM sequence: AAG
ttctgtagcagggaatgtta

SEQ ID NO: 28470 - DNA, 20 bp, Artificial Sequence
  Description of Artificial Sequence: Synthetic oligonucleotide
  Target: SCN10A; (+) strand; PAM type: NRG; PAM sequence: CAG
tgttaaagaataaaatttcc

SEQ ID NO: 28471 - DNA, 20 bp, Artificial Sequence
  Description of Artificial Sequence: Synthetic oligonucleotide
  Target: SCN10A; (+) strand; PAM type: NRG; PAM sequence: TGG
aataaaatttcccagtcttg

SEQ ID NO: 28472 - DNA, 20 bp, Artificial Sequence
  Description of Artificial Sequence: Synthetic oligonucleotide
  Target: SCN10A; (+) strand; PAM type: NRG; PAM sequence: TGG
ggaatccttaacttttccta

SEQ ID NO: 28473 - DNA, 20 bp, Artificial Sequence
  Description of Artificial Sequence: Synthetic oligonucleotide
  Target: SCN10A; (+) strand; PAM type: NRG; PAM sequence: AAG
atccttaacttttcctatgg

SEQ ID NO: 28474 - DNA, 20 bp, Artificial Sequence
  Description of Artificial Sequence: Synthetic oligonucleotide
  Target: SCN10A; (+) strand; PAM type: NRG; PAM sequence: AAG
acttttcctatggaagaaac

SEQ ID NO: 28475 - DNA, 20 bp, Artificial Sequence
  Description of Artificial Sequence: Synthetic oligonucleotide
  Target: SCN10A; (+) strand; PAM type: NRG; PAM sequence: TAG
cctatggaagaaacaagatt

SEQ ID NO: 28476 - DNA, 20 bp, Artificial Sequence
  Description of Artificial Sequence: Synthetic oligonucleotide
  Target: SCN10A; (+) strand; PAM type: NRG; PAM sequence: GAG
tatggaagaaacaagattta

SEQ ID NO: 28477 - DNA, 20 bp, Artificial Sequence
  Description of Artificial Sequence: Synthetic oligonucleotide
  Target: SCN10A; (+) strand; PAM type: NRG; PAM sequence: GAG
agaaacaagatttagagcct

SEQ ID NO: 28478 - DNA, 20 bp, Artificial Sequence
  Description of Artificial Sequence: Synthetic oligonucleotide
  Target: SCN10A; (+) strand; PAM type: NRG; PAM sequence: CAG
atttagagcctgagcatcat

SEQ ID NO: 28479 - DNA, 20 bp, Artificial Sequence
  Description of Artificial Sequence: Synthetic oligonucleotide
  Target: SCN10A; (+) strand; PAM type: NRG; PAM sequence: GAG
ttagagcctgagcatcatca

SEQ ID NO: 28480 - DNA, 20 bp, Artificial Sequence
  Description of Artificial Sequence: Synthetic oligonucleotide
  Target: SCN10A; (+) strand; PAM type: NRG; PAM sequence: AGG
tagagcctgagcatcatcag

SEQ ID NO: 28481 - DNA, 20 bp, Artificial Sequence
  Description of Artificial Sequence: Synthetic oligonucleotide
  Target: SCN10A; (+) strand; PAM type: NRG; PAM sequence: GAG
gcctgagcatcatcagaggt

SEQ ID NO: 28482 - DNA, 20 bp, Artificial Sequence
  Description of Artificial Sequence: Synthetic oligonucleotide
  Target: SCN10A; (+) strand; PAM type: NRG; PAM sequence: GAG
ctgagcatcatcagaggtga

SEQ ID NO: 28483 - DNA, 20 bp, Artificial Sequence
  Description of Artificial Sequence: Synthetic oligonucleotide
  Target: SCN10A; (+) strand; PAM type: NRG; PAM sequence: AGG
tgagcatcatcagaggtgag

SEQ ID NO: 28484 - DNA, 20 bp, Artificial Sequence
  Description of Artificial Sequence: Synthetic oligonucleotide
  Target: SCN10A; (+) strand; PAM type: NRG; PAM sequence: GAG
agcatcatcagaggtgagag

SEQ ID NO: 28485 - DNA, 20 bp, Artificial Sequence
  Description of Artificial Sequence: Synthetic oligonucleotide
  Target: SCN10A; (+) strand; PAM type: NRG; PAM sequence: AGG
gcatcatcagaggtgagagg

SEQ ID NO: 28486 - DNA, 20 bp, Artificial Sequence
  Description of Artificial Sequence: Synthetic oligonucleotide
  Target: SCN10A; (+) strand; PAM type: NRG; PAM sequence: GAG
agaggtgagaggaggtgtgt

SEQ ID NO: 28487 - DNA, 20 bp, Artificial Sequence
  Description of Artificial Sequence: Synthetic oligonucleotide
  Target: SCN10A; (+) strand; PAM type: NRG; PAM sequence: AGG
gaggtgagaggaggtgtgtg

SEQ ID NO: 28488 - DNA, 20 bp, Artificial Sequence
  Description of Artificial Sequence: Synthetic oligonucleotide
  Target: SCN10A; (+) strand; PAM type: NRG; PAM sequence: TGG
aggtgtgtgaggctcctatg

SEQ ID NO: 28489 - DNA, 20 bp, Artificial Sequence
  Description of Artificial Sequence: Synthetic oligonucleotide
  Target: SCN10A; (+) strand; PAM type: NRG; PAM sequence: CAG
gtgaggctcctatgtggtcc

SEQ ID NO: 28490 - DNA, 20 bp, Artificial Sequence
  Description of Artificial Sequence: Synthetic oligonucleotide
  Target: SCN10A; (+) strand; PAM type: NRG; PAM sequence: AGG
tgaggctcctatgtggtccc

SEQ ID NO: 28491 - DNA, 20 bp, Artificial Sequence
  Description of Artificial Sequence: Synthetic oligonucleotide
  Target: SCN10A; (+) strand; PAM type: NRG; PAM sequence: AAG
gctcctatgtggtcccaggt

SEQ ID NO: 28492 - DNA, 20 bp, Artificial Sequence
  Description of Artificial Sequence: Synthetic oligonucleotide
  Target: SCN10A; (+) strand; PAM type: NRG; PAM sequence: TGG
aggtaagctctgtcatgaaa

SEQ ID NO: 28493 - DNA, 20 bp, Artificial Sequence
  Description of Artificial Sequence: Synthetic oligonucleotide
  Target: SCN10A; (+) strand; PAM type: NRG; PAM sequence: TGG
aaatggcacccatgcactga

SEQ ID NO: 28494 - DNA, 20 bp, Artificial Sequence
  Description of Artificial Sequence: Synthetic oligonucleotide
  Target: SCN10A; (+) strand; PAM type: NRG; PAM sequence: GGG
aatggcacccatgcactgat

SEQ ID NO: 28495 - DNA, 20 bp, Artificial Sequence
  Description of Artificial Sequence: Synthetic oligonucleotide
  Target: SCN10A; (+) strand; PAM type: NRG; PAM sequence: GGG
atggcacccatgcactgatg

SEQ ID NO: 28496 - DNA, 20 bp, Artificial Sequence
  Description of Artificial Sequence: Synthetic oligonucleotide
  Target: SCN10A; (+) strand; PAM type: NRG; PAM sequence: CAG
gcacccatgcactgatgggg

SEQ ID NO: 28497 - DNA, 20 bp, Artificial Sequence
  Description of Artificial Sequence: Synthetic oligonucleotide
  Target: SCN10A; (+) strand; PAM type: NRG; PAM sequence: CAG
atggggcagaaatcctgtgt

SEQ ID NO: 28498 - DNA, 20 bp, Artificial Sequence
  Description of Artificial Sequence: Synthetic oligonucleotide
  Target: SCN10A; (+) strand; PAM type: NRG; PAM sequence: TGG
atcctgtgtcagtgctttgc

SEQ ID NO: 28499 - DNA, 20 bp, Artificial Sequence
  Description of Artificial Sequence: Synthetic oligonucleotide
  Target: SCN10A; (+) strand; PAM type: NRG; PAM sequence: CAG
cagtgctttgctggtatgac

SEQ ID NO: 28500 - DNA, 20 bp, Artificial Sequence
  Description of Artificial Sequence: Synthetic oligonucleotide
  Target: SCN10A; (+) strand; PAM type: NRG; PAM sequence: TGG
ggtatgaccagcttgacctt

SEQ ID NO: 28501 - DNA, 20 bp, Artificial Sequence
  Description of Artificial Sequence: Synthetic oligonucleotide
  Target: SCN10A; (+) strand; PAM type: NRG; PAM sequence: GGG
gtatgaccagcttgaccttt

SEQ ID NO: 28502 - DNA, 20 bp, Artificial Sequence
  Description of Artificial Sequence: Synthetic oligonucleotide
  Target: SCN10A; (+) strand; PAM type: NRG; PAM sequence: GGG
tatgaccagcttgacctttg

SEQ ID NO: 28503 - DNA, 20 bp, Artificial Sequence
  Description of Artificial Sequence: Synthetic oligonucleotide
  Target: SCN10A; (+) strand; PAM type: NRG; PAM sequence: AAG
gcttgacctttggggctcct

SEQ ID NO: 28504 - DNA, 20 bp, Artificial Sequence
  Description of Artificial Sequence: Synthetic oligonucleotide
  Target: SCN10A; (+) strand; PAM type: NRG; PAM sequence: AGG
cttgacctttggggctccta

SEQ ID NO: 28505 - DNA, 20 bp, Artificial Sequence
  Description of Artificial Sequence: Synthetic oligonucleotide
  Target: SCN10A; (+) strand; PAM type: NRG; PAM sequence: GGG
ttgacctttggggctcctaa

SEQ ID NO: 28506 - DNA, 20 bp, Artificial Sequence
  Description of Artificial Sequence: Synthetic oligonucleotide
  Target: SCN10A; (+) strand; PAM type: NRG; PAM sequence: GGG
tgacctttggggctcctaag

SEQ ID NO: 28507 - DNA, 20 bp, Artificial Sequence
  Description of Artificial Sequence: Synthetic oligonucleotide
  Target: SCN10A; (+) strand; PAM type: NRG; PAM sequence: GAG
acctttggggctcctaaggg

SEQ ID NO: 28508 - DNA, 20 bp, Artificial Sequence
  Description of Artificial Sequence: Synthetic oligonucleotide
  Target: SCN10A; (+) strand; PAM type: NRG; PAM sequence: AAG
tttggggctcctaaggggag

SEQ ID NO: 28509 - DNA, 20 bp, Artificial Sequence
  Description of Artificial Sequence: Synthetic oligonucleotide
  Target: SCN10A; (+) strand; PAM type: NRG; PAM sequence: AGG
ttggggctcctaaggggaga

SEQ ID NO: 28510 - DNA, 20 bp, Artificial Sequence
  Description of Artificial Sequence: Synthetic oligonucleotide
  Target: SCN10A; (+) strand; PAM type: NRG; PAM sequence: TGG
gggctcctaaggggagaagg

SEQ ID NO: 28511 - DNA, 20 bp, Artificial Sequence
  Description of Artificial Sequence: Synthetic oligonucleotide
  Target: SCN10A; (+) strand; PAM type: NRG; PAM sequence: CAG
aggggagaaggtggacattc

SEQ ID NO: 28512 - DNA, 20 bp, Artificial Sequence
  Description of Artificial Sequence: Synthetic oligonucleotide
  Target: SCN10A; (+) strand; PAM type: NRG; PAM sequence: AGG
ggggagaaggtggacattcc

SEQ ID NO: 28513 - DNA, 20 bp, Artificial Sequence
  Description of Artificial Sequence: Synthetic oligonucleotide
  Target: SCN10A; (+) strand; PAM type: NRG; PAM sequence: GGG
gggagaaggtggacattcca

SEQ ID NO: 28514 - DNA, 20 bp, Artificial Sequence
  Description of Artificial Sequence: Synthetic oligonucleotide
  Target: SCN10A; (+) strand; PAM type: NRG; PAM sequence: TGG
acattccagggccaataatc

SEQ ID NO: 28515 - DNA, 20 bp, Artificial Sequence
  Description of Artificial Sequence: Synthetic oligonucleotide
  Target: SCN10A; (+) strand; PAM type: NRG; PAM sequence: AAG
agggccaataatctggccaa

SEQ ID NO: 28516 - DNA, 20 bp, Artificial Sequence
  Description of Artificial Sequence: Synthetic oligonucleotide
  Target: SCN10A; (+) strand; PAM type: NRG; PAM sequence: AAG
ccaataatctggccaaaagc

SEQ ID NO: 28517 - DNA, 20 bp, Artificial Sequence
  Description of Artificial Sequence: Synthetic oligonucleotide
  Target: SCN10A; (+) strand; PAM type: NRG; PAM sequence: TGG
taatctggccaaaagcaagc

SEQ ID NO: 28518 - DNA, 20 bp, Artificial Sequence
  Description of Artificial Sequence: Synthetic oligonucleotide
  Target: SCN10A; (+) strand; PAM type: NRG; PAM sequence: GGG
aatctggccaaaagcaagct

SEQ ID NO: 28519 - DNA, 20 bp, Artificial Sequence
  Description of Artificial Sequence: Synthetic oligonucleotide
  Target: SCN10A; (+) strand; PAM type: NRG; PAM sequence: TGG
ggccaaaagcaagctgggcc

SEQ ID NO: 28520 - DNA, 20 bp, Artificial Sequence
  Description of Artificial Sequence: Synthetic oligonucleotide
  Target: SCN10A; (+) strand; PAM type: NRG; PAM sequence: GGG
gccaaaagcaagctgggcct

SEQ ID NO: 28521 - DNA, 20 bp, Artificial Sequence
  Description of Artificial Sequence: Synthetic oligonucleotide
  Target: SCN10A; (+) strand; PAM type: NRG; PAM sequence: AAG
aaaagcaagctgggcctggg

SEQ ID NO: 28522 - DNA, 20 bp, Artificial Sequence
  Description of Artificial Sequence: Synthetic oligonucleotide
  Target: SCN10A; (+) strand; PAM type: NRG; PAM sequence: AAG
agcaagctgggcctgggaag

SEQ ID NO: 28523 - DNA, 20 bp, Artificial Sequence
  Description of Artificial Sequence: Synthetic oligonucleotide
  Target: SCN10A; (+) strand; PAM type: NRG; PAM sequence: AGG
gcaagctgggcctgggaaga

SEQ ID NO: 28524 - DNA, 20 bp, Artificial Sequence
  Description of Artificial Sequence: Synthetic oligonucleotide
  Target: SCN10A; (+) strand; PAM type: NRG; PAM sequence: GGG
caagctgggcctgggaagaa

SEQ ID NO: 28525 - DNA, 20 bp, Artificial Sequence
  Description of Artificial Sequence: Synthetic oligonucleotide
  Target: SCN10A; (+) strand; PAM type: NRG; PAM sequence: TAG
gggcctgggaagaagggtct

SEQ ID NO: 28526 - DNA, 20 bp, Artificial Sequence
  Description of Artificial Sequence: Synthetic oligonucleotide
  Target: SCN10A; (+) strand; PAM type: NRG; PAM sequence: TGG
ctgggaagaagggtcttagt

SEQ ID NO: 28527 - DNA, 20 bp, Artificial Sequence
  Description of Artificial Sequence: Synthetic oligonucleotide
  Target: SCN10A; (+) strand; PAM type: NRG; PAM sequence: GGG
tgggaagaagggtcttagtt

SEQ ID NO: 28528 - DNA, 20 bp, Artificial Sequence
  Description of Artificial Sequence: Synthetic oligonucleotide
  Target: SCN10A; (+) strand; PAM type: NRG; PAM sequence: GAG
ggaagaagggtcttagttgg

SEQ ID NO: 28529 - DNA, 20 bp, Artificial Sequence
  Description of Artificial Sequence: Synthetic oligonucleotide
  Target: SCN10A; (+) strand; PAM type: NRG; PAM sequence: TGG
agaagggtcttagttgggag

SEQ ID NO: 28530 - DNA, 20 bp, Artificial Sequence
  Description of Artificial Sequence: Synthetic oligonucleotide
  Target: SCN10A; (+) strand; PAM type: NRG; PAM sequence: GGG
gaagggtcttagttgggagt

SEQ ID NO: 28531 - DNA, 20 bp, Artificial Sequence
  Description of Artificial Sequence: Synthetic oligonucleotide
  Target: SCN10A; (+) strand; PAM type: NRG; PAM sequence: TGG
gtgggaatttccttttgcct

SEQ ID NO: 28532 - DNA, 20 bp, Artificial Sequence
  Description of Artificial Sequence: Synthetic oligonucleotide
  Target: SCN10A; (+) strand; PAM type: NRG; PAM sequence: TGG
tttgccttggatttctttct

SEQ ID NO: 28533 - DNA, 20 bp, Artificial Sequence
  Description of Artificial Sequence: Synthetic oligonucleotide
  Target: SCN10A; (+) strand; PAM type: NRG; PAM sequence: TAG
ttggatttctttcttggttc

SEQ ID NO: 28534 - DNA, 20 bp, Artificial Sequence
  Description of Artificial Sequence: Synthetic oligonucleotide
  Target: SCN10A; (+) strand; PAM type: NRG; PAM sequence: AAG
tttcttggttctagactttg

SEQ ID NO: 28535 - DNA, 20 bp, Artificial Sequence
  Description of Artificial Sequence: Synthetic oligonucleotide
  Target: SCN10A; (+) strand; PAM type: NRG; PAM sequence: GAG
tcttggttctagactttgaa

SEQ ID NO: 28536 - DNA, 20 bp, Artificial Sequence
  Description of Artificial Sequence: Synthetic oligonucleotide
  Target: SCN10A; (+) strand; PAM type: NRG; PAM sequence: AGG
cttggttctagactttgaag

SEQ ID NO: 28537 - DNA, 20 bp, Artificial Sequence
  Description of Artificial Sequence: Synthetic oligonucleotide
  Target: SCN10A; (+) strand; PAM type: NRG; PAM sequence: GGG
ttggttctagactttgaaga

SEQ ID NO: 28538 - DNA, 20 bp, Artificial Sequence
  Description of Artificial Sequence: Synthetic oligonucleotide
  Target: SCN10A; (+) strand; PAM type: NRG; PAM sequence: AAG
gttctagactttgaagaggg

SEQ ID NO: 28539 - DNA, 20 bp, Artificial Sequence
  Description of Artificial Sequence: Synthetic oligonucleotide
  Target: SCN10A; (+) strand; PAM type: NRG; PAM sequence: CGG
tttgaagagggaagatgatc

SEQ ID NO: 28540 - DNA, 20 bp, Artificial Sequence
  Description of Artificial Sequence: Synthetic oligonucleotide
  Target: SCN10A; (+) strand; PAM type: NRG; PAM sequence: TGG
gatgatccggcttgtgccac

SEQ ID NO: 28541 - DNA, 20 bp, Artificial Sequence
  Description of Artificial Sequence: Synthetic oligonucleotide
  Target: SCN10A; (+) strand; PAM type: NRG; PAM sequence: GGG
atgatccggcttgtgccact

SEQ ID NO: 28542 - DNA, 20 bp, Artificial Sequence
  Description of Artificial Sequence: Synthetic oligonucleotide
  Target: SCN10A; (+) strand; PAM type: NRG; PAM sequence: TGG
ggcttgtgccactgggcatg

SEQ ID NO: 28543 - DNA, 20 bp, Artificial Sequence
  Description of Artificial Sequence: Synthetic oligonucleotide
  Target: SCN10A; (+) strand; PAM type: NRG; PAM sequence: GGG
gcttgtgccactgggcatgt

SEQ ID NO: 28544 - DNA, 20 bp, Artificial Sequence
  Description of Artificial Sequence: Synthetic oligonucleotide
  Target: SCN10A; (+) strand; PAM type: NRG; PAM sequence: AAG
cactgggcatgtgggtgtca

SEQ ID NO: 28545 - DNA, 20 bp, Artificial Sequence
  Description of Artificial Sequence: Synthetic oligonucleotide
  Target: SCN10A; (+) strand; PAM type: NRG; PAM sequence: TGG
caaagatgttgcctgccatt

SEQ ID NO: 28546 - DNA, 20 bp, Artificial Sequence
  Description of Artificial Sequence: Synthetic oligonucleotide
  Target: SCN10A; (+) strand; PAM type: NRG; PAM sequence: TGG
gttgcctgccatttggatgc

SEQ ID NO: 28547 - DNA, 20 bp, Artificial Sequence
  Description of Artificial Sequence: Synthetic oligonucleotide
  Target: SCN10A; (+) strand; PAM type: NRG; PAM sequence: CAG
cctgccatttggatgctggt

SEQ ID NO: 28548 - DNA, 20 bp, Artificial Sequence
  Description of Artificial Sequence: Synthetic oligonucleotide
  Target: SCN10A; (+) strand; PAM type: NRG; PAM sequence: AGG
ctgccatttggatgctggtc

SEQ ID NO: 28549 - DNA, 20 bp, Artificial Sequence
  Description of Artificial Sequence: Synthetic oligonucleotide
  Target: SCN10A; (+) strand; PAM type: NRG; PAM sequence: GAG
gccatttggatgctggtcag

SEQ ID NO: 28550 - DNA, 20 bp, Artificial Sequence
  Description of Artificial Sequence: Synthetic oligonucleotide
  Target: SCN10A; (+) strand; PAM type: NRG; PAM sequence: TAG
tttggatgctggtcaggagc

SEQ ID NO: 28551 - DNA, 20 bp, Artificial Sequence
  Description of Artificial Sequence: Synthetic oligonucleotide
  Target: SCN10A; (+) strand; PAM type: NRG; PAM sequence: AGG
ttggatgctggtcaggagct

SEQ ID NO: 28552 - DNA, 20 bp, Artificial Sequence
  Description of Artificial Sequence: Synthetic oligonucleotide
  Target: SCN10A; (+) strand; PAM type: NRG; PAM sequence: TGG
atgctggtcaggagctagga

SEQ ID NO: 28553 - DNA, 20 bp, Artificial Sequence
  Description of Artificial Sequence: Synthetic oligonucleotide
  Target: SCN10A; (+) strand; PAM type: NRG; PAM sequence: AAG
gtcaggagctaggatggtcc

SEQ ID NO: 28554 - DNA, 20 bp, Artificial Sequence
  Description of Artificial Sequence: Synthetic oligonucleotide
  Target: SCN10A; (+) strand; PAM type: NRG; PAM sequence: TGG
ctaggatggtccaagaccta

SEQ ID NO: 28555 - DNA, 20 bp, Artificial Sequence
  Description of Artificial Sequence: Synthetic oligonucleotide
  Target: SCN10A; (+) strand; PAM type: NRG; PAM sequence: GGG
taggatggtccaagacctat

SEQ ID NO: 28556 - DNA, 20 bp, Artificial Sequence
  Description of Artificial Sequence: Synthetic oligonucleotide
  Target: SCN10A; (+) strand; PAM type: NRG; PAM sequence: TGG
ggtccaagacctatgggtcc

SEQ ID NO: 28557 - DNA, 20 bp, Artificial Sequence
  Description of Artificial Sequence: Synthetic oligonucleotide
  Target: SCN10A; (+) strand; PAM type: NRG; PAM sequence: GAG
tccaagacctatgggtcctg

SEQ ID NO: 28558 - DNA, 20 bp, Artificial Sequence
  Description of Artificial Sequence: Synthetic oligonucleotide
  Target: SCN10A; (+) strand; PAM type: NRG; PAM sequence: CAG
gacctatgggtcctggagtg

SEQ ID NO: 28559 - DNA, 20 bp, Artificial Sequence
  Description of Artificial Sequence: Synthetic oligonucleotide
  Target: SCN10A; (+) strand; PAM type: NRG; PAM sequence: CAG
tcctggagtgcagccatctg

SEQ ID NO: 28560 - DNA, 20 bp, Artificial Sequence
  Description of Artificial Sequence: Synthetic oligonucleotide
  Target: SCN10A; (+) strand; PAM type: NRG; PAM sequence: AGG
cctggagtgcagccatctgc

SEQ ID NO: 28561 - DNA, 20 bp, Artificial Sequence
  Description of Artificial Sequence: Synthetic oligonucleotide
  Target: SCN10A; (+) strand; PAM type: NRG; PAM sequence: TGG
agccatctgcaggtgctgct

SEQ ID NO: 28562 - DNA, 20 bp, Artificial Sequence
  Description of Artificial Sequence: Synthetic oligonucleotide
  Target: SCN10A; (+) strand; PAM type: NRG; PAM sequence: TGG
ctttgtgctgatttctctgt

SEQ ID NO: 28563 - DNA, 20 bp, Artificial Sequence
  Description of Artificial Sequence: Synthetic oligonucleotide
  Target: SCN10A; (+) strand; PAM type: NRG; PAM sequence: AAG
ttggcatccctgccacttca

SEQ ID NO: 28564 - DNA, 20 bp, Artificial Sequence
  Description of Artificial Sequence: Synthetic oligonucleotide
  Target: SCN10A; (+) strand; PAM type: NRG; PAM sequence: TAG
aaagttttgtttaaatgttc

SEQ ID NO: 28565 - DNA, 20 bp, Artificial Sequence
  Description of Artificial Sequence: Synthetic oligonucleotide
  Target: SCN10A; (+) strand; PAM type: NRG; PAM sequence: CAG
taaatgttctagccttgcct

SEQ ID NO: 28566 - DNA, 20 bp, Artificial Sequence
  Description of Artificial Sequence: Synthetic oligonucleotide
  Target: SCN10A; (+) strand; PAM type: NRG; PAM sequence: TAG
ttgcctcagctatgcgaaat

SEQ ID NO: 28567 - DNA, 20 bp, Artificial Sequence
  Description of Artificial Sequence: Synthetic oligonucleotide
  Target: SCN10A; (+) strand; PAM type: NRG; PAM sequence: AGG
tgcctcagctatgcgaaatt

SEQ ID NO: 28568 - DNA, 20 bp, Artificial Sequence
  Description of Artificial Sequence: Synthetic oligonucleotide
  Target: SCN10A; (+) strand; PAM type: NRG; PAM sequence: GGG
gcctcagctatgcgaaatta

SEQ ID NO: 28569 - DNA, 20 bp, Artificial Sequence
  Description of Artificial Sequence: Synthetic oligonucleotide
  Target: SCN10A; (+) strand; PAM type: NRG; PAM sequence: AAG
ctatgcgaaattagggaaca

SEQ ID NO: 28570 - DNA, 20 bp, Artificial Sequence
  Description of Artificial Sequence: Synthetic oligonucleotide
  Target: SCN10A; (+) strand; PAM type: NRG; PAM sequence: AGG
tatgcgaaattagggaacaa

SEQ ID NO: 28571 - DNA, 20 bp, Artificial Sequence
  Description of Artificial Sequence: Synthetic oligonucleotide
  Target: SCN10A; (+) strand; PAM type: NRG; PAM sequence: AAG
cgaaattagggaacaaagga

SEQ ID NO: 28572 - DNA, 20 bp, Artificial Sequence
  Description of Artificial Sequence: Synthetic oligonucleotide
  Target: SCN10A; (+) strand; PAM type: NRG; PAM sequence: GAG
aaattagggaacaaaggaaa

SEQ ID NO: 28573 - DNA, 20 bp, Artificial Sequence
  Description of Artificial Sequence: Synthetic oligonucleotide
  Target: SCN10A; (+) strand; PAM type: NRG; PAM sequence: TGG
gaaagagtgtttaccttgct

SEQ ID NO: 28574 - DNA, 20 bp, Artificial Sequence
  Description of Artificial Sequence: Synthetic oligonucleotide
  Target: SCN10A; (+) strand; PAM type: NRG; PAM sequence: GGG
aaagagtgtttaccttgctt

SEQ ID NO: 28575 - DNA, 20 bp, Artificial Sequence
  Description of Artificial Sequence: Synthetic oligonucleotide
  Target: SCN10A; (+) strand; PAM type: NRG; PAM sequence: CAG
agtgtttaccttgcttgggc

SEQ ID NO: 28576 - DNA, 20 bp, Artificial Sequence
  Description of Artificial Sequence: Synthetic oligonucleotide
  Target: SCN10A; (+) strand; PAM type: NRG; PAM sequence: AAG
cttgcttgggccagaatatt

SEQ ID NO: 28577 - DNA, 20 bp, Artificial Sequence
  Description of Artificial Sequence: Synthetic oligonucleotide
  Target: SCN10A; (+) strand; PAM type: NRG; PAM sequence: AGG
ttgcttgggccagaatatta

SEQ ID NO: 28578 - DNA, 20 bp, Artificial Sequence
  Description of Artificial Sequence: Synthetic oligonucleotide
  Target: SCN10A; (+) strand; PAM type: NRG; PAM sequence: GGG
tgcttgggccagaatattaa

SEQ ID NO: 28579 - DNA, 20 bp, Artificial Sequence
  Description of Artificial Sequence: Synthetic oligonucleotide
  Target: SCN10A; (+) strand; PAM type: NRG; PAM sequence: GGG
gcttgggccagaatattaag

SEQ ID NO: 28580 - DNA, 20 bp, Artificial Sequence
  Description of Artificial Sequence: Synthetic oligonucleotide
  Target: SCN10A; (+) strand; PAM type: NRG; PAM sequence: GAG
ttgggccagaatattaaggg

SEQ ID NO: 28581 - DNA, 20 bp, Artificial Sequence
  Description of Artificial Sequence: Synthetic oligonucleotide
  Target: SCN10A; (+) strand; PAM type: NRG; PAM sequence: GAG
gggccagaatattaagggga

SEQ ID NO: 28582 - DNA, 20 bp, Artificial Sequence
  Description of Artificial Sequence: Synthetic oligonucleotide
  Target: SCN10A; (+) strand; PAM type: NRG; PAM sequence: AAG
gagagccacgttcctccact

SEQ ID NO: 28583 - DNA, 20 bp, Artificial Sequence
  Description of Artificial Sequence: Synthetic oligonucleotide
  Target: SCN10A; (+) strand; PAM type: NRG; PAM sequence: AGG
agagccacgttcctccacta

SEQ ID NO: 28584 - DNA, 20 bp, Artificial Sequence
  Description of Artificial Sequence: Synthetic oligonucleotide
  Target: SCN10A; (+) strand; PAM type: NRG; PAM sequence: TAG
ccacgttcctccactaaggc

SEQ ID NO: 28585 - DNA, 20 bp, Artificial Sequence
  Description of Artificial Sequence: Synthetic oligonucleotide
  Target: SCN10A; (+) strand; PAM type: NRG; PAM sequence: AAG
tcctccactaaggctagcaa

SEQ ID NO: 28586 - DNA, 20 bp, Artificial Sequence
  Description of Artificial Sequence: Synthetic oligonucleotide
  Target: SCN10A; (+) strand; PAM type: NRG; PAM sequence: AGG
cctccactaaggctagcaaa

SEQ ID NO: 28587 - DNA, 20 bp, Artificial Sequence
  Description of Artificial Sequence: Synthetic oligonucleotide
  Target: SCN10A; (+) strand; PAM type: NRG; PAM sequence: GAG
actaaggctagcaaaaggtt

SEQ ID NO: 28588 - DNA, 20 bp, Artificial Sequence
  Description of Artificial Sequence: Synthetic oligonucleotide
  Target: SCN10A; (+) strand; PAM type: NRG; PAM sequence: GAG
taaggctagcaaaaggttga

SEQ ID NO: 28589 - DNA, 20 bp, Artificial Sequence
  Description of Artificial Sequence: Synthetic oligonucleotide
  Target: SCN10A; (+) strand; PAM type: NRG; PAM sequence: AAG
atccactcttcttccattca

SEQ ID NO: 28590 - DNA, 20 bp, Artificial Sequence
  Description of Artificial Sequence: Synthetic oligonucleotide
  Target: SCN10A; (+) strand; PAM type: NRG; PAM sequence: AGG
tccactcttcttccattcaa

SEQ ID NO: 28591 - DNA, 20 bp, Artificial Sequence
  Description of Artificial Sequence: Synthetic oligonucleotide
  Target: SCN10A; (+) strand; PAM type: NRG; PAM sequence: TGG
ctcttcttccattcaaagga

SEQ ID NO: 28592 - DNA, 20 bp, Artificial Sequence
  Description of Artificial Sequence: Synthetic oligonucleotide
  Target: SCN10A; (+) strand; PAM type: NRG; PAM sequence: GAG
cttcttccattcaaaggatg

SEQ ID NO: 28593 - DNA, 20 bp, Artificial Sequence
  Description of Artificial Sequence: Synthetic oligonucleotide
  Target: SCN10A; (+) strand; PAM type: NRG; PAM sequence: CAG
attcaaaggatggagaatct

SEQ ID NO: 28594 - DNA, 20 bp, Artificial Sequence
  Description of Artificial Sequence: Synthetic oligonucleotide
  Target: SCN10A; (+) strand; PAM type: NRG; PAM sequence: AGG
ttcaaaggatggagaatctc

SEQ ID NO: 28595 - DNA, 20 bp, Artificial Sequence
  Description of Artificial Sequence: Synthetic oligonucleotide
  Target: SCN10A; (+) strand; PAM type: NRG; PAM sequence: CAG
aggatggagaatctcaggaa

SEQ ID NO: 28596 - DNA, 20 bp, Artificial Sequence
  Description of Artificial Sequence: Synthetic oligonucleotide
  Target: SCN10A; (+) strand; PAM type: NRG; PAM sequence: TGG
gagaatctcaggaacagaat

SEQ ID NO: 28597 - DNA, 20 bp, Artificial Sequence
  Description of Artificial Sequence: Synthetic oligonucleotide
  Target: SCN10A; (+) strand; PAM type: NRG; PAM sequence: GAG
tcaggaacagaattggttat

SEQ ID NO: 28598 - DNA, 20 bp, Artificial Sequence
  Description of Artificial Sequence: Synthetic oligonucleotide
  Target: SCN10A; (+) strand; PAM type: NRG; PAM sequence: AGG
caggaacagaattggttatg

SEQ ID NO: 28599 - DNA, 20 bp, Artificial Sequence
  Description of Artificial Sequence: Synthetic oligonucleotide
  Target: SCN10A; (+) strand; PAM type: NRG; PAM sequence: TGG
tttcacttcccctccacatg

SEQ ID NO: 28600 - DNA, 20 bp, Artificial Sequence
  Description of Artificial Sequence: Synthetic oligonucleotide
  Target: SCN10A; (+) strand; PAM type: NRG; PAM sequence: GAG
tcacttcccctccacatgtg

SEQ ID NO: 28601 - DNA, 20 bp, Artificial Sequence
  Description of Artificial Sequence: Synthetic oligonucleotide
  Target: SCN10A; (+) strand; PAM type: NRG; PAM sequence: AGG
cacttcccctccacatgtgg

SEQ ID NO: 28602 - DNA, 20 bp, Artificial Sequence
  Description of Artificial Sequence: Synthetic oligonucleotide
  Target: SCN10A; (+) strand; PAM type: NRG; PAM sequence: CGG
gtctccccctgtgccatcct

SEQ ID NO: 28603 - DNA, 20 bp, Artificial Sequence
  Description of Artificial Sequence: Synthetic oligonucleotide
  Target: SCN10A; (+) strand; PAM type: NRG; PAM sequence: GAG
ctccccctgtgccatcctcg

SEQ ID NO: 28604 - DNA, 20 bp, Artificial Sequence
  Description of Artificial Sequence: Synthetic oligonucleotide
  Target: SCN10A; (+) strand; PAM type: NRG; PAM sequence: AGG
tccccctgtgccatcctcgg

SEQ ID NO: 28605 - DNA, 20 bp, Artificial Sequence
  Description of Artificial Sequence: Synthetic oligonucleotide
  Target: SCN10A; (+) strand; PAM type: NRG; PAM sequence: TAG
gtgccatcctcggaggatct

SEQ ID NO: 28606 - DNA, 20 bp, Artificial Sequence
  Description of Artificial Sequence: Synthetic oligonucleotide
  Target: SCN10A; (+) strand; PAM type: NRG; PAM sequence: CAG
tcctcggaggatcttagttg

SEQ ID NO: 28607 - DNA, 20 bp, Artificial Sequence
  Description of Artificial Sequence: Synthetic oligonucleotide
  Target: SCN10A; (+) strand; PAM type: NRG; PAM sequence: TAG
gatcttagttgcagcttaat

SEQ ID NO: 28608 - DNA, 20 bp, Artificial Sequence
  Description of Artificial Sequence: Synthetic oligonucleotide
  Target: SCN10A; (+) strand; PAM type: NRG; PAM sequence: AGG
atcttagttgcagcttaatt

SEQ ID NO: 28609 - DNA, 20 bp, Artificial Sequence
  Description of Artificial Sequence: Synthetic oligonucleotide
  Target: SCN10A; (+) strand; PAM type: NRG; PAM sequence: GAG
cttagttgcagcttaattag

SEQ ID NO: 28610 - DNA, 20 bp, Artificial Sequence
  Description of Artificial Sequence: Synthetic oligonucleotide
  Target: SCN10A; (+) strand; PAM type: NRG; PAM sequence: TGG
tgcagcttaattaggagaaa

SEQ ID NO: 28611 - DNA, 20 bp, Artificial Sequence
  Description of Artificial Sequence: Synthetic oligonucleotide
  Target: SCN10A; (+) strand; PAM type: NRG; PAM sequence: CAG
gagaaatggtgattttgttg

SEQ ID NO: 28612 - DNA, 20 bp, Artificial Sequence
  Description of Artificial Sequence: Synthetic oligonucleotide
  Target: SCN10A; (+) strand; PAM type: NRG; PAM sequence: AGG
agaaatggtgattttgttgc

SEQ ID NO: 28613 - DNA, 20 bp, Artificial Sequence
  Description of Artificial Sequence: Synthetic oligonucleotide
  Target: SCN10A; (+) strand; PAM type: NRG; PAM sequence: TGG
tcccactcctatttactgcc

SEQ ID NO: 28614 - DNA, 20 bp, Artificial Sequence
  Description of Artificial Sequence: Synthetic oligonucleotide
  Target: SCN10A; (+) strand; PAM type: NRG; PAM sequence: TAG
actgcctggaatttcaacat

SEQ ID NO: 28615 - DNA, 20 bp, Artificial Sequence
  Description of Artificial Sequence: Synthetic oligonucleotide
  Target: SCN10A; (+) strand; PAM type: NRG; PAM sequence: AGG
ctgcctggaatttcaacatt

SEQ ID NO: 28616 - DNA, 20 bp, Artificial Sequence
  Description of Artificial Sequence: Synthetic oligonucleotide
  Target: SCN10A; (+) strand; PAM type: NRG; PAM sequence: GGG
tgcctggaatttcaacatta

SEQ ID NO: 28617 - DNA, 20 bp, Artificial Sequence
  Description of Artificial Sequence: Synthetic oligonucleotide
  Target: SCN10A; (+) strand; PAM type: NRG; PAM sequence: TAG
acattagggtcatgcctttg

SEQ ID NO: 28618 - DNA, 20 bp, Artificial Sequence
  Description of Artificial Sequence: Synthetic oligonucleotide
  Target: SCN10A; (+) strand; PAM type: NRG; PAM sequence: AGG
cattagggtcatgcctttgt

SEQ ID NO: 28619 - DNA, 20 bp, Artificial Sequence
  Description of Artificial Sequence: Synthetic oligonucleotide
  Target: SCN10A; (+) strand; PAM type: NRG; PAM sequence: TAG
tagggtcatgcctttgtagg

SEQ ID NO: 28620 - DNA, 20 bp, Artificial Sequence
  Description of Artificial Sequence: Synthetic oligonucleotide
  Target: SCN10A; (+) strand; PAM type: NRG; PAM sequence: CAG
ttgtaggtagatgccctctc

SEQ ID NO: 28621 - DNA, 20 bp, Artificial Sequence
  Description of Artificial Sequence: Synthetic oligonucleotide
  Target: SCN10A; (+) strand; PAM type: NRG; PAM sequence: AGG
tgtaggtagatgccctctcc

SEQ ID NO: 28622 - DNA, 20 bp, Artificial Sequence
  Description of Artificial Sequence: Synthetic oligonucleotide
  Target: SCN10A; (+) strand; PAM type: NRG; PAM sequence: GGG
gtaggtagatgccctctcca

SEQ ID NO: 28623 - DNA, 20 bp, Artificial Sequence
  Description of Artificial Sequence: Synthetic oligonucleotide
  Target: SCN10A; (+) strand; PAM type: NRG; PAM sequence: AAG
aatatgatttatcttgtcct

SEQ ID NO: 28624 - DNA, 20 bp, Artificial Sequence
  Description of Artificial Sequence: Synthetic oligonucleotide
  Target: SCN10A; (+) strand; PAM type: NRG; PAM sequence: GAG
ctaagaatgttgtcttcctt

SEQ ID NO: 28625 - DNA, 20 bp, Artificial Sequence
  Description of Artificial Sequence: Synthetic oligonucleotide
  Target: SCN10A; (+) strand; PAM type: NRG; PAM sequence: AGG
taagaatgttgtcttccttg

SEQ ID NO: 28626 - DNA, 20 bp, Artificial Sequence
  Description of Artificial Sequence: Synthetic oligonucleotide
  Target: SCN10A; (+) strand; PAM type: NRG; PAM sequence: GGG
aagaatgttgtcttccttga

SEQ ID NO: 28627 - DNA, 20 bp, Artificial Sequence
  Description of Artificial Sequence: Synthetic oligonucleotide
  Target: SCN10A; (+) strand; PAM type: NRG; PAM sequence: GGG
agaatgttgtcttccttgag

SEQ ID NO: 28628 - DNA, 20 bp, Artificial Sequence
  Description of Artificial Sequence: Synthetic oligonucleotide
  Target: SCN10A; (+) strand; PAM type: NRG; PAM sequence: GAG
aatgttgtcttccttgaggg

SEQ ID NO: 28629 - DNA, 20 bp, Artificial Sequence
  Description of Artificial Sequence: Synthetic oligonucleotide
  Target: SCN10A; (+) strand; PAM type: NRG; PAM sequence: AGG
atgttgtcttccttgagggg

SEQ ID NO: 28630 - DNA, 20 bp, Artificial Sequence
  Description of Artificial Sequence: Synthetic oligonucleotide
  Target: SCN10A; (+) strand; PAM type: NRG; PAM sequence: AAG
ttgtcttccttgaggggagg

SEQ ID NO: 28631 - DNA, 20 bp, Artificial Sequence
  Description of Artificial Sequence: Synthetic oligonucleotide
  Target: SCN10A; (+) strand; PAM type: NRG; PAM sequence: TGG
tgaggggaggaagctttctt

SEQ ID NO: 28632 - DNA, 20 bp, Artificial Sequence
  Description of Artificial Sequence: Synthetic oligonucleotide
  Target: SCN10A; (+) strand; PAM type: NRG; PAM sequence: CAG
ggggaggaagctttctttgg

SEQ ID NO: 28633 - DNA, 20 bp, Artificial Sequence
  Description of Artificial Sequence: Synthetic oligonucleotide
  Target: SCN10A; (+) strand; PAM type: NRG; PAM sequence: TGG
aagctttctttggcagccta

SEQ ID NO: 28634 - DNA, 20 bp, Artificial Sequence
  Description of Artificial Sequence: Synthetic oligonucleotide
  Target: SCN10A; (+) strand; PAM type: NRG; PAM sequence: GGG
agctttctttggcagcctat

SEQ ID NO: 28635 - DNA, 20 bp, Artificial Sequence
  Description of Artificial Sequence: Synthetic oligonucleotide
  Target: SCN10A; (+) strand; PAM type: NRG; PAM sequence: GGG
gctttctttggcagcctatg

SEQ ID NO: 28636 - DNA, 20 bp, Artificial Sequence
  Description of Artificial Sequence: Synthetic oligonucleotide
  Target: SCN10A; (+) strand; PAM type: NRG; PAM sequence: TGG
tctttggcagcctatggggt

SEQ ID NO: 28637 - DNA, 20 bp, Artificial Sequence
  Description of Artificial Sequence: Synthetic oligonucleotide
  Target: SCN10A; (+) strand; PAM type: NRG; PAM sequence: GGG
ctttggcagcctatggggtt

SEQ ID NO: 28638 - DNA, 20 bp, Artificial Sequence
  Description of Artificial Sequence: Synthetic oligonucleotide
  Target: SCN10A; (+) strand; PAM type: NRG; PAM sequence: CAG
cctatggggttgggtgatga

SEQ ID NO: 28639 - DNA, 20 bp, Artificial Sequence
  Description of Artificial Sequence: Synthetic oligonucleotide
  Target: SCN10A; (+) strand; PAM type: NRG; PAM sequence: AGG
ctatggggttgggtgatgac

SEQ ID NO: 28640 - DNA, 20 bp, Artificial Sequence
  Description of Artificial Sequence: Synthetic oligonucleotide
  Target: SCN10A; (+) strand; PAM type: NRG; PAM sequence: GGG
tatggggttgggtgatgaca

SEQ ID NO: 28641 - DNA, 20 bp, Artificial Sequence
  Description of Artificial Sequence: Synthetic oligonucleotide
  Target: SCN10A; (+) strand; PAM type: NRG; PAM sequence: AAG
ggggttgggtgatgacaggg

SEQ ID NO: 28642 - DNA, 20 bp, Artificial Sequence
  Description of Artificial Sequence: Synthetic oligonucleotide
  Target: SCN10A; (+) strand; PAM type: NRG; PAM sequence: AAG
gttgggtgatgacagggaag

SEQ ID NO: 28643 - DNA, 20 bp, Artificial Sequence
  Description of Artificial Sequence: Synthetic oligonucleotide
  Target: SCN10A; (+) strand; PAM type: NRG; PAM sequence: TGG
ggtgatgacagggaagaagc

SEQ ID NO: 28644 - DNA, 20 bp, Artificial Sequence
  Description of Artificial Sequence: Synthetic oligonucleotide
  Target: SCN10A; (+) strand; PAM type: NRG; PAM sequence: GGG
gtgatgacagggaagaagct

SEQ ID NO: 28645 - DNA, 20 bp, Artificial Sequence
  Description of Artificial Sequence: Synthetic oligonucleotide
  Target: SCN10A; (+) strand; PAM type: NRG; PAM sequence: AAG
gggaagaagctgggatgtca

SEQ ID NO: 28646 - DNA, 20 bp, Artificial Sequence
  Description of Artificial Sequence: Synthetic oligonucleotide
  Target: SCN10A; (+) strand; PAM type: NRG; PAM sequence: GAG
gaagaagctgggatgtcaaa

SEQ ID NO: 28647 - DNA, 20 bp, Artificial Sequence
  Description of Artificial Sequence: Synthetic oligonucleotide
  Target: SCN10A; (+) strand; PAM type: NRG; PAM sequence: GAG
agaagctgggatgtcaaaga

SEQ ID NO: 28648 - DNA, 20 bp, Artificial Sequence
  Description of Artificial Sequence: Synthetic oligonucleotide
  Target: SCN10A; (+) strand; PAM type: NRG; PAM sequence: GAG
tgggatgtcaaagagagatt

SEQ ID NO: 28649 - DNA, 20 bp, Artificial Sequence
  Description of Artificial Sequence: Synthetic oligonucleotide
  Target: SCN10A; (+) strand; PAM type: NRG; PAM sequence: TAG
gatgtcaaagagagattgag

SEQ ID NO: 28650 - DNA, 20 bp, Artificial Sequence
  Description of Artificial Sequence: Synthetic oligonucleotide
  Target: SCN10A; (+) strand; PAM type: NRG; PAM sequence: TGG
aagagagattgagtagtatg

SEQ ID NO: 28651 - DNA, 20 bp, Artificial Sequence
  Description of Artificial Sequence: Synthetic oligonucleotide
  Target: SCN10A; (+) strand; PAM type: NRG; PAM sequence: GGG
agagagattgagtagtatgt

SEQ ID NO: 28652 - DNA, 20 bp, Artificial Sequence
  Description of Artificial Sequence: Synthetic oligonucleotide
  Target: SCN10A; (+) strand; PAM type: NRG; PAM sequence: GGG
gagagattgagtagtatgtg

SEQ ID NO: 28653 - DNA, 20 bp, Artificial Sequence
  Description of Artificial Sequence: Synthetic oligonucleotide
  Target: SCN10A; (+) strand; PAM type: NRG; PAM sequence: GGG
agagattgagtagtatgtgg

SEQ ID NO: 28654 - DNA, 20 bp, Artificial Sequence
  Description of Artificial Sequence: Synthetic oligonucleotide
  Target: SCN10A; (+) strand; PAM type: NRG; PAM sequence: AAG
gattgagtagtatgtggggg

SEQ ID NO: 28655 - DNA, 20 bp, Artificial Sequence
  Description of Artificial Sequence: Synthetic oligonucleotide
  Target: SCN10A; (+) strand; PAM type: NRG; PAM sequence: AGG
attgagtagtatgtggggga

SEQ ID NO: 28656 - DNA, 20 bp, Artificial Sequence
  Description of Artificial Sequence: Synthetic oligonucleotide
  Target: SCN10A; (+) strand; PAM type: NRG; PAM sequence: AAG
aaaactttcatgtttttgcc

SEQ ID NO: 28657 - DNA, 20 bp, Artificial Sequence
  Description of Artificial Sequence: Synthetic oligonucleotide
  Target: SCN10A; (+) strand; PAM type: NRG; PAM sequence: AGG
aaactttcatgtttttgcca

SEQ ID NO: 28658 - DNA, 20 bp, Artificial Sequence
  Description of Artificial Sequence: Synthetic oligonucleotide
  Target: SCN10A; (+) strand; PAM type: NRG; PAM sequence: GGG
aactttcatgtttttgccaa

SEQ ID NO: 28659 - DNA, 20 bp, Artificial Sequence
  Description of Artificial Sequence: Synthetic oligonucleotide
  Target: SCN10A; (+) strand; PAM type: NRG; PAM sequence: TAG
tttttgccaagggttgtccc

SEQ ID NO: 28660 - DNA, 20 bp, Artificial Sequence
  Description of Artificial Sequence: Synthetic oligonucleotide
  Target: SCN10A; (+) strand; PAM type: NRG; PAM sequence: TGG
gtccctagcacacacctcct

SEQ ID NO: 28661 - DNA, 20 bp, Artificial Sequence
  Description of Artificial Sequence: Synthetic oligonucleotide
  Target: SCN10A; (+) strand; PAM type: NRG; PAM sequence: TGG
gcacacacctccttggcatc

SEQ ID NO: 28662 - DNA, 20 bp, Artificial Sequence
  Description of Artificial Sequence: Synthetic oligonucleotide
  Target: SCN10A; (+) strand; PAM type: NRG; PAM sequence: TGG
cttggcatctggctcaaatg

SEQ ID NO: 28663 - DNA, 20 bp, Artificial Sequence
  Description of Artificial Sequence: Synthetic oligonucleotide
  Target: SCN10A; (+) strand; PAM type: NRG; PAM sequence: CAG
atgtggattcaatcttactc

SEQ ID NO: 28664 - DNA, 20 bp, Artificial Sequence
  Description of Artificial Sequence: Synthetic oligonucleotide
  Target: SCN10A; (+) strand; PAM type: NRG; PAM sequence: AAG
ttcaatcttactccagccac

SEQ ID NO: 28665 - DNA, 20 bp, Artificial Sequence
  Description of Artificial Sequence: Synthetic oligonucleotide
  Target: SCN10A; (+) strand; PAM type: NRG; PAM sequence: AAG
tcttactccagccacaagta

SEQ ID NO: 28666 - DNA, 20 bp, Artificial Sequence
  Description of Artificial Sequence: Synthetic oligonucleotide
  Target: SCN10A; (+) strand; PAM type: NRG; PAM sequence: AGG
cttactccagccacaagtaa

SEQ ID NO: 28667 - DNA, 20 bp, Artificial Sequence
  Description of Artificial Sequence: Synthetic oligonucleotide
  Target: SCN10A; (+) strand; PAM type: NRG; PAM sequence: CAG
ctccagccacaagtaaaggc

SEQ ID NO: 28668 - DNA, 20 bp, Artificial Sequence
  Description of Artificial Sequence: Synthetic oligonucleotide
  Target: SCN10A; (+) strand; PAM type: NRG; PAM sequence: TGG
gccacaagtaaaggccagtg

SEQ ID NO: 28669 - DNA, 20 bp, Artificial Sequence
  Description of Artificial Sequence: Synthetic oligonucleotide
  Target: SCN10A; (+) strand; PAM type: NRG; PAM sequence: CAG
agtaaaggccagtgtggact

SEQ ID NO: 28670 - DNA, 20 bp, Artificial Sequence
  Description of Artificial Sequence: Synthetic oligonucleotide
  Target: SCN10A; (+) strand; PAM type: NRG; PAM sequence: CAG
ggactcagctgcttgcttct

SEQ ID NO: 28671 - DNA, 20 bp, Artificial Sequence
  Description of Artificial Sequence: Synthetic oligonucleotide
  Target: SCN10A; (+) strand; PAM type: NRG; PAM sequence: AAG
tcagctgcttgcttctcagt

SEQ ID NO: 28672 - DNA, 20 bp, Artificial Sequence
  Description of Artificial Sequence: Synthetic oligonucleotide
  Target: SCN10A; (+) strand; PAM type: NRG; PAM sequence: TAG
gcttgcttctcagtaagtct

SEQ ID NO: 28673 - DNA, 20 bp, Artificial Sequence
  Description of Artificial Sequence: Synthetic oligonucleotide
  Target: SCN10A; (+) strand; PAM type: NRG; PAM sequence: AGG
cttgcttctcagtaagtctt

SEQ ID NO: 28674 - DNA, 20 bp, Artificial Sequence
  Description of Artificial Sequence: Synthetic oligonucleotide
  Target: SCN10A; (+) strand; PAM type: NRG; PAM sequence: GGG
ttgcttctcagtaagtctta

SEQ ID NO: 28675 - DNA, 20 bp, Artificial Sequence
  Description of Artificial Sequence: Synthetic oligonucleotide
  Target: SCN10A; (+) strand; PAM type: NRG; PAM sequence: TGG
cattacccatgacttgaatg

SEQ ID NO: 28676 - DNA, 20 bp, Artificial Sequence
  Description of Artificial Sequence: Synthetic oligonucleotide
  Target: SCN10A; (+) strand; PAM type: NRG; PAM sequence: TGG
acccatgacttgaatgtggt

SEQ ID NO: 28677 - DNA, 20 bp, Artificial Sequence
  Description of Artificial Sequence: Synthetic oligonucleotide
  Target: SCN10A; (+) strand; PAM type: NRG; PAM sequence: GGG
cccatgacttgaatgtggtt

SEQ ID NO: 28678 - DNA, 20 bp, Artificial Sequence
  Description of Artificial Sequence: Synthetic oligonucleotide
  Target: SCN10A; (+) strand; PAM type: NRG; PAM sequence: CAG
acttgaatgtggttgggact

SEQ ID NO: 28679 - DNA, 20 bp, Artificial Sequence
  Description of Artificial Sequence: Synthetic oligonucleotide
  Target: SCN10A; (+) strand; PAM type: NRG; PAM sequence: GAG
tttcacctaattttaatttt

SEQ ID NO: 28680 - DNA, 20 bp, Artificial Sequence
  Description of Artificial Sequence: Synthetic oligonucleotide
  Target: SCN10A; (+) strand; PAM type: NRG; PAM sequence: TGG
ctctccactgaacttgttga

SEQ ID NO: 28681 - DNA, 20 bp, Artificial Sequence
  Description of Artificial Sequence: Synthetic oligonucleotide
  Target: SCN10A; (+) strand; PAM type: NRG; PAM sequence: GAG
ctccactgaacttgttgatg

SEQ ID NO: 28682 - DNA, 20 bp, Artificial Sequence
  Description of Artificial Sequence: Synthetic oligonucleotide
  Target: SCN10A; (+) strand; PAM type: NRG; PAM sequence: AGG
tccactgaacttgttgatgg

SEQ ID NO: 28683 - DNA, 20 bp, Artificial Sequence
  Description of Artificial Sequence: Synthetic oligonucleotide
  Target: SCN10A; (+) strand; PAM type: NRG; PAM sequence: GGG
ccactgaacttgttgatgga

SEQ ID NO: 28684 - DNA, 20 bp, Artificial Sequence
  Description of Artificial Sequence: Synthetic oligonucleotide
  Target: SCN10A; (+) strand; PAM type: NRG; PAM sequence: GAG
ttgatggagggatactcaat

SEQ ID NO: 28685 - DNA, 20 bp, Artificial Sequence
  Description of Artificial Sequence: Synthetic oligonucleotide
  Target: SCN10A; (+) strand; PAM type: NRG; PAM sequence: AAG
gagggatactcaatgagcct

SEQ ID NO: 28686 - DNA, 20 bp, Artificial Sequence
  Description of Artificial Sequence: Synthetic oligonucleotide
  Target: SCN10A; (+) strand; PAM type: NRG; PAM sequence: AGG
agggatactcaatgagccta

SEQ ID NO: 28687 - DNA, 20 bp, Artificial Sequence
  Description of Artificial Sequence: Synthetic oligonucleotide
  Target: SCN10A; (+) strand; PAM type: NRG; PAM sequence: CAG
tgagcctaaggacttttgct

SEQ ID NO: 28688 - DNA, 20 bp, Artificial Sequence
  Description of Artificial Sequence: Synthetic oligonucleotide
  Target: SCN10A; (+) strand; PAM type: NRG; PAM sequence: AGG
gagcctaaggacttttgctc

SEQ ID NO: 28689 - DNA, 20 bp, Artificial Sequence
  Description of Artificial Sequence: Synthetic oligonucleotide
  Target: SCN10A; (+) strand; PAM type: NRG; PAM sequence: CAG
tgctcaggttcactcaaatc

SEQ ID NO: 28690 - DNA, 20 bp, Artificial Sequence
  Description of Artificial Sequence: Synthetic oligonucleotide
  Target: SCN10A; (+) strand; PAM type: NRG; PAM sequence: TGG
atccagttatcttgattgta

SEQ ID NO: 28691 - DNA, 20 bp, Artificial Sequence
  Description of Artificial Sequence: Synthetic oligonucleotide
  Target: SCN10A; (+) strand; PAM type: NRG; PAM sequence: GGG
tccagttatcttgattgtat

SEQ ID NO: 28692 - DNA, 20 bp, Artificial Sequence
  Description of Artificial Sequence: Synthetic oligonucleotide
  Target: SCN10A; (+) strand; PAM type: NRG; PAM sequence: TAG
tcttgattgtatgggtgatt

SEQ ID NO: 28693 - DNA, 20 bp, Artificial Sequence
  Description of Artificial Sequence: Synthetic oligonucleotide
  Target: SCN10A; (+) strand; PAM type: NRG; PAM sequence: AGG
cttgattgtatgggtgattt

SEQ ID NO: 28694 - DNA, 20 bp, Artificial Sequence
  Description of Artificial Sequence: Synthetic oligonucleotide
  Target: SCN10A; (+) strand; PAM type: NRG; PAM sequence: AAG
gattgtatgggtgatttagg

SEQ ID NO: 28695 - DNA, 20 bp, Artificial Sequence
  Description of Artificial Sequence: Synthetic oligonucleotide
  Target: SCN10A; (+) strand; PAM type: NRG; PAM sequence: AAG
gtatgggtgatttaggaaga

SEQ ID NO: 28696 - DNA, 20 bp, Artificial Sequence
  Description of Artificial Sequence: Synthetic oligonucleotide
  Target: SCN10A; (+) strand; PAM type: NRG; PAM sequence: CAG
ggaagaaagctgtgccccta

SEQ ID NO: 28697 - DNA, 20 bp, Artificial Sequence
  Description of Artificial Sequence: Synthetic oligonucleotide
  Target: SCN10A; (+) strand; PAM type: NRG; PAM sequence: GAG
aagaaagctgtgcccctaca

SEQ ID NO: 28698 - DNA, 20 bp, Artificial Sequence
  Description of Artificial Sequence: Synthetic oligonucleotide
  Target: SCN10A; (+) strand; PAM type: NRG; PAM sequence: AGG
agaaagctgtgcccctacag

SEQ ID NO: 28699 - DNA, 20 bp, Artificial Sequence
  Description of Artificial Sequence: Synthetic oligonucleotide
  Target: SCN10A; (+) strand; PAM type: NRG; PAM sequence: CAG
cccattgtaatacttcttat

SEQ ID NO: 28700 - DNA, 20 bp, Artificial Sequence
  Description of Artificial Sequence: Synthetic oligonucleotide
  Target: SCN10A; (+) strand; PAM type: NRG; PAM sequence: TAG
taatacttcttatcagaatc

SEQ ID NO: 28701 - DNA, 20 bp, Artificial Sequence
  Description of Artificial Sequence: Synthetic oligonucleotide
  Target: SCN10A; (+) strand; PAM type: NRG; PAM sequence: TAG
cttcttatcagaatctagac

SEQ ID NO: 28702 - DNA, 20 bp, Artificial Sequence
  Description of Artificial Sequence: Synthetic oligonucleotide
  Target: SCN10A; (+) strand; PAM type: NRG; PAM sequence: CAG
atgaccactatttcaaaata

SEQ ID NO: 28703 - DNA, 20 bp, Artificial Sequence
  Description of Artificial Sequence: Synthetic oligonucleotide
  Target: SCN10A; (+) strand; PAM type: NRG; PAM sequence: AAG
atttcaaaatacagtgtcaa

SEQ ID NO: 28704 - DNA, 20 bp, Artificial Sequence
  Description of Artificial Sequence: Synthetic oligonucleotide
  Target: SCN10A; (+) strand; PAM type: NRG; PAM sequence: AAG
tttttcactttgttctgaca

SEQ ID NO: 28705 - DNA, 20 bp, Artificial Sequence
  Description of Artificial Sequence: Synthetic oligonucleotide
  Target: SCN10A; (+) strand; PAM type: NRG; PAM sequence: AAG
ctttgttctgacaaagtttg

SEQ ID NO: 28706 - DNA, 20 bp, Artificial Sequence
  Description of Artificial Sequence: Synthetic oligonucleotide
  Target: SCN10A; (+) strand; PAM type: NRG; PAM sequence: TAG
cttgatttaaaaaaatctaa

SEQ ID NO: 28707 - DNA, 20 bp, Artificial Sequence
  Description of Artificial Sequence: Synthetic oligonucleotide
  Target: SCN10A; (+) strand; PAM type: NRG; PAM sequence: TGG
tttaaaaaaatctaatagct

SEQ ID NO: 28708 - DNA, 20 bp, Artificial Sequence
  Description of Artificial Sequence: Synthetic oligonucleotide
  Target: SCN10A; (+) strand; PAM type: NRG; PAM sequence: CAG
aaatctaatagcttggctaa

SEQ ID NO: 28709 - DNA, 20 bp, Artificial Sequence
  Description of Artificial Sequence: Synthetic oligonucleotide
  Target: SCN10A; (+) strand; PAM type: NRG; PAM sequence: TAG
gcatgtctccataattcatt

SEQ ID NO: 28710 - DNA, 20 bp, Artificial Sequence
  Description of Artificial Sequence: Synthetic oligonucleotide
  Target: SCN10A; (+) strand; PAM type: NRG; PAM sequence: AGG
catgtctccataattcattt

SEQ ID NO: 28711 - DNA, 20 bp, Artificial Sequence
  Description of Artificial Sequence: Synthetic oligonucleotide
  Target: SCN10A; (+) strand; PAM type: NRG; PAM sequence: GGG
atgtctccataattcattta

SEQ ID NO: 28712 - DNA, 20 bp, Artificial Sequence
  Description of Artificial Sequence: Synthetic oligonucleotide
  Target: SCN10A; (+) strand; PAM type: NRG; PAM sequence: AAG
ctccataattcatttaggga

SEQ ID NO: 28713 - DNA, 20 bp, Artificial Sequence
  Description of Artificial Sequence: Synthetic oligonucleotide
  Target: SCN10A; (+) strand; PAM type: NRG; PAM sequence: AGG
tccataattcatttagggaa

SEQ ID NO: 28714 - DNA, 20 bp, Artificial Sequence
  Description of Artificial Sequence: Synthetic oligonucleotide
  Target: SCN10A; (+) strand; PAM type: NRG; PAM sequence: TGG
ttcctttgttaaatgtcctt

SEQ ID NO: 28715 - DNA, 20 bp, Artificial Sequence
  Description of Artificial Sequence: Synthetic oligonucleotide
  Target: SCN10A; (+) strand; PAM type: NRG; PAM sequence: TGG
ctttggacttttcccttgtg

SEQ ID NO: 28716 - DNA, 20 bp, Artificial Sequence
  Description of Artificial Sequence: Synthetic oligonucleotide
  Target: SCN10A; (+) strand; PAM type: NRG; PAM sequence: GGG
tttggacttttcccttgtgt

SEQ ID NO: 28717 - DNA, 20 bp, Artificial Sequence
  Description of Artificial Sequence: Synthetic oligonucleotide
  Target: SCN10A; (+) strand; PAM type: NRG; PAM sequence: GGG
ttggacttttcccttgtgtg

SEQ ID NO: 28718 - DNA, 20 bp, Artificial Sequence
  Description of Artificial Sequence: Synthetic oligonucleotide
  Target: SCN10A; (+) strand; PAM type: NRG; PAM sequence: AAG
gacttttcccttgtgtgggg

SEQ ID NO: 28719 - DNA, 20 bp, Artificial Sequence
  Description of Artificial Sequence: Synthetic oligonucleotide
  Target: SCN10A; (+) strand; PAM type: NRG; PAM sequence: AGG
acttttcccttgtgtgggga

SEQ ID NO: 28720 - DNA, 20 bp, Artificial Sequence
  Description of Artificial Sequence: Synthetic oligonucleotide
  Target: SCN10A; (+) strand; PAM type: NRG; PAM sequence: GGG
cttttcccttgtgtggggaa

SEQ ID NO: 28721 - DNA, 20 bp, Artificial Sequence
  Description of Artificial Sequence: Synthetic oligonucleotide
  Target: SCN10A; (+) strand; PAM type: NRG; PAM sequence: CAG
ggctaatgaaattgtgtcat

SEQ ID NO: 28722 - DNA, 20 bp, Artificial Sequence
  Description of Artificial Sequence: Synthetic oligonucleotide
  Target: SCN10A; (+) strand; PAM type: NRG; PAM sequence: TAG
tcttcactaatgctgcatct

SEQ ID NO: 28723 - DNA, 20 bp, Artificial Sequence
  Description of Artificial Sequence: Synthetic oligonucleotide
  Target: SCN10A; (+) strand; PAM type: NRG; PAM sequence: CAG
ctaatgctgcatcttagcca

SEQ ID NO: 28724 - DNA, 20 bp, Artificial Sequence
  Description of Artificial Sequence: Synthetic oligonucleotide
  Target: SCN10A; (+) strand; PAM type: NRG; PAM sequence: AAG
tgctgcatcttagccacaga

SEQ ID NO: 28725 - DNA, 20 bp, Artificial Sequence
  Description of Artificial Sequence: Synthetic oligonucleotide
  Target: SCN10A; (+) strand; PAM type: NRG; PAM sequence: TAG
ttagccacagaaagtttatg

SEQ ID NO: 28726 - DNA, 20 bp, Artificial Sequence
  Description of Artificial Sequence: Synthetic oligonucleotide
  Target: SCN10A; (+) strand; PAM type: NRG; PAM sequence: AAG
gccacagaaagtttatgtag

SEQ ID NO: 28727 - DNA, 20 bp, Artificial Sequence
  Description of Artificial Sequence: Synthetic oligonucleotide
  Target: SCN10A; (+) strand; PAM type: NRG; PAM sequence: AGG
ccacagaaagtttatgtaga

SEQ ID NO: 28728 - DNA, 20 bp, Artificial Sequence
  Description of Artificial Sequence: Synthetic oligonucleotide
  Target: SCN10A; (+) strand; PAM type: NRG; PAM sequence: CAG
aaagtttatgtagaaggaca

SEQ ID NO: 28729 - DNA, 20 bp, Artificial Sequence
  Description of Artificial Sequence: Synthetic oligonucleotide
  Target: SCN10A; (+) strand; PAM type: NRG; PAM sequence: AGG
aagtttatgtagaaggacac

SEQ ID NO: 28730 - DNA, 20 bp, Artificial Sequence
  Description of Artificial Sequence: Synthetic oligonucleotide
  Target: SCN10A; (+) strand; PAM type: NRG; PAM sequence: GGG
agtttatgtagaaggacaca

SEQ ID NO: 28731 - DNA, 20 bp, Artificial Sequence
  Description of Artificial Sequence: Synthetic oligonucleotide
  Target: SCN10A; (+) strand; PAM type: NRG; PAM sequence: TGG
acagggccaattccattcac

SEQ ID NO: 28732 - DNA, 20 bp, Artificial Sequence
  Description of Artificial Sequence: Synthetic oligonucleotide
  Target: SCN10A; (+) strand; PAM type: NRG; PAM sequence: GAG
agggccaattccattcactg

SEQ ID NO: 28733 - DNA, 20 bp, Artificial Sequence
  Description of Artificial Sequence: Synthetic oligonucleotide
  Target: SCN10A; (+) strand; PAM type: NRG; PAM sequence: TGG
gccaattccattcactggag

SEQ ID NO: 28734 - DNA, 20 bp, Artificial Sequence
  Description of Artificial Sequence: Synthetic oligonucleotide
  Target: SCN10A; (+) strand; PAM type: NRG; PAM sequence: TGG
attccattcactggagtgga

SEQ ID NO: 28735 - DNA, 20 bp, Artificial Sequence
  Description of Artificial Sequence: Synthetic oligonucleotide
  Target: SCN10A; (+) strand; PAM type: NRG; PAM sequence: CAG
attcactggagtggatggct

SEQ ID NO: 28736 - DNA, 20 bp, Artificial Sequence
  Description of Artificial Sequence: Synthetic oligonucleotide
  Target: SCN10A; (+) strand; PAM type: NRG; PAM sequence: AAG
gatggctcagaaattctttg

SEQ ID NO: 28737 - DNA, 20 bp, Artificial Sequence
  Description of Artificial Sequence: Synthetic oligonucleotide
  Target: SCN10A; (+) strand; PAM type: NRG; PAM sequence: AAG
ctgttcatccattcccaaaa

SEQ ID NO: 28738 - DNA, 20 bp, Artificial Sequence
  Description of Artificial Sequence: Synthetic oligonucleotide
  Target: SCN10A; (+) strand; PAM type: NRG; PAM sequence: TAG
ttcccaaaaaagtgctatct

SEQ ID NO: 28739 - DNA, 20 bp, Artificial Sequence
  Description of Artificial Sequence: Synthetic oligonucleotide
  Target: SCN10A; (+) strand; PAM type: NRG; PAM sequence: AGG
tcccaaaaaagtgctatctt

SEQ ID NO: 28740 - DNA, 20 bp, Artificial Sequence
  Description of Artificial Sequence: Synthetic oligonucleotide
  Target: SCN10A; (+) strand; PAM type: NRG; PAM sequence: GGG
cccaaaaaagtgctatctta

SEQ ID NO: 28741 - DNA, 20 bp, Artificial Sequence
  Description of Artificial Sequence: Synthetic oligonucleotide
  Target: SCN10A; (+) strand; PAM type: NRG; PAM sequence: CAG
agtgctatcttagggcctct

SEQ ID NO: 28742 - DNA, 20 bp, Artificial Sequence
  Description of Artificial Sequence: Synthetic oligonucleotide
  Target: SCN10A; (+) strand; PAM type: NRG; PAM sequence: GAG
tgctatcttagggcctctca

SEQ ID NO: 28743 - DNA, 20 bp, Artificial Sequence
  Description of Artificial Sequence: Synthetic oligonucleotide
  Target: SCN10A; (+) strand; PAM type: NRG; PAM sequence: AGG
gctatcttagggcctctcag

SEQ ID NO: 28744 - DNA, 20 bp, Artificial Sequence
  Description of Artificial Sequence: Synthetic oligonucleotide
  Target: SCN10A; (+) strand; PAM type: NRG; PAM sequence: TGG
gcttgatgttttctatcttc

SEQ ID NO: 28745 - DNA, 20 bp, Artificial Sequence
  Description of Artificial Sequence: Synthetic oligonucleotide
  Target: SCN10A; (+) strand; PAM type: NRG; PAM sequence: CAG
tgatgttttctatcttctgg

SEQ ID NO: 28746 - DNA, 20 bp, Artificial Sequence
  Description of Artificial Sequence: Synthetic oligonucleotide
  Target: SCN10A; (+) strand; PAM type: NRG; PAM sequence: AAG
tgttttctatcttctggcag

SEQ ID NO: 28747 - DNA, 20 bp, Artificial Sequence
  Description of Artificial Sequence: Synthetic oligonucleotide
  Target: SCN10A; (+) strand; PAM type: NRG; PAM sequence: GAG
ctatcttctggcagaagact

SEQ ID NO: 28748 - DNA, 20 bp, Artificial Sequence
  Description of Artificial Sequence: Synthetic oligonucleotide
  Target: SCN10A; (+) strand; PAM type: NRG; PAM sequence: AAG
tcttctggcagaagactgag

SEQ ID NO: 28749 - DNA, 20 bp, Artificial Sequence
  Description of Artificial Sequence: Synthetic oligonucleotide
  Target: SCN10A; (+) strand; PAM type: NRG; PAM sequence: TAG
gcagaagactgagaagaact

SEQ ID NO: 28750 - DNA, 20 bp, Artificial Sequence
  Description of Artificial Sequence: Synthetic oligonucleotide
  Target: SCN10A; (+) strand; PAM type: NRG; PAM sequence: AGG
cagaagactgagaagaactt

SEQ ID NO: 28751 - DNA, 20 bp, Artificial Sequence
  Description of Artificial Sequence: Synthetic oligonucleotide
  Target: SCN10A; (+) strand; PAM type: NRG; PAM sequence: TGG
aacttaggtgatatcatgtg

SEQ ID NO: 28752 - DNA, 20 bp, Artificial Sequence
  Description of Artificial Sequence: Synthetic oligonucleotide
  Target: SCN10A; (+) strand; PAM type: NRG; PAM sequence: TGG
aggtgatatcatgtgtggta

SEQ ID NO: 28753 - DNA, 20 bp, Artificial Sequence
  Description of Artificial Sequence: Synthetic oligonucleotide
  Target: SCN10A; (+) strand; PAM type: NRG; PAM sequence: GGG
ggtgatatcatgtgtggtat

SEQ ID NO: 28754 - DNA, 20 bp, Artificial Sequence
  Description of Artificial Sequence: Synthetic oligonucleotide
  Target: SCN10A; (+) strand; PAM type: NRG; PAM sequence: TAG
gatatcatgtgtggtatggg

SEQ ID NO: 28755 - DNA, 20 bp, Artificial Sequence
  Description of Artificial Sequence: Synthetic oligonucleotide
  Target: SCN10A; (+) strand; PAM type: NRG; PAM sequence: TGG
ggtatgggtagtacatttaa

SEQ ID NO: 28756 - DNA, 20 bp, Artificial Sequence
  Description of Artificial Sequence: Synthetic oligonucleotide
  Target: SCN10A; (+) strand; PAM type: NRG; PAM sequence: GAG
tatgggtagtacatttaatg

SEQ ID NO: 28757 - DNA, 20 bp, Artificial Sequence
  Description of Artificial Sequence: Synthetic oligonucleotide
  Target: SCN10A; (+) strand; PAM type: NRG; PAM sequence: AGG
atgggtagtacatttaatgg

SEQ ID NO: 28758 - DNA, 20 bp, Artificial Sequence
  Description of Artificial Sequence: Synthetic oligonucleotide
  Target: SCN10A; (+) strand; PAM type: NRG; PAM sequence: AAG
acatttaatggaggaacgca

SEQ ID NO: 28759 - DNA, 20 bp, Artificial Sequence
  Description of Artificial Sequence: Synthetic oligonucleotide
  Target: SCN10A; (+) strand; PAM type: NRG; PAM sequence: GAG
aacgcaaagccatgtctctt

SEQ ID NO: 28760 - DNA, 20 bp, Artificial Sequence
  Description of Artificial Sequence: Synthetic oligonucleotide
  Target: SCN10A; (+) strand; PAM type: NRG; PAM sequence: AAG
tcttgagatctttatgaaaa

SEQ ID NO: 28761 - DNA, 20 bp, Artificial Sequence
  Description of Artificial Sequence: Synthetic oligonucleotide
  Target: SCN10A; (+) strand; PAM type: NRG; PAM sequence: AGG
cttgagatctttatgaaaaa

SEQ ID NO: 28762 - DNA, 20 bp, Artificial Sequence
  Description of Artificial Sequence: Synthetic oligonucleotide
  Target: SCN10A; (+) strand; PAM type: NRG; PAM sequence: GAG
tgagatctttatgaaaaaag

SEQ ID NO: 28763 - DNA, 20 bp, Artificial Sequence
  Description of Artificial Sequence: Synthetic oligonucleotide
  Target: SCN10A; (+) strand; PAM type: NRG; PAM sequence: TAG
tatgaaaaaaggagtgaaac

SEQ ID NO: 28764 - DNA, 20 bp, Artificial Sequence
  Description of Artificial Sequence: Synthetic oligonucleotide
  Target: SCN10A; (+) strand; PAM type: NRG; PAM sequence: GAG
tgaaaaaaggagtgaaacta

SEQ ID NO: 28765 - DNA, 20 bp, Artificial Sequence
  Description of Artificial Sequence: Synthetic oligonucleotide
  Target: SCN10A; (+) strand; PAM type: NRG; PAM sequence: TGG
aaaggagtgaaactagagtc

SEQ ID NO: 28766 - DNA, 20 bp, Artificial Sequence
  Description of Artificial Sequence: Synthetic oligonucleotide
  Target: SCN10A; (+) strand; PAM type: NRG; PAM sequence: GAG
tttgcccaatctttaaactc

SEQ ID NO: 28767 - DNA, 20 bp, Artificial Sequence
  Description of Artificial Sequence: Synthetic oligonucleotide
  Target: SCN10A; (+) strand; PAM type: NRG; PAM sequence: TGG
gcccaatctttaaactcgag

SEQ ID NO: 28768 - DNA, 20 bp, Artificial Sequence
  Description of Artificial Sequence: Synthetic oligonucleotide
  Target: SCN10A; (+) strand; PAM type: NRG; PAM sequence: GGG
cccaatctttaaactcgagt

SEQ ID NO: 28769 - DNA, 20 bp, Artificial Sequence
  Description of Artificial Sequence: Synthetic oligonucleotide
  Target: SCN10A; (+) strand; PAM type: NRG; PAM sequence: TGG
aactcgagtgggataacttt

SEQ ID NO: 28770 - DNA, 20 bp, Artificial Sequence
  Description of Artificial Sequence: Synthetic oligonucleotide
  Target: SCN10A; (+) strand; PAM type: NRG; PAM sequence: TGG
ggataacttttggttcctac

SEQ ID NO: 28771 - DNA, 20 bp, Artificial Sequence
  Description of Artificial Sequence: Synthetic oligonucleotide
  Target: SCN10A; (+) strand; PAM type: NRG; PAM sequence: GGG
gataacttttggttcctact

SEQ ID NO: 28772 - DNA, 20 bp, Artificial Sequence
  Description of Artificial Sequence: Synthetic oligonucleotide
  Target: SCN10A; (+) strand; PAM type: NRG; PAM sequence: TGG
ccactaccatgactgcatct

SEQ ID NO: 28773 - DNA, 20 bp, Artificial Sequence
  Description of Artificial Sequence: Synthetic oligonucleotide
  Target: SCN10A; (+) strand; PAM type: NRG; PAM sequence: CAG
gactgcatcttggatcctga

SEQ ID NO: 28774 - DNA, 20 bp, Artificial Sequence
  Description of Artificial Sequence: Synthetic oligonucleotide
  Target: SCN10A; (+) strand; PAM type: NRG; PAM sequence: AGG
actgcatcttggatcctgac

SEQ ID NO: 28775 - DNA, 20 bp, Artificial Sequence
  Description of Artificial Sequence: Synthetic oligonucleotide
  Target: SCN10A; (+) strand; PAM type: NRG; PAM sequence: GGG
ctgcatcttggatcctgaca

SEQ ID NO: 28776 - DNA, 20 bp, Artificial Sequence
  Description of Artificial Sequence: Synthetic oligonucleotide
  Target: SCN10A; (+) strand; PAM type: NRG; PAM sequence: GGG
tgcatcttggatcctgacag

SEQ ID NO: 28777 - DNA, 20 bp, Artificial Sequence
  Description of Artificial Sequence: Synthetic oligonucleotide
  Target: SCN10A; (+) strand; PAM type: NRG; PAM sequence: GAG
catcttggatcctgacaggg

SEQ ID NO: 28778 - DNA, 20 bp, Artificial Sequence
  Description of Artificial Sequence: Synthetic oligonucleotide
  Target: SCN10A; (+) strand; PAM type: NRG; PAM sequence: TGG
ttggatcctgacaggggagt

SEQ ID NO: 28779 - DNA, 20 bp, Artificial Sequence
  Description of Artificial Sequence: Synthetic oligonucleotide
  Target: SCN10A; (+) strand; PAM type: NRG; PAM sequence: GGG
tggatcctgacaggggagtt

SEQ ID NO: 28780 - DNA, 20 bp, Artificial Sequence
  Description of Artificial Sequence: Synthetic oligonucleotide
  Target: SCN10A; (+) strand; PAM type: NRG; PAM sequence: TAG
tcatttcctctctatacctg

SEQ ID NO: 28781 - DNA, 20 bp, Artificial Sequence
  Description of Artificial Sequence: Synthetic oligonucleotide
  Target: SCN10A; (+) strand; PAM type: NRG; PAM sequence: AGG
catttcctctctatacctgt

SEQ ID NO: 28782 - DNA, 20 bp, Artificial Sequence
  Description of Artificial Sequence: Synthetic oligonucleotide
  Target: SCN10A; (+) strand; PAM type: NRG; PAM sequence: TGG
cctctctatacctgtaggcg

SEQ ID NO: 28783 - DNA, 20 bp, Artificial Sequence
  Description of Artificial Sequence: Synthetic oligonucleotide
  Target: SCN10A; (+) strand; PAM type: NRG; PAM sequence: GGG
ctctctatacctgtaggcgt

SEQ ID NO: 28784 - DNA, 20 bp, Artificial Sequence
  Description of Artificial Sequence: Synthetic oligonucleotide
  Target: SCN10A; (+) strand; PAM type: NRG; PAM sequence: GGG
tctctatacctgtaggcgtg

SEQ ID NO: 28785 - DNA, 20 bp, Artificial Sequence
  Description of Artificial Sequence: Synthetic oligonucleotide
  Target: SCN10A; (+) strand; PAM type: NRG; PAM sequence: TAG
ctatacctgtaggcgtgggg

SEQ ID NO: 28786 - DNA, 20 bp, Artificial Sequence
  Description of Artificial Sequence: Synthetic oligonucleotide
  Target: SCN10A; (+) strand; PAM type: NRG; PAM sequence: TAG
tgtaggcgtggggtagaata

SEQ ID NO: 28787 - DNA, 20 bp, Artificial Sequence
  Description of Artificial Sequence: Synthetic oligonucleotide
  Target: SCN10A; (+) strand; PAM type: NRG; PAM sequence: AGG
gtaggcgtggggtagaatat

SEQ ID NO: 28788 - DNA, 20 bp, Artificial Sequence
  Description of Artificial Sequence: Synthetic oligonucleotide
  Target: SCN10A; (+) strand; PAM type: NRG; PAM sequence: GGG
taggcgtggggtagaatata

SEQ ID NO: 28789 - DNA, 20 bp, Artificial Sequence
  Description of Artificial Sequence: Synthetic oligonucleotide
  Target: SCN10A; (+) strand; PAM type: NRG; PAM sequence: TGG
ggtagaatatagggtgatac

SEQ ID NO: 28790 - DNA, 20 bp, Artificial Sequence
  Description of Artificial Sequence: Synthetic oligonucleotide
  Target: SCN10A; (+) strand; PAM type: NRG; PAM sequence: GAG
tagaatatagggtgatactg

SEQ ID NO: 28791 - DNA, 20 bp, Artificial Sequence
  Description of Artificial Sequence: Synthetic oligonucleotide
  Target: SCN10A; (+) strand; PAM type: NRG; PAM sequence: TAG
actggagatctactgcgacc

SEQ ID NO: 28792 - DNA, 20 bp, Artificial Sequence
  Description of Artificial Sequence: Synthetic oligonucleotide
  Target: SCN10A; (+) strand; PAM type: NRG; PAM sequence: AAG
accatgatacataaccacac

SEQ ID NO: 28793 - DNA, 20 bp, Artificial Sequence
  Description of Artificial Sequence: Synthetic oligonucleotide
  Target: SCN10A; (+) strand; PAM type: NRG; PAM sequence: TGG
aaccacacaagtttaatccc

SEQ ID NO: 28794 - DNA, 20 bp, Artificial Sequence
  Description of Artificial Sequence: Synthetic oligonucleotide
  Target: SCN10A; (+) strand; PAM type: NRG; PAM sequence: GGG
accacacaagtttaatccct

SEQ ID NO: 28795 - DNA, 20 bp, Artificial Sequence
  Description of Artificial Sequence: Synthetic oligonucleotide
  Target: SCN10A; (+) strand; PAM type: NRG; PAM sequence: TAG
taactacccttactgtcact

SEQ ID NO: 28796 - DNA, 20 bp, Artificial Sequence
  Description of Artificial Sequence: Synthetic oligonucleotide
  Target: SCN10A; (+) strand; PAM type: NRG; PAM sequence: TGG
tacttgaactctaaaactgt

SEQ ID NO: 28797 - DNA, 20 bp, Artificial Sequence
  Description of Artificial Sequence: Synthetic oligonucleotide
  Target: SCN10A; (+) strand; PAM type: NRG; PAM sequence: GAG
cttgaactctaaaactgttg

SEQ ID NO: 28798 - DNA, 20 bp, Artificial Sequence
  Description of Artificial Sequence: Synthetic oligonucleotide
  Target: SCN10A; (+) strand; PAM type: NRG; PAM sequence: CAG
ctaaaactgttggagaaact

SEQ ID NO: 28799 - DNA, 20 bp, Artificial Sequence
  Description of Artificial Sequence: Synthetic oligonucleotide
  Target: SCN10A; (+) strand; PAM type: NRG; PAM sequence: CAG
aaactcagtgcttcccccaa

SEQ ID NO: 28800 - DNA, 20 bp, Artificial Sequence
  Description of Artificial Sequence: Synthetic oligonucleotide
  Target: SCN10A; (+) strand; PAM type: NRG; PAM sequence: TAG
cccaacagattcatttcaaa

SEQ ID NO: 28801 - DNA, 20 bp, Artificial Sequence
  Description of Artificial Sequence: Synthetic oligonucleotide
  Target: SCN10A; (+) strand; PAM type: NRG; PAM sequence: AAG
ttcatttcaaatagctgtaa

SEQ ID NO: 28802 - DNA, 20 bp, Artificial Sequence
  Description of Artificial Sequence: Synthetic oligonucleotide
  Target: SCN10A; (+) strand; PAM type: NRG; PAM sequence: AGG
tcatttcaaatagctgtaaa

SEQ ID NO: 28803 - DNA, 20 bp, Artificial Sequence
  Description of Artificial Sequence: Synthetic oligonucleotide
  Target: SCN10A; (+) strand; PAM type: NRG; PAM sequence: CAG
tgtaaaaggtatgtttactc

SEQ ID NO: 28804 - DNA, 20 bp, Artificial Sequence
  Description of Artificial Sequence: Synthetic oligonucleotide
  Target: SCN10A; (+) strand; PAM type: NRG; PAM sequence: AAG
aaaaggtatgtttactccag

SEQ ID NO: 28805 - DNA, 20 bp, Artificial Sequence
  Description of Artificial Sequence: Synthetic oligonucleotide
  Target: SCN10A; (+) strand; PAM type: NRG; PAM sequence: CAG
gtatgtttactccagaagac

SEQ ID NO: 28806 - DNA, 20 bp, Artificial Sequence
  Description of Artificial Sequence: Synthetic oligonucleotide
  Target: SCN10A; (+) strand; PAM type: NRG; PAM sequence: GAG
atgtttactccagaagacca

SEQ ID NO: 28807 - DNA, 20 bp, Artificial Sequence
  Description of Artificial Sequence: Synthetic oligonucleotide
  Target: SCN10A; (+) strand; PAM type: NRG; PAM sequence: TGG
cttttgaacttctcattcct

SEQ ID NO: 28808 - DNA, 20 bp, Artificial Sequence
  Description of Artificial Sequence: Synthetic oligonucleotide
  Target: SCN10A; (+) strand; PAM type: NRG; PAM sequence: GGG
ttttgaacttctcattcctt

SEQ ID NO: 28809 - DNA, 20 bp, Artificial Sequence
  Description of Artificial Sequence: Synthetic oligonucleotide
  Target: SCN10A; (+) strand; PAM type: NRG; PAM sequence: TAG
aacttctcattccttgggcc

SEQ ID NO: 28810 - DNA, 20 bp, Artificial Sequence
  Description of Artificial Sequence: Synthetic oligonucleotide
  Target: SCN10A; (+) strand; PAM type: NRG; PAM sequence: AGG
acttctcattccttgggcct

SEQ ID NO: 28811 - DNA, 20 bp, Artificial Sequence
  Description of Artificial Sequence: Synthetic oligonucleotide
  Target: SCN10A; (+) strand; PAM type: NRG; PAM sequence: CAG
ccctcatcccaacgtcaacc

SEQ ID NO: 28812 - DNA, 20 bp, Artificial Sequence
  Description of Artificial Sequence: Synthetic oligonucleotide
  Target: SCN10A; (+) strand; PAM type: NRG; PAM sequence: CAG
cagatcttctcttccataaa

SEQ ID NO: 28813 - DNA, 20 bp, Artificial Sequence
  Description of Artificial Sequence: Synthetic oligonucleotide
  Target: SCN10A; (+) strand; PAM type: NRG; PAM sequence: CAG
ttccataaacagcactccct

SEQ ID NO: 28814 - DNA, 20 bp, Artificial Sequence
  Description of Artificial Sequence: Synthetic oligonucleotide
  Target: SCN10A; (+) strand; PAM type: NRG; PAM sequence: AGG
tccataaacagcactccctc

SEQ ID NO: 28815 - DNA, 20 bp, Artificial Sequence
  Description of Artificial Sequence: Synthetic oligonucleotide
  Target: SCN10A; (+) strand; PAM type: NRG; PAM sequence: CAG
cctcaggcccctgcctgaca

SEQ ID NO: 28816 - DNA, 20 bp, Artificial Sequence
  Description of Artificial Sequence: Synthetic oligonucleotide
  Target: SCN10A; (+) strand; PAM type: NRG; PAM sequence: AGG
ctcaggcccctgcctgacac

SEQ ID NO: 28817 - DNA, 20 bp, Artificial Sequence
  Description of Artificial Sequence: Synthetic oligonucleotide
  Target: SCN10A; (+) strand; PAM type: NRG; PAM sequence: TAG
gcccctgcctgacacaggca

SEQ ID NO: 28818 - DNA, 20 bp, Artificial Sequence
  Description of Artificial Sequence: Synthetic oligonucleotide
  Target: SCN10A; (+) strand; PAM type: NRG; PAM sequence: TGG
acaggcatagactgtcatgt

SEQ ID NO: 28819 - DNA, 20 bp, Artificial Sequence
  Description of Artificial Sequence: Synthetic oligonucleotide
  Target: SCN10A; (+) strand; PAM type: NRG; PAM sequence: CAG
agactgtcatgttggattca

SEQ ID NO: 28820 - DNA, 20 bp, Artificial Sequence
  Description of Artificial Sequence: Synthetic oligonucleotide
  Target: SCN10A; (+) strand; PAM type: NRG; PAM sequence: CAG
tgtcatgttggattcacaga

SEQ ID NO: 28821 - DNA, 20 bp, Artificial Sequence
  Description of Artificial Sequence: Synthetic oligonucleotide
  Target: SCN10A; (+) strand; PAM type: NRG; PAM sequence: AGG
gtcatgttggattcacagac

SEQ ID NO: 28822 - DNA, 20 bp, Artificial Sequence
  Description of Artificial Sequence: Synthetic oligonucleotide
  Target: SCN10A; (+) strand; PAM type: NRG; PAM sequence: TAG
gattcacagacaggctgtgc

SEQ ID NO: 28823 - DNA, 20 bp, Artificial Sequence
  Description of Artificial Sequence: Synthetic oligonucleotide
  Target: SCN10A; (+) strand; PAM type: NRG; PAM sequence: GAG
ttcacagacaggctgtgcta

SEQ ID NO: 28824 - DNA, 20 bp, Artificial Sequence
  Description of Artificial Sequence: Synthetic oligonucleotide
  Target: SCN10A; (+) strand; PAM type: NRG; PAM sequence: AGG
tcacagacaggctgtgctag

SEQ ID NO: 28825 - DNA, 20 bp, Artificial Sequence
  Description of Artificial Sequence: Synthetic oligonucleotide
  Target: SCN10A; (+) strand; PAM type: NRG; PAM sequence: TGG
gctgtgctagaggaaacctc

SEQ ID NO: 28826 - DNA, 20 bp, Artificial Sequence
  Description of Artificial Sequence: Synthetic oligonucleotide
  Target: SCN10A; (+) strand; PAM type: NRG; PAM sequence: GGG
ctgtgctagaggaaacctct

SEQ ID NO: 28827 - DNA, 20 bp, Artificial Sequence
  Description of Artificial Sequence: Synthetic oligonucleotide
  Target: SCN10A; (+) strand; PAM type: NRG; PAM sequence: GGG
tgtgctagaggaaacctctg

SEQ ID NO: 28828 - DNA, 20 bp, Artificial Sequence
  Description of Artificial Sequence: Synthetic oligonucleotide
  Target: SCN10A; (+) strand; PAM type: NRG; PAM sequence: CAG
aggaaacctctggggctcac

SEQ ID NO: 28829 - DNA, 20 bp, Artificial Sequence
  Description of Artificial Sequence: Synthetic oligonucleotide
  Target: SCN10A; (+) strand; PAM type: NRG; PAM sequence: AGG
ggaaacctctggggctcacc

SEQ ID NO: 28830 - DNA, 20 bp, Artificial Sequence
  Description of Artificial Sequence: Synthetic oligonucleotide
  Target: SCN10A; (+) strand; PAM type: NRG; PAM sequence: GGG
gaaacctctggggctcacca

SEQ ID NO: 28831 - DNA, 20 bp, Artificial Sequence
  Description of Artificial Sequence: Synthetic oligonucleotide
  Target: SCN10A; (+) strand; PAM type: NRG; PAM sequence: GGG
aaacctctggggctcaccag

SEQ ID NO: 28832 - DNA, 20 bp, Artificial Sequence
  Description of Artificial Sequence: Synthetic oligonucleotide
  Target: SCN10A; (+) strand; PAM type: NRG; PAM sequence: TGG
ctggggctcaccaggggccg

SEQ ID NO: 28833 - DNA, 20 bp, Artificial Sequence
  Description of Artificial Sequence: Synthetic oligonucleotide
  Target: SCN10A; (+) strand; PAM type: NRG; PAM sequence: GGG
tggggctcaccaggggccgt

SEQ ID NO: 28834 - DNA, 20 bp, Artificial Sequence
  Description of Artificial Sequence: Synthetic oligonucleotide
  Target: SCN10A; (+) strand; PAM type: NRG; PAM sequence: TGG
gctcaccaggggccgtggga

SEQ ID NO: 28835 - DNA, 20 bp, Artificial Sequence
  Description of Artificial Sequence: Synthetic oligonucleotide
  Target: SCN10A; (+) strand; PAM type: NRG; PAM sequence: GGG
ctcaccaggggccgtgggat

SEQ ID NO: 28836 - DNA, 20 bp, Artificial Sequence
  Description of Artificial Sequence: Synthetic oligonucleotide
  Target: SCN10A; (+) strand; PAM type: NRG; PAM sequence: TGG
ggggccgtgggatgggcttc

SEQ ID NO: 28837 - DNA, 20 bp, Artificial Sequence
  Description of Artificial Sequence: Synthetic oligonucleotide
  Target: SCN10A; (+) strand; PAM type: NRG; PAM sequence: GGG
gggccgtgggatgggcttct

SEQ ID NO: 28838 - DNA, 20 bp, Artificial Sequence
  Description of Artificial Sequence: Synthetic oligonucleotide
  Target: SCN10A; (+) strand; PAM type: NRG; PAM sequence: GGG
ggccgtgggatgggcttctg

SEQ ID NO: 28839 - DNA, 20 bp, Artificial Sequence
  Description of Artificial Sequence: Synthetic oligonucleotide
  Target: SCN10A; (+) strand; PAM type: NRG; PAM sequence: TGG
gatgggcttctggggcttct

SEQ ID NO: 28840 - DNA, 20 bp, Artificial Sequence
  Description of Artificial Sequence: Synthetic oligonucleotide
  Target: SCN10A; (+) strand; PAM type: NRG; PAM sequence: GAG
tgggcttctggggcttcttg

SEQ ID NO: 28841 - DNA, 20 bp, Artificial Sequence
  Description of Artificial Sequence: Synthetic oligonucleotide
  Target: SCN10A; (+) strand; PAM type: NRG; PAM sequence: TGG
cttggagcccaacttcttca

SEQ ID NO: 28842 - DNA, 20 bp, Artificial Sequence
  Description of Artificial Sequence: Synthetic oligonucleotide
  Target: SCN10A; (+) strand; PAM type: NRG; PAM sequence: TAG
ccaacttcttcatggcattg

SEQ ID NO: 28843 - DNA, 20 bp, Artificial Sequence
  Description of Artificial Sequence: Synthetic oligonucleotide
  Target: SCN10A; (+) strand; PAM type: NRG; PAM sequence: AAG
tcttctgctcctctgtcatg

SEQ ID NO: 28844 - DNA, 20 bp, Artificial Sequence
  Description of Artificial Sequence: Synthetic oligonucleotide
  Target: SCN10A; (+) strand; PAM type: NRG; PAM sequence: TGG
cctctgtcatgaagatgtcc

SEQ ID NO: 28845 - DNA, 20 bp, Artificial Sequence
  Description of Artificial Sequence: Synthetic oligonucleotide
  Target: SCN10A; (+) strand; PAM type: NRG; PAM sequence: AAG
tgaagatgtcctggccccct

SEQ ID NO: 28846 - DNA, 20 bp, Artificial Sequence
  Description of Artificial Sequence: Synthetic oligonucleotide
  Target: SCN10A; (+) strand; PAM type: NRG; PAM sequence: CAG
atgtcctggccccctaagtg

SEQ ID NO: 28847 - DNA, 20 bp, Artificial Sequence
  Description of Artificial Sequence: Synthetic oligonucleotide
  Target: SCN10A; (+) strand; PAM type: NRG; PAM sequence: GAG
gtcctggccccctaagtgca

SEQ ID NO: 28848 - DNA, 20 bp, Artificial Sequence
  Description of Artificial Sequence: Synthetic oligonucleotide
  Target: SCN10A; (+) strand; PAM type: NRG; PAM sequence: GAG
cctggccccctaagtgcaga

SEQ ID NO: 28849 - DNA, 20 bp, Artificial Sequence
  Description of Artificial Sequence: Synthetic oligonucleotide
  Target: SCN10A; (+) strand; PAM type: NRG; PAM sequence: AGG
ctggccccctaagtgcagag

SEQ ID NO: 28850 - DNA, 20 bp, Artificial Sequence
  Description of Artificial Sequence: Synthetic oligonucleotide
  Target: SCN10A; (+) strand; PAM type: NRG; PAM sequence: GGG
tggccccctaagtgcagaga

SEQ ID NO: 28851 - DNA, 20 bp, Artificial Sequence
  Description of Artificial Sequence: Synthetic oligonucleotide
  Target: SCN10A; (+) strand; PAM type: NRG; PAM sequence: AAG
agagggccacactgttacta

SEQ ID NO: 28852 - DNA, 20 bp, Artificial Sequence
  Description of Artificial Sequence: Synthetic oligonucleotide
  Target: SCN10A; (+) strand; PAM type: NRG; PAM sequence: AAG
ggccacactgttactaaagc

SEQ ID NO: 28853 - DNA, 20 bp, Artificial Sequence
  Description of Artificial Sequence: Synthetic oligonucleotide
  Target: SCN10A; (+) strand; PAM type: NRG; PAM sequence: GAG
ccacactgttactaaagcaa

SEQ ID NO: 28854 - DNA, 20 bp, Artificial Sequence
  Description of Artificial Sequence: Synthetic oligonucleotide
  Target: SCN10A; (+) strand; PAM type: NRG; PAM sequence: AGG
cacactgttactaaagcaag

SEQ ID NO: 28855 - DNA, 20 bp, Artificial Sequence
  Description of Artificial Sequence: Synthetic oligonucleotide
  Target: SCN10A; (+) strand; PAM type: NRG; PAM sequence: CGG
aaagcaagaggaacccccta

SEQ ID NO: 28856 - DNA, 20 bp, Artificial Sequence
  Description of Artificial Sequence: Synthetic oligonucleotide
  Target: SCN10A; (+) strand; PAM type: NRG; PAM sequence: CAG
ccccctacggataccaaaat

SEQ ID NO: 28857 - DNA, 20 bp, Artificial Sequence
  Description of Artificial Sequence: Synthetic oligonucleotide
  Target: SCN10A; (+) strand; PAM type: NRG; PAM sequence: CAG
tacggataccaaaatcagaa

SEQ ID NO: 28858 - DNA, 20 bp, Artificial Sequence
  Description of Artificial Sequence: Synthetic oligonucleotide
  Target: SCN10A; (+) strand; PAM type: NRG; PAM sequence: AGG
acggataccaaaatcagaac

SEQ ID NO: 28859 - DNA, 20 bp, Artificial Sequence
  Description of Artificial Sequence: Synthetic oligonucleotide
  Target: SCN10A; (+) strand; PAM type: NRG; PAM sequence: CAG
gataccaaaatcagaacagg

SEQ ID NO: 28860 - DNA, 20 bp, Artificial Sequence
  Description of Artificial Sequence: Synthetic oligonucleotide
  Target: SCN10A; (+) strand; PAM type: NRG; PAM sequence: AGG
ataccaaaatcagaacaggc

SEQ ID NO: 28861 - DNA, 20 bp, Artificial Sequence
  Description of Artificial Sequence: Synthetic oligonucleotide
  Target: SCN10A; (+) strand; PAM type: NRG; PAM sequence: GAG
accaaaatcagaacaggcag

SEQ ID NO: 28862 - DNA, 20 bp, Artificial Sequence
  Description of Artificial Sequence: Synthetic oligonucleotide
  Target: SCN10A; (+) strand; PAM type: NRG; PAM sequence: GAG
caaaatcagaacaggcagga

SEQ ID NO: 28863 - DNA, 20 bp, Artificial Sequence
  Description of Artificial Sequence: Synthetic oligonucleotide
  Target: SCN10A; (+) strand; PAM type: NRG; PAM sequence: AAG
atcagaacaggcaggagaga

SEQ ID NO: 28864 - DNA, 20 bp, Artificial Sequence
  Description of Artificial Sequence: Synthetic oligonucleotide
  Target: SCN10A; (+) strand; PAM type: NRG; PAM sequence: AGG
tcagaacaggcaggagagaa

SEQ ID NO: 28865 - DNA, 20 bp, Artificial Sequence
  Description of Artificial Sequence: Synthetic oligonucleotide
  Target: SCN10A; (+) strand; PAM type: NRG; PAM sequence: CAG
caaccttctcccctcctctg

SEQ ID NO: 28866 - DNA, 20 bp, Artificial Sequence
  Description of Artificial Sequence: Synthetic oligonucleotide
  Target: SCN10A; (+) strand; PAM type: NRG; PAM sequence: TAG
cttctcccctcctctgcaga

SEQ ID NO: 28867 - DNA, 20 bp, Artificial Sequence
  Description of Artificial Sequence: Synthetic oligonucleotide
  Target: SCN10A; (+) strand; PAM type: NRG; PAM sequence: AAG
cctctgcagatagacaaacc

SEQ ID NO: 28868 - DNA, 20 bp, Artificial Sequence
  Description of Artificial Sequence: Synthetic oligonucleotide
  Target: SCN10A; (+) strand; PAM type: NRG; PAM sequence: CAG
gcagatagacaaaccaagcc

SEQ ID NO: 28869 - DNA, 20 bp, Artificial Sequence
  Description of Artificial Sequence: Synthetic oligonucleotide
  Target: SCN10A; (+) strand; PAM type: NRG; PAM sequence: AAG
gacaaaccaagcccagcatc

SEQ ID NO: 28870 - DNA, 20 bp, Artificial Sequence
  Description of Artificial Sequence: Synthetic oligonucleotide
  Target: SCN10A; (+) strand; PAM type: NRG; PAM sequence: AGG
acaaaccaagcccagcatca

SEQ ID NO: 28871 - DNA, 20 bp, Artificial Sequence
  Description of Artificial Sequence: Synthetic oligonucleotide
  Target: SCN10A; (+) strand; PAM type: NRG; PAM sequence: GAG
aaaccaagcccagcatcaag

SEQ ID NO: 28872 - DNA, 20 bp, Artificial Sequence
  Description of Artificial Sequence: Synthetic oligonucleotide
  Target: SCN10A; (+) strand; PAM type: NRG; PAM sequence: CAG
aaggagtgtcttgccacatc

SEQ ID NO: 28873 - DNA, 20 bp, Artificial Sequence
  Description of Artificial Sequence: Synthetic oligonucleotide
  Target: SCN10A; (+) strand; PAM type: NRG; PAM sequence: CGG
tgtcttgccacatccagtgt

SEQ ID NO: 28874 - DNA, 20 bp, Artificial Sequence
  Description of Artificial Sequence: Synthetic oligonucleotide
  Target: SCN10A; (+) strand; PAM type: NRG; PAM sequence: CGG
tgccacatccagtgtcggaa

SEQ ID NO: 28875 - DNA, 20 bp, Artificial Sequence
  Description of Artificial Sequence: Synthetic oligonucleotide
  Target: SCN10A; (+) strand; PAM type: NRG; PAM sequence: TGG
cacatccagtgtcggaacgg

SEQ ID NO: 28876 - DNA, 20 bp, Artificial Sequence
  Description of Artificial Sequence: Synthetic oligonucleotide
  Target: SCN10A; (+) strand; PAM type: NRG; PAM sequence: GGG
acatccagtgtcggaacggt

SEQ ID NO: 28877 - DNA, 20 bp, Artificial Sequence
  Description of Artificial Sequence: Synthetic oligonucleotide
  Target: SCN10A; (+) strand; PAM type: NRG; PAM sequence: GAG
agtgtcggaacggtgggact

SEQ ID NO: 28878 - DNA, 20 bp, Artificial Sequence
  Description of Artificial Sequence: Synthetic oligonucleotide
  Target: SCN10A; (+) strand; PAM type: NRG; PAM sequence: TGG
tccattgctgactccctgcc

SEQ ID NO: 28879 - DNA, 20 bp, Artificial Sequence
  Description of Artificial Sequence: Synthetic oligonucleotide
  Target: SCN10A; (+) strand; PAM type: NRG; PAM sequence: GGG
ccattgctgactccctgcct

SEQ ID NO: 28880 - DNA, 20 bp, Artificial Sequence
  Description of Artificial Sequence: Synthetic oligonucleotide
  Target: SCN10A; (+) strand; PAM type: NRG; PAM sequence: AAG
actccctgcctgggtctcta

SEQ ID NO: 28881 - DNA, 20 bp, Artificial Sequence
  Description of Artificial Sequence: Synthetic oligonucleotide
  Target: SCN10A; (+) strand; PAM type: NRG; PAM sequence: AAG
ctgcctgggtctctaaagca

SEQ ID NO: 28882 - DNA, 20 bp, Artificial Sequence
  Description of Artificial Sequence: Synthetic oligonucleotide
  Target: SCN10A; (+) strand; PAM type: NRG; PAM sequence: CAG
ctgggtctctaaagcaaagc

SEQ ID NO: 28883 - DNA, 20 bp, Artificial Sequence
  Description of Artificial Sequence: Synthetic oligonucleotide
  Target: SCN10A; (+) strand; PAM type: NRG; PAM sequence: CAG
caaagccagtttctgttctc

SEQ ID NO: 28884 - DNA, 20 bp, Artificial Sequence
  Description of Artificial Sequence: Synthetic oligonucleotide
  Target: SCN10A; (+) strand; PAM type: NRG; PAM sequence: AGG
aaagccagtttctgttctcc

SEQ ID NO: 28885 - DNA, 20 bp, Artificial Sequence
  Description of Artificial Sequence: Synthetic oligonucleotide
  Target: SCN10A; (+) strand; PAM type: NRG; PAM sequence: GGG
aagccagtttctgttctcca

SEQ ID NO: 28886 - DNA, 20 bp, Artificial Sequence
  Description of Artificial Sequence: Synthetic oligonucleotide
  Target: SCN10A; (+) strand; PAM type: NRG; PAM sequence: CAG
gtttctgttctccagggatc

SEQ ID NO: 28887 - DNA, 20 bp, Artificial Sequence
  Description of Artificial Sequence: Synthetic oligonucleotide
  Target: SCN10A; (+) strand; PAM type: NRG; PAM sequence: GAG
ttctgttctccagggatcca

SEQ ID NO: 28888 - DNA, 20 bp, Artificial Sequence
  Description of Artificial Sequence: Synthetic oligonucleotide
  Target: SCN10A; (+) strand; PAM type: NRG; PAM sequence: TGG
ctccagggatccagagatgc

SEQ ID NO: 28889 - DNA, 20 bp, Artificial Sequence
  Description of Artificial Sequence: Synthetic oligonucleotide
  Target: SCN10A; (+) strand; PAM type: NRG; PAM sequence: AAG
ggatccagagatgctggata

SEQ ID NO: 28890 - DNA, 20 bp, Artificial Sequence
  Description of Artificial Sequence: Synthetic oligonucleotide
  Target: SCN10A; (+) strand; PAM type: NRG; PAM sequence: AGG
gatccagagatgctggataa

SEQ ID NO: 28891 - DNA, 20 bp, Artificial Sequence
  Description of Artificial Sequence: Synthetic oligonucleotide
  Target: SCN10A; (+) strand; PAM type: NRG; PAM sequence: GGG
atccagagatgctggataaa

SEQ ID NO: 28892 - DNA, 20 bp, Artificial Sequence
  Description of Artificial Sequence: Synthetic oligonucleotide
  Target: SCN10A; (+) strand; PAM type: NRG; PAM sequence: TGG
cagagatgctggataaaggg

SEQ ID NO: 28893 - DNA, 20 bp, Artificial Sequence
  Description of Artificial Sequence: Synthetic oligonucleotide
  Target: SCN10A; (+) strand; PAM type: NRG; PAM sequence: GGG
agagatgctggataaagggt

SEQ ID NO: 28894 - DNA, 20 bp, Artificial Sequence
  Description of Artificial Sequence: Synthetic oligonucleotide
  Target: SCN10A; (+) strand; PAM type: NRG; PAM sequence: GGG
gagatgctggataaagggtg

SEQ ID NO: 28895 - DNA, 20 bp, Artificial Sequence
  Description of Artificial Sequence: Synthetic oligonucleotide
  Target: SCN10A; (+) strand; PAM type: NRG; PAM sequence: GAG
gatgctggataaagggtggg

SEQ ID NO: 28896 - DNA, 20 bp, Artificial Sequence
  Description of Artificial Sequence: Synthetic oligonucleotide
  Target: SCN10A; (+) strand; PAM type: NRG; PAM sequence: AGG
atgctggataaagggtgggg

SEQ ID NO: 28897 - DNA, 20 bp, Artificial Sequence
  Description of Artificial Sequence: Synthetic oligonucleotide
  Target: SCN10A; (+) strand; PAM type: NRG; PAM sequence: GGG
tgctggataaagggtgggga

SEQ ID NO: 28898 - DNA, 20 bp, Artificial Sequence
  Description of Artificial Sequence: Synthetic oligonucleotide
  Target: SCN10A; (+) strand; PAM type: NRG; PAM sequence: TGG
ggataaagggtggggagggt

SEQ ID NO: 28899 - DNA, 20 bp, Artificial Sequence
  Description of Artificial Sequence: Synthetic oligonucleotide
  Target: SCN10A; (+) strand; PAM type: NRG; PAM sequence: CAG
gggtggggagggttggtaaa

SEQ ID NO: 28900 - DNA, 20 bp, Artificial Sequence
  Description of Artificial Sequence: Synthetic oligonucleotide
  Target: SCN10A; (+) strand; PAM type: NRG; PAM sequence: AGG
ggtggggagggttggtaaac

SEQ ID NO: 28901 - DNA, 20 bp, Artificial Sequence
  Description of Artificial Sequence: Synthetic oligonucleotide
  Target: SCN10A; (+) strand; PAM type: NRG; PAM sequence: AAG
agggttggtaaacaggactc

SEQ ID NO: 28902 - DNA, 20 bp, Artificial Sequence
  Description of Artificial Sequence: Synthetic oligonucleotide
  Target: SCN10A; (+) strand; PAM type: NRG; PAM sequence: AGG
gggttggtaaacaggactca

SEQ ID NO: 28903 - DNA, 20 bp, Artificial Sequence
  Description of Artificial Sequence: Synthetic oligonucleotide
  Target: SCN10A; (+) strand; PAM type: NRG; PAM sequence: GAG
gttggtaaacaggactcaag

SEQ ID NO: 28904 - DNA, 20 bp, Artificial Sequence
  Description of Artificial Sequence: Synthetic oligonucleotide
  Target: SCN10A; (+) strand; PAM type: NRG; PAM sequence: AAG
ggtaaacaggactcaaggag

SEQ ID NO: 28905 - DNA, 20 bp, Artificial Sequence
  Description of Artificial Sequence: Synthetic oligonucleotide
  Target: SCN10A; (+) strand; PAM type: NRG; PAM sequence: AGG
gtaaacaggactcaaggaga

SEQ ID NO: 28906 - DNA, 20 bp, Artificial Sequence
  Description of Artificial Sequence: Synthetic oligonucleotide
  Target: SCN10A; (+) strand; PAM type: NRG; PAM sequence: TGG
ctcaaggagaaggtacatgt

SEQ ID NO: 28907 - DNA, 20 bp, Artificial Sequence
  Description of Artificial Sequence: Synthetic oligonucleotide
  Target: SCN10A; (+) strand; PAM type: NRG; PAM sequence: GAG
gtacatgttggttcaaatct

SEQ ID NO: 28908 - DNA, 20 bp, Artificial Sequence
  Description of Artificial Sequence: Synthetic oligonucleotide
  Target: SCN10A; (+) strand; PAM type: NRG; PAM sequence: TGG
gttggttcaaatctgagcct

SEQ ID NO: 28909 - DNA, 20 bp, Artificial Sequence
  Description of Artificial Sequence: Synthetic oligonucleotide
  Target: SCN10A; (+) strand; PAM type: NRG; PAM sequence: TAG
tcaaatctgagccttggatc

SEQ ID NO: 28910 - DNA, 20 bp, Artificial Sequence
  Description of Artificial Sequence: Synthetic oligonucleotide
  Target: SCN10A; (+) strand; PAM type: NRG; PAM sequence: CAG
tggatctagcctgttcattc

SEQ ID NO: 28911 - DNA, 20 bp, Artificial Sequence
  Description of Artificial Sequence: Synthetic oligonucleotide
  Target: SCN10A; (+) strand; PAM type: NRG; PAM sequence: TGG
ttcattccagtaaaattctt

SEQ ID NO: 28912 - DNA, 20 bp, Artificial Sequence
  Description of Artificial Sequence: Synthetic oligonucleotide
  Target: SCN10A; (+) strand; PAM type: NRG; PAM sequence: GGG
tcattccagtaaaattcttt

SEQ ID NO: 28913 - DNA, 20 bp, Artificial Sequence
  Description of Artificial Sequence: Synthetic oligonucleotide
  Target: SCN10A; (+) strand; PAM type: NRG; PAM sequence: TAG
agtaaaattctttgggcttc

SEQ ID NO: 28914 - DNA, 20 bp, Artificial Sequence
  Description of Artificial Sequence: Synthetic oligonucleotide
  Target: SCN10A; (+) strand; PAM type: NRG; PAM sequence: GAG
taaaattctttgggcttcta

SEQ ID NO: 28915 - DNA, 20 bp, Artificial Sequence
  Description of Artificial Sequence: Synthetic oligonucleotide
  Target: SCN10A; (+) strand; PAM type: NRG; PAM sequence: CAG
tctttgggcttctagagtca

SEQ ID NO: 28916 - DNA, 20 bp, Artificial Sequence
  Description of Artificial Sequence: Synthetic oligonucleotide
  Target: SCN10A; (+) strand; PAM type: NRG; PAM sequence: CAG
tctagagtcacagtccctcc

SEQ ID NO: 28917 - DNA, 20 bp, Artificial Sequence
  Description of Artificial Sequence: Synthetic oligonucleotide
  Target: SCN10A; (+) strand; PAM type: NRG; PAM sequence: AGG
ctagagtcacagtccctccc

SEQ ID NO: 28918 - DNA, 20 bp, Artificial Sequence
  Description of Artificial Sequence: Synthetic oligonucleotide
  Target: SCN10A; (+) strand; PAM type: NRG; PAM sequence: GGG
tagagtcacagtccctccca

SEQ ID NO: 28919 - DNA, 20 bp, Artificial Sequence
  Description of Artificial Sequence: Synthetic oligonucleotide
  Target: SCN10A; (+) strand; PAM type: NRG; PAM sequence: GGG
agagtcacagtccctcccag

SEQ ID NO: 28920 - DNA, 20 bp, Artificial Sequence
  Description of Artificial Sequence: Synthetic oligonucleotide
  Target: SCN10A; (+) strand; PAM type: NRG; PAM sequence: GGG
gagtcacagtccctcccagg

SEQ ID NO: 28921 - DNA, 20 bp, Artificial Sequence
  Description of Artificial Sequence: Synthetic oligonucleotide
  Target: SCN10A; (+) strand; PAM type: NRG; PAM sequence: AAG
cacagtccctcccagggggc

SEQ ID NO: 28922 - DNA, 20 bp, Artificial Sequence
  Description of Artificial Sequence: Synthetic oligonucleotide
  Target: SCN10A; (+) strand; PAM type: NRG; PAM sequence: GAG
cagtccctcccagggggcaa

SEQ ID NO: 28923 - DNA, 20 bp, Artificial Sequence
  Description of Artificial Sequence: Synthetic oligonucleotide
  Target: SCN10A; (+) strand; PAM type: NRG; PAM sequence: GAG
cagggggcaagagatttcct

SEQ ID NO: 28924 - DNA, 20 bp, Artificial Sequence
  Description of Artificial Sequence: Synthetic oligonucleotide
  Target: SCN10A; (+) strand; PAM type: NRG; PAM sequence: AGG
agggggcaagagatttcctg

SEQ ID NO: 28925 - DNA, 20 bp, Artificial Sequence
  Description of Artificial Sequence: Synthetic oligonucleotide
  Target: SCN10A; (+) strand; PAM type: NRG; PAM sequence: AAG
gagatttcctgaggaccttg

SEQ ID NO: 28926 - DNA, 20 bp, Artificial Sequence
  Description of Artificial Sequence: Synthetic oligonucleotide
  Target: SCN10A; (+) strand; PAM type: NRG; PAM sequence: AAG
ttcctgaggaccttgaagca

SEQ ID NO: 28927 - DNA, 20 bp, Artificial Sequence
  Description of Artificial Sequence: Synthetic oligonucleotide
  Target: SCN10A; (+) strand; PAM type: NRG; PAM sequence: TGG
ggaccttgaagcaaagactc

SEQ ID NO: 28928 - DNA, 20 bp, Artificial Sequence
  Description of Artificial Sequence: Synthetic oligonucleotide
  Target: SCN10A; (+) strand; PAM type: NRG; PAM sequence: GGG
gaccttgaagcaaagactct

SEQ ID NO: 28929 - DNA, 20 bp, Artificial Sequence
  Description of Artificial Sequence: Synthetic oligonucleotide
  Target: SCN10A; (+) strand; PAM type: NRG; PAM sequence: GAG
ccttgaagcaaagactctgg

SEQ ID NO: 28930 - DNA, 20 bp, Artificial Sequence
  Description of Artificial Sequence: Synthetic oligonucleotide
  Target: SCN10A; (+) strand; PAM type: NRG; PAM sequence: AGG
cttgaagcaaagactctggg

SEQ ID NO: 28931 - DNA, 20 bp, Artificial Sequence
  Description of Artificial Sequence: Synthetic oligonucleotide
  Target: SCN10A; (+) strand; PAM type: NRG; PAM sequence: GGG
ttgaagcaaagactctggga

SEQ ID NO: 28932 - DNA, 20 bp, Artificial Sequence
  Description of Artificial Sequence: Synthetic oligonucleotide
  Target: SCN10A; (+) strand; PAM type: NRG; PAM sequence: CAG
agcaaagactctgggaggga

SEQ ID NO: 28933 - DNA, 20 bp, Artificial Sequence
  Description of Artificial Sequence: Synthetic oligonucleotide
  Target: SCN10A; (+) strand; PAM type: NRG; PAM sequence: AAG
aaagactctgggagggacag

SEQ ID NO: 28934 - DNA, 20 bp, Artificial Sequence
  Description of Artificial Sequence: Synthetic oligonucleotide
  Target: SCN10A; (+) strand; PAM type: NRG; PAM sequence: TGG
agaagccctcaaatcttttc

SEQ ID NO: 28935 - DNA, 20 bp, Artificial Sequence
  Description of Artificial Sequence: Synthetic oligonucleotide
  Target: SCN10A; (+) strand; PAM type: NRG; PAM sequence: GAG
aagccctcaaatcttttctg

SEQ ID NO: 28936 - DNA, 20 bp, Artificial Sequence
  Description of Artificial Sequence: Synthetic oligonucleotide
  Target: SCN10A; (+) strand; PAM type: NRG; PAM sequence: GAG
gccctcaaatcttttctgga

SEQ ID NO: 28937 - DNA, 20 bp, Artificial Sequence
  Description of Artificial Sequence: Synthetic oligonucleotide
  Target: SCN10A; (+) strand; PAM type: NRG; PAM sequence: AGG
ccctcaaatcttttctggag

SEQ ID NO: 28938 - DNA, 20 bp, Artificial Sequence
  Description of Artificial Sequence: Synthetic oligonucleotide
  Target: SCN10A; (+) strand; PAM type: NRG; PAM sequence: GAG
ctcaaatcttttctggagag

SEQ ID NO: 28939 - DNA, 20 bp, Artificial Sequence
  Description of Artificial Sequence: Synthetic oligonucleotide
  Target: SCN10A; (+) strand; PAM type: NRG; PAM sequence: AGG
tcaaatcttttctggagagg

SEQ ID NO: 28940 - DNA, 20 bp, Artificial Sequence
  Description of Artificial Sequence: Synthetic oligonucleotide
  Target: SCN10A; (+) strand; PAM type: NRG; PAM sequence: GAG
aaatcttttctggagaggag

SEQ ID NO: 28941 - DNA, 20 bp, Artificial Sequence
  Description of Artificial Sequence: Synthetic oligonucleotide
  Target: SCN10A; (+) strand; PAM type: NRG; PAM sequence: GAG
ttttctggagaggaggagat

SEQ ID NO: 28942 - DNA, 20 bp, Artificial Sequence
  Description of Artificial Sequence: Synthetic oligonucleotide
  Target: SCN10A; (+) strand; PAM type: NRG; PAM sequence: AGG
tttctggagaggaggagatg

SEQ ID NO: 28943 - DNA, 20 bp, Artificial Sequence
  Description of Artificial Sequence: Synthetic oligonucleotide
  Target: SCN10A; (+) strand; PAM type: NRG; PAM sequence: TGG
gacaattactgccttatcct

SEQ ID NO: 28944 - DNA, 20 bp, Artificial Sequence
  Description of Artificial Sequence: Synthetic oligonucleotide
  Target: SCN10A; (+) strand; PAM type: NRG; PAM sequence: GGG
acaattactgccttatcctt

SEQ ID NO: 28945 - DNA, 20 bp, Artificial Sequence
  Description of Artificial Sequence: Synthetic oligonucleotide
  Target: SCN10A; (+) strand; PAM type: NRG; PAM sequence: TGG
ctgccttatccttgggtcct

SEQ ID NO: 28946 - DNA, 20 bp, Artificial Sequence
  Description of Artificial Sequence: Synthetic oligonucleotide
  Target: SCN10A; (+) strand; PAM type: NRG; PAM sequence: CAG
tatccttgggtccttggtct

SEQ ID NO: 28947 - DNA, 20 bp, Artificial Sequence
  Description of Artificial Sequence: Synthetic oligonucleotide
  Target: SCN10A; (+) strand; PAM type: NRG; PAM sequence: GAG
tccttgggtccttggtctca

SEQ ID NO: 28948 - DNA, 20 bp, Artificial Sequence
  Description of Artificial Sequence: Synthetic oligonucleotide
  Target: SCN10A; (+) strand; PAM type: NRG; PAM sequence: AGG
ccttgggtccttggtctcag

SEQ ID NO: 28949 - DNA, 20 bp, Artificial Sequence
  Description of Artificial Sequence: Synthetic oligonucleotide
  Target: SCN10A; (+) strand; PAM type: NRG; PAM sequence: GGG
cttgggtccttggtctcaga

SEQ ID NO: 28950 - DNA, 20 bp, Artificial Sequence
  Description of Artificial Sequence: Synthetic oligonucleotide
  Target: SCN10A; (+) strand; PAM type: NRG; PAM sequence: TGG
cttggtctcagagggacctc

SEQ ID NO: 28951 - DNA, 20 bp, Artificial Sequence
  Description of Artificial Sequence: Synthetic oligonucleotide
  Target: SCN10A; (+) strand; PAM type: NRG; PAM sequence: GAG
gagggacctctggttctctt

SEQ ID NO: 28952 - DNA, 20 bp, Artificial Sequence
  Description of Artificial Sequence: Synthetic oligonucleotide
  Target: SCN10A; (+) strand; PAM type: NRG; PAM sequence: AGG
agggacctctggttctcttg

SEQ ID NO: 28953 - DNA, 20 bp, Artificial Sequence
  Description of Artificial Sequence: Synthetic oligonucleotide
  Target: SCN10A; (+) strand; PAM type: NRG; PAM sequence: CAG
tggttctcttgaggccctgc

SEQ ID NO: 28954 - DNA, 20 bp, Artificial Sequence
  Description of Artificial Sequence: Synthetic oligonucleotide
  Target: SCN10A; (+) strand; PAM type: NRG; PAM sequence: CAG
cacactgccctctgctgtta

SEQ ID NO: 28955 - DNA, 20 bp, Artificial Sequence
  Description of Artificial Sequence: Synthetic oligonucleotide
  Target: SCN10A; (+) strand; PAM type: NRG; PAM sequence: CAG
gccctctgctgttacagtgc

SEQ ID NO: 28956 - DNA, 20 bp, Artificial Sequence
  Description of Artificial Sequence: Synthetic oligonucleotide
  Target: SCN10A; (+) strand; PAM type: NRG; PAM sequence: AAG
tgccagaaactgcaccaacg

SEQ ID NO: 28957 - DNA, 20 bp, Artificial Sequence
  Description of Artificial Sequence: Synthetic oligonucleotide
  Target: SCN10A; (+) strand; PAM type: NRG; PAM sequence: TAG
acgaagatgttttcctccct

SEQ ID NO: 28958 - DNA, 20 bp, Artificial Sequence
  Description of Artificial Sequence: Synthetic oligonucleotide
  Target: SCN10A; (+) strand; PAM type: NRG; PAM sequence: AGG
cgaagatgttttcctccctt

SEQ ID NO: 28959 - DNA, 20 bp, Artificial Sequence
  Description of Artificial Sequence: Synthetic oligonucleotide
  Target: SCN10A; (+) strand; PAM type: NRG; PAM sequence: TGG
atgttttcctcccttaggat

SEQ ID NO: 28960 - DNA, 20 bp, Artificial Sequence
  Description of Artificial Sequence: Synthetic oligonucleotide
  Target: SCN10A; (+) strand; PAM type: NRG; PAM sequence: GGG
tgttttcctcccttaggatt

SEQ ID NO: 28961 - DNA, 20 bp, Artificial Sequence
  Description of Artificial Sequence: Synthetic oligonucleotide
  Target: SCN10A; (+) strand; PAM type: NRG; PAM sequence: TAG
cctcccttaggattgggtat

SEQ ID NO: 28962 - DNA, 20 bp, Artificial Sequence
  Description of Artificial Sequence: Synthetic oligonucleotide
  Target: SCN10A; (+) strand; PAM type: NRG; PAM sequence: TAG
attgggtattagtttttctt

SEQ ID NO: 28963 - DNA, 20 bp, Artificial Sequence
  Description of Artificial Sequence: Synthetic oligonucleotide
  Target: SCN10A; (+) strand; PAM type: NRG; PAM sequence: AGG
ttgggtattagtttttcttt

SEQ ID NO: 28964 - DNA, 20 bp, Artificial Sequence
  Description of Artificial Sequence: Synthetic oligonucleotide
  Target: SCN10A; (+) strand; PAM type: NRG; PAM sequence: GGG
tgggtattagtttttcttta

SEQ ID NO: 28965 - DNA, 20 bp, Artificial Sequence
  Description of Artificial Sequence: Synthetic oligonucleotide
  Target: SCN10A; (+) strand; PAM type: NRG; PAM sequence: GGG
gggtattagtttttctttag

SEQ ID NO: 28966 - DNA, 20 bp, Artificial Sequence
  Description of Artificial Sequence: Synthetic oligonucleotide
  Target: SCN10A; (+) strand; PAM type: NRG; PAM sequence: TGG
gtttttctttaggggccctt

SEQ ID NO: 28967 - DNA, 20 bp, Artificial Sequence
  Description of Artificial Sequence: Synthetic oligonucleotide
  Target: SCN10A; (+) strand; PAM type: NRG; PAM sequence: TAG
ttcattcaaactctcacctt

SEQ ID NO: 28968 - DNA, 20 bp, Artificial Sequence
  Description of Artificial Sequence: Synthetic oligonucleotide
  Target: SCN10A; (+) strand; PAM type: NRG; PAM sequence: AAG
agcttcctgacataatttga

SEQ ID NO: 28969 - DNA, 20 bp, Artificial Sequence
  Description of Artificial Sequence: Synthetic oligonucleotide
  Target: SCN10A; (+) strand; PAM type: NRG; PAM sequence: AAG
ttttaataacatgtttatgt

SEQ ID NO: 28970 - DNA, 20 bp, Artificial Sequence
  Description of Artificial Sequence: Synthetic oligonucleotide
  Target: SCN10A; (+) strand; PAM type: NRG; PAM sequence: TAG
aataacatgtttatgtaagt

SEQ ID NO: 28971 - DNA, 20 bp, Artificial Sequence
  Description of Artificial Sequence: Synthetic oligonucleotide
  Target: SCN10A; (+) strand; PAM type: NRG; PAM sequence: TGG
aagttagtccctgcaaatgc

SEQ ID NO: 28972 - DNA, 20 bp, Artificial Sequence
  Description of Artificial Sequence: Synthetic oligonucleotide
  Target: SCN10A; (+) strand; PAM type: NRG; PAM sequence: GGG
agttagtccctgcaaatgct

SEQ ID NO: 28973 - DNA, 20 bp, Artificial Sequence
  Description of Artificial Sequence: Synthetic oligonucleotide
  Target: SCN10A; (+) strand; PAM type: NRG; PAM sequence: TGG
ccctgcaaatgctgggaaac

SEQ ID NO: 28974 - DNA, 20 bp, Artificial Sequence
  Description of Artificial Sequence: Synthetic oligonucleotide
  Target: SCN10A; (+) strand; PAM type: NRG; PAM sequence: GGG
cctgcaaatgctgggaaact

SEQ ID NO: 28975 - DNA, 20 bp, Artificial Sequence
  Description of Artificial Sequence: Synthetic oligonucleotide
  Target: SCN10A; (+) strand; PAM type: NRG; PAM sequence: GAG
aaatgctgggaaactgggct

SEQ ID NO: 28976 - DNA, 20 bp, Artificial Sequence
  Description of Artificial Sequence: Synthetic oligonucleotide
  Target: SCN10A; (+) strand; PAM type: NRG; PAM sequence: TGG
ggaaactgggctgagatctg

SEQ ID NO: 28977 - DNA, 20 bp, Artificial Sequence
  Description of Artificial Sequence: Synthetic oligonucleotide
  Target: SCN10A; (+) strand; PAM type: NRG; PAM sequence: AAG
ctgagatctgtggaatttga

SEQ ID NO: 28978 - DNA, 20 bp, Artificial Sequence
  Description of Artificial Sequence: Synthetic oligonucleotide
  Target: SCN10A; (+) strand; PAM type: NRG; PAM sequence: AGG
tgagatctgtggaatttgaa

SEQ ID NO: 28979 - DNA, 20 bp, Artificial Sequence
  Description of Artificial Sequence: Synthetic oligonucleotide
  Target: SCN10A; (+) strand; PAM type: NRG; PAM sequence: GAG
agatctgtggaatttgaaag

SEQ ID NO: 28980 - DNA, 20 bp, Artificial Sequence
  Description of Artificial Sequence: Synthetic oligonucleotide
  Target: SCN10A; (+) strand; PAM type: NRG; PAM sequence: GAG
tggaatttgaaaggagatct

SEQ ID NO: 28981 - DNA, 20 bp, Artificial Sequence
  Description of Artificial Sequence: Synthetic oligonucleotide
  Target: SCN10A; (+) strand; PAM type: NRG; PAM sequence: AAG
aatttgaaaggagatctgag

SEQ ID NO: 28982 - DNA, 20 bp, Artificial Sequence
  Description of Artificial Sequence: Synthetic oligonucleotide
  Target: SCN10A; (+) strand; PAM type: NRG; PAM sequence: TGG
aggagatctgagaagatctg

SEQ ID NO: 28983 - DNA, 20 bp, Artificial Sequence
  Description of Artificial Sequence: Synthetic oligonucleotide
  Target: SCN10A; (+) strand; PAM type: NRG; PAM sequence: AAG
tgagaagatctgtggacaca

SEQ ID NO: 28984 - DNA, 20 bp, Artificial Sequence
  Description of Artificial Sequence: Synthetic oligonucleotide
  Target: SCN10A; (+) strand; PAM type: NRG; PAM sequence: AGG
gagaagatctgtggacacaa

SEQ ID NO: 28985 - DNA, 20 bp, Artificial Sequence
  Description of Artificial Sequence: Synthetic oligonucleotide
  Target: SCN10A; (+) strand; PAM type: NRG; PAM sequence: GGG
agaagatctgtggacacaaa

SEQ ID NO: 28986 - DNA, 20 bp, Artificial Sequence
  Description of Artificial Sequence: Synthetic oligonucleotide
  Target: SCN10A; (+) strand; PAM type: NRG; PAM sequence: TGG
tgtggacacaaagggcttcc

SEQ ID NO: 28987 - DNA, 20 bp, Artificial Sequence
  Description of Artificial Sequence: Synthetic oligonucleotide
  Target: SCN10A; (+) strand; PAM type: NRG; PAM sequence: GGG
gtggacacaaagggcttcct

SEQ ID NO: 28988 - DNA, 20 bp, Artificial Sequence
  Description of Artificial Sequence: Synthetic oligonucleotide
  Target: SCN10A; (+) strand; PAM type: NRG; PAM sequence: GAG
ggacacaaagggcttcctgg

SEQ ID NO: 28989 - DNA, 20 bp, Artificial Sequence
  Description of Artificial Sequence: Synthetic oligonucleotide
  Target: SCN10A; (+) strand; PAM type: NRG; PAM sequence: AGG
gacacaaagggcttcctggg

SEQ ID NO: 28990 - DNA, 20 bp, Artificial Sequence
  Description of Artificial Sequence: Synthetic oligonucleotide
  Target: SCN10A; (+) strand; PAM type: NRG; PAM sequence: TGG
tcctgggaggaccatcttta

SEQ ID NO: 28991 - DNA, 20 bp, Artificial Sequence
  Description of Artificial Sequence: Synthetic oligonucleotide
  Target: SCN10A; (+) strand; PAM type: NRG; PAM sequence: GGG
cctgggaggaccatctttat

SEQ ID NO: 28992 - DNA, 20 bp, Artificial Sequence
  Description of Artificial Sequence: Synthetic oligonucleotide
  Target: SCN10A; (+) strand; PAM type: NRG; PAM sequence: GGG
ctgggaggaccatctttatg

SEQ ID NO: 28993 - DNA, 20 bp, Artificial Sequence
  Description of Artificial Sequence: Synthetic oligonucleotide
  Target: SCN10A; (+) strand; PAM type: NRG; PAM sequence: GGG
tgggaggaccatctttatgg

SEQ ID NO: 28994 - DNA, 20 bp, Artificial Sequence
  Description of Artificial Sequence: Synthetic oligonucleotide
  Target: SCN10A; (+) strand; PAM type: NRG; PAM sequence: GGG
gggaggaccatctttatggg

SEQ ID NO: 28995 - DNA, 20 bp, Artificial Sequence
  Description of Artificial Sequence: Synthetic oligonucleotide
  Target: SCN10A; (+) strand; PAM type: NRG; PAM sequence: GAG
gaggaccatctttatggggg

SEQ ID NO: 28996 - DNA, 20 bp, Artificial Sequence
  Description of Artificial Sequence: Synthetic oligonucleotide
  Target: SCN10A; (+) strand; PAM type: NRG; PAM sequence: GAG
ggaccatctttatgggggga

SEQ ID NO: 28997 - DNA, 20 bp, Artificial Sequence
  Description of Artificial Sequence: Synthetic oligonucleotide
  Target: SCN10A; (+) strand; PAM type: NRG; PAM sequence: AAG
ccatctttatggggggagag

SEQ ID NO: 28998 - DNA, 20 bp, Artificial Sequence
  Description of Artificial Sequence: Synthetic oligonucleotide
  Target: SCN10A; (+) strand; PAM type: NRG; PAM sequence: AGG
catctttatggggggagaga

SEQ ID NO: 28999 - DNA, 20 bp, Artificial Sequence
  Description of Artificial Sequence: Synthetic oligonucleotide
  Target: SCN10A; (+) strand; PAM type: NRG; PAM sequence: AAG
tttatggggggagagaagga

SEQ ID NO: 29000 - DNA, 20 bp, Artificial Sequence
  Description of Artificial Sequence: Synthetic oligonucleotide
  Target: SCN10A; (+) strand; PAM type: NRG; PAM sequence: AGG
ttatggggggagagaaggaa

SEQ ID NO: 29001 - DNA, 20 bp, Artificial Sequence
  Description of Artificial Sequence: Synthetic oligonucleotide
  Target: SCN10A; (+) strand; PAM type: NRG; PAM sequence: GGG
tatggggggagagaaggaaa

SEQ ID NO: 29002 - DNA, 20 bp, Artificial Sequence
  Description of Artificial Sequence: Synthetic oligonucleotide
  Target: SCN10A; (+) strand; PAM type: NRG; PAM sequence: AAG
gggggagagaaggaaagggc

SEQ ID NO: 29003 - DNA, 20 bp, Artificial Sequence
  Description of Artificial Sequence: Synthetic oligonucleotide
  Target: SCN10A; (+) strand; PAM type: NRG; PAM sequence: AGG
ggggagagaaggaaagggca

SEQ ID NO: 29004 - DNA, 20 bp, Artificial Sequence
  Description of Artificial Sequence: Synthetic oligonucleotide
  Target: SCN10A; (+) strand; PAM type: NRG; PAM sequence: GGG
gggagagaaggaaagggcaa

SEQ ID NO: 29005 - DNA, 20 bp, Artificial Sequence
  Description of Artificial Sequence: Synthetic oligonucleotide
  Target: SCN10A; (+) strand; PAM type: NRG; PAM sequence: CAG
agagaaggaaagggcaaggg

SEQ ID NO: 29006 - DNA, 20 bp, Artificial Sequence
  Description of Artificial Sequence: Synthetic oligonucleotide
  Target: SCN10A; (+) strand; PAM type: NRG; PAM sequence: TGG
gaaggaaagggcaagggcag

SEQ ID NO: 29007 - DNA, 20 bp, Artificial Sequence
  Description of Artificial Sequence: Synthetic oligonucleotide
  Target: SCN10A; (+) strand; PAM type: NRG; PAM sequence: GGG
aaggaaagggcaagggcagt

SEQ ID NO: 29008 - DNA, 20 bp, Artificial Sequence
  Description of Artificial Sequence: Synthetic oligonucleotide
  Target: SCN10A; (+) strand; PAM type: NRG; PAM sequence: TAG
gaaagggcaagggcagtggg

SEQ ID NO: 29009 - DNA, 20 bp, Artificial Sequence
  Description of Artificial Sequence: Synthetic oligonucleotide
  Target: SCN10A; (+) strand; PAM type: NRG; PAM sequence: AGG
aaagggcaagggcagtgggt

SEQ ID NO: 29010 - DNA, 20 bp, Artificial Sequence
  Description of Artificial Sequence: Synthetic oligonucleotide
  Target: SCN10A; (+) strand; PAM type: NRG; PAM sequence: GAG
ggcaagggcagtgggtaggt

SEQ ID NO: 29011 - DNA, 20 bp, Artificial Sequence
  Description of Artificial Sequence: Synthetic oligonucleotide
  Target: SCN10A; (+) strand; PAM type: NRG; PAM sequence: CAG
ggcagtgggtaggtgagctc

SEQ ID NO: 29012 - DNA, 20 bp, Artificial Sequence
  Description of Artificial Sequence: Synthetic oligonucleotide
  Target: SCN10A; (+) strand; PAM type: NRG; PAM sequence: AGG
gcagtgggtaggtgagctcc

SEQ ID NO: 29013 - DNA, 20 bp, Artificial Sequence
  Description of Artificial Sequence: Synthetic oligonucleotide
  Target: SCN10A; (+) strand; PAM type: NRG; PAM sequence: GAG
tgggtaggtgagctccaggt

SEQ ID NO: 29014 - DNA, 20 bp, Artificial Sequence
  Description of Artificial Sequence: Synthetic oligonucleotide
  Target: SCN10A; (+) strand; PAM type: NRG; PAM sequence: AGG
gggtaggtgagctccaggtg

SEQ ID NO: 29015 - DNA, 20 bp, Artificial Sequence
  Description of Artificial Sequence: Synthetic oligonucleotide
  Target: SCN10A; (+) strand; PAM type: NRG; PAM sequence: GAG
gctccaggtgaggtcatgct

SEQ ID NO: 29016 - DNA, 20 bp, Artificial Sequence
  Description of Artificial Sequence: Synthetic oligonucleotide
  Target: SCN10A; (+) strand; PAM type: NRG; PAM sequence: AAG
tcatgctgagaactctgacc

SEQ ID NO: 29017 - DNA, 20 bp, Artificial Sequence
  Description of Artificial Sequence: Synthetic oligonucleotide
  Target: SCN10A; (+) strand; PAM type: NRG; PAM sequence: AGG
catgctgagaactctgacca

SEQ ID NO: 29018 - DNA, 20 bp, Artificial Sequence
  Description of Artificial Sequence: Synthetic oligonucleotide
  Target: SCN10A; (+) strand; PAM type: NRG; PAM sequence: CAG
gagaactctgaccaaggatt

SEQ ID NO: 29019 - DNA, 20 bp, Artificial Sequence
  Description of Artificial Sequence: Synthetic oligonucleotide
  Target: SCN10A; (+) strand; PAM type: NRG; PAM sequence: TAG
aactctgaccaaggattcag

SEQ ID NO: 29020 - DNA, 20 bp, Artificial Sequence
  Description of Artificial Sequence: Synthetic oligonucleotide
  Target: SCN10A; (+) strand; PAM type: NRG; PAM sequence: CAG
gaccaaggattcagtagatg

SEQ ID NO: 29021 - DNA, 20 bp, Artificial Sequence
  Description of Artificial Sequence: Synthetic oligonucleotide
  Target: SCN10A; (+) strand; PAM type: NRG; PAM sequence: CAG
attcagtagatgcagtttct

SEQ ID NO: 29022 - DNA, 20 bp, Artificial Sequence
  Description of Artificial Sequence: Synthetic oligonucleotide
  Target: SCN10A; (+) strand; PAM type: NRG; PAM sequence: CAG
atgcagtttctcagtgaccc

SEQ ID NO: 29023 - DNA, 20 bp, Artificial Sequence
  Description of Artificial Sequence: Synthetic oligonucleotide
  Target: SCN10A; (+) strand; PAM type: NRG; PAM sequence: TGG
gtttctcagtgaccccagcc

SEQ ID NO: 29024 - DNA, 20 bp, Artificial Sequence
  Description of Artificial Sequence: Synthetic oligonucleotide
  Target: SCN10A; (+) strand; PAM type: NRG; PAM sequence: TAG
agtgaccccagcctggtcac

SEQ ID NO: 29025 - DNA, 20 bp, Artificial Sequence
  Description of Artificial Sequence: Synthetic oligonucleotide
  Target: SCN10A; (+) strand; PAM type: NRG; PAM sequence: CAG
tgtaatctgtttcttgacct

SEQ ID NO: 29026 - DNA, 20 bp, Artificial Sequence
  Description of Artificial Sequence: Synthetic oligonucleotide
  Target: SCN10A; (+) strand; PAM type: NRG; PAM sequence: GAG
agttttctcatctgtaaaat

SEQ ID NO: 29027 - DNA, 20 bp, Artificial Sequence
  Description of Artificial Sequence: Synthetic oligonucleotide
  Target: SCN10A; (+) strand; PAM type: NRG; PAM sequence: GAG
ttttctcatctgtaaaatga

SEQ ID NO: 29028 - DNA, 20 bp, Artificial Sequence
  Description of Artificial Sequence: Synthetic oligonucleotide
  Target: SCN10A; (+) strand; PAM type: NRG; PAM sequence: CAG
tcaataatctcaaacctccc

SEQ ID NO: 29029 - DNA, 20 bp, Artificial Sequence
  Description of Artificial Sequence: Synthetic oligonucleotide
  Target: SCN10A; (+) strand; PAM type: NRG; PAM sequence: AGG
caataatctcaaacctcccc

SEQ ID NO: 29030 - DNA, 20 bp, Artificial Sequence
  Description of Artificial Sequence: Synthetic oligonucleotide
  Target: SCN10A; (+) strand; PAM type: NRG; PAM sequence: GGG
aataatctcaaacctcccca

SEQ ID NO: 29031 - DNA, 20 bp, Artificial Sequence
  Description of Artificial Sequence: Synthetic oligonucleotide
  Target: SCN10A; (+) strand; PAM type: NRG; PAM sequence: TAG
aacctccccagggtactaaa

SEQ ID NO: 29032 - DNA, 20 bp, Artificial Sequence
  Description of Artificial Sequence: Synthetic oligonucleotide
  Target: SCN10A; (+) strand; PAM type: NRG; PAM sequence: CAG
taaatagcactgtcttgtcc

SEQ ID NO: 29033 - DNA, 20 bp, Artificial Sequence
  Description of Artificial Sequence: Synthetic oligonucleotide
  Target: SCN10A; (+) strand; PAM type: NRG; PAM sequence: CAG
tcctgtcctcttcttatgct

SEQ ID NO: 29034 - DNA, 20 bp, Artificial Sequence
  Description of Artificial Sequence: Synthetic oligonucleotide
  Target: SCN10A; (+) strand; PAM type: NRG; PAM sequence: TGG
tcttcttatgctcagaaccc

SEQ ID NO: 29035 - DNA, 20 bp, Artificial Sequence
  Description of Artificial Sequence: Synthetic oligonucleotide
  Target: SCN10A; (+) strand; PAM type: NRG; PAM sequence: GGG
cttcttatgctcagaaccct

SEQ ID NO: 29036 - DNA, 20 bp, Artificial Sequence
  Description of Artificial Sequence: Synthetic oligonucleotide
  Target: SCN10A; (+) strand; PAM type: NRG; PAM sequence: AAG
ttatgctcagaaccctgggc

SEQ ID NO: 29037 - DNA, 20 bp, Artificial Sequence
  Description of Artificial Sequence: Synthetic oligonucleotide
  Target: SCN10A; (+) strand; PAM type: NRG; PAM sequence: AGG
tatgctcagaaccctgggca

SEQ ID NO: 29038 - DNA, 20 bp, Artificial Sequence
  Description of Artificial Sequence: Synthetic oligonucleotide
  Target: SCN10A; (+) strand; PAM type: NRG; PAM sequence: AAG
cctgggcaaggatttcctgt

SEQ ID NO: 29039 - DNA, 20 bp, Artificial Sequence
  Description of Artificial Sequence: Synthetic oligonucleotide
  Target: SCN10A; (+) strand; PAM type: NRG; PAM sequence: TGG
gggcaaggatttcctgtaag

SEQ ID NO: 29040 - DNA, 20 bp, Artificial Sequence
  Description of Artificial Sequence: Synthetic oligonucleotide
  Target: SCN10A; (+) strand; PAM type: NRG; PAM sequence: TAG
tgtaagtggaatgcctgccc

SEQ ID NO: 29041 - DNA, 20 bp, Artificial Sequence
  Description of Artificial Sequence: Synthetic oligonucleotide
  Target: SCN10A; (+) strand; PAM type: NRG; PAM sequence: TAG
aagtggaatgcctgccctag

SEQ ID NO: 29042 - DNA, 20 bp, Artificial Sequence
  Description of Artificial Sequence: Synthetic oligonucleotide
  Target: SCN10A; (+) strand; PAM type: NRG; PAM sequence: AGG
agtggaatgcctgccctagt

SEQ ID NO: 29043 - DNA, 20 bp, Artificial Sequence
  Description of Artificial Sequence: Synthetic oligonucleotide
  Target: SCN10A; (+) strand; PAM type: NRG; PAM sequence: TAG
tatatattttaaattgttaa

SEQ ID NO: 29044 - DNA, 20 bp, Artificial Sequence
  Description of Artificial Sequence: Synthetic oligonucleotide
  Target: SCN10A; (+) strand; PAM type: NRG; PAM sequence: CAG
ttttaaattgttaatagcaa

SEQ ID NO: 29045 - DNA, 20 bp, Artificial Sequence
  Description of Artificial Sequence: Synthetic oligonucleotide
  Target: SCN10A; (+) strand; PAM type: NRG; PAM sequence: TGG
ttgttaatagcaacagcatc

SEQ ID NO: 29046 - DNA, 20 bp, Artificial Sequence
  Description of Artificial Sequence: Synthetic oligonucleotide
  Target: SCN10A; (+) strand; PAM type: NRG; PAM sequence: GAG
caacagcatctggtgctctt

SEQ ID NO: 29047 - DNA, 20 bp, Artificial Sequence
  Description of Artificial Sequence: Synthetic oligonucleotide
  Target: SCN10A; (+) strand; PAM type: NRG; PAM sequence: AGG
aacagcatctggtgctcttg

SEQ ID NO: 29048 - DNA, 20 bp, Artificial Sequence
  Description of Artificial Sequence: Synthetic oligonucleotide
  Target: SCN10A; (+) strand; PAM type: NRG; PAM sequence: CAG
tggtgctcttgaggcgctgc

SEQ ID NO: 29049 - DNA, 20 bp, Artificial Sequence
  Description of Artificial Sequence: Synthetic oligonucleotide
  Target: SCN10A; (+) strand; PAM type: NRG; PAM sequence: CAG
cacactcccctctgctgtta

SEQ ID NO: 29050 - DNA, 20 bp, Artificial Sequence
  Description of Artificial Sequence: Synthetic oligonucleotide
  Target: SCN10A; (+) strand; PAM type: NRG; PAM sequence: CAG
cccctctgctgttacagtgc

SEQ ID NO: 29051 - DNA, 20 bp, Artificial Sequence
  Description of Artificial Sequence: Synthetic oligonucleotide
  Target: SCN10A; (+) strand; PAM type: NRG; PAM sequence: AAG
tgccagaaactgcaccacca

SEQ ID NO: 29052 - DNA, 20 bp, Artificial Sequence
  Description of Artificial Sequence: Synthetic oligonucleotide
  Target: SCN10A; (+) strand; PAM type: NRG; PAM sequence: CAG
caccaaagttgtcttatgct

SEQ ID NO: 29053 - DNA, 20 bp, Artificial Sequence
  Description of Artificial Sequence: Synthetic oligonucleotide
  Target: SCN10A; (+) strand; PAM type: NRG; PAM sequence: CAG
tatgctcagtgatctttgtt

SEQ ID NO: 29054 - DNA, 20 bp, Artificial Sequence
  Description of Artificial Sequence: Synthetic oligonucleotide
  Target: SCN10A; (+) strand; PAM type: NRG; PAM sequence: AGG
atgctcagtgatctttgttc

SEQ ID NO: 29055 - DNA, 20 bp, Artificial Sequence
  Description of Artificial Sequence: Synthetic oligonucleotide
  Target: SCN10A; (+) strand; PAM type: NRG; PAM sequence: CAG
gtttacccctcaccacaatc

SEQ ID NO: 29056 - DNA, 20 bp, Artificial Sequence
  Description of Artificial Sequence: Synthetic oligonucleotide
  Target: SCN10A; (+) strand; PAM type: NRG; PAM sequence: GAG
ttacccctcaccacaatcca

SEQ ID NO: 29057 - DNA, 20 bp, Artificial Sequence
  Description of Artificial Sequence: Synthetic oligonucleotide
  Target: SCN10A; (+) strand; PAM type: NRG; PAM sequence: GAG
acccctcaccacaatccaga

SEQ ID NO: 29058 - DNA, 20 bp, Artificial Sequence
  Description of Artificial Sequence: Synthetic oligonucleotide
  Target: SCN10A; (+) strand; PAM type: NRG; PAM sequence: TAG
cctcaccacaatccagagag

SEQ ID NO: 29059 - DNA, 20 bp, Artificial Sequence
  Description of Artificial Sequence: Synthetic oligonucleotide
  Target: SCN10A; (+) strand; PAM type: NRG; PAM sequence: AGG
ctcaccacaatccagagagt

SEQ ID NO: 29060 - DNA, 20 bp, Artificial Sequence
  Description of Artificial Sequence: Synthetic oligonucleotide
  Target: SCN10A; (+) strand; PAM type: NRG; PAM sequence: TAG
atccagagagtaggtattat

SEQ ID NO: 29061 - DNA, 20 bp, Artificial Sequence
  Description of Artificial Sequence: Synthetic oligonucleotide
  Target: SCN10A; (+) strand; PAM type: NRG; PAM sequence: GAG
attagccccattgaatgaat

SEQ ID NO: 29062 - DNA, 20 bp, Artificial Sequence
  Description of Artificial Sequence: Synthetic oligonucleotide
  Target: SCN10A; (+) strand; PAM type: NRG; PAM sequence: GAG
attgaatgaatgagaaaact

SEQ ID NO: 29063 - DNA, 20 bp, Artificial Sequence
  Description of Artificial Sequence: Synthetic oligonucleotide
  Target: SCN10A; (+) strand; PAM type: NRG; PAM sequence: CAG
tgaatgagaaaactgagact

SEQ ID NO: 29064 - DNA, 20 bp, Artificial Sequence
  Description of Artificial Sequence: Synthetic oligonucleotide
  Target: SCN10A; (+) strand; PAM type: NRG; PAM sequence: GAG
aatgagaaaactgagactca

SEQ ID NO: 29065 - DNA, 20 bp, Artificial Sequence
  Description of Artificial Sequence: Synthetic oligonucleotide
  Target: SCN10A; (+) strand; PAM type: NRG; PAM sequence: AGG
atgagaaaactgagactcag

SEQ ID NO: 29066 - DNA, 20 bp, Artificial Sequence
  Description of Artificial Sequence: Synthetic oligonucleotide
  Target: SCN10A; (+) strand; PAM type: NRG; PAM sequence: GGG
tgagaaaactgagactcaga

SEQ ID NO: 29067 - DNA, 20 bp, Artificial Sequence
  Description of Artificial Sequence: Synthetic oligonucleotide
  Target: SCN10A; (+) strand; PAM type: NRG; PAM sequence: GGG
gagaaaactgagactcagag

SEQ ID NO: 29068 - DNA, 20 bp, Artificial Sequence
  Description of Artificial Sequence: Synthetic oligonucleotide
  Target: SCN10A; (+) strand; PAM type: NRG; PAM sequence: CAG
agaggggtttaaaatattgc

SEQ ID NO: 29069 - DNA, 20 bp, Artificial Sequence
  Description of Artificial Sequence: Synthetic oligonucleotide
  Target: SCN10A; (+) strand; PAM type: NRG; PAM sequence: GAG
gtttaaaatattgccagcat

SEQ ID NO: 29070 - DNA, 20 bp, Artificial Sequence
  Description of Artificial Sequence: Synthetic oligonucleotide
  Target: SCN10A; (+) strand; PAM type: NRG; PAM sequence: AAG
tgccagcatgagccatccac

SEQ ID NO: 29071 - DNA, 20 bp, Artificial Sequence
  Description of Artificial Sequence: Synthetic oligonucleotide
  Target: SCN10A; (+) strand; PAM type: NRG; PAM sequence: TAG
cagcatgagccatccacaag

SEQ ID NO: 29072 - DNA, 20 bp, Artificial Sequence
  Description of Artificial Sequence: Synthetic oligonucleotide
  Target: SCN10A; (+) strand; PAM type: NRG; PAM sequence: GAG
tgagccatccacaagtagtt

SEQ ID NO: 29073 - DNA, 20 bp, Artificial Sequence
  Description of Artificial Sequence: Synthetic oligonucleotide
  Target: SCN10A; (+) strand; PAM type: NRG; PAM sequence: CAG
ccatccacaagtagttgagt

SEQ ID NO: 29074 - DNA, 20 bp, Artificial Sequence
  Description of Artificial Sequence: Synthetic oligonucleotide
  Target: SCN10A; (+) strand; PAM type: NRG; PAM sequence: AGG
catccacaagtagttgagtc

SEQ ID NO: 29075 - DNA, 20 bp, Artificial Sequence
  Description of Artificial Sequence: Synthetic oligonucleotide
  Target: SCN10A; (+) strand; PAM type: NRG; PAM sequence: CAG
ttgagtcaggaatgcaaacc

SEQ ID NO: 29076 - DNA, 20 bp, Artificial Sequence
  Description of Artificial Sequence: Synthetic oligonucleotide
  Target: SCN10A; (+) strand; PAM type: NRG; PAM sequence: AGG
tgagtcaggaatgcaaaccc

SEQ ID NO: 29077 - DNA, 20 bp, Artificial Sequence
  Description of Artificial Sequence: Synthetic oligonucleotide
  Target: SCN10A; (+) strand; PAM type: NRG; PAM sequence: TAG
tactctgtgacttatccatg

SEQ ID NO: 29078 - DNA, 20 bp, Artificial Sequence
  Description of Artificial Sequence: Synthetic oligonucleotide
  Target: SCN10A; (+) strand; PAM type: NRG; PAM sequence: CGG
ccatgtagccccttttctct

SEQ ID NO: 29079 - DNA, 20 bp, Artificial Sequence
  Description of Artificial Sequence: Synthetic oligonucleotide
  Target: SCN10A; (+) strand; PAM type: NRG; PAM sequence: GGG
catgtagccccttttctctc

SEQ ID NO: 29080 - DNA, 20 bp, Artificial Sequence
  Description of Artificial Sequence: Synthetic oligonucleotide
  Target: SCN10A; (+) strand; PAM type: NRG; PAM sequence: CAG
ccccttttctctcgggatct

SEQ ID NO: 29081 - DNA, 20 bp, Artificial Sequence
  Description of Artificial Sequence: Synthetic oligonucleotide
  Target: SCN10A; (+) strand; PAM type: NRG; PAM sequence: TAG
ggatctcagttacgcaaatc

SEQ ID NO: 29082 - DNA, 20 bp, Artificial Sequence
  Description of Artificial Sequence: Synthetic oligonucleotide
  Target: SCN10A; (+) strand; PAM type: NRG; PAM sequence: CAG
tcagttacgcaaatctagaa

SEQ ID NO: 29083 - DNA, 20 bp, Artificial Sequence
  Description of Artificial Sequence: Synthetic oligonucleotide
  Target: SCN10A; (+) strand; PAM type: NRG; PAM sequence: CAG
agaacagcgcctatctacct

SEQ ID NO: 29084 - DNA, 20 bp, Artificial Sequence
  Description of Artificial Sequence: Synthetic oligonucleotide
  Target: SCN10A; (+) strand; PAM type: NRG; PAM sequence: AGG
gaacagcgcctatctacctc

SEQ ID NO: 29085 - DNA, 20 bp, Artificial Sequence
  Description of Artificial Sequence: Synthetic oligonucleotide
  Target: SCN10A; (+) strand; PAM type: NRG; PAM sequence: GGG
aacagcgcctatctacctca

SEQ ID NO: 29086 - DNA, 20 bp, Artificial Sequence
  Description of Artificial Sequence: Synthetic oligonucleotide
  Target: SCN10A; (+) strand; PAM type: NRG; PAM sequence: GGG
acagcgcctatctacctcag

SEQ ID NO: 29087 - DNA, 20 bp, Artificial Sequence
  Description of Artificial Sequence: Synthetic oligonucleotide
  Target: SCN10A; (+) strand; PAM type: NRG; PAM sequence: TGG
gcctatctacctcaggggta

SEQ ID NO: 29088 - DNA, 20 bp, Artificial Sequence
  Description of Artificial Sequence: Synthetic oligonucleotide
  Target: SCN10A; (+) strand; PAM type: NRG; PAM sequence: AAG
tatctacctcaggggtatgg

SEQ ID NO: 29089 - DNA, 20 bp, Artificial Sequence
  Description of Artificial Sequence: Synthetic oligonucleotide
  Target: SCN10A; (+) strand; PAM type: NRG; PAM sequence: AGG
atctacctcaggggtatgga

SEQ ID NO: 29090 - DNA, 20 bp, Artificial Sequence
  Description of Artificial Sequence: Synthetic oligonucleotide
  Target: SCN10A; (+) strand; PAM type: NRG; PAM sequence: AAG
gtatggaaggcattaaatga

SEQ ID NO: 29091 - DNA, 20 bp, Artificial Sequence
  Description of Artificial Sequence: Synthetic oligonucleotide
  Target: SCN10A; (+) strand; PAM type: NRG; PAM sequence: AGG
tatggaaggcattaaatgaa

SEQ ID NO: 29092 - DNA, 20 bp, Artificial Sequence
  Description of Artificial Sequence: Synthetic oligonucleotide
  Target: SCN10A; (+) strand; PAM type: NRG; PAM sequence: TAG
ggcattaaatgaaaggataa

SEQ ID NO: 29093 - DNA, 20 bp, Artificial Sequence
  Description of Artificial Sequence: Synthetic oligonucleotide
  Target: SCN10A; (+) strand; PAM type: NRG; PAM sequence: AGG
gcattaaatgaaaggataat

SEQ ID NO: 29094 - DNA, 20 bp, Artificial Sequence
  Description of Artificial Sequence: Synthetic oligonucleotide
  Target: SCN10A; (+) strand; PAM type: NRG; PAM sequence: GAG
tgacattttcttataaacat

SEQ ID NO: 29095 - DNA, 20 bp, Artificial Sequence
  Description of Artificial Sequence: Synthetic oligonucleotide
  Target: SCN10A; (+) strand; PAM type: NRG; PAM sequence: GAG
acattttcttataaacatga

SEQ ID NO: 29096 - DNA, 20 bp, Artificial Sequence
  Description of Artificial Sequence: Synthetic oligonucleotide
  Target: SCN10A; (+) strand; PAM type: NRG; PAM sequence: AGG
cattttcttataaacatgag

SEQ ID NO: 29097 - DNA, 20 bp, Artificial Sequence
  Description of Artificial Sequence: Synthetic oligonucleotide
  Target: SCN10A; (+) strand; PAM type: NRG; PAM sequence: TGG
tataaacatgagaggttatc

SEQ ID NO: 29098 - DNA, 20 bp, Artificial Sequence
  Description of Artificial Sequence: Synthetic oligonucleotide
  Target: SCN10A; (+) strand; PAM type: NRG; PAM sequence: GGG
ataaacatgagaggttatct

SEQ ID NO: 29099 - DNA, 20 bp, Artificial Sequence
  Description of Artificial Sequence: Synthetic oligonucleotide
  Target: SCN10A; (+) strand; PAM type: NRG; PAM sequence: CAG
gggattcgattcctattaat

SEQ ID NO: 29100 - DNA, 20 bp, Artificial Sequence
  Description of Artificial Sequence: Synthetic oligonucleotide
  Target: SCN10A; (+) strand; PAM type: NRG; PAM sequence: GAG
gattcgattcctattaatca

SEQ ID NO: 29101 - DNA, 20 bp, Artificial Sequence
  Description of Artificial Sequence: Synthetic oligonucleotide
  Target: SCN10A; (+) strand; PAM type: NRG; PAM sequence: CGG
cgattcctattaatcagagt

SEQ ID NO: 29102 - DNA, 20 bp, Artificial Sequence
  Description of Artificial Sequence: Synthetic oligonucleotide
  Target: SCN10A; (+) strand; PAM type: NRG; PAM sequence: TGG
ttaatcagagtcggcaccct

SEQ ID NO: 29103 - DNA, 20 bp, Artificial Sequence
  Description of Artificial Sequence: Synthetic oligonucleotide
  Target: SCN10A; (+) strand; PAM type: NRG; PAM sequence: GAG
aatcagagtcggcacccttg

SEQ ID NO: 29104 - DNA, 20 bp, Artificial Sequence
  Description of Artificial Sequence: Synthetic oligonucleotide
  Target: SCN10A; (+) strand; PAM type: NRG; PAM sequence: AGG
atcagagtcggcacccttgg

SEQ ID NO: 29105 - DNA, 20 bp, Artificial Sequence
  Description of Artificial Sequence: Synthetic oligonucleotide
  Target: SCN10A; (+) strand; PAM type: NRG; PAM sequence: AAG
gtcggcacccttggaggcac

SEQ ID NO: 29106 - DNA, 20 bp, Artificial Sequence
  Description of Artificial Sequence: Synthetic oligonucleotide
  Target: SCN10A; (+) strand; PAM type: NRG; PAM sequence: AAG
caagccttcctccccatccc

SEQ ID NO: 29107 - DNA, 20 bp, Artificial Sequence
  Description of Artificial Sequence: Synthetic oligonucleotide
  Target: SCN10A; (+) strand; PAM type: NRG; PAM sequence: AGG
aagccttcctccccatccca

SEQ ID NO: 29108 - DNA, 20 bp, Artificial Sequence
  Description of Artificial Sequence: Synthetic oligonucleotide
  Target: SCN10A; (+) strand; PAM type: NRG; PAM sequence: GAG
gccttcctccccatcccaag

SEQ ID NO: 29109 - DNA, 20 bp, Artificial Sequence
  Description of Artificial Sequence: Synthetic oligonucleotide
  Target: SCN10A; (+) strand; PAM type: NRG; PAM sequence: AGG
ccttcctccccatcccaagg

SEQ ID NO: 29110 - DNA, 20 bp, Artificial Sequence
  Description of Artificial Sequence: Synthetic oligonucleotide
  Target: SCN10A; (+) strand; PAM type: NRG; PAM sequence: GGG
cttcctccccatcccaagga

SEQ ID NO: 29111 - DNA, 20 bp, Artificial Sequence
  Description of Artificial Sequence: Synthetic oligonucleotide
  Target: SCN10A; (+) strand; PAM type: NRG; PAM sequence: TGG
ctccccatcccaaggagggt

SEQ ID NO: 29112 - DNA, 20 bp, Artificial Sequence
  Description of Artificial Sequence: Synthetic oligonucleotide
  Target: SCN10A; (+) strand; PAM type: NRG; PAM sequence: GGG
tccccatcccaaggagggtt

SEQ ID NO: 29113 - DNA, 20 bp, Artificial Sequence
  Description of Artificial Sequence: Synthetic oligonucleotide
  Target: SCN10A; (+) strand; PAM type: NRG; PAM sequence: CAG
aaggagggttgggattctgc

SEQ ID NO: 29114 - DNA, 20 bp, Artificial Sequence
  Description of Artificial Sequence: Synthetic oligonucleotide
  Target: SCN10A; (+) strand; PAM type: NRG; PAM sequence: TGG
ggttgggattctgccagtgc

SEQ ID NO: 29115 - DNA, 20 bp, Artificial Sequence
  Description of Artificial Sequence: Synthetic oligonucleotide
  Target: SCN10A; (+) strand; PAM type: NRG; PAM sequence: GGG
gttgggattctgccagtgct

SEQ ID NO: 29116 - DNA, 20 bp, Artificial Sequence
  Description of Artificial Sequence: Synthetic oligonucleotide
  Target: SCN10A; (+) strand; PAM type: NRG; PAM sequence: TGG
attctgccagtgctgggcca

SEQ ID NO: 29117 - DNA, 20 bp, Artificial Sequence
  Description of Artificial Sequence: Synthetic oligonucleotide
  Target: SCN10A; (+) strand; PAM type: NRG; PAM sequence: GAG
gctgggccatggcctttcct

SEQ ID NO: 29118 - DNA, 20 bp, Artificial Sequence
  Description of Artificial Sequence: Synthetic oligonucleotide
  Target: SCN10A; (+) strand; PAM type: NRG; PAM sequence: AGG
ctgggccatggcctttcctg

SEQ ID NO: 29119 - DNA, 20 bp, Artificial Sequence
  Description of Artificial Sequence: Synthetic oligonucleotide
  Target: SCN10A; (+) strand; PAM type: NRG; PAM sequence: CAG
tttcctgaggtgccctgact

SEQ ID NO: 29120 - DNA, 20 bp, Artificial Sequence
  Description of Artificial Sequence: Synthetic oligonucleotide
  Target: SCN10A; (+) strand; PAM type: NRG; PAM sequence: TGG
tgccctgactcagtcctttg

SEQ ID NO: 29121 - DNA, 20 bp, Artificial Sequence
  Description of Artificial Sequence: Synthetic oligonucleotide
  Target: SCN10A; (+) strand; PAM type: NRG; PAM sequence: GGG
gccctgactcagtcctttgt

SEQ ID NO: 29122 - DNA, 20 bp, Artificial Sequence
  Description of Artificial Sequence: Synthetic oligonucleotide
  Target: SCN10A; (+) strand; PAM type: NRG; PAM sequence: GGG
ccctgactcagtcctttgtg

SEQ ID NO: 29123 - DNA, 20 bp, Artificial Sequence
  Description of Artificial Sequence: Synthetic oligonucleotide
  Target: SCN10A; (+) strand; PAM type: NRG; PAM sequence: CAG
gtggggatcatatcccccaa

SEQ ID NO: 29124 - DNA, 20 bp, Artificial Sequence
  Description of Artificial Sequence: Synthetic oligonucleotide
  Target: SCN10A; (+) strand; PAM type: NRG; PAM sequence: AGG
tggggatcatatcccccaac

SEQ ID NO: 29125 - DNA, 20 bp, Artificial Sequence
  Description of Artificial Sequence: Synthetic oligonucleotide
  Target: SCN10A; (+) strand; PAM type: NRG; PAM sequence: CAG
gatcatatcccccaacaggt

SEQ ID NO: 29126 - DNA, 20 bp, Artificial Sequence
  Description of Artificial Sequence: Synthetic oligonucleotide
  Target: SCN10A; (+) strand; PAM type: NRG; PAM sequence: AAG
atatcccccaacaggtcagc

SEQ ID NO: 29127 - DNA, 20 bp, Artificial Sequence
  Description of Artificial Sequence: Synthetic oligonucleotide
  Target: SCN10A; (+) strand; PAM type: NRG; PAM sequence: TAG
cccaacaggtcagcaagttc

SEQ ID NO: 29128 - DNA, 20 bp, Artificial Sequence
  Description of Artificial Sequence: Synthetic oligonucleotide
  Target: SCN10A; (+) strand; PAM type: NRG; PAM sequence: CAG
tttccctgcttgtattctcc

SEQ ID NO: 29129 - DNA, 20 bp, Artificial Sequence
  Description of Artificial Sequence: Synthetic oligonucleotide
  Target: SCN10A; (+) strand; PAM type: NRG; PAM sequence: AGG
ttccctgcttgtattctccc

SEQ ID NO: 29130 - DNA, 20 bp, Artificial Sequence
  Description of Artificial Sequence: Synthetic oligonucleotide
  Target: SCN10A; (+) strand; PAM type: NRG; PAM sequence: GGG
tccctgcttgtattctccca

SEQ ID NO: 29131 - DNA, 20 bp, Artificial Sequence
  Description of Artificial Sequence: Synthetic oligonucleotide
  Target: SCN10A; (+) strand; PAM type: NRG; PAM sequence: TGG
gtattctcccagggctcact

SEQ ID NO: 29132 - DNA, 20 bp, Artificial Sequence
  Description of Artificial Sequence: Synthetic oligonucleotide
  Target: SCN10A; (+) strand; PAM type: NRG; PAM sequence: TGG
tggaacacatctaacacacc

SEQ ID NO: 29133 - DNA, 20 bp, Artificial Sequence
  Description of Artificial Sequence: Synthetic oligonucleotide
  Target: SCN10A; (+) strand; PAM type: NRG; PAM sequence: CAG
acatctaacacacctggttc

SEQ ID NO: 29134 - DNA, 20 bp, Artificial Sequence
  Description of Artificial Sequence: Synthetic oligonucleotide
  Target: SCN10A; (+) strand; PAM type: NRG; PAM sequence: TGG
ctaacacacctggttccagt

SEQ ID NO: 29135 - DNA, 20 bp, Artificial Sequence
  Description of Artificial Sequence: Synthetic oligonucleotide
  Target: SCN10A; (+) strand; PAM type: NRG; PAM sequence: GGG
taacacacctggttccagtt

SEQ ID NO: 29136 - DNA, 20 bp, Artificial Sequence
  Description of Artificial Sequence: Synthetic oligonucleotide
  Target: SCN10A; (+) strand; PAM type: NRG; PAM sequence: AAG
cacacctggttccagttggg

SEQ ID NO: 29137 - DNA, 20 bp, Artificial Sequence
  Description of Artificial Sequence: Synthetic oligonucleotide
  Target: SCN10A; (+) strand; PAM type: NRG; PAM sequence: AAG
tggttccagttgggaagacc

SEQ ID NO: 29138 - DNA, 20 bp, Artificial Sequence
  Description of Artificial Sequence: Synthetic oligonucleotide
  Target: SCN10A; (+) strand; PAM type: NRG; PAM sequence: GAG
gggaagaccaagatcccttt

SEQ ID NO: 29139 - DNA, 20 bp, Artificial Sequence
  Description of Artificial Sequence: Synthetic oligonucleotide
  Target: SCN10A; (+) strand; PAM type: NRG; PAM sequence: GAG
ccctttgagatgtgaatcct

SEQ ID NO: 29140 - DNA, 20 bp, Artificial Sequence
  Description of Artificial Sequence: Synthetic oligonucleotide
  Target: SCN10A; (+) strand; PAM type: NRG; PAM sequence: GAG
ttgagatgtgaatcctgagt

SEQ ID NO: 29141 - DNA, 20 bp, Artificial Sequence
  Description of Artificial Sequence: Synthetic oligonucleotide
  Target: SCN10A; (+) strand; PAM type: NRG; PAM sequence: AGG
tgagatgtgaatcctgagtg

SEQ ID NO: 29142 - DNA, 20 bp, Artificial Sequence
  Description of Artificial Sequence: Synthetic oligonucleotide
  Target: SCN10A; (+) strand; PAM type: NRG; PAM sequence: TAG
tgaatcctgagtgaggatgt

SEQ ID NO: 29143 - DNA, 20 bp, Artificial Sequence
  Description of Artificial Sequence: Synthetic oligonucleotide
  Target: SCN10A; (+) strand; PAM type: NRG; PAM sequence: TGG
atcctgagtgaggatgttag

SEQ ID NO: 29144 - DNA, 20 bp, Artificial Sequence
  Description of Artificial Sequence: Synthetic oligonucleotide
  Target: SCN10A; (+) strand; PAM type: NRG; PAM sequence: GGG
tcctgagtgaggatgttagt

SEQ ID NO: 29145 - DNA, 20 bp, Artificial Sequence
  Description of Artificial Sequence: Synthetic oligonucleotide
  Target: SCN10A; (+) strand; PAM type: NRG; PAM sequence: GGG
cctgagtgaggatgttagtg

SEQ ID NO: 29146 - DNA, 20 bp, Artificial Sequence
  Description of Artificial Sequence: Synthetic oligonucleotide
  Target: SCN10A; (+) strand; PAM type: NRG; PAM sequence: CAG
tgttagtggggcattgctga

SEQ ID NO: 29147 - DNA, 20 bp, Artificial Sequence
  Description of Artificial Sequence: Synthetic oligonucleotide
  Target: SCN10A; (+) strand; PAM type: NRG; PAM sequence: GAG
ttagtggggcattgctgaca

SEQ ID NO: 29148 - DNA, 20 bp, Artificial Sequence
  Description of Artificial Sequence: Synthetic oligonucleotide
  Target: SCN10A; (+) strand; PAM type: NRG; PAM sequence: GAG
agtggggcattgctgacaga

SEQ ID NO: 29149 - DNA, 20 bp, Artificial Sequence
  Description of Artificial Sequence: Synthetic oligonucleotide
  Target: SCN10A; (+) strand; PAM type: NRG; PAM sequence: CAG
aaatgcaactcttcctgcaa

SEQ ID NO: 29150 - DNA, 20 bp, Artificial Sequence
  Description of Artificial Sequence: Synthetic oligonucleotide
  Target: SCN10A; (+) strand; PAM type: NRG; PAM sequence: CAG
tcttcctgcaacagcaatca

SEQ ID NO: 29151 - DNA, 20 bp, Artificial Sequence
  Description of Artificial Sequence: Synthetic oligonucleotide
  Target: SCN10A; (+) strand; PAM type: NRG; PAM sequence: AGG
cttcctgcaacagcaatcac

SEQ ID NO: 29152 - DNA, 20 bp, Artificial Sequence
  Description of Artificial Sequence: Synthetic oligonucleotide
  Target: SCN10A; (+) strand; PAM type: NRG; PAM sequence: GGG
ttcctgcaacagcaatcaca

SEQ ID NO: 29153 - DNA, 20 bp, Artificial Sequence
  Description of Artificial Sequence: Synthetic oligonucleotide
  Target: SCN10A; (+) strand; PAM type: NRG; PAM sequence: AAG
tgcaacagcaatcacagggc

SEQ ID NO: 29154 - DNA, 20 bp, Artificial Sequence
  Description of Artificial Sequence: Synthetic oligonucleotide
  Target: SCN10A; (+) strand; PAM type: NRG; PAM sequence: AGG
gcaacagcaatcacagggca

SEQ ID NO: 29155 - DNA, 20 bp, Artificial Sequence
  Description of Artificial Sequence: Synthetic oligonucleotide
  Target: SCN10A; (+) strand; PAM type: NRG; PAM sequence: GGG
caacagcaatcacagggcaa

SEQ ID NO: 29156 - DNA, 20 bp, Artificial Sequence
  Description of Artificial Sequence: Synthetic oligonucleotide
  Target: SCN10A; (+) strand; PAM type: NRG; PAM sequence: TAG
agcaatcacagggcaagggt

SEQ ID NO: 29157 - DNA, 20 bp, Artificial Sequence
  Description of Artificial Sequence: Synthetic oligonucleotide
  Target: SCN10A; (+) strand; PAM type: NRG; PAM sequence: AAG
aagggttagcactgatatta

SEQ ID NO: 29158 - DNA, 20 bp, Artificial Sequence
  Description of Artificial Sequence: Synthetic oligonucleotide
  Target: SCN10A; (+) strand; PAM type: NRG; PAM sequence: TGG
tagcactgatattaaagtga

SEQ ID NO: 29159 - DNA, 20 bp, Artificial Sequence
  Description of Artificial Sequence: Synthetic oligonucleotide
  Target: SCN10A; (+) strand; PAM type: NRG; PAM sequence: GGG
agcactgatattaaagtgat

SEQ ID NO: 29160 - DNA, 20 bp, Artificial Sequence
  Description of Artificial Sequence: Synthetic oligonucleotide
  Target: SCN10A; (+) strand; PAM type: NRG; PAM sequence: GAG
atattaaagtgatgggctgt

SEQ ID NO: 29161 - DNA, 20 bp, Artificial Sequence
  Description of Artificial Sequence: Synthetic oligonucleotide
  Target: SCN10A; (+) strand; PAM type: NRG; PAM sequence: TAG
ttaaagtgatgggctgtgag

SEQ ID NO: 29162 - DNA, 20 bp, Artificial Sequence
  Description of Artificial Sequence: Synthetic oligonucleotide
  Target: SCN10A; (+) strand; PAM type: NRG; PAM sequence: TGG
tgatgggctgtgagtagtgt

SEQ ID NO: 29163 - DNA, 20 bp, Artificial Sequence
  Description of Artificial Sequence: Synthetic oligonucleotide
  Target: SCN10A; (+) strand; PAM type: NRG; PAM sequence: CAG
tgagtagtgttggcttttgt

SEQ ID NO: 29164 - DNA, 20 bp, Artificial Sequence
  Description of Artificial Sequence: Synthetic oligonucleotide
  Target: SCN10A; (+) strand; PAM type: NRG; PAM sequence: AGG
gagtagtgttggcttttgtc

SEQ ID NO: 29165 - DNA, 20 bp, Artificial Sequence
  Description of Artificial Sequence: Synthetic oligonucleotide
  Target: SCN10A; (+) strand; PAM type: NRG; PAM sequence: GAG
gtagtgttggcttttgtcag

SEQ ID NO: 29166 - DNA, 20 bp, Artificial Sequence
  Description of Artificial Sequence: Synthetic oligonucleotide
  Target: SCN10A; (+) strand; PAM type: NRG; PAM sequence: AGG
tagtgttggcttttgtcagg

SEQ ID NO: 29167 - DNA, 20 bp, Artificial Sequence
  Description of Artificial Sequence: Synthetic oligonucleotide
  Target: SCN10A; (+) strand; PAM type: NRG; PAM sequence: CAG
gttggcttttgtcaggaggc

SEQ ID NO: 29168 - DNA, 20 bp, Artificial Sequence
  Description of Artificial Sequence: Synthetic oligonucleotide
  Target: SCN10A; (+) strand; PAM type: NRG; PAM sequence: GAG
tggcttttgtcaggaggcca

SEQ ID NO: 29169 - DNA, 20 bp, Artificial Sequence
  Description of Artificial Sequence: Synthetic oligonucleotide
  Target: SCN10A; (+) strand; PAM type: NRG; PAM sequence: TGG
ttttgtcaggaggccagagc

SEQ ID NO: 29170 - DNA, 20 bp, Artificial Sequence
  Description of Artificial Sequence: Synthetic oligonucleotide
  Target: SCN10A; (+) strand; PAM type: NRG; PAM sequence: GGG
tttgtcaggaggccagagct

SEQ ID NO: 29171 - DNA, 20 bp, Artificial Sequence
  Description of Artificial Sequence: Synthetic oligonucleotide
  Target: SCN10A; (+) strand; PAM type: NRG; PAM sequence: CAG
gtcaggaggccagagctggg

SEQ ID NO: 29172 - DNA, 20 bp, Artificial Sequence
  Description of Artificial Sequence: Synthetic oligonucleotide
  Target: SCN10A; (+) strand; PAM type: NRG; PAM sequence: AGG
tcaggaggccagagctgggc

SEQ ID NO: 29173 - DNA, 20 bp, Artificial Sequence
  Description of Artificial Sequence: Synthetic oligonucleotide
  Target: SCN10A; (+) strand; PAM type: NRG; PAM sequence: GGG
caggaggccagagctgggca

SEQ ID NO: 29174 - DNA, 20 bp, Artificial Sequence
  Description of Artificial Sequence: Synthetic oligonucleotide
  Target: SCN10A; (+) strand; PAM type: NRG; PAM sequence: CAG
ggccagagctgggcagggaa

SEQ ID NO: 29175 - DNA, 20 bp, Artificial Sequence
  Description of Artificial Sequence: Synthetic oligonucleotide
  Target: SCN10A; (+) strand; PAM type: NRG; PAM sequence: AGG
gccagagctgggcagggaac

SEQ ID NO: 29176 - DNA, 20 bp, Artificial Sequence
  Description of Artificial Sequence: Synthetic oligonucleotide
  Target: SCN10A; (+) strand; PAM type: NRG; PAM sequence: AAG
gggcagggaacaggaaatat

SEQ ID NO: 29177 - DNA, 20 bp, Artificial Sequence
  Description of Artificial Sequence: Synthetic oligonucleotide
  Target: SCN10A; (+) strand; PAM type: NRG; PAM sequence: AGG
ggcagggaacaggaaatata

SEQ ID NO: 29178 - DNA, 20 bp, Artificial Sequence
  Description of Artificial Sequence: Synthetic oligonucleotide
  Target: SCN10A; (+) strand; PAM type: NRG; PAM sequence: CAG
aaatataaggcttaccacta

SEQ ID NO: 29179 - DNA, 20 bp, Artificial Sequence
  Description of Artificial Sequence: Synthetic oligonucleotide
  Target: SCN10A; (+) strand; PAM type: NRG; PAM sequence: CAG
tataaggcttaccactacag

SEQ ID NO: 29180 - DNA, 20 bp, Artificial Sequence
  Description of Artificial Sequence: Synthetic oligonucleotide
  Target: SCN10A; (+) strand; PAM type: NRG; PAM sequence: CAG
cttaccactacagcagaaac

SEQ ID NO: 29181 - DNA, 20 bp, Artificial Sequence
  Description of Artificial Sequence: Synthetic oligonucleotide
  Target: SCN10A; (+) strand; PAM type: NRG; PAM sequence: GAG
agcagaaaccagaaactcct

SEQ ID NO: 29182 - DNA, 20 bp, Artificial Sequence
  Description of Artificial Sequence: Synthetic oligonucleotide
  Target: SCN10A; (+) strand; PAM type: NRG; PAM sequence: AAG
tcttttttttctgttgattg

SEQ ID NO: 29183 - DNA, 20 bp, Artificial Sequence
  Description of Artificial Sequence: Synthetic oligonucleotide
  Target: SCN10A; (+) strand; PAM type: NRG; PAM sequence: AAG
tgtcaattatgaccccaaca

SEQ ID NO: 29184 - DNA, 20 bp, Artificial Sequence
  Description of Artificial Sequence: Synthetic oligonucleotide
  Target: SCN10A; (+) strand; PAM type: NRG; PAM sequence: GAG
tcaattatgaccccaacaaa

SEQ ID NO: 29185 - DNA, 20 bp, Artificial Sequence
  Description of Artificial Sequence: Synthetic oligonucleotide
  Target: SCN10A; (+) strand; PAM type: NRG; PAM sequence: CAG
atgaccccaacaaagagatt

SEQ ID NO: 29186 - DNA, 20 bp, Artificial Sequence
  Description of Artificial Sequence: Synthetic oligonucleotide
  Target: SCN10A; (+) strand; PAM type: NRG; PAM sequence: AAG
caacaaagagattcagtgtg

SEQ ID NO: 29187 - DNA, 20 bp, Artificial Sequence
  Description of Artificial Sequence: Synthetic oligonucleotide
  Target: SCN10A; (+) strand; PAM type: NRG; PAM sequence: AAG
caaagagattcagtgtgaag

SEQ ID NO: 29188 - DNA, 20 bp, Artificial Sequence
  Description of Artificial Sequence: Synthetic oligonucleotide
  Target: SCN10A; (+) strand; PAM type: NRG; PAM sequence: AAG
agaagcctccaaaaatgatg

SEQ ID NO: 29189 - DNA, 20 bp, Artificial Sequence
  Description of Artificial Sequence: Synthetic oligonucleotide
  Target: SCN10A; (+) strand; PAM type: NRG; PAM sequence: AAG
caaaaatgatgaagatgaca

SEQ ID NO: 29190 - DNA, 20 bp, Artificial Sequence
  Description of Artificial Sequence: Synthetic oligonucleotide
  Target: SCN10A; (+) strand; PAM type: NRG; PAM sequence: TGG
gtacacgttgtcctcccact

SEQ ID NO: 29191 - DNA, 20 bp, Artificial Sequence
  Description of Artificial Sequence: Synthetic oligonucleotide
  Target: SCN10A; (+) strand; PAM type: NRG; PAM sequence: GGG
tacacgttgtcctcccactt

SEQ ID NO: 29192 - DNA, 20 bp, Artificial Sequence
  Description of Artificial Sequence: Synthetic oligonucleotide
  Target: SCN10A; (+) strand; PAM type: NRG; PAM sequence: CAG
gttgcatgttgacctgtgac

SEQ ID NO: 29193 - DNA, 20 bp, Artificial Sequence
  Description of Artificial Sequence: Synthetic oligonucleotide
  Target: SCN10A; (+) strand; PAM type: NRG; PAM sequence: AAG
atgttgacctgtgaccagac

SEQ ID NO: 29194 - DNA, 20 bp, Artificial Sequence
  Description of Artificial Sequence: Synthetic oligonucleotide
  Target: SCN10A; (+) strand; PAM type: NRG; PAM sequence: AGG
tgttgacctgtgaccagaca

SEQ ID NO: 29195 - DNA, 20 bp, Artificial Sequence
  Description of Artificial Sequence: Synthetic oligonucleotide
  Target: SCN10A; (+) strand; PAM type: NRG; PAM sequence: GGG
gttgacctgtgaccagacaa

SEQ ID NO: 29196 - DNA, 20 bp, Artificial Sequence
  Description of Artificial Sequence: Synthetic oligonucleotide
  Target: SCN10A; (+) strand; PAM type: NRG; PAM sequence: GAG
tgacctgtgaccagacaagg

SEQ ID NO: 29197 - DNA, 20 bp, Artificial Sequence
  Description of Artificial Sequence: Synthetic oligonucleotide
  Target: SCN10A; (+) strand; PAM type: NRG; PAM sequence: GAG
acctgtgaccagacaaggga

SEQ ID NO: 29198 - DNA, 20 bp, Artificial Sequence
  Description of Artificial Sequence: Synthetic oligonucleotide
  Target: SCN10A; (+) strand; PAM type: NRG; PAM sequence: TGG
tgtgaccagacaagggagag

SEQ ID NO: 29199 - DNA, 20 bp, Artificial Sequence
  Description of Artificial Sequence: Synthetic oligonucleotide
  Target: SCN10A; (+) strand; PAM type: NRG; PAM sequence: GGG
gtgaccagacaagggagagt

SEQ ID NO: 29200 - DNA, 20 bp, Artificial Sequence
  Description of Artificial Sequence: Synthetic oligonucleotide
  Target: SCN10A; (+) strand; PAM type: NRG; PAM sequence: AAG
accagacaagggagagtggg

SEQ ID NO: 29201 - DNA, 20 bp, Artificial Sequence
  Description of Artificial Sequence: Synthetic oligonucleotide
  Target: SCN10A; (+) strand; PAM type: NRG; PAM sequence: AGG
ccagacaagggagagtggga

SEQ ID NO: 29202 - DNA, 20 bp, Artificial Sequence
  Description of Artificial Sequence: Synthetic oligonucleotide
  Target: SCN10A; (+) strand; PAM type: NRG; PAM sequence: GAG
agacaagggagagtgggaag

SEQ ID NO: 29203 - DNA, 20 bp, Artificial Sequence
  Description of Artificial Sequence: Synthetic oligonucleotide
  Target: SCN10A; (+) strand; PAM type: NRG; PAM sequence: AGG
gacaagggagagtgggaagg

SEQ ID NO: 29204 - DNA, 20 bp, Artificial Sequence
  Description of Artificial Sequence: Synthetic oligonucleotide
  Target: SCN10A; (+) strand; PAM type: NRG; PAM sequence: GGG
acaagggagagtgggaagga

SEQ ID NO: 29205 - DNA, 20 bp, Artificial Sequence
  Description of Artificial Sequence: Synthetic oligonucleotide
  Target: SCN10A; (+) strand; PAM type: NRG; PAM sequence: TGG
agggagagtgggaaggaggg

SEQ ID NO: 29206 - DNA, 20 bp, Artificial Sequence
  Description of Artificial Sequence: Synthetic oligonucleotide
  Target: SCN10A; (+) strand; PAM type: NRG; PAM sequence: GGG
gggagagtgggaaggagggt

SEQ ID NO: 29207 - DNA, 20 bp, Artificial Sequence
  Description of Artificial Sequence: Synthetic oligonucleotide
  Target: SCN10A; (+) strand; PAM type: NRG; PAM sequence: TAG
gggaaggagggtgggtgtct

SEQ ID NO: 29208 - DNA, 20 bp, Artificial Sequence
  Description of Artificial Sequence: Synthetic oligonucleotide
  Target: SCN10A; (+) strand; PAM type: NRG; PAM sequence: CAG
ggagggtgggtgtcttagtt

SEQ ID NO: 29209 - DNA, 20 bp, Artificial Sequence
  Description of Artificial Sequence: Synthetic oligonucleotide
  Target: SCN10A; (+) strand; PAM type: NRG; PAM sequence: AGG
gagggtgggtgtcttagttc

SEQ ID NO: 29210 - DNA, 20 bp, Artificial Sequence
  Description of Artificial Sequence: Synthetic oligonucleotide
  Target: SCN10A; (+) strand; PAM type: NRG; PAM sequence: AAG
ttagttcaggttcactctga

SEQ ID NO: 29211 - DNA, 20 bp, Artificial Sequence
  Description of Artificial Sequence: Synthetic oligonucleotide
  Target: SCN10A; (+) strand; PAM type: NRG; PAM sequence: AAG
tcaggttcactctgaaagcc

SEQ ID NO: 29212 - DNA, 20 bp, Artificial Sequence
  Description of Artificial Sequence: Synthetic oligonucleotide
  Target: SCN10A; (+) strand; PAM type: NRG; PAM sequence: AAG
tcactctgaaagccaagcct

SEQ ID NO: 29213 - DNA, 20 bp, Artificial Sequence
  Description of Artificial Sequence: Synthetic oligonucleotide
  Target: SCN10A; (+) strand; PAM type: NRG; PAM sequence: TGG
tgaaagccaagcctaagaca

SEQ ID NO: 29214 - DNA, 20 bp, Artificial Sequence
  Description of Artificial Sequence: Synthetic oligonucleotide
  Target: SCN10A; (+) strand; PAM type: NRG; PAM sequence: TGG
ccaagcctaagacatggacc

SEQ ID NO: 29215 - DNA, 20 bp, Artificial Sequence
  Description of Artificial Sequence: Synthetic oligonucleotide
  Target: SCN10A; (+) strand; PAM type: NRG; PAM sequence: GGG
caagcctaagacatggacct

SEQ ID NO: 29216 - DNA, 20 bp, Artificial Sequence
  Description of Artificial Sequence: Synthetic oligonucleotide
  Target: SCN10A; (+) strand; PAM type: NRG; PAM sequence: CAG
ctaagacatggacctgggtg

SEQ ID NO: 29217 - DNA, 20 bp, Artificial Sequence
  Description of Artificial Sequence: Synthetic oligonucleotide
  Target: SCN10A; (+) strand; PAM type: NRG; PAM sequence: AGG
taagacatggacctgggtgc

SEQ ID NO: 29218 - DNA, 20 bp, Artificial Sequence
  Description of Artificial Sequence: Synthetic oligonucleotide
  Target: SCN10A; (+) strand; PAM type: NRG; PAM sequence: TGG
ctgggtgcaggtgatttatc

SEQ ID NO: 29219 - DNA, 20 bp, Artificial Sequence
  Description of Artificial Sequence: Synthetic oligonucleotide
  Target: SCN10A; (+) strand; PAM type: NRG; PAM sequence: GGG
tgggtgcaggtgatttatct

SEQ ID NO: 29220 - DNA, 20 bp, Artificial Sequence
  Description of Artificial Sequence: Synthetic oligonucleotide
  Target: SCN10A; (+) strand; PAM type: NRG; PAM sequence: GAG
ggtgcaggtgatttatctgg

SEQ ID NO: 29221 - DNA, 20 bp, Artificial Sequence
  Description of Artificial Sequence: Synthetic oligonucleotide
  Target: SCN10A; (+) strand; PAM type: NRG; PAM sequence: AGG
gtgcaggtgatttatctggg

SEQ ID NO: 29222 - DNA, 20 bp, Artificial Sequence
  Description of Artificial Sequence: Synthetic oligonucleotide
  Target: SCN10A; (+) strand; PAM type: NRG; PAM sequence: AAG
atttatctgggaggtgatcc

SEQ ID NO: 29223 - DNA, 20 bp, Artificial Sequence
  Description of Artificial Sequence: Synthetic oligonucleotide
  Target: SCN10A; (+) strand; PAM type: NRG; PAM sequence: AGG
tttatctgggaggtgatcca

SEQ ID NO: 29224 - DNA, 20 bp, Artificial Sequence
  Description of Artificial Sequence: Synthetic oligonucleotide
  Target: SCN10A; (+) strand; PAM type: NRG; PAM sequence: AAG
atctgggaggtgatccaagg

SEQ ID NO: 29225 - DNA, 20 bp, Artificial Sequence
  Description of Artificial Sequence: Synthetic oligonucleotide
  Target: SCN10A; (+) strand; PAM type: NRG; PAM sequence: CAG
tgggaggtgatccaaggaag

SEQ ID NO: 29226 - DNA, 20 bp, Artificial Sequence
  Description of Artificial Sequence: Synthetic oligonucleotide
  Target: SCN10A; (+) strand; PAM type: NRG; PAM sequence: AGG
gggaggtgatccaaggaagc

SEQ ID NO: 29227 - DNA, 20 bp, Artificial Sequence
  Description of Artificial Sequence: Synthetic oligonucleotide
  Target: SCN10A; (+) strand; PAM type: NRG; PAM sequence: GAG
tgatccaaggaagcaggaat

SEQ ID NO: 29228 - DNA, 20 bp, Artificial Sequence
  Description of Artificial Sequence: Synthetic oligonucleotide
  Target: SCN10A; (+) strand; PAM type: NRG; PAM sequence: AGG
gatccaaggaagcaggaatg

SEQ ID NO: 29229 - DNA, 20 bp, Artificial Sequence
  Description of Artificial Sequence: Synthetic oligonucleotide
  Target: SCN10A; (+) strand; PAM type: NRG; PAM sequence: GGG
atccaaggaagcaggaatga

SEQ ID NO: 29230 - DNA, 20 bp, Artificial Sequence
  Description of Artificial Sequence: Synthetic oligonucleotide
  Target: SCN10A; (+) strand; PAM type: NRG; PAM sequence: GAG
ccaaggaagcaggaatgagg

SEQ ID NO: 29231 - DNA, 20 bp, Artificial Sequence
  Description of Artificial Sequence: Synthetic oligonucleotide
  Target: SCN10A; (+) strand; PAM type: NRG; PAM sequence: TGG
aggaagcaggaatgagggag

SEQ ID NO: 29232 - DNA, 20 bp, Artificial Sequence
  Description of Artificial Sequence: Synthetic oligonucleotide
  Target: SCN10A; (+) strand; PAM type: NRG; PAM sequence: GGG
ggaagcaggaatgagggagt

SEQ ID NO: 29233 - DNA, 20 bp, Artificial Sequence
  Description of Artificial Sequence: Synthetic oligonucleotide
  Target: SCN10A; (+) strand; PAM type: NRG; PAM sequence: GGG
gaagcaggaatgagggagtg

SEQ ID NO: 29234 - DNA, 20 bp, Artificial Sequence
  Description of Artificial Sequence: Synthetic oligonucleotide
  Target: SCN10A; (+) strand; PAM type: NRG; PAM sequence: AAG
gcaggaatgagggagtgggg

SEQ ID NO: 29235 - DNA, 20 bp, Artificial Sequence
  Description of Artificial Sequence: Synthetic oligonucleotide
  Target: SCN10A; (+) strand; PAM type: NRG; PAM sequence: AAG
atgagggagtggggaagaat

SEQ ID NO: 29236 - DNA, 20 bp, Artificial Sequence
  Description of Artificial Sequence: Synthetic oligonucleotide
  Target: SCN10A; (+) strand; PAM type: NRG; PAM sequence: CGG
agggagtggggaagaataag

SEQ ID NO: 29237 - DNA, 20 bp, Artificial Sequence
  Description of Artificial Sequence: Synthetic oligonucleotide
  Target: SCN10A; (+) strand; PAM type: NRG; PAM sequence: GGG
gggagtggggaagaataagc

SEQ ID NO: 29238 - DNA, 20 bp, Artificial Sequence
  Description of Artificial Sequence: Synthetic oligonucleotide
  Target: SCN10A; (+) strand; PAM type: NRG; PAM sequence: TGG
tggggaagaataagcgggaa

SEQ ID NO: 29239 - DNA, 20 bp, Artificial Sequence
  Description of Artificial Sequence: Synthetic oligonucleotide
  Target: SCN10A; (+) strand; PAM type: NRG; PAM sequence: GGG
ggggaagaataagcgggaat

SEQ ID NO: 29240 - DNA, 20 bp, Artificial Sequence
  Description of Artificial Sequence: Synthetic oligonucleotide
  Target: SCN10A; (+) strand; PAM type: NRG; PAM sequence: GAG
ggaagaataagcgggaatgg

SEQ ID NO: 29241 - DNA, 20 bp, Artificial Sequence
  Description of Artificial Sequence: Synthetic oligonucleotide
  Target: SCN10A; (+) strand; PAM type: NRG; PAM sequence: AAG
agaataagcgggaatgggag

SEQ ID NO: 29242 - DNA, 20 bp, Artificial Sequence
  Description of Artificial Sequence: Synthetic oligonucleotide
  Target: SCN10A; (+) strand; PAM type: NRG; PAM sequence: GAG
aataagcgggaatgggagaa

SEQ ID NO: 29243 - DNA, 20 bp, Artificial Sequence
  Description of Artificial Sequence: Synthetic oligonucleotide
  Target: SCN10A; (+) strand; PAM type: NRG; PAM sequence: AAG
gaatgggagaagagcctgtg

SEQ ID NO: 29244 - DNA, 20 bp, Artificial Sequence
  Description of Artificial Sequence: Synthetic oligonucleotide
  Target: SCN10A; (+) strand; PAM type: NRG; PAM sequence: GAG
atgggagaagagcctgtgaa

SEQ ID NO: 29245 - DNA, 20 bp, Artificial Sequence
  Description of Artificial Sequence: Synthetic oligonucleotide
  Target: SCN10A; (+) strand; PAM type: NRG; PAM sequence: AGG
tgggagaagagcctgtgaag

SEQ ID NO: 29246 - DNA, 20 bp, Artificial Sequence
  Description of Artificial Sequence: Synthetic oligonucleotide
  Target: SCN10A; (+) strand; PAM type: NRG; PAM sequence: AAG
cctgtgaagaggatgttgtt

SEQ ID NO: 29247 - DNA, 20 bp, Artificial Sequence
  Description of Artificial Sequence: Synthetic oligonucleotide
  Target: SCN10A; (+) strand; PAM type: NRG; PAM sequence: CAG
gtgaagaggatgttgttaag

SEQ ID NO: 29248 - DNA, 20 bp, Artificial Sequence
  Description of Artificial Sequence: Synthetic oligonucleotide
  Target: SCN10A; (+) strand; PAM type: NRG; PAM sequence: AGG
tgaagaggatgttgttaagc

SEQ ID NO: 29249 - DNA, 20 bp, Artificial Sequence
  Description of Artificial Sequence: Synthetic oligonucleotide
  Target: SCN10A; (+) strand; PAM type: NRG; PAM sequence: GGG
gaagaggatgttgttaagca

SEQ ID NO: 29250 - DNA, 20 bp, Artificial Sequence
  Description of Artificial Sequence: Synthetic oligonucleotide
  Target: SCN10A; (+) strand; PAM type: NRG; PAM sequence: TGG
tgttaagcagggcatcattg

SEQ ID NO: 29251 - DNA, 20 bp, Artificial Sequence
  Description of Artificial Sequence: Synthetic oligonucleotide
  Target: SCN10A; (+) strand; PAM type: NRG; PAM sequence: GGG
gttaagcagggcatcattgt

SEQ ID NO: 29252 - DNA, 20 bp, Artificial Sequence
  Description of Artificial Sequence: Synthetic oligonucleotide
  Target: SCN10A; (+) strand; PAM type: NRG; PAM sequence: AAG
ggcatcattgtgggcaactg

SEQ ID NO: 29253 - DNA, 20 bp, Artificial Sequence
  Description of Artificial Sequence: Synthetic oligonucleotide
  Target: SCN10A; (+) strand; PAM type: NRG; PAM sequence: TGG
caactgaagcgcaatcctac

SEQ ID NO: 29254 - DNA, 20 bp, Artificial Sequence
  Description of Artificial Sequence: Synthetic oligonucleotide
  Target: SCN10A; (+) strand; PAM type: NRG; PAM sequence: GGG
aactgaagcgcaatcctact

SEQ ID NO: 29255 - DNA, 20 bp, Artificial Sequence
  Description of Artificial Sequence: Synthetic oligonucleotide
  Target: SCN10A; (+) strand; PAM type: NRG; PAM sequence: GGG
actgaagcgcaatcctactg

SEQ ID NO: 29256 - DNA, 20 bp, Artificial Sequence
  Description of Artificial Sequence: Synthetic oligonucleotide
  Target: SCN10A; (+) strand; PAM type: NRG; PAM sequence: GAG
caatcctactggggtcctct

SEQ ID NO: 29257 - DNA, 20 bp, Artificial Sequence
  Description of Artificial Sequence: Synthetic oligonucleotide
  Target: SCN10A; (+) strand; PAM type: NRG; PAM sequence: TAG
gggtcctctgagtaactgtg

SEQ ID NO: 29258 - DNA, 20 bp, Artificial Sequence
  Description of Artificial Sequence: Synthetic oligonucleotide
  Target: SCN10A; (+) strand; PAM type: NRG; PAM sequence: GAG
gtcctctgagtaactgtgta

SEQ ID NO: 29259 - DNA, 20 bp, Artificial Sequence
  Description of Artificial Sequence: Synthetic oligonucleotide
  Target: SCN10A; (+) strand; PAM type: NRG; PAM sequence: CAG
gtaactgtgtagagcacatg

SEQ ID NO: 29260 - DNA, 20 bp, Artificial Sequence
  Description of Artificial Sequence: Synthetic oligonucleotide
  Target: SCN10A; (+) strand; PAM type: NRG; PAM sequence: AGG
taactgtgtagagcacatgc

SEQ ID NO: 29261 - DNA, 20 bp, Artificial Sequence
  Description of Artificial Sequence: Synthetic oligonucleotide
  Target: SCN10A; (+) strand; PAM type: NRG; PAM sequence: AAG
acatgcaggattatatcacc

SEQ ID NO: 29262 - DNA, 20 bp, Artificial Sequence
  Description of Artificial Sequence: Synthetic oligonucleotide
  Target: SCN10A; (+) strand; PAM type: NRG; PAM sequence: AGG
catgcaggattatatcacca

SEQ ID NO: 29263 - DNA, 20 bp, Artificial Sequence
  Description of Artificial Sequence: Synthetic oligonucleotide
  Target: SCN10A; (+) strand; PAM type: NRG; PAM sequence: GGG
atgcaggattatatcaccaa

SEQ ID NO: 29264 - DNA, 20 bp, Artificial Sequence
  Description of Artificial Sequence: Synthetic oligonucleotide
  Target: SCN10A; (+) strand; PAM type: NRG; PAM sequence: CAG
aggattatatcaccaaggga

SEQ ID NO: 29265 - DNA, 20 bp, Artificial Sequence
  Description of Artificial Sequence: Synthetic oligonucleotide
  Target: SCN10A; (+) strand; PAM type: NRG; PAM sequence: AGG
ggattatatcaccaagggac

SEQ ID NO: 29266 - DNA, 20 bp, Artificial Sequence
  Description of Artificial Sequence: Synthetic oligonucleotide
  Target: SCN10A; (+) strand; PAM type: NRG; PAM sequence: GGG
gattatatcaccaagggaca

SEQ ID NO: 29267 - DNA, 20 bp, Artificial Sequence
  Description of Artificial Sequence: Synthetic oligonucleotide
  Target: SCN10A; (+) strand; PAM type: NRG; PAM sequence: TGG
tcaccaagggacagggaaac

SEQ ID NO: 29268 - DNA, 20 bp, Artificial Sequence
  Description of Artificial Sequence: Synthetic oligonucleotide
  Target: SCN10A; (+) strand; PAM type: NRG; PAM sequence: GAG
accaagggacagggaaactg

SEQ ID NO: 29269 - DNA, 20 bp, Artificial Sequence
  Description of Artificial Sequence: Synthetic oligonucleotide
  Target: SCN10A; (+) strand; PAM type: NRG; PAM sequence: CAG
gaaactggagtatttatcct

SEQ ID NO: 29270 - DNA, 20 bp, Artificial Sequence
  Description of Artificial Sequence: Synthetic oligonucleotide
  Target: SCN10A; (+) strand; PAM type: NRG; PAM sequence: TGG
ctcagactcccaaaacttat

SEQ ID NO: 29271 - DNA, 20 bp, Artificial Sequence
  Description of Artificial Sequence: Synthetic oligonucleotide
  Target: SCN10A; (+) strand; PAM type: NRG; PAM sequence: AAG
gactcccaaaacttattggt

SEQ ID NO: 29272 - DNA, 20 bp, Artificial Sequence
  Description of Artificial Sequence: Synthetic oligonucleotide
  Target: SCN10A; (+) strand; PAM type: NRG; PAM sequence: AGG
actcccaaaacttattggta

SEQ ID NO: 29273 - DNA, 20 bp, Artificial Sequence
  Description of Artificial Sequence: Synthetic oligonucleotide
  Target: SCN10A; (+) strand; PAM type: NRG; PAM sequence: GGG
ctcccaaaacttattggtaa

SEQ ID NO: 29274 - DNA, 20 bp, Artificial Sequence
  Description of Artificial Sequence: Synthetic oligonucleotide
  Target: SCN10A; (+) strand; PAM type: NRG; PAM sequence: TAG
ttattggtaagggttgcccc

SEQ ID NO: 29275 - DNA, 20 bp, Artificial Sequence
  Description of Artificial Sequence: Synthetic oligonucleotide
  Target: SCN10A; (+) strand; PAM type: NRG; PAM sequence: AGG
tattggtaagggttgcccct

SEQ ID NO: 29276 - DNA, 20 bp, Artificial Sequence
  Description of Artificial Sequence: Synthetic oligonucleotide
  Target: SCN10A; (+) strand; PAM type: NRG; PAM sequence: GGG
attggtaagggttgccccta

SEQ ID NO: 29277 - DNA, 20 bp, Artificial Sequence
  Description of Artificial Sequence: Synthetic oligonucleotide
  Target: SCN10A; (+) strand; PAM type: NRG; PAM sequence: TGG
ccctagggacattaaatccc

SEQ ID NO: 29278 - DNA, 20 bp, Artificial Sequence
  Description of Artificial Sequence: Synthetic oligonucleotide
  Target: SCN10A; (+) strand; PAM type: NRG; PAM sequence: TGG
gacattaaatccctggtact

SEQ ID NO: 29279 - DNA, 20 bp, Artificial Sequence
  Description of Artificial Sequence: Synthetic oligonucleotide
  Target: SCN10A; (+) strand; PAM type: NRG; PAM sequence: GGG
acattaaatccctggtactt

SEQ ID NO: 29280 - DNA, 20 bp, Artificial Sequence
  Description of Artificial Sequence: Synthetic oligonucleotide
  Target: SCN10A; (+) strand; PAM type: NRG; PAM sequence: GGG
cattaaatccctggtacttg

SEQ ID NO: 29281 - DNA, 20 bp, Artificial Sequence
  Description of Artificial Sequence: Synthetic oligonucleotide
  Target: SCN10A; (+) strand; PAM type: NRG; PAM sequence: GGG
attaaatccctggtacttgg

SEQ ID NO: 29282 - DNA, 20 bp, Artificial Sequence
  Description of Artificial Sequence: Synthetic oligonucleotide
  Target: SCN10A; (+) strand; PAM type: NRG; PAM sequence: GAG
taaatccctggtacttgggg

SEQ ID NO: 29283 - DNA, 20 bp, Artificial Sequence
  Description of Artificial Sequence: Synthetic oligonucleotide
  Target: SCN10A; (+) strand; PAM type: NRG; PAM sequence: AAG
atccctggtacttgggggag

SEQ ID NO: 29284 - DNA, 20 bp, Artificial Sequence
  Description of Artificial Sequence: Synthetic oligonucleotide
  Target: SCN10A; (+) strand; PAM type: NRG; PAM sequence: AAG
tgggggagaagttgctgcac

SEQ ID NO: 29285 - DNA, 20 bp, Artificial Sequence
  Description of Artificial Sequence: Synthetic oligonucleotide
  Target: SCN10A; (+) strand; PAM type: NRG; PAM sequence: AAG
aagttgctgcacaagctcct

SEQ ID NO: 29286 - DNA, 20 bp, Artificial Sequence
  Description of Artificial Sequence: Synthetic oligonucleotide
  Target: SCN10A; (+) strand; PAM type: NRG; PAM sequence: TGG
ctgcacaagctcctaagccc

SEQ ID NO: 29287 - DNA, 20 bp, Artificial Sequence
  Description of Artificial Sequence: Synthetic oligonucleotide
  Target: SCN10A; (+) strand; PAM type: NRG; PAM sequence: GAG
gcacaagctcctaagccctg

SEQ ID NO: 29288 - DNA, 20 bp, Artificial Sequence
  Description of Artificial Sequence: Synthetic oligonucleotide
  Target: SCN10A; (+) strand; PAM type: NRG; PAM sequence: CAG
taagccctggagtctttata

SEQ ID NO: 29289 - DNA, 20 bp, Artificial Sequence
  Description of Artificial Sequence: Synthetic oligonucleotide
  Target: SCN10A; (+) strand; PAM type: NRG; PAM sequence: GAG
agccctggagtctttataca

SEQ ID NO: 29290 - DNA, 20 bp, Artificial Sequence
  Description of Artificial Sequence: Synthetic oligonucleotide
  Target: SCN10A; (+) strand; PAM type: NRG; PAM sequence: CAG
ggagtctttatacagagaat

SEQ ID NO: 29291 - DNA, 20 bp, Artificial Sequence
  Description of Artificial Sequence: Synthetic oligonucleotide
  Target: SCN10A; (+) strand; PAM type: NRG; PAM sequence: AAG
gtctttatacagagaatcag

SEQ ID NO: 29292 - DNA, 20 bp, Artificial Sequence
  Description of Artificial Sequence: Synthetic oligonucleotide
  Target: SCN10A; (+) strand; PAM type: NRG; PAM sequence: CAG
tatacagagaatcagaagtg

SEQ ID NO: 29293 - DNA, 20 bp, Artificial Sequence
  Description of Artificial Sequence: Synthetic oligonucleotide
  Target: SCN10A; (+) strand; PAM type: NRG; PAM sequence: CAG
agaatcagaagtgcagcctg

SEQ ID NO: 29294 - DNA, 20 bp, Artificial Sequence
  Description of Artificial Sequence: Synthetic oligonucleotide
  Target: SCN10A; (+) strand; PAM type: NRG; PAM sequence: AGG
gaatcagaagtgcagcctgc

SEQ ID NO: 29295 - DNA, 20 bp, Artificial Sequence
  Description of Artificial Sequence: Synthetic oligonucleotide
  Target: SCN10A; (+) strand; PAM type: NRG; PAM sequence: CAG
gtgcagcctgcaggtgaaat

SEQ ID NO: 29296 - DNA, 20 bp, Artificial Sequence
  Description of Artificial Sequence: Synthetic oligonucleotide
  Target: SCN10A; (+) strand; PAM type: NRG; PAM sequence: AAG
cagcctgcaggtgaaatcag

SEQ ID NO: 29297 - DNA, 20 bp, Artificial Sequence
  Description of Artificial Sequence: Synthetic oligonucleotide
  Target: SCN10A; (+) strand; PAM type: NRG; PAM sequence: TGG
cctgcaggtgaaatcagaag

SEQ ID NO: 29298 - DNA, 20 bp, Artificial Sequence
  Description of Artificial Sequence: Synthetic oligonucleotide
  Target: SCN10A; (+) strand; PAM type: NRG; PAM sequence: GGG
ctgcaggtgaaatcagaagt

SEQ ID NO: 29299 - DNA, 20 bp, Artificial Sequence
  Description of Artificial Sequence: Synthetic oligonucleotide
  Target: SCN10A; (+) strand; PAM type: NRG; PAM sequence: AAG
ggtgaaatcagaagtgggct

SEQ ID NO: 29300 - DNA, 20 bp, Artificial Sequence
  Description of Artificial Sequence: Synthetic oligonucleotide
  Target: SCN10A; (+) strand; PAM type: NRG; PAM sequence: AGG
gtgaaatcagaagtgggcta

SEQ ID NO: 29301 - DNA, 20 bp, Artificial Sequence
  Description of Artificial Sequence: Synthetic oligonucleotide
  Target: SCN10A; (+) strand; PAM type: NRG; PAM sequence: GGG
tgaaatcagaagtgggctaa

SEQ ID NO: 29302 - DNA, 20 bp, Artificial Sequence
  Description of Artificial Sequence: Synthetic oligonucleotide
  Target: SCN10A; (+) strand; PAM type: NRG; PAM sequence: AAG
aatcagaagtgggctaaggg

SEQ ID NO: 29303 - DNA, 20 bp, Artificial Sequence
  Description of Artificial Sequence: Synthetic oligonucleotide
  Target: SCN10A; (+) strand; PAM type: NRG; PAM sequence: GAG
tcagaagtgggctaagggaa

SEQ ID NO: 29304 - DNA, 20 bp, Artificial Sequence
  Description of Artificial Sequence: Synthetic oligonucleotide
  Target: SCN10A; (+) strand; PAM type: NRG; PAM sequence: AGG
cagaagtgggctaagggaag

SEQ ID NO: 29305 - DNA, 20 bp, Artificial Sequence
  Description of Artificial Sequence: Synthetic oligonucleotide
  Target: SCN10A; (+) strand; PAM type: NRG; PAM sequence: TGG
aagtgggctaagggaagagg

SEQ ID NO: 29306 - DNA, 20 bp, Artificial Sequence
  Description of Artificial Sequence: Synthetic oligonucleotide
  Target: SCN10A; (+) strand; PAM type: NRG; PAM sequence: CAG
tgggctaagggaagaggtgg

SEQ ID NO: 29307 - DNA, 20 bp, Artificial Sequence
  Description of Artificial Sequence: Synthetic oligonucleotide
  Target: SCN10A; (+) strand; PAM type: NRG; PAM sequence: AGG
gggctaagggaagaggtggc

SEQ ID NO: 29308 - DNA, 20 bp, Artificial Sequence
  Description of Artificial Sequence: Synthetic oligonucleotide
  Target: SCN10A; (+) strand; PAM type: NRG; PAM sequence: GGG
ggctaagggaagaggtggca

SEQ ID NO: 29309 - DNA, 20 bp, Artificial Sequence
  Description of Artificial Sequence: Synthetic oligonucleotide
  Target: SCN10A; (+) strand; PAM type: NRG; PAM sequence: CAG
aagaggtggcagggaattga

SEQ ID NO: 29310 - DNA, 20 bp, Artificial Sequence
  Description of Artificial Sequence: Synthetic oligonucleotide
  Target: SCN10A; (+) strand; PAM type: NRG; PAM sequence: CAG
ggaattgacagtgcctgcca

SEQ ID NO: 29311 - DNA, 20 bp, Artificial Sequence
  Description of Artificial Sequence: Synthetic oligonucleotide
  Target: SCN10A; (+) strand; PAM type: NRG; PAM sequence: CAG
attgacagtgcctgccacag

SEQ ID NO: 29312 - DNA, 20 bp, Artificial Sequence
  Description of Artificial Sequence: Synthetic oligonucleotide
  Target: SCN10A; (+) strand; PAM type: NRG; PAM sequence: AGG
ttgacagtgcctgccacagc

SEQ ID NO: 29313 - DNA, 20 bp, Artificial Sequence
  Description of Artificial Sequence: Synthetic oligonucleotide
  Target: SCN10A; (+) strand; PAM type: NRG; PAM sequence: AAG
acagtgcctgccacagcagg

SEQ ID NO: 29314 - DNA, 20 bp, Artificial Sequence
  Description of Artificial Sequence: Synthetic oligonucleotide
  Target: SCN10A; (+) strand; PAM type: NRG; PAM sequence: TGG
gtgcctgccacagcaggaag

SEQ ID NO: 29315 - DNA, 20 bp, Artificial Sequence
  Description of Artificial Sequence: Synthetic oligonucleotide
  Target: SCN10A; (+) strand; PAM type: NRG; PAM sequence: TAG
aggaagtggtcattccccaa

SEQ ID NO: 29316 - DNA, 20 bp, Artificial Sequence
  Description of Artificial Sequence: Synthetic oligonucleotide
  Target: SCN10A; (+) strand; PAM type: NRG; PAM sequence: CAG
attccccaatagtgtctccc

SEQ ID NO: 29317 - DNA, 20 bp, Artificial Sequence
  Description of Artificial Sequence: Synthetic oligonucleotide
  Target: SCN10A; (+) strand; PAM type: NRG; PAM sequence: TGG
ccaatagtgtctccccagcc

SEQ ID NO: 29318 - DNA, 20 bp, Artificial Sequence
  Description of Artificial Sequence: Synthetic oligonucleotide
  Target: SCN10A; (+) strand; PAM type: NRG; PAM sequence: GAG
cttttcttttcttttttttt

SEQ ID NO: 29319 - DNA, 20 bp, Artificial Sequence
  Description of Artificial Sequence: Synthetic oligonucleotide
  Target: SCN10A; (+) strand; PAM type: NRG; PAM sequence: GAG
ttttctttttttttgagatt

SEQ ID NO: 29320 - DNA, 20 bp, Artificial Sequence
  Description of Artificial Sequence: Synthetic oligonucleotide
  Target: SCN10A; (+) strand; PAM type: NRG; PAM sequence: AAG
tgagtctcgctgtctcgccc

SEQ ID NO: 29321 - DNA, 20 bp, Artificial Sequence
  Description of Artificial Sequence: Synthetic oligonucleotide
  Target: SCN10A; (+) strand; PAM type: NRG; PAM sequence: TGG
tctcgctgtctcgcccaagc

SEQ ID NO: 29322 - DNA, 20 bp, Artificial Sequence
  Description of Artificial Sequence: Synthetic oligonucleotide
  Target: SCN10A; (+) strand; PAM type: NRG; PAM sequence: GAG
tcgctgtctcgcccaagctg

SEQ ID NO: 29323 - DNA, 20 bp, Artificial Sequence
  Description of Artificial Sequence: Synthetic oligonucleotide
  Target: SCN10A; (+) strand; PAM type: NRG; PAM sequence: CAG
gtctcgcccaagctggagtg

SEQ ID NO: 29324 - DNA, 20 bp, Artificial Sequence
  Description of Artificial Sequence: Synthetic oligonucleotide
  Target: SCN10A; (+) strand; PAM type: NRG; PAM sequence: CAG
ggagtgcagtgacgcaatct

SEQ ID NO: 29325 - DNA, 20 bp, Artificial Sequence
  Description of Artificial Sequence: Synthetic oligonucleotide
  Target: SCN10A; (+) strand; PAM type: NRG; PAM sequence: CGG
tcactgcaacttctgcctcc

SEQ ID NO: 29326 - DNA, 20 bp, Artificial Sequence
  Description of Artificial Sequence: Synthetic oligonucleotide
  Target: SCN10A; (+) strand; PAM type: NRG; PAM sequence: GGG
cactgcaacttctgcctccc

SEQ ID NO: 29327 - DNA, 20 bp, Artificial Sequence
  Description of Artificial Sequence: Synthetic oligonucleotide
  Target: SCN10A; (+) strand; PAM type: NRG; PAM sequence: AAG
aacttctgcctcccgggttc

SEQ ID NO: 29328 - DNA, 20 bp, Artificial Sequence
  Description of Artificial Sequence: Synthetic oligonucleotide
  Target: SCN10A; (+) strand; PAM type: NRG; PAM sequence: GAG
cttctgcctcccgggttcaa

SEQ ID NO: 29329 - DNA, 20 bp, Artificial Sequence
  Description of Artificial Sequence: Synthetic oligonucleotide
  Target: SCN10A; (+) strand; PAM type: NRG; PAM sequence: CAG
ttcaagagattctcctgtct

SEQ ID NO: 29330 - DNA, 20 bp, Artificial Sequence
  Description of Artificial Sequence: Synthetic oligonucleotide
  Target: SCN10A; (+) strand; PAM type: NRG; PAM sequence: GAG
ttctcctgtctcagtctccc

SEQ ID NO: 29331 - DNA, 20 bp, Artificial Sequence
  Description of Artificial Sequence: Synthetic oligonucleotide
  Target: SCN10A; (+) strand; PAM type: NRG; PAM sequence: CAG
tcctgtctcagtctcccgag

SEQ ID NO: 29332 - DNA, 20 bp, Artificial Sequence
  Description of Artificial Sequence: Synthetic oligonucleotide
  Target: SCN10A; (+) strand; PAM type: NRG; PAM sequence: TGG
gtctcagtctcccgagcagc

SEQ ID NO: 29333 - DNA, 20 bp, Artificial Sequence
  Description of Artificial Sequence: Synthetic oligonucleotide
  Target: SCN10A; (+) strand; PAM type: NRG; PAM sequence: GGG
tctcagtctcccgagcagct

SEQ ID NO: 29334 - DNA, 20 bp, Artificial Sequence
  Description of Artificial Sequence: Synthetic oligonucleotide
  Target: SCN10A; (+) strand; PAM type: NRG; PAM sequence: CAG
ctcccgagcagctgggacta

SEQ ID NO: 29335 - DNA, 20 bp, Artificial Sequence
  Description of Artificial Sequence: Synthetic oligonucleotide
  Target: SCN10A; (+) strand; PAM type: NRG; PAM sequence: AGG
tcccgagcagctgggactac

SEQ ID NO: 29336 - DNA, 20 bp, Artificial Sequence
  Description of Artificial Sequence: Synthetic oligonucleotide
  Target: SCN10A; (+) strand; PAM type: NRG; PAM sequence: AAG
gcagctgggactacaggcac

SEQ ID NO: 29337 - DNA, 20 bp, Artificial Sequence
  Description of Artificial Sequence: Synthetic oligonucleotide
  Target: SCN10A; (+) strand; PAM type: NRG; PAM sequence: TAG
tgctaatttctttcatattt

SEQ ID NO: 29338 - DNA, 20 bp, Artificial Sequence
  Description of Artificial Sequence: Synthetic oligonucleotide
  Target: SCN10A; (+) strand; PAM type: NRG; PAM sequence: TAG
taatttctttcatattttag

SEQ ID NO: 29339 - DNA, 20 bp, Artificial Sequence
  Description of Artificial Sequence: Synthetic oligonucleotide
  Target: SCN10A; (+) strand; PAM type: NRG; PAM sequence: GAG
atttctttcatattttagta

SEQ ID NO: 29340 - DNA, 20 bp, Artificial Sequence
  Description of Artificial Sequence: Synthetic oligonucleotide
  Target: SCN10A; (+) strand; PAM type: NRG; PAM sequence: TGG
ctttcatattttagtagaga

SEQ ID NO: 29341 - DNA, 20 bp, Artificial Sequence
  Description of Artificial Sequence: Synthetic oligonucleotide
  Target: SCN10A; (+) strand; PAM type: NRG; PAM sequence: GGG
tttcatattttagtagagat

SEQ ID NO: 29342 - DNA, 20 bp, Artificial Sequence
  Description of Artificial Sequence: Synthetic oligonucleotide
  Target: SCN10A; (+) strand; PAM type: NRG; PAM sequence: GGG
ttcatattttagtagagatg

SEQ ID NO: 29343 - DNA, 20 bp, Artificial Sequence
  Description of Artificial Sequence: Synthetic oligonucleotide
  Target: SCN10A; (+) strand; PAM type: NRG; PAM sequence: CAG
tggggtttcaccgtattgcc

SEQ ID NO: 29344 - DNA, 20 bp, Artificial Sequence
  Description of Artificial Sequence: Synthetic oligonucleotide
  Target: SCN10A; (+) strand; PAM type: NRG; PAM sequence: AGG
ggggtttcaccgtattgccc

SEQ ID NO: 29345 - DNA, 20 bp, Artificial Sequence
  Description of Artificial Sequence: Synthetic oligonucleotide
  Target: SCN10A; (+) strand; PAM type: NRG; PAM sequence: TGG
tttcaccgtattgcccaggc

SEQ ID NO: 29346 - DNA, 20 bp, Artificial Sequence
  Description of Artificial Sequence: Synthetic oligonucleotide
  Target: SCN10A; (+) strand; PAM type: NRG; PAM sequence: GAG
attgcccaggctggtctcct

SEQ ID NO: 29347 - DNA, 20 bp, Artificial Sequence
  Description of Artificial Sequence: Synthetic oligonucleotide
  Target: SCN10A; (+) strand; PAM type: NRG; PAM sequence: CAG
ccaggctggtctcctgagct

SEQ ID NO: 29348 - DNA, 20 bp, Artificial Sequence
  Description of Artificial Sequence: Synthetic oligonucleotide
  Target: SCN10A; (+) strand; PAM type: NRG; PAM sequence: AGG
caggctggtctcctgagctc

SEQ ID NO: 29349 - DNA, 20 bp, Artificial Sequence
  Description of Artificial Sequence: Synthetic oligonucleotide
  Target: SCN10A; (+) strand; PAM type: NRG; PAM sequence: CGG
ctcaggcaatctgcccacct

SEQ ID NO: 29350 - DNA, 20 bp, Artificial Sequence
  Description of Artificial Sequence: Synthetic oligonucleotide
  Target: SCN10A; (+) strand; PAM type: NRG; PAM sequence: AAG
ctgcccacctcggcctccca

SEQ ID NO: 29351 - DNA, 20 bp, Artificial Sequence
  Description of Artificial Sequence: Synthetic oligonucleotide
  Target: SCN10A; (+) strand; PAM type: NRG; PAM sequence: TAG
acctcggcctcccaaagtgc

SEQ ID NO: 29352 - DNA, 20 bp, Artificial Sequence
  Description of Artificial Sequence: Synthetic oligonucleotide
  Target: SCN10A; (+) strand; PAM type: NRG; PAM sequence: AGG
cctcggcctcccaaagtgct

SEQ ID NO: 29353 - DNA, 20 bp, Artificial Sequence
  Description of Artificial Sequence: Synthetic oligonucleotide
  Target: SCN10A; (+) strand; PAM type: NRG; PAM sequence: CAG
ctcccaaagtgctaggatta

SEQ ID NO: 29354 - DNA, 20 bp, Artificial Sequence
  Description of Artificial Sequence: Synthetic oligonucleotide
  Target: SCN10A; (+) strand; PAM type: NRG; PAM sequence: AGG
tcccaaagtgctaggattac

SEQ ID NO: 29355 - DNA, 20 bp, Artificial Sequence
  Description of Artificial Sequence: Synthetic oligonucleotide
  Target: SCN10A; (+) strand; PAM type: NRG; PAM sequence: TGG
caggcatgaaccactgcgcc

SEQ ID NO: 29356 - DNA, 20 bp, Artificial Sequence
  Description of Artificial Sequence: Synthetic oligonucleotide
  Target: SCN10A; (+) strand; PAM type: NRG; PAM sequence: TGG
ccactgcgcctggcccatcc

SEQ ID NO: 29357 - DNA, 20 bp, Artificial Sequence
  Description of Artificial Sequence: Synthetic oligonucleotide
  Target: SCN10A; (+) strand; PAM type: NRG; PAM sequence: GGG
cactgcgcctggcccatcct

SEQ ID NO: 29358 - DNA, 20 bp, Artificial Sequence
  Description of Artificial Sequence: Synthetic oligonucleotide
  Target: SCN10A; (+) strand; PAM type: NRG; PAM sequence: TAG
gcccatcctgggttttatga

SEQ ID NO: 29359 - DNA, 20 bp, Artificial Sequence
  Description of Artificial Sequence: Synthetic oligonucleotide
  Target: SCN10A; (+) strand; PAM type: NRG; PAM sequence: GAG
tgggttttatgatagttcct

SEQ ID NO: 29360 - DNA, 20 bp, Artificial Sequence
  Description of Artificial Sequence: Synthetic oligonucleotide
  Target: SCN10A; (+) strand; PAM type: NRG; PAM sequence: TAG
cctccctatgcaccttgatt

SEQ ID NO: 29361 - DNA, 20 bp, Artificial Sequence
  Description of Artificial Sequence: Synthetic oligonucleotide
  Target: SCN10A; (+) strand; PAM type: NRG; PAM sequence: CAG
gctttgctcccacccttgtc

SEQ ID NO: 29362 - DNA, 20 bp, Artificial Sequence
  Description of Artificial Sequence: Synthetic oligonucleotide
  Target: SCN10A; (+) strand; PAM type: NRG; PAM sequence: AGG
ctttgctcccacccttgtcc

SEQ ID NO: 29363 - DNA, 20 bp, Artificial Sequence
  Description of Artificial Sequence: Synthetic oligonucleotide
  Target: SCN10A; (+) strand; PAM type: NRG; PAM sequence: GGG
tttgctcccacccttgtcca

SEQ ID NO: 29364 - DNA, 20 bp, Artificial Sequence
  Description of Artificial Sequence: Synthetic oligonucleotide
  Target: SCN10A; (+) strand; PAM type: NRG; PAM sequence: GAG
tgctcccacccttgtccagg

SEQ ID NO: 29365 - DNA, 20 bp, Artificial Sequence
  Description of Artificial Sequence: Synthetic oligonucleotide
  Target: SCN10A; (+) strand; PAM type: NRG; PAM sequence: TGG
tcccacccttgtccagggag

SEQ ID NO: 29366 - DNA, 20 bp, Artificial Sequence
  Description of Artificial Sequence: Synthetic oligonucleotide
  Target: SCN10A; (+) strand; PAM type: NRG; PAM sequence: TAG
ggctcacatgaactgtctct

SEQ ID NO: 29367 - DNA, 20 bp, Artificial Sequence
  Description of Artificial Sequence: Synthetic oligonucleotide
  Target: SCN10A; (+) strand; PAM type: NRG; PAM sequence: GAG
ctcacatgaactgtctctta

SEQ ID NO: 29368 - DNA, 20 bp, Artificial Sequence
  Description of Artificial Sequence: Synthetic oligonucleotide
  Target: SCN10A; (+) strand; PAM type: NRG; PAM sequence: AGG
tcacatgaactgtctcttag

SEQ ID NO: 29369 - DNA, 20 bp, Artificial Sequence
  Description of Artificial Sequence: Synthetic oligonucleotide
  Target: SCN10A; (+) strand; PAM type: NRG; PAM sequence: CAG
ttatctgatgctttcctcaa

SEQ ID NO: 29370 - DNA, 20 bp, Artificial Sequence
  Description of Artificial Sequence: Synthetic oligonucleotide
  Target: SCN10A; (+) strand; PAM type: NRG; PAM sequence: CAG
atgctttcctcaacagtgaa

SEQ ID NO: 29371 - DNA, 20 bp, Artificial Sequence
  Description of Artificial Sequence: Synthetic oligonucleotide
  Target: SCN10A; (+) strand; PAM type: NRG; PAM sequence: GAG
gctttcctcaacagtgaaca

SEQ ID NO: 29372 - DNA, 20 bp, Artificial Sequence
  Description of Artificial Sequence: Synthetic oligonucleotide
  Target: SCN10A; (+) strand; PAM type: NRG; PAM sequence: AGG
ctttcctcaacagtgaacag

SEQ ID NO: 29373 - DNA, 20 bp, Artificial Sequence
  Description of Artificial Sequence: Synthetic oligonucleotide
  Target: SCN10A; (+) strand; PAM type: NRG; PAM sequence: GAG
agtgaacagaggaaaacctc

SEQ ID NO: 29374 - DNA, 20 bp, Artificial Sequence
  Description of Artificial Sequence: Synthetic oligonucleotide
  Target: SCN10A; (+) strand; PAM type: NRG; PAM sequence: AAG
gaacagaggaaaacctcgag

SEQ ID NO: 29375 - DNA, 20 bp, Artificial Sequence
  Description of Artificial Sequence: Synthetic oligonucleotide
  Target: SCN10A; (+) strand; PAM type: NRG; PAM sequence: TGG
gaggaaaacctcgagaagcc

SEQ ID NO: 29376 - DNA, 20 bp, Artificial Sequence
  Description of Artificial Sequence: Synthetic oligonucleotide
  Target: SCN10A; (+) strand; PAM type: NRG; PAM sequence: GGG
aggaaaacctcgagaagcct

SEQ ID NO: 29377 - DNA, 20 bp, Artificial Sequence
  Description of Artificial Sequence: Synthetic oligonucleotide
  Target: SCN10A; (+) strand; PAM type: NRG; PAM sequence: GGG
ggaaaacctcgagaagcctg

SEQ ID NO: 29378 - DNA, 20 bp, Artificial Sequence
  Description of Artificial Sequence: Synthetic oligonucleotide
  Target: SCN10A; (+) strand; PAM type: NRG; PAM sequence: GAG
aaaacctcgagaagcctggg

SEQ ID NO: 29379 - DNA, 20 bp, Artificial Sequence
  Description of Artificial Sequence: Synthetic oligonucleotide
  Target: SCN10A; (+) strand; PAM type: NRG; PAM sequence: TAG
ctcgagaagcctggggagtg

SEQ ID NO: 29380 - DNA, 20 bp, Artificial Sequence
  Description of Artificial Sequence: Synthetic oligonucleotide
  Target: SCN10A; (+) strand; PAM type: NRG; PAM sequence: AAG
agcctggggagtgtagatga

SEQ ID NO: 29381 - DNA, 20 bp, Artificial Sequence
  Description of Artificial Sequence: Synthetic oligonucleotide
  Target: SCN10A; (+) strand; PAM type: NRG; PAM sequence: AGG
gcctggggagtgtagatgaa

SEQ ID NO: 29382 - DNA, 20 bp, Artificial Sequence
  Description of Artificial Sequence: Synthetic oligonucleotide
  Target: SCN10A; (+) strand; PAM type: NRG; PAM sequence: GGG
cctggggagtgtagatgaaa

SEQ ID NO: 29383 - DNA, 20 bp, Artificial Sequence
  Description of Artificial Sequence: Synthetic oligonucleotide
  Target: SCN10A; (+) strand; PAM type: NRG; PAM sequence: GGG
ctggggagtgtagatgaaag

SEQ ID NO: 29384 - DNA, 20 bp, Artificial Sequence
  Description of Artificial Sequence: Synthetic oligonucleotide
  Target: SCN10A; (+) strand; PAM type: NRG; PAM sequence: GGG
tggggagtgtagatgaaagg

SEQ ID NO: 29385 - DNA, 20 bp, Artificial Sequence
  Description of Artificial Sequence: Synthetic oligonucleotide
  Target: SCN10A; (+) strand; PAM type: NRG; PAM sequence: AAG
gagtgtagatgaaaggggga

SEQ ID NO: 29386 - DNA, 20 bp, Artificial Sequence
  Description of Artificial Sequence: Synthetic oligonucleotide
  Target: SCN10A; (+) strand; PAM type: NRG; PAM sequence: CGG
agatgaaagggggaaagcct

SEQ ID NO: 29387 - DNA, 20 bp, Artificial Sequence
  Description of Artificial Sequence: Synthetic oligonucleotide
  Target: SCN10A; (+) strand; PAM type: NRG; PAM sequence: TGG
tgaaagggggaaagcctcgg

SEQ ID NO: 29388 - DNA, 20 bp, Artificial Sequence
  Description of Artificial Sequence: Synthetic oligonucleotide
  Target: SCN10A; (+) strand; PAM type: NRG; PAM sequence: CAG
tcggtggctgaaacactcaa

SEQ ID NO: 29389 - DNA, 20 bp, Artificial Sequence
  Description of Artificial Sequence: Synthetic oligonucleotide
  Target: SCN10A; (+) strand; PAM type: NRG; PAM sequence: GAG
ggtggctgaaacactcaaca

SEQ ID NO: 29390 - DNA, 20 bp, Artificial Sequence
  Description of Artificial Sequence: Synthetic oligonucleotide
  Target: SCN10A; (+) strand; PAM type: NRG; PAM sequence: GAG
tggctgaaacactcaacaga

SEQ ID NO: 29391 - DNA, 20 bp, Artificial Sequence
  Description of Artificial Sequence: Synthetic oligonucleotide
  Target: SCN10A; (+) strand; PAM type: NRG; PAM sequence: CAG
tgaaacactcaacagagagc

SEQ ID NO: 29392 - DNA, 20 bp, Artificial Sequence
  Description of Artificial Sequence: Synthetic oligonucleotide
  Target: SCN10A; (+) strand; PAM type: NRG; PAM sequence: TGG
acactcaacagagagccagc

SEQ ID NO: 29393 - DNA, 20 bp, Artificial Sequence
  Description of Artificial Sequence: Synthetic oligonucleotide
  Target: SCN10A; (+) strand; PAM type: NRG; PAM sequence: AAG
agccagctggacactgctgc

SEQ ID NO: 29394 - DNA, 20 bp, Artificial Sequence
  Description of Artificial Sequence: Synthetic oligonucleotide
  Target: SCN10A; (+) strand; PAM type: NRG; PAM sequence: AGG
gccagctggacactgctgca

SEQ ID NO: 29395 - DNA, 20 bp, Artificial Sequence
  Description of Artificial Sequence: Synthetic oligonucleotide
  Target: SCN10A; (+) strand; PAM type: NRG; PAM sequence: GAG
cagctggacactgctgcaag

SEQ ID NO: 29396 - DNA, 20 bp, Artificial Sequence
  Description of Artificial Sequence: Synthetic oligonucleotide
  Target: SCN10A; (+) strand; PAM type: NRG; PAM sequence: AGG
agctggacactgctgcaagg

SEQ ID NO: 29397 - DNA, 20 bp, Artificial Sequence
  Description of Artificial Sequence: Synthetic oligonucleotide
  Target: SCN10A; (+) strand; PAM type: NRG; PAM sequence: GGG
gctggacactgctgcaagga

SEQ ID NO: 29398 - DNA, 20 bp, Artificial Sequence
  Description of Artificial Sequence: Synthetic oligonucleotide
  Target: SCN10A; (+) strand; PAM type: NRG; PAM sequence: CAG
gacactgctgcaaggaggga

SEQ ID NO: 29399 - DNA, 20 bp, Artificial Sequence
  Description of Artificial Sequence: Synthetic oligonucleotide
  Target: SCN10A; (+) strand; PAM type: NRG; PAM sequence: GAG
gctgcaaggagggacagtgt

SEQ ID NO: 29400 - DNA, 20 bp, Artificial Sequence
  Description of Artificial Sequence: Synthetic oligonucleotide
  Target: SCN10A; (+) strand; PAM type: NRG; PAM sequence: AGG
ctgcaaggagggacagtgtg

SEQ ID NO: 29401 - DNA, 20 bp, Artificial Sequence
  Description of Artificial Sequence: Synthetic oligonucleotide
  Target: SCN10A; (+) strand; PAM type: NRG; PAM sequence: TGG
gagggacagtgtgaggttgc

SEQ ID NO: 29402 - DNA, 20 bp, Artificial Sequence
  Description of Artificial Sequence: Synthetic oligonucleotide
  Target: SCN10A; (+) strand; PAM type: NRG; PAM sequence: GGG
agggacagtgtgaggttgct

SEQ ID NO: 29403 - DNA, 20 bp, Artificial Sequence
  Description of Artificial Sequence: Synthetic oligonucleotide
  Target: SCN10A; (+) strand; PAM type: NRG; PAM sequence: CAG
tgctgggtgatcgcctcttc

SEQ ID NO: 29404 - DNA, 20 bp, Artificial Sequence
  Description of Artificial Sequence: Synthetic oligonucleotide
  Target: SCN10A; (+) strand; PAM type: NRG; PAM sequence: CAG
gtgatcgcctcttccagtac

SEQ ID NO: 29405 - DNA, 20 bp, Artificial Sequence
  Description of Artificial Sequence: Synthetic oligonucleotide
  Target: SCN10A; (+) strand; PAM type: NRG; PAM sequence: AGG
tgatcgcctcttccagtacc

SEQ ID NO: 29406 - DNA, 20 bp, Artificial Sequence
  Description of Artificial Sequence: Synthetic oligonucleotide
  Target: SCN10A; (+) strand; PAM type: NRG; PAM sequence: GGG
gatcgcctcttccagtacca

SEQ ID NO: 29407 - DNA, 20 bp, Artificial Sequence
  Description of Artificial Sequence: Synthetic oligonucleotide
  Target: SCN10A; (+) strand; PAM type: NRG; PAM sequence: CAG
tcgtcacttcatttcaaatg

SEQ ID NO: 29408 - DNA, 20 bp, Artificial Sequence
  Description of Artificial Sequence: Synthetic oligonucleotide
  Target: SCN10A; (+) strand; PAM type: NRG; PAM sequence: TGG
atttcaaatgcagactgata

SEQ ID NO: 29409 - DNA, 20 bp, Artificial Sequence
  Description of Artificial Sequence: Synthetic oligonucleotide
  Target: SCN10A; (+) strand; PAM type: NRG; PAM sequence: GGG
tttcaaatgcagactgatat

SEQ ID NO: 29410 - DNA, 20 bp, Artificial Sequence
  Description of Artificial Sequence: Synthetic oligonucleotide
  Target: SCN10A; (+) strand; PAM type: NRG; PAM sequence: TAG
caaatgcagactgatatggg

SEQ ID NO: 29411 - DNA, 20 bp, Artificial Sequence
  Description of Artificial Sequence: Synthetic oligonucleotide
  Target: SCN10A; (+) strand; PAM type: NRG; PAM sequence: CAG
actgatatgggtagaatgca

SEQ ID NO: 29412 - DNA, 20 bp, Artificial Sequence
  Description of Artificial Sequence: Synthetic oligonucleotide
  Target: SCN10A; (+) strand; PAM type: NRG; PAM sequence: GAG
tgatatgggtagaatgcaca

SEQ ID NO: 29413 - DNA, 20 bp, Artificial Sequence
  Description of Artificial Sequence: Synthetic oligonucleotide
  Target: SCN10A; (+) strand; PAM type: NRG; PAM sequence: AGG
gatatgggtagaatgcacag

SEQ ID NO: 29414 - DNA, 20 bp, Artificial Sequence
  Description of Artificial Sequence: Synthetic oligonucleotide
  Target: SCN10A; (+) strand; PAM type: NRG; PAM sequence: GGG
atatgggtagaatgcacaga

SEQ ID NO: 29415 - DNA, 20 bp, Artificial Sequence
  Description of Artificial Sequence: Synthetic oligonucleotide
  Target: SCN10A; (+) strand; PAM type: NRG; PAM sequence: GGG
tatgggtagaatgcacagag

SEQ ID NO: 29416 - DNA, 20 bp, Artificial Sequence
  Description of Artificial Sequence: Synthetic oligonucleotide
  Target: SCN10A; (+) strand; PAM type: NRG; PAM sequence: AAG
gggtagaatgcacagagggg

SEQ ID NO: 29417 - DNA, 20 bp, Artificial Sequence
  Description of Artificial Sequence: Synthetic oligonucleotide
  Target: SCN10A; (+) strand; PAM type: NRG; PAM sequence: AGG
ggtagaatgcacagagggga

SEQ ID NO: 29418 - DNA, 20 bp, Artificial Sequence
  Description of Artificial Sequence: Synthetic oligonucleotide
  Target: SCN10A; (+) strand; PAM type: NRG; PAM sequence: TAG
atgcacagaggggaaggctg

SEQ ID NO: 29419 - DNA, 20 bp, Artificial Sequence
  Description of Artificial Sequence: Synthetic oligonucleotide
  Target: SCN10A; (+) strand; PAM type: NRG; PAM sequence: AGG
tgcacagaggggaaggctgt

SEQ ID NO: 29420 - DNA, 20 bp, Artificial Sequence
  Description of Artificial Sequence: Synthetic oligonucleotide
  Target: SCN10A; (+) strand; PAM type: NRG; PAM sequence: GGG
gcacagaggggaaggctgta

SEQ ID NO: 29421 - DNA, 20 bp, Artificial Sequence
  Description of Artificial Sequence: Synthetic oligonucleotide
  Target: SCN10A; (+) strand; PAM type: NRG; PAM sequence: CAG
agaggggaaggctgtaggga

SEQ ID NO: 29422 - DNA, 20 bp, Artificial Sequence
  Description of Artificial Sequence: Synthetic oligonucleotide
  Target: SCN10A; (+) strand; PAM type: NRG; PAM sequence: TGG
ggggaaggctgtagggacag

SEQ ID NO: 29423 - DNA, 20 bp, Artificial Sequence
  Description of Artificial Sequence: Synthetic oligonucleotide
  Target: SCN10A; (+) strand; PAM type: NRG; PAM sequence: GGG
gggaaggctgtagggacagt

SEQ ID NO: 29424 - DNA, 20 bp, Artificial Sequence
  Description of Artificial Sequence: Synthetic oligonucleotide
  Target: SCN10A; (+) strand; PAM type: NRG; PAM sequence: GAG
ggctgtagggacagtgggct

SEQ ID NO: 29425 - DNA, 20 bp, Artificial Sequence
  Description of Artificial Sequence: Synthetic oligonucleotide
  Target: SCN10A; (+) strand; PAM type: NRG; PAM sequence: CGG
gtgggctgagactcacctcc

SEQ ID NO: 29426 - DNA, 20 bp, Artificial Sequence
  Description of Artificial Sequence: Synthetic oligonucleotide
  Target: SCN10A; (+) strand; PAM type: NRG; PAM sequence: GGG
tgggctgagactcacctccc

SEQ ID NO: 29427 - DNA, 20 bp, Artificial Sequence
  Description of Artificial Sequence: Synthetic oligonucleotide
  Target: SCN10A; (+) strand; PAM type: NRG; PAM sequence: CAG
actcacctcccgggaatcaa

SEQ ID NO: 29428 - DNA, 20 bp, Artificial Sequence
  Description of Artificial Sequence: Synthetic oligonucleotide
  Target: SCN10A; (+) strand; PAM type: NRG; PAM sequence: CAG
ctgcatacataatgtccatc

SEQ ID NO: 29429 - DNA, 20 bp, Artificial Sequence
  Description of Artificial Sequence: Synthetic oligonucleotide
  Target: SCN10A; (+) strand; PAM type: NRG; PAM sequence: AAG
taatgtccatccagccttta

SEQ ID NO: 29430 - DNA, 20 bp, Artificial Sequence
  Description of Artificial Sequence: Synthetic oligonucleotide
  Target: SCN10A; (+) strand; PAM type: NRG; PAM sequence: AGG
aatgtccatccagcctttaa

SEQ ID NO: 29431 - DNA, 20 bp, Artificial Sequence
  Description of Artificial Sequence: Synthetic oligonucleotide
  Target: SCN10A; (+) strand; PAM type: NRG; PAM sequence: TGG
tccagcctttaaaggttgcc

SEQ ID NO: 29432 - DNA, 20 bp, Artificial Sequence
  Description of Artificial Sequence: Synthetic oligonucleotide
  Target: SCN10A; (+) strand; PAM type: NRG; PAM sequence: GAG
cagcctttaaaggttgcctg

SEQ ID NO: 29433 - DNA, 20 bp, Artificial Sequence
  Description of Artificial Sequence: Synthetic oligonucleotide
  Target: SCN10A; (+) strand; PAM type: NRG; PAM sequence: AAG
tttaaaggttgcctggagac

SEQ ID NO: 29434 - DNA, 20 bp, Artificial Sequence
  Description of Artificial Sequence: Synthetic oligonucleotide
  Target: SCN10A; (+) strand; PAM type: NRG; PAM sequence: AGG
ttaaaggttgcctggagaca

SEQ ID NO: 29435 - DNA, 20 bp, Artificial Sequence
  Description of Artificial Sequence: Synthetic oligonucleotide
  Target: SCN10A; (+) strand; PAM type: NRG; PAM sequence: GAG
aaaggttgcctggagacaag

SEQ ID NO: 29436 - DNA, 20 bp, Artificial Sequence
  Description of Artificial Sequence: Synthetic oligonucleotide
  Target: SCN10A; (+) strand; PAM type: NRG; PAM sequence: CAG
ggttgcctggagacaaggag

SEQ ID NO: 29437 - DNA, 20 bp, Artificial Sequence
  Description of Artificial Sequence: Synthetic oligonucleotide
  Target: SCN10A; (+) strand; PAM type: NRG; PAM sequence: GAG
ttgcctggagacaaggagca

SEQ ID NO: 29438 - DNA, 20 bp, Artificial Sequence
  Description of Artificial Sequence: Synthetic oligonucleotide
  Target: SCN10A; (+) strand; PAM type: NRG; PAM sequence: AGG
tgcctggagacaaggagcag

SEQ ID NO: 29439 - DNA, 20 bp, Artificial Sequence
  Description of Artificial Sequence: Synthetic oligonucleotide
  Target: SCN10A; (+) strand; PAM type: NRG; PAM sequence: CAG
gacaaggagcagaggccact

SEQ ID NO: 29440 - DNA, 20 bp, Artificial Sequence
  Description of Artificial Sequence: Synthetic oligonucleotide
  Target: SCN10A; (+) strand; PAM type: NRG; PAM sequence: TGG
gtctgcccatccatctatac

SEQ ID NO: 29441 - DNA, 20 bp, Artificial Sequence
  Description of Artificial Sequence: Synthetic oligonucleotide
  Target: SCN10A; (+) strand; PAM type: NRG; PAM sequence: AAG
atctatactggacccttccc

SEQ ID NO: 29442 - DNA, 20 bp, Artificial Sequence
  Description of Artificial Sequence: Synthetic oligonucleotide
  Target: SCN10A; (+) strand; PAM type: NRG; PAM sequence: TGG
actggacccttcccaagcca

SEQ ID NO: 29443 - DNA, 20 bp, Artificial Sequence
  Description of Artificial Sequence: Synthetic oligonucleotide
  Target: SCN10A; (+) strand; PAM type: NRG; PAM sequence: TGG
ggacccttcccaagccatgg

SEQ ID NO: 29444 - DNA, 20 bp, Artificial Sequence
  Description of Artificial Sequence: Synthetic oligonucleotide
  Target: SCN10A; (+) strand; PAM type: NRG; PAM sequence: CAG
cttcccaagccatggtggcc

SEQ ID NO: 29445 - DNA, 20 bp, Artificial Sequence
  Description of Artificial Sequence: Synthetic oligonucleotide
  Target: SCN10A; (+) strand; PAM type: NRG; PAM sequence: GAG
ccaagccatggtggcccagt

SEQ ID NO: 29446 - DNA, 20 bp, Artificial Sequence
  Description of Artificial Sequence: Synthetic oligonucleotide
  Target: SCN10A; (+) strand; PAM type: NRG; PAM sequence: GAG
aagccatggtggcccagtga

SEQ ID NO: 29447 - DNA, 20 bp, Artificial Sequence
  Description of Artificial Sequence: Synthetic oligonucleotide
  Target: SCN10A; (+) strand; PAM type: NRG; PAM sequence: GAG
gccatggtggcccagtgaga

SEQ ID NO: 29448 - DNA, 20 bp, Artificial Sequence
  Description of Artificial Sequence: Synthetic oligonucleotide
  Target: SCN10A; (+) strand; PAM type: NRG; PAM sequence: AGG
ccatggtggcccagtgagag

SEQ ID NO: 29449 - DNA, 20 bp, Artificial Sequence
  Description of Artificial Sequence: Synthetic oligonucleotide
  Target: SCN10A; (+) strand; PAM type: NRG; PAM sequence: GAG
atggtggcccagtgagagag

SEQ ID NO: 29450 - DNA, 20 bp, Artificial Sequence
  Description of Artificial Sequence: Synthetic oligonucleotide
  Target: SCN10A; (+) strand; PAM type: NRG; PAM sequence: GAG
ggtggcccagtgagagagga

SEQ ID NO: 29451 - DNA, 20 bp, Artificial Sequence
  Description of Artificial Sequence: Synthetic oligonucleotide
  Target: SCN10A; (+) strand; PAM type: NRG; PAM sequence: GAG
tggcccagtgagagaggaga

SEQ ID NO: 29452 - DNA, 20 bp, Artificial Sequence
  Description of Artificial Sequence: Synthetic oligonucleotide
  Target: SCN10A; (+) strand; PAM type: NRG; PAM sequence: TGG
gagaggagagagtcctgtgt

SEQ ID NO: 29453 - DNA, 20 bp, Artificial Sequence
  Description of Artificial Sequence: Synthetic oligonucleotide
  Target: SCN10A; (+) strand; PAM type: NRG; PAM sequence: AAG
ggagagagtcctgtgttgga

SEQ ID NO: 29454 - DNA, 20 bp, Artificial Sequence
  Description of Artificial Sequence: Synthetic oligonucleotide
  Target: SCN10A; (+) strand; PAM type: NRG; PAM sequence: AGG
gagagagtcctgtgttggaa

SEQ ID NO: 29455 - DNA, 20 bp, Artificial Sequence
  Description of Artificial Sequence: Synthetic oligonucleotide
  Target: SCN10A; (+) strand; PAM type: NRG; PAM sequence: GGG
agagagtcctgtgttggaaa

SEQ ID NO: 29456 - DNA, 20 bp, Artificial Sequence
  Description of Artificial Sequence: Synthetic oligonucleotide
  Target: SCN10A; (+) strand; PAM type: NRG; PAM sequence: CAG
tgtgttggaaagggcttgtg

SEQ ID NO: 29457 - DNA, 20 bp, Artificial Sequence
  Description of Artificial Sequence: Synthetic oligonucleotide
  Target: SCN10A; (+) strand; PAM type: NRG; PAM sequence: AAG
ttggaaagggcttgtgcaga

SEQ ID NO: 29458 - DNA, 20 bp, Artificial Sequence
  Description of Artificial Sequence: Synthetic oligonucleotide
  Target: SCN10A; (+) strand; PAM type: NRG; PAM sequence: AAG
ggcttgtgcagaaagaatga

SEQ ID NO: 29459 - DNA, 20 bp, Artificial Sequence
  Description of Artificial Sequence: Synthetic oligonucleotide
  Target: SCN10A; (+) strand; PAM type: NRG; PAM sequence: AGG
gcttgtgcagaaagaatgaa

SEQ ID NO: 29460 - DNA, 20 bp, Artificial Sequence
  Description of Artificial Sequence: Synthetic oligonucleotide
  Target: SCN10A; (+) strand; PAM type: NRG; PAM sequence: AAG
tgcagaaagaatgaaaggaa

SEQ ID NO: 29461 - DNA, 20 bp, Artificial Sequence
  Description of Artificial Sequence: Synthetic oligonucleotide
  Target: SCN10A; (+) strand; PAM type: NRG; PAM sequence: TGG
aatgaaaggaaaagttccct

SEQ ID NO: 29462 - DNA, 20 bp, Artificial Sequence
  Description of Artificial Sequence: Synthetic oligonucleotide
  Target: SCN10A; (+) strand; PAM type: NRG; PAM sequence: GGG
atgaaaggaaaagttccctt

SEQ ID NO: 29463 - DNA, 20 bp, Artificial Sequence
  Description of Artificial Sequence: Synthetic oligonucleotide
  Target: SCN10A; (+) strand; PAM type: NRG; PAM sequence: AAG
taatctcatatgatgattta

SEQ ID NO: 29464 - DNA, 20 bp, Artificial Sequence
  Description of Artificial Sequence: Synthetic oligonucleotide
  Target: SCN10A; (+) strand; PAM type: NRG; PAM sequence: TGG
atttaaagtaatcccacatg

SEQ ID NO: 29465 - DNA, 20 bp, Artificial Sequence
  Description of Artificial Sequence: Synthetic oligonucleotide
  Target: SCN10A; (+) strand; PAM type: NRG; PAM sequence: AAG
aatcccacatgtggctgttt

SEQ ID NO: 29466 - DNA, 20 bp, Artificial Sequence
  Description of Artificial Sequence: Synthetic oligonucleotide
  Target: SCN10A; (+) strand; PAM type: NRG; PAM sequence: TAG
cacatgtggctgtttaagaa

SEQ ID NO: 29467 - DNA, 20 bp, Artificial Sequence
  Description of Artificial Sequence: Synthetic oligonucleotide
  Target: SCN10A; (+) strand; PAM type: NRG; PAM sequence: GAG
catgtggctgtttaagaata

SEQ ID NO: 29468 - DNA, 20 bp, Artificial Sequence
  Description of Artificial Sequence: Synthetic oligonucleotide
  Target: SCN10A; (+) strand; PAM type: NRG; PAM sequence: TAG
gtggctgtttaagaatagag

SEQ ID NO: 29469 - DNA, 20 bp, Artificial Sequence
  Description of Artificial Sequence: Synthetic oligonucleotide
  Target: SCN10A; (+) strand; PAM type: NRG; PAM sequence: AAG
ttaagaatagagtagcatta

SEQ ID NO: 29470 - DNA, 20 bp, Artificial Sequence
  Description of Artificial Sequence: Synthetic oligonucleotide
  Target: SCN10A; (+) strand; PAM type: NRG; PAM sequence: CAG
atagagtagcattaaagaca

SEQ ID NO: 29471 - DNA, 20 bp, Artificial Sequence
  Description of Artificial Sequence: Synthetic oligonucleotide
  Target: SCN10A; (+) strand; PAM type: NRG; PAM sequence: GAG
agagtagcattaaagacaca

SEQ ID NO: 29472 - DNA, 20 bp, Artificial Sequence
  Description of Artificial Sequence: Synthetic oligonucleotide
  Target: SCN10A; (+) strand; PAM type: NRG; PAM sequence: CAG
attaaagacacagagccttt

SEQ ID NO: 29473 - DNA, 20 bp, Artificial Sequence
  Description of Artificial Sequence: Synthetic oligonucleotide
  Target: SCN10A; (+) strand; PAM type: NRG; PAM sequence: TAG
acacagagcctttcagaatg

SEQ ID NO: 29474 - DNA, 20 bp, Artificial Sequence
  Description of Artificial Sequence: Synthetic oligonucleotide
  Target: SCN10A; (+) strand; PAM type: NRG; PAM sequence: TGG
gagcctttcagaatgtagta

SEQ ID NO: 29475 - DNA, 20 bp, Artificial Sequence
  Description of Artificial Sequence: Synthetic oligonucleotide
  Target: SCN10A; (+) strand; PAM type: NRG; PAM sequence: GAG
ttcagaatgtagtatggact

SEQ ID NO: 29476 - DNA, 20 bp, Artificial Sequence
  Description of Artificial Sequence: Synthetic oligonucleotide
  Target: SCN10A; (+) strand; PAM type: NRG; PAM sequence: AGG
tcagaatgtagtatggactg

SEQ ID NO: 29477 - DNA, 20 bp, Artificial Sequence
  Description of Artificial Sequence: Synthetic oligonucleotide
  Target: SCN10A; (+) strand; PAM type: NRG; PAM sequence: GAG
tgtagtatggactgaggact

SEQ ID NO: 29478 - DNA, 20 bp, Artificial Sequence
  Description of Artificial Sequence: Synthetic oligonucleotide
  Target: SCN10A; (+) strand; PAM type: NRG; PAM sequence: TAG
tggactgaggactgagtgtc

SEQ ID NO: 29479 - DNA, 20 bp, Artificial Sequence
  Description of Artificial Sequence: Synthetic oligonucleotide
  Target: SCN10A; (+) strand; PAM type: NRG; PAM sequence: AGG
ggactgaggactgagtgtct

SEQ ID NO: 29480 - DNA, 20 bp, Artificial Sequence
  Description of Artificial Sequence: Synthetic oligonucleotide
  Target: SCN10A; (+) strand; PAM type: NRG; PAM sequence: TGG
ggactgagtgtctaggtgtc

SEQ ID NO: 29481 - DNA, 20 bp, Artificial Sequence
  Description of Artificial Sequence: Synthetic oligonucleotide
  Target: SCN10A; (+) strand; PAM type: NRG; PAM sequence: TAG
agtgtctaggtgtctggttc

SEQ ID NO: 29482 - DNA, 20 bp, Artificial Sequence
  Description of Artificial Sequence: Synthetic oligonucleotide
  Target: SCN10A; (+) strand; PAM type: NRG; PAM sequence: AAG
gttctagtgccaattgctac

SEQ ID NO: 29483 - DNA, 20 bp, Artificial Sequence
  Description of Artificial Sequence: Synthetic oligonucleotide
  Target: SCN10A; (+) strand; PAM type: NRG; PAM sequence: AAG
tctgctctgtgcacttgcct

SEQ ID NO: 29484 - DNA, 20 bp, Artificial Sequence
  Description of Artificial Sequence: Synthetic oligonucleotide
  Target: SCN10A; (+) strand; PAM type: NRG; PAM sequence: AGG
ctgctctgtgcacttgccta

SEQ ID NO: 29485 - DNA, 20 bp, Artificial Sequence
  Description of Artificial Sequence: Synthetic oligonucleotide
  Target: SCN10A; (+) strand; PAM type: NRG; PAM sequence: CAG
ttgcctaaggtttcccctct

SEQ ID NO: 29486 - DNA, 20 bp, Artificial Sequence
  Description of Artificial Sequence: Synthetic oligonucleotide
  Target: SCN10A; (+) strand; PAM type: NRG; PAM sequence: AGG
tgcctaaggtttcccctctc

SEQ ID NO: 29487 - DNA, 20 bp, Artificial Sequence
  Description of Artificial Sequence: Synthetic oligonucleotide
  Target: SCN10A; (+) strand; PAM type: NRG; PAM sequence: GGG
gcctaaggtttcccctctca

SEQ ID NO: 29488 - DNA, 20 bp, Artificial Sequence
  Description of Artificial Sequence: Synthetic oligonucleotide
  Target: SCN10A; (+) strand; PAM type: NRG; PAM sequence: CAG
tctcagggctgccattttct

SEQ ID NO: 29489 - DNA, 20 bp, Artificial Sequence
  Description of Artificial Sequence: Synthetic oligonucleotide
  Target: SCN10A; (+) strand; PAM type: NRG; PAM sequence: AAG
ccaccttatgcacatgatgt

SEQ ID NO: 29490 - DNA, 20 bp, Artificial Sequence
  Description of Artificial Sequence: Synthetic oligonucleotide
  Target: SCN10A; (+) strand; PAM type: NRG; PAM sequence: TGG
ttatgcacatgatgtaagaa

SEQ ID NO: 29491 - DNA, 20 bp, Artificial Sequence
  Description of Artificial Sequence: Synthetic oligonucleotide
  Target: SCN10A; (+) strand; PAM type: NRG; PAM sequence: CAG
tgtaagaatggtatatcttc

SEQ ID NO: 29492 - DNA, 20 bp, Artificial Sequence
  Description of Artificial Sequence: Synthetic oligonucleotide
  Target: SCN10A; (+) strand; PAM type: NRG; PAM sequence: TGG
agaatggtatatcttccaga

SEQ ID NO: 29493 - DNA, 20 bp, Artificial Sequence
  Description of Artificial Sequence: Synthetic oligonucleotide
  Target: SCN10A; (+) strand; PAM type: NRG; PAM sequence: GAG
aatggtatatcttccagatg

SEQ ID NO: 29494 - DNA, 20 bp, Artificial Sequence
  Description of Artificial Sequence: Synthetic oligonucleotide
  Target: SCN10A; (+) strand; PAM type: NRG; PAM sequence: AAG
ggtatatcttccagatggag

SEQ ID NO: 29495 - DNA, 20 bp, Artificial Sequence
  Description of Artificial Sequence: Synthetic oligonucleotide
  Target: SCN10A; (+) strand; PAM type: NRG; PAM sequence: GAG
atcttccagatggagaagtt

SEQ ID NO: 29496 - DNA, 20 bp, Artificial Sequence
  Description of Artificial Sequence: Synthetic oligonucleotide
  Target: SCN10A; (+) strand; PAM type: NRG; PAM sequence: TAG
ccagatggagaagttgagaa

SEQ ID NO: 29497 - DNA, 20 bp, Artificial Sequence
  Description of Artificial Sequence: Synthetic oligonucleotide
  Target: SCN10A; (+) strand; PAM type: NRG; PAM sequence: AAG
gatggagaagttgagaatag

SEQ ID NO: 29498 - DNA, 20 bp, Artificial Sequence
  Description of Artificial Sequence: Synthetic oligonucleotide
  Target: SCN10A; (+) strand; PAM type: NRG; PAM sequence: CAG
gacctccatgttcctgcctt

SEQ ID NO: 29499 - DNA, 20 bp, Artificial Sequence
  Description of Artificial Sequence: Synthetic oligonucleotide
  Target: SCN10A; (+) strand; PAM type: NRG; PAM sequence: TAG
catgttcctgccttcagctt

SEQ ID NO: 29500 - DNA, 20 bp, Artificial Sequence
  Description of Artificial Sequence: Synthetic oligonucleotide
  Target: SCN10A; (+) strand; PAM type: NRG; PAM sequence: GAG
ccttcagctttagcattctt

SEQ ID NO: 29501 - DNA, 20 bp, Artificial Sequence
  Description of Artificial Sequence: Synthetic oligonucleotide
  Target: SCN10A; (+) strand; PAM type: NRG; PAM sequence: AGG
cttcagctttagcattcttg

SEQ ID NO: 29502 - DNA, 20 bp, Artificial Sequence
  Description of Artificial Sequence: Synthetic oligonucleotide
  Target: SCN10A; (+) strand; PAM type: NRG; PAM sequence: TAG
gctttagcattcttgaggtc

SEQ ID NO: 29503 - DNA, 20 bp, Artificial Sequence
  Description of Artificial Sequence: Synthetic oligonucleotide
  Target: SCN10A; (+) strand; PAM type: NRG; PAM sequence: TGG
cattcttgaggtctagaaac

SEQ ID NO: 29504 - DNA, 20 bp, Artificial Sequence
  Description of Artificial Sequence: Synthetic oligonucleotide
  Target: SCN10A; (+) strand; PAM type: NRG; PAM sequence: GGG
attcttgaggtctagaaact

SEQ ID NO: 29505 - DNA, 20 bp, Artificial Sequence
  Description of Artificial Sequence: Synthetic oligonucleotide
  Target: SCN10A; (+) strand; PAM type: NRG; PAM sequence: CAG
tagaaactgggtgtgccttc

SEQ ID NO: 29506 - DNA, 20 bp, Artificial Sequence
  Description of Artificial Sequence: Synthetic oligonucleotide
  Target: SCN10A; (+) strand; PAM type: NRG; PAM sequence: CAG
ggtgtgccttccagcatgtt

SEQ ID NO: 29507 - DNA, 20 bp, Artificial Sequence
  Description of Artificial Sequence: Synthetic oligonucleotide
  Target: SCN10A; (+) strand; PAM type: NRG; PAM sequence: GAG
tgtgccttccagcatgttca

SEQ ID NO: 29508 - DNA, 20 bp, Artificial Sequence
  Description of Artificial Sequence: Synthetic oligonucleotide
  Target: SCN10A; (+) strand; PAM type: NRG; PAM sequence: AAG
ccagcatgttcagagcatgc

SEQ ID NO: 29509 - DNA, 20 bp, Artificial Sequence
  Description of Artificial Sequence: Synthetic oligonucleotide
  Target: SCN10A; (+) strand; PAM type: NRG; PAM sequence: TAG
tcagagcatgcaagacatct

SEQ ID NO: 29510 - DNA, 20 bp, Artificial Sequence
  Description of Artificial Sequence: Synthetic oligonucleotide
  Target: SCN10A; (+) strand; PAM type: NRG; PAM sequence: TAG
catcttagttcttacactcc

SEQ ID NO: 29511 - DNA, 20 bp, Artificial Sequence
  Description of Artificial Sequence: Synthetic oligonucleotide
  Target: SCN10A; (+) strand; PAM type: NRG; PAM sequence: AGG
atcttagttcttacactcct

SEQ ID NO: 29512 - DNA, 20 bp, Artificial Sequence
  Description of Artificial Sequence: Synthetic oligonucleotide
  Target: SCN10A; (+) strand; PAM type: NRG; PAM sequence: CAG
ttacactcctaggcctgtta

SEQ ID NO: 29513 - DNA, 20 bp, Artificial Sequence
  Description of Artificial Sequence: Synthetic oligonucleotide
  Target: SCN10A; (+) strand; PAM type: NRG; PAM sequence: GAG
ggcctgttacagcacttaat

SEQ ID NO: 29514 - DNA, 20 bp, Artificial Sequence
  Description of Artificial Sequence: Synthetic oligonucleotide
  Target: SCN10A; (+) strand; PAM type: NRG; PAM sequence: TAG
agctgttttaattcacctat

SEQ ID NO: 29515 - DNA, 20 bp, Artificial Sequence
  Description of Artificial Sequence: Synthetic oligonucleotide
  Target: SCN10A; (+) strand; PAM type: NRG; PAM sequence: CAG
ctattagtctgtttctcata

SEQ ID NO: 29516 - DNA, 20 bp, Artificial Sequence
  Description of Artificial Sequence: Synthetic oligonucleotide
  Target: SCN10A; (+) strand; PAM type: NRG; PAM sequence: CAG
gtctgtttctcatacagcat

SEQ ID NO: 29517 - DNA, 20 bp, Artificial Sequence
  Description of Artificial Sequence: Synthetic oligonucleotide
  Target: SCN10A; (+) strand; PAM type: NRG; PAM sequence: AAG
ctcatacagcatcagtgtcc

SEQ ID NO: 29518 - DNA, 20 bp, Artificial Sequence
  Description of Artificial Sequence: Synthetic oligonucleotide
  Target: SCN10A; (+) strand; PAM type: NRG; PAM sequence: CAG
acagcatcagtgtccaagcc

SEQ ID NO: 29519 - DNA, 20 bp, Artificial Sequence
  Description of Artificial Sequence: Synthetic oligonucleotide
  Target: SCN10A; (+) strand; PAM type: NRG; PAM sequence: CAG
ccagttctgactgtatctcc

SEQ ID NO: 29520 - DNA, 20 bp, Artificial Sequence
  Description of Artificial Sequence: Synthetic oligonucleotide
  Target: SCN10A; (+) strand; PAM type: NRG; PAM sequence: AGG
cagttctgactgtatctccc

SEQ ID NO: 29521 - DNA, 20 bp, Artificial Sequence
  Description of Artificial Sequence: Synthetic oligonucleotide
  Target: SCN10A; (+) strand; PAM type: NRG; PAM sequence: GGG
agttctgactgtatctccca

SEQ ID NO: 29522 - DNA, 20 bp, Artificial Sequence
  Description of Artificial Sequence: Synthetic oligonucleotide
  Target: SCN10A; (+) strand; PAM type: NRG; PAM sequence: GAG
tgactgtatctcccagggct

SEQ ID NO: 29523 - DNA, 20 bp, Artificial Sequence
  Description of Artificial Sequence: Synthetic oligonucleotide
  Target: SCN10A; (+) strand; PAM type: NRG; PAM sequence: TAG
ctgtatctcccagggctgag

SEQ ID NO: 29524 - DNA, 20 bp, Artificial Sequence
  Description of Artificial Sequence: Synthetic oligonucleotide
  Target: SCN10A; (+) strand; PAM type: NRG; PAM sequence: TGG
gggctgagtagtaccatgcc

SEQ ID NO: 29525 - DNA, 20 bp, Artificial Sequence
  Description of Artificial Sequence: Synthetic oligonucleotide
  Target: SCN10A; (+) strand; PAM type: NRG; PAM sequence: CAG
tagtaccatgcctggcatac

SEQ ID NO: 29526 - DNA, 20 bp, Artificial Sequence
  Description of Artificial Sequence: Synthetic oligonucleotide
  Target: SCN10A; (+) strand; PAM type: NRG; PAM sequence: GAG
gtaccatgcctggcatacca

SEQ ID NO: 29527 - DNA, 20 bp, Artificial Sequence
  Description of Artificial Sequence: Synthetic oligonucleotide
  Target: SCN10A; (+) strand; PAM type: NRG; PAM sequence: CAG
cctggcataccagagctact

SEQ ID NO: 29528 - DNA, 20 bp, Artificial Sequence
  Description of Artificial Sequence: Synthetic oligonucleotide
  Target: SCN10A; (+) strand; PAM type: NRG; PAM sequence: GAG
tggcataccagagctactca

SEQ ID NO: 29529 - DNA, 20 bp, Artificial Sequence
  Description of Artificial Sequence: Synthetic oligonucleotide
  Target: SCN10A; (+) strand; PAM type: NRG; PAM sequence: AAG
attatttgttgaataaatgc

SEQ ID NO: 29530 - DNA, 20 bp, Artificial Sequence
  Description of Artificial Sequence: Synthetic oligonucleotide
  Target: SCN10A; (+) strand; PAM type: NRG; PAM sequence: TGG
tgaataaatgcaagaaccaa

SEQ ID NO: 29531 - DNA, 20 bp, Artificial Sequence
  Description of Artificial Sequence: Synthetic oligonucleotide
  Target: SCN10A; (+) strand; PAM type: NRG; PAM sequence: TGG
ataaatgcaagaaccaatgg

SEQ ID NO: 29532 - DNA, 20 bp, Artificial Sequence
  Description of Artificial Sequence: Synthetic oligonucleotide
  Target: SCN10A; (+) strand; PAM type: NRG; PAM sequence: TAG
caagaaccaatggtggaatg

SEQ ID NO: 29533 - DNA, 20 bp, Artificial Sequence
  Description of Artificial Sequence: Synthetic oligonucleotide
  Target: SCN10A; (+) strand; PAM type: NRG; PAM sequence: AAG
atggtggaatgtagacactc

SEQ ID NO: 29534 - DNA, 20 bp, Artificial Sequence
  Description of Artificial Sequence: Synthetic oligonucleotide
  Target: SCN10A; (+) strand; PAM type: NRG; PAM sequence: GAG
ggtggaatgtagacactcaa

SEQ ID NO: 29535 - DNA, 20 bp, Artificial Sequence
  Description of Artificial Sequence: Synthetic oligonucleotide
  Target: SCN10A; (+) strand; PAM type: NRG; PAM sequence: AAG
taactgcatgacaaatgtat

SEQ ID NO: 29536 - DNA, 20 bp, Artificial Sequence
  Description of Artificial Sequence: Synthetic oligonucleotide
  Target: SCN10A; (+) strand; PAM type: NRG; PAM sequence: CAG
tgtattaacacttgaatgaa

SEQ ID NO: 29537 - DNA, 20 bp, Artificial Sequence
  Description of Artificial Sequence: Synthetic oligonucleotide
  Target: SCN10A; (+) strand; PAM type: NRG; PAM sequence: GAG
tattaacacttgaatgaaca

SEQ ID NO: 29538 - DNA, 20 bp, Artificial Sequence
  Description of Artificial Sequence: Synthetic oligonucleotide
  Target: SCN10A; (+) strand; PAM type: NRG; PAM sequence: AGG
attaacacttgaatgaacag

SEQ ID NO: 29539 - DNA, 20 bp, Artificial Sequence
  Description of Artificial Sequence: Synthetic oligonucleotide
  Target: SCN10A; (+) strand; PAM type: NRG; PAM sequence: CAG
tgaacagaggactgaatgaa

SEQ ID NO: 29540 - DNA, 20 bp, Artificial Sequence
  Description of Artificial Sequence: Synthetic oligonucleotide
  Target: SCN10A; (+) strand; PAM type: NRG; PAM sequence: AGG
gaacagaggactgaatgaac

SEQ ID NO: 29541 - DNA, 20 bp, Artificial Sequence
  Description of Artificial Sequence: Synthetic oligonucleotide
  Target: SCN10A; (+) strand; PAM type: NRG; PAM sequence: TAG
cagaggactgaatgaacagg

SEQ ID NO: 29542 - DNA, 20 bp, Artificial Sequence
  Description of Artificial Sequence: Synthetic oligonucleotide
  Target: SCN10A; (+) strand; PAM type: NRG; PAM sequence: AAG
actgaatgaacaggtagatg

SEQ ID NO: 29543 - DNA, 20 bp, Artificial Sequence
  Description of Artificial Sequence: Synthetic oligonucleotide
  Target: SCN10A; (+) strand; PAM type: NRG; PAM sequence: AGG
ctgaatgaacaggtagatga

SEQ ID NO: 29544 - DNA, 20 bp, Artificial Sequence
  Description of Artificial Sequence: Synthetic oligonucleotide
  Target: SCN10A; (+) strand; PAM type: NRG; PAM sequence: AAG
atgaacaggtagatgaaggc

SEQ ID NO: 29545 - DNA, 20 bp, Artificial Sequence
  Description of Artificial Sequence: Synthetic oligonucleotide
  Target: SCN10A; (+) strand; PAM type: NRG; PAM sequence: GAG
ggtagatgaaggcaagaaat

SEQ ID NO: 29546 - DNA, 20 bp, Artificial Sequence
  Description of Artificial Sequence: Synthetic oligonucleotide
  Target: SCN10A; (+) strand; PAM type: NRG; PAM sequence: TGG
gcaagaaatgagtgattgac

SEQ ID NO: 29547 - DNA, 20 bp, Artificial Sequence
  Description of Artificial Sequence: Synthetic oligonucleotide
  Target: SCN10A; (+) strand; PAM type: NRG; PAM sequence: AAG
agtgattgactggatgatga

SEQ ID NO: 29548 - DNA, 20 bp, Artificial Sequence
  Description of Artificial Sequence: Synthetic oligonucleotide
  Target: SCN10A; (+) strand; PAM type: NRG; PAM sequence: AAG
attgactggatgatgaaaga

SEQ ID NO: 29549 - DNA, 20 bp, Artificial Sequence
  Description of Artificial Sequence: Synthetic oligonucleotide
  Target: SCN10A; (+) strand; PAM type: NRG; PAM sequence: AAG
actggatgatgaaagaaaga

SEQ ID NO: 29550 - DNA, 20 bp, Artificial Sequence
  Description of Artificial Sequence: Synthetic oligonucleotide
  Target: SCN10A; (+) strand; PAM type: NRG; PAM sequence: CAG
gatgatgaaagaaagaaaga

SEQ ID NO: 29551 - DNA, 20 bp, Artificial Sequence
  Description of Artificial Sequence: Synthetic oligonucleotide
  Target: SCN10A; (+) strand; PAM type: NRG; PAM sequence: AGG
atgatgaaagaaagaaagac

SEQ ID NO: 29552 - DNA, 20 bp, Artificial Sequence
  Description of Artificial Sequence: Synthetic oligonucleotide
  Target: SCN10A; (+) strand; PAM type: NRG; PAM sequence: TAG
aacattatatatcattacaa

SEQ ID NO: 29553 - DNA, 20 bp, Artificial Sequence
  Description of Artificial Sequence: Synthetic oligonucleotide
  Target: SCN10A; (+) strand; PAM type: NRG; PAM sequence: GAG
atcattacaatagacctaat

SEQ ID NO: 29554 - DNA, 20 bp, Artificial Sequence
  Description of Artificial Sequence: Synthetic oligonucleotide
  Target: SCN10A; (+) strand; PAM type: NRG; PAM sequence: TAG
agacataatttattaccatt

SEQ ID NO: 29555 - DNA, 20 bp, Artificial Sequence
  Description of Artificial Sequence: Synthetic oligonucleotide
  Target: SCN10A; (+) strand; PAM type: NRG; PAM sequence: AGG
gacataatttattaccattt

SEQ ID NO: 29556 - DNA, 20 bp, Artificial Sequence
  Description of Artificial Sequence: Synthetic oligonucleotide
  Target: SCN10A; (+) strand; PAM type: NRG; PAM sequence: AAG
accatttaggaaatgatgtg

SEQ ID NO: 29557 - DNA, 20 bp, Artificial Sequence
  Description of Artificial Sequence: Synthetic oligonucleotide
  Target: SCN10A; (+) strand; PAM type: NRG; PAM sequence: AAG
taggaaatgatgtgaagttg

SEQ ID NO: 29558 - DNA, 20 bp, Artificial Sequence
  Description of Artificial Sequence: Synthetic oligonucleotide
  Target: SCN10A; (+) strand; PAM type: NRG; PAM sequence: TGG
gaagttgaagactgaacatg

SEQ ID NO: 29559 - DNA, 20 bp, Artificial Sequence
  Description of Artificial Sequence: Synthetic oligonucleotide
  Target: SCN10A; (+) strand; PAM type: NRG; PAM sequence: CAG
tatgccgtgtctattttgta

SEQ ID NO: 29560 - DNA, 20 bp, Artificial Sequence
  Description of Artificial Sequence: Synthetic oligonucleotide
  Target: SCN10A; (+) strand; PAM type: NRG; PAM sequence: AGG
atgccgtgtctattttgtac

SEQ ID NO: 29561 - DNA, 20 bp, Artificial Sequence
  Description of Artificial Sequence: Synthetic oligonucleotide
  Target: SCN10A; (+) strand; PAM type: NRG; PAM sequence: TGG
ctcaccacctgataatccca

SEQ ID NO: 29562 - DNA, 20 bp, Artificial Sequence
  Description of Artificial Sequence: Synthetic oligonucleotide
  Target: SCN10A; (+) strand; PAM type: NRG; PAM sequence: CAG
accacctgataatcccatgg

SEQ ID NO: 29563 - DNA, 20 bp, Artificial Sequence
  Description of Artificial Sequence: Synthetic oligonucleotide
  Target: SCN10A; (+) strand; PAM type: NRG; PAM sequence: AGG
ccacctgataatcccatggc

SEQ ID NO: 29564 - DNA, 20 bp, Artificial Sequence
  Description of Artificial Sequence: Synthetic oligonucleotide
  Target: SCN10A; (+) strand; PAM type: NRG; PAM sequence: TAG
atccctttatgctattctac

SEQ ID NO: 29565 - DNA, 20 bp, Artificial Sequence
  Description of Artificial Sequence: Synthetic oligonucleotide
  Target: SCN10A; (+) strand; PAM type: NRG; PAM sequence: TAG
cactgtgatatcatattcac

SEQ ID NO: 29566 - DNA, 20 bp, Artificial Sequence
  Description of Artificial Sequence: Synthetic oligonucleotide
  Target: SCN10A; (+) strand; PAM type: NRG; PAM sequence: AGG
actgtgatatcatattcact

SEQ ID NO: 29567 - DNA, 20 bp, Artificial Sequence
  Description of Artificial Sequence: Synthetic oligonucleotide
  Target: SCN10A; (+) strand; PAM type: NRG; PAM sequence: AAG
gtgatatcatattcactagg

SEQ ID NO: 29568 - DNA, 20 bp, Artificial Sequence
  Description of Artificial Sequence: Synthetic oligonucleotide
  Target: SCN10A; (+) strand; PAM type: NRG; PAM sequence: AGG
tgatatcatattcactagga

SEQ ID NO: 29569 - DNA, 20 bp, Artificial Sequence
  Description of Artificial Sequence: Synthetic oligonucleotide
  Target: SCN10A; (+) strand; PAM type: NRG; PAM sequence: TAG
tattcactaggaaggccctc

SEQ ID NO: 29570 - DNA, 20 bp, Artificial Sequence
  Description of Artificial Sequence: Synthetic oligonucleotide
  Target: SCN10A; (+) strand; PAM type: NRG; PAM sequence: TGG
aggaaggccctctagcctca

SEQ ID NO: 29571 - DNA, 20 bp, Artificial Sequence
  Description of Artificial Sequence: Synthetic oligonucleotide
  Target: SCN10A; (+) strand; PAM type: NRG; PAM sequence: TAG
ggccctctagcctcatggtg

SEQ ID NO: 29572 - DNA, 20 bp, Artificial Sequence
  Description of Artificial Sequence: Synthetic oligonucleotide
  Target: SCN10A; (+) strand; PAM type: NRG; PAM sequence: TAG
tagcctcatggtgtagtctg

SEQ ID NO: 29573 - DNA, 20 bp, Artificial Sequence
  Description of Artificial Sequence: Synthetic oligonucleotide
  Target: SCN10A; (+) strand; PAM type: NRG; PAM sequence: AGG
agcctcatggtgtagtctgt

SEQ ID NO: 29574 - DNA, 20 bp, Artificial Sequence
  Description of Artificial Sequence: Synthetic oligonucleotide
  Target: SCN10A; (+) strand; PAM type: NRG; PAM sequence: TAG
catggtgtagtctgtaggaa

SEQ ID NO: 29575 - DNA, 20 bp, Artificial Sequence
  Description of Artificial Sequence: Synthetic oligonucleotide
  Target: SCN10A; (+) strand; PAM type: NRG; PAM sequence: GAG
tggtgtagtctgtaggaata

SEQ ID NO: 29576 - DNA, 20 bp, Artificial Sequence
  Description of Artificial Sequence: Synthetic oligonucleotide
  Target: SCN10A; (+) strand; PAM type: NRG; PAM sequence: CAG
gtaggaatagagaatgacct

SEQ ID NO: 29577 - DNA, 20 bp, Artificial Sequence
  Description of Artificial Sequence: Synthetic oligonucleotide
  Target: SCN10A; (+) strand; PAM type: NRG; PAM sequence: GAG
gaatgacctcagttcacact

SEQ ID NO: 29578 - DNA, 20 bp, Artificial Sequence
  Description of Artificial Sequence: Synthetic oligonucleotide
  Target: SCN10A; (+) strand; PAM type: NRG; PAM sequence: AAG
actgagtgctactccttgca

SEQ ID NO: 29579 - DNA, 20 bp, Artificial Sequence
  Description of Artificial Sequence: Synthetic oligonucleotide
  Target: SCN10A; (+) strand; PAM type: NRG; PAM sequence: TAG
ctccttgcaaagtccccaca

SEQ ID NO: 29580 - DNA, 20 bp, Artificial Sequence
  Description of Artificial Sequence: Synthetic oligonucleotide
  Target: SCN10A; (+) strand; PAM type: NRG; PAM sequence: TGG
agtccccacatagcatcttc

SEQ ID NO: 29581 - DNA, 20 bp, Artificial Sequence
  Description of Artificial Sequence: Synthetic oligonucleotide
  Target: SCN10A; (+) strand; PAM type: NRG; PAM sequence: GGG
gtccccacatagcatcttct

SEQ ID NO: 29582 - DNA, 20 bp, Artificial Sequence
  Description of Artificial Sequence: Synthetic oligonucleotide
  Target: SCN10A; (+) strand; PAM type: NRG; PAM sequence: TAG
catagcatcttctgggaacc

SEQ ID NO: 29583 - DNA, 20 bp, Artificial Sequence
  Description of Artificial Sequence: Synthetic oligonucleotide
  Target: SCN10A; (+) strand; PAM type: NRG; PAM sequence: GAG
cctagactctccattttatt

SEQ ID NO: 29584 - DNA, 20 bp, Artificial Sequence
  Description of Artificial Sequence: Synthetic oligonucleotide
  Target: SCN10A; (+) strand; PAM type: NRG; PAM sequence: CGG
agactctccattttattgag

SEQ ID NO: 29585 - DNA, 20 bp, Artificial Sequence
  Description of Artificial Sequence: Synthetic oligonucleotide
  Target: SCN10A; (+) strand; PAM type: NRG; PAM sequence: AAG
tccattttattgagcggcca

SEQ ID NO: 29586 - DNA, 20 bp, Artificial Sequence
  Description of Artificial Sequence: Synthetic oligonucleotide
  Target: SCN10A; (+) strand; PAM type: NRG; PAM sequence: AAG
ttttattgagcggccaaagc

SEQ ID NO: 29587 - DNA, 20 bp, Artificial Sequence
  Description of Artificial Sequence: Synthetic oligonucleotide
  Target: SCN10A; (+) strand; PAM type: NRG; PAM sequence: GAG
ttattgagcggccaaagcaa

SEQ ID NO: 29588 - DNA, 20 bp, Artificial Sequence
  Description of Artificial Sequence: Synthetic oligonucleotide
  Target: SCN10A; (+) strand; PAM type: NRG; PAM sequence: TGG
agcggccaaagcaagagata

SEQ ID NO: 29589 - DNA, 20 bp, Artificial Sequence
  Description of Artificial Sequence: Synthetic oligonucleotide
  Target: SCN10A; (+) strand; PAM type: NRG; PAM sequence: TGG
aagagatatggttgatctca

SEQ ID NO: 29590 - DNA, 20 bp, Artificial Sequence
  Description of Artificial Sequence: Synthetic oligonucleotide
  Target: SCN10A; (+) strand; PAM type: NRG; PAM sequence: CAG
catggttgactcaccacctg

SEQ ID NO: 29591 - DNA, 20 bp, Artificial Sequence
  Description of Artificial Sequence: Synthetic oligonucleotide
  Target: SCN10A; (+) strand; PAM type: NRG; PAM sequence: AAG
ggttgactcaccacctgcag

SEQ ID NO: 29592 - DNA, 20 bp, Artificial Sequence
  Description of Artificial Sequence: Synthetic oligonucleotide
  Target: SCN10A; (+) strand; PAM type: NRG; PAM sequence: AAG
ctcaccacctgcagaagtgc

SEQ ID NO: 29593 - DNA, 20 bp, Artificial Sequence
  Description of Artificial Sequence: Synthetic oligonucleotide
  Target: SCN10A; (+) strand; PAM type: NRG; PAM sequence: AGG
tcaccacctgcagaagtgca

SEQ ID NO: 29594 - DNA, 20 bp, Artificial Sequence
  Description of Artificial Sequence: Synthetic oligonucleotide
  Target: SCN10A; (+) strand; PAM type: NRG; PAM sequence: AAG
aacccattgcaacattatca

SEQ ID NO: 29595 - DNA, 20 bp, Artificial Sequence
  Description of Artificial Sequence: Synthetic oligonucleotide
  Target: SCN10A; (+) strand; PAM type: NRG; PAM sequence: CAG
agttgactttcacattgacc

SEQ ID NO: 29596 - DNA, 20 bp, Artificial Sequence
  Description of Artificial Sequence: Synthetic oligonucleotide
  Target: SCN10A; (+) strand; PAM type: NRG; PAM sequence: AAG
tgactttcacattgacccag

SEQ ID NO: 29597 - DNA, 20 bp, Artificial Sequence
  Description of Artificial Sequence: Synthetic oligonucleotide
  Target: SCN10A; (+) strand; PAM type: NRG; PAM sequence: AAG
ctttcacattgacccagaag

SEQ ID NO: 29598 - DNA, 20 bp, Artificial Sequence
  Description of Artificial Sequence: Synthetic oligonucleotide
  Target: SCN10A; (+) strand; PAM type: NRG; PAM sequence: CAG
attgacccagaagaagctgc

SEQ ID NO: 29599 - DNA, 20 bp, Artificial Sequence
  Description of Artificial Sequence: Synthetic oligonucleotide
  Target: SCN10A; (+) strand; PAM type: NRG; PAM sequence: TGG
gacccagaagaagctgccag

SEQ ID NO: 29600 - DNA, 20 bp, Artificial Sequence
  Description of Artificial Sequence: Synthetic oligonucleotide
  Target: SCN10A; (+) strand; PAM type: NRG; PAM sequence: GAG
cccagaagaagctgccagtg

SEQ ID NO: 29601 - DNA, 20 bp, Artificial Sequence
  Description of Artificial Sequence: Synthetic oligonucleotide
  Target: SCN10A; (+) strand; PAM type: NRG; PAM sequence: CAG
cagtggagttttgaatcttg

SEQ ID NO: 29602 - DNA, 20 bp, Artificial Sequence
  Description of Artificial Sequence: Synthetic oligonucleotide
  Target: SCN10A; (+) strand; PAM type: NRG; PAM sequence: CAG
ggagttttgaatcttgcagt

SEQ ID NO: 29603 - DNA, 20 bp, Artificial Sequence
  Description of Artificial Sequence: Synthetic oligonucleotide
  Target: SCN10A; (+) strand; PAM type: NRG; PAM sequence: AAG
cttgttattcacaatcgaca

SEQ ID NO: 29604 - DNA, 20 bp, Artificial Sequence
  Description of Artificial Sequence: Synthetic oligonucleotide
  Target: SCN10A; (+) strand; PAM type: NRG; PAM sequence: AGG
ttgttattcacaatcgacaa

SEQ ID NO: 29605 - DNA, 20 bp, Artificial Sequence
  Description of Artificial Sequence: Synthetic oligonucleotide
  Target: SCN10A; (+) strand; PAM type: NRG; PAM sequence: AAG
ttcacaatcgacaaaggtac

SEQ ID NO: 29606 - DNA, 20 bp, Artificial Sequence
  Description of Artificial Sequence: Synthetic oligonucleotide
  Target: SCN10A; (+) strand; PAM type: NRG; PAM sequence: AGG
tcacaatcgacaaaggtaca

SEQ ID NO: 29607 - DNA, 20 bp, Artificial Sequence
  Description of Artificial Sequence: Synthetic oligonucleotide
  Target: SCN10A; (+) strand; PAM type: NRG; PAM sequence: GGG
cacaatcgacaaaggtacaa

SEQ ID NO: 29608 - DNA, 20 bp, Artificial Sequence
  Description of Artificial Sequence: Synthetic oligonucleotide
  Target: SCN10A; (+) strand; PAM type: NRG; PAM sequence: CGG
tacaagggaaaactctccat

SEQ ID NO: 29609 - DNA, 20 bp, Artificial Sequence
  Description of Artificial Sequence: Synthetic oligonucleotide
  Target: SCN10A; (+) strand; PAM type: NRG; PAM sequence: TAG
gggaaaactctccatcggta

SEQ ID NO: 29610 - DNA, 20 bp, Artificial Sequence
  Description of Artificial Sequence: Synthetic oligonucleotide
  Target: SCN10A; (+) strand; PAM type: NRG; PAM sequence: AAG
acctccaaaacttccctgcg

SEQ ID NO: 29611 - DNA, 20 bp, Artificial Sequence
  Description of Artificial Sequence: Synthetic oligonucleotide
  Target: SCN10A; (+) strand; PAM type: NRG; PAM sequence: GAG
ctccaaaacttccctgcgaa

SEQ ID NO: 29612 - DNA, 20 bp, Artificial Sequence
  Description of Artificial Sequence: Synthetic oligonucleotide
  Target: SCN10A; (+) strand; PAM type: NRG; PAM sequence: AGG
tccaaaacttccctgcgaag

SEQ ID NO: 29613 - DNA, 20 bp, Artificial Sequence
  Description of Artificial Sequence: Synthetic oligonucleotide
  Target: SCN10A; (+) strand; PAM type: NRG; PAM sequence: AAG
ggttcacacccatgatgctg

SEQ ID NO: 29614 - DNA, 20 bp, Artificial Sequence
  Description of Artificial Sequence: Synthetic oligonucleotide
  Target: SCN10A; (+) strand; PAM type: NRG; PAM sequence: GAG
acacccatgatgctgaagat

SEQ ID NO: 29615 - DNA, 20 bp, Artificial Sequence
  Description of Artificial Sequence: Synthetic oligonucleotide
  Target: SCN10A; (+) strand; PAM type: NRG; PAM sequence: CAG
ccatgatgctgaagatgagc

SEQ ID NO: 29616 - DNA, 20 bp, Artificial Sequence
  Description of Artificial Sequence: Synthetic oligonucleotide
  Target: SCN10A; (+) strand; PAM type: NRG; PAM sequence: AAG
tgatgctgaagatgagccag

SEQ ID NO: 29617 - DNA, 20 bp, Artificial Sequence
  Description of Artificial Sequence: Synthetic oligonucleotide
  Target: SCN10A; (+) strand; PAM type: NRG; PAM sequence: GAG
ctgaagatgagccagaagat

SEQ ID NO: 29618 - DNA, 20 bp, Artificial Sequence
  Description of Artificial Sequence: Synthetic oligonucleotide
  Target: SCN10A; (+) strand; PAM type: NRG; PAM sequence: AGG
tgaagatgagccagaagatg

SEQ ID NO: 29619 - DNA, 20 bp, Artificial Sequence
  Description of Artificial Sequence: Synthetic oligonucleotide
  Target: SCN10A; (+) strand; PAM type: NRG; PAM sequence: CAG
agatgagccagaagatgagg

SEQ ID NO: 29620 - DNA, 20 bp, Artificial Sequence
  Description of Artificial Sequence: Synthetic oligonucleotide
  Target: SCN10A; (+) strand; PAM type: NRG; PAM sequence: GAG
agccagaagatgaggcagac

SEQ ID NO: 29621 - DNA, 20 bp, Artificial Sequence
  Description of Artificial Sequence: Synthetic oligonucleotide
  Target: SCN10A; (+) strand; PAM type: NRG; PAM sequence: AGG
gccagaagatgaggcagacg

SEQ ID NO: 29622 - DNA, 20 bp, Artificial Sequence
  Description of Artificial Sequence: Synthetic oligonucleotide
  Target: SCN10A; (+) strand; PAM type: NRG; PAM sequence: GAG
cagaagatgaggcagacgag

SEQ ID NO: 29623 - DNA, 20 bp, Artificial Sequence
  Description of Artificial Sequence: Synthetic oligonucleotide
  Target: SCN10A; (+) strand; PAM type: NRG; PAM sequence: AGG
agaagatgaggcagacgagg

SEQ ID NO: 29624 - DNA, 20 bp, Artificial Sequence
  Description of Artificial Sequence: Synthetic oligonucleotide
  Target: SCN10A; (+) strand; PAM type: NRG; PAM sequence: TGG
gacgaggaggacattcatga

SEQ ID NO: 29625 - DNA, 20 bp, Artificial Sequence
  Description of Artificial Sequence: Synthetic oligonucleotide
  Target: SCN10A; (+) strand; PAM type: NRG; PAM sequence: TGG
aggaggacattcatgatgga

SEQ ID NO: 29626 - DNA, 20 bp, Artificial Sequence
  Description of Artificial Sequence: Synthetic oligonucleotide
  Target: SCN10A; (+) strand; PAM type: NRG; PAM sequence: GGG
ggaggacattcatgatggat

SEQ ID NO: 29627 - DNA, 20 bp, Artificial Sequence
  Description of Artificial Sequence: Synthetic oligonucleotide
  Target: SCN10A; (+) strand; PAM type: NRG; PAM sequence: TGG
gacattcatgatggatggga

SEQ ID NO: 29628 - DNA, 20 bp, Artificial Sequence
  Description of Artificial Sequence: Synthetic oligonucleotide
  Target: SCN10A; (+) strand; PAM type: NRG; PAM sequence: CAG
atggatgggatggcgcccac

SEQ ID NO: 29629 - DNA, 20 bp, Artificial Sequence
  Description of Artificial Sequence: Synthetic oligonucleotide
  Target: SCN10A; (+) strand; PAM type: NRG; PAM sequence: AGG
tggatgggatggcgcccacc

SEQ ID NO: 29630 - DNA, 20 bp, Artificial Sequence
  Description of Artificial Sequence: Synthetic oligonucleotide
  Target: SCN10A; (+) strand; PAM type: NRG; PAM sequence: GGG
ggatgggatggcgcccacca

SEQ ID NO: 29631 - DNA, 20 bp, Artificial Sequence
  Description of Artificial Sequence: Synthetic oligonucleotide
  Target: SCN10A; (+) strand; PAM type: NRG; PAM sequence: TGG
ccagggcatccaccaccacc

SEQ ID NO: 29632 - DNA, 20 bp, Artificial Sequence
  Description of Artificial Sequence: Synthetic oligonucleotide
  Target: SCN10A; (+) strand; PAM type: NRG; PAM sequence: TGG
gggcatccaccaccacctgg

SEQ ID NO: 29633 - DNA, 20 bp, Artificial Sequence
  Description of Artificial Sequence: Synthetic oligonucleotide
  Target: SCN10A; (+) strand; PAM type: NRG; PAM sequence: GGG
ggcatccaccaccacctggt

SEQ ID NO: 29634 - DNA, 20 bp, Artificial Sequence
  Description of Artificial Sequence: Synthetic oligonucleotide
  Target: SCN10A; (+) strand; PAM type: NRG; PAM sequence: GAG
catccaccaccacctggtgg

SEQ ID NO: 29635 - DNA, 20 bp, Artificial Sequence
  Description of Artificial Sequence: Synthetic oligonucleotide
  Target: SCN10A; (+) strand; PAM type: NRG; PAM sequence: TAG
caccaccacctggtgggaga

SEQ ID NO: 29636 - DNA, 20 bp, Artificial Sequence
  Description of Artificial Sequence: Synthetic oligonucleotide
  Target: SCN10A; (+) strand; PAM type: NRG; PAM sequence: GAG
ccaccacctggtgggagata

SEQ ID NO: 29637 - DNA, 20 bp, Artificial Sequence
  Description of Artificial Sequence: Synthetic oligonucleotide
  Target: SCN10A; (+) strand; PAM type: NRG; PAM sequence: AAG
cacctggtgggagatagaga

SEQ ID NO: 29638 - DNA, 20 bp, Artificial Sequence
  Description of Artificial Sequence: Synthetic oligonucleotide
  Target: SCN10A; (+) strand; PAM type: NRG; PAM sequence: TGG
gtgggagatagagaaagacc

SEQ ID NO: 29639 - DNA, 20 bp, Artificial Sequence
  Description of Artificial Sequence: Synthetic oligonucleotide
  Target: SCN10A; (+) strand; PAM type: NRG; PAM sequence: TGG
caatgccccaccccctctgc

SEQ ID NO: 29640 - DNA, 20 bp, Artificial Sequence
  Description of Artificial Sequence: Synthetic oligonucleotide
  Target: SCN10A; (+) strand; PAM type: NRG; PAM sequence: CAG
tatctctttctatactcatt

SEQ ID NO: 29641 - DNA, 20 bp, Artificial Sequence
  Description of Artificial Sequence: Synthetic oligonucleotide
  Target: SCN10A; (+) strand; PAM type: NRG; PAM sequence: AGG
atctctttctatactcattc

SEQ ID NO: 29642 - DNA, 20 bp, Artificial Sequence
  Description of Artificial Sequence: Synthetic oligonucleotide
  Target: SCN10A; (+) strand; PAM type: NRG; PAM sequence: GAG
actcattcaggctgcttcat

SEQ ID NO: 29643 - DNA, 20 bp, Artificial Sequence
  Description of Artificial Sequence: Synthetic oligonucleotide
  Target: SCN10A; (+) strand; PAM type: NRG; PAM sequence: CAG
attcaggctgcttcatgagc

SEQ ID NO: 29644 - DNA, 20 bp, Artificial Sequence
  Description of Artificial Sequence: Synthetic oligonucleotide
  Target: SCN10A; (+) strand; PAM type: NRG; PAM sequence: TGG
caggctgcttcatgagccag

SEQ ID NO: 29645 - DNA, 20 bp, Artificial Sequence
  Description of Artificial Sequence: Synthetic oligonucleotide
  Target: SCN10A; (+) strand; PAM type: NRG; PAM sequence: TGG
cttcatgagccagtggcctt

SEQ ID NO: 29646 - DNA, 20 bp, Artificial Sequence
  Description of Artificial Sequence: Synthetic oligonucleotide
  Target: SCN10A; (+) strand; PAM type: NRG; PAM sequence: AAG
catgagccagtggcctttgg

SEQ ID NO: 29647 - DNA, 20 bp, Artificial Sequence
  Description of Artificial Sequence: Synthetic oligonucleotide
  Target: SCN10A; (+) strand; PAM type: NRG; PAM sequence: AAG
gagccagtggcctttggaag

SEQ ID NO: 29648 - DNA, 20 bp, Artificial Sequence
  Description of Artificial Sequence: Synthetic oligonucleotide
  Target: SCN10A; (+) strand; PAM type: NRG; PAM sequence: AAG
cagtggcctttggaagaagc

SEQ ID NO: 29649 - DNA, 20 bp, Artificial Sequence
  Description of Artificial Sequence: Synthetic oligonucleotide
  Target: SCN10A; (+) strand; PAM type: NRG; PAM sequence: GAG
gtggcctttggaagaagcaa

SEQ ID NO: 29650 - DNA, 20 bp, Artificial Sequence
  Description of Artificial Sequence: Synthetic oligonucleotide
  Target: SCN10A; (+) strand; PAM type: NRG; PAM sequence: AAG
gcctttggaagaagcaagag

SEQ ID NO: 29651 - DNA, 20 bp, Artificial Sequence
  Description of Artificial Sequence: Synthetic oligonucleotide
  Target: SCN10A; (+) strand; PAM type: NRG; PAM sequence: TGG
tttggaagaagcaagagaag

SEQ ID NO: 29652 - DNA, 20 bp, Artificial Sequence
  Description of Artificial Sequence: Synthetic oligonucleotide
  Target: SCN10A; (+) strand; PAM type: NRG; PAM sequence: GGG
ttggaagaagcaagagaagt

SEQ ID NO: 29653 - DNA, 20 bp, Artificial Sequence
  Description of Artificial Sequence: Synthetic oligonucleotide
  Target: SCN10A; (+) strand; PAM type: NRG; PAM sequence: TAG
agcaagagaagtgggttaat

SEQ ID NO: 29654 - DNA, 20 bp, Artificial Sequence
  Description of Artificial Sequence: Synthetic oligonucleotide
  Target: SCN10A; (+) strand; PAM type: NRG; PAM sequence: CAG
ggttaattagtgcaataatt

SEQ ID NO: 29655 - DNA, 20 bp, Artificial Sequence
  Description of Artificial Sequence: Synthetic oligonucleotide
  Target: SCN10A; (+) strand; PAM type: NRG; PAM sequence: CAG
ttagtgcaataattcagact

SEQ ID NO: 29656 - DNA, 20 bp, Artificial Sequence
  Description of Artificial Sequence: Synthetic oligonucleotide
  Target: SCN10A; (+) strand; PAM type: NRG; PAM sequence: AAG
gtgcaataattcagactcag

SEQ ID NO: 29657 - DNA, 20 bp, Artificial Sequence
  Description of Artificial Sequence: Synthetic oligonucleotide
  Target: SCN10A; (+) strand; PAM type: NRG; PAM sequence: GAG
taattcagactcagaagact

SEQ ID NO: 29658 - DNA, 20 bp, Artificial Sequence
  Description of Artificial Sequence: Synthetic oligonucleotide
  Target: SCN10A; (+) strand; PAM type: NRG; PAM sequence: GAG
attcagactcagaagactga

SEQ ID NO: 29659 - DNA, 20 bp, Artificial Sequence
  Description of Artificial Sequence: Synthetic oligonucleotide
  Target: SCN10A; (+) strand; PAM type: NRG; PAM sequence: TGG
ctcagaagactgagagacat

SEQ ID NO: 29660 - DNA, 20 bp, Artificial Sequence
  Description of Artificial Sequence: Synthetic oligonucleotide
  Target: SCN10A; (+) strand; PAM type: NRG; PAM sequence: GGG
tcagaagactgagagacatt

SEQ ID NO: 29661 - DNA, 20 bp, Artificial Sequence
  Description of Artificial Sequence: Synthetic oligonucleotide
  Target: SCN10A; (+) strand; PAM type: NRG; PAM sequence: CAG
gaagactgagagacattggg

SEQ ID NO: 29662 - DNA, 20 bp, Artificial Sequence
  Description of Artificial Sequence: Synthetic oligonucleotide
  Target: SCN10A; (+) strand; PAM type: NRG; PAM sequence: AAG
tgagagacattgggcagctg

SEQ ID NO: 29663 - DNA, 20 bp, Artificial Sequence
  Description of Artificial Sequence: Synthetic oligonucleotide
  Target: SCN10A; (+) strand; PAM type: NRG; PAM sequence: TGG
agacattgggcagctgaaga

SEQ ID NO: 29664 - DNA, 20 bp, Artificial Sequence
  Description of Artificial Sequence: Synthetic oligonucleotide
  Target: SCN10A; (+) strand; PAM type: NRG; PAM sequence: TAG
tgggcagctgaagatggatt

SEQ ID NO: 29665 - DNA, 20 bp, Artificial Sequence
  Description of Artificial Sequence: Synthetic oligonucleotide
  Target: SCN10A; (+) strand; PAM type: NRG; PAM sequence: CAG
cttcttcccttaacctcatt

SEQ ID NO: 29666 - DNA, 20 bp, Artificial Sequence
  Description of Artificial Sequence: Synthetic oligonucleotide
  Target: SCN10A; (+) strand; PAM type: NRG; PAM sequence: AGG
ttcttcccttaacctcattc

SEQ ID NO: 29667 - DNA, 20 bp, Artificial Sequence
  Description of Artificial Sequence: Synthetic oligonucleotide
  Target: SCN10A; (+) strand; PAM type: NRG; PAM sequence: GGG
tcttcccttaacctcattca

SEQ ID NO: 29668 - DNA, 20 bp, Artificial Sequence
  Description of Artificial Sequence: Synthetic oligonucleotide
  Target: SCN10A; (+) strand; PAM type: NRG; PAM sequence: TGG
tcccttaacctcattcaggg

SEQ ID NO: 29669 - DNA, 20 bp, Artificial Sequence
  Description of Artificial Sequence: Synthetic oligonucleotide
  Target: SCN10A; (+) strand; PAM type: NRG; PAM sequence: GGG
cccttaacctcattcagggt

SEQ ID NO: 29670 - DNA, 20 bp, Artificial Sequence
  Description of Artificial Sequence: Synthetic oligonucleotide
  Target: SCN10A; (+) strand; PAM type: NRG; PAM sequence: CAG
acctcattcagggtgggttg

SEQ ID NO: 29671 - DNA, 20 bp, Artificial Sequence
  Description of Artificial Sequence: Synthetic oligonucleotide
  Target: SCN10A; (+) strand; PAM type: NRG; PAM sequence: GAG
cattcagggtgggttgcagt

SEQ ID NO: 29672 - DNA, 20 bp, Artificial Sequence
  Description of Artificial Sequence: Synthetic oligonucleotide
  Target: SCN10A; (+) strand; PAM type: NRG; PAM sequence: AAG
tcagggtgggttgcagtgag

SEQ ID NO: 29673 - DNA, 20 bp, Artificial Sequence
  Description of Artificial Sequence: Synthetic oligonucleotide
  Target: SCN10A; (+) strand; PAM type: NRG; PAM sequence: TGG
ggtgggttgcagtgagaaga

SEQ ID NO: 29674 - DNA, 20 bp, Artificial Sequence
  Description of Artificial Sequence: Synthetic oligonucleotide
  Target: SCN10A; (+) strand; PAM type: NRG; PAM sequence: GAG
gttgcagtgagaagatggat

SEQ ID NO: 29675 - DNA, 20 bp, Artificial Sequence
  Description of Artificial Sequence: Synthetic oligonucleotide
  Target: SCN10A; (+) strand; PAM type: NRG; PAM sequence: AAG
gagaagatggatgagtttac

SEQ ID NO: 29676 - DNA, 20 bp, Artificial Sequence
  Description of Artificial Sequence: Synthetic oligonucleotide
  Target: SCN10A; (+) strand; PAM type: NRG; PAM sequence: TAG
acaagcatactgcactcatt

SEQ ID NO: 29677 - DNA, 20 bp, Artificial Sequence
  Description of Artificial Sequence: Synthetic oligonucleotide
  Target: SCN10A; (+) strand; PAM type: NRG; PAM sequence: AAG
agcatactgcactcatttag

SEQ ID NO: 29678 - DNA, 20 bp, Artificial Sequence
  Description of Artificial Sequence: Synthetic oligonucleotide
  Target: SCN10A; (+) strand; PAM type: NRG; PAM sequence: GAG
ctgcactcatttagaagtgt

SEQ ID NO: 29679 - DNA, 20 bp, Artificial Sequence
  Description of Artificial Sequence: Synthetic oligonucleotide
  Target: SCN10A; (+) strand; PAM type: NRG; PAM sequence: CAG
gtgtattatacttgcacata

SEQ ID NO: 29680 - DNA, 20 bp, Artificial Sequence
  Description of Artificial Sequence: Synthetic oligonucleotide
  Target: SCN10A; (+) strand; PAM type: NRG; PAM sequence: TAG
tacttgcacatacagacttc

SEQ ID NO: 29681 - DNA, 20 bp, Artificial Sequence
  Description of Artificial Sequence: Synthetic oligonucleotide
  Target: SCN10A; (+) strand; PAM type: NRG; PAM sequence: AAG
cacaatttaaatacaattta

SEQ ID NO: 29682 - DNA, 20 bp, Artificial Sequence
  Description of Artificial Sequence: Synthetic oligonucleotide
  Target: SCN10A; (+) strand; PAM type: NRG; PAM sequence: TGG
atacaatttaaagtatgccg

SEQ ID NO: 29683 - DNA, 20 bp, Artificial Sequence
  Description of Artificial Sequence: Synthetic oligonucleotide
  Target: SCN10A; (+) strand; PAM type: NRG; PAM sequence: AAG
atttaaagtatgccgtggtc

SEQ ID NO: 29684 - DNA, 20 bp, Artificial Sequence
  Description of Artificial Sequence: Synthetic oligonucleotide
  Target: SCN10A; (+) strand; PAM type: NRG; PAM sequence: CAG
agtatgccgtggtcaagaac

SEQ ID NO: 29685 - DNA, 20 bp, Artificial Sequence
  Description of Artificial Sequence: Synthetic oligonucleotide
  Target: SCN10A; (+) strand; PAM type: NRG; PAM sequence: TAG
ctaaatccatattcacaaaa

SEQ ID NO: 29686 - DNA, 20 bp, Artificial Sequence
  Description of Artificial Sequence: Synthetic oligonucleotide
  Target: SCN10A; (+) strand; PAM type: NRG; PAM sequence: AAG
aaaatagcttatttgtaaat

SEQ ID NO: 29687 - DNA, 20 bp, Artificial Sequence
  Description of Artificial Sequence: Synthetic oligonucleotide
  Target: SCN10A; (+) strand; PAM type: NRG; PAM sequence: GAG
ttatttgtaaataagcaaat

SEQ ID NO: 29688 - DNA, 20 bp, Artificial Sequence
  Description of Artificial Sequence: Synthetic oligonucleotide
  Target: SCN10A; (+) strand; PAM type: NRG; PAM sequence: TAG
ataagcaaatgagaatctat

SEQ ID NO: 29689 - DNA, 20 bp, Artificial Sequence
  Description of Artificial Sequence: Synthetic oligonucleotide
  Target: SCN10A; (+) strand; PAM type: NRG; PAM sequence: TAG
agaatctattagatacaaaa

SEQ ID NO: 29690 - DNA, 20 bp, Artificial Sequence
  Description of Artificial Sequence: Synthetic oligonucleotide
  Target: SCN10A; (+) strand; PAM type: NRG; PAM sequence: CGG
tttcaaactatttcaatctt

SEQ ID NO: 29691 - DNA, 20 bp, Artificial Sequence
  Description of Artificial Sequence: Synthetic oligonucleotide
  Target: SCN10A; (+) strand; PAM type: NRG; PAM sequence: GGG
ttcaaactatttcaatcttc

SEQ ID NO: 29692 - DNA, 20 bp, Artificial Sequence
  Description of Artificial Sequence: Synthetic oligonucleotide
  Target: SCN10A; (+) strand; PAM type: NRG; PAM sequence: TAG
ctatttcaatcttcgggtcc

SEQ ID NO: 29693 - DNA, 20 bp, Artificial Sequence
  Description of Artificial Sequence: Synthetic oligonucleotide
  Target: SCN10A; (+) strand; PAM type: NRG; PAM sequence: AAG
ttcgggtcctagtgtttgta

SEQ ID NO: 29694 - DNA, 20 bp, Artificial Sequence
  Description of Artificial Sequence: Synthetic oligonucleotide
  Target: SCN10A; (+) strand; PAM type: NRG; PAM sequence: AGG
tcgggtcctagtgtttgtaa

SEQ ID NO: 29695 - DNA, 20 bp, Artificial Sequence
  Description of Artificial Sequence: Synthetic oligonucleotide
  Target: SCN10A; (+) strand; PAM type: NRG; PAM sequence: AAG
cctagtgtttgtaaaggtac

SEQ ID NO: 29696 - DNA, 20 bp, Artificial Sequence
  Description of Artificial Sequence: Synthetic oligonucleotide
  Target: SCN10A; (+) strand; PAM type: NRG; PAM sequence: AAG
aaggtacaagttaatttcaa

SEQ ID NO: 29697 - DNA, 20 bp, Artificial Sequence
  Description of Artificial Sequence: Synthetic oligonucleotide
  Target: SCN10A; (+) strand; PAM type: NRG; PAM sequence: AAG
aaagcccacttttgtttttg

SEQ ID NO: 29698 - DNA, 20 bp, Artificial Sequence
  Description of Artificial Sequence: Synthetic oligonucleotide
  Target: SCN10A; (+) strand; PAM type: NRG; PAM sequence: CAG
gaagctatgatgactacttc

SEQ ID NO: 29699 - DNA, 20 bp, Artificial Sequence
  Description of Artificial Sequence: Synthetic oligonucleotide
  Target: SCN10A; (+) strand; PAM type: NRG; PAM sequence: TAG
tgactacttccagccaatga

SEQ ID NO: 29700 - DNA, 20 bp, Artificial Sequence
  Description of Artificial Sequence: Synthetic oligonucleotide
  Target: SCN10A; (+) strand; PAM type: NRG; PAM sequence: TGG
ctacttccagccaatgatag

SEQ ID NO: 29701 - DNA, 20 bp, Artificial Sequence
  Description of Artificial Sequence: Synthetic oligonucleotide
  Target: SCN10A; (+) strand; PAM type: NRG; PAM sequence: GAG
acttccagccaatgatagtg

SEQ ID NO: 29702 - DNA, 20 bp, Artificial Sequence
  Description of Artificial Sequence: Synthetic oligonucleotide
  Target: SCN10A; (+) strand; PAM type: NRG; PAM sequence: AAG
cagccaatgatagtggagca

SEQ ID NO: 29703 - DNA, 20 bp, Artificial Sequence
  Description of Artificial Sequence: Synthetic oligonucleotide
  Target: SCN10A; (+) strand; PAM type: NRG; PAM sequence: TGG
agcaaaaccttactttctgc

SEQ ID NO: 29704 - DNA, 20 bp, Artificial Sequence
  Description of Artificial Sequence: Synthetic oligonucleotide
  Target: SCN10A; (+) strand; PAM type: NRG; PAM sequence: GGG
gcaaaaccttactttctgct

SEQ ID NO: 29705 - DNA, 20 bp, Artificial Sequence
  Description of Artificial Sequence: Synthetic oligonucleotide
  Target: SCN10A; (+) strand; PAM type: NRG; PAM sequence: GGG
caaaaccttactttctgctg

SEQ ID NO: 29706 - DNA, 20 bp, Artificial Sequence
  Description of Artificial Sequence: Synthetic oligonucleotide
  Target: SCN10A; (+) strand; PAM type: NRG; PAM sequence: GAG
aaaccttactttctgctggg

SEQ ID NO: 29707 - DNA, 20 bp, Artificial Sequence
  Description of Artificial Sequence: Synthetic oligonucleotide
  Target: SCN10A; (+) strand; PAM type: NRG; PAM sequence: GAG
ggggagccatttgtaattat

SEQ ID NO: 29708 - DNA, 20 bp, Artificial Sequence
  Description of Artificial Sequence: Synthetic oligonucleotide
  Target: SCN10A; (+) strand; PAM type: NRG; PAM sequence: AGG
gggagccatttgtaattatg

SEQ ID NO: 29709 - DNA, 20 bp, Artificial Sequence
  Description of Artificial Sequence: Synthetic oligonucleotide
  Target: SCN10A; (+) strand; PAM type: NRG; PAM sequence: AAG
agccatttgtaattatgagg

SEQ ID NO: 29710 - DNA, 20 bp, Artificial Sequence
  Description of Artificial Sequence: Synthetic oligonucleotide
  Target: SCN10A; (+) strand; PAM type: NRG; PAM sequence: GAG
ccatttgtaattatgaggaa

SEQ ID NO: 29711 - DNA, 20 bp, Artificial Sequence
  Description of Artificial Sequence: Synthetic oligonucleotide
  Target: SCN10A; (+) strand; PAM type: NRG; PAM sequence: AGG
catttgtaattatgaggaag

SEQ ID NO: 29712 - DNA, 20 bp, Artificial Sequence
  Description of Artificial Sequence: Synthetic oligonucleotide
  Target: SCN10A; (+) strand; PAM type: NRG; PAM sequence: TGG
ttgtaattatgaggaagagg

SEQ ID NO: 29713 - DNA, 20 bp, Artificial Sequence
  Description of Artificial Sequence: Synthetic oligonucleotide
  Target: SCN10A; (+) strand; PAM type: NRG; PAM sequence: GGG
tgtaattatgaggaagaggt

SEQ ID NO: 29714 - DNA, 20 bp, Artificial Sequence
  Description of Artificial Sequence: Synthetic oligonucleotide
  Target: SCN10A; (+) strand; PAM type: NRG; PAM sequence: CAG
aggaagaggtgggtgtcaat

SEQ ID NO: 29715 - DNA, 20 bp, Artificial Sequence
  Description of Artificial Sequence: Synthetic oligonucleotide
  Target: SCN10A; (+) strand; PAM type: NRG; PAM sequence: AAG
ggtgtcaatcagcaatctct

SEQ ID NO: 29716 - DNA, 20 bp, Artificial Sequence
  Description of Artificial Sequence: Synthetic oligonucleotide
  Target: SCN10A; (+) strand; PAM type: NRG; PAM sequence: AAG
caatcagcaatctctaagac

SEQ ID NO: 29717 - DNA, 20 bp, Artificial Sequence
  Description of Artificial Sequence: Synthetic oligonucleotide
  Target: SCN10A; (+) strand; PAM type: NRG; PAM sequence: AGG
aatcagcaatctctaagaca

SEQ ID NO: 29718 - DNA, 20 bp, Artificial Sequence
  Description of Artificial Sequence: Synthetic oligonucleotide
  Target: SCN10A; (+) strand; PAM type: NRG; PAM sequence: TGG
caatctctaagacaaggctc

SEQ ID NO: 29719 - DNA, 20 bp, Artificial Sequence
  Description of Artificial Sequence: Synthetic oligonucleotide
  Target: SCN10A; (+) strand; PAM type: NRG; PAM sequence: GAG
taagacaaggctctggctgt

SEQ ID NO: 29720 - DNA, 20 bp, Artificial Sequence
  Description of Artificial Sequence: Synthetic oligonucleotide
  Target: SCN10A; (+) strand; PAM type: NRG; PAM sequence: CGG
ctgtgagcattctgtcctga

SEQ ID NO: 29721 - DNA, 20 bp, Artificial Sequence
  Description of Artificial Sequence: Synthetic oligonucleotide
  Target: SCN10A; (+) strand; PAM type: NRG; PAM sequence: GAG
gtgagcattctgtcctgacg

SEQ ID NO: 29722 - DNA, 20 bp, Artificial Sequence
  Description of Artificial Sequence: Synthetic oligonucleotide
  Target: SCN10A; (+) strand; PAM type: NRG; PAM sequence: AGG
tgagcattctgtcctgacgg

SEQ ID NO: 29723 - DNA, 20 bp, Artificial Sequence
  Description of Artificial Sequence: Synthetic oligonucleotide
  Target: SCN10A; (+) strand; PAM type: NRG; PAM sequence: CAG
gcattctgtcctgacggagg

SEQ ID NO: 29724 - DNA, 20 bp, Artificial Sequence
  Description of Artificial Sequence: Synthetic oligonucleotide
  Target: SCN10A; (+) strand; PAM type: NRG; PAM sequence: TAG
tctgtcctgacggaggcagt

SEQ ID NO: 29725 - DNA, 20 bp, Artificial Sequence
  Description of Artificial Sequence: Synthetic oligonucleotide
  Target: SCN10A; (+) strand; PAM type: NRG; PAM sequence: AGG
ctgtcctgacggaggcagtt

SEQ ID NO: 29726 - DNA, 20 bp, Artificial Sequence
  Description of Artificial Sequence: Synthetic oligonucleotide
  Target: SCN10A; (+) strand; PAM type: NRG; PAM sequence: GGG
tgtcctgacggaggcagtta

SEQ ID NO: 29727 - DNA, 20 bp, Artificial Sequence
  Description of Artificial Sequence: Synthetic oligonucleotide
  Target: SCN10A; (+) strand; PAM type: NRG; PAM sequence: AAG
ctgacggaggcagttagggc

SEQ ID NO: 29728 - DNA, 20 bp, Artificial Sequence
  Description of Artificial Sequence: Synthetic oligonucleotide
  Target: SCN10A; (+) strand; PAM type: NRG; PAM sequence: AGG
tgacggaggcagttagggca

SEQ ID NO: 29729 - DNA, 20 bp, Artificial Sequence
  Description of Artificial Sequence: Synthetic oligonucleotide
  Target: SCN10A; (+) strand; PAM type: NRG; PAM sequence: TGG
cggaggcagttagggcaagg

SEQ ID NO: 29730 - DNA, 20 bp, Artificial Sequence
  Description of Artificial Sequence: Synthetic oligonucleotide
  Target: SCN10A; (+) strand; PAM type: NRG; PAM sequence: GAG
gaggcagttagggcaaggtg

SEQ ID NO: 29731 - DNA, 20 bp, Artificial Sequence
  Description of Artificial Sequence: Synthetic oligonucleotide
  Target: SCN10A; (+) strand; PAM type: NRG; PAM sequence: AGG
aggcagttagggcaaggtgg

SEQ ID NO: 29732 - DNA, 20 bp, Artificial Sequence
  Description of Artificial Sequence: Synthetic oligonucleotide
  Target: SCN10A; (+) strand; PAM type: NRG; PAM sequence: CAG
tagggcaaggtggaggctga

SEQ ID NO: 29733 - DNA, 20 bp, Artificial Sequence
  Description of Artificial Sequence: Synthetic oligonucleotide
  Target: SCN10A; (+) strand; PAM type: NRG; PAM sequence: TGG
ggcaaggtggaggctgacag

SEQ ID NO: 29734 - DNA, 20 bp, Artificial Sequence
  Description of Artificial Sequence: Synthetic oligonucleotide
  Target: SCN10A; (+) strand; PAM type: NRG; PAM sequence: TGG
aaggtggaggctgacagtgg

SEQ ID NO: 29735 - DNA, 20 bp, Artificial Sequence
  Description of Artificial Sequence: Synthetic oligonucleotide
  Target: SCN10A; (+) strand; PAM type: NRG; PAM sequence: AAG
ggaggctgacagtggtggat

SEQ ID NO: 29736 - DNA, 20 bp, Artificial Sequence
  Description of Artificial Sequence: Synthetic oligonucleotide
  Target: SCN10A; (+) strand; PAM type: NRG; PAM sequence: AGG
gaggctgacagtggtggata

SEQ ID NO: 29737 - DNA, 20 bp, Artificial Sequence
  Description of Artificial Sequence: Synthetic oligonucleotide
  Target: SCN10A; (+) strand; PAM type: NRG; PAM sequence: AAG
ctgacagtggtggataagga

SEQ ID NO: 29738 - DNA, 20 bp, Artificial Sequence
  Description of Artificial Sequence: Synthetic oligonucleotide
  Target: SCN10A; (+) strand; PAM type: NRG; PAM sequence: AGG
tgacagtggtggataaggaa

SEQ ID NO: 29739 - DNA, 20 bp, Artificial Sequence
  Description of Artificial Sequence: Synthetic oligonucleotide
  Target: SCN10A; (+) strand; PAM type: NRG; PAM sequence: GGG
gacagtggtggataaggaaa

SEQ ID NO: 29740 - DNA, 20 bp, Artificial Sequence
  Description of Artificial Sequence: Synthetic oligonucleotide
  Target: SCN10A; (+) strand; PAM type: NRG; PAM sequence: GGG
acagtggtggataaggaaag

SEQ ID NO: 29741 - DNA, 20 bp, Artificial Sequence
  Description of Artificial Sequence: Synthetic oligonucleotide
  Target: SCN10A; (+) strand; PAM type: NRG; PAM sequence: TGG
gtggtggataaggaaagggg

SEQ ID NO: 29742 - DNA, 20 bp, Artificial Sequence
  Description of Artificial Sequence: Synthetic oligonucleotide
  Target: SCN10A; (+) strand; PAM type: NRG; PAM sequence: TGG
tggataaggaaaggggtgga

SEQ ID NO: 29743 - DNA, 20 bp, Artificial Sequence
  Description of Artificial Sequence: Synthetic oligonucleotide
  Target: SCN10A; (+) strand; PAM type: NRG; PAM sequence: AAG
ataaggaaaggggtggatgg

SEQ ID NO: 29744 - DNA, 20 bp, Artificial Sequence
  Description of Artificial Sequence: Synthetic oligonucleotide
  Target: SCN10A; (+) strand; PAM type: NRG; PAM sequence: AGG
taaggaaaggggtggatgga

SEQ ID NO: 29745 - DNA, 20 bp, Artificial Sequence
  Description of Artificial Sequence: Synthetic oligonucleotide
  Target: SCN10A; (+) strand; PAM type: NRG; PAM sequence: GGG
aaggaaaggggtggatggaa

SEQ ID NO: 29746 - DNA, 20 bp, Artificial Sequence
  Description of Artificial Sequence: Synthetic oligonucleotide
  Target: SCN10A; (+) strand; PAM type: NRG; PAM sequence: CAG
ggatggaagggaaaaattta

SEQ ID NO: 29747 - DNA, 20 bp, Artificial Sequence
  Description of Artificial Sequence: Synthetic oligonucleotide
  Target: SCN10A; (+) strand; PAM type: NRG; PAM sequence: AGG
gatggaagggaaaaatttac

SEQ ID NO: 29748 - DNA, 20 bp, Artificial Sequence
  Description of Artificial Sequence: Synthetic oligonucleotide
  Target: SCN10A; (+) strand; PAM type: NRG; PAM sequence: AAG
caggacctgatgattgcatt

SEQ ID NO: 29749 - DNA, 20 bp, Artificial Sequence
  Description of Artificial Sequence: Synthetic oligonucleotide
  Target: SCN10A; (+) strand; PAM type: NRG; PAM sequence: TAG
gacctgatgattgcattaag

SEQ ID NO: 29750 - DNA, 20 bp, Artificial Sequence
  Description of Artificial Sequence: Synthetic oligonucleotide
  Target: SCN10A; (+) strand; PAM type: NRG; PAM sequence: AGG
acctgatgattgcattaagt

SEQ ID NO: 29751 - DNA, 20 bp, Artificial Sequence
  Description of Artificial Sequence: Synthetic oligonucleotide
  Target: SCN10A; (+) strand; PAM type: NRG; PAM sequence: GAG
ctgatgattgcattaagtag

SEQ ID NO: 29752 - DNA, 20 bp, Artificial Sequence
  Description of Artificial Sequence: Synthetic oligonucleotide
  Target: SCN10A; (+) strand; PAM type: NRG; PAM sequence: GAG
gatgattgcattaagtagga

SEQ ID NO: 29753 - DNA, 20 bp, Artificial Sequence
  Description of Artificial Sequence: Synthetic oligonucleotide
  Target: SCN10A; (+) strand; PAM type: NRG; PAM sequence: AAG
gattgcattaagtaggagag

SEQ ID NO: 29754 - DNA, 20 bp, Artificial Sequence
  Description of Artificial Sequence: Synthetic oligonucleotide
  Target: SCN10A; (+) strand; PAM type: NRG; PAM sequence: AAG
tgcattaagtaggagagaag

SEQ ID NO: 29755 - DNA, 20 bp, Artificial Sequence
  Description of Artificial Sequence: Synthetic oligonucleotide
  Target: SCN10A; (+) strand; PAM type: NRG; PAM sequence: CAG
gtaggagagaagaagcattc

SEQ ID NO: 29756 - DNA, 20 bp, Artificial Sequence
  Description of Artificial Sequence: Synthetic oligonucleotide
  Target: SCN10A; (+) strand; PAM type: NRG; PAM sequence: TGG
ggagagaagaagcattccag

SEQ ID NO: 29757 - DNA, 20 bp, Artificial Sequence
  Description of Artificial Sequence: Synthetic oligonucleotide
  Target: SCN10A; (+) strand; PAM type: NRG; PAM sequence: GGG
gagagaagaagcattccagt

SEQ ID NO: 29758 - DNA, 20 bp, Artificial Sequence
  Description of Artificial Sequence: Synthetic oligonucleotide
  Target: SCN10A; (+) strand; PAM type: NRG; PAM sequence: TGG
agaagaagcattccagtggg

SEQ ID NO: 29759 - DNA, 20 bp, Artificial Sequence
  Description of Artificial Sequence: Synthetic oligonucleotide
  Target: SCN10A; (+) strand; PAM type: NRG; PAM sequence: CAG
agaagcattccagtgggtgg

SEQ ID NO: 29760 - DNA, 20 bp, Artificial Sequence
  Description of Artificial Sequence: Synthetic oligonucleotide
  Target: SCN10A; (+) strand; PAM type: NRG; PAM sequence: GAG
cattccagtgggtggcagct

SEQ ID NO: 29761 - DNA, 20 bp, Artificial Sequence
  Description of Artificial Sequence: Synthetic oligonucleotide
  Target: SCN10A; (+) strand; PAM type: NRG; PAM sequence: AGG
attccagtgggtggcagctg

SEQ ID NO: 29762 - DNA, 20 bp, Artificial Sequence
  Description of Artificial Sequence: Synthetic oligonucleotide
  Target: SCN10A; (+) strand; PAM type: NRG; PAM sequence: GAG
tgggtggcagctgaggtaat

SEQ ID NO: 29763 - DNA, 20 bp, Artificial Sequence
  Description of Artificial Sequence: Synthetic oligonucleotide
  Target: SCN10A; (+) strand; PAM type: NRG; PAM sequence: TGG
tgagctgatgatgtcactca

SEQ ID NO: 29764 - DNA, 20 bp, Artificial Sequence
  Description of Artificial Sequence: Synthetic oligonucleotide
  Target: SCN10A; (+) strand; PAM type: NRG; PAM sequence: GAG
agctgatgatgtcactcatg

SEQ ID NO: 29765 - DNA, 20 bp, Artificial Sequence
  Description of Artificial Sequence: Synthetic oligonucleotide
  Target: SCN10A; (+) strand; PAM type: NRG; PAM sequence: TAG
tgatgtcactcatggagtat

SEQ ID NO: 29766 - DNA, 20 bp, Artificial Sequence
  Description of Artificial Sequence: Synthetic oligonucleotide
  Target: SCN10A; (+) strand; PAM type: NRG; PAM sequence: GAG
atgtcactcatggagtatta

SEQ ID NO: 29767 - DNA, 20 bp, Artificial Sequence
  Description of Artificial Sequence: Synthetic oligonucleotide
  Target: SCN10A; (+) strand; PAM type: NRG; PAM sequence: AGG
tgtcactcatggagtattag

SEQ ID NO: 29768 - DNA, 20 bp, Artificial Sequence
  Description of Artificial Sequence: Synthetic oligonucleotide
  Target: SCN10A; (+) strand; PAM type: NRG; PAM sequence: AAG
actcatggagtattagagga

SEQ ID NO: 29769 - DNA, 20 bp, Artificial Sequence
  Description of Artificial Sequence: Synthetic oligonucleotide
  Target: SCN10A; (+) strand; PAM type: NRG; PAM sequence: TGG
gaggaaagactcatttgtca

SEQ ID NO: 29770 - DNA, 20 bp, Artificial Sequence
  Description of Artificial Sequence: Synthetic oligonucleotide
  Target: SCN10A; (+) strand; PAM type: NRG; PAM sequence: AAG
aaagactcatttgtcatgga

SEQ ID NO: 29771 - DNA, 20 bp, Artificial Sequence
  Description of Artificial Sequence: Synthetic oligonucleotide
  Target: SCN10A; (+) strand; PAM type: NRG; PAM sequence: CAG
actcatttgtcatggaaaga

SEQ ID NO: 29772 - DNA, 20 bp, Artificial Sequence
  Description of Artificial Sequence: Synthetic oligonucleotide
  Target: SCN10A; (+) strand; PAM type: NRG; PAM sequence: GAG
tcatttgtcatggaaagaca

SEQ ID NO: 29773 - DNA, 20 bp, Artificial Sequence
  Description of Artificial Sequence: Synthetic oligonucleotide
  Target: SCN10A; (+) strand; PAM type: NRG; PAM sequence: TGG
tcatggaaagacagagaact

SEQ ID NO: 29774 - DNA, 20 bp, Artificial Sequence
  Description of Artificial Sequence: Synthetic oligonucleotide
  Target: SCN10A; (+) strand; PAM type: NRG; PAM sequence: GGG
catggaaagacagagaactt

SEQ ID NO: 29775 - DNA, 20 bp, Artificial Sequence
  Description of Artificial Sequence: Synthetic oligonucleotide
  Target: SCN10A; (+) strand; PAM type: NRG; PAM sequence: TGG
acagagaacttgggatgttc

SEQ ID NO: 29776 - DNA, 20 bp, Artificial Sequence
  Description of Artificial Sequence: Synthetic oligonucleotide
  Target: SCN10A; (+) strand; PAM type: NRG; PAM sequence: GAG
agagaacttgggatgttctg

SEQ ID NO: 29777 - DNA, 20 bp, Artificial Sequence
  Description of Artificial Sequence: Synthetic oligonucleotide
  Target: SCN10A; (+) strand; PAM type: NRG; PAM sequence: TGG
ttgggatgttctggagatgt

SEQ ID NO: 29778 - DNA, 20 bp, Artificial Sequence
  Description of Artificial Sequence: Synthetic oligonucleotide
  Target: SCN10A; (+) strand; PAM type: NRG; PAM sequence: AAG
gttctggagatgttggcaat

SEQ ID NO: 29779 - DNA, 20 bp, Artificial Sequence
  Description of Artificial Sequence: Synthetic oligonucleotide
  Target: SCN10A; (+) strand; PAM type: NRG; PAM sequence: GAG
tctggagatgttggcaataa

SEQ ID NO: 29780 - DNA, 20 bp, Artificial Sequence
  Description of Artificial Sequence: Synthetic oligonucleotide
  Target: SCN10A; (+) strand; PAM type: NRG; PAM sequence: AGG
ctggagatgttggcaataag

SEQ ID NO: 29781 - DNA, 20 bp, Artificial Sequence
  Description of Artificial Sequence: Synthetic oligonucleotide
  Target: SCN10A; (+) strand; PAM type: NRG; PAM sequence: CAG
gagatgttggcaataagagg

SEQ ID NO: 29782 - DNA, 20 bp, Artificial Sequence
  Description of Artificial Sequence: Synthetic oligonucleotide
  Target: SCN10A; (+) strand; PAM type: NRG; PAM sequence: GAG
gatgttggcaataagaggca

SEQ ID NO: 29783 - DNA, 20 bp, Artificial Sequence
  Description of Artificial Sequence: Synthetic oligonucleotide
  Target: SCN10A; (+) strand; PAM type: NRG; PAM sequence: TGG
ttggcaataagaggcagagt

SEQ ID NO: 29784 - DNA, 20 bp, Artificial Sequence
  Description of Artificial Sequence: Synthetic oligonucleotide
  Target: SCN10A; (+) strand; PAM type: NRG; PAM sequence: GGG
tggcaataagaggcagagtt

SEQ ID NO: 29785 - DNA, 20 bp, Artificial Sequence
  Description of Artificial Sequence: Synthetic oligonucleotide
  Target: SCN10A; (+) strand; PAM type: NRG; PAM sequence: GAG
agaggcagagttgggtgatt

SEQ ID NO: 29786 - DNA, 20 bp, Artificial Sequence
  Description of Artificial Sequence: Synthetic oligonucleotide
  Target: SCN10A; (+) strand; PAM type: NRG; PAM sequence: TAG
gagttgggtgattgagataa

SEQ ID NO: 29787 - DNA, 20 bp, Artificial Sequence
  Description of Artificial Sequence: Synthetic oligonucleotide
  Target: SCN10A; (+) strand; PAM type: NRG; PAM sequence: TGG
attgagataatagatgcttg

SEQ ID NO: 29788 - DNA, 20 bp, Artificial Sequence
  Description of Artificial Sequence: Synthetic oligonucleotide
  Target: SCN10A; (+) strand; PAM type: NRG; PAM sequence: GAG
tgagataatagatgcttgtg

SEQ ID NO: 29789 - DNA, 20 bp, Artificial Sequence
  Description of Artificial Sequence: Synthetic oligonucleotide
  Target: SCN10A; (+) strand; PAM type: NRG; PAM sequence: CAG
atgcttgtggagcgatgatt

SEQ ID NO: 29790 - DNA, 20 bp, Artificial Sequence
  Description of Artificial Sequence: Synthetic oligonucleotide
  Target: SCN10A; (+) strand; PAM type: NRG; PAM sequence: AGG
tgcttgtggagcgatgattc

SEQ ID NO: 29791 - DNA, 20 bp, Artificial Sequence
  Description of Artificial Sequence: Synthetic oligonucleotide
  Target: SCN10A; (+) strand; PAM type: NRG; PAM sequence: AAG
tgattcaggattacttcact

SEQ ID NO: 29792 - DNA, 20 bp, Artificial Sequence
  Description of Artificial Sequence: Synthetic oligonucleotide
  Target: SCN10A; (+) strand; PAM type: NRG; PAM sequence: GAG
attcaggattacttcactaa

SEQ ID NO: 29793 - DNA, 20 bp, Artificial Sequence
  Description of Artificial Sequence: Synthetic oligonucleotide
  Target: SCN10A; (+) strand; PAM type: NRG; PAM sequence: AAG
ggattacttcactaagagca

SEQ ID NO: 29794 - DNA, 20 bp, Artificial Sequence
  Description of Artificial Sequence: Synthetic oligonucleotide
  Target: SCN10A; (+) strand; PAM type: NRG; PAM sequence: AGG
gattacttcactaagagcaa

SEQ ID NO: 29795 - DNA, 20 bp, Artificial Sequence
  Description of Artificial Sequence: Synthetic oligonucleotide
  Target: SCN10A; (+) strand; PAM type: NRG; PAM sequence: GGG
attacttcactaagagcaaa

SEQ ID NO: 29796 - DNA, 20 bp, Artificial Sequence
  Description of Artificial Sequence: Synthetic oligonucleotide
  Target: SCN10A; (+) strand; PAM type: NRG; PAM sequence: GGG
ttacttcactaagagcaaag

SEQ ID NO: 29797 - DNA, 20 bp, Artificial Sequence
  Description of Artificial Sequence: Synthetic oligonucleotide
  Target: SCN10A; (+) strand; PAM type: NRG; PAM sequence: GGG
tacttcactaagagcaaagg

SEQ ID NO: 29798 - DNA, 20 bp, Artificial Sequence
  Description of Artificial Sequence: Synthetic oligonucleotide
  Target: SCN10A; (+) strand; PAM type: NRG; PAM sequence: GAG
tcactaagagcaaagggggt

SEQ ID NO: 29799 - DNA, 20 bp, Artificial Sequence
  Description of Artificial Sequence: Synthetic oligonucleotide
  Target: SCN10A; (+) strand; PAM type: NRG; PAM sequence: AGG
cactaagagcaaagggggtg

SEQ ID NO: 29800 - DNA, 20 bp, Artificial Sequence
  Description of Artificial Sequence: Synthetic oligonucleotide
  Target: SCN10A; (+) strand; PAM type: NRG; PAM sequence: TGG
agagcaaagggggtgaggtc

SEQ ID NO: 29801 - DNA, 20 bp, Artificial Sequence
  Description of Artificial Sequence: Synthetic oligonucleotide
  Target: SCN10A; (+) strand; PAM type: NRG; PAM sequence: GGG
gagcaaagggggtgaggtct

SEQ ID NO: 29802 - DNA, 20 bp, Artificial Sequence
  Description of Artificial Sequence: Synthetic oligonucleotide
  Target: SCN10A; (+) strand; PAM type: NRG; PAM sequence: TGG
agggggtgaggtctgggtcc

SEQ ID NO: 29803 - DNA, 20 bp, Artificial Sequence
  Description of Artificial Sequence: Synthetic oligonucleotide
  Target: SCN10A; (+) strand; PAM type: NRG; PAM sequence: TGG
gggtgaggtctgggtcctgg

SEQ ID NO: 29804 - DNA, 20 bp, Artificial Sequence
  Description of Artificial Sequence: Synthetic oligonucleotide
  Target: SCN10A; (+) strand; PAM type: NRG; PAM sequence: TGG
cctggtggctgtaatattta

SEQ ID NO: 29805 - DNA, 20 bp, Artificial Sequence
  Description of Artificial Sequence: Synthetic oligonucleotide
  Target: SCN10A; (+) strand; PAM type: NRG; PAM sequence: GGG
ctggtggctgtaatatttat

SEQ ID NO: 29806 - DNA, 20 bp, Artificial Sequence
  Description of Artificial Sequence: Synthetic oligonucleotide
  Target: SCN10A; (+) strand; PAM type: NRG; PAM sequence: AAG
ctgtaatatttatgggtgac

SEQ ID NO: 29807 - DNA, 20 bp, Artificial Sequence
  Description of Artificial Sequence: Synthetic oligonucleotide
  Target: SCN10A; (+) strand; PAM type: NRG; PAM sequence: AGG
tgtaatatttatgggtgaca

SEQ ID NO: 29808 - DNA, 20 bp, Artificial Sequence
  Description of Artificial Sequence: Synthetic oligonucleotide
  Target: SCN10A; (+) strand; PAM type: NRG; PAM sequence: GGG
gtaatatttatgggtgacaa

SEQ ID NO: 29809 - DNA, 20 bp, Artificial Sequence
  Description of Artificial Sequence: Synthetic oligonucleotide
  Target: SCN10A; (+) strand; PAM type: NRG; PAM sequence: AAG
atatttatgggtgacaaggg

SEQ ID NO: 29810 - DNA, 20 bp, Artificial Sequence
  Description of Artificial Sequence: Synthetic oligonucleotide
  Target: SCN10A; (+) strand; PAM type: NRG; PAM sequence: TGG
ttatgggtgacaagggaaga

SEQ ID NO: 29811 - DNA, 20 bp, Artificial Sequence
  Description of Artificial Sequence: Synthetic oligonucleotide
  Target: SCN10A; (+) strand; PAM type: NRG; PAM sequence: GGG
tatgggtgacaagggaagat

SEQ ID NO: 29812 - DNA, 20 bp, Artificial Sequence
  Description of Artificial Sequence: Synthetic oligonucleotide
  Target: SCN10A; (+) strand; PAM type: NRG; PAM sequence: AAG
agggaagatgggcccacaaa

SEQ ID NO: 29813 - DNA, 20 bp, Artificial Sequence
  Description of Artificial Sequence: Synthetic oligonucleotide
  Target: SCN10A; (+) strand; PAM type: NRG; PAM sequence: AAG
gggcccacaaaaagacttga

SEQ ID NO: 29814 - DNA, 20 bp, Artificial Sequence
  Description of Artificial Sequence: Synthetic oligonucleotide
  Target: SCN10A; (+) strand; PAM type: NRG; PAM sequence: GAG
gcccacaaaaagacttgaaa

SEQ ID NO: 29815 - DNA, 20 bp, Artificial Sequence
  Description of Artificial Sequence: Synthetic oligonucleotide
  Target: SCN10A; (+) strand; PAM type: NRG; PAM sequence: AAG
aaaagacttgaaagagaact

SEQ ID NO: 29816 - DNA, 20 bp, Artificial Sequence
  Description of Artificial Sequence: Synthetic oligonucleotide
  Target: SCN10A; (+) strand; PAM type: NRG; PAM sequence: GAG
aagacttgaaagagaactaa

SEQ ID NO: 29817 - DNA, 20 bp, Artificial Sequence
  Description of Artificial Sequence: Synthetic oligonucleotide
  Target: SCN10A; (+) strand; PAM type: NRG; PAM sequence: GAG
gacttgaaagagaactaaga

SEQ ID NO: 29818 - DNA, 20 bp, Artificial Sequence
  Description of Artificial Sequence: Synthetic oligonucleotide
  Target: SCN10A; (+) strand; PAM type: NRG; PAM sequence: TAG
tgaaagagaactaagagagt

SEQ ID NO: 29819 - DNA, 20 bp, Artificial Sequence
  Description of Artificial Sequence: Synthetic oligonucleotide
  Target: SCN10A; (+) strand; PAM type: NRG; PAM sequence: AGG
gaaagagaactaagagagtt

SEQ ID NO: 29820 - DNA, 20 bp, Artificial Sequence
  Description of Artificial Sequence: Synthetic oligonucleotide
  Target: SCN10A; (+) strand; PAM type: NRG; PAM sequence: CAG
actaagagagttaggacatg

SEQ ID NO: 29821 - DNA, 20 bp, Artificial Sequence
  Description of Artificial Sequence: Synthetic oligonucleotide
  Target: SCN10A; (+) strand; PAM type: NRG; PAM sequence: AAG
taggacatgcagcaccacca

SEQ ID NO: 29822 - DNA, 20 bp, Artificial Sequence
  Description of Artificial Sequence: Synthetic oligonucleotide
  Target: SCN10A; (+) strand; PAM type: NRG; PAM sequence: CAG
acatgcagcaccaccaaagt

SEQ ID NO: 29823 - DNA, 20 bp, Artificial Sequence
  Description of Artificial Sequence: Synthetic oligonucleotide
  Target: SCN10A; (+) strand; PAM type: NRG; PAM sequence: GAG
atgcagcaccaccaaagtca

SEQ ID NO: 29824 - DNA, 20 bp, Artificial Sequence
  Description of Artificial Sequence: Synthetic oligonucleotide
  Target: SCN10A; (+) strand; PAM type: NRG; PAM sequence: CAG
cagcaccaccaaagtcagag

SEQ ID NO: 29825 - DNA, 20 bp, Artificial Sequence
  Description of Artificial Sequence: Synthetic oligonucleotide
  Target: SCN10A; (+) strand; PAM type: NRG; PAM sequence: AGG
agcaccaccaaagtcagagc

SEQ ID NO: 29826 - DNA, 20 bp, Artificial Sequence
  Description of Artificial Sequence: Synthetic oligonucleotide
  Target: SCN10A; (+) strand; PAM type: NRG; PAM sequence: AAG
accaccaaagtcagagcagg

SEQ ID NO: 29827 - DNA, 20 bp, Artificial Sequence
  Description of Artificial Sequence: Synthetic oligonucleotide
  Target: SCN10A; (+) strand; PAM type: NRG; PAM sequence: AAG
caaagtcagagcaggaagtg

SEQ ID NO: 29828 - DNA, 20 bp, Artificial Sequence
  Description of Artificial Sequence: Synthetic oligonucleotide
  Target: SCN10A; (+) strand; PAM type: NRG; PAM sequence: CAG
cagagcaggaagtgaagact

SEQ ID NO: 29829 - DNA, 20 bp, Artificial Sequence
  Description of Artificial Sequence: Synthetic oligonucleotide
  Target: SCN10A; (+) strand; PAM type: NRG; PAM sequence: GAG
gagcaggaagtgaagactca

SEQ ID NO: 29830 - DNA, 20 bp, Artificial Sequence
  Description of Artificial Sequence: Synthetic oligonucleotide
  Target: SCN10A; (+) strand; PAM type: NRG; PAM sequence: TGG
gaagactcagagcctacctt

SEQ ID NO: 29831 - DNA, 20 bp, Artificial Sequence
  Description of Artificial Sequence: Synthetic oligonucleotide
  Target: SCN10A; (+) strand; PAM type: NRG; PAM sequence: GAG
agactcagagcctacctttg

SEQ ID NO: 29832 - DNA, 20 bp, Artificial Sequence
  Description of Artificial Sequence: Synthetic oligonucleotide
  Target: SCN10A; (+) strand; PAM type: NRG; PAM sequence: AGG
gactcagagcctacctttgg

SEQ ID NO: 29833 - DNA, 20 bp, Artificial Sequence
  Description of Artificial Sequence: Synthetic oligonucleotide
  Target: SCN10A; (+) strand; PAM type: NRG; PAM sequence: TGG
tcagagcctacctttggagg

SEQ ID NO: 29834 - DNA, 20 bp, Artificial Sequence
  Description of Artificial Sequence: Synthetic oligonucleotide
  Target: SCN10A; (+) strand; PAM type: NRG; PAM sequence: GGG
cagagcctacctttggaggt

SEQ ID NO: 29835 - DNA, 20 bp, Artificial Sequence
  Description of Artificial Sequence: Synthetic oligonucleotide
  Target: SCN10A; (+) strand; PAM type: NRG; PAM sequence: GGG
agagcctacctttggaggtg

SEQ ID NO: 29836 - DNA, 20 bp, Artificial Sequence
  Description of Artificial Sequence: Synthetic oligonucleotide
  Target: SCN10A; (+) strand; PAM type: NRG; PAM sequence: CGG
tacctttggaggtggggccc

SEQ ID NO: 29837 - DNA, 20 bp, Artificial Sequence
  Description of Artificial Sequence: Synthetic oligonucleotide
  Target: SCN10A; (+) strand; PAM type: NRG; PAM sequence: GAG
cctttggaggtggggccccg

SEQ ID NO: 29838 - DNA, 20 bp, Artificial Sequence
  Description of Artificial Sequence: Synthetic oligonucleotide
  Target: SCN10A; (+) strand; PAM type: NRG; PAM sequence: CAG
ggaggtggggccccggagct

SEQ ID NO: 29839 - DNA, 20 bp, Artificial Sequence
  Description of Artificial Sequence: Synthetic oligonucleotide
  Target: SCN10A; (+) strand; PAM type: NRG; PAM sequence: AGG
gaggtggggccccggagctc

SEQ ID NO: 29840 - DNA, 20 bp, Artificial Sequence
  Description of Artificial Sequence: Synthetic oligonucleotide
  Target: SCN10A; (+) strand; PAM type: NRG; PAM sequence: GGG
aggtggggccccggagctca

SEQ ID NO: 29841 - DNA, 20 bp, Artificial Sequence
  Description of Artificial Sequence: Synthetic oligonucleotide
  Target: SCN10A; (+) strand; PAM type: NRG; PAM sequence: TGG
ggggccccggagctcagggt

SEQ ID NO: 29842 - DNA, 20 bp, Artificial Sequence
  Description of Artificial Sequence: Synthetic oligonucleotide
  Target: SCN10A; (+) strand; PAM type: NRG; PAM sequence: TGG
gccccggagctcagggttgg

SEQ ID NO: 29843 - DNA, 20 bp, Artificial Sequence
  Description of Artificial Sequence: Synthetic oligonucleotide
  Target: SCN10A; (+) strand; PAM type: NRG; PAM sequence: GGG
ccccggagctcagggttggt

SEQ ID NO: 29844 - DNA, 20 bp, Artificial Sequence
  Description of Artificial Sequence: Synthetic oligonucleotide
  Target: SCN10A; (+) strand; PAM type: NRG; PAM sequence: TGG
ggagctcagggttggtggga

SEQ ID NO: 29845 - DNA, 20 bp, Artificial Sequence
  Description of Artificial Sequence: Synthetic oligonucleotide
  Target: SCN10A; (+) strand; PAM type: NRG; PAM sequence: GAG
agctcagggttggtgggatg

SEQ ID NO: 29846 - DNA, 20 bp, Artificial Sequence
  Description of Artificial Sequence: Synthetic oligonucleotide
  Target: SCN10A; (+) strand; PAM type: NRG; PAM sequence: AGG
gctcagggttggtgggatgg

SEQ ID NO: 29847 - DNA, 20 bp, Artificial Sequence
  Description of Artificial Sequence: Synthetic oligonucleotide
  Target: SCN10A; (+) strand; PAM type: NRG; PAM sequence: GGG
ctcagggttggtgggatgga

SEQ ID NO: 29848 - DNA, 20 bp, Artificial Sequence
  Description of Artificial Sequence: Synthetic oligonucleotide
  Target: SCN10A; (+) strand; PAM type: NRG; PAM sequence: AAG
ttggtgggatggagggcata

SEQ ID NO: 29849 - DNA, 20 bp, Artificial Sequence
  Description of Artificial Sequence: Synthetic oligonucleotide
  Target: SCN10A; (+) strand; PAM type: NRG; PAM sequence: AGG
tggtgggatggagggcataa

SEQ ID NO: 29850 - DNA, 20 bp, Artificial Sequence
  Description of Artificial Sequence: Synthetic oligonucleotide
  Target: SCN10A; (+) strand; PAM type: NRG; PAM sequence: GGG
ggtgggatggagggcataaa

SEQ ID NO: 29851 - DNA, 20 bp, Artificial Sequence
  Description of Artificial Sequence: Synthetic oligonucleotide
  Target: SCN10A; (+) strand; PAM type: NRG; PAM sequence: GGG
gtgggatggagggcataaag

SEQ ID NO: 29852 - DNA, 20 bp, Artificial Sequence
  Description of Artificial Sequence: Synthetic oligonucleotide
  Target: SCN10A; (+) strand; PAM type: NRG; PAM sequence: GGG
tgggatggagggcataaagg

SEQ ID NO: 29853 - DNA, 20 bp, Artificial Sequence
  Description of Artificial Sequence: Synthetic oligonucleotide
  Target: SCN10A; (+) strand; PAM type: NRG; PAM sequence: AAG
gatggagggcataaaggggg

SEQ ID NO: 29854 - DNA, 20 bp, Artificial Sequence
  Description of Artificial Sequence: Synthetic oligonucleotide
  Target: SCN10A; (+) strand; PAM type: NRG; PAM sequence: AGG
atggagggcataaaggggga

SEQ ID NO: 29855 - DNA, 20 bp, Artificial Sequence
  Description of Artificial Sequence: Synthetic oligonucleotide
  Target: SCN10A; (+) strand; PAM type: NRG; PAM sequence: GGG
tggagggcataaagggggaa

SEQ ID NO: 29856 - DNA, 20 bp, Artificial Sequence
  Description of Artificial Sequence: Synthetic oligonucleotide
  Target: SCN10A; (+) strand; PAM type: NRG; PAM sequence: CAG
ggaagggttaccaaaacctg

SEQ ID NO: 29857 - DNA, 20 bp, Artificial Sequence
  Description of Artificial Sequence: Synthetic oligonucleotide
  Target: SCN10A; (+) strand; PAM type: NRG; PAM sequence: CAG
ggttaccaaaacctgcagac

SEQ ID NO: 29858 - DNA, 20 bp, Artificial Sequence
  Description of Artificial Sequence: Synthetic oligonucleotide
  Target: SCN10A; (+) strand; PAM type: NRG; PAM sequence: GAG
ttaccaaaacctgcagacca

SEQ ID NO: 29859 - DNA, 20 bp, Artificial Sequence
  Description of Artificial Sequence: Synthetic oligonucleotide
  Target: SCN10A; (+) strand; PAM type: NRG; PAM sequence: AAG
ccaaaacctgcagaccagag

SEQ ID NO: 29860 - DNA, 20 bp, Artificial Sequence
  Description of Artificial Sequence: Synthetic oligonucleotide
  Target: SCN10A; (+) strand; PAM type: NRG; PAM sequence: GAG
aagttttttgtttgtttttt

SEQ ID NO: 29861 - DNA, 20 bp, Artificial Sequence
  Description of Artificial Sequence: Synthetic oligonucleotide
  Target: SCN10A; (+) strand; PAM type: NRG; PAM sequence: AGG
agttttttgtttgttttttg

SEQ ID NO: 29862 - DNA, 20 bp, Artificial Sequence
  Description of Artificial Sequence: Synthetic oligonucleotide
  Target: SCN10A; (+) strand; PAM type: NRG; PAM sequence: CGG
tttttgtttgttttttgagg

SEQ ID NO: 29863 - DNA, 20 bp, Artificial Sequence
  Description of Artificial Sequence: Synthetic oligonucleotide
  Target: SCN10A; (+) strand; PAM type: NRG; PAM sequence: GAG
tttgtttgttttttgaggcg

SEQ ID NO: 29864 - DNA, 20 bp, Artificial Sequence
  Description of Artificial Sequence: Synthetic oligonucleotide
  Target: SCN10A; (+) strand; PAM type: NRG; PAM sequence: CAG
cggagtctcgctctgtcacc

SEQ ID NO: 29865 - DNA, 20 bp, Artificial Sequence
  Description of Artificial Sequence: Synthetic oligonucleotide
  Target: SCN10A; (+) strand; PAM type: NRG; PAM sequence: AGG
ggagtctcgctctgtcaccc

SEQ ID NO: 29866 - DNA, 20 bp, Artificial Sequence
  Description of Artificial Sequence: Synthetic oligonucleotide
  Target: SCN10A; (+) strand; PAM type: NRG; PAM sequence: TGG
tctcgctctgtcacccaggc

SEQ ID NO: 29867 - DNA, 20 bp, Artificial Sequence
  Description of Artificial Sequence: Synthetic oligonucleotide
  Target: SCN10A; (+) strand; PAM type: NRG; PAM sequence: GAG
tcgctctgtcacccaggctg

SEQ ID NO: 29868 - DNA, 20 bp, Artificial Sequence
  Description of Artificial Sequence: Synthetic oligonucleotide
  Target: SCN10A; (+) strand; PAM type: NRG; PAM sequence: TGG
tcacccaggctggagtataa

SEQ ID NO: 29869 - DNA, 20 bp, Artificial Sequence
  Description of Artificial Sequence: Synthetic oligonucleotide
  Target: SCN10A; (+) strand; PAM type: NRG; PAM sequence: CGG
ggagtataatggcacaatct

SEQ ID NO: 29870 - DNA, 20 bp, Artificial Sequence
  Description of Artificial Sequence: Synthetic oligonucleotide
  Target: SCN10A; (+) strand; PAM type: NRG; PAM sequence: TGG
ctcactaccaccacacctcg

SEQ ID NO: 29871 - DNA, 20 bp, Artificial Sequence
  Description of Artificial Sequence: Synthetic oligonucleotide
  Target: SCN10A; (+) strand; PAM type: NRG; PAM sequence: TGG
actaccaccacacctcgtgg

SEQ ID NO: 29872 - DNA, 20 bp, Artificial Sequence
  Description of Artificial Sequence: Synthetic oligonucleotide
  Target: SCN10A; (+) strand; PAM type: NRG; PAM sequence: TAG
accaccacacctcgtggtgg

SEQ ID NO: 29873 - DNA, 20 bp, Artificial Sequence
  Description of Artificial Sequence: Synthetic oligonucleotide
  Target: SCN10A; (+) strand; PAM type: NRG; PAM sequence: TAG
ggtagtgatttttgtacttt

SEQ ID NO: 29874 - DNA, 20 bp, Artificial Sequence
  Description of Artificial Sequence: Synthetic oligonucleotide
  Target: SCN10A; (+) strand; PAM type: NRG; PAM sequence: CAG
agtgatttttgtacttttag

SEQ ID NO: 29875 - DNA, 20 bp, Artificial Sequence
  Description of Artificial Sequence: Synthetic oligonucleotide
  Target: SCN10A; (+) strand; PAM type: NRG; PAM sequence: GAG
tgatttttgtacttttagca

SEQ ID NO: 29876 - DNA, 20 bp, Artificial Sequence
  Description of Artificial Sequence: Synthetic oligonucleotide
  Target: SCN10A; (+) strand; PAM type: NRG; PAM sequence: CAG
ttttgtacttttagcagaga

SEQ ID NO: 29877 - DNA, 20 bp, Artificial Sequence
  Description of Artificial Sequence: Synthetic oligonucleotide
  Target: SCN10A; (+) strand; PAM type: NRG; PAM sequence: AGG
tttgtacttttagcagagac

SEQ ID NO: 29878 - DNA, 20 bp, Artificial Sequence
  Description of Artificial Sequence: Synthetic oligonucleotide
  Target: SCN10A; (+) strand; PAM type: NRG; PAM sequence: GGG
ttgtacttttagcagagaca

SEQ ID NO: 29879 - DNA, 20 bp, Artificial Sequence
  Description of Artificial Sequence: Synthetic oligonucleotide
  Target: SCN10A; (+) strand; PAM type: NRG; PAM sequence: CGG
ttttagcagagacagggttt

SEQ ID NO: 29880 - DNA, 20 bp, Artificial Sequence
  Description of Artificial Sequence: Synthetic oligonucleotide
  Target: SCN10A; (+) strand; PAM type: NRG; PAM sequence: TGG
gagacagggtttcggcatgt

SEQ ID NO: 29881 - DNA, 20 bp, Artificial Sequence
  Description of Artificial Sequence: Synthetic oligonucleotide
  Target: SCN10A; (+) strand; PAM type: NRG; PAM sequence: CAG
cagggtttcggcatgttggc

SEQ ID NO: 29882 - DNA, 20 bp, Artificial Sequence
  Description of Artificial Sequence: Synthetic oligonucleotide
  Target: SCN10A; (+) strand; PAM type: NRG; PAM sequence: AGG
agggtttcggcatgttggcc

SEQ ID NO: 29883 - DNA, 20 bp, Artificial Sequence
  Description of Artificial Sequence: Synthetic oligonucleotide
  Target: SCN10A; (+) strand; PAM type: NRG; PAM sequence: GGG
gggtttcggcatgttggcca

SEQ ID NO: 29884 - DNA, 20 bp, Artificial Sequence
  Description of Artificial Sequence: Synthetic oligonucleotide
  Target: SCN10A; (+) strand; PAM type: NRG; PAM sequence: TGG
tttcggcatgttggccaggg

SEQ ID NO: 29885 - DNA, 20 bp, Artificial Sequence
  Description of Artificial Sequence: Synthetic oligonucleotide
  Target: SCN10A; (+) strand; PAM type: NRG; PAM sequence: CAG
tggttttgaactcctaacct

SEQ ID NO: 29886 - DNA, 20 bp, Artificial Sequence
  Description of Artificial Sequence: Synthetic oligonucleotide
  Target: SCN10A; (+) strand; PAM type: NRG; PAM sequence: AGG
ggttttgaactcctaacctc

SEQ ID NO: 29887 - DNA, 20 bp, Artificial Sequence
  Description of Artificial Sequence: Synthetic oligonucleotide
  Target: SCN10A; (+) strand; PAM type: NRG; PAM sequence: CAG
ctcaggtgatccgcccgcct

SEQ ID NO: 29888 - DNA, 20 bp, Artificial Sequence
  Description of Artificial Sequence: Synthetic oligonucleotide
  Target: SCN10A; (+) strand; PAM type: NRG; PAM sequence: AAG
ccgcccgcctcagcctccca

SEQ ID NO: 29889 - DNA, 20 bp, Artificial Sequence
  Description of Artificial Sequence: Synthetic oligonucleotide
  Target: SCN10A; (+) strand; PAM type: NRG; PAM sequence: TGG
gcctcagcctcccaaagtgc

SEQ ID NO: 29890 - DNA, 20 bp, Artificial Sequence
  Description of Artificial Sequence: Synthetic oligonucleotide
  Target: SCN10A; (+) strand; PAM type: NRG; PAM sequence: GGG
cctcagcctcccaaagtgct

SEQ ID NO: 29891 - DNA, 20 bp, Artificial Sequence
  Description of Artificial Sequence: Synthetic oligonucleotide
  Target: SCN10A; (+) strand; PAM type: NRG; PAM sequence: CAG
ctcccaaagtgctgggatta

SEQ ID NO: 29892 - DNA, 20 bp, Artificial Sequence
  Description of Artificial Sequence: Synthetic oligonucleotide
  Target: SCN10A; (+) strand; PAM type: NRG; PAM sequence: AGG
tcccaaagtgctgggattac

SEQ ID NO: 29893 - DNA, 20 bp, Artificial Sequence
  Description of Artificial Sequence: Synthetic oligonucleotide
  Target: SCN10A; (+) strand; PAM type: NRG; PAM sequence: TGG
caggcatgaaccaccgtgcc

SEQ ID NO: 29894 - DNA, 20 bp, Artificial Sequence
  Description of Artificial Sequence: Synthetic oligonucleotide
  Target: SCN10A; (+) strand; PAM type: NRG; PAM sequence: CAG
catgaaccaccgtgcctggc

SEQ ID NO: 29895 - DNA, 20 bp, Artificial Sequence
  Description of Artificial Sequence: Synthetic oligonucleotide
  Target: SCN10A; (+) strand; PAM type: NRG; PAM sequence: GAG
accaccgtgcctggccagat

SEQ ID NO: 29896 - DNA, 20 bp, Artificial Sequence
  Description of Artificial Sequence: Synthetic oligonucleotide
  Target: SCN10A; (+) strand; PAM type: NRG; PAM sequence: GAG
caccgtgcctggccagatga

SEQ ID NO: 29897 - DNA, 20 bp, Artificial Sequence
  Description of Artificial Sequence: Synthetic oligonucleotide
  Target: SCN10A; (+) strand; PAM type: NRG; PAM sequence: AAG
cgtgcctggccagatgagag

SEQ ID NO: 29898 - DNA, 20 bp, Artificial Sequence
  Description of Artificial Sequence: Synthetic oligonucleotide
  Target: SCN10A; (+) strand; PAM type: NRG; PAM sequence: GAG
ggccagatgagagaagtttt

SEQ ID NO: 29899 - DNA, 20 bp, Artificial Sequence
  Description of Artificial Sequence: Synthetic oligonucleotide
  Target: SCN10A; (+) strand; PAM type: NRG; PAM sequence: CAG
gatgagagaagttttgagat

SEQ ID NO: 29900 - DNA, 20 bp, Artificial Sequence
  Description of Artificial Sequence: Synthetic oligonucleotide
  Target: SCN10A; (+) strand; PAM type: NRG; PAM sequence: GAG
tacccgcatgccttcaaatc

SEQ ID NO: 29901 - DNA, 20 bp, Artificial Sequence
  Description of Artificial Sequence: Synthetic oligonucleotide
  Target: SCN10A; (+) strand; PAM type: NRG; PAM sequence: AAG
cgcatgccttcaaatcgaga

SEQ ID NO: 29902 - DNA, 20 bp, Artificial Sequence
  Description of Artificial Sequence: Synthetic oligonucleotide
  Target: SCN10A; (+) strand; PAM type: NRG; PAM sequence: GAG
catgccttcaaatcgagaaa

SEQ ID NO: 29903 - DNA, 20 bp, Artificial Sequence
  Description of Artificial Sequence: Synthetic oligonucleotide
  Target: SCN10A; (+) strand; PAM type: NRG; PAM sequence: CAG
tcaaatcgagaaagagcccg

SEQ ID NO: 29904 - DNA, 20 bp, Artificial Sequence
  Description of Artificial Sequence: Synthetic oligonucleotide
  Target: SCN10A; (+) strand; PAM type: NRG; PAM sequence: TGG
aatcgagaaagagcccgcag

SEQ ID NO: 29905 - DNA, 20 bp, Artificial Sequence
  Description of Artificial Sequence: Synthetic oligonucleotide
  Target: SCN10A; (+) strand; PAM type: NRG; PAM sequence: CAG
gaaagagcccgcagtggccg

SEQ ID NO: 29906 - DNA, 20 bp, Artificial Sequence
  Description of Artificial Sequence: Synthetic oligonucleotide
  Target: SCN10A; (+) strand; PAM type: NRG; PAM sequence: GAG
aagagcccgcagtggccgca

SEQ ID NO: 29907 - DNA, 20 bp, Artificial Sequence
  Description of Artificial Sequence: Synthetic oligonucleotide
  Target: SCN10A; (+) strand; PAM type: NRG; PAM sequence: AAG
cgcagtggccgcagagcgcg

SEQ ID NO: 29908 - DNA, 20 bp, Artificial Sequence
  Description of Artificial Sequence: Synthetic oligonucleotide
  Target: SCN10A; (+) strand; PAM type: NRG; PAM sequence: AGG
gcagtggccgcagagcgcga

SEQ ID NO: 29909 - DNA, 20 bp, Artificial Sequence
  Description of Artificial Sequence: Synthetic oligonucleotide
  Target: SCN10A; (+) strand; PAM type: NRG; PAM sequence: GGG
cagtggccgcagagcgcgaa

SEQ ID NO: 29910 - DNA, 20 bp, Artificial Sequence
  Description of Artificial Sequence: Synthetic oligonucleotide
  Target: SCN10A; (+) strand; PAM type: NRG; PAM sequence: AAG
cgcagagcgcgaagggttcg

SEQ ID NO: 29911 - DNA, 20 bp, Artificial Sequence
  Description of Artificial Sequence: Synthetic oligonucleotide
  Target: SCN10A; (+) strand; PAM type: NRG; PAM sequence: AGG
gcagagcgcgaagggttcga

SEQ ID NO: 29912 - DNA, 20 bp, Artificial Sequence
  Description of Artificial Sequence: Synthetic oligonucleotide
  Target: SCN10A; (+) strand; PAM type: NRG; PAM sequence: GGG
cagagcgcgaagggttcgaa

SEQ ID NO: 29913 - DNA, 20 bp, Artificial Sequence
  Description of Artificial Sequence: Synthetic oligonucleotide
  Target: SCN10A; (+) strand; PAM type: NRG; PAM sequence: TGG
aagggttcgaagggctttga

SEQ ID NO: 29914 - DNA, 20 bp, Artificial Sequence
  Description of Artificial Sequence: Synthetic oligonucleotide
  Target: SCN10A; (+) strand; PAM type: NRG; PAM sequence: GGG
agggttcgaagggctttgat

SEQ ID NO: 29915 - DNA, 20 bp, Artificial Sequence
  Description of Artificial Sequence: Synthetic oligonucleotide
  Target: SCN10A; (+) strand; PAM type: NRG; PAM sequence: GAG
ggttcgaagggctttgatgg

SEQ ID NO: 29916 - DNA, 20 bp, Artificial Sequence
  Description of Artificial Sequence: Synthetic oligonucleotide
  Target: SCN10A; (+) strand; PAM type: NRG; PAM sequence: CAG
ggctttgatgggagccactt

SEQ ID NO: 29917 - DNA, 20 bp, Artificial Sequence
  Description of Artificial Sequence: Synthetic oligonucleotide
  Target: SCN10A; (+) strand; PAM type: NRG; PAM sequence: CAG
ggagccacttcagaatattc

SEQ ID NO: 29918 - DNA, 20 bp, Artificial Sequence
  Description of Artificial Sequence: Synthetic oligonucleotide
  Target: SCN10A; (+) strand; PAM type: NRG; PAM sequence: GAG
tattccagaatcttcgctgt

SEQ ID NO: 29919 - DNA, 20 bp, Artificial Sequence
  Description of Artificial Sequence: Synthetic oligonucleotide
  Target: SCN10A; (+) strand; PAM type: NRG; PAM sequence: CAG
atcttcgctgtgagacttat

SEQ ID NO: 29920 - DNA, 20 bp, Artificial Sequence
  Description of Artificial Sequence: Synthetic oligonucleotide
  Target: SCN10A; (+) strand; PAM type: NRG; PAM sequence: GAG
tcgctgtgagacttatcagt

SEQ ID NO: 29921 - DNA, 20 bp, Artificial Sequence
  Description of Artificial Sequence: Synthetic oligonucleotide
  Target: SCN10A; (+) strand; PAM type: NRG; PAM sequence: GAG
gagacttatcagtgagatct

SEQ ID NO: 29922 - DNA, 20 bp, Artificial Sequence
  Description of Artificial Sequence: Synthetic oligonucleotide
  Target: SCN10A; (+) strand; PAM type: NRG; PAM sequence: CAG
ttatcagtgagatctgagtg

SEQ ID NO: 29923 - DNA, 20 bp, Artificial Sequence
  Description of Artificial Sequence: Synthetic oligonucleotide
  Target: SCN10A; (+) strand; PAM type: NRG; PAM sequence: AGG
tatcagtgagatctgagtgc

SEQ ID NO: 29924 - DNA, 20 bp, Artificial Sequence
  Description of Artificial Sequence: Synthetic oligonucleotide
  Target: SCN10A; (+) strand; PAM type: NRG; PAM sequence: GAG
tcagtgagatctgagtgcag

SEQ ID NO: 29925 - DNA, 20 bp, Artificial Sequence
  Description of Artificial Sequence: Synthetic oligonucleotide
  Target: SCN10A; (+) strand; PAM type: NRG; PAM sequence: GAG
agtgagatctgagtgcagga

SEQ ID NO: 29926 - DNA, 20 bp, Artificial Sequence
  Description of Artificial Sequence: Synthetic oligonucleotide
  Target: SCN10A; (+) strand; PAM type: NRG; PAM sequence: AGG
gtgagatctgagtgcaggag

SEQ ID NO: 29927 - DNA, 20 bp, Artificial Sequence
  Description of Artificial Sequence: Synthetic oligonucleotide
  Target: SCN10A; (+) strand; PAM type: NRG; PAM sequence: GGG
tgagatctgagtgcaggaga

SEQ ID NO: 29928 - DNA, 20 bp, Artificial Sequence
  Description of Artificial Sequence: Synthetic oligonucleotide
  Target: SCN10A; (+) strand; PAM type: NRG; PAM sequence: CAG
gatctgagtgcaggagaggg

SEQ ID NO: 29929 - DNA, 20 bp, Artificial Sequence
  Description of Artificial Sequence: Synthetic oligonucleotide
  Target: SCN10A; (+) strand; PAM type: NRG; PAM sequence: TAG
agagggcagaaacatcactc

SEQ ID NO: 29930 - DNA, 20 bp, Artificial Sequence
  Description of Artificial Sequence: Synthetic oligonucleotide
  Target: SCN10A; (+) strand; PAM type: NRG; PAM sequence: AGG
gagggcagaaacatcactct

SEQ ID NO: 29931 - DNA, 20 bp, Artificial Sequence
  Description of Artificial Sequence: Synthetic oligonucleotide
  Target: SCN10A; (+) strand; PAM type: NRG; PAM sequence: CAG
gaaacatcactctaggtttc

SEQ ID NO: 29932 - DNA, 20 bp, Artificial Sequence
  Description of Artificial Sequence: Synthetic oligonucleotide
  Target: SCN10A; (+) strand; PAM type: NRG; PAM sequence: AAG
catcactctaggtttccaga

SEQ ID NO: 29933 - DNA, 20 bp, Artificial Sequence
  Description of Artificial Sequence: Synthetic oligonucleotide
  Target: SCN10A; (+) strand; PAM type: NRG; PAM sequence: AGG
atcactctaggtttccagaa

SEQ ID NO: 29934 - DNA, 20 bp, Artificial Sequence
  Description of Artificial Sequence: Synthetic oligonucleotide
  Target: SCN10A; (+) strand; PAM type: NRG; PAM sequence: CAG
actctaggtttccagaaagg

SEQ ID NO: 29935 - DNA, 20 bp, Artificial Sequence
  Description of Artificial Sequence: Synthetic oligonucleotide
  Target: SCN10A; (+) strand; PAM type: NRG; PAM sequence: TGG
ttccagaaaggcagtcctcg

SEQ ID NO: 29936 - DNA, 20 bp, Artificial Sequence
  Description of Artificial Sequence: Synthetic oligonucleotide
  Target: SCN10A; (+) strand; PAM type: NRG; PAM sequence: AAG
cagaaaggcagtcctcgtgg

SEQ ID NO: 29937 - DNA, 20 bp, Artificial Sequence
  Description of Artificial Sequence: Synthetic oligonucleotide
  Target: SCN10A; (+) strand; PAM type: NRG; PAM sequence: AGG
agaaaggcagtcctcgtgga

SEQ ID NO: 29938 - DNA, 20 bp, Artificial Sequence
  Description of Artificial Sequence: Synthetic oligonucleotide
  Target: SCN10A; (+) strand; PAM type: NRG; PAM sequence: GAG
aaaggcagtcctcgtggaag

SEQ ID NO: 29939 - DNA, 20 bp, Artificial Sequence
  Description of Artificial Sequence: Synthetic oligonucleotide
  Target: SCN10A; (+) strand; PAM type: NRG; PAM sequence: CAG
gcagtcctcgtggaaggaga

SEQ ID NO: 29940 - DNA, 20 bp, Artificial Sequence
  Description of Artificial Sequence: Synthetic oligonucleotide
  Target: SCN10A; (+) strand; PAM type: NRG; PAM sequence: AGG
cagtcctcgtggaaggagac

SEQ ID NO: 29941 - DNA, 20 bp, Artificial Sequence
  Description of Artificial Sequence: Synthetic oligonucleotide
  Target: SCN10A; (+) strand; PAM type: NRG; PAM sequence: CAG
ggagacaggaactccctgcc

SEQ ID NO: 29942 - DNA, 20 bp, Artificial Sequence
  Description of Artificial Sequence: Synthetic oligonucleotide
  Target: SCN10A; (+) strand; PAM type: NRG; PAM sequence: AAG
cctcccattcctacacgtct

SEQ ID NO: 29943 - DNA, 20 bp, Artificial Sequence
  Description of Artificial Sequence: Synthetic oligonucleotide
  Target: SCN10A; (+) strand; PAM type: NRG; PAM sequence: TAG
acacgtctaagccatcatcc

SEQ ID NO: 29944 - DNA, 20 bp, Artificial Sequence
  Description of Artificial Sequence: Synthetic oligonucleotide
  Target: SCN10A; (+) strand; PAM type: NRG; PAM sequence: CGG
atcctagctcccaccttatt

SEQ ID NO: 29945 - DNA, 20 bp, Artificial Sequence
  Description of Artificial Sequence: Synthetic oligonucleotide
  Target: SCN10A; (+) strand; PAM type: NRG; PAM sequence: GAG
accttattcggaactccaat

SEQ ID NO: 29946 - DNA, 20 bp, Artificial Sequence
  Description of Artificial Sequence: Synthetic oligonucleotide
  Target: SCN10A; (+) strand; PAM type: NRG; PAM sequence: GAG
cttattcggaactccaatga

SEQ ID NO: 29947 - DNA, 20 bp, Artificial Sequence
  Description of Artificial Sequence: Synthetic oligonucleotide
  Target: SCN10A; (+) strand; PAM type: NRG; PAM sequence: AGG
ttattcggaactccaatgag

SEQ ID NO: 29948 - DNA, 20 bp, Artificial Sequence
  Description of Artificial Sequence: Synthetic oligonucleotide
  Target: SCN10A; (+) strand; PAM type: NRG; PAM sequence: TAG
cggaactccaatgagaggtc

SEQ ID NO: 29949 - DNA, 20 bp, Artificial Sequence
  Description of Artificial Sequence: Synthetic oligonucleotide
  Target: SCN10A; (+) strand; PAM type: NRG; PAM sequence: AAG
actccaatgagaggtctaga

SEQ ID NO: 29950 - DNA, 20 bp, Artificial Sequence
  Description of Artificial Sequence: Synthetic oligonucleotide
  Target: SCN10A; (+) strand; PAM type: NRG; PAM sequence: GAG
tccaatgagaggtctagaaa

SEQ ID NO: 29951 - DNA, 20 bp, Artificial Sequence
  Description of Artificial Sequence: Synthetic oligonucleotide
  Target: SCN10A; (+) strand; PAM type: NRG; PAM sequence: TGG
caccactctcttaaacaatc

SEQ ID NO: 29952 - DNA, 20 bp, Artificial Sequence
  Description of Artificial Sequence: Synthetic oligonucleotide
  Target: SCN10A; (+) strand; PAM type: NRG; PAM sequence: GGG
accactctcttaaacaatct

SEQ ID NO: 29953 - DNA, 20 bp, Artificial Sequence
  Description of Artificial Sequence: Synthetic oligonucleotide
  Target: SCN10A; (+) strand; PAM type: NRG; PAM sequence: AAG
ctctcttaaacaatctgggc

SEQ ID NO: 29954 - DNA, 20 bp, Artificial Sequence
  Description of Artificial Sequence: Synthetic oligonucleotide
  Target: SCN10A; (+) strand; PAM type: NRG; PAM sequence: CAG
caatctgggcaagaaaaact

SEQ ID NO: 29955 - DNA, 20 bp, Artificial Sequence
  Description of Artificial Sequence: Synthetic oligonucleotide
  Target: SCN10A; (+) strand; PAM type: NRG; PAM sequence: TGG
tctctaacatcaccaacctc

SEQ ID NO: 29956 - DNA, 20 bp, Artificial Sequence
  Description of Artificial Sequence: Synthetic oligonucleotide
  Target: SCN10A; (+) strand; PAM type: NRG; PAM sequence: TAG
catcaccaacctctggtacg

SEQ ID NO: 29957 - DNA, 20 bp, Artificial Sequence
  Description of Artificial Sequence: Synthetic oligonucleotide
  Target: SCN10A; (+) strand; PAM type: NRG; PAM sequence: AGG
atcaccaacctctggtacgt

SEQ ID NO: 29958 - DNA, 20 bp, Artificial Sequence
  Description of Artificial Sequence: Synthetic oligonucleotide
  Target: SCN10A; (+) strand; PAM type: NRG; PAM sequence: TGG
accaacctctggtacgtagg

SEQ ID NO: 29959 - DNA, 20 bp, Artificial Sequence
  Description of Artificial Sequence: Synthetic oligonucleotide
  Target: SCN10A; (+) strand; PAM type: NRG; PAM sequence: AAG
cctctggtacgtaggtggcc

SEQ ID NO: 29960 - DNA, 20 bp, Artificial Sequence
  Description of Artificial Sequence: Synthetic oligonucleotide
  Target: SCN10A; (+) strand; PAM type: NRG; PAM sequence: CAG
tacgtaggtggccaagcttc

SEQ ID NO: 29961 - DNA, 20 bp, Artificial Sequence
  Description of Artificial Sequence: Synthetic oligonucleotide
  Target: SCN10A; (+) strand; PAM type: NRG; PAM sequence: TAG
tcaactcttccttttccttc

SEQ ID NO: 29962 - DNA, 20 bp, Artificial Sequence
  Description of Artificial Sequence: Synthetic oligonucleotide
  Target: SCN10A; (+) strand; PAM type: NRG; PAM sequence: AGG
caactcttccttttccttct

SEQ ID NO: 29963 - DNA, 20 bp, Artificial Sequence
  Description of Artificial Sequence: Synthetic oligonucleotide
  Target: SCN10A; (+) strand; PAM type: NRG; PAM sequence: GGG
aactcttccttttccttcta

SEQ ID NO: 29964 - DNA, 20 bp, Artificial Sequence
  Description of Artificial Sequence: Synthetic oligonucleotide
  Target: SCN10A; (+) strand; PAM type: NRG; PAM sequence: GGG
actcttccttttccttctag

SEQ ID NO: 29965 - DNA, 20 bp, Artificial Sequence
  Description of Artificial Sequence: Synthetic oligonucleotide
  Target: SCN10A; (+) strand; PAM type: NRG; PAM sequence: CAG
cttccttttccttctagggg

SEQ ID NO: 29966 - DNA, 20 bp, Artificial Sequence
  Description of Artificial Sequence: Synthetic oligonucleotide
  Target: SCN10A; (+) strand; PAM type: NRG; PAM sequence: CAG
ccttttccttctaggggcag

SEQ ID NO: 29967 - DNA, 20 bp, Artificial Sequence
  Description of Artificial Sequence: Synthetic oligonucleotide
  Target: SCN10A; (+) strand; PAM type: NRG; PAM sequence: CAG
ttccttctaggggcagcagt

SEQ ID NO: 29968 - DNA, 20 bp, Artificial Sequence
  Description of Artificial Sequence: Synthetic oligonucleotide
  Target: SCN10A; (+) strand; PAM type: NRG; PAM sequence: AGG
tccttctaggggcagcagtc

SEQ ID NO: 29969 - DNA, 20 bp, Artificial Sequence
  Description of Artificial Sequence: Synthetic oligonucleotide
  Target: SCN10A; (+) strand; PAM type: NRG; PAM sequence: CAG
acaaccttgaaactgatttt

SEQ ID NO: 29970 - DNA, 20 bp, Artificial Sequence
  Description of Artificial Sequence: Synthetic oligonucleotide
  Target: SCN10A; (+) strand; PAM type: NRG; PAM sequence: GAG
aaccttgaaactgattttca

SEQ ID NO: 29971 - DNA, 20 bp, Artificial Sequence
  Description of Artificial Sequence: Synthetic oligonucleotide
  Target: SCN10A; (+) strand; PAM type: NRG; PAM sequence: TGG
gaaactgattttcagagact

SEQ ID NO: 29972 - DNA, 20 bp, Artificial Sequence
  Description of Artificial Sequence: Synthetic oligonucleotide
  Target: SCN10A; (+) strand; PAM type: NRG; PAM sequence: GAG
aactgattttcagagacttg

SEQ ID NO: 29973 - DNA, 20 bp, Artificial Sequence
  Description of Artificial Sequence: Synthetic oligonucleotide
  Target: SCN10A; (+) strand; PAM type: NRG; PAM sequence: TAG
ggagacatgatgttccctcc

SEQ ID NO: 29974 - DNA, 20 bp, Artificial Sequence
  Description of Artificial Sequence: Synthetic oligonucleotide
  Target: SCN10A; (+) strand; PAM type: NRG; PAM sequence: AGG
gagacatgatgttccctcct

SEQ ID NO: 29975 - DNA, 20 bp, Artificial Sequence
  Description of Artificial Sequence: Synthetic oligonucleotide
  Target: SCN10A; (+) strand; PAM type: NRG; PAM sequence: GGG
agacatgatgttccctccta

SEQ ID NO: 29976 - DNA, 20 bp, Artificial Sequence
  Description of Artificial Sequence: Synthetic oligonucleotide
  Target: SCN10A; (+) strand; PAM type: NRG; PAM sequence: GGG
gacatgatgttccctcctag

SEQ ID NO: 29977 - DNA, 20 bp, Artificial Sequence
  Description of Artificial Sequence: Synthetic oligonucleotide
  Target: SCN10A; (+) strand; PAM type: NRG; PAM sequence: GAG
tccctcctaggggctatgct

SEQ ID NO: 29978 - DNA, 20 bp, Artificial Sequence
  Description of Artificial Sequence: Synthetic oligonucleotide
  Target: SCN10A; (+) strand; PAM type: NRG; PAM sequence: GAG
cctcctaggggctatgctga

SEQ ID NO: 29979 - DNA, 20 bp, Artificial Sequence
  Description of Artificial Sequence: Synthetic oligonucleotide
  Target: SCN10A; (+) strand; PAM type: NRG; PAM sequence: GAG
ctatgctgagagtctattct

SEQ ID NO: 29980 - DNA, 20 bp, Artificial Sequence
  Description of Artificial Sequence: Synthetic oligonucleotide
  Target: SCN10A; (+) strand; PAM type: NRG; PAM sequence: AGG
tatgctgagagtctattctg

SEQ ID NO: 29981 - DNA, 20 bp, Artificial Sequence
  Description of Artificial Sequence: Synthetic oligonucleotide
  Target: SCN10A; (+) strand; PAM type: NRG; PAM sequence: TAG
agagtctattctgaggaata

SEQ ID NO: 29982 - DNA, 20 bp, Artificial Sequence
  Description of Artificial Sequence: Synthetic oligonucleotide
  Target: SCN10A; (+) strand; PAM type: NRG; PAM sequence: CAG
taatctgaattatatttgct

SEQ ID NO: 29983 - DNA, 20 bp, Artificial Sequence
  Description of Artificial Sequence: Synthetic oligonucleotide
  Target: SCN10A; (+) strand; PAM type: NRG; PAM sequence: GAG
atctgaattatatttgctca

SEQ ID NO: 29984 - DNA, 20 bp, Artificial Sequence
  Description of Artificial Sequence: Synthetic oligonucleotide
  Target: SCN10A; (+) strand; PAM type: NRG; PAM sequence: AAG
tgaattatatttgctcagag

SEQ ID NO: 29985 - DNA, 20 bp, Artificial Sequence
  Description of Artificial Sequence: Synthetic oligonucleotide
  Target: SCN10A; (+) strand; PAM type: NRG; PAM sequence: TGG
attatatttgctcagagaag

SEQ ID NO: 29986 - DNA, 20 bp, Artificial Sequence
  Description of Artificial Sequence: Synthetic oligonucleotide
  Target: SCN10A; (+) strand; PAM type: NRG; PAM sequence: GGG
ttatatttgctcagagaagt

SEQ ID NO: 29987 - DNA, 20 bp, Artificial Sequence
  Description of Artificial Sequence: Synthetic oligonucleotide
  Target: SCN10A; (+) strand; PAM type: NRG; PAM sequence: GGG
tatatttgctcagagaagtg

SEQ ID NO: 29988 - DNA, 20 bp, Artificial Sequence
  Description of Artificial Sequence: Synthetic oligonucleotide
  Target: SCN10A; (+) strand; PAM type: NRG; PAM sequence: TGG
atttgctcagagaagtgggg

SEQ ID NO: 29989 - DNA, 20 bp, Artificial Sequence
  Description of Artificial Sequence: Synthetic oligonucleotide
  Target: SCN10A; (+) strand; PAM type: NRG; PAM sequence: AAG
gctcagagaagtggggtgga

SEQ ID NO: 29990 - DNA, 20 bp, Artificial Sequence
  Description of Artificial Sequence: Synthetic oligonucleotide
  Target: SCN10A; (+) strand; PAM type: NRG; PAM sequence: TAG
gagaagtggggtggaaagaa

SEQ ID NO: 29991 - DNA, 20 bp, Artificial Sequence
  Description of Artificial Sequence: Synthetic oligonucleotide
  Target: SCN10A; (+) strand; PAM type: NRG; PAM sequence: TGG
aagtggggtggaaagaatag

SEQ ID NO: 29992 - DNA, 20 bp, Artificial Sequence
  Description of Artificial Sequence: Synthetic oligonucleotide
  Target: SCN10A; (+) strand; PAM type: NRG; PAM sequence: TGG
gggtggaaagaatagtggtt

SEQ ID NO: 29993 - DNA, 20 bp, Artificial Sequence
  Description of Artificial Sequence: Synthetic oligonucleotide
  Target: SCN10A; (+) strand; PAM type: NRG; PAM sequence: GGG
ggtggaaagaatagtggttt

SEQ ID NO: 29994 - DNA, 20 bp, Artificial Sequence
  Description of Artificial Sequence: Synthetic oligonucleotide
  Target: SCN10A; (+) strand; PAM type: NRG; PAM sequence: TGG
ggaaagaatagtggtttggg

SEQ ID NO: 29995 - DNA, 20 bp, Artificial Sequence
  Description of Artificial Sequence: Synthetic oligonucleotide
  Target: SCN10A; (+) strand; PAM type: NRG; PAM sequence: GGG
gaaagaatagtggtttgggt

SEQ ID NO: 29996 - DNA, 20 bp, Artificial Sequence
  Description of Artificial Sequence: Synthetic oligonucleotide
  Target: SCN10A; (+) strand; PAM type: NRG; PAM sequence: GGG
aaagaatagtggtttgggtg

SEQ ID NO: 29997 - DNA, 20 bp, Artificial Sequence
  Description of Artificial Sequence: Synthetic oligonucleotide
  Target: SCN10A; (+) strand; PAM type: NRG; PAM sequence: GAG
tttgaaccctgattttttgt

SEQ ID NO: 29998 - DNA, 20 bp, Artificial Sequence
  Description of Artificial Sequence: Synthetic oligonucleotide
  Target: SCN10A; (+) strand; PAM type: NRG; PAM sequence: TGG
accctgattttttgtgagct

SEQ ID NO: 29999 - DNA, 20 bp, Artificial Sequence
  Description of Artificial Sequence: Synthetic oligonucleotide
  Target: SCN10A; (+) strand; PAM type: NRG; PAM sequence: GGG
ccctgattttttgtgagctt

SEQ ID NO: 30000 - DNA, 20 bp, Artificial Sequence
  Description of Artificial Sequence: Synthetic oligonucleotide
  Target: SCN10A; (+) strand; PAM type: NRG; PAM sequence: TAG
gattttttgtgagcttgggt

SEQ ID NO: 30001 - DNA, 20 bp, Artificial Sequence
  Description of Artificial Sequence: Synthetic oligonucleotide
  Target: SCN10A; (+) strand; PAM type: NRG; PAM sequence: TGG
tgtgagcttgggttagtgcc

SEQ ID NO: 30002 - DNA, 20 bp, Artificial Sequence
  Description of Artificial Sequence: Synthetic oligonucleotide
  Target: SCN10A; (+) strand; PAM type: NRG; PAM sequence: TAG
agcttgggttagtgcctggc

SEQ ID NO: 30003 - DNA, 20 bp, Artificial Sequence
  Description of Artificial Sequence: Synthetic oligonucleotide
  Target: SCN10A; (+) strand; PAM type: NRG; PAM sequence: CAG
gggttagtgcctggctagtc

SEQ ID NO: 30004 - DNA, 20 bp, Artificial Sequence
  Description of Artificial Sequence: Synthetic oligonucleotide
  Target: SCN10A; (+) strand; PAM type: NRG; PAM sequence: AGG
ggttagtgcctggctagtcc

SEQ ID NO: 30005 - DNA, 20 bp, Artificial Sequence
  Description of Artificial Sequence: Synthetic oligonucleotide
  Target: SCN10A; (+) strand; PAM type: NRG; PAM sequence: GGG
gttagtgcctggctagtcca

SEQ ID NO: 30006 - DNA, 20 bp, Artificial Sequence
  Description of Artificial Sequence: Synthetic oligonucleotide
  Target: SCN10A; (+) strand; PAM type: NRG; PAM sequence: AAG
tcaccctttgtaaaatgaaa

SEQ ID NO: 30007 - DNA, 20 bp, Artificial Sequence
  Description of Artificial Sequence: Synthetic oligonucleotide
  Target: SCN10A; (+) strand; PAM type: NRG; PAM sequence: CAG
cctttgtaaaatgaaaaagt

SEQ ID NO: 30008 - DNA, 20 bp, Artificial Sequence
  Description of Artificial Sequence: Synthetic oligonucleotide
  Target: SCN10A; (+) strand; PAM type: NRG; PAM sequence: AAG
taaaatgaaaaagtcagact

SEQ ID NO: 30009 - DNA, 20 bp, Artificial Sequence
  Description of Artificial Sequence: Synthetic oligonucleotide
  Target: SCN10A; (+) strand; PAM type: NRG; PAM sequence: GAG
aaatgaaaaagtcagactaa

SEQ ID NO: 30010 - DNA, 20 bp, Artificial Sequence
  Description of Artificial Sequence: Synthetic oligonucleotide
  Target: SCN10A; (+) strand; PAM type: NRG; PAM sequence: AAG
gtcagactaagagaattcca

SEQ ID NO: 30011 - DNA, 20 bp, Artificial Sequence
  Description of Artificial Sequence: Synthetic oligonucleotide
  Target: SCN10A; (+) strand; PAM type: NRG; PAM sequence: TAG
agagaattccaaagttctga

SEQ ID NO: 30012 - DNA, 20 bp, Artificial Sequence
  Description of Artificial Sequence: Synthetic oligonucleotide
  Target: SCN10A; (+) strand; PAM type: NRG; PAM sequence: CAG
ccaaagttctgatagctctg

SEQ ID NO: 30013 - DNA, 20 bp, Artificial Sequence
  Description of Artificial Sequence: Synthetic oligonucleotide
  Target: SCN10A; (+) strand; PAM type: NRG; PAM sequence: AAG
tagctctgcagttcttcaaa

SEQ ID NO: 30014 - DNA, 20 bp, Artificial Sequence
  Description of Artificial Sequence: Synthetic oligonucleotide
  Target: SCN10A; (+) strand; PAM type: NRG; PAM sequence: TGG
gcagttcttcaaaaagtttc

SEQ ID NO: 30015 - DNA, 20 bp, Artificial Sequence
  Description of Artificial Sequence: Synthetic oligonucleotide
  Target: SCN10A; (+) strand; PAM type: NRG; PAM sequence: TGG
tcttcaaaaagtttctggta

SEQ ID NO: 30016 - DNA, 20 bp, Artificial Sequence
  Description of Artificial Sequence: Synthetic oligonucleotide
  Target: SCN10A; (+) strand; PAM type: NRG; PAM sequence: GGG
cttcaaaaagtttctggtat

SEQ ID NO: 30017 - DNA, 20 bp, Artificial Sequence
  Description of Artificial Sequence: Synthetic oligonucleotide
  Target: SCN10A; (+) strand; PAM type: NRG; PAM sequence: GAG
agtttctggtatgggtccat

SEQ ID NO: 30018 - DNA, 20 bp, Artificial Sequence
  Description of Artificial Sequence: Synthetic oligonucleotide
  Target: SCN10A; (+) strand; PAM type: NRG; PAM sequence: TAG
tggtatgggtccatgagatc

SEQ ID NO: 30019 - DNA, 20 bp, Artificial Sequence
  Description of Artificial Sequence: Synthetic oligonucleotide
  Target: SCN10A; (+) strand; PAM type: NRG; PAM sequence: TAG
tccatgagatctagcttcaa

SEQ ID NO: 30020 - DNA, 20 bp, Artificial Sequence
  Description of Artificial Sequence: Synthetic oligonucleotide
  Target: SCN10A; (+) strand; PAM type: NRG; PAM sequence: GAG
tctagcttcaatagatatct

SEQ ID NO: 30021 - DNA, 20 bp, Artificial Sequence
  Description of Artificial Sequence: Synthetic oligonucleotide
  Target: SCN10A; (+) strand; PAM type: NRG; PAM sequence: GAG
agatataatgactgacttgt

SEQ ID NO: 30022 - DNA, 20 bp, Artificial Sequence
  Description of Artificial Sequence: Synthetic oligonucleotide
  Target: SCN10A; (+) strand; PAM type: NRG; PAM sequence: TGG
actgacttgtgagccccttt

SEQ ID NO: 30023 - DNA, 20 bp, Artificial Sequence
  Description of Artificial Sequence: Synthetic oligonucleotide
  Target: SCN10A; (+) strand; PAM type: NRG; PAM sequence: CAG
gtgagccccttttggtctgt

SEQ ID NO: 30024 - DNA, 20 bp, Artificial Sequence
  Description of Artificial Sequence: Synthetic oligonucleotide
  Target: SCN10A; (+) strand; PAM type: NRG; PAM sequence: AAG
ttggtctgtcagttttcttt

SEQ ID NO: 30025 - DNA, 20 bp, Artificial Sequence
  Description of Artificial Sequence: Synthetic oligonucleotide
  Target: SCN10A; (+) strand; PAM type: NRG; PAM sequence: TGG
gtctgtcagttttctttaag

SEQ ID NO: 30026 - DNA, 20 bp, Artificial Sequence
  Description of Artificial Sequence: Synthetic oligonucleotide
  Target: SCN10A; (+) strand; PAM type: NRG; PAM sequence: TGG
tgtcagttttctttaagtgg

SEQ ID NO: 30027 - DNA, 20 bp, Artificial Sequence
  Description of Artificial Sequence: Synthetic oligonucleotide
  Target: SCN10A; (+) strand; PAM type: NRG; PAM sequence: AAG
tttctttaagtggtggtcca

SEQ ID NO: 30028 - DNA, 20 bp, Artificial Sequence
  Description of Artificial Sequence: Synthetic oligonucleotide
  Target: SCN10A; (+) strand; PAM type: NRG; PAM sequence: AAG
gtggtggtccaaagactgca

SEQ ID NO: 30029 - DNA, 20 bp, Artificial Sequence
  Description of Artificial Sequence: Synthetic oligonucleotide
  Target: SCN10A; (+) strand; PAM type: NRG; PAM sequence: AGG
tggtggtccaaagactgcaa

SEQ ID NO: 30030 - DNA, 20 bp, Artificial Sequence
  Description of Artificial Sequence: Synthetic oligonucleotide
  Target: SCN10A; (+) strand; PAM type: NRG; PAM sequence: CAG
ggtccaaagactgcaaagga

SEQ ID NO: 30031 - DNA, 20 bp, Artificial Sequence
  Description of Artificial Sequence: Synthetic oligonucleotide
  Target: SCN10A; (+) strand; PAM type: NRG; PAM sequence: AAG
gacagaaacttacatgaaaa

SEQ ID NO: 30032 - DNA, 20 bp, Artificial Sequence
  Description of Artificial Sequence: Synthetic oligonucleotide
  Target: SCN10A; (+) strand; PAM type: NRG; PAM sequence: TAG
catgaaaaaagttcccctgc

SEQ ID NO: 30033 - DNA, 20 bp, Artificial Sequence
  Description of Artificial Sequence: Synthetic oligonucleotide
  Target: SCN10A; (+) strand; PAM type: NRG; PAM sequence: AGG
atgaaaaaagttcccctgct

SEQ ID NO: 30034 - DNA, 20 bp, Artificial Sequence
  Description of Artificial Sequence: Synthetic oligonucleotide
  Target: SCN10A; (+) strand; PAM type: NRG; PAM sequence: AAG
ttcccctgctaggaactttg

SEQ ID NO: 30035 - DNA, 20 bp, Artificial Sequence
  Description of Artificial Sequence: Synthetic oligonucleotide
  Target: SCN10A; (+) strand; PAM type: NRG; PAM sequence: AGG
tcccctgctaggaactttga

SEQ ID NO: 30036 - DNA, 20 bp, Artificial Sequence
  Description of Artificial Sequence: Synthetic oligonucleotide
  Target: SCN10A; (+) strand; PAM type: NRG; PAM sequence: CAG
gctaggaactttgaaggtgc

SEQ ID NO: 30037 - DNA, 20 bp, Artificial Sequence
  Description of Artificial Sequence: Synthetic oligonucleotide
  Target: SCN10A; (+) strand; PAM type: NRG; PAM sequence: AGG
ctaggaactttgaaggtgcc

SEQ ID NO: 30038 - DNA, 20 bp, Artificial Sequence
  Description of Artificial Sequence: Synthetic oligonucleotide
  Target: SCN10A; (+) strand; PAM type: NRG; PAM sequence: GGG
taggaactttgaaggtgcca

SEQ ID NO: 30039 - DNA, 20 bp, Artificial Sequence
  Description of Artificial Sequence: Synthetic oligonucleotide
  Target: SCN10A; (+) strand; PAM type: NRG; PAM sequence: GAG
ggaactttgaaggtgccagg

SEQ ID NO: 30040 - DNA, 20 bp, Artificial Sequence
  Description of Artificial Sequence: Synthetic oligonucleotide
  Target: SCN10A; (+) strand; PAM type: NRG; PAM sequence: TAG
aaggtgccagggagatgtca

SEQ ID NO: 30041 - DNA, 20 bp, Artificial Sequence
  Description of Artificial Sequence: Synthetic oligonucleotide
  Target: SCN10A; (+) strand; PAM type: NRG; PAM sequence: CGG
ccagggagatgtcatagata

SEQ ID NO: 30042 - DNA, 20 bp, Artificial Sequence
  Description of Artificial Sequence: Synthetic oligonucleotide
  Target: SCN10A; (+) strand; PAM type: NRG; PAM sequence: GGG
cagggagatgtcatagatac

SEQ ID NO: 30043 - DNA, 20 bp, Artificial Sequence
  Description of Artificial Sequence: Synthetic oligonucleotide
  Target: SCN10A; (+) strand; PAM type: NRG; PAM sequence: GAG
gggctatgaccctgtcctgt

SEQ ID NO: 30044 - DNA, 20 bp, Artificial Sequence
  Description of Artificial Sequence: Synthetic oligonucleotide
  Target: SCN10A; (+) strand; PAM type: NRG; PAM sequence: TAG
gaccctgtcctgtgagatct

SEQ ID NO: 30045 - DNA, 20 bp, Artificial Sequence
  Description of Artificial Sequence: Synthetic oligonucleotide
  Target: SCN10A; (+) strand; PAM type: NRG; PAM sequence: CAG
gtgagatcttagccacacca

SEQ ID NO: 30046 - DNA, 20 bp, Artificial Sequence
  Description of Artificial Sequence: Synthetic oligonucleotide
  Target: SCN10A; (+) strand; PAM type: NRG; PAM sequence: TGG
gatcttagccacaccacaga

SEQ ID NO: 30047 - DNA, 20 bp, Artificial Sequence
  Description of Artificial Sequence: Synthetic oligonucleotide
  Target: SCN10A; (+) strand; PAM type: NRG; PAM sequence: TGG
cttagccacaccacagatgg

SEQ ID NO: 30048 - DNA, 20 bp, Artificial Sequence
  Description of Artificial Sequence: Synthetic oligonucleotide
  Target: SCN10A; (+) strand; PAM type: NRG; PAM sequence: GGG
ttagccacaccacagatggt

SEQ ID NO: 30049 - DNA, 20 bp, Artificial Sequence
  Description of Artificial Sequence: Synthetic oligonucleotide
  Target: SCN10A; (+) strand; PAM type: NRG; PAM sequence: CAG
cacagatggtgggctgaatt

SEQ ID NO: 30050 - DNA, 20 bp, Artificial Sequence
  Description of Artificial Sequence: Synthetic oligonucleotide
  Target: SCN10A; (+) strand; PAM type: NRG; PAM sequence: AGG
acagatggtgggctgaattc

SEQ ID NO: 30051 - DNA, 20 bp, Artificial Sequence
  Description of Artificial Sequence: Synthetic oligonucleotide
  Target: SCN10A; (+) strand; PAM type: NRG; PAM sequence: CAG
tggtgggctgaattcaggct

SEQ ID NO: 30052 - DNA, 20 bp, Artificial Sequence
  Description of Artificial Sequence: Synthetic oligonucleotide
  Target: SCN10A; (+) strand; PAM type: NRG; PAM sequence: TGG
aattcaggctcagcttatcc

SEQ ID NO: 30053 - DNA, 20 bp, Artificial Sequence
  Description of Artificial Sequence: Synthetic oligonucleotide
  Target: SCN10A; (+) strand; PAM type: NRG; PAM sequence: CAG
tcaggctcagcttatcctgg

SEQ ID NO: 30054 - DNA, 20 bp, Artificial Sequence
  Description of Artificial Sequence: Synthetic oligonucleotide
  Target: SCN10A; (+) strand; PAM type: NRG; PAM sequence: TAG
gctcagcttatcctggcagt

SEQ ID NO: 30055 - DNA, 20 bp, Artificial Sequence
  Description of Artificial Sequence: Synthetic oligonucleotide
  Target: SCN10A; (+) strand; PAM type: NRG; PAM sequence: AGG
ctcagcttatcctggcagtt

SEQ ID NO: 30056 - DNA, 20 bp, Artificial Sequence
  Description of Artificial Sequence: Synthetic oligonucleotide
  Target: SCN10A; (+) strand; PAM type: NRG; PAM sequence: TGG
agcttatcctggcagttagg

SEQ ID NO: 30057 - DNA, 20 bp, Artificial Sequence
  Description of Artificial Sequence: Synthetic oligonucleotide
  Target: SCN10A; (+) strand; PAM type: NRG; PAM sequence: GGG
gcttatcctggcagttaggt

SEQ ID NO: 30058 - DNA, 20 bp, Artificial Sequence
  Description of Artificial Sequence: Synthetic oligonucleotide
  Target: SCN10A; (+) strand; PAM type: NRG; PAM sequence: CAG
gcagttaggtgggatgcaca

SEQ ID NO: 30059 - DNA, 20 bp, Artificial Sequence
  Description of Artificial Sequence: Synthetic oligonucleotide
  Target: SCN10A; (+) strand; PAM type: NRG; PAM sequence: AGG
cagttaggtgggatgcacac

SEQ ID NO: 30060 - DNA, 20 bp, Artificial Sequence
  Description of Artificial Sequence: Synthetic oligonucleotide
  Target: SCN10A; (+) strand; PAM type: NRG; PAM sequence: GAG
gttaggtgggatgcacacag

SEQ ID NO: 30061 - DNA, 20 bp, Artificial Sequence
  Description of Artificial Sequence: Synthetic oligonucleotide
  Target: SCN10A; (+) strand; PAM type: NRG; PAM sequence: CAG
tgggatgcacacaggagctt

SEQ ID NO: 30062 - DNA, 20 bp, Artificial Sequence
  Description of Artificial Sequence: Synthetic oligonucleotide
  Target: SCN10A; (+) strand; PAM type: NRG; PAM sequence: AAG
tgcacacaggagcttcagaa

SEQ ID NO: 30063 - DNA, 20 bp, Artificial Sequence
  Description of Artificial Sequence: Synthetic oligonucleotide
  Target: SCN10A; (+) strand; PAM type: NRG; PAM sequence: AAG
acacaggagcttcagaaaag

SEQ ID NO: 30064 - DNA, 20 bp, Artificial Sequence
  Description of Artificial Sequence: Synthetic oligonucleotide
  Target: SCN10A; (+) strand; PAM type: NRG; PAM sequence: AGG
cacaggagcttcagaaaaga

SEQ ID NO: 30065 - DNA, 20 bp, Artificial Sequence
  Description of Artificial Sequence: Synthetic oligonucleotide
  Target: SCN10A; (+) strand; PAM type: NRG; PAM sequence: GGG
acaggagcttcagaaaagaa

SEQ ID NO: 30066 - DNA, 20 bp, Artificial Sequence
  Description of Artificial Sequence: Synthetic oligonucleotide
  Target: SCN10A; (+) strand; PAM type: NRG; PAM sequence: GAG
aaaagaagggctttatactt

SEQ ID NO: 30067 - DNA, 20 bp, Artificial Sequence
  Description of Artificial Sequence: Synthetic oligonucleotide
  Target: SCN10A; (+) strand; PAM type: NRG; PAM sequence: TGG
agaagggctttatacttgag

SEQ ID NO: 30068 - DNA, 20 bp, Artificial Sequence
  Description of Artificial Sequence: Synthetic oligonucleotide
  Target: SCN10A; (+) strand; PAM type: NRG; PAM sequence: CAG
agggctttatacttgagtgg

SEQ ID NO: 30069 - DNA, 20 bp, Artificial Sequence
  Description of Artificial Sequence: Synthetic oligonucleotide
  Target: SCN10A; (+) strand; PAM type: NRG; PAM sequence: GAG
ggctttatacttgagtggca

SEQ ID NO: 30070 - DNA, 20 bp, Artificial Sequence
  Description of Artificial Sequence: Synthetic oligonucleotide
  Target: SCN10A; (+) strand; PAM type: NRG; PAM sequence: AAG
tacttgagtggcagagcccc

SEQ ID NO: 30071 - DNA, 20 bp, Artificial Sequence
  Description of Artificial Sequence: Synthetic oligonucleotide
  Target: SCN10A; (+) strand; PAM type: NRG; PAM sequence: TGG
cccaagcaatgtccattctt

SEQ ID NO: 30072 - DNA, 20 bp, Artificial Sequence
  Description of Artificial Sequence: Synthetic oligonucleotide
  Target: SCN10A; (+) strand; PAM type: NRG; PAM sequence: GAG
gcaatgtccattctttggat

SEQ ID NO: 30073 - DNA, 20 bp, Artificial Sequence
  Description of Artificial Sequence: Synthetic oligonucleotide
  Target: SCN10A; (+) strand; PAM type: NRG; PAM sequence: TGG
atgtccattctttggatgag

SEQ ID NO: 30074 - DNA, 20 bp, Artificial Sequence
  Description of Artificial Sequence: Synthetic oligonucleotide
  Target: SCN10A; (+) strand; PAM type: NRG; PAM sequence: CAG
ggatgagtggcttattgcac

SEQ ID NO: 30075 - DNA, 20 bp, Artificial Sequence
  Description of Artificial Sequence: Synthetic oligonucleotide
  Target: SCN10A; (+) strand; PAM type: NRG; PAM sequence: AGG
gatgagtggcttattgcacc

SEQ ID NO: 30076 - DNA, 20 bp, Artificial Sequence
  Description of Artificial Sequence: Synthetic oligonucleotide
  Target: SCN10A; (+) strand; PAM type: NRG; PAM sequence: AAG
tggcttattgcaccaggaca

SEQ ID NO: 30077 - DNA, 20 bp, Artificial Sequence
  Description of Artificial Sequence: Synthetic oligonucleotide
  Target: SCN10A; (+) strand; PAM type: NRG; PAM sequence: CGG
attgcaccaggacaaagaac

SEQ ID NO: 30078 - DNA, 20 bp, Artificial Sequence
  Description of Artificial Sequence: Synthetic oligonucleotide
  Target: SCN10A; (+) strand; PAM type: NRG; PAM sequence: TGG
accaggacaaagaaccggaa

SEQ ID NO: 30079 - DNA, 20 bp, Artificial Sequence
  Description of Artificial Sequence: Synthetic oligonucleotide
  Target: SCN10A; (+) strand; PAM type: NRG; PAM sequence: AAG
aggacaaagaaccggaatgg

SEQ ID NO: 30080 - DNA, 20 bp, Artificial Sequence
  Description of Artificial Sequence: Synthetic oligonucleotide
  Target: SCN10A; (+) strand; PAM type: NRG; PAM sequence: AGG
ggacaaagaaccggaatgga

SEQ ID NO: 30081 - DNA, 20 bp, Artificial Sequence
  Description of Artificial Sequence: Synthetic oligonucleotide
  Target: SCN10A; (+) strand; PAM type: NRG; PAM sequence: GGG
gacaaagaaccggaatggaa

SEQ ID NO: 30082 - DNA, 20 bp, Artificial Sequence
  Description of Artificial Sequence: Synthetic oligonucleotide
  Target: SCN10A; (+) strand; PAM type: NRG; PAM sequence: AAG
ccctcttccttcattcatgc

SEQ ID NO: 30083 - DNA, 20 bp, Artificial Sequence
  Description of Artificial Sequence: Synthetic oligonucleotide
  Target: SCN10A; (+) strand; PAM type: NRG; PAM sequence: AGG
cctcttccttcattcatgca

SEQ ID NO: 30084 - DNA, 20 bp, Artificial Sequence
  Description of Artificial Sequence: Synthetic oligonucleotide
  Target: SCN10A; (+) strand; PAM type: NRG; PAM sequence: CAG
ccttcattcatgcaaggctc

SEQ ID NO: 30085 - DNA, 20 bp, Artificial Sequence
  Description of Artificial Sequence: Synthetic oligonucleotide
  Target: SCN10A; (+) strand; PAM type: NRG; PAM sequence: CAG
tcatgcaaggctccagacat

SEQ ID NO: 30086 - DNA, 20 bp, Artificial Sequence
  Description of Artificial Sequence: Synthetic oligonucleotide
  Target: SCN10A; (+) strand; PAM type: NRG; PAM sequence: CAG
tgcaaggctccagacatcag

SEQ ID NO: 30087 - DNA, 20 bp, Artificial Sequence
  Description of Artificial Sequence: Synthetic oligonucleotide
  Target: SCN10A; (+) strand; PAM type: NRG; PAM sequence: AGG
gcaaggctccagacatcagc

SEQ ID NO: 30088 - DNA, 20 bp, Artificial Sequence
  Description of Artificial Sequence: Synthetic oligonucleotide
  Target: SCN10A; (+) strand; PAM type: NRG; PAM sequence: GAG
ggctccagacatcagcaggt

SEQ ID NO: 30089 - DNA, 20 bp, Artificial Sequence
  Description of Artificial Sequence: Synthetic oligonucleotide
  Target: SCN10A; (+) strand; PAM type: NRG; PAM sequence: CAG
agacatcagcaggtgagacc

SEQ ID NO: 30090 - DNA, 20 bp, Artificial Sequence
  Description of Artificial Sequence: Synthetic oligonucleotide
  Target: SCN10A; (+) strand; PAM type: NRG; PAM sequence: TGG
gcaggtgagacccagctgcc

SEQ ID NO: 30091 - DNA, 20 bp, Artificial Sequence
  Description of Artificial Sequence: Synthetic oligonucleotide
  Target: SCN10A; (+) strand; PAM type: NRG; PAM sequence: GGG
caggtgagacccagctgcct

SEQ ID NO: 30092 - DNA, 20 bp, Artificial Sequence
  Description of Artificial Sequence: Synthetic oligonucleotide
  Target: SCN10A; (+) strand; PAM type: NRG; PAM sequence: GAG
acccagctgcctgggtgcat

SEQ ID NO: 30093 - DNA, 20 bp, Artificial Sequence
  Description of Artificial Sequence: Synthetic oligonucleotide
  Target: SCN10A; (+) strand; PAM type: NRG; PAM sequence: AGG
cccagctgcctgggtgcatg

SEQ ID NO: 30094 - DNA, 20 bp, Artificial Sequence
  Description of Artificial Sequence: Synthetic oligonucleotide
  Target: SCN10A; (+) strand; PAM type: NRG; PAM sequence: GGG
ccagctgcctgggtgcatga

SEQ ID NO: 30095 - DNA, 20 bp, Artificial Sequence
  Description of Artificial Sequence: Synthetic oligonucleotide
  Target: SCN10A; (+) strand; PAM type: NRG; PAM sequence: TAG
gctgcctgggtgcatgaggg

SEQ ID NO: 30096 - DNA, 20 bp, Artificial Sequence
  Description of Artificial Sequence: Synthetic oligonucleotide
  Target: SCN10A; (+) strand; PAM type: NRG; PAM sequence: AGG
ctgcctgggtgcatgagggt

SEQ ID NO: 30097 - DNA, 20 bp, Artificial Sequence
  Description of Artificial Sequence: Synthetic oligonucleotide
  Target: SCN10A; (+) strand; PAM type: NRG; PAM sequence: GGG
tgcctgggtgcatgagggta

SEQ ID NO: 30098 - DNA, 20 bp, Artificial Sequence
  Description of Artificial Sequence: Synthetic oligonucleotide
  Target: SCN10A; (+) strand; PAM type: NRG; PAM sequence: GAG
cctgggtgcatgagggtagg

SEQ ID NO: 30099 - DNA, 20 bp, Artificial Sequence
  Description of Artificial Sequence: Synthetic oligonucleotide
  Target: SCN10A; (+) strand; PAM type: NRG; PAM sequence: AGG
ctgggtgcatgagggtaggg

SEQ ID NO: 30100 - DNA, 20 bp, Artificial Sequence
  Description of Artificial Sequence: Synthetic oligonucleotide
  Target: SCN10A; (+) strand; PAM type: NRG; PAM sequence: TGG
tgcatgagggtagggaggtt

SEQ ID NO: 30101 - DNA, 20 bp, Artificial Sequence
  Description of Artificial Sequence: Synthetic oligonucleotide
  Target: SCN10A; (+) strand; PAM type: NRG; PAM sequence: GGG
gcatgagggtagggaggttt

SEQ ID NO: 30102 - DNA, 20 bp, Artificial Sequence
  Description of Artificial Sequence: Synthetic oligonucleotide
  Target: SCN10A; (+) strand; PAM type: NRG; PAM sequence: GGG
catgagggtagggaggtttg

SEQ ID NO: 30103 - DNA, 20 bp, Artificial Sequence
  Description of Artificial Sequence: Synthetic oligonucleotide
  Target: SCN10A; (+) strand; PAM type: NRG; PAM sequence: CAG
agggtagggaggtttggggc

SEQ ID NO: 30104 - DNA, 20 bp, Artificial Sequence
  Description of Artificial Sequence: Synthetic oligonucleotide
  Target: SCN10A; (+) strand; PAM type: NRG; PAM sequence: CAG
gttccatgctgaaccctatt

SEQ ID NO: 30105 - DNA, 20 bp, Artificial Sequence
  Description of Artificial Sequence: Synthetic oligonucleotide
  Target: SCN10A; (+) strand; PAM type: NRG; PAM sequence: CAG
accctattcagtcttttgct

SEQ ID NO: 30106 - DNA, 20 bp, Artificial Sequence
  Description of Artificial Sequence: Synthetic oligonucleotide
  Target: SCN10A; (+) strand; PAM type: NRG; PAM sequence: TGG
cagtcttttgctcagccccc

SEQ ID NO: 30107 - DNA, 20 bp, Artificial Sequence
  Description of Artificial Sequence: Synthetic oligonucleotide
  Target: SCN10A; (+) strand; PAM type: NRG; PAM sequence: GGG
agtcttttgctcagccccct

SEQ ID NO: 30108 - DNA, 20 bp, Artificial Sequence
  Description of Artificial Sequence: Synthetic oligonucleotide
  Target: SCN10A; (+) strand; PAM type: NRG; PAM sequence: AAG
cttttgctcagccccctggg

SEQ ID NO: 30109 - DNA, 20 bp, Artificial Sequence
  Description of Artificial Sequence: Synthetic oligonucleotide
  Target: SCN10A; (+) strand; PAM type: NRG; PAM sequence: TGG
cctgggaagtctgcctcaca

SEQ ID NO: 30110 - DNA, 20 bp, Artificial Sequence
  Description of Artificial Sequence: Synthetic oligonucleotide
  Target: SCN10A; (+) strand; PAM type: NRG; PAM sequence: CAG
tgcctcacatggataatctg

SEQ ID NO: 30111 - DNA, 20 bp, Artificial Sequence
  Description of Artificial Sequence: Synthetic oligonucleotide
  Target: SCN10A; (+) strand; PAM type: NRG; PAM sequence: TGG
tcacatggataatctgcagc

SEQ ID NO: 30112 - DNA, 20 bp, Artificial Sequence
  Description of Artificial Sequence: Synthetic oligonucleotide
  Target: SCN10A; (+) strand; PAM type: NRG; PAM sequence: GGG
cacatggataatctgcagct

SEQ ID NO: 30113 - DNA, 20 bp, Artificial Sequence
  Description of Artificial Sequence: Synthetic oligonucleotide
  Target: SCN10A; (+) strand; PAM type: NRG; PAM sequence: GGG
acatggataatctgcagctg

SEQ ID NO: 30114 - DNA, 20 bp, Artificial Sequence
  Description of Artificial Sequence: Synthetic oligonucleotide
  Target: SCN10A; (+) strand; PAM type: NRG; PAM sequence: CAG
tggataatctgcagctgggg

SEQ ID NO: 30115 - DNA, 20 bp, Artificial Sequence
  Description of Artificial Sequence: Synthetic oligonucleotide
  Target: SCN10A; (+) strand; PAM type: NRG; PAM sequence: CAG
taatctgcagctggggcaga

SEQ ID NO: 30116 - DNA, 20 bp, Artificial Sequence
  Description of Artificial Sequence: Synthetic oligonucleotide
  Target: SCN10A; (+) strand; PAM type: NRG; PAM sequence: AGG
aatctgcagctggggcagac

SEQ ID NO: 30117 - DNA, 20 bp, Artificial Sequence
  Description of Artificial Sequence: Synthetic oligonucleotide
  Target: SCN10A; (+) strand; PAM type: NRG; PAM sequence: CAG
agacaggtgctgtgcctctc

SEQ ID NO: 30118 - DNA, 20 bp, Artificial Sequence
  Description of Artificial Sequence: Synthetic oligonucleotide
  Target: SCN10A; (+) strand; PAM type: NRG; PAM sequence: AAG
ggtgctgtgcctctccagca

SEQ ID NO: 30119 - DNA, 20 bp, Artificial Sequence
  Description of Artificial Sequence: Synthetic oligonucleotide
  Target: SCN10A; (+) strand; PAM type: NRG; PAM sequence: AAG
ccagcaaagtctgtccaccc

SEQ ID NO: 30120 - DNA, 20 bp, Artificial Sequence
  Description of Artificial Sequence: Synthetic oligonucleotide
  Target: SCN10A; (+) strand; PAM type: NRG; PAM sequence: CAG
ccacctccattcccactgct

SEQ ID NO: 30121 - DNA, 20 bp, Artificial Sequence
  Description of Artificial Sequence: Synthetic oligonucleotide
  Target: SCN10A; (+) strand; PAM type: NRG; PAM sequence: TAG
attcccactgctcagcccac

SEQ ID NO: 30122 - DNA, 20 bp, Artificial Sequence
  Description of Artificial Sequence: Synthetic oligonucleotide
  Target: SCN10A; (+) strand; PAM type: NRG; PAM sequence: AAG
gctcagcccactagcctccc

SEQ ID NO: 30123 - DNA, 20 bp, Artificial Sequence
  Description of Artificial Sequence: Synthetic oligonucleotide
  Target: SCN10A; (+) strand; PAM type: NRG; PAM sequence: TAG
cagcccactagcctcccaag

SEQ ID NO: 30124 - DNA, 20 bp, Artificial Sequence
  Description of Artificial Sequence: Synthetic oligonucleotide
  Target: SCN10A; (+) strand; PAM type: NRG; PAM sequence: CAG
ctagcctcccaagtagtctc

SEQ ID NO: 30125 - DNA, 20 bp, Artificial Sequence
  Description of Artificial Sequence: Synthetic oligonucleotide
  Target: SCN10A; (+) strand; PAM type: NRG; PAM sequence: AGG
tagcctcccaagtagtctcc

SEQ ID NO: 30126 - DNA, 20 bp, Artificial Sequence
  Description of Artificial Sequence: Synthetic oligonucleotide
  Target: SCN10A; (+) strand; PAM type: NRG; PAM sequence: TAG
cccaagtagtctccaggccc

SEQ ID NO: 30127 - DNA, 20 bp, Artificial Sequence
  Description of Artificial Sequence: Synthetic oligonucleotide
  Target: SCN10A; (+) strand; PAM type: NRG; PAM sequence: TGG
ctcttactcccaaacatcac

SEQ ID NO: 30128 - DNA, 20 bp, Artificial Sequence
  Description of Artificial Sequence: Synthetic oligonucleotide
  Target: SCN10A; (+) strand; PAM type: NRG; PAM sequence: CAG
cactggtactttatcaccct

SEQ ID NO: 30129 - DNA, 20 bp, Artificial Sequence
  Description of Artificial Sequence: Synthetic oligonucleotide
  Target: SCN10A; (+) strand; PAM type: NRG; PAM sequence: AGG
actggtactttatcaccctc

SEQ ID NO: 30130 - DNA, 20 bp, Artificial Sequence
  Description of Artificial Sequence: Synthetic oligonucleotide
  Target: SCN10A; (+) strand; PAM type: NRG; PAM sequence: TAG
aggataaactccatactctg

SEQ ID NO: 30131 - DNA, 20 bp, Artificial Sequence
  Description of Artificial Sequence: Synthetic oligonucleotide
  Target: SCN10A; (+) strand; PAM type: NRG; PAM sequence: TGG
actctgtagcctgtgtcata

SEQ ID NO: 30132 - DNA, 20 bp, Artificial Sequence
  Description of Artificial Sequence: Synthetic oligonucleotide
  Target: SCN10A; (+) strand; PAM type: NRG; PAM sequence: CAG
atggtcacaacctacttttc

SEQ ID NO: 30133 - DNA, 20 bp, Artificial Sequence
  Description of Artificial Sequence: Synthetic oligonucleotide
  Target: SCN10A; (+) strand; PAM type: NRG; PAM sequence: GAG
cccaaatcaaattgttccct

SEQ ID NO: 30134 - DNA, 20 bp, Artificial Sequence
  Description of Artificial Sequence: Synthetic oligonucleotide
  Target: SCN10A; (+) strand; PAM type: NRG; PAM sequence: AAG
ttgtgtctgtgcctttgttc

SEQ ID NO: 30135 - DNA, 20 bp, Artificial Sequence
  Description of Artificial Sequence: Synthetic oligonucleotide
  Target: SCN10A; (+) strand; PAM type: NRG; PAM sequence: AGG
tgtgtctgtgcctttgttca

SEQ ID NO: 30136 - DNA, 20 bp, Artificial Sequence
  Description of Artificial Sequence: Synthetic oligonucleotide
  Target: SCN10A; (+) strand; PAM type: NRG; PAM sequence: CAG
tctgtgcctttgttcaaggt

SEQ ID NO: 30137 - DNA, 20 bp, Artificial Sequence
  Description of Artificial Sequence: Synthetic oligonucleotide
  Target: SCN10A; (+) strand; PAM type: NRG; PAM sequence: TAG
ctttgttcaaggtcagcctt

SEQ ID NO: 30138 - DNA, 20 bp, Artificial Sequence
  Description of Artificial Sequence: Synthetic oligonucleotide
  Target: SCN10A; (+) strand; PAM type: NRG; PAM sequence: AAG
ttcaaggtcagcctttagct

SEQ ID NO: 30139 - DNA, 20 bp, Artificial Sequence
  Description of Artificial Sequence: Synthetic oligonucleotide
  Target: SCN10A; (+) strand; PAM type: NRG; PAM sequence: CGG
aggtcagcctttagctaaga

SEQ ID NO: 30140 - DNA, 20 bp, Artificial Sequence
  Description of Artificial Sequence: Synthetic oligonucleotide
  Target: SCN10A; (+) strand; PAM type: NRG; PAM sequence: GGG
ggtcagcctttagctaagac

SEQ ID NO: 30141 - DNA, 20 bp, Artificial Sequence
  Description of Artificial Sequence: Synthetic oligonucleotide
  Target: SCN10A; (+) strand; PAM type: NRG; PAM sequence: CAG
tagctaagacgggccttccc

SEQ ID NO: 30142 - DNA, 20 bp, Artificial Sequence
  Description of Artificial Sequence: Synthetic oligonucleotide
  Target: SCN10A; (+) strand; PAM type: NRG; PAM sequence: CAG
ggccttccccagtcctctcg

SEQ ID NO: 30143 - DNA, 20 bp, Artificial Sequence
  Description of Artificial Sequence: Synthetic oligonucleotide
  Target: SCN10A; (+) strand; PAM type: NRG; PAM sequence: TGG
ccagtcctctcgcagctcct

SEQ ID NO: 30144 - DNA, 20 bp, Artificial Sequence
  Description of Artificial Sequence: Synthetic oligonucleotide
  Target: SCN10A; (+) strand; PAM type: NRG; PAM sequence: TAG
acatctaatgccacctccca

SEQ ID NO: 30145 - DNA, 20 bp, Artificial Sequence
  Description of Artificial Sequence: Synthetic oligonucleotide
  Target: SCN10A; (+) strand; PAM type: NRG; PAM sequence: AGG
catctaatgccacctcccat

SEQ ID NO: 30146 - DNA, 20 bp, Artificial Sequence
  Description of Artificial Sequence: Synthetic oligonucleotide
  Target: SCN10A; (+) strand; PAM type: NRG; PAM sequence: AAG
ctaatgccacctcccatagg

SEQ ID NO: 30147 - DNA, 20 bp, Artificial Sequence
  Description of Artificial Sequence: Synthetic oligonucleotide
  Target: SCN10A; (+) strand; PAM type: NRG; PAM sequence: AAG
attctcaaccaccccacccc

SEQ ID NO: 30148 - DNA, 20 bp, Artificial Sequence
  Description of Artificial Sequence: Synthetic oligonucleotide
  Target: SCN10A; (+) strand; PAM type: NRG; PAM sequence: GAG
tctcaaccaccccaccccaa

SEQ ID NO: 30149 - DNA, 20 bp, Artificial Sequence
  Description of Artificial Sequence: Synthetic oligonucleotide
  Target: SCN10A; (+) strand; PAM type: NRG; PAM sequence: TGG
caaccaccccaccccaagag

SEQ ID NO: 30150 - DNA, 20 bp, Artificial Sequence
  Description of Artificial Sequence: Synthetic oligonucleotide
  Target: SCN10A; (+) strand; PAM type: NRG; PAM sequence: AAG
ccaccccaccccaagagtgg

SEQ ID NO: 30151 - DNA, 20 bp, Artificial Sequence
  Description of Artificial Sequence: Synthetic oligonucleotide
  Target: SCN10A; (+) strand; PAM type: NRG; PAM sequence: AAG
ccccaccccaagagtggaag

SEQ ID NO: 30152 - DNA, 20 bp, Artificial Sequence
  Description of Artificial Sequence: Synthetic oligonucleotide
  Target: SCN10A; (+) strand; PAM type: NRG; PAM sequence: AGG
cccaccccaagagtggaaga

SEQ ID NO: 30153 - DNA, 20 bp, Artificial Sequence
  Description of Artificial Sequence: Synthetic oligonucleotide
  Target: SCN10A; (+) strand; PAM type: NRG; PAM sequence: AAG
gctcatgtctctgtgtctcc

SEQ ID NO: 30154 - DNA, 20 bp, Artificial Sequence
  Description of Artificial Sequence: Synthetic oligonucleotide
  Target: SCN10A; (+) strand; PAM type: NRG; PAM sequence: CAG
tccaagatactaattgcccc

SEQ ID NO: 30155 - DNA, 20 bp, Artificial Sequence
  Description of Artificial Sequence: Synthetic oligonucleotide
  Target: SCN10A; (+) strand; PAM type: NRG; PAM sequence: CAG
aagatactaattgcccccag

SEQ ID NO: 30156 - DNA, 20 bp, Artificial Sequence
  Description of Artificial Sequence: Synthetic oligonucleotide
  Target: SCN10A; (+) strand; PAM type: NRG; PAM sequence: AAG
atgtgtgtcttgtctgctga

SEQ ID NO: 30157 - DNA, 20 bp, Artificial Sequence
  Description of Artificial Sequence: Synthetic oligonucleotide
  Target: SCN10A; (+) strand; PAM type: NRG; PAM sequence: AAG
tcttgtctgctgaaagacta

SEQ ID NO: 30158 - DNA, 20 bp, Artificial Sequence
  Description of Artificial Sequence: Synthetic oligonucleotide
  Target: SCN10A; (+) strand; PAM type: NRG; PAM sequence: AAG
ctgctgaaagactaaagtgt

SEQ ID NO: 30159 - DNA, 20 bp, Artificial Sequence
  Description of Artificial Sequence: Synthetic oligonucleotide
  Target: SCN10A; (+) strand; PAM type: NRG; PAM sequence: TGG
aagactaaagtgtaagatcc

SEQ ID NO: 30160 - DNA, 20 bp, Artificial Sequence
  Description of Artificial Sequence: Synthetic oligonucleotide
  Target: SCN10A; (+) strand; PAM type: NRG; PAM sequence: GAG
gactaaagtgtaagatcctg

SEQ ID NO: 30161 - DNA, 20 bp, Artificial Sequence
  Description of Artificial Sequence: Synthetic oligonucleotide
  Target: SCN10A; (+) strand; PAM type: NRG; PAM sequence: TAG
aaagtgtaagatcctggaga

SEQ ID NO: 30162 - DNA, 20 bp, Artificial Sequence
  Description of Artificial Sequence: Synthetic oligonucleotide
  Target: SCN10A; (+) strand; PAM type: NRG; PAM sequence: GAG
tgtaagatcctggagatagt

SEQ ID NO: 30163 - DNA, 20 bp, Artificial Sequence
  Description of Artificial Sequence: Synthetic oligonucleotide
  Target: SCN10A; (+) strand; PAM type: NRG; PAM sequence: AAG
ctgtgcttctgtttcttaca

SEQ ID NO: 30164 - DNA, 20 bp, Artificial Sequence
  Description of Artificial Sequence: Synthetic oligonucleotide
  Target: SCN10A; (+) strand; PAM type: NRG; PAM sequence: AAG
tttcttacaaagcacttcat

SEQ ID NO: 30165 - DNA, 20 bp, Artificial Sequence
  Description of Artificial Sequence: Synthetic oligonucleotide
  Target: SCN10A; (+) strand; PAM type: NRG; PAM sequence: TAG
taagacaatcctgtattcaa

SEQ ID NO: 30166 - DNA, 20 bp, Artificial Sequence
  Description of Artificial Sequence: Synthetic oligonucleotide
  Target: SCN10A; (+) strand; PAM type: NRG; PAM sequence: TAG
acaatcctgtattcaatagt

SEQ ID NO: 30167 - DNA, 20 bp, Artificial Sequence
  Description of Artificial Sequence: Synthetic oligonucleotide
  Target: SCN10A; (+) strand; PAM type: NRG; PAM sequence: TAG
gtattcaatagttagatgta

SEQ ID NO: 30168 - DNA, 20 bp, Artificial Sequence
  Description of Artificial Sequence: Synthetic oligonucleotide
  Target: SCN10A; (+) strand; PAM type: NRG; PAM sequence: TGG
atagttagatgtatagcaaa

SEQ ID NO: 30169 - DNA, 20 bp, Artificial Sequence
  Description of Artificial Sequence: Synthetic oligonucleotide
  Target: SCN10A; (+) strand; PAM type: NRG; PAM sequence: AAG
gttagatgtatagcaaatgg

SEQ ID NO: 30170 - DNA, 20 bp, Artificial Sequence
  Description of Artificial Sequence: Synthetic oligonucleotide
  Target: SCN10A; (+) strand; PAM type: NRG; PAM sequence: TAG
tatagcaaatggaagaaaaa

SEQ ID NO: 30171 - DNA, 20 bp, Artificial Sequence
  Description of Artificial Sequence: Synthetic oligonucleotide
  Target: SCN10A; (+) strand; PAM type: NRG; PAM sequence: AGG
atagcaaatggaagaaaaat

SEQ ID NO: 30172 - DNA, 20 bp, Artificial Sequence
  Description of Artificial Sequence: Synthetic oligonucleotide
  Target: SCN10A; (+) strand; PAM type: NRG; PAM sequence: TGG
tggaagaaaaataggatcat

SEQ ID NO: 30173 - DNA, 20 bp, Artificial Sequence
  Description of Artificial Sequence: Synthetic oligonucleotide
  Target: SCN10A; (+) strand; PAM type: NRG; PAM sequence: GGG
ggaagaaaaataggatcatt

SEQ ID NO: 30174 - DNA, 20 bp, Artificial Sequence
  Description of Artificial Sequence: Synthetic oligonucleotide
  Target: SCN10A; (+) strand; PAM type: NRG; PAM sequence: TGG
gaaaaataggatcattggga

SEQ ID NO: 30175 - DNA, 20 bp, Artificial Sequence
  Description of Artificial Sequence: Synthetic oligonucleotide
  Target: SCN10A; (+) strand; PAM type: NRG; PAM sequence: TAG
aataggatcattgggatggc

SEQ ID NO: 30176 - DNA, 20 bp, Artificial Sequence
  Description of Artificial Sequence: Synthetic oligonucleotide
  Target: SCN10A; (+) strand; PAM type: NRG; PAM sequence: AAG
aggatcattgggatggctag

SEQ ID NO: 30177 - DNA, 20 bp, Artificial Sequence
  Description of Artificial Sequence: Synthetic oligonucleotide
  Target: SCN10A; (+) strand; PAM type: NRG; PAM sequence: AGG
ggatcattgggatggctaga

SEQ ID NO: 30178 - DNA, 20 bp, Artificial Sequence
  Description of Artificial Sequence: Synthetic oligonucleotide
  Target: SCN10A; (+) strand; PAM type: NRG; PAM sequence: AAG
cattgggatggctagaagga

SEQ ID NO: 30179 - DNA, 20 bp, Artificial Sequence
  Description of Artificial Sequence: Synthetic oligonucleotide
  Target: SCN10A; (+) strand; PAM type: NRG; PAM sequence: AAG
gggatggctagaaggaaaga

SEQ ID NO: 30180 - DNA, 20 bp, Artificial Sequence
  Description of Artificial Sequence: Synthetic oligonucleotide
  Target: SCN10A; (+) strand; PAM type: NRG; PAM sequence: AAG
tggctagaaggaaagaaaga

SEQ ID NO: 30181 - DNA, 20 bp, Artificial Sequence
  Description of Artificial Sequence: Synthetic oligonucleotide
  Target: SCN10A; (+) strand; PAM type: NRG; PAM sequence: AAG
ctagaaggaaagaaagaaag

SEQ ID NO: 30182 - DNA, 20 bp, Artificial Sequence
  Description of Artificial Sequence: Synthetic oligonucleotide
  Target: SCN10A; (+) strand; PAM type: NRG; PAM sequence: CAG
aggaaagaaagaaagaagta

SEQ ID NO: 30183 - DNA, 20 bp, Artificial Sequence
  Description of Artificial Sequence: Synthetic oligonucleotide
  Target: SCN10A; (+) strand; PAM type: NRG; PAM sequence: TGG
aagaaagaaagaagtacagc

SEQ ID NO: 30184 - DNA, 20 bp, Artificial Sequence
  Description of Artificial Sequence: Synthetic oligonucleotide
  Target: SCN10A; (+) strand; PAM type: NRG; PAM sequence: AAG
aagaagtacagctggatgaa

SEQ ID NO: 30185 - DNA, 20 bp, Artificial Sequence
  Description of Artificial Sequence: Synthetic oligonucleotide
  Target: SCN10A; (+) strand; PAM type: NRG; PAM sequence: AAG
tacagctggatgaaaagttg

SEQ ID NO: 30186 - DNA, 20 bp, Artificial Sequence
  Description of Artificial Sequence: Synthetic oligonucleotide
  Target: SCN10A; (+) strand; PAM type: NRG; PAM sequence: AGG
acagctggatgaaaagttga

SEQ ID NO: 30187 - DNA, 20 bp, Artificial Sequence
  Description of Artificial Sequence: Synthetic oligonucleotide
  Target: SCN10A; (+) strand; PAM type: NRG; PAM sequence: GGG
cagctggatgaaaagttgaa

SEQ ID NO: 30188 - DNA, 20 bp, Artificial Sequence
  Description of Artificial Sequence: Synthetic oligonucleotide
  Target: SCN10A; (+) strand; PAM type: NRG; PAM sequence: TAG
aaagttgaagggtgattgca

SEQ ID NO: 30189 - DNA, 20 bp, Artificial Sequence
  Description of Artificial Sequence: Synthetic oligonucleotide
  Target: SCN10A; (+) strand; PAM type: NRG; PAM sequence: GAG
agttgaagggtgattgcata

SEQ ID NO: 30190 - DNA, 20 bp, Artificial Sequence
  Description of Artificial Sequence: Synthetic oligonucleotide
  Target: SCN10A; (+) strand; PAM type: NRG; PAM sequence: AGG
gttgaagggtgattgcatag

SEQ ID NO: 30191 - DNA, 20 bp, Artificial Sequence
  Description of Artificial Sequence: Synthetic oligonucleotide
  Target: SCN10A; (+) strand; PAM type: NRG; PAM sequence: GGG
ttgaagggtgattgcataga

SEQ ID NO: 30192 - DNA, 20 bp, Artificial Sequence
  Description of Artificial Sequence: Synthetic oligonucleotide
  Target: SCN10A; (+) strand; PAM type: NRG; PAM sequence: AAG
ttgcatagagggatgaatta

SEQ ID NO: 30193 - DNA, 20 bp, Artificial Sequence
  Description of Artificial Sequence: Synthetic oligonucleotide
  Target: SCN10A; (+) strand; PAM type: NRG; PAM sequence: AGG
tgcatagagggatgaattaa

SEQ ID NO: 30194 - DNA, 20 bp, Artificial Sequence
  Description of Artificial Sequence: Synthetic oligonucleotide
  Target: SCN10A; (+) strand; PAM type: NRG; PAM sequence: TAG
ttaaaggatacaatgataaa

SEQ ID NO: 30195 - DNA, 20 bp, Artificial Sequence
  Description of Artificial Sequence: Synthetic oligonucleotide
  Target: SCN10A; (+) strand; PAM type: NRG; PAM sequence: AGG
taaaggatacaatgataaat

SEQ ID NO: 30196 - DNA, 20 bp, Artificial Sequence
  Description of Artificial Sequence: Synthetic oligonucleotide
  Target: SCN10A; (+) strand; PAM type: NRG; PAM sequence: TAG
ggatacaatgataaatagga

SEQ ID NO: 30197 - DNA, 20 bp, Artificial Sequence
  Description of Artificial Sequence: Synthetic oligonucleotide
  Target: SCN10A; (+) strand; PAM type: NRG; PAM sequence: TAG
aatgtataacatgaatacta

SEQ ID NO: 30198 - DNA, 20 bp, Artificial Sequence
  Description of Artificial Sequence: Synthetic oligonucleotide
  Target: SCN10A; (+) strand; PAM type: NRG; PAM sequence: TAG
atgaatactatagttaataa

SEQ ID NO: 30199 - DNA, 20 bp, Artificial Sequence
  Description of Artificial Sequence: Synthetic oligonucleotide
  Target: SCN10A; (+) strand; PAM type: NRG; PAM sequence: CAG
taataatagcatattgtttt

SEQ ID NO: 30200 - DNA, 20 bp, Artificial Sequence
  Description of Artificial Sequence: Synthetic oligonucleotide
  Target: SCN10A; (+) strand; PAM type: NRG; PAM sequence: GAG
tttcagtatttttgctcgct

SEQ ID NO: 30201 - DNA, 20 bp, Artificial Sequence
  Description of Artificial Sequence: Synthetic oligonucleotide
  Target: SCN10A; (+) strand; PAM type: NRG; PAM sequence: TAG
ttttgctcgctgagtaatta

SEQ ID NO: 30202 - DNA, 20 bp, Artificial Sequence
  Description of Artificial Sequence: Synthetic oligonucleotide
  Target: SCN10A; (+) strand; PAM type: NRG; PAM sequence: CAG
aattatagctgctcttgcca

SEQ ID NO: 30203 - DNA, 20 bp, Artificial Sequence
  Description of Artificial Sequence: Synthetic oligonucleotide
  Target: SCN10A; (+) strand; PAM type: NRG; PAM sequence: AGG
attatagctgctcttgccac

SEQ ID NO: 30204 - DNA, 20 bp, Artificial Sequence
  Description of Artificial Sequence: Synthetic oligonucleotide
  Target: SCN10A; (+) strand; PAM type: NRG; PAM sequence: GGG
ttatagctgctcttgccaca

SEQ ID NO: 30205 - DNA, 20 bp, Artificial Sequence
  Description of Artificial Sequence: Synthetic oligonucleotide
  Target: SCN10A; (+) strand; PAM type: NRG; PAM sequence: GGG
tatagctgctcttgccacag

SEQ ID NO: 30206 - DNA, 20 bp, Artificial Sequence
  Description of Artificial Sequence: Synthetic oligonucleotide
  Target: SCN10A; (+) strand; PAM type: NRG; PAM sequence: GGG
atagctgctcttgccacagg

SEQ ID NO: 30207 - DNA, 20 bp, Artificial Sequence
  Description of Artificial Sequence: Synthetic oligonucleotide
  Target: SCN10A; (+) strand; PAM type: NRG; PAM sequence: GAG
agctgctcttgccacagggg

SEQ ID NO: 30208 - DNA, 20 bp, Artificial Sequence
  Description of Artificial Sequence: Synthetic oligonucleotide
  Target: SCN10A; (+) strand; PAM type: NRG; PAM sequence: TGG
tcttgccacagggggagaaa

SEQ ID NO: 30209 - DNA, 20 bp, Artificial Sequence
  Description of Artificial Sequence: Synthetic oligonucleotide
  Target: SCN10A; (+) strand; PAM type: NRG; PAM sequence: GGG
cttgccacagggggagaaat

SEQ ID NO: 30210 - DNA, 20 bp, Artificial Sequence
  Description of Artificial Sequence: Synthetic oligonucleotide
  Target: SCN10A; (+) strand; PAM type: NRG; PAM sequence: GAG
ggagaaatgggtaactatgt

SEQ ID NO: 30211 - DNA, 20 bp, Artificial Sequence
  Description of Artificial Sequence: Synthetic oligonucleotide
  Target: SCN10A; (+) strand; PAM type: NRG; PAM sequence: TGG
tgggtaactatgtgagatga

SEQ ID NO: 30212 - DNA, 20 bp, Artificial Sequence
  Description of Artificial Sequence: Synthetic oligonucleotide
  Target: SCN10A; (+) strand; PAM type: NRG; PAM sequence: TAG
tatgttaatatgttccacta

SEQ ID NO: 30213 - DNA, 20 bp, Artificial Sequence
  Description of Artificial Sequence: Synthetic oligonucleotide
  Target: SCN10A; (+) strand; PAM type: NRG; PAM sequence: TGG
gtatcccttaaaaattgata

SEQ ID NO: 30214 - DNA, 20 bp, Artificial Sequence
  Description of Artificial Sequence: Synthetic oligonucleotide
  Target: SCN10A; (+) strand; PAM type: NRG; PAM sequence: TGG
ccttaaaaattgatatggtt

SEQ ID NO: 30215 - DNA, 20 bp, Artificial Sequence
  Description of Artificial Sequence: Synthetic oligonucleotide
  Target: SCN10A; (+) strand; PAM type: NRG; PAM sequence: TGG
tcttgaattcccatgtgttg

SEQ ID NO: 30216 - DNA, 20 bp, Artificial Sequence
  Description of Artificial Sequence: Synthetic oligonucleotide
  Target: SCN10A; (+) strand; PAM type: NRG; PAM sequence: GGG
cttgaattcccatgtgttgt

SEQ ID NO: 30217 - DNA, 20 bp, Artificial Sequence
  Description of Artificial Sequence: Synthetic oligonucleotide
  Target: SCN10A; (+) strand; PAM type: NRG; PAM sequence: GAG
tgaattcccatgtgttgtgg

SEQ ID NO: 30218 - DNA, 20 bp, Artificial Sequence
  Description of Artificial Sequence: Synthetic oligonucleotide
  Target: SCN10A; (+) strand; PAM type: NRG; PAM sequence: AGG
gaattcccatgtgttgtggg

SEQ ID NO: 30219 - DNA, 20 bp, Artificial Sequence
  Description of Artificial Sequence: Synthetic oligonucleotide
  Target: SCN10A; (+) strand; PAM type: NRG; PAM sequence: GGG
aattcccatgtgttgtggga

SEQ ID NO: 30220 - DNA, 20 bp, Artificial Sequence
  Description of Artificial Sequence: Synthetic oligonucleotide
  Target: SCN10A; (+) strand; PAM type: NRG; PAM sequence: GGG
attcccatgtgttgtgggag

SEQ ID NO: 30221 - DNA, 20 bp, Artificial Sequence
  Description of Artificial Sequence: Synthetic oligonucleotide
  Target: SCN10A; (+) strand; PAM type: NRG; PAM sequence: GAG
tcccatgtgttgtgggaggg

SEQ ID NO: 30222 - DNA, 20 bp, Artificial Sequence
  Description of Artificial Sequence: Synthetic oligonucleotide
  Target: SCN10A; (+) strand; PAM type: NRG; PAM sequence: AGG
cccatgtgttgtgggagggg

SEQ ID NO: 30223 - DNA, 20 bp, Artificial Sequence
  Description of Artificial Sequence: Synthetic oligonucleotide
  Target: SCN10A; (+) strand; PAM type: NRG; PAM sequence: GGG
ccatgtgttgtgggagggga

SEQ ID NO: 30224 - DNA, 20 bp, Artificial Sequence
  Description of Artificial Sequence: Synthetic oligonucleotide
  Target: SCN10A; (+) strand; PAM type: NRG; PAM sequence: TGG
gtgggaggggagggaccctg

SEQ ID NO: 30225 - DNA, 20 bp, Artificial Sequence
  Description of Artificial Sequence: Synthetic oligonucleotide
  Target: SCN10A; (+) strand; PAM type: NRG; PAM sequence: GGG
tgggaggggagggaccctgt

SEQ ID NO: 30226 - DNA, 20 bp, Artificial Sequence
  Description of Artificial Sequence: Synthetic oligonucleotide
  Target: SCN10A; (+) strand; PAM type: NRG; PAM sequence: GAG
ggaggggagggaccctgtgg

SEQ ID NO: 30227 - DNA, 20 bp, Artificial Sequence
  Description of Artificial Sequence: Synthetic oligonucleotide
  Target: SCN10A; (+) strand; PAM type: NRG; PAM sequence: AGG
gaggggagggaccctgtggg

SEQ ID NO: 30228 - DNA, 20 bp, Artificial Sequence
  Description of Artificial Sequence: Synthetic oligonucleotide
  Target: SCN10A; (+) strand; PAM type: NRG; PAM sequence: AAG
ggagggaccctgtgggaggt

SEQ ID NO: 30229 - DNA, 20 bp, Artificial Sequence
  Description of Artificial Sequence: Synthetic oligonucleotide
  Target: SCN10A; (+) strand; PAM type: NRG; PAM sequence: TGG
tgtgggaggtaagtgaatca

SEQ ID NO: 30230 - DNA, 20 bp, Artificial Sequence
  Description of Artificial Sequence: Synthetic oligonucleotide
  Target: SCN10A; (+) strand; PAM type: NRG; PAM sequence: GGG
gtgggaggtaagtgaatcat

SEQ ID NO: 30231 - DNA, 20 bp, Artificial Sequence
  Description of Artificial Sequence: Synthetic oligonucleotide
  Target: SCN10A; (+) strand; PAM type: NRG; PAM sequence: GAG
gggaggtaagtgaatcatgg

SEQ ID NO: 30232 - DNA, 20 bp, Artificial Sequence
  Description of Artificial Sequence: Synthetic oligonucleotide
  Target: SCN10A; (+) strand; PAM type: NRG; PAM sequence: CAG
aggtaagtgaatcatgggag

SEQ ID NO: 30233 - DNA, 20 bp, Artificial Sequence
  Description of Artificial Sequence: Synthetic oligonucleotide
  Target: SCN10A; (+) strand; PAM type: NRG; PAM sequence: AGG
ggtaagtgaatcatgggagc

SEQ ID NO: 30234 - DNA, 20 bp, Artificial Sequence
  Description of Artificial Sequence: Synthetic oligonucleotide
  Target: SCN10A; (+) strand; PAM type: NRG; PAM sequence: TAG
ttcccatgctgttctcatga

SEQ ID NO: 30235 - DNA, 20 bp, Artificial Sequence
  Description of Artificial Sequence: Synthetic oligonucleotide
  Target: SCN10A; (+) strand; PAM type: NRG; PAM sequence: AAG
ctgttctcatgatagtgaat

SEQ ID NO: 30236 - DNA, 20 bp, Artificial Sequence
  Description of Artificial Sequence: Synthetic oligonucleotide
  Target: SCN10A; (+) strand; PAM type: NRG; PAM sequence: GAG
tgatagtgaataagtttcat

SEQ ID NO: 30237 - DNA, 20 bp, Artificial Sequence
  Description of Artificial Sequence: Synthetic oligonucleotide
  Target: SCN10A; (+) strand; PAM type: NRG; PAM sequence: CGG
ataagtttcatgagatgtga

SEQ ID NO: 30238 - DNA, 20 bp, Artificial Sequence
  Description of Artificial Sequence: Synthetic oligonucleotide
  Target: SCN10A; (+) strand; PAM type: NRG; PAM sequence: AAG
atgagatgtgacggtattat

SEQ ID NO: 30239 - DNA, 20 bp, Artificial Sequence
  Description of Artificial Sequence: Synthetic oligonucleotide
  Target: SCN10A; (+) strand; PAM type: NRG; PAM sequence: AGG
tgagatgtgacggtattata

SEQ ID NO: 30240 - DNA, 20 bp, Artificial Sequence
  Description of Artificial Sequence: Synthetic oligonucleotide
  Target: SCN10A; (+) strand; PAM type: NRG; PAM sequence: GGG
gagatgtgacggtattataa

SEQ ID NO: 30241 - DNA, 20 bp, Artificial Sequence
  Description of Artificial Sequence: Synthetic oligonucleotide
  Target: SCN10A; (+) strand; PAM type: NRG; PAM sequence: GGG
agatgtgacggtattataag

SEQ ID NO: 30242 - DNA, 20 bp, Artificial Sequence
  Description of Artificial Sequence: Synthetic oligonucleotide
  Target: SCN10A; (+) strand; PAM type: NRG; PAM sequence: GGG
gatgtgacggtattataagg

SEQ ID NO: 30243 - DNA, 20 bp, Artificial Sequence
  Description of Artificial Sequence: Synthetic oligonucleotide
  Target: SCN10A; (+) strand; PAM type: NRG; PAM sequence: GAG
tgtgacggtattataagggg

SEQ ID NO: 30244 - DNA, 20 bp, Artificial Sequence
  Description of Artificial Sequence: Synthetic oligonucleotide
  Target: SCN10A; (+) strand; PAM type: NRG; PAM sequence: AAG
ttgcctgctgccatccacat

SEQ ID NO: 30245 - DNA, 20 bp, Artificial Sequence
  Description of Artificial Sequence: Synthetic oligonucleotide
  Target: SCN10A; (+) strand; PAM type: NRG; PAM sequence: AAG
tttccttttgccatgattgt

SEQ ID NO: 30246 - DNA, 20 bp, Artificial Sequence
  Description of Artificial Sequence: Synthetic oligonucleotide
  Target: SCN10A; (+) strand; PAM type: NRG; PAM sequence: AGG
ttccttttgccatgattgta

SEQ ID NO: 30247 - DNA, 20 bp, Artificial Sequence
  Description of Artificial Sequence: Synthetic oligonucleotide
  Target: SCN10A; (+) strand; PAM type: NRG; PAM sequence: CAG
ccatgattgtaaggcttccc

SEQ ID NO: 30248 - DNA, 20 bp, Artificial Sequence
  Description of Artificial Sequence: Synthetic oligonucleotide
  Target: SCN10A; (+) strand; PAM type: NRG; PAM sequence: AAG
aaggcttccccagccatgtg

SEQ ID NO: 30249 - DNA, 20 bp, Artificial Sequence
  Description of Artificial Sequence: Synthetic oligonucleotide
  Target: SCN10A; (+) strand; PAM type: NRG; PAM sequence: AAG
ccccagccatgtgaagctgt

SEQ ID NO: 30250 - DNA, 20 bp, Artificial Sequence
  Description of Artificial Sequence: Synthetic oligonucleotide
  Target: SCN10A; (+) strand; PAM type: NRG; PAM sequence: CAG
tctttcttttataaattgcc

SEQ ID NO: 30251 - DNA, 20 bp, Artificial Sequence
  Description of Artificial Sequence: Synthetic oligonucleotide
  Target: SCN10A; (+) strand; PAM type: NRG; PAM sequence: TAG
ttttataaattgcccagtct

SEQ ID NO: 30252 - DNA, 20 bp, Artificial Sequence
  Description of Artificial Sequence: Synthetic oligonucleotide
  Target: SCN10A; (+) strand; PAM type: NRG; PAM sequence: AGG
tttataaattgcccagtctt

SEQ ID NO: 30253 - DNA, 20 bp, Artificial Sequence
  Description of Artificial Sequence: Synthetic oligonucleotide
  Target: SCN10A; (+) strand; PAM type: NRG; PAM sequence: CAG
agtcttaggtatgtctttat

SEQ ID NO: 30254 - DNA, 20 bp, Artificial Sequence
  Description of Artificial Sequence: Synthetic oligonucleotide
  Target: SCN10A; (+) strand; PAM type: NRG; PAM sequence: CAG
cttaggtatgtctttatcag

SEQ ID NO: 30255 - DNA, 20 bp, Artificial Sequence
  Description of Artificial Sequence: Synthetic oligonucleotide
  Target: SCN10A; (+) strand; PAM type: NRG; PAM sequence: TAG
ctttatcagcagcatgaaaa

SEQ ID NO: 30256 - DNA, 20 bp, Artificial Sequence
  Description of Artificial Sequence: Synthetic oligonucleotide
  Target: SCN10A; (+) strand; PAM type: NRG; PAM sequence: AAG
tatattttttaaaattttaa

SEQ ID NO: 30257 - DNA, 20 bp, Artificial Sequence
  Description of Artificial Sequence: Synthetic oligonucleotide
  Target: SCN10A; (+) strand; PAM type: NRG; PAM sequence: CAG
tttaaaattttaaaagataa

SEQ ID NO: 30258 - DNA, 20 bp, Artificial Sequence
  Description of Artificial Sequence: Synthetic oligonucleotide
  Target: SCN10A; (+) strand; PAM type: NRG; PAM sequence: AAG
taaaagataacagacacaaa

SEQ ID NO: 30259 - DNA, 20 bp, Artificial Sequence
  Description of Artificial Sequence: Synthetic oligonucleotide
  Target: SCN10A; (+) strand; PAM type: NRG; PAM sequence: TGG
agataacagacacaaaaaga

SEQ ID NO: 30260 - DNA, 20 bp, Artificial Sequence
  Description of Artificial Sequence: Synthetic oligonucleotide
  Target: SCN10A; (+) strand; PAM type: NRG; PAM sequence: TAG
aacagacacaaaaagatgga

SEQ ID NO: 30261 - DNA, 20 bp, Artificial Sequence
  Description of Artificial Sequence: Synthetic oligonucleotide
  Target: SCN10A; (+) strand; PAM type: NRG; PAM sequence: AGG
acagacacaaaaagatggat

SEQ ID NO: 30262 - DNA, 20 bp, Artificial Sequence
  Description of Artificial Sequence: Synthetic oligonucleotide
  Target: SCN10A; (+) strand; PAM type: NRG; PAM sequence: TAG
acacaaaaagatggatagga

SEQ ID NO: 30263 - DNA, 20 bp, Artificial Sequence
  Description of Artificial Sequence: Synthetic oligonucleotide
  Target: SCN10A; (+) strand; PAM type: NRG; PAM sequence: TAG
aaaaagatggataggataga

SEQ ID NO: 30264 - DNA, 20 bp, Artificial Sequence
  Description of Artificial Sequence: Synthetic oligonucleotide
  Target: SCN10A; (+) strand; PAM type: NRG; PAM sequence: TGG
ggataggatagatagttgaa

SEQ ID NO: 30265 - DNA, 20 bp, Artificial Sequence
  Description of Artificial Sequence: Synthetic oligonucleotide
  Target: SCN10A; (+) strand; PAM type: NRG; PAM sequence: AAG
taggatagatagttgaatgg

SEQ ID NO: 30266 - DNA, 20 bp, Artificial Sequence
  Description of Artificial Sequence: Synthetic oligonucleotide
  Target: SCN10A; (+) strand; PAM type: NRG; PAM sequence: AGG
aggatagatagttgaatgga

SEQ ID NO: 30267 - DNA, 20 bp, Artificial Sequence
  Description of Artificial Sequence: Synthetic oligonucleotide
  Target: SCN10A; (+) strand; PAM type: NRG; PAM sequence: TGG
tagatagttgaatggaagga

SEQ ID NO: 30268 - DNA, 20 bp, Artificial Sequence
  Description of Artificial Sequence: Synthetic oligonucleotide
  Target: SCN10A; (+) strand; PAM type: NRG; PAM sequence: GGG
agatagttgaatggaaggat

SEQ ID NO: 30269 - DNA, 20 bp, Artificial Sequence
  Description of Artificial Sequence: Synthetic oligonucleotide
  Target: SCN10A; (+) strand; PAM type: NRG; PAM sequence: GAG
atagttgaatggaaggatgg

SEQ ID NO: 30270 - DNA, 20 bp, Artificial Sequence
  Description of Artificial Sequence: Synthetic oligonucleotide
  Target: SCN10A; (+) strand; PAM type: NRG; PAM sequence: AAG
gaaggatgggagaaacaaac

SEQ ID NO: 30271 - DNA, 20 bp, Artificial Sequence
  Description of Artificial Sequence: Synthetic oligonucleotide
  Target: SCN10A; (+) strand; PAM type: NRG; PAM sequence: AAG
gatgggagaaacaaacaaga

SEQ ID NO: 30272 - DNA, 20 bp, Artificial Sequence
  Description of Artificial Sequence: Synthetic oligonucleotide
  Target: SCN10A; (+) strand; PAM type: NRG; PAM sequence: AGG
atgggagaaacaaacaagaa

SEQ ID NO: 30273 - DNA, 20 bp, Artificial Sequence
  Description of Artificial Sequence: Synthetic oligonucleotide
  Target: SCN10A; (+) strand; PAM type: NRG; PAM sequence: AAG
agaaacaaacaagaaaggaa

SEQ ID NO: 30274 - DNA, 20 bp, Artificial Sequence
  Description of Artificial Sequence: Synthetic oligonucleotide
  Target: SCN10A; (+) strand; PAM type: NRG; PAM sequence: AAG
acaagaaaggaaaagtatga

SEQ ID NO: 30275 - DNA, 20 bp, Artificial Sequence
  Description of Artificial Sequence: Synthetic oligonucleotide
  Target: SCN10A; (+) strand; PAM type: NRG; PAM sequence: CAG
agaaaggaaaagtatgaaag

SEQ ID NO: 30276 - DNA, 20 bp, Artificial Sequence
  Description of Artificial Sequence: Synthetic oligonucleotide
  Target: SCN10A; (+) strand; PAM type: NRG; PAM sequence: AGG
gaaaggaaaagtatgaaagc

SEQ ID NO: 30277 - DNA, 20 bp, Artificial Sequence
  Description of Artificial Sequence: Synthetic oligonucleotide
  Target: SCN10A; (+) strand; PAM type: NRG; PAM sequence: GGG
aaaggaaaagtatgaaagca

SEQ ID NO: 30278 - DNA, 20 bp, Artificial Sequence
  Description of Artificial Sequence: Synthetic oligonucleotide
  Target: SCN10A; (+) strand; PAM type: NRG; PAM sequence: TAG
aaaagtatgaaagcagggaa

SEQ ID NO: 30279 - DNA, 20 bp, Artificial Sequence
  Description of Artificial Sequence: Synthetic oligonucleotide
  Target: SCN10A; (+) strand; PAM type: NRG; PAM sequence: TGG
tgaaagcagggaatagtgaa

SEQ ID NO: 30280 - DNA, 20 bp, Artificial Sequence
  Description of Artificial Sequence: Synthetic oligonucleotide
  Target: SCN10A; (+) strand; PAM type: NRG; PAM sequence: TAG
agcagggaatagtgaatgga

SEQ ID NO: 30281 - DNA, 20 bp, Artificial Sequence
  Description of Artificial Sequence: Synthetic oligonucleotide
  Target: SCN10A; (+) strand; PAM type: NRG; PAM sequence: GAG
ggaatagtgaatggatagat

SEQ ID NO: 30282 - DNA, 20 bp, Artificial Sequence
  Description of Artificial Sequence: Synthetic oligonucleotide
  Target: SCN10A; (+) strand; PAM type: NRG; PAM sequence: TAG
tagtgaatggatagatgaga

SEQ ID NO: 30283 - DNA, 20 bp, Artificial Sequence
  Description of Artificial Sequence: Synthetic oligonucleotide
  Target: SCN10A; (+) strand; PAM type: NRG; PAM sequence: AGG
agtgaatggatagatgagat

SEQ ID NO: 30284 - DNA, 20 bp, Artificial Sequence
  Description of Artificial Sequence: Synthetic oligonucleotide
  Target: SCN10A; (+) strand; PAM type: NRG; PAM sequence: TGG
gaatggatagatgagatagg

SEQ ID NO: 30285 - DNA, 20 bp, Artificial Sequence
  Description of Artificial Sequence: Synthetic oligonucleotide
  Target: SCN10A; (+) strand; PAM type: NRG; PAM sequence: AAG
gatagatgagataggtggat

SEQ ID NO: 30286 - DNA, 20 bp, Artificial Sequence
  Description of Artificial Sequence: Synthetic oligonucleotide
  Target: SCN10A; (+) strand; PAM type: NRG; PAM sequence: GAG
tagatgagataggtggataa

SEQ ID NO: 30287 - DNA, 20 bp, Artificial Sequence
  Description of Artificial Sequence: Synthetic oligonucleotide
  Target: SCN10A; (+) strand; PAM type: NRG; PAM sequence: AAG
atgagataggtggataagag

SEQ ID NO: 30288 - DNA, 20 bp, Artificial Sequence
  Description of Artificial Sequence: Synthetic oligonucleotide
  Target: SCN10A; (+) strand; PAM type: NRG; PAM sequence: AGG
tgagataggtggataagaga

SEQ ID NO: 30289 - DNA, 20 bp, Artificial Sequence
  Description of Artificial Sequence: Synthetic oligonucleotide
  Target: SCN10A; (+) strand; PAM type: NRG; PAM sequence: TGG
ataggtggataagagaagga

SEQ ID NO: 30290 - DNA, 20 bp, Artificial Sequence
  Description of Artificial Sequence: Synthetic oligonucleotide
  Target: SCN10A; (+) strand; PAM type: NRG; PAM sequence: TGG
gtggataagagaaggatgga

SEQ ID NO: 30291 - DNA, 20 bp, Artificial Sequence
  Description of Artificial Sequence: Synthetic oligonucleotide
  Target: SCN10A; (+) strand; PAM type: NRG; PAM sequence: TGG
ataagagaaggatggatggc

SEQ ID NO: 30292 - DNA, 20 bp, Artificial Sequence
  Description of Artificial Sequence: Synthetic oligonucleotide
  Target: SCN10A; (+) strand; PAM type: NRG; PAM sequence: GGG
taagagaaggatggatggct

SEQ ID NO: 30293 - DNA, 20 bp, Artificial Sequence
  Description of Artificial Sequence: Synthetic oligonucleotide
  Target: SCN10A; (+) strand; PAM type: NRG; PAM sequence: TGG
taaaatgactaatgcatgaa

SEQ ID NO: 30294 - DNA, 20 bp, Artificial Sequence
  Description of Artificial Sequence: Synthetic oligonucleotide
  Target: SCN10A; (+) strand; PAM type: NRG; PAM sequence: AAG
atgactaatgcatgaatgga

SEQ ID NO: 30295 - DNA, 20 bp, Artificial Sequence
  Description of Artificial Sequence: Synthetic oligonucleotide
  Target: SCN10A; (+) strand; PAM type: NRG; PAM sequence: TGG
ctaatgcatgaatggaaaga

SEQ ID NO: 30296 - DNA, 20 bp, Artificial Sequence
  Description of Artificial Sequence: Synthetic oligonucleotide
  Target: SCN10A; (+) strand; PAM type: NRG; PAM sequence: GGG
taatgcatgaatggaaagat

SEQ ID NO: 30297 - DNA, 20 bp, Artificial Sequence
  Description of Artificial Sequence: Synthetic oligonucleotide
  Target: SCN10A; (+) strand; PAM type: NRG; PAM sequence: GGG
aatgcatgaatggaaagatg

SEQ ID NO: 30298 - DNA, 20 bp, Artificial Sequence
  Description of Artificial Sequence: Synthetic oligonucleotide
  Target: SCN10A; (+) strand; PAM type: NRG; PAM sequence: GAG
tgcatgaatggaaagatggg

SEQ ID NO: 30299 - DNA, 20 bp, Artificial Sequence
  Description of Artificial Sequence: Synthetic oligonucleotide
  Target: SCN10A; (+) strand; PAM type: NRG; PAM sequence: TGG
tgaatggaaagatggggagc

SEQ ID NO: 30300 - DNA, 20 bp, Artificial Sequence
  Description of Artificial Sequence: Synthetic oligonucleotide
  Target: SCN10A; (+) strand; PAM type: NRG; PAM sequence: CAG
tggaaagatggggagctgga

SEQ ID NO: 30301 - DNA, 20 bp, Artificial Sequence
  Description of Artificial Sequence: Synthetic oligonucleotide
  Target: SCN10A; (+) strand; PAM type: NRG; PAM sequence: TAG
agatggggagctggacagaa

SEQ ID NO: 30302 - DNA, 20 bp, Artificial Sequence
  Description of Artificial Sequence: Synthetic oligonucleotide
  Target: SCN10A; (+) strand; PAM type: NRG; PAM sequence: TGG
agctggacagaatagatgaa

SEQ ID NO: 30303 - DNA, 20 bp, Artificial Sequence
  Description of Artificial Sequence: Synthetic oligonucleotide
  Target: SCN10A; (+) strand; PAM type: NRG; PAM sequence: TAG
aatagatgaatggaataaat

SEQ ID NO: 30304 - DNA, 20 bp, Artificial Sequence
  Description of Artificial Sequence: Synthetic oligonucleotide
  Target: SCN10A; (+) strand; PAM type: NRG; PAM sequence: TGG
ggaataaattagtgaatgac

SEQ ID NO: 30305 - DNA, 20 bp, Artificial Sequence
  Description of Artificial Sequence: Synthetic oligonucleotide
  Target: SCN10A; (+) strand; PAM type: NRG; PAM sequence: AAG
ataaattagtgaatgactgg

SEQ ID NO: 30306 - DNA, 20 bp, Artificial Sequence
  Description of Artificial Sequence: Synthetic oligonucleotide
  Target: SCN10A; (+) strand; PAM type: NRG; PAM sequence: AGG
taaattagtgaatgactgga

SEQ ID NO: 30307 - DNA, 20 bp, Artificial Sequence
  Description of Artificial Sequence: Synthetic oligonucleotide
  Target: SCN10A; (+) strand; PAM type: NRG; PAM sequence: TAG
gtgaatgactggaaggttga

SEQ ID NO: 30308 - DNA, 20 bp, Artificial Sequence
  Description of Artificial Sequence: Synthetic oligonucleotide
  Target: SCN10A; (+) strand; PAM type: NRG; PAM sequence: AGG
tgaatgactggaaggttgat

SEQ ID NO: 30309 - DNA, 20 bp, Artificial Sequence
  Description of Artificial Sequence: Synthetic oligonucleotide
  Target: SCN10A; (+) strand; PAM type: NRG; PAM sequence: TGG
tgactggaaggttgatagga

SEQ ID NO: 30310 - DNA, 20 bp, Artificial Sequence
  Description of Artificial Sequence: Synthetic oligonucleotide
  Target: SCN10A; (+) strand; PAM type: NRG; PAM sequence: TGG
aggttgataggatggatgaa

SEQ ID NO: 30311 - DNA, 20 bp, Artificial Sequence
  Description of Artificial Sequence: Synthetic oligonucleotide
  Target: SCN10A; (+) strand; PAM type: NRG; PAM sequence: TGG
atggatgaatggatgatgaa

SEQ ID NO: 30312 - DNA, 20 bp, Artificial Sequence
  Description of Artificial Sequence: Synthetic oligonucleotide
  Target: SCN10A; (+) strand; PAM type: NRG; PAM sequence: AAG
gatgaatggatgatgaatgg

SEQ ID NO: 30313 - DNA, 20 bp, Artificial Sequence
  Description of Artificial Sequence: Synthetic oligonucleotide
  Target: SCN10A; (+) strand; PAM type: NRG; PAM sequence: AGG
atgaatggatgatgaatgga

SEQ ID NO: 30314 - DNA, 20 bp, Artificial Sequence
  Description of Artificial Sequence: Synthetic oligonucleotide
  Target: SCN10A; (+) strand; PAM type: NRG; PAM sequence: GGG
tgaatggatgatgaatggaa

SEQ ID NO: 30315 - DNA, 20 bp, Artificial Sequence
  Description of Artificial Sequence: Synthetic oligonucleotide
  Target: SCN10A; (+) strand; PAM type: NRG; PAM sequence: AAG
tggatgatgaatggaaggga

SEQ ID NO: 30316 - DNA, 20 bp, Artificial Sequence
  Description of Artificial Sequence: Synthetic oligonucleotide
  Target: SCN10A; (+) strand; PAM type: NRG; PAM sequence: AGG
ggatgatgaatggaagggaa

SEQ ID NO: 30317 - DNA, 20 bp, Artificial Sequence
  Description of Artificial Sequence: Synthetic oligonucleotide
  Target: SCN10A; (+) strand; PAM type: NRG; PAM sequence: GGG
gatgatgaatggaagggaaa

SEQ ID NO: 30318 - DNA, 20 bp, Artificial Sequence
  Description of Artificial Sequence: Synthetic oligonucleotide
  Target: SCN10A; (+) strand; PAM type: NRG; PAM sequence: CAG
aagggaaagggatgaatgaa

SEQ ID NO: 30319 - DNA, 20 bp, Artificial Sequence
  Description of Artificial Sequence: Synthetic oligonucleotide
  Target: SCN10A; (+) strand; PAM type: NRG; PAM sequence: AAG
aaagggatgaatgaacagat

SEQ ID NO: 30320 - DNA, 20 bp, Artificial Sequence
  Description of Artificial Sequence: Synthetic oligonucleotide
  Target: SCN10A; (+) strand; PAM type: NRG; PAM sequence: TGG
gggatgaatgaacagataag

SEQ ID NO: 30321 - DNA, 20 bp, Artificial Sequence
  Description of Artificial Sequence: Synthetic oligonucleotide
  Target: SCN10A; (+) strand; PAM type: NRG; PAM sequence: AAG
atgaatgaacagataagtgg

SEQ ID NO: 30322 - DNA, 20 bp, Artificial Sequence
  Description of Artificial Sequence: Synthetic oligonucleotide
  Target: SCN10A; (+) strand; PAM type: NRG; PAM sequence: AAG
atgaacagataagtggaaga

SEQ ID NO: 30323 - DNA, 20 bp, Artificial Sequence
  Description of Artificial Sequence: Synthetic oligonucleotide
  Target: SCN10A; (+) strand; PAM type: NRG; PAM sequence: AGG
tgaacagataagtggaagaa

SEQ ID NO: 30324 - DNA, 20 bp, Artificial Sequence
  Description of Artificial Sequence: Synthetic oligonucleotide
  Target: SCN10A; (+) strand; PAM type: NRG; PAM sequence: AAG
acagataagtggaagaaagg

SEQ ID NO: 30325 - DNA, 20 bp, Artificial Sequence
  Description of Artificial Sequence: Synthetic oligonucleotide
  Target: SCN10A; (+) strand; PAM type: NRG; PAM sequence: TAG
taagtggaagaaaggaagaa

SEQ ID NO: 30326 - DNA, 20 bp, Artificial Sequence
  Description of Artificial Sequence: Synthetic oligonucleotide
  Target: SCN10A; (+) strand; PAM type: NRG; PAM sequence: TGG
tggaagaaaggaagaataga

SEQ ID NO: 30327 - DNA, 20 bp, Artificial Sequence
  Description of Artificial Sequence: Synthetic oligonucleotide
  Target: SCN10A; (+) strand; PAM type: NRG; PAM sequence: TAG
agaaaggaagaatagatgga

SEQ ID NO: 30328 - DNA, 20 bp, Artificial Sequence
  Description of Artificial Sequence: Synthetic oligonucleotide
  Target: SCN10A; (+) strand; PAM type: NRG; PAM sequence: AGG
gaaaggaagaatagatggat

SEQ ID NO: 30329 - DNA, 20 bp, Artificial Sequence
  Description of Artificial Sequence: Synthetic oligonucleotide
  Target: SCN10A; (+) strand; PAM type: NRG; PAM sequence: AAG
atagatggataggttgaaac

SEQ ID NO: 30330 - DNA, 20 bp, Artificial Sequence
  Description of Artificial Sequence: Synthetic oligonucleotide
  Target: SCN10A; (+) strand; PAM type: NRG; PAM sequence: TGG
tggataggttgaaacaagaa

SEQ ID NO: 30331 - DNA, 20 bp, Artificial Sequence
  Description of Artificial Sequence: Synthetic oligonucleotide
  Target: SCN10A; (+) strand; PAM type: NRG; PAM sequence: AAG
taggttgaaacaagaatgga

SEQ ID NO: 30332 - DNA, 20 bp, Artificial Sequence
  Description of Artificial Sequence: Synthetic oligonucleotide
  Target: SCN10A; (+) strand; PAM type: NRG; PAM sequence: TAG
ttgaaacaagaatggaaaga

SEQ ID NO: 30333 - DNA, 20 bp, Artificial Sequence
  Description of Artificial Sequence: Synthetic oligonucleotide
  Target: SCN10A; (+) strand; PAM type: NRG; PAM sequence: AAG
aaacaagaatggaaagatag

SEQ ID NO: 30334 - DNA, 20 bp, Artificial Sequence
  Description of Artificial Sequence: Synthetic oligonucleotide
  Target: SCN10A; (+) strand; PAM type: NRG; PAM sequence: GAG
gaatggaaagatagaagaat

SEQ ID NO: 30335 - DNA, 20 bp, Artificial Sequence
  Description of Artificial Sequence: Synthetic oligonucleotide
  Target: SCN10A; (+) strand; PAM type: NRG; PAM sequence: TGG
tggaaagatagaagaatgag

SEQ ID NO: 30336 - DNA, 20 bp, Artificial Sequence
  Description of Artificial Sequence: Synthetic oligonucleotide
  Target: SCN10A; (+) strand; PAM type: NRG; PAM sequence: TAG
aagatagaagaatgagtgga

SEQ ID NO: 30337 - DNA, 20 bp, Artificial Sequence
  Description of Artificial Sequence: Synthetic oligonucleotide
  Target: SCN10A; (+) strand; PAM type: NRG; PAM sequence: AAG
atagaagaatgagtggatag

SEQ ID NO: 30338 - DNA, 20 bp, Artificial Sequence
  Description of Artificial Sequence: Synthetic oligonucleotide
  Target: SCN10A; (+) strand; PAM type: NRG; PAM sequence: AGG
tagaagaatgagtggataga

SEQ ID NO: 30339 - DNA, 20 bp, Artificial Sequence
  Description of Artificial Sequence: Synthetic oligonucleotide
  Target: SCN10A; (+) strand; PAM type: NRG; PAM sequence: GAG
gaatgagtggatagaaggat

SEQ ID NO: 30340 - DNA, 20 bp, Artificial Sequence
  Description of Artificial Sequence: Synthetic oligonucleotide
  Target: SCN10A; (+) strand; PAM type: NRG; PAM sequence: GAG
gagtggatagaaggatgagt

SEQ ID NO: 30341 - DNA, 20 bp, Artificial Sequence
  Description of Artificial Sequence: Synthetic oligonucleotide
  Target: SCN10A; (+) strand; PAM type: NRG; PAM sequence: TAG
tggatagaaggatgagtgag

SEQ ID NO: 30342 - DNA, 20 bp, Artificial Sequence
  Description of Artificial Sequence: Synthetic oligonucleotide
  Target: SCN10A; (+) strand; PAM type: NRG; PAM sequence: AAG
atagaaggatgagtgagtag

SEQ ID NO: 30343 - DNA, 20 bp, Artificial Sequence
  Description of Artificial Sequence: Synthetic oligonucleotide
  Target: SCN10A; (+) strand; PAM type: NRG; PAM sequence: TGG
tgagtgagtagaagcatgct

SEQ ID NO: 30344 - DNA, 20 bp, Artificial Sequence
  Description of Artificial Sequence: Synthetic oligonucleotide
  Target: SCN10A; (+) strand; PAM type: NRG; PAM sequence: TGG
tgagtagaagcatgcttgga

SEQ ID NO: 30345 - DNA, 20 bp, Artificial Sequence
  Description of Artificial Sequence: Synthetic oligonucleotide
  Target: SCN10A; (+) strand; PAM type: NRG; PAM sequence: AAG
gtagaagcatgcttggatgg

SEQ ID NO: 30346 - DNA, 20 bp, Artificial Sequence
  Description of Artificial Sequence: Synthetic oligonucleotide
  Target: SCN10A; (+) strand; PAM type: NRG; PAM sequence: GAG
tggatggaagatgcgtgaat

SEQ ID NO: 30347 - DNA, 20 bp, Artificial Sequence
  Description of Artificial Sequence: Synthetic oligonucleotide
  Target: SCN10A; (+) strand; PAM type: NRG; PAM sequence: CAG
aagatgcgtgaatgagtgaa

SEQ ID NO: 30348 - DNA, 20 bp, Artificial Sequence
  Description of Artificial Sequence: Synthetic oligonucleotide
  Target: SCN10A; (+) strand; PAM type: NRG; PAM sequence: TAG
tgaatgagtgaacagaatgt

SEQ ID NO: 30349 - DNA, 20 bp, Artificial Sequence
  Description of Artificial Sequence: Synthetic oligonucleotide
  Target: SCN10A; (+) strand; PAM type: NRG; PAM sequence: TGG
tgaacagaatgttagatgat

SEQ ID NO: 30350 - DNA, 20 bp, Artificial Sequence
  Description of Artificial Sequence: Synthetic oligonucleotide
  Target: SCN10A; (+) strand; PAM type: NRG; PAM sequence: CAG
cagaatgttagatgattgga

SEQ ID NO: 30351 - DNA, 20 bp, Artificial Sequence
  Description of Artificial Sequence: Synthetic oligonucleotide
  Target: SCN10A; (+) strand; PAM type: NRG; PAM sequence: TGG
atgttagatgattggacagt

SEQ ID NO: 30352 - DNA, 20 bp, Artificial Sequence
  Description of Artificial Sequence: Synthetic oligonucleotide
  Target: SCN10A; (+) strand; PAM type: NRG; PAM sequence: TAG
tagatgattggacagttgga

SEQ ID NO: 30353 - DNA, 20 bp, Artificial Sequence
  Description of Artificial Sequence: Synthetic oligonucleotide
  Target: SCN10A; (+) strand; PAM type: NRG; PAM sequence: AAG
atgattggacagttggatag

SEQ ID NO: 30354 - DNA, 20 bp, Artificial Sequence
  Description of Artificial Sequence: Synthetic oligonucleotide
  Target: SCN10A; (+) strand; PAM type: NRG; PAM sequence: AAG
tggatagaagaatgaatcaa

SEQ ID NO: 30355 - DNA, 20 bp, Artificial Sequence
  Description of Artificial Sequence: Synthetic oligonucleotide
  Target: SCN10A; (+) strand; PAM type: NRG; PAM sequence: TAG
tagaagaatgaatcaaaaga

SEQ ID NO: 30356 - DNA, 20 bp, Artificial Sequence
  Description of Artificial Sequence: Synthetic oligonucleotide
  Target: SCN10A; (+) strand; PAM type: NRG; PAM sequence: AAG
agaatgaatcaaaagataga

SEQ ID NO: 30357 - DNA, 20 bp, Artificial Sequence
  Description of Artificial Sequence: Synthetic oligonucleotide
  Target: SCN10A; (+) strand; PAM type: NRG; PAM sequence: AAG
atcaaaagatagaaagatat

SEQ ID NO: 30358 - DNA, 20 bp, Artificial Sequence
  Description of Artificial Sequence: Synthetic oligonucleotide
  Target: SCN10A; (+) strand; PAM type: NRG; PAM sequence: AGG
tcaaaagatagaaagatata

SEQ ID NO: 30359 - DNA, 20 bp, Artificial Sequence
  Description of Artificial Sequence: Synthetic oligonucleotide
  Target: SCN10A; (+) strand; PAM type: NRG; PAM sequence: GGG
caaaagatagaaagatataa

SEQ ID NO: 30360 - DNA, 20 bp, Artificial Sequence
  Description of Artificial Sequence: Synthetic oligonucleotide
  Target: SCN10A; (+) strand; PAM type: NRG; PAM sequence: AAG
gatagaaagatataagggtt

SEQ ID NO: 30361 - DNA, 20 bp, Artificial Sequence
  Description of Artificial Sequence: Synthetic oligonucleotide
  Target: SCN10A; (+) strand; PAM type: NRG; PAM sequence: AGG
atagaaagatataagggtta

SEQ ID NO: 30362 - DNA, 20 bp, Artificial Sequence
  Description of Artificial Sequence: Synthetic oligonucleotide
  Target: SCN10A; (+) strand; PAM type: NRG; PAM sequence: TAG
taagggttaaggatgatgaa

SEQ ID NO: 30363 - DNA, 20 bp, Artificial Sequence
  Description of Artificial Sequence: Synthetic oligonucleotide
  Target: SCN10A; (+) strand; PAM type: NRG; PAM sequence: TGG
ggttaaggatgatgaataga

SEQ ID NO: 30364 - DNA, 20 bp, Artificial Sequence
  Description of Artificial Sequence: Synthetic oligonucleotide
  Target: SCN10A; (+) strand; PAM type: NRG; PAM sequence: AAG
taaggatgatgaatagatgg

SEQ ID NO: 30365 - DNA, 20 bp, Artificial Sequence
  Description of Artificial Sequence: Synthetic oligonucleotide
  Target: SCN10A; (+) strand; PAM type: NRG; PAM sequence: AGG
aaggatgatgaatagatgga

SEQ ID NO: 30366 - DNA, 20 bp, Artificial Sequence
  Description of Artificial Sequence: Synthetic oligonucleotide
  Target: SCN10A; (+) strand; PAM type: NRG; PAM sequence: AAG
gatgatgaatagatggaagg

SEQ ID NO: 30367 - DNA, 20 bp, Artificial Sequence
  Description of Artificial Sequence: Synthetic oligonucleotide
  Target: SCN10A; (+) strand; PAM type: NRG; PAM sequence: TAG
tgaatagatggaaggaagtt

SEQ ID NO: 30368 - DNA, 20 bp, Artificial Sequence
  Description of Artificial Sequence: Synthetic oligonucleotide
  Target: SCN10A; (+) strand; PAM type: NRG; PAM sequence: AAG
tggaaggaagtttagaataa

SEQ ID NO: 30369 - DNA, 20 bp, Artificial Sequence
  Description of Artificial Sequence: Synthetic oligonucleotide
  Target: SCN10A; (+) strand; PAM type: NRG; PAM sequence: TGG
ggaagtttagaataaaagat

SEQ ID NO: 30370 - DNA, 20 bp, Artificial Sequence
  Description of Artificial Sequence: Synthetic oligonucleotide
  Target: SCN10A; (+) strand; PAM type: NRG; PAM sequence: GGG
gaagtttagaataaaagatt

SEQ ID NO: 30371 - DNA, 20 bp, Artificial Sequence
  Description of Artificial Sequence: Synthetic oligonucleotide
  Target: SCN10A; (+) strand; PAM type: NRG; PAM sequence: CAG
gtttagaataaaagattggg

SEQ ID NO: 30372 - DNA, 20 bp, Artificial Sequence
  Description of Artificial Sequence: Synthetic oligonucleotide
  Target: SCN10A; (+) strand; PAM type: NRG; PAM sequence: AAG
tagaataaaagattgggcag

SEQ ID NO: 30373 - DNA, 20 bp, Artificial Sequence
  Description of Artificial Sequence: Synthetic oligonucleotide
  Target: SCN10A; (+) strand; PAM type: NRG; PAM sequence: GAG
gaataaaagattgggcagaa

SEQ ID NO: 30374 - DNA, 20 bp, Artificial Sequence
  Description of Artificial Sequence: Synthetic oligonucleotide
  Target: SCN10A; (+) strand; PAM type: NRG; PAM sequence: AAG
taaaagattgggcagaagag

SEQ ID NO: 30375 - DNA, 20 bp, Artificial Sequence
  Description of Artificial Sequence: Synthetic oligonucleotide
  Target: SCN10A; (+) strand; PAM type: NRG; PAM sequence: GAG
aaagattgggcagaagagaa

SEQ ID NO: 30376 - DNA, 20 bp, Artificial Sequence
  Description of Artificial Sequence: Synthetic oligonucleotide
  Target: SCN10A; (+) strand; PAM type: NRG; PAM sequence: AGG
aagattgggcagaagagaag

SEQ ID NO: 30377 - DNA, 20 bp, Artificial Sequence
  Description of Artificial Sequence: Synthetic oligonucleotide
  Target: SCN10A; (+) strand; PAM type: NRG; PAM sequence: GGG
agattgggcagaagagaaga

SEQ ID NO: 30378 - DNA, 20 bp, Artificial Sequence
  Description of Artificial Sequence: Synthetic oligonucleotide
  Target: SCN10A; (+) strand; PAM type: NRG; PAM sequence: AAG
tgggcagaagagaagaggga

SEQ ID NO: 30379 - DNA, 20 bp, Artificial Sequence
  Description of Artificial Sequence: Synthetic oligonucleotide
  Target: SCN10A; (+) strand; PAM type: NRG; PAM sequence: AAG
gcagaagagaagagggaaag

SEQ ID NO: 30380 - DNA, 20 bp, Artificial Sequence
  Description of Artificial Sequence: Synthetic oligonucleotide
  Target: SCN10A; (+) strand; PAM type: NRG; PAM sequence: TGG
agagaagagggaaagaagaa

SEQ ID NO: 30381 - DNA, 20 bp, Artificial Sequence
  Description of Artificial Sequence: Synthetic oligonucleotide
  Target: SCN10A; (+) strand; PAM type: NRG; PAM sequence: GGG
gagaagagggaaagaagaat

SEQ ID NO: 30382 - DNA, 20 bp, Artificial Sequence
  Description of Artificial Sequence: Synthetic oligonucleotide
  Target: SCN10A; (+) strand; PAM type: NRG; PAM sequence: TGG
gagggaaagaagaatgggaa

SEQ ID NO: 30383 - DNA, 20 bp, Artificial Sequence
  Description of Artificial Sequence: Synthetic oligonucleotide
  Target: SCN10A; (+) strand; PAM type: NRG; PAM sequence: TGG
gaaagaagaatgggaatgga

SEQ ID NO: 30384 - DNA, 20 bp, Artificial Sequence
  Description of Artificial Sequence: Synthetic oligonucleotide
  Target: SCN10A; (+) strand; PAM type: NRG; PAM sequence: TGG
gaagaatgggaatggatgga

SEQ ID NO: 30385 - DNA, 20 bp, Artificial Sequence
  Description of Artificial Sequence: Synthetic oligonucleotide
  Target: SCN10A; (+) strand; PAM type: NRG; PAM sequence: AAG
gaatgggaatggatggatgg

SEQ ID NO: 30386 - DNA, 20 bp, Artificial Sequence
  Description of Artificial Sequence: Synthetic oligonucleotide
  Target: SCN10A; (+) strand; PAM type: NRG; PAM sequence: AGG
aatgggaatggatggatgga

SEQ ID NO: 30387 - DNA, 20 bp, Artificial Sequence
  Description of Artificial Sequence: Synthetic oligonucleotide
  Target: SCN10A; (+) strand; PAM type: NRG; PAM sequence: GGG
atgggaatggatggatggaa

SEQ ID NO: 30388 - DNA, 20 bp, Artificial Sequence
  Description of Artificial Sequence: Synthetic oligonucleotide
  Target: SCN10A; (+) strand; PAM type: NRG; PAM sequence: GGG
tgggaatggatggatggaag

SEQ ID NO: 30389 - DNA, 20 bp, Artificial Sequence
  Description of Artificial Sequence: Synthetic oligonucleotide
  Target: SCN10A; (+) strand; PAM type: NRG; PAM sequence: GAG
ggaatggatggatggaaggg

SEQ ID NO: 30390 - DNA, 20 bp, Artificial Sequence
  Description of Artificial Sequence: Synthetic oligonucleotide
  Target: SCN10A; (+) strand; PAM type: NRG; PAM sequence: AGG
gaatggatggatggaagggg

SEQ ID NO: 30391 - DNA, 20 bp, Artificial Sequence
  Description of Artificial Sequence: Synthetic oligonucleotide
  Target: SCN10A; (+) strand; PAM type: NRG; PAM sequence: AAG
atggaaggggaggactgatg

SEQ ID NO: 30392 - DNA, 20 bp, Artificial Sequence
  Description of Artificial Sequence: Synthetic oligonucleotide
  Target: SCN10A; (+) strand; PAM type: NRG; PAM sequence: CAG
ggaggactgatgaagatgta

SEQ ID NO: 30393 - DNA, 20 bp, Artificial Sequence
  Description of Artificial Sequence: Synthetic oligonucleotide
  Target: SCN10A; (+) strand; PAM type: NRG; PAM sequence: TGG
gactgatgaagatgtacagc

SEQ ID NO: 30394 - DNA, 20 bp, Artificial Sequence
  Description of Artificial Sequence: Synthetic oligonucleotide
  Target: SCN10A; (+) strand; PAM type: NRG; PAM sequence: AAG
tgatgaagatgtacagctgg

SEQ ID NO: 30395 - DNA, 20 bp, Artificial Sequence
  Description of Artificial Sequence: Synthetic oligonucleotide
  Target: SCN10A; (+) strand; PAM type: NRG; PAM sequence: AAG
atgtacagctggaagaaata

SEQ ID NO: 30396 - DNA, 20 bp, Artificial Sequence
  Description of Artificial Sequence: Synthetic oligonucleotide
  Target: SCN10A; (+) strand; PAM type: NRG; PAM sequence: TGG
acagctggaagaaataaaga

SEQ ID NO: 30397 - DNA, 20 bp, Artificial Sequence
  Description of Artificial Sequence: Synthetic oligonucleotide
  Target: SCN10A; (+) strand; PAM type: NRG; PAM sequence: TGG
ctggaagaaataaagatgga

SEQ ID NO: 30398 - DNA, 20 bp, Artificial Sequence
  Description of Artificial Sequence: Synthetic oligonucleotide
  Target: SCN10A; (+) strand; PAM type: NRG; PAM sequence: TGG
aataaagatggatggatgtt

SEQ ID NO: 30399 - DNA, 20 bp, Artificial Sequence
  Description of Artificial Sequence: Synthetic oligonucleotide
  Target: SCN10A; (+) strand; PAM type: NRG; PAM sequence: GGG
ataaagatggatggatgttt

SEQ ID NO: 30400 - DNA, 20 bp, Artificial Sequence
  Description of Artificial Sequence: Synthetic oligonucleotide
  Target: SCN10A; (+) strand; PAM type: NRG; PAM sequence: GAG
aaagatggatggatgtttgg

SEQ ID NO: 30401 - DNA, 20 bp, Artificial Sequence
  Description of Artificial Sequence: Synthetic oligonucleotide
  Target: SCN10A; (+) strand; PAM type: NRG; PAM sequence: AGG
aagatggatggatgtttggg

SEQ ID NO: 30402 - DNA, 20 bp, Artificial Sequence
  Description of Artificial Sequence: Synthetic oligonucleotide
  Target: SCN10A; (+) strand; PAM type: NRG; PAM sequence: AAG
atggatggatgtttgggagg

SEQ ID NO: 30403 - DNA, 20 bp, Artificial Sequence
  Description of Artificial Sequence: Synthetic oligonucleotide
  Target: SCN10A; (+) strand; PAM type: NRG; PAM sequence: AGG
tggatggatgtttgggagga

SEQ ID NO: 30404 - DNA, 20 bp, Artificial Sequence
  Description of Artificial Sequence: Synthetic oligonucleotide
  Target: SCN10A; (+) strand; PAM type: NRG; PAM sequence: AAG
gatgtttgggaggaaggaaa

SEQ ID NO: 30405 - DNA, 20 bp, Artificial Sequence
  Description of Artificial Sequence: Synthetic oligonucleotide
  Target: SCN10A; (+) strand; PAM type: NRG; PAM sequence: AGG
atgtttgggaggaaggaaaa

SEQ ID NO: 30406 - DNA, 20 bp, Artificial Sequence
  Description of Artificial Sequence: Synthetic oligonucleotide
  Target: SCN10A; (+) strand; PAM type: NRG; PAM sequence: AAG
tttgggaggaaggaaaaagg

SEQ ID NO: 30407 - DNA, 20 bp, Artificial Sequence
  Description of Artificial Sequence: Synthetic oligonucleotide
  Target: SCN10A; (+) strand; PAM type: NRG; PAM sequence: TGG
aaggaaaaaggaagactgaa

SEQ ID NO: 30408 - DNA, 20 bp, Artificial Sequence
  Description of Artificial Sequence: Synthetic oligonucleotide
  Target: SCN10A; (+) strand; PAM type: NRG; PAM sequence: TGG
aaaaaggaagactgaatggt

SEQ ID NO: 30409 - DNA, 20 bp, Artificial Sequence
  Description of Artificial Sequence: Synthetic oligonucleotide
  Target: SCN10A; (+) strand; PAM type: NRG; PAM sequence: AAG
gactgaatggttggatacaa

SEQ ID NO: 30410 - DNA, 20 bp, Artificial Sequence
  Description of Artificial Sequence: Synthetic oligonucleotide
  Target: SCN10A; (+) strand; PAM type: NRG; PAM sequence: AGG
actgaatggttggatacaaa

SEQ ID NO: 30411 - DNA, 20 bp, Artificial Sequence
  Description of Artificial Sequence: Synthetic oligonucleotide
  Target: SCN10A; (+) strand; PAM type: NRG; PAM sequence: TGG
gatacaaaaggtgaaatgta

SEQ ID NO: 30412 - DNA, 20 bp, Artificial Sequence
  Description of Artificial Sequence: Synthetic oligonucleotide
  Target: SCN10A; (+) strand; PAM type: NRG; PAM sequence: AAG
acaaaaggtgaaatgtatgg

SEQ ID NO: 30413 - DNA, 20 bp, Artificial Sequence
  Description of Artificial Sequence: Synthetic oligonucleotide
  Target: SCN10A; (+) strand; PAM type: NRG; PAM sequence: AGG
caaaaggtgaaatgtatgga

SEQ ID NO: 30414 - DNA, 20 bp, Artificial Sequence
  Description of Artificial Sequence: Synthetic oligonucleotide
  Target: SCN10A; (+) strand; PAM type: NRG; PAM sequence: AAG
aaggtgaaatgtatggaagg

SEQ ID NO: 30415 - DNA, 20 bp, Artificial Sequence
  Description of Artificial Sequence: Synthetic oligonucleotide
  Target: SCN10A; (+) strand; PAM type: NRG; PAM sequence: AGG
aggtgaaatgtatggaagga

SEQ ID NO: 30416 - DNA, 20 bp, Artificial Sequence
  Description of Artificial Sequence: Synthetic oligonucleotide
  Target: SCN10A; (+) strand; PAM type: NRG; PAM sequence: TGG
gaaatgtatggaaggaagga

SEQ ID NO: 30417 - DNA, 20 bp, Artificial Sequence
  Description of Artificial Sequence: Synthetic oligonucleotide
  Target: SCN10A; (+) strand; PAM type: NRG; PAM sequence: TGG
tgtatggaaggaaggatgga

SEQ ID NO: 30418 - DNA, 20 bp, Artificial Sequence
  Description of Artificial Sequence: Synthetic oligonucleotide
  Target: SCN10A; (+) strand; PAM type: NRG; PAM sequence: TGG
tggaaggaaggatggatggt

SEQ ID NO: 30419 - DNA, 20 bp, Artificial Sequence
  Description of Artificial Sequence: Synthetic oligonucleotide
  Target: SCN10A; (+) strand; PAM type: NRG; PAM sequence: AAG
aaggaaggatggatggttgg

SEQ ID NO: 30420 - DNA, 20 bp, Artificial Sequence
  Description of Artificial Sequence: Synthetic oligonucleotide
  Target: SCN10A; (+) strand; PAM type: NRG; PAM sequence: AGG
aggaaggatggatggttgga

SEQ ID NO: 30421 - DNA, 20 bp, Artificial Sequence
  Description of Artificial Sequence: Synthetic oligonucleotide
  Target: SCN10A; (+) strand; PAM type: NRG; PAM sequence: AAG
aaggatggatggttggaagg

SEQ ID NO: 30422 - DNA, 20 bp, Artificial Sequence
  Description of Artificial Sequence: Synthetic oligonucleotide
  Target: SCN10A; (+) strand; PAM type: NRG; PAM sequence: CAG
ggatggttggaaggaagaat

SEQ ID NO: 30423 - DNA, 20 bp, Artificial Sequence
  Description of Artificial Sequence: Synthetic oligonucleotide
  Target: SCN10A; (+) strand; PAM type: NRG; PAM sequence: TAG
tggttggaaggaagaatcag

SEQ ID NO: 30424 - DNA, 20 bp, Artificial Sequence
  Description of Artificial Sequence: Synthetic oligonucleotide
  Target: SCN10A; (+) strand; PAM type: NRG; PAM sequence: AGG
ggttggaaggaagaatcagt

SEQ ID NO: 30425 - DNA, 20 bp, Artificial Sequence
  Description of Artificial Sequence: Synthetic oligonucleotide
  Target: SCN10A; (+) strand; PAM type: NRG; PAM sequence: AAG
tggaaggaagaatcagtagg

SEQ ID NO: 30426 - DNA, 20 bp, Artificial Sequence
  Description of Artificial Sequence: Synthetic oligonucleotide
  Target: SCN10A; (+) strand; PAM type: NRG; PAM sequence: TGG
aggaagaatcagtaggaaga

SEQ ID NO: 30427 - DNA, 20 bp, Artificial Sequence
  Description of Artificial Sequence: Synthetic oligonucleotide
  Target: SCN10A; (+) strand; PAM type: NRG; PAM sequence: GAG
agtaggaagatggatgaaat

SEQ ID NO: 30428 - DNA, 20 bp, Artificial Sequence
  Description of Artificial Sequence: Synthetic oligonucleotide
  Target: SCN10A; (+) strand; PAM type: NRG; PAM sequence: AAG
aaatgagtgcatgaccgttt

SEQ ID NO: 30429 - DNA, 20 bp, Artificial Sequence
  Description of Artificial Sequence: Synthetic oligonucleotide
  Target: SCN10A; (+) strand; PAM type: NRG; PAM sequence: AGG
aatgagtgcatgaccgttta

SEQ ID NO: 30430 - DNA, 20 bp, Artificial Sequence
  Description of Artificial Sequence: Synthetic oligonucleotide
  Target: SCN10A; (+) strand; PAM type: NRG; PAM sequence: TAG
gcatgaccgtttaaggtgat

SEQ ID NO: 30431 - DNA, 20 bp, Artificial Sequence
  Description of Artificial Sequence: Synthetic oligonucleotide
  Target: SCN10A; (+) strand; PAM type: NRG; PAM sequence: AGG
catgaccgtttaaggtgatt

SEQ ID NO: 30432 - DNA, 20 bp, Artificial Sequence
  Description of Artificial Sequence: Synthetic oligonucleotide
  Target: SCN10A; (+) strand; PAM type: NRG; PAM sequence: GAG
cgtttaaggtgattaggact

SEQ ID NO: 30433 - DNA, 20 bp, Artificial Sequence
  Description of Artificial Sequence: Synthetic oligonucleotide
  Target: SCN10A; (+) strand; PAM type: NRG; PAM sequence: TGG
aaggtgattaggactgagac

SEQ ID NO: 30434 - DNA, 20 bp, Artificial Sequence
  Description of Artificial Sequence: Synthetic oligonucleotide
  Target: SCN10A; (+) strand; PAM type: NRG; PAM sequence: GAG
tgattaggactgagactggt

SEQ ID NO: 30435 - DNA, 20 bp, Artificial Sequence
  Description of Artificial Sequence: Synthetic oligonucleotide
  Target: SCN10A; (+) strand; PAM type: NRG; PAM sequence: AAG
gagactggtgagatcaacat

SEQ ID NO: 30436 - DNA, 20 bp, Artificial Sequence
  Description of Artificial Sequence: Synthetic oligonucleotide
  Target: SCN10A; (+) strand; PAM type: NRG; PAM sequence: CAG
actggtgagatcaacataag

SEQ ID NO: 30437 - DNA, 20 bp, Artificial Sequence
  Description of Artificial Sequence: Synthetic oligonucleotide
  Target: SCN10A; (+) strand; PAM type: NRG; PAM sequence: AGG
ctggtgagatcaacataagc

SEQ ID NO: 30438 - DNA, 20 bp, Artificial Sequence
  Description of Artificial Sequence: Synthetic oligonucleotide
  Target: SCN10A; (+) strand; PAM type: NRG; PAM sequence: GAG
ggtgagatcaacataagcag

SEQ ID NO: 30439 - DNA, 20 bp, Artificial Sequence
  Description of Artificial Sequence: Synthetic oligonucleotide
  Target: SCN10A; (+) strand; PAM type: NRG; PAM sequence: AAG
caggagtgactgtgccccca

SEQ ID NO: 30440 - DNA, 20 bp, Artificial Sequence
  Description of Artificial Sequence: Synthetic oligonucleotide
  Target: SCN10A; (+) strand; PAM type: NRG; PAM sequence: AGG
aggagtgactgtgcccccaa

SEQ ID NO: 30441 - DNA, 20 bp, Artificial Sequence
  Description of Artificial Sequence: Synthetic oligonucleotide
  Target: SCN10A; (+) strand; PAM type: NRG; PAM sequence: GGG
ggagtgactgtgcccccaaa

SEQ ID NO: 30442 - DNA, 20 bp, Artificial Sequence
  Description of Artificial Sequence: Synthetic oligonucleotide
  Target: SCN10A; (+) strand; PAM type: NRG; PAM sequence: GGG
gagtgactgtgcccccaaag

SEQ ID NO: 30443 - DNA, 20 bp, Artificial Sequence
  Description of Artificial Sequence: Synthetic oligonucleotide
  Target: SCN10A; (+) strand; PAM type: NRG; PAM sequence: TGG
tgactgtgcccccaaagggg

SEQ ID NO: 30444 - DNA, 20 bp, Artificial Sequence
  Description of Artificial Sequence: Synthetic oligonucleotide
  Target: SCN10A; (+) strand; PAM type: NRG; PAM sequence: GGG
gactgtgcccccaaaggggt

SEQ ID NO: 30445 - DNA, 20 bp, Artificial Sequence
  Description of Artificial Sequence: Synthetic oligonucleotide
  Target: SCN10A; (+) strand; PAM type: NRG; PAM sequence: CGG
cccccaaaggggtgggacac

SEQ ID NO: 30446 - DNA, 20 bp, Artificial Sequence
  Description of Artificial Sequence: Synthetic oligonucleotide
  Target: SCN10A; (+) strand; PAM type: NRG; PAM sequence: CAG
gaataattatttcatatgca

SEQ ID NO: 30447 - DNA, 20 bp, Artificial Sequence
  Description of Artificial Sequence: Synthetic oligonucleotide
  Target: SCN10A; (+) strand; PAM type: NRG; PAM sequence: CAG
cagaattatcacccatgact

SEQ ID NO: 30448 - DNA, 20 bp, Artificial Sequence
  Description of Artificial Sequence: Synthetic oligonucleotide
  Target: SCN10A; (+) strand; PAM type: NRG; PAM sequence: CAG
atcacccatgactcagattt

SEQ ID NO: 30449 - DNA, 20 bp, Artificial Sequence
  Description of Artificial Sequence: Synthetic oligonucleotide
  Target: SCN10A; (+) strand; PAM type: NRG; PAM sequence: AGG
tcacccatgactcagatttc

SEQ ID NO: 30450 - DNA, 20 bp, Artificial Sequence
  Description of Artificial Sequence: Synthetic oligonucleotide
  Target: SCN10A; (+) strand; PAM type: NRG; PAM sequence: CAG
gactcagatttcaggcctca

SEQ ID NO: 30451 - DNA, 20 bp, Artificial Sequence
  Description of Artificial Sequence: Synthetic oligonucleotide
  Target: SCN10A; (+) strand; PAM type: NRG; PAM sequence: TGG
ggcctcacagctaatccttg

SEQ ID NO: 30452 - DNA, 20 bp, Artificial Sequence
  Description of Artificial Sequence: Synthetic oligonucleotide
  Target: SCN10A; (+) strand; PAM type: NRG; PAM sequence: CAG
cacagctaatccttgtggta

SEQ ID NO: 30453 - DNA, 20 bp, Artificial Sequence
  Description of Artificial Sequence: Synthetic oligonucleotide
  Target: SCN10A; (+) strand; PAM type: NRG; PAM sequence: TGG
agctaatccttgtggtacag

SEQ ID NO: 30454 - DNA, 20 bp, Artificial Sequence
  Description of Artificial Sequence: Synthetic oligonucleotide
  Target: SCN10A; (+) strand; PAM type: NRG; PAM sequence: AAG
ccttgtggtacagtggcctg

SEQ ID NO: 30455 - DNA, 20 bp, Artificial Sequence
  Description of Artificial Sequence: Synthetic oligonucleotide
  Target: SCN10A; (+) strand; PAM type: NRG; PAM sequence: TAG
gtacagtggcctgaagctgc

SEQ ID NO: 30456 - DNA, 20 bp, Artificial Sequence
  Description of Artificial Sequence: Synthetic oligonucleotide
  Target: SCN10A; (+) strand; PAM type: NRG; PAM sequence: TGG
gcctgaagctgctagtgcat

SEQ ID NO: 30457 - DNA, 20 bp, Artificial Sequence
  Description of Artificial Sequence: Synthetic oligonucleotide
  Target: SCN10A; (+) strand; PAM type: NRG; PAM sequence: CAG
agctgctagtgcattggcat

SEQ ID NO: 30458 - DNA, 20 bp, Artificial Sequence
  Description of Artificial Sequence: Synthetic oligonucleotide
  Target: SCN10A; (+) strand; PAM type: NRG; PAM sequence: AGG
gctgctagtgcattggcatc

SEQ ID NO: 30459 - DNA, 20 bp, Artificial Sequence
  Description of Artificial Sequence: Synthetic oligonucleotide
  Target: SCN10A; (+) strand; PAM type: NRG; PAM sequence: GGG
ctgctagtgcattggcatca

SEQ ID NO: 30460 - DNA, 20 bp, Artificial Sequence
  Description of Artificial Sequence: Synthetic oligonucleotide
  Target: SCN10A; (+) strand; PAM type: NRG; PAM sequence: AAG
ctagtgcattggcatcaggg

SEQ ID NO: 30461 - DNA, 20 bp, Artificial Sequence
  Description of Artificial Sequence: Synthetic oligonucleotide
  Target: SCN10A; (+) strand; PAM type: NRG; PAM sequence: AAG
gtgcattggcatcagggaag

SEQ ID NO: 30462 - DNA, 20 bp, Artificial Sequence
  Description of Artificial Sequence: Synthetic oligonucleotide
  Target: SCN10A; (+) strand; PAM type: NRG; PAM sequence: GAG
gcattggcatcagggaagaa

SEQ ID NO: 30463 - DNA, 20 bp, Artificial Sequence
  Description of Artificial Sequence: Synthetic oligonucleotide
  Target: SCN10A; (+) strand; PAM type: NRG; PAM sequence: CAG
gaagaagagaattgaatgca

SEQ ID NO: 30464 - DNA, 20 bp, Artificial Sequence
  Description of Artificial Sequence: Synthetic oligonucleotide
  Target: SCN10A; (+) strand; PAM type: NRG; PAM sequence: AGG
aagaagagaattgaatgcac

SEQ ID NO: 30465 - DNA, 20 bp, Artificial Sequence
  Description of Artificial Sequence: Synthetic oligonucleotide
  Target: SCN10A; (+) strand; PAM type: NRG; PAM sequence: TGG
ttgaatgcacaggcctgcta

SEQ ID NO: 30466 - DNA, 20 bp, Artificial Sequence
  Description of Artificial Sequence: Synthetic oligonucleotide
  Target: SCN10A; (+) strand; PAM type: NRG; PAM sequence: GAG
gaatgcacaggcctgctatg

SEQ ID NO: 30467 - DNA, 20 bp, Artificial Sequence
  Description of Artificial Sequence: Synthetic oligonucleotide
  Target: SCN10A; (+) strand; PAM type: NRG; PAM sequence: AGG
aatgcacaggcctgctatgg

SEQ ID NO: 30468 - DNA, 20 bp, Artificial Sequence
  Description of Artificial Sequence: Synthetic oligonucleotide
  Target: SCN10A; (+) strand; PAM type: NRG; PAM sequence: CAG
gcctgctatggaggacctgc

SEQ ID NO: 30469 - DNA, 20 bp, Artificial Sequence
  Description of Artificial Sequence: Synthetic oligonucleotide
  Target: SCN10A; (+) strand; PAM type: NRG; PAM sequence: CAG
ctatggaggacctgccagca

SEQ ID NO: 30470 - DNA, 20 bp, Artificial Sequence
  Description of Artificial Sequence: Synthetic oligonucleotide
  Target: SCN10A; (+) strand; PAM type: NRG; PAM sequence: AGG
tatggaggacctgccagcac

SEQ ID NO: 30471 - DNA, 20 bp, Artificial Sequence
  Description of Artificial Sequence: Synthetic oligonucleotide
  Target: SCN10A; (+) strand; PAM type: NRG; PAM sequence: GAG
tggaggacctgccagcacag

SEQ ID NO: 30472 - DNA, 20 bp, Artificial Sequence
  Description of Artificial Sequence: Synthetic oligonucleotide
  Target: SCN10A; (+) strand; PAM type: NRG; PAM sequence: AGG
ggaggacctgccagcacagg

SEQ ID NO: 30473 - DNA, 20 bp, Artificial Sequence
  Description of Artificial Sequence: Synthetic oligonucleotide
  Target: SCN10A; (+) strand; PAM type: NRG; PAM sequence: TGG
gacctgccagcacaggaggc

SEQ ID NO: 30474 - DNA, 20 bp, Artificial Sequence
  Description of Artificial Sequence: Synthetic oligonucleotide
  Target: SCN10A; (+) strand; PAM type: NRG; PAM sequence: CAG
tgccagcacaggaggctgga

SEQ ID NO: 30475 - DNA, 20 bp, Artificial Sequence
  Description of Artificial Sequence: Synthetic oligonucleotide
  Target: SCN10A; (+) strand; PAM type: NRG; PAM sequence: CAG
gttctgtgctgaacctcatc

SEQ ID NO: 30476 - DNA, 20 bp, Artificial Sequence
  Description of Artificial Sequence: Synthetic oligonucleotide
  Target: SCN10A; (+) strand; PAM type: NRG; PAM sequence: CAG
tgctgaacctcatccagctt

SEQ ID NO: 30477 - DNA, 20 bp, Artificial Sequence
  Description of Artificial Sequence: Synthetic oligonucleotide
  Target: SCN10A; (+) strand; PAM type: NRG; PAM sequence: AGG
gctgaacctcatccagcttc

SEQ ID NO: 30478 - DNA, 20 bp, Artificial Sequence
  Description of Artificial Sequence: Synthetic oligonucleotide
  Target: SCN10A; (+) strand; PAM type: NRG; PAM sequence: GAG
tgaacctcatccagcttcag

SEQ ID NO: 30479 - DNA, 20 bp, Artificial Sequence
  Description of Artificial Sequence: Synthetic oligonucleotide
  Target: SCN10A; (+) strand; PAM type: NRG; PAM sequence: AGG
gaacctcatccagcttcagg

SEQ ID NO: 30480 - DNA, 20 bp, Artificial Sequence
  Description of Artificial Sequence: Synthetic oligonucleotide
  Target: SCN10A; (+) strand; PAM type: NRG; PAM sequence: AAG
ctcatccagcttcaggaggc

SEQ ID NO: 30481 - DNA, 20 bp, Artificial Sequence
  Description of Artificial Sequence: Synthetic oligonucleotide
  Target: SCN10A; (+) strand; PAM type: NRG; PAM sequence: CAG
caggaggcaagcaccaaata

SEQ ID NO: 30482 - DNA, 20 bp, Artificial Sequence
  Description of Artificial Sequence: Synthetic oligonucleotide
  Target: SCN10A; (+) strand; PAM type: NRG; PAM sequence: TGG
acatttcctgacacctctgc

SEQ ID NO: 30483 - DNA, 20 bp, Artificial Sequence
  Description of Artificial Sequence: Synthetic oligonucleotide
  Target: SCN10A; (+) strand; PAM type: NRG; PAM sequence: GGG
catttcctgacacctctgct

SEQ ID NO: 30484 - DNA, 20 bp, Artificial Sequence
  Description of Artificial Sequence: Synthetic oligonucleotide
  Target: SCN10A; (+) strand; PAM type: NRG; PAM sequence: CAG
ttcctgacacctctgctggg

SEQ ID NO: 30485 - DNA, 20 bp, Artificial Sequence
  Description of Artificial Sequence: Synthetic oligonucleotide
  Target: SCN10A; (+) strand; PAM type: NRG; PAM sequence: TGG
tgctgggcagaccttgctgc

SEQ ID NO: 30486 - DNA, 20 bp, Artificial Sequence
  Description of Artificial Sequence: Synthetic oligonucleotide
  Target: SCN10A; (+) strand; PAM type: NRG; PAM sequence: CAG
tgggcagaccttgctgctgg

SEQ ID NO: 30487 - DNA, 20 bp, Artificial Sequence
  Description of Artificial Sequence: Synthetic oligonucleotide
  Target: SCN10A; (+) strand; PAM type: NRG; PAM sequence: GAG
cttgctgctggcagctgctt

SEQ ID NO: 30488 - DNA, 20 bp, Artificial Sequence
  Description of Artificial Sequence: Synthetic oligonucleotide
  Target: SCN10A; (+) strand; PAM type: NRG; PAM sequence: TGG
gctgctggcagctgcttgag

SEQ ID NO: 30489 - DNA, 20 bp, Artificial Sequence
  Description of Artificial Sequence: Synthetic oligonucleotide
  Target: SCN10A; (+) strand; PAM type: NRG; PAM sequence: GGG
ctgctggcagctgcttgagt

SEQ ID NO: 30490 - DNA, 20 bp, Artificial Sequence
  Description of Artificial Sequence: Synthetic oligonucleotide
  Target: SCN10A; (+) strand; PAM type: NRG; PAM sequence: GGG
tgctggcagctgcttgagtg

SEQ ID NO: 30491 - DNA, 20 bp, Artificial Sequence
  Description of Artificial Sequence: Synthetic oligonucleotide
  Target: SCN10A; (+) strand; PAM type: NRG; PAM sequence: CAG
tggcagctgcttgagtgggg

SEQ ID NO: 30492 - DNA, 20 bp, Artificial Sequence
  Description of Artificial Sequence: Synthetic oligonucleotide
  Target: SCN10A; (+) strand; PAM type: NRG; PAM sequence: AGG
ggcagctgcttgagtggggc

SEQ ID NO: 30493 - DNA, 20 bp, Artificial Sequence
  Description of Artificial Sequence: Synthetic oligonucleotide
  Target: SCN10A; (+) strand; PAM type: NRG; PAM sequence: CAG
agctgcttgagtggggcagg

SEQ ID NO: 30494 - DNA, 20 bp, Artificial Sequence
  Description of Artificial Sequence: Synthetic oligonucleotide
  Target: SCN10A; (+) strand; PAM type: NRG; PAM sequence: GAG
ctgcttgagtggggcaggca

SEQ ID NO: 30495 - DNA, 20 bp, Artificial Sequence
  Description of Artificial Sequence: Synthetic oligonucleotide
  Target: SCN10A; (+) strand; PAM type: NRG; PAM sequence: CAG
ggggcaggcagagaccaaca

SEQ ID NO: 30496 - DNA, 20 bp, Artificial Sequence
  Description of Artificial Sequence: Synthetic oligonucleotide
  Target: SCN10A; (+) strand; PAM type: NRG; PAM sequence: CAG
cacatgcctcaccctgcttg

SEQ ID NO: 30497 - DNA, 20 bp, Artificial Sequence
  Description of Artificial Sequence: Synthetic oligonucleotide
  Target: SCN10A; (+) strand; PAM type: NRG; PAM sequence: CAG
accctgcttgcagaaaccct

SEQ ID NO: 30498 - DNA, 20 bp, Artificial Sequence
  Description of Artificial Sequence: Synthetic oligonucleotide
  Target: SCN10A; (+) strand; PAM type: NRG; PAM sequence: CGG
tgcagaaaccctcagctatg

SEQ ID NO: 30499 - DNA, 20 bp, Artificial Sequence
  Description of Artificial Sequence: Synthetic oligonucleotide
  Target: SCN10A; (+) strand; PAM type: NRG; PAM sequence: CAG
agaaaccctcagctatgcgg

SEQ ID NO: 30500 - DNA, 20 bp, Artificial Sequence
  Description of Artificial Sequence: Synthetic oligonucleotide
  Target: SCN10A; (+) strand; PAM type: NRG; PAM sequence: CAG
ctcagctatgcggcagtgaa

SEQ ID NO: 30501 - DNA, 20 bp, Artificial Sequence
  Description of Artificial Sequence: Synthetic oligonucleotide
  Target: SCN10A; (+) strand; PAM type: NRG; PAM sequence: CAG
gcggcagtgaacagataact

SEQ ID NO: 30502 - DNA, 20 bp, Artificial Sequence
  Description of Artificial Sequence: Synthetic oligonucleotide
  Target: SCN10A; (+) strand; PAM type: NRG; PAM sequence: AAG
actcagttaaccatgctgca

SEQ ID NO: 30503 - DNA, 20 bp, Artificial Sequence
  Description of Artificial Sequence: Synthetic oligonucleotide
  Target: SCN10A; (+) strand; PAM type: NRG; PAM sequence: AAG
gttaaccatgctgcaaagca

SEQ ID NO: 30504 - DNA, 20 bp, Artificial Sequence
  Description of Artificial Sequence: Synthetic oligonucleotide
  Target: SCN10A; (+) strand; PAM type: NRG; PAM sequence: AAG
aaccatgctgcaaagcaaag

SEQ ID NO: 30505 - DNA, 20 bp, Artificial Sequence
  Description of Artificial Sequence: Synthetic oligonucleotide
  Target: SCN10A; (+) strand; PAM type: NRG; PAM sequence: AGG
accatgctgcaaagcaaaga

SEQ ID NO: 30506 - DNA, 20 bp, Artificial Sequence
  Description of Artificial Sequence: Synthetic oligonucleotide
  Target: SCN10A; (+) strand; PAM type: NRG; PAM sequence: TAG
atgctgcaaagcaaagaagg

SEQ ID NO: 30507 - DNA, 20 bp, Artificial Sequence
  Description of Artificial Sequence: Synthetic oligonucleotide
  Target: SCN10A; (+) strand; PAM type: NRG; PAM sequence: TGG
ctgcaaagcaaagaaggtag

SEQ ID NO: 30508 - DNA, 20 bp, Artificial Sequence
  Description of Artificial Sequence: Synthetic oligonucleotide
  Target: SCN10A; (+) strand; PAM type: NRG; PAM sequence: TAG
aagcaaagaaggtagtggcc

SEQ ID NO: 30509 - DNA, 20 bp, Artificial Sequence
  Description of Artificial Sequence: Synthetic oligonucleotide
  Target: SCN10A; (+) strand; PAM type: NRG; PAM sequence: CAG
aaagaaggtagtggcctaga

SEQ ID NO: 30510 - DNA, 20 bp, Artificial Sequence
  Description of Artificial Sequence: Synthetic oligonucleotide
  Target: SCN10A; (+) strand; PAM type: NRG; PAM sequence: TAG
ggtagtggcctagacagtga

SEQ ID NO: 30511 - DNA, 20 bp, Artificial Sequence
  Description of Artificial Sequence: Synthetic oligonucleotide
  Target: SCN10A; (+) strand; PAM type: NRG; PAM sequence: TGG
tagacagtgatagtgcaatg

SEQ ID NO: 30512 - DNA, 20 bp, Artificial Sequence
  Description of Artificial Sequence: Synthetic oligonucleotide
  Target: SCN10A; (+) strand; PAM type: NRG; PAM sequence: TGG
acagtgatagtgcaatgtgg

SEQ ID NO: 30513 - DNA, 20 bp, Artificial Sequence
  Description of Artificial Sequence: Synthetic oligonucleotide
  Target: SCN10A; (+) strand; PAM type: NRG; PAM sequence: AAG
gatagtgcaatgtggtggtt

SEQ ID NO: 30514 - DNA, 20 bp, Artificial Sequence
  Description of Artificial Sequence: Synthetic oligonucleotide
  Target: SCN10A; (+) strand; PAM type: NRG; PAM sequence: GAG
tgcaatgtggtggttaagat

SEQ ID NO: 30515 - DNA, 20 bp, Artificial Sequence
  Description of Artificial Sequence: Synthetic oligonucleotide
  Target: SCN10A; (+) strand; PAM type: NRG; PAM sequence: AGG
gcaatgtggtggttaagatg

SEQ ID NO: 30516 - DNA, 20 bp, Artificial Sequence
  Description of Artificial Sequence: Synthetic oligonucleotide
  Target: SCN10A; (+) strand; PAM type: NRG; PAM sequence: AAG
atgtggtggttaagatgagg

SEQ ID NO: 30517 - DNA, 20 bp, Artificial Sequence
  Description of Artificial Sequence: Synthetic oligonucleotide
  Target: SCN10A; (+) strand; PAM type: NRG; PAM sequence: GAG
gtggtggttaagatgaggaa

SEQ ID NO: 30518 - DNA, 20 bp, Artificial Sequence
  Description of Artificial Sequence: Synthetic oligonucleotide
  Target: SCN10A; (+) strand; PAM type: NRG; PAM sequence: GAG
aagatgaggaagagatgact

SEQ ID NO: 30519 - DNA, 20 bp, Artificial Sequence
  Description of Artificial Sequence: Synthetic oligonucleotide
  Target: SCN10A; (+) strand; PAM type: NRG; PAM sequence: AGG
agatgaggaagagatgactg

SEQ ID NO: 30520 - DNA, 20 bp, Artificial Sequence
  Description of Artificial Sequence: Synthetic oligonucleotide
  Target: SCN10A; (+) strand; PAM type: NRG; PAM sequence: GAG
gaatcacatgtctgatgtgt

SEQ ID NO: 30521 - DNA, 20 bp, Artificial Sequence
  Description of Artificial Sequence: Synthetic oligonucleotide
  Target: SCN10A; (+) strand; PAM type: NRG; PAM sequence: AAG
tcacatgtctgatgtgtgag

SEQ ID NO: 30522 - DNA, 20 bp, Artificial Sequence
  Description of Artificial Sequence: Synthetic oligonucleotide
  Target: SCN10A; (+) strand; PAM type: NRG; PAM sequence: CAG
tctgatgtgtgagaagcaca

SEQ ID NO: 30523 - DNA, 20 bp, Artificial Sequence
  Description of Artificial Sequence: Synthetic oligonucleotide
  Target: SCN10A; (+) strand; PAM type: NRG; PAM sequence: CAG
acacagtcaattctctaatg

SEQ ID NO: 30524 - DNA, 20 bp, Artificial Sequence
  Description of Artificial Sequence: Synthetic oligonucleotide
  Target: SCN10A; (+) strand; PAM type: NRG; PAM sequence: AGG
cacagtcaattctctaatgc

SEQ ID NO: 30525 - DNA, 20 bp, Artificial Sequence
  Description of Artificial Sequence: Synthetic oligonucleotide
  Target: SCN10A; (+) strand; PAM type: NRG; PAM sequence: GGG
acagtcaattctctaatgca

SEQ ID NO: 30526 - DNA, 20 bp, Artificial Sequence
  Description of Artificial Sequence: Synthetic oligonucleotide
  Target: SCN10A; (+) strand; PAM type: NRG; PAM sequence: TGG
ttctctaatgcagggattac

SEQ ID NO: 30527 - DNA, 20 bp, Artificial Sequence
  Description of Artificial Sequence: Synthetic oligonucleotide
  Target: SCN10A; (+) strand; PAM type: NRG; PAM sequence: CAG
aatgcagggattactggcca

SEQ ID NO: 30528 - DNA, 20 bp, Artificial Sequence
  Description of Artificial Sequence: Synthetic oligonucleotide
  Target: SCN10A; (+) strand; PAM type: NRG; PAM sequence: AGG
atgcagggattactggccac

SEQ ID NO: 30529 - DNA, 20 bp, Artificial Sequence
  Description of Artificial Sequence: Synthetic oligonucleotide
  Target: SCN10A; (+) strand; PAM type: NRG; PAM sequence: GAG
tactggccacaggttaccat

SEQ ID NO: 30530 - DNA, 20 bp, Artificial Sequence
  Description of Artificial Sequence: Synthetic oligonucleotide
  Target: SCN10A; (+) strand; PAM type: NRG; PAM sequence: CAG
gagtgtgaacacatgaactc

SEQ ID NO: 30531 - DNA, 20 bp, Artificial Sequence
  Description of Artificial Sequence: Synthetic oligonucleotide
  Target: SCN10A; (+) strand; PAM type: NRG; PAM sequence: TGG
tctgttcttttcaatgccac

SEQ ID NO: 30532 - DNA, 20 bp, Artificial Sequence
  Description of Artificial Sequence: Synthetic oligonucleotide
  Target: SCN10A; (+) strand; PAM type: NRG; PAM sequence: GGG
ctgttcttttcaatgccact

SEQ ID NO: 30533 - DNA, 20 bp, Artificial Sequence
  Description of Artificial Sequence: Synthetic oligonucleotide
  Target: SCN10A; (+) strand; PAM type: NRG; PAM sequence: GGG
tgttcttttcaatgccactg

SEQ ID NO: 30534 - DNA, 20 bp, Artificial Sequence
  Description of Artificial Sequence: Synthetic oligonucleotide
  Target: SCN10A; (+) strand; PAM type: NRG; PAM sequence: GAG
ttcttttcaatgccactggg

SEQ ID NO: 30535 - DNA, 20 bp, Artificial Sequence
  Description of Artificial Sequence: Synthetic oligonucleotide
  Target: SCN10A; (+) strand; PAM type: NRG; PAM sequence: AGG
tcttttcaatgccactgggg

SEQ ID NO: 30536 - DNA, 20 bp, Artificial Sequence
  Description of Artificial Sequence: Synthetic oligonucleotide
  Target: SCN10A; (+) strand; PAM type: NRG; PAM sequence: GAG
ttttcaatgccactggggag

SEQ ID NO: 30537 - DNA, 20 bp, Artificial Sequence
  Description of Artificial Sequence: Synthetic oligonucleotide
  Target: SCN10A; (+) strand; PAM type: NRG; PAM sequence: AGG
tttcaatgccactggggagg

SEQ ID NO: 30538 - DNA, 20 bp, Artificial Sequence
  Description of Artificial Sequence: Synthetic oligonucleotide
  Target: SCN10A; (+) strand; PAM type: NRG; PAM sequence: CAG
caatgccactggggaggagg

SEQ ID NO: 30539 - DNA, 20 bp, Artificial Sequence
  Description of Artificial Sequence: Synthetic oligonucleotide
  Target: SCN10A; (+) strand; PAM type: NRG; PAM sequence: CAG
tgccactggggaggaggcag

SEQ ID NO: 30540 - DNA, 20 bp, Artificial Sequence
  Description of Artificial Sequence: Synthetic oligonucleotide
  Target: SCN10A; (+) strand; PAM type: NRG; PAM sequence: AAG
tggggaggaggcagcagtat

SEQ ID NO: 30541 - DNA, 20 bp, Artificial Sequence
  Description of Artificial Sequence: Synthetic oligonucleotide
  Target: SCN10A; (+) strand; PAM type: NRG; PAM sequence: CAG
aggaggcagcagtataagct

SEQ ID NO: 30542 - DNA, 20 bp, Artificial Sequence
  Description of Artificial Sequence: Synthetic oligonucleotide
  Target: SCN10A; (+) strand; PAM type: NRG; PAM sequence: TGG
aggcagcagtataagctcag

SEQ ID NO: 30543 - DNA, 20 bp, Artificial Sequence
  Description of Artificial Sequence: Synthetic oligonucleotide
  Target: SCN10A; (+) strand; PAM type: NRG; PAM sequence: AAG
agtataagctcagtggttct

SEQ ID NO: 30544 - DNA, 20 bp, Artificial Sequence
  Description of Artificial Sequence: Synthetic oligonucleotide
  Target: SCN10A; (+) strand; PAM type: NRG; PAM sequence: TGG
agctcagtggttctaagcca

SEQ ID NO: 30545 - DNA, 20 bp, Artificial Sequence
  Description of Artificial Sequence: Synthetic oligonucleotide
  Target: SCN10A; (+) strand; PAM type: NRG; PAM sequence: TGG
tctaagccatggctgcacct

SEQ ID NO: 30546 - DNA, 20 bp, Artificial Sequence
  Description of Artificial Sequence: Synthetic oligonucleotide
  Target: SCN10A; (+) strand; PAM type: NRG; PAM sequence: TGG
ggctgcaccttggaaatgcc

SEQ ID NO: 30547 - DNA, 20 bp, Artificial Sequence
  Description of Artificial Sequence: Synthetic oligonucleotide
  Target: SCN10A; (+) strand; PAM type: NRG; PAM sequence: GGG
gctgcaccttggaaatgcct

SEQ ID NO: 30548 - DNA, 20 bp, Artificial Sequence
  Description of Artificial Sequence: Synthetic oligonucleotide
  Target: SCN10A; (+) strand; PAM type: NRG; PAM sequence: GAG
tgcaccttggaaatgcctgg

SEQ ID NO: 30549 - DNA, 20 bp, Artificial Sequence
  Description of Artificial Sequence: Synthetic oligonucleotide
  Target: SCN10A; (+) strand; PAM type: NRG; PAM sequence: CAG
ctgggagcatttataaaata

SEQ ID NO: 30550 - DNA, 20 bp, Artificial Sequence
  Description of Artificial Sequence: Synthetic oligonucleotide
  Target: SCN10A; (+) strand; PAM type: NRG; PAM sequence: AGG
tgggagcatttataaaatac

SEQ ID NO: 30551 - DNA, 20 bp, Artificial Sequence
  Description of Artificial Sequence: Synthetic oligonucleotide
  Target: SCN10A; (+) strand; PAM type: NRG; PAM sequence: TGG
atttataaaatacaggtgcc

SEQ ID NO: 30552 - DNA, 20 bp, Artificial Sequence
  Description of Artificial Sequence: Synthetic oligonucleotide
  Target: SCN10A; (+) strand; PAM type: NRG; PAM sequence: GGG
tttataaaatacaggtgcct

SEQ ID NO: 30553 - DNA, 20 bp, Artificial Sequence
  Description of Artificial Sequence: Synthetic oligonucleotide
  Target: SCN10A; (+) strand; PAM type: NRG; PAM sequence: AAG
caggtgcctgggcaccaccc

SEQ ID NO: 30554 - DNA, 20 bp, Artificial Sequence
  Description of Artificial Sequence: Synthetic oligonucleotide
  Target: SCN10A; (+) strand; PAM type: NRG; PAM sequence: AAG
gggcaccacccaagaccaat

SEQ ID NO: 30555 - DNA, 20 bp, Artificial Sequence
  Description of Artificial Sequence: Synthetic oligonucleotide
  Target: SCN10A; (+) strand; PAM type: NRG; PAM sequence: CAG
ccacccaagaccaataagat

SEQ ID NO: 30556 - DNA, 20 bp, Artificial Sequence
  Description of Artificial Sequence: Synthetic oligonucleotide
  Target: SCN10A; (+) strand; PAM type: NRG; PAM sequence: TGG
accaataagatcagaatctc

SEQ ID NO: 30557 - DNA, 20 bp, Artificial Sequence
  Description of Artificial Sequence: Synthetic oligonucleotide
  Target: SCN10A; (+) strand; PAM type: NRG; PAM sequence: GGG
ccaataagatcagaatctct

SEQ ID NO: 30558 - DNA, 20 bp, Artificial Sequence
  Description of Artificial Sequence: Synthetic oligonucleotide
  Target: SCN10A; (+) strand; PAM type: NRG; PAM sequence: GGG
caataagatcagaatctctg

SEQ ID NO: 30559 - DNA, 20 bp, Artificial Sequence
  Description of Artificial Sequence: Synthetic oligonucleotide
  Target: SCN10A; (+) strand; PAM type: NRG; PAM sequence: TAG
taagatcagaatctctgggg

SEQ ID NO: 30560 - DNA, 20 bp, Artificial Sequence
  Description of Artificial Sequence: Synthetic oligonucleotide
  Target: SCN10A; (+) strand; PAM type: NRG; PAM sequence: TGG
gatcagaatctctggggtag

SEQ ID NO: 30561 - DNA, 20 bp, Artificial Sequence
  Description of Artificial Sequence: Synthetic oligonucleotide
  Target: SCN10A; (+) strand; PAM type: NRG; PAM sequence: TGG
cagaatctctggggtagtgg

SEQ ID NO: 30562 - DNA, 20 bp, Artificial Sequence
  Description of Artificial Sequence: Synthetic oligonucleotide
  Target: SCN10A; (+) strand; PAM type: NRG; PAM sequence: CGG
atctctggggtagtggtggt

SEQ ID NO: 30563 - DNA, 20 bp, Artificial Sequence
  Description of Artificial Sequence: Synthetic oligonucleotide
  Target: SCN10A; (+) strand; PAM type: NRG; PAM sequence: TAG
gtcggtcactgcatatttca

SEQ ID NO: 30564 - DNA, 20 bp, Artificial Sequence
  Description of Artificial Sequence: Synthetic oligonucleotide
  Target: SCN10A; (+) strand; PAM type: NRG; PAM sequence: CAG
ctgcatatttcatagctccc

SEQ ID NO: 30565 - DNA, 20 bp, Artificial Sequence
  Description of Artificial Sequence: Synthetic oligonucleotide
  Target: SCN10A; (+) strand; PAM type: NRG; PAM sequence: AGG
tgcatatttcatagctcccc

SEQ ID NO: 30566 - DNA, 20 bp, Artificial Sequence
  Description of Artificial Sequence: Synthetic oligonucleotide
  Target: SCN10A; (+) strand; PAM type: NRG; PAM sequence: AAG
tagctccccaggtgattctc

SEQ ID NO: 30567 - DNA, 20 bp, Artificial Sequence
  Description of Artificial Sequence: Synthetic oligonucleotide
  Target: SCN10A; (+) strand; PAM type: NRG; PAM sequence: CAG
ccccaggtgattctcaagtg

SEQ ID NO: 30568 - DNA, 20 bp, Artificial Sequence
  Description of Artificial Sequence: Synthetic oligonucleotide
  Target: SCN10A; (+) strand; PAM type: NRG; PAM sequence: CAG
aggtgattctcaagtgcagc

SEQ ID NO: 30569 - DNA, 20 bp, Artificial Sequence
  Description of Artificial Sequence: Synthetic oligonucleotide
  Target: SCN10A; (+) strand; PAM type: NRG; PAM sequence: AGG
ggtgattctcaagtgcagcc

SEQ ID NO: 30570 - DNA, 20 bp, Artificial Sequence
  Description of Artificial Sequence: Synthetic oligonucleotide
  Target: SCN10A; (+) strand; PAM type: NRG; PAM sequence: GAG
tctcaagtgcagccaggtgt

SEQ ID NO: 30571 - DNA, 20 bp, Artificial Sequence
  Description of Artificial Sequence: Synthetic oligonucleotide
  Target: SCN10A; (+) strand; PAM type: NRG; PAM sequence: AGG
ctcaagtgcagccaggtgtg

SEQ ID NO: 30572 - DNA, 20 bp, Artificial Sequence
  Description of Artificial Sequence: Synthetic oligonucleotide
  Target: SCN10A; (+) strand; PAM type: NRG; PAM sequence: CAG
gcagccaggtgtgaggacca

SEQ ID NO: 30573 - DNA, 20 bp, Artificial Sequence
  Description of Artificial Sequence: Synthetic oligonucleotide
  Target: SCN10A; (+) strand; PAM type: NRG; PAM sequence: CAG
gtgtgaggaccacagaaccg

SEQ ID NO: 30574 - DNA, 20 bp, Artificial Sequence
  Description of Artificial Sequence: Synthetic oligonucleotide
  Target: SCN10A; (+) strand; PAM type: NRG; PAM sequence: AGG
tgtgaggaccacagaaccgc

SEQ ID NO: 30575 - DNA, 20 bp, Artificial Sequence
  Description of Artificial Sequence: Synthetic oligonucleotide
  Target: SCN10A; (+) strand; PAM type: NRG; PAM sequence: TGG
gaggaccacagaaccgcagg

SEQ ID NO: 30576 - DNA, 20 bp, Artificial Sequence
  Description of Artificial Sequence: Synthetic oligonucleotide
  Target: SCN10A; (+) strand; PAM type: NRG; PAM sequence: GGG
aggaccacagaaccgcaggt

SEQ ID NO: 30577 - DNA, 20 bp, Artificial Sequence
  Description of Artificial Sequence: Synthetic oligonucleotide
  Target: SCN10A; (+) strand; PAM type: NRG; PAM sequence: AAG
accacagaaccgcaggtggg

SEQ ID NO: 30578 - DNA, 20 bp, Artificial Sequence
  Description of Artificial Sequence: Synthetic oligonucleotide
  Target: SCN10A; (+) strand; PAM type: NRG; PAM sequence: CAG
gggaagattctctgtgctca

SEQ ID NO: 30579 - DNA, 20 bp, Artificial Sequence
  Description of Artificial Sequence: Synthetic oligonucleotide
  Target: SCN10A; (+) strand; PAM type: NRG; PAM sequence: TGG
ttctctgtgctcacagttca

SEQ ID NO: 30580 - DNA, 20 bp, Artificial Sequence
  Description of Artificial Sequence: Synthetic oligonucleotide
  Target: SCN10A; (+) strand; PAM type: NRG; PAM sequence: AAG
ctcacagttcatggctcccc

SEQ ID NO: 30581 - DNA, 20 bp, Artificial Sequence
  Description of Artificial Sequence: Synthetic oligonucleotide
  Target: SCN10A; (+) strand; PAM type: NRG; PAM sequence: AGG
tcacagttcatggctcccca

SEQ ID NO: 30582 - DNA, 20 bp, Artificial Sequence
  Description of Artificial Sequence: Synthetic oligonucleotide
  Target: SCN10A; (+) strand; PAM type: NRG; PAM sequence: CAG
gttcatggctccccaaggtc

SEQ ID NO: 30583 - DNA, 20 bp, Artificial Sequence
  Description of Artificial Sequence: Synthetic oligonucleotide
  Target: SCN10A; (+) strand; PAM type: NRG; PAM sequence: AAG
catggctccccaaggtccag

SEQ ID NO: 30584 - DNA, 20 bp, Artificial Sequence
  Description of Artificial Sequence: Synthetic oligonucleotide
  Target: SCN10A; (+) strand; PAM type: NRG; PAM sequence: TGG
aggtccagaagacccatcta

SEQ ID NO: 30585 - DNA, 20 bp, Artificial Sequence
  Description of Artificial Sequence: Synthetic oligonucleotide
  Target: SCN10A; (+) strand; PAM type: NRG; PAM sequence: CAG
agaagacccatctatggatg

SEQ ID NO: 30586 - DNA, 20 bp, Artificial Sequence
  Description of Artificial Sequence: Synthetic oligonucleotide
  Target: SCN10A; (+) strand; PAM type: NRG; PAM sequence: AGG
gaagacccatctatggatgc

SEQ ID NO: 30587 - DNA, 20 bp, Artificial Sequence
  Description of Artificial Sequence: Synthetic oligonucleotide
  Target: SCN10A; (+) strand; PAM type: NRG; PAM sequence: GGG
aagacccatctatggatgca

SEQ ID NO: 30588 - DNA, 20 bp, Artificial Sequence
  Description of Artificial Sequence: Synthetic oligonucleotide
  Target: SCN10A; (+) strand; PAM type: NRG; PAM sequence: AAG
atctatggatgcagggccat

SEQ ID NO: 30589 - DNA, 20 bp, Artificial Sequence
  Description of Artificial Sequence: Synthetic oligonucleotide
  Target: SCN10A; (+) strand; PAM type: NRG; PAM sequence: GAG
tgcagggccataagacctct

SEQ ID NO: 30590 - DNA, 20 bp, Artificial Sequence
  Description of Artificial Sequence: Synthetic oligonucleotide
  Target: SCN10A; (+) strand; PAM type: NRG; PAM sequence: GAG
cagggccataagacctctga

SEQ ID NO: 30591 - DNA, 20 bp, Artificial Sequence
  Description of Artificial Sequence: Synthetic oligonucleotide
  Target: SCN10A; (+) strand; PAM type: NRG; PAM sequence: TGG
ctgcatgtgtcatctcactt

SEQ ID NO: 30592 - DNA, 20 bp, Artificial Sequence
  Description of Artificial Sequence: Synthetic oligonucleotide
  Target: SCN10A; (+) strand; PAM type: NRG; PAM sequence: CAG
tcactttggatgtaaaaatg

SEQ ID NO: 30593 - DNA, 20 bp, Artificial Sequence
  Description of Artificial Sequence: Synthetic oligonucleotide
  Target: SCN10A; (+) strand; PAM type: NRG; PAM sequence: GAG
actttggatgtaaaaatgca

SEQ ID NO: 30594 - DNA, 20 bp, Artificial Sequence
  Description of Artificial Sequence: Synthetic oligonucleotide
  Target: SCN10A; (+) strand; PAM type: NRG; PAM sequence: AGG
ctttggatgtaaaaatgcag

SEQ ID NO: 30595 - DNA, 20 bp, Artificial Sequence
  Description of Artificial Sequence: Synthetic oligonucleotide
  Target: SCN10A; (+) strand; PAM type: NRG; PAM sequence: CAG
tgtaaaaatgcagaggattg

SEQ ID NO: 30596 - DNA, 20 bp, Artificial Sequence
  Description of Artificial Sequence: Synthetic oligonucleotide
  Target: SCN10A; (+) strand; PAM type: NRG; PAM sequence: AGG
gtaaaaatgcagaggattgc

SEQ ID NO: 30597 - DNA, 20 bp, Artificial Sequence
  Description of Artificial Sequence: Synthetic oligonucleotide
  Target: SCN10A; (+) strand; PAM type: NRG; PAM sequence: GGG
taaaaatgcagaggattgca

SEQ ID NO: 30598 - DNA, 20 bp, Artificial Sequence
  Description of Artificial Sequence: Synthetic oligonucleotide
  Target: SCN10A; (+) strand; PAM type: NRG; PAM sequence: TGG
attgcagggatctttctgaa

SEQ ID NO: 30599 - DNA, 20 bp, Artificial Sequence
  Description of Artificial Sequence: Synthetic oligonucleotide
  Target: SCN10A; (+) strand; PAM type: NRG; PAM sequence: GAG
tgcagggatctttctgaatg

SEQ ID NO: 30600 - DNA, 20 bp, Artificial Sequence
  Description of Artificial Sequence: Synthetic oligonucleotide
  Target: SCN10A; (+) strand; PAM type: NRG; PAM sequence: CAG
agacctaataactcacctaa

SEQ ID NO: 30601 - DNA, 20 bp, Artificial Sequence
  Description of Artificial Sequence: Synthetic oligonucleotide
  Target: SCN10A; (+) strand; PAM type: NRG; PAM sequence: CAG
taacagtcactattgtgtca

SEQ ID NO: 30602 - DNA, 20 bp, Artificial Sequence
  Description of Artificial Sequence: Synthetic oligonucleotide
  Target: SCN10A; (+) strand; PAM type: NRG; PAM sequence: TGG
tgtcacagtcacatactgcc

SEQ ID NO: 30603 - DNA, 20 bp, Artificial Sequence
  Description of Artificial Sequence: Synthetic oligonucleotide
  Target: SCN10A; (+) strand; PAM type: NRG; PAM sequence: TGG
tgcctggactttaccactca

SEQ ID NO: 30604 - DNA, 20 bp, Artificial Sequence
  Description of Artificial Sequence: Synthetic oligonucleotide
  Target: SCN10A; (+) strand; PAM type: NRG; PAM sequence: GGG
gcctggactttaccactcat

SEQ ID NO: 30605 - DNA, 20 bp, Artificial Sequence
  Description of Artificial Sequence: Synthetic oligonucleotide
  Target: SCN10A; (+) strand; PAM type: NRG; PAM sequence: CAG
actttaccactcatgggtgt

SEQ ID NO: 30606 - DNA, 20 bp, Artificial Sequence
  Description of Artificial Sequence: Synthetic oligonucleotide
  Target: SCN10A; (+) strand; PAM type: NRG; PAM sequence: AGG
ctttaccactcatgggtgtc

SEQ ID NO: 30607 - DNA, 20 bp, Artificial Sequence
  Description of Artificial Sequence: Synthetic oligonucleotide
  Target: SCN10A; (+) strand; PAM type: NRG; PAM sequence: GGG
tttaccactcatgggtgtca

SEQ ID NO: 30608 - DNA, 20 bp, Artificial Sequence
  Description of Artificial Sequence: Synthetic oligonucleotide
  Target: SCN10A; (+) strand; PAM type: NRG; PAM sequence: CAG
atgggtgtcagggctattct

SEQ ID NO: 30609 - DNA, 20 bp, Artificial Sequence
  Description of Artificial Sequence: Synthetic oligonucleotide
  Target: SCN10A; (+) strand; PAM type: NRG; PAM sequence: TGG
aaatgctcaaaacttttctt

SEQ ID NO: 30610 - DNA, 20 bp, Artificial Sequence
  Description of Artificial Sequence: Synthetic oligonucleotide
  Target: SCN10A; (+) strand; PAM type: NRG; PAM sequence: GAG
atgctcaaaacttttctttg

SEQ ID NO: 30611 - DNA, 20 bp, Artificial Sequence
  Description of Artificial Sequence: Synthetic oligonucleotide
  Target: SCN10A; (+) strand; PAM type: NRG; PAM sequence: TAG
ctcaaaacttttctttggag

SEQ ID NO: 30612 - DNA, 20 bp, Artificial Sequence
  Description of Artificial Sequence: Synthetic oligonucleotide
  Target: SCN10A; (+) strand; PAM type: NRG; PAM sequence: GAG
ttttctttggagtagccctt

SEQ ID NO: 30613 - DNA, 20 bp, Artificial Sequence
  Description of Artificial Sequence: Synthetic oligonucleotide
  Target: SCN10A; (+) strand; PAM type: NRG; PAM sequence: AGG
tttctttggagtagcccttg

SEQ ID NO: 30614 - DNA, 20 bp, Artificial Sequence
  Description of Artificial Sequence: Synthetic oligonucleotide
  Target: SCN10A; (+) strand; PAM type: NRG; PAM sequence: GGG
ttctttggagtagcccttga

SEQ ID NO: 30615 - DNA, 20 bp, Artificial Sequence
  Description of Artificial Sequence: Synthetic oligonucleotide
  Target: SCN10A; (+) strand; PAM type: NRG; PAM sequence: CAG
ttggagtagcccttgagggc

SEQ ID NO: 30616 - DNA, 20 bp, Artificial Sequence
  Description of Artificial Sequence: Synthetic oligonucleotide
  Target: SCN10A; (+) strand; PAM type: NRG; PAM sequence: AGG
tggagtagcccttgagggcc

SEQ ID NO: 30617 - DNA, 20 bp, Artificial Sequence
  Description of Artificial Sequence: Synthetic oligonucleotide
  Target: SCN10A; (+) strand; PAM type: NRG; PAM sequence: GAG
cccttgagggccaggtctct

SEQ ID NO: 30618 - DNA, 20 bp, Artificial Sequence
  Description of Artificial Sequence: Synthetic oligonucleotide
  Target: SCN10A; (+) strand; PAM type: NRG; PAM sequence: TAG
tctctgagcttcctttgccc

SEQ ID NO: 30619 - DNA, 20 bp, Artificial Sequence
  Description of Artificial Sequence: Synthetic oligonucleotide
  Target: SCN10A; (+) strand; PAM type: NRG; PAM sequence: TAG
agcttcctttgccctagctg

SEQ ID NO: 30620 - DNA, 20 bp, Artificial Sequence
  Description of Artificial Sequence: Synthetic oligonucleotide
  Target: SCN10A; (+) strand; PAM type: NRG; PAM sequence: CAG
tcctttgccctagctgtagc

SEQ ID NO: 30621 - DNA, 20 bp, Artificial Sequence
  Description of Artificial Sequence: Synthetic oligonucleotide
  Target: SCN10A; (+) strand; PAM type: NRG; PAM sequence: AGG
cctttgccctagctgtagcc

SEQ ID NO: 30622 - DNA, 20 bp, Artificial Sequence
  Description of Artificial Sequence: Synthetic oligonucleotide
  Target: SCN10A; (+) strand; PAM type: NRG; PAM sequence: GAG
tttgccctagctgtagccag

SEQ ID NO: 30623 - DNA, 20 bp, Artificial Sequence
  Description of Artificial Sequence: Synthetic oligonucleotide
  Target: SCN10A; (+) strand; PAM type: NRG; PAM sequence: CAG
ccctagctgtagccaggagt

SEQ ID NO: 30624 - DNA, 20 bp, Artificial Sequence
  Description of Artificial Sequence: Synthetic oligonucleotide
  Target: SCN10A; (+) strand; PAM type: NRG; PAM sequence: GAG
ctagctgtagccaggagtca

SEQ ID NO: 30625 - DNA, 20 bp, Artificial Sequence
  Description of Artificial Sequence: Synthetic oligonucleotide
  Target: SCN10A; (+) strand; PAM type: NRG; PAM sequence: AGG
tagctgtagccaggagtcag

SEQ ID NO: 30626 - DNA, 20 bp, Artificial Sequence
  Description of Artificial Sequence: Synthetic oligonucleotide
  Target: SCN10A; (+) strand; PAM type: NRG; PAM sequence: GGG
agctgtagccaggagtcaga

SEQ ID NO: 30627 - DNA, 20 bp, Artificial Sequence
  Description of Artificial Sequence: Synthetic oligonucleotide
  Target: SCN10A; (+) strand; PAM type: NRG; PAM sequence: GGG
gctgtagccaggagtcagag

SEQ ID NO: 30628 - DNA, 20 bp, Artificial Sequence
  Description of Artificial Sequence: Synthetic oligonucleotide
  Target: SCN10A; (+) strand; PAM type: NRG; PAM sequence: GAG
tgtagccaggagtcagaggg

SEQ ID NO: 30629 - DNA, 20 bp, Artificial Sequence
  Description of Artificial Sequence: Synthetic oligonucleotide
  Target: SCN10A; (+) strand; PAM type: NRG; PAM sequence: AGG
gtagccaggagtcagagggg

SEQ ID NO: 30630 - DNA, 20 bp, Artificial Sequence
  Description of Artificial Sequence: Synthetic oligonucleotide
  Target: SCN10A; (+) strand; PAM type: NRG; PAM sequence: GAG
aaaccccacgtgttcccact

SEQ ID NO: 30631 - DNA, 20 bp, Artificial Sequence
  Description of Artificial Sequence: Synthetic oligonucleotide
  Target: SCN10A; (+) strand; PAM type: NRG; PAM sequence: GAG
gagccactcacattcacaat

SEQ ID NO: 30632 - DNA, 20 bp, Artificial Sequence
  Description of Artificial Sequence: Synthetic oligonucleotide
  Target: SCN10A; (+) strand; PAM type: NRG; PAM sequence: AGG
agccactcacattcacaatg

SEQ ID NO: 30633 - DNA, 20 bp, Artificial Sequence
  Description of Artificial Sequence: Synthetic oligonucleotide
  Target: SCN10A; (+) strand; PAM type: NRG; PAM sequence: AAG
cactcacattcacaatgagg

SEQ ID NO: 30634 - DNA, 20 bp, Artificial Sequence
  Description of Artificial Sequence: Synthetic oligonucleotide
  Target: SCN10A; (+) strand; PAM type: NRG; PAM sequence: CAG
acattcacaatgaggaagtc

SEQ ID NO: 30635 - DNA, 20 bp, Artificial Sequence
  Description of Artificial Sequence: Synthetic oligonucleotide
  Target: SCN10A; (+) strand; PAM type: NRG; PAM sequence: CAG
tcacaatgaggaagtccagc

SEQ ID NO: 30636 - DNA, 20 bp, Artificial Sequence
  Description of Artificial Sequence: Synthetic oligonucleotide
  Target: SCN10A; (+) strand; PAM type: NRG; PAM sequence: CAG
tgaggaagtccagccagcac

SEQ ID NO: 30637 - DNA, 20 bp, Artificial Sequence
  Description of Artificial Sequence: Synthetic oligonucleotide
  Target: SCN10A; (+) strand; PAM type: NRG; PAM sequence: AGG
gaggaagtccagccagcacc

SEQ ID NO: 30638 - DNA, 20 bp, Artificial Sequence
  Description of Artificial Sequence: Synthetic oligonucleotide
  Target: SCN10A; (+) strand; PAM type: NRG; PAM sequence: TGG
gtccagccagcaccaggcat

SEQ ID NO: 30639 - DNA, 20 bp, Artificial Sequence
  Description of Artificial Sequence: Synthetic oligonucleotide
  Target: SCN10A; (+) strand; PAM type: NRG; PAM sequence: AAG
gccagcaccaggcattggtg

SEQ ID NO: 30640 - DNA, 20 bp, Artificial Sequence
  Description of Artificial Sequence: Synthetic oligonucleotide
  Target: SCN10A; (+) strand; PAM type: NRG; PAM sequence: AAG
cattggtgaagtactttttg

SEQ ID NO: 30641 - DNA, 20 bp, Artificial Sequence
  Description of Artificial Sequence: Synthetic oligonucleotide
  Target: SCN10A; (+) strand; PAM type: NRG; PAM sequence: TAG
tgaagtactttttgaagcca

SEQ ID NO: 30642 - DNA, 20 bp, Artificial Sequence
  Description of Artificial Sequence: Synthetic oligonucleotide
  Target: SCN10A; (+) strand; PAM type: NRG; PAM sequence: AGG
gaagtactttttgaagccat

SEQ ID NO: 30643 - DNA, 20 bp, Artificial Sequence
  Description of Artificial Sequence: Synthetic oligonucleotide
  Target: SCN10A; (+) strand; PAM type: NRG; PAM sequence: AAG
aagccataggccacccactt

SEQ ID NO: 30644 - DNA, 20 bp, Artificial Sequence
  Description of Artificial Sequence: Synthetic oligonucleotide
  Target: SCN10A; (+) strand; PAM type: NRG; PAM sequence: CAG
ccataggccacccacttaag

SEQ ID NO: 30645 - DNA, 20 bp, Artificial Sequence
  Description of Artificial Sequence: Synthetic oligonucleotide
  Target: SCN10A; (+) strand; PAM type: NRG; PAM sequence: AAG
taagcagcatctcgaacaca

SEQ ID NO: 30646 - DNA, 20 bp, Artificial Sequence
  Description of Artificial Sequence: Synthetic oligonucleotide
  Target: SCN10A; (+) strand; PAM type: NRG; PAM sequence: AAG
gcatctcgaacacaaagata

SEQ ID NO: 30647 - DNA, 20 bp, Artificial Sequence
  Description of Artificial Sequence: Synthetic oligonucleotide
  Target: SCN10A; (+) strand; PAM type: NRG; PAM sequence: AGG
catctcgaacacaaagataa

SEQ ID NO: 30648 - DNA, 20 bp, Artificial Sequence
  Description of Artificial Sequence: Synthetic oligonucleotide
  Target: SCN10A; (+) strand; PAM type: NRG; PAM sequence: AAG
cgaacacaaagataaaggtg

SEQ ID NO: 30649 - DNA, 20 bp, Artificial Sequence
  Description of Artificial Sequence: Synthetic oligonucleotide
  Target: SCN10A; (+) strand; PAM type: NRG; PAM sequence: CAG
gataaaggtgaagaccctgt

SEQ ID NO: 30650 - DNA, 20 bp, Artificial Sequence
  Description of Artificial Sequence: Synthetic oligonucleotide
  Target: SCN10A; (+) strand; PAM type: NRG; PAM sequence: CAG
aagaccctgtcagtgtactc

SEQ ID NO: 30651 - DNA, 20 bp, Artificial Sequence
  Description of Artificial Sequence: Synthetic oligonucleotide
  Target: SCN10A; (+) strand; PAM type: NRG; PAM sequence: AAG
cctgtcagtgtactccagca

SEQ ID NO: 30652 - DNA, 20 bp, Artificial Sequence
  Description of Artificial Sequence: Synthetic oligonucleotide
  Target: SCN10A; (+) strand; PAM type: NRG; PAM sequence: TGG
ctccagcaaagctttcaccg

SEQ ID NO: 30653 - DNA, 20 bp, Artificial Sequence
  Description of Artificial Sequence: Synthetic oligonucleotide
  Target: SCN10A; (+) strand; PAM type: NRG; PAM sequence: GGG
tccagcaaagctttcaccgt

SEQ ID NO: 30654 - DNA, 20 bp, Artificial Sequence
  Description of Artificial Sequence: Synthetic oligonucleotide
  Target: SCN10A; (+) strand; PAM type: NRG; PAM sequence: TGG
aagctttcaccgtgggcttc

SEQ ID NO: 30655 - DNA, 20 bp, Artificial Sequence
  Description of Artificial Sequence: Synthetic oligonucleotide
  Target: SCN10A; (+) strand; PAM type: NRG; PAM sequence: CAG
ttcaccgtgggcttctggtc

SEQ ID NO: 30656 - DNA, 20 bp, Artificial Sequence
  Description of Artificial Sequence: Synthetic oligonucleotide
  Target: SCN10A; (+) strand; PAM type: NRG; PAM sequence: AGG
tcaccgtgggcttctggtcc

SEQ ID NO: 30657 - DNA, 20 bp, Artificial Sequence
  Description of Artificial Sequence: Synthetic oligonucleotide
  Target: SCN10A; (+) strand; PAM type: NRG; PAM sequence: TAG
tgggcttctggtccaggtaa

SEQ ID NO: 30658 - DNA, 20 bp, Artificial Sequence
  Description of Artificial Sequence: Synthetic oligonucleotide
  Target: SCN10A; (+) strand; PAM type: NRG; PAM sequence: AAG
ggtccaggtaatagtcttca

SEQ ID NO: 30659 - DNA, 20 bp, Artificial Sequence
  Description of Artificial Sequence: Synthetic oligonucleotide
  Target: SCN10A; (+) strand; PAM type: NRG; PAM sequence: AGG
gtccaggtaatagtcttcaa

SEQ ID NO: 30660 - DNA, 20 bp, Artificial Sequence
  Description of Artificial Sequence: Synthetic oligonucleotide
  Target: SCN10A; (+) strand; PAM type: NRG; PAM sequence: TGG
ggtaatagtcttcaaaggcc

SEQ ID NO: 30661 - DNA, 20 bp, Artificial Sequence
  Description of Artificial Sequence: Synthetic oligonucleotide
  Target: SCN10A; (+) strand; PAM type: NRG; PAM sequence: AAG
aatagtcttcaaaggcctgg

SEQ ID NO: 30662 - DNA, 20 bp, Artificial Sequence
  Description of Artificial Sequence: Synthetic oligonucleotide
  Target: SCN10A; (+) strand; PAM type: NRG; PAM sequence: AGG
atagtcttcaaaggcctgga

SEQ ID NO: 30663 - DNA, 20 bp, Artificial Sequence
  Description of Artificial Sequence: Synthetic oligonucleotide
  Target: SCN10A; (+) strand; PAM type: NRG; PAM sequence: AAG
gtcttcaaaggcctggaagg

SEQ ID NO: 30664 - DNA, 20 bp, Artificial Sequence
  Description of Artificial Sequence: Synthetic oligonucleotide
  Target: SCN10A; (+) strand; PAM type: NRG; PAM sequence: AAG
tcaaaggcctggaaggaaga

SEQ ID NO: 30665 - DNA, 20 bp, Artificial Sequence
  Description of Artificial Sequence: Synthetic oligonucleotide
  Target: SCN10A; (+) strand; PAM type: NRG; PAM sequence: AGG
caaaggcctggaaggaagaa

SEQ ID NO: 30666 - DNA, 20 bp, Artificial Sequence
  Description of Artificial Sequence: Synthetic oligonucleotide
  Target: SCN10A; (+) strand; PAM type: NRG; PAM sequence: CAG
cctggaaggaagaaaggatg

SEQ ID NO: 30667 - DNA, 20 bp, Artificial Sequence
  Description of Artificial Sequence: Synthetic oligonucleotide
  Target: SCN10A; (+) strand; PAM type: NRG; PAM sequence: TGG
aaggaagaaaggatgcagaa

SEQ ID NO: 30668 - DNA, 20 bp, Artificial Sequence
  Description of Artificial Sequence: Synthetic oligonucleotide
  Target: SCN10A; (+) strand; PAM type: NRG; PAM sequence: CAG
gaagaaaggatgcagaatgg

SEQ ID NO: 30669 - DNA, 20 bp, Artificial Sequence
  Description of Artificial Sequence: Synthetic oligonucleotide
  Target: SCN10A; (+) strand; PAM type: NRG; PAM sequence: AGG
aagaaaggatgcagaatggc

SEQ ID NO: 30670 - DNA, 20 bp, Artificial Sequence
  Description of Artificial Sequence: Synthetic oligonucleotide
  Target: SCN10A; (+) strand; PAM type: NRG; PAM sequence: TGG
atgcagaatggcaggctgcc

SEQ ID NO: 30671 - DNA, 20 bp, Artificial Sequence
  Description of Artificial Sequence: Synthetic oligonucleotide
  Target: SCN10A; (+) strand; PAM type: NRG; PAM sequence: CAG
tggcaggctgcctggaccca

SEQ ID NO: 30672 - DNA, 20 bp, Artificial Sequence
  Description of Artificial Sequence: Synthetic oligonucleotide
  Target: SCN10A; (+) strand; PAM type: NRG; PAM sequence: TGG
gctgcctggacccacagcac

SEQ ID NO: 30673 - DNA, 20 bp, Artificial Sequence
  Description of Artificial Sequence: Synthetic oligonucleotide
  Target: SCN10A; (+) strand; PAM type: NRG; PAM sequence: GGG
ctgcctggacccacagcact

SEQ ID NO: 30674 - DNA, 20 bp, Artificial Sequence
  Description of Artificial Sequence: Synthetic oligonucleotide
  Target: SCN10A; (+) strand; PAM type: NRG; PAM sequence: GGG
tgcctggacccacagcactg

SEQ ID NO: 30675 - DNA, 20 bp, Artificial Sequence
  Description of Artificial Sequence: Synthetic oligonucleotide
  Target: SCN10A; (+) strand; PAM type: NRG; PAM sequence: CAG
ggacccacagcactggggcc

SEQ ID NO: 30676 - DNA, 20 bp, Artificial Sequence
  Description of Artificial Sequence: Synthetic oligonucleotide
  Target: SCN10A; (+) strand; PAM type: NRG; PAM sequence: TAG
agcactggggcccagactga

SEQ ID NO: 30677 - DNA, 20 bp, Artificial Sequence
  Description of Artificial Sequence: Synthetic oligonucleotide
  Target: SCN10A; (+) strand; PAM type: NRG; PAM sequence: AGG
gcactggggcccagactgat

SEQ ID NO: 30678 - DNA, 20 bp, Artificial Sequence
  Description of Artificial Sequence: Synthetic oligonucleotide
  Target: SCN10A; (+) strand; PAM type: NRG; PAM sequence: GGG
cactggggcccagactgata

SEQ ID NO: 30679 - DNA, 20 bp, Artificial Sequence
  Description of Artificial Sequence: Synthetic oligonucleotide
  Target: SCN10A; (+) strand; PAM type: NRG; PAM sequence: AAG
tggggcccagactgataggg

SEQ ID NO: 30680 - DNA, 20 bp, Artificial Sequence
  Description of Artificial Sequence: Synthetic oligonucleotide
  Target: SCN10A; (+) strand; PAM type: NRG; PAM sequence: AGG
ggggcccagactgataggga

SEQ ID NO: 30681 - DNA, 20 bp, Artificial Sequence
  Description of Artificial Sequence: Synthetic oligonucleotide
  Target: SCN10A; (+) strand; PAM type: NRG; PAM sequence: CAG
cagactgatagggaaggacc

SEQ ID NO: 30682 - DNA, 20 bp, Artificial Sequence
  Description of Artificial Sequence: Synthetic oligonucleotide
  Target: SCN10A; (+) strand; PAM type: NRG; PAM sequence: CAG
ctgatagggaaggacccagc

SEQ ID NO: 30683 - DNA, 20 bp, Artificial Sequence
  Description of Artificial Sequence: Synthetic oligonucleotide
  Target: SCN10A; (+) strand; PAM type: NRG; PAM sequence: CAG
gacccagccagccctgacca

SEQ ID NO: 30684 - DNA, 20 bp, Artificial Sequence
  Description of Artificial Sequence: Synthetic oligonucleotide
  Target: SCN10A; (+) strand; PAM type: NRG; PAM sequence: TGG
ccagccctgaccacagtccc

SEQ ID NO: 30685 - DNA, 20 bp, Artificial Sequence
  Description of Artificial Sequence: Synthetic oligonucleotide
  Target: SCN10A; (+) strand; PAM type: NRG; PAM sequence: AAG
gccctgaccacagtccctgg

SEQ ID NO: 30686 - DNA, 20 bp, Artificial Sequence
  Description of Artificial Sequence: Synthetic oligonucleotide
  Target: SCN10A; (+) strand; PAM type: NRG; PAM sequence: AGG
ccctgaccacagtccctgga

SEQ ID NO: 30687 - DNA, 20 bp, Artificial Sequence
  Description of Artificial Sequence: Synthetic oligonucleotide
  Target: SCN10A; (+) strand; PAM type: NRG; PAM sequence: GGG
cctgaccacagtccctggaa

SEQ ID NO: 30688 - DNA, 20 bp, Artificial Sequence
  Description of Artificial Sequence: Synthetic oligonucleotide
  Target: SCN10A; (+) strand; PAM type: NRG; PAM sequence: GGG
ctgaccacagtccctggaag

SEQ ID NO: 30689 - DNA, 20 bp, Artificial Sequence
  Description of Artificial Sequence: Synthetic oligonucleotide
  Target: SCN10A; (+) strand; PAM type: NRG; PAM sequence: TGG
acagtccctggaaggggatt

SEQ ID NO: 30690 - DNA, 20 bp, Artificial Sequence
  Description of Artificial Sequence: Synthetic oligonucleotide
  Target: SCN10A; (+) strand; PAM type: NRG; PAM sequence: TAG
gtccctggaaggggatttgg

SEQ ID NO: 30691 - DNA, 20 bp, Artificial Sequence
  Description of Artificial Sequence: Synthetic oligonucleotide
  Target: SCN10A; (+) strand; PAM type: NRG; PAM sequence: CAG
ctggaaggggatttggtagt

SEQ ID NO: 30692 - DNA, 20 bp, Artificial Sequence
  Description of Artificial Sequence: Synthetic oligonucleotide
  Target: SCN10A; (+) strand; PAM type: NRG; PAM sequence: CAG
ggatttggtagtcagcttgc

SEQ ID NO: 30693 - DNA, 20 bp, Artificial Sequence
  Description of Artificial Sequence: Synthetic oligonucleotide
  Target: SCN10A; (+) strand; PAM type: NRG; PAM sequence: TAG
tttggtagtcagcttgccag

SEQ ID NO: 30694 - DNA, 20 bp, Artificial Sequence
  Description of Artificial Sequence: Synthetic oligonucleotide
  Target: SCN10A; (+) strand; PAM type: NRG; PAM sequence: TGG
cagtagcattttgtttgctg

SEQ ID NO: 30695 - DNA, 20 bp, Artificial Sequence
  Description of Artificial Sequence: Synthetic oligonucleotide
  Target: SCN10A; (+) strand; PAM type: NRG; PAM sequence: GGG
agtagcattttgtttgctgt

SEQ ID NO: 30696 - DNA, 20 bp, Artificial Sequence
  Description of Artificial Sequence: Synthetic oligonucleotide
  Target: SCN10A; (+) strand; PAM type: NRG; PAM sequence: GGG
gtagcattttgtttgctgtg

SEQ ID NO: 30697 - DNA, 20 bp, Artificial Sequence
  Description of Artificial Sequence: Synthetic oligonucleotide
  Target: SCN10A; (+) strand; PAM type: NRG; PAM sequence: GAG
agcattttgtttgctgtggg

SEQ ID NO: 30698 - DNA, 20 bp, Artificial Sequence
  Description of Artificial Sequence: Synthetic oligonucleotide
  Target: SCN10A; (+) strand; PAM type: NRG; PAM sequence: AGG
gcattttgtttgctgtgggg

SEQ ID NO: 30699 - DNA, 20 bp, Artificial Sequence
  Description of Artificial Sequence: Synthetic oligonucleotide
  Target: SCN10A; (+) strand; PAM type: NRG; PAM sequence: AAG
ttgtttgctgtggggaggta

SEQ ID NO: 30700 - DNA, 20 bp, Artificial Sequence
  Description of Artificial Sequence: Synthetic oligonucleotide
  Target: SCN10A; (+) strand; PAM type: NRG; PAM sequence: TGG
tttgctgtggggaggtaaag

SEQ ID NO: 30701 - DNA, 20 bp, Artificial Sequence
  Description of Artificial Sequence: Synthetic oligonucleotide
  Target: SCN10A; (+) strand; PAM type: NRG; PAM sequence: GGG
ttgctgtggggaggtaaagt

SEQ ID NO: 30702 - DNA, 20 bp, Artificial Sequence
  Description of Artificial Sequence: Synthetic oligonucleotide
  Target: SCN10A; (+) strand; PAM type: NRG; PAM sequence: TAG
tgtggggaggtaaagtggga

SEQ ID NO: 30703 - DNA, 20 bp, Artificial Sequence
  Description of Artificial Sequence: Synthetic oligonucleotide
  Target: SCN10A; (+) strand; PAM type: NRG; PAM sequence: TGG
ggggaggtaaagtgggatag

SEQ ID NO: 30704 - DNA, 20 bp, Artificial Sequence
  Description of Artificial Sequence: Synthetic oligonucleotide
  Target: SCN10A; (+) strand; PAM type: NRG; PAM sequence: GAG
ggaggtaaagtgggatagtg

SEQ ID NO: 30705 - DNA, 20 bp, Artificial Sequence
  Description of Artificial Sequence: Synthetic oligonucleotide
  Target: SCN10A; (+) strand; PAM type: NRG; PAM sequence: AGG
gaggtaaagtgggatagtgg

SEQ ID NO: 30706 - DNA, 20 bp, Artificial Sequence
  Description of Artificial Sequence: Synthetic oligonucleotide
  Target: SCN10A; (+) strand; PAM type: NRG; PAM sequence: GAG
ggtaaagtgggatagtggag

SEQ ID NO: 30707 - DNA, 20 bp, Artificial Sequence
  Description of Artificial Sequence: Synthetic oligonucleotide
  Target: SCN10A; (+) strand; PAM type: NRG; PAM sequence: AGG
gtaaagtgggatagtggagg

SEQ ID NO: 30708 - DNA, 20 bp, Artificial Sequence
  Description of Artificial Sequence: Synthetic oligonucleotide
  Target: SCN10A; (+) strand; PAM type: NRG; PAM sequence: GAG
gatagtggaggaggtactgt

SEQ ID NO: 30709 - DNA, 20 bp, Artificial Sequence
  Description of Artificial Sequence: Synthetic oligonucleotide
  Target: SCN10A; (+) strand; PAM type: NRG; PAM sequence: AAG
aggaggtactgtgagatcca

SEQ ID NO: 30710 - DNA, 20 bp, Artificial Sequence
  Description of Artificial Sequence: Synthetic oligonucleotide
  Target: SCN10A; (+) strand; PAM type: NRG; PAM sequence: CAG
gatccaaagcatgacttctt

SEQ ID NO: 30711 - DNA, 20 bp, Artificial Sequence
  Description of Artificial Sequence: Synthetic oligonucleotide
  Target: SCN10A; (+) strand; PAM type: NRG; PAM sequence: AGG
atccaaagcatgacttcttc

SEQ ID NO: 30712 - DNA, 20 bp, Artificial Sequence
  Description of Artificial Sequence: Synthetic oligonucleotide
  Target: SCN10A; (+) strand; PAM type: NRG; PAM sequence: GGG
tccaaagcatgacttcttca

SEQ ID NO: 30713 - DNA, 20 bp, Artificial Sequence
  Description of Artificial Sequence: Synthetic oligonucleotide
  Target: SCN10A; (+) strand; PAM type: NRG; PAM sequence: TGG
catgacttcttcagggccaa

SEQ ID NO: 30714 - DNA, 20 bp, Artificial Sequence
  Description of Artificial Sequence: Synthetic oligonucleotide
  Target: SCN10A; (+) strand; PAM type: NRG; PAM sequence: GGG
atgacttcttcagggccaat

SEQ ID NO: 30715 - DNA, 20 bp, Artificial Sequence
  Description of Artificial Sequence: Synthetic oligonucleotide
  Target: SCN10A; (+) strand; PAM type: NRG; PAM sequence: GGG
tgacttcttcagggccaatg

SEQ ID NO: 30716 - DNA, 20 bp, Artificial Sequence
  Description of Artificial Sequence: Synthetic oligonucleotide
  Target: SCN10A; (+) strand; PAM type: NRG; PAM sequence: CAG
tcagggccaatggggacaaa

SEQ ID NO: 30717 - DNA, 20 bp, Artificial Sequence
  Description of Artificial Sequence: Synthetic oligonucleotide
  Target: SCN10A; (+) strand; PAM type: NRG; PAM sequence: CAG
aacagccctgctgatacttg

SEQ ID NO: 30718 - DNA, 20 bp, Artificial Sequence
  Description of Artificial Sequence: Synthetic oligonucleotide
  Target: SCN10A; (+) strand; PAM type: NRG; PAM sequence: AGG
acagccctgctgatacttgc

SEQ ID NO: 30719 - DNA, 20 bp, Artificial Sequence
  Description of Artificial Sequence: Synthetic oligonucleotide
  Target: SCN10A; (+) strand; PAM type: NRG; PAM sequence: GGG
cagccctgctgatacttgca

SEQ ID NO: 30720 - DNA, 20 bp, Artificial Sequence
  Description of Artificial Sequence: Synthetic oligonucleotide
  Target: SCN10A; (+) strand; PAM type: NRG; PAM sequence: AAG
cttgcagggatgctgaatgc

SEQ ID NO: 30721 - DNA, 20 bp, Artificial Sequence
  Description of Artificial Sequence: Synthetic oligonucleotide
  Target: SCN10A; (+) strand; PAM type: NRG; PAM sequence: AGG
ttgcagggatgctgaatgca

SEQ ID NO: 30722 - DNA, 20 bp, Artificial Sequence
  Description of Artificial Sequence: Synthetic oligonucleotide
  Target: SCN10A; (+) strand; PAM type: NRG; PAM sequence: GGG
tgcagggatgctgaatgcaa

SEQ ID NO: 30723 - DNA, 20 bp, Artificial Sequence
  Description of Artificial Sequence: Synthetic oligonucleotide
  Target: SCN10A; (+) strand; PAM type: NRG; PAM sequence: GAG
cagggatgctgaatgcaagg

SEQ ID NO: 30724 - DNA, 20 bp, Artificial Sequence
  Description of Artificial Sequence: Synthetic oligonucleotide
  Target: SCN10A; (+) strand; PAM type: NRG; PAM sequence: AAG
gatgctgaatgcaagggaga

SEQ ID NO: 30725 - DNA, 20 bp, Artificial Sequence
  Description of Artificial Sequence: Synthetic oligonucleotide
  Target: SCN10A; (+) strand; PAM type: NRG; PAM sequence: TGG
gaaagaaaaccttctcaaat

SEQ ID NO: 30726 - DNA, 20 bp, Artificial Sequence
  Description of Artificial Sequence: Synthetic oligonucleotide
  Target: SCN10A; (+) strand; PAM type: NRG; PAM sequence: TGG
aaccttctcaaattggattt

SEQ ID NO: 30727 - DNA, 20 bp, Artificial Sequence
  Description of Artificial Sequence: Synthetic oligonucleotide
  Target: SCN10A; (+) strand; PAM type: NRG; PAM sequence: AAG
cttctcaaattggattttgg

SEQ ID NO: 30728 - DNA, 20 bp, Artificial Sequence
  Description of Artificial Sequence: Synthetic oligonucleotide
  Target: SCN10A; (+) strand; PAM type: NRG; PAM sequence: AAG
tggattttggaagtgaacca

SEQ ID NO: 30729 - DNA, 20 bp, Artificial Sequence
  Description of Artificial Sequence: Synthetic oligonucleotide
  Target: SCN10A; (+) strand; PAM type: NRG; PAM sequence: AGG
ggattttggaagtgaaccaa

SEQ ID NO: 30730 - DNA, 20 bp, Artificial Sequence
  Description of Artificial Sequence: Synthetic oligonucleotide
  Target: SCN10A; (+) strand; PAM type: NRG; PAM sequence: GGG
gattttggaagtgaaccaaa

SEQ ID NO: 30731 - DNA, 20 bp, Artificial Sequence
  Description of Artificial Sequence: Synthetic oligonucleotide
  Target: SCN10A; (+) strand; PAM type: NRG; PAM sequence: CAG
gtgaaccaaagggatgctaa

SEQ ID NO: 30732 - DNA, 20 bp, Artificial Sequence
  Description of Artificial Sequence: Synthetic oligonucleotide
  Target: SCN10A; (+) strand; PAM type: NRG; PAM sequence: AAG
gtgactttgtttaaaaataa

SEQ ID NO: 30733 - DNA, 20 bp, Artificial Sequence
  Description of Artificial Sequence: Synthetic oligonucleotide
  Target: SCN10A; (+) strand; PAM type: NRG; PAM sequence: CGG
tttaaaaataaaagcatcaa

SEQ ID NO: 30734 - DNA, 20 bp, Artificial Sequence
  Description of Artificial Sequence: Synthetic oligonucleotide
  Target: SCN10A; (+) strand; PAM type: NRG; PAM sequence: CAG
aaagcatcaacggatgttca

SEQ ID NO: 30735 - DNA, 20 bp, Artificial Sequence
  Description of Artificial Sequence: Synthetic oligonucleotide
  Target: SCN10A; (+) strand; PAM type: NRG; PAM sequence: AGG
aagcatcaacggatgttcac

SEQ ID NO: 30736 - DNA, 20 bp, Artificial Sequence
  Description of Artificial Sequence: Synthetic oligonucleotide
  Target: SCN10A; (+) strand; PAM type: NRG; PAM sequence: CAG
catcaacggatgttcacagg

SEQ ID NO: 30737 - DNA, 20 bp, Artificial Sequence
  Description of Artificial Sequence: Synthetic oligonucleotide
  Target: SCN10A; (+) strand; PAM type: NRG; PAM sequence: AAG
caggcagtttacaaaaatga

SEQ ID NO: 30738 - DNA, 20 bp, Artificial Sequence
  Description of Artificial Sequence: Synthetic oligonucleotide
  Target: SCN10A; (+) strand; PAM type: NRG; PAM sequence: AAG
cagtttacaaaaatgaaagt

SEQ ID NO: 30739 - DNA, 20 bp, Artificial Sequence
  Description of Artificial Sequence: Synthetic oligonucleotide
  Target: SCN10A; (+) strand; PAM type: NRG; PAM sequence: AAG
tcgccaacacacctctgaaa

SEQ ID NO: 30740 - DNA, 20 bp, Artificial Sequence
  Description of Artificial Sequence: Synthetic oligonucleotide
  Target: SCN10A; (+) strand; PAM type: NRG; PAM sequence: TGG
aaaagaatgttctatctcac

SEQ ID NO: 30741 - DNA, 20 bp, Artificial Sequence
  Description of Artificial Sequence: Synthetic oligonucleotide
  Target: SCN10A; (+) strand; PAM type: NRG; PAM sequence: AAG
gttctatctcactggtaatc

SEQ ID NO: 30742 - DNA, 20 bp, Artificial Sequence
  Description of Artificial Sequence: Synthetic oligonucleotide
  Target: SCN10A; (+) strand; PAM type: NRG; PAM sequence: AGG
ttctatctcactggtaatca

SEQ ID NO: 30743 - DNA, 20 bp, Artificial Sequence
  Description of Artificial Sequence: Synthetic oligonucleotide
  Target: SCN10A; (+) strand; PAM type: NRG; PAM sequence: AAG
atcaaggaaattcaaattaa

SEQ ID NO: 30744 - DNA, 20 bp, Artificial Sequence
  Description of Artificial Sequence: Synthetic oligonucleotide
  Target: SCN10A; (+) strand; PAM type: NRG; PAM sequence: AAG
aaggaaattcaaattaaaag

SEQ ID NO: 30745 - DNA, 20 bp, Artificial Sequence
  Description of Artificial Sequence: Synthetic oligonucleotide
  Target: SCN10A; (+) strand; PAM type: NRG; PAM sequence: CAG
agatgctgtttttcttttat

SEQ ID NO: 30746 - DNA, 20 bp, Artificial Sequence
  Description of Artificial Sequence: Synthetic oligonucleotide
  Target: SCN10A; (+) strand; PAM type: NRG; PAM sequence: TGG
ctgtttttcttttatcagac

SEQ ID NO: 30747 - DNA, 20 bp, Artificial Sequence
  Description of Artificial Sequence: Synthetic oligonucleotide
  Target: SCN10A; (+) strand; PAM type: NRG; PAM sequence: TGG
tttttcttttatcagactgg

SEQ ID NO: 30748 - DNA, 20 bp, Artificial Sequence
  Description of Artificial Sequence: Synthetic oligonucleotide
  Target: SCN10A; (+) strand; PAM type: NRG; PAM sequence: GAG
tttcttttatcagactggtg

SEQ ID NO: 30749 - DNA, 20 bp, Artificial Sequence
  Description of Artificial Sequence: Synthetic oligonucleotide
  Target: SCN10A; (+) strand; PAM type: NRG; PAM sequence: TGG
ttttatcagactggtggaga

SEQ ID NO: 30750 - DNA, 20 bp, Artificial Sequence
  Description of Artificial Sequence: Synthetic oligonucleotide
  Target: SCN10A; (+) strand; PAM type: NRG; PAM sequence: AAG
tcagactggtggagatggaa

SEQ ID NO: 30751 - DNA, 20 bp, Artificial Sequence
  Description of Artificial Sequence: Synthetic oligonucleotide
  Target: SCN10A; (+) strand; PAM type: NRG; PAM sequence: TAG
ctggtggagatggaaaagaa

SEQ ID NO: 30752 - DNA, 20 bp, Artificial Sequence
  Description of Artificial Sequence: Synthetic oligonucleotide
  Target: SCN10A; (+) strand; PAM type: NRG; PAM sequence: AGG
tggtggagatggaaaagaat

SEQ ID NO: 30753 - DNA, 20 bp, Artificial Sequence
  Description of Artificial Sequence: Synthetic oligonucleotide
  Target: SCN10A; (+) strand; PAM type: NRG; PAM sequence: GGG
ggtggagatggaaaagaata

SEQ ID NO: 30754 - DNA, 20 bp, Artificial Sequence
  Description of Artificial Sequence: Synthetic oligonucleotide
  Target: SCN10A; (+) strand; PAM type: NRG; PAM sequence: GGG
gtggagatggaaaagaatag

SEQ ID NO: 30755 - DNA, 20 bp, Artificial Sequence
  Description of Artificial Sequence: Synthetic oligonucleotide
  Target: SCN10A; (+) strand; PAM type: NRG; PAM sequence: TAG
gaaaagaataggggaaaccc

SEQ ID NO: 30756 - DNA, 20 bp, Artificial Sequence
  Description of Artificial Sequence: Synthetic oligonucleotide
  Target: SCN10A; (+) strand; PAM type: NRG; PAM sequence: AGG
aaaagaataggggaaaccct

SEQ ID NO: 30757 - DNA, 20 bp, Artificial Sequence
  Description of Artificial Sequence: Synthetic oligonucleotide
  Target: SCN10A; (+) strand; PAM type: NRG; PAM sequence: TGG
ggggaaaccctaggatgctg

SEQ ID NO: 30758 - DNA, 20 bp, Artificial Sequence
  Description of Artificial Sequence: Synthetic oligonucleotide
  Target: SCN10A; (+) strand; PAM type: NRG; PAM sequence: TGG
accctaggatgctgtggctg

SEQ ID NO: 30759 - DNA, 20 bp, Artificial Sequence
  Description of Artificial Sequence: Synthetic oligonucleotide
  Target: SCN10A; (+) strand; PAM type: NRG; PAM sequence: GGG
ccctaggatgctgtggctgt

SEQ ID NO: 30760 - DNA, 20 bp, Artificial Sequence
  Description of Artificial Sequence: Synthetic oligonucleotide
  Target: SCN10A; (+) strand; PAM type: NRG; PAM sequence: GGG
cctaggatgctgtggctgtg

SEQ ID NO: 30761 - DNA, 20 bp, Artificial Sequence
  Description of Artificial Sequence: Synthetic oligonucleotide
  Target: SCN10A; (+) strand; PAM type: NRG; PAM sequence: GGG
ctaggatgctgtggctgtgg

SEQ ID NO: 30762 - DNA, 20 bp, Artificial Sequence
  Description of Artificial Sequence: Synthetic oligonucleotide
  Target: SCN10A; (+) strand; PAM type: NRG; PAM sequence: GGG
taggatgctgtggctgtggg

SEQ ID NO: 30763 - DNA, 20 bp, Artificial Sequence
  Description of Artificial Sequence: Synthetic oligonucleotide
  Target: SCN10A; (+) strand; PAM type: NRG; PAM sequence: GAG
tttttttttttttttttttt

SEQ ID NO: 30764 - DNA, 20 bp, Artificial Sequence
  Description of Artificial Sequence: Synthetic oligonucleotide
  Target: SCN10A; (+) strand; PAM type: NRG; PAM sequence: CGG
ttttttttttttttttgaga

SEQ ID NO: 30765 - DNA, 20 bp, Artificial Sequence
  Description of Artificial Sequence: Synthetic oligonucleotide
  Target: SCN10A; (+) strand; PAM type: NRG; PAM sequence: GAG
ttttttttttttttgagacg

SEQ ID NO: 30766 - DNA, 20 bp, Artificial Sequence
  Description of Artificial Sequence: Synthetic oligonucleotide
  Target: SCN10A; (+) strand; PAM type: NRG; PAM sequence: CAG
cggagtctcgctctgtcgcc

SEQ ID NO: 30767 - DNA, 20 bp, Artificial Sequence
  Description of Artificial Sequence: Synthetic oligonucleotide
  Target: SCN10A; (+) strand; PAM type: NRG; PAM sequence: AGG
ggagtctcgctctgtcgccc

SEQ ID NO: 30768 - DNA, 20 bp, Artificial Sequence
  Description of Artificial Sequence: Synthetic oligonucleotide
  Target: SCN10A; (+) strand; PAM type: NRG; PAM sequence: TGG
tctcgctctgtcgcccaggc

SEQ ID NO: 30769 - DNA, 20 bp, Artificial Sequence
  Description of Artificial Sequence: Synthetic oligonucleotide
  Target: SCN10A; (+) strand; PAM type: NRG; PAM sequence: GAG
tcgctctgtcgcccaggctg

SEQ ID NO: 30770 - DNA, 20 bp, Artificial Sequence
  Description of Artificial Sequence: Synthetic oligonucleotide
  Target: SCN10A; (+) strand; PAM type: NRG; PAM sequence: CAG
ctgtcgcccaggctggagtg

SEQ ID NO: 30771 - DNA, 20 bp, Artificial Sequence
  Description of Artificial Sequence: Synthetic oligonucleotide
  Target: SCN10A; (+) strand; PAM type: NRG; PAM sequence: TAG
tcgcccaggctggagtgcag

SEQ ID NO: 30772 - DNA, 20 bp, Artificial Sequence
  Description of Artificial Sequence: Synthetic oligonucleotide
  Target: SCN10A; (+) strand; PAM type: NRG; PAM sequence: CGG
cccaggctggagtgcagtag

SEQ ID NO: 30773 - DNA, 20 bp, Artificial Sequence
  Description of Artificial Sequence: Synthetic oligonucleotide
  Target: SCN10A; (+) strand; PAM type: NRG; PAM sequence: GGG
ccaggctggagtgcagtagc

SEQ ID NO: 30774 - DNA, 20 bp, Artificial Sequence
  Description of Artificial Sequence: Synthetic oligonucleotide
  Target: SCN10A; (+) strand; PAM type: NRG; PAM sequence: CGG
ggagtgcagtagcgggatct

SEQ ID NO: 30775 - DNA, 20 bp, Artificial Sequence
  Description of Artificial Sequence: Synthetic oligonucleotide
  Target: SCN10A; (+) strand; PAM type: NRG; PAM sequence: AAG
gcgggatctcggctcactgc

SEQ ID NO: 30776 - DNA, 20 bp, Artificial Sequence
  Description of Artificial Sequence: Synthetic oligonucleotide
  Target: SCN10A; (+) strand; PAM type: NRG; PAM sequence: CAG
tcactgcaagctctgcctcc

SEQ ID NO: 30777 - DNA, 20 bp, Artificial Sequence
  Description of Artificial Sequence: Synthetic oligonucleotide
  Target: SCN10A; (+) strand; PAM type: NRG; PAM sequence: AGG
cactgcaagctctgcctccc

SEQ ID NO: 30778 - DNA, 20 bp, Artificial Sequence
  Description of Artificial Sequence: Synthetic oligonucleotide
  Target: SCN10A; (+) strand; PAM type: NRG; PAM sequence: CAG
ttcacgccattctcctgcct

SEQ ID NO: 30779 - DNA, 20 bp, Artificial Sequence
  Description of Artificial Sequence: Synthetic oligonucleotide
  Target: SCN10A; (+) strand; PAM type: NRG; PAM sequence: AAG
ttctcctgcctcagcctccc

SEQ ID NO: 30780 - DNA, 20 bp, Artificial Sequence
  Description of Artificial Sequence: Synthetic oligonucleotide
  Target: SCN10A; (+) strand; PAM type: NRG; PAM sequence: TAG
tcctgcctcagcctcccaag

SEQ ID NO: 30781 - DNA, 20 bp, Artificial Sequence
  Description of Artificial Sequence: Synthetic oligonucleotide
  Target: SCN10A; (+) strand; PAM type: NRG; PAM sequence: TGG
gcctcagcctcccaagtagc

SEQ ID NO: 30782 - DNA, 20 bp, Artificial Sequence
  Description of Artificial Sequence: Synthetic oligonucleotide
  Target: SCN10A; (+) strand; PAM type: NRG; PAM sequence: GGG
cctcagcctcccaagtagct

SEQ ID NO: 30783 - DNA, 20 bp, Artificial Sequence
  Description of Artificial Sequence: Synthetic oligonucleotide
  Target: SCN10A; (+) strand; PAM type: NRG; PAM sequence: CAG
ctcccaagtagctgggacta

SEQ ID NO: 30784 - DNA, 20 bp, Artificial Sequence
  Description of Artificial Sequence: Synthetic oligonucleotide
  Target: SCN10A; (+) strand; PAM type: NRG; PAM sequence: AGG
tcccaagtagctgggactac

SEQ ID NO: 30785 - DNA, 20 bp, Artificial Sequence
  Description of Artificial Sequence: Synthetic oligonucleotide
  Target: SCN10A; (+) strand; PAM type: NRG; PAM sequence: CGG
caggcgcccgccactacgcc

SEQ ID NO: 30786 - DNA, 20 bp, Artificial Sequence
  Description of Artificial Sequence: Synthetic oligonucleotide
  Target: SCN10A; (+) strand; PAM type: NRG; PAM sequence: TAG
cggctaattttttgtatttt

SEQ ID NO: 30787 - DNA, 20 bp, Artificial Sequence
  Description of Artificial Sequence: Synthetic oligonucleotide
  Target: SCN10A; (+) strand; PAM type: NRG; PAM sequence: TAG
ctaattttttgtatttttag

SEQ ID NO: 30788 - DNA, 20 bp, Artificial Sequence
  Description of Artificial Sequence: Synthetic oligonucleotide
  Target: SCN10A; (+) strand; PAM type: NRG; PAM sequence: GAG
aattttttgtatttttagta

SEQ ID NO: 30789 - DNA, 20 bp, Artificial Sequence
  Description of Artificial Sequence: Synthetic oligonucleotide
  Target: SCN10A; (+) strand; PAM type: NRG; PAM sequence: CGG
ttttgtatttttagtagaga

SEQ ID NO: 30790 - DNA, 20 bp, Artificial Sequence
  Description of Artificial Sequence: Synthetic oligonucleotide
  Target: SCN10A; (+) strand; PAM type: NRG; PAM sequence: GGG
tttgtatttttagtagagac

SEQ ID NO: 30791 - DNA, 20 bp, Artificial Sequence
  Description of Artificial Sequence: Synthetic oligonucleotide
  Target: SCN10A; (+) strand; PAM type: NRG; PAM sequence: GGG
ttgtatttttagtagagacg

SEQ ID NO: 30792 - DNA, 20 bp, Artificial Sequence
  Description of Artificial Sequence: Synthetic oligonucleotide
  Target: SCN10A; (+) strand; PAM type: NRG; PAM sequence: TAG
gagacggggtttcaccgttt

SEQ ID NO: 30793 - DNA, 20 bp, Artificial Sequence
  Description of Artificial Sequence: Synthetic oligonucleotide
  Target: SCN10A; (+) strand; PAM type: NRG; PAM sequence: CGG
cggggtttcaccgttttagc

SEQ ID NO: 30794 - DNA, 20 bp, Artificial Sequence
  Description of Artificial Sequence: Synthetic oligonucleotide
  Target: SCN10A; (+) strand; PAM type: NRG; PAM sequence: GGG
ggggtttcaccgttttagcc

SEQ ID NO: 30795 - DNA, 20 bp, Artificial Sequence
  Description of Artificial Sequence: Synthetic oligonucleotide
  Target: SCN10A; (+) strand; PAM type: NRG; PAM sequence: TGG
tttcaccgttttagccggga

SEQ ID NO: 30796 - DNA, 20 bp, Artificial Sequence
  Description of Artificial Sequence: Synthetic oligonucleotide
  Target: SCN10A; (+) strand; PAM type: NRG; PAM sequence: CAG
acctcatgatccgcccgcct

SEQ ID NO: 30797 - DNA, 20 bp, Artificial Sequence
  Description of Artificial Sequence: Synthetic oligonucleotide
  Target: SCN10A; (+) strand; PAM type: NRG; PAM sequence: AAG
ccgcccgcctcagcctccca

SEQ ID NO: 30798 - DNA, 20 bp, Artificial Sequence
  Description of Artificial Sequence: Synthetic oligonucleotide
  Target: SCN10A; (+) strand; PAM type: NRG; PAM sequence: TGG
gcctcagcctcccaaagtgc

SEQ ID NO: 30799 - DNA, 20 bp, Artificial Sequence
  Description of Artificial Sequence: Synthetic oligonucleotide
  Target: SCN10A; (+) strand; PAM type: NRG; PAM sequence: GGG
cctcagcctcccaaagtgct

SEQ ID NO: 30800 - DNA, 20 bp, Artificial Sequence
  Description of Artificial Sequence: Synthetic oligonucleotide
  Target: SCN10A; (+) strand; PAM type: NRG; PAM sequence: CAG
ctcccaaagtgctgggatta

SEQ ID NO: 30801 - DNA, 20 bp, Artificial Sequence
  Description of Artificial Sequence: Synthetic oligonucleotide
  Target: SCN10A; (+) strand; PAM type: NRG; PAM sequence: AGG
tcccaaagtgctgggattac

SEQ ID NO: 30802 - DNA, 20 bp, Artificial Sequence
  Description of Artificial Sequence: Synthetic oligonucleotide
  Target: SCN10A; (+) strand; PAM type: NRG; PAM sequence: GAG
agtgctgggattacaggcgt

SEQ ID NO: 30803 - DNA, 20 bp, Artificial Sequence
  Description of Artificial Sequence: Synthetic oligonucleotide
  Target: SCN10A; (+) strand; PAM type: NRG; PAM sequence: CGG
caggcgtgagccaccgcgcc

SEQ ID NO: 30804 - DNA, 20 bp, Artificial Sequence
  Description of Artificial Sequence: Synthetic oligonucleotide
  Target: SCN10A; (+) strand; PAM type: NRG; PAM sequence: AAG
ccgcgcccggccactcttac

SEQ ID NO: 30805 - DNA, 20 bp, Artificial Sequence
  Description of Artificial Sequence: Synthetic oligonucleotide
  Target: SCN10A; (+) strand; PAM type: NRG; PAM sequence: TGG
cggccactcttacaagtgac

SEQ ID NO: 30806 - DNA, 20 bp, Artificial Sequence
  Description of Artificial Sequence: Synthetic oligonucleotide
  Target: SCN10A; (+) strand; PAM type: NRG; PAM sequence: CAG
ccactcttacaagtgactgg

SEQ ID NO: 30807 - DNA, 20 bp, Artificial Sequence
  Description of Artificial Sequence: Synthetic oligonucleotide
  Target: SCN10A; (+) strand; PAM type: NRG; PAM sequence: AGG
cactcttacaagtgactggc

SEQ ID NO: 30808 - DNA, 20 bp, Artificial Sequence
  Description of Artificial Sequence: Synthetic oligonucleotide
  Target: SCN10A; (+) strand; PAM type: NRG; PAM sequence: GAG
ctcttacaagtgactggcag

SEQ ID NO: 30809 - DNA, 20 bp, Artificial Sequence
  Description of Artificial Sequence: Synthetic oligonucleotide
  Target: SCN10A; (+) strand; PAM type: NRG; PAM sequence: TGG
gactggcaggagtgaaaacc

SEQ ID NO: 30810 - DNA, 20 bp, Artificial Sequence
  Description of Artificial Sequence: Synthetic oligonucleotide
  Target: SCN10A; (+) strand; PAM type: NRG; PAM sequence: CAG
ggcaggagtgaaaacctggc

SEQ ID NO: 30811 - DNA, 20 bp, Artificial Sequence
  Description of Artificial Sequence: Synthetic oligonucleotide
  Target: SCN10A; (+) strand; PAM type: NRG; PAM sequence: AAG
aacctggccagtcctgtgtg

SEQ ID NO: 30812 - DNA, 20 bp, Artificial Sequence
  Description of Artificial Sequence: Synthetic oligonucleotide
  Target: SCN10A; (+) strand; PAM type: NRG; PAM sequence: TGG
agtcctgtgtgaagccaaat

SEQ ID NO: 30813 - DNA, 20 bp, Artificial Sequence
  Description of Artificial Sequence: Synthetic oligonucleotide
  Target: SCN10A; (+) strand; PAM type: NRG; PAM sequence: CAG
gccaaattggcaatgtgact

SEQ ID NO: 30814 - DNA, 20 bp, Artificial Sequence
  Description of Artificial Sequence: Synthetic oligonucleotide
  Target: SCN10A; (+) strand; PAM type: NRG; PAM sequence: GAG
caaattggcaatgtgactca

SEQ ID NO: 30815 - DNA, 20 bp, Artificial Sequence
  Description of Artificial Sequence: Synthetic oligonucleotide
  Target: SCN10A; (+) strand; PAM type: NRG; PAM sequence: AGG
aaattggcaatgtgactcag

SEQ ID NO: 30816 - DNA, 20 bp, Artificial Sequence
  Description of Artificial Sequence: Synthetic oligonucleotide
  Target: SCN10A; (+) strand; PAM type: NRG; PAM sequence: CAG
gcaatgtgactcagaggttt

SEQ ID NO: 30817 - DNA, 20 bp, Artificial Sequence
  Description of Artificial Sequence: Synthetic oligonucleotide
  Target: SCN10A; (+) strand; PAM type: NRG; PAM sequence: AGG
caatgtgactcagaggtttc

SEQ ID NO: 30818 - DNA, 20 bp, Artificial Sequence
  Description of Artificial Sequence: Synthetic oligonucleotide
  Target: SCN10A; (+) strand; PAM type: NRG; PAM sequence: TAG
actcagaggtttcaggaacc

SEQ ID NO: 30819 - DNA, 20 bp, Artificial Sequence
  Description of Artificial Sequence: Synthetic oligonucleotide
  Target: SCN10A; (+) strand; PAM type: NRG; PAM sequence: AAG
aacctagcaattcctccttc

SEQ ID NO: 30820 - DNA, 20 bp, Artificial Sequence
  Description of Artificial Sequence: Synthetic oligonucleotide
  Target: SCN10A; (+) strand; PAM type: NRG; PAM sequence: AAG
ctccttcaagcactaatcct

SEQ ID NO: 30821 - DNA, 20 bp, Artificial Sequence
  Description of Artificial Sequence: Synthetic oligonucleotide
  Target: SCN10A; (+) strand; PAM type: NRG; PAM sequence: AGG
tccttcaagcactaatccta

SEQ ID NO: 30822 - DNA, 20 bp, Artificial Sequence
  Description of Artificial Sequence: Synthetic oligonucleotide
  Target: SCN10A; (+) strand; PAM type: NRG; PAM sequence: TGG
agcactaatcctaaggacac

SEQ ID NO: 30823 - DNA, 20 bp, Artificial Sequence
  Description of Artificial Sequence: Synthetic oligonucleotide
  Target: SCN10A; (+) strand; PAM type: NRG; PAM sequence: GAG
cactaatcctaaggacactg

SEQ ID NO: 30824 - DNA, 20 bp, Artificial Sequence
  Description of Artificial Sequence: Synthetic oligonucleotide
  Target: SCN10A; (+) strand; PAM type: NRG; PAM sequence: AGG
actaatcctaaggacactgg

SEQ ID NO: 30825 - DNA, 20 bp, Artificial Sequence
  Description of Artificial Sequence: Synthetic oligonucleotide
  Target: SCN10A; (+) strand; PAM type: NRG; PAM sequence: TGG
ctaaggacactggaggctgt

SEQ ID NO: 30826 - DNA, 20 bp, Artificial Sequence
  Description of Artificial Sequence: Synthetic oligonucleotide
  Target: SCN10A; (+) strand; PAM type: NRG; PAM sequence: CAG
ggaggctgttggtgcccact

SEQ ID NO: 30827 - DNA, 20 bp, Artificial Sequence
  Description of Artificial Sequence: Synthetic oligonucleotide
  Target: SCN10A; (+) strand; PAM type: NRG; PAM sequence: AGG
gaggctgttggtgcccactc

SEQ ID NO: 30828 - DNA, 20 bp, Artificial Sequence
  Description of Artificial Sequence: Synthetic oligonucleotide
  Target: SCN10A; (+) strand; PAM type: NRG; PAM sequence: AAG
tgcccactcaggtcctcttt

SEQ ID NO: 30829 - DNA, 20 bp, Artificial Sequence
  Description of Artificial Sequence: Synthetic oligonucleotide
  Target: SCN10A; (+) strand; PAM type: NRG; PAM sequence: AGG
gcccactcaggtcctcttta

SEQ ID NO: 30830 - DNA, 20 bp, Artificial Sequence
  Description of Artificial Sequence: Synthetic oligonucleotide
  Target: SCN10A; (+) strand; PAM type: NRG; PAM sequence: GGG
cccactcaggtcctctttaa

SEQ ID NO: 30831 - DNA, 20 bp, Artificial Sequence
  Description of Artificial Sequence: Synthetic oligonucleotide
  Target: SCN10A; (+) strand; PAM type: NRG; PAM sequence: GGG
ccactcaggtcctctttaag

SEQ ID NO: 30832 - DNA, 20 bp, Artificial Sequence
  Description of Artificial Sequence: Synthetic oligonucleotide
  Target: SCN10A; (+) strand; PAM type: NRG; PAM sequence: CAG
tcaggtcctctttaaggggc

SEQ ID NO: 30833 - DNA, 20 bp, Artificial Sequence
  Description of Artificial Sequence: Synthetic oligonucleotide
  Target: SCN10A; (+) strand; PAM type: NRG; PAM sequence: TGG
tgcccctatccttcatctgc

SEQ ID NO: 30834 - DNA, 20 bp, Artificial Sequence
  Description of Artificial Sequence: Synthetic oligonucleotide
  Target: SCN10A; (+) strand; PAM type: NRG; PAM sequence: GGG
gcccctatccttcatctgct

SEQ ID NO: 30835 - DNA, 20 bp, Artificial Sequence
  Description of Artificial Sequence: Synthetic oligonucleotide
  Target: SCN10A; (+) strand; PAM type: NRG; PAM sequence: GAG
ccctatccttcatctgctgg

SEQ ID NO: 30836 - DNA, 20 bp, Artificial Sequence
  Description of Artificial Sequence: Synthetic oligonucleotide
  Target: SCN10A; (+) strand; PAM type: NRG; PAM sequence: CGG
ccttcatctgctgggagtgt

SEQ ID NO: 30837 - DNA, 20 bp, Artificial Sequence
  Description of Artificial Sequence: Synthetic oligonucleotide
  Target: SCN10A; (+) strand; PAM type: NRG; PAM sequence: TAG
ctgggagtgtcggctgctaa

SEQ ID NO: 30838 - DNA, 20 bp, Artificial Sequence
  Description of Artificial Sequence: Synthetic oligonucleotide
  Target: SCN10A; (+) strand; PAM type: NRG; PAM sequence: TGG
tgtcggctgctaatagttca

SEQ ID NO: 30839 - DNA, 20 bp, Artificial Sequence
  Description of Artificial Sequence: Synthetic oligonucleotide
  Target: SCN10A; (+) strand; PAM type: NRG; PAM sequence: CAG
ctgctaatagttcatggatg

SEQ ID NO: 30840 - DNA, 20 bp, Artificial Sequence
  Description of Artificial Sequence: Synthetic oligonucleotide
  Target: SCN10A; (+) strand; PAM type: NRG; PAM sequence: TGG
tgcagacacccccttcctga

SEQ ID NO: 30841 - DNA, 20 bp, Artificial Sequence
  Description of Artificial Sequence: Synthetic oligonucleotide
  Target: SCN10A; (+) strand; PAM type: NRG; PAM sequence: TGG
ccccttcctgatggcttcgc

SEQ ID NO: 30842 - DNA, 20 bp, Artificial Sequence
  Description of Artificial Sequence: Synthetic oligonucleotide
  Target: SCN10A; (+) strand; PAM type: NRG; PAM sequence: GGG
cccttcctgatggcttcgct

SEQ ID NO: 30843 - DNA, 20 bp, Artificial Sequence
  Description of Artificial Sequence: Synthetic oligonucleotide
  Target: SCN10A; (+) strand; PAM type: NRG; PAM sequence: TGG
tcctgatggcttcgctgggc

SEQ ID NO: 30844 - DNA, 20 bp, Artificial Sequence
  Description of Artificial Sequence: Synthetic oligonucleotide
  Target: SCN10A; (+) strand; PAM type: NRG; PAM sequence: GAG
ctgatggcttcgctgggctg

SEQ ID NO: 30845 - DNA, 20 bp, Artificial Sequence
  Description of Artificial Sequence: Synthetic oligonucleotide
  Target: SCN10A; (+) strand; PAM type: NRG; PAM sequence: AGG
tgatggcttcgctgggctgg

SEQ ID NO: 30846 - DNA, 20 bp, Artificial Sequence
  Description of Artificial Sequence: Synthetic oligonucleotide
  Target: SCN10A; (+) strand; PAM type: NRG; PAM sequence: TGG
ggaggaaactgtgtccacct

SEQ ID NO: 30847 - DNA, 20 bp, Artificial Sequence
  Description of Artificial Sequence: Synthetic oligonucleotide
  Target: SCN10A; (+) strand; PAM type: NRG; PAM sequence: GGG
gaggaaactgtgtccacctt

SEQ ID NO: 30848 - DNA, 20 bp, Artificial Sequence
  Description of Artificial Sequence: Synthetic oligonucleotide
  Target: SCN10A; (+) strand; PAM type: NRG; PAM sequence: TGG
gaaatgcttatcctccccgc

SEQ ID NO: 30849 - DNA, 20 bp, Artificial Sequence
  Description of Artificial Sequence: Synthetic oligonucleotide
  Target: SCN10A; (+) strand; PAM type: NRG; PAM sequence: GGG
aaatgcttatcctccccgct

SEQ ID NO: 30850 - DNA, 20 bp, Artificial Sequence
  Description of Artificial Sequence: Synthetic oligonucleotide
  Target: SCN10A; (+) strand; PAM type: NRG; PAM sequence: GGG
aatgcttatcctccccgctg

SEQ ID NO: 30851 - DNA, 20 bp, Artificial Sequence
  Description of Artificial Sequence: Synthetic oligonucleotide
  Target: SCN10A; (+) strand; PAM type: NRG; PAM sequence: CAG
gcttatcctccccgctgggg

SEQ ID NO: 30852 - DNA, 20 bp, Artificial Sequence
  Description of Artificial Sequence: Synthetic oligonucleotide
  Target: SCN10A; (+) strand; PAM type: NRG; PAM sequence: CAG
ctccccgctggggcagccct

SEQ ID NO: 30853 - DNA, 20 bp, Artificial Sequence
  Description of Artificial Sequence: Synthetic oligonucleotide
  Target: SCN10A; (+) strand; PAM type: NRG; PAM sequence: CAG
ccgctggggcagccctcagc

SEQ ID NO: 30854 - DNA, 20 bp, Artificial Sequence
  Description of Artificial Sequence: Synthetic oligonucleotide
  Target: SCN10A; (+) strand; PAM type: NRG; PAM sequence: AGG
cgctggggcagccctcagcc

SEQ ID NO: 30855 - DNA, 20 bp, Artificial Sequence
  Description of Artificial Sequence: Synthetic oligonucleotide
  Target: SCN10A; (+) strand; PAM type: NRG; PAM sequence: GGG
gctggggcagccctcagcca

SEQ ID NO: 30856 - DNA, 20 bp, Artificial Sequence
  Description of Artificial Sequence: Synthetic oligonucleotide
  Target: SCN10A; (+) strand; PAM type: NRG; PAM sequence: CAG
gggcagccctcagccaggga

SEQ ID NO: 30857 - DNA, 20 bp, Artificial Sequence
  Description of Artificial Sequence: Synthetic oligonucleotide
  Target: SCN10A; (+) strand; PAM type: NRG; PAM sequence: CAG
ccctcagccagggacagtga

SEQ ID NO: 30858 - DNA, 20 bp, Artificial Sequence
  Description of Artificial Sequence: Synthetic oligonucleotide
  Target: SCN10A; (+) strand; PAM type: NRG; PAM sequence: AGG
cctcagccagggacagtgac

SEQ ID NO: 30859 - DNA, 20 bp, Artificial Sequence
  Description of Artificial Sequence: Synthetic oligonucleotide
  Target: SCN10A; (+) strand; PAM type: NRG; PAM sequence: GGG
ctcagccagggacagtgaca

SEQ ID NO: 30860 - DNA, 20 bp, Artificial Sequence
  Description of Artificial Sequence: Synthetic oligonucleotide
  Target: SCN10A; (+) strand; PAM type: NRG; PAM sequence: GGG
tcagccagggacagtgacag

SEQ ID NO: 30861 - DNA, 20 bp, Artificial Sequence
  Description of Artificial Sequence: Synthetic oligonucleotide
  Target: SCN10A; (+) strand; PAM type: NRG; PAM sequence: GGG
cagccagggacagtgacagg

SEQ ID NO: 30862 - DNA, 20 bp, Artificial Sequence
  Description of Artificial Sequence: Synthetic oligonucleotide
  Target: SCN10A; (+) strand; PAM type: NRG; PAM sequence: AAG
acagtgacagggggatttac

SEQ ID NO: 30863 - DNA, 20 bp, Artificial Sequence
  Description of Artificial Sequence: Synthetic oligonucleotide
  Target: SCN10A; (+) strand; PAM type: NRG; PAM sequence: AGG
cagtgacagggggatttaca

SEQ ID NO: 30864 - DNA, 20 bp, Artificial Sequence
  Description of Artificial Sequence: Synthetic oligonucleotide
  Target: SCN10A; (+) strand; PAM type: NRG; PAM sequence: AAG
aaggctgtcttctttgcctc

SEQ ID NO: 30865 - DNA, 20 bp, Artificial Sequence
  Description of Artificial Sequence: Synthetic oligonucleotide
  Target: SCN10A; (+) strand; PAM type: NRG; PAM sequence: AGG
aggctgtcttctttgcctca

SEQ ID NO: 30866 - DNA, 20 bp, Artificial Sequence
  Description of Artificial Sequence: Synthetic oligonucleotide
  Target: SCN10A; (+) strand; PAM type: NRG; PAM sequence: TGG
ctgtcttctttgcctcaagg

SEQ ID NO: 30867 - DNA, 20 bp, Artificial Sequence
  Description of Artificial Sequence: Synthetic oligonucleotide
  Target: SCN10A; (+) strand; PAM type: NRG; PAM sequence: GGG
tgtcttctttgcctcaaggt

SEQ ID NO: 30868 - DNA, 20 bp, Artificial Sequence
  Description of Artificial Sequence: Synthetic oligonucleotide
  Target: SCN10A; (+) strand; PAM type: NRG; PAM sequence: CAG
ttctttgcctcaaggtggga

SEQ ID NO: 30869 - DNA, 20 bp, Artificial Sequence
  Description of Artificial Sequence: Synthetic oligonucleotide
  Target: SCN10A; (+) strand; PAM type: NRG; PAM sequence: TGG
ctcaaggtgggacagctctt

SEQ ID NO: 30870 - DNA, 20 bp, Artificial Sequence
  Description of Artificial Sequence: Synthetic oligonucleotide
  Target: SCN10A; (+) strand; PAM type: NRG; PAM sequence: CAG
ctttggtgtcctttgtgctt

SEQ ID NO: 30871 - DNA, 20 bp, Artificial Sequence
  Description of Artificial Sequence: Synthetic oligonucleotide
  Target: SCN10A; (+) strand; PAM type: NRG; PAM sequence: AGG
tttggtgtcctttgtgcttc

SEQ ID NO: 30872 - DNA, 20 bp, Artificial Sequence
  Description of Artificial Sequence: Synthetic oligonucleotide
  Target: SCN10A; (+) strand; PAM type: NRG; PAM sequence: GGG
ttggtgtcctttgtgcttca

SEQ ID NO: 30873 - DNA, 20 bp, Artificial Sequence
  Description of Artificial Sequence: Synthetic oligonucleotide
  Target: SCN10A; (+) strand; PAM type: NRG; PAM sequence: TGG
ttgtgcttcagggctttcca

SEQ ID NO: 30874 - DNA, 20 bp, Artificial Sequence
  Description of Artificial Sequence: Synthetic oligonucleotide
  Target: SCN10A; (+) strand; PAM type: NRG; PAM sequence: GGG
tgtgcttcagggctttccat

SEQ ID NO: 30875 - DNA, 20 bp, Artificial Sequence
  Description of Artificial Sequence: Synthetic oligonucleotide
  Target: SCN10A; (+) strand; PAM type: NRG; PAM sequence: CAG
ttcagggctttccatgggat

SEQ ID NO: 30876 - DNA, 20 bp, Artificial Sequence
  Description of Artificial Sequence: Synthetic oligonucleotide
  Target: SCN10A; (+) strand; PAM type: NRG; PAM sequence: AAG
gctttccatgggatcagctg

SEQ ID NO: 30877 - DNA, 20 bp, Artificial Sequence
  Description of Artificial Sequence: Synthetic oligonucleotide
  Target: SCN10A; (+) strand; PAM type: NRG; PAM sequence: CGG
tccatgggatcagctgaagc

SEQ ID NO: 30878 - DNA, 20 bp, Artificial Sequence
  Description of Artificial Sequence: Synthetic oligonucleotide
  Target: SCN10A; (+) strand; PAM type: NRG; PAM sequence: CAG
actgaacccacatcttttct

SEQ ID NO: 30879 - DNA, 20 bp, Artificial Sequence
  Description of Artificial Sequence: Synthetic oligonucleotide
  Target: SCN10A; (+) strand; PAM type: NRG; PAM sequence: TAG
tcagcttccgattctgtgtc

SEQ ID NO: 30880 - DNA, 20 bp, Artificial Sequence
  Description of Artificial Sequence: Synthetic oligonucleotide
  Target: SCN10A; (+) strand; PAM type: NRG; PAM sequence: AGG
cagcttccgattctgtgtct

SEQ ID NO: 30881 - DNA, 20 bp, Artificial Sequence
  Description of Artificial Sequence: Synthetic oligonucleotide
  Target: SCN10A; (+) strand; PAM type: NRG; PAM sequence: GAG
tccgattctgtgtctaggac

SEQ ID NO: 30882 - DNA, 20 bp, Artificial Sequence
  Description of Artificial Sequence: Synthetic oligonucleotide
  Target: SCN10A; (+) strand; PAM type: NRG; PAM sequence: AGG
ccgattctgtgtctaggacg

SEQ ID NO: 30883 - DNA, 20 bp, Artificial Sequence
  Description of Artificial Sequence: Synthetic oligonucleotide
  Target: SCN10A; (+) strand; PAM type: NRG; PAM sequence: AAG
ctgtgtctaggacgaggact

SEQ ID NO: 30884 - DNA, 20 bp, Artificial Sequence
  Description of Artificial Sequence: Synthetic oligonucleotide
  Target: SCN10A; (+) strand; PAM type: NRG; PAM sequence: TGG
gtctaggacgaggactaaga

SEQ ID NO: 30885 - DNA, 20 bp, Artificial Sequence
  Description of Artificial Sequence: Synthetic oligonucleotide
  Target: SCN10A; (+) strand; PAM type: NRG; PAM sequence: GGG
tctaggacgaggactaagat

SEQ ID NO: 30886 - DNA, 20 bp, Artificial Sequence
  Description of Artificial Sequence: Synthetic oligonucleotide
  Target: SCN10A; (+) strand; PAM type: NRG; PAM sequence: GAG
taggacgaggactaagatgg

SEQ ID NO: 30887 - DNA, 20 bp, Artificial Sequence
  Description of Artificial Sequence: Synthetic oligonucleotide
  Target: SCN10A; (+) strand; PAM type: NRG; PAM sequence: AAG
ggagattatccaacgtctct

SEQ ID NO: 30888 - DNA, 20 bp, Artificial Sequence
  Description of Artificial Sequence: Synthetic oligonucleotide
  Target: SCN10A; (+) strand; PAM type: NRG; PAM sequence: AGG
gagattatccaacgtctcta

SEQ ID NO: 30889 - DNA, 20 bp, Artificial Sequence
  Description of Artificial Sequence: Synthetic oligonucleotide
  Target: SCN10A; (+) strand; PAM type: NRG; PAM sequence: GGG
agattatccaacgtctctaa

SEQ ID NO: 30890 - DNA, 20 bp, Artificial Sequence
  Description of Artificial Sequence: Synthetic oligonucleotide
  Target: SCN10A; (+) strand; PAM type: NRG; PAM sequence: GAG
attatccaacgtctctaagg

SEQ ID NO: 30891 - DNA, 20 bp, Artificial Sequence
  Description of Artificial Sequence: Synthetic oligonucleotide
  Target: SCN10A; (+) strand; PAM type: NRG; PAM sequence: CAG
cgtctctaagggagtacaca

SEQ ID NO: 30892 - DNA, 20 bp, Artificial Sequence
  Description of Artificial Sequence: Synthetic oligonucleotide
  Target: SCN10A; (+) strand; PAM type: NRG; PAM sequence: AGG
gtctctaagggagtacacac

SEQ ID NO: 30893 - DNA, 20 bp, Artificial Sequence
  Description of Artificial Sequence: Synthetic oligonucleotide
  Target: SCN10A; (+) strand; PAM type: NRG; PAM sequence: GGG
tctctaagggagtacacaca

SEQ ID NO: 30894 - DNA, 20 bp, Artificial Sequence
  Description of Artificial Sequence: Synthetic oligonucleotide
  Target: SCN10A; (+) strand; PAM type: NRG; PAM sequence: TAG
agggaatattcaatgtgtat

SEQ ID NO: 30895 - DNA, 20 bp, Artificial Sequence
  Description of Artificial Sequence: Synthetic oligonucleotide
  Target: SCN10A; (+) strand; PAM type: NRG; PAM sequence: AAG
gaatattcaatgtgtattag

SEQ ID NO: 30896 - DNA, 20 bp, Artificial Sequence
  Description of Artificial Sequence: Synthetic oligonucleotide
  Target: SCN10A; (+) strand; PAM type: NRG; PAM sequence: TAG
atgtgtattagaagtaaaca

SEQ ID NO: 30897 - DNA, 20 bp, Artificial Sequence
  Description of Artificial Sequence: Synthetic oligonucleotide
  Target: SCN10A; (+) strand; PAM type: NRG; PAM sequence: GAG
gtgtattagaagtaaacata

SEQ ID NO: 30898 - DNA, 20 bp, Artificial Sequence
  Description of Artificial Sequence: Synthetic oligonucleotide
  Target: SCN10A; (+) strand; PAM type: NRG; PAM sequence: TGG
ttagaagtaaacatagagat

SEQ ID NO: 30899 - DNA, 20 bp, Artificial Sequence
  Description of Artificial Sequence: Synthetic oligonucleotide
  Target: SCN10A; (+) strand; PAM type: NRG; PAM sequence: GAG
agtaaacatagagattggtt

SEQ ID NO: 30900 - DNA, 20 bp, Artificial Sequence
  Description of Artificial Sequence: Synthetic oligonucleotide
  Target: SCN10A; (+) strand; PAM type: NRG; PAM sequence: AAG
gattggttgagtaaattata

SEQ ID NO: 30901 - DNA, 20 bp, Artificial Sequence
  Description of Artificial Sequence: Synthetic oligonucleotide
  Target: SCN10A; (+) strand; PAM type: NRG; PAM sequence: AGG
attggttgagtaaattataa

SEQ ID NO: 30902 - DNA, 20 bp, Artificial Sequence
  Description of Artificial Sequence: Synthetic oligonucleotide
  Target: SCN10A; (+) strand; PAM type: NRG; PAM sequence: TAG
aattataaaggaatatgtta

SEQ ID NO: 30903 - DNA, 20 bp, Artificial Sequence
  Description of Artificial Sequence: Synthetic oligonucleotide
  Target: SCN10A; (+) strand; PAM type: NRG; PAM sequence: GAG
atatgttatagccattaaat

SEQ ID NO: 30904 - DNA, 20 bp, Artificial Sequence
  Description of Artificial Sequence: Synthetic oligonucleotide
  Target: SCN10A; (+) strand; PAM type: NRG; PAM sequence: GAG
gccattaaatgagataatat

SEQ ID NO: 30905 - DNA, 20 bp, Artificial Sequence
  Description of Artificial Sequence: Synthetic oligonucleotide
  Target: SCN10A; (+) strand; PAM type: NRG; PAM sequence: GAG
ataatatgagactatttact

SEQ ID NO: 30906 - DNA, 20 bp, Artificial Sequence
  Description of Artificial Sequence: Synthetic oligonucleotide
  Target: SCN10A; (+) strand; PAM type: NRG; PAM sequence: GAG
tttactgagaaaaatgtact

SEQ ID NO: 30907 - DNA, 20 bp, Artificial Sequence
  Description of Artificial Sequence: Synthetic oligonucleotide
  Target: SCN10A; (+) strand; PAM type: NRG; PAM sequence: AGG
ttactgagaaaaatgtactg

SEQ ID NO: 30908 - DNA, 20 bp, Artificial Sequence
  Description of Artificial Sequence: Synthetic oligonucleotide
  Target: SCN10A; (+) strand; PAM type: NRG; PAM sequence: TAG
agaaaaatgtactgaggtta

SEQ ID NO: 30909 - DNA, 20 bp, Artificial Sequence
  Description of Artificial Sequence: Synthetic oligonucleotide
  Target: SCN10A; (+) strand; PAM type: NRG; PAM sequence: TGG
ggttatagaatgcataaatg

SEQ ID NO: 30910 - DNA, 20 bp, Artificial Sequence
  Description of Artificial Sequence: Synthetic oligonucleotide
  Target: SCN10A; (+) strand; PAM type: NRG; PAM sequence: AAG
tatgtgtatattttatgcat

SEQ ID NO: 30911 - DNA, 20 bp, Artificial Sequence
  Description of Artificial Sequence: Synthetic oligonucleotide
  Target: SCN10A; (+) strand; PAM type: NRG; PAM sequence: AAG
tgtatattttatgcataagc

SEQ ID NO: 30912 - DNA, 20 bp, Artificial Sequence
  Description of Artificial Sequence: Synthetic oligonucleotide
  Target: SCN10A; (+) strand; PAM type: NRG; PAM sequence: GAG
attttatgcataagcaagat

SEQ ID NO: 30913 - DNA, 20 bp, Artificial Sequence
  Description of Artificial Sequence: Synthetic oligonucleotide
  Target: SCN10A; (+) strand; PAM type: NRG; PAM sequence: AAG
tatgcataagcaagatgaga

SEQ ID NO: 30914 - DNA, 20 bp, Artificial Sequence
  Description of Artificial Sequence: Synthetic oligonucleotide
  Target: SCN10A; (+) strand; PAM type: NRG; PAM sequence: GAG
tgcataagcaagatgagaaa

SEQ ID NO: 30915 - DNA, 20 bp, Artificial Sequence
  Description of Artificial Sequence: Synthetic oligonucleotide
  Target: SCN10A; (+) strand; PAM type: NRG; PAM sequence: AGG
gcataagcaagatgagaaag

SEQ ID NO: 30916 - DNA, 20 bp, Artificial Sequence
  Description of Artificial Sequence: Synthetic oligonucleotide
  Target: SCN10A; (+) strand; PAM type: NRG; PAM sequence: CAG
aagatgagaaagaggtatac

SEQ ID NO: 30917 - DNA, 20 bp, Artificial Sequence
  Description of Artificial Sequence: Synthetic oligonucleotide
  Target: SCN10A; (+) strand; PAM type: NRG; PAM sequence: AAG
aggtataccagcatgttttc

SEQ ID NO: 30918 - DNA, 20 bp, Artificial Sequence
  Description of Artificial Sequence: Synthetic oligonucleotide
  Target: SCN10A; (+) strand; PAM type: NRG; PAM sequence: GAG
ataccagcatgttttcaagt

SEQ ID NO: 30919 - DNA, 20 bp, Artificial Sequence
  Description of Artificial Sequence: Synthetic oligonucleotide
  Target: SCN10A; (+) strand; PAM type: NRG; PAM sequence: GAG
tttcaagtgagtttctcttt

SEQ ID NO: 30920 - DNA, 20 bp, Artificial Sequence
  Description of Artificial Sequence: Synthetic oligonucleotide
  Target: SCN10A; (+) strand; PAM type: NRG; PAM sequence: TAG
gtgagtttctctttgagtga

SEQ ID NO: 30921 - DNA, 20 bp, Artificial Sequence
  Description of Artificial Sequence: Synthetic oligonucleotide
  Target: SCN10A; (+) strand; PAM type: NRG; PAM sequence: AGG
tgagtttctctttgagtgat

SEQ ID NO: 30922 - DNA, 20 bp, Artificial Sequence
  Description of Artificial Sequence: Synthetic oligonucleotide
  Target: SCN10A; (+) strand; PAM type: NRG; PAM sequence: GGG
gagtttctctttgagtgata

SEQ ID NO: 30923 - DNA, 20 bp, Artificial Sequence
  Description of Artificial Sequence: Synthetic oligonucleotide
  Target: SCN10A; (+) strand; PAM type: NRG; PAM sequence: TGG
ctctttgagtgatagggaaa

SEQ ID NO: 30924 - DNA, 20 bp, Artificial Sequence
  Description of Artificial Sequence: Synthetic oligonucleotide
  Target: SCN10A; (+) strand; PAM type: NRG; PAM sequence: AAG
tacctttttctataatttcc

SEQ ID NO: 30925 - DNA, 20 bp, Artificial Sequence
  Description of Artificial Sequence: Synthetic oligonucleotide
  Target: SCN10A; (+) strand; PAM type: NRG; PAM sequence: TGG
ataatttccaagtatttttt

SEQ ID NO: 30926 - DNA, 20 bp, Artificial Sequence
  Description of Artificial Sequence: Synthetic oligonucleotide
  Target: SCN10A; (+) strand; PAM type: NRG; PAM sequence: CAG
tttttggtactttactttgt

SEQ ID NO: 30927 - DNA, 20 bp, Artificial Sequence
  Description of Artificial Sequence: Synthetic oligonucleotide
  Target: SCN10A; (+) strand; PAM type: NRG; PAM sequence: AAG
aaaatgcatgttatttttaa

SEQ ID NO: 30928 - DNA, 20 bp, Artificial Sequence
  Description of Artificial Sequence: Synthetic oligonucleotide
  Target: SCN10A; (+) strand; PAM type: NRG; PAM sequence: AGG
aaatgcatgttatttttaaa

SEQ ID NO: 30929 - DNA, 20 bp, Artificial Sequence
  Description of Artificial Sequence: Synthetic oligonucleotide
  Target: SCN10A; (+) strand; PAM type: NRG; PAM sequence: AAG
ttatttttaaaaggtactca

SEQ ID NO: 30930 - DNA, 20 bp, Artificial Sequence
  Description of Artificial Sequence: Synthetic oligonucleotide
  Target: SCN10A; (+) strand; PAM type: NRG; PAM sequence: AAG
ttaaaaggtactcaaagtga

SEQ ID NO: 30931 - DNA, 20 bp, Artificial Sequence
  Description of Artificial Sequence: Synthetic oligonucleotide
  Target: SCN10A; (+) strand; PAM type: NRG; PAM sequence: AAG
gtactcaaagtgaaagccta

SEQ ID NO: 30932 - DNA, 20 bp, Artificial Sequence
  Description of Artificial Sequence: Synthetic oligonucleotide
  Target: SCN10A; (+) strand; PAM type: NRG; PAM sequence: AAG
ctcaaagtgaaagcctaaag

SEQ ID NO: 30933 - DNA, 20 bp, Artificial Sequence
  Description of Artificial Sequence: Synthetic oligonucleotide
  Target: SCN10A; (+) strand; PAM type: NRG; PAM sequence: AGG
tcaaagtgaaagcctaaaga

SEQ ID NO: 30934 - DNA, 20 bp, Artificial Sequence
  Description of Artificial Sequence: Synthetic oligonucleotide
  Target: SCN10A; (+) strand; PAM type: NRG; PAM sequence: TGG
agcctaaagaaggctaaatt

SEQ ID NO: 30935 - DNA, 20 bp, Artificial Sequence
  Description of Artificial Sequence: Synthetic oligonucleotide
  Target: SCN10A; (+) strand; PAM type: NRG; PAM sequence: CAG
aagaaggctaaatttggtgc

SEQ ID NO: 30936 - DNA, 20 bp, Artificial Sequence
  Description of Artificial Sequence: Synthetic oligonucleotide
  Target: SCN10A; (+) strand; PAM type: NRG; PAM sequence: CAG
aaatttggtgccagcctgtt

SEQ ID NO: 30937 - DNA, 20 bp, Artificial Sequence
  Description of Artificial Sequence: Synthetic oligonucleotide
  Target: SCN10A; (+) strand; PAM type: NRG; PAM sequence: CAG
ggtgccagcctgttcagtcc

SEQ ID NO: 30938 - DNA, 20 bp, Artificial Sequence
  Description of Artificial Sequence: Synthetic oligonucleotide
  Target: SCN10A; (+) strand; PAM type: NRG; PAM sequence: AGG
gtgccagcctgttcagtccc

SEQ ID NO: 30939 - DNA, 20 bp, Artificial Sequence
  Description of Artificial Sequence: Synthetic oligonucleotide
  Target: SCN10A; (+) strand; PAM type: NRG; PAM sequence: GGG
tgccagcctgttcagtccca

SEQ ID NO: 30940 - DNA, 20 bp, Artificial Sequence
  Description of Artificial Sequence: Synthetic oligonucleotide
  Target: SCN10A; (+) strand; PAM type: NRG; PAM sequence: GGG
gccagcctgttcagtcccag

SEQ ID NO: 30941 - DNA, 20 bp, Artificial Sequence
  Description of Artificial Sequence: Synthetic oligonucleotide
  Target: SCN10A; (+) strand; PAM type: NRG; PAM sequence: AAG
agcctgttcagtcccagggg

SEQ ID NO: 30942 - DNA, 20 bp, Artificial Sequence
  Description of Artificial Sequence: Synthetic oligonucleotide
  Target: SCN10A; (+) strand; PAM type: NRG; PAM sequence: AGG
gcctgttcagtcccagggga

SEQ ID NO: 30943 - DNA, 20 bp, Artificial Sequence
  Description of Artificial Sequence: Synthetic oligonucleotide
  Target: SCN10A; (+) strand; PAM type: NRG; PAM sequence: GAG
ctgttcagtcccaggggaag

SEQ ID NO: 30944 - DNA, 20 bp, Artificial Sequence
  Description of Artificial Sequence: Synthetic oligonucleotide
  Target: SCN10A; (+) strand; PAM type: NRG; PAM sequence: TGG
tcagtcccaggggaaggaga

SEQ ID NO: 30945 - DNA, 20 bp, Artificial Sequence
  Description of Artificial Sequence: Synthetic oligonucleotide
  Target: SCN10A; (+) strand; PAM type: NRG; PAM sequence: GGG
cagtcccaggggaaggagat

SEQ ID NO: 30946 - DNA, 20 bp, Artificial Sequence
  Description of Artificial Sequence: Synthetic oligonucleotide
  Target: SCN10A; (+) strand; PAM type: NRG; PAM sequence: GAG
gtcccaggggaaggagatgg

SEQ ID NO: 30947 - DNA, 20 bp, Artificial Sequence
  Description of Artificial Sequence: Synthetic oligonucleotide
  Target: SCN10A; (+) strand; PAM type: NRG; PAM sequence: AGG
tcccaggggaaggagatggg

SEQ ID NO: 30948 - DNA, 20 bp, Artificial Sequence
  Description of Artificial Sequence: Synthetic oligonucleotide
  Target: SCN10A; (+) strand; PAM type: NRG; PAM sequence: GGG
cccaggggaaggagatggga

SEQ ID NO: 30949 - DNA, 20 bp, Artificial Sequence
  Description of Artificial Sequence: Synthetic oligonucleotide
  Target: SCN10A; (+) strand; PAM type: NRG; PAM sequence: AAG
aggggaaggagatgggaggg

SEQ ID NO: 30950 - DNA, 20 bp, Artificial Sequence
  Description of Artificial Sequence: Synthetic oligonucleotide
  Target: SCN10A; (+) strand; PAM type: NRG; PAM sequence: AGG
ggggaaggagatgggaggga

SEQ ID NO: 30951 - DNA, 20 bp, Artificial Sequence
  Description of Artificial Sequence: Synthetic oligonucleotide
  Target: SCN10A; (+) strand; PAM type: NRG; PAM sequence: GGG
gggaaggagatgggagggaa

SEQ ID NO: 30952 - DNA, 20 bp, Artificial Sequence
  Description of Artificial Sequence: Synthetic oligonucleotide
  Target: SCN10A; (+) strand; PAM type: NRG; PAM sequence: GAG
gaaggagatgggagggaagg

SEQ ID NO: 30953 - DNA, 20 bp, Artificial Sequence
  Description of Artificial Sequence: Synthetic oligonucleotide
  Target: SCN10A; (+) strand; PAM type: NRG; PAM sequence: GAG
aggagatgggagggaaggga

SEQ ID NO: 30954 - DNA, 20 bp, Artificial Sequence
  Description of Artificial Sequence: Synthetic oligonucleotide
  Target: SCN10A; (+) strand; PAM type: NRG; PAM sequence: CAG
tgggagggaagggagagctg

SEQ ID NO: 30955 - DNA, 20 bp, Artificial Sequence
  Description of Artificial Sequence: Synthetic oligonucleotide
  Target: SCN10A; (+) strand; PAM type: NRG; PAM sequence: AGG
gggagggaagggagagctgc

SEQ ID NO: 30956 - DNA, 20 bp, Artificial Sequence
  Description of Artificial Sequence: Synthetic oligonucleotide
  Target: SCN10A; (+) strand; PAM type: NRG; PAM sequence: GGG
ggagggaagggagagctgca

SEQ ID NO: 30957 - DNA, 20 bp, Artificial Sequence
  Description of Artificial Sequence: Synthetic oligonucleotide
  Target: SCN10A; (+) strand; PAM type: NRG; PAM sequence: GGG
gagggaagggagagctgcag

SEQ ID NO: 30958 - DNA, 20 bp, Artificial Sequence
  Description of Artificial Sequence: Synthetic oligonucleotide
  Target: SCN10A; (+) strand; PAM type: NRG; PAM sequence: GGG
agggaagggagagctgcagg

SEQ ID NO: 30959 - DNA, 20 bp, Artificial Sequence
  Description of Artificial Sequence: Synthetic oligonucleotide
  Target: SCN10A; (+) strand; PAM type: NRG; PAM sequence: CGG
gaagggagagctgcaggggg

SEQ ID NO: 30960 - DNA, 20 bp, Artificial Sequence
  Description of Artificial Sequence: Synthetic oligonucleotide
  Target: SCN10A; (+) strand; PAM type: NRG; PAM sequence: GGG
aagggagagctgcagggggc

SEQ ID NO: 30961 - DNA, 20 bp, Artificial Sequence
  Description of Artificial Sequence: Synthetic oligonucleotide
  Target: SCN10A; (+) strand; PAM type: NRG; PAM sequence: TGG
gagagctgcagggggcgggc

SEQ ID NO: 30962 - DNA, 20 bp, Artificial Sequence
  Description of Artificial Sequence: Synthetic oligonucleotide
  Target: SCN10A; (+) strand; PAM type: NRG; PAM sequence: GGG
agagctgcagggggcgggct

SEQ ID NO: 30963 - DNA, 20 bp, Artificial Sequence
  Description of Artificial Sequence: Synthetic oligonucleotide
  Target: SCN10A; (+) strand; PAM type: NRG; PAM sequence: TGG
ctgcagggggcgggctgggc

SEQ ID NO: 30964 - DNA, 20 bp, Artificial Sequence
  Description of Artificial Sequence: Synthetic oligonucleotide
  Target: SCN10A; (+) strand; PAM type: NRG; PAM sequence: CAG
gggggcgggctgggctggcg

SEQ ID NO: 30965 - DNA, 20 bp, Artificial Sequence
  Description of Artificial Sequence: Synthetic oligonucleotide
  Target: SCN10A; (+) strand; PAM type: NRG; PAM sequence: CAG
gctgggctggcgcagtgctg

SEQ ID NO: 30966 - DNA, 20 bp, Artificial Sequence
  Description of Artificial Sequence: Synthetic oligonucleotide
  Target: SCN10A; (+) strand; PAM type: NRG; PAM sequence: AGG
ctgggctggcgcagtgctgc

SEQ ID NO: 30967 - DNA, 20 bp, Artificial Sequence
  Description of Artificial Sequence: Synthetic oligonucleotide
  Target: SCN10A; (+) strand; PAM type: NRG; PAM sequence: GAG
tggcgcagtgctgcaggtct

SEQ ID NO: 30968 - DNA, 20 bp, Artificial Sequence
  Description of Artificial Sequence: Synthetic oligonucleotide
  Target: SCN10A; (+) strand; PAM type: NRG; PAM sequence: TGG
tgcaggtctgagcttcctcc

SEQ ID NO: 30969 - DNA, 20 bp, Artificial Sequence
  Description of Artificial Sequence: Synthetic oligonucleotide
  Target: SCN10A; (+) strand; PAM type: NRG; PAM sequence: GGG
gcaggtctgagcttcctcct

SEQ ID NO: 30970 - DNA, 20 bp, Artificial Sequence
  Description of Artificial Sequence: Synthetic oligonucleotide
  Target: SCN10A; (+) strand; PAM type: NRG; PAM sequence: TGG
tgagcttcctcctgggaatg

SEQ ID NO: 30971 - DNA, 20 bp, Artificial Sequence
  Description of Artificial Sequence: Synthetic oligonucleotide
  Target: SCN10A; (+) strand; PAM type: NRG; PAM sequence: GGG
gagcttcctcctgggaatgt

SEQ ID NO: 30972 - DNA, 20 bp, Artificial Sequence
  Description of Artificial Sequence: Synthetic oligonucleotide
  Target: SCN10A; (+) strand; PAM type: NRG; PAM sequence: GGG
agcttcctcctgggaatgtg

SEQ ID NO: 30973 - DNA, 20 bp, Artificial Sequence
  Description of Artificial Sequence: Synthetic oligonucleotide
  Target: SCN10A; (+) strand; PAM type: NRG; PAM sequence: GGG
gcttcctcctgggaatgtgg

SEQ ID NO: 30974 - DNA, 20 bp, Artificial Sequence
  Description of Artificial Sequence: Synthetic oligonucleotide
  Target: SCN10A; (+) strand; PAM type: NRG; PAM sequence: GGG
cttcctcctgggaatgtggg

SEQ ID NO: 30975 - DNA, 20 bp, Artificial Sequence
  Description of Artificial Sequence: Synthetic oligonucleotide
  Target: SCN10A; (+) strand; PAM type: NRG; PAM sequence: TGG
cctcctgggaatgtgggggg

SEQ ID NO: 30976 - DNA, 20 bp, Artificial Sequence
  Description of Artificial Sequence: Synthetic oligonucleotide
  Target: SCN10A; (+) strand; PAM type: NRG; PAM sequence: CGG
tgggaatgtggggggtggac

SEQ ID NO: 30977 - DNA, 20 bp, Artificial Sequence
  Description of Artificial Sequence: Synthetic oligonucleotide
  Target: SCN10A; (+) strand; PAM type: NRG; PAM sequence: GGG
gggaatgtggggggtggacc

SEQ ID NO: 30978 - DNA, 20 bp, Artificial Sequence
  Description of Artificial Sequence: Synthetic oligonucleotide
  Target: SCN10A; (+) strand; PAM type: NRG; PAM sequence: GGG
ggaatgtggggggtggaccg

SEQ ID NO: 30979 - DNA, 20 bp, Artificial Sequence
  Description of Artificial Sequence: Synthetic oligonucleotide
  Target: SCN10A; (+) strand; PAM type: NRG; PAM sequence: AAG
ggggggtggaccggggtgtg

SEQ ID NO: 30980 - DNA, 20 bp, Artificial Sequence
  Description of Artificial Sequence: Synthetic oligonucleotide
  Target: SCN10A; (+) strand; PAM type: NRG; PAM sequence: GAG
ggggtggaccggggtgtgaa

SEQ ID NO: 30981 - DNA, 20 bp, Artificial Sequence
  Description of Artificial Sequence: Synthetic oligonucleotide
  Target: SCN10A; (+) strand; PAM type: NRG; PAM sequence: AAG
gtggaccggggtgtgaagag

SEQ ID NO: 30982 - DNA, 20 bp, Artificial Sequence
  Description of Artificial Sequence: Synthetic oligonucleotide
  Target: SCN10A; (+) strand; PAM type: NRG; PAM sequence: AGG
tggaccggggtgtgaagaga

SEQ ID NO: 30983 - DNA, 20 bp, Artificial Sequence
  Description of Artificial Sequence: Synthetic oligonucleotide
  Target: SCN10A; (+) strand; PAM type: NRG; PAM sequence: GGG
ggaccggggtgtgaagagaa

SEQ ID NO: 30984 - DNA, 20 bp, Artificial Sequence
  Description of Artificial Sequence: Synthetic oligonucleotide
  Target: SCN10A; (+) strand; PAM type: NRG; PAM sequence: GGG
gaccggggtgtgaagagaag

SEQ ID NO: 30985 - DNA, 20 bp, Artificial Sequence
  Description of Artificial Sequence: Synthetic oligonucleotide
  Target: SCN10A; (+) strand; PAM type: NRG; PAM sequence: GGG
accggggtgtgaagagaagg

SEQ ID NO: 30986 - DNA, 20 bp, Artificial Sequence
  Description of Artificial Sequence: Synthetic oligonucleotide
  Target: SCN10A; (+) strand; PAM type: NRG; PAM sequence: TAG
gggtgtgaagagaagggggc

SEQ ID NO: 30987 - DNA, 20 bp, Artificial Sequence
  Description of Artificial Sequence: Synthetic oligonucleotide
  Target: SCN10A; (+) strand; PAM type: NRG; PAM sequence: GAG
gtgtgaagagaagggggcta

SEQ ID NO: 30988 - DNA, 20 bp, Artificial Sequence
  Description of Artificial Sequence: Synthetic oligonucleotide
  Target: SCN10A; (+) strand; PAM type: NRG; PAM sequence: GAG
gtgaagagaagggggctaga

SEQ ID NO: 30989 - DNA, 20 bp, Artificial Sequence
  Description of Artificial Sequence: Synthetic oligonucleotide
  Target: SCN10A; (+) strand; PAM type: NRG; PAM sequence: GAG
gaagagaagggggctagaga

SEQ ID NO: 30990 - DNA, 20 bp, Artificial Sequence
  Description of Artificial Sequence: Synthetic oligonucleotide
  Target: SCN10A; (+) strand; PAM type: NRG; PAM sequence: AAG
gagaagggggctagagagag

SEQ ID NO: 30991 - DNA, 20 bp, Artificial Sequence
  Description of Artificial Sequence: Synthetic oligonucleotide
  Target: SCN10A; (+) strand; PAM type: NRG; PAM sequence: AGG
agaagggggctagagagaga

SEQ ID NO: 30992 - DNA, 20 bp, Artificial Sequence
  Description of Artificial Sequence: Synthetic oligonucleotide
  Target: SCN10A; (+) strand; PAM type: NRG; PAM sequence: GGG
gaagggggctagagagagaa

SEQ ID NO: 30993 - DNA, 20 bp, Artificial Sequence
  Description of Artificial Sequence: Synthetic oligonucleotide
  Target: SCN10A; (+) strand; PAM type: NRG; PAM sequence: GAG
agggggctagagagagaagg

SEQ ID NO: 30994 - DNA, 20 bp, Artificial Sequence
  Description of Artificial Sequence: Synthetic oligonucleotide
  Target: SCN10A; (+) strand; PAM type: NRG; PAM sequence: AGG
gggggctagagagagaaggg

SEQ ID NO: 30995 - DNA, 20 bp, Artificial Sequence
  Description of Artificial Sequence: Synthetic oligonucleotide
  Target: SCN10A; (+) strand; PAM type: NRG; PAM sequence: GGG
ggggctagagagagaaggga

SEQ ID NO: 30996 - DNA, 20 bp, Artificial Sequence
  Description of Artificial Sequence: Synthetic oligonucleotide
  Target: SCN10A; (+) strand; PAM type: NRG; PAM sequence: GAG
ggctagagagagaagggagg

SEQ ID NO: 30997 - DNA, 20 bp, Artificial Sequence
  Description of Artificial Sequence: Synthetic oligonucleotide
  Target: SCN10A; (+) strand; PAM type: NRG; PAM sequence: AAG
agagagagaagggagggagc

SEQ ID NO: 30998 - DNA, 20 bp, Artificial Sequence
  Description of Artificial Sequence: Synthetic oligonucleotide
  Target: SCN10A; (+) strand; PAM type: NRG; PAM sequence: AGG
gagagagaagggagggagca

SEQ ID NO: 30999 - DNA, 20 bp, Artificial Sequence
  Description of Artificial Sequence: Synthetic oligonucleotide
  Target: SCN10A; (+) strand; PAM type: NRG; PAM sequence: GGG
agagagaagggagggagcaa

SEQ ID NO: 31000 - DNA, 20 bp, Artificial Sequence
  Description of Artificial Sequence: Synthetic oligonucleotide
  Target: SCN10A; (+) strand; PAM type: NRG; PAM sequence: GAG
agagaagggagggagcaagg

SEQ ID NO: 31001 - DNA, 20 bp, Artificial Sequence
  Description of Artificial Sequence: Synthetic oligonucleotide
  Target: SCN10A; (+) strand; PAM type: NRG; PAM sequence: GAG
agaagggagggagcaaggga

SEQ ID NO: 31002 - DNA, 20 bp, Artificial Sequence
  Description of Artificial Sequence: Synthetic oligonucleotide
  Target: SCN10A; (+) strand; PAM type: NRG; PAM sequence: CAG
agggagggagcaagggagag

SEQ ID NO: 31003 - DNA, 20 bp, Artificial Sequence
  Description of Artificial Sequence: Synthetic oligonucleotide
  Target: SCN10A; (+) strand; PAM type: NRG; PAM sequence: GAG
ggagggagcaagggagagca

SEQ ID NO: 31004 - DNA, 20 bp, Artificial Sequence
  Description of Artificial Sequence: Synthetic oligonucleotide
  Target: SCN10A; (+) strand; PAM type: NRG; PAM sequence: AAG
gggagcaagggagagcagag

SEQ ID NO: 31005 - DNA, 20 bp, Artificial Sequence
  Description of Artificial Sequence: Synthetic oligonucleotide
  Target: SCN10A; (+) strand; PAM type: NRG; PAM sequence: GAG
ggagagcagagaagcaaaat

SEQ ID NO: 31006 - DNA, 20 bp, Artificial Sequence
  Description of Artificial Sequence: Synthetic oligonucleotide
  Target: SCN10A; (+) strand; PAM type: NRG; PAM sequence: AGG
gagagcagagaagcaaaatg

SEQ ID NO: 31007 - DNA, 20 bp, Artificial Sequence
  Description of Artificial Sequence: Synthetic oligonucleotide
  Target: SCN10A; (+) strand; PAM type: NRG; PAM sequence: GAG
gagcagagaagcaaaatgag

SEQ ID NO: 31008 - DNA, 20 bp, Artificial Sequence
  Description of Artificial Sequence: Synthetic oligonucleotide
  Target: SCN10A; (+) strand; PAM type: NRG; PAM sequence: GAG
gcagagaagcaaaatgagga

SEQ ID NO: 31009 - DNA, 20 bp, Artificial Sequence
  Description of Artificial Sequence: Synthetic oligonucleotide
  Target: SCN10A; (+) strand; PAM type: NRG; PAM sequence: AAG
gagaagcaaaatgaggagag

SEQ ID NO: 31010 - DNA, 20 bp, Artificial Sequence
  Description of Artificial Sequence: Synthetic oligonucleotide
  Target: SCN10A; (+) strand; PAM type: NRG; PAM sequence: AGG
agaagcaaaatgaggagaga

SEQ ID NO: 31011 - DNA, 20 bp, Artificial Sequence
  Description of Artificial Sequence: Synthetic oligonucleotide
  Target: SCN10A; (+) strand; PAM type: NRG; PAM sequence: AAG
aatgaggagagaaggcccac

SEQ ID NO: 31012 - DNA, 20 bp, Artificial Sequence
  Description of Artificial Sequence: Synthetic oligonucleotide
  Target: SCN10A; (+) strand; PAM type: NRG; PAM sequence: TAG
aggcccacaagccaatgacg

SEQ ID NO: 31013 - DNA, 20 bp, Artificial Sequence
  Description of Artificial Sequence: Synthetic oligonucleotide
  Target: SCN10A; (+) strand; PAM type: NRG; PAM sequence: GAG
ccacaagccaatgacgtagt

SEQ ID NO: 31014 - DNA, 20 bp, Artificial Sequence
  Description of Artificial Sequence: Synthetic oligonucleotide
  Target: SCN10A; (+) strand; PAM type: NRG; PAM sequence: AGG
cacaagccaatgacgtagtg

SEQ ID NO: 31015 - DNA, 20 bp, Artificial Sequence
  Description of Artificial Sequence: Synthetic oligonucleotide
  Target: SCN10A; (+) strand; PAM type: NRG; PAM sequence: GAG
caagccaatgacgtagtgag

SEQ ID NO: 31016 - DNA, 20 bp, Artificial Sequence
  Description of Artificial Sequence: Synthetic oligonucleotide
  Target: SCN10A; (+) strand; PAM type: NRG; PAM sequence: GAG
agccaatgacgtagtgagga

SEQ ID NO: 31017 - DNA, 20 bp, Artificial Sequence
  Description of Artificial Sequence: Synthetic oligonucleotide
  Target: SCN10A; (+) strand; PAM type: NRG; PAM sequence: TGG
gacgtagtgaggagagcacc

SEQ ID NO: 31018 - DNA, 20 bp, Artificial Sequence
  Description of Artificial Sequence: Synthetic oligonucleotide
  Target: SCN10A; (+) strand; PAM type: NRG; PAM sequence: CAG
tgaggagagcacctggccaa

SEQ ID NO: 31019 - DNA, 20 bp, Artificial Sequence
  Description of Artificial Sequence: Synthetic oligonucleotide
  Target: SCN10A; (+) strand; PAM type: NRG; PAM sequence: TGG
cacctggccaacagcacatg

SEQ ID NO: 31020 - DNA, 20 bp, Artificial Sequence
  Description of Artificial Sequence: Synthetic oligonucleotide
  Target: SCN10A; (+) strand; PAM type: NRG; PAM sequence: CAG
atgtggttattactttaatc

SEQ ID NO: 31021 - DNA, 20 bp, Artificial Sequence
  Description of Artificial Sequence: Synthetic oligonucleotide
  Target: SCN10A; (+) strand; PAM type: NRG; PAM sequence: CAG
tggttattactttaatccag

SEQ ID NO: 31022 - DNA, 20 bp, Artificial Sequence
  Description of Artificial Sequence: Synthetic oligonucleotide
  Target: SCN10A; (+) strand; PAM type: NRG; PAM sequence: AGG
ggttattactttaatccagc

SEQ ID NO: 31023 - DNA, 20 bp, Artificial Sequence
  Description of Artificial Sequence: Synthetic oligonucleotide
  Target: SCN10A; (+) strand; PAM type: NRG; PAM sequence: TGG
ttactttaatccagcaggac

SEQ ID NO: 31024 - DNA, 20 bp, Artificial Sequence
  Description of Artificial Sequence: Synthetic oligonucleotide
  Target: SCN10A; (+) strand; PAM type: NRG; PAM sequence: AAG
ctttaatccagcaggactgg

SEQ ID NO: 31025 - DNA, 20 bp, Artificial Sequence
  Description of Artificial Sequence: Synthetic oligonucleotide
  Target: SCN10A; (+) strand; PAM type: NRG; PAM sequence: AGG
tttaatccagcaggactgga

SEQ ID NO: 31026 - DNA, 20 bp, Artificial Sequence
  Description of Artificial Sequence: Synthetic oligonucleotide
  Target: SCN10A; (+) strand; PAM type: NRG; PAM sequence: GAG
taatccagcaggactggaag

SEQ ID NO: 31027 - DNA, 20 bp, Artificial Sequence
  Description of Artificial Sequence: Synthetic oligonucleotide
  Target: SCN10A; (+) strand; PAM type: NRG; PAM sequence: AAG
tccagcaggactggaaggag

SEQ ID NO: 31028 - DNA, 20 bp, Artificial Sequence
  Description of Artificial Sequence: Synthetic oligonucleotide
  Target: SCN10A; (+) strand; PAM type: NRG; PAM sequence: GAG
cagcaggactggaaggagaa

SEQ ID NO: 31029 - DNA, 20 bp, Artificial Sequence
  Description of Artificial Sequence: Synthetic oligonucleotide
  Target: SCN10A; (+) strand; PAM type: NRG; PAM sequence: TAG
ggactggaaggagaagagca

SEQ ID NO: 31030 - DNA, 20 bp, Artificial Sequence
  Description of Artificial Sequence: Synthetic oligonucleotide
  Target: SCN10A; (+) strand; PAM type: NRG; PAM sequence: AGG
gactggaaggagaagagcat

SEQ ID NO: 31031 - DNA, 20 bp, Artificial Sequence
  Description of Artificial Sequence: Synthetic oligonucleotide
  Target: SCN10A; (+) strand; PAM type: NRG; PAM sequence: TGG
gaaggagaagagcataggtg

SEQ ID NO: 31032 - DNA, 20 bp, Artificial Sequence
  Description of Artificial Sequence: Synthetic oligonucleotide
  Target: SCN10A; (+) strand; PAM type: NRG; PAM sequence: GAG
aggagaagagcataggtgtg

SEQ ID NO: 31033 - DNA, 20 bp, Artificial Sequence
  Description of Artificial Sequence: Synthetic oligonucleotide
  Target: SCN10A; (+) strand; PAM type: NRG; PAM sequence: AAG
gaagagcataggtgtggaga

SEQ ID NO: 31034 - DNA, 20 bp, Artificial Sequence
  Description of Artificial Sequence: Synthetic oligonucleotide
  Target: SCN10A; (+) strand; PAM type: NRG; PAM sequence: CAG
ggtgtggagaaagcactgcc

SEQ ID NO: 31035 - DNA, 20 bp, Artificial Sequence
  Description of Artificial Sequence: Synthetic oligonucleotide
  Target: SCN10A; (+) strand; PAM type: NRG; PAM sequence: TGG
cctctcttgcccctgcaatt

SEQ ID NO: 31036 - DNA, 20 bp, Artificial Sequence
  Description of Artificial Sequence: Synthetic oligonucleotide
  Target: SCN10A; (+) strand; PAM type: NRG; PAM sequence: GAG
tttggcctctacactgtgct

SEQ ID NO: 31037 - DNA, 20 bp, Artificial Sequence
  Description of Artificial Sequence: Synthetic oligonucleotide
  Target: SCN10A; (+) strand; PAM type: NRG; PAM sequence: AGG
ttggcctctacactgtgctg

SEQ ID NO: 31038 - DNA, 20 bp, Artificial Sequence
  Description of Artificial Sequence: Synthetic oligonucleotide
  Target: SCN10A; (+) strand; PAM type: NRG; PAM sequence: TGG
acactgtgctgaggtccgtg

SEQ ID NO: 31039 - DNA, 20 bp, Artificial Sequence
  Description of Artificial Sequence: Synthetic oligonucleotide
  Target: SCN10A; (+) strand; PAM type: NRG; PAM sequence: CAG
ggacaatcactgccctgtgc

SEQ ID NO: 31040 - DNA, 20 bp, Artificial Sequence
  Description of Artificial Sequence: Synthetic oligonucleotide
  Target: SCN10A; (+) strand; PAM type: NRG; PAM sequence: AGG
gacaatcactgccctgtgcc

SEQ ID NO: 31041 - DNA, 20 bp, Artificial Sequence
  Description of Artificial Sequence: Synthetic oligonucleotide
  Target: SCN10A; (+) strand; PAM type: NRG; PAM sequence: GGG
acaatcactgccctgtgcca

SEQ ID NO: 31042 - DNA, 20 bp, Artificial Sequence
  Description of Artificial Sequence: Synthetic oligonucleotide
  Target: SCN10A; (+) strand; PAM type: NRG; PAM sequence: TGG
actgccctgtgccagggcac

SEQ ID NO: 31043 - DNA, 20 bp, Artificial Sequence
  Description of Artificial Sequence: Synthetic oligonucleotide
  Target: SCN10A; (+) strand; PAM type: NRG; PAM sequence: GGG
ctgccctgtgccagggcact

SEQ ID NO: 31044 - DNA, 20 bp, Artificial Sequence
  Description of Artificial Sequence: Synthetic oligonucleotide
  Target: SCN10A; (+) strand; PAM type: NRG; PAM sequence: CAG
gccagggcactgggcacctg

SEQ ID NO: 31045 - DNA, 20 bp, Artificial Sequence
  Description of Artificial Sequence: Synthetic oligonucleotide
  Target: SCN10A; (+) strand; PAM type: NRG; PAM sequence: CAG
cacctgcagccgctgtcaca

SEQ ID NO: 31046 - DNA, 20 bp, Artificial Sequence
  Description of Artificial Sequence: Synthetic oligonucleotide
  Target: SCN10A; (+) strand; PAM type: NRG; PAM sequence: CAG
cacacagttccccctccacc

SEQ ID NO: 31047 - DNA, 20 bp, Artificial Sequence
  Description of Artificial Sequence: Synthetic oligonucleotide
  Target: SCN10A; (+) strand; PAM type: NRG; PAM sequence: AGG
acacagttccccctccaccc

SEQ ID NO: 31048 - DNA, 20 bp, Artificial Sequence
  Description of Artificial Sequence: Synthetic oligonucleotide
  Target: SCN10A; (+) strand; PAM type: NRG; PAM sequence: TGG
agttccccctccacccagga

SEQ ID NO: 31049 - DNA, 20 bp, Artificial Sequence
  Description of Artificial Sequence: Synthetic oligonucleotide
  Target: SCN10A; (+) strand; PAM type: NRG; PAM sequence: CAG
tccccctccacccaggatgg

SEQ ID NO: 31050 - DNA, 20 bp, Artificial Sequence
  Description of Artificial Sequence: Synthetic oligonucleotide
  Target: SCN10A; (+) strand; PAM type: NRG; PAM sequence: CAG
ctccacccaggatggcagac

SEQ ID NO: 31051 - DNA, 20 bp, Artificial Sequence
  Description of Artificial Sequence: Synthetic oligonucleotide
  Target: SCN10A; (+) strand; PAM type: NRG; PAM sequence: TGG
cccgaaactctcttctccct

SEQ ID NO: 31052 - DNA, 20 bp, Artificial Sequence
  Description of Artificial Sequence: Synthetic oligonucleotide
  Target: SCN10A; (+) strand; PAM type: NRG; PAM sequence: TAG
gctttgcgtcattgccaccc

SEQ ID NO: 31053 - DNA, 20 bp, Artificial Sequence
  Description of Artificial Sequence: Synthetic oligonucleotide
  Target: SCN10A; (+) strand; PAM type: NRG; PAM sequence: CAG
ctagttttcctcccacctct

SEQ ID NO: 31054 - DNA, 20 bp, Artificial Sequence
  Description of Artificial Sequence: Synthetic oligonucleotide
  Target: SCN10A; (+) strand; PAM type: NRG; PAM sequence: AAG
cgcacctgtgctcctcccta

SEQ ID NO: 31055 - DNA, 20 bp, Artificial Sequence
  Description of Artificial Sequence: Synthetic oligonucleotide
  Target: SCN10A; (+) strand; PAM type: NRG; PAM sequence: GAG
ctgtgctcctccctaaagct

SEQ ID NO: 31056 - DNA, 20 bp, Artificial Sequence
  Description of Artificial Sequence: Synthetic oligonucleotide
  Target: SCN10A; (+) strand; PAM type: NRG; PAM sequence: AGG
tgtgctcctccctaaagctg

SEQ ID NO: 31057 - DNA, 20 bp, Artificial Sequence
  Description of Artificial Sequence: Synthetic oligonucleotide
  Target: SCN10A; (+) strand; PAM type: NRG; PAM sequence: GAG
taaagctgaggccatgcacc

SEQ ID NO: 31058 - DNA, 20 bp, Artificial Sequence
  Description of Artificial Sequence: Synthetic oligonucleotide
  Target: SCN10A; (+) strand; PAM type: NRG; PAM sequence: CAG
agctgaggccatgcaccgag

SEQ ID NO: 31059 - DNA, 20 bp, Artificial Sequence
  Description of Artificial Sequence: Synthetic oligonucleotide
  Target: SCN10A; (+) strand; PAM type: NRG; PAM sequence: TGG
agcagttttgtcacccttcc

SEQ ID NO: 31060 - DNA, 20 bp, Artificial Sequence
  Description of Artificial Sequence: Synthetic oligonucleotide
  Target: SCN10A; (+) strand; PAM type: NRG; PAM sequence: TGG
gtcacccttcctggacaatc

SEQ ID NO: 31061 - DNA, 20 bp, Artificial Sequence
  Description of Artificial Sequence: Synthetic oligonucleotide
  Target: SCN10A; (+) strand; PAM type: NRG; PAM sequence: TAG
ttcctggacaatctggcatt

SEQ ID NO: 31062 - DNA, 20 bp, Artificial Sequence
  Description of Artificial Sequence: Synthetic oligonucleotide
  Target: SCN10A; (+) strand; PAM type: NRG; PAM sequence: TGG
tggacaatctggcatttaga

SEQ ID NO: 31063 - DNA, 20 bp, Artificial Sequence
  Description of Artificial Sequence: Synthetic oligonucleotide
  Target: SCN10A; (+) strand; PAM type: NRG; PAM sequence: GAG
gacaatctggcatttagatg

SEQ ID NO: 31064 - DNA, 20 bp, Artificial Sequence
  Description of Artificial Sequence: Synthetic oligonucleotide
  Target: SCN10A; (+) strand; PAM type: NRG; PAM sequence: AGG
acaatctggcatttagatgg

SEQ ID NO: 31065 - DNA, 20 bp, Artificial Sequence
  Description of Artificial Sequence: Synthetic oligonucleotide
  Target: SCN10A; (+) strand; PAM type: NRG; PAM sequence: TAG
ctggcatttagatggaggcc

SEQ ID NO: 31066 - DNA, 20 bp, Artificial Sequence
  Description of Artificial Sequence: Synthetic oligonucleotide
  Target: SCN10A; (+) strand; PAM type: NRG; PAM sequence: TAG
tagatggaggcctagatatt

SEQ ID NO: 31067 - DNA, 20 bp, Artificial Sequence
  Description of Artificial Sequence: Synthetic oligonucleotide
  Target: SCN10A; (+) strand; PAM type: NRG; PAM sequence: TAG
atggaggcctagatatttag

SEQ ID NO: 31068 - DNA, 20 bp, Artificial Sequence
  Description of Artificial Sequence: Synthetic oligonucleotide
  Target: SCN10A; (+) strand; PAM type: NRG; PAM sequence: AGG
tggaggcctagatatttagt

SEQ ID NO: 31069 - DNA, 20 bp, Artificial Sequence
  Description of Artificial Sequence: Synthetic oligonucleotide
  Target: SCN10A; (+) strand; PAM type: NRG; PAM sequence: TAG
gatatttagtaggttgtttt

SEQ ID NO: 31070 - DNA, 20 bp, Artificial Sequence
  Description of Artificial Sequence: Synthetic oligonucleotide
  Target: SCN10A; (+) strand; PAM type: NRG; PAM sequence: GAG
tatttagtaggttgttttta

SEQ ID NO: 31071 - DNA, 20 bp, Artificial Sequence
  Description of Artificial Sequence: Synthetic oligonucleotide
  Target: SCN10A; (+) strand; PAM type: NRG; PAM sequence: GAG
tttagtaggttgtttttaga

SEQ ID NO: 31072 - DNA, 20 bp, Artificial Sequence
  Description of Artificial Sequence: Synthetic oligonucleotide
  Target: SCN10A; (+) strand; PAM type: NRG; PAM sequence: GAG
ttagagagtaaatgacacat

SEQ ID NO: 31073 - DNA, 20 bp, Artificial Sequence
  Description of Artificial Sequence: Synthetic oligonucleotide
  Target: SCN10A; (+) strand; PAM type: NRG; PAM sequence: AGG
tagagagtaaatgacacatg

SEQ ID NO: 31074 - DNA, 20 bp, Artificial Sequence
  Description of Artificial Sequence: Synthetic oligonucleotide
  Target: SCN10A; (+) strand; PAM type: NRG; PAM sequence: AAG
gtaaatgacacatgaggcgc

SEQ ID NO: 31075 - DNA, 20 bp, Artificial Sequence
  Description of Artificial Sequence: Synthetic oligonucleotide
  Target: SCN10A; (+) strand; PAM type: NRG; PAM sequence: GAG
tgacacatgaggcgcaagat

SEQ ID NO: 31076 - DNA, 20 bp, Artificial Sequence
  Description of Artificial Sequence: Synthetic oligonucleotide
  Target: SCN10A; (+) strand; PAM type: NRG; PAM sequence: CAG
caagatgagtgaaaacactg

SEQ ID NO: 31077 - DNA, 20 bp, Artificial Sequence
  Description of Artificial Sequence: Synthetic oligonucleotide
  Target: SCN10A; (+) strand; PAM type: NRG; PAM sequence: CGG
aaaacactgcagccgtgaat

SEQ ID NO: 31078 - DNA, 20 bp, Artificial Sequence
  Description of Artificial Sequence: Synthetic oligonucleotide
  Target: SCN10A; (+) strand; PAM type: NRG; PAM sequence: AAG
acactgcagccgtgaatcgg

SEQ ID NO: 31079 - DNA, 20 bp, Artificial Sequence
  Description of Artificial Sequence: Synthetic oligonucleotide
  Target: SCN10A; (+) strand; PAM type: NRG; PAM sequence: GAG
actgcagccgtgaatcggaa

SEQ ID NO: 31080 - DNA, 20 bp, Artificial Sequence
  Description of Artificial Sequence: Synthetic oligonucleotide
  Target: SCN10A; (+) strand; PAM type: NRG; PAM sequence: CGG
gcagccgtgaatcggaagag

SEQ ID NO: 31081 - DNA, 20 bp, Artificial Sequence
  Description of Artificial Sequence: Synthetic oligonucleotide
  Target: SCN10A; (+) strand; PAM type: NRG; PAM sequence: GGG
cagccgtgaatcggaagagc

SEQ ID NO: 31082 - DNA, 20 bp, Artificial Sequence
  Description of Artificial Sequence: Synthetic oligonucleotide
  Target: SCN10A; (+) strand; PAM type: NRG; PAM sequence: TAG
gaatcggaagagcgggactg

SEQ ID NO: 31083 - DNA, 20 bp, Artificial Sequence
  Description of Artificial Sequence: Synthetic oligonucleotide
  Target: SCN10A; (+) strand; PAM type: NRG; PAM sequence: TAG
gaagagcgggactgtagtcc

SEQ ID NO: 31084 - DNA, 20 bp, Artificial Sequence
  Description of Artificial Sequence: Synthetic oligonucleotide
  Target: SCN10A; (+) strand; PAM type: NRG; PAM sequence: TAG
gtcctagcccttcaactaat

SEQ ID NO: 31085 - DNA, 20 bp, Artificial Sequence
  Description of Artificial Sequence: Synthetic oligonucleotide
  Target: SCN10A; (+) strand; PAM type: NRG; PAM sequence: CAG
caccctgaactctctattcc

SEQ ID NO: 31086 - DNA, 20 bp, Artificial Sequence
  Description of Artificial Sequence: Synthetic oligonucleotide
  Target: SCN10A; (+) strand; PAM type: NRG; PAM sequence: AAG
gcccttcaactaattacctg

SEQ ID NO: 31087 - DNA, 20 bp, Artificial Sequence
  Description of Artificial Sequence: Synthetic oligonucleotide
  Target: SCN10A; (+) strand; PAM type: NRG; PAM sequence: TGG
cctgaagcccctcatgcctt

SEQ ID NO: 31088 - DNA, 20 bp, Artificial Sequence
  Description of Artificial Sequence: Synthetic oligonucleotide
  Target: SCN10A; (+) strand; PAM type: NRG; PAM sequence: GGG
ctgaagcccctcatgccttt

SEQ ID NO: 31089 - DNA, 20 bp, Artificial Sequence
  Description of Artificial Sequence: Synthetic oligonucleotide
  Target: SCN10A; (+) strand; PAM type: NRG; PAM sequence: TAG
tgggctttgacttcctcatt

SEQ ID NO: 31090 - DNA, 20 bp, Artificial Sequence
  Description of Artificial Sequence: Synthetic oligonucleotide
  Target: SCN10A; (+) strand; PAM type: NRG; PAM sequence: GAG
tttagaaaatgcaaacaact

SEQ ID NO: 31091 - DNA, 20 bp, Artificial Sequence
  Description of Artificial Sequence: Synthetic oligonucleotide
  Target: SCN10A; (+) strand; PAM type: NRG; PAM sequence: AGG
ttagaaaatgcaaacaactg

SEQ ID NO: 31092 - DNA, 20 bp, Artificial Sequence
  Description of Artificial Sequence: Synthetic oligonucleotide
  Target: SCN10A; (+) strand; PAM type: NRG; PAM sequence: AAG
tgcaaacaactgaggatgtt

SEQ ID NO: 31093 - DNA, 20 bp, Artificial Sequence
  Description of Artificial Sequence: Synthetic oligonucleotide
  Target: SCN10A; (+) strand; PAM type: NRG; PAM sequence: TGG
tcctgtgtctatgtctacct

SEQ ID NO: 31094 - DNA, 20 bp, Artificial Sequence
  Description of Artificial Sequence: Synthetic oligonucleotide
  Target: SCN10A; (+) strand; PAM type: NRG; PAM sequence: TGG
ctatgtctaccttggtctat

SEQ ID NO: 31095 - DNA, 20 bp, Artificial Sequence
  Description of Artificial Sequence: Synthetic oligonucleotide
  Target: SCN10A; (+) strand; PAM type: NRG; PAM sequence: CGG
tgtctaccttggtctattgg

SEQ ID NO: 31096 - DNA, 20 bp, Artificial Sequence
  Description of Artificial Sequence: Synthetic oligonucleotide
  Target: SCN10A; (+) strand; PAM type: NRG; PAM sequence: GAG
tctaccttggtctattggcg

SEQ ID NO: 31097 - DNA, 20 bp, Artificial Sequence
  Description of Artificial Sequence: Synthetic oligonucleotide
  Target: SCN10A; (+) strand; PAM type: NRG; PAM sequence: TAG
accttggtctattggcggag

SEQ ID NO: 31098 - DNA, 20 bp, Artificial Sequence
  Description of Artificial Sequence: Synthetic oligonucleotide
  Target: SCN10A; (+) strand; PAM type: NRG; PAM sequence: GAG
ggtctattggcggagtagtt

SEQ ID NO: 31099 - DNA, 20 bp, Artificial Sequence
  Description of Artificial Sequence: Synthetic oligonucleotide
  Target: SCN10A; (+) strand; PAM type: NRG; PAM sequence: AAG
cggagtagttgagattgtgt

SEQ ID NO: 31100 - DNA, 20 bp, Artificial Sequence
  Description of Artificial Sequence: Synthetic oligonucleotide
  Target: SCN10A; (+) strand; PAM type: NRG; PAM sequence: AGG
ggagtagttgagattgtgta

SEQ ID NO: 31101 - DNA, 20 bp, Artificial Sequence
  Description of Artificial Sequence: Synthetic oligonucleotide
  Target: SCN10A; (+) strand; PAM type: NRG; PAM sequence: GAG
agtagttgagattgtgtaag

SEQ ID NO: 31102 - DNA, 20 bp, Artificial Sequence
  Description of Artificial Sequence: Synthetic oligonucleotide
  Target: SCN10A; (+) strand; PAM type: NRG; PAM sequence: AAG
tgagattgtgtaaggagctt

SEQ ID NO: 31103 - DNA, 20 bp, Artificial Sequence
  Description of Artificial Sequence: Synthetic oligonucleotide
  Target: SCN10A; (+) strand; PAM type: NRG; PAM sequence: CAG
tgtgtaaggagcttaagcca

SEQ ID NO: 31104 - DNA, 20 bp, Artificial Sequence
  Description of Artificial Sequence: Synthetic oligonucleotide
  Target: SCN10A; (+) strand; PAM type: NRG; PAM sequence: CAG
aaggagcttaagccacagta

SEQ ID NO: 31105 - DNA, 20 bp, Artificial Sequence
  Description of Artificial Sequence: Synthetic oligonucleotide
  Target: SCN10A; (+) strand; PAM type: NRG; PAM sequence: GAG
ggagcttaagccacagtaca

SEQ ID NO: 31106 - DNA, 20 bp, Artificial Sequence
  Description of Artificial Sequence: Synthetic oligonucleotide
  Target: SCN10A; (+) strand; PAM type: NRG; PAM sequence: GAG
agcttaagccacagtacaga

SEQ ID NO: 31107 - DNA, 20 bp, Artificial Sequence
  Description of Artificial Sequence: Synthetic oligonucleotide
  Target: SCN10A; (+) strand; PAM type: NRG; PAM sequence: AAG
ccttccttctttgctctaca

SEQ ID NO: 31108 - DNA, 20 bp, Artificial Sequence
  Description of Artificial Sequence: Synthetic oligonucleotide
  Target: SCN10A; (+) strand; PAM type: NRG; PAM sequence: CAG
cttctttgctctacaaagcc

SEQ ID NO: 31109 - DNA, 20 bp, Artificial Sequence
  Description of Artificial Sequence: Synthetic oligonucleotide
  Target: SCN10A; (+) strand; PAM type: NRG; PAM sequence: CAG
gctctacaaagcccagtatt

SEQ ID NO: 31110 - DNA, 20 bp, Artificial Sequence
  Description of Artificial Sequence: Synthetic oligonucleotide
  Target: SCN10A; (+) strand; PAM type: NRG; PAM sequence: CAG
tacaaagcccagtattcagc

SEQ ID NO: 31111 - DNA, 20 bp, Artificial Sequence
  Description of Artificial Sequence: Synthetic oligonucleotide
  Target: SCN10A; (+) strand; PAM type: NRG; PAM sequence: AGG
acaaagcccagtattcagcc

SEQ ID NO: 31112 - DNA, 20 bp, Artificial Sequence
  Description of Artificial Sequence: Synthetic oligonucleotide
  Target: SCN10A; (+) strand; PAM type: NRG; PAM sequence: GGG
caaagcccagtattcagcca

SEQ ID NO: 31113 - DNA, 20 bp, Artificial Sequence
  Description of Artificial Sequence: Synthetic oligonucleotide
  Target: SCN10A; (+) strand; PAM type: NRG; PAM sequence: TAG
ccagtattcagccagggcct

SEQ ID NO: 31114 - DNA, 20 bp, Artificial Sequence
  Description of Artificial Sequence: Synthetic oligonucleotide
  Target: SCN10A; (+) strand; PAM type: NRG; PAM sequence: GAG
agtattcagccagggcctta

SEQ ID NO: 31115 - DNA, 20 bp, Artificial Sequence
  Description of Artificial Sequence: Synthetic oligonucleotide
  Target: SCN10A; (+) strand; PAM type: NRG; PAM sequence: AAG
ctctgaatctctattcccat

SEQ ID NO: 31116 - DNA, 20 bp, Artificial Sequence
  Description of Artificial Sequence: Synthetic oligonucleotide
  Target: SCN10A; (+) strand; PAM type: NRG; PAM sequence: AGG
tctgaatctctattcccata

SEQ ID NO: 31117 - DNA, 20 bp, Artificial Sequence
  Description of Artificial Sequence: Synthetic oligonucleotide
  Target: SCN10A; (+) strand; PAM type: NRG; PAM sequence: AAG
ccataaggccttgttattca

SEQ ID NO: 31118 - DNA, 20 bp, Artificial Sequence
  Description of Artificial Sequence: Synthetic oligonucleotide
  Target: SCN10A; (+) strand; PAM type: NRG; PAM sequence: TGG
aggccttgttattcaaagtg

SEQ ID NO: 31119 - DNA, 20 bp, Artificial Sequence
  Description of Artificial Sequence: Synthetic oligonucleotide
  Target: SCN10A; (+) strand; PAM type: NRG; PAM sequence: GGG
ggccttgttattcaaagtgt

SEQ ID NO: 31120 - DNA, 20 bp, Artificial Sequence
  Description of Artificial Sequence: Synthetic oligonucleotide
  Target: SCN10A; (+) strand; PAM type: NRG; PAM sequence: GAG
tattcaaagtgtgggtcact

SEQ ID NO: 31121 - DNA, 20 bp, Artificial Sequence
  Description of Artificial Sequence: Synthetic oligonucleotide
  Target: SCN10A; (+) strand; PAM type: NRG; PAM sequence: AGG
attcaaagtgtgggtcactg

SEQ ID NO: 31122 - DNA, 20 bp, Artificial Sequence
  Description of Artificial Sequence: Synthetic oligonucleotide
  Target: SCN10A; (+) strand; PAM type: NRG; PAM sequence: GGG
ttcaaagtgtgggtcactga

SEQ ID NO: 31123 - DNA, 20 bp, Artificial Sequence
  Description of Artificial Sequence: Synthetic oligonucleotide
  Target: SCN10A; (+) strand; PAM type: NRG; PAM sequence: CAG
aaagtgtgggtcactgaggg

SEQ ID NO: 31124 - DNA, 20 bp, Artificial Sequence
  Description of Artificial Sequence: Synthetic oligonucleotide
  Target: SCN10A; (+) strand; PAM type: NRG; PAM sequence: AAG
tgggtcactgagggcagtgc

SEQ ID NO: 31125 - DNA, 20 bp, Artificial Sequence
  Description of Artificial Sequence: Synthetic oligonucleotide
  Target: SCN10A; (+) strand; PAM type: NRG; PAM sequence: TGG
agggcagtgcaagcatcacc

SEQ ID NO: 31126 - DNA, 20 bp, Artificial Sequence
  Description of Artificial Sequence: Synthetic oligonucleotide
  Target: SCN10A; (+) strand; PAM type: NRG; PAM sequence: GGG
gggcagtgcaagcatcacct

SEQ ID NO: 31127 - DNA, 20 bp, Artificial Sequence
  Description of Artificial Sequence: Synthetic oligonucleotide
  Target: SCN10A; (+) strand; PAM type: NRG; PAM sequence: GAG
gcagtgcaagcatcacctgg

SEQ ID NO: 31128 - DNA, 20 bp, Artificial Sequence
  Description of Artificial Sequence: Synthetic oligonucleotide
  Target: SCN10A; (+) strand; PAM type: NRG; PAM sequence: TAG
agcatcacctgggagcttgt

SEQ ID NO: 31129 - DNA, 20 bp, Artificial Sequence
  Description of Artificial Sequence: Synthetic oligonucleotide
  Target: SCN10A; (+) strand; PAM type: NRG; PAM sequence: CAG
ttgttagaaatgcaaattct

SEQ ID NO: 31130 - DNA, 20 bp, Artificial Sequence
  Description of Artificial Sequence: Synthetic oligonucleotide
  Target: SCN10A; (+) strand; PAM type: NRG; PAM sequence: AGG
tgttagaaatgcaaattctc

SEQ ID NO: 31131 - DNA, 20 bp, Artificial Sequence
  Description of Artificial Sequence: Synthetic oligonucleotide
  Target: SCN10A; (+) strand; PAM type: NRG; PAM sequence: CAG
caaattctcaggccctgcca

SEQ ID NO: 31132 - DNA, 20 bp, Artificial Sequence
  Description of Artificial Sequence: Synthetic oligonucleotide
  Target: SCN10A; (+) strand; PAM type: NRG; PAM sequence: TGG
caggccctgccacagattta

SEQ ID NO: 31133 - DNA, 20 bp, Artificial Sequence
  Description of Artificial Sequence: Synthetic oligonucleotide
  Target: SCN10A; (+) strand; PAM type: NRG; PAM sequence: GAG
ctgccacagatttatggaat

SEQ ID NO: 31134 - DNA, 20 bp, Artificial Sequence
  Description of Artificial Sequence: Synthetic oligonucleotide
  Target: SCN10A; (+) strand; PAM type: NRG; PAM sequence: AAG
atgagaatctgcatttgaac

SEQ ID NO: 31135 - DNA, 20 bp, Artificial Sequence
  Description of Artificial Sequence: Synthetic oligonucleotide
  Target: SCN10A; (+) strand; PAM type: NRG; PAM sequence: TGG
tctgcatttgaacaagctcc

SEQ ID NO: 31136 - DNA, 20 bp, Artificial Sequence
  Description of Artificial Sequence: Synthetic oligonucleotide
  Target: SCN10A; (+) strand; PAM type: NRG; PAM sequence: GGG
ctgcatttgaacaagctcct

SEQ ID NO: 31137 - DNA, 20 bp, Artificial Sequence
  Description of Artificial Sequence: Synthetic oligonucleotide
  Target: SCN10A; (+) strand; PAM type: NRG; PAM sequence: GAG
gcatttgaacaagctcctgg

SEQ ID NO: 31138 - DNA, 20 bp, Artificial Sequence
  Description of Artificial Sequence: Synthetic oligonucleotide
  Target: SCN10A; (+) strand; PAM type: NRG; PAM sequence: GAG
ctcctgggagattaaatttt

SEQ ID NO: 31139 - DNA, 20 bp, Artificial Sequence
  Description of Artificial Sequence: Synthetic oligonucleotide
  Target: SCN10A; (+) strand; PAM type: NRG; PAM sequence: AAG
ctgggagattaaattttgag

SEQ ID NO: 31140 - DNA, 20 bp, Artificial Sequence
  Description of Artificial Sequence: Synthetic oligonucleotide
  Target: SCN10A; (+) strand; PAM type: NRG; PAM sequence: GAG
ctattgtaatgattttctgt

SEQ ID NO: 31141 - DNA, 20 bp, Artificial Sequence
  Description of Artificial Sequence: Synthetic oligonucleotide
  Target: SCN10A; (+) strand; PAM type: NRG; PAM sequence: AAG
atgattttctgtgagcttta

SEQ ID NO: 31142 - DNA, 20 bp, Artificial Sequence
  Description of Artificial Sequence: Synthetic oligonucleotide
  Target: SCN10A; (+) strand; PAM type: NRG; PAM sequence: AGG
tgattttctgtgagctttaa

SEQ ID NO: 31143 - DNA, 20 bp, Artificial Sequence
  Description of Artificial Sequence: Synthetic oligonucleotide
  Target: SCN10A; (+) strand; PAM type: NRG; PAM sequence: GAG
attttctgtgagctttaaag

SEQ ID NO: 31144 - DNA, 20 bp, Artificial Sequence
  Description of Artificial Sequence: Synthetic oligonucleotide
  Target: SCN10A; (+) strand; PAM type: NRG; PAM sequence: TAG
gtgagctttaaaggagtaat

SEQ ID NO: 31145 - DNA, 20 bp, Artificial Sequence
  Description of Artificial Sequence: Synthetic oligonucleotide
  Target: SCN10A; (+) strand; PAM type: NRG; PAM sequence: TAG
agctttaaaggagtaattag

SEQ ID NO: 31146 - DNA, 20 bp, Artificial Sequence
  Description of Artificial Sequence: Synthetic oligonucleotide
  Target: SCN10A; (+) strand; PAM type: NRG; PAM sequence: TGG
aaggagtaattagtagcatt

SEQ ID NO: 31147 - DNA, 20 bp, Artificial Sequence
  Description of Artificial Sequence: Synthetic oligonucleotide
  Target: SCN10A; (+) strand; PAM type: NRG; PAM sequence: AAG
gagtaattagtagcatttgg

SEQ ID NO: 31148 - DNA, 20 bp, Artificial Sequence
  Description of Artificial Sequence: Synthetic oligonucleotide
  Target: SCN10A; (+) strand; PAM type: NRG; PAM sequence: TGG
taattagtagcatttggaag

SEQ ID NO: 31149 - DNA, 20 bp, Artificial Sequence
  Description of Artificial Sequence: Synthetic oligonucleotide
  Target: SCN10A; (+) strand; PAM type: NRG; PAM sequence: AAG
gcatttggaagtggtttgat

SEQ ID NO: 31150 - DNA, 20 bp, Artificial Sequence
  Description of Artificial Sequence: Synthetic oligonucleotide
  Target: SCN10A; (+) strand; PAM type: NRG; PAM sequence: AGG
catttggaagtggtttgata

SEQ ID NO: 31151 - DNA, 20 bp, Artificial Sequence
  Description of Artificial Sequence: Synthetic oligonucleotide
  Target: SCN10A; (+) strand; PAM type: NRG; PAM sequence: AAG
tggaagtggtttgataagga

SEQ ID NO: 31152 - DNA, 20 bp, Artificial Sequence
  Description of Artificial Sequence: Synthetic oligonucleotide
  Target: SCN10A; (+) strand; PAM type: NRG; PAM sequence: TAG
agtggtttgataaggaaaga

SEQ ID NO: 31153 - DNA, 20 bp, Artificial Sequence
  Description of Artificial Sequence: Synthetic oligonucleotide
  Target: SCN10A; (+) strand; PAM type: NRG; PAM sequence: TAG
agatagtcctttttgtattg

SEQ ID NO: 31154 - DNA, 20 bp, Artificial Sequence
  Description of Artificial Sequence: Synthetic oligonucleotide
  Target: SCN10A; (+) strand; PAM type: NRG; PAM sequence: AGG
gatagtcctttttgtattgt

SEQ ID NO: 31155 - DNA, 20 bp, Artificial Sequence
  Description of Artificial Sequence: Synthetic oligonucleotide
  Target: SCN10A; (+) strand; PAM type: NRG; PAM sequence: CAG
ctttttgtattgtaggcctt

SEQ ID NO: 31156 - DNA, 20 bp, Artificial Sequence
  Description of Artificial Sequence: Synthetic oligonucleotide
  Target: SCN10A; (+) strand; PAM type: NRG; PAM sequence: GAG
ttttgtattgtaggccttca

SEQ ID NO: 31157 - DNA, 20 bp, Artificial Sequence
  Description of Artificial Sequence: Synthetic oligonucleotide
  Target: SCN10A; (+) strand; PAM type: NRG; PAM sequence: AAG
tgtattgtaggccttcagag

SEQ ID NO: 31158 - DNA, 20 bp, Artificial Sequence
  Description of Artificial Sequence: Synthetic oligonucleotide
  Target: SCN10A; (+) strand; PAM type: NRG; PAM sequence: AGG
gtattgtaggccttcagaga

SEQ ID NO: 31159 - DNA, 20 bp, Artificial Sequence
  Description of Artificial Sequence: Synthetic oligonucleotide
  Target: SCN10A; (+) strand; PAM type: NRG; PAM sequence: TGG
cttcagagaaggccgtgtgt

SEQ ID NO: 31160 - DNA, 20 bp, Artificial Sequence
  Description of Artificial Sequence: Synthetic oligonucleotide
  Target: SCN10A; (+) strand; PAM type: NRG; PAM sequence: GGG
ttcagagaaggccgtgtgtt

SEQ ID NO: 31161 - DNA, 20 bp, Artificial Sequence
  Description of Artificial Sequence: Synthetic oligonucleotide
  Target: SCN10A; (+) strand; PAM type: NRG; PAM sequence: GGG
tcagagaaggccgtgtgttg

SEQ ID NO: 31162 - DNA, 20 bp, Artificial Sequence
  Description of Artificial Sequence: Synthetic oligonucleotide
  Target: SCN10A; (+) strand; PAM type: NRG; PAM sequence: GAG
agagaaggccgtgtgttggg

SEQ ID NO: 31163 - DNA, 20 bp, Artificial Sequence
  Description of Artificial Sequence: Synthetic oligonucleotide
  Target: SCN10A; (+) strand; PAM type: NRG; PAM sequence: AGG
gagaaggccgtgtgttgggg

SEQ ID NO: 31164 - DNA, 20 bp, Artificial Sequence
  Description of Artificial Sequence: Synthetic oligonucleotide
  Target: SCN10A; (+) strand; PAM type: NRG; PAM sequence: CAG
aggccgtgtgttggggaggt

SEQ ID NO: 31165 - DNA, 20 bp, Artificial Sequence
  Description of Artificial Sequence: Synthetic oligonucleotide
  Target: SCN10A; (+) strand; PAM type: NRG; PAM sequence: GAG
gccgtgtgttggggaggtca

SEQ ID NO: 31166 - DNA, 20 bp, Artificial Sequence
  Description of Artificial Sequence: Synthetic oligonucleotide
  Target: SCN10A; (+) strand; PAM type: NRG; PAM sequence: AGG
ccgtgtgttggggaggtcag

SEQ ID NO: 31167 - DNA, 20 bp, Artificial Sequence
  Description of Artificial Sequence: Synthetic oligonucleotide
  Target: SCN10A; (+) strand; PAM type: NRG; PAM sequence: GGG
cgtgtgttggggaggtcaga

SEQ ID NO: 31168 - DNA, 20 bp, Artificial Sequence
  Description of Artificial Sequence: Synthetic oligonucleotide
  Target: SCN10A; (+) strand; PAM type: NRG; PAM sequence: TGG
gtgttggggaggtcagaggg

SEQ ID NO: 31169 - DNA, 20 bp, Artificial Sequence
  Description of Artificial Sequence: Synthetic oligonucleotide
  Target: SCN10A; (+) strand; PAM type: NRG; PAM sequence: GGG
tgttggggaggtcagagggt

SEQ ID NO: 31170 - DNA, 20 bp, Artificial Sequence
  Description of Artificial Sequence: Synthetic oligonucleotide
  Target: SCN10A; (+) strand; PAM type: NRG; PAM sequence: AAG
tggggaggtcagagggtggg

SEQ ID NO: 31171 - DNA, 20 bp, Artificial Sequence
  Description of Artificial Sequence: Synthetic oligonucleotide
  Target: SCN10A; (+) strand; PAM type: NRG; PAM sequence: CAG
gaggtcagagggtgggaagc

SEQ ID NO: 31172 - DNA, 20 bp, Artificial Sequence
  Description of Artificial Sequence: Synthetic oligonucleotide
  Target: SCN10A; (+) strand; PAM type: NRG; PAM sequence: AGG
aggtcagagggtgggaagcc

SEQ ID NO: 31173 - DNA, 20 bp, Artificial Sequence
  Description of Artificial Sequence: Synthetic oligonucleotide
  Target: SCN10A; (+) strand; PAM type: NRG; PAM sequence: GGG
ggtcagagggtgggaagcca

SEQ ID NO: 31174 - DNA, 20 bp, Artificial Sequence
  Description of Artificial Sequence: Synthetic oligonucleotide
  Target: SCN10A; (+) strand; PAM type: NRG; PAM sequence: GGG
gtcagagggtgggaagccag

SEQ ID NO: 31175 - DNA, 20 bp, Artificial Sequence
  Description of Artificial Sequence: Synthetic oligonucleotide
  Target: SCN10A; (+) strand; PAM type: NRG; PAM sequence: CGG
gggtgggaagccaggggctt

SEQ ID NO: 31176 - DNA, 20 bp, Artificial Sequence
  Description of Artificial Sequence: Synthetic oligonucleotide
  Target: SCN10A; (+) strand; PAM type: NRG; PAM sequence: GGG
ggtgggaagccaggggcttc

SEQ ID NO: 31177 - DNA, 20 bp, Artificial Sequence
  Description of Artificial Sequence: Synthetic oligonucleotide
  Target: SCN10A; (+) strand; PAM type: NRG; PAM sequence: AAG
caggggcttcgggattaaat

SEQ ID NO: 31178 - DNA, 20 bp, Artificial Sequence
  Description of Artificial Sequence: Synthetic oligonucleotide
  Target: SCN10A; (+) strand; PAM type: NRG; PAM sequence: AGG
aggggcttcgggattaaata

SEQ ID NO: 31179 - DNA, 20 bp, Artificial Sequence
  Description of Artificial Sequence: Synthetic oligonucleotide
  Target: SCN10A; (+) strand; PAM type: NRG; PAM sequence: GGG
ggggcttcgggattaaataa

SEQ ID NO: 31180 - DNA, 20 bp, Artificial Sequence
  Description of Artificial Sequence: Synthetic oligonucleotide
  Target: SCN10A; (+) strand; PAM type: NRG; PAM sequence: AAG
ttcgggattaaataagggca

SEQ ID NO: 31181 - DNA, 20 bp, Artificial Sequence
  Description of Artificial Sequence: Synthetic oligonucleotide
  Target: SCN10A; (+) strand; PAM type: NRG; PAM sequence: TGG
ggattaaataagggcaaagc

SEQ ID NO: 31182 - DNA, 20 bp, Artificial Sequence
  Description of Artificial Sequence: Synthetic oligonucleotide
  Target: SCN10A; (+) strand; PAM type: NRG; PAM sequence: GGG
gattaaataagggcaaagct

SEQ ID NO: 31183 - DNA, 20 bp, Artificial Sequence
  Description of Artificial Sequence: Synthetic oligonucleotide
  Target: SCN10A; (+) strand; PAM type: NRG; PAM sequence: AAG
agctgggttttgctactgac

SEQ ID NO: 31184 - DNA, 20 bp, Artificial Sequence
  Description of Artificial Sequence: Synthetic oligonucleotide
  Target: SCN10A; (+) strand; PAM type: NRG; PAM sequence: TGG
gggttttgctactgacaagt

SEQ ID NO: 31185 - DNA, 20 bp, Artificial Sequence
  Description of Artificial Sequence: Synthetic oligonucleotide
  Target: SCN10A; (+) strand; PAM type: NRG; PAM sequence: GGG
ggttttgctactgacaagtt

SEQ ID NO: 31186 - DNA, 20 bp, Artificial Sequence
  Description of Artificial Sequence: Synthetic oligonucleotide
  Target: SCN10A; (+) strand; PAM type: NRG; PAM sequence: TGG
actgacaagttgggtgacct

SEQ ID NO: 31187 - DNA, 20 bp, Artificial Sequence
  Description of Artificial Sequence: Synthetic oligonucleotide
  Target: SCN10A; (+) strand; PAM type: NRG; PAM sequence: AAG
caagttgggtgaccttggac

SEQ ID NO: 31188 - DNA, 20 bp, Artificial Sequence
  Description of Artificial Sequence: Synthetic oligonucleotide
  Target: SCN10A; (+) strand; PAM type: NRG; PAM sequence: GAG
acaagccttttaaacatttt

SEQ ID NO: 31189 - DNA, 20 bp, Artificial Sequence
  Description of Artificial Sequence: Synthetic oligonucleotide
  Target: SCN10A; (+) strand; PAM type: NRG; PAM sequence: CAG
cttttaaacattttgagtgt

SEQ ID NO: 31190 - DNA, 20 bp, Artificial Sequence
  Description of Artificial Sequence: Synthetic oligonucleotide
  Target: SCN10A; (+) strand; PAM type: NRG; PAM sequence: TAG
tgtcagtttccccatctata

SEQ ID NO: 31191 - DNA, 20 bp, Artificial Sequence
  Description of Artificial Sequence: Synthetic oligonucleotide
  Target: SCN10A; (+) strand; PAM type: NRG; PAM sequence: TGG
cagtttccccatctatatag

SEQ ID NO: 31192 - DNA, 20 bp, Artificial Sequence
  Description of Artificial Sequence: Synthetic oligonucleotide
  Target: SCN10A; (+) strand; PAM type: NRG; PAM sequence: GGG
agtttccccatctatatagt

SEQ ID NO: 31193 - DNA, 20 bp, Artificial Sequence
  Description of Artificial Sequence: Synthetic oligonucleotide
  Target: SCN10A; (+) strand; PAM type: NRG; PAM sequence: GAG
tttccccatctatatagtgg

SEQ ID NO: 31194 - DNA, 20 bp, Artificial Sequence
  Description of Artificial Sequence: Synthetic oligonucleotide
  Target: SCN10A; (+) strand; PAM type: NRG; PAM sequence: AGG
ttccccatctatatagtggg

SEQ ID NO: 31195 - DNA, 20 bp, Artificial Sequence
  Description of Artificial Sequence: Synthetic oligonucleotide
  Target: SCN10A; (+) strand; PAM type: NRG; PAM sequence: CAG
ctcactcactcaaatgcttg

SEQ ID NO: 31196 - DNA, 20 bp, Artificial Sequence
  Description of Artificial Sequence: Synthetic oligonucleotide
  Target: SCN10A; (+) strand; PAM type: NRG; PAM sequence: CAG
ctcactcaaatgcttgcagc

SEQ ID NO: 31197 - DNA, 20 bp, Artificial Sequence
  Description of Artificial Sequence: Synthetic oligonucleotide
  Target: SCN10A; (+) strand; PAM type: NRG; PAM sequence: AGG
tcactcaaatgcttgcagcc

SEQ ID NO: 31198 - DNA, 20 bp, Artificial Sequence
  Description of Artificial Sequence: Synthetic oligonucleotide
  Target: SCN10A; (+) strand; PAM type: NRG; PAM sequence: TGG
caaatgcttgcagccaggtt

SEQ ID NO: 31199 - DNA, 20 bp, Artificial Sequence
  Description of Artificial Sequence: Synthetic oligonucleotide
  Target: SCN10A; (+) strand; PAM type: NRG; PAM sequence: CAG
atgcttgcagccaggtttgg

SEQ ID NO: 31200 - DNA, 20 bp, Artificial Sequence
  Description of Artificial Sequence: Synthetic oligonucleotide
  Target: SCN10A; (+) strand; PAM type: NRG; PAM sequence: AGG
tgcttgcagccaggtttggc

SEQ ID NO: 31201 - DNA, 20 bp, Artificial Sequence
  Description of Artificial Sequence: Synthetic oligonucleotide
  Target: SCN10A; (+) strand; PAM type: NRG; PAM sequence: TGG
cagccaggtttggcaggcca

SEQ ID NO: 31202 - DNA, 20 bp, Artificial Sequence
  Description of Artificial Sequence: Synthetic oligonucleotide
  Target: SCN10A; (+) strand; PAM type: NRG; PAM sequence: CGG
aggtttggcaggccatggca

SEQ ID NO: 31203 - DNA, 20 bp, Artificial Sequence
  Description of Artificial Sequence: Synthetic oligonucleotide
  Target: SCN10A; (+) strand; PAM type: NRG; PAM sequence: GGG
ggtttggcaggccatggcac

SEQ ID NO: 31204 - DNA, 20 bp, Artificial Sequence
  Description of Artificial Sequence: Synthetic oligonucleotide
  Target: SCN10A; (+) strand; PAM type: NRG; PAM sequence: AAG
acctcccatgctctgctgct

SEQ ID NO: 31205 - DNA, 20 bp, Artificial Sequence
  Description of Artificial Sequence: Synthetic oligonucleotide
  Target: SCN10A; (+) strand; PAM type: NRG; PAM sequence: GAG
ctcccatgctctgctgctaa

SEQ ID NO: 31206 - DNA, 20 bp, Artificial Sequence
  Description of Artificial Sequence: Synthetic oligonucleotide
  Target: SCN10A; (+) strand; PAM type: NRG; PAM sequence: AGG
tcccatgctctgctgctaag

SEQ ID NO: 31207 - DNA, 20 bp, Artificial Sequence
  Description of Artificial Sequence: Synthetic oligonucleotide
  Target: SCN10A; (+) strand; PAM type: NRG; PAM sequence: GGG
cccatgctctgctgctaaga

SEQ ID NO: 31208 - DNA, 20 bp, Artificial Sequence
  Description of Artificial Sequence: Synthetic oligonucleotide
  Target: SCN10A; (+) strand; PAM type: NRG; PAM sequence: GGG
ccatgctctgctgctaagag

SEQ ID NO: 31209 - DNA, 20 bp, Artificial Sequence
  Description of Artificial Sequence: Synthetic oligonucleotide
  Target: SCN10A; (+) strand; PAM type: NRG; PAM sequence: TGG
gctaagaggggccctcgccc

SEQ ID NO: 31210 - DNA, 20 bp, Artificial Sequence
  Description of Artificial Sequence: Synthetic oligonucleotide
  Target: SCN10A; (+) strand; PAM type: NRG; PAM sequence: GGG
ctaagaggggccctcgccct

SEQ ID NO: 31211 - DNA, 20 bp, Artificial Sequence
  Description of Artificial Sequence: Synthetic oligonucleotide
  Target: SCN10A; (+) strand; PAM type: NRG; PAM sequence: CAG
ggggccctcgccctgggctg

SEQ ID NO: 31212 - DNA, 20 bp, Artificial Sequence
  Description of Artificial Sequence: Synthetic oligonucleotide
  Target: SCN10A; (+) strand; PAM type: NRG; PAM sequence: TAG
ctgggctgcagctctccttc

SEQ ID NO: 31213 - DNA, 20 bp, Artificial Sequence
  Description of Artificial Sequence: Synthetic oligonucleotide
  Target: SCN10A; (+) strand; PAM type: NRG; PAM sequence: AAG
gcagctctccttctagtgac

SEQ ID NO: 31214 - DNA, 20 bp, Artificial Sequence
  Description of Artificial Sequence: Synthetic oligonucleotide
  Target: SCN10A; (+) strand; PAM type: NRG; PAM sequence: AGG
cagctctccttctagtgaca

SEQ ID NO: 31215 - DNA, 20 bp, Artificial Sequence
  Description of Artificial Sequence: Synthetic oligonucleotide
  Target: SCN10A; (+) strand; PAM type: NRG; PAM sequence: TGG
tctccttctagtgacaaggt

SEQ ID NO: 31216 - DNA, 20 bp, Artificial Sequence
  Description of Artificial Sequence: Synthetic oligonucleotide
  Target: SCN10A; (+) strand; PAM type: NRG; PAM sequence: GGG
ctccttctagtgacaaggtt

SEQ ID NO: 31217 - DNA, 20 bp, Artificial Sequence
  Description of Artificial Sequence: Synthetic oligonucleotide
  Target: SCN10A; (+) strand; PAM type: NRG; PAM sequence: GGG
tccttctagtgacaaggttg

SEQ ID NO: 31218 - DNA, 20 bp, Artificial Sequence
  Description of Artificial Sequence: Synthetic oligonucleotide
  Target: SCN10A; (+) strand; PAM type: NRG; PAM sequence: CAG
gtgacaaggttggggacttt

SEQ ID NO: 31219 - DNA, 20 bp, Artificial Sequence
  Description of Artificial Sequence: Synthetic oligonucleotide
  Target: SCN10A; (+) strand; PAM type: NRG; PAM sequence: CAG
aaggttggggactttcagct

SEQ ID NO: 31220 - DNA, 20 bp, Artificial Sequence
  Description of Artificial Sequence: Synthetic oligonucleotide
  Target: SCN10A; (+) strand; PAM type: NRG; PAM sequence: TAG
gttggggactttcagctcag

SEQ ID NO: 31221 - DNA, 20 bp, Artificial Sequence
  Description of Artificial Sequence: Synthetic oligonucleotide
  Target: SCN10A; (+) strand; PAM type: NRG; PAM sequence: CAG
gggactttcagctcagtagt

SEQ ID NO: 31222 - DNA, 20 bp, Artificial Sequence
  Description of Artificial Sequence: Synthetic oligonucleotide
  Target: SCN10A; (+) strand; PAM type: NRG; PAM sequence: AGG
ggactttcagctcagtagtc

SEQ ID NO: 31223 - DNA, 20 bp, Artificial Sequence
  Description of Artificial Sequence: Synthetic oligonucleotide
  Target: SCN10A; (+) strand; PAM type: NRG; PAM sequence: GAG
actttcagctcagtagtcag

SEQ ID NO: 31224 - DNA, 20 bp, Artificial Sequence
  Description of Artificial Sequence: Synthetic oligonucleotide
  Target: SCN10A; (+) strand; PAM type: NRG; PAM sequence: CAG
gtcaggagaacccactgatg

SEQ ID NO: 31225 - DNA, 20 bp, Artificial Sequence
  Description of Artificial Sequence: Synthetic oligonucleotide
  Target: SCN10A; (+) strand; PAM type: NRG; PAM sequence: CAG
agaacccactgatgcagctc

SEQ ID NO: 31226 - DNA, 20 bp, Artificial Sequence
  Description of Artificial Sequence: Synthetic oligonucleotide
  Target: SCN10A; (+) strand; PAM type: NRG; PAM sequence: AGG
gaacccactgatgcagctcc

SEQ ID NO: 31227 - DNA, 20 bp, Artificial Sequence
  Description of Artificial Sequence: Synthetic oligonucleotide
  Target: SCN10A; (+) strand; PAM type: NRG; PAM sequence: GGG
aacccactgatgcagctcca

SEQ ID NO: 31228 - DNA, 20 bp, Artificial Sequence
  Description of Artificial Sequence: Synthetic oligonucleotide
  Target: SCN10A; (+) strand; PAM type: NRG; PAM sequence: TGG
tgatgcagctccagggcctt

SEQ ID NO: 31229 - DNA, 20 bp, Artificial Sequence
  Description of Artificial Sequence: Synthetic oligonucleotide
  Target: SCN10A; (+) strand; PAM type: NRG; PAM sequence: TAG
gctccagggcctttggattg

SEQ ID NO: 31230 - DNA, 20 bp, Artificial Sequence
  Description of Artificial Sequence: Synthetic oligonucleotide
  Target: SCN10A; (+) strand; PAM type: NRG; PAM sequence: AGG
ctccagggcctttggattgt

SEQ ID NO: 31231 - DNA, 20 bp, Artificial Sequence
  Description of Artificial Sequence: Synthetic oligonucleotide
  Target: SCN10A; (+) strand; PAM type: NRG; PAM sequence: GAG
ccagggcctttggattgtag

SEQ ID NO: 31232 - DNA, 20 bp, Artificial Sequence
  Description of Artificial Sequence: Synthetic oligonucleotide
  Target: SCN10A; (+) strand; PAM type: NRG; PAM sequence: TGG
gattgtaggagattcctatc

SEQ ID NO: 31233 - DNA, 20 bp, Artificial Sequence
  Description of Artificial Sequence: Synthetic oligonucleotide
  Target: SCN10A; (+) strand; PAM type: NRG; PAM sequence: GAG
ttgtaggagattcctatctg

SEQ ID NO: 31234 - DNA, 20 bp, Artificial Sequence
  Description of Artificial Sequence: Synthetic oligonucleotide
  Target: SCN10A; (+) strand; PAM type: NRG; PAM sequence: AGG
tgtaggagattcctatctgg

SEQ ID NO: 31235 - DNA, 20 bp, Artificial Sequence
  Description of Artificial Sequence: Synthetic oligonucleotide
  Target: SCN10A; (+) strand; PAM type: NRG; PAM sequence: TGG
agattcctatctggaggatt

SEQ ID NO: 31236 - DNA, 20 bp, Artificial Sequence
  Description of Artificial Sequence: Synthetic oligonucleotide
  Target: SCN10A; (+) strand; PAM type: NRG; PAM sequence: GGG
gattcctatctggaggattt

SEQ ID NO: 31237 - DNA, 20 bp, Artificial Sequence
  Description of Artificial Sequence: Synthetic oligonucleotide
  Target: SCN10A; (+) strand; PAM type: NRG; PAM sequence: GGG
attcctatctggaggatttg

SEQ ID NO: 31238 - DNA, 20 bp, Artificial Sequence
  Description of Artificial Sequence: Synthetic oligonucleotide
  Target: SCN10A; (+) strand; PAM type: NRG; PAM sequence: GGG
ttcctatctggaggatttgg

SEQ ID NO: 31239 - DNA, 20 bp, Artificial Sequence
  Description of Artificial Sequence: Synthetic oligonucleotide
  Target: SCN10A; (+) strand; PAM type: NRG; PAM sequence: CAG
ctatctggaggatttggggg

SEQ ID NO: 31240 - DNA, 20 bp, Artificial Sequence
  Description of Artificial Sequence: Synthetic oligonucleotide
  Target: SCN10A; (+) strand; PAM type: NRG; PAM sequence: AGG
tatctggaggatttgggggc

SEQ ID NO: 31241 - DNA, 20 bp, Artificial Sequence
  Description of Artificial Sequence: Synthetic oligonucleotide
  Target: SCN10A; (+) strand; PAM type: NRG; PAM sequence: GGG
atctggaggatttgggggca

SEQ ID NO: 31242 - DNA, 20 bp, Artificial Sequence
  Description of Artificial Sequence: Synthetic oligonucleotide
  Target: SCN10A; (+) strand; PAM type: NRG; PAM sequence: CAG
gggactatgcctccccttac

SEQ ID NO: 31243 - DNA, 20 bp, Artificial Sequence
  Description of Artificial Sequence: Synthetic oligonucleotide
  Target: SCN10A; (+) strand; PAM type: NRG; PAM sequence: GAG
gactatgcctccccttacca

SEQ ID NO: 31244 - DNA, 20 bp, Artificial Sequence
  Description of Artificial Sequence: Synthetic oligonucleotide
  Target: SCN10A; (+) strand; PAM type: NRG; PAM sequence: GAG
cttaccagagatccactgct

SEQ ID NO: 31245 - DNA, 20 bp, Artificial Sequence
  Description of Artificial Sequence: Synthetic oligonucleotide
  Target: SCN10A; (+) strand; PAM type: NRG; PAM sequence: CAG
accagagatccactgctgag

SEQ ID NO: 31246 - DNA, 20 bp, Artificial Sequence
  Description of Artificial Sequence: Synthetic oligonucleotide
  Target: SCN10A; (+) strand; PAM type: NRG; PAM sequence: AGG
ccagagatccactgctgagc

SEQ ID NO: 31247 - DNA, 20 bp, Artificial Sequence
  Description of Artificial Sequence: Synthetic oligonucleotide
  Target: SCN10A; (+) strand; PAM type: NRG; PAM sequence: AAG
cactgctgagcaggatcatg

SEQ ID NO: 31248 - DNA, 20 bp, Artificial Sequence
  Description of Artificial Sequence: Synthetic oligonucleotide
  Target: SCN10A; (+) strand; PAM type: NRG; PAM sequence: AAG
gcaggatcatgaagatgatg

SEQ ID NO: 31249 - DNA, 20 bp, Artificial Sequence
  Description of Artificial Sequence: Synthetic oligonucleotide
  Target: SCN10A; (+) strand; PAM type: NRG; PAM sequence: CAG
agatgatgaagctctcaaac

SEQ ID NO: 31250 - DNA, 20 bp, Artificial Sequence
  Description of Artificial Sequence: Synthetic oligonucleotide
  Target: SCN10A; (+) strand; PAM type: NRG; PAM sequence: CGG
accagctgtgctccacgata

SEQ ID NO: 31251 - DNA, 20 bp, Artificial Sequence
  Description of Artificial Sequence: Synthetic oligonucleotide
  Target: SCN10A; (+) strand; PAM type: NRG; PAM sequence: TAG
agctgtgctccacgatacgg

SEQ ID NO: 31252 - DNA, 20 bp, Artificial Sequence
  Description of Artificial Sequence: Synthetic oligonucleotide
  Target: SCN10A; (+) strand; PAM type: NRG; PAM sequence: AAG
gtgctccacgatacggtagc

SEQ ID NO: 31253 - DNA, 20 bp, Artificial Sequence
  Description of Artificial Sequence: Synthetic oligonucleotide
  Target: SCN10A; (+) strand; PAM type: NRG; PAM sequence: CAG
agcaagtcttgcgcacctgc

SEQ ID NO: 31254 - DNA, 20 bp, Artificial Sequence
  Description of Artificial Sequence: Synthetic oligonucleotide
  Target: SCN10A; (+) strand; PAM type: NRG; PAM sequence: TGG
acctgccagcccacatccca

SEQ ID NO: 31255 - DNA, 20 bp, Artificial Sequence
  Description of Artificial Sequence: Synthetic oligonucleotide
  Target: SCN10A; (+) strand; PAM type: NRG; PAM sequence: TGG
gcccacatcccatggactct

SEQ ID NO: 31256 - DNA, 20 bp, Artificial Sequence
  Description of Artificial Sequence: Synthetic oligonucleotide
  Target: SCN10A; (+) strand; PAM type: NRG; PAM sequence: TGG
cacatcccatggactcttgg

SEQ ID NO: 31257 - DNA, 20 bp, Artificial Sequence
  Description of Artificial Sequence: Synthetic oligonucleotide
  Target: SCN10A; (+) strand; PAM type: NRG; PAM sequence: CAG
catggactcttggtggtatc

SEQ ID NO: 31258 - DNA, 20 bp, Artificial Sequence
  Description of Artificial Sequence: Synthetic oligonucleotide
  Target: SCN10A; (+) strand; PAM type: NRG; PAM sequence: CAG
tcttggtggtatccagtttg

SEQ ID NO: 31259 - DNA, 20 bp, Artificial Sequence
  Description of Artificial Sequence: Synthetic oligonucleotide
  Target: SCN10A; (+) strand; PAM type: NRG; PAM sequence: CAG
tggtggtatccagtttgcag

SEQ ID NO: 31260 - DNA, 20 bp, Artificial Sequence
  Description of Artificial Sequence: Synthetic oligonucleotide
  Target: SCN10A; (+) strand; PAM type: NRG; PAM sequence: AGG
ggtggtatccagtttgcagc

SEQ ID NO: 31261 - DNA, 20 bp, Artificial Sequence
  Description of Artificial Sequence: Synthetic oligonucleotide
  Target: SCN10A; (+) strand; PAM type: NRG; PAM sequence: GGG
gtggtatccagtttgcagca

SEQ ID NO: 31262 - DNA, 20 bp, Artificial Sequence
  Description of Artificial Sequence: Synthetic oligonucleotide
  Target: SCN10A; (+) strand; PAM type: NRG; PAM sequence: CAG
tatccagtttgcagcaggga

SEQ ID NO: 31263 - DNA, 20 bp, Artificial Sequence
  Description of Artificial Sequence: Synthetic oligonucleotide
  Target: SCN10A; (+) strand; PAM type: NRG; PAM sequence: TGG
ccagtttgcagcagggacag

SEQ ID NO: 31264 - DNA, 20 bp, Artificial Sequence
  Description of Artificial Sequence: Synthetic oligonucleotide
  Target: SCN10A; (+) strand; PAM type: NRG; PAM sequence: TGG
acagtggcgaatgcatcctg

SEQ ID NO: 31265 - DNA, 20 bp, Artificial Sequence
  Description of Artificial Sequence: Synthetic oligonucleotide
  Target: SCN10A; (+) strand; PAM type: NRG; PAM sequence: GGG
cagtggcgaatgcatcctgt

SEQ ID NO: 31266 - DNA, 20 bp, Artificial Sequence
  Description of Artificial Sequence: Synthetic oligonucleotide
  Target: SCN10A; (+) strand; PAM type: NRG; PAM sequence: GGG
agtggcgaatgcatcctgtg

SEQ ID NO: 31267 - DNA, 20 bp, Artificial Sequence
  Description of Artificial Sequence: Synthetic oligonucleotide
  Target: SCN10A; (+) strand; PAM type: NRG; PAM sequence: GAG
tggcgaatgcatcctgtggg

SEQ ID NO: 31268 - DNA, 20 bp, Artificial Sequence
  Description of Artificial Sequence: Synthetic oligonucleotide
  Target: SCN10A; (+) strand; PAM type: NRG; PAM sequence: GAG
gcgaatgcatcctgtgggga

SEQ ID NO: 31269 - DNA, 20 bp, Artificial Sequence
  Description of Artificial Sequence: Synthetic oligonucleotide
  Target: SCN10A; (+) strand; PAM type: NRG; PAM sequence: AGG
cgaatgcatcctgtggggag

SEQ ID NO: 31270 - DNA, 20 bp, Artificial Sequence
  Description of Artificial Sequence: Synthetic oligonucleotide
  Target: SCN10A; (+) strand; PAM type: NRG; PAM sequence: TGG
ctgtggggagaggtgactga

SEQ ID NO: 31271 - DNA, 20 bp, Artificial Sequence
  Description of Artificial Sequence: Synthetic oligonucleotide
  Target: SCN10A; (+) strand; PAM type: NRG; PAM sequence: TGG
tggggagaggtgactgatgg

SEQ ID NO: 31272 - DNA, 20 bp, Artificial Sequence
  Description of Artificial Sequence: Synthetic oligonucleotide
  Target: SCN10A; (+) strand; PAM type: NRG; PAM sequence: GGG
ggggagaggtgactgatggt

SEQ ID NO: 31273 - DNA, 20 bp, Artificial Sequence
  Description of Artificial Sequence: Synthetic oligonucleotide
  Target: SCN10A; (+) strand; PAM type: NRG; PAM sequence: TGG
aggtgactgatggtgggtga

SEQ ID NO: 31274 - DNA, 20 bp, Artificial Sequence
  Description of Artificial Sequence: Synthetic oligonucleotide
  Target: SCN10A; (+) strand; PAM type: NRG; PAM sequence: CAG
gactgatggtgggtgatggc

SEQ ID NO: 31275 - DNA, 20 bp, Artificial Sequence
  Description of Artificial Sequence: Synthetic oligonucleotide
  Target: SCN10A; (+) strand; PAM type: NRG; PAM sequence: TGG
tgatggtgggtgatggccag

SEQ ID NO: 31276 - DNA, 20 bp, Artificial Sequence
  Description of Artificial Sequence: Synthetic oligonucleotide
  Target: SCN10A; (+) strand; PAM type: NRG; PAM sequence: GGG
gatggtgggtgatggccagt

SEQ ID NO: 31277 - DNA, 20 bp, Artificial Sequence
  Description of Artificial Sequence: Synthetic oligonucleotide
  Target: SCN10A; (+) strand; PAM type: NRG; PAM sequence: AAG
tgggtgatggccagtgggca

SEQ ID NO: 31278 - DNA, 20 bp, Artificial Sequence
  Description of Artificial Sequence: Synthetic oligonucleotide
  Target: SCN10A; (+) strand; PAM type: NRG; PAM sequence: AGG
gggtgatggccagtgggcaa

SEQ ID NO: 31279 - DNA, 20 bp, Artificial Sequence
  Description of Artificial Sequence: Synthetic oligonucleotide
  Target: SCN10A; (+) strand; PAM type: NRG; PAM sequence: GGG
ggtgatggccagtgggcaaa

SEQ ID NO: 31280 - DNA, 20 bp, Artificial Sequence
  Description of Artificial Sequence: Synthetic oligonucleotide
  Target: SCN10A; (+) strand; PAM type: NRG; PAM sequence: GGG
gtgatggccagtgggcaaag

SEQ ID NO: 31281 - DNA, 20 bp, Artificial Sequence
  Description of Artificial Sequence: Synthetic oligonucleotide
  Target: SCN10A; (+) strand; PAM type: NRG; PAM sequence: CAG
gataatttctgctcctgctg

SEQ ID NO: 31282 - DNA, 20 bp, Artificial Sequence
  Description of Artificial Sequence: Synthetic oligonucleotide
  Target: SCN10A; (+) strand; PAM type: NRG; PAM sequence: GAG
taatttctgctcctgctgca

SEQ ID NO: 31283 - DNA, 20 bp, Artificial Sequence
  Description of Artificial Sequence: Synthetic oligonucleotide
  Target: SCN10A; (+) strand; PAM type: NRG; PAM sequence: TAG
ctgcagagaaaccattctgc

SEQ ID NO: 31284 - DNA, 20 bp, Artificial Sequence
  Description of Artificial Sequence: Synthetic oligonucleotide
  Target: SCN10A; (+) strand; PAM type: NRG; PAM sequence: AGG
tgcagagaaaccattctgct

SEQ ID NO: 31285 - DNA, 20 bp, Artificial Sequence
  Description of Artificial Sequence: Synthetic oligonucleotide
  Target: SCN10A; (+) strand; PAM type: NRG; PAM sequence: TGG
aaacccacttgtcatgccct

SEQ ID NO: 31286 - DNA, 20 bp, Artificial Sequence
  Description of Artificial Sequence: Synthetic oligonucleotide
  Target: SCN10A; (+) strand; PAM type: NRG; PAM sequence: TGG
cttggaaaaaaattctttcc

SEQ ID NO: 31287 - DNA, 20 bp, Artificial Sequence
  Description of Artificial Sequence: Synthetic oligonucleotide
  Target: SCN10A; (+) strand; PAM type: NRG; PAM sequence: TGG
aaaaattctttcctggaata

SEQ ID NO: 31288 - DNA, 20 bp, Artificial Sequence
  Description of Artificial Sequence: Synthetic oligonucleotide
  Target: SCN10A; (+) strand; PAM type: NRG; PAM sequence: GGG
aaaattctttcctggaatat

SEQ ID NO: 31289 - DNA, 20 bp, Artificial Sequence
  Description of Artificial Sequence: Synthetic oligonucleotide
  Target: SCN10A; (+) strand; PAM type: NRG; PAM sequence: AAG
tctttcctggaatatgggtg

SEQ ID NO: 31290 - DNA, 20 bp, Artificial Sequence
  Description of Artificial Sequence: Synthetic oligonucleotide
  Target: SCN10A; (+) strand; PAM type: NRG; PAM sequence: GAG
tttcctggaatatgggtgaa

SEQ ID NO: 31291 - DNA, 20 bp, Artificial Sequence
  Description of Artificial Sequence: Synthetic oligonucleotide
  Target: SCN10A; (+) strand; PAM type: NRG; PAM sequence: AGG
ttcctggaatatgggtgaag

SEQ ID NO: 31292 - DNA, 20 bp, Artificial Sequence
  Description of Artificial Sequence: Synthetic oligonucleotide
  Target: SCN10A; (+) strand; PAM type: NRG; PAM sequence: GGG
tcctggaatatgggtgaaga

SEQ ID NO: 31293 - DNA, 20 bp, Artificial Sequence
  Description of Artificial Sequence: Synthetic oligonucleotide
  Target: SCN10A; (+) strand; PAM type: NRG; PAM sequence: GGG
cctggaatatgggtgaagag

SEQ ID NO: 31294 - DNA, 20 bp, Artificial Sequence
  Description of Artificial Sequence: Synthetic oligonucleotide
  Target: SCN10A; (+) strand; PAM type: NRG; PAM sequence: CAG
gggtgaagaggggtcccttc

SEQ ID NO: 31295 - DNA, 20 bp, Artificial Sequence
  Description of Artificial Sequence: Synthetic oligonucleotide
  Target: SCN10A; (+) strand; PAM type: NRG; PAM sequence: AGG
ggtgaagaggggtcccttcc

SEQ ID NO: 31296 - DNA, 20 bp, Artificial Sequence
  Description of Artificial Sequence: Synthetic oligonucleotide
  Target: SCN10A; (+) strand; PAM type: NRG; PAM sequence: GGG
gtgaagaggggtcccttcca

SEQ ID NO: 31297 - DNA, 20 bp, Artificial Sequence
  Description of Artificial Sequence: Synthetic oligonucleotide
  Target: SCN10A; (+) strand; PAM type: NRG; PAM sequence: GAG
gaagaggggtcccttccagg

SEQ ID NO: 31298 - DNA, 20 bp, Artificial Sequence
  Description of Artificial Sequence: Synthetic oligonucleotide
  Target: SCN10A; (+) strand; PAM type: NRG; PAM sequence: CAG
ttccagggagtccctcaatc

SEQ ID NO: 31299 - DNA, 20 bp, Artificial Sequence
  Description of Artificial Sequence: Synthetic oligonucleotide
  Target: SCN10A; (+) strand; PAM type: NRG; PAM sequence: CAG
agtccctcaatccagaccaa

SEQ ID NO: 31300 - DNA, 20 bp, Artificial Sequence
  Description of Artificial Sequence: Synthetic oligonucleotide
  Target: SCN10A; (+) strand; PAM type: NRG; PAM sequence: AGG
gtccctcaatccagaccaac

SEQ ID NO: 31301 - DNA, 20 bp, Artificial Sequence
  Description of Artificial Sequence: Synthetic oligonucleotide
  Target: SCN10A; (+) strand; PAM type: NRG; PAM sequence: CAG
caggtgttcctctccatcat

SEQ ID NO: 31302 - DNA, 20 bp, Artificial Sequence
  Description of Artificial Sequence: Synthetic oligonucleotide
  Target: SCN10A; (+) strand; PAM type: NRG; PAM sequence: TAG
gcccactctgatgtttttcc

SEQ ID NO: 31303 - DNA, 20 bp, Artificial Sequence
  Description of Artificial Sequence: Synthetic oligonucleotide
  Target: SCN10A; (+) strand; PAM type: NRG; PAM sequence: CAG
tcctagccatatccttctta

SEQ ID NO: 31304 - DNA, 20 bp, Artificial Sequence
  Description of Artificial Sequence: Synthetic oligonucleotide
  Target: SCN10A; (+) strand; PAM type: NRG; PAM sequence: CAG
atccttcttacagatgacac

SEQ ID NO: 31305 - DNA, 20 bp, Artificial Sequence
  Description of Artificial Sequence: Synthetic oligonucleotide
  Target: SCN10A; (+) strand; PAM type: NRG; PAM sequence: TGG
cttcttacagatgacaccag

SEQ ID NO: 31306 - DNA, 20 bp, Artificial Sequence
  Description of Artificial Sequence: Synthetic oligonucleotide
  Target: SCN10A; (+) strand; PAM type: NRG; PAM sequence: TGG
tccttctgcccacctatacc

SEQ ID NO: 31307 - DNA, 20 bp, Artificial Sequence
  Description of Artificial Sequence: Synthetic oligonucleotide
  Target: SCN10A; (+) strand; PAM type: NRG; PAM sequence: CAG
gcccacctatacctggaaaa

SEQ ID NO: 31308 - DNA, 20 bp, Artificial Sequence
  Description of Artificial Sequence: Synthetic oligonucleotide
  Target: SCN10A; (+) strand; PAM type: NRG; PAM sequence: AAG
cctatacctggaaaacagac

SEQ ID NO: 31309 - DNA, 20 bp, Artificial Sequence
  Description of Artificial Sequence: Synthetic oligonucleotide
  Target: SCN10A; (+) strand; PAM type: NRG; PAM sequence: CGG
cctggaaaacagacaagcta

SEQ ID NO: 31310 - DNA, 20 bp, Artificial Sequence
  Description of Artificial Sequence: Synthetic oligonucleotide
  Target: SCN10A; (+) strand; PAM type: NRG; PAM sequence: GAG
acagacaagctacggcgtat

SEQ ID NO: 31311 - DNA, 20 bp, Artificial Sequence
  Description of Artificial Sequence: Synthetic oligonucleotide
  Target: SCN10A; (+) strand; PAM type: NRG; PAM sequence: TGG
caagctacggcgtatgagcc

SEQ ID NO: 31312 - DNA, 20 bp, Artificial Sequence
  Description of Artificial Sequence: Synthetic oligonucleotide
  Target: SCN10A; (+) strand; PAM type: NRG; PAM sequence: GGG
aagctacggcgtatgagcct

SEQ ID NO: 31313 - DNA, 20 bp, Artificial Sequence
  Description of Artificial Sequence: Synthetic oligonucleotide
  Target: SCN10A; (+) strand; PAM type: NRG; PAM sequence: GGG
agctacggcgtatgagcctg

SEQ ID NO: 31314 - DNA, 20 bp, Artificial Sequence
  Description of Artificial Sequence: Synthetic oligonucleotide
  Target: SCN10A; (+) strand; PAM type: NRG; PAM sequence: GGG
gctacggcgtatgagcctgg

SEQ ID NO: 31315 - DNA, 20 bp, Artificial Sequence
  Description of Artificial Sequence: Synthetic oligonucleotide
  Target: SCN10A; (+) strand; PAM type: NRG; PAM sequence: GAG
gtatgagcctgggggtgcct

SEQ ID NO: 31316 - DNA, 20 bp, Artificial Sequence
  Description of Artificial Sequence: Synthetic oligonucleotide
  Target: SCN10A; (+) strand; PAM type: NRG; PAM sequence: AGG
tatgagcctgggggtgcctg

SEQ ID NO: 31317 - DNA, 20 bp, Artificial Sequence
  Description of Artificial Sequence: Synthetic oligonucleotide
  Target: SCN10A; (+) strand; PAM type: NRG; PAM sequence: GGG
atgagcctgggggtgcctga

SEQ ID NO: 31318 - DNA, 20 bp, Artificial Sequence
  Description of Artificial Sequence: Synthetic oligonucleotide
  Target: SCN10A; (+) strand; PAM type: NRG; PAM sequence: GGG
tgagcctgggggtgcctgag

SEQ ID NO: 31319 - DNA, 20 bp, Artificial Sequence
  Description of Artificial Sequence: Synthetic oligonucleotide
  Target: SCN10A; (+) strand; PAM type: NRG; PAM sequence: GGG
gagcctgggggtgcctgagg

SEQ ID NO: 31320 - DNA, 20 bp, Artificial Sequence
  Description of Artificial Sequence: Synthetic oligonucleotide
  Target: SCN10A; (+) strand; PAM type: NRG; PAM sequence: AAG
gcctgagggggatatgctcc

SEQ ID NO: 31321 - DNA, 20 bp, Artificial Sequence
  Description of Artificial Sequence: Synthetic oligonucleotide
  Target: SCN10A; (+) strand; PAM type: NRG; PAM sequence: AAG
gggggatatgctccaagccc

SEQ ID NO: 31322 - DNA, 20 bp, Artificial Sequence
  Description of Artificial Sequence: Synthetic oligonucleotide
  Target: SCN10A; (+) strand; PAM type: NRG; PAM sequence: GAG
ctccaagcccaagctgaact

SEQ ID NO: 31323 - DNA, 20 bp, Artificial Sequence
  Description of Artificial Sequence: Synthetic oligonucleotide
  Target: SCN10A; (+) strand; PAM type: NRG; PAM sequence: AGG
tccaagcccaagctgaactg

SEQ ID NO: 31324 - DNA, 20 bp, Artificial Sequence
  Description of Artificial Sequence: Synthetic oligonucleotide
  Target: SCN10A; (+) strand; PAM type: NRG; PAM sequence: GGG
ccaagcccaagctgaactga

SEQ ID NO: 31325 - DNA, 20 bp, Artificial Sequence
  Description of Artificial Sequence: Synthetic oligonucleotide
  Target: SCN10A; (+) strand; PAM type: NRG; PAM sequence: TGG
ctgaactgagggccacgacg

SEQ ID NO: 31326 - DNA, 20 bp, Artificial Sequence
  Description of Artificial Sequence: Synthetic oligonucleotide
  Target: SCN10A; (+) strand; PAM type: NRG; PAM sequence: TGG
actgagggccacgacgtggc

SEQ ID NO: 31327 - DNA, 20 bp, Artificial Sequence
  Description of Artificial Sequence: Synthetic oligonucleotide
  Target: SCN10A; (+) strand; PAM type: NRG; PAM sequence: GGG
ctgagggccacgacgtggct

SEQ ID NO: 31328 - DNA, 20 bp, Artificial Sequence
  Description of Artificial Sequence: Synthetic oligonucleotide
  Target: SCN10A; (+) strand; PAM type: NRG; PAM sequence: TGG
gggccacgacgtggctggga

SEQ ID NO: 31329 - DNA, 20 bp, Artificial Sequence
  Description of Artificial Sequence: Synthetic oligonucleotide
  Target: SCN10A; (+) strand; PAM type: NRG; PAM sequence: GGG
ggccacgacgtggctgggat

SEQ ID NO: 31330 - DNA, 20 bp, Artificial Sequence
  Description of Artificial Sequence: Synthetic oligonucleotide
  Target: SCN10A; (+) strand; PAM type: NRG; PAM sequence: GGG
gccacgacgtggctgggatg

SEQ ID NO: 31331 - DNA, 20 bp, Artificial Sequence
  Description of Artificial Sequence: Synthetic oligonucleotide
  Target: SCN10A; (+) strand; PAM type: NRG; PAM sequence: TGG
gacgtggctgggatggggat

SEQ ID NO: 31332 - DNA, 20 bp, Artificial Sequence
  Description of Artificial Sequence: Synthetic oligonucleotide
  Target: SCN10A; (+) strand; PAM type: NRG; PAM sequence: GGG
acgtggctgggatggggatt

SEQ ID NO: 31333 - DNA, 20 bp, Artificial Sequence
  Description of Artificial Sequence: Synthetic oligonucleotide
  Target: SCN10A; (+) strand; PAM type: NRG; PAM sequence: CAG
gctgggatggggattgggtc

SEQ ID NO: 31334 - DNA, 20 bp, Artificial Sequence
  Description of Artificial Sequence: Synthetic oligonucleotide
  Target: SCN10A; (+) strand; PAM type: NRG; PAM sequence: CAG
gatggggattgggtccagcc

SEQ ID NO: 31335 - DNA, 20 bp, Artificial Sequence
  Description of Artificial Sequence: Synthetic oligonucleotide
  Target: SCN10A; (+) strand; PAM type: NRG; PAM sequence: CAG
ggattgggtccagcccagct

SEQ ID NO: 31336 - DNA, 20 bp, Artificial Sequence
  Description of Artificial Sequence: Synthetic oligonucleotide
  Target: SCN10A; (+) strand; PAM type: NRG; PAM sequence: CAG
gggtccagcccagctcagcc

SEQ ID NO: 31337 - DNA, 20 bp, Artificial Sequence
  Description of Artificial Sequence: Synthetic oligonucleotide
  Target: SCN10A; (+) strand; PAM type: NRG; PAM sequence: CAG
cagcccagctcagcccagcc

SEQ ID NO: 31338 - DNA, 20 bp, Artificial Sequence
  Description of Artificial Sequence: Synthetic oligonucleotide
  Target: SCN10A; (+) strand; PAM type: NRG; PAM sequence: AGG
agcccagctcagcccagccc

SEQ ID NO: 31339 - DNA, 20 bp, Artificial Sequence
  Description of Artificial Sequence: Synthetic oligonucleotide
  Target: SCN10A; (+) strand; PAM type: NRG; PAM sequence: GGG
gcccagctcagcccagccca

SEQ ID NO: 31340 - DNA, 20 bp, Artificial Sequence
  Description of Artificial Sequence: Synthetic oligonucleotide
  Target: SCN10A; (+) strand; PAM type: NRG; PAM sequence: AAG
aaaactattaataaaaactc

SEQ ID NO: 31341 - DNA, 20 bp, Artificial Sequence
  Description of Artificial Sequence: Synthetic oligonucleotide
  Target: SCN10A; (+) strand; PAM type: NRG; PAM sequence: TAG
aaaatttttctttgtatttt

SEQ ID NO: 31342 - DNA, 20 bp, Artificial Sequence
  Description of Artificial Sequence: Synthetic oligonucleotide
  Target: SCN10A; (+) strand; PAM type: NRG; PAM sequence: AAG
tttttctttgtatttttaga

SEQ ID NO: 31343 - DNA, 20 bp, Artificial Sequence
  Description of Artificial Sequence: Synthetic oligonucleotide
  Target: SCN10A; (+) strand; PAM type: NRG; PAM sequence: GAG
ttgtatttttagaaagcatt

SEQ ID NO: 31344 - DNA, 20 bp, Artificial Sequence
  Description of Artificial Sequence: Synthetic oligonucleotide
  Target: SCN10A; (+) strand; PAM type: NRG; PAM sequence: AGG
tgtatttttagaaagcattg

SEQ ID NO: 31345 - DNA, 20 bp, Artificial Sequence
  Description of Artificial Sequence: Synthetic oligonucleotide
  Target: SCN10A; (+) strand; PAM type: NRG; PAM sequence: TAG
tgaggccacaattcccttta

SEQ ID NO: 31346 - DNA, 20 bp, Artificial Sequence
  Description of Artificial Sequence: Synthetic oligonucleotide
  Target: SCN10A; (+) strand; PAM type: NRG; PAM sequence: TGG
ccacaattccctttatagaa

SEQ ID NO: 31347 - DNA, 20 bp, Artificial Sequence
  Description of Artificial Sequence: Synthetic oligonucleotide
  Target: SCN10A; (+) strand; PAM type: NRG; PAM sequence: GAG
tcattgcacaaatatttatt

SEQ ID NO: 31348 - DNA, 20 bp, Artificial Sequence
  Description of Artificial Sequence: Synthetic oligonucleotide
  Target: SCN10A; (+) strand; PAM type: NRG; PAM sequence: GAG
gcctcactgttctaaacact

SEQ ID NO: 31349 - DNA, 20 bp, Artificial Sequence
  Description of Artificial Sequence: Synthetic oligonucleotide
  Target: SCN10A; (+) strand; PAM type: NRG; PAM sequence: GAG
ctcactgttctaaacactga

SEQ ID NO: 31350 - DNA, 20 bp, Artificial Sequence
  Description of Artificial Sequence: Synthetic oligonucleotide
  Target: SCN10A; (+) strand; PAM type: NRG; PAM sequence: AGG
tcactgttctaaacactgag

SEQ ID NO: 31351 - DNA, 20 bp, Artificial Sequence
  Description of Artificial Sequence: Synthetic oligonucleotide
  Target: SCN10A; (+) strand; PAM type: NRG; PAM sequence: AAG
tgttctaaacactgagagga

SEQ ID NO: 31352 - DNA, 20 bp, Artificial Sequence
  Description of Artificial Sequence: Synthetic oligonucleotide
  Target: SCN10A; (+) strand; PAM type: NRG; PAM sequence: AAG
cactgagaggaaagatgact

SEQ ID NO: 31353 - DNA, 20 bp, Artificial Sequence
  Description of Artificial Sequence: Synthetic oligonucleotide
  Target: SCN10A; (+) strand; PAM type: NRG; PAM sequence: CAG
gaggaaagatgactaagaca

SEQ ID NO: 31354 - DNA, 20 bp, Artificial Sequence
  Description of Artificial Sequence: Synthetic oligonucleotide
  Target: SCN10A; (+) strand; PAM type: NRG; PAM sequence: AGG
aggaaagatgactaagacac

SEQ ID NO: 31355 - DNA, 20 bp, Artificial Sequence
  Description of Artificial Sequence: Synthetic oligonucleotide
  Target: SCN10A; (+) strand; PAM type: NRG; PAM sequence: GAG
aagacacaggttctgctttt

SEQ ID NO: 31356 - DNA, 20 bp, Artificial Sequence
  Description of Artificial Sequence: Synthetic oligonucleotide
  Target: SCN10A; (+) strand; PAM type: NRG; PAM sequence: GAG
gacacaggttctgcttttga

SEQ ID NO: 31357 - DNA, 20 bp, Artificial Sequence
  Description of Artificial Sequence: Synthetic oligonucleotide
  Target: SCN10A; (+) strand; PAM type: NRG; PAM sequence: AAG
tgcttttgagagctaaacaa

SEQ ID NO: 31358 - DNA, 20 bp, Artificial Sequence
  Description of Artificial Sequence: Synthetic oligonucleotide
  Target: SCN10A; (+) strand; PAM type: NRG; PAM sequence: GAG
tgagagctaaacaaaagatt

SEQ ID NO: 31359 - DNA, 20 bp, Artificial Sequence
  Description of Artificial Sequence: Synthetic oligonucleotide
  Target: SCN10A; (+) strand; PAM type: NRG; PAM sequence: AGG
gagagctaaacaaaagattg

SEQ ID NO: 31360 - DNA, 20 bp, Artificial Sequence
  Description of Artificial Sequence: Synthetic oligonucleotide
  Target: SCN10A; (+) strand; PAM type: NRG; PAM sequence: GGG
agagctaaacaaaagattga

SEQ ID NO: 31361 - DNA, 20 bp, Artificial Sequence
  Description of Artificial Sequence: Synthetic oligonucleotide
  Target: SCN10A; (+) strand; PAM type: NRG; PAM sequence: AAG
gctaaacaaaagattgaggg

SEQ ID NO: 31362 - DNA, 20 bp, Artificial Sequence
  Description of Artificial Sequence: Synthetic oligonucleotide
  Target: SCN10A; (+) strand; PAM type: NRG; PAM sequence: CAG
aaacaaaagattgagggaag

SEQ ID NO: 31363 - DNA, 20 bp, Artificial Sequence
  Description of Artificial Sequence: Synthetic oligonucleotide
  Target: SCN10A; (+) strand; PAM type: NRG; PAM sequence: TGG
tgagggaagcagatacatca

SEQ ID NO: 31364 - DNA, 20 bp, Artificial Sequence
  Description of Artificial Sequence: Synthetic oligonucleotide
  Target: SCN10A; (+) strand; PAM type: NRG; PAM sequence: TGG
gatacatcatggccttcctc

SEQ ID NO: 31365 - DNA, 20 bp, Artificial Sequence
  Description of Artificial Sequence: Synthetic oligonucleotide
  Target: SCN10A; (+) strand; PAM type: NRG; PAM sequence: GGG
atacatcatggccttcctct

SEQ ID NO: 31366 - DNA, 20 bp, Artificial Sequence
  Description of Artificial Sequence: Synthetic oligonucleotide
  Target: SCN10A; (+) strand; PAM type: NRG; PAM sequence: TGG
gccttcctctgggtccttca

SEQ ID NO: 31367 - DNA, 20 bp, Artificial Sequence
  Description of Artificial Sequence: Synthetic oligonucleotide
  Target: SCN10A; (+) strand; PAM type: NRG; PAM sequence: AAG
ggtccttcatggtccaaatc

SEQ ID NO: 31368 - DNA, 20 bp, Artificial Sequence
  Description of Artificial Sequence: Synthetic oligonucleotide
  Target: SCN10A; (+) strand; PAM type: NRG; PAM sequence: GAG
tccttcatggtccaaatcaa

SEQ ID NO: 31369 - DNA, 20 bp, Artificial Sequence
  Description of Artificial Sequence: Synthetic oligonucleotide
  Target: SCN10A; (+) strand; PAM type: NRG; PAM sequence: CAG
tggtccaaatcaagagtttt

SEQ ID NO: 31370 - DNA, 20 bp, Artificial Sequence
  Description of Artificial Sequence: Synthetic oligonucleotide
  Target: SCN10A; (+) strand; PAM type: NRG; PAM sequence: TGG
tccaaatcaagagttttcag

SEQ ID NO: 31371 - DNA, 20 bp, Artificial Sequence
  Description of Artificial Sequence: Synthetic oligonucleotide
  Target: SCN10A; (+) strand; PAM type: NRG; PAM sequence: TGG
agagttttcagtggtgttta

SEQ ID NO: 31372 - DNA, 20 bp, Artificial Sequence
  Description of Artificial Sequence: Synthetic oligonucleotide
  Target: SCN10A; (+) strand; PAM type: NRG; PAM sequence: TGG
gttttcagtggtgtttatgg

SEQ ID NO: 31373 - DNA, 20 bp, Artificial Sequence
  Description of Artificial Sequence: Synthetic oligonucleotide
  Target: SCN10A; (+) strand; PAM type: NRG; PAM sequence: AAG
acgtttccccctttcaactc

SEQ ID NO: 31374 - DNA, 20 bp, Artificial Sequence
  Description of Artificial Sequence: Synthetic oligonucleotide
  Target: SCN10A; (+) strand; PAM type: NRG; PAM sequence: GAG
gtttccccctttcaactcaa

SEQ ID NO: 31375 - DNA, 20 bp, Artificial Sequence
  Description of Artificial Sequence: Synthetic oligonucleotide
  Target: SCN10A; (+) strand; PAM type: NRG; PAM sequence: AGG
tttccccctttcaactcaag

SEQ ID NO: 31376 - DNA, 20 bp, Artificial Sequence
  Description of Artificial Sequence: Synthetic oligonucleotide
  Target: SCN10A; (+) strand; PAM type: NRG; PAM sequence: GGG
ttccccctttcaactcaaga

SEQ ID NO: 31377 - DNA, 20 bp, Artificial Sequence
  Description of Artificial Sequence: Synthetic oligonucleotide
  Target: SCN10A; (+) strand; PAM type: NRG; PAM sequence: TGG
ccctttcaactcaagagggc

SEQ ID NO: 31378 - DNA, 20 bp, Artificial Sequence
  Description of Artificial Sequence: Synthetic oligonucleotide
  Target: SCN10A; (+) strand; PAM type: NRG; PAM sequence: TAG
tcaactcaagagggctggtt

SEQ ID NO: 31379 - DNA, 20 bp, Artificial Sequence
  Description of Artificial Sequence: Synthetic oligonucleotide
  Target: SCN10A; (+) strand; PAM type: NRG; PAM sequence: CGG
gagggctggtttagaactca

SEQ ID NO: 31380 - DNA, 20 bp, Artificial Sequence
  Description of Artificial Sequence: Synthetic oligonucleotide
  Target: SCN10A; (+) strand; PAM type: NRG; PAM sequence: GAG
gggctggtttagaactcacg

SEQ ID NO: 31381 - DNA, 20 bp, Artificial Sequence
  Description of Artificial Sequence: Synthetic oligonucleotide
  Target: SCN10A; (+) strand; PAM type: NRG; PAM sequence: AGG
ggctggtttagaactcacgg

SEQ ID NO: 31382 - DNA, 20 bp, Artificial Sequence
  Description of Artificial Sequence: Synthetic oligonucleotide
  Target: SCN10A; (+) strand; PAM type: NRG; PAM sequence: GGG
gctggtttagaactcacgga

SEQ ID NO: 31383 - DNA, 20 bp, Artificial Sequence
  Description of Artificial Sequence: Synthetic oligonucleotide
  Target: SCN10A; (+) strand; PAM type: NRG; PAM sequence: GGG
ctggtttagaactcacggag

SEQ ID NO: 31384 - DNA, 20 bp, Artificial Sequence
  Description of Artificial Sequence: Synthetic oligonucleotide
  Target: SCN10A; (+) strand; PAM type: NRG; PAM sequence: GAG
gaactcacggaggggttttt

SEQ ID NO: 31385 - DNA, 20 bp, Artificial Sequence
  Description of Artificial Sequence: Synthetic oligonucleotide
  Target: SCN10A; (+) strand; PAM type: NRG; PAM sequence: AGG
aactcacggaggggtttttg

SEQ ID NO: 31386 - DNA, 20 bp, Artificial Sequence
  Description of Artificial Sequence: Synthetic oligonucleotide
  Target: SCN10A; (+) strand; PAM type: NRG; PAM sequence: GGG
actcacggaggggtttttga

SEQ ID NO: 31387 - DNA, 20 bp, Artificial Sequence
  Description of Artificial Sequence: Synthetic oligonucleotide
  Target: SCN10A; (+) strand; PAM type: NRG; PAM sequence: AAG
cggaggggtttttgagggta

SEQ ID NO: 31388 - DNA, 20 bp, Artificial Sequence
  Description of Artificial Sequence: Synthetic oligonucleotide
  Target: SCN10A; (+) strand; PAM type: NRG; PAM sequence: GAG
gaggggtttttgagggtaaa

SEQ ID NO: 31389 - DNA, 20 bp, Artificial Sequence
  Description of Artificial Sequence: Synthetic oligonucleotide
  Target: SCN10A; (+) strand; PAM type: NRG; PAM sequence: AGG
aggggtttttgagggtaaag

SEQ ID NO: 31390 - DNA, 20 bp, Artificial Sequence
  Description of Artificial Sequence: Synthetic oligonucleotide
  Target: SCN10A; (+) strand; PAM type: NRG; PAM sequence: AAG
ggtttttgagggtaaagagg

SEQ ID NO: 31391 - DNA, 20 bp, Artificial Sequence
  Description of Artificial Sequence: Synthetic oligonucleotide
  Target: SCN10A; (+) strand; PAM type: NRG; PAM sequence: AGG
gtttttgagggtaaagagga

SEQ ID NO: 31392 - DNA, 20 bp, Artificial Sequence
  Description of Artificial Sequence: Synthetic oligonucleotide
  Target: SCN10A; (+) strand; PAM type: NRG; PAM sequence: TAG
ggaaggcccacgtctctccg

SEQ ID NO: 31393 - DNA, 20 bp, Artificial Sequence
  Description of Artificial Sequence: Synthetic oligonucleotide
  Target: SCN10A; (+) strand; PAM type: NRG; PAM sequence: TAG
cgtctctccgtagtgtctga

SEQ ID NO: 31394 - DNA, 20 bp, Artificial Sequence
  Description of Artificial Sequence: Synthetic oligonucleotide
  Target: SCN10A; (+) strand; PAM type: NRG; PAM sequence: AGG
gtctctccgtagtgtctgat

SEQ ID NO: 31395 - DNA, 20 bp, Artificial Sequence
  Description of Artificial Sequence: Synthetic oligonucleotide
  Target: SCN10A; (+) strand; PAM type: NRG; PAM sequence: GGG
tctctccgtagtgtctgata

SEQ ID NO: 31396 - DNA, 20 bp, Artificial Sequence
  Description of Artificial Sequence: Synthetic oligonucleotide
  Target: SCN10A; (+) strand; PAM type: NRG; PAM sequence: GAG
cgtagtgtctgatagggcat

SEQ ID NO: 31397 - DNA, 20 bp, Artificial Sequence
  Description of Artificial Sequence: Synthetic oligonucleotide
  Target: SCN10A; (+) strand; PAM type: NRG; PAM sequence: CAG
gtctgatagggcatgagatg

SEQ ID NO: 31398 - DNA, 20 bp, Artificial Sequence
  Description of Artificial Sequence: Synthetic oligonucleotide
  Target: SCN10A; (+) strand; PAM type: NRG; PAM sequence: CGG
ggcatgagatgcagatacca

SEQ ID NO: 31399 - DNA, 20 bp, Artificial Sequence
  Description of Artificial Sequence: Synthetic oligonucleotide
  Target: SCN10A; (+) strand; PAM type: NRG; PAM sequence: CAG
tgagatgcagataccacggc

SEQ ID NO: 31400 - DNA, 20 bp, Artificial Sequence
  Description of Artificial Sequence: Synthetic oligonucleotide
  Target: SCN10A; (+) strand; PAM type: NRG; PAM sequence: AGG
gagatgcagataccacggcc

SEQ ID NO: 31401 - DNA, 20 bp, Artificial Sequence
  Description of Artificial Sequence: Synthetic oligonucleotide
  Target: SCN10A; (+) strand; PAM type: NRG; PAM sequence: TGG
acggccaggctgctgccacc

SEQ ID NO: 31402 - DNA, 20 bp, Artificial Sequence
  Description of Artificial Sequence: Synthetic oligonucleotide
  Target: SCN10A; (+) strand; PAM type: NRG; PAM sequence: GGG
cggccaggctgctgccacct

SEQ ID NO: 31403 - DNA, 20 bp, Artificial Sequence
  Description of Artificial Sequence: Synthetic oligonucleotide
  Target: SCN10A; (+) strand; PAM type: NRG; PAM sequence: GGG
ggccaggctgctgccacctg

SEQ ID NO: 31404 - DNA, 20 bp, Artificial Sequence
  Description of Artificial Sequence: Synthetic oligonucleotide
  Target: SCN10A; (+) strand; PAM type: NRG; PAM sequence: CGG
tggggcatgtgtgtctgatg

SEQ ID NO: 31405 - DNA, 20 bp, Artificial Sequence
  Description of Artificial Sequence: Synthetic oligonucleotide
  Target: SCN10A; (+) strand; PAM type: NRG; PAM sequence: GGG
ggggcatgtgtgtctgatgc

SEQ ID NO: 31406 - DNA, 20 bp, Artificial Sequence
  Description of Artificial Sequence: Synthetic oligonucleotide
  Target: SCN10A; (+) strand; PAM type: NRG; PAM sequence: AAG
tgtctgatgcgggcgccctc

SEQ ID NO: 31407 - DNA, 20 bp, Artificial Sequence
  Description of Artificial Sequence: Synthetic oligonucleotide
  Target: SCN10A; (+) strand; PAM type: NRG; PAM sequence: TGG
gatgcgggcgccctcaagcc

SEQ ID NO: 31408 - DNA, 20 bp, Artificial Sequence
  Description of Artificial Sequence: Synthetic oligonucleotide
  Target: SCN10A; (+) strand; PAM type: NRG; PAM sequence: GGG
atgcgggcgccctcaagcct

SEQ ID NO: 31409 - DNA, 20 bp, Artificial Sequence
  Description of Artificial Sequence: Synthetic oligonucleotide
  Target: SCN10A; (+) strand; PAM type: NRG; PAM sequence: GAG
gcgggcgccctcaagcctgg

SEQ ID NO: 31410 - DNA, 20 bp, Artificial Sequence
  Description of Artificial Sequence: Synthetic oligonucleotide
  Target: SCN10A; (+) strand; PAM type: NRG; PAM sequence: GAG
gcgccctcaagcctgggagt

SEQ ID NO: 31411 - DNA, 20 bp, Artificial Sequence
  Description of Artificial Sequence: Synthetic oligonucleotide
  Target: SCN10A; (+) strand; PAM type: NRG; PAM sequence: AGG
cgccctcaagcctgggagtg

SEQ ID NO: 31412 - DNA, 20 bp, Artificial Sequence
  Description of Artificial Sequence: Synthetic oligonucleotide
  Target: SCN10A; (+) strand; PAM type: NRG; PAM sequence: CAG
cctcaagcctgggagtgagg

SEQ ID NO: 31413 - DNA, 20 bp, Artificial Sequence
  Description of Artificial Sequence: Synthetic oligonucleotide
  Target: SCN10A; (+) strand; PAM type: NRG; PAM sequence: AAG
aagcctgggagtgaggcagc

SEQ ID NO: 31414 - DNA, 20 bp, Artificial Sequence
  Description of Artificial Sequence: Synthetic oligonucleotide
  Target: SCN10A; (+) strand; PAM type: NRG; PAM sequence: TGG
cctgggagtgaggcagcaag

SEQ ID NO: 31415 - DNA, 20 bp, Artificial Sequence
  Description of Artificial Sequence: Synthetic oligonucleotide
  Target: SCN10A; (+) strand; PAM type: NRG; PAM sequence: GGG
ctgggagtgaggcagcaagt

SEQ ID NO: 31416 - DNA, 20 bp, Artificial Sequence
  Description of Artificial Sequence: Synthetic oligonucleotide
  Target: SCN10A; (+) strand; PAM type: NRG; PAM sequence: CAG
agtgaggcagcaagtgggca

SEQ ID NO: 31417 - DNA, 20 bp, Artificial Sequence
  Description of Artificial Sequence: Synthetic oligonucleotide
  Target: SCN10A; (+) strand; PAM type: NRG; PAM sequence: TGG
cacagcttgtttgtcttctg

SEQ ID NO: 31418 - DNA, 20 bp, Artificial Sequence
  Description of Artificial Sequence: Synthetic oligonucleotide
  Target: SCN10A; (+) strand; PAM type: NRG; PAM sequence: CAG
tgtttgtcttctgtggatcc

SEQ ID NO: 31419 - DNA, 20 bp, Artificial Sequence
  Description of Artificial Sequence: Synthetic oligonucleotide
  Target: SCN10A; (+) strand; PAM type: NRG; PAM sequence: AGG
gtttgtcttctgtggatccc

SEQ ID NO: 31420 - DNA, 20 bp, Artificial Sequence
  Description of Artificial Sequence: Synthetic oligonucleotide
  Target: SCN10A; (+) strand; PAM type: NRG; PAM sequence: GAG
gtcttctgtggatcccaggt

SEQ ID NO: 31421 - DNA, 20 bp, Artificial Sequence
  Description of Artificial Sequence: Synthetic oligonucleotide
  Target: SCN10A; (+) strand; PAM type: NRG; PAM sequence: TGG
caggtgagtgttcgctcaac

SEQ ID NO: 31422 - DNA, 20 bp, Artificial Sequence
  Description of Artificial Sequence: Synthetic oligonucleotide
  Target: SCN10A; (+) strand; PAM type: NRG; PAM sequence: TGG
gtgttcgctcaactggattc

SEQ ID NO: 31423 - DNA, 20 bp, Artificial Sequence
  Description of Artificial Sequence: Synthetic oligonucleotide
  Target: SCN10A; (+) strand; PAM type: NRG; PAM sequence: CAG
attctggccctaattaacat

SEQ ID NO: 31424 - DNA, 20 bp, Artificial Sequence
  Description of Artificial Sequence: Synthetic oligonucleotide
  Target: SCN10A; (+) strand; PAM type: NRG; PAM sequence: GAG
gccctaattaacatcagtgt

SEQ ID NO: 31425 - DNA, 20 bp, Artificial Sequence
  Description of Artificial Sequence: Synthetic oligonucleotide
  Target: SCN10A; (+) strand; PAM type: NRG; PAM sequence: AGG
ccctaattaacatcagtgtg

SEQ ID NO: 31426 - DNA, 20 bp, Artificial Sequence
  Description of Artificial Sequence: Synthetic oligonucleotide
  Target: SCN10A; (+) strand; PAM type: NRG; PAM sequence: GGG
cctaattaacatcagtgtga

SEQ ID NO: 31427 - DNA, 20 bp, Artificial Sequence
  Description of Artificial Sequence: Synthetic oligonucleotide
  Target: SCN10A; (+) strand; PAM type: NRG; PAM sequence: GGG
ctaattaacatcagtgtgag

SEQ ID NO: 31428 - DNA, 20 bp, Artificial Sequence
  Description of Artificial Sequence: Synthetic oligonucleotide
  Target: SCN10A; (+) strand; PAM type: NRG; PAM sequence: GGG
taattaacatcagtgtgagg

SEQ ID NO: 31429 - DNA, 20 bp, Artificial Sequence
  Description of Artificial Sequence: Synthetic oligonucleotide
  Target: SCN10A; (+) strand; PAM type: NRG; PAM sequence: TGG
catcagtgtgagggggcctg

SEQ ID NO: 31430 - DNA, 20 bp, Artificial Sequence
  Description of Artificial Sequence: Synthetic oligonucleotide
  Target: SCN10A; (+) strand; PAM type: NRG; PAM sequence: AAG
ctgtcccttcaccttctgtg

SEQ ID NO: 31431 - DNA, 20 bp, Artificial Sequence
  Description of Artificial Sequence: Synthetic oligonucleotide
  Target: SCN10A; (+) strand; PAM type: NRG; PAM sequence: CAG
tcccttcaccttctgtgaag

SEQ ID NO: 31432 - DNA, 20 bp, Artificial Sequence
  Description of Artificial Sequence: Synthetic oligonucleotide
  Target: SCN10A; (+) strand; PAM type: NRG; PAM sequence: TGG
ccttctgtgaagcagtcatc

SEQ ID NO: 31433 - DNA, 20 bp, Artificial Sequence
  Description of Artificial Sequence: Synthetic oligonucleotide
  Target: SCN10A; (+) strand; PAM type: NRG; PAM sequence: CAG
aagcagtcatctggttcttc

SEQ ID NO: 31434 - DNA, 20 bp, Artificial Sequence
  Description of Artificial Sequence: Synthetic oligonucleotide
  Target: SCN10A; (+) strand; PAM type: NRG; PAM sequence: AGG
agcagtcatctggttcttcc

SEQ ID NO: 31435 - DNA, 20 bp, Artificial Sequence
  Description of Artificial Sequence: Synthetic oligonucleotide
  Target: SCN10A; (+) strand; PAM type: NRG; PAM sequence: CAG
ggttcttccaggtcatctgc

SEQ ID NO: 31436 - DNA, 20 bp, Artificial Sequence
  Description of Artificial Sequence: Synthetic oligonucleotide
  Target: SCN10A; (+) strand; PAM type: NRG; PAM sequence: CAG
ttccaggtcatctgccagct

SEQ ID NO: 31437 - DNA, 20 bp, Artificial Sequence
  Description of Artificial Sequence: Synthetic oligonucleotide
  Target: SCN10A; (+) strand; PAM type: NRG; PAM sequence: AGG
tccaggtcatctgccagctc

SEQ ID NO: 31438 - DNA, 20 bp, Artificial Sequence
  Description of Artificial Sequence: Synthetic oligonucleotide
  Target: SCN10A; (+) strand; PAM type: NRG; PAM sequence: GGG
ccaggtcatctgccagctca

SEQ ID NO: 31439 - DNA, 20 bp, Artificial Sequence
  Description of Artificial Sequence: Synthetic oligonucleotide
  Target: SCN10A; (+) strand; PAM type: NRG; PAM sequence: CAG
gccagctcagggatcttcct

SEQ ID NO: 31440 - DNA, 20 bp, Artificial Sequence
  Description of Artificial Sequence: Synthetic oligonucleotide
  Target: SCN10A; (+) strand; PAM type: NRG; PAM sequence: AGG
ccagctcagggatcttcctc

SEQ ID NO: 31441 - DNA, 20 bp, Artificial Sequence
  Description of Artificial Sequence: Synthetic oligonucleotide
  Target: SCN10A; (+) strand; PAM type: NRG; PAM sequence: CAG
gatcttcctcaggatttcct

SEQ ID NO: 31442 - DNA, 20 bp, Artificial Sequence
  Description of Artificial Sequence: Synthetic oligonucleotide
  Target: SCN10A; (+) strand; PAM type: NRG; PAM sequence: AGG
atcttcctcaggatttcctc

SEQ ID NO: 31443 - DNA, 20 bp, Artificial Sequence
  Description of Artificial Sequence: Synthetic oligonucleotide
  Target: SCN10A; (+) strand; PAM type: NRG; PAM sequence: TAG
ctcaggatttcctcaggatc

SEQ ID NO: 31444 - DNA, 20 bp, Artificial Sequence
  Description of Artificial Sequence: Synthetic oligonucleotide
  Target: SCN10A; (+) strand; PAM type: NRG; PAM sequence: AGG
tcaggatttcctcaggatct

SEQ ID NO: 31445 - DNA, 20 bp, Artificial Sequence
  Description of Artificial Sequence: Synthetic oligonucleotide
  Target: SCN10A; (+) strand; PAM type: NRG; PAM sequence: CAG
ggatttcctcaggatctagg

SEQ ID NO: 31446 - DNA, 20 bp, Artificial Sequence
  Description of Artificial Sequence: Synthetic oligonucleotide
  Target: SCN10A; (+) strand; PAM type: NRG; PAM sequence: CAG
gcagtccaccgtgctgccct

SEQ ID NO: 31447 - DNA, 20 bp, Artificial Sequence
  Description of Artificial Sequence: Synthetic oligonucleotide
  Target: SCN10A; (+) strand; PAM type: NRG; PAM sequence: GAG
agtccaccgtgctgccctca

SEQ ID NO: 31448 - DNA, 20 bp, Artificial Sequence
  Description of Artificial Sequence: Synthetic oligonucleotide
  Target: SCN10A; (+) strand; PAM type: NRG; PAM sequence: AGG
gtccaccgtgctgccctcag

SEQ ID NO: 31449 - DNA, 20 bp, Artificial Sequence
  Description of Artificial Sequence: Synthetic oligonucleotide
  Target: SCN10A; (+) strand; PAM type: NRG; PAM sequence: GAG
ccaccgtgctgccctcagag

SEQ ID NO: 31450 - DNA, 20 bp, Artificial Sequence
  Description of Artificial Sequence: Synthetic oligonucleotide
  Target: SCN10A; (+) strand; PAM type: NRG; PAM sequence: CAG
cttgtgtcgtccactccctg

SEQ ID NO: 31451 - DNA, 20 bp, Artificial Sequence
  Description of Artificial Sequence: Synthetic oligonucleotide
  Target: SCN10A; (+) strand; PAM type: NRG; PAM sequence: AGG
ttgtgtcgtccactccctgc

SEQ ID NO: 31452 - DNA, 20 bp, Artificial Sequence
  Description of Artificial Sequence: Synthetic oligonucleotide
  Target: SCN10A; (+) strand; PAM type: NRG; PAM sequence: GGG
tgtgtcgtccactccctgca

SEQ ID NO: 31453 - DNA, 20 bp, Artificial Sequence
  Description of Artificial Sequence: Synthetic oligonucleotide
  Target: SCN10A; (+) strand; PAM type: NRG; PAM sequence: GGG
gtgtcgtccactccctgcag

SEQ ID NO: 31454 - DNA, 20 bp, Artificial Sequence
  Description of Artificial Sequence: Synthetic oligonucleotide
  Target: SCN10A; (+) strand; PAM type: NRG; PAM sequence: GAG
gtcgtccactccctgcaggg

SEQ ID NO: 31455 - DNA, 20 bp, Artificial Sequence
  Description of Artificial Sequence: Synthetic oligonucleotide
  Target: SCN10A; (+) strand; PAM type: NRG; PAM sequence: AAG
gtccactccctgcaggggag

SEQ ID NO: 31456 - DNA, 20 bp, Artificial Sequence
  Description of Artificial Sequence: Synthetic oligonucleotide
  Target: SCN10A; (+) strand; PAM type: NRG; PAM sequence: CAG
ctccctgcaggggagaagcc

SEQ ID NO: 31457 - DNA, 20 bp, Artificial Sequence
  Description of Artificial Sequence: Synthetic oligonucleotide
  Target: SCN10A; (+) strand; PAM type: NRG; PAM sequence: AGG
tccctgcaggggagaagccc

SEQ ID NO: 31458 - DNA, 20 bp, Artificial Sequence
  Description of Artificial Sequence: Synthetic oligonucleotide
  Target: SCN10A; (+) strand; PAM type: NRG; PAM sequence: GGG
ccctgcaggggagaagccca

SEQ ID NO: 31459 - DNA, 20 bp, Artificial Sequence
  Description of Artificial Sequence: Synthetic oligonucleotide
  Target: SCN10A; (+) strand; PAM type: NRG; PAM sequence: CAG
tgcaggggagaagcccaggg

SEQ ID NO: 31460 - DNA, 20 bp, Artificial Sequence
  Description of Artificial Sequence: Synthetic oligonucleotide
  Target: SCN10A; (+) strand; PAM type: NRG; PAM sequence: CGG
gcagtgaactcgtctctccg

SEQ ID NO: 31461 - DNA, 20 bp, Artificial Sequence
  Description of Artificial Sequence: Synthetic oligonucleotide
  Target: SCN10A; (+) strand; PAM type: NRG; PAM sequence: GGG
cagtgaactcgtctctccgc

SEQ ID NO: 31462 - DNA, 20 bp, Artificial Sequence
  Description of Artificial Sequence: Synthetic oligonucleotide
  Target: SCN10A; (+) strand; PAM type: NRG; PAM sequence: GGG
agtgaactcgtctctccgcg

SEQ ID NO: 31463 - DNA, 20 bp, Artificial Sequence
  Description of Artificial Sequence: Synthetic oligonucleotide
  Target: SCN10A; (+) strand; PAM type: NRG; PAM sequence: CGG
actcgtctctccgcggggcc

SEQ ID NO: 31464 - DNA, 20 bp, Artificial Sequence
  Description of Artificial Sequence: Synthetic oligonucleotide
  Target: SCN10A; (+) strand; PAM type: NRG; PAM sequence: GGG
ctcgtctctccgcggggccc

SEQ ID NO: 31465 - DNA, 20 bp, Artificial Sequence
  Description of Artificial Sequence: Synthetic oligonucleotide
  Target: SCN10A; (+) strand; PAM type: NRG; PAM sequence: GGG
tcgtctctccgcggggcccg

SEQ ID NO: 31466 - DNA, 20 bp, Artificial Sequence
  Description of Artificial Sequence: Synthetic oligonucleotide
  Target: SCN10A; (+) strand; PAM type: NRG; PAM sequence: CGG
ggggcccggggaattgcaca

SEQ ID NO: 31467 - DNA, 20 bp, Artificial Sequence
  Description of Artificial Sequence: Synthetic oligonucleotide
  Target: SCN10A; (+) strand; PAM type: NRG; PAM sequence: CAG
ggaattgcacacggtcactg

SEQ ID NO: 31468 - DNA, 20 bp, Artificial Sequence
  Description of Artificial Sequence: Synthetic oligonucleotide
  Target: SCN10A; (+) strand; PAM type: NRG; PAM sequence: AGG
gaattgcacacggtcactgc

SEQ ID NO: 31469 - DNA, 20 bp, Artificial Sequence
  Description of Artificial Sequence: Synthetic oligonucleotide
  Target: SCN10A; (+) strand; PAM type: NRG; PAM sequence: TGG
ggttcaactgcacccatgtt

SEQ ID NO: 31470 - DNA, 20 bp, Artificial Sequence
  Description of Artificial Sequence: Synthetic oligonucleotide
  Target: SCN10A; (+) strand; PAM type: NRG; PAM sequence: CAG
acccatgtttggtgcctcgc

SEQ ID NO: 31471 - DNA, 20 bp, Artificial Sequence
  Description of Artificial Sequence: Synthetic oligonucleotide
  Target: SCN10A; (+) strand; PAM type: NRG; PAM sequence: GAG
tgtttggtgcctcgccagct

SEQ ID NO: 31472 - DNA, 20 bp, Artificial Sequence
  Description of Artificial Sequence: Synthetic oligonucleotide
  Target: SCN10A; (+) strand; PAM type: NRG; PAM sequence: AGG
gtttggtgcctcgccagctg

SEQ ID NO: 31473 - DNA, 20 bp, Artificial Sequence
  Description of Artificial Sequence: Synthetic oligonucleotide
  Target: SCN10A; (+) strand; PAM type: NRG; PAM sequence: TGG
gtgcctcgccagctgaggcc

SEQ ID NO: 31474 - DNA, 20 bp, Artificial Sequence
  Description of Artificial Sequence: Synthetic oligonucleotide
  Target: SCN10A; (+) strand; PAM type: NRG; PAM sequence: TGG
tggaacactgctcttctccc

SEQ ID NO: 31475 - DNA, 20 bp, Artificial Sequence
  Description of Artificial Sequence: Synthetic oligonucleotide
  Target: SCN10A; (+) strand; PAM type: NRG; PAM sequence: GAG
gaacactgctcttctccctg

SEQ ID NO: 31476 - DNA, 20 bp, Artificial Sequence
  Description of Artificial Sequence: Synthetic oligonucleotide
  Target: SCN10A; (+) strand; PAM type: NRG; PAM sequence: CAG
tgctcttctccctggagccc

SEQ ID NO: 31477 - DNA, 20 bp, Artificial Sequence
  Description of Artificial Sequence: Synthetic oligonucleotide
  Target: SCN10A; (+) strand; PAM type: NRG; PAM sequence: GAG
ctcttctccctggagcccca

SEQ ID NO: 31478 - DNA, 20 bp, Artificial Sequence
  Description of Artificial Sequence: Synthetic oligonucleotide
  Target: SCN10A; (+) strand; PAM type: NRG; PAM sequence: AGG
tcttctccctggagccccag

SEQ ID NO: 31479 - DNA, 20 bp, Artificial Sequence
  Description of Artificial Sequence: Synthetic oligonucleotide
  Target: SCN10A; (+) strand; PAM type: NRG; PAM sequence: TAG
tccctggagccccagaggct

SEQ ID NO: 31480 - DNA, 20 bp, Artificial Sequence
  Description of Artificial Sequence: Synthetic oligonucleotide
  Target: SCN10A; (+) strand; PAM type: NRG; PAM sequence: GAG
ccccagaggcttagctgtgt

SEQ ID NO: 31481 - DNA, 20 bp, Artificial Sequence
  Description of Artificial Sequence: Synthetic oligonucleotide
  Target: SCN10A; (+) strand; PAM type: NRG; PAM sequence: CGG
tgtgtgagactgtaaacctt

SEQ ID NO: 31482 - DNA, 20 bp, Artificial Sequence
  Description of Artificial Sequence: Synthetic oligonucleotide
  Target: SCN10A; (+) strand; PAM type: NRG; PAM sequence: GGG
gtgtgagactgtaaaccttc

SEQ ID NO: 31483 - DNA, 20 bp, Artificial Sequence
  Description of Artificial Sequence: Synthetic oligonucleotide
  Target: SCN10A; (+) strand; PAM type: NRG; PAM sequence: GGG
tgtgagactgtaaaccttcg

SEQ ID NO: 31484 - DNA, 20 bp, Artificial Sequence
  Description of Artificial Sequence: Synthetic oligonucleotide
  Target: SCN10A; (+) strand; PAM type: NRG; PAM sequence: TGG
taaaccttcggggcccctga

SEQ ID NO: 31485 - DNA, 20 bp, Artificial Sequence
  Description of Artificial Sequence: Synthetic oligonucleotide
  Target: SCN10A; (+) strand; PAM type: NRG; PAM sequence: GAG
aaccttcggggcccctgatg

SEQ ID NO: 31486 - DNA, 20 bp, Artificial Sequence
  Description of Artificial Sequence: Synthetic oligonucleotide
  Target: SCN10A; (+) strand; PAM type: NRG; PAM sequence: TGG
cggggcccctgatggagtgc

SEQ ID NO: 31487 - DNA, 20 bp, Artificial Sequence
  Description of Artificial Sequence: Synthetic oligonucleotide
  Target: SCN10A; (+) strand; PAM type: NRG; PAM sequence: TGG
ccctgatggagtgctggcaa

SEQ ID NO: 31488 - DNA, 20 bp, Artificial Sequence
  Description of Artificial Sequence: Synthetic oligonucleotide
  Target: SCN10A; (+) strand; PAM type: NRG; PAM sequence: GAG
tggagtgctggcaatggccc

SEQ ID NO: 31489 - DNA, 20 bp, Artificial Sequence
  Description of Artificial Sequence: Synthetic oligonucleotide
  Target: SCN10A; (+) strand; PAM type: NRG; PAM sequence: CAG
attacacccataacgactct

SEQ ID NO: 31490 - DNA, 20 bp, Artificial Sequence
  Description of Artificial Sequence: Synthetic oligonucleotide
  Target: SCN10A; (+) strand; PAM type: NRG; PAM sequence: TGG
taacgactctcagcattcac

SEQ ID NO: 31491 - DNA, 20 bp, Artificial Sequence
  Description of Artificial Sequence: Synthetic oligonucleotide
  Target: SCN10A; (+) strand; PAM type: NRG; PAM sequence: GGG
aacgactctcagcattcact

SEQ ID NO: 31492 - DNA, 20 bp, Artificial Sequence
  Description of Artificial Sequence: Synthetic oligonucleotide
  Target: SCN10A; (+) strand; PAM type: NRG; PAM sequence: TGG
tgggcttgaatatttaatca

SEQ ID NO: 31493 - DNA, 20 bp, Artificial Sequence
  Description of Artificial Sequence: Synthetic oligonucleotide
  Target: SCN10A; (+) strand; PAM type: NRG; PAM sequence: GAG
ggcttgaatatttaatcatg

SEQ ID NO: 31494 - DNA, 20 bp, Artificial Sequence
  Description of Artificial Sequence: Synthetic oligonucleotide
  Target: SCN10A; (+) strand; PAM type: NRG; PAM sequence: CAG
ttaatcatggagtaatgctg

SEQ ID NO: 31495 - DNA, 20 bp, Artificial Sequence
  Description of Artificial Sequence: Synthetic oligonucleotide
  Target: SCN10A; (+) strand; PAM type: NRG; PAM sequence: AGG
taatcatggagtaatgctgc

SEQ ID NO: 31496 - DNA, 20 bp, Artificial Sequence
  Description of Artificial Sequence: Synthetic oligonucleotide
  Target: SCN10A; (+) strand; PAM type: NRG; PAM sequence: GGG
aatcatggagtaatgctgca

SEQ ID NO: 31497 - DNA, 20 bp, Artificial Sequence
  Description of Artificial Sequence: Synthetic oligonucleotide
  Target: SCN10A; (+) strand; PAM type: NRG; PAM sequence: GGG
atcatggagtaatgctgcag

SEQ ID NO: 31498 - DNA, 20 bp, Artificial Sequence
  Description of Artificial Sequence: Synthetic oligonucleotide
  Target: SCN10A; (+) strand; PAM type: NRG; PAM sequence: TGG
gcaggggcctgctgccctcc

SEQ ID NO: 31499 - DNA, 20 bp, Artificial Sequence
  Description of Artificial Sequence: Synthetic oligonucleotide
  Target: SCN10A; (+) strand; PAM type: NRG; PAM sequence: CAG
ggggcctgctgccctcctgg

SEQ ID NO: 31500 - DNA, 20 bp, Artificial Sequence
  Description of Artificial Sequence: Synthetic oligonucleotide
  Target: SCN10A; (+) strand; PAM type: NRG; PAM sequence: CAG
tgctgccctcctggcagctc

SEQ ID NO: 31501 - DNA, 20 bp, Artificial Sequence
  Description of Artificial Sequence: Synthetic oligonucleotide
  Target: SCN10A; (+) strand; PAM type: NRG; PAM sequence: CAG
ctccagccctataatgtctc

SEQ ID NO: 31502 - DNA, 20 bp, Artificial Sequence
  Description of Artificial Sequence: Synthetic oligonucleotide
  Target: SCN10A; (+) strand; PAM type: NRG; PAM sequence: TAG
tgtctccagatgaattcaat

SEQ ID NO: 31503 - DNA, 20 bp, Artificial Sequence
  Description of Artificial Sequence: Synthetic oligonucleotide
  Target: SCN10A; (+) strand; PAM type: NRG; PAM sequence: AGG
gtctccagatgaattcaatt

SEQ ID NO: 31504 - DNA, 20 bp, Artificial Sequence
  Description of Artificial Sequence: Synthetic oligonucleotide
  Target: SCN10A; (+) strand; PAM type: NRG; PAM sequence: GGG
tctccagatgaattcaatta

SEQ ID NO: 31505 - DNA, 20 bp, Artificial Sequence
  Description of Artificial Sequence: Synthetic oligonucleotide
  Target: SCN10A; (+) strand; PAM type: NRG; PAM sequence: GGG
ctccagatgaattcaattag

SEQ ID NO: 31506 - DNA, 20 bp, Artificial Sequence
  Description of Artificial Sequence: Synthetic oligonucleotide
  Target: SCN10A; (+) strand; PAM type: NRG; PAM sequence: AAG
atgaattcaattaggggttg

SEQ ID NO: 31507 - DNA, 20 bp, Artificial Sequence
  Description of Artificial Sequence: Synthetic oligonucleotide
  Target: SCN10A; (+) strand; PAM type: NRG; PAM sequence: TAG
ggttgaagttgctctcatat

SEQ ID NO: 31508 - DNA, 20 bp, Artificial Sequence
  Description of Artificial Sequence: Synthetic oligonucleotide
  Target: SCN10A; (+) strand; PAM type: NRG; PAM sequence: TAG
tctcatattagtaaacctga

SEQ ID NO: 31509 - DNA, 20 bp, Artificial Sequence
  Description of Artificial Sequence: Synthetic oligonucleotide
  Target: SCN10A; (+) strand; PAM type: NRG; PAM sequence: TGG
aaacctgatagctttgctaa

SEQ ID NO: 31510 - DNA, 20 bp, Artificial Sequence
  Description of Artificial Sequence: Synthetic oligonucleotide
  Target: SCN10A; (+) strand; PAM type: NRG; PAM sequence: TGG
gctttgctaatggacccaaa

SEQ ID NO: 31511 - DNA, 20 bp, Artificial Sequence
  Description of Artificial Sequence: Synthetic oligonucleotide
  Target: SCN10A; (+) strand; PAM type: NRG; PAM sequence: TGG
ttgctaatggacccaaatgg

SEQ ID NO: 31512 - DNA, 20 bp, Artificial Sequence
  Description of Artificial Sequence: Synthetic oligonucleotide
  Target: SCN10A; (+) strand; PAM type: NRG; PAM sequence: GGG
tgctaatggacccaaatggt

SEQ ID NO: 31513 - DNA, 20 bp, Artificial Sequence
  Description of Artificial Sequence: Synthetic oligonucleotide
  Target: SCN10A; (+) strand; PAM type: NRG; PAM sequence: GGG
gctaatggacccaaatggtg

SEQ ID NO: 31514 - DNA, 20 bp, Artificial Sequence
  Description of Artificial Sequence: Synthetic oligonucleotide
  Target: SCN10A; (+) strand; PAM type: NRG; PAM sequence: CGG
aatggacccaaatggtgggg

SEQ ID NO: 31515 - DNA, 20 bp, Artificial Sequence
  Description of Artificial Sequence: Synthetic oligonucleotide
  Target: SCN10A; (+) strand; PAM type: NRG; PAM sequence: GGG
atggacccaaatggtggggc

SEQ ID NO: 31516 - DNA, 20 bp, Artificial Sequence
  Description of Artificial Sequence: Synthetic oligonucleotide
  Target: SCN10A; (+) strand; PAM type: NRG; PAM sequence: CAG
gggtccccatttgtcgctgt

SEQ ID NO: 31517 - DNA, 20 bp, Artificial Sequence
  Description of Artificial Sequence: Synthetic oligonucleotide
  Target: SCN10A; (+) strand; PAM type: NRG; PAM sequence: AGG
ggtccccatttgtcgctgtc

SEQ ID NO: 31518 - DNA, 20 bp, Artificial Sequence
  Description of Artificial Sequence: Synthetic oligonucleotide
  Target: SCN10A; (+) strand; PAM type: NRG; PAM sequence: TAG
gctgtcaggcccctcctgcc

SEQ ID NO: 31519 - DNA, 20 bp, Artificial Sequence
  Description of Artificial Sequence: Synthetic oligonucleotide
  Target: SCN10A; (+) strand; PAM type: NRG; PAM sequence: CGG
tcaggcccctcctgcctagc

SEQ ID NO: 31520 - DNA, 20 bp, Artificial Sequence
  Description of Artificial Sequence: Synthetic oligonucleotide
  Target: SCN10A; (+) strand; PAM type: NRG; PAM sequence: GGG
caggcccctcctgcctagcc

SEQ ID NO: 31521 - DNA, 20 bp, Artificial Sequence
  Description of Artificial Sequence: Synthetic oligonucleotide
  Target: SCN10A; (+) strand; PAM type: NRG; PAM sequence: GGG
aggcccctcctgcctagccg

SEQ ID NO: 31522 - DNA, 20 bp, Artificial Sequence
  Description of Artificial Sequence: Synthetic oligonucleotide
  Target: SCN10A; (+) strand; PAM type: NRG; PAM sequence: TGG
ctcctgcctagccggggtca

SEQ ID NO: 31523 - DNA, 20 bp, Artificial Sequence
  Description of Artificial Sequence: Synthetic oligonucleotide
  Target: SCN10A; (+) strand; PAM type: NRG; PAM sequence: AAG
gcctagccggggtcatggac

SEQ ID NO: 31524 - DNA, 20 bp, Artificial Sequence
  Description of Artificial Sequence: Synthetic oligonucleotide
  Target: SCN10A; (+) strand; PAM type: NRG; PAM sequence: CAG
aaaaacaaaaaaccaacacc

SEQ ID NO: 31525 - DNA, 20 bp, Artificial Sequence
  Description of Artificial Sequence: Synthetic oligonucleotide
  Target: SCN10A; (+) strand; PAM type: NRG; PAM sequence: AAG
aacaaaaaaccaacacccag

SEQ ID NO: 31526 - DNA, 20 bp, Artificial Sequence
  Description of Artificial Sequence: Synthetic oligonucleotide
  Target: SCN10A; (+) strand; PAM type: NRG; PAM sequence: GAG
agttgtgtactgaaaacatt

SEQ ID NO: 31527 - DNA, 20 bp, Artificial Sequence
  Description of Artificial Sequence: Synthetic oligonucleotide
  Target: SCN10A; (+) strand; PAM type: NRG; PAM sequence: TAG
tgtgtactgaaaacattgag

SEQ ID NO: 31528 - DNA, 20 bp, Artificial Sequence
  Description of Artificial Sequence: Synthetic oligonucleotide
  Target: SCN10A; (+) strand; PAM type: NRG; PAM sequence: AGG
gtgtactgaaaacattgagt

SEQ ID NO: 31529 - DNA, 20 bp, Artificial Sequence
  Description of Artificial Sequence: Synthetic oligonucleotide
  Target: SCN10A; (+) strand; PAM type: NRG; PAM sequence: GGG
tgtactgaaaacattgagta

SEQ ID NO: 31530 - DNA, 20 bp, Artificial Sequence
  Description of Artificial Sequence: Synthetic oligonucleotide
  Target: SCN10A; (+) strand; PAM type: NRG; PAM sequence: TAG
aaacattgagtagggacaac

SEQ ID NO: 31531 - DNA, 20 bp, Artificial Sequence
  Description of Artificial Sequence: Synthetic oligonucleotide
  Target: SCN10A; (+) strand; PAM type: NRG; PAM sequence: CAG
attgagtagggacaactagc

SEQ ID NO: 31532 - DNA, 20 bp, Artificial Sequence
  Description of Artificial Sequence: Synthetic oligonucleotide
  Target: SCN10A; (+) strand; PAM type: NRG; PAM sequence: AGG
ttgagtagggacaactagcc

SEQ ID NO: 31533 - DNA, 20 bp, Artificial Sequence
  Description of Artificial Sequence: Synthetic oligonucleotide
  Target: SCN10A; (+) strand; PAM type: NRG; PAM sequence: GGG
tgagtagggacaactagcca

SEQ ID NO: 31534 - DNA, 20 bp, Artificial Sequence
  Description of Artificial Sequence: Synthetic oligonucleotide
  Target: SCN10A; (+) strand; PAM type: NRG; PAM sequence: GGG
gagtagggacaactagccag

SEQ ID NO: 31535 - DNA, 20 bp, Artificial Sequence
  Description of Artificial Sequence: Synthetic oligonucleotide
  Target: SCN10A; (+) strand; PAM type: NRG; PAM sequence: GAG
gtagggacaactagccaggg

SEQ ID NO: 31536 - DNA, 20 bp, Artificial Sequence
  Description of Artificial Sequence: Synthetic oligonucleotide
  Target: SCN10A; (+) strand; PAM type: NRG; PAM sequence: TGG
caactagccaggggagtcct

SEQ ID NO: 31537 - DNA, 20 bp, Artificial Sequence
  Description of Artificial Sequence: Synthetic oligonucleotide
  Target: SCN10A; (+) strand; PAM type: NRG; PAM sequence: TGG
aggggagtccttggaacatt

SEQ ID NO: 31538 - DNA, 20 bp, Artificial Sequence
  Description of Artificial Sequence: Synthetic oligonucleotide
  Target: SCN10A; (+) strand; PAM type: NRG; PAM sequence: GGG
ggggagtccttggaacattt

SEQ ID NO: 31539 - DNA, 20 bp, Artificial Sequence
  Description of Artificial Sequence: Synthetic oligonucleotide
  Target: SCN10A; (+) strand; PAM type: NRG; PAM sequence: AAG
gagtccttggaacatttggg

SEQ ID NO: 31540 - DNA, 20 bp, Artificial Sequence
  Description of Artificial Sequence: Synthetic oligonucleotide
  Target: SCN10A; (+) strand; PAM type: NRG; PAM sequence: AAG
tccttggaacatttgggaag

SEQ ID NO: 31541 - DNA, 20 bp, Artificial Sequence
  Description of Artificial Sequence: Synthetic oligonucleotide
  Target: SCN10A; (+) strand; PAM type: NRG; PAM sequence: CAG
agaagcatgacatccacgtg

SEQ ID NO: 31542 - DNA, 20 bp, Artificial Sequence
  Description of Artificial Sequence: Synthetic oligonucleotide
  Target: SCN10A; (+) strand; PAM type: NRG; PAM sequence: CAG
catccacgtgcagaatgtga

SEQ ID NO: 31543 - DNA, 20 bp, Artificial Sequence
  Description of Artificial Sequence: Synthetic oligonucleotide
  Target: SCN10A; (+) strand; PAM type: NRG; PAM sequence: CAG
agaatgtgacagccctcacc

SEQ ID NO: 31544 - DNA, 20 bp, Artificial Sequence
  Description of Artificial Sequence: Synthetic oligonucleotide
  Target: SCN10A; (+) strand; PAM type: NRG; PAM sequence: TGG
atgtgacagccctcacccag

SEQ ID NO: 31545 - DNA, 20 bp, Artificial Sequence
  Description of Artificial Sequence: Synthetic oligonucleotide
  Target: SCN10A; (+) strand; PAM type: NRG; PAM sequence: GGG
tgtgacagccctcacccagt

SEQ ID NO: 31546 - DNA, 20 bp, Artificial Sequence
  Description of Artificial Sequence: Synthetic oligonucleotide
  Target: SCN10A; (+) strand; PAM type: NRG; PAM sequence: AAG
gccctcacccagtgggaacc

SEQ ID NO: 31547 - DNA, 20 bp, Artificial Sequence
  Description of Artificial Sequence: Synthetic oligonucleotide
  Target: SCN10A; (+) strand; PAM type: NRG; PAM sequence: CGG
ctcacccagtgggaaccaag

SEQ ID NO: 31548 - DNA, 20 bp, Artificial Sequence
  Description of Artificial Sequence: Synthetic oligonucleotide
  Target: SCN10A; (+) strand; PAM type: NRG; PAM sequence: CAG
aagcggcttctgttcaccca

SEQ ID NO: 31549 - DNA, 20 bp, Artificial Sequence
  Description of Artificial Sequence: Synthetic oligonucleotide
  Target: SCN10A; (+) strand; PAM type: NRG; PAM sequence: CAG
acagcccccaaatcccgtcc

SEQ ID NO: 31550 - DNA, 20 bp, Artificial Sequence
  Description of Artificial Sequence: Synthetic oligonucleotide
  Target: SCN10A; (+) strand; PAM type: NRG; PAM sequence: TGG
cctcttatcttaccctgctg

SEQ ID NO: 31551 - DNA, 20 bp, Artificial Sequence
  Description of Artificial Sequence: Synthetic oligonucleotide
  Target: SCN10A; (+) strand; PAM type: NRG; PAM sequence: CAG
ttatcttaccctgctgtggt

SEQ ID NO: 31552 - DNA, 20 bp, Artificial Sequence
  Description of Artificial Sequence: Synthetic oligonucleotide
  Target: SCN10A; (+) strand; PAM type: NRG; PAM sequence: TAG
ctgctgtggtcagccttgcc

SEQ ID NO: 31553 - DNA, 20 bp, Artificial Sequence
  Description of Artificial Sequence: Synthetic oligonucleotide
  Target: SCN10A; (+) strand; PAM type: NRG; PAM sequence: AGG
tgctgtggtcagccttgcct

SEQ ID NO: 31554 - DNA, 20 bp, Artificial Sequence
  Description of Artificial Sequence: Synthetic oligonucleotide
  Target: SCN10A; (+) strand; PAM type: NRG; PAM sequence: GGG
gctgtggtcagccttgccta

SEQ ID NO: 31555 - DNA, 20 bp, Artificial Sequence
  Description of Artificial Sequence: Synthetic oligonucleotide
  Target: SCN10A; (+) strand; PAM type: NRG; PAM sequence: CAG
tcagccttgcctagggcaca

SEQ ID NO: 31556 - DNA, 20 bp, Artificial Sequence
  Description of Artificial Sequence: Synthetic oligonucleotide
  Target: SCN10A; (+) strand; PAM type: NRG; PAM sequence: CAG
ccttgcctagggcacacagc

SEQ ID NO: 31557 - DNA, 20 bp, Artificial Sequence
  Description of Artificial Sequence: Synthetic oligonucleotide
  Target: SCN10A; (+) strand; PAM type: NRG; PAM sequence: TAG
tgcctagggcacacagccag

SEQ ID NO: 31558 - DNA, 20 bp, Artificial Sequence
  Description of Artificial Sequence: Synthetic oligonucleotide
  Target: SCN10A; (+) strand; PAM type: NRG; PAM sequence: AAG
gccagtagctgacattcttc

SEQ ID NO: 31559 - DNA, 20 bp, Artificial Sequence
  Description of Artificial Sequence: Synthetic oligonucleotide
  Target: SCN10A; (+) strand; PAM type: NRG; PAM sequence: AAG
agctgacattcttcaagctg

SEQ ID NO: 31560 - DNA, 20 bp, Artificial Sequence
  Description of Artificial Sequence: Synthetic oligonucleotide
  Target: SCN10A; (+) strand; PAM type: NRG; PAM sequence: AGG
gctgacattcttcaagctga

SEQ ID NO: 31561 - DNA, 20 bp, Artificial Sequence
  Description of Artificial Sequence: Synthetic oligonucleotide
  Target: SCN10A; (+) strand; PAM type: NRG; PAM sequence: GGG
ctgacattcttcaagctgaa

SEQ ID NO: 31562 - DNA, 20 bp, Artificial Sequence
  Description of Artificial Sequence: Synthetic oligonucleotide
  Target: SCN10A; (+) strand; PAM type: NRG; PAM sequence: TGG
gctgaagggcttgataactt

SEQ ID NO: 31563 - DNA, 20 bp, Artificial Sequence
  Description of Artificial Sequence: Synthetic oligonucleotide
  Target: SCN10A; (+) strand; PAM type: NRG; PAM sequence: GGG
ctgaagggcttgataacttt

SEQ ID NO: 31564 - DNA, 20 bp, Artificial Sequence
  Description of Artificial Sequence: Synthetic oligonucleotide
  Target: SCN10A; (+) strand; PAM type: NRG; PAM sequence: GGG
tgaagggcttgataactttg

SEQ ID NO: 31565 - DNA, 20 bp, Artificial Sequence
  Description of Artificial Sequence: Synthetic oligonucleotide
  Target: SCN10A; (+) strand; PAM type: NRG; PAM sequence: GAG
atgacttccttatctctgtt

SEQ ID NO: 31566 - DNA, 20 bp, Artificial Sequence
  Description of Artificial Sequence: Synthetic oligonucleotide
  Target: SCN10A; (+) strand; PAM type: NRG; PAM sequence: CAG
ttccttatctctgttgagcc

SEQ ID NO: 31567 - DNA, 20 bp, Artificial Sequence
  Description of Artificial Sequence: Synthetic oligonucleotide
  Target: SCN10A; (+) strand; PAM type: NRG; PAM sequence: AAG
tgagcccagtgcctgtcaca

SEQ ID NO: 31568 - DNA, 20 bp, Artificial Sequence
  Description of Artificial Sequence: Synthetic oligonucleotide
  Target: SCN10A; (+) strand; PAM type: NRG; PAM sequence: CAG
cccagtgcctgtcacaaagt

SEQ ID NO: 31569 - DNA, 20 bp, Artificial Sequence
  Description of Artificial Sequence: Synthetic oligonucleotide
  Target: SCN10A; (+) strand; PAM type: NRG; PAM sequence: CAG
cctgtcacaaagtcagcact

SEQ ID NO: 31570 - DNA, 20 bp, Artificial Sequence
  Description of Artificial Sequence: Synthetic oligonucleotide
  Target: SCN10A; (+) strand; PAM type: NRG; PAM sequence: TGG
gtcacaaagtcagcactcag

SEQ ID NO: 31571 - DNA, 20 bp, Artificial Sequence
  Description of Artificial Sequence: Synthetic oligonucleotide
  Target: SCN10A; (+) strand; PAM type: NRG; PAM sequence: TAG
caaagtcagcactcagtggc

SEQ ID NO: 31572 - DNA, 20 bp, Artificial Sequence
  Description of Artificial Sequence: Synthetic oligonucleotide
  Target: SCN10A; (+) strand; PAM type: NRG; PAM sequence: AGG
aaagtcagcactcagtggct

SEQ ID NO: 31573 - DNA, 20 bp, Artificial Sequence
  Description of Artificial Sequence: Synthetic oligonucleotide
  Target: SCN10A; (+) strand; PAM type: NRG; PAM sequence: AAG
caaattaaattcttgaattg

SEQ ID NO: 31574 - DNA, 20 bp, Artificial Sequence
  Description of Artificial Sequence: Synthetic oligonucleotide
  Target: SCN10A; (+) strand; PAM type: NRG; PAM sequence: AGG
aaattaaattcttgaattga

SEQ ID NO: 31575 - DNA, 20 bp, Artificial Sequence
  Description of Artificial Sequence: Synthetic oligonucleotide
  Target: SCN10A; (+) strand; PAM type: NRG; PAM sequence: CAG
ttaaattcttgaattgaagg

SEQ ID NO: 31576 - DNA, 20 bp, Artificial Sequence
  Description of Artificial Sequence: Synthetic oligonucleotide
  Target: SCN10A; (+) strand; PAM type: NRG; PAM sequence: AAG
aattgaaggcagtgttatta

SEQ ID NO: 31577 - DNA, 20 bp, Artificial Sequence
  Description of Artificial Sequence: Synthetic oligonucleotide
  Target: SCN10A; (+) strand; PAM type: NRG; PAM sequence: TAG
ttaaagatgctaaactttta

SEQ ID NO: 31578 - DNA, 20 bp, Artificial Sequence
  Description of Artificial Sequence: Synthetic oligonucleotide
  Target: SCN10A; (+) strand; PAM type: NRG; PAM sequence: TAG
tatagatgcctctttcccta

SEQ ID NO: 31579 - DNA, 20 bp, Artificial Sequence
  Description of Artificial Sequence: Synthetic oligonucleotide
  Target: SCN10A; (+) strand; PAM type: NRG; PAM sequence: AAG
ccctatagcttgtttccttc

SEQ ID NO: 31580 - DNA, 20 bp, Artificial Sequence
  Description of Artificial Sequence: Synthetic oligonucleotide
  Target: SCN10A; (+) strand; PAM type: NRG; PAM sequence: AAG
ttgtttccttcaagatttgt

SEQ ID NO: 31581 - DNA, 20 bp, Artificial Sequence
  Description of Artificial Sequence: Synthetic oligonucleotide
  Target: SCN10A; (+) strand; PAM type: NRG; PAM sequence: AAG
catttatttttaccttgtat

SEQ ID NO: 31582 - DNA, 20 bp, Artificial Sequence
  Description of Artificial Sequence: Synthetic oligonucleotide
  Target: SCN10A; (+) strand; PAM type: NRG; PAM sequence: CAG
atcctaaacctctaatcttc

SEQ ID NO: 31583 - DNA, 20 bp, Artificial Sequence
  Description of Artificial Sequence: Synthetic oligonucleotide
  Target: SCN10A; (+) strand; PAM type: NRG; PAM sequence: CAG
aaacctctaatcttccagct

SEQ ID NO: 31584 - DNA, 20 bp, Artificial Sequence
  Description of Artificial Sequence: Synthetic oligonucleotide
  Target: SCN10A; (+) strand; PAM type: NRG; PAM sequence: GAG
tcttccagctcagtctctgt

SEQ ID NO: 31585 - DNA, 20 bp, Artificial Sequence
  Description of Artificial Sequence: Synthetic oligonucleotide
  Target: SCN10A; (+) strand; PAM type: NRG; PAM sequence: AGG
cttccagctcagtctctgtg

SEQ ID NO: 31586 - DNA, 20 bp, Artificial Sequence
  Description of Artificial Sequence: Synthetic oligonucleotide
  Target: SCN10A; (+) strand; PAM type: NRG; PAM sequence: TAG
gtcacttcactactcaccta

SEQ ID NO: 31587 - DNA, 20 bp, Artificial Sequence
  Description of Artificial Sequence: Synthetic oligonucleotide
  Target: SCN10A; (+) strand; PAM type: NRG; PAM sequence: GAG
cacttcactactcacctata

SEQ ID NO: 31588 - DNA, 20 bp, Artificial Sequence
  Description of Artificial Sequence: Synthetic oligonucleotide
  Target: SCN10A; (+) strand; PAM type: NRG; PAM sequence: GAG
cttcactactcacctataga

SEQ ID NO: 31589 - DNA, 20 bp, Artificial Sequence
  Description of Artificial Sequence: Synthetic oligonucleotide
  Target: SCN10A; (+) strand; PAM type: NRG; PAM sequence: TAG
acctatagagagcctctccc

SEQ ID NO: 31590 - DNA, 20 bp, Artificial Sequence
  Description of Artificial Sequence: Synthetic oligonucleotide
  Target: SCN10A; (+) strand; PAM type: NRG; PAM sequence: CAG
agagagcctctccctagccc

SEQ ID NO: 31591 - DNA, 20 bp, Artificial Sequence
  Description of Artificial Sequence: Synthetic oligonucleotide
  Target: SCN10A; (+) strand; PAM type: NRG; PAM sequence: AGG
gagagcctctccctagcccc

SEQ ID NO: 31592 - DNA, 20 bp, Artificial Sequence
  Description of Artificial Sequence: Synthetic oligonucleotide
  Target: SCN10A; (+) strand; PAM type: NRG; PAM sequence: TAG
agccccaggctacttttgcc

SEQ ID NO: 31593 - DNA, 20 bp, Artificial Sequence
  Description of Artificial Sequence: Synthetic oligonucleotide
  Target: SCN10A; (+) strand; PAM type: NRG; PAM sequence: GAG
ccccaggctacttttgccta

SEQ ID NO: 31594 - DNA, 20 bp, Artificial Sequence
  Description of Artificial Sequence: Synthetic oligonucleotide
  Target: SCN10A; (+) strand; PAM type: NRG; PAM sequence: TGG
tttgcctagagaaaatgatg

SEQ ID NO: 31595 - DNA, 20 bp, Artificial Sequence
  Description of Artificial Sequence: Synthetic oligonucleotide
  Target: SCN10A; (+) strand; PAM type: NRG; PAM sequence: AAG
agagaaaatgatgtggacaa

SEQ ID NO: 31596 - DNA, 20 bp, Artificial Sequence
  Description of Artificial Sequence: Synthetic oligonucleotide
  Target: SCN10A; (+) strand; PAM type: NRG; PAM sequence: AAG
aaaatgatgtggacaaaaga

SEQ ID NO: 31597 - DNA, 20 bp, Artificial Sequence
  Description of Artificial Sequence: Synthetic oligonucleotide
  Target: SCN10A; (+) strand; PAM type: NRG; PAM sequence: TGG
atgatgtggacaaaagaaag

SEQ ID NO: 31598 - DNA, 20 bp, Artificial Sequence
  Description of Artificial Sequence: Synthetic oligonucleotide
  Target: SCN10A; (+) strand; PAM type: NRG; PAM sequence: GGG
tgatgtggacaaaagaaagt

SEQ ID NO: 31599 - DNA, 20 bp, Artificial Sequence
  Description of Artificial Sequence: Synthetic oligonucleotide
  Target: SCN10A; (+) strand; PAM type: NRG; PAM sequence: GGG
gatgtggacaaaagaaagtg

SEQ ID NO: 31600 - DNA, 20 bp, Artificial Sequence
  Description of Artificial Sequence: Synthetic oligonucleotide
  Target: SCN10A; (+) strand; PAM type: NRG; PAM sequence: GGG
atgtggacaaaagaaagtgg

SEQ ID NO: 31601 - DNA, 20 bp, Artificial Sequence
  Description of Artificial Sequence: Synthetic oligonucleotide
  Target: SCN10A; (+) strand; PAM type: NRG; PAM sequence: GAG
gtggacaaaagaaagtgggg

SEQ ID NO: 31602 - DNA, 20 bp, Artificial Sequence
  Description of Artificial Sequence: Synthetic oligonucleotide
  Target: SCN10A; (+) strand; PAM type: NRG; PAM sequence: AAG
agaaagtgggggagaatcac

SEQ ID NO: 31603 - DNA, 20 bp, Artificial Sequence
  Description of Artificial Sequence: Synthetic oligonucleotide
  Target: SCN10A; (+) strand; PAM type: NRG; PAM sequence: AGG
gaaagtgggggagaatcaca

SEQ ID NO: 31604 - DNA, 20 bp, Artificial Sequence
  Description of Artificial Sequence: Synthetic oligonucleotide
  Target: SCN10A; (+) strand; PAM type: NRG; PAM sequence: GGG
aaagtgggggagaatcacaa

SEQ ID NO: 31605 - DNA, 20 bp, Artificial Sequence
  Description of Artificial Sequence: Synthetic oligonucleotide
  Target: SCN10A; (+) strand; PAM type: NRG; PAM sequence: GAG
gggaaaacttcttcatctgt

SEQ ID NO: 31606 - DNA, 20 bp, Artificial Sequence
  Description of Artificial Sequence: Synthetic oligonucleotide
  Target: SCN10A; (+) strand; PAM type: NRG; PAM sequence: TGG
cacctccaactcttatttgc

SEQ ID NO: 31607 - DNA, 20 bp, Artificial Sequence
  Description of Artificial Sequence: Synthetic oligonucleotide
  Target: SCN10A; (+) strand; PAM type: NRG; PAM sequence: AAG
ctcttatttgctggctctga

SEQ ID NO: 31608 - DNA, 20 bp, Artificial Sequence
  Description of Artificial Sequence: Synthetic oligonucleotide
  Target: SCN10A; (+) strand; PAM type: NRG; PAM sequence: TGG
tctttcgtttccttttttct

SEQ ID NO: 31609 - DNA, 20 bp, Artificial Sequence
  Description of Artificial Sequence: Synthetic oligonucleotide
  Target: SCN10A; (+) strand; PAM type: NRG; PAM sequence: TGG
ttttcttggctgtcatttcc

SEQ ID NO: 31610 - DNA, 20 bp, Artificial Sequence
  Description of Artificial Sequence: Synthetic oligonucleotide
  Target: SCN10A; (+) strand; PAM type: NRG; PAM sequence: GGG
tttcttggctgtcatttcct

SEQ ID NO: 31611 - DNA, 20 bp, Artificial Sequence
  Description of Artificial Sequence: Synthetic oligonucleotide
  Target: SCN10A; (+) strand; PAM type: NRG; PAM sequence: CAG
cctgggcacttactttgtct

SEQ ID NO: 31612 - DNA, 20 bp, Artificial Sequence
  Description of Artificial Sequence: Synthetic oligonucleotide
  Target: SCN10A; (+) strand; PAM type: NRG; PAM sequence: AGG
ctgggcacttactttgtctc

SEQ ID NO: 31613 - DNA, 20 bp, Artificial Sequence
  Description of Artificial Sequence: Synthetic oligonucleotide
  Target: SCN10A; (+) strand; PAM type: NRG; PAM sequence: CAG
ggcacttactttgtctcagg

SEQ ID NO: 31614 - DNA, 20 bp, Artificial Sequence
  Description of Artificial Sequence: Synthetic oligonucleotide
  Target: SCN10A; (+) strand; PAM type: NRG; PAM sequence: AGG
gcacttactttgtctcaggc

SEQ ID NO: 31615 - DNA, 20 bp, Artificial Sequence
  Description of Artificial Sequence: Synthetic oligonucleotide
  Target: SCN10A; (+) strand; PAM type: NRG; PAM sequence: AAG
gcaggacctaaacatttgac

SEQ ID NO: 31616 - DNA, 20 bp, Artificial Sequence
  Description of Artificial Sequence: Synthetic oligonucleotide
  Target: SCN10A; (+) strand; PAM type: NRG; PAM sequence: CAG
ggacctaaacatttgacaag

SEQ ID NO: 31617 - DNA, 20 bp, Artificial Sequence
  Description of Artificial Sequence: Synthetic oligonucleotide
  Target: SCN10A; (+) strand; PAM type: NRG; PAM sequence: AAG
tgacaagcagcatctcattt

SEQ ID NO: 31618 - DNA, 20 bp, Artificial Sequence
  Description of Artificial Sequence: Synthetic oligonucleotide
  Target: SCN10A; (+) strand; PAM type: NRG; PAM sequence: AAG
agcttcaaaataatcctacc

SEQ ID NO: 31619 - DNA, 20 bp, Artificial Sequence
  Description of Artificial Sequence: Synthetic oligonucleotide
  Target: SCN10A; (+) strand; PAM type: NRG; PAM sequence: TAG
ttcaaaataatcctaccaag

SEQ ID NO: 31620 - DNA, 20 bp, Artificial Sequence
  Description of Artificial Sequence: Synthetic oligonucleotide
  Target: SCN10A; (+) strand; PAM type: NRG; PAM sequence: AGG
tcaaaataatcctaccaagt

SEQ ID NO: 31621 - DNA, 20 bp, Artificial Sequence
  Description of Artificial Sequence: Synthetic oligonucleotide
  Target: SCN10A; (+) strand; PAM type: NRG; PAM sequence: CAG
accaagtaggcattaccatt

SEQ ID NO: 31622 - DNA, 20 bp, Artificial Sequence
  Description of Artificial Sequence: Synthetic oligonucleotide
  Target: SCN10A; (+) strand; PAM type: NRG; PAM sequence: TAG
ggcattaccattcagtttca

SEQ ID NO: 31623 - DNA, 20 bp, Artificial Sequence
  Description of Artificial Sequence: Synthetic oligonucleotide
  Target: SCN10A; (+) strand; PAM type: NRG; PAM sequence: TGG
cagtttcatagatgaataaa

SEQ ID NO: 31624 - DNA, 20 bp, Artificial Sequence
  Description of Artificial Sequence: Synthetic oligonucleotide
  Target: SCN10A; (+) strand; PAM type: NRG; PAM sequence: CGG
tttcatagatgaataaatgg

SEQ ID NO: 31625 - DNA, 20 bp, Artificial Sequence
  Description of Artificial Sequence: Synthetic oligonucleotide
  Target: SCN10A; (+) strand; PAM type: NRG; PAM sequence: CAG
tagatgaataaatggcggct

SEQ ID NO: 31626 - DNA, 20 bp, Artificial Sequence
  Description of Artificial Sequence: Synthetic oligonucleotide
  Target: SCN10A; (+) strand; PAM type: NRG; PAM sequence: GAG
gatgaataaatggcggctca

SEQ ID NO: 31627 - DNA, 20 bp, Artificial Sequence
  Description of Artificial Sequence: Synthetic oligonucleotide
  Target: SCN10A; (+) strand; PAM type: NRG; PAM sequence: GAG
tgaataaatggcggctcaga

SEQ ID NO: 31628 - DNA, 20 bp, Artificial Sequence
  Description of Artificial Sequence: Synthetic oligonucleotide
  Target: SCN10A; (+) strand; PAM type: NRG; PAM sequence: AGG
gaataaatggcggctcagag

SEQ ID NO: 31629 - DNA, 20 bp, Artificial Sequence
  Description of Artificial Sequence: Synthetic oligonucleotide
  Target: SCN10A; (+) strand; PAM type: NRG; PAM sequence: TGG
aatggcggctcagagaggtt

SEQ ID NO: 31630 - DNA, 20 bp, Artificial Sequence
  Description of Artificial Sequence: Synthetic oligonucleotide
  Target: SCN10A; (+) strand; PAM type: NRG; PAM sequence: GGG
atggcggctcagagaggttt

SEQ ID NO: 31631 - DNA, 20 bp, Artificial Sequence
  Description of Artificial Sequence: Synthetic oligonucleotide
  Target: SCN10A; (+) strand; PAM type: NRG; PAM sequence: TAG
agaggtttgggaactgatct

SEQ ID NO: 31632 - DNA, 20 bp, Artificial Sequence
  Description of Artificial Sequence: Synthetic oligonucleotide
  Target: SCN10A; (+) strand; PAM type: NRG; PAM sequence: AGG
gaggtttgggaactgatctt

SEQ ID NO: 31633 - DNA, 20 bp, Artificial Sequence
  Description of Artificial Sequence: Synthetic oligonucleotide
  Target: SCN10A; (+) strand; PAM type: NRG; PAM sequence: CAG
ggaactgatcttaggtccca

SEQ ID NO: 31634 - DNA, 20 bp, Artificial Sequence
  Description of Artificial Sequence: Synthetic oligonucleotide
  Target: SCN10A; (+) strand; PAM type: NRG; PAM sequence: TGG
atcttaggtcccacagcttg

SEQ ID NO: 31635 - DNA, 20 bp, Artificial Sequence
  Description of Artificial Sequence: Synthetic oligonucleotide
  Target: SCN10A; (+) strand; PAM type: NRG; PAM sequence: GAG
cttaggtcccacagcttgtg

SEQ ID NO: 31636 - DNA, 20 bp, Artificial Sequence
  Description of Artificial Sequence: Synthetic oligonucleotide
  Target: SCN10A; (+) strand; PAM type: NRG; PAM sequence: TAG
tcactctttctttctatacc

SEQ ID NO: 31637 - DNA, 20 bp, Artificial Sequence
  Description of Artificial Sequence: Synthetic oligonucleotide
  Target: SCN10A; (+) strand; PAM type: NRG; PAM sequence: TGG
ttctatacctagaaccaccc

SEQ ID NO: 31638 - DNA, 20 bp, Artificial Sequence
  Description of Artificial Sequence: Synthetic oligonucleotide
  Target: SCN10A; (+) strand; PAM type: NRG; PAM sequence: GAG
ctatacctagaaccaccctg

SEQ ID NO: 31639 - DNA, 20 bp, Artificial Sequence
  Description of Artificial Sequence: Synthetic oligonucleotide
  Target: SCN10A; (+) strand; PAM type: NRG; PAM sequence: GAG
acctagaaccaccctggagt

SEQ ID NO: 31640 - DNA, 20 bp, Artificial Sequence
  Description of Artificial Sequence: Synthetic oligonucleotide
  Target: SCN10A; (+) strand; PAM type: NRG; PAM sequence: TGG
accaccctggagtgagattg

SEQ ID NO: 31641 - DNA, 20 bp, Artificial Sequence
  Description of Artificial Sequence: Synthetic oligonucleotide
  Target: SCN10A; (+) strand; PAM type: NRG; PAM sequence: TGG
ctggagtgagattgtggcaa

SEQ ID NO: 31642 - DNA, 20 bp, Artificial Sequence
  Description of Artificial Sequence: Synthetic oligonucleotide
  Target: SCN10A; (+) strand; PAM type: NRG; PAM sequence: TGG
gagattgtggcaatggtata

SEQ ID NO: 31643 - DNA, 20 bp, Artificial Sequence
  Description of Artificial Sequence: Synthetic oligonucleotide
  Target: SCN10A; (+) strand; PAM type: NRG; PAM sequence: AAG
gtggcaatggtatatggtga

SEQ ID NO: 31644 - DNA, 20 bp, Artificial Sequence
  Description of Artificial Sequence: Synthetic oligonucleotide
  Target: SCN10A; (+) strand; PAM type: NRG; PAM sequence: CGG
tggtgaaagttgaaattgtg

SEQ ID NO: 31645 - DNA, 20 bp, Artificial Sequence
  Description of Artificial Sequence: Synthetic oligonucleotide
  Target: SCN10A; (+) strand; PAM type: NRG; PAM sequence: TAG
aaagttgaaattgtgcggat

SEQ ID NO: 31646 - DNA, 20 bp, Artificial Sequence
  Description of Artificial Sequence: Synthetic oligonucleotide
  Target: SCN10A; (+) strand; PAM type: NRG; PAM sequence: CGG
ttgaaattgtgcggattagc

SEQ ID NO: 31647 - DNA, 20 bp, Artificial Sequence
  Description of Artificial Sequence: Synthetic oligonucleotide
  Target: SCN10A; (+) strand; PAM type: NRG; PAM sequence: GAG
gaaattgtgcggattagccg

SEQ ID NO: 31648 - DNA, 20 bp, Artificial Sequence
  Description of Artificial Sequence: Synthetic oligonucleotide
  Target: SCN10A; (+) strand; PAM type: NRG; PAM sequence: AGG
aaattgtgcggattagccgg

SEQ ID NO: 31649 - DNA, 20 bp, Artificial Sequence
  Description of Artificial Sequence: Synthetic oligonucleotide
  Target: SCN10A; (+) strand; PAM type: NRG; PAM sequence: TGG
tgtgcggattagccggaggt

SEQ ID NO: 31650 - DNA, 20 bp, Artificial Sequence
  Description of Artificial Sequence: Synthetic oligonucleotide
  Target: SCN10A; (+) strand; PAM type: NRG; PAM sequence: GGG
gtgcggattagccggaggtt

SEQ ID NO: 31651 - DNA, 20 bp, Artificial Sequence
  Description of Artificial Sequence: Synthetic oligonucleotide
  Target: SCN10A; (+) strand; PAM type: NRG; PAM sequence: GAG
gcggattagccggaggttgg

SEQ ID NO: 31652 - DNA, 20 bp, Artificial Sequence
  Description of Artificial Sequence: Synthetic oligonucleotide
  Target: SCN10A; (+) strand; PAM type: NRG; PAM sequence: AGG
cggattagccggaggttggg

SEQ ID NO: 31653 - DNA, 20 bp, Artificial Sequence
  Description of Artificial Sequence: Synthetic oligonucleotide
  Target: SCN10A; (+) strand; PAM type: NRG; PAM sequence: GGG
ggattagccggaggttggga

SEQ ID NO: 31654 - DNA, 20 bp, Artificial Sequence
  Description of Artificial Sequence: Synthetic oligonucleotide
  Target: SCN10A; (+) strand; PAM type: NRG; PAM sequence: CAG
ggagggactttaaaaattcc

SEQ ID NO: 31655 - DNA, 20 bp, Artificial Sequence
  Description of Artificial Sequence: Synthetic oligonucleotide
  Target: SCN10A; (+) strand; PAM type: NRG; PAM sequence: AGG
gagggactttaaaaattccc

SEQ ID NO: 31656 - DNA, 20 bp, Artificial Sequence
  Description of Artificial Sequence: Synthetic oligonucleotide
  Target: SCN10A; (+) strand; PAM type: NRG; PAM sequence: AAG
actttaaaaattcccaggat

SEQ ID NO: 31657 - DNA, 20 bp, Artificial Sequence
  Description of Artificial Sequence: Synthetic oligonucleotide
  Target: SCN10A; (+) strand; PAM type: NRG; PAM sequence: GAG
aaattcccaggataagaaat

SEQ ID NO: 31658 - DNA, 20 bp, Artificial Sequence
  Description of Artificial Sequence: Synthetic oligonucleotide
  Target: SCN10A; (+) strand; PAM type: NRG; PAM sequence: AGG
aattcccaggataagaaatg

SEQ ID NO: 31659 - DNA, 20 bp, Artificial Sequence
  Description of Artificial Sequence: Synthetic oligonucleotide
  Target: SCN10A; (+) strand; PAM type: NRG; PAM sequence: GAG
agaaatgaggttatgtgatt

SEQ ID NO: 31660 - DNA, 20 bp, Artificial Sequence
  Description of Artificial Sequence: Synthetic oligonucleotide
  Target: SCN10A; (+) strand; PAM type: NRG; PAM sequence: CAG
tgaggttatgtgattgagtg

SEQ ID NO: 31661 - DNA, 20 bp, Artificial Sequence
  Description of Artificial Sequence: Synthetic oligonucleotide
  Target: SCN10A; (+) strand; PAM type: NRG; PAM sequence: TGG
ttatgtgattgagtgcagtc

SEQ ID NO: 31662 - DNA, 20 bp, Artificial Sequence
  Description of Artificial Sequence: Synthetic oligonucleotide
  Target: SCN10A; (+) strand; PAM type: NRG; PAM sequence: CAG
ccaccttcaccgccaccctc

SEQ ID NO: 31663 - DNA, 20 bp, Artificial Sequence
  Description of Artificial Sequence: Synthetic oligonucleotide
  Target: SCN10A; (+) strand; PAM type: NRG; PAM sequence: CAG
cgccaccctccagcctctac

SEQ ID NO: 31664 - DNA, 20 bp, Artificial Sequence
  Description of Artificial Sequence: Synthetic oligonucleotide
  Target: SCN10A; (+) strand; PAM type: NRG; PAM sequence: CAG
gcctctaccagcccactgct

SEQ ID NO: 31665 - DNA, 20 bp, Artificial Sequence
  Description of Artificial Sequence: Synthetic oligonucleotide
  Target: SCN10A; (+) strand; PAM type: NRG; PAM sequence: TGG
ccagcccactgctcagtgtc

SEQ ID NO: 31666 - DNA, 20 bp, Artificial Sequence
  Description of Artificial Sequence: Synthetic oligonucleotide
  Target: SCN10A; (+) strand; PAM type: NRG; PAM sequence: TGG
cccactgctcagtgtctggc

SEQ ID NO: 31667 - DNA, 20 bp, Artificial Sequence
  Description of Artificial Sequence: Synthetic oligonucleotide
  Target: SCN10A; (+) strand; PAM type: NRG; PAM sequence: CAG
ggctggctgtccaacctctc

SEQ ID NO: 31668 - DNA, 20 bp, Artificial Sequence
  Description of Artificial Sequence: Synthetic oligonucleotide
  Target: SCN10A; (+) strand; PAM type: NRG; PAM sequence: AGG
gctggctgtccaacctctcc

SEQ ID NO: 31669 - DNA, 20 bp, Artificial Sequence
  Description of Artificial Sequence: Synthetic oligonucleotide
  Target: SCN10A; (+) strand; PAM type: NRG; PAM sequence: AAG
ggctgtccaacctctccagg

SEQ ID NO: 31670 - DNA, 20 bp, Artificial Sequence
  Description of Artificial Sequence: Synthetic oligonucleotide
  Target: SCN10A; (+) strand; PAM type: NRG; PAM sequence: CAG
ggaagctgacatacctacct

SEQ ID NO: 31671 - DNA, 20 bp, Artificial Sequence
  Description of Artificial Sequence: Synthetic oligonucleotide
  Target: SCN10A; (+) strand; PAM type: NRG; PAM sequence: CAG
agctgacatacctacctcag

SEQ ID NO: 31672 - DNA, 20 bp, Artificial Sequence
  Description of Artificial Sequence: Synthetic oligonucleotide
  Target: SCN10A; (+) strand; PAM type: NRG; PAM sequence: AGG
gctgacatacctacctcagc

SEQ ID NO: 31673 - DNA, 20 bp, Artificial Sequence
  Description of Artificial Sequence: Synthetic oligonucleotide
  Target: SCN10A; (+) strand; PAM type: NRG; PAM sequence: GGG
ctgacatacctacctcagca

SEQ ID NO: 31674 - DNA, 20 bp, Artificial Sequence
  Description of Artificial Sequence: Synthetic oligonucleotide
  Target: SCN10A; (+) strand; PAM type: NRG; PAM sequence: GAG
acctacctcagcagggacct

SEQ ID NO: 31675 - DNA, 20 bp, Artificial Sequence
  Description of Artificial Sequence: Synthetic oligonucleotide
  Target: SCN10A; (+) strand; PAM type: NRG; PAM sequence: AGG
cctacctcagcagggacctg

SEQ ID NO: 31676 - DNA, 20 bp, Artificial Sequence
  Description of Artificial Sequence: Synthetic oligonucleotide
  Target: SCN10A; (+) strand; PAM type: NRG; PAM sequence: CAG
ctcagcagggacctgaggaa

SEQ ID NO: 31677 - DNA, 20 bp, Artificial Sequence
  Description of Artificial Sequence: Synthetic oligonucleotide
  Target: SCN10A; (+) strand; PAM type: NRG; PAM sequence: CAG
tcatctttccacgtctcacc

SEQ ID NO: 31678 - DNA, 20 bp, Artificial Sequence
  Description of Artificial Sequence: Synthetic oligonucleotide
  Target: SCN10A; (+) strand; PAM type: NRG; PAM sequence: AGG
catctttccacgtctcaccc

SEQ ID NO: 31679 - DNA, 20 bp, Artificial Sequence
  Description of Artificial Sequence: Synthetic oligonucleotide
  Target: SCN10A; (+) strand; PAM type: NRG; PAM sequence: GGG
atctttccacgtctcaccca

SEQ ID NO: 31680 - DNA, 20 bp, Artificial Sequence
  Description of Artificial Sequence: Synthetic oligonucleotide
  Target: SCN10A; (+) strand; PAM type: NRG; PAM sequence: TGG
ttccacgtctcacccaggga

SEQ ID NO: 31681 - DNA, 20 bp, Artificial Sequence
  Description of Artificial Sequence: Synthetic oligonucleotide
  Target: SCN10A; (+) strand; PAM type: NRG; PAM sequence: GAG
ccacgtctcacccagggatg

SEQ ID NO: 31682 - DNA, 20 bp, Artificial Sequence
  Description of Artificial Sequence: Synthetic oligonucleotide
  Target: SCN10A; (+) strand; PAM type: NRG; PAM sequence: CAG
gtctcacccagggatggagc

SEQ ID NO: 31683 - DNA, 20 bp, Artificial Sequence
  Description of Artificial Sequence: Synthetic oligonucleotide
  Target: SCN10A; (+) strand; PAM type: NRG; PAM sequence: AGG
tctcacccagggatggagcc

SEQ ID NO: 31684 - DNA, 20 bp, Artificial Sequence
  Description of Artificial Sequence: Synthetic oligonucleotide
  Target: SCN10A; (+) strand; PAM type: NRG; PAM sequence: CAG
cagggatggagccaggtcct

SEQ ID NO: 31685 - DNA, 20 bp, Artificial Sequence
  Description of Artificial Sequence: Synthetic oligonucleotide
  Target: SCN10A; (+) strand; PAM type: NRG; PAM sequence: AAG
ggatggagccaggtcctcag

SEQ ID NO: 31686 - DNA, 20 bp, Artificial Sequence
  Description of Artificial Sequence: Synthetic oligonucleotide
  Target: SCN10A; (+) strand; PAM type: NRG; PAM sequence: CAG
caggtcctcagaagatgttc

SEQ ID NO: 31687 - DNA, 20 bp, Artificial Sequence
  Description of Artificial Sequence: Synthetic oligonucleotide
  Target: SCN10A; (+) strand; PAM type: NRG; PAM sequence: TGG
tcagaagatgttccagtgcc

SEQ ID NO: 31688 - DNA, 20 bp, Artificial Sequence
  Description of Artificial Sequence: Synthetic oligonucleotide
  Target: SCN10A; (+) strand; PAM type: NRG; PAM sequence: GGG
cagaagatgttccagtgcct

SEQ ID NO: 31689 - DNA, 20 bp, Artificial Sequence
  Description of Artificial Sequence: Synthetic oligonucleotide
  Target: SCN10A; (+) strand; PAM type: NRG; PAM sequence: TGG
tgttccagtgcctgggctcc

SEQ ID NO: 31690 - DNA, 20 bp, Artificial Sequence
  Description of Artificial Sequence: Synthetic oligonucleotide
  Target: SCN10A; (+) strand; PAM type: NRG; PAM sequence: GGG
gttccagtgcctgggctcct

SEQ ID NO: 31691 - DNA, 20 bp, Artificial Sequence
  Description of Artificial Sequence: Synthetic oligonucleotide
  Target: SCN10A; (+) strand; PAM type: NRG; PAM sequence: CAG
gtgcctgggctcctgggtgt

SEQ ID NO: 31692 - DNA, 20 bp, Artificial Sequence
  Description of Artificial Sequence: Synthetic oligonucleotide
  Target: SCN10A; (+) strand; PAM type: NRG; PAM sequence: AGG
tgcctgggctcctgggtgtc

SEQ ID NO: 31693 - DNA, 20 bp, Artificial Sequence
  Description of Artificial Sequence: Synthetic oligonucleotide
  Target: SCN10A; (+) strand; PAM type: NRG; PAM sequence: TGG
ctgggctcctgggtgtcagg

SEQ ID NO: 31694 - DNA, 20 bp, Artificial Sequence
  Description of Artificial Sequence: Synthetic oligonucleotide
  Target: SCN10A; (+) strand; PAM type: NRG; PAM sequence: CAG
ccacacctctcgacttgctg

SEQ ID NO: 31695 - DNA, 20 bp, Artificial Sequence
  Description of Artificial Sequence: Synthetic oligonucleotide
  Target: SCN10A; (+) strand; PAM type: NRG; PAM sequence: TAG
cttgctgcagctgctcctgc

SEQ ID NO: 31696 - DNA, 20 bp, Artificial Sequence
  Description of Artificial Sequence: Synthetic oligonucleotide
  Target: SCN10A; (+) strand; PAM type: NRG; PAM sequence: GAG
ctgcagctgctcctgctagt

SEQ ID NO: 31697 - DNA, 20 bp, Artificial Sequence
  Description of Artificial Sequence: Synthetic oligonucleotide
  Target: SCN10A; (+) strand; PAM type: NRG; PAM sequence: GAG
gcagctgctcctgctagtga

SEQ ID NO: 31698 - DNA, 20 bp, Artificial Sequence
  Description of Artificial Sequence: Synthetic oligonucleotide
  Target: SCN10A; (+) strand; PAM type: NRG; PAM sequence: GAG
agctgctcctgctagtgaga

SEQ ID NO: 31699 - DNA, 20 bp, Artificial Sequence
  Description of Artificial Sequence: Synthetic oligonucleotide
  Target: SCN10A; (+) strand; PAM type: NRG; PAM sequence: AGG
gctgctcctgctagtgagag

SEQ ID NO: 31700 - DNA, 20 bp, Artificial Sequence
  Description of Artificial Sequence: Synthetic oligonucleotide
  Target: SCN10A; (+) strand; PAM type: NRG; PAM sequence: GGG
ctgctcctgctagtgagaga

SEQ ID NO: 31701 - DNA, 20 bp, Artificial Sequence
  Description of Artificial Sequence: Synthetic oligonucleotide
  Target: SCN10A; (+) strand; PAM type: NRG; PAM sequence: TGG
tagtgagagagggtcccaac

SEQ ID NO: 31702 - DNA, 20 bp, Artificial Sequence
  Description of Artificial Sequence: Synthetic oligonucleotide
  Target: SCN10A; (+) strand; PAM type: NRG; PAM sequence: GGG
agtgagagagggtcccaact

SEQ ID NO: 31703 - DNA, 20 bp, Artificial Sequence
  Description of Artificial Sequence: Synthetic oligonucleotide
  Target: SCN10A; (+) strand; PAM type: NRG; PAM sequence: TGG
gagggtcccaactgggtgcc

SEQ ID NO: 31704 - DNA, 20 bp, Artificial Sequence
  Description of Artificial Sequence: Synthetic oligonucleotide
  Target: SCN10A; (+) strand; PAM type: NRG; PAM sequence: TAG
tgggtgcctggccccaccct

SEQ ID NO: 31705 - DNA, 20 bp, Artificial Sequence
  Description of Artificial Sequence: Synthetic oligonucleotide
  Target: SCN10A; (+) strand; PAM type: NRG; PAM sequence: CAG
tggccccacccttagatgac

SEQ ID NO: 31706 - DNA, 20 bp, Artificial Sequence
  Description of Artificial Sequence: Synthetic oligonucleotide
  Target: SCN10A; (+) strand; PAM type: NRG; PAM sequence: AAG
gatgaccagttctaaatttg

SEQ ID NO: 31707 - DNA, 20 bp, Artificial Sequence
  Description of Artificial Sequence: Synthetic oligonucleotide
  Target: SCN10A; (+) strand; PAM type: NRG; PAM sequence: AGG
atgaccagttctaaatttga

SEQ ID NO: 31708 - DNA, 20 bp, Artificial Sequence
  Description of Artificial Sequence: Synthetic oligonucleotide
  Target: SCN10A; (+) strand; PAM type: NRG; PAM sequence: GGG
tgaccagttctaaatttgaa

SEQ ID NO: 31709 - DNA, 20 bp, Artificial Sequence
  Description of Artificial Sequence: Synthetic oligonucleotide
  Target: SCN10A; (+) strand; PAM type: NRG; PAM sequence: CAG
tgaagggatcttgcacatca

SEQ ID NO: 31710 - DNA, 20 bp, Artificial Sequence
  Description of Artificial Sequence: Synthetic oligonucleotide
  Target: SCN10A; (+) strand; PAM type: NRG; PAM sequence: AGG
gaagggatcttgcacatcac

SEQ ID NO: 31711 - DNA, 20 bp, Artificial Sequence
  Description of Artificial Sequence: Synthetic oligonucleotide
  Target: SCN10A; (+) strand; PAM type: NRG; PAM sequence: CAG
tcttgcacatcacaggctgc

SEQ ID NO: 31712 - DNA, 20 bp, Artificial Sequence
  Description of Artificial Sequence: Synthetic oligonucleotide
  Target: SCN10A; (+) strand; PAM type: NRG; PAM sequence: GAG
ttgcacatcacaggctgcca

SEQ ID NO: 31713 - DNA, 20 bp, Artificial Sequence
  Description of Artificial Sequence: Synthetic oligonucleotide
  Target: SCN10A; (+) strand; PAM type: NRG; PAM sequence: AAG
catcacaggctgccagagcc

SEQ ID NO: 31714 - DNA, 20 bp, Artificial Sequence
  Description of Artificial Sequence: Synthetic oligonucleotide
  Target: SCN10A; (+) strand; PAM type: NRG; PAM sequence: GAG
tcacaggctgccagagccaa

SEQ ID NO: 31715 - DNA, 20 bp, Artificial Sequence
  Description of Artificial Sequence: Synthetic oligonucleotide
  Target: SCN10A; (+) strand; PAM type: NRG; PAM sequence: AAG
tatatacatacacgtgtgtg

SEQ ID NO: 31716 - DNA, 20 bp, Artificial Sequence
  Description of Artificial Sequence: Synthetic oligonucleotide
  Target: SCN10A; (+) strand; PAM type: NRG; PAM sequence: GAG
tacatacacgtgtgtgaagt

SEQ ID NO: 31717 - DNA, 20 bp, Artificial Sequence
  Description of Artificial Sequence: Synthetic oligonucleotide
  Target: SCN10A; (+) strand; PAM type: NRG; PAM sequence: AAG
acgtgtgtgaagtgagcatg

SEQ ID NO: 31718 - DNA, 20 bp, Artificial Sequence
  Description of Artificial Sequence: Synthetic oligonucleotide
  Target: SCN10A; (+) strand; PAM type: NRG; PAM sequence: TAG
tgaagtgagcatgaagacta

SEQ ID NO: 31719 - DNA, 20 bp, Artificial Sequence
  Description of Artificial Sequence: Synthetic oligonucleotide
  Target: SCN10A; (+) strand; PAM type: NRG; PAM sequence: TAG
gtgagcatgaagactatagc

SEQ ID NO: 31720 - DNA, 20 bp, Artificial Sequence
  Description of Artificial Sequence: Synthetic oligonucleotide
  Target: SCN10A; (+) strand; PAM type: NRG; PAM sequence: TAG
gcatgaagactatagctaga

SEQ ID NO: 31721 - DNA, 20 bp, Artificial Sequence
  Description of Artificial Sequence: Synthetic oligonucleotide
  Target: SCN10A; (+) strand; PAM type: NRG; PAM sequence: TGG
atagacctatgttttatcct

SEQ ID NO: 31722 - DNA, 20 bp, Artificial Sequence
  Description of Artificial Sequence: Synthetic oligonucleotide
  Target: SCN10A; (+) strand; PAM type: NRG; PAM sequence: GGG
tagacctatgttttatcctt

SEQ ID NO: 31723 - DNA, 20 bp, Artificial Sequence
  Description of Artificial Sequence: Synthetic oligonucleotide
  Target: SCN10A; (+) strand; PAM type: NRG; PAM sequence: AAG
ccttgggctccattaattat

SEQ ID NO: 31724 - DNA, 20 bp, Artificial Sequence
  Description of Artificial Sequence: Synthetic oligonucleotide
  Target: SCN10A; (+) strand; PAM type: NRG; PAM sequence: TAG
aattataagatgtgtgacct

SEQ ID NO: 31725 - DNA, 20 bp, Artificial Sequence
  Description of Artificial Sequence: Synthetic oligonucleotide
  Target: SCN10A; (+) strand; PAM type: NRG; PAM sequence: AGG
attataagatgtgtgacctt

SEQ ID NO: 31726 - DNA, 20 bp, Artificial Sequence
  Description of Artificial Sequence: Synthetic oligonucleotide
  Target: SCN10A; (+) strand; PAM type: NRG; PAM sequence: AAG
taagatgtgtgaccttaggc

SEQ ID NO: 31727 - DNA, 20 bp, Artificial Sequence
  Description of Artificial Sequence: Synthetic oligonucleotide
  Target: SCN10A; (+) strand; PAM type: NRG; PAM sequence: CAG
tctctaatcttcatttttcc

SEQ ID NO: 31728 - DNA, 20 bp, Artificial Sequence
  Description of Artificial Sequence: Synthetic oligonucleotide
  Target: SCN10A; (+) strand; PAM type: NRG; PAM sequence: AAG
ttcccagcttcaaaattgaa

SEQ ID NO: 31729 - DNA, 20 bp, Artificial Sequence
  Description of Artificial Sequence: Synthetic oligonucleotide
  Target: SCN10A; (+) strand; PAM type: NRG; PAM sequence: AGG
tcccagcttcaaaattgaaa

SEQ ID NO: 31730 - DNA, 20 bp, Artificial Sequence
  Description of Artificial Sequence: Synthetic oligonucleotide
  Target: SCN10A; (+) strand; PAM type: NRG; PAM sequence: TAG
agcttcaaaattgaaaaggc

SEQ ID NO: 31731 - DNA, 20 bp, Artificial Sequence
  Description of Artificial Sequence: Synthetic oligonucleotide
  Target: SCN10A; (+) strand; PAM type: NRG; PAM sequence: CAG
aaggctagatctgcatcatt

SEQ ID NO: 31732 - DNA, 20 bp, Artificial Sequence
  Description of Artificial Sequence: Synthetic oligonucleotide
  Target: SCN10A; (+) strand; PAM type: NRG; PAM sequence: TAG
gttttgatgactaaatatgt

SEQ ID NO: 31733 - DNA, 20 bp, Artificial Sequence
  Description of Artificial Sequence: Synthetic oligonucleotide
  Target: SCN10A; (+) strand; PAM type: NRG; PAM sequence: AAG
cttgtaaaacactttgcacg

SEQ ID NO: 31734 - DNA, 20 bp, Artificial Sequence
  Description of Artificial Sequence: Synthetic oligonucleotide
  Target: SCN10A; (+) strand; PAM type: NRG; PAM sequence: TGG
aacactttgcacgaagtgct

SEQ ID NO: 31735 - DNA, 20 bp, Artificial Sequence
  Description of Artificial Sequence: Synthetic oligonucleotide
  Target: SCN10A; (+) strand; PAM type: NRG; PAM sequence: TAG
gcacgaagtgcttggctcaa

SEQ ID NO: 31736 - DNA, 20 bp, Artificial Sequence
  Description of Artificial Sequence: Synthetic oligonucleotide
  Target: SCN10A; (+) strand; PAM type: NRG; PAM sequence: TAG
gtgcttggctcaatagattt

SEQ ID NO: 31737 - DNA, 20 bp, Artificial Sequence
  Description of Artificial Sequence: Synthetic oligonucleotide
  Target: SCN10A; (+) strand; PAM type: NRG; PAM sequence: CAG
catgaccattgttatttgtc

SEQ ID NO: 31738 - DNA, 20 bp, Artificial Sequence
  Description of Artificial Sequence: Synthetic oligonucleotide
  Target: SCN10A; (+) strand; PAM type: NRG; PAM sequence: GAG
tgaccattgttatttgtcca

SEQ ID NO: 31739 - DNA, 20 bp, Artificial Sequence
  Description of Artificial Sequence: Synthetic oligonucleotide
  Target: SCN10A; (+) strand; PAM type: NRG; PAM sequence: AGG
gaccattgttatttgtccag

SEQ ID NO: 31740 - DNA, 20 bp, Artificial Sequence
  Description of Artificial Sequence: Synthetic oligonucleotide
  Target: SCN10A; (+) strand; PAM type: NRG; PAM sequence: TAG
ttgtccagaggtcaaaattg

SEQ ID NO: 31741 - DNA, 20 bp, Artificial Sequence
  Description of Artificial Sequence: Synthetic oligonucleotide
  Target: SCN10A; (+) strand; PAM type: NRG; PAM sequence: AGG
tgtccagaggtcaaaattgt

SEQ ID NO: 31742 - DNA, 20 bp, Artificial Sequence
  Description of Artificial Sequence: Synthetic oligonucleotide
  Target: SCN10A; (+) strand; PAM type: NRG; PAM sequence: GGG
gtccagaggtcaaaattgta

SEQ ID NO: 31743 - DNA, 20 bp, Artificial Sequence
  Description of Artificial Sequence: Synthetic oligonucleotide
  Target: SCN10A; (+) strand; PAM type: NRG; PAM sequence: TGG
ggtcaaaattgtagggaact

SEQ ID NO: 31744 - DNA, 20 bp, Artificial Sequence
  Description of Artificial Sequence: Synthetic oligonucleotide
  Target: SCN10A; (+) strand; PAM type: NRG; PAM sequence: TGG
ttgtagggaacttggccacc

SEQ ID NO: 31745 - DNA, 20 bp, Artificial Sequence
  Description of Artificial Sequence: Synthetic oligonucleotide
  Target: SCN10A; (+) strand; PAM type: NRG; PAM sequence: GAG
gtagggaacttggccacctg

SEQ ID NO: 31746 - DNA, 20 bp, Artificial Sequence
  Description of Artificial Sequence: Synthetic oligonucleotide
  Target: SCN10A; (+) strand; PAM type: NRG; PAM sequence: AAG
ttggccacctggagctccct

SEQ ID NO: 31747 - DNA, 20 bp, Artificial Sequence
  Description of Artificial Sequence: Synthetic oligonucleotide
  Target: SCN10A; (+) strand; PAM type: NRG; PAM sequence: GAG
ggccacctggagctccctaa

SEQ ID NO: 31748 - DNA, 20 bp, Artificial Sequence
  Description of Artificial Sequence: Synthetic oligonucleotide
  Target: SCN10A; (+) strand; PAM type: NRG; PAM sequence: AAG
ggagctccctaagagcccca

SEQ ID NO: 31749 - DNA, 20 bp, Artificial Sequence
  Description of Artificial Sequence: Synthetic oligonucleotide
  Target: SCN10A; (+) strand; PAM type: NRG; PAM sequence: GAG
aagtaactgaaaatgcttct

SEQ ID NO: 31750 - DNA, 20 bp, Artificial Sequence
  Description of Artificial Sequence: Synthetic oligonucleotide
  Target: SCN10A; (+) strand; PAM type: NRG; PAM sequence: TGG
taactgaaaatgcttctgag

SEQ ID NO: 31751 - DNA, 20 bp, Artificial Sequence
  Description of Artificial Sequence: Synthetic oligonucleotide
  Target: SCN10A; (+) strand; PAM type: NRG; PAM sequence: CAG
ctgaaaatgcttctgagtgg

SEQ ID NO: 31752 - DNA, 20 bp, Artificial Sequence
  Description of Artificial Sequence: Synthetic oligonucleotide
  Target: SCN10A; (+) strand; PAM type: NRG; PAM sequence: CAG
aaatgcttctgagtggcaga

SEQ ID NO: 31753 - DNA, 20 bp, Artificial Sequence
  Description of Artificial Sequence: Synthetic oligonucleotide
  Target: SCN10A; (+) strand; PAM type: NRG; PAM sequence: CAG
tgagtggcagacagctgtca

SEQ ID NO: 31754 - DNA, 20 bp, Artificial Sequence
  Description of Artificial Sequence: Synthetic oligonucleotide
  Target: SCN10A; (+) strand; PAM type: NRG; PAM sequence: GAG
agtggcagacagctgtcaca

SEQ ID NO: 31755 - DNA, 20 bp, Artificial Sequence
  Description of Artificial Sequence: Synthetic oligonucleotide
  Target: SCN10A; (+) strand; PAM type: NRG; PAM sequence: TAG
tcatgctctctgctgttacc

SEQ ID NO: 31756 - DNA, 20 bp, Artificial Sequence
  Description of Artificial Sequence: Synthetic oligonucleotide
  Target: SCN10A; (+) strand; PAM type: NRG; PAM sequence: AAG
tctctgctgttacctagaca

SEQ ID NO: 31757 - DNA, 20 bp, Artificial Sequence
  Description of Artificial Sequence: Synthetic oligonucleotide
  Target: SCN10A; (+) strand; PAM type: NRG; PAM sequence: AGG
ctctgctgttacctagacaa

SEQ ID NO: 31758 - DNA, 20 bp, Artificial Sequence
  Description of Artificial Sequence: Synthetic oligonucleotide
  Target: SCN10A; (+) strand; PAM type: NRG; PAM sequence: TGG
agacaaaggcatgtaaaata

SEQ ID NO: 31759 - DNA, 20 bp, Artificial Sequence
  Description of Artificial Sequence: Synthetic oligonucleotide
  Target: SCN10A; (+) strand; PAM type: NRG; PAM sequence: CAG
caaaggcatgtaaaatatgg

SEQ ID NO: 31760 - DNA, 20 bp, Artificial Sequence
  Description of Artificial Sequence: Synthetic oligonucleotide
  Target: SCN10A; (+) strand; PAM type: NRG; PAM sequence: CAG
taaaatatggcagctgataa

SEQ ID NO: 31761 - DNA, 20 bp, Artificial Sequence
  Description of Artificial Sequence: Synthetic oligonucleotide
  Target: SCN10A; (+) strand; PAM type: NRG; PAM sequence: CAG
aatatggcagctgataacag

SEQ ID NO: 31762 - DNA, 20 bp, Artificial Sequence
  Description of Artificial Sequence: Synthetic oligonucleotide
  Target: SCN10A; (+) strand; PAM type: NRG; PAM sequence: TGG
cagctgataacagcagctgc

SEQ ID NO: 31763 - DNA, 20 bp, Artificial Sequence
  Description of Artificial Sequence: Synthetic oligonucleotide
  Target: SCN10A; (+) strand; PAM type: NRG; PAM sequence: AAG
aacagcagctgctggaacac

SEQ ID NO: 31764 - DNA, 20 bp, Artificial Sequence
  Description of Artificial Sequence: Synthetic oligonucleotide
  Target: SCN10A; (+) strand; PAM type: NRG; PAM sequence: CAG
tggaacacaagtgacgactg

SEQ ID NO: 31765 - DNA, 20 bp, Artificial Sequence
  Description of Artificial Sequence: Synthetic oligonucleotide
  Target: SCN10A; (+) strand; PAM type: NRG; PAM sequence: AGG
ggaacacaagtgacgactgc

SEQ ID NO: 31766 - DNA, 20 bp, Artificial Sequence
  Description of Artificial Sequence: Synthetic oligonucleotide
  Target: SCN10A; (+) strand; PAM type: NRG; PAM sequence: GGG
gaacacaagtgacgactgca

SEQ ID NO: 31767 - DNA, 20 bp, Artificial Sequence
  Description of Artificial Sequence: Synthetic oligonucleotide
  Target: SCN10A; (+) strand; PAM type: NRG; PAM sequence: AAG
cacaagtgacgactgcaggg

SEQ ID NO: 31768 - DNA, 20 bp, Artificial Sequence
  Description of Artificial Sequence: Synthetic oligonucleotide
  Target: SCN10A; (+) strand; PAM type: NRG; PAM sequence: AAG
aagtgacgactgcagggaag

SEQ ID NO: 31769 - DNA, 20 bp, Artificial Sequence
  Description of Artificial Sequence: Synthetic oligonucleotide
  Target: SCN10A; (+) strand; PAM type: NRG; PAM sequence: AGG
agtgacgactgcagggaaga

SEQ ID NO: 31770 - DNA, 20 bp, Artificial Sequence
  Description of Artificial Sequence: Synthetic oligonucleotide
  Target: SCN10A; (+) strand; PAM type: NRG; PAM sequence: TGG
gactgcagggaagaaggcta

SEQ ID NO: 31771 - DNA, 20 bp, Artificial Sequence
  Description of Artificial Sequence: Synthetic oligonucleotide
  Target: SCN10A; (+) strand; PAM type: NRG; PAM sequence: GGG
actgcagggaagaaggctat

SEQ ID NO: 31772 - DNA, 20 bp, Artificial Sequence
  Description of Artificial Sequence: Synthetic oligonucleotide
  Target: SCN10A; (+) strand; PAM type: NRG; PAM sequence: GAG
tgcagggaagaaggctatgg

SEQ ID NO: 31773 - DNA, 20 bp, Artificial Sequence
  Description of Artificial Sequence: Synthetic oligonucleotide
  Target: SCN10A; (+) strand; PAM type: NRG; PAM sequence: GAG
cagggaagaaggctatggga

SEQ ID NO: 31774 - DNA, 20 bp, Artificial Sequence
  Description of Artificial Sequence: Synthetic oligonucleotide
  Target: SCN10A; (+) strand; PAM type: NRG; PAM sequence: CAG
agaaggctatgggagagcta

SEQ ID NO: 31775 - DNA, 20 bp, Artificial Sequence
  Description of Artificial Sequence: Synthetic oligonucleotide
  Target: SCN10A; (+) strand; PAM type: NRG; PAM sequence: AAG
atgggagagctacagactca

SEQ ID NO: 31776 - DNA, 20 bp, Artificial Sequence
  Description of Artificial Sequence: Synthetic oligonucleotide
  Target: SCN10A; (+) strand; PAM type: NRG; PAM sequence: CAG
agagctacagactcaaagca

SEQ ID NO: 31777 - DNA, 20 bp, Artificial Sequence
  Description of Artificial Sequence: Synthetic oligonucleotide
  Target: SCN10A; (+) strand; PAM type: NRG; PAM sequence: TGG
gactcaaagcacagcttttc

SEQ ID NO: 31778 - DNA, 20 bp, Artificial Sequence
  Description of Artificial Sequence: Synthetic oligonucleotide
  Target: SCN10A; (+) strand; PAM type: NRG; PAM sequence: TAG
cacagcttttctggaccact

SEQ ID NO: 31779 - DNA, 20 bp, Artificial Sequence
  Description of Artificial Sequence: Synthetic oligonucleotide
  Target: SCN10A; (+) strand; PAM type: NRG; PAM sequence: TGG
ttctggaccacttagtaacc

SEQ ID NO: 31780 - DNA, 20 bp, Artificial Sequence
  Description of Artificial Sequence: Synthetic oligonucleotide
  Target: SCN10A; (+) strand; PAM type: NRG; PAM sequence: CAG
ggaccacttagtaacctggc

SEQ ID NO: 31781 - DNA, 20 bp, Artificial Sequence
  Description of Artificial Sequence: Synthetic oligonucleotide
  Target: SCN10A; (+) strand; PAM type: NRG; PAM sequence: CAG
ccacttagtaacctggccag

SEQ ID NO: 31782 - DNA, 20 bp, Artificial Sequence
  Description of Artificial Sequence: Synthetic oligonucleotide
  Target: SCN10A; (+) strand; PAM type: NRG; PAM sequence: GAG
cagcagccctgcatgttcct

SEQ ID NO: 31783 - DNA, 20 bp, Artificial Sequence
  Description of Artificial Sequence: Synthetic oligonucleotide
  Target: SCN10A; (+) strand; PAM type: NRG; PAM sequence: AGG
agcagccctgcatgttcctg

SEQ ID NO: 31784 - DNA, 20 bp, Artificial Sequence
  Description of Artificial Sequence: Synthetic oligonucleotide
  Target: SCN10A; (+) strand; PAM type: NRG; PAM sequence: CAG
tgcatgttcctgaggcctca

SEQ ID NO: 31785 - DNA, 20 bp, Artificial Sequence
  Description of Artificial Sequence: Synthetic oligonucleotide
  Target: SCN10A; (+) strand; PAM type: NRG; PAM sequence: AGG
gcatgttcctgaggcctcac

SEQ ID NO: 31786 - DNA, 20 bp, Artificial Sequence
  Description of Artificial Sequence: Synthetic oligonucleotide
  Target: SCN10A; (+) strand; PAM type: NRG; PAM sequence: GGG
catgttcctgaggcctcaca

SEQ ID NO: 31787 - DNA, 20 bp, Artificial Sequence
  Description of Artificial Sequence: Synthetic oligonucleotide
  Target: SCN10A; (+) strand; PAM type: NRG; PAM sequence: TGG
ggttccctgccttcccacgt

SEQ ID NO: 31788 - DNA, 20 bp, Artificial Sequence
  Description of Artificial Sequence: Synthetic oligonucleotide
  Target: SCN10A; (+) strand; PAM type: NRG; PAM sequence: GGG
gttccctgccttcccacgtt

SEQ ID NO: 31789 - DNA, 20 bp, Artificial Sequence
  Description of Artificial Sequence: Synthetic oligonucleotide
  Target: SCN10A; (+) strand; PAM type: NRG; PAM sequence: CAG
ccctgccttcccacgttggg

SEQ ID NO: 31790 - DNA, 20 bp, Artificial Sequence
  Description of Artificial Sequence: Synthetic oligonucleotide
  Target: SCN10A; (+) strand; PAM type: NRG; PAM sequence: GAG
ctgccttcccacgttgggca

SEQ ID NO: 31791 - DNA, 20 bp, Artificial Sequence
  Description of Artificial Sequence: Synthetic oligonucleotide
  Target: SCN10A; (+) strand; PAM type: NRG; PAM sequence: AGG
tgccttcccacgttgggcag

SEQ ID NO: 31792 - DNA, 20 bp, Artificial Sequence
  Description of Artificial Sequence: Synthetic oligonucleotide
  Target: SCN10A; (+) strand; PAM type: NRG; PAM sequence: GAG
tgggcagaggtgaatgccct

SEQ ID NO: 31793 - DNA, 20 bp, Artificial Sequence
  Description of Artificial Sequence: Synthetic oligonucleotide
  Target: SCN10A; (+) strand; PAM type: NRG; PAM sequence: GAG
ggtgaatgccctgagttact

SEQ ID NO: 31794 - DNA, 20 bp, Artificial Sequence
  Description of Artificial Sequence: Synthetic oligonucleotide
  Target: SCN10A; (+) strand; PAM type: NRG; PAM sequence: AAG
gaatgccctgagttactgag

SEQ ID NO: 31795 - DNA, 20 bp, Artificial Sequence
  Description of Artificial Sequence: Synthetic oligonucleotide
  Target: SCN10A; (+) strand; PAM type: NRG; PAM sequence: GAG
atgccctgagttactgagaa

SEQ ID NO: 31796 - DNA, 20 bp, Artificial Sequence
  Description of Artificial Sequence: Synthetic oligonucleotide
  Target: SCN10A; (+) strand; PAM type: NRG; PAM sequence: AGG
tgccctgagttactgagaag

SEQ ID NO: 31797 - DNA, 20 bp, Artificial Sequence
  Description of Artificial Sequence: Synthetic oligonucleotide
  Target: SCN10A; (+) strand; PAM type: NRG; PAM sequence: TAG
ctgagttactgagaagaggt

SEQ ID NO: 31798 - DNA, 20 bp, Artificial Sequence
  Description of Artificial Sequence: Synthetic oligonucleotide
  Target: SCN10A; (+) strand; PAM type: NRG; PAM sequence: GAG
gttactgagaagaggttagc

SEQ ID NO: 31799 - DNA, 20 bp, Artificial Sequence
  Description of Artificial Sequence: Synthetic oligonucleotide
  Target: SCN10A; (+) strand; PAM type: NRG; PAM sequence: AGG
ttactgagaagaggttagcg

SEQ ID NO: 31800 - DNA, 20 bp, Artificial Sequence
  Description of Artificial Sequence: Synthetic oligonucleotide
  Target: SCN10A; (+) strand; PAM type: NRG; PAM sequence: GGG
tactgagaagaggttagcga

SEQ ID NO: 31801 - DNA, 20 bp, Artificial Sequence
  Description of Artificial Sequence: Synthetic oligonucleotide
  Target: SCN10A; (+) strand; PAM type: NRG; PAM sequence: CAG
gttagcgagggttgatatac

SEQ ID NO: 31802 - DNA, 20 bp, Artificial Sequence
  Description of Artificial Sequence: Synthetic oligonucleotide
  Target: SCN10A; (+) strand; PAM type: NRG; PAM sequence: AAG
gagggttgatataccagctt

SEQ ID NO: 31803 - DNA, 20 bp, Artificial Sequence
  Description of Artificial Sequence: Synthetic oligonucleotide
  Target: SCN10A; (+) strand; PAM type: NRG; PAM sequence: AGG
agggttgatataccagctta

SEQ ID NO: 31804 - DNA, 20 bp, Artificial Sequence
  Description of Artificial Sequence: Synthetic oligonucleotide
  Target: SCN10A; (+) strand; PAM type: NRG; PAM sequence: TAG
gttgatataccagcttaagg

SEQ ID NO: 31805 - DNA, 20 bp, Artificial Sequence
  Description of Artificial Sequence: Synthetic oligonucleotide
  Target: SCN10A; (+) strand; PAM type: NRG; PAM sequence: AAG
atataccagcttaaggtagt

SEQ ID NO: 31806 - DNA, 20 bp, Artificial Sequence
  Description of Artificial Sequence: Synthetic oligonucleotide
  Target: SCN10A; (+) strand; PAM type: NRG; PAM sequence: AGG
tataccagcttaaggtagta

SEQ ID NO: 31807 - DNA, 20 bp, Artificial Sequence
  Description of Artificial Sequence: Synthetic oligonucleotide
  Target: SCN10A; (+) strand; PAM type: NRG; PAM sequence: TAG
cagcttaaggtagtaaggaa

SEQ ID NO: 31808 - DNA, 20 bp, Artificial Sequence
  Description of Artificial Sequence: Synthetic oligonucleotide
  Target: SCN10A; (+) strand; PAM type: NRG; PAM sequence: AAG
aggtagtaaggaatagtgcc

SEQ ID NO: 31809 - DNA, 20 bp, Artificial Sequence
  Description of Artificial Sequence: Synthetic oligonucleotide
  Target: SCN10A; (+) strand; PAM type: NRG; PAM sequence: TGG
taaaaatatatattatcaaa

SEQ ID NO: 31810 - DNA, 20 bp, Artificial Sequence
  Description of Artificial Sequence: Synthetic oligonucleotide
  Target: SCN10A; (+) strand; PAM type: NRG; PAM sequence: TAG
ggctcaaatgtgctttaaat

SEQ ID NO: 31811 - DNA, 20 bp, Artificial Sequence
  Description of Artificial Sequence: Synthetic oligonucleotide
  Target: SCN10A; (+) strand; PAM type: NRG; PAM sequence: TGG
caaatgtgctttaaattagt

SEQ ID NO: 31812 - DNA, 20 bp, Artificial Sequence
  Description of Artificial Sequence: Synthetic oligonucleotide
  Target: SCN10A; (+) strand; PAM type: NRG; PAM sequence: AAG
tttaaattagttggtgccaa

SEQ ID NO: 31813 - DNA, 20 bp, Artificial Sequence
  Description of Artificial Sequence: Synthetic oligonucleotide
  Target: SCN10A; (+) strand; PAM type: NRG; PAM sequence: AGG
ttaaattagttggtgccaaa

SEQ ID NO: 31814 - DNA, 20 bp, Artificial Sequence
  Description of Artificial Sequence: Synthetic oligonucleotide
  Target: SCN10A; (+) strand; PAM type: NRG; PAM sequence: GAG
aaattagttggtgccaaaag

SEQ ID NO: 31815 - DNA, 20 bp, Artificial Sequence
  Description of Artificial Sequence: Synthetic oligonucleotide
  Target: SCN10A; (+) strand; PAM type: NRG; PAM sequence: TGG
tttccctgtgataccacttg

SEQ ID NO: 31816 - DNA, 20 bp, Artificial Sequence
  Description of Artificial Sequence: Synthetic oligonucleotide
  Target: SCN10A; (+) strand; PAM type: NRG; PAM sequence: GGG
ttccctgtgataccacttgt

SEQ ID NO: 31817 - DNA, 20 bp, Artificial Sequence
  Description of Artificial Sequence: Synthetic oligonucleotide
  Target: SCN10A; (+) strand; PAM type: NRG; PAM sequence: GGG
tccctgtgataccacttgtg

SEQ ID NO: 31818 - DNA, 20 bp, Artificial Sequence
  Description of Artificial Sequence: Synthetic oligonucleotide
  Target: SCN10A; (+) strand; PAM type: NRG; PAM sequence: AAG
gtgataccacttgtggggaa

SEQ ID NO: 31819 - DNA, 20 bp, Artificial Sequence
  Description of Artificial Sequence: Synthetic oligonucleotide
  Target: SCN10A; (+) strand; PAM type: NRG; PAM sequence: TGG
taccacttgtggggaaaagc

SEQ ID NO: 31820 - DNA, 20 bp, Artificial Sequence
  Description of Artificial Sequence: Synthetic oligonucleotide
  Target: SCN10A; (+) strand; PAM type: NRG; PAM sequence: GAG
tggggaaaagctggctaaat

SEQ ID NO: 31821 - DNA, 20 bp, Artificial Sequence
  Description of Artificial Sequence: Synthetic oligonucleotide
  Target: SCN10A; (+) strand; PAM type: NRG; PAM sequence: AAG
gctggctaaatgagtcacat

SEQ ID NO: 31822 - DNA, 20 bp, Artificial Sequence
  Description of Artificial Sequence: Synthetic oligonucleotide
  Target: SCN10A; (+) strand; PAM type: NRG; PAM sequence: CAG
taaatgagtcacataagaat

SEQ ID NO: 31823 - DNA, 20 bp, Artificial Sequence
  Description of Artificial Sequence: Synthetic oligonucleotide
  Target: SCN10A; (+) strand; PAM type: NRG; PAM sequence: AGG
aaatgagtcacataagaatc

SEQ ID NO: 31824 - DNA, 20 bp, Artificial Sequence
  Description of Artificial Sequence: Synthetic oligonucleotide
  Target: SCN10A; (+) strand; PAM type: NRG; PAM sequence: TAG
acataagaatcaggacttct

SEQ ID NO: 31825 - DNA, 20 bp, Artificial Sequence
  Description of Artificial Sequence: Synthetic oligonucleotide
  Target: SCN10A; (+) strand; PAM type: NRG; PAM sequence: AGG
cataagaatcaggacttctt

SEQ ID NO: 31826 - DNA, 20 bp, Artificial Sequence
  Description of Artificial Sequence: Synthetic oligonucleotide
  Target: SCN10A; (+) strand; PAM type: NRG; PAM sequence: TGG
atcaggacttcttaggatgc

SEQ ID NO: 31827 - DNA, 20 bp, Artificial Sequence
  Description of Artificial Sequence: Synthetic oligonucleotide
  Target: SCN10A; (+) strand; PAM type: NRG; PAM sequence: AAG
gacttcttaggatgctggta

SEQ ID NO: 31828 - DNA, 20 bp, Artificial Sequence
  Description of Artificial Sequence: Synthetic oligonucleotide
  Target: SCN10A; (+) strand; PAM type: NRG; PAM sequence: TAG
cttaggatgctggtaaagat

SEQ ID NO: 31829 - DNA, 20 bp, Artificial Sequence
  Description of Artificial Sequence: Synthetic oligonucleotide
  Target: SCN10A; (+) strand; PAM type: NRG; PAM sequence: GAG
gatgctggtaaagattagat

SEQ ID NO: 31830 - DNA, 20 bp, Artificial Sequence
  Description of Artificial Sequence: Synthetic oligonucleotide
  Target: SCN10A; (+) strand; PAM type: NRG; PAM sequence: TGG
gattagatgagccttgctct

SEQ ID NO: 31831 - DNA, 20 bp, Artificial Sequence
  Description of Artificial Sequence: Synthetic oligonucleotide
  Target: SCN10A; (+) strand; PAM type: NRG; PAM sequence: TAG
cttggacaacatcctgttct

SEQ ID NO: 31832 - DNA, 20 bp, Artificial Sequence
  Description of Artificial Sequence: Synthetic oligonucleotide
  Target: SCN10A; (+) strand; PAM type: NRG; PAM sequence: GAG
tggacaacatcctgttctta

SEQ ID NO: 31833 - DNA, 20 bp, Artificial Sequence
  Description of Artificial Sequence: Synthetic oligonucleotide
  Target: SCN10A; (+) strand; PAM type: NRG; PAM sequence: TAG
tgttcttagagaaatctcat

SEQ ID NO: 31834 - DNA, 20 bp, Artificial Sequence
  Description of Artificial Sequence: Synthetic oligonucleotide
  Target: SCN10A; (+) strand; PAM type: NRG; PAM sequence: CAG
tctcattagcatctcatgca

SEQ ID NO: 31835 - DNA, 20 bp, Artificial Sequence
  Description of Artificial Sequence: Synthetic oligonucleotide
  Target: SCN10A; (+) strand; PAM type: NRG; PAM sequence: GAG
tcattagcatctcatgcaca

SEQ ID NO: 31836 - DNA, 20 bp, Artificial Sequence
  Description of Artificial Sequence: Synthetic oligonucleotide
  Target: SCN10A; (+) strand; PAM type: NRG; PAM sequence: TGG
agcatctcatgcacagagcc

SEQ ID NO: 31837 - DNA, 20 bp, Artificial Sequence
  Description of Artificial Sequence: Synthetic oligonucleotide
  Target: SCN10A; (+) strand; PAM type: NRG; PAM sequence: GGG
gcatctcatgcacagagcct

SEQ ID NO: 31838 - DNA, 20 bp, Artificial Sequence
  Description of Artificial Sequence: Synthetic oligonucleotide
  Target: SCN10A; (+) strand; PAM type: NRG; PAM sequence: TGG
ctcatgcacagagcctgggt

SEQ ID NO: 31839 - DNA, 20 bp, Artificial Sequence
  Description of Artificial Sequence: Synthetic oligonucleotide
  Target: SCN10A; (+) strand; PAM type: NRG; PAM sequence: GGG
tcatgcacagagcctgggtt

SEQ ID NO: 31840 - DNA, 20 bp, Artificial Sequence
  Description of Artificial Sequence: Synthetic oligonucleotide
  Target: SCN10A; (+) strand; PAM type: NRG; PAM sequence: CAG
tgcacagagcctgggttggg

SEQ ID NO: 31841 - DNA, 20 bp, Artificial Sequence
  Description of Artificial Sequence: Synthetic oligonucleotide
  Target: SCN10A; (+) strand; PAM type: NRG; PAM sequence: GAG
cacagagcctgggttgggca

SEQ ID NO: 31842 - DNA, 20 bp, Artificial Sequence
  Description of Artificial Sequence: Synthetic oligonucleotide
  Target: SCN10A; (+) strand; PAM type: NRG; PAM sequence: TGG
cctgggttgggcagagcgca

SEQ ID NO: 31843 - DNA, 20 bp, Artificial Sequence
  Description of Artificial Sequence: Synthetic oligonucleotide
  Target: SCN10A; (+) strand; PAM type: NRG; PAM sequence: GGG
ctgggttgggcagagcgcat

SEQ ID NO: 31844 - DNA, 20 bp, Artificial Sequence
  Description of Artificial Sequence: Synthetic oligonucleotide
  Target: SCN10A; (+) strand; PAM type: NRG; PAM sequence: CAG
gttgggcagagcgcatggga

SEQ ID NO: 31845 - DNA, 20 bp, Artificial Sequence
  Description of Artificial Sequence: Synthetic oligonucleotide
  Target: SCN10A; (+) strand; PAM type: NRG; PAM sequence: AAG
cgcatgggacagctgtgtga

SEQ ID NO: 31846 - DNA, 20 bp, Artificial Sequence
  Description of Artificial Sequence: Synthetic oligonucleotide
  Target: SCN10A; (+) strand; PAM type: NRG; PAM sequence: AAG
ctgtgtgaaagacaatcccc

SEQ ID NO: 31847 - DNA, 20 bp, Artificial Sequence
  Description of Artificial Sequence: Synthetic oligonucleotide
  Target: SCN10A; (+) strand; PAM type: NRG; PAM sequence: AAG
agacaatccccaagcacctc

SEQ ID NO: 31848 - DNA, 20 bp, Artificial Sequence
  Description of Artificial Sequence: Synthetic oligonucleotide
  Target: SCN10A; (+) strand; PAM type: NRG; PAM sequence: AGG
gacaatccccaagcacctca

SEQ ID NO: 31849 - DNA, 20 bp, Artificial Sequence
  Description of Artificial Sequence: Synthetic oligonucleotide
  Target: SCN10A; (+) strand; PAM type: NRG; PAM sequence: TGG
aatccccaagcacctcaagg

SEQ ID NO: 31850 - DNA, 20 bp, Artificial Sequence
  Description of Artificial Sequence: Synthetic oligonucleotide
  Target: SCN10A; (+) strand; PAM type: NRG; PAM sequence: TGG
ccactccctgtttgtctgcc

SEQ ID NO: 31851 - DNA, 20 bp, Artificial Sequence
  Description of Artificial Sequence: Synthetic oligonucleotide
  Target: SCN10A; (+) strand; PAM type: NRG; PAM sequence: GGG
cactccctgtttgtctgcct

SEQ ID NO: 31852 - DNA, 20 bp, Artificial Sequence
  Description of Artificial Sequence: Synthetic oligonucleotide
  Target: SCN10A; (+) strand; PAM type: NRG; PAM sequence: GGG
actccctgtttgtctgcctg

SEQ ID NO: 31853 - DNA, 20 bp, Artificial Sequence
  Description of Artificial Sequence: Synthetic oligonucleotide
  Target: SCN10A; (+) strand; PAM type: NRG; PAM sequence: CAG
ggaattctgactttttcttc

SEQ ID NO: 31854 - DNA, 20 bp, Artificial Sequence
  Description of Artificial Sequence: Synthetic oligonucleotide
  Target: SCN10A; (+) strand; PAM type: NRG; PAM sequence: AGG
gaattctgactttttcttcc

SEQ ID NO: 31855 - DNA, 20 bp, Artificial Sequence
  Description of Artificial Sequence: Synthetic oligonucleotide
  Target: SCN10A; (+) strand; PAM type: NRG; PAM sequence: TGG
tgctcaaacgccaactcctc

SEQ ID NO: 31856 - DNA, 20 bp, Artificial Sequence
  Description of Artificial Sequence: Synthetic oligonucleotide
  Target: SCN10A; (+) strand; PAM type: NRG; PAM sequence: AAG
caaacgccaactcctctgga

SEQ ID NO: 31857 - DNA, 20 bp, Artificial Sequence
  Description of Artificial Sequence: Synthetic oligonucleotide
  Target: SCN10A; (+) strand; PAM type: NRG; PAM sequence: TGG
gccaactcctctggaaagct

SEQ ID NO: 31858 - DNA, 20 bp, Artificial Sequence
  Description of Artificial Sequence: Synthetic oligonucleotide
  Target: SCN10A; (+) strand; PAM type: NRG; PAM sequence: TGG
ctcctctggaaagcttggca

SEQ ID NO: 31859 - DNA, 20 bp, Artificial Sequence
  Description of Artificial Sequence: Synthetic oligonucleotide
  Target: SCN10A; (+) strand; PAM type: NRG; PAM sequence: AAG
ggtttaaacttctttatgtc

SEQ ID NO: 31860 - DNA, 20 bp, Artificial Sequence
  Description of Artificial Sequence: Synthetic oligonucleotide
  Target: SCN10A; (+) strand; PAM type: NRG; PAM sequence: AGG
gtttaaacttctttatgtca

SEQ ID NO: 31861 - DNA, 20 bp, Artificial Sequence
  Description of Artificial Sequence: Synthetic oligonucleotide
  Target: SCN10A; (+) strand; PAM type: NRG; PAM sequence: AAG
ccttttgccctttgtcactc

SEQ ID NO: 31862 - DNA, 20 bp, Artificial Sequence
  Description of Artificial Sequence: Synthetic oligonucleotide
  Target: SCN10A; (+) strand; PAM type: NRG; PAM sequence: AAG
cctttgtcactcaagccctg

SEQ ID NO: 31863 - DNA, 20 bp, Artificial Sequence
  Description of Artificial Sequence: Synthetic oligonucleotide
  Target: SCN10A; (+) strand; PAM type: NRG; PAM sequence: TGG
aagcccctccccactgcctg

SEQ ID NO: 31864 - DNA, 20 bp, Artificial Sequence
  Description of Artificial Sequence: Synthetic oligonucleotide
  Target: SCN10A; (+) strand; PAM type: NRG; PAM sequence: TGG
cactgcctgtggctgtccct

SEQ ID NO: 31865 - DNA, 20 bp, Artificial Sequence
  Description of Artificial Sequence: Synthetic oligonucleotide
  Target: SCN10A; (+) strand; PAM type: NRG; PAM sequence: GGG
actgcctgtggctgtccctt

SEQ ID NO: 31866 - DNA, 20 bp, Artificial Sequence
  Description of Artificial Sequence: Synthetic oligonucleotide
  Target: SCN10A; (+) strand; PAM type: NRG; PAM sequence: GGG
ctgcctgtggctgtcccttg

SEQ ID NO: 31867 - DNA, 20 bp, Artificial Sequence
  Description of Artificial Sequence: Synthetic oligonucleotide
  Target: SCN10A; (+) strand; PAM type: NRG; PAM sequence: TGG
gataactcttacctgtcctt

SEQ ID NO: 31868 - DNA, 20 bp, Artificial Sequence
  Description of Artificial Sequence: Synthetic oligonucleotide
  Target: SCN10A; (+) strand; PAM type: NRG; PAM sequence: GGG
ataactcttacctgtccttt

SEQ ID NO: 31869 - DNA, 20 bp, Artificial Sequence
  Description of Artificial Sequence: Synthetic oligonucleotide
  Target: SCN10A; (+) strand; PAM type: NRG; PAM sequence: GGG
taactcttacctgtcctttg

SEQ ID NO: 31870 - DNA, 20 bp, Artificial Sequence
  Description of Artificial Sequence: Synthetic oligonucleotide
  Target: SCN10A; (+) strand; PAM type: NRG; PAM sequence: TGG
ctttggggatcacttcctgc

SEQ ID NO: 31871 - DNA, 20 bp, Artificial Sequence
  Description of Artificial Sequence: Synthetic oligonucleotide
  Target: SCN10A; (+) strand; PAM type: NRG; PAM sequence: AAG
tggggatcacttcctgctgg

SEQ ID NO: 31872 - DNA, 20 bp, Artificial Sequence
  Description of Artificial Sequence: Synthetic oligonucleotide
  Target: SCN10A; (+) strand; PAM type: NRG; PAM sequence: GAG
cacttcctgctggaagctct

SEQ ID NO: 31873 - DNA, 20 bp, Artificial Sequence
  Description of Artificial Sequence: Synthetic oligonucleotide
  Target: SCN10A; (+) strand; PAM type: NRG; PAM sequence: AAG
cttccccaccatcatcctcc

SEQ ID NO: 31874 - DNA, 20 bp, Artificial Sequence
  Description of Artificial Sequence: Synthetic oligonucleotide
  Target: SCN10A; (+) strand; PAM type: NRG; PAM sequence: AAG
ccatcatcctccaagtcatc

SEQ ID NO: 31875 - DNA, 20 bp, Artificial Sequence
  Description of Artificial Sequence: Synthetic oligonucleotide
  Target: SCN10A; (+) strand; PAM type: NRG; PAM sequence: CAG
atcctccaagtcatcaagat

SEQ ID NO: 31876 - DNA, 20 bp, Artificial Sequence
  Description of Artificial Sequence: Synthetic oligonucleotide
  Target: SCN10A; (+) strand; PAM type: NRG; PAM sequence: CAG
atcaagatcagattcaccct

SEQ ID NO: 31877 - DNA, 20 bp, Artificial Sequence
  Description of Artificial Sequence: Synthetic oligonucleotide
  Target: SCN10A; (+) strand; PAM type: NRG; PAM sequence: TGG
atcagattcaccctcagcaa

SEQ ID NO: 31878 - DNA, 20 bp, Artificial Sequence
  Description of Artificial Sequence: Synthetic oligonucleotide
  Target: SCN10A; (+) strand; PAM type: NRG; PAM sequence: GGG
tcagattcaccctcagcaat

SEQ ID NO: 31879 - DNA, 20 bp, Artificial Sequence
  Description of Artificial Sequence: Synthetic oligonucleotide
  Target: SCN10A; (+) strand; PAM type: NRG; PAM sequence: CAG
ttcaccctcagcaatgggca

SEQ ID NO: 31880 - DNA, 20 bp, Artificial Sequence
  Description of Artificial Sequence: Synthetic oligonucleotide
  Target: SCN10A; (+) strand; PAM type: NRG; PAM sequence: GAG
caccctcagcaatgggcaca

SEQ ID NO: 31881 - DNA, 20 bp, Artificial Sequence
  Description of Artificial Sequence: Synthetic oligonucleotide
  Target: SCN10A; (+) strand; PAM type: NRG; PAM sequence: CAG
aatgggcacagagacccaca

SEQ ID NO: 31882 - DNA, 20 bp, Artificial Sequence
  Description of Artificial Sequence: Synthetic oligonucleotide
  Target: SCN10A; (+) strand; PAM type: NRG; PAM sequence: CGG
ggcacagagacccacacagt

SEQ ID NO: 31883 - DNA, 20 bp, Artificial Sequence
  Description of Artificial Sequence: Synthetic oligonucleotide
  Target: SCN10A; (+) strand; PAM type: NRG; PAM sequence: TAG
agagacccacacagtcggat

SEQ ID NO: 31884 - DNA, 20 bp, Artificial Sequence
  Description of Artificial Sequence: Synthetic oligonucleotide
  Target: SCN10A; (+) strand; PAM type: NRG; PAM sequence: AAG
acacagtcggattagcgatg

SEQ ID NO: 31885 - DNA, 20 bp, Artificial Sequence
  Description of Artificial Sequence: Synthetic oligonucleotide
  Target: SCN10A; (+) strand; PAM type: NRG; PAM sequence: TGG
gaagtcactgtgctcatccc

SEQ ID NO: 31886 - DNA, 20 bp, Artificial Sequence
  Description of Artificial Sequence: Synthetic oligonucleotide
  Target: SCN10A; (+) strand; PAM type: NRG; PAM sequence: GGG
aagtcactgtgctcatccct

SEQ ID NO: 31887 - DNA, 20 bp, Artificial Sequence
  Description of Artificial Sequence: Synthetic oligonucleotide
  Target: SCN10A; (+) strand; PAM type: NRG; PAM sequence: GGG
agtcactgtgctcatccctg

SEQ ID NO: 31888 - DNA, 20 bp, Artificial Sequence
  Description of Artificial Sequence: Synthetic oligonucleotide
  Target: SCN10A; (+) strand; PAM type: NRG; PAM sequence: TGG
gtgctcatccctggggcctc

SEQ ID NO: 31889 - DNA, 20 bp, Artificial Sequence
  Description of Artificial Sequence: Synthetic oligonucleotide
  Target: SCN10A; (+) strand; PAM type: NRG; PAM sequence: GGG
tgctcatccctggggcctct

SEQ ID NO: 31890 - DNA, 20 bp, Artificial Sequence
  Description of Artificial Sequence: Synthetic oligonucleotide
  Target: SCN10A; (+) strand; PAM type: NRG; PAM sequence: GAG
ctcatccctggggcctctgg

SEQ ID NO: 31891 - DNA, 20 bp, Artificial Sequence
  Description of Artificial Sequence: Synthetic oligonucleotide
  Target: SCN10A; (+) strand; PAM type: NRG; PAM sequence: TGG
ccctggggcctctgggagct

SEQ ID NO: 31892 - DNA, 20 bp, Artificial Sequence
  Description of Artificial Sequence: Synthetic oligonucleotide
  Target: SCN10A; (+) strand; PAM type: NRG; PAM sequence: GAG
ctggggcctctgggagcttg

SEQ ID NO: 31893 - DNA, 20 bp, Artificial Sequence
  Description of Artificial Sequence: Synthetic oligonucleotide
  Target: SCN10A; (+) strand; PAM type: NRG; PAM sequence: CAG
tctgggagcttggagccctc

SEQ ID NO: 31894 - DNA, 20 bp, Artificial Sequence
  Description of Artificial Sequence: Synthetic oligonucleotide
  Target: SCN10A; (+) strand; PAM type: NRG; PAM sequence: GAG
tgggagcttggagccctcca

SEQ ID NO: 31895 - DNA, 20 bp, Artificial Sequence
  Description of Artificial Sequence: Synthetic oligonucleotide
  Target: SCN10A; (+) strand; PAM type: NRG; PAM sequence: TGG
gagccctccagagctccccc

SEQ ID NO: 31896 - DNA, 20 bp, Artificial Sequence
  Description of Artificial Sequence: Synthetic oligonucleotide
  Target: SCN10A; (+) strand; PAM type: NRG; PAM sequence: CAG
ccctccagagctccccctgg

SEQ ID NO: 31897 - DNA, 20 bp, Artificial Sequence
  Description of Artificial Sequence: Synthetic oligonucleotide
  Target: SCN10A; (+) strand; PAM type: NRG; PAM sequence: TGG
agagctccccctggcagtgt

SEQ ID NO: 31898 - DNA, 20 bp, Artificial Sequence
  Description of Artificial Sequence: Synthetic oligonucleotide
  Target: SCN10A; (+) strand; PAM type: NRG; PAM sequence: CAG
gctccccctggcagtgttgg

SEQ ID NO: 31899 - DNA, 20 bp, Artificial Sequence
  Description of Artificial Sequence: Synthetic oligonucleotide
  Target: SCN10A; (+) strand; PAM type: NRG; PAM sequence: TGG
tggcagtgttggcagcaatg

SEQ ID NO: 31900 - DNA, 20 bp, Artificial Sequence
  Description of Artificial Sequence: Synthetic oligonucleotide
  Target: SCN10A; (+) strand; PAM type: NRG; PAM sequence: CAG
gttggcagcaatgtggttct

SEQ ID NO: 31901 - DNA, 20 bp, Artificial Sequence
  Description of Artificial Sequence: Synthetic oligonucleotide
  Target: SCN10A; (+) strand; PAM type: NRG; PAM sequence: TGG
agcaatgtggttctcagcct

SEQ ID NO: 31902 - DNA, 20 bp, Artificial Sequence
  Description of Artificial Sequence: Synthetic oligonucleotide
  Target: SCN10A; (+) strand; PAM type: NRG; PAM sequence: GAG
caatgtggttctcagccttg

SEQ ID NO: 31903 - DNA, 20 bp, Artificial Sequence
  Description of Artificial Sequence: Synthetic oligonucleotide
  Target: SCN10A; (+) strand; PAM type: NRG; PAM sequence: TGG
gtggttctcagccttggagc

SEQ ID NO: 31904 - DNA, 20 bp, Artificial Sequence
  Description of Artificial Sequence: Synthetic oligonucleotide
  Target: SCN10A; (+) strand; PAM type: NRG; PAM sequence: GAG
ggttctcagccttggagctg

SEQ ID NO: 31905 - DNA, 20 bp, Artificial Sequence
  Description of Artificial Sequence: Synthetic oligonucleotide
  Target: SCN10A; (+) strand; PAM type: NRG; PAM sequence: GAG
ttctcagccttggagctgga

SEQ ID NO: 31906 - DNA, 20 bp, Artificial Sequence
  Description of Artificial Sequence: Synthetic oligonucleotide
  Target: SCN10A; (+) strand; PAM type: NRG; PAM sequence: TGG
tcagccttggagctggagag

SEQ ID NO: 31907 - DNA, 20 bp, Artificial Sequence
  Description of Artificial Sequence: Synthetic oligonucleotide
  Target: SCN10A; (+) strand; PAM type: NRG; PAM sequence: GGG
cagccttggagctggagagt

SEQ ID NO: 31908 - DNA, 20 bp, Artificial Sequence
  Description of Artificial Sequence: Synthetic oligonucleotide
  Target: SCN10A; (+) strand; PAM type: NRG; PAM sequence: GAG
gccttggagctggagagtgg

SEQ ID NO: 31909 - DNA, 20 bp, Artificial Sequence
  Description of Artificial Sequence: Synthetic oligonucleotide
  Target: SCN10A; (+) strand; PAM type: NRG; PAM sequence: CAG
gagagtgggagtttcaccac

SEQ ID NO: 31910 - DNA, 20 bp, Artificial Sequence
  Description of Artificial Sequence: Synthetic oligonucleotide
  Target: SCN10A; (+) strand; PAM type: NRG; PAM sequence: CAG
tgggagtttcaccaccagct

SEQ ID NO: 31911 - DNA, 20 bp, Artificial Sequence
  Description of Artificial Sequence: Synthetic oligonucleotide
  Target: SCN10A; (+) strand; PAM type: NRG; PAM sequence: AGG
gggagtttcaccaccagctc

SEQ ID NO: 31912 - DNA, 20 bp, Artificial Sequence
  Description of Artificial Sequence: Synthetic oligonucleotide
  Target: SCN10A; (+) strand; PAM type: NRG; PAM sequence: TGG
caccagctcaggctctgcct

SEQ ID NO: 31913 - DNA, 20 bp, Artificial Sequence
  Description of Artificial Sequence: Synthetic oligonucleotide
  Target: SCN10A; (+) strand; PAM type: NRG; PAM sequence: GGG
accagctcaggctctgcctt

SEQ ID NO: 31914 - DNA, 20 bp, Artificial Sequence
  Description of Artificial Sequence: Synthetic oligonucleotide
  Target: SCN10A; (+) strand; PAM type: NRG; PAM sequence: TGG
gctcaggctctgccttgggc

SEQ ID NO: 31915 - DNA, 20 bp, Artificial Sequence
  Description of Artificial Sequence: Synthetic oligonucleotide
  Target: SCN10A; (+) strand; PAM type: NRG; PAM sequence: GGG
ctcaggctctgccttgggct

SEQ ID NO: 31916 - DNA, 20 bp, Artificial Sequence
  Description of Artificial Sequence: Synthetic oligonucleotide
  Target: SCN10A; (+) strand; PAM type: NRG; PAM sequence: GGG
tcaggctctgccttgggctg

SEQ ID NO: 31917 - DNA, 20 bp, Artificial Sequence
  Description of Artificial Sequence: Synthetic oligonucleotide
  Target: SCN10A; (+) strand; PAM type: NRG; PAM sequence: GGG
caggctctgccttgggctgg

SEQ ID NO: 31918 - DNA, 20 bp, Artificial Sequence
  Description of Artificial Sequence: Synthetic oligonucleotide
  Target: SCN10A; (+) strand; PAM type: NRG; PAM sequence: TGG
tctgccttgggctgggggaa

SEQ ID NO: 31919 - DNA, 20 bp, Artificial Sequence
  Description of Artificial Sequence: Synthetic oligonucleotide
  Target: SCN10A; (+) strand; PAM type: NRG; PAM sequence: GGG
ctgccttgggctgggggaat

SEQ ID NO: 31920 - DNA, 20 bp, Artificial Sequence
  Description of Artificial Sequence: Synthetic oligonucleotide
  Target: SCN10A; (+) strand; PAM type: NRG; PAM sequence: CAG
ccttgggctgggggaatggg

SEQ ID NO: 31921 - DNA, 20 bp, Artificial Sequence
  Description of Artificial Sequence: Synthetic oligonucleotide
  Target: SCN10A; (+) strand; PAM type: NRG; PAM sequence: AGG
cttgggctgggggaatgggc

SEQ ID NO: 31922 - DNA, 20 bp, Artificial Sequence
  Description of Artificial Sequence: Synthetic oligonucleotide
  Target: SCN10A; (+) strand; PAM type: NRG; PAM sequence: AAG
ggaatgggcaggacctgctg

SEQ ID NO: 31923 - DNA, 20 bp, Artificial Sequence
  Description of Artificial Sequence: Synthetic oligonucleotide
  Target: SCN10A; (+) strand; PAM type: NRG; PAM sequence: AAG
atgggcaggacctgctgaag

SEQ ID NO: 31924 - DNA, 20 bp, Artificial Sequence
  Description of Artificial Sequence: Synthetic oligonucleotide
  Target: SCN10A; (+) strand; PAM type: NRG; PAM sequence: AAG
gacctgctgaagaagctgca

SEQ ID NO: 31925 - DNA, 20 bp, Artificial Sequence
  Description of Artificial Sequence: Synthetic oligonucleotide
  Target: SCN10A; (+) strand; PAM type: NRG; PAM sequence: GAG
cctgctgaagaagctgcaaa

SEQ ID NO: 31926 - DNA, 20 bp, Artificial Sequence
  Description of Artificial Sequence: Synthetic oligonucleotide
  Target: SCN10A; (+) strand; PAM type: NRG; PAM sequence: TGG
gaagctgcaaagagcctgtt

SEQ ID NO: 31927 - DNA, 20 bp, Artificial Sequence
  Description of Artificial Sequence: Synthetic oligonucleotide
  Target: SCN10A; (+) strand; PAM type: NRG; PAM sequence: TGG
aaagagcctgtttggtacga

SEQ ID NO: 31928 - DNA, 20 bp, Artificial Sequence
  Description of Artificial Sequence: Synthetic oligonucleotide
  Target: SCN10A; (+) strand; PAM type: NRG; PAM sequence: AAG
cctgtttggtacgatggcca

SEQ ID NO: 31929 - DNA, 20 bp, Artificial Sequence
  Description of Artificial Sequence: Synthetic oligonucleotide
  Target: SCN10A; (+) strand; PAM type: NRG; PAM sequence: TGG
tggtacgatggccaaagacc

SEQ ID NO: 31930 - DNA, 20 bp, Artificial Sequence
  Description of Artificial Sequence: Synthetic oligonucleotide
  Target: SCN10A; (+) strand; PAM type: NRG; PAM sequence: CAG
ccaaagacctggatccgtgc

SEQ ID NO: 31931 - DNA, 20 bp, Artificial Sequence
  Description of Artificial Sequence: Synthetic oligonucleotide
  Target: SCN10A; (+) strand; PAM type: NRG; PAM sequence: AGG
caaagacctggatccgtgcc

SEQ ID NO: 31932 - DNA, 20 bp, Artificial Sequence
  Description of Artificial Sequence: Synthetic oligonucleotide
  Target: SCN10A; (+) strand; PAM type: NRG; PAM sequence: GGG
aaagacctggatccgtgcca

SEQ ID NO: 31933 - DNA, 20 bp, Artificial Sequence
  Description of Artificial Sequence: Synthetic oligonucleotide
  Target: SCN10A; (+) strand; PAM type: NRG; PAM sequence: CAG
atccgtgccagggccacctg

SEQ ID NO: 31934 - DNA, 20 bp, Artificial Sequence
  Description of Artificial Sequence: Synthetic oligonucleotide
  Target: SCN10A; (+) strand; PAM type: NRG; PAM sequence: AGG
tccgtgccagggccacctgc

SEQ ID NO: 31935 - DNA, 20 bp, Artificial Sequence
  Description of Artificial Sequence: Synthetic oligonucleotide
  Target: SCN10A; (+) strand; PAM type: NRG; PAM sequence: CGG
ttcacctccccatcgtcctc

SEQ ID NO: 31936 - DNA, 20 bp, Artificial Sequence
  Description of Artificial Sequence: Synthetic oligonucleotide
  Target: SCN10A; (+) strand; PAM type: NRG; PAM sequence: GGG
tcacctccccatcgtcctcc

SEQ ID NO: 31937 - DNA, 20 bp, Artificial Sequence
  Description of Artificial Sequence: Synthetic oligonucleotide
  Target: SCN10A; (+) strand; PAM type: NRG; PAM sequence: GGG
cacctccccatcgtcctccg

SEQ ID NO: 31938 - DNA, 20 bp, Artificial Sequence
  Description of Artificial Sequence: Synthetic oligonucleotide
  Target: SCN10A; (+) strand; PAM type: NRG; PAM sequence: GAG
ccatcgtcctccggggctgt

SEQ ID NO: 31939 - DNA, 20 bp, Artificial Sequence
  Description of Artificial Sequence: Synthetic oligonucleotide
  Target: SCN10A; (+) strand; PAM type: NRG; PAM sequence: AGG
catcgtcctccggggctgtg

SEQ ID NO: 31940 - DNA, 20 bp, Artificial Sequence
  Description of Artificial Sequence: Synthetic oligonucleotide
  Target: SCN10A; (+) strand; PAM type: NRG; PAM sequence: CAG
ctccggggctgtgaggttgt

SEQ ID NO: 31941 - DNA, 20 bp, Artificial Sequence
  Description of Artificial Sequence: Synthetic oligonucleotide
  Target: SCN10A; (+) strand; PAM type: NRG; PAM sequence: AAG
tgtgaggttgtcagcactga

SEQ ID NO: 31942 - DNA, 20 bp, Artificial Sequence
  Description of Artificial Sequence: Synthetic oligonucleotide
  Target: SCN10A; (+) strand; PAM type: NRG; PAM sequence: GAG
tgaggttgtcagcactgaaa

SEQ ID NO: 31943 - DNA, 20 bp, Artificial Sequence
  Description of Artificial Sequence: Synthetic oligonucleotide
  Target: SCN10A; (+) strand; PAM type: NRG; PAM sequence: TAG
tcagcactgaaagagttcaa

SEQ ID NO: 31944 - DNA, 20 bp, Artificial Sequence
  Description of Artificial Sequence: Synthetic oligonucleotide
  Target: SCN10A; (+) strand; PAM type: NRG; PAM sequence: CAG
gcactgaaagagttcaatag

SEQ ID NO: 31945 - DNA, 20 bp, Artificial Sequence
  Description of Artificial Sequence: Synthetic oligonucleotide
  Target: SCN10A; (+) strand; PAM type: NRG; PAM sequence: AGG
cactgaaagagttcaatagc

SEQ ID NO: 31946 - DNA, 20 bp, Artificial Sequence
  Description of Artificial Sequence: Synthetic oligonucleotide
  Target: SCN10A; (+) strand; PAM type: NRG; PAM sequence: GGG
actgaaagagttcaatagca

SEQ ID NO: 31947 - DNA, 20 bp, Artificial Sequence
  Description of Artificial Sequence: Synthetic oligonucleotide
  Target: SCN10A; (+) strand; PAM type: NRG; PAM sequence: CAG
ttcaatagcagggcgatgaa

SEQ ID NO: 31948 - DNA, 20 bp, Artificial Sequence
  Description of Artificial Sequence: Synthetic oligonucleotide
  Target: SCN10A; (+) strand; PAM type: NRG; PAM sequence: AGG
tcaatagcagggcgatgaac

SEQ ID NO: 31949 - DNA, 20 bp, Artificial Sequence
  Description of Artificial Sequence: Synthetic oligonucleotide
  Target: SCN10A; (+) strand; PAM type: NRG; PAM sequence: AAG
agcagggcgatgaacaggtt

SEQ ID NO: 31950 - DNA, 20 bp, Artificial Sequence
  Description of Artificial Sequence: Synthetic oligonucleotide
  Target: SCN10A; (+) strand; PAM type: NRG; PAM sequence: AAG
atgaacaggttaagcacctg

SEQ ID NO: 31951 - DNA, 20 bp, Artificial Sequence
  Description of Artificial Sequence: Synthetic oligonucleotide
  Target: SCN10A; (+) strand; PAM type: NRG; PAM sequence: GAG
gaacaggttaagcacctgaa

SEQ ID NO: 31952 - DNA, 20 bp, Artificial Sequence
  Description of Artificial Sequence: Synthetic oligonucleotide
  Target: SCN10A; (+) strand; PAM type: NRG; PAM sequence: AAG
caggttaagcacctgaagag

SEQ ID NO: 31953 - DNA, 20 bp, Artificial Sequence
  Description of Artificial Sequence: Synthetic oligonucleotide
  Target: SCN10A; (+) strand; PAM type: NRG; PAM sequence: AGG
aggttaagcacctgaagaga

SEQ ID NO: 31954 - DNA, 20 bp, Artificial Sequence
  Description of Artificial Sequence: Synthetic oligonucleotide
  Target: SCN10A; (+) strand; PAM type: NRG; PAM sequence: TGG
aagcacctgaagagaaggaa

SEQ ID NO: 31955 - DNA, 20 bp, Artificial Sequence
  Description of Artificial Sequence: Synthetic oligonucleotide
  Target: SCN10A; (+) strand; PAM type: NRG; PAM sequence: AAG
cacctgaagagaaggaatgg

SEQ ID NO: 31956 - DNA, 20 bp, Artificial Sequence
  Description of Artificial Sequence: Synthetic oligonucleotide
  Target: SCN10A; (+) strand; PAM type: NRG; PAM sequence: AGG
acctgaagagaaggaatgga

SEQ ID NO: 31957 - DNA, 20 bp, Artificial Sequence
  Description of Artificial Sequence: Synthetic oligonucleotide
  Target: SCN10A; (+) strand; PAM type: NRG; PAM sequence: GGG
cctgaagagaaggaatggaa

SEQ ID NO: 31958 - DNA, 20 bp, Artificial Sequence
  Description of Artificial Sequence: Synthetic oligonucleotide
  Target: SCN10A; (+) strand; PAM type: NRG; PAM sequence: AAG
gaagagaaggaatggaaggg

SEQ ID NO: 31959 - DNA, 20 bp, Artificial Sequence
  Description of Artificial Sequence: Synthetic oligonucleotide
  Target: SCN10A; (+) strand; PAM type: NRG; PAM sequence: AAG
gggaagattgatcaatctct

SEQ ID NO: 31960 - DNA, 20 bp, Artificial Sequence
  Description of Artificial Sequence: Synthetic oligonucleotide
  Target: SCN10A; (+) strand; PAM type: NRG; PAM sequence: GAG
gattgatcaatctctaagct

SEQ ID NO: 31961 - DNA, 20 bp, Artificial Sequence
  Description of Artificial Sequence: Synthetic oligonucleotide
  Target: SCN10A; (+) strand; PAM type: NRG; PAM sequence: TGG
ctctaagctgagccccacat

SEQ ID NO: 31962 - DNA, 20 bp, Artificial Sequence
  Description of Artificial Sequence: Synthetic oligonucleotide
  Target: SCN10A; (+) strand; PAM type: NRG; PAM sequence: CGG
tgagccccacattggcctac

SEQ ID NO: 31963 - DNA, 20 bp, Artificial Sequence
  Description of Artificial Sequence: Synthetic oligonucleotide
  Target: SCN10A; (+) strand; PAM type: NRG; PAM sequence: GGG
gagccccacattggcctacc

SEQ ID NO: 31964 - DNA, 20 bp, Artificial Sequence
  Description of Artificial Sequence: Synthetic oligonucleotide
  Target: SCN10A; (+) strand; PAM type: NRG; PAM sequence: TAG
cccacattggcctaccgggt

SEQ ID NO: 31965 - DNA, 20 bp, Artificial Sequence
  Description of Artificial Sequence: Synthetic oligonucleotide
  Target: SCN10A; (+) strand; PAM type: NRG; PAM sequence: CAG
acattggcctaccgggttag

SEQ ID NO: 31966 - DNA, 20 bp, Artificial Sequence
  Description of Artificial Sequence: Synthetic oligonucleotide
  Target: SCN10A; (+) strand; PAM type: NRG; PAM sequence: TGG
tggcctaccgggttagcagc

SEQ ID NO: 31967 - DNA, 20 bp, Artificial Sequence
  Description of Artificial Sequence: Synthetic oligonucleotide
  Target: SCN10A; (+) strand; PAM type: NRG; PAM sequence: TGG
ctaccgggttagcagctggc

SEQ ID NO: 31968 - DNA, 20 bp, Artificial Sequence
  Description of Artificial Sequence: Synthetic oligonucleotide
  Target: SCN10A; (+) strand; PAM type: NRG; PAM sequence: AAG
cgggttagcagctggctggc

SEQ ID NO: 31969 - DNA, 20 bp, Artificial Sequence
  Description of Artificial Sequence: Synthetic oligonucleotide
  Target: SCN10A; (+) strand; PAM type: NRG; PAM sequence: CAG
ttagcagctggctggcaaga

SEQ ID NO: 31970 - DNA, 20 bp, Artificial Sequence
  Description of Artificial Sequence: Synthetic oligonucleotide
  Target: SCN10A; (+) strand; PAM type: NRG; PAM sequence: CGG
gctggctggcaagacagcca

SEQ ID NO: 31971 - DNA, 20 bp, Artificial Sequence
  Description of Artificial Sequence: Synthetic oligonucleotide
  Target: SCN10A; (+) strand; PAM type: NRG; PAM sequence: TGG
ctggcaagacagccacggcc

SEQ ID NO: 31972 - DNA, 20 bp, Artificial Sequence
  Description of Artificial Sequence: Synthetic oligonucleotide
  Target: SCN10A; (+) strand; PAM type: NRG; PAM sequence: GGG
tggcaagacagccacggcct

SEQ ID NO: 31973 - DNA, 20 bp, Artificial Sequence
  Description of Artificial Sequence: Synthetic oligonucleotide
  Target: SCN10A; (+) strand; PAM type: NRG; PAM sequence: CGG
tgggcctcttcctgcccacc

SEQ ID NO: 31974 - DNA, 20 bp, Artificial Sequence
  Description of Artificial Sequence: Synthetic oligonucleotide
  Target: SCN10A; (+) strand; PAM type: NRG; PAM sequence: GGG
gggcctcttcctgcccaccc

SEQ ID NO: 31975 - DNA, 20 bp, Artificial Sequence
  Description of Artificial Sequence: Synthetic oligonucleotide
  Target: SCN10A; (+) strand; PAM type: NRG; PAM sequence: TGG
acccgggatgctgtcccttt

SEQ ID NO: 31976 - DNA, 20 bp, Artificial Sequence
  Description of Artificial Sequence: Synthetic oligonucleotide
  Target: SCN10A; (+) strand; PAM type: NRG; PAM sequence: GGG
cccgggatgctgtccctttt

SEQ ID NO: 31977 - DNA, 20 bp, Artificial Sequence
  Description of Artificial Sequence: Synthetic oligonucleotide
  Target: SCN10A; (+) strand; PAM type: NRG; PAM sequence: GGG
ccgggatgctgtcccttttg

SEQ ID NO: 31978 - DNA, 20 bp, Artificial Sequence
  Description of Artificial Sequence: Synthetic oligonucleotide
  Target: SCN10A; (+) strand; PAM type: NRG; PAM sequence: GGG
cgggatgctgtcccttttgg

SEQ ID NO: 31979 - DNA, 20 bp, Artificial Sequence
  Description of Artificial Sequence: Synthetic oligonucleotide
  Target: SCN10A; (+) strand; PAM type: NRG; PAM sequence: TGG
tgctgtcccttttgggggaa

SEQ ID NO: 31980 - DNA, 20 bp, Artificial Sequence
  Description of Artificial Sequence: Synthetic oligonucleotide
  Target: SCN10A; (+) strand; PAM type: NRG; PAM sequence: GAG
tttgggggaatggactttct

SEQ ID NO: 31981 - DNA, 20 bp, Artificial Sequence
  Description of Artificial Sequence: Synthetic oligonucleotide
  Target: SCN10A; (+) strand; PAM type: NRG; PAM sequence: GAG
tgggggaatggactttctga

SEQ ID NO: 31982 - DNA, 20 bp, Artificial Sequence
  Description of Artificial Sequence: Synthetic oligonucleotide
  Target: SCN10A; (+) strand; PAM type: NRG; PAM sequence: CAG
gggaatggactttctgagag

SEQ ID NO: 31983 - DNA, 20 bp, Artificial Sequence
  Description of Artificial Sequence: Synthetic oligonucleotide
  Target: SCN10A; (+) strand; PAM type: NRG; PAM sequence: GAG
tggactttctgagagcagtt

SEQ ID NO: 31984 - DNA, 20 bp, Artificial Sequence
  Description of Artificial Sequence: Synthetic oligonucleotide
  Target: SCN10A; (+) strand; PAM type: NRG; PAM sequence: AGG
ggactttctgagagcagttg

SEQ ID NO: 31985 - DNA, 20 bp, Artificial Sequence
  Description of Artificial Sequence: Synthetic oligonucleotide
  Target: SCN10A; (+) strand; PAM type: NRG; PAM sequence: GGG
gactttctgagagcagttga

SEQ ID NO: 31986 - DNA, 20 bp, Artificial Sequence
  Description of Artificial Sequence: Synthetic oligonucleotide
  Target: SCN10A; (+) strand; PAM type: NRG; PAM sequence: AAG
ttctgagagcagttgaggga

SEQ ID NO: 31987 - DNA, 20 bp, Artificial Sequence
  Description of Artificial Sequence: Synthetic oligonucleotide
  Target: SCN10A; (+) strand; PAM type: NRG; PAM sequence: TGG
agagcagttgagggaaagtt

SEQ ID NO: 31988 - DNA, 20 bp, Artificial Sequence
  Description of Artificial Sequence: Synthetic oligonucleotide
  Target: SCN10A; (+) strand; PAM type: NRG; PAM sequence: GGG
gagcagttgagggaaagttt

SEQ ID NO: 31989 - DNA, 20 bp, Artificial Sequence
  Description of Artificial Sequence: Synthetic oligonucleotide
  Target: SCN10A; (+) strand; PAM type: NRG; PAM sequence: GGG
agcagttgagggaaagtttg

SEQ ID NO: 31990 - DNA, 20 bp, Artificial Sequence
  Description of Artificial Sequence: Synthetic oligonucleotide
  Target: SCN10A; (+) strand; PAM type: NRG; PAM sequence: TGG
gggaaagtttggggatgtcc

SEQ ID NO: 31991 - DNA, 20 bp, Artificial Sequence
  Description of Artificial Sequence: Synthetic oligonucleotide
  Target: SCN10A; (+) strand; PAM type: NRG; PAM sequence: GAG
gaaagtttggggatgtcctg

SEQ ID NO: 31992 - DNA, 20 bp, Artificial Sequence
  Description of Artificial Sequence: Synthetic oligonucleotide
  Target: SCN10A; (+) strand; PAM type: NRG; PAM sequence: CAG
tgtcctggagtgacccgcct

SEQ ID NO: 31993 - DNA, 20 bp, Artificial Sequence
  Description of Artificial Sequence: Synthetic oligonucleotide
  Target: SCN10A; (+) strand; PAM type: NRG; PAM sequence: TGG
cctggagtgacccgcctcag

SEQ ID NO: 31994 - DNA, 20 bp, Artificial Sequence
  Description of Artificial Sequence: Synthetic oligonucleotide
  Target: SCN10A; (+) strand; PAM type: NRG; PAM sequence: GAG
agtgacccgcctcagtggac

SEQ ID NO: 31995 - DNA, 20 bp, Artificial Sequence
  Description of Artificial Sequence: Synthetic oligonucleotide
  Target: SCN10A; (+) strand; PAM type: NRG; PAM sequence: AGG
gtgacccgcctcagtggacg

SEQ ID NO: 31996 - DNA, 20 bp, Artificial Sequence
  Description of Artificial Sequence: Synthetic oligonucleotide
  Target: SCN10A; (+) strand; PAM type: NRG; PAM sequence: TGG
ccgcctcagtggacgaggct

SEQ ID NO: 31997 - DNA, 20 bp, Artificial Sequence
  Description of Artificial Sequence: Synthetic oligonucleotide
  Target: SCN10A; (+) strand; PAM type: NRG; PAM sequence: AAG
cctcagtggacgaggcttgg

SEQ ID NO: 31998 - DNA, 20 bp, Artificial Sequence
  Description of Artificial Sequence: Synthetic oligonucleotide
  Target: SCN10A; (+) strand; PAM type: NRG; PAM sequence: AAG
gaagcatattttccaccata

SEQ ID NO: 31999 - DNA, 20 bp, Artificial Sequence
  Description of Artificial Sequence: Synthetic oligonucleotide
  Target: SCN10A; (+) strand; PAM type: NRG; PAM sequence: AGG
aagcatattttccaccataa

SEQ ID NO: 32000 - DNA, 20 bp, Artificial Sequence
  Description of Artificial Sequence: Synthetic oligonucleotide
  Target: SCN10A; (+) strand; PAM type: NRG; PAM sequence: GAG
gcatattttccaccataaag

SEQ ID NO: 32001 - DNA, 20 bp, Artificial Sequence
  Description of Artificial Sequence: Synthetic oligonucleotide
  Target: SCN10A; (+) strand; PAM type: NRG; PAM sequence: AGG
catattttccaccataaagg

SEQ ID NO: 32002 - DNA, 20 bp, Artificial Sequence
  Description of Artificial Sequence: Synthetic oligonucleotide
  Target: SCN10A; (+) strand; PAM type: NRG; PAM sequence: GAG
tattttccaccataaaggag

SEQ ID NO: 32003 - DNA, 20 bp, Artificial Sequence
  Description of Artificial Sequence: Synthetic oligonucleotide
  Target: SCN10A; (+) strand; PAM type: NRG; PAM sequence: GAG
taaaggaggagccccccgct

SEQ ID NO: 32004 - DNA, 20 bp, Artificial Sequence
  Description of Artificial Sequence: Synthetic oligonucleotide
  Target: SCN10A; (+) strand; PAM type: NRG; PAM sequence: CAG
aggaggagccccccgctgag

SEQ ID NO: 32005 - DNA, 20 bp, Artificial Sequence
  Description of Artificial Sequence: Synthetic oligonucleotide
  Target: SCN10A; (+) strand; PAM type: NRG; PAM sequence: GAG
gaggagccccccgctgagca

SEQ ID NO: 32006 - DNA, 20 bp, Artificial Sequence
  Description of Artificial Sequence: Synthetic oligonucleotide
  Target: SCN10A; (+) strand; PAM type: NRG; PAM sequence: AGG
aggagccccccgctgagcag

SEQ ID NO: 32007 - DNA, 20 bp, Artificial Sequence
  Description of Artificial Sequence: Synthetic oligonucleotide
  Target: SCN10A; (+) strand; PAM type: NRG; PAM sequence: GGG
ggagccccccgctgagcaga

SEQ ID NO: 32008 - DNA, 20 bp, Artificial Sequence
  Description of Artificial Sequence: Synthetic oligonucleotide
  Target: SCN10A; (+) strand; PAM type: NRG; PAM sequence: TAG
ccgctgagcagagggacatt

SEQ ID NO: 32009 - DNA, 20 bp, Artificial Sequence
  Description of Artificial Sequence: Synthetic oligonucleotide
  Target: SCN10A; (+) strand; PAM type: NRG; PAM sequence: AGG
cgctgagcagagggacattt

SEQ ID NO: 32010 - DNA, 20 bp, Artificial Sequence
  Description of Artificial Sequence: Synthetic oligonucleotide
  Target: SCN10A; (+) strand; PAM type: NRG; PAM sequence: GGG
gctgagcagagggacattta

SEQ ID NO: 32011 - DNA, 20 bp, Artificial Sequence
  Description of Artificial Sequence: Synthetic oligonucleotide
  Target: SCN10A; (+) strand; PAM type: NRG; PAM sequence: CAG
agagggacatttagggacaa

SEQ ID NO: 32012 - DNA, 20 bp, Artificial Sequence
  Description of Artificial Sequence: Synthetic oligonucleotide
  Target: SCN10A; (+) strand; PAM type: NRG; PAM sequence: GAG
agggacatttagggacaaca

SEQ ID NO: 32013 - DNA, 20 bp, Artificial Sequence
  Description of Artificial Sequence: Synthetic oligonucleotide
  Target: SCN10A; (+) strand; PAM type: NRG; PAM sequence: GAG
ggacatttagggacaacaga

SEQ ID NO: 32014 - DNA, 20 bp, Artificial Sequence
  Description of Artificial Sequence: Synthetic oligonucleotide
  Target: SCN10A; (+) strand; PAM type: NRG; PAM sequence: AAG
catttagggacaacagagag

SEQ ID NO: 32015 - DNA, 20 bp, Artificial Sequence
  Description of Artificial Sequence: Synthetic oligonucleotide
  Target: SCN10A; (+) strand; PAM type: NRG; PAM sequence: AGG
atttagggacaacagagaga

SEQ ID NO: 32016 - DNA, 20 bp, Artificial Sequence
  Description of Artificial Sequence: Synthetic oligonucleotide
  Target: SCN10A; (+) strand; PAM type: NRG; PAM sequence: CAG
ggacaacagagagaaggcac

SEQ ID NO: 32017 - DNA, 20 bp, Artificial Sequence
  Description of Artificial Sequence: Synthetic oligonucleotide
  Target: SCN10A; (+) strand; PAM type: NRG; PAM sequence: AAG
gcaaccaccctcatgtgcca

SEQ ID NO: 32018 - DNA, 20 bp, Artificial Sequence
  Description of Artificial Sequence: Synthetic oligonucleotide
  Target: SCN10A; (+) strand; PAM type: NRG; PAM sequence: TGG
accctcatgtgccaaagccc

SEQ ID NO: 32019 - DNA, 20 bp, Artificial Sequence
  Description of Artificial Sequence: Synthetic oligonucleotide
  Target: SCN10A; (+) strand; PAM type: NRG; PAM sequence: GGG
ccctcatgtgccaaagccct

SEQ ID NO: 32020 - DNA, 20 bp, Artificial Sequence
  Description of Artificial Sequence: Synthetic oligonucleotide
  Target: SCN10A; (+) strand; PAM type: NRG; PAM sequence: TGG
ctgggctctgttcctgactc

SEQ ID NO: 32021 - DNA, 20 bp, Artificial Sequence
  Description of Artificial Sequence: Synthetic oligonucleotide
  Target: SCN10A; (+) strand; PAM type: NRG; PAM sequence: TGG
tgttcctgactctggaatcc

SEQ ID NO: 32022 - DNA, 20 bp, Artificial Sequence
  Description of Artificial Sequence: Synthetic oligonucleotide
  Target: SCN10A; (+) strand; PAM type: NRG; PAM sequence: GGG
gttcctgactctggaatcct

SEQ ID NO: 32023 - DNA, 20 bp, Artificial Sequence
  Description of Artificial Sequence: Synthetic oligonucleotide
  Target: SCN10A; (+) strand; PAM type: NRG; PAM sequence: CAG
tgggcacatcttgctgcttc

SEQ ID NO: 32024 - DNA, 20 bp, Artificial Sequence
  Description of Artificial Sequence: Synthetic oligonucleotide
  Target: SCN10A; (+) strand; PAM type: NRG; PAM sequence: GAG
ctgcttccagttcttcactt

SEQ ID NO: 32025 - DNA, 20 bp, Artificial Sequence
  Description of Artificial Sequence: Synthetic oligonucleotide
  Target: SCN10A; (+) strand; PAM type: NRG; PAM sequence: GAG
gcttccagttcttcacttga

SEQ ID NO: 32026 - DNA, 20 bp, Artificial Sequence
  Description of Artificial Sequence: Synthetic oligonucleotide
  Target: SCN10A; (+) strand; PAM type: NRG; PAM sequence: CAG
tccagttcttcacttgagag

SEQ ID NO: 32027 - DNA, 20 bp, Artificial Sequence
  Description of Artificial Sequence: Synthetic oligonucleotide
  Target: SCN10A; (+) strand; PAM type: NRG; PAM sequence: AAG
tcttcacttgagagcagatg

SEQ ID NO: 32028 - DNA, 20 bp, Artificial Sequence
  Description of Artificial Sequence: Synthetic oligonucleotide
  Target: SCN10A; (+) strand; PAM type: NRG; PAM sequence: GAG
ttcacttgagagcagatgaa

SEQ ID NO: 32029 - DNA, 20 bp, Artificial Sequence
  Description of Artificial Sequence: Synthetic oligonucleotide
  Target: SCN10A; (+) strand; PAM type: NRG; PAM sequence: CGG
acttgagagcagatgaagag

SEQ ID NO: 32030 - DNA, 20 bp, Artificial Sequence
  Description of Artificial Sequence: Synthetic oligonucleotide
  Target: SCN10A; (+) strand; PAM type: NRG; PAM sequence: AAG
gcagatgaagagcggttgtg

SEQ ID NO: 32031 - DNA, 20 bp, Artificial Sequence
  Description of Artificial Sequence: Synthetic oligonucleotide
  Target: SCN10A; (+) strand; PAM type: NRG; PAM sequence: GAG
ttgtgaagacaaaatgatat

SEQ ID NO: 32032 - DNA, 20 bp, Artificial Sequence
  Description of Artificial Sequence: Synthetic oligonucleotide
  Target: SCN10A; (+) strand; PAM type: NRG; PAM sequence: AAG
aaatgatatgagaaatgtaa

SEQ ID NO: 32033 - DNA, 20 bp, Artificial Sequence
  Description of Artificial Sequence: Synthetic oligonucleotide
  Target: SCN10A; (+) strand; PAM type: NRG; PAM sequence: CAG
atgagaaatgtaaaagtgct

SEQ ID NO: 32034 - DNA, 20 bp, Artificial Sequence
  Description of Artificial Sequence: Synthetic oligonucleotide
  Target: SCN10A; (+) strand; PAM type: NRG; PAM sequence: GAG
gagaaatgtaaaagtgctca

SEQ ID NO: 32035 - DNA, 20 bp, Artificial Sequence
  Description of Artificial Sequence: Synthetic oligonucleotide
  Target: SCN10A; (+) strand; PAM type: NRG; PAM sequence: AGG
agaaatgtaaaagtgctcag

SEQ ID NO: 32036 - DNA, 20 bp, Artificial Sequence
  Description of Artificial Sequence: Synthetic oligonucleotide
  Target: SCN10A; (+) strand; PAM type: NRG; PAM sequence: GGG
gaaatgtaaaagtgctcaga

SEQ ID NO: 32037 - DNA, 20 bp, Artificial Sequence
  Description of Artificial Sequence: Synthetic oligonucleotide
  Target: SCN10A; (+) strand; PAM type: NRG; PAM sequence: GGG
aaatgtaaaagtgctcagag

SEQ ID NO: 32038 - DNA, 20 bp, Artificial Sequence
  Description of Artificial Sequence: Synthetic oligonucleotide
  Target: SCN10A; (+) strand; PAM type: NRG; PAM sequence: GAG
gaggggtaaacttcctgtct

SEQ ID NO: 32039 - DNA, 20 bp, Artificial Sequence
  Description of Artificial Sequence: Synthetic oligonucleotide
  Target: SCN10A; (+) strand; PAM type: NRG; PAM sequence: AGG
aggggtaaacttcctgtctg

SEQ ID NO: 32040 - DNA, 20 bp, Artificial Sequence
  Description of Artificial Sequence: Synthetic oligonucleotide
  Target: SCN10A; (+) strand; PAM type: NRG; PAM sequence: GGG
ggggtaaacttcctgtctga

SEQ ID NO: 32041 - DNA, 20 bp, Artificial Sequence
  Description of Artificial Sequence: Synthetic oligonucleotide
  Target: SCN10A; (+) strand; PAM type: NRG; PAM sequence: GAG
taaacttcctgtctgagggt

SEQ ID NO: 32042 - DNA, 20 bp, Artificial Sequence
  Description of Artificial Sequence: Synthetic oligonucleotide
  Target: SCN10A; (+) strand; PAM type: NRG; PAM sequence: AGG
aaacttcctgtctgagggtg

SEQ ID NO: 32043 - DNA, 20 bp, Artificial Sequence
  Description of Artificial Sequence: Synthetic oligonucleotide
  Target: SCN10A; (+) strand; PAM type: NRG; PAM sequence: GGG
aacttcctgtctgagggtga

SEQ ID NO: 32044 - DNA, 20 bp, Artificial Sequence
  Description of Artificial Sequence: Synthetic oligonucleotide
  Target: SCN10A; (+) strand; PAM type: NRG; PAM sequence: GGG
acttcctgtctgagggtgag

SEQ ID NO: 32045 - DNA, 20 bp, Artificial Sequence
  Description of Artificial Sequence: Synthetic oligonucleotide
  Target: SCN10A; (+) strand; PAM type: NRG; PAM sequence: TGG
ctgagggtgaggggcatctg

SEQ ID NO: 32046 - DNA, 20 bp, Artificial Sequence
  Description of Artificial Sequence: Synthetic oligonucleotide
  Target: SCN10A; (+) strand; PAM type: NRG; PAM sequence: CAG
gaggggcatctgtggctctg

SEQ ID NO: 32047 - DNA, 20 bp, Artificial Sequence
  Description of Artificial Sequence: Synthetic oligonucleotide
  Target: SCN10A; (+) strand; PAM type: NRG; PAM sequence: AGG
aggggcatctgtggctctgc

SEQ ID NO: 32048 - DNA, 20 bp, Artificial Sequence
  Description of Artificial Sequence: Synthetic oligonucleotide
  Target: SCN10A; (+) strand; PAM type: NRG; PAM sequence: GGG
ggggcatctgtggctctgca

SEQ ID NO: 32049 - DNA, 20 bp, Artificial Sequence
  Description of Artificial Sequence: Synthetic oligonucleotide
  Target: SCN10A; (+) strand; PAM type: NRG; PAM sequence: TGG
catctgtggctctgcaggga

SEQ ID NO: 32050 - DNA, 20 bp, Artificial Sequence
  Description of Artificial Sequence: Synthetic oligonucleotide
  Target: SCN10A; (+) strand; PAM type: NRG; PAM sequence: TGG
ctgtggctctgcagggatgg

SEQ ID NO: 32051 - DNA, 20 bp, Artificial Sequence
  Description of Artificial Sequence: Synthetic oligonucleotide
  Target: SCN10A; (+) strand; PAM type: NRG; PAM sequence: GGG
tgtggctctgcagggatggt

SEQ ID NO: 32052 - DNA, 20 bp, Artificial Sequence
  Description of Artificial Sequence: Synthetic oligonucleotide
  Target: SCN10A; (+) strand; PAM type: NRG; PAM sequence: CAG
ctctgcagggatggtgggct

SEQ ID NO: 32053 - DNA, 20 bp, Artificial Sequence
  Description of Artificial Sequence: Synthetic oligonucleotide
  Target: SCN10A; (+) strand; PAM type: NRG; PAM sequence: TGG
cagggatggtgggctcagcc

SEQ ID NO: 32054 - DNA, 20 bp, Artificial Sequence
  Description of Artificial Sequence: Synthetic oligonucleotide
  Target: SCN10A; (+) strand; PAM type: NRG; PAM sequence: AAG
ggatggtgggctcagcctgg

SEQ ID NO: 32055 - DNA, 20 bp, Artificial Sequence
  Description of Artificial Sequence: Synthetic oligonucleotide
  Target: SCN10A; (+) strand; PAM type: NRG; PAM sequence: CAG
gtgggctcagcctggaagaa

SEQ ID NO: 32056 - DNA, 20 bp, Artificial Sequence
  Description of Artificial Sequence: Synthetic oligonucleotide
  Target: SCN10A; (+) strand; PAM type: NRG; PAM sequence: GAG
gggctcagcctggaagaaca

SEQ ID NO: 32057 - DNA, 20 bp, Artificial Sequence
  Description of Artificial Sequence: Synthetic oligonucleotide
  Target: SCN10A; (+) strand; PAM type: NRG; PAM sequence: TGG
gcctggaagaacagagtttc

SEQ ID NO: 32058 - DNA, 20 bp, Artificial Sequence
  Description of Artificial Sequence: Synthetic oligonucleotide
  Target: SCN10A; (+) strand; PAM type: NRG; PAM sequence: GGG
cctggaagaacagagtttct

SEQ ID NO: 32059 - DNA, 20 bp, Artificial Sequence
  Description of Artificial Sequence: Synthetic oligonucleotide
  Target: SCN10A; (+) strand; PAM type: NRG; PAM sequence: CAG
agaacagagtttctgggatg

SEQ ID NO: 32060 - DNA, 20 bp, Artificial Sequence
  Description of Artificial Sequence: Synthetic oligonucleotide
  Target: SCN10A; (+) strand; PAM type: NRG; PAM sequence: AGG
gaacagagtttctgggatgc

SEQ ID NO: 32061 - DNA, 20 bp, Artificial Sequence
  Description of Artificial Sequence: Synthetic oligonucleotide
  Target: SCN10A; (+) strand; PAM type: NRG; PAM sequence: CAG
cagagtttctgggatgcagg

SEQ ID NO: 32062 - DNA, 20 bp, Artificial Sequence
  Description of Artificial Sequence: Synthetic oligonucleotide
  Target: SCN10A; (+) strand; PAM type: NRG; PAM sequence: GAG
gagtttctgggatgcaggca

SEQ ID NO: 32063 - DNA, 20 bp, Artificial Sequence
  Description of Artificial Sequence: Synthetic oligonucleotide
  Target: SCN10A; (+) strand; PAM type: NRG; PAM sequence: AGG
agtttctgggatgcaggcag

SEQ ID NO: 32064 - DNA, 20 bp, Artificial Sequence
  Description of Artificial Sequence: Synthetic oligonucleotide
  Target: SCN10A; (+) strand; PAM type: NRG; PAM sequence: TGG
gatgcaggcagaggcatccc

SEQ ID NO: 32065 - DNA, 20 bp, Artificial Sequence
  Description of Artificial Sequence: Synthetic oligonucleotide
  Target: SCN10A; (+) strand; PAM type: NRG; PAM sequence: CAG
aggcagaggcatccctggct

SEQ ID NO: 32066 - DNA, 20 bp, Artificial Sequence
  Description of Artificial Sequence: Synthetic oligonucleotide
  Target: SCN10A; (+) strand; PAM type: NRG; PAM sequence: AGG
ggcagaggcatccctggctc

SEQ ID NO: 32067 - DNA, 20 bp, Artificial Sequence
  Description of Artificial Sequence: Synthetic oligonucleotide
  Target: SCN10A; (+) strand; PAM type: NRG; PAM sequence: CAG
ggcatccctggctcaggcac

SEQ ID NO: 32068 - DNA, 20 bp, Artificial Sequence
  Description of Artificial Sequence: Synthetic oligonucleotide
  Target: SCN10A; (+) strand; PAM type: NRG; PAM sequence: AGG
gcatccctggctcaggcacc

SEQ ID NO: 32069 - DNA, 20 bp, Artificial Sequence
  Description of Artificial Sequence: Synthetic oligonucleotide
  Target: SCN10A; (+) strand; PAM type: NRG; PAM sequence: GGG
catccctggctcaggcacca

SEQ ID NO: 32070 - DNA, 20 bp, Artificial Sequence
  Description of Artificial Sequence: Synthetic oligonucleotide
  Target: SCN10A; (+) strand; PAM type: NRG; PAM sequence: TGG
ccctggctcaggcaccaggg

SEQ ID NO: 32071 - DNA, 20 bp, Artificial Sequence
  Description of Artificial Sequence: Synthetic oligonucleotide
  Target: SCN10A; (+) strand; PAM type: NRG; PAM sequence: AAG
gctcaggcaccagggtggaa

SEQ ID NO: 32072 - DNA, 20 bp, Artificial Sequence
  Description of Artificial Sequence: Synthetic oligonucleotide
  Target: SCN10A; (+) strand; PAM type: NRG; PAM sequence: AAG
caccagggtggaaaagacta

SEQ ID NO: 32073 - DNA, 20 bp, Artificial Sequence
  Description of Artificial Sequence: Synthetic oligonucleotide
  Target: SCN10A; (+) strand; PAM type: NRG; PAM sequence: GAG
ccagggtggaaaagactaaa

SEQ ID NO: 32074 - DNA, 20 bp, Artificial Sequence
  Description of Artificial Sequence: Synthetic oligonucleotide
  Target: SCN10A; (+) strand; PAM type: NRG; PAM sequence: TGG
gtggaaaagactaaagagtc

SEQ ID NO: 32075 - DNA, 20 bp, Artificial Sequence
  Description of Artificial Sequence: Synthetic oligonucleotide
  Target: SCN10A; (+) strand; PAM type: NRG; PAM sequence: TGG
tgttgttgcttcccttttct

SEQ ID NO: 32076 - DNA, 20 bp, Artificial Sequence
  Description of Artificial Sequence: Synthetic oligonucleotide
  Target: SCN10A; (+) strand; PAM type: NRG; PAM sequence: TAG
ttgcttcccttttcttggtt

SEQ ID NO: 32077 - DNA, 20 bp, Artificial Sequence
  Description of Artificial Sequence: Synthetic oligonucleotide
  Target: SCN10A; (+) strand; PAM type: NRG; PAM sequence: GAG
cttctgtctataaaactcat

SEQ ID NO: 32078 - DNA, 20 bp, Artificial Sequence
  Description of Artificial Sequence: Synthetic oligonucleotide
  Target: SCN10A; (+) strand; PAM type: NRG; PAM sequence: AGG
ttctgtctataaaactcatg

SEQ ID NO: 32079 - DNA, 20 bp, Artificial Sequence
  Description of Artificial Sequence: Synthetic oligonucleotide
  Target: SCN10A; (+) strand; PAM type: NRG; PAM sequence: AAG
gtctataaaactcatgagga

SEQ ID NO: 32080 - DNA, 20 bp, Artificial Sequence
  Description of Artificial Sequence: Synthetic oligonucleotide
  Target: SCN10A; (+) strand; PAM type: NRG; PAM sequence: AAG
aactcatgaggaaagaaccc

SEQ ID NO: 32081 - DNA, 20 bp, Artificial Sequence
  Description of Artificial Sequence: Synthetic oligonucleotide
  Target: SCN10A; (+) strand; PAM type: NRG; PAM sequence: TGG
catgaggaaagaacccaagt

SEQ ID NO: 32082 - DNA, 20 bp, Artificial Sequence
  Description of Artificial Sequence: Synthetic oligonucleotide
  Target: SCN10A; (+) strand; PAM type: NRG; PAM sequence: CAG
aacccaagttggttgatgtc

SEQ ID NO: 32083 - DNA, 20 bp, Artificial Sequence
  Description of Artificial Sequence: Synthetic oligonucleotide
  Target: SCN10A; (+) strand; PAM type: NRG; PAM sequence: AGG
acccaagttggttgatgtcc

SEQ ID NO: 32084 - DNA, 20 bp, Artificial Sequence
  Description of Artificial Sequence: Synthetic oligonucleotide
  Target: SCN10A; (+) strand; PAM type: NRG; PAM sequence: GGG
cccaagttggttgatgtcca

SEQ ID NO: 32085 - DNA, 20 bp, Artificial Sequence
  Description of Artificial Sequence: Synthetic oligonucleotide
  Target: SCN10A; (+) strand; PAM type: NRG; PAM sequence: AAG
tggttgatgtccagggcaat

SEQ ID NO: 32086 - DNA, 20 bp, Artificial Sequence
  Description of Artificial Sequence: Synthetic oligonucleotide
  Target: SCN10A; (+) strand; PAM type: NRG; PAM sequence: AAG
tgatgtccagggcaataaga

SEQ ID NO: 32087 - DNA, 20 bp, Artificial Sequence
  Description of Artificial Sequence: Synthetic oligonucleotide
  Target: SCN10A; (+) strand; PAM type: NRG; PAM sequence: AGG
gatgtccagggcaataagaa

SEQ ID NO: 32088 - DNA, 20 bp, Artificial Sequence
  Description of Artificial Sequence: Synthetic oligonucleotide
  Target: SCN10A; (+) strand; PAM type: NRG; PAM sequence: GGG
atgtccagggcaataagaaa

SEQ ID NO: 32089 - DNA, 20 bp, Artificial Sequence
  Description of Artificial Sequence: Synthetic oligonucleotide
  Target: SCN10A; (+) strand; PAM type: NRG; PAM sequence: GGG
tgtccagggcaataagaaag

SEQ ID NO: 32090 - DNA, 20 bp, Artificial Sequence
  Description of Artificial Sequence: Synthetic oligonucleotide
  Target: SCN10A; (+) strand; PAM type: NRG; PAM sequence: TGG
ggcaataagaaaggggcttc

SEQ ID NO: 32091 - DNA, 20 bp, Artificial Sequence
  Description of Artificial Sequence: Synthetic oligonucleotide
  Target: SCN10A; (+) strand; PAM type: NRG; PAM sequence: AAG
aataagaaaggggcttctgg

SEQ ID NO: 32092 - DNA, 20 bp, Artificial Sequence
  Description of Artificial Sequence: Synthetic oligonucleotide
  Target: SCN10A; (+) strand; PAM type: NRG; PAM sequence: CAG
actgcatcctcccacacaac

SEQ ID NO: 32093 - DNA, 20 bp, Artificial Sequence
  Description of Artificial Sequence: Synthetic oligonucleotide
  Target: SCN10A; (+) strand; PAM type: NRG; PAM sequence: CAG
catcctcccacacaaccagt

SEQ ID NO: 32094 - DNA, 20 bp, Artificial Sequence
  Description of Artificial Sequence: Synthetic oligonucleotide
  Target: SCN10A; (+) strand; PAM type: NRG; PAM sequence: CAG
cccacacaaccagtcagtcc

SEQ ID NO: 32095 - DNA, 20 bp, Artificial Sequence
  Description of Artificial Sequence: Synthetic oligonucleotide
  Target: SCN10A; (+) strand; PAM type: NRG; PAM sequence: AGG
ccacacaaccagtcagtccc

SEQ ID NO: 32096 - DNA, 20 bp, Artificial Sequence
  Description of Artificial Sequence: Synthetic oligonucleotide
  Target: SCN10A; (+) strand; PAM type: NRG; PAM sequence: GAG
acacaaccagtcagtcccag

SEQ ID NO: 32097 - DNA, 20 bp, Artificial Sequence
  Description of Artificial Sequence: Synthetic oligonucleotide
  Target: SCN10A; (+) strand; PAM type: NRG; PAM sequence: AGG
cacaaccagtcagtcccagg

SEQ ID NO: 32098 - DNA, 20 bp, Artificial Sequence
  Description of Artificial Sequence: Synthetic oligonucleotide
  Target: SCN10A; (+) strand; PAM type: NRG; PAM sequence: GGG
acaaccagtcagtcccagga

SEQ ID NO: 32099 - DNA, 20 bp, Artificial Sequence
  Description of Artificial Sequence: Synthetic oligonucleotide
  Target: SCN10A; (+) strand; PAM type: NRG; PAM sequence: AAG
ccagtcagtcccaggagggc

SEQ ID NO: 32100 - DNA, 20 bp, Artificial Sequence
  Description of Artificial Sequence: Synthetic oligonucleotide
  Target: SCN10A; (+) strand; PAM type: NRG; PAM sequence: AGG
cagtcagtcccaggagggca

SEQ ID NO: 32101 - DNA, 20 bp, Artificial Sequence
  Description of Artificial Sequence: Synthetic oligonucleotide
  Target: SCN10A; (+) strand; PAM type: NRG; PAM sequence: CAG
ggcaaggaccccaccatgac

SEQ ID NO: 32102 - DNA, 20 bp, Artificial Sequence
  Description of Artificial Sequence: Synthetic oligonucleotide
  Target: SCN10A; (+) strand; PAM type: NRG; PAM sequence: GAG
caaggaccccaccatgacca

SEQ ID NO: 32103 - DNA, 20 bp, Artificial Sequence
  Description of Artificial Sequence: Synthetic oligonucleotide
  Target: SCN10A; (+) strand; PAM type: NRG; PAM sequence: TGG
ggaccccaccatgaccagag

SEQ ID NO: 32104 - DNA, 20 bp, Artificial Sequence
  Description of Artificial Sequence: Synthetic oligonucleotide
  Target: SCN10A; (+) strand; PAM type: NRG; PAM sequence: GGG
gaccccaccatgaccagagt

SEQ ID NO: 32105 - DNA, 20 bp, Artificial Sequence
  Description of Artificial Sequence: Synthetic oligonucleotide
  Target: SCN10A; (+) strand; PAM type: NRG; PAM sequence: TGG
cccaccatgaccagagtggg

SEQ ID NO: 32106 - DNA, 20 bp, Artificial Sequence
  Description of Artificial Sequence: Synthetic oligonucleotide
  Target: SCN10A; (+) strand; PAM type: NRG; PAM sequence: GAG
caccatgaccagagtgggtg

SEQ ID NO: 32107 - DNA, 20 bp, Artificial Sequence
  Description of Artificial Sequence: Synthetic oligonucleotide
  Target: SCN10A; (+) strand; PAM type: NRG; PAM sequence: AAG
tgaccagagtgggtggagac

SEQ ID NO: 32108 - DNA, 20 bp, Artificial Sequence
  Description of Artificial Sequence: Synthetic oligonucleotide
  Target: SCN10A; (+) strand; PAM type: NRG; PAM sequence: GAG
agagtgggtggagacaagct

SEQ ID NO: 32109 - DNA, 20 bp, Artificial Sequence
  Description of Artificial Sequence: Synthetic oligonucleotide
  Target: SCN10A; (+) strand; PAM type: NRG; PAM sequence: AGG
gagtgggtggagacaagctg

SEQ ID NO: 32110 - DNA, 20 bp, Artificial Sequence
  Description of Artificial Sequence: Synthetic oligonucleotide
  Target: SCN10A; (+) strand; PAM type: NRG; PAM sequence: GGG
agtgggtggagacaagctga

SEQ ID NO: 32111 - DNA, 20 bp, Artificial Sequence
  Description of Artificial Sequence: Synthetic oligonucleotide
  Target: SCN10A; (+) strand; PAM type: NRG; PAM sequence: CAG
gggtggagacaagctgaggg

SEQ ID NO: 32112 - DNA, 20 bp, Artificial Sequence
  Description of Artificial Sequence: Synthetic oligonucleotide
  Target: SCN10A; (+) strand; PAM type: NRG; PAM sequence: AGG
ggtggagacaagctgagggc

SEQ ID NO: 32113 - DNA, 20 bp, Artificial Sequence
  Description of Artificial Sequence: Synthetic oligonucleotide
  Target: SCN10A; (+) strand; PAM type: NRG; PAM sequence: GGG
gtggagacaagctgagggca

SEQ ID NO: 32114 - DNA, 20 bp, Artificial Sequence
  Description of Artificial Sequence: Synthetic oligonucleotide
  Target: SCN10A; (+) strand; PAM type: NRG; PAM sequence: GGG
tggagacaagctgagggcag

SEQ ID NO: 32115 - DNA, 20 bp, Artificial Sequence
  Description of Artificial Sequence: Synthetic oligonucleotide
  Target: SCN10A; (+) strand; PAM type: NRG; PAM sequence: GGG
ggagacaagctgagggcagg

SEQ ID NO: 32116 - DNA, 20 bp, Artificial Sequence
  Description of Artificial Sequence: Synthetic oligonucleotide
  Target: SCN10A; (+) strand; PAM type: NRG; PAM sequence: CAG
acaagctgagggcagggggc

SEQ ID NO: 32117 - DNA, 20 bp, Artificial Sequence
  Description of Artificial Sequence: Synthetic oligonucleotide
  Target: SCN10A; (+) strand; PAM type: NRG; PAM sequence: AGG
caagctgagggcagggggcc

SEQ ID NO: 32118 - DNA, 20 bp, Artificial Sequence
  Description of Artificial Sequence: Synthetic oligonucleotide
  Target: SCN10A; (+) strand; PAM type: NRG; PAM sequence: TGG
ctgagggcagggggccaggc

SEQ ID NO: 32119 - DNA, 20 bp, Artificial Sequence
  Description of Artificial Sequence: Synthetic oligonucleotide
  Target: SCN10A; (+) strand; PAM type: NRG; PAM sequence: GGG
tgagggcagggggccaggct

SEQ ID NO: 32120 - DNA, 20 bp, Artificial Sequence
  Description of Artificial Sequence: Synthetic oligonucleotide
  Target: SCN10A; (+) strand; PAM type: NRG; PAM sequence: GGG
gagggcagggggccaggctg

SEQ ID NO: 32121 - DNA, 20 bp, Artificial Sequence
  Description of Artificial Sequence: Synthetic oligonucleotide
  Target: SCN10A; (+) strand; PAM type: NRG; PAM sequence: CGG
ggcagggggccaggctgggg

SEQ ID NO: 32122 - DNA, 20 bp, Artificial Sequence
  Description of Artificial Sequence: Synthetic oligonucleotide
  Target: SCN10A; (+) strand; PAM type: NRG; PAM sequence: GAG
cagggggccaggctggggcg

SEQ ID NO: 32123 - DNA, 20 bp, Artificial Sequence
  Description of Artificial Sequence: Synthetic oligonucleotide
  Target: SCN10A; (+) strand; PAM type: NRG; PAM sequence: AAG
ggggccaggctggggcggag

SEQ ID NO: 32124 - DNA, 20 bp, Artificial Sequence
  Description of Artificial Sequence: Synthetic oligonucleotide
  Target: SCN10A; (+) strand; PAM type: NRG; PAM sequence: AGG
gggccaggctggggcggaga

SEQ ID NO: 32125 - DNA, 20 bp, Artificial Sequence
  Description of Artificial Sequence: Synthetic oligonucleotide
  Target: SCN10A; (+) strand; PAM type: NRG; PAM sequence: GGG
ggccaggctggggcggagaa

SEQ ID NO: 32126 - DNA, 20 bp, Artificial Sequence
  Description of Artificial Sequence: Synthetic oligonucleotide
  Target: SCN10A; (+) strand; PAM type: NRG; PAM sequence: GGG
gccaggctggggcggagaag

SEQ ID NO: 32127 - DNA, 20 bp, Artificial Sequence
  Description of Artificial Sequence: Synthetic oligonucleotide
  Target: SCN10A; (+) strand; PAM type: NRG; PAM sequence: TGG
ctggggcggagaaggggtat

SEQ ID NO: 32128 - DNA, 20 bp, Artificial Sequence
  Description of Artificial Sequence: Synthetic oligonucleotide
  Target: SCN10A; (+) strand; PAM type: NRG; PAM sequence: GGG
tggggcggagaaggggtatt

SEQ ID NO: 32129 - DNA, 20 bp, Artificial Sequence
  Description of Artificial Sequence: Synthetic oligonucleotide
  Target: SCN10A; (+) strand; PAM type: NRG; PAM sequence: GGG
ggggcggagaaggggtattg

SEQ ID NO: 32130 - DNA, 20 bp, Artificial Sequence
  Description of Artificial Sequence: Synthetic oligonucleotide
  Target: SCN10A; (+) strand; PAM type: NRG; PAM sequence: TGG
gaaggggtattggggcttat

SEQ ID NO: 32131 - DNA, 20 bp, Artificial Sequence
  Description of Artificial Sequence: Synthetic oligonucleotide
  Target: SCN10A; (+) strand; PAM type: NRG; PAM sequence: AAG
gggtattggggcttattggc

SEQ ID NO: 32132 - DNA, 20 bp, Artificial Sequence
  Description of Artificial Sequence: Synthetic oligonucleotide
  Target: SCN10A; (+) strand; PAM type: NRG; PAM sequence: GAG
attggggcttattggcaagt

SEQ ID NO: 32133 - DNA, 20 bp, Artificial Sequence
  Description of Artificial Sequence: Synthetic oligonucleotide
  Target: SCN10A; (+) strand; PAM type: NRG; PAM sequence: CAG
cttattggcaagtgagtctc

SEQ ID NO: 32134 - DNA, 20 bp, Artificial Sequence
  Description of Artificial Sequence: Synthetic oligonucleotide
  Target: SCN10A; (+) strand; PAM type: NRG; PAM sequence: GAG
tattggcaagtgagtctcca

SEQ ID NO: 32135 - DNA, 20 bp, Artificial Sequence
  Description of Artificial Sequence: Synthetic oligonucleotide
  Target: SCN10A; (+) strand; PAM type: NRG; PAM sequence: AGG
attggcaagtgagtctccag

SEQ ID NO: 32136 - DNA, 20 bp, Artificial Sequence
  Description of Artificial Sequence: Synthetic oligonucleotide
  Target: SCN10A; (+) strand; PAM type: NRG; PAM sequence: GGG
ttggcaagtgagtctccaga

SEQ ID NO: 32137 - DNA, 20 bp, Artificial Sequence
  Description of Artificial Sequence: Synthetic oligonucleotide
  Target: SCN10A; (+) strand; PAM type: NRG; PAM sequence: GGG
tggcaagtgagtctccagag

SEQ ID NO: 32138 - DNA, 20 bp, Artificial Sequence
  Description of Artificial Sequence: Synthetic oligonucleotide
  Target: SCN10A; (+) strand; PAM type: NRG; PAM sequence: TGG
agaggggcttcctccaaaca

SEQ ID NO: 32139 - DNA, 20 bp, Artificial Sequence
  Description of Artificial Sequence: Synthetic oligonucleotide
  Target: SCN10A; (+) strand; PAM type: NRG; PAM sequence: GAG
aggggcttcctccaaacatg

SEQ ID NO: 32140 - DNA, 20 bp, Artificial Sequence
  Description of Artificial Sequence: Synthetic oligonucleotide
  Target: SCN10A; (+) strand; PAM type: NRG; PAM sequence: TAG
ggcttcctccaaacatggag

SEQ ID NO: 32141 - DNA, 20 bp, Artificial Sequence
  Description of Artificial Sequence: Synthetic oligonucleotide
  Target: SCN10A; (+) strand; PAM type: NRG; PAM sequence: TGG
agattttgttattatttctg

SEQ ID NO: 32142 - DNA, 20 bp, Artificial Sequence
  Description of Artificial Sequence: Synthetic oligonucleotide
  Target: SCN10A; (+) strand; PAM type: NRG; PAM sequence: TGG
tgttattatttctgtggcct

SEQ ID NO: 32143 - DNA, 20 bp, Artificial Sequence
  Description of Artificial Sequence: Synthetic oligonucleotide
  Target: SCN10A; (+) strand; PAM type: NRG; PAM sequence: CAG
cccattgtgccccctccctg

SEQ ID NO: 32144 - DNA, 20 bp, Artificial Sequence
  Description of Artificial Sequence: Synthetic oligonucleotide
  Target: SCN10A; (+) strand; PAM type: NRG; PAM sequence: CAG
gcagcctctccccctgctcc

SEQ ID NO: 32145 - DNA, 20 bp, Artificial Sequence
  Description of Artificial Sequence: Synthetic oligonucleotide
  Target: SCN10A; (+) strand; PAM type: NRG; PAM sequence: TAG
cctctccccctgctcccagc

SEQ ID NO: 32146 - DNA, 20 bp, Artificial Sequence
  Description of Artificial Sequence: Synthetic oligonucleotide
  Target: SCN10A; (+) strand; PAM type: NRG; PAM sequence: AGG
ctctccccctgctcccagct

SEQ ID NO: 32147 - DNA, 20 bp, Artificial Sequence
  Description of Artificial Sequence: Synthetic oligonucleotide
  Target: SCN10A; (+) strand; PAM type: NRG; PAM sequence: CAG
gctcccagctaggacctgtg

SEQ ID NO: 32148 - DNA, 20 bp, Artificial Sequence
  Description of Artificial Sequence: Synthetic oligonucleotide
  Target: SCN10A; (+) strand; PAM type: NRG; PAM sequence: TGG
cagctaggacctgtgcagct

SEQ ID NO: 32149 - DNA, 20 bp, Artificial Sequence
  Description of Artificial Sequence: Synthetic oligonucleotide
  Target: SCN10A; (+) strand; PAM type: NRG; PAM sequence: GAG
gctaggacctgtgcagcttg

SEQ ID NO: 32150 - DNA, 20 bp, Artificial Sequence
  Description of Artificial Sequence: Synthetic oligonucleotide
  Target: SCN10A; (+) strand; PAM type: NRG; PAM sequence: CAG
cctgtgcagcttggagaaat

SEQ ID NO: 32151 - DNA, 20 bp, Artificial Sequence
  Description of Artificial Sequence: Synthetic oligonucleotide
  Target: SCN10A; (+) strand; PAM type: NRG; PAM sequence: CAG
tgcagcttggagaaatcagt

SEQ ID NO: 32152 - DNA, 20 bp, Artificial Sequence
  Description of Artificial Sequence: Synthetic oligonucleotide
  Target: SCN10A; (+) strand; PAM type: NRG; PAM sequence: GAG
cctgaataaaaatgttttct

SEQ ID NO: 32153 - DNA, 20 bp, Artificial Sequence
  Description of Artificial Sequence: Synthetic oligonucleotide
  Target: SCN10A; (+) strand; PAM type: NRG; PAM sequence: CAG
aaatgttttctgagccccct

SEQ ID NO: 32154 - DNA, 20 bp, Artificial Sequence
  Description of Artificial Sequence: Synthetic oligonucleotide
  Target: SCN10A; (+) strand; PAM type: NRG; PAM sequence: TGG
ttttctgagccccctcagat

SEQ ID NO: 32155 - DNA, 20 bp, Artificial Sequence
  Description of Artificial Sequence: Synthetic oligonucleotide
  Target: SCN10A; (+) strand; PAM type: NRG; PAM sequence: GGG
tttctgagccccctcagatt

SEQ ID NO: 32156 - DNA, 20 bp, Artificial Sequence
  Description of Artificial Sequence: Synthetic oligonucleotide
  Target: SCN10A; (+) strand; PAM type: NRG; PAM sequence: GGG
ttctgagccccctcagattg

SEQ ID NO: 32157 - DNA, 20 bp, Artificial Sequence
  Description of Artificial Sequence: Synthetic oligonucleotide
  Target: SCN10A; (+) strand; PAM type: NRG; PAM sequence: AAG
tgagccccctcagattgggg

SEQ ID NO: 32158 - DNA, 20 bp, Artificial Sequence
  Description of Artificial Sequence: Synthetic oligonucleotide
  Target: SCN10A; (+) strand; PAM type: NRG; PAM sequence: AGG
gagccccctcagattgggga

SEQ ID NO: 32159 - DNA, 20 bp, Artificial Sequence
  Description of Artificial Sequence: Synthetic oligonucleotide
  Target: SCN10A; (+) strand; PAM type: NRG; PAM sequence: CAG
gaaggacatttttcctttaa

SEQ ID NO: 32160 - DNA, 20 bp, Artificial Sequence
  Description of Artificial Sequence: Synthetic oligonucleotide
  Target: SCN10A; (+) strand; PAM type: NRG; PAM sequence: TAG
atttttcctttaacagctaa

SEQ ID NO: 32161 - DNA, 20 bp, Artificial Sequence
  Description of Artificial Sequence: Synthetic oligonucleotide
  Target: SCN10A; (+) strand; PAM type: NRG; PAM sequence: GAG
gctaatagacaccgtttatt

SEQ ID NO: 32162 - DNA, 20 bp, Artificial Sequence
  Description of Artificial Sequence: Synthetic oligonucleotide
  Target: SCN10A; (+) strand; PAM type: NRG; PAM sequence: CAG
cgtttattgagttcctgcct

SEQ ID NO: 32163 - DNA, 20 bp, Artificial Sequence
  Description of Artificial Sequence: Synthetic oligonucleotide
  Target: SCN10A; (+) strand; PAM type: NRG; PAM sequence: CAG
attgagttcctgcctcagcc

SEQ ID NO: 32164 - DNA, 20 bp, Artificial Sequence
  Description of Artificial Sequence: Synthetic oligonucleotide
  Target: SCN10A; (+) strand; PAM type: NRG; PAM sequence: TAG
cctcagcccagacattgcat

SEQ ID NO: 32165 - DNA, 20 bp, Artificial Sequence
  Description of Artificial Sequence: Synthetic oligonucleotide
  Target: SCN10A; (+) strand; PAM type: NRG; PAM sequence: AGG
ctcagcccagacattgcatt

SEQ ID NO: 32166 - DNA, 20 bp, Artificial Sequence
  Description of Artificial Sequence: Synthetic oligonucleotide
  Target: SCN10A; (+) strand; PAM type: NRG; PAM sequence: CAG
ctcctgtcatttaattctcc

SEQ ID NO: 32167 - DNA, 20 bp, Artificial Sequence
  Description of Artificial Sequence: Synthetic oligonucleotide
  Target: SCN10A; (+) strand; PAM type: NRG; PAM sequence: GAG
aattctcccagtaaacccat

SEQ ID NO: 32168 - DNA, 20 bp, Artificial Sequence
  Description of Artificial Sequence: Synthetic oligonucleotide
  Target: SCN10A; (+) strand; PAM type: NRG; PAM sequence: AAG
ctcccagtaaacccatgagt

SEQ ID NO: 32169 - DNA, 20 bp, Artificial Sequence
  Description of Artificial Sequence: Synthetic oligonucleotide
  Target: SCN10A; (+) strand; PAM type: NRG; PAM sequence: AAG
agcattattttcttgatttt

SEQ ID NO: 32170 - DNA, 20 bp, Artificial Sequence
  Description of Artificial Sequence: Synthetic oligonucleotide
  Target: SCN10A; (+) strand; PAM type: NRG; PAM sequence: AGG
gcattattttcttgatttta

SEQ ID NO: 32171 - DNA, 20 bp, Artificial Sequence
  Description of Artificial Sequence: Synthetic oligonucleotide
  Target: SCN10A; (+) strand; PAM type: NRG; PAM sequence: TAG
tttcttgattttaaggaaat

SEQ ID NO: 32172 - DNA, 20 bp, Artificial Sequence
  Description of Artificial Sequence: Synthetic oligonucleotide
  Target: SCN10A; (+) strand; PAM type: NRG; PAM sequence: GAG
ttttaaggaaattagatctt

SEQ ID NO: 32173 - DNA, 20 bp, Artificial Sequence
  Description of Artificial Sequence: Synthetic oligonucleotide
  Target: SCN10A; (+) strand; PAM type: NRG; PAM sequence: AGG
tttaaggaaattagatcttg

SEQ ID NO: 32174 - DNA, 20 bp, Artificial Sequence
  Description of Artificial Sequence: Synthetic oligonucleotide
  Target: SCN10A; (+) strand; PAM type: NRG; PAM sequence: GAG
taaggaaattagatcttgag

SEQ ID NO: 32175 - DNA, 20 bp, Artificial Sequence
  Description of Artificial Sequence: Synthetic oligonucleotide
  Target: SCN10A; (+) strand; PAM type: NRG; PAM sequence: AAG
aattagatcttgaggagatt

SEQ ID NO: 32176 - DNA, 20 bp, Artificial Sequence
  Description of Artificial Sequence: Synthetic oligonucleotide
  Target: SCN10A; (+) strand; PAM type: NRG; PAM sequence: TGG
aggagattaagtctcttgcc

SEQ ID NO: 32177 - DNA, 20 bp, Artificial Sequence
  Description of Artificial Sequence: Synthetic oligonucleotide
  Target: SCN10A; (+) strand; PAM type: NRG; PAM sequence: GGG
ggagattaagtctcttgcct

SEQ ID NO: 32178 - DNA, 20 bp, Artificial Sequence
  Description of Artificial Sequence: Synthetic oligonucleotide
  Target: SCN10A; (+) strand; PAM type: NRG; PAM sequence: GGG
gagattaagtctcttgcctg

SEQ ID NO: 32179 - DNA, 20 bp, Artificial Sequence
  Description of Artificial Sequence: Synthetic oligonucleotide
  Target: SCN10A; (+) strand; PAM type: NRG; PAM sequence: TAG
cttgcctggggtcacccacc

SEQ ID NO: 32180 - DNA, 20 bp, Artificial Sequence
  Description of Artificial Sequence: Synthetic oligonucleotide
  Target: SCN10A; (+) strand; PAM type: NRG; PAM sequence: TGG
ggggtcacccacctagtaaa

SEQ ID NO: 32181 - DNA, 20 bp, Artificial Sequence
  Description of Artificial Sequence: Synthetic oligonucleotide
  Target: SCN10A; (+) strand; PAM type: NRG; PAM sequence: TGG
gtcacccacctagtaaatgg

SEQ ID NO: 32182 - DNA, 20 bp, Artificial Sequence
  Description of Artificial Sequence: Synthetic oligonucleotide
  Target: SCN10A; (+) strand; PAM type: NRG; PAM sequence: GAG
cacccacctagtaaatggtg

SEQ ID NO: 32183 - DNA, 20 bp, Artificial Sequence
  Description of Artificial Sequence: Synthetic oligonucleotide
  Target: SCN10A; (+) strand; PAM type: NRG; PAM sequence: CAG
ccacctagtaaatggtggag

SEQ ID NO: 32184 - DNA, 20 bp, Artificial Sequence
  Description of Artificial Sequence: Synthetic oligonucleotide
  Target: SCN10A; (+) strand; PAM type: NRG; PAM sequence: GAG
acctagtaaatggtggagca

SEQ ID NO: 32185 - DNA, 20 bp, Artificial Sequence
  Description of Artificial Sequence: Synthetic oligonucleotide
  Target: SCN10A; (+) strand; PAM type: NRG; PAM sequence: CAG
gtggagcagagattctacac

SEQ ID NO: 32186 - DNA, 20 bp, Artificial Sequence
  Description of Artificial Sequence: Synthetic oligonucleotide
  Target: SCN10A; (+) strand; PAM type: NRG; PAM sequence: AGG
tggagcagagattctacacc

SEQ ID NO: 32187 - DNA, 20 bp, Artificial Sequence
  Description of Artificial Sequence: Synthetic oligonucleotide
  Target: SCN10A; (+) strand; PAM type: NRG; PAM sequence: AAG
tcatatgttctcattcctgc

SEQ ID NO: 32188 - DNA, 20 bp, Artificial Sequence
  Description of Artificial Sequence: Synthetic oligonucleotide
  Target: SCN10A; (+) strand; PAM type: NRG; PAM sequence: CAG
atgttctcattcctgcaagt

SEQ ID NO: 32189 - DNA, 20 bp, Artificial Sequence
  Description of Artificial Sequence: Synthetic oligonucleotide
  Target: SCN10A; (+) strand; PAM type: NRG; PAM sequence: AAG
tgcaagtcagactgcctccc

SEQ ID NO: 32190 - DNA, 20 bp, Artificial Sequence
  Description of Artificial Sequence: Synthetic oligonucleotide
  Target: SCN10A; (+) strand; PAM type: NRG; PAM sequence: AGG
gcaagtcagactgcctccca

SEQ ID NO: 32191 - DNA, 20 bp, Artificial Sequence
  Description of Artificial Sequence: Synthetic oligonucleotide
  Target: SCN10A; (+) strand; PAM type: NRG; PAM sequence: AAG
gaatcccacatgaatttgaa

SEQ ID NO: 32192 - DNA, 20 bp, Artificial Sequence
  Description of Artificial Sequence: Synthetic oligonucleotide
  Target: SCN10A; (+) strand; PAM type: NRG; PAM sequence: AAG
acatgaatttgaaaagtttg

SEQ ID NO: 32193 - DNA, 20 bp, Artificial Sequence
  Description of Artificial Sequence: Synthetic oligonucleotide
  Target: SCN10A; (+) strand; PAM type: NRG; PAM sequence: CAG
aagtttgaagacttttcaac

SEQ ID NO: 32194 - DNA, 20 bp, Artificial Sequence
  Description of Artificial Sequence: Synthetic oligonucleotide
  Target: SCN10A; (+) strand; PAM type: NRG; PAM sequence: GAG
gtttgaagacttttcaacca

SEQ ID NO: 32195 - DNA, 20 bp, Artificial Sequence
  Description of Artificial Sequence: Synthetic oligonucleotide
  Target: SCN10A; (+) strand; PAM type: NRG; PAM sequence: AAG
tgaagacttttcaaccagag

SEQ ID NO: 32196 - DNA, 20 bp, Artificial Sequence
  Description of Artificial Sequence: Synthetic oligonucleotide
  Target: SCN10A; (+) strand; PAM type: NRG; PAM sequence: TGG
tcaaccagagaagtacaatc

SEQ ID NO: 32197 - DNA, 20 bp, Artificial Sequence
  Description of Artificial Sequence: Synthetic oligonucleotide
  Target: SCN10A; (+) strand; PAM type: NRG; PAM sequence: GGG
caaccagagaagtacaatct

SEQ ID NO: 32198 - DNA, 20 bp, Artificial Sequence
  Description of Artificial Sequence: Synthetic oligonucleotide
  Target: SCN10A; (+) strand; PAM type: NRG; PAM sequence: CAG
acaatctgggcataaaaatg

SEQ ID NO: 32199 - DNA, 20 bp, Artificial Sequence
  Description of Artificial Sequence: Synthetic oligonucleotide
  Target: SCN10A; (+) strand; PAM type: NRG; PAM sequence: AAG
gggcataaaaatgcagatca

SEQ ID NO: 32200 - DNA, 20 bp, Artificial Sequence
  Description of Artificial Sequence: Synthetic oligonucleotide
  Target: SCN10A; (+) strand; PAM type: NRG; PAM sequence: CAG
aatgcagatcaaagcttttt

SEQ ID NO: 32201 - DNA, 20 bp, Artificial Sequence
  Description of Artificial Sequence: Synthetic oligonucleotide
  Target: SCN10A; (+) strand; PAM type: NRG; PAM sequence: CAG
caaagctttttcagataacc

SEQ ID NO: 32202 - DNA, 20 bp, Artificial Sequence
  Description of Artificial Sequence: Synthetic oligonucleotide
  Target: SCN10A; (+) strand; PAM type: NRG; PAM sequence: AAG
agctttttcagataacccag

SEQ ID NO: 32203 - DNA, 20 bp, Artificial Sequence
  Description of Artificial Sequence: Synthetic oligonucleotide
  Target: SCN10A; (+) strand; PAM type: NRG; PAM sequence: CAG
cagaagccttctcctttccc

SEQ ID NO: 32204 - DNA, 20 bp, Artificial Sequence
  Description of Artificial Sequence: Synthetic oligonucleotide
  Target: SCN10A; (+) strand; PAM type: NRG; PAM sequence: AGG
agaagccttctcctttcccc

SEQ ID NO: 32205 - DNA, 20 bp, Artificial Sequence
  Description of Artificial Sequence: Synthetic oligonucleotide
  Target: SCN10A; (+) strand; PAM type: NRG; PAM sequence: GAG
aagccttctcctttccccag

SEQ ID NO: 32206 - DNA, 20 bp, Artificial Sequence
  Description of Artificial Sequence: Synthetic oligonucleotide
  Target: SCN10A; (+) strand; PAM type: NRG; PAM sequence: CAG
cttctcctttccccaggaga

SEQ ID NO: 32207 - DNA, 20 bp, Artificial Sequence
  Description of Artificial Sequence: Synthetic oligonucleotide
  Target: SCN10A; (+) strand; PAM type: NRG; PAM sequence: CAG
tccccaggagacagtgcccc

SEQ ID NO: 32208 - DNA, 20 bp, Artificial Sequence
  Description of Artificial Sequence: Synthetic oligonucleotide
  Target: SCN10A; (+) strand; PAM type: NRG; PAM sequence: CAG
ccaggagacagtgcccccag

SEQ ID NO: 32209 - DNA, 20 bp, Artificial Sequence
  Description of Artificial Sequence: Synthetic oligonucleotide
  Target: SCN10A; (+) strand; PAM type: NRG; PAM sequence: AGG
caggagacagtgcccccagc

SEQ ID NO: 32210 - DNA, 20 bp, Artificial Sequence
  Description of Artificial Sequence: Synthetic oligonucleotide
  Target: SCN10A; (+) strand; PAM type: NRG; PAM sequence: GGG
aggagacagtgcccccagca

SEQ ID NO: 32211 - DNA, 20 bp, Artificial Sequence
  Description of Artificial Sequence: Synthetic oligonucleotide
  Target: SCN10A; (+) strand; PAM type: NRG; PAM sequence: CAG
cagggttcaccactcaccac

SEQ ID NO: 32212 - DNA, 20 bp, Artificial Sequence
  Description of Artificial Sequence: Synthetic oligonucleotide
  Target: SCN10A; (+) strand; PAM type: NRG; PAM sequence: AGG
agggttcaccactcaccacc

SEQ ID NO: 32213 - DNA, 20 bp, Artificial Sequence
  Description of Artificial Sequence: Synthetic oligonucleotide
  Target: SCN10A; (+) strand; PAM type: NRG; PAM sequence: TAG
ccactcaccaccaggttccc

SEQ ID NO: 32214 - DNA, 20 bp, Artificial Sequence
  Description of Artificial Sequence: Synthetic oligonucleotide
  Target: SCN10A; (+) strand; PAM type: NRG; PAM sequence: AAG
tccctagcaccatcaccgtc

SEQ ID NO: 32215 - DNA, 20 bp, Artificial Sequence
  Description of Artificial Sequence: Synthetic oligonucleotide
  Target: SCN10A; (+) strand; PAM type: NRG; PAM sequence: AAG
agcaccatcaccgtcaagaa

SEQ ID NO: 32216 - DNA, 20 bp, Artificial Sequence
  Description of Artificial Sequence: Synthetic oligonucleotide
  Target: SCN10A; (+) strand; PAM type: NRG; PAM sequence: AGG
gcaccatcaccgtcaagaaa

SEQ ID NO: 32217 - DNA, 20 bp, Artificial Sequence
  Description of Artificial Sequence: Synthetic oligonucleotide
  Target: SCN10A; (+) strand; PAM type: NRG; PAM sequence: GAG
atcaccgtcaagaaaaggat

SEQ ID NO: 32218 - DNA, 20 bp, Artificial Sequence
  Description of Artificial Sequence: Synthetic oligonucleotide
  Target: SCN10A; (+) strand; PAM type: NRG; PAM sequence: AGG
tcaccgtcaagaaaaggatg

SEQ ID NO: 32219 - DNA, 20 bp, Artificial Sequence
  Description of Artificial Sequence: Synthetic oligonucleotide
  Target: SCN10A; (+) strand; PAM type: NRG; PAM sequence: TGG
caagaaaaggatgaggcata

SEQ ID NO: 32220 - DNA, 20 bp, Artificial Sequence
  Description of Artificial Sequence: Synthetic oligonucleotide
  Target: SCN10A; (+) strand; PAM type: NRG; PAM sequence: TGG
ggatgaggcatatggatttt

SEQ ID NO: 32221 - DNA, 20 bp, Artificial Sequence
  Description of Artificial Sequence: Synthetic oligonucleotide
  Target: SCN10A; (+) strand; PAM type: NRG; PAM sequence: CAG
atttttggccaacttccatg

SEQ ID NO: 32222 - DNA, 20 bp, Artificial Sequence
  Description of Artificial Sequence: Synthetic oligonucleotide
  Target: SCN10A; (+) strand; PAM type: NRG; PAM sequence: AGG
tttttggccaacttccatgc

SEQ ID NO: 32223 - DNA, 20 bp, Artificial Sequence
  Description of Artificial Sequence: Synthetic oligonucleotide
  Target: SCN10A; (+) strand; PAM type: NRG; PAM sequence: CAG
tgttctcaatccactctcca

SEQ ID NO: 32224 - DNA, 20 bp, Artificial Sequence
  Description of Artificial Sequence: Synthetic oligonucleotide
  Target: SCN10A; (+) strand; PAM type: NRG; PAM sequence: GAG
ttctcaatccactctccaca

SEQ ID NO: 32225 - DNA, 20 bp, Artificial Sequence
  Description of Artificial Sequence: Synthetic oligonucleotide
  Target: SCN10A; (+) strand; PAM type: NRG; PAM sequence: AGG
tctcaatccactctccacag

SEQ ID NO: 32226 - DNA, 20 bp, Artificial Sequence
  Description of Artificial Sequence: Synthetic oligonucleotide
  Target: SCN10A; (+) strand; PAM type: NRG; PAM sequence: CGG
tccactctccacagaggata

SEQ ID NO: 32227 - DNA, 20 bp, Artificial Sequence
  Description of Artificial Sequence: Synthetic oligonucleotide
  Target: SCN10A; (+) strand; PAM type: NRG; PAM sequence: AAG
actctccacagaggatacgg

SEQ ID NO: 32228 - DNA, 20 bp, Artificial Sequence
  Description of Artificial Sequence: Synthetic oligonucleotide
  Target: SCN10A; (+) strand; PAM type: NRG; PAM sequence: GAG
cagaggatacggaagacaat

SEQ ID NO: 32229 - DNA, 20 bp, Artificial Sequence
  Description of Artificial Sequence: Synthetic oligonucleotide
  Target: SCN10A; (+) strand; PAM type: NRG; PAM sequence: AGG
agaggatacggaagacaatg

SEQ ID NO: 32230 - DNA, 20 bp, Artificial Sequence
  Description of Artificial Sequence: Synthetic oligonucleotide
  Target: SCN10A; (+) strand; PAM type: NRG; PAM sequence: AAG
gatacggaagacaatgagga

SEQ ID NO: 32231 - DNA, 20 bp, Artificial Sequence
  Description of Artificial Sequence: Synthetic oligonucleotide
  Target: SCN10A; (+) strand; PAM type: NRG; PAM sequence: GAG
tacggaagacaatgaggaaa

SEQ ID NO: 32232 - DNA, 20 bp, Artificial Sequence
  Description of Artificial Sequence: Synthetic oligonucleotide
  Target: SCN10A; (+) strand; PAM type: NRG; PAM sequence: TGG
ggaagacaatgaggaaagag

SEQ ID NO: 32233 - DNA, 20 bp, Artificial Sequence
  Description of Artificial Sequence: Synthetic oligonucleotide
  Target: SCN10A; (+) strand; PAM type: NRG; PAM sequence: AAG
agacaatgaggaaagagtgg

SEQ ID NO: 32234 - DNA, 20 bp, Artificial Sequence
  Description of Artificial Sequence: Synthetic oligonucleotide
  Target: SCN10A; (+) strand; PAM type: NRG; PAM sequence: AAG
caatgaggaaagagtggaag

SEQ ID NO: 32235 - DNA, 20 bp, Artificial Sequence
  Description of Artificial Sequence: Synthetic oligonucleotide
  Target: SCN10A; (+) strand; PAM type: NRG; PAM sequence: CAG
ggaagaagtcgtgcatgtgc

SEQ ID NO: 32236 - DNA, 20 bp, Artificial Sequence
  Description of Artificial Sequence: Synthetic oligonucleotide
  Target: SCN10A; (+) strand; PAM type: NRG; PAM sequence: CGG
agaagtcgtgcatgtgccag

SEQ ID NO: 32237 - DNA, 20 bp, Artificial Sequence
  Description of Artificial Sequence: Synthetic oligonucleotide
  Target: SCN10A; (+) strand; PAM type: NRG; PAM sequence: GGG
gaagtcgtgcatgtgccagc

SEQ ID NO: 32238 - DNA, 20 bp, Artificial Sequence
  Description of Artificial Sequence: Synthetic oligonucleotide
  Target: SCN10A; (+) strand; PAM type: NRG; PAM sequence: GGG
aagtcgtgcatgtgccagcg

SEQ ID NO: 32239 - DNA, 20 bp, Artificial Sequence
  Description of Artificial Sequence: Synthetic oligonucleotide
  Target: SCN10A; (+) strand; PAM type: NRG; PAM sequence: CAG
cgtgcatgtgccagcggggc

SEQ ID NO: 32240 - DNA, 20 bp, Artificial Sequence
  Description of Artificial Sequence: Synthetic oligonucleotide
  Target: SCN10A; (+) strand; PAM type: NRG; PAM sequence: TGG
gccagcggggccagtcttca

SEQ ID NO: 32241 - DNA, 20 bp, Artificial Sequence
  Description of Artificial Sequence: Synthetic oligonucleotide
  Target: SCN10A; (+) strand; PAM type: NRG; PAM sequence: GGG
ccagcggggccagtcttcat

SEQ ID NO: 32242 - DNA, 20 bp, Artificial Sequence
  Description of Artificial Sequence: Synthetic oligonucleotide
  Target: SCN10A; (+) strand; PAM type: NRG; PAM sequence: GGG
cagcggggccagtcttcatg

SEQ ID NO: 32243 - DNA, 20 bp, Artificial Sequence
  Description of Artificial Sequence: Synthetic oligonucleotide
  Target: SCN10A; (+) strand; PAM type: NRG; PAM sequence: CGG
gggccagtcttcatggggcg

SEQ ID NO: 32244 - DNA, 20 bp, Artificial Sequence
  Description of Artificial Sequence: Synthetic oligonucleotide
  Target: SCN10A; (+) strand; PAM type: NRG; PAM sequence: GAG
gccagtcttcatggggcgcg

SEQ ID NO: 32245 - DNA, 20 bp, Artificial Sequence
  Description of Artificial Sequence: Synthetic oligonucleotide
  Target: SCN10A; (+) strand; PAM type: NRG; PAM sequence: CGG
ggggcgcggagatatttttt

SEQ ID NO: 32246 - DNA, 20 bp, Artificial Sequence
  Description of Artificial Sequence: Synthetic oligonucleotide
  Target: SCN10A; (+) strand; PAM type: NRG; PAM sequence: CGG
agatattttttcggttgtta

SEQ ID NO: 32247 - DNA, 20 bp, Artificial Sequence
  Description of Artificial Sequence: Synthetic oligonucleotide
  Target: SCN10A; (+) strand; PAM type: NRG; PAM sequence: TAG
tattttttcggttgttacgg

SEQ ID NO: 32248 - DNA, 20 bp, Artificial Sequence
  Description of Artificial Sequence: Synthetic oligonucleotide
  Target: SCN10A; (+) strand; PAM type: NRG; PAM sequence: TAG
ttgttacggtagttttcccc

SEQ ID NO: 32249 - DNA, 20 bp, Artificial Sequence
  Description of Artificial Sequence: Synthetic oligonucleotide
  Target: SCN10A; (+) strand; PAM type: NRG; PAM sequence: AGG
tgttacggtagttttcccct

SEQ ID NO: 32250 - DNA, 20 bp, Artificial Sequence
  Description of Artificial Sequence: Synthetic oligonucleotide
  Target: SCN10A; (+) strand; PAM type: NRG; PAM sequence: GAG
ttacggtagttttcccctag

SEQ ID NO: 32251 - DNA, 20 bp, Artificial Sequence
  Description of Artificial Sequence: Synthetic oligonucleotide
  Target: SCN10A; (+) strand; PAM type: NRG; PAM sequence: CAG
cctaggagctgcttgccaac

SEQ ID NO: 32252 - DNA, 20 bp, Artificial Sequence
  Description of Artificial Sequence: Synthetic oligonucleotide
  Target: SCN10A; (+) strand; PAM type: NRG; PAM sequence: GAG
taggagctgcttgccaacca

SEQ ID NO: 32253 - DNA, 20 bp, Artificial Sequence
  Description of Artificial Sequence: Synthetic oligonucleotide
  Target: SCN10A; (+) strand; PAM type: NRG; PAM sequence: AAG
gctgcttgccaaccagagca

SEQ ID NO: 32254 - DNA, 20 bp, Artificial Sequence
  Description of Artificial Sequence: Synthetic oligonucleotide
  Target: SCN10A; (+) strand; PAM type: NRG; PAM sequence: AAG
tgccaaccagagcaaagaca

SEQ ID NO: 32255 - DNA, 20 bp, Artificial Sequence
  Description of Artificial Sequence: Synthetic oligonucleotide
  Target: SCN10A; (+) strand; PAM type: NRG; PAM sequence: TGG
agcaaagacaaagacaatga

SEQ ID NO: 32256 - DNA, 20 bp, Artificial Sequence
  Description of Artificial Sequence: Synthetic oligonucleotide
  Target: SCN10A; (+) strand; PAM type: NRG; PAM sequence: CAG
aagacaaagacaatgatggc

SEQ ID NO: 32257 - DNA, 20 bp, Artificial Sequence
  Description of Artificial Sequence: Synthetic oligonucleotide
  Target: SCN10A; (+) strand; PAM type: NRG; PAM sequence: AGG
agacaaagacaatgatggcc

SEQ ID NO: 32258 - DNA, 20 bp, Artificial Sequence
  Description of Artificial Sequence: Synthetic oligonucleotide
  Target: SCN10A; (+) strand; PAM type: NRG; PAM sequence: TGG
gacaatgatggccaggatga

SEQ ID NO: 32259 - DNA, 20 bp, Artificial Sequence
  Description of Artificial Sequence: Synthetic oligonucleotide
  Target: SCN10A; (+) strand; PAM type: NRG; PAM sequence: GAG
atgatggccaggatgatggt

SEQ ID NO: 32260 - DNA, 20 bp, Artificial Sequence
  Description of Artificial Sequence: Synthetic oligonucleotide
  Target: SCN10A; (+) strand; PAM type: NRG; PAM sequence: AGG
tgatggccaggatgatggtg

SEQ ID NO: 32261 - DNA, 20 bp, Artificial Sequence
  Description of Artificial Sequence: Synthetic oligonucleotide
  Target: SCN10A; (+) strand; PAM type: NRG; PAM sequence: CAG
aggatgatggtgaggttccc

SEQ ID NO: 32262 - DNA, 20 bp, Artificial Sequence
  Description of Artificial Sequence: Synthetic oligonucleotide
  Target: SCN10A; (+) strand; PAM type: NRG; PAM sequence: GAG
ggttccccagtgcccccact

SEQ ID NO: 32263 - DNA, 20 bp, Artificial Sequence
  Description of Artificial Sequence: Synthetic oligonucleotide
  Target: SCN10A; (+) strand; PAM type: NRG; PAM sequence: GAG
gagtttccgatgatcttgat

SEQ ID NO: 32264 - DNA, 20 bp, Artificial Sequence
  Description of Artificial Sequence: Synthetic oligonucleotide
  Target: SCN10A; (+) strand; PAM type: NRG; PAM sequence: AAG
tgatcttgatgagtgtgttt

SEQ ID NO: 32265 - DNA, 20 bp, Artificial Sequence
  Description of Artificial Sequence: Synthetic oligonucleotide
  Target: SCN10A; (+) strand; PAM type: NRG; PAM sequence: AGG
gatcttgatgagtgtgttta

SEQ ID NO: 32266 - DNA, 20 bp, Artificial Sequence
  Description of Artificial Sequence: Synthetic oligonucleotide
  Target: SCN10A; (+) strand; PAM type: NRG; PAM sequence: TGG
cttgatgagtgtgtttaagg

SEQ ID NO: 32267 - DNA, 20 bp, Artificial Sequence
  Description of Artificial Sequence: Synthetic oligonucleotide
  Target: SCN10A; (+) strand; PAM type: NRG; PAM sequence: GGG
ttgatgagtgtgtttaaggt

SEQ ID NO: 32268 - DNA, 20 bp, Artificial Sequence
  Description of Artificial Sequence: Synthetic oligonucleotide
  Target: SCN10A; (+) strand; PAM type: NRG; PAM sequence: CAG
tgagtgtgtttaaggtgggc

SEQ ID NO: 32269 - DNA, 20 bp, Artificial Sequence
  Description of Artificial Sequence: Synthetic oligonucleotide
  Target: SCN10A; (+) strand; PAM type: NRG; PAM sequence: AGG
gagtgtgtttaaggtgggcc

SEQ ID NO: 32270 - DNA, 20 bp, Artificial Sequence
  Description of Artificial Sequence: Synthetic oligonucleotide
  Target: SCN10A; (+) strand; PAM type: NRG; PAM sequence: TGG
gtttaaggtgggccaggatt

SEQ ID NO: 32271 - DNA, 20 bp, Artificial Sequence
  Description of Artificial Sequence: Synthetic oligonucleotide
  Target: SCN10A; (+) strand; PAM type: NRG; PAM sequence: CAG
aaggtgggccaggatttggc

SEQ ID NO: 32272 - DNA, 20 bp, Artificial Sequence
  Description of Artificial Sequence: Synthetic oligonucleotide
  Target: SCN10A; (+) strand; PAM type: NRG; PAM sequence: CAG
ttggccagcttgaatacgcg

SEQ ID NO: 32273 - DNA, 20 bp, Artificial Sequence
  Description of Artificial Sequence: Synthetic oligonucleotide
  Target: SCN10A; (+) strand; PAM type: NRG; PAM sequence: CAG
agcttgaatacgcgcagctg

SEQ ID NO: 32274 - DNA, 20 bp, Artificial Sequence
  Description of Artificial Sequence: Synthetic oligonucleotide
  Target: SCN10A; (+) strand; PAM type: NRG; PAM sequence: GAG
cttgaatacgcgcagctgca

SEQ ID NO: 32275 - DNA, 20 bp, Artificial Sequence
  Description of Artificial Sequence: Synthetic oligonucleotide
  Target: SCN10A; (+) strand; PAM type: NRG; PAM sequence: CAG
tacgcgcagctgcagagaaa

SEQ ID NO: 32276 - DNA, 20 bp, Artificial Sequence
  Description of Artificial Sequence: Synthetic oligonucleotide
  Target: SCN10A; (+) strand; PAM type: NRG; PAM sequence: GAG
cgcgcagctgcagagaaaca

SEQ ID NO: 32277 - DNA, 20 bp, Artificial Sequence
  Description of Artificial Sequence: Synthetic oligonucleotide
  Target: SCN10A; (+) strand; PAM type: NRG; PAM sequence: CAG
tgcagagaaacagagaccgt

SEQ ID NO: 32278 - DNA, 20 bp, Artificial Sequence
  Description of Artificial Sequence: Synthetic oligonucleotide
  Target: SCN10A; (+) strand; PAM type: NRG; PAM sequence: AGG
gcagagaaacagagaccgtc

SEQ ID NO: 32279 - DNA, 20 bp, Artificial Sequence
  Description of Artificial Sequence: Synthetic oligonucleotide
  Target: SCN10A; (+) strand; PAM type: NRG; PAM sequence: TGG
aaacagagaccgtcaggttt

SEQ ID NO: 32280 - DNA, 20 bp, Artificial Sequence
  Description of Artificial Sequence: Synthetic oligonucleotide
  Target: SCN10A; (+) strand; PAM type: NRG; PAM sequence: TAG
cagagaccgtcaggttttgg

SEQ ID NO: 32281 - DNA, 20 bp, Artificial Sequence
  Description of Artificial Sequence: Synthetic oligonucleotide
  Target: SCN10A; (+) strand; PAM type: NRG; PAM sequence: AAG
tgctcattacctttcatcta

SEQ ID NO: 32282 - DNA, 20 bp, Artificial Sequence
  Description of Artificial Sequence: Synthetic oligonucleotide
  Target: SCN10A; (+) strand; PAM type: NRG; PAM sequence: TGG
ctttcatctaaagttttgcc

SEQ ID NO: 32283 - DNA, 20 bp, Artificial Sequence
  Description of Artificial Sequence: Synthetic oligonucleotide
  Target: SCN10A; (+) strand; PAM type: NRG; PAM sequence: AAG
aaagttttgcctggaaacca

SEQ ID NO: 32284 - DNA, 20 bp, Artificial Sequence
  Description of Artificial Sequence: Synthetic oligonucleotide
  Target: SCN10A; (+) strand; PAM type: NRG; PAM sequence: TGG
ttgcctggaaaccaaagatc

SEQ ID NO: 32285 - DNA, 20 bp, Artificial Sequence
  Description of Artificial Sequence: Synthetic oligonucleotide
  Target: SCN10A; (+) strand; PAM type: NRG; PAM sequence: GGG
tgcctggaaaccaaagatct

SEQ ID NO: 32286 - DNA, 20 bp, Artificial Sequence
  Description of Artificial Sequence: Synthetic oligonucleotide
  Target: SCN10A; (+) strand; PAM type: NRG; PAM sequence: AAG
caaagatctgggaaaaacac

SEQ ID NO: 32287 - DNA, 20 bp, Artificial Sequence
  Description of Artificial Sequence: Synthetic oligonucleotide
  Target: SCN10A; (+) strand; PAM type: NRG; PAM sequence: AGG
aaagatctgggaaaaacaca

SEQ ID NO: 32288 - DNA, 20 bp, Artificial Sequence
  Description of Artificial Sequence: Synthetic oligonucleotide
  Target: SCN10A; (+) strand; PAM type: NRG; PAM sequence: CAG
ggcctctcatcccattaaac

SEQ ID NO: 32289 - DNA, 20 bp, Artificial Sequence
  Description of Artificial Sequence: Synthetic oligonucleotide
  Target: SCN10A; (+) strand; PAM type: NRG; PAM sequence: AGG
gcctctcatcccattaaacc

SEQ ID NO: 32290 - DNA, 20 bp, Artificial Sequence
  Description of Artificial Sequence: Synthetic oligonucleotide
  Target: SCN10A; (+) strand; PAM type: NRG; PAM sequence: GGG
cctctcatcccattaaacca

SEQ ID NO: 32291 - DNA, 20 bp, Artificial Sequence
  Description of Artificial Sequence: Synthetic oligonucleotide
  Target: SCN10A; (+) strand; PAM type: NRG; PAM sequence: TGG
cattaaaccagggcgttttc

SEQ ID NO: 32292 - DNA, 20 bp, Artificial Sequence
  Description of Artificial Sequence: Synthetic oligonucleotide
  Target: SCN10A; (+) strand; PAM type: NRG; PAM sequence: TGG
cgttttctggacactgcttt

SEQ ID NO: 32293 - DNA, 20 bp, Artificial Sequence
  Description of Artificial Sequence: Synthetic oligonucleotide
  Target: SCN10A; (+) strand; PAM type: NRG; PAM sequence: GAG
ttttctggacactgcttttg

SEQ ID NO: 32294 - DNA, 20 bp, Artificial Sequence
  Description of Artificial Sequence: Synthetic oligonucleotide
  Target: SCN10A; (+) strand; PAM type: NRG; PAM sequence: TGG
aaaatatgatctgccttcta

SEQ ID NO: 32295 - DNA, 20 bp, Artificial Sequence
  Description of Artificial Sequence: Synthetic oligonucleotide
  Target: SCN10A; (+) strand; PAM type: NRG; PAM sequence: AAG
atctgccttctatggttcat

SEQ ID NO: 32296 - DNA, 20 bp, Artificial Sequence
  Description of Artificial Sequence: Synthetic oligonucleotide
  Target: SCN10A; (+) strand; PAM type: NRG; PAM sequence: TGG
tcaatgtgcttcattgactg

SEQ ID NO: 32297 - DNA, 20 bp, Artificial Sequence
  Description of Artificial Sequence: Synthetic oligonucleotide
  Target: SCN10A; (+) strand; PAM type: NRG; PAM sequence: GAG
gtgcttcattgactgtggct

SEQ ID NO: 32298 - DNA, 20 bp, Artificial Sequence
  Description of Artificial Sequence: Synthetic oligonucleotide
  Target: SCN10A; (+) strand; PAM type: NRG; PAM sequence: CAG
ttcattgactgtggctgagt

SEQ ID NO: 32299 - DNA, 20 bp, Artificial Sequence
  Description of Artificial Sequence: Synthetic oligonucleotide
  Target: SCN10A; (+) strand; PAM type: NRG; PAM sequence: AGG
tcattgactgtggctgagtc

SEQ ID NO: 32300 - DNA, 20 bp, Artificial Sequence
  Description of Artificial Sequence: Synthetic oligonucleotide
  Target: SCN10A; (+) strand; PAM type: NRG; PAM sequence: GGG
cattgactgtggctgagtca

SEQ ID NO: 32301 - DNA, 20 bp, Artificial Sequence
  Description of Artificial Sequence: Synthetic oligonucleotide
  Target: SCN10A; (+) strand; PAM type: NRG; PAM sequence: TGG
gctgagtcagggtcttctac

SEQ ID NO: 32302 - DNA, 20 bp, Artificial Sequence
  Description of Artificial Sequence: Synthetic oligonucleotide
  Target: SCN10A; (+) strand; PAM type: NRG; PAM sequence: GGG
ctgagtcagggtcttctact

SEQ ID NO: 32303 - DNA, 20 bp, Artificial Sequence
  Description of Artificial Sequence: Synthetic oligonucleotide
  Target: SCN10A; (+) strand; PAM type: NRG; PAM sequence: GGG
tgagtcagggtcttctactg

SEQ ID NO: 32304 - DNA, 20 bp, Artificial Sequence
  Description of Artificial Sequence: Synthetic oligonucleotide
  Target: SCN10A; (+) strand; PAM type: NRG; PAM sequence: TGG
gtcagggtcttctactgggg

SEQ ID NO: 32305 - DNA, 20 bp, Artificial Sequence
  Description of Artificial Sequence: Synthetic oligonucleotide
  Target: SCN10A; (+) strand; PAM type: NRG; PAM sequence: TGG
agggtcttctactggggtgg

SEQ ID NO: 32306 - DNA, 20 bp, Artificial Sequence
  Description of Artificial Sequence: Synthetic oligonucleotide
  Target: SCN10A; (+) strand; PAM type: NRG; PAM sequence: TAG
gcgatctgtactctgttcta

SEQ ID NO: 32307 - DNA, 20 bp, Artificial Sequence
  Description of Artificial Sequence: Synthetic oligonucleotide
  Target: SCN10A; (+) strand; PAM type: NRG; PAM sequence: CAG
tgtactctgttctatagcca

SEQ ID NO: 32308 - DNA, 20 bp, Artificial Sequence
  Description of Artificial Sequence: Synthetic oligonucleotide
  Target: SCN10A; (+) strand; PAM type: NRG; PAM sequence: AGG
gtactctgttctatagccac

SEQ ID NO: 32309 - DNA, 20 bp, Artificial Sequence
  Description of Artificial Sequence: Synthetic oligonucleotide
  Target: SCN10A; (+) strand; PAM type: NRG; PAM sequence: TGG
ggcctgatccctcctgaata

SEQ ID NO: 32310 - DNA, 20 bp, Artificial Sequence
  Description of Artificial Sequence: Synthetic oligonucleotide
  Target: SCN10A; (+) strand; PAM type: NRG; PAM sequence: GGG
gcctgatccctcctgaatat

SEQ ID NO: 32311 - DNA, 20 bp, Artificial Sequence
  Description of Artificial Sequence: Synthetic oligonucleotide
  Target: SCN10A; (+) strand; PAM type: NRG; PAM sequence: TGG
ctgaatatgggcctcttctg

SEQ ID NO: 32312 - DNA, 20 bp, Artificial Sequence
  Description of Artificial Sequence: Synthetic oligonucleotide
  Target: SCN10A; (+) strand; PAM type: NRG; PAM sequence: GAG
gaatatgggcctcttctgtg

SEQ ID NO: 32313 - DNA, 20 bp, Artificial Sequence
  Description of Artificial Sequence: Synthetic oligonucleotide
  Target: SCN10A; (+) strand; PAM type: NRG; PAM sequence: AGG
aatatgggcctcttctgtgg

SEQ ID NO: 32314 - DNA, 20 bp, Artificial Sequence
  Description of Artificial Sequence: Synthetic oligonucleotide
  Target: SCN10A; (+) strand; PAM type: NRG; PAM sequence: TGG
atgggcctcttctgtggagg

SEQ ID NO: 32315 - DNA, 20 bp, Artificial Sequence
  Description of Artificial Sequence: Synthetic oligonucleotide
  Target: SCN10A; (+) strand; PAM type: NRG; PAM sequence: GGG
tgggcctcttctgtggaggt

SEQ ID NO: 32316 - DNA, 20 bp, Artificial Sequence
  Description of Artificial Sequence: Synthetic oligonucleotide
  Target: SCN10A; (+) strand; PAM type: NRG; PAM sequence: GGG
gggcctcttctgtggaggtg

SEQ ID NO: 32317 - DNA, 20 bp, Artificial Sequence
  Description of Artificial Sequence: Synthetic oligonucleotide
  Target: SCN10A; (+) strand; PAM type: NRG; PAM sequence: TGG
cctcttctgtggaggtgggg

SEQ ID NO: 32318 - DNA, 20 bp, Artificial Sequence
  Description of Artificial Sequence: Synthetic oligonucleotide
  Target: SCN10A; (+) strand; PAM type: NRG; PAM sequence: GGG
ctcttctgtggaggtggggt

SEQ ID NO: 32319 - DNA, 20 bp, Artificial Sequence
  Description of Artificial Sequence: Synthetic oligonucleotide
  Target: SCN10A; (+) strand; PAM type: NRG; PAM sequence: TGG
tggaggtggggtgggtgtga

SEQ ID NO: 32320 - DNA, 20 bp, Artificial Sequence
  Description of Artificial Sequence: Synthetic oligonucleotide
  Target: SCN10A; (+) strand; PAM type: NRG; PAM sequence: GGG
ggaggtggggtgggtgtgat

SEQ ID NO: 32321 - DNA, 20 bp, Artificial Sequence
  Description of Artificial Sequence: Synthetic oligonucleotide
  Target: SCN10A; (+) strand; PAM type: NRG; PAM sequence: GGG
gaggtggggtgggtgtgatg

SEQ ID NO: 32322 - DNA, 20 bp, Artificial Sequence
  Description of Artificial Sequence: Synthetic oligonucleotide
  Target: SCN10A; (+) strand; PAM type: NRG; PAM sequence: AAG
gtgtgatggggctcacaaat

SEQ ID NO: 32323 - DNA, 20 bp, Artificial Sequence
  Description of Artificial Sequence: Synthetic oligonucleotide
  Target: SCN10A; (+) strand; PAM type: NRG; PAM sequence: GAG
gatggggctcacaaataagt

SEQ ID NO: 32324 - DNA, 20 bp, Artificial Sequence
  Description of Artificial Sequence: Synthetic oligonucleotide
  Target: SCN10A; (+) strand; PAM type: NRG; PAM sequence: AAG
gctcacaaataagtgagaac

SEQ ID NO: 32325 - DNA, 20 bp, Artificial Sequence
  Description of Artificial Sequence: Synthetic oligonucleotide
  Target: SCN10A; (+) strand; PAM type: NRG; PAM sequence: AAG
aacaagcttatttatgactg

SEQ ID NO: 32326 - DNA, 20 bp, Artificial Sequence
  Description of Artificial Sequence: Synthetic oligonucleotide
  Target: SCN10A; (+) strand; PAM type: NRG; PAM sequence: GAG
caagcttatttatgactgaa

SEQ ID NO: 32327 - DNA, 20 bp, Artificial Sequence
  Description of Artificial Sequence: Synthetic oligonucleotide
  Target: SCN10A; (+) strand; PAM type: NRG; PAM sequence: GAG
agcttatttatgactgaaga

SEQ ID NO: 32328 - DNA, 20 bp, Artificial Sequence
  Description of Artificial Sequence: Synthetic oligonucleotide
  Target: SCN10A; (+) strand; PAM type: NRG; PAM sequence: CAG
atttatgactgaagagagac

SEQ ID NO: 32329 - DNA, 20 bp, Artificial Sequence
  Description of Artificial Sequence: Synthetic oligonucleotide
  Target: SCN10A; (+) strand; PAM type: NRG; PAM sequence: CGG
gaagagagaccagcctcctt

SEQ ID NO: 32330 - DNA, 20 bp, Artificial Sequence
  Description of Artificial Sequence: Synthetic oligonucleotide
  Target: SCN10A; (+) strand; PAM type: NRG; PAM sequence: GGG
aagagagaccagcctccttc

SEQ ID NO: 32331 - DNA, 20 bp, Artificial Sequence
  Description of Artificial Sequence: Synthetic oligonucleotide
  Target: SCN10A; (+) strand; PAM type: NRG; PAM sequence: TAG
agagaccagcctccttcggg

SEQ ID NO: 32332 - DNA, 20 bp, Artificial Sequence
  Description of Artificial Sequence: Synthetic oligonucleotide
  Target: SCN10A; (+) strand; PAM type: NRG; PAM sequence: AGG
gagaccagcctccttcgggt

SEQ ID NO: 32333 - DNA, 20 bp, Artificial Sequence
  Description of Artificial Sequence: Synthetic oligonucleotide
  Target: SCN10A; (+) strand; PAM type: NRG; PAM sequence: GGG
agaccagcctccttcgggta

SEQ ID NO: 32334 - DNA, 20 bp, Artificial Sequence
  Description of Artificial Sequence: Synthetic oligonucleotide
  Target: SCN10A; (+) strand; PAM type: NRG; PAM sequence: GGG
gaccagcctccttcgggtag

SEQ ID NO: 32335 - DNA, 20 bp, Artificial Sequence
  Description of Artificial Sequence: Synthetic oligonucleotide
  Target: SCN10A; (+) strand; PAM type: NRG; PAM sequence: TAG
ggatgacccactgcattcga

SEQ ID NO: 32336 - DNA, 20 bp, Artificial Sequence
  Description of Artificial Sequence: Synthetic oligonucleotide
  Target: SCN10A; (+) strand; PAM type: NRG; PAM sequence: AGG
gatgacccactgcattcgat

SEQ ID NO: 32337 - DNA, 20 bp, Artificial Sequence
  Description of Artificial Sequence: Synthetic oligonucleotide
  Target: SCN10A; (+) strand; PAM type: NRG; PAM sequence: TGG
ccactgcattcgataggtat

SEQ ID NO: 32338 - DNA, 20 bp, Artificial Sequence
  Description of Artificial Sequence: Synthetic oligonucleotide
  Target: SCN10A; (+) strand; PAM type: NRG; PAM sequence: TAG
ggtattggcaaaacatctct

SEQ ID NO: 32339 - DNA, 20 bp, Artificial Sequence
  Description of Artificial Sequence: Synthetic oligonucleotide
  Target: SCN10A; (+) strand; PAM type: NRG; PAM sequence: AGG
gtattggcaaaacatctctt

SEQ ID NO: 32340 - DNA, 20 bp, Artificial Sequence
  Description of Artificial Sequence: Synthetic oligonucleotide
  Target: SCN10A; (+) strand; PAM type: NRG; PAM sequence: GGG
tattggcaaaacatctctta

SEQ ID NO: 32341 - DNA, 20 bp, Artificial Sequence
  Description of Artificial Sequence: Synthetic oligonucleotide
  Target: SCN10A; (+) strand; PAM type: NRG; PAM sequence: TGG
tcttagggcatttctcatct

SEQ ID NO: 32342 - DNA, 20 bp, Artificial Sequence
  Description of Artificial Sequence: Synthetic oligonucleotide
  Target: SCN10A; (+) strand; PAM type: NRG; PAM sequence: GGG
cttagggcatttctcatctt

SEQ ID NO: 32343 - DNA, 20 bp, Artificial Sequence
  Description of Artificial Sequence: Synthetic oligonucleotide
  Target: SCN10A; (+) strand; PAM type: NRG; PAM sequence: GGG
ttagggcatttctcatcttg

SEQ ID NO: 32344 - DNA, 20 bp, Artificial Sequence
  Description of Artificial Sequence: Synthetic oligonucleotide
  Target: SCN10A; (+) strand; PAM type: NRG; PAM sequence: CAG
gggcatttctcatcttgggg

SEQ ID NO: 32345 - DNA, 20 bp, Artificial Sequence
  Description of Artificial Sequence: Synthetic oligonucleotide
  Target: SCN10A; (+) strand; PAM type: NRG; PAM sequence: TGG
catttctcatcttggggcag

SEQ ID NO: 32346 - DNA, 20 bp, Artificial Sequence
  Description of Artificial Sequence: Synthetic oligonucleotide
  Target: SCN10A; (+) strand; PAM type: NRG; PAM sequence: CAG
acaacatctgttgctcccac

SEQ ID NO: 32347 - DNA, 20 bp, Artificial Sequence
  Description of Artificial Sequence: Synthetic oligonucleotide
  Target: SCN10A; (+) strand; PAM type: NRG; PAM sequence: TGG
tgcaaatgtccatgatttca

SEQ ID NO: 32348 - DNA, 20 bp, Artificial Sequence
  Description of Artificial Sequence: Synthetic oligonucleotide
  Target: SCN10A; (+) strand; PAM type: NRG; PAM sequence: CAG
tgtccatgatttcatggact

SEQ ID NO: 32349 - DNA, 20 bp, Artificial Sequence
  Description of Artificial Sequence: Synthetic oligonucleotide
  Target: SCN10A; (+) strand; PAM type: NRG; PAM sequence: AAG
ttcatggactcagcattcat

SEQ ID NO: 32350 - DNA, 20 bp, Artificial Sequence
  Description of Artificial Sequence: Synthetic oligonucleotide
  Target: SCN10A; (+) strand; PAM type: NRG; PAM sequence: CAG
tgaccaacgaacctaccccc

SEQ ID NO: 32351 - DNA, 20 bp, Artificial Sequence
  Description of Artificial Sequence: Synthetic oligonucleotide
  Target: SCN10A; (+) strand; PAM type: NRG; PAM sequence: CAG
gaacctaccccccagaactc

SEQ ID NO: 32352 - DNA, 20 bp, Artificial Sequence
  Description of Artificial Sequence: Synthetic oligonucleotide
  Target: SCN10A; (+) strand; PAM type: NRG; PAM sequence: CAG
cccccagaactccagccgtg

SEQ ID NO: 32353 - DNA, 20 bp, Artificial Sequence
  Description of Artificial Sequence: Synthetic oligonucleotide
  Target: SCN10A; (+) strand; PAM type: NRG; PAM sequence: AGG
ccccagaactccagccgtgc

SEQ ID NO: 32354 - DNA, 20 bp, Artificial Sequence
  Description of Artificial Sequence: Synthetic oligonucleotide
  Target: SCN10A; (+) strand; PAM type: NRG; PAM sequence: TGG
actccagccgtgcaggtgca

SEQ ID NO: 32355 - DNA, 20 bp, Artificial Sequence
  Description of Artificial Sequence: Synthetic oligonucleotide
  Target: SCN10A; (+) strand; PAM type: NRG; PAM sequence: CAG
ccagccgtgcaggtgcatgg

SEQ ID NO: 32356 - DNA, 20 bp, Artificial Sequence
  Description of Artificial Sequence: Synthetic oligonucleotide
  Target: SCN10A; (+) strand; PAM type: NRG; PAM sequence: TAG
gcaggtgcatggcagtgtgc

SEQ ID NO: 32357 - DNA, 20 bp, Artificial Sequence
  Description of Artificial Sequence: Synthetic oligonucleotide
  Target: SCN10A; (+) strand; PAM type: NRG; PAM sequence: GAG
atggcagtgtgctagcctat

SEQ ID NO: 32358 - DNA, 20 bp, Artificial Sequence
  Description of Artificial Sequence: Synthetic oligonucleotide
  Target: SCN10A; (+) strand; PAM type: NRG; PAM sequence: AGG
tggcagtgtgctagcctatg

SEQ ID NO: 32359 - DNA, 20 bp, Artificial Sequence
  Description of Artificial Sequence: Synthetic oligonucleotide
  Target: SCN10A; (+) strand; PAM type: NRG; PAM sequence: AAG
gctagcctatgaggtgtatg

SEQ ID NO: 32360 - DNA, 20 bp, Artificial Sequence
  Description of Artificial Sequence: Synthetic oligonucleotide
  Target: SCN10A; (+) strand; PAM type: NRG; PAM sequence: GAG
tagcctatgaggtgtatgaa

SEQ ID NO: 32361 - DNA, 20 bp, Artificial Sequence
  Description of Artificial Sequence: Synthetic oligonucleotide
  Target: SCN10A; (+) strand; PAM type: NRG; PAM sequence: GAG
gcctatgaggtgtatgaaga

SEQ ID NO: 32362 - DNA, 20 bp, Artificial Sequence
  Description of Artificial Sequence: Synthetic oligonucleotide
  Target: SCN10A; (+) strand; PAM type: NRG; PAM sequence: AGG
cctatgaggtgtatgaagag

SEQ ID NO: 32363 - DNA, 20 bp, Artificial Sequence
  Description of Artificial Sequence: Synthetic oligonucleotide
  Target: SCN10A; (+) strand; PAM type: NRG; PAM sequence: TGG
ggtgtatgaagagaggtgtg

SEQ ID NO: 32364 - DNA, 20 bp, Artificial Sequence
  Description of Artificial Sequence: Synthetic oligonucleotide
  Target: SCN10A; (+) strand; PAM type: NRG; PAM sequence: GGG
gtgtatgaagagaggtgtgt

SEQ ID NO: 32365 - DNA, 20 bp, Artificial Sequence
  Description of Artificial Sequence: Synthetic oligonucleotide
  Target: SCN10A; (+) strand; PAM type: NRG; PAM sequence: TGG
tgtgtgggctcttgctctca

SEQ ID NO: 32366 - DNA, 20 bp, Artificial Sequence
  Description of Artificial Sequence: Synthetic oligonucleotide
  Target: SCN10A; (+) strand; PAM type: NRG; PAM sequence: TGG
tcttgctctcatggaaccaa

SEQ ID NO: 32367 - DNA, 20 bp, Artificial Sequence
  Description of Artificial Sequence: Synthetic oligonucleotide
  Target: SCN10A; (+) strand; PAM type: NRG; PAM sequence: TAG
ctctcatggaaccaatggtt

SEQ ID NO: 32368 - DNA, 20 bp, Artificial Sequence
  Description of Artificial Sequence: Synthetic oligonucleotide
  Target: SCN10A; (+) strand; PAM type: NRG; PAM sequence: GAG
gaaccaatggtttagttact

SEQ ID NO: 32369 - DNA, 20 bp, Artificial Sequence
  Description of Artificial Sequence: Synthetic oligonucleotide
  Target: SCN10A; (+) strand; PAM type: NRG; PAM sequence: AAG
aatggtttagttactgagaa

SEQ ID NO: 32370 - DNA, 20 bp, Artificial Sequence
  Description of Artificial Sequence: Synthetic oligonucleotide
  Target: SCN10A; (+) strand; PAM type: NRG; PAM sequence: AAG
ttagttactgagaaaagatg

SEQ ID NO: 32371 - DNA, 20 bp, Artificial Sequence
  Description of Artificial Sequence: Synthetic oligonucleotide
  Target: SCN10A; (+) strand; PAM type: NRG; PAM sequence: AAG
gagaaaagatgaagtctcaa

SEQ ID NO: 32372 - DNA, 20 bp, Artificial Sequence
  Description of Artificial Sequence: Synthetic oligonucleotide
  Target: SCN10A; (+) strand; PAM type: NRG; PAM sequence: AAG
actgtaaactcaaatatgct

SEQ ID NO: 32373 - DNA, 20 bp, Artificial Sequence
  Description of Artificial Sequence: Synthetic oligonucleotide
  Target: SCN10A; (+) strand; PAM type: NRG; PAM sequence: AAG
tcaaatatgctaagtcccac

SEQ ID NO: 32374 - DNA, 20 bp, Artificial Sequence
  Description of Artificial Sequence: Synthetic oligonucleotide
  Target: SCN10A; (+) strand; PAM type: NRG; PAM sequence: CAG
atatgctaagtcccacaaga

SEQ ID NO: 32375 - DNA, 20 bp, Artificial Sequence
  Description of Artificial Sequence: Synthetic oligonucleotide
  Target: SCN10A; (+) strand; PAM type: NRG; PAM sequence: AAG
cacaagacagcaaaatcatc

SEQ ID NO: 32376 - DNA, 20 bp, Artificial Sequence
  Description of Artificial Sequence: Synthetic oligonucleotide
  Target: SCN10A; (+) strand; PAM type: NRG; PAM sequence: TGG
tgttttaaaatatatttgta

SEQ ID NO: 32377 - DNA, 20 bp, Artificial Sequence
  Description of Artificial Sequence: Synthetic oligonucleotide
  Target: SCN10A; (+) strand; PAM type: NRG; PAM sequence: CAG
tgtatggttctctaatttgt

SEQ ID NO: 32378 - DNA, 20 bp, Artificial Sequence
  Description of Artificial Sequence: Synthetic oligonucleotide
  Target: SCN10A; (+) strand; PAM type: NRG; PAM sequence: AGG
gtatggttctctaatttgtc

SEQ ID NO: 32379 - DNA, 20 bp, Artificial Sequence
  Description of Artificial Sequence: Synthetic oligonucleotide
  Target: SCN10A; (+) strand; PAM type: NRG; PAM sequence: GAG
tttgtcaggaaaaaaaatct

SEQ ID NO: 32380 - DNA, 20 bp, Artificial Sequence
  Description of Artificial Sequence: Synthetic oligonucleotide
  Target: SCN10A; (+) strand; PAM type: NRG; PAM sequence: CAG
aaaaatctgagctcaactgt

SEQ ID NO: 32381 - DNA, 20 bp, Artificial Sequence
  Description of Artificial Sequence: Synthetic oligonucleotide
  Target: SCN10A; (+) strand; PAM type: NRG; PAM sequence: CAG
gagctcaactgtcagtctgt

SEQ ID NO: 32382 - DNA, 20 bp, Artificial Sequence
  Description of Artificial Sequence: Synthetic oligonucleotide
  Target: SCN10A; (+) strand; PAM type: NRG; PAM sequence: AAG
caactgtcagtctgtcagtc

SEQ ID NO: 32383 - DNA, 20 bp, Artificial Sequence
  Description of Artificial Sequence: Synthetic oligonucleotide
  Target: SCN10A; (+) strand; PAM type: NRG; PAM sequence: AGG
aactgtcagtctgtcagtca

SEQ ID NO: 32384 - DNA, 20 bp, Artificial Sequence
  Description of Artificial Sequence: Synthetic oligonucleotide
  Target: SCN10A; (+) strand; PAM type: NRG; PAM sequence: TGG
tgtcagtcaaggtgtgttta

SEQ ID NO: 32385 - DNA, 20 bp, Artificial Sequence
  Description of Artificial Sequence: Synthetic oligonucleotide
  Target: SCN10A; (+) strand; PAM type: NRG; PAM sequence: GAG
tcagtcaaggtgtgtttatg

SEQ ID NO: 32386 - DNA, 20 bp, Artificial Sequence
  Description of Artificial Sequence: Synthetic oligonucleotide
  Target: SCN10A; (+) strand; PAM type: NRG; PAM sequence: AAG
gtgtttatggagcacctact

SEQ ID NO: 32387 - DNA, 20 bp, Artificial Sequence
  Description of Artificial Sequence: Synthetic oligonucleotide
  Target: SCN10A; (+) strand; PAM type: NRG; PAM sequence: GAG
gtttatggagcacctactaa

SEQ ID NO: 32388 - DNA, 20 bp, Artificial Sequence
  Description of Artificial Sequence: Synthetic oligonucleotide
  Target: SCN10A; (+) strand; PAM type: NRG; PAM sequence: CAG
atggagcacctactaagagc

SEQ ID NO: 32389 - DNA, 20 bp, Artificial Sequence
  Description of Artificial Sequence: Synthetic oligonucleotide
  Target: SCN10A; (+) strand; PAM type: NRG; PAM sequence: AGG
tggagcacctactaagagcc

SEQ ID NO: 32390 - DNA, 20 bp, Artificial Sequence
  Description of Artificial Sequence: Synthetic oligonucleotide
  Target: SCN10A; (+) strand; PAM type: NRG; PAM sequence: TGG
acctactaagagccaggctg

SEQ ID NO: 32391 - DNA, 20 bp, Artificial Sequence
  Description of Artificial Sequence: Synthetic oligonucleotide
  Target: SCN10A; (+) strand; PAM type: NRG; PAM sequence: TAG
ctaagagccaggctgtggct

SEQ ID NO: 32392 - DNA, 20 bp, Artificial Sequence
  Description of Artificial Sequence: Synthetic oligonucleotide
  Target: SCN10A; (+) strand; PAM type: NRG; PAM sequence: AGG
taagagccaggctgtggctt

SEQ ID NO: 32393 - DNA, 20 bp, Artificial Sequence
  Description of Artificial Sequence: Synthetic oligonucleotide
  Target: SCN10A; (+) strand; PAM type: NRG; PAM sequence: TAG
ccaggctgtggcttaggtgc

SEQ ID NO: 32394 - DNA, 20 bp, Artificial Sequence
  Description of Artificial Sequence: Synthetic oligonucleotide
  Target: SCN10A; (+) strand; PAM type: NRG; PAM sequence: AGG
caggctgtggcttaggtgct

SEQ ID NO: 32395 - DNA, 20 bp, Artificial Sequence
  Description of Artificial Sequence: Synthetic oligonucleotide
  Target: SCN10A; (+) strand; PAM type: NRG; PAM sequence: CAG
ggatgcaatgctgaacacaa

SEQ ID NO: 32396 - DNA, 20 bp, Artificial Sequence
  Description of Artificial Sequence: Synthetic oligonucleotide
  Target: SCN10A; (+) strand; PAM type: NRG; PAM sequence: TAG
caatgctgaacacaacagtg

SEQ ID NO: 32397 - DNA, 20 bp, Artificial Sequence
  Description of Artificial Sequence: Synthetic oligonucleotide
  Target: SCN10A; (+) strand; PAM type: NRG; PAM sequence: GAG
attttatcacccatatccgt

SEQ ID NO: 32398 - DNA, 20 bp, Artificial Sequence
  Description of Artificial Sequence: Synthetic oligonucleotide
  Target: SCN10A; (+) strand; PAM type: NRG; PAM sequence: CGG
atatccgtgagtaaatccca

SEQ ID NO: 32399 - DNA, 20 bp, Artificial Sequence
  Description of Artificial Sequence: Synthetic oligonucleotide
  Target: SCN10A; (+) strand; PAM type: NRG; PAM sequence: GGG
tatccgtgagtaaatcccac

SEQ ID NO: 32400 - DNA, 20 bp, Artificial Sequence
  Description of Artificial Sequence: Synthetic oligonucleotide
  Target: SCN10A; (+) strand; PAM type: NRG; PAM sequence: GAG
tccgtgagtaaatcccacgg

SEQ ID NO: 32401 - DNA, 20 bp, Artificial Sequence
  Description of Artificial Sequence: Synthetic oligonucleotide
  Target: SCN10A; (+) strand; PAM type: NRG; PAM sequence: AGG
ccgtgagtaaatcccacggg

SEQ ID NO: 32402 - DNA, 20 bp, Artificial Sequence
  Description of Artificial Sequence: Synthetic oligonucleotide
  Target: SCN10A; (+) strand; PAM type: NRG; PAM sequence: GAG
gtgagtaaatcccacgggag

SEQ ID NO: 32403 - DNA, 20 bp, Artificial Sequence
  Description of Artificial Sequence: Synthetic oligonucleotide
  Target: SCN10A; (+) strand; PAM type: NRG; PAM sequence: AGG
tgagtaaatcccacgggagg

SEQ ID NO: 32404 - DNA, 20 bp, Artificial Sequence
  Description of Artificial Sequence: Synthetic oligonucleotide
  Target: SCN10A; (+) strand; PAM type: NRG; PAM sequence: CAG
ggaggtttaatcctgttata

SEQ ID NO: 32405 - DNA, 20 bp, Artificial Sequence
  Description of Artificial Sequence: Synthetic oligonucleotide
  Target: SCN10A; (+) strand; PAM type: NRG; PAM sequence: AAG
gtttaatcctgttatacagt

SEQ ID NO: 32406 - DNA, 20 bp, Artificial Sequence
  Description of Artificial Sequence: Synthetic oligonucleotide
  Target: SCN10A; (+) strand; PAM type: NRG; PAM sequence: TGG
gtatgcacctctttatgtga

SEQ ID NO: 32407 - DNA, 20 bp, Artificial Sequence
  Description of Artificial Sequence: Synthetic oligonucleotide
  Target: SCN10A; (+) strand; PAM type: NRG; PAM sequence: GGG
tatgcacctctttatgtgat

SEQ ID NO: 32408 - DNA, 20 bp, Artificial Sequence
  Description of Artificial Sequence: Synthetic oligonucleotide
  Target: SCN10A; (+) strand; PAM type: NRG; PAM sequence: GGG
atgcacctctttatgtgatg

SEQ ID NO: 32409 - DNA, 20 bp, Artificial Sequence
  Description of Artificial Sequence: Synthetic oligonucleotide
  Target: SCN10A; (+) strand; PAM type: NRG; PAM sequence: GGG
tgcacctctttatgtgatgg

SEQ ID NO: 32410 - DNA, 20 bp, Artificial Sequence
  Description of Artificial Sequence: Synthetic oligonucleotide
  Target: SCN10A; (+) strand; PAM type: NRG; PAM sequence: GAG
cacctctttatgtgatgggg

SEQ ID NO: 32411 - DNA, 20 bp, Artificial Sequence
  Description of Artificial Sequence: Synthetic oligonucleotide
  Target: SCN10A; (+) strand; PAM type: NRG; PAM sequence: GAG
cctctttatgtgatggggga

SEQ ID NO: 32412 - DNA, 20 bp, Artificial Sequence
  Description of Artificial Sequence: Synthetic oligonucleotide
  Target: SCN10A; (+) strand; PAM type: NRG; PAM sequence: CGG
ctttatgtgatgggggagag

SEQ ID NO: 32413 - DNA, 20 bp, Artificial Sequence
  Description of Artificial Sequence: Synthetic oligonucleotide
  Target: SCN10A; (+) strand; PAM type: NRG; PAM sequence: GGG
tttatgtgatgggggagagc

SEQ ID NO: 32414 - DNA, 20 bp, Artificial Sequence
  Description of Artificial Sequence: Synthetic oligonucleotide
  Target: SCN10A; (+) strand; PAM type: NRG; PAM sequence: TGG
cgttcaccttacacccaatc

SEQ ID NO: 32415 - DNA, 20 bp, Artificial Sequence
  Description of Artificial Sequence: Synthetic oligonucleotide
  Target: SCN10A; (+) strand; PAM type: NRG; PAM sequence: AAG
tcaccttacacccaatctgg

SEQ ID NO: 32416 - DNA, 20 bp, Artificial Sequence
  Description of Artificial Sequence: Synthetic oligonucleotide
  Target: SCN10A; (+) strand; PAM type: NRG; PAM sequence: TGG
tggaagttactctcctcata

SEQ ID NO: 32417 - DNA, 20 bp, Artificial Sequence
  Description of Artificial Sequence: Synthetic oligonucleotide
  Target: SCN10A; (+) strand; PAM type: NRG; PAM sequence: GGG
ggaagttactctcctcatat

SEQ ID NO: 32418 - DNA, 20 bp, Artificial Sequence
  Description of Artificial Sequence: Synthetic oligonucleotide
  Target: SCN10A; (+) strand; PAM type: NRG; PAM sequence: AAG
agttactctcctcatatggg

SEQ ID NO: 32419 - DNA, 20 bp, Artificial Sequence
  Description of Artificial Sequence: Synthetic oligonucleotide
  Target: SCN10A; (+) strand; PAM type: NRG; PAM sequence: CAG
tactctcctcatatgggaag

SEQ ID NO: 32420 - DNA, 20 bp, Artificial Sequence
  Description of Artificial Sequence: Synthetic oligonucleotide
  Target: SCN10A; (+) strand; PAM type: NRG; PAM sequence: GAG
ctctcctcatatgggaagca

SEQ ID NO: 32421 - DNA, 20 bp, Artificial Sequence
  Description of Artificial Sequence: Synthetic oligonucleotide
  Target: SCN10A; (+) strand; PAM type: NRG; PAM sequence: TGG
agcttaaaacaacaactctg

SEQ ID NO: 32422 - DNA, 20 bp, Artificial Sequence
  Description of Artificial Sequence: Synthetic oligonucleotide
  Target: SCN10A; (+) strand; PAM type: NRG; PAM sequence: TGG
aaaacaacaactctgtggac

SEQ ID NO: 32423 - DNA, 20 bp, Artificial Sequence
  Description of Artificial Sequence: Synthetic oligonucleotide
  Target: SCN10A; (+) strand; PAM type: NRG; PAM sequence: CAG
acaactctgtggactggtca

SEQ ID NO: 32424 - DNA, 20 bp, Artificial Sequence
  Description of Artificial Sequence: Synthetic oligonucleotide
  Target: SCN10A; (+) strand; PAM type: NRG; PAM sequence: GAG
aactctgtggactggtcaca

SEQ ID NO: 32425 - DNA, 20 bp, Artificial Sequence
  Description of Artificial Sequence: Synthetic oligonucleotide
  Target: SCN10A; (+) strand; PAM type: NRG; PAM sequence: AGG
actctgtggactggtcacag

SEQ ID NO: 32426 - DNA, 20 bp, Artificial Sequence
  Description of Artificial Sequence: Synthetic oligonucleotide
  Target: SCN10A; (+) strand; PAM type: NRG; PAM sequence: CAG
ctgtggactggtcacagagg

SEQ ID NO: 32427 - DNA, 20 bp, Artificial Sequence
  Description of Artificial Sequence: Synthetic oligonucleotide
  Target: SCN10A; (+) strand; PAM type: NRG; PAM sequence: GAG
gataaacacaaataaaaact

SEQ ID NO: 32428 - DNA, 20 bp, Artificial Sequence
  Description of Artificial Sequence: Synthetic oligonucleotide
  Target: SCN10A; (+) strand; PAM type: NRG; PAM sequence: TAG
cacaaataaaaactgagcat

SEQ ID NO: 32429 - DNA, 20 bp, Artificial Sequence
  Description of Artificial Sequence: Synthetic oligonucleotide
  Target: SCN10A; (+) strand; PAM type: NRG; PAM sequence: TAG
aaaaactgagcattagtaac

SEQ ID NO: 32430 - DNA, 20 bp, Artificial Sequence
  Description of Artificial Sequence: Synthetic oligonucleotide
  Target: SCN10A; (+) strand; PAM type: NRG; PAM sequence: TGG
ctgagcattagtaactagta

SEQ ID NO: 32431 - DNA, 20 bp, Artificial Sequence
  Description of Artificial Sequence: Synthetic oligonucleotide
  Target: SCN10A; (+) strand; PAM type: NRG; PAM sequence: GGG
tgagcattagtaactagtat

SEQ ID NO: 32432 - DNA, 20 bp, Artificial Sequence
  Description of Artificial Sequence: Synthetic oligonucleotide
  Target: SCN10A; (+) strand; PAM type: NRG; PAM sequence: GGG
gagcattagtaactagtatg

SEQ ID NO: 32433 - DNA, 20 bp, Artificial Sequence
  Description of Artificial Sequence: Synthetic oligonucleotide
  Target: SCN10A; (+) strand; PAM type: NRG; PAM sequence: GAG
gcattagtaactagtatggg

SEQ ID NO: 32434 - DNA, 20 bp, Artificial Sequence
  Description of Artificial Sequence: Synthetic oligonucleotide
  Target: SCN10A; (+) strand; PAM type: NRG; PAM sequence: CAG
ttagtaactagtatggggag

SEQ ID NO: 32435 - DNA, 20 bp, Artificial Sequence
  Description of Artificial Sequence: Synthetic oligonucleotide
  Target: SCN10A; (+) strand; PAM type: NRG; PAM sequence: AGG
tagtaactagtatggggagc

SEQ ID NO: 32436 - DNA, 20 bp, Artificial Sequence
  Description of Artificial Sequence: Synthetic oligonucleotide
  Target: SCN10A; (+) strand; PAM type: NRG; PAM sequence: TAG
agtatggggagcaggaaacg

SEQ ID NO: 32437 - DNA, 20 bp, Artificial Sequence
  Description of Artificial Sequence: Synthetic oligonucleotide
  Target: SCN10A; (+) strand; PAM type: NRG; PAM sequence: TGG
ggagcaggaaacgtagtcca

SEQ ID NO: 32438 - DNA, 20 bp, Artificial Sequence
  Description of Artificial Sequence: Synthetic oligonucleotide
  Target: SCN10A; (+) strand; PAM type: NRG; PAM sequence: AAG
acgtagtccatggcctgccg

SEQ ID NO: 32439 - DNA, 20 bp, Artificial Sequence
  Description of Artificial Sequence: Synthetic oligonucleotide
  Target: SCN10A; (+) strand; PAM type: NRG; PAM sequence: AGG
cgtagtccatggcctgccga

SEQ ID NO: 32440 - DNA, 20 bp, Artificial Sequence
  Description of Artificial Sequence: Synthetic oligonucleotide
  Target: SCN10A; (+) strand; PAM type: NRG; PAM sequence: AAG
catggcctgccgaaggttgt

SEQ ID NO: 32441 - DNA, 20 bp, Artificial Sequence
  Description of Artificial Sequence: Synthetic oligonucleotide
  Target: SCN10A; (+) strand; PAM type: NRG; PAM sequence: TAG
cctgccgaaggttgtaagcc

SEQ ID NO: 32442 - DNA, 20 bp, Artificial Sequence
  Description of Artificial Sequence: Synthetic oligonucleotide
  Target: SCN10A; (+) strand; PAM type: NRG; PAM sequence: CAG
gccgaaggttgtaagcctag

SEQ ID NO: 32443 - DNA, 20 bp, Artificial Sequence
  Description of Artificial Sequence: Synthetic oligonucleotide
  Target: SCN10A; (+) strand; PAM type: NRG; PAM sequence: AGG
ccgaaggttgtaagcctagc

SEQ ID NO: 32444 - DNA, 20 bp, Artificial Sequence
  Description of Artificial Sequence: Synthetic oligonucleotide
  Target: SCN10A; (+) strand; PAM type: NRG; PAM sequence: AAG
caggaatttctccctgcttt

SEQ ID NO: 32445 - DNA, 20 bp, Artificial Sequence
  Description of Artificial Sequence: Synthetic oligonucleotide
  Target: SCN10A; (+) strand; PAM type: NRG; PAM sequence: TAG
atttctccctgctttaagac

SEQ ID NO: 32446 - DNA, 20 bp, Artificial Sequence
  Description of Artificial Sequence: Synthetic oligonucleotide
  Target: SCN10A; (+) strand; PAM type: NRG; PAM sequence: AAG
tgctttaagactagatccca

SEQ ID NO: 32447 - DNA, 20 bp, Artificial Sequence
  Description of Artificial Sequence: Synthetic oligonucleotide
  Target: SCN10A; (+) strand; PAM type: NRG; PAM sequence: GAG
ctttaagactagatcccaaa

SEQ ID NO: 32448 - DNA, 20 bp, Artificial Sequence
  Description of Artificial Sequence: Synthetic oligonucleotide
  Target: SCN10A; (+) strand; PAM type: NRG; PAM sequence: AAG
aagagctatacccttcatgt

SEQ ID NO: 32449 - DNA, 20 bp, Artificial Sequence
  Description of Artificial Sequence: Synthetic oligonucleotide
  Target: SCN10A; (+) strand; PAM type: NRG; PAM sequence: AGG
agagctatacccttcatgta

SEQ ID NO: 32450 - DNA, 20 bp, Artificial Sequence
  Description of Artificial Sequence: Synthetic oligonucleotide
  Target: SCN10A; (+) strand; PAM type: NRG; PAM sequence: CAG
ggatgaaccacaaacaatcc

SEQ ID NO: 32451 - DNA, 20 bp, Artificial Sequence
  Description of Artificial Sequence: Synthetic oligonucleotide
  Target: SCN10A; (+) strand; PAM type: NRG; PAM sequence: AGG
gatgaaccacaaacaatccc

SEQ ID NO: 32452 - DNA, 20 bp, Artificial Sequence
  Description of Artificial Sequence: Synthetic oligonucleotide
  Target: SCN10A; (+) strand; PAM type: NRG; PAM sequence: GAG
tgaaccacaaacaatcccag

SEQ ID NO: 32453 - DNA, 20 bp, Artificial Sequence
  Description of Artificial Sequence: Synthetic oligonucleotide
  Target: SCN10A; (+) strand; PAM type: NRG; PAM sequence: AAG
aaacaatcccaggagaatgc

SEQ ID NO: 32454 - DNA, 20 bp, Artificial Sequence
  Description of Artificial Sequence: Synthetic oligonucleotide
  Target: SCN10A; (+) strand; PAM type: NRG; PAM sequence: AGG
aacaatcccaggagaatgca

SEQ ID NO: 32455 - DNA, 20 bp, Artificial Sequence
  Description of Artificial Sequence: Synthetic oligonucleotide
  Target: SCN10A; (+) strand; PAM type: NRG; PAM sequence: TGG
agaatgcaaggaaaattgaa

SEQ ID NO: 32456 - DNA, 20 bp, Artificial Sequence
  Description of Artificial Sequence: Synthetic oligonucleotide
  Target: SCN10A; (+) strand; PAM type: NRG; PAM sequence: TGG
tgcaaggaaaattgaatggc

SEQ ID NO: 32457 - DNA, 20 bp, Artificial Sequence
  Description of Artificial Sequence: Synthetic oligonucleotide
  Target: SCN10A; (+) strand; PAM type: NRG; PAM sequence: TAG
gaaaattgaatggctggtgt

SEQ ID NO: 32458 - DNA, 20 bp, Artificial Sequence
  Description of Artificial Sequence: Synthetic oligonucleotide
  Target: SCN10A; (+) strand; PAM type: NRG; PAM sequence: AGG
aaaattgaatggctggtgtt

SEQ ID NO: 32459 - DNA, 20 bp, Artificial Sequence
  Description of Artificial Sequence: Synthetic oligonucleotide
  Target: SCN10A; (+) strand; PAM type: NRG; PAM sequence: CAG
gaatggctggtgttaggtac

SEQ ID NO: 32460 - DNA, 20 bp, Artificial Sequence
  Description of Artificial Sequence: Synthetic oligonucleotide
  Target: SCN10A; (+) strand; PAM type: NRG; PAM sequence: CAG
ctggtgttaggtaccagcta

SEQ ID NO: 32461 - DNA, 20 bp, Artificial Sequence
  Description of Artificial Sequence: Synthetic oligonucleotide
  Target: SCN10A; (+) strand; PAM type: NRG; PAM sequence: AGG
tggtgttaggtaccagctac

SEQ ID NO: 32462 - DNA, 20 bp, Artificial Sequence
  Description of Artificial Sequence: Synthetic oligonucleotide
  Target: SCN10A; (+) strand; PAM type: NRG; PAM sequence: GAG
gtgttaggtaccagctacag

SEQ ID NO: 32463 - DNA, 20 bp, Artificial Sequence
  Description of Artificial Sequence: Synthetic oligonucleotide
  Target: SCN10A; (+) strand; PAM type: NRG; PAM sequence: AGG
tgttaggtaccagctacagg

SEQ ID NO: 32464 - DNA, 20 bp, Artificial Sequence
  Description of Artificial Sequence: Synthetic oligonucleotide
  Target: SCN10A; (+) strand; PAM type: NRG; PAM sequence: GAG
acaggaggaaaattgacgct

SEQ ID NO: 32465 - DNA, 20 bp, Artificial Sequence
  Description of Artificial Sequence: Synthetic oligonucleotide
  Target: SCN10A; (+) strand; PAM type: NRG; PAM sequence: AAG
gctgagcatttgaaacaaca

SEQ ID NO: 32466 - DNA, 20 bp, Artificial Sequence
  Description of Artificial Sequence: Synthetic oligonucleotide
  Target: SCN10A; (+) strand; PAM type: NRG; PAM sequence: TGG
gagcatttgaaacaacaaag

SEQ ID NO: 32467 - DNA, 20 bp, Artificial Sequence
  Description of Artificial Sequence: Synthetic oligonucleotide
  Target: SCN10A; (+) strand; PAM type: NRG; PAM sequence: TAG
acaacaaagtggtgctcata

SEQ ID NO: 32468 - DNA, 20 bp, Artificial Sequence
  Description of Artificial Sequence: Synthetic oligonucleotide
  Target: SCN10A; (+) strand; PAM type: NRG; PAM sequence: AGG
caacaaagtggtgctcatat

SEQ ID NO: 32469 - DNA, 20 bp, Artificial Sequence
  Description of Artificial Sequence: Synthetic oligonucleotide
  Target: SCN10A; (+) strand; PAM type: NRG; PAM sequence: TGG
tgctcatataggattttatc

SEQ ID NO: 32470 - DNA, 20 bp, Artificial Sequence
  Description of Artificial Sequence: Synthetic oligonucleotide
  Target: SCN10A; (+) strand; PAM type: NRG; PAM sequence: TAG
tatctggaattcacactacc

SEQ ID NO: 32471 - DNA, 20 bp, Artificial Sequence
  Description of Artificial Sequence: Synthetic oligonucleotide
  Target: SCN10A; (+) strand; PAM type: NRG; PAM sequence: AGG
atctggaattcacactacct

SEQ ID NO: 32472 - DNA, 20 bp, Artificial Sequence
  Description of Artificial Sequence: Synthetic oligonucleotide
  Target: SCN10A; (+) strand; PAM type: NRG; PAM sequence: AAG
tcacactacctaggtatttt

SEQ ID NO: 32473 - DNA, 20 bp, Artificial Sequence
  Description of Artificial Sequence: Synthetic oligonucleotide
  Target: SCN10A; (+) strand; PAM type: NRG; PAM sequence: GAG
ctacctaggtattttaagtt

SEQ ID NO: 32474 - DNA, 20 bp, Artificial Sequence
  Description of Artificial Sequence: Synthetic oligonucleotide
  Target: SCN10A; (+) strand; PAM type: NRG; PAM sequence: TAG
tttaagttgagaatttaatt

SEQ ID NO: 32475 - DNA, 20 bp, Artificial Sequence
  Description of Artificial Sequence: Synthetic oligonucleotide
  Target: SCN10A; (+) strand; PAM type: NRG; PAM sequence: GAG
taagttgagaatttaattta

SEQ ID NO: 32476 - DNA, 20 bp, Artificial Sequence
  Description of Artificial Sequence: Synthetic oligonucleotide
  Target: SCN10A; (+) strand; PAM type: NRG; PAM sequence: AAG
taatttagagcaattctaca

SEQ ID NO: 32477 - DNA, 20 bp, Artificial Sequence
  Description of Artificial Sequence: Synthetic oligonucleotide
  Target: SCN10A; (+) strand; PAM type: NRG; PAM sequence: CAG
caattctacaaagtgctctg

SEQ ID NO: 32478 - DNA, 20 bp, Artificial Sequence
  Description of Artificial Sequence: Synthetic oligonucleotide
  Target: SCN10A; (+) strand; PAM type: NRG; PAM sequence: TGG
gaattaaatgcaaatacctc

SEQ ID NO: 32479 - DNA, 20 bp, Artificial Sequence
  Description of Artificial Sequence: Synthetic oligonucleotide
  Target: SCN10A; (+) strand; PAM type: NRG; PAM sequence: GAG
attaaatgcaaatacctctg

SEQ ID NO: 32480 - DNA, 20 bp, Artificial Sequence
  Description of Artificial Sequence: Synthetic oligonucleotide
  Target: SCN10A; (+) strand; PAM type: NRG; PAM sequence: AGG
ttaaatgcaaatacctctgg

SEQ ID NO: 32481 - DNA, 20 bp, Artificial Sequence
  Description of Artificial Sequence: Synthetic oligonucleotide
  Target: SCN10A; (+) strand; PAM type: NRG; PAM sequence: CAG
ggaggaacctgcctttatct

SEQ ID NO: 32482 - DNA, 20 bp, Artificial Sequence
  Description of Artificial Sequence: Synthetic oligonucleotide
  Target: SCN10A; (+) strand; PAM type: NRG; PAM sequence: AGG
gaggaacctgcctttatctc

SEQ ID NO: 32483 - DNA, 20 bp, Artificial Sequence
  Description of Artificial Sequence: Synthetic oligonucleotide
  Target: SCN10A; (+) strand; PAM type: NRG; PAM sequence: AAG
tattccctcaaaaattgttt

SEQ ID NO: 32484 - DNA, 20 bp, Artificial Sequence
  Description of Artificial Sequence: Synthetic oligonucleotide
  Target: SCN10A; (+) strand; PAM type: NRG; PAM sequence: GAG
ttccctcaaaaattgtttaa

SEQ ID NO: 32485 - DNA, 20 bp, Artificial Sequence
  Description of Artificial Sequence: Synthetic oligonucleotide
  Target: SCN10A; (+) strand; PAM type: NRG; PAM sequence: CAG
caaaaattgtttaagagttg

SEQ ID NO: 32486 - DNA, 20 bp, Artificial Sequence
  Description of Artificial Sequence: Synthetic oligonucleotide
  Target: SCN10A; (+) strand; PAM type: NRG; PAM sequence: CAG
agtaaaaaaacaaacaaaaa

SEQ ID NO: 32487 - DNA, 20 bp, Artificial Sequence
  Description of Artificial Sequence: Synthetic oligonucleotide
  Target: SCN10A; (+) strand; PAM type: NRG; PAM sequence: AAG
aaaaaaacaaacaaaaacag

SEQ ID NO: 32488 - DNA, 20 bp, Artificial Sequence
  Description of Artificial Sequence: Synthetic oligonucleotide
  Target: SCN10A; (+) strand; PAM type: NRG; PAM sequence: AGG
aaaaaacaaacaaaaacaga

SEQ ID NO: 32489 - DNA, 20 bp, Artificial Sequence
  Description of Artificial Sequence: Synthetic oligonucleotide
  Target: SCN10A; (+) strand; PAM type: NRG; PAM sequence: GAG
caaacaaaaacagaaggaat

SEQ ID NO: 32490 - DNA, 20 bp, Artificial Sequence
  Description of Artificial Sequence: Synthetic oligonucleotide
  Target: SCN10A; (+) strand; PAM type: NRG; PAM sequence: AAG
aacagaaggaatgagtcatc

SEQ ID NO: 32491 - DNA, 20 bp, Artificial Sequence
  Description of Artificial Sequence: Synthetic oligonucleotide
  Target: SCN10A; (+) strand; PAM type: NRG; PAM sequence: GAG
cagaaggaatgagtcatcaa

SEQ ID NO: 32492 - DNA, 20 bp, Artificial Sequence
  Description of Artificial Sequence: Synthetic oligonucleotide
  Target: SCN10A; (+) strand; PAM type: NRG; PAM sequence: GAG
atgagtcatcaagagtgaat

SEQ ID NO: 32493 - DNA, 20 bp, Artificial Sequence
  Description of Artificial Sequence: Synthetic oligonucleotide
  Target: SCN10A; (+) strand; PAM type: NRG; PAM sequence: AAG
caagagtgaatgagatcttg

SEQ ID NO: 32494 - DNA, 20 bp, Artificial Sequence
  Description of Artificial Sequence: Synthetic oligonucleotide
  Target: SCN10A; (+) strand; PAM type: NRG; PAM sequence: CAG
atgagatcttgaagaaacca

SEQ ID NO: 32495 - DNA, 20 bp, Artificial Sequence
  Description of Artificial Sequence: Synthetic oligonucleotide
  Target: SCN10A; (+) strand; PAM type: NRG; PAM sequence: TGG
tcttgaagaaaccacagatg

SEQ ID NO: 32496 - DNA, 20 bp, Artificial Sequence
  Description of Artificial Sequence: Synthetic oligonucleotide
  Target: SCN10A; (+) strand; PAM type: NRG; PAM sequence: TAG
agaaaccacagatgtggaaa

SEQ ID NO: 32497 - DNA, 20 bp, Artificial Sequence
  Description of Artificial Sequence: Synthetic oligonucleotide
  Target: SCN10A; (+) strand; PAM type: NRG; PAM sequence: CAG
aaatagtcattccatttctt

SEQ ID NO: 32498 - DNA, 20 bp, Artificial Sequence
  Description of Artificial Sequence: Synthetic oligonucleotide
  Target: SCN10A; (+) strand; PAM type: NRG; PAM sequence: TAG
cattccatttcttcagatga

SEQ ID NO: 32499 - DNA, 20 bp, Artificial Sequence
  Description of Artificial Sequence: Synthetic oligonucleotide
  Target: SCN10A; (+) strand; PAM type: NRG; PAM sequence: TAG
tcttcagatgatagaattat

SEQ ID NO: 32500 - DNA, 20 bp, Artificial Sequence
  Description of Artificial Sequence: Synthetic oligonucleotide
  Target: SCN10A; (+) strand; PAM type: NRG; PAM sequence: CAG
cagatgatagaattattagt

SEQ ID NO: 32501 - DNA, 20 bp, Artificial Sequence
  Description of Artificial Sequence: Synthetic oligonucleotide
  Target: SCN10A; (+) strand; PAM type: NRG; PAM sequence: GAG
gatgatagaattattagtca

SEQ ID NO: 32502 - DNA, 20 bp, Artificial Sequence
  Description of Artificial Sequence: Synthetic oligonucleotide
  Target: SCN10A; (+) strand; PAM type: NRG; PAM sequence: CAG
gaattattagtcagagataa

SEQ ID NO: 32503 - DNA, 20 bp, Artificial Sequence
  Description of Artificial Sequence: Synthetic oligonucleotide
  Target: SCN10A; (+) strand; PAM type: NRG; PAM sequence: TAG
gtcagagataacagtataat

SEQ ID NO: 32504 - DNA, 20 bp, Artificial Sequence
  Description of Artificial Sequence: Synthetic oligonucleotide
  Target: SCN10A; (+) strand; PAM type: NRG; PAM sequence: AAG
taattagatataatatgtta

SEQ ID NO: 32505 - DNA, 20 bp, Artificial Sequence
  Description of Artificial Sequence: Synthetic oligonucleotide
  Target: SCN10A; (+) strand; PAM type: NRG; PAM sequence: CAG
taataacttgaaactatgtg

SEQ ID NO: 32506 - DNA, 20 bp, Artificial Sequence
  Description of Artificial Sequence: Synthetic oligonucleotide
  Target: SCN10A; (+) strand; PAM type: NRG; PAM sequence: GAG
ataacttgaaactatgtgca

SEQ ID NO: 32507 - DNA, 20 bp, Artificial Sequence
  Description of Artificial Sequence: Synthetic oligonucleotide
  Target: SCN10A; (+) strand; PAM type: NRG; PAM sequence: TAG
tgcagagaataaaaaaacta

SEQ ID NO: 32508 - DNA, 20 bp, Artificial Sequence
  Description of Artificial Sequence: Synthetic oligonucleotide
  Target: SCN10A; (+) strand; PAM type: NRG; PAM sequence: AAG
aaactatagataacaataac

SEQ ID NO: 32509 - DNA, 20 bp, Artificial Sequence
  Description of Artificial Sequence: Synthetic oligonucleotide
  Target: SCN10A; (+) strand; PAM type: NRG; PAM sequence: TAG
agttgtgaaaaatacactct

SEQ ID NO: 32510 - DNA, 20 bp, Artificial Sequence
  Description of Artificial Sequence: Synthetic oligonucleotide
  Target: SCN10A; (+) strand; PAM type: NRG; PAM sequence: AAG
ttaaaattaaaaatattatg

SEQ ID NO: 32511 - DNA, 20 bp, Artificial Sequence
  Description of Artificial Sequence: Synthetic oligonucleotide
  Target: SCN10A; (+) strand; PAM type: NRG; PAM sequence: AAG
aaattaaaaatattatgaag

SEQ ID NO: 32512 - DNA, 20 bp, Artificial Sequence
  Description of Artificial Sequence: Synthetic oligonucleotide
  Target: SCN10A; (+) strand; PAM type: NRG; PAM sequence: AGG
aattaaaaatattatgaaga

SEQ ID NO: 32513 - DNA, 20 bp, Artificial Sequence
  Description of Artificial Sequence: Synthetic oligonucleotide
  Target: SCN10A; (+) strand; PAM type: NRG; PAM sequence: CAG
attatgaagaaggtttgcat

SEQ ID NO: 32514 - DNA, 20 bp, Artificial Sequence
  Description of Artificial Sequence: Synthetic oligonucleotide
  Target: SCN10A; (+) strand; PAM type: NRG; PAM sequence: CAG
ggtttgcatcagatttgaca

SEQ ID NO: 32515 - DNA, 20 bp, Artificial Sequence
  Description of Artificial Sequence: Synthetic oligonucleotide
  Target: SCN10A; (+) strand; PAM type: NRG; PAM sequence: TGG
gcatcagatttgacacagtt

SEQ ID NO: 32516 - DNA, 20 bp, Artificial Sequence
  Description of Artificial Sequence: Synthetic oligonucleotide
  Target: SCN10A; (+) strand; PAM type: NRG; PAM sequence: GGG
catcagatttgacacagttt

SEQ ID NO: 32517 - DNA, 20 bp, Artificial Sequence
  Description of Artificial Sequence: Synthetic oligonucleotide
  Target: SCN10A; (+) strand; PAM type: NRG; PAM sequence: GAG
tcagatttgacacagtttgg

SEQ ID NO: 32518 - DNA, 20 bp, Artificial Sequence
  Description of Artificial Sequence: Synthetic oligonucleotide
  Target: SCN10A; (+) strand; PAM type: NRG; PAM sequence: GAG
agatttgacacagtttggga

SEQ ID NO: 32519 - DNA, 20 bp, Artificial Sequence
  Description of Artificial Sequence: Synthetic oligonucleotide
  Target: SCN10A; (+) strand; PAM type: NRG; PAM sequence: TAG
gacacagtttgggagagaat

SEQ ID NO: 32520 - DNA, 20 bp, Artificial Sequence
  Description of Artificial Sequence: Synthetic oligonucleotide
  Target: SCN10A; (+) strand; PAM type: NRG; PAM sequence: GAG
tgggagagaattagtgaact

SEQ ID NO: 32521 - DNA, 20 bp, Artificial Sequence
  Description of Artificial Sequence: Synthetic oligonucleotide
  Target: SCN10A; (+) strand; PAM type: NRG; PAM sequence: AGG
gggagagaattagtgaactg

SEQ ID NO: 32522 - DNA, 20 bp, Artificial Sequence
  Description of Artificial Sequence: Synthetic oligonucleotide
  Target: SCN10A; (+) strand; PAM type: NRG; PAM sequence: CAG
ttagtgaactgaggatatat

SEQ ID NO: 32523 - DNA, 20 bp, Artificial Sequence
  Description of Artificial Sequence: Synthetic oligonucleotide
  Target: SCN10A; (+) strand; PAM type: NRG; PAM sequence: CAG
atatatcagaataaattatt

SEQ ID NO: 32524 - DNA, 20 bp, Artificial Sequence
  Description of Artificial Sequence: Synthetic oligonucleotide
  Target: SCN10A; (+) strand; PAM type: NRG; PAM sequence: TAG
aaattattcagaatgtaacc

SEQ ID NO: 32525 - DNA, 20 bp, Artificial Sequence
  Description of Artificial Sequence: Synthetic oligonucleotide
  Target: SCN10A; (+) strand; PAM type: NRG; PAM sequence: GAG
attattcagaatgtaaccta

SEQ ID NO: 32526 - DNA, 20 bp, Artificial Sequence
  Description of Artificial Sequence: Synthetic oligonucleotide
  Target: SCN10A; (+) strand; PAM type: NRG; PAM sequence: GAG
tattcagaatgtaacctaga

SEQ ID NO: 32527 - DNA, 20 bp, Artificial Sequence
  Description of Artificial Sequence: Synthetic oligonucleotide
  Target: SCN10A; (+) strand; PAM type: NRG; PAM sequence: AAG
aatgtaacctagagagacat

SEQ ID NO: 32528 - DNA, 20 bp, Artificial Sequence
  Description of Artificial Sequence: Synthetic oligonucleotide
  Target: SCN10A; (+) strand; PAM type: NRG; PAM sequence: TAG
taagatgaaaaataacaaaa

SEQ ID NO: 32529 - DNA, 20 bp, Artificial Sequence
  Description of Artificial Sequence: Synthetic oligonucleotide
  Target: SCN10A; (+) strand; PAM type: NRG; PAM sequence: AAG
gaaaaataacaaaatagtgt

SEQ ID NO: 32530 - DNA, 20 bp, Artificial Sequence
  Description of Artificial Sequence: Synthetic oligonucleotide
  Target: SCN10A; (+) strand; PAM type: NRG; PAM sequence: GAG
aaaataacaaaatagtgtaa

SEQ ID NO: 32531 - DNA, 20 bp, Artificial Sequence
  Description of Artificial Sequence: Synthetic oligonucleotide
  Target: SCN10A; (+) strand; PAM type: NRG; PAM sequence: TAG
acaaaatagtgtaagagaca

SEQ ID NO: 32532 - DNA, 20 bp, Artificial Sequence
  Description of Artificial Sequence: Synthetic oligonucleotide
  Target: SCN10A; (+) strand; PAM type: NRG; PAM sequence: GAG
aaaatagtgtaagagacata

SEQ ID NO: 32533 - DNA, 20 bp, Artificial Sequence
  Description of Artificial Sequence: Synthetic oligonucleotide
  Target: SCN10A; (+) strand; PAM type: NRG; PAM sequence: AGG
aaatagtgtaagagacatag

SEQ ID NO: 32534 - DNA, 20 bp, Artificial Sequence
  Description of Artificial Sequence: Synthetic oligonucleotide
  Target: SCN10A; (+) strand; PAM type: NRG; PAM sequence: TAG
agtgtaagagacatagagga

SEQ ID NO: 32535 - DNA, 20 bp, Artificial Sequence
  Description of Artificial Sequence: Synthetic oligonucleotide
  Target: SCN10A; (+) strand; PAM type: NRG; PAM sequence: GAG
agagacatagaggatagaat

SEQ ID NO: 32536 - DNA, 20 bp, Artificial Sequence
  Description of Artificial Sequence: Synthetic oligonucleotide
  Target: SCN10A; (+) strand; PAM type: NRG; PAM sequence: GAG
agacatagaggatagaatga

SEQ ID NO: 32537 - DNA, 20 bp, Artificial Sequence
  Description of Artificial Sequence: Synthetic oligonucleotide
  Target: SCN10A; (+) strand; PAM type: NRG; PAM sequence: GAG
acatagaggatagaatgaga

SEQ ID NO: 32538 - DNA, 20 bp, Artificial Sequence
  Description of Artificial Sequence: Synthetic oligonucleotide
  Target: SCN10A; (+) strand; PAM type: NRG; PAM sequence: AAG
gtttaacatctatctaacca

SEQ ID NO: 32539 - DNA, 20 bp, Artificial Sequence
  Description of Artificial Sequence: Synthetic oligonucleotide
  Target: SCN10A; (+) strand; PAM type: NRG; PAM sequence: CAG
acatctatctaaccaaagtc

SEQ ID NO: 32540 - DNA, 20 bp, Artificial Sequence
  Description of Artificial Sequence: Synthetic oligonucleotide
  Target: SCN10A; (+) strand; PAM type: NRG; PAM sequence: AAG
tctatctaaccaaagtccag

SEQ ID NO: 32541 - DNA, 20 bp, Artificial Sequence
  Description of Artificial Sequence: Synthetic oligonucleotide
  Target: SCN10A; (+) strand; PAM type: NRG; PAM sequence: AGG
ctatctaaccaaagtccaga

SEQ ID NO: 32542 - DNA, 20 bp, Artificial Sequence
  Description of Artificial Sequence: Synthetic oligonucleotide
  Target: SCN10A; (+) strand; PAM type: NRG; PAM sequence: GAG
atctaaccaaagtccagaag

SEQ ID NO: 32543 - DNA, 20 bp, Artificial Sequence
  Description of Artificial Sequence: Synthetic oligonucleotide
  Target: SCN10A; (+) strand; PAM type: NRG; PAM sequence: TAG
aagtccagaaggagaaaaaa

SEQ ID NO: 32544 - DNA, 20 bp, Artificial Sequence
  Description of Artificial Sequence: Synthetic oligonucleotide
  Target: SCN10A; (+) strand; PAM type: NRG; PAM sequence: TGG
cagaaggagaaaaaatagaa

SEQ ID NO: 32545 - DNA, 20 bp, Artificial Sequence
  Description of Artificial Sequence: Synthetic oligonucleotide
  Target: SCN10A; (+) strand; PAM type: NRG; PAM sequence: TGG
ggagaaaaaatagaatggcg

SEQ ID NO: 32546 - DNA, 20 bp, Artificial Sequence
  Description of Artificial Sequence: Synthetic oligonucleotide
  Target: SCN10A; (+) strand; PAM type: NRG; PAM sequence: GAG
agaaaaaatagaatggcgtg

SEQ ID NO: 32547 - DNA, 20 bp, Artificial Sequence
  Description of Artificial Sequence: Synthetic oligonucleotide
  Target: SCN10A; (+) strand; PAM type: NRG; PAM sequence: AGG
gaaaaaatagaatggcgtgg

SEQ ID NO: 32548 - DNA, 20 bp, Artificial Sequence
  Description of Artificial Sequence: Synthetic oligonucleotide
  Target: SCN10A; (+) strand; PAM type: NRG; PAM sequence: TGG
atgactgcccacatcatgtc

SEQ ID NO: 32549 - DNA, 20 bp, Artificial Sequence
  Description of Artificial Sequence: Synthetic oligonucleotide
  Target: SCN10A; (+) strand; PAM type: NRG; PAM sequence: GGG
tgactgcccacatcatgtct

SEQ ID NO: 32550 - DNA, 20 bp, Artificial Sequence
  Description of Artificial Sequence: Synthetic oligonucleotide
  Target: SCN10A; (+) strand; PAM type: NRG; PAM sequence: CAG
catcatgtctgggaactttc

SEQ ID NO: 32551 - DNA, 20 bp, Artificial Sequence
  Description of Artificial Sequence: Synthetic oligonucleotide
  Target: SCN10A; (+) strand; PAM type: NRG; PAM sequence: AAG
ctgggaactttccagaattg

SEQ ID NO: 32552 - DNA, 20 bp, Artificial Sequence
  Description of Artificial Sequence: Synthetic oligonucleotide
  Target: SCN10A; (+) strand; PAM type: NRG; PAM sequence: AAG
tgaagaaaattacaaaacta

SEQ ID NO: 32553 - DNA, 20 bp, Artificial Sequence
  Description of Artificial Sequence: Synthetic oligonucleotide
  Target: SCN10A; (+) strand; PAM type: NRG; PAM sequence: AAG
aattacaaaactaaagattc

SEQ ID NO: 32554 - DNA, 20 bp, Artificial Sequence
  Description of Artificial Sequence: Synthetic oligonucleotide
  Target: SCN10A; (+) strand; PAM type: NRG; PAM sequence: AAG
tacaaaactaaagattcaag

SEQ ID NO: 32555 - DNA, 20 bp, Artificial Sequence
  Description of Artificial Sequence: Synthetic oligonucleotide
  Target: SCN10A; (+) strand; PAM type: NRG; PAM sequence: CAG
aaactaaagattcaagaagt

SEQ ID NO: 32556 - DNA, 20 bp, Artificial Sequence
  Description of Artificial Sequence: Synthetic oligonucleotide
  Target: SCN10A; (+) strand; PAM type: NRG; PAM sequence: AAG
tcaagaagtcagtatatctt

SEQ ID NO: 32557 - DNA, 20 bp, Artificial Sequence
  Description of Artificial Sequence: Synthetic oligonucleotide
  Target: SCN10A; (+) strand; PAM type: NRG; PAM sequence: TGG
tatatcttaagcattataaa

SEQ ID NO: 32558 - DNA, 20 bp, Artificial Sequence
  Description of Artificial Sequence: Synthetic oligonucleotide
  Target: SCN10A; (+) strand; PAM type: NRG; PAM sequence: AAG
tcttaagcattataaatgga

SEQ ID NO: 32559 - DNA, 20 bp, Artificial Sequence
  Description of Artificial Sequence: Synthetic oligonucleotide
  Target: SCN10A; (+) strand; PAM type: NRG; PAM sequence: AAG
taagcattataaatggaaag

SEQ ID NO: 32560 - DNA, 20 bp, Artificial Sequence
  Description of Artificial Sequence: Synthetic oligonucleotide
  Target: SCN10A; (+) strand; PAM type: NRG; PAM sequence: TAG
aatggaaagaagtccacacc

SEQ ID NO: 32561 - DNA, 20 bp, Artificial Sequence
  Description of Artificial Sequence: Synthetic oligonucleotide
  Target: SCN10A; (+) strand; PAM type: NRG; PAM sequence: CAG
gtccacacctagacatatta

SEQ ID NO: 32562 - DNA, 20 bp, Artificial Sequence
  Description of Artificial Sequence: Synthetic oligonucleotide
  Target: SCN10A; (+) strand; PAM type: NRG; PAM sequence: CAG
gacatattacagtgaaactg

SEQ ID NO: 32563 - DNA, 20 bp, Artificial Sequence
  Description of Artificial Sequence: Synthetic oligonucleotide
  Target: SCN10A; (+) strand; PAM type: NRG; PAM sequence: AAG
agtgaaactgcagaacacca

SEQ ID NO: 32564 - DNA, 20 bp, Artificial Sequence
  Description of Artificial Sequence: Synthetic oligonucleotide
  Target: SCN10A; (+) strand; PAM type: NRG; PAM sequence: TGG
aaactgcagaacaccaaaga

SEQ ID NO: 32565 - DNA, 20 bp, Artificial Sequence
  Description of Artificial Sequence: Synthetic oligonucleotide
  Target: SCN10A; (+) strand; PAM type: NRG; PAM sequence: TAG
tgcagaacaccaaagatgga

SEQ ID NO: 32566 - DNA, 20 bp, Artificial Sequence
  Description of Artificial Sequence: Synthetic oligonucleotide
  Target: SCN10A; (+) strand; PAM type: NRG; PAM sequence: AAG
agaacaccaaagatggatag

SEQ ID NO: 32567 - DNA, 20 bp, Artificial Sequence
  Description of Artificial Sequence: Synthetic oligonucleotide
  Target: SCN10A; (+) strand; PAM type: NRG; PAM sequence: AAG
agatggatagaagatttaaa

SEQ ID NO: 32568 - DNA, 20 bp, Artificial Sequence
  Description of Artificial Sequence: Synthetic oligonucleotide
  Target: SCN10A; (+) strand; PAM type: NRG; PAM sequence: CAG
tagaagatttaaaaagcatc

SEQ ID NO: 32569 - DNA, 20 bp, Artificial Sequence
  Description of Artificial Sequence: Synthetic oligonucleotide
  Target: SCN10A; (+) strand; PAM type: NRG; PAM sequence: AAG
agatttaaaaagcatccaga

SEQ ID NO: 32570 - DNA, 20 bp, Artificial Sequence
  Description of Artificial Sequence: Synthetic oligonucleotide
  Target: SCN10A; (+) strand; PAM type: NRG; PAM sequence: AGG
gatttaaaaagcatccagaa

SEQ ID NO: 32571 - DNA, 20 bp, Artificial Sequence
  Description of Artificial Sequence: Synthetic oligonucleotide
  Target: SCN10A; (+) strand; PAM type: NRG; PAM sequence: AAG
ttaaaaagcatccagaaagg

SEQ ID NO: 32572 - DNA, 20 bp, Artificial Sequence
  Description of Artificial Sequence: Synthetic oligonucleotide
  Target: SCN10A; (+) strand; PAM type: NRG; PAM sequence: AGG
taaaaagcatccagaaagga

SEQ ID NO: 32573 - DNA, 20 bp, Artificial Sequence
  Description of Artificial Sequence: Synthetic oligonucleotide
  Target: SCN10A; (+) strand; PAM type: NRG; PAM sequence: CAG
atccagaaaggaaggaataa

SEQ ID NO: 32574 - DNA, 20 bp, Artificial Sequence
  Description of Artificial Sequence: Synthetic oligonucleotide
  Target: SCN10A; (+) strand; PAM type: NRG; PAM sequence: AAG
aggaataacagttaaattga

SEQ ID NO: 32575 - DNA, 20 bp, Artificial Sequence
  Description of Artificial Sequence: Synthetic oligonucleotide
  Target: SCN10A; (+) strand; PAM type: NRG; PAM sequence: TAG
attgaaagctgactgctcat

SEQ ID NO: 32576 - DNA, 20 bp, Artificial Sequence
  Description of Artificial Sequence: Synthetic oligonucleotide
  Target: SCN10A; (+) strand; PAM type: NRG; PAM sequence: TGG
tgactgctcattagcaacaa

SEQ ID NO: 32577 - DNA, 20 bp, Artificial Sequence
  Description of Artificial Sequence: Synthetic oligonucleotide
  Target: SCN10A; (+) strand; PAM type: NRG; PAM sequence: GAG
actgctcattagcaacaatg

SEQ ID NO: 32578 - DNA, 20 bp, Artificial Sequence
  Description of Artificial Sequence: Synthetic oligonucleotide
  Target: SCN10A; (+) strand; PAM type: NRG; PAM sequence: AGG
ctgctcattagcaacaatgg

SEQ ID NO: 32579 - DNA, 20 bp, Artificial Sequence
  Description of Artificial Sequence: Synthetic oligonucleotide
  Target: SCN10A; (+) strand; PAM type: NRG; PAM sequence: TGG
caacaatggaggctaattgt

SEQ ID NO: 32580 - DNA, 20 bp, Artificial Sequence
  Description of Artificial Sequence: Synthetic oligonucleotide
  Target: SCN10A; (+) strand; PAM type: NRG; PAM sequence: AAG
ttggaatactatcttcactg

SEQ ID NO: 32581 - DNA, 20 bp, Artificial Sequence
  Description of Artificial Sequence: Synthetic oligonucleotide
  Target: SCN10A; (+) strand; PAM type: NRG; PAM sequence: AGG
tggaatactatcttcactga

SEQ ID NO: 32582 - DNA, 20 bp, Artificial Sequence
  Description of Artificial Sequence: Synthetic oligonucleotide
  Target: SCN10A; (+) strand; PAM type: NRG; PAM sequence: AAG
aatactatcttcactgaagg

SEQ ID NO: 32583 - DNA, 20 bp, Artificial Sequence
  Description of Artificial Sequence: Synthetic oligonucleotide
  Target: SCN10A; (+) strand; PAM type: NRG; PAM sequence: AAG
atcttcactgaaggaagata

SEQ ID NO: 32584 - DNA, 20 bp, Artificial Sequence
  Description of Artificial Sequence: Synthetic oligonucleotide
  Target: SCN10A; (+) strand; PAM type: NRG; PAM sequence: TAG
aaggaagataaagtatcaac

SEQ ID NO: 32585 - DNA, 20 bp, Artificial Sequence
  Description of Artificial Sequence: Synthetic oligonucleotide
  Target: SCN10A; (+) strand; PAM type: NRG; PAM sequence: AAG
aactagaattttacattcat

SEQ ID NO: 32586 - DNA, 20 bp, Artificial Sequence
  Description of Artificial Sequence: Synthetic oligonucleotide
  Target: SCN10A; (+) strand; PAM type: NRG; PAM sequence: AAG
ttcataagaaatgtctctca

SEQ ID NO: 32587 - DNA, 20 bp, Artificial Sequence
  Description of Artificial Sequence: Synthetic oligonucleotide
  Target: SCN10A; (+) strand; PAM type: NRG; PAM sequence: CGG
agaaatgtctctcaaagaca

SEQ ID NO: 32588 - DNA, 20 bp, Artificial Sequence
  Description of Artificial Sequence: Synthetic oligonucleotide
  Target: SCN10A; (+) strand; PAM type: NRG; PAM sequence: GGG
gaaatgtctctcaaagacac

SEQ ID NO: 32589 - DNA, 20 bp, Artificial Sequence
  Description of Artificial Sequence: Synthetic oligonucleotide
  Target: SCN10A; (+) strand; PAM type: NRG; PAM sequence: AAG
tcaaagacacgggcaaactg

SEQ ID NO: 32590 - DNA, 20 bp, Artificial Sequence
  Description of Artificial Sequence: Synthetic oligonucleotide
  Target: SCN10A; (+) strand; PAM type: NRG; PAM sequence: GAG
aaagacacgggcaaactgaa

SEQ ID NO: 32591 - DNA, 20 bp, Artificial Sequence
  Description of Artificial Sequence: Synthetic oligonucleotide
  Target: SCN10A; (+) strand; PAM type: NRG; PAM sequence: CAG
gcaaactgaagagcaaattt

SEQ ID NO: 32592 - DNA, 20 bp, Artificial Sequence
  Description of Artificial Sequence: Synthetic oligonucleotide
  Target: SCN10A; (+) strand; PAM type: NRG; PAM sequence: AAG
gagcaaatttcagataaaca

SEQ ID NO: 32593 - DNA, 20 bp, Artificial Sequence
  Description of Artificial Sequence: Synthetic oligonucleotide
  Target: SCN10A; (+) strand; PAM type: NRG; PAM sequence: GAG
gcaaatttcagataaacaaa

SEQ ID NO: 32594 - DNA, 20 bp, Artificial Sequence
  Description of Artificial Sequence: Synthetic oligonucleotide
  Target: SCN10A; (+) strand; PAM type: NRG; PAM sequence: AGG
caaatttcagataaacaaag

SEQ ID NO: 32595 - DNA, 20 bp, Artificial Sequence
  Description of Artificial Sequence: Synthetic oligonucleotide
  Target: SCN10A; (+) strand; PAM type: NRG; PAM sequence: TGG
tcagataaacaaagaggtta

SEQ ID NO: 32596 - DNA, 20 bp, Artificial Sequence
  Description of Artificial Sequence: Synthetic oligonucleotide
  Target: SCN10A; (+) strand; PAM type: NRG; PAM sequence: CAG
ataaacaaagaggttatggc

SEQ ID NO: 32597 - DNA, 20 bp, Artificial Sequence
  Description of Artificial Sequence: Synthetic oligonucleotide
  Target: SCN10A; (+) strand; PAM type: NRG; PAM sequence: AAG
aacaaagaggttatggccag

SEQ ID NO: 32598 - DNA, 20 bp, Artificial Sequence
  Description of Artificial Sequence: Synthetic oligonucleotide
  Target: SCN10A; (+) strand; PAM type: NRG; PAM sequence: AGG
acaaagaggttatggccaga

SEQ ID NO: 32599 - DNA, 20 bp, Artificial Sequence
  Description of Artificial Sequence: Synthetic oligonucleotide
  Target: SCN10A; (+) strand; PAM type: NRG; PAM sequence: AAG
ggccagaaggcacttactaa

SEQ ID NO: 32600 - DNA, 20 bp, Artificial Sequence
  Description of Artificial Sequence: Synthetic oligonucleotide
  Target: SCN10A; (+) strand; PAM type: NRG; PAM sequence: AAG
acttactaaaagaaattcta

SEQ ID NO: 32601 - DNA, 20 bp, Artificial Sequence
  Description of Artificial Sequence: Synthetic oligonucleotide
  Target: SCN10A; (+) strand; PAM type: NRG; PAM sequence: AGG
cttactaaaagaaattctaa

SEQ ID NO: 32602 - DNA, 20 bp, Artificial Sequence
  Description of Artificial Sequence: Synthetic oligonucleotide
  Target: SCN10A; (+) strand; PAM type: NRG; PAM sequence: GAG
tactaaaagaaattctaaag

SEQ ID NO: 32603 - DNA, 20 bp, Artificial Sequence
  Description of Artificial Sequence: Synthetic oligonucleotide
  Target: SCN10A; (+) strand; PAM type: NRG; PAM sequence: AGG
actaaaagaaattctaaagg

SEQ ID NO: 32604 - DNA, 20 bp, Artificial Sequence
  Description of Artificial Sequence: Synthetic oligonucleotide
  Target: SCN10A; (+) strand; PAM type: NRG; PAM sequence: CAG
aaattctaaaggaggtactt

SEQ ID NO: 32605 - DNA, 20 bp, Artificial Sequence
  Description of Artificial Sequence: Synthetic oligonucleotide
  Target: SCN10A; (+) strand; PAM type: NRG; PAM sequence: AGG
aattctaaaggaggtacttc

SEQ ID NO: 32606 - DNA, 20 bp, Artificial Sequence
  Description of Artificial Sequence: Synthetic oligonucleotide
  Target: SCN10A; (+) strand; PAM type: NRG; PAM sequence: TAG
tctaaaggaggtacttcagg

SEQ ID NO: 32607 - DNA, 20 bp, Artificial Sequence
  Description of Artificial Sequence: Synthetic oligonucleotide
  Target: SCN10A; (+) strand; PAM type: NRG; PAM sequence: TAG
aaggaggtacttcaggtaga

SEQ ID NO: 32608 - DNA, 20 bp, Artificial Sequence
  Description of Artificial Sequence: Synthetic oligonucleotide
  Target: SCN10A; (+) strand; PAM type: NRG; PAM sequence: AAG
aggtacttcaggtagataga

SEQ ID NO: 32609 - DNA, 20 bp, Artificial Sequence
  Description of Artificial Sequence: Synthetic oligonucleotide
  Target: SCN10A; (+) strand; PAM type: NRG; PAM sequence: CAG
aggtagatagaaagtgatcc

SEQ ID NO: 32610 - DNA, 20 bp, Artificial Sequence
  Description of Artificial Sequence: Synthetic oligonucleotide
  Target: SCN10A; (+) strand; PAM type: NRG; PAM sequence: AAG
tagatagaaagtgatcccag

SEQ ID NO: 32611 - DNA, 20 bp, Artificial Sequence
  Description of Artificial Sequence: Synthetic oligonucleotide
  Target: SCN10A; (+) strand; PAM type: NRG; PAM sequence: AAG
atatgtaatgtgtaatatac

SEQ ID NO: 32612 - DNA, 20 bp, Artificial Sequence
  Description of Artificial Sequence: Synthetic oligonucleotide
  Target: SCN10A; (+) strand; PAM type: NRG; PAM sequence: AAG
gaatgtgaaactgtgctcca

SEQ ID NO: 32613 - DNA, 20 bp, Artificial Sequence
  Description of Artificial Sequence: Synthetic oligonucleotide
  Target: SCN10A; (+) strand; PAM type: NRG; PAM sequence: AGG
aatgtgaaactgtgctccaa

SEQ ID NO: 32614 - DNA, 20 bp, Artificial Sequence
  Description of Artificial Sequence: Synthetic oligonucleotide
  Target: SCN10A; (+) strand; PAM type: NRG; PAM sequence: GGG
atgtgaaactgtgctccaaa

SEQ ID NO: 32615 - DNA, 20 bp, Artificial Sequence
  Description of Artificial Sequence: Synthetic oligonucleotide
  Target: SCN10A; (+) strand; PAM type: NRG; PAM sequence: AAG
aactgtgctccaaagggttg

SEQ ID NO: 32616 - DNA, 20 bp, Artificial Sequence
  Description of Artificial Sequence: Synthetic oligonucleotide
  Target: SCN10A; (+) strand; PAM type: NRG; PAM sequence: TAG
gaaatcaataactaaatttt

SEQ ID NO: 32617 - DNA, 20 bp, Artificial Sequence
  Description of Artificial Sequence: Synthetic oligonucleotide
  Target: SCN10A; (+) strand; PAM type: NRG; PAM sequence: AGG
aaatcaataactaaattttt

SEQ ID NO: 32618 - DNA, 20 bp, Artificial Sequence
  Description of Artificial Sequence: Synthetic oligonucleotide
  Target: SCN10A; (+) strand; PAM type: NRG; PAM sequence: CAG
taactaaatttttaggctta

SEQ ID NO: 32619 - DNA, 20 bp, Artificial Sequence
  Description of Artificial Sequence: Synthetic oligonucleotide
  Target: SCN10A; (+) strand; PAM type: NRG; PAM sequence: AGG
aactaaatttttaggcttac

SEQ ID NO: 32620 - DNA, 20 bp, Artificial Sequence
  Description of Artificial Sequence: Synthetic oligonucleotide
  Target: SCN10A; (+) strand; PAM type: NRG; PAM sequence: CAG
tttttaggcttacaggatac

SEQ ID NO: 32621 - DNA, 20 bp, Artificial Sequence
  Description of Artificial Sequence: Synthetic oligonucleotide
  Target: SCN10A; (+) strand; PAM type: NRG; PAM sequence: AAG
aggcttacaggataccagat

SEQ ID NO: 32622 - DNA, 20 bp, Artificial Sequence
  Description of Artificial Sequence: Synthetic oligonucleotide
  Target: SCN10A; (+) strand; PAM type: NRG; PAM sequence: AAG
gaaactcaaactgtgttcca

SEQ ID NO: 32623 - DNA, 20 bp, Artificial Sequence
  Description of Artificial Sequence: Synthetic oligonucleotide
  Target: SCN10A; (+) strand; PAM type: NRG; PAM sequence: GAG
aactcaaactgtgttccaaa

SEQ ID NO: 32624 - DNA, 20 bp, Artificial Sequence
  Description of Artificial Sequence: Synthetic oligonucleotide
  Target: SCN10A; (+) strand; PAM type: NRG; PAM sequence: AAG
caaactgtgttccaaagagt

SEQ ID NO: 32625 - DNA, 20 bp, Artificial Sequence
  Description of Artificial Sequence: Synthetic oligonucleotide
  Target: SCN10A; (+) strand; PAM type: NRG; PAM sequence: CAG
tgttccaaagagtaagaaat

SEQ ID NO: 32626 - DNA, 20 bp, Artificial Sequence
  Description of Artificial Sequence: Synthetic oligonucleotide
  Target: SCN10A; (+) strand; PAM type: NRG; PAM sequence: GAG
agtaacttacaaaaattctt

SEQ ID NO: 32627 - DNA, 20 bp, Artificial Sequence
  Description of Artificial Sequence: Synthetic oligonucleotide
  Target: SCN10A; (+) strand; PAM type: NRG; PAM sequence: TAG
tacaaaaattcttgagtttt

SEQ ID NO: 32628 - DNA, 20 bp, Artificial Sequence
  Description of Artificial Sequence: Synthetic oligonucleotide
  Target: SCN10A; (+) strand; PAM type: NRG; PAM sequence: AGG
acaaaaattcttgagttttt

SEQ ID NO: 32629 - DNA, 20 bp, Artificial Sequence
  Description of Artificial Sequence: Synthetic oligonucleotide
  Target: SCN10A; (+) strand; PAM type: NRG; PAM sequence: TAG
aaattcttgagtttttagga

SEQ ID NO: 32630 - DNA, 20 bp, Artificial Sequence
  Description of Artificial Sequence: Synthetic oligonucleotide
  Target: SCN10A; (+) strand; PAM type: NRG; PAM sequence: CAG
ttcttgagtttttaggatag

SEQ ID NO: 32631 - DNA, 20 bp, Artificial Sequence
  Description of Artificial Sequence: Synthetic oligonucleotide
  Target: SCN10A; (+) strand; PAM type: NRG; PAM sequence: TAG
tgagtttttaggatagcaga

SEQ ID NO: 32632 - DNA, 20 bp, Artificial Sequence
  Description of Artificial Sequence: Synthetic oligonucleotide
  Target: SCN10A; (+) strand; PAM type: NRG; PAM sequence: AGG
gagtttttaggatagcagat

SEQ ID NO: 32633 - DNA, 20 bp, Artificial Sequence
  Description of Artificial Sequence: Synthetic oligonucleotide
  Target: SCN10A; (+) strand; PAM type: NRG; PAM sequence: AAG
tttaggatagcagataggta

SEQ ID NO: 32634 - DNA, 20 bp, Artificial Sequence
  Description of Artificial Sequence: Synthetic oligonucleotide
  Target: SCN10A; (+) strand; PAM type: NRG; PAM sequence: GAG
aggtaaagaaacaacttgct

SEQ ID NO: 32635 - DNA, 20 bp, Artificial Sequence
  Description of Artificial Sequence: Synthetic oligonucleotide
  Target: SCN10A; (+) strand; PAM type: NRG; PAM sequence: CAG
cttgtgtgatgatgaaaaaa

SEQ ID NO: 32636 - DNA, 20 bp, Artificial Sequence
  Description of Artificial Sequence: Synthetic oligonucleotide
  Target: SCN10A; (+) strand; PAM type: NRG; PAM sequence: AGG
ttgtgtgatgatgaaaaaac

SEQ ID NO: 32637 - DNA, 20 bp, Artificial Sequence
  Description of Artificial Sequence: Synthetic oligonucleotide
  Target: SCN10A; (+) strand; PAM type: NRG; PAM sequence: TGG
aaaaacaggctgaaatcaat

SEQ ID NO: 32638 - DNA, 20 bp, Artificial Sequence
  Description of Artificial Sequence: Synthetic oligonucleotide
  Target: SCN10A; (+) strand; PAM type: NRG; PAM sequence: CAG
aggctgaaatcaattggaac

SEQ ID NO: 32639 - DNA, 20 bp, Artificial Sequence
  Description of Artificial Sequence: Synthetic oligonucleotide
  Target: SCN10A; (+) strand; PAM type: NRG; PAM sequence: AGG
ggctgaaatcaattggaacc

SEQ ID NO: 32640 - DNA, 20 bp, Artificial Sequence
  Description of Artificial Sequence: Synthetic oligonucleotide
  Target: SCN10A; (+) strand; PAM type: NRG; PAM sequence: TGG
gaaatcaattggaaccagga

SEQ ID NO: 32641 - DNA, 20 bp, Artificial Sequence
  Description of Artificial Sequence: Synthetic oligonucleotide
  Target: SCN10A; (+) strand; PAM type: NRG; PAM sequence: TGG
ttggaaccaggatggccgac

SEQ ID NO: 32642 - DNA, 20 bp, Artificial Sequence
  Description of Artificial Sequence: Synthetic oligonucleotide
  Target: SCN10A; (+) strand; PAM type: NRG; PAM sequence: GAG
ggaaccaggatggccgactg

SEQ ID NO: 32643 - DNA, 20 bp, Artificial Sequence
  Description of Artificial Sequence: Synthetic oligonucleotide
  Target: SCN10A; (+) strand; PAM type: NRG; PAM sequence: CAG
atggccgactggagtttgtg

SEQ ID NO: 32644 - DNA, 20 bp, Artificial Sequence
  Description of Artificial Sequence: Synthetic oligonucleotide
  Target: SCN10A; (+) strand; PAM type: NRG; PAM sequence: GAG
gactggagtttgtgcagaat

SEQ ID NO: 32645 - DNA, 20 bp, Artificial Sequence
  Description of Artificial Sequence: Synthetic oligonucleotide
  Target: SCN10A; (+) strand; PAM type: NRG; PAM sequence: TGG
gaatgagcttgctgacgtca

SEQ ID NO: 32646 - DNA, 20 bp, Artificial Sequence
  Description of Artificial Sequence: Synthetic oligonucleotide
  Target: SCN10A; (+) strand; PAM type: NRG; PAM sequence: CAG
tattgcatactaactccccc

SEQ ID NO: 32647 - DNA, 20 bp, Artificial Sequence
  Description of Artificial Sequence: Synthetic oligonucleotide
  Target: SCN10A; (+) strand; PAM type: NRG; PAM sequence: GAG
gatttgcatatgcaacccat

SEQ ID NO: 32648 - DNA, 20 bp, Artificial Sequence
  Description of Artificial Sequence: Synthetic oligonucleotide
  Target: SCN10A; (+) strand; PAM type: NRG; PAM sequence: AAG
tgcatatgcaacccatgagt

SEQ ID NO: 32649 - DNA, 20 bp, Artificial Sequence
  Description of Artificial Sequence: Synthetic oligonucleotide
  Target: SCN10A; (+) strand; PAM type: NRG; PAM sequence: AAG
gcaacccatgagtaagcatg

SEQ ID NO: 32650 - DNA, 20 bp, Artificial Sequence
  Description of Artificial Sequence: Synthetic oligonucleotide
  Target: SCN10A; (+) strand; PAM type: NRG; PAM sequence: GAG
aacccatgagtaagcatgaa

SEQ ID NO: 32651 - DNA, 20 bp, Artificial Sequence
  Description of Artificial Sequence: Synthetic oligonucleotide
  Target: SCN10A; (+) strand; PAM type: NRG; PAM sequence: CAG
agcatgaagagataactgtg

SEQ ID NO: 32652 - DNA, 20 bp, Artificial Sequence
  Description of Artificial Sequence: Synthetic oligonucleotide
  Target: SCN10A; (+) strand; PAM type: NRG; PAM sequence: AGG
gcatgaagagataactgtgc

SEQ ID NO: 32653 - DNA, 20 bp, Artificial Sequence
  Description of Artificial Sequence: Synthetic oligonucleotide
  Target: SCN10A; (+) strand; PAM type: NRG; PAM sequence: TGG
gagataactgtgcaggccca

SEQ ID NO: 32654 - DNA, 20 bp, Artificial Sequence
  Description of Artificial Sequence: Synthetic oligonucleotide
  Target: SCN10A; (+) strand; PAM type: NRG; PAM sequence: CGG
caccaatcacctgcaaatcc

SEQ ID NO: 32655 - DNA, 20 bp, Artificial Sequence
  Description of Artificial Sequence: Synthetic oligonucleotide
  Target: SCN10A; (+) strand; PAM type: NRG; PAM sequence: AAG
ctaataaaaatactgccttg

SEQ ID NO: 32656 - DNA, 20 bp, Artificial Sequence
  Description of Artificial Sequence: Synthetic oligonucleotide
  Target: SCN10A; (+) strand; PAM type: NRG; PAM sequence: CAG
taaaaatactgccttgaaga

SEQ ID NO: 32657 - DNA, 20 bp, Artificial Sequence
  Description of Artificial Sequence: Synthetic oligonucleotide
  Target: SCN10A; (+) strand; PAM type: NRG; PAM sequence: CAG
atactgccttgaagacagca

SEQ ID NO: 32658 - DNA, 20 bp, Artificial Sequence
  Description of Artificial Sequence: Synthetic oligonucleotide
  Target: SCN10A; (+) strand; PAM type: NRG; PAM sequence: AGG
tactgccttgaagacagcac

SEQ ID NO: 32659 - DNA, 20 bp, Artificial Sequence
  Description of Artificial Sequence: Synthetic oligonucleotide
  Target: SCN10A; (+) strand; PAM type: NRG; PAM sequence: GGG
actgccttgaagacagcaca

SEQ ID NO: 32660 - DNA, 20 bp, Artificial Sequence
  Description of Artificial Sequence: Synthetic oligonucleotide
  Target: SCN10A; (+) strand; PAM type: NRG; PAM sequence: GAG
tgccttgaagacagcacagg

SEQ ID NO: 32661 - DNA, 20 bp, Artificial Sequence
  Description of Artificial Sequence: Synthetic oligonucleotide
  Target: SCN10A; (+) strand; PAM type: NRG; PAM sequence: CAG
ttgaagacagcacagggaga

SEQ ID NO: 32662 - DNA, 20 bp, Artificial Sequence
  Description of Artificial Sequence: Synthetic oligonucleotide
  Target: SCN10A; (+) strand; PAM type: NRG; PAM sequence: GAG
cagcacagggagacagatct

SEQ ID NO: 32663 - DNA, 20 bp, Artificial Sequence
  Description of Artificial Sequence: Synthetic oligonucleotide
  Target: SCN10A; (+) strand; PAM type: NRG; PAM sequence: CAG
ttgacctcctgtcttcttgc

SEQ ID NO: 32664 - DNA, 20 bp, Artificial Sequence
  Description of Artificial Sequence: Synthetic oligonucleotide
  Target: SCN10A; (+) strand; PAM type: NRG; PAM sequence: CAG
cctcctgtcttcttgccagc

SEQ ID NO: 32665 - DNA, 20 bp, Artificial Sequence
  Description of Artificial Sequence: Synthetic oligonucleotide
  Target: SCN10A; (+) strand; PAM type: NRG; PAM sequence: CAG
tcttcttgccagccagcttg

SEQ ID NO: 32666 - DNA, 20 bp, Artificial Sequence
  Description of Artificial Sequence: Synthetic oligonucleotide
  Target: SCN10A; (+) strand; PAM type: NRG; PAM sequence: AAG
gccagccagcttgcagtatt

SEQ ID NO: 32667 - DNA, 20 bp, Artificial Sequence
  Description of Artificial Sequence: Synthetic oligonucleotide
  Target: SCN10A; (+) strand; PAM type: NRG; PAM sequence: AAG
ttaagcttttcttttctcaa

SEQ ID NO: 32668 - DNA, 20 bp, Artificial Sequence
  Description of Artificial Sequence: Synthetic oligonucleotide
  Target: SCN10A; (+) strand; PAM type: NRG; PAM sequence: TGG
cttttcttttctcaaaagcc

SEQ ID NO: 32669 - DNA, 20 bp, Artificial Sequence
  Description of Artificial Sequence: Synthetic oligonucleotide
  Target: SCN10A; (+) strand; PAM type: NRG; PAM sequence: TGG
aaagcctggtgtcctcgtct

SEQ ID NO: 32670 - DNA, 20 bp, Artificial Sequence
  Description of Artificial Sequence: Synthetic oligonucleotide
  Target: SCN10A; (+) strand; PAM type: NRG; PAM sequence: AAG
tgtcctcgtcttggcttcca

SEQ ID NO: 32671 - DNA, 20 bp, Artificial Sequence
  Description of Artificial Sequence: Synthetic oligonucleotide
  Target: SCN10A; (+) strand; PAM type: NRG; PAM sequence: TAG
cgtcttggcttccaaagtca

SEQ ID NO: 32672 - DNA, 20 bp, Artificial Sequence
  Description of Artificial Sequence: Synthetic oligonucleotide
  Target: SCN10A; (+) strand; PAM type: NRG; PAM sequence: TGG
ggcttccaaagtcatagtat

SEQ ID NO: 32673 - DNA, 20 bp, Artificial Sequence
  Description of Artificial Sequence: Synthetic oligonucleotide
  Target: SCN10A; (+) strand; PAM type: NRG; PAM sequence: TAG
aaagtcatagtattggcttc

SEQ ID NO: 32674 - DNA, 20 bp, Artificial Sequence
  Description of Artificial Sequence: Synthetic oligonucleotide
  Target: SCN10A; (+) strand; PAM type: NRG; PAM sequence: GAG
agtcatagtattggcttcta

SEQ ID NO: 32675 - DNA, 20 bp, Artificial Sequence
  Description of Artificial Sequence: Synthetic oligonucleotide
  Target: SCN10A; (+) strand; PAM type: NRG; PAM sequence: TGG
agtattggcttctagagcat

SEQ ID NO: 32676 - DNA, 20 bp, Artificial Sequence
  Description of Artificial Sequence: Synthetic oligonucleotide
  Target: SCN10A; (+) strand; PAM type: NRG; PAM sequence: GGG
gtattggcttctagagcatt

SEQ ID NO: 32677 - DNA, 20 bp, Artificial Sequence
  Description of Artificial Sequence: Synthetic oligonucleotide
  Target: SCN10A; (+) strand; PAM type: NRG; PAM sequence: CAG
ttggcttctagagcattggg

SEQ ID NO: 32678 - DNA, 20 bp, Artificial Sequence
  Description of Artificial Sequence: Synthetic oligonucleotide
  Target: SCN10A; (+) strand; PAM type: NRG; PAM sequence: GAG
cttctagagcattgggcagt

SEQ ID NO: 32679 - DNA, 20 bp, Artificial Sequence
  Description of Artificial Sequence: Synthetic oligonucleotide
  Target: SCN10A; (+) strand; PAM type: NRG; PAM sequence: TGG
attgggcagtgagcccccac

SEQ ID NO: 32680 - DNA, 20 bp, Artificial Sequence
  Description of Artificial Sequence: Synthetic oligonucleotide
  Target: SCN10A; (+) strand; PAM type: NRG; PAM sequence: AAG
cccccactggctctataaca

SEQ ID NO: 32681 - DNA, 20 bp, Artificial Sequence
  Description of Artificial Sequence: Synthetic oligonucleotide
  Target: SCN10A; (+) strand; PAM type: NRG; PAM sequence: AGG
ccccactggctctataacaa

SEQ ID NO: 32682 - DNA, 20 bp, Artificial Sequence
  Description of Artificial Sequence: Synthetic oligonucleotide
  Target: SCN10A; (+) strand; PAM type: NRG; PAM sequence: AAG
ggctctataacaaaggtata

SEQ ID NO: 32683 - DNA, 20 bp, Artificial Sequence
  Description of Artificial Sequence: Synthetic oligonucleotide
  Target: SCN10A; (+) strand; PAM type: NRG; PAM sequence: GAG
ctctataacaaaggtataaa

SEQ ID NO: 32684 - DNA, 20 bp, Artificial Sequence
  Description of Artificial Sequence: Synthetic oligonucleotide
  Target: SCN10A; (+) strand; PAM type: NRG; PAM sequence: AAG
ataacaaaggtataaagagc

SEQ ID NO: 32685 - DNA, 20 bp, Artificial Sequence
  Description of Artificial Sequence: Synthetic oligonucleotide
  Target: SCN10A; (+) strand; PAM type: NRG; PAM sequence: AAG
caaaggtataaagagcaaga

SEQ ID NO: 32686 - DNA, 20 bp, Artificial Sequence
  Description of Artificial Sequence: Synthetic oligonucleotide
  Target: SCN10A; (+) strand; PAM type: NRG; PAM sequence: AAG
ataaagagcaagaaagtgct

SEQ ID NO: 32687 - DNA, 20 bp, Artificial Sequence
  Description of Artificial Sequence: Synthetic oligonucleotide
  Target: SCN10A; (+) strand; PAM type: NRG; PAM sequence: GAG
agcaagaaagtgctaagcat

SEQ ID NO: 32688 - DNA, 20 bp, Artificial Sequence
  Description of Artificial Sequence: Synthetic oligonucleotide
  Target: SCN10A; (+) strand; PAM type: NRG; PAM sequence: GAG
caagaaagtgctaagcatga

SEQ ID NO: 32689 - DNA, 20 bp, Artificial Sequence
  Description of Artificial Sequence: Synthetic oligonucleotide
  Target: SCN10A; (+) strand; PAM type: NRG; PAM sequence: GAG
agtgaatctaaataaacatt

SEQ ID NO: 32690 - DNA, 20 bp, Artificial Sequence
  Description of Artificial Sequence: Synthetic oligonucleotide
  Target: SCN10A; (+) strand; PAM type: NRG; PAM sequence: TGG
gaatctaaataaacattgag

SEQ ID NO: 32691 - DNA, 20 bp, Artificial Sequence
  Description of Artificial Sequence: Synthetic oligonucleotide
  Target: SCN10A; (+) strand; PAM type: NRG; PAM sequence: GAG
acacaacaacaatgtcttgt

SEQ ID NO: 32692 - DNA, 20 bp, Artificial Sequence
  Description of Artificial Sequence: Synthetic oligonucleotide
  Target: SCN10A; (+) strand; PAM type: NRG; PAM sequence: TGG
caacaatgtcttgtgagatg

SEQ ID NO: 32693 - DNA, 20 bp, Artificial Sequence
  Description of Artificial Sequence: Synthetic oligonucleotide
  Target: SCN10A; (+) strand; PAM type: NRG; PAM sequence: AAG
caatgtcttgtgagatgtgg

SEQ ID NO: 32694 - DNA, 20 bp, Artificial Sequence
  Description of Artificial Sequence: Synthetic oligonucleotide
  Target: SCN10A; (+) strand; PAM type: NRG; PAM sequence: GAG
atgtcttgtgagatgtggaa

SEQ ID NO: 32695 - DNA, 20 bp, Artificial Sequence
  Description of Artificial Sequence: Synthetic oligonucleotide
  Target: SCN10A; (+) strand; PAM type: NRG; PAM sequence: TGG
ttgtgagatgtggaagagac

SEQ ID NO: 32696 - DNA, 20 bp, Artificial Sequence
  Description of Artificial Sequence: Synthetic oligonucleotide
  Target: SCN10A; (+) strand; PAM type: NRG; PAM sequence: TAG
tgtggaagagactggtcata

SEQ ID NO: 32697 - DNA, 20 bp, Artificial Sequence
  Description of Artificial Sequence: Synthetic oligonucleotide
  Target: SCN10A; (+) strand; PAM type: NRG; PAM sequence: CAG
tccattcacttttctcctcc

SEQ ID NO: 32698 - DNA, 20 bp, Artificial Sequence
  Description of Artificial Sequence: Synthetic oligonucleotide
  Target: SCN10A; (+) strand; PAM type: NRG; PAM sequence: CGG
ttttctcctcccagacacaa

SEQ ID NO: 32699 - DNA, 20 bp, Artificial Sequence
  Description of Artificial Sequence: Synthetic oligonucleotide
  Target: SCN10A; (+) strand; PAM type: NRG; PAM sequence: AAG
tctcctcccagacacaacgg

SEQ ID NO: 32700 - DNA, 20 bp, Artificial Sequence
  Description of Artificial Sequence: Synthetic oligonucleotide
  Target: SCN10A; (+) strand; PAM type: NRG; PAM sequence: CAG
cacaacggaagactgttttc

SEQ ID NO: 32701 - DNA, 20 bp, Artificial Sequence
  Description of Artificial Sequence: Synthetic oligonucleotide
  Target: SCN10A; (+) strand; PAM type: NRG; PAM sequence: TAG
tttccagttttgcttgcaaa

SEQ ID NO: 32702 - DNA, 20 bp, Artificial Sequence
  Description of Artificial Sequence: Synthetic oligonucleotide
  Target: SCN10A; (+) strand; PAM type: NRG; PAM sequence: TGG
cagttttgcttgcaaatagt

SEQ ID NO: 32703 - DNA, 20 bp, Artificial Sequence
  Description of Artificial Sequence: Synthetic oligonucleotide
  Target: SCN10A; (+) strand; PAM type: NRG; PAM sequence: GGG
agttttgcttgcaaatagtt

SEQ ID NO: 32704 - DNA, 20 bp, Artificial Sequence
  Description of Artificial Sequence: Synthetic oligonucleotide
  Target: SCN10A; (+) strand; PAM type: NRG; PAM sequence: GGG
gttttgcttgcaaatagttg

SEQ ID NO: 32705 - DNA, 20 bp, Artificial Sequence
  Description of Artificial Sequence: Synthetic oligonucleotide
  Target: SCN10A; (+) strand; PAM type: NRG; PAM sequence: TAG
gcaaatagttggggtcatgt

SEQ ID NO: 32706 - DNA, 20 bp, Artificial Sequence
  Description of Artificial Sequence: Synthetic oligonucleotide
  Target: SCN10A; (+) strand; PAM type: NRG; PAM sequence: TGG
aatagttggggtcatgttag

SEQ ID NO: 32707 - DNA, 20 bp, Artificial Sequence
  Description of Artificial Sequence: Synthetic oligonucleotide
  Target: SCN10A; (+) strand; PAM type: NRG; PAM sequence: GGG
atagttggggtcatgttagt

SEQ ID NO: 32708 - DNA, 20 bp, Artificial Sequence
  Description of Artificial Sequence: Synthetic oligonucleotide
  Target: SCN10A; (+) strand; PAM type: NRG; PAM sequence: TGG
tcatgttagtgggttctgtc

SEQ ID NO: 32709 - DNA, 20 bp, Artificial Sequence
  Description of Artificial Sequence: Synthetic oligonucleotide
  Target: SCN10A; (+) strand; PAM type: NRG; PAM sequence: TGG
tgttagtgggttctgtctgg

SEQ ID NO: 32710 - DNA, 20 bp, Artificial Sequence
  Description of Artificial Sequence: Synthetic oligonucleotide
  Target: SCN10A; (+) strand; PAM type: NRG; PAM sequence: TGG
gtgggttctgtctggtggaa

SEQ ID NO: 32711 - DNA, 20 bp, Artificial Sequence
  Description of Artificial Sequence: Synthetic oligonucleotide
  Target: SCN10A; (+) strand; PAM type: NRG; PAM sequence: GAG
gggttctgtctggtggaatg

SEQ ID NO: 32712 - DNA, 20 bp, Artificial Sequence
  Description of Artificial Sequence: Synthetic oligonucleotide
  Target: SCN10A; (+) strand; PAM type: NRG; PAM sequence: TGG
tctgtctggtggaatggaga

SEQ ID NO: 32713 - DNA, 20 bp, Artificial Sequence
  Description of Artificial Sequence: Synthetic oligonucleotide
  Target: SCN10A; (+) strand; PAM type: NRG; PAM sequence: GAG
tgtctggtggaatggagatg

SEQ ID NO: 32714 - DNA, 20 bp, Artificial Sequence
  Description of Artificial Sequence: Synthetic oligonucleotide
  Target: SCN10A; (+) strand; PAM type: NRG; PAM sequence: CAG
tggtggaatggagatggaga

SEQ ID NO: 32715 - DNA, 20 bp, Artificial Sequence
  Description of Artificial Sequence: Synthetic oligonucleotide
  Target: SCN10A; (+) strand; PAM type: NRG; PAM sequence: AAG
tggaatggagatggagacag

SEQ ID NO: 32716 - DNA, 20 bp, Artificial Sequence
  Description of Artificial Sequence: Synthetic oligonucleotide
  Target: SCN10A; (+) strand; PAM type: NRG; PAM sequence: TAG
gaagtaatatacatgacttt

SEQ ID NO: 32717 - DNA, 20 bp, Artificial Sequence
  Description of Artificial Sequence: Synthetic oligonucleotide
  Target: SCN10A; (+) strand; PAM type: NRG; PAM sequence: AGG
aagtaatatacatgactttt

SEQ ID NO: 32718 - DNA, 20 bp, Artificial Sequence
  Description of Artificial Sequence: Synthetic oligonucleotide
  Target: SCN10A; (+) strand; PAM type: NRG; PAM sequence: TAG
atatacatgacttttaggca

SEQ ID NO: 32719 - DNA, 20 bp, Artificial Sequence
  Description of Artificial Sequence: Synthetic oligonucleotide
  Target: SCN10A; (+) strand; PAM type: NRG; PAM sequence: AAG
tccctttcatgttcaccata

SEQ ID NO: 32720 - DNA, 20 bp, Artificial Sequence
  Description of Artificial Sequence: Synthetic oligonucleotide
  Target: SCN10A; (+) strand; PAM type: NRG; PAM sequence: AGG
ccctttcatgttcaccataa

SEQ ID NO: 32721 - DNA, 20 bp, Artificial Sequence
  Description of Artificial Sequence: Synthetic oligonucleotide
  Target: SCN10A; (+) strand; PAM type: NRG; PAM sequence: AAG
accataaaggtcactaactg

SEQ ID NO: 32722 - DNA, 20 bp, Artificial Sequence
  Description of Artificial Sequence: Synthetic oligonucleotide
  Target: SCN10A; (+) strand; PAM type: NRG; PAM sequence: TGG
taaaggtcactaactgaaga

SEQ ID NO: 32723 - DNA, 20 bp, Artificial Sequence
  Description of Artificial Sequence: Synthetic oligonucleotide
  Target: SCN10A; (+) strand; PAM type: NRG; PAM sequence: TGG
aagatggtgacatcacgata

SEQ ID NO: 32724 - DNA, 20 bp, Artificial Sequence
  Description of Artificial Sequence: Synthetic oligonucleotide
  Target: SCN10A; (+) strand; PAM type: NRG; PAM sequence: GGG
agatggtgacatcacgatat

SEQ ID NO: 32725 - DNA, 20 bp, Artificial Sequence
  Description of Artificial Sequence: Synthetic oligonucleotide
  Target: SCN10A; (+) strand; PAM type: NRG; PAM sequence: TAG
atcacgatatgggataatcc

SEQ ID NO: 32726 - DNA, 20 bp, Artificial Sequence
  Description of Artificial Sequence: Synthetic oligonucleotide
  Target: SCN10A; (+) strand; PAM type: NRG; PAM sequence: GAG
tgggataatcctagatcctt

SEQ ID NO: 32727 - DNA, 20 bp, Artificial Sequence
  Description of Artificial Sequence: Synthetic oligonucleotide
  Target: SCN10A; (+) strand; PAM type: NRG; PAM sequence: AGG
gggataatcctagatccttg

SEQ ID NO: 32728 - DNA, 20 bp, Artificial Sequence
  Description of Artificial Sequence: Synthetic oligonucleotide
  Target: SCN10A; (+) strand; PAM type: NRG; PAM sequence: AAG
gatccttgaggcgctacttg

SEQ ID NO: 32729 - DNA, 20 bp, Artificial Sequence
  Description of Artificial Sequence: Synthetic oligonucleotide
  Target: SCN10A; (+) strand; PAM type: NRG; PAM sequence: TAG
ccttgaggcgctacttgaag

SEQ ID NO: 32730 - DNA, 20 bp, Artificial Sequence
  Description of Artificial Sequence: Synthetic oligonucleotide
  Target: SCN10A; (+) strand; PAM type: NRG; PAM sequence: CAG
ctacttgaagtagacactcc

SEQ ID NO: 32731 - DNA, 20 bp, Artificial Sequence
  Description of Artificial Sequence: Synthetic oligonucleotide
  Target: SCN10A; (+) strand; PAM type: NRG; PAM sequence: AGG
tacttgaagtagacactccc

SEQ ID NO: 32732 - DNA, 20 bp, Artificial Sequence
  Description of Artificial Sequence: Synthetic oligonucleotide
  Target: SCN10A; (+) strand; PAM type: NRG; PAM sequence: GAG
cttgaagtagacactcccag

SEQ ID NO: 32733 - DNA, 20 bp, Artificial Sequence
  Description of Artificial Sequence: Synthetic oligonucleotide
  Target: SCN10A; (+) strand; PAM type: NRG; PAM sequence: GAG
tgaagtagacactcccagga

SEQ ID NO: 32734 - DNA, 20 bp, Artificial Sequence
  Description of Artificial Sequence: Synthetic oligonucleotide
  Target: SCN10A; (+) strand; PAM type: NRG; PAM sequence: AAG
tcccaggagagcttcccaac

SEQ ID NO: 32735 - DNA, 20 bp, Artificial Sequence
  Description of Artificial Sequence: Synthetic oligonucleotide
  Target: SCN10A; (+) strand; PAM type: NRG; PAM sequence: GAG
acaagcactgaatgtgctgt

SEQ ID NO: 32736 - DNA, 20 bp, Artificial Sequence
  Description of Artificial Sequence: Synthetic oligonucleotide
  Target: SCN10A; (+) strand; PAM type: NRG; PAM sequence: CAG
atctctattatgttaactca

SEQ ID NO: 32737 - DNA, 20 bp, Artificial Sequence
  Description of Artificial Sequence: Synthetic oligonucleotide
  Target: SCN10A; (+) strand; PAM type: NRG; PAM sequence: TAG
attatgttaactcacagatt

SEQ ID NO: 32738 - DNA, 20 bp, Artificial Sequence
  Description of Artificial Sequence: Synthetic oligonucleotide
  Target: SCN10A; (+) strand; PAM type: NRG; PAM sequence: GAG
tatgttaactcacagattta

SEQ ID NO: 32739 - DNA, 20 bp, Artificial Sequence
  Description of Artificial Sequence: Synthetic oligonucleotide
  Target: SCN10A; (+) strand; PAM type: NRG; PAM sequence: AGG
atgttaactcacagatttag

SEQ ID NO: 32740 - DNA, 20 bp, Artificial Sequence
  Description of Artificial Sequence: Synthetic oligonucleotide
  Target: SCN10A; (+) strand; PAM type: NRG; PAM sequence: GGG
tgttaactcacagatttaga

SEQ ID NO: 32741 - DNA, 20 bp, Artificial Sequence
  Description of Artificial Sequence: Synthetic oligonucleotide
  Target: SCN10A; (+) strand; PAM type: NRG; PAM sequence: CAG
agatttagagggtatcactg

SEQ ID NO: 32742 - DNA, 20 bp, Artificial Sequence
  Description of Artificial Sequence: Synthetic oligonucleotide
  Target: SCN10A; (+) strand; PAM type: NRG; PAM sequence: TAG
ttagagggtatcactgcagc

SEQ ID NO: 32743 - DNA, 20 bp, Artificial Sequence
  Description of Artificial Sequence: Synthetic oligonucleotide
  Target: SCN10A; (+) strand; PAM type: NRG; PAM sequence: GAG
cagctagttgtacttatctt

SEQ ID NO: 32744 - DNA, 20 bp, Artificial Sequence
  Description of Artificial Sequence: Synthetic oligonucleotide
  Target: SCN10A; (+) strand; PAM type: NRG; PAM sequence: TGG
gttgtacttatcttgagtaa

SEQ ID NO: 32745 - DNA, 20 bp, Artificial Sequence
  Description of Artificial Sequence: Synthetic oligonucleotide
  Target: SCN10A; (+) strand; PAM type: NRG; PAM sequence: GAG
tgtacttatcttgagtaatg

SEQ ID NO: 32746 - DNA, 20 bp, Artificial Sequence
  Description of Artificial Sequence: Synthetic oligonucleotide
  Target: SCN10A; (+) strand; PAM type: NRG; PAM sequence: AAG
agaaattgcttcattgaaaa

SEQ ID NO: 32747 - DNA, 20 bp, Artificial Sequence
  Description of Artificial Sequence: Synthetic oligonucleotide
  Target: SCN10A; (+) strand; PAM type: NRG; PAM sequence: AGG
gaaattgcttcattgaaaaa

SEQ ID NO: 32748 - DNA, 20 bp, Artificial Sequence
  Description of Artificial Sequence: Synthetic oligonucleotide
  Target: SCN10A; (+) strand; PAM type: NRG; PAM sequence: AAG
aaaaggtattgccttttcaa

SEQ ID NO: 32749 - DNA, 20 bp, Artificial Sequence
  Description of Artificial Sequence: Synthetic oligonucleotide
  Target: SCN10A; (+) strand; PAM type: NRG; PAM sequence: TGG
tttcaaaagcatcaactatg

SEQ ID NO: 32750 - DNA, 20 bp, Artificial Sequence
  Description of Artificial Sequence: Synthetic oligonucleotide
  Target: SCN10A; (+) strand; PAM type: NRG; PAM sequence: TGG
aagcatcaactatgtggcac

SEQ ID NO: 32751 - DNA, 20 bp, Artificial Sequence
  Description of Artificial Sequence: Synthetic oligonucleotide
  Target: SCN10A; (+) strand; PAM type: NRG; PAM sequence: TGG
gcactggcttaatgatcatg

SEQ ID NO: 32752 - DNA, 20 bp, Artificial Sequence
  Description of Artificial Sequence: Synthetic oligonucleotide
  Target: SCN10A; (+) strand; PAM type: NRG; PAM sequence: TGG
ctggcttaatgatcatgtgg

SEQ ID NO: 32753 - DNA, 20 bp, Artificial Sequence
  Description of Artificial Sequence: Synthetic oligonucleotide
  Target: SCN10A; (+) strand; PAM type: NRG; PAM sequence: GGG
tggcttaatgatcatgtggt

SEQ ID NO: 32754 - DNA, 20 bp, Artificial Sequence
  Description of Artificial Sequence: Synthetic oligonucleotide
  Target: SCN10A; (+) strand; PAM type: NRG; PAM sequence: AAG
atgatcatgtggtgggcaac

SEQ ID NO: 32755 - DNA, 20 bp, Artificial Sequence
  Description of Artificial Sequence: Synthetic oligonucleotide
  Target: SCN10A; (+) strand; PAM type: NRG; PAM sequence: AGG
tgatcatgtggtgggcaaca

SEQ ID NO: 32756 - DNA, 20 bp, Artificial Sequence
  Description of Artificial Sequence: Synthetic oligonucleotide
  Target: SCN10A; (+) strand; PAM type: NRG; PAM sequence: AAG
tcatgtggtgggcaacaagg

SEQ ID NO: 32757 - DNA, 20 bp, Artificial Sequence
  Description of Artificial Sequence: Synthetic oligonucleotide
  Target: SCN10A; (+) strand; PAM type: NRG; PAM sequence: TAG
gtgggcaacaaggaagctga

SEQ ID NO: 32758 - DNA, 20 bp, Artificial Sequence
  Description of Artificial Sequence: Synthetic oligonucleotide
  Target: SCN10A; (+) strand; PAM type: NRG; PAM sequence: AGG
tgggcaacaaggaagctgat

SEQ ID NO: 32759 - DNA, 20 bp, Artificial Sequence
  Description of Artificial Sequence: Synthetic oligonucleotide
  Target: SCN10A; (+) strand; PAM type: NRG; PAM sequence: GAG
ggcaacaaggaagctgatag

SEQ ID NO: 32760 - DNA, 20 bp, Artificial Sequence
  Description of Artificial Sequence: Synthetic oligonucleotide
  Target: SCN10A; (+) strand; PAM type: NRG; PAM sequence: AAG
aacaaggaagctgataggag

SEQ ID NO: 32761 - DNA, 20 bp, Artificial Sequence
  Description of Artificial Sequence: Synthetic oligonucleotide
  Target: SCN10A; (+) strand; PAM type: NRG; PAM sequence: AGG
acaaggaagctgataggaga

SEQ ID NO: 32762 - DNA, 20 bp, Artificial Sequence
  Description of Artificial Sequence: Synthetic oligonucleotide
  Target: SCN10A; (+) strand; PAM type: NRG; PAM sequence: TGG
gaagctgataggagaaggct

SEQ ID NO: 32763 - DNA, 20 bp, Artificial Sequence
  Description of Artificial Sequence: Synthetic oligonucleotide
  Target: SCN10A; (+) strand; PAM type: NRG; PAM sequence: CAG
gaatgtcaatctatgttatt

SEQ ID NO: 32764 - DNA, 20 bp, Artificial Sequence
  Description of Artificial Sequence: Synthetic oligonucleotide
  Target: SCN10A; (+) strand; PAM type: NRG; PAM sequence: TGG
ttcagtgacaaaaatattgc

SEQ ID NO: 32765 - DNA, 20 bp, Artificial Sequence
  Description of Artificial Sequence: Synthetic oligonucleotide
  Target: SCN10A; (+) strand; PAM type: NRG; PAM sequence: GAG
atattgctggcaaaaatttt

SEQ ID NO: 32766 - DNA, 20 bp, Artificial Sequence
  Description of Artificial Sequence: Synthetic oligonucleotide
  Target: SCN10A; (+) strand; PAM type: NRG; PAM sequence: AGG
tattgctggcaaaaattttg

SEQ ID NO: 32767 - DNA, 20 bp, Artificial Sequence
  Description of Artificial Sequence: Synthetic oligonucleotide
  Target: SCN10A; (+) strand; PAM type: NRG; PAM sequence: CAG
tgctggcaaaaattttgagg

SEQ ID NO: 32768 - DNA, 20 bp, Artificial Sequence
  Description of Artificial Sequence: Synthetic oligonucleotide
  Target: SCN10A; (+) strand; PAM type: NRG; PAM sequence: GAG
ctggcaaaaattttgaggca

SEQ ID NO: 32769 - DNA, 20 bp, Artificial Sequence
  Description of Artificial Sequence: Synthetic oligonucleotide
  Target: SCN10A; (+) strand; PAM type: NRG; PAM sequence: GAG
aaaattttgaggcagagcac

SEQ ID NO: 32770 - DNA, 20 bp, Artificial Sequence
  Description of Artificial Sequence: Synthetic oligonucleotide
  Target: SCN10A; (+) strand; PAM type: NRG; PAM sequence: CAG
agagcacgagcctcatgaac

SEQ ID NO: 32771 - DNA, 20 bp, Artificial Sequence
  Description of Artificial Sequence: Synthetic oligonucleotide
  Target: SCN10A; (+) strand; PAM type: NRG; PAM sequence: TAG
gcctcatgaaccagcaaccc

SEQ ID NO: 32772 - DNA, 20 bp, Artificial Sequence
  Description of Artificial Sequence: Synthetic oligonucleotide
  Target: SCN10A; (+) strand; PAM type: NRG; PAM sequence: AGG
cctcatgaaccagcaaccct

SEQ ID NO: 32773 - DNA, 20 bp, Artificial Sequence
  Description of Artificial Sequence: Synthetic oligonucleotide
  Target: SCN10A; (+) strand; PAM type: NRG; PAM sequence: GGG
ctcatgaaccagcaacccta

SEQ ID NO: 32774 - DNA, 20 bp, Artificial Sequence
  Description of Artificial Sequence: Synthetic oligonucleotide
  Target: SCN10A; (+) strand; PAM type: NRG; PAM sequence: GGG
tcatgaaccagcaaccctag

SEQ ID NO: 32775 - DNA, 20 bp, Artificial Sequence
  Description of Artificial Sequence: Synthetic oligonucleotide
  Target: SCN10A; (+) strand; PAM type: NRG; PAM sequence: AAG
tgaaccagcaaccctagggg

SEQ ID NO: 32776 - DNA, 20 bp, Artificial Sequence
  Description of Artificial Sequence: Synthetic oligonucleotide
  Target: SCN10A; (+) strand; PAM type: NRG; PAM sequence: AGG
gaaccagcaaccctagggga

SEQ ID NO: 32777 - DNA, 20 bp, Artificial Sequence
  Description of Artificial Sequence: Synthetic oligonucleotide
  Target: SCN10A; (+) strand; PAM type: NRG; PAM sequence: GGG
aaccagcaaccctaggggaa

SEQ ID NO: 32778 - DNA, 20 bp, Artificial Sequence
  Description of Artificial Sequence: Synthetic oligonucleotide
  Target: SCN10A; (+) strand; PAM type: NRG; PAM sequence: TAG
gggaagggtttattaaacct

SEQ ID NO: 32779 - DNA, 20 bp, Artificial Sequence
  Description of Artificial Sequence: Synthetic oligonucleotide
  Target: SCN10A; (+) strand; PAM type: NRG; PAM sequence: TGG
tttattaaaccttagtattg

SEQ ID NO: 32780 - DNA, 20 bp, Artificial Sequence
  Description of Artificial Sequence: Synthetic oligonucleotide
  Target: SCN10A; (+) strand; PAM type: NRG; PAM sequence: GGG
ttattaaaccttagtattgt

SEQ ID NO: 32781 - DNA, 20 bp, Artificial Sequence
  Description of Artificial Sequence: Synthetic oligonucleotide
  Target: SCN10A; (+) strand; PAM type: NRG; PAM sequence: CAG
taaaccttagtattgtgggt

SEQ ID NO: 32782 - DNA, 20 bp, Artificial Sequence
  Description of Artificial Sequence: Synthetic oligonucleotide
  Target: SCN10A; (+) strand; PAM type: NRG; PAM sequence: TGG
tattgtgggtcagttgtaat

SEQ ID NO: 32783 - DNA, 20 bp, Artificial Sequence
  Description of Artificial Sequence: Synthetic oligonucleotide
  Target: SCN10A; (+) strand; PAM type: NRG; PAM sequence: TGG
tcagttgtaattggctatgt

SEQ ID NO: 32784 - DNA, 20 bp, Artificial Sequence
  Description of Artificial Sequence: Synthetic oligonucleotide
  Target: SCN10A; (+) strand; PAM type: NRG; PAM sequence: AAG
tgtaattggctatgttggtc

SEQ ID NO: 32785 - DNA, 20 bp, Artificial Sequence
  Description of Artificial Sequence: Synthetic oligonucleotide
  Target: SCN10A; (+) strand; PAM type: NRG; PAM sequence: CAG
attggctatgttggtcaaga

SEQ ID NO: 32786 - DNA, 20 bp, Artificial Sequence
  Description of Artificial Sequence: Synthetic oligonucleotide
  Target: SCN10A; (+) strand; PAM type: NRG; PAM sequence: AAG
tatgttggtcaagacagtac

SEQ ID NO: 32787 - DNA, 20 bp, Artificial Sequence
  Description of Artificial Sequence: Synthetic oligonucleotide
  Target: SCN10A; (+) strand; PAM type: NRG; PAM sequence: AAG
ttggtcaagacagtacaaga

SEQ ID NO: 32788 - DNA, 20 bp, Artificial Sequence
  Description of Artificial Sequence: Synthetic oligonucleotide
  Target: SCN10A; (+) strand; PAM type: NRG; PAM sequence: GAG
ggtcaagacagtacaagaaa

SEQ ID NO: 32789 - DNA, 20 bp, Artificial Sequence
  Description of Artificial Sequence: Synthetic oligonucleotide
  Target: SCN10A; (+) strand; PAM type: NRG; PAM sequence: TAG
agacagtacaagaaagagat

SEQ ID NO: 32790 - DNA, 20 bp, Artificial Sequence
  Description of Artificial Sequence: Synthetic oligonucleotide
  Target: SCN10A; (+) strand; PAM type: NRG; PAM sequence: CAG
gtacaagaaagagattagct

SEQ ID NO: 32791 - DNA, 20 bp, Artificial Sequence
  Description of Artificial Sequence: Synthetic oligonucleotide
  Target: SCN10A; (+) strand; PAM type: NRG; PAM sequence: AGG
tacaagaaagagattagctc

SEQ ID NO: 32792 - DNA, 20 bp, Artificial Sequence
  Description of Artificial Sequence: Synthetic oligonucleotide
  Target: SCN10A; (+) strand; PAM type: NRG; PAM sequence: AAG
agaaagagattagctcagga

SEQ ID NO: 32793 - DNA, 20 bp, Artificial Sequence
  Description of Artificial Sequence: Synthetic oligonucleotide
  Target: SCN10A; (+) strand; PAM type: NRG; PAM sequence: TAG
agattagctcaggaaagatt

SEQ ID NO: 32794 - DNA, 20 bp, Artificial Sequence
  Description of Artificial Sequence: Synthetic oligonucleotide
  Target: SCN10A; (+) strand; PAM type: NRG; PAM sequence: TGG
tagctcaggaaagatttagc

SEQ ID NO: 32795 - DNA, 20 bp, Artificial Sequence
  Description of Artificial Sequence: Synthetic oligonucleotide
  Target: SCN10A; (+) strand; PAM type: NRG; PAM sequence: AAG
gaaagatttagctggtttat

SEQ ID NO: 32796 - DNA, 20 bp, Artificial Sequence
  Description of Artificial Sequence: Synthetic oligonucleotide
  Target: SCN10A; (+) strand; PAM type: NRG; PAM sequence: AAG
tagctggtttataagaataa

SEQ ID NO: 32797 - DNA, 20 bp, Artificial Sequence
  Description of Artificial Sequence: Synthetic oligonucleotide
  Target: SCN10A; (+) strand; PAM type: NRG; PAM sequence: CAG
gaataaaagaaaatataatc

SEQ ID NO: 32798 - DNA, 20 bp, Artificial Sequence
  Description of Artificial Sequence: Synthetic oligonucleotide
  Target: SCN10A; (+) strand; PAM type: NRG; PAM sequence: AAG
taaaagaaaatataatccag

SEQ ID NO: 32799 - DNA, 20 bp, Artificial Sequence
  Description of Artificial Sequence: Synthetic oligonucleotide
  Target: SCN10A; (+) strand; PAM type: NRG; PAM sequence: TAG
gaaaatataatccagaagtt

SEQ ID NO: 32800 - DNA, 20 bp, Artificial Sequence
  Description of Artificial Sequence: Synthetic oligonucleotide
  Target: SCN10A; (+) strand; PAM type: NRG; PAM sequence: GAG
aaatataatccagaagttta

SEQ ID NO: 32801 - DNA, 20 bp, Artificial Sequence
  Description of Artificial Sequence: Synthetic oligonucleotide
  Target: SCN10A; (+) strand; PAM type: NRG; PAM sequence: TAG
agtttagagccttgacgatt

SEQ ID NO: 32802 - DNA, 20 bp, Artificial Sequence
  Description of Artificial Sequence: Synthetic oligonucleotide
  Target: SCN10A; (+) strand; PAM type: NRG; PAM sequence: AGG
gtttagagccttgacgattt

SEQ ID NO: 32803 - DNA, 20 bp, Artificial Sequence
  Description of Artificial Sequence: Synthetic oligonucleotide
  Target: SCN10A; (+) strand; PAM type: NRG; PAM sequence: GGG
tttagagccttgacgattta

SEQ ID NO: 32804 - DNA, 20 bp, Artificial Sequence
  Description of Artificial Sequence: Synthetic oligonucleotide
  Target: SCN10A; (+) strand; PAM type: NRG; PAM sequence: TAG
ttagggaactgtactgcttc

SEQ ID NO: 32805 - DNA, 20 bp, Artificial Sequence
  Description of Artificial Sequence: Synthetic oligonucleotide
  Target: SCN10A; (+) strand; PAM type: NRG; PAM sequence: CAG
actgtactgcttctagattc

SEQ ID NO: 32806 - DNA, 20 bp, Artificial Sequence
  Description of Artificial Sequence: Synthetic oligonucleotide
  Target: SCN10A; (+) strand; PAM type: NRG; PAM sequence: AGG
ctgtactgcttctagattcc

SEQ ID NO: 32807 - DNA, 20 bp, Artificial Sequence
  Description of Artificial Sequence: Synthetic oligonucleotide
  Target: SCN10A; (+) strand; PAM type: NRG; PAM sequence: CAG
tactgcttctagattccagg

SEQ ID NO: 32808 - DNA, 20 bp, Artificial Sequence
  Description of Artificial Sequence: Synthetic oligonucleotide
  Target: SCN10A; (+) strand; PAM type: NRG; PAM sequence: GAG
gcttctagattccaggcagt

SEQ ID NO: 32809 - DNA, 20 bp, Artificial Sequence
  Description of Artificial Sequence: Synthetic oligonucleotide
  Target: SCN10A; (+) strand; PAM type: NRG; PAM sequence: TGG
agattccaggcagtgagcaa

SEQ ID NO: 32810 - DNA, 20 bp, Artificial Sequence
  Description of Artificial Sequence: Synthetic oligonucleotide
  Target: SCN10A; (+) strand; PAM type: NRG; PAM sequence: GGG
gattccaggcagtgagcaat

SEQ ID NO: 32811 - DNA, 20 bp, Artificial Sequence
  Description of Artificial Sequence: Synthetic oligonucleotide
  Target: SCN10A; (+) strand; PAM type: NRG; PAM sequence: AAG
aggcagtgagcaatgggatt

SEQ ID NO: 32812 - DNA, 20 bp, Artificial Sequence
  Description of Artificial Sequence: Synthetic oligonucleotide
  Target: SCN10A; (+) strand; PAM type: NRG; PAM sequence: AAG
gattaagtcttcaaatgttg

SEQ ID NO: 32813 - DNA, 20 bp, Artificial Sequence
  Description of Artificial Sequence: Synthetic oligonucleotide
  Target: SCN10A; (+) strand; PAM type: NRG; PAM sequence: TAG
agtcttcaaatgttgaagac

SEQ ID NO: 32814 - DNA, 20 bp, Artificial Sequence
  Description of Artificial Sequence: Synthetic oligonucleotide
  Target: SCN10A; (+) strand; PAM type: NRG; PAM sequence: TAG
caattaaatgaaacaactct

SEQ ID NO: 32815 - DNA, 20 bp, Artificial Sequence
  Description of Artificial Sequence: Synthetic oligonucleotide
  Target: SCN10A; (+) strand; PAM type: NRG; PAM sequence: AAG
aaatgaaacaactcttagca

SEQ ID NO: 32816 - DNA, 20 bp, Artificial Sequence
  Description of Artificial Sequence: Synthetic oligonucleotide
  Target: SCN10A; (+) strand; PAM type: NRG; PAM sequence: TAG
acaactcttagcaaagcttg

SEQ ID NO: 32817 - DNA, 20 bp, Artificial Sequence
  Description of Artificial Sequence: Synthetic oligonucleotide
  Target: SCN10A; (+) strand; PAM type: NRG; PAM sequence: TGG
cttagcaaagcttgtagtaa

SEQ ID NO: 32818 - DNA, 20 bp, Artificial Sequence
  Description of Artificial Sequence: Synthetic oligonucleotide
  Target: SCN10A; (+) strand; PAM type: NRG; PAM sequence: TAG
caaagcttgtagtaatggtg

SEQ ID NO: 32819 - DNA, 20 bp, Artificial Sequence
  Description of Artificial Sequence: Synthetic oligonucleotide
  Target: SCN10A; (+) strand; PAM type: NRG; PAM sequence: AAG
gtagccactgtttcttgtgc

SEQ ID NO: 32820 - DNA, 20 bp, Artificial Sequence
  Description of Artificial Sequence: Synthetic oligonucleotide
  Target: SCN10A; (+) strand; PAM type: NRG; PAM sequence: GAG
agccactgtttcttgtgcaa

SEQ ID NO: 32821 - DNA, 20 bp, Artificial Sequence
  Description of Artificial Sequence: Synthetic oligonucleotide
  Target: SCN10A; (+) strand; PAM type: NRG; PAM sequence: AAG
actgtttcttgtgcaagaga

SEQ ID NO: 32822 - DNA, 20 bp, Artificial Sequence
  Description of Artificial Sequence: Synthetic oligonucleotide
  Target: SCN10A; (+) strand; PAM type: NRG; PAM sequence: AGG
ctgtttcttgtgcaagagaa

SEQ ID NO: 32823 - DNA, 20 bp, Artificial Sequence
  Description of Artificial Sequence: Synthetic oligonucleotide
  Target: SCN10A; (+) strand; PAM type: NRG; PAM sequence: TGG
tcttgtgcaagagaaaggca

SEQ ID NO: 32824 - DNA, 20 bp, Artificial Sequence
  Description of Artificial Sequence: Synthetic oligonucleotide
  Target: SCN10A; (+) strand; PAM type: NRG; PAM sequence: GGG
cttgtgcaagagaaaggcat

SEQ ID NO: 32825 - DNA, 20 bp, Artificial Sequence
  Description of Artificial Sequence: Synthetic oligonucleotide
  Target: SCN10A; (+) strand; PAM type: NRG; PAM sequence: GGG
ttgtgcaagagaaaggcatg

SEQ ID NO: 32826 - DNA, 20 bp, Artificial Sequence
  Description of Artificial Sequence: Synthetic oligonucleotide
  Target: SCN10A; (+) strand; PAM type: NRG; PAM sequence: AAG
gcaagagaaaggcatgggga

SEQ ID NO: 32827 - DNA, 20 bp, Artificial Sequence
  Description of Artificial Sequence: Synthetic oligonucleotide
  Target: SCN10A; (+) strand; PAM type: NRG; PAM sequence: AGG
caagagaaaggcatggggaa

SEQ ID NO: 32828 - DNA, 20 bp, Artificial Sequence
  Description of Artificial Sequence: Synthetic oligonucleotide
  Target: SCN10A; (+) strand; PAM type: NRG; PAM sequence: AAG
agaaaggcatggggaaagga

SEQ ID NO: 32829 - DNA, 20 bp, Artificial Sequence
  Description of Artificial Sequence: Synthetic oligonucleotide
  Target: SCN10A; (+) strand; PAM type: NRG; PAM sequence: AAG
ggcatggggaaaggaaagca

SEQ ID NO: 32830 - DNA, 20 bp, Artificial Sequence
  Description of Artificial Sequence: Synthetic oligonucleotide
  Target: SCN10A; (+) strand; PAM type: NRG; PAM sequence: AAG
gaaaggaaagcaaagaaata

SEQ ID NO: 32831 - DNA, 20 bp, Artificial Sequence
  Description of Artificial Sequence: Synthetic oligonucleotide
  Target: SCN10A; (+) strand; PAM type: NRG; PAM sequence: GAG
caaagaaataaagaacaatt

SEQ ID NO: 32832 - DNA, 20 bp, Artificial Sequence
  Description of Artificial Sequence: Synthetic oligonucleotide
  Target: SCN10A; (+) strand; PAM type: NRG; PAM sequence: AAG
aacaattgagaactttgtca

SEQ ID NO: 32833 - DNA, 20 bp, Artificial Sequence
  Description of Artificial Sequence: Synthetic oligonucleotide
  Target: SCN10A; (+) strand; PAM type: NRG; PAM sequence: AAG
attgagaactttgtcaaaga

SEQ ID NO: 32834 - DNA, 20 bp, Artificial Sequence
  Description of Artificial Sequence: Synthetic oligonucleotide
  Target: SCN10A; (+) strand; PAM type: NRG; PAM sequence: TGG
gtcaaagaaagcactttgtg

SEQ ID NO: 32835 - DNA, 20 bp, Artificial Sequence
  Description of Artificial Sequence: Synthetic oligonucleotide
  Target: SCN10A; (+) strand; PAM type: NRG; PAM sequence: GAG
aaagcactttgtgtggcaat

SEQ ID NO: 32836 - DNA, 20 bp, Artificial Sequence
  Description of Artificial Sequence: Synthetic oligonucleotide
  Target: SCN10A; (+) strand; PAM type: NRG; PAM sequence: GAG
agcactttgtgtggcaatga

SEQ ID NO: 32837 - DNA, 20 bp, Artificial Sequence
  Description of Artificial Sequence: Synthetic oligonucleotide
  Target: SCN10A; (+) strand; PAM type: NRG; PAM sequence: AGG
gcactttgtgtggcaatgag

SEQ ID NO: 32838 - DNA, 20 bp, Artificial Sequence
  Description of Artificial Sequence: Synthetic oligonucleotide
  Target: SCN10A; (+) strand; PAM type: NRG; PAM sequence: AAG
gtgtggcaatgagaggtctg

SEQ ID NO: 32839 - DNA, 20 bp, Artificial Sequence
  Description of Artificial Sequence: Synthetic oligonucleotide
  Target: SCN10A; (+) strand; PAM type: NRG; PAM sequence: AAG
tgagaggtctgaagccatct

SEQ ID NO: 32840 - DNA, 20 bp, Artificial Sequence
  Description of Artificial Sequence: Synthetic oligonucleotide
  Target: SCN10A; (+) strand; PAM type: NRG; PAM sequence: AAG
tgaagccatctaagtttttg

SEQ ID NO: 32841 - DNA, 20 bp, Artificial Sequence
  Description of Artificial Sequence: Synthetic oligonucleotide
  Target: SCN10A; (+) strand; PAM type: NRG; PAM sequence: AAG
atcaaaatccctgactgaaa

SEQ ID NO: 32842 - DNA, 20 bp, Artificial Sequence
  Description of Artificial Sequence: Synthetic oligonucleotide
  Target: SCN10A; (+) strand; PAM type: NRG; PAM sequence: TGG
ttaaaccttaaaacaaacct

SEQ ID NO: 32843 - DNA, 20 bp, Artificial Sequence
  Description of Artificial Sequence: Synthetic oligonucleotide
  Target: SCN10A; (+) strand; PAM type: NRG; PAM sequence: AAG
ttggctttccattttcccac

SEQ ID NO: 32844 - DNA, 20 bp, Artificial Sequence
  Description of Artificial Sequence: Synthetic oligonucleotide
  Target: SCN10A; (+) strand; PAM type: NRG; PAM sequence: CAG
gctttccattttcccacaag

SEQ ID NO: 32845 - DNA, 20 bp, Artificial Sequence
  Description of Artificial Sequence: Synthetic oligonucleotide
  Target: SCN10A; (+) strand; PAM type: NRG; PAM sequence: AGG
ctttccattttcccacaagc

SEQ ID NO: 32846 - DNA, 20 bp, Artificial Sequence
  Description of Artificial Sequence: Synthetic oligonucleotide
  Target: SCN10A; (+) strand; PAM type: NRG; PAM sequence: GAG
ttccattttcccacaagcag

SEQ ID NO: 32847 - DNA, 20 bp, Artificial Sequence
  Description of Artificial Sequence: Synthetic oligonucleotide
  Target: SCN10A; (+) strand; PAM type: NRG; PAM sequence: AGG
tccattttcccacaagcagg

SEQ ID NO: 32848 - DNA, 20 bp, Artificial Sequence
  Description of Artificial Sequence: Synthetic oligonucleotide
  Target: SCN10A; (+) strand; PAM type: NRG; PAM sequence: AAG
caagcaggaggcaaactttg

SEQ ID NO: 32849 - DNA, 20 bp, Artificial Sequence
  Description of Artificial Sequence: Synthetic oligonucleotide
  Target: SCN10A; (+) strand; PAM type: NRG; PAM sequence: TGG
ggcaaactttgaagttatat

SEQ ID NO: 32850 - DNA, 20 bp, Artificial Sequence
  Description of Artificial Sequence: Synthetic oligonucleotide
  Target: SCN10A; (+) strand; PAM type: NRG; PAM sequence: CAG
gaagttatattggcctcctt

SEQ ID NO: 32851 - DNA, 20 bp, Artificial Sequence
  Description of Artificial Sequence: Synthetic oligonucleotide
  Target: SCN10A; (+) strand; PAM type: NRG; PAM sequence: AGG
aagttatattggcctccttc

SEQ ID NO: 32852 - DNA, 20 bp, Artificial Sequence
  Description of Artificial Sequence: Synthetic oligonucleotide
  Target: SCN10A; (+) strand; PAM type: NRG; PAM sequence: TGG
atattggcctccttcaggca

SEQ ID NO: 32853 - DNA, 20 bp, Artificial Sequence
  Description of Artificial Sequence: Synthetic oligonucleotide
  Target: SCN10A; (+) strand; PAM type: NRG; PAM sequence: AAG
ggcctccttcaggcatggca

SEQ ID NO: 32854 - DNA, 20 bp, Artificial Sequence
  Description of Artificial Sequence: Synthetic oligonucleotide
  Target: SCN10A; (+) strand; PAM type: NRG; PAM sequence: TGG
ggcatggcaaagtcacttct

SEQ ID NO: 32855 - DNA, 20 bp, Artificial Sequence
  Description of Artificial Sequence: Synthetic oligonucleotide
  Target: SCN10A; (+) strand; PAM type: NRG; PAM sequence: GAG
catggcaaagtcacttcttg

SEQ ID NO: 32856 - DNA, 20 bp, Artificial Sequence
  Description of Artificial Sequence: Synthetic oligonucleotide
  Target: SCN10A; (+) strand; PAM type: NRG; PAM sequence: TAG
tcacttcttggagtcccacc

SEQ ID NO: 32857 - DNA, 20 bp, Artificial Sequence
  Description of Artificial Sequence: Synthetic oligonucleotide
  Target: SCN10A; (+) strand; PAM type: NRG; PAM sequence: GAG
acttcttggagtcccaccta

SEQ ID NO: 32858 - DNA, 20 bp, Artificial Sequence
  Description of Artificial Sequence: Synthetic oligonucleotide
  Target: SCN10A; (+) strand; PAM type: NRG; PAM sequence: TGG
gagtcccacctagagctgtc

SEQ ID NO: 32859 - DNA, 20 bp, Artificial Sequence
  Description of Artificial Sequence: Synthetic oligonucleotide
  Target: SCN10A; (+) strand; PAM type: NRG; PAM sequence: TAG
tagagctgtctggcttgcat

SEQ ID NO: 32860 - DNA, 20 bp, Artificial Sequence
  Description of Artificial Sequence: Synthetic oligonucleotide
  Target: SCN10A; (+) strand; PAM type: NRG; PAM sequence: AGG
agagctgtctggcttgcatt

SEQ ID NO: 32861 - DNA, 20 bp, Artificial Sequence
  Description of Artificial Sequence: Synthetic oligonucleotide
  Target: SCN10A; (+) strand; PAM type: NRG; PAM sequence: GAG
cttgcattaggctatgatac

SEQ ID NO: 32862 - DNA, 20 bp, Artificial Sequence
  Description of Artificial Sequence: Synthetic oligonucleotide
  Target: SCN10A; (+) strand; PAM type: NRG; PAM sequence: GAG
cattaggctatgatacgagt

SEQ ID NO: 32863 - DNA, 20 bp, Artificial Sequence
  Description of Artificial Sequence: Synthetic oligonucleotide
  Target: SCN10A; (+) strand; PAM type: NRG; PAM sequence: TGG
agtgagaaataaacctttat

SEQ ID NO: 32864 - DNA, 20 bp, Artificial Sequence
  Description of Artificial Sequence: Synthetic oligonucleotide
  Target: SCN10A; (+) strand; PAM type: NRG; PAM sequence: GGG
gtgagaaataaacctttatt

SEQ ID NO: 32865 - DNA, 20 bp, Artificial Sequence
  Description of Artificial Sequence: Synthetic oligonucleotide
  Target: SCN10A; (+) strand; PAM type: NRG; PAM sequence: GGG
tgagaaataaacctttattg

SEQ ID NO: 32866 - DNA, 20 bp, Artificial Sequence
  Description of Artificial Sequence: Synthetic oligonucleotide
  Target: SCN10A; (+) strand; PAM type: NRG; PAM sequence: CAG
aaataaacctttattggggt

SEQ ID NO: 32867 - DNA, 20 bp, Artificial Sequence
  Description of Artificial Sequence: Synthetic oligonucleotide
  Target: SCN10A; (+) strand; PAM type: NRG; PAM sequence: CAG
ctttattggggtcagttact

SEQ ID NO: 32868 - DNA, 20 bp, Artificial Sequence
  Description of Artificial Sequence: Synthetic oligonucleotide
  Target: SCN10A; (+) strand; PAM type: NRG; PAM sequence: TAG
tggggtcagttactcagttt

SEQ ID NO: 32869 - DNA, 20 bp, Artificial Sequence
  Description of Artificial Sequence: Synthetic oligonucleotide
  Target: SCN10A; (+) strand; PAM type: NRG; PAM sequence: GAG
gggtcagttactcagtttta

SEQ ID NO: 32870 - DNA, 20 bp, Artificial Sequence
  Description of Artificial Sequence: Synthetic oligonucleotide
  Target: SCN10A; (+) strand; PAM type: NRG; PAM sequence: TAG
tttagagattgtctgtataa

SEQ ID NO: 32871 - DNA, 20 bp, Artificial Sequence
  Description of Artificial Sequence: Synthetic oligonucleotide
  Target: SCN10A; (+) strand; PAM type: NRG; PAM sequence: AGG
ttagagattgtctgtataat

SEQ ID NO: 32872 - DNA, 20 bp, Artificial Sequence
  Description of Artificial Sequence: Synthetic oligonucleotide
  Target: SCN10A; (+) strand; PAM type: NRG; PAM sequence: TAG
gagattgtctgtataatagg

SEQ ID NO: 32873 - DNA, 20 bp, Artificial Sequence
  Description of Artificial Sequence: Synthetic oligonucleotide
  Target: SCN10A; (+) strand; PAM type: NRG; PAM sequence: AAG
taataaaaatttttataaac

SEQ ID NO: 32874 - DNA, 20 bp, Artificial Sequence
  Description of Artificial Sequence: Synthetic oligonucleotide
  Target: SCN10A; (+) strand; PAM type: NRG; PAM sequence: TGG
tacttatcattacaataaat

SEQ ID NO: 32875 - DNA, 20 bp, Artificial Sequence
  Description of Artificial Sequence: Synthetic oligonucleotide
  Target: SCN10A; (+) strand; PAM type: NRG; PAM sequence: GGG
acttatcattacaataaatt

SEQ ID NO: 32876 - DNA, 20 bp, Artificial Sequence
  Description of Artificial Sequence: Synthetic oligonucleotide
  Target: SCN10A; (+) strand; PAM type: NRG; PAM sequence: AAG
atcattacaataaattggga

SEQ ID NO: 32877 - DNA, 20 bp, Artificial Sequence
  Description of Artificial Sequence: Synthetic oligonucleotide
  Target: SCN10A; (+) strand; PAM type: NRG; PAM sequence: AGG
tcattacaataaattgggaa

SEQ ID NO: 32878 - DNA, 20 bp, Artificial Sequence
  Description of Artificial Sequence: Synthetic oligonucleotide
  Target: SCN10A; (+) strand; PAM type: NRG; PAM sequence: TGG
ataaattgggaaaggatatc

SEQ ID NO: 32879 - DNA, 20 bp, Artificial Sequence
  Description of Artificial Sequence: Synthetic oligonucleotide
  Target: SCN10A; (+) strand; PAM type: NRG; PAM sequence: AAG
gaaaggatatctggaatgaa

SEQ ID NO: 32880 - DNA, 20 bp, Artificial Sequence
  Description of Artificial Sequence: Synthetic oligonucleotide
  Target: SCN10A; (+) strand; PAM type: NRG; PAM sequence: TGG
tctggaatgaaaagttgtct

SEQ ID NO: 32881 - DNA, 20 bp, Artificial Sequence
  Description of Artificial Sequence: Synthetic oligonucleotide
  Target: SCN10A; (+) strand; PAM type: NRG; PAM sequence: GAG
tggaatgaaaagttgtcttg

SEQ ID NO: 32882 - DNA, 20 bp, Artificial Sequence
  Description of Artificial Sequence: Synthetic oligonucleotide
  Target: SCN10A; (+) strand; PAM type: NRG; PAM sequence: AGG
ggaatgaaaagttgtcttgg

SEQ ID NO: 32883 - DNA, 20 bp, Artificial Sequence
  Description of Artificial Sequence: Synthetic oligonucleotide
  Target: SCN10A; (+) strand; PAM type: NRG; PAM sequence: AAG
atgaaaagttgtcttggagg

SEQ ID NO: 32884 - DNA, 20 bp, Artificial Sequence
  Description of Artificial Sequence: Synthetic oligonucleotide
  Target: SCN10A; (+) strand; PAM type: NRG; PAM sequence: AGG
tgaaaagttgtcttggagga

SEQ ID NO: 32885 - DNA, 20 bp, Artificial Sequence
  Description of Artificial Sequence: Synthetic oligonucleotide
  Target: SCN10A; (+) strand; PAM type: NRG; PAM sequence: AAG
gttgtcttggaggaaggtta

SEQ ID NO: 32886 - DNA, 20 bp, Artificial Sequence
  Description of Artificial Sequence: Synthetic oligonucleotide
  Target: SCN10A; (+) strand; PAM type: NRG; PAM sequence: TAG
tggaggaaggttaaagattt

SEQ ID NO: 32887 - DNA, 20 bp, Artificial Sequence
  Description of Artificial Sequence: Synthetic oligonucleotide
  Target: SCN10A; (+) strand; PAM type: NRG; PAM sequence: TGG
taaagattttagctaacttt

SEQ ID NO: 32888 - DNA, 20 bp, Artificial Sequence
  Description of Artificial Sequence: Synthetic oligonucleotide
  Target: SCN10A; (+) strand; PAM type: NRG; PAM sequence: AAG
gctaacttttggctttgatt

SEQ ID NO: 32889 - DNA, 20 bp, Artificial Sequence
  Description of Artificial Sequence: Synthetic oligonucleotide
  Target: SCN10A; (+) strand; PAM type: NRG; PAM sequence: TGG
gctttgattaagttaactaa

SEQ ID NO: 32890 - DNA, 20 bp, Artificial Sequence
  Description of Artificial Sequence: Synthetic oligonucleotide
  Target: SCN10A; (+) strand; PAM type: NRG; PAM sequence: GAG
tttgattaagttaactaatg

SEQ ID NO: 32891 - DNA, 20 bp, Artificial Sequence
  Description of Artificial Sequence: Synthetic oligonucleotide
  Target: SCN10A; (+) strand; PAM type: NRG; PAM sequence: GAG
tgattaagttaactaatgga

SEQ ID NO: 32892 - DNA, 20 bp, Artificial Sequence
  Description of Artificial Sequence: Synthetic oligonucleotide
  Target: SCN10A; (+) strand; PAM type: NRG; PAM sequence: CAG
aatttatgctgtaatttctg

SEQ ID NO: 32893 - DNA, 20 bp, Artificial Sequence
  Description of Artificial Sequence: Synthetic oligonucleotide
  Target: SCN10A; (+) strand; PAM type: NRG; PAM sequence: TGG
tttctgcagccacgacctcc

SEQ ID NO: 32894 - DNA, 20 bp, Artificial Sequence
  Description of Artificial Sequence: Synthetic oligonucleotide
  Target: SCN10A; (+) strand; PAM type: NRG; PAM sequence: GGG
ttctgcagccacgacctcct

SEQ ID NO: 32895 - DNA, 20 bp, Artificial Sequence
  Description of Artificial Sequence: Synthetic oligonucleotide
  Target: SCN10A; (+) strand; PAM type: NRG; PAM sequence: AAG
agccacgacctcctgggctc

SEQ ID NO: 32896 - DNA, 20 bp, Artificial Sequence
  Description of Artificial Sequence: Synthetic oligonucleotide
  Target: SCN10A; (+) strand; PAM type: NRG; PAM sequence: CAG
ctcaagtcatcctcccacct

SEQ ID NO: 32897 - DNA, 20 bp, Artificial Sequence
  Description of Artificial Sequence: Synthetic oligonucleotide
  Target: SCN10A; (+) strand; PAM type: NRG; PAM sequence: TAG
tcccacctcagcctcccaaa

SEQ ID NO: 32898 - DNA, 20 bp, Artificial Sequence
  Description of Artificial Sequence: Synthetic oligonucleotide
  Target: SCN10A; (+) strand; PAM type: NRG; PAM sequence: GAG
cctcagcctcccaaatagct

SEQ ID NO: 32899 - DNA, 20 bp, Artificial Sequence
  Description of Artificial Sequence: Synthetic oligonucleotide
  Target: SCN10A; (+) strand; PAM type: NRG; PAM sequence: CAG
ctcccaaatagctgagacta

SEQ ID NO: 32900 - DNA, 20 bp, Artificial Sequence
  Description of Artificial Sequence: Synthetic oligonucleotide
  Target: SCN10A; (+) strand; PAM type: NRG; PAM sequence: CAG
cagacacgtgccatcatgcc

SEQ ID NO: 32901 - DNA, 20 bp, Artificial Sequence
  Description of Artificial Sequence: Synthetic oligonucleotide
  Target: SCN10A; (+) strand; PAM type: NRG; PAM sequence: GAG
ttatttatttatttattttt

SEQ ID NO: 32902 - DNA, 20 bp, Artificial Sequence
  Description of Artificial Sequence: Synthetic oligonucleotide
  Target: SCN10A; (+) strand; PAM type: NRG; PAM sequence: TGG
ttatttatttatttttgaga

SEQ ID NO: 32903 - DNA, 20 bp, Artificial Sequence
  Description of Artificial Sequence: Synthetic oligonucleotide
  Target: SCN10A; (+) strand; PAM type: NRG; PAM sequence: GAG
atttatttatttttgagatg

SEQ ID NO: 32904 - DNA, 20 bp, Artificial Sequence
  Description of Artificial Sequence: Synthetic oligonucleotide
  Target: SCN10A; (+) strand; PAM type: NRG; PAM sequence: CAG
ggagttttgcccttgttgcc

SEQ ID NO: 32905 - DNA, 20 bp, Artificial Sequence
  Description of Artificial Sequence: Synthetic oligonucleotide
  Target: SCN10A; (+) strand; PAM type: NRG; PAM sequence: AGG
gagttttgcccttgttgccc

SEQ ID NO: 32906 - DNA, 20 bp, Artificial Sequence
  Description of Artificial Sequence: Synthetic oligonucleotide
  Target: SCN10A; (+) strand; PAM type: NRG; PAM sequence: TGG
tttgcccttgttgcccaggc

SEQ ID NO: 32907 - DNA, 20 bp, Artificial Sequence
  Description of Artificial Sequence: Synthetic oligonucleotide
  Target: SCN10A; (+) strand; PAM type: NRG; PAM sequence: GAG
tgcccttgttgcccaggctg

SEQ ID NO: 32908 - DNA, 20 bp, Artificial Sequence
  Description of Artificial Sequence: Synthetic oligonucleotide
  Target: SCN10A; (+) strand; PAM type: NRG; PAM sequence: TGG
ttgcccaggctggagtgcaa

SEQ ID NO: 32909 - DNA, 20 bp, Artificial Sequence
  Description of Artificial Sequence: Synthetic oligonucleotide
  Target: SCN10A; (+) strand; PAM type: NRG; PAM sequence: CAG
ggagtgcaatggtgcaatct

SEQ ID NO: 32910 - DNA, 20 bp, Artificial Sequence
  Description of Artificial Sequence: Synthetic oligonucleotide
  Target: SCN10A; (+) strand; PAM type: NRG; PAM sequence: CGG
tcaccgcaacctccgcctcc

SEQ ID NO: 32911 - DNA, 20 bp, Artificial Sequence
  Description of Artificial Sequence: Synthetic oligonucleotide
  Target: SCN10A; (+) strand; PAM type: NRG; PAM sequence: GGG
caccgcaacctccgcctccc

SEQ ID NO: 32912 - DNA, 20 bp, Artificial Sequence
  Description of Artificial Sequence: Synthetic oligonucleotide
  Target: SCN10A; (+) strand; PAM type: NRG; PAM sequence: AAG
aacctccgcctcccgggttc

SEQ ID NO: 32913 - DNA, 20 bp, Artificial Sequence
  Description of Artificial Sequence: Synthetic oligonucleotide
  Target: SCN10A; (+) strand; PAM type: NRG; PAM sequence: CAG
ttcaagcaattctcctccct

SEQ ID NO: 32914 - DNA, 20 bp, Artificial Sequence
  Description of Artificial Sequence: Synthetic oligonucleotide
  Target: SCN10A; (+) strand; PAM type: NRG; PAM sequence: AAG
ttctcctccctcagcctccc

SEQ ID NO: 32915 - DNA, 20 bp, Artificial Sequence
  Description of Artificial Sequence: Synthetic oligonucleotide
  Target: SCN10A; (+) strand; PAM type: NRG; PAM sequence: TAG
tcctccctcagcctcccaag

SEQ ID NO: 32916 - DNA, 20 bp, Artificial Sequence
  Description of Artificial Sequence: Synthetic oligonucleotide
  Target: SCN10A; (+) strand; PAM type: NRG; PAM sequence: TGG
ccctcagcctcccaagtagc

SEQ ID NO: 32917 - DNA, 20 bp, Artificial Sequence
  Description of Artificial Sequence: Synthetic oligonucleotide
  Target: SCN10A; (+) strand; PAM type: NRG; PAM sequence: GGG
cctcagcctcccaagtagct

SEQ ID NO: 32918 - DNA, 20 bp, Artificial Sequence
  Description of Artificial Sequence: Synthetic oligonucleotide
  Target: SCN10A; (+) strand; PAM type: NRG; PAM sequence: AAG
tcccaagtagctgggattaa

SEQ ID NO: 32919 - DNA, 20 bp, Artificial Sequence
  Description of Artificial Sequence: Synthetic oligonucleotide
  Target: SCN10A; (+) strand; PAM type: NRG; PAM sequence: TGG
aaagtatgcaccatcacacc

SEQ ID NO: 32920 - DNA, 20 bp, Artificial Sequence
  Description of Artificial Sequence: Synthetic oligonucleotide
  Target: SCN10A; (+) strand; PAM type: NRG; PAM sequence: TGG
cctggctaattttgtatttt

SEQ ID NO: 32921 - DNA, 20 bp, Artificial Sequence
  Description of Artificial Sequence: Synthetic oligonucleotide
  Target: SCN10A; (+) strand; PAM type: NRG; PAM sequence: TAG
ggctaattttgtatttttgg

SEQ ID NO: 32922 - DNA, 20 bp, Artificial Sequence
  Description of Artificial Sequence: Synthetic oligonucleotide
  Target: SCN10A; (+) strand; PAM type: NRG; PAM sequence: GAG
ctaattttgtatttttggta

SEQ ID NO: 32923 - DNA, 20 bp, Artificial Sequence
  Description of Artificial Sequence: Synthetic oligonucleotide
  Target: SCN10A; (+) strand; PAM type: NRG; PAM sequence: TGG
ttttgtatttttggtagaga

SEQ ID NO: 32924 - DNA, 20 bp, Artificial Sequence
  Description of Artificial Sequence: Synthetic oligonucleotide
  Target: SCN10A; (+) strand; PAM type: NRG; PAM sequence: GGG
tttgtatttttggtagagat

SEQ ID NO: 32925 - DNA, 20 bp, Artificial Sequence
  Description of Artificial Sequence: Synthetic oligonucleotide
  Target: SCN10A; (+) strand; PAM type: NRG; PAM sequence: TGG
gagatgggtcttctccatgt

SEQ ID NO: 32926 - DNA, 20 bp, Artificial Sequence
  Description of Artificial Sequence: Synthetic oligonucleotide
  Target: SCN10A; (+) strand; PAM type: NRG; PAM sequence: CAG
tgggtcttctccatgttggt

SEQ ID NO: 32927 - DNA, 20 bp, Artificial Sequence
  Description of Artificial Sequence: Synthetic oligonucleotide
  Target: SCN10A; (+) strand; PAM type: NRG; PAM sequence: AGG
gggtcttctccatgttggtc

SEQ ID NO: 32928 - DNA, 20 bp, Artificial Sequence
  Description of Artificial Sequence: Synthetic oligonucleotide
  Target: SCN10A; (+) strand; PAM type: NRG; PAM sequence: TGG
cttctccatgttggtcaggc

SEQ ID NO: 32929 - DNA, 20 bp, Artificial Sequence
  Description of Artificial Sequence: Synthetic oligonucleotide
  Target: SCN10A; (+) strand; PAM type: NRG; PAM sequence: CAG
tggtctcgaactcccgacct

SEQ ID NO: 32930 - DNA, 20 bp, Artificial Sequence
  Description of Artificial Sequence: Synthetic oligonucleotide
  Target: SCN10A; (+) strand; PAM type: NRG; PAM sequence: AGG
ggtctcgaactcccgacctc

SEQ ID NO: 32931 - DNA, 20 bp, Artificial Sequence
  Description of Artificial Sequence: Synthetic oligonucleotide
  Target: SCN10A; (+) strand; PAM type: NRG; PAM sequence: CAG
ccgcctgcctgcgcctccaa

SEQ ID NO: 32932 - DNA, 20 bp, Artificial Sequence
  Description of Artificial Sequence: Synthetic oligonucleotide
  Target: SCN10A; (+) strand; PAM type: NRG; PAM sequence: TGG
gcctgcgcctccaacagtgc

SEQ ID NO: 32933 - DNA, 20 bp, Artificial Sequence
  Description of Artificial Sequence: Synthetic oligonucleotide
  Target: SCN10A; (+) strand; PAM type: NRG; PAM sequence: GGG
cctgcgcctccaacagtgct

SEQ ID NO: 32934 - DNA, 20 bp, Artificial Sequence
  Description of Artificial Sequence: Synthetic oligonucleotide
  Target: SCN10A; (+) strand; PAM type: NRG; PAM sequence: CAG
ctccaacagtgctgggatta

SEQ ID NO: 32935 - DNA, 20 bp, Artificial Sequence
  Description of Artificial Sequence: Synthetic oligonucleotide
  Target: SCN10A; (+) strand; PAM type: NRG; PAM sequence: AGG
tccaacagtgctgggattac

SEQ ID NO: 32936 - DNA, 20 bp, Artificial Sequence
  Description of Artificial Sequence: Synthetic oligonucleotide
  Target: SCN10A; (+) strand; PAM type: NRG; PAM sequence: TGG
caggcattaaccactgcccc

SEQ ID NO: 32937 - DNA, 20 bp, Artificial Sequence
  Description of Artificial Sequence: Synthetic oligonucleotide
  Target: SCN10A; (+) strand; PAM type: NRG; PAM sequence: GAG
ttctttttattgttttcaat

SEQ ID NO: 32938 - DNA, 20 bp, Artificial Sequence
  Description of Artificial Sequence: Synthetic oligonucleotide
  Target: SCN10A; (+) strand; PAM type: NRG; PAM sequence: CGG
ttttattgttttcaatgaga

SEQ ID NO: 32939 - DNA, 20 bp, Artificial Sequence
  Description of Artificial Sequence: Synthetic oligonucleotide
  Target: SCN10A; (+) strand; PAM type: NRG; PAM sequence: GAG
ttattgttttcaatgagacg

SEQ ID NO: 32940 - DNA, 20 bp, Artificial Sequence
  Description of Artificial Sequence: Synthetic oligonucleotide
  Target: SCN10A; (+) strand; PAM type: NRG; PAM sequence: CAG
cggagtctcgctctgttgcc

SEQ ID NO: 32941 - DNA, 20 bp, Artificial Sequence
  Description of Artificial Sequence: Synthetic oligonucleotide
  Target: SCN10A; (+) strand; PAM type: NRG; PAM sequence: AGG
ggagtctcgctctgttgccc

SEQ ID NO: 32942 - DNA, 20 bp, Artificial Sequence
  Description of Artificial Sequence: Synthetic oligonucleotide
  Target: SCN10A; (+) strand; PAM type: NRG; PAM sequence: TGG
tctcgctctgttgcccaggc

SEQ ID NO: 32943 - DNA, 20 bp, Artificial Sequence
  Description of Artificial Sequence: Synthetic oligonucleotide
  Target: SCN10A; (+) strand; PAM type: NRG; PAM sequence: GAG
tcgctctgttgcccaggctg

SEQ ID NO: 32944 - DNA, 20 bp, Artificial Sequence
  Description of Artificial Sequence: Synthetic oligonucleotide
  Target: SCN10A; (+) strand; PAM type: NRG; PAM sequence: CAG
ctgttgcccaggctggagtg

SEQ ID NO: 32945 - DNA, 20 bp, Artificial Sequence
  Description of Artificial Sequence: Synthetic oligonucleotide
  Target: SCN10A; (+) strand; PAM type: NRG; PAM sequence: TGG
ttgcccaggctggagtgcag

SEQ ID NO: 32946 - DNA, 20 bp, Artificial Sequence
  Description of Artificial Sequence: Synthetic oligonucleotide
  Target: SCN10A; (+) strand; PAM type: NRG; PAM sequence: CAG
ggagtgcagtggcatgatct

SEQ ID NO: 32947 - DNA, 20 bp, Artificial Sequence
  Description of Artificial Sequence: Synthetic oligonucleotide
  Target: SCN10A; (+) strand; PAM type: NRG; PAM sequence: TGG
ctcactgcaacctctgtctc

SEQ ID NO: 32948 - DNA, 20 bp, Artificial Sequence
  Description of Artificial Sequence: Synthetic oligonucleotide
  Target: SCN10A; (+) strand; PAM type: NRG; PAM sequence: GGG
tcactgcaacctctgtctct

SEQ ID NO: 32949 - DNA, 20 bp, Artificial Sequence
  Description of Artificial Sequence: Synthetic oligonucleotide
  Target: SCN10A; (+) strand; PAM type: NRG; PAM sequence: AAG
aacctctgtctctgggattc

SEQ ID NO: 32950 - DNA, 20 bp, Artificial Sequence
  Description of Artificial Sequence: Synthetic oligonucleotide
  Target: SCN10A; (+) strand; PAM type: NRG; PAM sequence: GAG
ttctcatgcctcaccctcct

SEQ ID NO: 32951 - DNA, 20 bp, Artificial Sequence
  Description of Artificial Sequence: Synthetic oligonucleotide
  Target: SCN10A; (+) strand; PAM type: NRG; PAM sequence: TAG
tcatgcctcaccctcctgag

SEQ ID NO: 32952 - DNA, 20 bp, Artificial Sequence
  Description of Artificial Sequence: Synthetic oligonucleotide
  Target: SCN10A; (+) strand; PAM type: NRG; PAM sequence: TGG
gcctcaccctcctgagtagc

SEQ ID NO: 32953 - DNA, 20 bp, Artificial Sequence
  Description of Artificial Sequence: Synthetic oligonucleotide
  Target: SCN10A; (+) strand; PAM type: NRG; PAM sequence: GGG
cctcaccctcctgagtagct

SEQ ID NO: 32954 - DNA, 20 bp, Artificial Sequence
  Description of Artificial Sequence: Synthetic oligonucleotide
  Target: SCN10A; (+) strand; PAM type: NRG; PAM sequence: CAG
ctcctgagtagctgggatta

SEQ ID NO: 32955 - DNA, 20 bp, Artificial Sequence
  Description of Artificial Sequence: Synthetic oligonucleotide
  Target: SCN10A; (+) strand; PAM type: NRG; PAM sequence: AGG
tcctgagtagctgggattac

SEQ ID NO: 32956 - DNA, 20 bp, Artificial Sequence
  Description of Artificial Sequence: Synthetic oligonucleotide
  Target: SCN10A; (+) strand; PAM type: NRG; PAM sequence: CAG
caggtgtgtgccaccacacc

SEQ ID NO: 32957 - DNA, 20 bp, Artificial Sequence
  Description of Artificial Sequence: Synthetic oligonucleotide
  Target: SCN10A; (+) strand; PAM type: NRG; PAM sequence: TAG
ccagctaatttatatatttt

SEQ ID NO: 32958 - DNA, 20 bp, Artificial Sequence
  Description of Artificial Sequence: Synthetic oligonucleotide
  Target: SCN10A; (+) strand; PAM type: NRG; PAM sequence: TAG
gctaatttatatatttttag

SEQ ID NO: 32959 - DNA, 20 bp, Artificial Sequence
  Description of Artificial Sequence: Synthetic oligonucleotide
  Target: SCN10A; (+) strand; PAM type: NRG; PAM sequence: GAG
taatttatatatttttagta

SEQ ID NO: 32960 - DNA, 20 bp, Artificial Sequence
  Description of Artificial Sequence: Synthetic oligonucleotide
  Target: SCN10A; (+) strand; PAM type: NRG; PAM sequence: TGG
ttatatatttttagtagaga

SEQ ID NO: 32961 - DNA, 20 bp, Artificial Sequence
  Description of Artificial Sequence: Synthetic oligonucleotide
  Target: SCN10A; (+) strand; PAM type: NRG; PAM sequence: GGG
tatatatttttagtagagat

SEQ ID NO: 32962 - DNA, 20 bp, Artificial Sequence
  Description of Artificial Sequence: Synthetic oligonucleotide
  Target: SCN10A; (+) strand; PAM type: NRG; PAM sequence: GGG
atatatttttagtagagatg

SEQ ID NO: 32963 - DNA, 20 bp, Artificial Sequence
  Description of Artificial Sequence: Synthetic oligonucleotide
  Target: SCN10A; (+) strand; PAM type: NRG; PAM sequence: TGG
gagatggggttttctcctgt

SEQ ID NO: 32964 - DNA, 20 bp, Artificial Sequence
  Description of Artificial Sequence: Synthetic oligonucleotide
  Target: SCN10A; (+) strand; PAM type: NRG; PAM sequence: CAG
tggggttttctcctgttggc

SEQ ID NO: 32965 - DNA, 20 bp, Artificial Sequence
  Description of Artificial Sequence: Synthetic oligonucleotide
  Target: SCN10A; (+) strand; PAM type: NRG; PAM sequence: AGG
ggggttttctcctgttggcc

SEQ ID NO: 32966 - DNA, 20 bp, Artificial Sequence
  Description of Artificial Sequence: Synthetic oligonucleotide
  Target: SCN10A; (+) strand; PAM type: NRG; PAM sequence: TGG
ttttctcctgttggccaggc

SEQ ID NO: 32967 - DNA, 20 bp, Artificial Sequence
  Description of Artificial Sequence: Synthetic oligonucleotide
  Target: SCN10A; (+) strand; PAM type: NRG; PAM sequence: AAG
ggtctccaactcctgtcctc

SEQ ID NO: 32968 - DNA, 20 bp, Artificial Sequence
  Description of Artificial Sequence: Synthetic oligonucleotide
  Target: SCN10A; (+) strand; PAM type: NRG; PAM sequence: TGG
ctcaagcaatcctcccacct

SEQ ID NO: 32969 - DNA, 20 bp, Artificial Sequence
  Description of Artificial Sequence: Synthetic oligonucleotide
  Target: SCN10A; (+) strand; PAM type: NRG; PAM sequence: TGG
accttggcctcccaaaattc

SEQ ID NO: 32970 - DNA, 20 bp, Artificial Sequence
  Description of Artificial Sequence: Synthetic oligonucleotide
  Target: SCN10A; (+) strand; PAM type: NRG; PAM sequence: GGG
ccttggcctcccaaaattct

SEQ ID NO: 32971 - DNA, 20 bp, Artificial Sequence
  Description of Artificial Sequence: Synthetic oligonucleotide
  Target: SCN10A; (+) strand; PAM type: NRG; PAM sequence: CAG
ctcccaaaattctgggatta

SEQ ID NO: 32972 - DNA, 20 bp, Artificial Sequence
  Description of Artificial Sequence: Synthetic oligonucleotide
  Target: SCN10A; (+) strand; PAM type: NRG; PAM sequence: AGG
tcccaaaattctgggattac

SEQ ID NO: 32973 - DNA, 20 bp, Artificial Sequence
  Description of Artificial Sequence: Synthetic oligonucleotide
  Target: SCN10A; (+) strand; PAM type: NRG; PAM sequence: GAG
aattctgggattacaggcgt

SEQ ID NO: 32974 - DNA, 20 bp, Artificial Sequence
  Description of Artificial Sequence: Synthetic oligonucleotide
  Target: SCN10A; (+) strand; PAM type: NRG; PAM sequence: TGG
caggcgtgagccaccccacc

SEQ ID NO: 32975 - DNA, 20 bp, Artificial Sequence
  Description of Artificial Sequence: Synthetic oligonucleotide
  Target: SCN10A; (+) strand; PAM type: NRG; PAM sequence: TGG
gccaccccacctggccccct

SEQ ID NO: 32976 - DNA, 20 bp, Artificial Sequence
  Description of Artificial Sequence: Synthetic oligonucleotide
  Target: SCN10A; (+) strand; PAM type: NRG; PAM sequence: TGG
ccttggctttaaaaaaaaaa

SEQ ID NO: 32977 - DNA, 20 bp, Artificial Sequence
  Description of Artificial Sequence: Synthetic oligonucleotide
  Target: SCN10A; (+) strand; PAM type: NRG; PAM sequence: TGG
aaaaaaaaatggcataatct

SEQ ID NO: 32978 - DNA, 20 bp, Artificial Sequence
  Description of Artificial Sequence: Synthetic oligonucleotide
  Target: SCN10A; (+) strand; PAM type: NRG; PAM sequence: TGG
ggaaccttgataccaaaacc

SEQ ID NO: 32979 - DNA, 20 bp, Artificial Sequence
  Description of Artificial Sequence: Synthetic oligonucleotide
  Target: SCN10A; (+) strand; PAM type: NRG; PAM sequence: AAG
ccttgataccaaaacctggc

SEQ ID NO: 32980 - DNA, 20 bp, Artificial Sequence
  Description of Artificial Sequence: Synthetic oligonucleotide
  Target: SCN10A; (+) strand; PAM type: NRG; PAM sequence: AGG
cttgataccaaaacctggca

SEQ ID NO: 32981 - DNA, 20 bp, Artificial Sequence
  Description of Artificial Sequence: Synthetic oligonucleotide
  Target: SCN10A; (+) strand; PAM type: NRG; PAM sequence: AAG
aaacctggcaaggacaatga

SEQ ID NO: 32982 - DNA, 20 bp, Artificial Sequence
  Description of Artificial Sequence: Synthetic oligonucleotide
  Target: SCN10A; (+) strand; PAM type: NRG; PAM sequence: CAG
ctggcaaggacaatgaaagt

SEQ ID NO: 32983 - DNA, 20 bp, Artificial Sequence
  Description of Artificial Sequence: Synthetic oligonucleotide
  Target: SCN10A; (+) strand; PAM type: NRG; PAM sequence: AGG
tggcaaggacaatgaaagtc

SEQ ID NO: 32984 - DNA, 20 bp, Artificial Sequence
  Description of Artificial Sequence: Synthetic oligonucleotide
  Target: SCN10A; (+) strand; PAM type: NRG; PAM sequence: TAG
aatgaaagtcaggaaaatta

SEQ ID NO: 32985 - DNA, 20 bp, Artificial Sequence
  Description of Artificial Sequence: Synthetic oligonucleotide
  Target: SCN10A; (+) strand; PAM type: NRG; PAM sequence: TGG
tcaaatattactcattgata

SEQ ID NO: 32986 - DNA, 20 bp, Artificial Sequence
  Description of Artificial Sequence: Synthetic oligonucleotide
  Target: SCN10A; (+) strand; PAM type: NRG; PAM sequence: AAG
gatatggataaaaaaatctt

SEQ ID NO: 32987 - DNA, 20 bp, Artificial Sequence
  Description of Artificial Sequence: Synthetic oligonucleotide
  Target: SCN10A; (+) strand; PAM type: NRG; PAM sequence: TAG
aaaaatcttaagcaaatttt

SEQ ID NO: 32988 - DNA, 20 bp, Artificial Sequence
  Description of Artificial Sequence: Synthetic oligonucleotide
  Target: SCN10A; (+) strand; PAM type: NRG; PAM sequence: AAG
ttaaaaaatgcatcacgatc

SEQ ID NO: 32989 - DNA, 20 bp, Artificial Sequence
  Description of Artificial Sequence: Synthetic oligonucleotide
  Target: SCN10A; (+) strand; PAM type: NRG; PAM sequence: TAG
aaaatgcatcacgatcaagc

SEQ ID NO: 32990 - DNA, 20 bp, Artificial Sequence
  Description of Artificial Sequence: Synthetic oligonucleotide
  Target: SCN10A; (+) strand; PAM type: NRG; PAM sequence: AGG
aaatgcatcacgatcaagct

SEQ ID NO: 32991 - DNA, 20 bp, Artificial Sequence
  Description of Artificial Sequence: Synthetic oligonucleotide
  Target: SCN10A; (+) strand; PAM type: NRG; PAM sequence: GAG
atcacgatcaagctaggttt

SEQ ID NO: 32992 - DNA, 20 bp, Artificial Sequence
  Description of Artificial Sequence: Synthetic oligonucleotide
  Target: SCN10A; (+) strand; PAM type: NRG; PAM sequence: TGG
cgatcaagctaggtttgagc

SEQ ID NO: 32993 - DNA, 20 bp, Artificial Sequence
  Description of Artificial Sequence: Synthetic oligonucleotide
  Target: SCN10A; (+) strand; PAM type: NRG; PAM sequence: GGG
gatcaagctaggtttgagct

SEQ ID NO: 32994 - DNA, 20 bp, Artificial Sequence
  Description of Artificial Sequence: Synthetic oligonucleotide
  Target: SCN10A; (+) strand; PAM type: NRG; PAM sequence: AAG
aggtttgagctgggaatgta

SEQ ID NO: 32995 - DNA, 20 bp, Artificial Sequence
  Description of Artificial Sequence: Synthetic oligonucleotide
  Target: SCN10A; (+) strand; PAM type: NRG; PAM sequence: TAG
atgtaaagttgatttaacat

SEQ ID NO: 32996 - DNA, 20 bp, Artificial Sequence
  Description of Artificial Sequence: Synthetic oligonucleotide
  Target: SCN10A; (+) strand; PAM type: NRG; PAM sequence: CAG
aatataattcaccactttaa

SEQ ID NO: 32997 - DNA, 20 bp, Artificial Sequence
  Description of Artificial Sequence: Synthetic oligonucleotide
  Target: SCN10A; (+) strand; PAM type: NRG; PAM sequence: AAG
ttcaccactttaacagattg

SEQ ID NO: 32998 - DNA, 20 bp, Artificial Sequence
  Description of Artificial Sequence: Synthetic oligonucleotide
  Target: SCN10A; (+) strand; PAM type: NRG; PAM sequence: AGG
tcaccactttaacagattga

SEQ ID NO: 32999 - DNA, 20 bp, Artificial Sequence
  Description of Artificial Sequence: Synthetic oligonucleotide
  Target: SCN10A; (+) strand; PAM type: NRG; PAM sequence: GAG
accactttaacagattgaag

SEQ ID NO: 33000 - DNA, 20 bp, Artificial Sequence
  Description of Artificial Sequence: Synthetic oligonucleotide
  Target: SCN10A; (+) strand; PAM type: NRG; PAM sequence: TAG
catgattatctcaatacatg

SEQ ID NO: 33001 - DNA, 20 bp, Artificial Sequence
  Description of Artificial Sequence: Synthetic oligonucleotide
  Target: SCN10A; (+) strand; PAM type: NRG; PAM sequence: AAG
atgataaatattcttgataa

SEQ ID NO: 33002 - DNA, 20 bp, Artificial Sequence
  Description of Artificial Sequence: Synthetic oligonucleotide
  Target: SCN10A; (+) strand; PAM type: NRG; PAM sequence: GAG
gataaatattcttgataaaa

SEQ ID NO: 33003 - DNA, 20 bp, Artificial Sequence
  Description of Artificial Sequence: Synthetic oligonucleotide
  Target: SCN10A; (+) strand; PAM type: NRG; PAM sequence: AAG
gagaacttcctgaactgata

SEQ ID NO: 33004 - DNA, 20 bp, Artificial Sequence
  Description of Artificial Sequence: Synthetic oligonucleotide
  Target: SCN10A; (+) strand; PAM type: NRG; PAM sequence: AAG
agatttcttatctttaaaaa

SEQ ID NO: 33005 - DNA, 20 bp, Artificial Sequence
  Description of Artificial Sequence: Synthetic oligonucleotide
  Target: SCN10A; (+) strand; PAM type: NRG; PAM sequence: TAG
aaaaagcctgccacaattgt

SEQ ID NO: 33006 - DNA, 20 bp, Artificial Sequence
  Description of Artificial Sequence: Synthetic oligonucleotide
  Target: SCN10A; (+) strand; PAM type: NRG; PAM sequence: GAG
aaagcctgccacaattgtta

SEQ ID NO: 33007 - DNA, 20 bp, Artificial Sequence
  Description of Artificial Sequence: Synthetic oligonucleotide
  Target: SCN10A; (+) strand; PAM type: NRG; PAM sequence: AGG
aagcctgccacaattgttag

SEQ ID NO: 33008 - DNA, 20 bp, Artificial Sequence
  Description of Artificial Sequence: Synthetic oligonucleotide
  Target: SCN10A; (+) strand; PAM type: NRG; PAM sequence: TGG
cctgccacaattgttagagg

SEQ ID NO: 33009 - DNA, 20 bp, Artificial Sequence
  Description of Artificial Sequence: Synthetic oligonucleotide
  Target: SCN10A; (+) strand; PAM type: NRG; PAM sequence: AAG
tagaggtggtgaaatattga

SEQ ID NO: 33010 - DNA, 20 bp, Artificial Sequence
  Description of Artificial Sequence: Synthetic oligonucleotide
  Target: SCN10A; (+) strand; PAM type: NRG; PAM sequence: AGG
agaggtggtgaaatattgaa

SEQ ID NO: 33011 - DNA, 20 bp, Artificial Sequence
  Description of Artificial Sequence: Synthetic oligonucleotide
  Target: SCN10A; (+) strand; PAM type: NRG; PAM sequence: TGG
aatattgaaaggattctttt

SEQ ID NO: 33012 - DNA, 20 bp, Artificial Sequence
  Description of Artificial Sequence: Synthetic oligonucleotide
  Target: SCN10A; (+) strand; PAM type: NRG; PAM sequence: GGG
atattgaaaggattcttttt

SEQ ID NO: 33013 - DNA, 20 bp, Artificial Sequence
  Description of Artificial Sequence: Synthetic oligonucleotide
  Target: SCN10A; (+) strand; PAM type: NRG; PAM sequence: CAG
gaaaggattctttttgggat

SEQ ID NO: 33014 - DNA, 20 bp, Artificial Sequence
  Description of Artificial Sequence: Synthetic oligonucleotide
  Target: SCN10A; (+) strand; PAM type: NRG; PAM sequence: AAG
ttgggatcagaaaattgata

SEQ ID NO: 33015 - DNA, 20 bp, Artificial Sequence
  Description of Artificial Sequence: Synthetic oligonucleotide
  Target: SCN10A; (+) strand; PAM type: NRG; PAM sequence: CAG
ttattaacacttcttttcaa

SEQ ID NO: 33016 - DNA, 20 bp, Artificial Sequence
  Description of Artificial Sequence: Synthetic oligonucleotide
  Target: SCN10A; (+) strand; PAM type: NRG; PAM sequence: TGG
acttcttttcaacagtgtac

SEQ ID NO: 33017 - DNA, 20 bp, Artificial Sequence
  Description of Artificial Sequence: Synthetic oligonucleotide
  Target: SCN10A; (+) strand; PAM type: NRG; PAM sequence: TAG
agtgtactggatgtcctaac

SEQ ID NO: 33018 - DNA, 20 bp, Artificial Sequence
  Description of Artificial Sequence: Synthetic oligonucleotide
  Target: SCN10A; (+) strand; PAM type: NRG; PAM sequence: CAG
actggatgtcctaactagca

SEQ ID NO: 33019 - DNA, 20 bp, Artificial Sequence
  Description of Artificial Sequence: Synthetic oligonucleotide
  Target: SCN10A; (+) strand; PAM type: NRG; PAM sequence: TAG
tcctaactagcacagtgatc

SEQ ID NO: 33020 - DNA, 20 bp, Artificial Sequence
  Description of Artificial Sequence: Synthetic oligonucleotide
  Target: SCN10A; (+) strand; PAM type: NRG; PAM sequence: AAG
tagcacagtgatctagtaaa

SEQ ID NO: 33021 - DNA, 20 bp, Artificial Sequence
  Description of Artificial Sequence: Synthetic oligonucleotide
  Target: SCN10A; (+) strand; PAM type: NRG; PAM sequence: TGG
atctagtaaaaagaacctaa

SEQ ID NO: 33022 - DNA, 20 bp, Artificial Sequence
  Description of Artificial Sequence: Synthetic oligonucleotide
  Target: SCN10A; (+) strand; PAM type: NRG; PAM sequence: AAG
taaaaagaacctaatggcat

SEQ ID NO: 33023 - DNA, 20 bp, Artificial Sequence
  Description of Artificial Sequence: Synthetic oligonucleotide
  Target: SCN10A; (+) strand; PAM type: NRG; PAM sequence: AGG
aaaaagaacctaatggcata

SEQ ID NO: 33024 - DNA, 20 bp, Artificial Sequence
  Description of Artificial Sequence: Synthetic oligonucleotide
  Target: SCN10A; (+) strand; PAM type: NRG; PAM sequence: TAG
gaacctaatggcataaggat

SEQ ID NO: 33025 - DNA, 20 bp, Artificial Sequence
  Description of Artificial Sequence: Synthetic oligonucleotide
  Target: SCN10A; (+) strand; PAM type: NRG; PAM sequence: AAG
taatggcataaggattagaa

SEQ ID NO: 33026 - DNA, 20 bp, Artificial Sequence
  Description of Artificial Sequence: Synthetic oligonucleotide
  Target: SCN10A; (+) strand; PAM type: NRG; PAM sequence: AAG
tggcataaggattagaaaag

SEQ ID NO: 33027 - DNA, 20 bp, Artificial Sequence
  Description of Artificial Sequence: Synthetic oligonucleotide
  Target: SCN10A; (+) strand; PAM type: NRG; PAM sequence: TAG
aggattagaaaagaagaaat

SEQ ID NO: 33028 - DNA, 20 bp, Artificial Sequence
  Description of Artificial Sequence: Synthetic oligonucleotide
  Target: SCN10A; (+) strand; PAM type: NRG; PAM sequence: AGG
ggattagaaaagaagaaatt

SEQ ID NO: 33029 - DNA, 20 bp, Artificial Sequence
  Description of Artificial Sequence: Synthetic oligonucleotide
  Target: SCN10A; (+) strand; PAM type: NRG; PAM sequence: TGG
tagaaaagaagaaattaggc

SEQ ID NO: 33030 - DNA, 20 bp, Artificial Sequence
  Description of Artificial Sequence: Synthetic oligonucleotide
  Target: SCN10A; (+) strand; PAM type: NRG; PAM sequence: GGG
agaaaagaagaaattaggct

SEQ ID NO: 33031 - DNA, 20 bp, Artificial Sequence
  Description of Artificial Sequence: Synthetic oligonucleotide
  Target: SCN10A; (+) strand; PAM type: NRG; PAM sequence: TGG
agaagaaattaggctgggcg

SEQ ID NO: 33032 - DNA, 20 bp, Artificial Sequence
  Description of Artificial Sequence: Synthetic oligonucleotide
  Target: SCN10A; (+) strand; PAM type: NRG; PAM sequence: GGG
gaagaaattaggctgggcgt

SEQ ID NO: 33033 - DNA, 20 bp, Artificial Sequence
  Description of Artificial Sequence: Synthetic oligonucleotide
  Target: SCN10A; (+) strand; PAM type: NRG; PAM sequence: TGG
gaaattaggctgggcgtggg

SEQ ID NO: 33034 - DNA, 20 bp, Artificial Sequence
  Description of Artificial Sequence: Synthetic oligonucleotide
  Target: SCN10A; (+) strand; PAM type: NRG; PAM sequence: CAG
gtggctcatgcctgtaatcc

SEQ ID NO: 33035 - DNA, 20 bp, Artificial Sequence
  Description of Artificial Sequence: Synthetic oligonucleotide
  Target: SCN10A; (+) strand; PAM type: NRG; PAM sequence: TAG
tgcctgtaatcccagcactt

SEQ ID NO: 33036 - DNA, 20 bp, Artificial Sequence
  Description of Artificial Sequence: Synthetic oligonucleotide
  Target: SCN10A; (+) strand; PAM type: NRG; PAM sequence: AGG
gcctgtaatcccagcacttt

SEQ ID NO: 33037 - DNA, 20 bp, Artificial Sequence
  Description of Artificial Sequence: Synthetic oligonucleotide
  Target: SCN10A; (+) strand; PAM type: NRG; PAM sequence: GAG
ctgtaatcccagcactttag

SEQ ID NO: 33038 - DNA, 20 bp, Artificial Sequence
  Description of Artificial Sequence: Synthetic oligonucleotide
  Target: SCN10A; (+) strand; PAM type: NRG; PAM sequence: AGG
tgtaatcccagcactttagg

SEQ ID NO: 33039 - DNA, 20 bp, Artificial Sequence
  Description of Artificial Sequence: Synthetic oligonucleotide
  Target: SCN10A; (+) strand; PAM type: NRG; PAM sequence: AAG
tcccagcactttaggaggcc

SEQ ID NO: 33040 - DNA, 20 bp, Artificial Sequence
  Description of Artificial Sequence: Synthetic oligonucleotide
  Target: SCN10A; (+) strand; PAM type: NRG; PAM sequence: AGG
cccagcactttaggaggcca

SEQ ID NO: 33041 - DNA, 20 bp, Artificial Sequence
  Description of Artificial Sequence: Synthetic oligonucleotide
  Target: SCN10A; (+) strand; PAM type: NRG; PAM sequence: CAG
agcactttaggaggccaagg

SEQ ID NO: 33042 - DNA, 20 bp, Artificial Sequence
  Description of Artificial Sequence: Synthetic oligonucleotide
  Target: SCN10A; (+) strand; PAM type: NRG; PAM sequence: AGG
gcactttaggaggccaaggc

SEQ ID NO: 33043 - DNA, 20 bp, Artificial Sequence
  Description of Artificial Sequence: Synthetic oligonucleotide
  Target: SCN10A; (+) strand; PAM type: NRG; PAM sequence: CAG
ctttaggaggccaaggcagg

SEQ ID NO: 33044 - DNA, 20 bp, Artificial Sequence
  Description of Artificial Sequence: Synthetic oligonucleotide
  Target: SCN10A; (+) strand; PAM type: NRG; PAM sequence: GAG
ggccaaggcaggcagatcat

SEQ ID NO: 33045 - DNA, 20 bp, Artificial Sequence
  Description of Artificial Sequence: Synthetic oligonucleotide
  Target: SCN10A; (+) strand; PAM type: NRG; PAM sequence: AGG
gccaaggcaggcagatcatg

SEQ ID NO: 33046 - DNA, 20 bp, Artificial Sequence
  Description of Artificial Sequence: Synthetic oligonucleotide
  Target: SCN10A; (+) strand; PAM type: NRG; PAM sequence: CAG
aggcaggcagatcatgaggt

SEQ ID NO: 33047 - DNA, 20 bp, Artificial Sequence
  Description of Artificial Sequence: Synthetic oligonucleotide
  Target: SCN10A; (+) strand; PAM type: NRG; PAM sequence: AGG
ggcaggcagatcatgaggtc

SEQ ID NO: 33048 - DNA, 20 bp, Artificial Sequence
  Description of Artificial Sequence: Synthetic oligonucleotide
  Target: SCN10A; (+) strand; PAM type: NRG; PAM sequence: GAG
caggcagatcatgaggtcag

SEQ ID NO: 33049 - DNA, 20 bp, Artificial Sequence
  Description of Artificial Sequence: Synthetic oligonucleotide
  Target: SCN10A; (+) strand; PAM type: NRG; PAM sequence: GAG
gatcatgaggtcaggagatc

SEQ ID NO: 33050 - DNA, 20 bp, Artificial Sequence
  Description of Artificial Sequence: Synthetic oligonucleotide
  Target: SCN10A; (+) strand; PAM type: NRG; PAM sequence: TGG
tcaggagatcgagaccatcc

SEQ ID NO: 33051 - DNA, 20 bp, Artificial Sequence
  Description of Artificial Sequence: Synthetic oligonucleotide
  Target: SCN10A; (+) strand; PAM type: NRG; PAM sequence: CGG
cgagaccatcctggctaaca

SEQ ID NO: 33052 - DNA, 20 bp, Artificial Sequence
  Description of Artificial Sequence: Synthetic oligonucleotide
  Target: SCN10A; (+) strand; PAM type: NRG; PAM sequence: AAG
ccgtctctactaaaaataca

SEQ ID NO: 33053 - DNA, 20 bp, Artificial Sequence
  Description of Artificial Sequence: Synthetic oligonucleotide
  Target: SCN10A; (+) strand; PAM type: NRG; PAM sequence: TAG
ctactaaaaatacaaagaat

SEQ ID NO: 33054 - DNA, 20 bp, Artificial Sequence
  Description of Artificial Sequence: Synthetic oligonucleotide
  Target: SCN10A; (+) strand; PAM type: NRG; PAM sequence: CAG
taaaaatacaaagaattagc

SEQ ID NO: 33055 - DNA, 20 bp, Artificial Sequence
  Description of Artificial Sequence: Synthetic oligonucleotide
  Target: SCN10A; (+) strand; PAM type: NRG; PAM sequence: AGG
aaaaatacaaagaattagcc

SEQ ID NO: 33056 - DNA, 20 bp, Artificial Sequence
  Description of Artificial Sequence: Synthetic oligonucleotide
  Target: SCN10A; (+) strand; PAM type: NRG; PAM sequence: TGG
tacaaagaattagccaggca

SEQ ID NO: 33057 - DNA, 20 bp, Artificial Sequence
  Description of Artificial Sequence: Synthetic oligonucleotide
  Target: SCN10A; (+) strand; PAM type: NRG; PAM sequence: TGG
aaagaattagccaggcatgg

SEQ ID NO: 33058 - DNA, 20 bp, Artificial Sequence
  Description of Artificial Sequence: Synthetic oligonucleotide
  Target: SCN10A; (+) strand; PAM type: NRG; PAM sequence: TGG
gaattagccaggcatggtgg

SEQ ID NO: 33059 - DNA, 20 bp, Artificial Sequence
  Description of Artificial Sequence: Synthetic oligonucleotide
  Target: SCN10A; (+) strand; PAM type: NRG; PAM sequence: GGG
aattagccaggcatggtggt

SEQ ID NO: 33060 - DNA, 20 bp, Artificial Sequence
  Description of Artificial Sequence: Synthetic oligonucleotide
  Target: SCN10A; (+) strand; PAM type: NRG; PAM sequence: TAG
ggcatggtggtgggtgcctg

SEQ ID NO: 33061 - DNA, 20 bp, Artificial Sequence
  Description of Artificial Sequence: Synthetic oligonucleotide
  Target: SCN10A; (+) strand; PAM type: NRG; PAM sequence: CAG
gtggtgggtgcctgtagtcc

SEQ ID NO: 33062 - DNA, 20 bp, Artificial Sequence
  Description of Artificial Sequence: Synthetic oligonucleotide
  Target: SCN10A; (+) strand; PAM type: NRG; PAM sequence: CAG
tgcctgtagtcccagctact

SEQ ID NO: 33063 - DNA, 20 bp, Artificial Sequence
  Description of Artificial Sequence: Synthetic oligonucleotide
  Target: SCN10A; (+) strand; PAM type: NRG; PAM sequence: AGG
gcctgtagtcccagctactc

SEQ ID NO: 33064 - DNA, 20 bp, Artificial Sequence
  Description of Artificial Sequence: Synthetic oligonucleotide
  Target: SCN10A; (+) strand; PAM type: NRG; PAM sequence: GAG
ctgtagtcccagctactcag

SEQ ID NO: 33065 - DNA, 20 bp, Artificial Sequence
  Description of Artificial Sequence: Synthetic oligonucleotide
  Target: SCN10A; (+) strand; PAM type: NRG; PAM sequence: AGG
tgtagtcccagctactcagg

SEQ ID NO: 33066 - DNA, 20 bp, Artificial Sequence
  Description of Artificial Sequence: Synthetic oligonucleotide
  Target: SCN10A; (+) strand; PAM type: NRG; PAM sequence: GAG
tcccagctactcaggaggct

SEQ ID NO: 33067 - DNA, 20 bp, Artificial Sequence
  Description of Artificial Sequence: Synthetic oligonucleotide
  Target: SCN10A; (+) strand; PAM type: NRG; PAM sequence: AGG
cccagctactcaggaggctg

SEQ ID NO: 33068 - DNA, 20 bp, Artificial Sequence
  Description of Artificial Sequence: Synthetic oligonucleotide
  Target: SCN10A; (+) strand; PAM type: NRG; PAM sequence: CAG
agctactcaggaggctgagg

SEQ ID NO: 33069 - DNA, 20 bp, Artificial Sequence
  Description of Artificial Sequence: Synthetic oligonucleotide
  Target: SCN10A; (+) strand; PAM type: NRG; PAM sequence: AGG
gctactcaggaggctgaggc

SEQ ID NO: 33070 - DNA, 20 bp, Artificial Sequence
  Description of Artificial Sequence: Synthetic oligonucleotide
  Target: SCN10A; (+) strand; PAM type: NRG; PAM sequence: GAG
tactcaggaggctgaggcag

SEQ ID NO: 33071 - DNA, 20 bp, Artificial Sequence
  Description of Artificial Sequence: Synthetic oligonucleotide
  Target: SCN10A; (+) strand; PAM type: NRG; PAM sequence: TGG
aggaggctgaggcaggagaa

SEQ ID NO: 33072 - DNA, 20 bp, Artificial Sequence
  Description of Artificial Sequence: Synthetic oligonucleotide
  Target: SCN10A; (+) strand; PAM type: NRG; PAM sequence: CGG
gcaggagaatggcgtgaacc

SEQ ID NO: 33073 - DNA, 20 bp, Artificial Sequence
  Description of Artificial Sequence: Synthetic oligonucleotide
  Target: SCN10A; (+) strand; PAM type: NRG; PAM sequence: GGG
caggagaatggcgtgaaccc

SEQ ID NO: 33074 - DNA, 20 bp, Artificial Sequence
  Description of Artificial Sequence: Synthetic oligonucleotide
  Target: SCN10A; (+) strand; PAM type: NRG; PAM sequence: GAG
ggagaatggcgtgaacccgg

SEQ ID NO: 33075 - DNA, 20 bp, Artificial Sequence
  Description of Artificial Sequence: Synthetic oligonucleotide
  Target: SCN10A; (+) strand; PAM type: NRG; PAM sequence: AGG
gagaatggcgtgaacccggg

SEQ ID NO: 33076 - DNA, 20 bp, Artificial Sequence
  Description of Artificial Sequence: Synthetic oligonucleotide
  Target: SCN10A; (+) strand; PAM type: NRG; PAM sequence: TGG
aatggcgtgaacccgggagg

SEQ ID NO: 33077 - DNA, 20 bp, Artificial Sequence
  Description of Artificial Sequence: Synthetic oligonucleotide
  Target: SCN10A; (+) strand; PAM type: NRG; PAM sequence: GAG
tggcgtgaacccgggaggtg

SEQ ID NO: 33078 - DNA, 20 bp, Artificial Sequence
  Description of Artificial Sequence: Synthetic oligonucleotide
  Target: SCN10A; (+) strand; PAM type: NRG; PAM sequence: TGG
gtgaacccgggaggtggagc

SEQ ID NO: 33079 - DNA, 20 bp, Artificial Sequence
  Description of Artificial Sequence: Synthetic oligonucleotide
  Target: SCN10A; (+) strand; PAM type: NRG; PAM sequence: GAG
cgggaggtggagctggcaat

SEQ ID NO: 33080 - DNA, 20 bp, Artificial Sequence
  Description of Artificial Sequence: Synthetic oligonucleotide
  Target: SCN10A; (+) strand; PAM type: NRG; PAM sequence: GAG
ggtggagctggcaatgagcc

SEQ ID NO: 33081 - DNA, 20 bp, Artificial Sequence
  Description of Artificial Sequence: Synthetic oligonucleotide
  Target: SCN10A; (+) strand; PAM type: NRG; PAM sequence: TAG
gagatcacgccactgcactc

SEQ ID NO: 33082 - DNA, 20 bp, Artificial Sequence
  Description of Artificial Sequence: Synthetic oligonucleotide
  Target: SCN10A; (+) strand; PAM type: NRG; PAM sequence: TGG
cacgccactgcactctagcc

SEQ ID NO: 33083 - DNA, 20 bp, Artificial Sequence
  Description of Artificial Sequence: Synthetic oligonucleotide
  Target: SCN10A; (+) strand; PAM type: NRG; PAM sequence: GGG
acgccactgcactctagcct

SEQ ID NO: 33084 - DNA, 20 bp, Artificial Sequence
  Description of Artificial Sequence: Synthetic oligonucleotide
  Target: SCN10A; (+) strand; PAM type: NRG; PAM sequence: CAG
ctgcactctagcctgggtga

SEQ ID NO: 33085 - DNA, 20 bp, Artificial Sequence
  Description of Artificial Sequence: Synthetic oligonucleotide
  Target: SCN10A; (+) strand; PAM type: NRG; PAM sequence: GAG
gcactctagcctgggtgaca

SEQ ID NO: 33086 - DNA, 20 bp, Artificial Sequence
  Description of Artificial Sequence: Synthetic oligonucleotide
  Target: SCN10A; (+) strand; PAM type: NRG; PAM sequence: GAG
tctagcctgggtgacagagc

SEQ ID NO: 33087 - DNA, 20 bp, Artificial Sequence
  Description of Artificial Sequence: Synthetic oligonucleotide
  Target: SCN10A; (+) strand; PAM type: NRG; PAM sequence: AAG
tcaaaaaaaaaaaaaaaaaa

SEQ ID NO: 33088 - DNA, 20 bp, Artificial Sequence
  Description of Artificial Sequence: Synthetic oligonucleotide
  Target: SCN10A; (+) strand; PAM type: NRG; PAM sequence: AAG
aaaaaaaaaaaaaaaaaaga

SEQ ID NO: 33089 - DNA, 20 bp, Artificial Sequence
  Description of Artificial Sequence: Synthetic oligonucleotide
  Target: SCN10A; (+) strand; PAM type: NRG; PAM sequence: AAG
aaaaaaaaaaaaagaaagaa

SEQ ID NO: 33090 - DNA, 20 bp, Artificial Sequence
  Description of Artificial Sequence: Synthetic oligonucleotide
  Target: SCN10A; (+) strand; PAM type: NRG; PAM sequence: AAG
aaaaaaaaaagaaagaaaag

SEQ ID NO: 33091 - DNA, 20 bp, Artificial Sequence
  Description of Artificial Sequence: Synthetic oligonucleotide
  Target: SCN10A; (+) strand; PAM type: NRG; PAM sequence: TAG
ttcacatgatgtgattatgt

SEQ ID NO: 33092 - DNA, 20 bp, Artificial Sequence
  Description of Artificial Sequence: Synthetic oligonucleotide
  Target: SCN10A; (+) strand; PAM type: NRG; PAM sequence: TAG
agaaaatttaaaacattgta

SEQ ID NO: 33093 - DNA, 20 bp, Artificial Sequence
  Description of Artificial Sequence: Synthetic oligonucleotide
  Target: SCN10A; (+) strand; PAM type: NRG; PAM sequence: TAG
acattgtatagataaattat

SEQ ID NO: 33094 - DNA, 20 bp, Artificial Sequence
  Description of Artificial Sequence: Synthetic oligonucleotide
  Target: SCN10A; (+) strand; PAM type: NRG; PAM sequence: AAG
gataaattattagaattaat

SEQ ID NO: 33095 - DNA, 20 bp, Artificial Sequence
  Description of Artificial Sequence: Synthetic oligonucleotide
  Target: SCN10A; (+) strand; PAM type: NRG; PAM sequence: GAG
taaattattagaattaataa

SEQ ID NO: 33096 - DNA, 20 bp, Artificial Sequence
  Description of Artificial Sequence: Synthetic oligonucleotide
  Target: SCN10A; (+) strand; PAM type: NRG; PAM sequence: TAG
gaattaataagagacatttc

SEQ ID NO: 33097 - DNA, 20 bp, Artificial Sequence
  Description of Artificial Sequence: Synthetic oligonucleotide
  Target: SCN10A; (+) strand; PAM type: NRG; PAM sequence: TAG
aatgttaaatatcaaaatgc

SEQ ID NO: 33098 - DNA, 20 bp, Artificial Sequence
  Description of Artificial Sequence: Synthetic oligonucleotide
  Target: SCN10A; (+) strand; PAM type: NRG; PAM sequence: CAG
aaaatgctagccaaaaatgc

SEQ ID NO: 33099 - DNA, 20 bp, Artificial Sequence
  Description of Artificial Sequence: Synthetic oligonucleotide
  Target: SCN10A; (+) strand; PAM type: NRG; PAM sequence: AAG
gctagccaaaaatgccagaa

SEQ ID NO: 33100 - DNA, 20 bp, Artificial Sequence
  Description of Artificial Sequence: Synthetic oligonucleotide
  Target: SCN10A; (+) strand; PAM type: NRG; PAM sequence: AAG
aatgccagaaaagaacattt

SEQ ID NO: 33101 - DNA, 20 bp, Artificial Sequence
  Description of Artificial Sequence: Synthetic oligonucleotide
  Target: SCN10A; (+) strand; PAM type: NRG; PAM sequence: AAG
gccagaaaagaacatttaag

SEQ ID NO: 33102 - DNA, 20 bp, Artificial Sequence
  Description of Artificial Sequence: Synthetic oligonucleotide
  Target: SCN10A; (+) strand; PAM type: NRG; PAM sequence: AAG
gaacatttaagaagatatgc

SEQ ID NO: 33103 - DNA, 20 bp, Artificial Sequence
  Description of Artificial Sequence: Synthetic oligonucleotide
  Target: SCN10A; (+) strand; PAM type: NRG; PAM sequence: TGG
agaagatatgcaagatccta

SEQ ID NO: 33104 - DNA, 20 bp, Artificial Sequence
  Description of Artificial Sequence: Synthetic oligonucleotide
  Target: SCN10A; (+) strand; PAM type: NRG; PAM sequence: GAG
aagatatgcaagatcctatg

SEQ ID NO: 33105 - DNA, 20 bp, Artificial Sequence
  Description of Artificial Sequence: Synthetic oligonucleotide
  Target: SCN10A; (+) strand; PAM type: NRG; PAM sequence: TGG
agaaaattataaaaacctca

SEQ ID NO: 33106 - DNA, 20 bp, Artificial Sequence
  Description of Artificial Sequence: Synthetic oligonucleotide
  Target: SCN10A; (+) strand; PAM type: NRG; PAM sequence: AAG
acatttttaaactttattga

SEQ ID NO: 33107 - DNA, 20 bp, Artificial Sequence
  Description of Artificial Sequence: Synthetic oligonucleotide
  Target: SCN10A; (+) strand; PAM type: NRG; PAM sequence: TGG
tttaaactttattgaaagac

SEQ ID NO: 33108 - DNA, 20 bp, Artificial Sequence
  Description of Artificial Sequence: Synthetic oligonucleotide
  Target: SCN10A; (+) strand; PAM type: NRG; PAM sequence: CAG
tttattgaaagactggtata

SEQ ID NO: 33109 - DNA, 20 bp, Artificial Sequence
  Description of Artificial Sequence: Synthetic oligonucleotide
  Target: SCN10A; (+) strand; PAM type: NRG; PAM sequence: TAG
tacagcgtatactatcttca

SEQ ID NO: 33110 - DNA, 20 bp, Artificial Sequence
  Description of Artificial Sequence: Synthetic oligonucleotide
  Target: SCN10A; (+) strand; PAM type: NRG; PAM sequence: CAG
cgtatactatcttcatagat

SEQ ID NO: 33111 - DNA, 20 bp, Artificial Sequence
  Description of Artificial Sequence: Synthetic oligonucleotide
  Target: SCN10A; (+) strand; PAM type: NRG; PAM sequence: AAG
atactatcttcatagatcag

SEQ ID NO: 33112 - DNA, 20 bp, Artificial Sequence
  Description of Artificial Sequence: Synthetic oligonucleotide
  Target: SCN10A; (+) strand; PAM type: NRG; PAM sequence: AAG
tcagaagactgaattatgta

SEQ ID NO: 33113 - DNA, 20 bp, Artificial Sequence
  Description of Artificial Sequence: Synthetic oligonucleotide
  Target: SCN10A; (+) strand; PAM type: NRG; PAM sequence: AAG
ctgaattatgtaaagattat

SEQ ID NO: 33114 - DNA, 20 bp, Artificial Sequence
  Description of Artificial Sequence: Synthetic oligonucleotide
  Target: SCN10A; (+) strand; PAM type: NRG; PAM sequence: CAG
ccaaattgacctatcaatta

SEQ ID NO: 33115 - DNA, 20 bp, Artificial Sequence
  Description of Artificial Sequence: Synthetic oligonucleotide
  Target: SCN10A; (+) strand; PAM type: NRG; PAM sequence: CAG
aattgacctatcaattacag

SEQ ID NO: 33116 - DNA, 20 bp, Artificial Sequence
  Description of Artificial Sequence: Synthetic oligonucleotide
  Target: SCN10A; (+) strand; PAM type: NRG; PAM sequence: TGG
tcaattacagcagtccctaa

SEQ ID NO: 33117 - DNA, 20 bp, Artificial Sequence
  Description of Artificial Sequence: Synthetic oligonucleotide
  Target: SCN10A; (+) strand; PAM type: NRG; PAM sequence: GGG
caattacagcagtccctaat

SEQ ID NO: 33118 - DNA, 20 bp, Artificial Sequence
  Description of Artificial Sequence: Synthetic oligonucleotide
  Target: SCN10A; (+) strand; PAM type: NRG; PAM sequence: TAG
gtccctaatgggaaaaacaa

SEQ ID NO: 33119 - DNA, 20 bp, Artificial Sequence
  Description of Artificial Sequence: Synthetic oligonucleotide
  Target: SCN10A; (+) strand; PAM type: NRG; PAM sequence: CAG
cctaatgggaaaaacaatag

SEQ ID NO: 33120 - DNA, 20 bp, Artificial Sequence
  Description of Artificial Sequence: Synthetic oligonucleotide
  Target: SCN10A; (+) strand; PAM type: NRG; PAM sequence: TGG
atagcagttttgtgtgtatg

SEQ ID NO: 33121 - DNA, 20 bp, Artificial Sequence
  Description of Artificial Sequence: Synthetic oligonucleotide
  Target: SCN10A; (+) strand; PAM type: NRG; PAM sequence: GGG
tagcagttttgtgtgtatgt

SEQ ID NO: 33122 - DNA, 20 bp, Artificial Sequence
  Description of Artificial Sequence: Synthetic oligonucleotide
  Target: SCN10A; (+) strand; PAM type: NRG; PAM sequence: TGG
gtgtatgtgggtatgtaact

SEQ ID NO: 33123 - DNA, 20 bp, Artificial Sequence
  Description of Artificial Sequence: Synthetic oligonucleotide
  Target: SCN10A; (+) strand; PAM type: NRG; PAM sequence: AAG
atgtgggtatgtaacttggc

SEQ ID NO: 33124 - DNA, 20 bp, Artificial Sequence
  Description of Artificial Sequence: Synthetic oligonucleotide
  Target: SCN10A; (+) strand; PAM type: NRG; PAM sequence: AAG
aacttggcaagataattcta

SEQ ID NO: 33125 - DNA, 20 bp, Artificial Sequence
  Description of Artificial Sequence: Synthetic oligonucleotide
  Target: SCN10A; (+) strand; PAM type: NRG; PAM sequence: AAG
taattctaaagtgaatatga

SEQ ID NO: 33126 - DNA, 20 bp, Artificial Sequence
  Description of Artificial Sequence: Synthetic oligonucleotide
  Target: SCN10A; (+) strand; PAM type: NRG; PAM sequence: CAG
aaagtgaatatgaaagtgtg

SEQ ID NO: 33127 - DNA, 20 bp, Artificial Sequence
  Description of Artificial Sequence: Synthetic oligonucleotide
  Target: SCN10A; (+) strand; PAM type: NRG; PAM sequence: AGG
aagtgaatatgaaagtgtgc

SEQ ID NO: 33128 - DNA, 20 bp, Artificial Sequence
  Description of Artificial Sequence: Synthetic oligonucleotide
  Target: SCN10A; (+) strand; PAM type: NRG; PAM sequence: AAG
aatatgaaagtgtgcaggcc

SEQ ID NO: 33129 - DNA, 20 bp, Artificial Sequence
  Description of Artificial Sequence: Synthetic oligonucleotide
  Target: SCN10A; (+) strand; PAM type: NRG; PAM sequence: AAG
tgcaggccaagatattcttg

SEQ ID NO: 33130 - DNA, 20 bp, Artificial Sequence
  Description of Artificial Sequence: Synthetic oligonucleotide
  Target: SCN10A; (+) strand; PAM type: NRG; PAM sequence: TAG
aagatattcttgaagtaaat

SEQ ID NO: 33131 - DNA, 20 bp, Artificial Sequence
  Description of Artificial Sequence: Synthetic oligonucleotide
  Target: SCN10A; (+) strand; PAM type: NRG; PAM sequence: AGG
agatattcttgaagtaaatt

SEQ ID NO: 33132 - DNA, 20 bp, Artificial Sequence
  Description of Artificial Sequence: Synthetic oligonucleotide
  Target: SCN10A; (+) strand; PAM type: NRG; PAM sequence: TGG
tattcttgaagtaaattagg

SEQ ID NO: 33133 - DNA, 20 bp, Artificial Sequence
  Description of Artificial Sequence: Synthetic oligonucleotide
  Target: SCN10A; (+) strand; PAM type: NRG; PAM sequence: CAG
taggtggattacttgattta

SEQ ID NO: 33134 - DNA, 20 bp, Artificial Sequence
  Description of Artificial Sequence: Synthetic oligonucleotide
  Target: SCN10A; (+) strand; PAM type: NRG; PAM sequence: CAG
gattacttgatttacagaca

SEQ ID NO: 33135 - DNA, 20 bp, Artificial Sequence
  Description of Artificial Sequence: Synthetic oligonucleotide
  Target: SCN10A; (+) strand; PAM type: NRG; PAM sequence: AAG
tacagacacagatatattta

SEQ ID NO: 33136 - DNA, 20 bp, Artificial Sequence
  Description of Artificial Sequence: Synthetic oligonucleotide
  Target: SCN10A; (+) strand; PAM type: NRG; PAM sequence: AAG
tatttaaagctgccataatt

SEQ ID NO: 33137 - DNA, 20 bp, Artificial Sequence
  Description of Artificial Sequence: Synthetic oligonucleotide
  Target: SCN10A; (+) strand; PAM type: NRG; PAM sequence: TGG
gccataattaagactgatat

SEQ ID NO: 33138 - DNA, 20 bp, Artificial Sequence
  Description of Artificial Sequence: Synthetic oligonucleotide
  Target: SCN10A; (+) strand; PAM type: NRG; PAM sequence: CAG
attaagactgatattggtgc

SEQ ID NO: 33139 - DNA, 20 bp, Artificial Sequence
  Description of Artificial Sequence: Synthetic oligonucleotide
  Target: SCN10A; (+) strand; PAM type: NRG; PAM sequence: AGG
ttaagactgatattggtgcc

SEQ ID NO: 33140 - DNA, 20 bp, Artificial Sequence
  Description of Artificial Sequence: Synthetic oligonucleotide
  Target: SCN10A; (+) strand; PAM type: NRG; PAM sequence: TAG
gactgatattggtgccagga

SEQ ID NO: 33141 - DNA, 20 bp, Artificial Sequence
  Description of Artificial Sequence: Synthetic oligonucleotide
  Target: SCN10A; (+) strand; PAM type: NRG; PAM sequence: TGG
ttggtgccaggatagaccaa

SEQ ID NO: 33142 - DNA, 20 bp, Artificial Sequence
  Description of Artificial Sequence: Synthetic oligonucleotide
  Target: SCN10A; (+) strand; PAM type: NRG; PAM sequence: CAG
aggatagaccaatggactaa

SEQ ID NO: 33143 - DNA, 20 bp, Artificial Sequence
  Description of Artificial Sequence: Synthetic oligonucleotide
  Target: SCN10A; (+) strand; PAM type: NRG; PAM sequence: GAG
gatagaccaatggactaaca

SEQ ID NO: 33144 - DNA, 20 bp, Artificial Sequence
  Description of Artificial Sequence: Synthetic oligonucleotide
  Target: SCN10A; (+) strand; PAM type: NRG; PAM sequence: TGG
caatggactaacagagcaaa

SEQ ID NO: 33145 - DNA, 20 bp, Artificial Sequence
  Description of Artificial Sequence: Synthetic oligonucleotide
  Target: SCN10A; (+) strand; PAM type: NRG; PAM sequence: GAG
atggactaacagagcaaatg

SEQ ID NO: 33146 - DNA, 20 bp, Artificial Sequence
  Description of Artificial Sequence: Synthetic oligonucleotide
  Target: SCN10A; (+) strand; PAM type: NRG; PAM sequence: AAG
actaacagagcaaatggagc

SEQ ID NO: 33147 - DNA, 20 bp, Artificial Sequence
  Description of Artificial Sequence: Synthetic oligonucleotide
  Target: SCN10A; (+) strand; PAM type: NRG; PAM sequence: AGG
ctaacagagcaaatggagca

SEQ ID NO: 33148 - DNA, 20 bp, Artificial Sequence
  Description of Artificial Sequence: Synthetic oligonucleotide
  Target: SCN10A; (+) strand; PAM type: NRG; PAM sequence: AAG
agcaaatggagcaaggcttt

SEQ ID NO: 33149 - DNA, 20 bp, Artificial Sequence
  Description of Artificial Sequence: Synthetic oligonucleotide
  Target: SCN10A; (+) strand; PAM type: NRG; PAM sequence: CGG
tggagcaaggctttaagtga

SEQ ID NO: 33150 - DNA, 20 bp, Artificial Sequence
  Description of Artificial Sequence: Synthetic oligonucleotide
  Target: SCN10A; (+) strand; PAM type: NRG; PAM sequence: GGG
ggagcaaggctttaagtgac

SEQ ID NO: 33151 - DNA, 20 bp, Artificial Sequence
  Description of Artificial Sequence: Synthetic oligonucleotide
  Target: SCN10A; (+) strand; PAM type: NRG; PAM sequence: GAG
agcaaggctttaagtgacgg

SEQ ID NO: 33152 - DNA, 20 bp, Artificial Sequence
  Description of Artificial Sequence: Synthetic oligonucleotide
  Target: SCN10A; (+) strand; PAM type: NRG; PAM sequence: AGG
gcaaggctttaagtgacggg

SEQ ID NO: 33153 - DNA, 20 bp, Artificial Sequence
  Description of Artificial Sequence: Synthetic oligonucleotide
  Target: SCN10A; (+) strand; PAM type: NRG; PAM sequence: GAG
aaggctttaagtgacgggag

SEQ ID NO: 33154 - DNA, 20 bp, Artificial Sequence
  Description of Artificial Sequence: Synthetic oligonucleotide
  Target: SCN10A; (+) strand; PAM type: NRG; PAM sequence: AAG
gctttaagtgacgggaggag

SEQ ID NO: 33155 - DNA, 20 bp, Artificial Sequence
  Description of Artificial Sequence: Synthetic oligonucleotide
  Target: SCN10A; (+) strand; PAM type: NRG; PAM sequence: TGG
gaggagaagcaatgctattt

SEQ ID NO: 33156 - DNA, 20 bp, Artificial Sequence
  Description of Artificial Sequence: Synthetic oligonucleotide
  Target: SCN10A; (+) strand; PAM type: NRG; PAM sequence: GGG
aggagaagcaatgctatttt

SEQ ID NO: 33157 - DNA, 20 bp, Artificial Sequence
  Description of Artificial Sequence: Synthetic oligonucleotide
  Target: SCN10A; (+) strand; PAM type: NRG; PAM sequence: GAG
gagaagcaatgctattttgg

SEQ ID NO: 33158 - DNA, 20 bp, Artificial Sequence
  Description of Artificial Sequence: Synthetic oligonucleotide
  Target: SCN10A; (+) strand; PAM type: NRG; PAM sequence: GAG
gaagcaatgctattttggga

SEQ ID NO: 33159 - DNA, 20 bp, Artificial Sequence
  Description of Artificial Sequence: Synthetic oligonucleotide
  Target: SCN10A; (+) strand; PAM type: NRG; PAM sequence: AAG
gcaatgctattttgggagag

SEQ ID NO: 33160 - DNA, 20 bp, Artificial Sequence
  Description of Artificial Sequence: Synthetic oligonucleotide
  Target: SCN10A; (+) strand; PAM type: NRG; PAM sequence: AGG
caatgctattttgggagaga

SEQ ID NO: 33161 - DNA, 20 bp, Artificial Sequence
  Description of Artificial Sequence: Synthetic oligonucleotide
  Target: SCN10A; (+) strand; PAM type: NRG; PAM sequence: AAG
tgctattttgggagagaagg

SEQ ID NO: 33162 - DNA, 20 bp, Artificial Sequence
  Description of Artificial Sequence: Synthetic oligonucleotide
  Target: SCN10A; (+) strand; PAM type: NRG; PAM sequence: CAG
attttgggagagaaggaaga

SEQ ID NO: 33163 - DNA, 20 bp, Artificial Sequence
  Description of Artificial Sequence: Synthetic oligonucleotide
  Target: SCN10A; (+) strand; PAM type: NRG; PAM sequence: CAG
tccttccttcaatcaatcaa

SEQ ID NO: 33164 - DNA, 20 bp, Artificial Sequence
  Description of Artificial Sequence: Synthetic oligonucleotide
  Target: SCN10A; (+) strand; PAM type: NRG; PAM sequence: AGG
ccttccttcaatcaatcaac

SEQ ID NO: 33165 - DNA, 20 bp, Artificial Sequence
  Description of Artificial Sequence: Synthetic oligonucleotide
  Target: SCN10A; (+) strand; PAM type: NRG; PAM sequence: GAG
tcaatcaacaggtgtttatt

SEQ ID NO: 33166 - DNA, 20 bp, Artificial Sequence
  Description of Artificial Sequence: Synthetic oligonucleotide
  Target: SCN10A; (+) strand; PAM type: NRG; PAM sequence: TGG
ttgagttcctatgtatgtgc

SEQ ID NO: 33167 - DNA, 20 bp, Artificial Sequence
  Description of Artificial Sequence: Synthetic oligonucleotide
  Target: SCN10A; (+) strand; PAM type: NRG; PAM sequence: GGG
tgagttcctatgtatgtgct

SEQ ID NO: 33168 - DNA, 20 bp, Artificial Sequence
  Description of Artificial Sequence: Synthetic oligonucleotide
  Target: SCN10A; (+) strand; PAM type: NRG; PAM sequence: TAG
gtatgtgctgggccttgtgc

SEQ ID NO: 33169 - DNA, 20 bp, Artificial Sequence
  Description of Artificial Sequence: Synthetic oligonucleotide
  Target: SCN10A; (+) strand; PAM type: NRG; PAM sequence: AGG
tatgtgctgggccttgtgct

SEQ ID NO: 33170 - DNA, 20 bp, Artificial Sequence
  Description of Artificial Sequence: Synthetic oligonucleotide
  Target: SCN10A; (+) strand; PAM type: NRG; PAM sequence: TGG
tgggccttgtgctaggccct

SEQ ID NO: 33171 - DNA, 20 bp, Artificial Sequence
  Description of Artificial Sequence: Synthetic oligonucleotide
  Target: SCN10A; (+) strand; PAM type: NRG; PAM sequence: GGG
gggccttgtgctaggccctt

SEQ ID NO: 33172 - DNA, 20 bp, Artificial Sequence
  Description of Artificial Sequence: Synthetic oligonucleotide
  Target: SCN10A; (+) strand; PAM type: NRG; PAM sequence: CGG
gctaggcccttgggataaaa

SEQ ID NO: 33173 - DNA, 20 bp, Artificial Sequence
  Description of Artificial Sequence: Synthetic oligonucleotide
  Target: SCN10A; (+) strand; PAM type: NRG; PAM sequence: TAG
aggcccttgggataaaacgg

SEQ ID NO: 33174 - DNA, 20 bp, Artificial Sequence
  Description of Artificial Sequence: Synthetic oligonucleotide
  Target: SCN10A; (+) strand; PAM type: NRG; PAM sequence: AAG
cttgggataaaacggtagac

SEQ ID NO: 33175 - DNA, 20 bp, Artificial Sequence
  Description of Artificial Sequence: Synthetic oligonucleotide
  Target: SCN10A; (+) strand; PAM type: NRG; PAM sequence: TGG
aaacggtagacaagaaactc

SEQ ID NO: 33176 - DNA, 20 bp, Artificial Sequence
  Description of Artificial Sequence: Synthetic oligonucleotide
  Target: SCN10A; (+) strand; PAM type: NRG; PAM sequence: TGG
aaactctggtttttgcctca

SEQ ID NO: 33177 - DNA, 20 bp, Artificial Sequence
  Description of Artificial Sequence: Synthetic oligonucleotide
  Target: SCN10A; (+) strand; PAM type: NRG; PAM sequence: GGG
aactctggtttttgcctcat

SEQ ID NO: 33178 - DNA, 20 bp, Artificial Sequence
  Description of Artificial Sequence: Synthetic oligonucleotide
  Target: SCN10A; (+) strand; PAM type: NRG; PAM sequence: TAG
ctggtttttgcctcatggga

SEQ ID NO: 33179 - DNA, 20 bp, Artificial Sequence
  Description of Artificial Sequence: Synthetic oligonucleotide
  Target: SCN10A; (+) strand; PAM type: NRG; PAM sequence: CAG
gtttttgcctcatgggatag

SEQ ID NO: 33180 - DNA, 20 bp, Artificial Sequence
  Description of Artificial Sequence: Synthetic oligonucleotide
  Target: SCN10A; (+) strand; PAM type: NRG; PAM sequence: AGG
tttttgcctcatgggatagc

SEQ ID NO: 33181 - DNA, 20 bp, Artificial Sequence
  Description of Artificial Sequence: Synthetic oligonucleotide
  Target: SCN10A; (+) strand; PAM type: NRG; PAM sequence: CAG
agcaggacaattgtaaatgc

SEQ ID NO: 33182 - DNA, 20 bp, Artificial Sequence
  Description of Artificial Sequence: Synthetic oligonucleotide
  Target: SCN10A; (+) strand; PAM type: NRG; PAM sequence: AGG
gcaggacaattgtaaatgcc

SEQ ID NO: 33183 - DNA, 20 bp, Artificial Sequence
  Description of Artificial Sequence: Synthetic oligonucleotide
  Target: SCN10A; (+) strand; PAM type: NRG; PAM sequence: AAG
aatgccaggttaatttgatg

SEQ ID NO: 33184 - DNA, 20 bp, Artificial Sequence
  Description of Artificial Sequence: Synthetic oligonucleotide
  Target: SCN10A; (+) strand; PAM type: NRG; PAM sequence: AGG
atgccaggttaatttgatga

SEQ ID NO: 33185 - DNA, 20 bp, Artificial Sequence
  Description of Artificial Sequence: Synthetic oligonucleotide
  Target: SCN10A; (+) strand; PAM type: NRG; PAM sequence: TAG
ttgatgaaggaatccaactt

SEQ ID NO: 33186 - DNA, 20 bp, Artificial Sequence
  Description of Artificial Sequence: Synthetic oligonucleotide
  Target: SCN10A; (+) strand; PAM type: NRG; PAM sequence: TAG
tgaaggaatccaactttaga

SEQ ID NO: 33187 - DNA, 20 bp, Artificial Sequence
  Description of Artificial Sequence: Synthetic oligonucleotide
  Target: SCN10A; (+) strand; PAM type: NRG; PAM sequence: TGG
gaatccaactttagatagtg

SEQ ID NO: 33188 - DNA, 20 bp, Artificial Sequence
  Description of Artificial Sequence: Synthetic oligonucleotide
  Target: SCN10A; (+) strand; PAM type: NRG; PAM sequence: TGG
ccaactttagatagtgtggt

SEQ ID NO: 33189 - DNA, 20 bp, Artificial Sequence
  Description of Artificial Sequence: Synthetic oligonucleotide
  Target: SCN10A; (+) strand; PAM type: NRG; PAM sequence: GGG
caactttagatagtgtggtt

SEQ ID NO: 33190 - DNA, 20 bp, Artificial Sequence
  Description of Artificial Sequence: Synthetic oligonucleotide
  Target: SCN10A; (+) strand; PAM type: NRG; PAM sequence: GGG
aactttagatagtgtggttg

SEQ ID NO: 33191 - DNA, 20 bp, Artificial Sequence
  Description of Artificial Sequence: Synthetic oligonucleotide
  Target: SCN10A; (+) strand; PAM type: NRG; PAM sequence: GAG
ctttagatagtgtggttggg

SEQ ID NO: 33192 - DNA, 20 bp, Artificial Sequence
  Description of Artificial Sequence: Synthetic oligonucleotide
  Target: SCN10A; (+) strand; PAM type: NRG; PAM sequence: AGG
tttagatagtgtggttgggg

SEQ ID NO: 33193 - DNA, 20 bp, Artificial Sequence
  Description of Artificial Sequence: Synthetic oligonucleotide
  Target: SCN10A; (+) strand; PAM type: NRG; PAM sequence: AAG
tggttggggaggtcccctct

SEQ ID NO: 33194 - DNA, 20 bp, Artificial Sequence
  Description of Artificial Sequence: Synthetic oligonucleotide
  Target: SCN10A; (+) strand; PAM type: NRG; PAM sequence: AGG
ggttggggaggtcccctcta

SEQ ID NO: 33195 - DNA, 20 bp, Artificial Sequence
  Description of Artificial Sequence: Synthetic oligonucleotide
  Target: SCN10A; (+) strand; PAM type: NRG; PAM sequence: GAG
ttggggaggtcccctctaag

SEQ ID NO: 33196 - DNA, 20 bp, Artificial Sequence
  Description of Artificial Sequence: Synthetic oligonucleotide
  Target: SCN10A; (+) strand; PAM type: NRG; PAM sequence: AGG
tggggaggtcccctctaagg

SEQ ID NO: 33197 - DNA, 20 bp, Artificial Sequence
  Description of Artificial Sequence: Synthetic oligonucleotide
  Target: SCN10A; (+) strand; PAM type: NRG; PAM sequence: AAG
gtcccctctaaggaggtgac

SEQ ID NO: 33198 - DNA, 20 bp, Artificial Sequence
  Description of Artificial Sequence: Synthetic oligonucleotide
  Target: SCN10A; (+) strand; PAM type: NRG; PAM sequence: CAG
ggtgacaagtgcattgaaca

SEQ ID NO: 33199 - DNA, 20 bp, Artificial Sequence
  Description of Artificial Sequence: Synthetic oligonucleotide
  Target: SCN10A; (+) strand; PAM type: NRG; PAM sequence: GAG
tgacaagtgcattgaacaca

SEQ ID NO: 33200 - DNA, 20 bp, Artificial Sequence
  Description of Artificial Sequence: Synthetic oligonucleotide
  Target: SCN10A; (+) strand; PAM type: NRG; PAM sequence: GAG
gtgcattgaacacagagttt

SEQ ID NO: 33201 - DNA, 20 bp, Artificial Sequence
  Description of Artificial Sequence: Synthetic oligonucleotide
  Target: SCN10A; (+) strand; PAM type: NRG; PAM sequence: AAG
tgaacacagagtttgagaat

SEQ ID NO: 33202 - DNA, 20 bp, Artificial Sequence
  Description of Artificial Sequence: Synthetic oligonucleotide
  Target: SCN10A; (+) strand; PAM type: NRG; PAM sequence: GAG
cacagagtttgagaataagt

SEQ ID NO: 33203 - DNA, 20 bp, Artificial Sequence
  Description of Artificial Sequence: Synthetic oligonucleotide
  Target: SCN10A; (+) strand; PAM type: NRG; PAM sequence: AAG
agtttgagaataagtgagct

SEQ ID NO: 33204 - DNA, 20 bp, Artificial Sequence
  Description of Artificial Sequence: Synthetic oligonucleotide
  Target: SCN10A; (+) strand; PAM type: NRG; PAM sequence: AAG
gagaataagtgagctaagtg

SEQ ID NO: 33205 - DNA, 20 bp, Artificial Sequence
  Description of Artificial Sequence: Synthetic oligonucleotide
  Target: SCN10A; (+) strand; PAM type: NRG; PAM sequence: AAG
agtgagctaagtgaagacta

SEQ ID NO: 33206 - DNA, 20 bp, Artificial Sequence
  Description of Artificial Sequence: Synthetic oligonucleotide
  Target: SCN10A; (+) strand; PAM type: NRG; PAM sequence: AGG
gtgagctaagtgaagactaa

SEQ ID NO: 33207 - DNA, 20 bp, Artificial Sequence
  Description of Artificial Sequence: Synthetic oligonucleotide
  Target: SCN10A; (+) strand; PAM type: NRG; PAM sequence: AAG
ctaagtgaagactaaaggaa

SEQ ID NO: 33208 - DNA, 20 bp, Artificial Sequence
  Description of Artificial Sequence: Synthetic oligonucleotide
  Target: SCN10A; (+) strand; PAM type: NRG; PAM sequence: CAG
agactaaaggaaaagtattc

SEQ ID NO: 33209 - DNA, 20 bp, Artificial Sequence
  Description of Artificial Sequence: Synthetic oligonucleotide
  Target: SCN10A; (+) strand; PAM type: NRG; PAM sequence: AGG
gactaaaggaaaagtattcc

SEQ ID NO: 33210 - DNA, 20 bp, Artificial Sequence
  Description of Artificial Sequence: Synthetic oligonucleotide
  Target: SCN10A; (+) strand; PAM type: NRG; PAM sequence: CAG
aaggaaaagtattccaggca

SEQ ID NO: 33211 - DNA, 20 bp, Artificial Sequence
  Description of Artificial Sequence: Synthetic oligonucleotide
  Target: SCN10A; (+) strand; PAM type: NRG; PAM sequence: AAG
gcacagcgaaaaaaacttca

SEQ ID NO: 33212 - DNA, 20 bp, Artificial Sequence
  Description of Artificial Sequence: Synthetic oligonucleotide
  Target: SCN10A; (+) strand; PAM type: NRG; PAM sequence: AGG
cacagcgaaaaaaacttcaa

SEQ ID NO: 33213 - DNA, 20 bp, Artificial Sequence
  Description of Artificial Sequence: Synthetic oligonucleotide
  Target: SCN10A; (+) strand; PAM type: NRG; PAM sequence: AAG
aaaaaaacttcaaaggccca

SEQ ID NO: 33214 - DNA, 20 bp, Artificial Sequence
  Description of Artificial Sequence: Synthetic oligonucleotide
  Target: SCN10A; (+) strand; PAM type: NRG; PAM sequence: AAG
aacttcaaaggcccaaagcc

SEQ ID NO: 33215 - DNA, 20 bp, Artificial Sequence
  Description of Artificial Sequence: Synthetic oligonucleotide
  Target: SCN10A; (+) strand; PAM type: NRG; PAM sequence: AAG
ttcaaaggcccaaagccaag

SEQ ID NO: 33216 - DNA, 20 bp, Artificial Sequence
  Description of Artificial Sequence: Synthetic oligonucleotide
  Target: SCN10A; (+) strand; PAM type: NRG; PAM sequence: AAG
gaagttctctgttatgtgtg

SEQ ID NO: 33217 - DNA, 20 bp, Artificial Sequence
  Description of Artificial Sequence: Synthetic oligonucleotide
  Target: SCN10A; (+) strand; PAM type: NRG; PAM sequence: AAG
gttctctgttatgtgtgaag

SEQ ID NO: 33218 - DNA, 20 bp, Artificial Sequence
  Description of Artificial Sequence: Synthetic oligonucleotide
  Target: SCN10A; (+) strand; PAM type: NRG; PAM sequence: GAG
tctctgttatgtgtgaagaa

SEQ ID NO: 33219 - DNA, 20 bp, Artificial Sequence
  Description of Artificial Sequence: Synthetic oligonucleotide
  Target: SCN10A; (+) strand; PAM type: NRG; PAM sequence: GAG
tctgttatgtgtgaagaaga

SEQ ID NO: 33220 - DNA, 20 bp, Artificial Sequence
  Description of Artificial Sequence: Synthetic oligonucleotide
  Target: SCN10A; (+) strand; PAM type: NRG; PAM sequence: GAG
tgttatgtgtgaagaagaga

SEQ ID NO: 33221 - DNA, 20 bp, Artificial Sequence
  Description of Artificial Sequence: Synthetic oligonucleotide
  Target: SCN10A; (+) strand; PAM type: NRG; PAM sequence: TAG
tatgtgtgaagaagagagag

SEQ ID NO: 33222 - DNA, 20 bp, Artificial Sequence
  Description of Artificial Sequence: Synthetic oligonucleotide
  Target: SCN10A; (+) strand; PAM type: NRG; PAM sequence: AGG
atgtgtgaagaagagagagt

SEQ ID NO: 33223 - DNA, 20 bp, Artificial Sequence
  Description of Artificial Sequence: Synthetic oligonucleotide
  Target: SCN10A; (+) strand; PAM type: NRG; PAM sequence: TGG
gaagagagagtaggcctttt

SEQ ID NO: 33224 - DNA, 20 bp, Artificial Sequence
  Description of Artificial Sequence: Synthetic oligonucleotide
  Target: SCN10A; (+) strand; PAM type: NRG; PAM sequence: TGG
agagagtaggcctttttggc

SEQ ID NO: 33225 - DNA, 20 bp, Artificial Sequence
  Description of Artificial Sequence: Synthetic oligonucleotide
  Target: SCN10A; (+) strand; PAM type: NRG; PAM sequence: GAG
agagtaggcctttttggctg

SEQ ID NO: 33226 - DNA, 20 bp, Artificial Sequence
  Description of Artificial Sequence: Synthetic oligonucleotide
  Target: SCN10A; (+) strand; PAM type: NRG; PAM sequence: AAG
aggcctttttggctggagca

SEQ ID NO: 33227 - DNA, 20 bp, Artificial Sequence
  Description of Artificial Sequence: Synthetic oligonucleotide
  Target: SCN10A; (+) strand; PAM type: NRG; PAM sequence: TGG
cctttttggctggagcaaag

SEQ ID NO: 33228 - DNA, 20 bp, Artificial Sequence
  Description of Artificial Sequence: Synthetic oligonucleotide
  Target: SCN10A; (+) strand; PAM type: NRG; PAM sequence: GGG
ctttttggctggagcaaagt

SEQ ID NO: 33229 - DNA, 20 bp, Artificial Sequence
  Description of Artificial Sequence: Synthetic oligonucleotide
  Target: SCN10A; (+) strand; PAM type: NRG; PAM sequence: AAG
ttggctggagcaaagtgggc

SEQ ID NO: 33230 - DNA, 20 bp, Artificial Sequence
  Description of Artificial Sequence: Synthetic oligonucleotide
  Target: SCN10A; (+) strand; PAM type: NRG; PAM sequence: CGG
ctggagcaaagtgggcaaga

SEQ ID NO: 33231 - DNA, 20 bp, Artificial Sequence
  Description of Artificial Sequence: Synthetic oligonucleotide
  Target: SCN10A; (+) strand; PAM type: NRG; PAM sequence: GAG
ggagcaaagtgggcaagacg

SEQ ID NO: 33232 - DNA, 20 bp, Artificial Sequence
  Description of Artificial Sequence: Synthetic oligonucleotide
  Target: SCN10A; (+) strand; PAM type: NRG; PAM sequence: TGG
aaagtgggcaagacggagac

SEQ ID NO: 33233 - DNA, 20 bp, Artificial Sequence
  Description of Artificial Sequence: Synthetic oligonucleotide
  Target: SCN10A; (+) strand; PAM type: NRG; PAM sequence: TGG
caagacggagactggtgaac

SEQ ID NO: 33234 - DNA, 20 bp, Artificial Sequence
  Description of Artificial Sequence: Synthetic oligonucleotide
  Target: SCN10A; (+) strand; PAM type: NRG; PAM sequence: CAG
gacggagactggtgaactgg

SEQ ID NO: 33235 - DNA, 20 bp, Artificial Sequence
  Description of Artificial Sequence: Synthetic oligonucleotide
  Target: SCN10A; (+) strand; PAM type: NRG; PAM sequence: AGG
acggagactggtgaactggc

SEQ ID NO: 33236 - DNA, 20 bp, Artificial Sequence
  Description of Artificial Sequence: Synthetic oligonucleotide
  Target: SCN10A; (+) strand; PAM type: NRG; PAM sequence: CAG
actggcaggtcctgattatg

SEQ ID NO: 33237 - DNA, 20 bp, Artificial Sequence
  Description of Artificial Sequence: Synthetic oligonucleotide
  Target: SCN10A; (+) strand; PAM type: NRG; PAM sequence: GAG
agaactttgtacaccatcat

SEQ ID NO: 33238 - DNA, 20 bp, Artificial Sequence
  Description of Artificial Sequence: Synthetic oligonucleotide
  Target: SCN10A; (+) strand; PAM type: NRG; PAM sequence: AGG
gaactttgtacaccatcatg

SEQ ID NO: 33239 - DNA, 20 bp, Artificial Sequence
  Description of Artificial Sequence: Synthetic oligonucleotide
  Target: SCN10A; (+) strand; PAM type: NRG; PAM sequence: GAG
actttgtacaccatcatgag

SEQ ID NO: 33240 - DNA, 20 bp, Artificial Sequence
  Description of Artificial Sequence: Synthetic oligonucleotide
  Target: SCN10A; (+) strand; PAM type: NRG; PAM sequence: TGG
gtacaccatcatgaggagtc

SEQ ID NO: 33241 - DNA, 20 bp, Artificial Sequence
  Description of Artificial Sequence: Synthetic oligonucleotide
  Target: SCN10A; (+) strand; PAM type: NRG; PAM sequence: CAG
aggagtctggattttattct

SEQ ID NO: 33242 - DNA, 20 bp, Artificial Sequence
  Description of Artificial Sequence: Synthetic oligonucleotide
  Target: SCN10A; (+) strand; PAM type: NRG; PAM sequence: GAG
gagtctggattttattctca

SEQ ID NO: 33243 - DNA, 20 bp, Artificial Sequence
  Description of Artificial Sequence: Synthetic oligonucleotide
  Target: SCN10A; (+) strand; PAM type: NRG; PAM sequence: TGG
ggattttattctcagagcaa

SEQ ID NO: 33244 - DNA, 20 bp, Artificial Sequence
  Description of Artificial Sequence: Synthetic oligonucleotide
  Target: SCN10A; (+) strand; PAM type: NRG; PAM sequence: GGG
gattttattctcagagcaat

SEQ ID NO: 33245 - DNA, 20 bp, Artificial Sequence
  Description of Artificial Sequence: Synthetic oligonucleotide
  Target: SCN10A; (+) strand; PAM type: NRG; PAM sequence: CAG
ttctcagagcaatgggaaac

SEQ ID NO: 33246 - DNA, 20 bp, Artificial Sequence
  Description of Artificial Sequence: Synthetic oligonucleotide
  Target: SCN10A; (+) strand; PAM type: NRG; PAM sequence: AAG
agagcaatgggaaaccagtg

SEQ ID NO: 33247 - DNA, 20 bp, Artificial Sequence
  Description of Artificial Sequence: Synthetic oligonucleotide
  Target: SCN10A; (+) strand; PAM type: NRG; PAM sequence: TAG
gaagttatttgtaacaaatg

SEQ ID NO: 33248 - DNA, 20 bp, Artificial Sequence
  Description of Artificial Sequence: Synthetic oligonucleotide
  Target: SCN10A; (+) strand; PAM type: NRG; PAM sequence: AGG
aagttatttgtaacaaatgt

SEQ ID NO: 33249 - DNA, 20 bp, Artificial Sequence
  Description of Artificial Sequence: Synthetic oligonucleotide
  Target: SCN10A; (+) strand; PAM type: NRG; PAM sequence: AAG
acaaatgtaggtactaacat

SEQ ID NO: 33250 - DNA, 20 bp, Artificial Sequence
  Description of Artificial Sequence: Synthetic oligonucleotide
  Target: SCN10A; (+) strand; PAM type: NRG; PAM sequence: TGG
taggtactaacataagatgt

SEQ ID NO: 33251 - DNA, 20 bp, Artificial Sequence
  Description of Artificial Sequence: Synthetic oligonucleotide
  Target: SCN10A; (+) strand; PAM type: NRG; PAM sequence: TAG
ctaacataagatgttggtaa

SEQ ID NO: 33252 - DNA, 20 bp, Artificial Sequence
  Description of Artificial Sequence: Synthetic oligonucleotide
  Target: SCN10A; (+) strand; PAM type: NRG; PAM sequence: AGG
taacataagatgttggtaat

SEQ ID NO: 33253 - DNA, 20 bp, Artificial Sequence
  Description of Artificial Sequence: Synthetic oligonucleotide
  Target: SCN10A; (+) strand; PAM type: NRG; PAM sequence: GGG
aacataagatgttggtaata

SEQ ID NO: 33254 - DNA, 20 bp, Artificial Sequence
  Description of Artificial Sequence: Synthetic oligonucleotide
  Target: SCN10A; (+) strand; PAM type: NRG; PAM sequence: TGG
gtgtgtgtgtgtgtgtgttg

SEQ ID NO: 33255 - DNA, 20 bp, Artificial Sequence
  Description of Artificial Sequence: Synthetic oligonucleotide
  Target: SCN10A; (+) strand; PAM type: NRG; PAM sequence: GGG
tgtgtgtgtgtgtgtgttgt

SEQ ID NO: 33256 - DNA, 20 bp, Artificial Sequence
  Description of Artificial Sequence: Synthetic oligonucleotide
  Target: SCN10A; (+) strand; PAM type: NRG; PAM sequence: TGG
tgtgtgtgttgtgggattga

SEQ ID NO: 33257 - DNA, 20 bp, Artificial Sequence
  Description of Artificial Sequence: Synthetic oligonucleotide
  Target: SCN10A; (+) strand; PAM type: NRG; PAM sequence: AAG
gtgggattgatggtatatga

SEQ ID NO: 33258 - DNA, 20 bp, Artificial Sequence
  Description of Artificial Sequence: Synthetic oligonucleotide
  Target: SCN10A; (+) strand; PAM type: NRG; PAM sequence: CAG
gctttctgttcaatctgctc

SEQ ID NO: 33259 - DNA, 20 bp, Artificial Sequence
  Description of Artificial Sequence: Synthetic oligonucleotide
  Target: SCN10A; (+) strand; PAM type: NRG; PAM sequence: AAG
tgaaaactgtcctgaaaata

SEQ ID NO: 33260 - DNA, 20 bp, Artificial Sequence
  Description of Artificial Sequence: Synthetic oligonucleotide
  Target: SCN10A; (+) strand; PAM type: NRG; PAM sequence: CAG
taaagtctattaattaaaac

SEQ ID NO: 33261 - DNA, 20 bp, Artificial Sequence
  Description of Artificial Sequence: Synthetic oligonucleotide
  Target: SCN10A; (+) strand; PAM type: NRG; PAM sequence: AGG
aaagtctattaattaaaacc

SEQ ID NO: 33262 - DNA, 20 bp, Artificial Sequence
  Description of Artificial Sequence: Synthetic oligonucleotide
  Target: SCN10A; (+) strand; PAM type: NRG; PAM sequence: CAG
attaaaaccaggaaactgac

SEQ ID NO: 33263 - DNA, 20 bp, Artificial Sequence
  Description of Artificial Sequence: Synthetic oligonucleotide
  Target: SCN10A; (+) strand; PAM type: NRG; PAM sequence: TGG
aaaccaggaaactgaccagc

SEQ ID NO: 33264 - DNA, 20 bp, Artificial Sequence
  Description of Artificial Sequence: Synthetic oligonucleotide
  Target: SCN10A; (+) strand; PAM type: NRG; PAM sequence: CGG
ccaggaaactgaccagctgg

SEQ ID NO: 33265 - DNA, 20 bp, Artificial Sequence
  Description of Artificial Sequence: Synthetic oligonucleotide
  Target: SCN10A; (+) strand; PAM type: NRG; PAM sequence: CAG
agctggcggtgatttttctc

SEQ ID NO: 33266 - DNA, 20 bp, Artificial Sequence
  Description of Artificial Sequence: Synthetic oligonucleotide
  Target: SCN10A; (+) strand; PAM type: NRG; PAM sequence: CAG
tttttctccagcatttctca

SEQ ID NO: 33267 - DNA, 20 bp, Artificial Sequence
  Description of Artificial Sequence: Synthetic oligonucleotide
  Target: SCN10A; (+) strand; PAM type: NRG; PAM sequence: CAG
ctccagcatttctcacagct

SEQ ID NO: 33268 - DNA, 20 bp, Artificial Sequence
  Description of Artificial Sequence: Synthetic oligonucleotide
  Target: SCN10A; (+) strand; PAM type: NRG; PAM sequence: AGG
tccagcatttctcacagctc

SEQ ID NO: 33269 - DNA, 20 bp, Artificial Sequence
  Description of Artificial Sequence: Synthetic oligonucleotide
  Target: SCN10A; (+) strand; PAM type: NRG; PAM sequence: CAG
catttctcacagctcaggtg

SEQ ID NO: 33270 - DNA, 20 bp, Artificial Sequence
  Description of Artificial Sequence: Synthetic oligonucleotide
  Target: SCN10A; (+) strand; PAM type: NRG; PAM sequence: AAG
ctcacagctcaggtgcagac

SEQ ID NO: 33271 - DNA, 20 bp, Artificial Sequence
  Description of Artificial Sequence: Synthetic oligonucleotide
  Target: SCN10A; (+) strand; PAM type: NRG; PAM sequence: AGG
tcacagctcaggtgcagaca

SEQ ID NO: 33272 - DNA, 20 bp, Artificial Sequence
  Description of Artificial Sequence: Synthetic oligonucleotide
  Target: SCN10A; (+) strand; PAM type: NRG; PAM sequence: TGG
cagctcaggtgcagacaagg

SEQ ID NO: 33273 - DNA, 20 bp, Artificial Sequence
  Description of Artificial Sequence: Synthetic oligonucleotide
  Target: SCN10A; (+) strand; PAM type: NRG; PAM sequence: GAG
gctcaggtgcagacaaggtg

SEQ ID NO: 33274 - DNA, 20 bp, Artificial Sequence
  Description of Artificial Sequence: Synthetic oligonucleotide
  Target: SCN10A; (+) strand; PAM type: NRG; PAM sequence: GAG
tcaggtgcagacaaggtgga

SEQ ID NO: 33275 - DNA, 20 bp, Artificial Sequence
  Description of Artificial Sequence: Synthetic oligonucleotide
  Target: SCN10A; (+) strand; PAM type: NRG; PAM sequence: TAG
gtggagagaaatatttgact

SEQ ID NO: 33276 - DNA, 20 bp, Artificial Sequence
  Description of Artificial Sequence: Synthetic oligonucleotide
  Target: SCN10A; (+) strand; PAM type: NRG; PAM sequence: CGG
aatatttgacttagactctc

SEQ ID NO: 33277 - DNA, 20 bp, Artificial Sequence
  Description of Artificial Sequence: Synthetic oligonucleotide
  Target: SCN10A; (+) strand; PAM type: NRG; PAM sequence: GAG
tttgacttagactctccggt

SEQ ID NO: 33278 - DNA, 20 bp, Artificial Sequence
  Description of Artificial Sequence: Synthetic oligonucleotide
  Target: SCN10A; (+) strand; PAM type: NRG; PAM sequence: AGG
ttgacttagactctccggtg

SEQ ID NO: 33279 - DNA, 20 bp, Artificial Sequence
  Description of Artificial Sequence: Synthetic oligonucleotide
  Target: SCN10A; (+) strand; PAM type: NRG; PAM sequence: TGG
tagactctccggtgaggttt

SEQ ID NO: 33280 - DNA, 20 bp, Artificial Sequence
  Description of Artificial Sequence: Synthetic oligonucleotide
  Target: SCN10A; (+) strand; PAM type: NRG; PAM sequence: AAG
ttggcaaacacaaaaacgca

SEQ ID NO: 33281 - DNA, 20 bp, Artificial Sequence
  Description of Artificial Sequence: Synthetic oligonucleotide
  Target: SCN10A; (+) strand; PAM type: NRG; PAM sequence: GAG
ggcaaacacaaaaacgcaaa

SEQ ID NO: 33282 - DNA, 20 bp, Artificial Sequence
  Description of Artificial Sequence: Synthetic oligonucleotide
  Target: SCN10A; (+) strand; PAM type: NRG; PAM sequence: AGG
gcaaacacaaaaacgcaaag

SEQ ID NO: 33283 - DNA, 20 bp, Artificial Sequence
  Description of Artificial Sequence: Synthetic oligonucleotide
  Target: SCN10A; (+) strand; PAM type: NRG; PAM sequence: CAG
aacacaaaaacgcaaagagg

SEQ ID NO: 33284 - DNA, 20 bp, Artificial Sequence
  Description of Artificial Sequence: Synthetic oligonucleotide
  Target: SCN10A; (+) strand; PAM type: NRG; PAM sequence: GAG
cacaaaaacgcaaagaggca

SEQ ID NO: 33285 - DNA, 20 bp, Artificial Sequence
  Description of Artificial Sequence: Synthetic oligonucleotide
  Target: SCN10A; (+) strand; PAM type: NRG; PAM sequence: AGG
acaaaaacgcaaagaggcag

SEQ ID NO: 33286 - DNA, 20 bp, Artificial Sequence
  Description of Artificial Sequence: Synthetic oligonucleotide
  Target: SCN10A; (+) strand; PAM type: NRG; PAM sequence: GGG
caaaaacgcaaagaggcaga

SEQ ID NO: 33287 - DNA, 20 bp, Artificial Sequence
  Description of Artificial Sequence: Synthetic oligonucleotide
  Target: SCN10A; (+) strand; PAM type: NRG; PAM sequence: AAG
acgcaaagaggcagagggaa

SEQ ID NO: 33288 - DNA, 20 bp, Artificial Sequence
  Description of Artificial Sequence: Synthetic oligonucleotide
  Target: SCN10A; (+) strand; PAM type: NRG; PAM sequence: AGG
cgcaaagaggcagagggaaa

SEQ ID NO: 33289 - DNA, 20 bp, Artificial Sequence
  Description of Artificial Sequence: Synthetic oligonucleotide
  Target: SCN10A; (+) strand; PAM type: NRG; PAM sequence: GAG
ggcagagggaaaaggtgatt

SEQ ID NO: 33290 - DNA, 20 bp, Artificial Sequence
  Description of Artificial Sequence: Synthetic oligonucleotide
  Target: SCN10A; (+) strand; PAM type: NRG; PAM sequence: AAG
aggtgattgagtttgttttc

SEQ ID NO: 33291 - DNA, 20 bp, Artificial Sequence
  Description of Artificial Sequence: Synthetic oligonucleotide
  Target: SCN10A; (+) strand; PAM type: NRG; PAM sequence: AGG
ggtgattgagtttgttttca

SEQ ID NO: 33292 - DNA, 20 bp, Artificial Sequence
  Description of Artificial Sequence: Synthetic oligonucleotide
  Target: SCN10A; (+) strand; PAM type: NRG; PAM sequence: GGG
gtgattgagtttgttttcaa

SEQ ID NO: 33293 - DNA, 20 bp, Artificial Sequence
  Description of Artificial Sequence: Synthetic oligonucleotide
  Target: SCN10A; (+) strand; PAM type: NRG; PAM sequence: TGG
tttcaagggcataataatat

SEQ ID NO: 33294 - DNA, 20 bp, Artificial Sequence
  Description of Artificial Sequence: Synthetic oligonucleotide
  Target: SCN10A; (+) strand; PAM type: NRG; PAM sequence: TGG
caagggcataataatattgg

SEQ ID NO: 33295 - DNA, 20 bp, Artificial Sequence
  Description of Artificial Sequence: Synthetic oligonucleotide
  Target: SCN10A; (+) strand; PAM type: NRG; PAM sequence: GGG
aagggcataataatattggt

SEQ ID NO: 33296 - DNA, 20 bp, Artificial Sequence
  Description of Artificial Sequence: Synthetic oligonucleotide
  Target: SCN10A; (+) strand; PAM type: NRG; PAM sequence: AAG
attggtgggctgtgaaatct

SEQ ID NO: 33297 - DNA, 20 bp, Artificial Sequence
  Description of Artificial Sequence: Synthetic oligonucleotide
  Target: SCN10A; (+) strand; PAM type: NRG; PAM sequence: TAG
gtgggctgtgaaatctaagc

SEQ ID NO: 33298 - DNA, 20 bp, Artificial Sequence
  Description of Artificial Sequence: Synthetic oligonucleotide
  Target: SCN10A; (+) strand; PAM type: NRG; PAM sequence: AGG
tgggctgtgaaatctaagct

SEQ ID NO: 33299 - DNA, 20 bp, Artificial Sequence
  Description of Artificial Sequence: Synthetic oligonucleotide
  Target: SCN10A; (+) strand; PAM type: NRG; PAM sequence: GAG
tgaaatctaagctaggtcat

SEQ ID NO: 33300 - DNA, 20 bp, Artificial Sequence
  Description of Artificial Sequence: Synthetic oligonucleotide
  Target: SCN10A; (+) strand; PAM type: NRG; PAM sequence: AGG
gaaatctaagctaggtcatg

SEQ ID NO: 33301 - DNA, 20 bp, Artificial Sequence
  Description of Artificial Sequence: Synthetic oligonucleotide
  Target: SCN10A; (+) strand; PAM type: NRG; PAM sequence: GGG
aaatctaagctaggtcatga

SEQ ID NO: 33302 - DNA, 20 bp, Artificial Sequence
  Description of Artificial Sequence: Synthetic oligonucleotide
  Target: SCN10A; (+) strand; PAM type: NRG; PAM sequence: AAG
tctaagctaggtcatgaggg

SEQ ID NO: 33303 - DNA, 20 bp, Artificial Sequence
  Description of Artificial Sequence: Synthetic oligonucleotide
  Target: SCN10A; (+) strand; PAM type: NRG; PAM sequence: TGG
aagctaggtcatgagggaag

SEQ ID NO: 33304 - DNA, 20 bp, Artificial Sequence
  Description of Artificial Sequence: Synthetic oligonucleotide
  Target: SCN10A; (+) strand; PAM type: NRG; PAM sequence: TAG
aggtcatgagggaagtggaa

SEQ ID NO: 33305 - DNA, 20 bp, Artificial Sequence
  Description of Artificial Sequence: Synthetic oligonucleotide
  Target: SCN10A; (+) strand; PAM type: NRG; PAM sequence: AAG
agggaagtggaatagatccc

SEQ ID NO: 33306 - DNA, 20 bp, Artificial Sequence
  Description of Artificial Sequence: Synthetic oligonucleotide
  Target: SCN10A; (+) strand; PAM type: NRG; PAM sequence: AAG
aagtggaatagatcccaaga

SEQ ID NO: 33307 - DNA, 20 bp, Artificial Sequence
  Description of Artificial Sequence: Synthetic oligonucleotide
  Target: SCN10A; (+) strand; PAM type: NRG; PAM sequence: TAG
atagatcccaagaaagtgtg

SEQ ID NO: 33308 - DNA, 20 bp, Artificial Sequence
  Description of Artificial Sequence: Synthetic oligonucleotide
  Target: SCN10A; (+) strand; PAM type: NRG; PAM sequence: TGG
atcccaagaaagtgtgtagt

SEQ ID NO: 33309 - DNA, 20 bp, Artificial Sequence
  Description of Artificial Sequence: Synthetic oligonucleotide
  Target: SCN10A; (+) strand; PAM type: NRG; PAM sequence: TGG
ccaagaaagtgtgtagttgg

SEQ ID NO: 33310 - DNA, 20 bp, Artificial Sequence
  Description of Artificial Sequence: Synthetic oligonucleotide
  Target: SCN10A; (+) strand; PAM type: NRG; PAM sequence: GGG
caagaaagtgtgtagttggt

SEQ ID NO: 33311 - DNA, 20 bp, Artificial Sequence
  Description of Artificial Sequence: Synthetic oligonucleotide
  Target: SCN10A; (+) strand; PAM type: NRG; PAM sequence: TGG
aagtgtgtagttggtgggtg

SEQ ID NO: 33312 - DNA, 20 bp, Artificial Sequence
  Description of Artificial Sequence: Synthetic oligonucleotide
  Target: SCN10A; (+) strand; PAM type: NRG; PAM sequence: TAG
gtgtagttggtgggtgtggt

SEQ ID NO: 33313 - DNA, 20 bp, Artificial Sequence
  Description of Artificial Sequence: Synthetic oligonucleotide
  Target: SCN10A; (+) strand; PAM type: NRG; PAM sequence: AGG
tgtagttggtgggtgtggtt

SEQ ID NO: 33314 - DNA, 20 bp, Artificial Sequence
  Description of Artificial Sequence: Synthetic oligonucleotide
  Target: SCN10A; (+) strand; PAM type: NRG; PAM sequence: GGG
gtagttggtgggtgtggtta

SEQ ID NO: 33315 - DNA, 20 bp, Artificial Sequence
  Description of Artificial Sequence: Synthetic oligonucleotide
  Target: SCN10A; (+) strand; PAM type: NRG; PAM sequence: GAG
gtgggtgtggttagggaatt

SEQ ID NO: 33316 - DNA, 20 bp, Artificial Sequence
  Description of Artificial Sequence: Synthetic oligonucleotide
  Target: SCN10A; (+) strand; PAM type: NRG; PAM sequence: CAG
ttagggaattgagcactgat

SEQ ID NO: 33317 - DNA, 20 bp, Artificial Sequence
  Description of Artificial Sequence: Synthetic oligonucleotide
  Target: SCN10A; (+) strand; PAM type: NRG; PAM sequence: CAG
cactgatcagcatgttaaat

SEQ ID NO: 33318 - DNA, 20 bp, Artificial Sequence
  Description of Artificial Sequence: Synthetic oligonucleotide
  Target: SCN10A; (+) strand; PAM type: NRG; PAM sequence: GAG
gatcagcatgttaaatcagc

SEQ ID NO: 33319 - DNA, 20 bp, Artificial Sequence
  Description of Artificial Sequence: Synthetic oligonucleotide
  Target: SCN10A; (+) strand; PAM type: NRG; PAM sequence: AGG
atcagcatgttaaatcagcg

SEQ ID NO: 33320 - DNA, 20 bp, Artificial Sequence
  Description of Artificial Sequence: Synthetic oligonucleotide
  Target: SCN10A; (+) strand; PAM type: NRG; PAM sequence: TGG
agcatgttaaatcagcgagg

SEQ ID NO: 33321 - DNA, 20 bp, Artificial Sequence
  Description of Artificial Sequence: Synthetic oligonucleotide
  Target: SCN10A; (+) strand; PAM type: NRG; PAM sequence: GGG
gcatgttaaatcagcgaggt

SEQ ID NO: 33322 - DNA, 20 bp, Artificial Sequence
  Description of Artificial Sequence: Synthetic oligonucleotide
  Target: SCN10A; (+) strand; PAM type: NRG; PAM sequence: GGG
catgttaaatcagcgaggtg

SEQ ID NO: 33323 - DNA, 20 bp, Artificial Sequence
  Description of Artificial Sequence: Synthetic oligonucleotide
  Target: SCN10A; (+) strand; PAM type: NRG; PAM sequence: CAG
ttaaatcagcgaggtgggga

SEQ ID NO: 33324 - DNA, 20 bp, Artificial Sequence
  Description of Artificial Sequence: Synthetic oligonucleotide
  Target: SCN10A; (+) strand; PAM type: NRG; PAM sequence: AGG
taaatcagcgaggtggggac

SEQ ID NO: 33325 - DNA, 20 bp, Artificial Sequence
  Description of Artificial Sequence: Synthetic oligonucleotide
  Target: SCN10A; (+) strand; PAM type: NRG; PAM sequence: GGG
aaatcagcgaggtggggaca

SEQ ID NO: 33326 - DNA, 20 bp, Artificial Sequence
  Description of Artificial Sequence: Synthetic oligonucleotide
  Target: SCN10A; (+) strand; PAM type: NRG; PAM sequence: TAG
tcagcgaggtggggacaggg

SEQ ID NO: 33327 - DNA, 20 bp, Artificial Sequence
  Description of Artificial Sequence: Synthetic oligonucleotide
  Target: SCN10A; (+) strand; PAM type: NRG; PAM sequence: CAG
gacagggtagcattcccctg

SEQ ID NO: 33328 - DNA, 20 bp, Artificial Sequence
  Description of Artificial Sequence: Synthetic oligonucleotide
  Target: SCN10A; (+) strand; PAM type: NRG; PAM sequence: TAG
cattcccctgcagaatcctg

SEQ ID NO: 33329 - DNA, 20 bp, Artificial Sequence
  Description of Artificial Sequence: Synthetic oligonucleotide
  Target: SCN10A; (+) strand; PAM type: NRG; PAM sequence: AGG
attcccctgcagaatcctgt

SEQ ID NO: 33330 - DNA, 20 bp, Artificial Sequence
  Description of Artificial Sequence: Synthetic oligonucleotide
  Target: SCN10A; (+) strand; PAM type: NRG; PAM sequence: GGG
ttcccctgcagaatcctgta

SEQ ID NO: 33331 - DNA, 20 bp, Artificial Sequence
  Description of Artificial Sequence: Synthetic oligonucleotide
  Target: SCN10A; (+) strand; PAM type: NRG; PAM sequence: GGG
tcccctgcagaatcctgtag

SEQ ID NO: 33332 - DNA, 20 bp, Artificial Sequence
  Description of Artificial Sequence: Synthetic oligonucleotide
  Target: SCN10A; (+) strand; PAM type: NRG; PAM sequence: CAG
cctgcagaatcctgtagggg

SEQ ID NO: 33333 - DNA, 20 bp, Artificial Sequence
  Description of Artificial Sequence: Synthetic oligonucleotide
  Target: SCN10A; (+) strand; PAM type: NRG; PAM sequence: AAG
tcctgtaggggcagactgtg

SEQ ID NO: 33334 - DNA, 20 bp, Artificial Sequence
  Description of Artificial Sequence: Synthetic oligonucleotide
  Target: SCN10A; (+) strand; PAM type: NRG; PAM sequence: TGG
gaagtaaacttgcctatttt

SEQ ID NO: 33335 - DNA, 20 bp, Artificial Sequence
  Description of Artificial Sequence: Synthetic oligonucleotide
  Target: SCN10A; (+) strand; PAM type: NRG; PAM sequence: TGG
cttgcctatttttggttgtt

SEQ ID NO: 33336 - DNA, 20 bp, Artificial Sequence
  Description of Artificial Sequence: Synthetic oligonucleotide
  Target: SCN10A; (+) strand; PAM type: NRG; PAM sequence: GGG
ttgcctatttttggttgttt

SEQ ID NO: 33337 - DNA, 20 bp, Artificial Sequence
  Description of Artificial Sequence: Synthetic oligonucleotide
  Target: SCN10A; (+) strand; PAM type: NRG; PAM sequence: TAG
tttttggttgtttgggactt

SEQ ID NO: 33338 - DNA, 20 bp, Artificial Sequence
  Description of Artificial Sequence: Synthetic oligonucleotide
  Target: SCN10A; (+) strand; PAM type: NRG; PAM sequence: TGG
ttgtttgggactttagactg

SEQ ID NO: 33339 - DNA, 20 bp, Artificial Sequence
  Description of Artificial Sequence: Synthetic oligonucleotide
  Target: SCN10A; (+) strand; PAM type: NRG; PAM sequence: GGG
tgtttgggactttagactgt

SEQ ID NO: 33340 - DNA, 20 bp, Artificial Sequence
  Description of Artificial Sequence: Synthetic oligonucleotide
  Target: SCN10A; (+) strand; PAM type: NRG; PAM sequence: CAG
gggactttagactgtgggat

SEQ ID NO: 33341 - DNA, 20 bp, Artificial Sequence
  Description of Artificial Sequence: Synthetic oligonucleotide
  Target: SCN10A; (+) strand; PAM type: NRG; PAM sequence: AAG
agactgtgggatcagaacaa

SEQ ID NO: 33342 - DNA, 20 bp, Artificial Sequence
  Description of Artificial Sequence: Synthetic oligonucleotide
  Target: SCN10A; (+) strand; PAM type: NRG; PAM sequence: TAG
ctgtgggatcagaacaaaag

SEQ ID NO: 33343 - DNA, 20 bp, Artificial Sequence
  Description of Artificial Sequence: Synthetic oligonucleotide
  Target: SCN10A; (+) strand; PAM type: NRG; PAM sequence: TAG
atcagaacaaaagtagcaca

SEQ ID NO: 33344 - DNA, 20 bp, Artificial Sequence
  Description of Artificial Sequence: Synthetic oligonucleotide
  Target: SCN10A; (+) strand; PAM type: NRG; PAM sequence: AAG
cacatagaccttaaaacact

SEQ ID NO: 33345 - DNA, 20 bp, Artificial Sequence
  Description of Artificial Sequence: Synthetic oligonucleotide
  Target: SCN10A; (+) strand; PAM type: NRG; PAM sequence: AAG
cactaagcttctgcttcccc

SEQ ID NO: 33346 - DNA, 20 bp, Artificial Sequence
  Description of Artificial Sequence: Synthetic oligonucleotide
  Target: SCN10A; (+) strand; PAM type: NRG; PAM sequence: TAG
agcttctgcttccccaagtg

SEQ ID NO: 33347 - DNA, 20 bp, Artificial Sequence
  Description of Artificial Sequence: Synthetic oligonucleotide
  Target: SCN10A; (+) strand; PAM type: NRG; PAM sequence: CAG
ttctgcttccccaagtgtag

SEQ ID NO: 33348 - DNA, 20 bp, Artificial Sequence
  Description of Artificial Sequence: Synthetic oligonucleotide
  Target: SCN10A; (+) strand; PAM type: NRG; PAM sequence: GAG
tttttttttttttttttttt

SEQ ID NO: 33349 - DNA, 20 bp, Artificial Sequence
  Description of Artificial Sequence: Synthetic oligonucleotide
  Target: SCN10A; (+) strand; PAM type: NRG; PAM sequence: CGG
ttttttttttttttttgaga

SEQ ID NO: 33350 - DNA, 20 bp, Artificial Sequence
  Description of Artificial Sequence: Synthetic oligonucleotide
  Target: SCN10A; (+) strand; PAM type: NRG; PAM sequence: GAG
ttttttttttttttgagacg

SEQ ID NO: 33351 - DNA, 20 bp, Artificial Sequence
  Description of Artificial Sequence: Synthetic oligonucleotide
  Target: SCN10A; (+) strand; PAM type: NRG; PAM sequence: TAG
tgagacggagtcccgctgtt

SEQ ID NO: 33352 - DNA, 20 bp, Artificial Sequence
  Description of Artificial Sequence: Synthetic oligonucleotide
  Target: SCN10A; (+) strand; PAM type: NRG; PAM sequence: CAG
cggagtcccgctgtttagcc

SEQ ID NO: 33353 - DNA, 20 bp, Artificial Sequence
  Description of Artificial Sequence: Synthetic oligonucleotide
  Target: SCN10A; (+) strand; PAM type: NRG; PAM sequence: AGG
ggagtcccgctgtttagccc

SEQ ID NO: 33354 - DNA, 20 bp, Artificial Sequence
  Description of Artificial Sequence: Synthetic oligonucleotide
  Target: SCN10A; (+) strand; PAM type: NRG; PAM sequence: CGG
tcccgctgtttagcccaggc

SEQ ID NO: 33355 - DNA, 20 bp, Artificial Sequence
  Description of Artificial Sequence: Synthetic oligonucleotide
  Target: SCN10A; (+) strand; PAM type: NRG; PAM sequence: CAG
gtttagcccaggccggattg

SEQ ID NO: 33356 - DNA, 20 bp, Artificial Sequence
  Description of Artificial Sequence: Synthetic oligonucleotide
  Target: SCN10A; (+) strand; PAM type: NRG; PAM sequence: TGG
tagcccaggccggattgcag

SEQ ID NO: 33357 - DNA, 20 bp, Artificial Sequence
  Description of Artificial Sequence: Synthetic oligonucleotide
  Target: SCN10A; (+) strand; PAM type: NRG; PAM sequence: CGG
ggattgcagtggcgcaatct

SEQ ID NO: 33358 - DNA, 20 bp, Artificial Sequence
  Description of Artificial Sequence: Synthetic oligonucleotide
  Target: SCN10A; (+) strand; PAM type: NRG; PAM sequence: AAG
gcgcaatctcggctcactgt

SEQ ID NO: 33359 - DNA, 20 bp, Artificial Sequence
  Description of Artificial Sequence: Synthetic oligonucleotide
  Target: SCN10A; (+) strand; PAM type: NRG; PAM sequence: CAG
tcactgtaagctccgcctcc

SEQ ID NO: 33360 - DNA, 20 bp, Artificial Sequence
  Description of Artificial Sequence: Synthetic oligonucleotide
  Target: SCN10A; (+) strand; PAM type: NRG; PAM sequence: AGG
cactgtaagctccgcctccc

SEQ ID NO: 33361 - DNA, 20 bp, Artificial Sequence
  Description of Artificial Sequence: Synthetic oligonucleotide
  Target: SCN10A; (+) strand; PAM type: NRG; PAM sequence: CAG
ttcacgccattctcctgcct

SEQ ID NO: 33362 - DNA, 20 bp, Artificial Sequence
  Description of Artificial Sequence: Synthetic oligonucleotide
  Target: SCN10A; (+) strand; PAM type: NRG; PAM sequence: GAG
ttctcctgcctcagcctccc

SEQ ID NO: 33363 - DNA, 20 bp, Artificial Sequence
  Description of Artificial Sequence: Synthetic oligonucleotide
  Target: SCN10A; (+) strand; PAM type: NRG; PAM sequence: TAG
tcctgcctcagcctcccgag

SEQ ID NO: 33364 - DNA, 20 bp, Artificial Sequence
  Description of Artificial Sequence: Synthetic oligonucleotide
  Target: SCN10A; (+) strand; PAM type: NRG; PAM sequence: TGG
gcctcagcctcccgagtagc

SEQ ID NO: 33365 - DNA, 20 bp, Artificial Sequence
  Description of Artificial Sequence: Synthetic oligonucleotide
  Target: SCN10A; (+) strand; PAM type: NRG; PAM sequence: GGG
cctcagcctcccgagtagct

SEQ ID NO: 33366 - DNA, 20 bp, Artificial Sequence
  Description of Artificial Sequence: Synthetic oligonucleotide
  Target: SCN10A; (+) strand; PAM type: NRG; PAM sequence: CAG
ctcccgagtagctgggacta

SEQ ID NO: 33367 - DNA, 20 bp, Artificial Sequence
  Description of Artificial Sequence: Synthetic oligonucleotide
  Target: SCN10A; (+) strand; PAM type: NRG; PAM sequence: AGG
tcccgagtagctgggactac

SEQ ID NO: 33368 - DNA, 20 bp, Artificial Sequence
  Description of Artificial Sequence: Synthetic oligonucleotide
  Target: SCN10A; (+) strand; PAM type: NRG; PAM sequence: CGG
caggcgcccgccaccgtgcc

SEQ ID NO: 33369 - DNA, 20 bp, Artificial Sequence
  Description of Artificial Sequence: Synthetic oligonucleotide
  Target: SCN10A; (+) strand; PAM type: NRG; PAM sequence: TAG
cggctaattttttgtatttt

SEQ ID NO: 33370 - DNA, 20 bp, Artificial Sequence
  Description of Artificial Sequence: Synthetic oligonucleotide
  Target: SCN10A; (+) strand; PAM type: NRG; PAM sequence: TAG
ctaattttttgtatttttag

SEQ ID NO: 33371 - DNA, 20 bp, Artificial Sequence
  Description of Artificial Sequence: Synthetic oligonucleotide
  Target: SCN10A; (+) strand; PAM type: NRG; PAM sequence: GAG
aattttttgtatttttagta

SEQ ID NO: 33372 - DNA, 20 bp, Artificial Sequence
  Description of Artificial Sequence: Synthetic oligonucleotide
  Target: SCN10A; (+) strand; PAM type: NRG; PAM sequence: CGG
ttttgtatttttagtagaga

SEQ ID NO: 33373 - DNA, 20 bp, Artificial Sequence
  Description of Artificial Sequence: Synthetic oligonucleotide
  Target: SCN10A; (+) strand; PAM type: NRG; PAM sequence: GGG
tttgtatttttagtagagac

SEQ ID NO: 33374 - DNA, 20 bp, Artificial Sequence
  Description of Artificial Sequence: Synthetic oligonucleotide
  Target: SCN10A; (+) strand; PAM type: NRG; PAM sequence: GGG
ttgtatttttagtagagacg

SEQ ID NO: 33375 - DNA, 20 bp, Artificial Sequence
  Description of Artificial Sequence: Synthetic oligonucleotide
  Target: SCN10A; (+) strand; PAM type: NRG; PAM sequence: TAG
gagacggggtttcaccgtgt

SEQ ID NO: 33376 - DNA, 20 bp, Artificial Sequence
  Description of Artificial Sequence: Synthetic oligonucleotide
  Target: SCN10A; (+) strand; PAM type: NRG; PAM sequence: AAG
ggggtttcaccgtgttagcc

SEQ ID NO: 33377 - DNA, 20 bp, Artificial Sequence
  Description of Artificial Sequence: Synthetic oligonucleotide
  Target: SCN10A; (+) strand; PAM type: NRG; PAM sequence: TGG
tttcaccgtgttagccaaga

SEQ ID NO: 33378 - DNA, 20 bp, Artificial Sequence
  Description of Artificial Sequence: Synthetic oligonucleotide
  Target: SCN10A; (+) strand; PAM type: NRG; PAM sequence: CGG
accttgtgatccgcctgcct

SEQ ID NO: 33379 - DNA, 20 bp, Artificial Sequence
  Description of Artificial Sequence: Synthetic oligonucleotide
  Target: SCN10A; (+) strand; PAM type: NRG; PAM sequence: AAG
ccgcctgcctcggcctccca

SEQ ID NO: 33380 - DNA, 20 bp, Artificial Sequence
  Description of Artificial Sequence: Synthetic oligonucleotide
  Target: SCN10A; (+) strand; PAM type: NRG; PAM sequence: TGG
gcctcggcctcccaaagtgc

SEQ ID NO: 33381 - DNA, 20 bp, Artificial Sequence
  Description of Artificial Sequence: Synthetic oligonucleotide
  Target: SCN10A; (+) strand; PAM type: NRG; PAM sequence: GGG
cctcggcctcccaaagtgct

SEQ ID NO: 33382 - DNA, 20 bp, Artificial Sequence
  Description of Artificial Sequence: Synthetic oligonucleotide
  Target: SCN10A; (+) strand; PAM type: NRG; PAM sequence: CAG
ctcccaaagtgctgggatta

SEQ ID NO: 33383 - DNA, 20 bp, Artificial Sequence
  Description of Artificial Sequence: Synthetic oligonucleotide
  Target: SCN10A; (+) strand; PAM type: NRG; PAM sequence: AGG
tcccaaagtgctgggattac

SEQ ID NO: 33384 - DNA, 20 bp, Artificial Sequence
  Description of Artificial Sequence: Synthetic oligonucleotide
  Target: SCN10A; (+) strand; PAM type: NRG; PAM sequence: GAG
agtgctgggattacaggcgt

SEQ ID NO: 33385 - DNA, 20 bp, Artificial Sequence
  Description of Artificial Sequence: Synthetic oligonucleotide
  Target: SCN10A; (+) strand; PAM type: NRG; PAM sequence: CAG
caggcgtgagccaccgcgcc

SEQ ID NO: 33386 - DNA, 20 bp, Artificial Sequence
  Description of Artificial Sequence: Synthetic oligonucleotide
  Target: SCN10A; (+) strand; PAM type: NRG; PAM sequence: TAG
cgcccagcctcgtattttat

SEQ ID NO: 33387 - DNA, 20 bp, Artificial Sequence
  Description of Artificial Sequence: Synthetic oligonucleotide
  Target: SCN10A; (+) strand; PAM type: NRG; PAM sequence: TGG
ttttattagaaaactaactg

SEQ ID NO: 33388 - DNA, 20 bp, Artificial Sequence
  Description of Artificial Sequence: Synthetic oligonucleotide
  Target: SCN10A; (+) strand; PAM type: NRG; PAM sequence: GGG
tttattagaaaactaactgt

SEQ ID NO: 33389 - DNA, 20 bp, Artificial Sequence
  Description of Artificial Sequence: Synthetic oligonucleotide
  Target: SCN10A; (+) strand; PAM type: NRG; PAM sequence: CAG
aaaactaactgtgggcctgc

SEQ ID NO: 33390 - DNA, 20 bp, Artificial Sequence
  Description of Artificial Sequence: Synthetic oligonucleotide
  Target: SCN10A; (+) strand; PAM type: NRG; PAM sequence: AGG
aaactaactgtgggcctgcc

SEQ ID NO: 33391 - DNA, 20 bp, Artificial Sequence
  Description of Artificial Sequence: Synthetic oligonucleotide
  Target: SCN10A; (+) strand; PAM type: NRG; PAM sequence: GGG
aactaactgtgggcctgcca

SEQ ID NO: 33392 - DNA, 20 bp, Artificial Sequence
  Description of Artificial Sequence: Synthetic oligonucleotide
  Target: SCN10A; (+) strand; PAM type: NRG; PAM sequence: TGG
actgtgggcctgccagggta

SEQ ID NO: 33393 - DNA, 20 bp, Artificial Sequence
  Description of Artificial Sequence: Synthetic oligonucleotide
  Target: SCN10A; (+) strand; PAM type: NRG; PAM sequence: GGG
ctgtgggcctgccagggtat

SEQ ID NO: 33394 - DNA, 20 bp, Artificial Sequence
  Description of Artificial Sequence: Synthetic oligonucleotide
  Target: SCN10A; (+) strand; PAM type: NRG; PAM sequence: GGG
tgtgggcctgccagggtatg

SEQ ID NO: 33395 - DNA, 20 bp, Artificial Sequence
  Description of Artificial Sequence: Synthetic oligonucleotide
  Target: SCN10A; (+) strand; PAM type: NRG; PAM sequence: GGG
gtgggcctgccagggtatgg

SEQ ID NO: 33396 - DNA, 20 bp, Artificial Sequence
  Description of Artificial Sequence: Synthetic oligonucleotide
  Target: SCN10A; (+) strand; PAM type: NRG; PAM sequence: TAG
gctctcttgacgattgtgca

SEQ ID NO: 33397 - DNA, 20 bp, Artificial Sequence
  Description of Artificial Sequence: Synthetic oligonucleotide
  Target: SCN10A; (+) strand; PAM type: NRG; PAM sequence: AGG
ctctcttgacgattgtgcat

SEQ ID NO: 33398 - DNA, 20 bp, Artificial Sequence
  Description of Artificial Sequence: Synthetic oligonucleotide
  Target: SCN10A; (+) strand; PAM type: NRG; PAM sequence: TAG
aggtaccttatattgaccat

SEQ ID NO: 33399 - DNA, 20 bp, Artificial Sequence
  Description of Artificial Sequence: Synthetic oligonucleotide
  Target: SCN10A; (+) strand; PAM type: NRG; PAM sequence: TAG
ccttatattgaccattagct

SEQ ID NO: 33400 - DNA, 20 bp, Artificial Sequence
  Description of Artificial Sequence: Synthetic oligonucleotide
  Target: SCN10A; (+) strand; PAM type: NRG; PAM sequence: AGG
cttatattgaccattagctt

SEQ ID NO: 33401 - DNA, 20 bp, Artificial Sequence
  Description of Artificial Sequence: Synthetic oligonucleotide
  Target: SCN10A; (+) strand; PAM type: NRG; PAM sequence: GGG
ttatattgaccattagctta

SEQ ID NO: 33402 - DNA, 20 bp, Artificial Sequence
  Description of Artificial Sequence: Synthetic oligonucleotide
  Target: SCN10A; (+) strand; PAM type: NRG; PAM sequence: GGG
tatattgaccattagcttag

SEQ ID NO: 33403 - DNA, 20 bp, Artificial Sequence
  Description of Artificial Sequence: Synthetic oligonucleotide
  Target: SCN10A; (+) strand; PAM type: NRG; PAM sequence: TAG
tacatcttgacatcaatttc

SEQ ID NO: 33404 - DNA, 20 bp, Artificial Sequence
  Description of Artificial Sequence: Synthetic oligonucleotide
  Target: SCN10A; (+) strand; PAM type: NRG; PAM sequence: TAG
gacatcaatttctagatacc

SEQ ID NO: 33405 - DNA, 20 bp, Artificial Sequence
  Description of Artificial Sequence: Synthetic oligonucleotide
  Target: SCN10A; (+) strand; PAM type: NRG; PAM sequence: GAG
catcaatttctagataccta

SEQ ID NO: 33406 - DNA, 20 bp, Artificial Sequence
  Description of Artificial Sequence: Synthetic oligonucleotide
  Target: SCN10A; (+) strand; PAM type: NRG; PAM sequence: AAG
tgatttaattctgaccttgt

SEQ ID NO: 33407 - DNA, 20 bp, Artificial Sequence
  Description of Artificial Sequence: Synthetic oligonucleotide
  Target: SCN10A; (+) strand; PAM type: NRG; PAM sequence: AAG
tctgaccttgtaagattttc

SEQ ID NO: 33408 - DNA, 20 bp, Artificial Sequence
  Description of Artificial Sequence: Synthetic oligonucleotide
  Target: SCN10A; (+) strand; PAM type: NRG; PAM sequence: TGG
cttgtaagattttcaagtta

SEQ ID NO: 33409 - DNA, 20 bp, Artificial Sequence
  Description of Artificial Sequence: Synthetic oligonucleotide
  Target: SCN10A; (+) strand; PAM type: NRG; PAM sequence: AAG
agattttcaagttatggata

SEQ ID NO: 33410 - DNA, 20 bp, Artificial Sequence
  Description of Artificial Sequence: Synthetic oligonucleotide
  Target: SCN10A; (+) strand; PAM type: NRG; PAM sequence: GAG
attttcaagttatggataaa

SEQ ID NO: 33411 - DNA, 20 bp, Artificial Sequence
  Description of Artificial Sequence: Synthetic oligonucleotide
  Target: SCN10A; (+) strand; PAM type: NRG; PAM sequence: CAG
ttatggataaagagtcctac

SEQ ID NO: 33412 - DNA, 20 bp, Artificial Sequence
  Description of Artificial Sequence: Synthetic oligonucleotide
  Target: SCN10A; (+) strand; PAM type: NRG; PAM sequence: AGG
tatggataaagagtcctacc

SEQ ID NO: 33413 - DNA, 20 bp, Artificial Sequence
  Description of Artificial Sequence: Synthetic oligonucleotide
  Target: SCN10A; (+) strand; PAM type: NRG; PAM sequence: TGG
tactctacccttctcctccc

SEQ ID NO: 33414 - DNA, 20 bp, Artificial Sequence
  Description of Artificial Sequence: Synthetic oligonucleotide
  Target: SCN10A; (+) strand; PAM type: NRG; PAM sequence: GGG
actctacccttctcctccct

SEQ ID NO: 33415 - DNA, 20 bp, Artificial Sequence
  Description of Artificial Sequence: Synthetic oligonucleotide
  Target: SCN10A; (+) strand; PAM type: NRG; PAM sequence: TGG
tacccttctcctccctggga

SEQ ID NO: 33416 - DNA, 20 bp, Artificial Sequence
  Description of Artificial Sequence: Synthetic oligonucleotide
  Target: SCN10A; (+) strand; PAM type: NRG; PAM sequence: CAG
tctcctccctgggatggtga

SEQ ID NO: 33417 - DNA, 20 bp, Artificial Sequence
  Description of Artificial Sequence: Synthetic oligonucleotide
  Target: SCN10A; (+) strand; PAM type: NRG; PAM sequence: CAG
tgggatggtgacagtaccat

SEQ ID NO: 33418 - DNA, 20 bp, Artificial Sequence
  Description of Artificial Sequence: Synthetic oligonucleotide
  Target: SCN10A; (+) strand; PAM type: NRG; PAM sequence: TAG
tggtgacagtaccatcagct

SEQ ID NO: 33419 - DNA, 20 bp, Artificial Sequence
  Description of Artificial Sequence: Synthetic oligonucleotide
  Target: SCN10A; (+) strand; PAM type: NRG; PAM sequence: AGG
ggtgacagtaccatcagctt

SEQ ID NO: 33420 - DNA, 20 bp, Artificial Sequence
  Description of Artificial Sequence: Synthetic oligonucleotide
  Target: SCN10A; (+) strand; PAM type: NRG; PAM sequence: CAG
gacagtaccatcagcttagg

SEQ ID NO: 33421 - DNA, 20 bp, Artificial Sequence
  Description of Artificial Sequence: Synthetic oligonucleotide
  Target: SCN10A; (+) strand; PAM type: NRG; PAM sequence: CAG
cttaggcagatgccatcaac

SEQ ID NO: 33422 - DNA, 20 bp, Artificial Sequence
  Description of Artificial Sequence: Synthetic oligonucleotide
  Target: SCN10A; (+) strand; PAM type: NRG; PAM sequence: TGG
tgccatcaaccagcgtttca

SEQ ID NO: 33423 - DNA, 20 bp, Artificial Sequence
  Description of Artificial Sequence: Synthetic oligonucleotide
  Target: SCN10A; (+) strand; PAM type: NRG; PAM sequence: CAG
tcaaccagcgtttcatggca

SEQ ID NO: 33424 - DNA, 20 bp, Artificial Sequence
  Description of Artificial Sequence: Synthetic oligonucleotide
  Target: SCN10A; (+) strand; PAM type: NRG; PAM sequence: CAG
ttcatggcacagctgtgtct

SEQ ID NO: 33425 - DNA, 20 bp, Artificial Sequence
  Description of Artificial Sequence: Synthetic oligonucleotide
  Target: SCN10A; (+) strand; PAM type: NRG; PAM sequence: AGG
tcatggcacagctgtgtctc

SEQ ID NO: 33426 - DNA, 20 bp, Artificial Sequence
  Description of Artificial Sequence: Synthetic oligonucleotide
  Target: SCN10A; (+) strand; PAM type: NRG; PAM sequence: TGG
gtctcaggacatgctttatt

SEQ ID NO: 33427 - DNA, 20 bp, Artificial Sequence
  Description of Artificial Sequence: Synthetic oligonucleotide
  Target: SCN10A; (+) strand; PAM type: NRG; PAM sequence: TAG
gacatgctttatttggtctt

SEQ ID NO: 33428 - DNA, 20 bp, Artificial Sequence
  Description of Artificial Sequence: Synthetic oligonucleotide
  Target: SCN10A; (+) strand; PAM type: NRG; PAM sequence: GAG
catgctttatttggtcttta

SEQ ID NO: 33429 - DNA, 20 bp, Artificial Sequence
  Description of Artificial Sequence: Synthetic oligonucleotide
  Target: SCN10A; (+) strand; PAM type: NRG; PAM sequence: TGG
tttagagtgtttttaaaaac

SEQ ID NO: 33430 - DNA, 20 bp, Artificial Sequence
  Description of Artificial Sequence: Synthetic oligonucleotide
  Target: SCN10A; (+) strand; PAM type: NRG; PAM sequence: TAG
agtgtttttaaaaactggat

SEQ ID NO: 33431 - DNA, 20 bp, Artificial Sequence
  Description of Artificial Sequence: Synthetic oligonucleotide
  Target: SCN10A; (+) strand; PAM type: NRG; PAM sequence: TAG
gtttttaaaaactggattag

SEQ ID NO: 33432 - DNA, 20 bp, Artificial Sequence
  Description of Artificial Sequence: Synthetic oligonucleotide
  Target: SCN10A; (+) strand; PAM type: NRG; PAM sequence: AAG
tggattagtagccaatatta

SEQ ID NO: 33433 - DNA, 20 bp, Artificial Sequence
  Description of Artificial Sequence: Synthetic oligonucleotide
  Target: SCN10A; (+) strand; PAM type: NRG; PAM sequence: TGG
aagacatttgcacaaaaatc

SEQ ID NO: 33434 - DNA, 20 bp, Artificial Sequence
  Description of Artificial Sequence: Synthetic oligonucleotide
  Target: SCN10A; (+) strand; PAM type: NRG; PAM sequence: TGG
atctggatttctgacttttt

SEQ ID NO: 33435 - DNA, 20 bp, Artificial Sequence
  Description of Artificial Sequence: Synthetic oligonucleotide
  Target: SCN10A; (+) strand; PAM type: NRG; PAM sequence: TAG
ttctgacttttttggaaaat

SEQ ID NO: 33436 - DNA, 20 bp, Artificial Sequence
  Description of Artificial Sequence: Synthetic oligonucleotide
  Target: SCN10A; (+) strand; PAM type: NRG; PAM sequence: TGG
attagtaactctgacaataa

SEQ ID NO: 33437 - DNA, 20 bp, Artificial Sequence
  Description of Artificial Sequence: Synthetic oligonucleotide
  Target: SCN10A; (+) strand; PAM type: NRG; PAM sequence: CAG
gtaactctgacaataatgga

SEQ ID NO: 33438 - DNA, 20 bp, Artificial Sequence
  Description of Artificial Sequence: Synthetic oligonucleotide
  Target: SCN10A; (+) strand; PAM type: NRG; PAM sequence: AGG
taactctgacaataatggac

SEQ ID NO: 33439 - DNA, 20 bp, Artificial Sequence
  Description of Artificial Sequence: Synthetic oligonucleotide
  Target: SCN10A; (+) strand; PAM type: NRG; PAM sequence: TAG
tgacaataatggacaggcca

SEQ ID NO: 33440 - DNA, 20 bp, Artificial Sequence
  Description of Artificial Sequence: Synthetic oligonucleotide
  Target: SCN10A; (+) strand; PAM type: NRG; PAM sequence: GAG
ctgtgtctcctttctttttt

SEQ ID NO: 33441 - DNA, 20 bp, Artificial Sequence
  Description of Artificial Sequence: Synthetic oligonucleotide
  Target: SCN10A; (+) strand; PAM type: NRG; PAM sequence: CAG
gtctcctttcttttttgaga

SEQ ID NO: 33442 - DNA, 20 bp, Artificial Sequence
  Description of Artificial Sequence: Synthetic oligonucleotide
  Target: SCN10A; (+) strand; PAM type: NRG; PAM sequence: AGG
tctcctttcttttttgagac

SEQ ID NO: 33443 - DNA, 20 bp, Artificial Sequence
  Description of Artificial Sequence: Synthetic oligonucleotide
  Target: SCN10A; (+) strand; PAM type: NRG; PAM sequence: CAG
caggttcttactctgtctcc

SEQ ID NO: 33444 - DNA, 20 bp, Artificial Sequence
  Description of Artificial Sequence: Synthetic oligonucleotide
  Target: SCN10A; (+) strand; PAM type: NRG; PAM sequence: AGG
aggttcttactctgtctccc

SEQ ID NO: 33445 - DNA, 20 bp, Artificial Sequence
  Description of Artificial Sequence: Synthetic oligonucleotide
  Target: SCN10A; (+) strand; PAM type: NRG; PAM sequence: TGG
tcttactctgtctcccaggc

SEQ ID NO: 33446 - DNA, 20 bp, Artificial Sequence
  Description of Artificial Sequence: Synthetic oligonucleotide
  Target: SCN10A; (+) strand; PAM type: NRG; PAM sequence: GAG
ttactctgtctcccaggctg

SEQ ID NO: 33447 - DNA, 20 bp, Artificial Sequence
  Description of Artificial Sequence: Synthetic oligonucleotide
  Target: SCN10A; (+) strand; PAM type: NRG; PAM sequence: CAG
ctgtctcccaggctggagtg

SEQ ID NO: 33448 - DNA, 20 bp, Artificial Sequence
  Description of Artificial Sequence: Synthetic oligonucleotide
  Target: SCN10A; (+) strand; PAM type: NRG; PAM sequence: TGG
tctcccaggctggagtgcag

SEQ ID NO: 33449 - DNA, 20 bp, Artificial Sequence
  Description of Artificial Sequence: Synthetic oligonucleotide
  Target: SCN10A; (+) strand; PAM type: NRG; PAM sequence: TGG
ggagtgcagtggcacgatca

SEQ ID NO: 33450 - DNA, 20 bp, Artificial Sequence
  Description of Artificial Sequence: Synthetic oligonucleotide
  Target: SCN10A; (+) strand; PAM type: NRG; PAM sequence: CAG
ggcacgatcatggtgcactg

SEQ ID NO: 33451 - DNA, 20 bp, Artificial Sequence
  Description of Artificial Sequence: Synthetic oligonucleotide
  Target: SCN10A; (+) strand; PAM type: NRG; PAM sequence: TGG
cactgcagcctccacctccc

SEQ ID NO: 33452 - DNA, 20 bp, Artificial Sequence
  Description of Artificial Sequence: Synthetic oligonucleotide
  Target: SCN10A; (+) strand; PAM type: NRG; PAM sequence: CAG
agcctccacctccctggtct

SEQ ID NO: 33453 - DNA, 20 bp, Artificial Sequence
  Description of Artificial Sequence: Synthetic oligonucleotide
  Target: SCN10A; (+) strand; PAM type: NRG; PAM sequence: AGG
gcctccacctccctggtctc

SEQ ID NO: 33454 - DNA, 20 bp, Artificial Sequence
  Description of Artificial Sequence: Synthetic oligonucleotide
  Target: SCN10A; (+) strand; PAM type: NRG; PAM sequence: CAG
ctcaggtgatcctcccacct

SEQ ID NO: 33455 - DNA, 20 bp, Artificial Sequence
  Description of Artificial Sequence: Synthetic oligonucleotide
  Target: SCN10A; (+) strand; PAM type: NRG; PAM sequence: GAG
tcctcccacctcagtcttct

SEQ ID NO: 33456 - DNA, 20 bp, Artificial Sequence
  Description of Artificial Sequence: Synthetic oligonucleotide
  Target: SCN10A; (+) strand; PAM type: NRG; PAM sequence: TAG
tcccacctcagtcttctgag

SEQ ID NO: 33457 - DNA, 20 bp, Artificial Sequence
  Description of Artificial Sequence: Synthetic oligonucleotide
  Target: SCN10A; (+) strand; PAM type: NRG; PAM sequence: TAG
acctcagtcttctgagtagc

SEQ ID NO: 33458 - DNA, 20 bp, Artificial Sequence
  Description of Artificial Sequence: Synthetic oligonucleotide
  Target: SCN10A; (+) strand; PAM type: NRG; PAM sequence: AGG
cctcagtcttctgagtagct

SEQ ID NO: 33459 - DNA, 20 bp, Artificial Sequence
  Description of Artificial Sequence: Synthetic oligonucleotide
  Target: SCN10A; (+) strand; PAM type: NRG; PAM sequence: CAG
cttctgagtagctaggataa

SEQ ID NO: 33460 - DNA, 20 bp, Artificial Sequence
  Description of Artificial Sequence: Synthetic oligonucleotide
  Target: SCN10A; (+) strand; PAM type: NRG; PAM sequence: TGG
cagatgtgcaccaccatgcc

SEQ ID NO: 33461 - DNA, 20 bp, Artificial Sequence
  Description of Artificial Sequence: Synthetic oligonucleotide
  Target: SCN10A; (+) strand; PAM type: NRG; PAM sequence: TAG
gctaattttttcattttttg

SEQ ID NO: 33462 - DNA, 20 bp, Artificial Sequence
  Description of Artificial Sequence: Synthetic oligonucleotide
  Target: SCN10A; (+) strand; PAM type: NRG; PAM sequence: GAG
taattttttcattttttgta

SEQ ID NO: 33463 - DNA, 20 bp, Artificial Sequence
  Description of Artificial Sequence: Synthetic oligonucleotide
  Target: SCN10A; (+) strand; PAM type: NRG; PAM sequence: CGG
tttttcattttttgtagaga

SEQ ID NO: 33464 - DNA, 20 bp, Artificial Sequence
  Description of Artificial Sequence: Synthetic oligonucleotide
  Target: SCN10A; (+) strand; PAM type: NRG; PAM sequence: GGG
ttttcattttttgtagagac

SEQ ID NO: 33465 - DNA, 20 bp, Artificial Sequence
  Description of Artificial Sequence: Synthetic oligonucleotide
  Target: SCN10A; (+) strand; PAM type: NRG; PAM sequence: GGG
tttcattttttgtagagacg

SEQ ID NO: 33466 - DNA, 20 bp, Artificial Sequence
  Description of Artificial Sequence: Synthetic oligonucleotide
  Target: SCN10A; (+) strand; PAM type: NRG; PAM sequence: TGG
ccatgttgcccttgaactcc

SEQ ID NO: 33467 - DNA, 20 bp, Artificial Sequence
  Description of Artificial Sequence: Synthetic oligonucleotide
  Target: SCN10A; (+) strand; PAM type: NRG; PAM sequence: GGG
catgttgcccttgaactcct

SEQ ID NO: 33468 - DNA, 20 bp, Artificial Sequence
  Description of Artificial Sequence: Synthetic oligonucleotide
  Target: SCN10A; (+) strand; PAM type: NRG; PAM sequence: AAG
gcccttgaactcctgggctc

SEQ ID NO: 33469 - DNA, 20 bp, Artificial Sequence
  Description of Artificial Sequence: Synthetic oligonucleotide
  Target: SCN10A; (+) strand; PAM type: NRG; PAM sequence: CGG
ctcaagcgatctgcctgcct

SEQ ID NO: 33470 - DNA, 20 bp, Artificial Sequence
  Description of Artificial Sequence: Synthetic oligonucleotide
  Target: SCN10A; (+) strand; PAM type: NRG; PAM sequence: AAG
ctgcctgcctcggcctccca

SEQ ID NO: 33471 - DNA, 20 bp, Artificial Sequence
  Description of Artificial Sequence: Synthetic oligonucleotide
  Target: SCN10A; (+) strand; PAM type: NRG; PAM sequence: TAG
gcctcggcctcccaaagtac

SEQ ID NO: 33472 - DNA, 20 bp, Artificial Sequence
  Description of Artificial Sequence: Synthetic oligonucleotide
  Target: SCN10A; (+) strand; PAM type: NRG; PAM sequence: AGG
cctcggcctcccaaagtact

SEQ ID NO: 33473 - DNA, 20 bp, Artificial Sequence
  Description of Artificial Sequence: Synthetic oligonucleotide
  Target: SCN10A; (+) strand; PAM type: NRG; PAM sequence: CAG
ctcccaaagtactaggatta

SEQ ID NO: 33474 - DNA, 20 bp, Artificial Sequence
  Description of Artificial Sequence: Synthetic oligonucleotide
  Target: SCN10A; (+) strand; PAM type: NRG; PAM sequence: AGG
tcccaaagtactaggattac

SEQ ID NO: 33475 - DNA, 20 bp, Artificial Sequence
  Description of Artificial Sequence: Synthetic oligonucleotide
  Target: SCN10A; (+) strand; PAM type: NRG; PAM sequence: GAG
agtactaggattacaggtgt

SEQ ID NO: 33476 - DNA, 20 bp, Artificial Sequence
  Description of Artificial Sequence: Synthetic oligonucleotide
  Target: SCN10A; (+) strand; PAM type: NRG; PAM sequence: TGG
caggtgtgagccactgcacc

SEQ ID NO: 33477 - DNA, 20 bp, Artificial Sequence
  Description of Artificial Sequence: Synthetic oligonucleotide
  Target: SCN10A; (+) strand; PAM type: NRG; PAM sequence: GAG
tgagccactgcacctggcct

SEQ ID NO: 33478 - DNA, 20 bp, Artificial Sequence
  Description of Artificial Sequence: Synthetic oligonucleotide
  Target: SCN10A; (+) strand; PAM type: NRG; PAM sequence: TGG
ccactgcacctggcctgaga

SEQ ID NO: 33479 - DNA, 20 bp, Artificial Sequence
  Description of Artificial Sequence: Synthetic oligonucleotide
  Target: SCN10A; (+) strand; PAM type: NRG; PAM sequence: CAG
ttctatgtaaacatccctcc

SEQ ID NO: 33480 - DNA, 20 bp, Artificial Sequence
  Description of Artificial Sequence: Synthetic oligonucleotide
  Target: SCN10A; (+) strand; PAM type: NRG; PAM sequence: AGG
tctatgtaaacatccctccc

SEQ ID NO: 33481 - DNA, 20 bp, Artificial Sequence
  Description of Artificial Sequence: Synthetic oligonucleotide
  Target: SCN10A; (+) strand; PAM type: NRG; PAM sequence: GAG
tatgtaaacatccctcccag

SEQ ID NO: 33482 - DNA, 20 bp, Artificial Sequence
  Description of Artificial Sequence: Synthetic oligonucleotide
  Target: SCN10A; (+) strand; PAM type: NRG; PAM sequence: TGG
ccaggagttgtgcactgctt

SEQ ID NO: 33483 - DNA, 20 bp, Artificial Sequence
  Description of Artificial Sequence: Synthetic oligonucleotide
  Target: SCN10A; (+) strand; PAM type: NRG; PAM sequence: GGG
caggagttgtgcactgcttt

SEQ ID NO: 33484 - DNA, 20 bp, Artificial Sequence
  Description of Artificial Sequence: Synthetic oligonucleotide
  Target: SCN10A; (+) strand; PAM type: NRG; PAM sequence: TAG
tgcactgctttgggtctgcc

SEQ ID NO: 33485 - DNA, 20 bp, Artificial Sequence
  Description of Artificial Sequence: Synthetic oligonucleotide
  Target: SCN10A; (+) strand; PAM type: NRG; PAM sequence: AGG
gcactgctttgggtctgcct

SEQ ID NO: 33486 - DNA, 20 bp, Artificial Sequence
  Description of Artificial Sequence: Synthetic oligonucleotide
  Target: SCN10A; (+) strand; PAM type: NRG; PAM sequence: TGG
ttgggtctgcctaggtgaaa

SEQ ID NO: 33487 - DNA, 20 bp, Artificial Sequence
  Description of Artificial Sequence: Synthetic oligonucleotide
  Target: SCN10A; (+) strand; PAM type: NRG; PAM sequence: GAG
gggtctgcctaggtgaaatg

SEQ ID NO: 33488 - DNA, 20 bp, Artificial Sequence
  Description of Artificial Sequence: Synthetic oligonucleotide
  Target: SCN10A; (+) strand; PAM type: NRG; PAM sequence: GAG
tcatctttgcctgtctacct

SEQ ID NO: 33489 - DNA, 20 bp, Artificial Sequence
  Description of Artificial Sequence: Synthetic oligonucleotide
  Target: SCN10A; (+) strand; PAM type: NRG; PAM sequence: AGG
catctttgcctgtctacctg

SEQ ID NO: 33490 - DNA, 20 bp, Artificial Sequence
  Description of Artificial Sequence: Synthetic oligonucleotide
  Target: SCN10A; (+) strand; PAM type: NRG; PAM sequence: CAG
gtctacctgaggcaaatatc

SEQ ID NO: 33491 - DNA, 20 bp, Artificial Sequence
  Description of Artificial Sequence: Synthetic oligonucleotide
  Target: SCN10A; (+) strand; PAM type: NRG; PAM sequence: TGG
cagtgcccacatctcttcca

SEQ ID NO: 33492 - DNA, 20 bp, Artificial Sequence
  Description of Artificial Sequence: Synthetic oligonucleotide
  Target: SCN10A; (+) strand; PAM type: NRG; PAM sequence: TGG
gcccacatctcttccatggc

SEQ ID NO: 33493 - DNA, 20 bp, Artificial Sequence
  Description of Artificial Sequence: Synthetic oligonucleotide
  Target: SCN10A; (+) strand; PAM type: NRG; PAM sequence: TGG
tggctctatgtcactgcaca

SEQ ID NO: 33494 - DNA, 20 bp, Artificial Sequence
  Description of Artificial Sequence: Synthetic oligonucleotide
  Target: SCN10A; (+) strand; PAM type: NRG; PAM sequence: GGG
ggctctatgtcactgcacat

SEQ ID NO: 33495 - DNA, 20 bp, Artificial Sequence
  Description of Artificial Sequence: Synthetic oligonucleotide
  Target: SCN10A; (+) strand; PAM type: NRG; PAM sequence: GAG
gtcactgcacatgggcattt

SEQ ID NO: 33496 - DNA, 20 bp, Artificial Sequence
  Description of Artificial Sequence: Synthetic oligonucleotide
  Target: SCN10A; (+) strand; PAM type: NRG; PAM sequence: CAG
tgagtttgccacccctaatc

SEQ ID NO: 33497 - DNA, 20 bp, Artificial Sequence
  Description of Artificial Sequence: Synthetic oligonucleotide
  Target: SCN10A; (+) strand; PAM type: NRG; PAM sequence: AGG
gagtttgccacccctaatcc

SEQ ID NO: 33498 - DNA, 20 bp, Artificial Sequence
  Description of Artificial Sequence: Synthetic oligonucleotide
  Target: SCN10A; (+) strand; PAM type: NRG; PAM sequence: AAG
acccctaatccaggtacgcc

SEQ ID NO: 33499 - DNA, 20 bp, Artificial Sequence
  Description of Artificial Sequence: Synthetic oligonucleotide
  Target: SCN10A; (+) strand; PAM type: NRG; PAM sequence: CAG
taatccaggtacgccaagtt

SEQ ID NO: 33500 - DNA, 20 bp, Artificial Sequence
  Description of Artificial Sequence: Synthetic oligonucleotide
  Target: SCN10A; (+) strand; PAM type: NRG; PAM sequence: AGG
aatccaggtacgccaagttc

SEQ ID NO: 33501 - DNA, 20 bp, Artificial Sequence
  Description of Artificial Sequence: Synthetic oligonucleotide
  Target: SCN10A; (+) strand; PAM type: NRG; PAM sequence: GGG
atccaggtacgccaagttca

SEQ ID NO: 33502 - DNA, 20 bp, Artificial Sequence
  Description of Artificial Sequence: Synthetic oligonucleotide
  Target: SCN10A; (+) strand; PAM type: NRG; PAM sequence: GGG
tccaggtacgccaagttcag

SEQ ID NO: 33503 - DNA, 20 bp, Artificial Sequence
  Description of Artificial Sequence: Synthetic oligonucleotide
  Target: SCN10A; (+) strand; PAM type: NRG; PAM sequence: CAG
gtacgccaagttcaggggct

SEQ ID NO: 33504 - DNA, 20 bp, Artificial Sequence
  Description of Artificial Sequence: Synthetic oligonucleotide
  Target: SCN10A; (+) strand; PAM type: NRG; PAM sequence: TGG
ggggctcagcactgtctcac

SEQ ID NO: 33505 - DNA, 20 bp, Artificial Sequence
  Description of Artificial Sequence: Synthetic oligonucleotide
  Target: SCN10A; (+) strand; PAM type: NRG; PAM sequence: TAG
tgtctcactggcccctgtga

SEQ ID NO: 33506 - DNA, 20 bp, Artificial Sequence
  Description of Artificial Sequence: Synthetic oligonucleotide
  Target: SCN10A; (+) strand; PAM type: NRG; PAM sequence: AGG
gtctcactggcccctgtgat

SEQ ID NO: 33507 - DNA, 20 bp, Artificial Sequence
  Description of Artificial Sequence: Synthetic oligonucleotide
  Target: SCN10A; (+) strand; PAM type: NRG; PAM sequence: GGG
tctcactggcccctgtgata

SEQ ID NO: 33508 - DNA, 20 bp, Artificial Sequence
  Description of Artificial Sequence: Synthetic oligonucleotide
  Target: SCN10A; (+) strand; PAM type: NRG; PAM sequence: AAG
ggcccctgtgatagggtccc

SEQ ID NO: 33509 - DNA, 20 bp, Artificial Sequence
  Description of Artificial Sequence: Synthetic oligonucleotide
  Target: SCN10A; (+) strand; PAM type: NRG; PAM sequence: CAG
ccctgtgatagggtcccaag

SEQ ID NO: 33510 - DNA, 20 bp, Artificial Sequence
  Description of Artificial Sequence: Synthetic oligonucleotide
  Target: SCN10A; (+) strand; PAM type: NRG; PAM sequence: TAG
ggtcccaagcagatctgtcc

SEQ ID NO: 33511 - DNA, 20 bp, Artificial Sequence
  Description of Artificial Sequence: Synthetic oligonucleotide
  Target: SCN10A; (+) strand; PAM type: NRG; PAM sequence: GAG
tcccaagcagatctgtccta

SEQ ID NO: 33512 - DNA, 20 bp, Artificial Sequence
  Description of Artificial Sequence: Synthetic oligonucleotide
  Target: SCN10A; (+) strand; PAM type: NRG; PAM sequence: TGG
catgcacccccttcaacctc

SEQ ID NO: 33513 - DNA, 20 bp, Artificial Sequence
  Description of Artificial Sequence: Synthetic oligonucleotide
  Target: SCN10A; (+) strand; PAM type: NRG; PAM sequence: CAG
ctctggatgccaacacttgt

SEQ ID NO: 33514 - DNA, 20 bp, Artificial Sequence
  Description of Artificial Sequence: Synthetic oligonucleotide
  Target: SCN10A; (+) strand; PAM type: NRG; PAM sequence: AGG
tctggatgccaacacttgtc

SEQ ID NO: 33515 - DNA, 20 bp, Artificial Sequence
  Description of Artificial Sequence: Synthetic oligonucleotide
  Target: SCN10A; (+) strand; PAM type: NRG; PAM sequence: TGG
gccaacacttgtcaggacct

SEQ ID NO: 33516 - DNA, 20 bp, Artificial Sequence
  Description of Artificial Sequence: Synthetic oligonucleotide
  Target: SCN10A; (+) strand; PAM type: NRG; PAM sequence: GGG
ccaacacttgtcaggacctt

SEQ ID NO: 33517 - DNA, 20 bp, Artificial Sequence
  Description of Artificial Sequence: Synthetic oligonucleotide
  Target: SCN10A; (+) strand; PAM type: NRG; PAM sequence: AAG
acacttgtcaggaccttggg

SEQ ID NO: 33518 - DNA, 20 bp, Artificial Sequence
  Description of Artificial Sequence: Synthetic oligonucleotide
  Target: SCN10A; (+) strand; PAM type: NRG; PAM sequence: TGG
caggaccttgggaagattgt

SEQ ID NO: 33519 - DNA, 20 bp, Artificial Sequence
  Description of Artificial Sequence: Synthetic oligonucleotide
  Target: SCN10A; (+) strand; PAM type: NRG; PAM sequence: AAG
ttgttttgtcacctctcttc

SEQ ID NO: 33520 - DNA, 20 bp, Artificial Sequence
  Description of Artificial Sequence: Synthetic oligonucleotide
  Target: SCN10A; (+) strand; PAM type: NRG; PAM sequence: TAG
ttgtcacctctcttcaagtc

SEQ ID NO: 33521 - DNA, 20 bp, Artificial Sequence
  Description of Artificial Sequence: Synthetic oligonucleotide
  Target: SCN10A; (+) strand; PAM type: NRG; PAM sequence: CAG
cctctcttcaagtctagatg

SEQ ID NO: 33522 - DNA, 20 bp, Artificial Sequence
  Description of Artificial Sequence: Synthetic oligonucleotide
  Target: SCN10A; (+) strand; PAM type: NRG; PAM sequence: AGG
ctctcttcaagtctagatgc

SEQ ID NO: 33523 - DNA, 20 bp, Artificial Sequence
  Description of Artificial Sequence: Synthetic oligonucleotide
  Target: SCN10A; (+) strand; PAM type: NRG; PAM sequence: GGG
tctcttcaagtctagatgca

SEQ ID NO: 33524 - DNA, 20 bp, Artificial Sequence
  Description of Artificial Sequence: Synthetic oligonucleotide
  Target: SCN10A; (+) strand; PAM type: NRG; PAM sequence: CAG
aagtctagatgcagggctcc

SEQ ID NO: 33525 - DNA, 20 bp, Artificial Sequence
  Description of Artificial Sequence: Synthetic oligonucleotide
  Target: SCN10A; (+) strand; PAM type: NRG; PAM sequence: GAG
cagggctcccagttaatact

SEQ ID NO: 33526 - DNA, 20 bp, Artificial Sequence
  Description of Artificial Sequence: Synthetic oligonucleotide
  Target: SCN10A; (+) strand; PAM type: NRG; PAM sequence: GAG
gggctcccagttaatactga

SEQ ID NO: 33527 - DNA, 20 bp, Artificial Sequence
  Description of Artificial Sequence: Synthetic oligonucleotide
  Target: SCN10A; (+) strand; PAM type: NRG; PAM sequence: GAG
gttaatactgagagattcct

SEQ ID NO: 33528 - DNA, 20 bp, Artificial Sequence
  Description of Artificial Sequence: Synthetic oligonucleotide
  Target: SCN10A; (+) strand; PAM type: NRG; PAM sequence: GAG
taatactgagagattcctga

SEQ ID NO: 33529 - DNA, 20 bp, Artificial Sequence
  Description of Artificial Sequence: Synthetic oligonucleotide
  Target: SCN10A; (+) strand; PAM type: NRG; PAM sequence: CAG
tactgagagattcctgagag

SEQ ID NO: 33530 - DNA, 20 bp, Artificial Sequence
  Description of Artificial Sequence: Synthetic oligonucleotide
  Target: SCN10A; (+) strand; PAM type: NRG; PAM sequence: AGG
actgagagattcctgagagc

SEQ ID NO: 33531 - DNA, 20 bp, Artificial Sequence
  Description of Artificial Sequence: Synthetic oligonucleotide
  Target: SCN10A; (+) strand; PAM type: NRG; PAM sequence: CGG
gagagattcctgagagcagg

SEQ ID NO: 33532 - DNA, 20 bp, Artificial Sequence
  Description of Artificial Sequence: Synthetic oligonucleotide
  Target: SCN10A; (+) strand; PAM type: NRG; PAM sequence: AAG
agcaggcggcctgcgctaac

SEQ ID NO: 33533 - DNA, 20 bp, Artificial Sequence
  Description of Artificial Sequence: Synthetic oligonucleotide
  Target: SCN10A; (+) strand; PAM type: NRG; PAM sequence: CAG
aacaagccgtgacatttctt

SEQ ID NO: 33534 - DNA, 20 bp, Artificial Sequence
  Description of Artificial Sequence: Synthetic oligonucleotide
  Target: SCN10A; (+) strand; PAM type: NRG; PAM sequence: AGG
acaagccgtgacatttcttc

SEQ ID NO: 33535 - DNA, 20 bp, Artificial Sequence
  Description of Artificial Sequence: Synthetic oligonucleotide
  Target: SCN10A; (+) strand; PAM type: NRG; PAM sequence: AAG
caggcctctttcctattccc

SEQ ID NO: 33536 - DNA, 20 bp, Artificial Sequence
  Description of Artificial Sequence: Synthetic oligonucleotide
  Target: SCN10A; (+) strand; PAM type: NRG; PAM sequence: GAG
ggcctctttcctattcccaa

SEQ ID NO: 33537 - DNA, 20 bp, Artificial Sequence
  Description of Artificial Sequence: Synthetic oligonucleotide
  Target: SCN10A; (+) strand; PAM type: NRG; PAM sequence: CAG
tctttcctattcccaagagt

SEQ ID NO: 33538 - DNA, 20 bp, Artificial Sequence
  Description of Artificial Sequence: Synthetic oligonucleotide
  Target: SCN10A; (+) strand; PAM type: NRG; PAM sequence: GAG
tcctattcccaagagtcagt

SEQ ID NO: 33539 - DNA, 20 bp, Artificial Sequence
  Description of Artificial Sequence: Synthetic oligonucleotide
  Target: SCN10A; (+) strand; PAM type: NRG; PAM sequence: AAG
ccaagagtcagtgagatgcc

SEQ ID NO: 33540 - DNA, 20 bp, Artificial Sequence
  Description of Artificial Sequence: Synthetic oligonucleotide
  Target: SCN10A; (+) strand; PAM type: NRG; PAM sequence: CAG
gtgagatgccaagcttcctc

SEQ ID NO: 33541 - DNA, 20 bp, Artificial Sequence
  Description of Artificial Sequence: Synthetic oligonucleotide
  Target: SCN10A; (+) strand; PAM type: NRG; PAM sequence: TGG
gatgccaagcttcctccaga

SEQ ID NO: 33542 - DNA, 20 bp, Artificial Sequence
  Description of Artificial Sequence: Synthetic oligonucleotide
  Target: SCN10A; (+) strand; PAM type: NRG; PAM sequence: TGG
caagcttcctccagatggcc

SEQ ID NO: 33543 - DNA, 20 bp, Artificial Sequence
  Description of Artificial Sequence: Synthetic oligonucleotide
  Target: SCN10A; (+) strand; PAM type: NRG; PAM sequence: GAG
agcttcctccagatggcctg

SEQ ID NO: 33544 - DNA, 20 bp, Artificial Sequence
  Description of Artificial Sequence: Synthetic oligonucleotide
  Target: SCN10A; (+) strand; PAM type: NRG; PAM sequence: TAG
ctccagatggcctggagacc

SEQ ID NO: 33545 - DNA, 20 bp, Artificial Sequence
  Description of Artificial Sequence: Synthetic oligonucleotide
  Target: SCN10A; (+) strand; PAM type: NRG; PAM sequence: TGG
acctagtgacccgacactcc

SEQ ID NO: 33546 - DNA, 20 bp, Artificial Sequence
  Description of Artificial Sequence: Synthetic oligonucleotide
  Target: SCN10A; (+) strand; PAM type: NRG; PAM sequence: GGG
cctagtgacccgacactcct

SEQ ID NO: 33547 - DNA, 20 bp, Artificial Sequence
  Description of Artificial Sequence: Synthetic oligonucleotide
  Target: SCN10A; (+) strand; PAM type: NRG; PAM sequence: CAG
cgacactcctgggaatctga

SEQ ID NO: 33548 - DNA, 20 bp, Artificial Sequence
  Description of Artificial Sequence: Synthetic oligonucleotide
  Target: SCN10A; (+) strand; PAM type: NRG; PAM sequence: AGG
gacactcctgggaatctgac

SEQ ID NO: 33549 - DNA, 20 bp, Artificial Sequence
  Description of Artificial Sequence: Synthetic oligonucleotide
  Target: SCN10A; (+) strand; PAM type: NRG; PAM sequence: TGG
tcctgggaatctgacaggtt

SEQ ID NO: 33550 - DNA, 20 bp, Artificial Sequence
  Description of Artificial Sequence: Synthetic oligonucleotide
  Target: SCN10A; (+) strand; PAM type: NRG; PAM sequence: TGG
aggtttggctgacaaacctg

SEQ ID NO: 33551 - DNA, 20 bp, Artificial Sequence
  Description of Artificial Sequence: Synthetic oligonucleotide
  Target: SCN10A; (+) strand; PAM type: NRG; PAM sequence: AAG
caaacctgtggctctgataa

SEQ ID NO: 33552 - DNA, 20 bp, Artificial Sequence
  Description of Artificial Sequence: Synthetic oligonucleotide
  Target: SCN10A; (+) strand; PAM type: NRG; PAM sequence: TGG
acctgtggctctgataaaag

SEQ ID NO: 33553 - DNA, 20 bp, Artificial Sequence
  Description of Artificial Sequence: Synthetic oligonucleotide
  Target: SCN10A; (+) strand; PAM type: NRG; PAM sequence: GGG
cctgtggctctgataaaagt

SEQ ID NO: 33554 - DNA, 20 bp, Artificial Sequence
  Description of Artificial Sequence: Synthetic oligonucleotide
  Target: SCN10A; (+) strand; PAM type: NRG; PAM sequence: TGG
gtggctctgataaaagtggg

SEQ ID NO: 33555 - DNA, 20 bp, Artificial Sequence
  Description of Artificial Sequence: Synthetic oligonucleotide
  Target: SCN10A; (+) strand; PAM type: NRG; PAM sequence: TGG
tgataaaagtgggtggcctg

SEQ ID NO: 33556 - DNA, 20 bp, Artificial Sequence
  Description of Artificial Sequence: Synthetic oligonucleotide
  Target: SCN10A; (+) strand; PAM type: NRG; PAM sequence: TAG
ggcctgtggcacttctcctg

SEQ ID NO: 33557 - DNA, 20 bp, Artificial Sequence
  Description of Artificial Sequence: Synthetic oligonucleotide
  Target: SCN10A; (+) strand; PAM type: NRG; PAM sequence: GAG
cctgtggcacttctcctgta

SEQ ID NO: 33558 - DNA, 20 bp, Artificial Sequence
  Description of Artificial Sequence: Synthetic oligonucleotide
  Target: SCN10A; (+) strand; PAM type: NRG; PAM sequence: AGG
ctgtggcacttctcctgtag

SEQ ID NO: 33559 - DNA, 20 bp, Artificial Sequence
  Description of Artificial Sequence: Synthetic oligonucleotide
  Target: SCN10A; (+) strand; PAM type: NRG; PAM sequence: GGG
tgtggcacttctcctgtaga

SEQ ID NO: 33560 - DNA, 20 bp, Artificial Sequence
  Description of Artificial Sequence: Synthetic oligonucleotide
  Target: SCN10A; (+) strand; PAM type: NRG; PAM sequence: TGG
ttctcctgtagagggcgtcc

SEQ ID NO: 33561 - DNA, 20 bp, Artificial Sequence
  Description of Artificial Sequence: Synthetic oligonucleotide
  Target: SCN10A; (+) strand; PAM type: NRG; PAM sequence: GAG
ctcctgtagagggcgtcctg

SEQ ID NO: 33562 - DNA, 20 bp, Artificial Sequence
  Description of Artificial Sequence: Synthetic oligonucleotide
  Target: SCN10A; (+) strand; PAM type: NRG; PAM sequence: GAG
gtagagggcgtcctggagct

SEQ ID NO: 33563 - DNA, 20 bp, Artificial Sequence
  Description of Artificial Sequence: Synthetic oligonucleotide
  Target: SCN10A; (+) strand; PAM type: NRG; PAM sequence: TAG
gggcgtcctggagctgagtt

SEQ ID NO: 33564 - DNA, 20 bp, Artificial Sequence
  Description of Artificial Sequence: Synthetic oligonucleotide
  Target: SCN10A; (+) strand; PAM type: NRG; PAM sequence: GAG
gcgtcctggagctgagttta

SEQ ID NO: 33565 - DNA, 20 bp, Artificial Sequence
  Description of Artificial Sequence: Synthetic oligonucleotide
  Target: SCN10A; (+) strand; PAM type: NRG; PAM sequence: AAG
tcctggagctgagtttagag

SEQ ID NO: 33566 - DNA, 20 bp, Artificial Sequence
  Description of Artificial Sequence: Synthetic oligonucleotide
  Target: SCN10A; (+) strand; PAM type: NRG; PAM sequence: GAG
ctggagctgagtttagagaa

SEQ ID NO: 33567 - DNA, 20 bp, Artificial Sequence
  Description of Artificial Sequence: Synthetic oligonucleotide
  Target: SCN10A; (+) strand; PAM type: NRG; PAM sequence: GAG
gaagagccatcattgcatgt

SEQ ID NO: 33568 - DNA, 20 bp, Artificial Sequence
  Description of Artificial Sequence: Synthetic oligonucleotide
  Target: SCN10A; (+) strand; PAM type: NRG; PAM sequence: GAG
agccatcattgcatgtgagt

SEQ ID NO: 33569 - DNA, 20 bp, Artificial Sequence
  Description of Artificial Sequence: Synthetic oligonucleotide
  Target: SCN10A; (+) strand; PAM type: NRG; PAM sequence: TAG
ttgcatgtgagtgagactaa

SEQ ID NO: 33570 - DNA, 20 bp, Artificial Sequence
  Description of Artificial Sequence: Synthetic oligonucleotide
  Target: SCN10A; (+) strand; PAM type: NRG; PAM sequence: AGG
tgcatgtgagtgagactaat

SEQ ID NO: 33571 - DNA, 20 bp, Artificial Sequence
  Description of Artificial Sequence: Synthetic oligonucleotide
  Target: SCN10A; (+) strand; PAM type: NRG; PAM sequence: CAG
atgtgagtgagactaatagg

SEQ ID NO: 33572 - DNA, 20 bp, Artificial Sequence
  Description of Artificial Sequence: Synthetic oligonucleotide
  Target: SCN10A; (+) strand; PAM type: NRG; PAM sequence: AGG
tgtgagtgagactaataggc

SEQ ID NO: 33573 - DNA, 20 bp, Artificial Sequence
  Description of Artificial Sequence: Synthetic oligonucleotide
  Target: SCN10A; (+) strand; PAM type: NRG; PAM sequence: AAG
tgagactaataggcaggttg

SEQ ID NO: 33574 - DNA, 20 bp, Artificial Sequence
  Description of Artificial Sequence: Synthetic oligonucleotide
  Target: SCN10A; (+) strand; PAM type: NRG; PAM sequence: AGG
gagactaataggcaggttga

SEQ ID NO: 33575 - DNA, 20 bp, Artificial Sequence
  Description of Artificial Sequence: Synthetic oligonucleotide
  Target: SCN10A; (+) strand; PAM type: NRG; PAM sequence: GAG
taggcaggttgaaggtgctt

SEQ ID NO: 33576 - DNA, 20 bp, Artificial Sequence
  Description of Artificial Sequence: Synthetic oligonucleotide
  Target: SCN10A; (+) strand; PAM type: NRG; PAM sequence: TGG
gttgaaggtgcttgagacat

SEQ ID NO: 33577 - DNA, 20 bp, Artificial Sequence
  Description of Artificial Sequence: Synthetic oligonucleotide
  Target: SCN10A; (+) strand; PAM type: NRG; PAM sequence: GGG
ttgaaggtgcttgagacatt

SEQ ID NO: 33578 - DNA, 20 bp, Artificial Sequence
  Description of Artificial Sequence: Synthetic oligonucleotide
  Target: SCN10A; (+) strand; PAM type: NRG; PAM sequence: GGG
tgaaggtgcttgagacattg

SEQ ID NO: 33579 - DNA, 20 bp, Artificial Sequence
  Description of Artificial Sequence: Synthetic oligonucleotide
  Target: SCN10A; (+) strand; PAM type: NRG; PAM sequence: CGG
agacattggggctgtgattt

SEQ ID NO: 33580 - DNA, 20 bp, Artificial Sequence
  Description of Artificial Sequence: Synthetic oligonucleotide
  Target: SCN10A; (+) strand; PAM type: NRG; PAM sequence: GGG
gacattggggctgtgatttc

SEQ ID NO: 33581 - DNA, 20 bp, Artificial Sequence
  Description of Artificial Sequence: Synthetic oligonucleotide
  Target: SCN10A; (+) strand; PAM type: NRG; PAM sequence: AAG
ggggctgtgatttcgggcac

SEQ ID NO: 33582 - DNA, 20 bp, Artificial Sequence
  Description of Artificial Sequence: Synthetic oligonucleotide
  Target: SCN10A; (+) strand; PAM type: NRG; PAM sequence: AGG
gggctgtgatttcgggcaca

SEQ ID NO: 33583 - DNA, 20 bp, Artificial Sequence
  Description of Artificial Sequence: Synthetic oligonucleotide
  Target: SCN10A; (+) strand; PAM type: NRG; PAM sequence: GGG
ggctgtgatttcgggcacaa

SEQ ID NO: 33584 - DNA, 20 bp, Artificial Sequence
  Description of Artificial Sequence: Synthetic oligonucleotide
  Target: SCN10A; (+) strand; PAM type: NRG; PAM sequence: CAG
gatttcgggcacaagggaat

SEQ ID NO: 33585 - DNA, 20 bp, Artificial Sequence
  Description of Artificial Sequence: Synthetic oligonucleotide
  Target: SCN10A; (+) strand; PAM type: NRG; PAM sequence: GAG
tttcgggcacaagggaatca

SEQ ID NO: 33586 - DNA, 20 bp, Artificial Sequence
  Description of Artificial Sequence: Synthetic oligonucleotide
  Target: SCN10A; (+) strand; PAM type: NRG; PAM sequence: GAG
aatcagagaatgacttcctt

SEQ ID NO: 33587 - DNA, 20 bp, Artificial Sequence
  Description of Artificial Sequence: Synthetic oligonucleotide
  Target: SCN10A; (+) strand; PAM type: NRG; PAM sequence: AGG
atcagagaatgacttccttg

SEQ ID NO: 33588 - DNA, 20 bp, Artificial Sequence
  Description of Artificial Sequence: Synthetic oligonucleotide
  Target: SCN10A; (+) strand; PAM type: NRG; PAM sequence: TGG
gagaatgacttccttgaggc

SEQ ID NO: 33589 - DNA, 20 bp, Artificial Sequence
  Description of Artificial Sequence: Synthetic oligonucleotide
  Target: SCN10A; (+) strand; PAM type: NRG; PAM sequence: AAG
aatgacttccttgaggctgg

SEQ ID NO: 33590 - DNA, 20 bp, Artificial Sequence
  Description of Artificial Sequence: Synthetic oligonucleotide
  Target: SCN10A; (+) strand; PAM type: NRG; PAM sequence: AGG
atgacttccttgaggctgga

SEQ ID NO: 33591 - DNA, 20 bp, Artificial Sequence
  Description of Artificial Sequence: Synthetic oligonucleotide
  Target: SCN10A; (+) strand; PAM type: NRG; PAM sequence: GAG
gacttccttgaggctggaag

SEQ ID NO: 33592 - DNA, 20 bp, Artificial Sequence
  Description of Artificial Sequence: Synthetic oligonucleotide
  Target: SCN10A; (+) strand; PAM type: NRG; PAM sequence: TGG
tccttgaggctggaaggagc

SEQ ID NO: 33593 - DNA, 20 bp, Artificial Sequence
  Description of Artificial Sequence: Synthetic oligonucleotide
  Target: SCN10A; (+) strand; PAM type: NRG; PAM sequence: GGG
ccttgaggctggaaggagct

SEQ ID NO: 33594 - DNA, 20 bp, Artificial Sequence
  Description of Artificial Sequence: Synthetic oligonucleotide
  Target: SCN10A; (+) strand; PAM type: NRG; PAM sequence: GGG
cttgaggctggaaggagctg

SEQ ID NO: 33595 - DNA, 20 bp, Artificial Sequence
  Description of Artificial Sequence: Synthetic oligonucleotide
  Target: SCN10A; (+) strand; PAM type: NRG; PAM sequence: TGG
gctggaaggagctggggctc

SEQ ID NO: 33596 - DNA, 20 bp, Artificial Sequence
  Description of Artificial Sequence: Synthetic oligonucleotide
  Target: SCN10A; (+) strand; PAM type: NRG; PAM sequence: GAG
tggaaggagctggggctctg

SEQ ID NO: 33597 - DNA, 20 bp, Artificial Sequence
  Description of Artificial Sequence: Synthetic oligonucleotide
  Target: SCN10A; (+) strand; PAM type: NRG; PAM sequence: CAG
aggagctggggctctggagt

SEQ ID NO: 33598 - DNA, 20 bp, Artificial Sequence
  Description of Artificial Sequence: Synthetic oligonucleotide
  Target: SCN10A; (+) strand; PAM type: NRG; PAM sequence: TGG
ggctctggagtcagacaacc

SEQ ID NO: 33599 - DNA, 20 bp, Artificial Sequence
  Description of Artificial Sequence: Synthetic oligonucleotide
  Target: SCN10A; (+) strand; PAM type: NRG; PAM sequence: GAG
gagtcagacaacctggattt

SEQ ID NO: 33600 - DNA, 20 bp, Artificial Sequence
  Description of Artificial Sequence: Synthetic oligonucleotide
  Target: SCN10A; (+) strand; PAM type: NRG; PAM sequence: CAG
gacaacctggatttgagatc

SEQ ID NO: 33601 - DNA, 20 bp, Artificial Sequence
  Description of Artificial Sequence: Synthetic oligonucleotide
  Target: SCN10A; (+) strand; PAM type: NRG; PAM sequence: AGG
acaacctggatttgagatcc

SEQ ID NO: 33602 - DNA, 20 bp, Artificial Sequence
  Description of Artificial Sequence: Synthetic oligonucleotide
  Target: SCN10A; (+) strand; PAM type: NRG; PAM sequence: TGG
ggatttgagatccaggtctg

SEQ ID NO: 33603 - DNA, 20 bp, Artificial Sequence
  Description of Artificial Sequence: Synthetic oligonucleotide
  Target: SCN10A; (+) strand; PAM type: NRG; PAM sequence: TGG
ctgtggcttattcgcttgct

SEQ ID NO: 33604 - DNA, 20 bp, Artificial Sequence
  Description of Artificial Sequence: Synthetic oligonucleotide
  Target: SCN10A; (+) strand; PAM type: NRG; PAM sequence: CAG
tggcttattcgcttgcttgg

SEQ ID NO: 33605 - DNA, 20 bp, Artificial Sequence
  Description of Artificial Sequence: Synthetic oligonucleotide
  Target: SCN10A; (+) strand; PAM type: NRG; PAM sequence: TGG
ttattcgcttgcttggcaga

SEQ ID NO: 33606 - DNA, 20 bp, Artificial Sequence
  Description of Artificial Sequence: Synthetic oligonucleotide
  Target: SCN10A; (+) strand; PAM type: NRG; PAM sequence: GGG
tattcgcttgcttggcagat

SEQ ID NO: 33607 - DNA, 20 bp, Artificial Sequence
  Description of Artificial Sequence: Synthetic oligonucleotide
  Target: SCN10A; (+) strand; PAM type: NRG; PAM sequence: GAG
ttcgcttgcttggcagatgg

SEQ ID NO: 33608 - DNA, 20 bp, Artificial Sequence
  Description of Artificial Sequence: Synthetic oligonucleotide
  Target: SCN10A; (+) strand; PAM type: NRG; PAM sequence: CGG
cttggcagatgggagacttt

SEQ ID NO: 33609 - DNA, 20 bp, Artificial Sequence
  Description of Artificial Sequence: Synthetic oligonucleotide
  Target: SCN10A; (+) strand; PAM type: NRG; PAM sequence: GGG
ttggcagatgggagactttc

SEQ ID NO: 33610 - DNA, 20 bp, Artificial Sequence
  Description of Artificial Sequence: Synthetic oligonucleotide
  Target: SCN10A; (+) strand; PAM type: NRG; PAM sequence: TGG
gggagactttcgggtcatca

SEQ ID NO: 33611 - DNA, 20 bp, Artificial Sequence
  Description of Artificial Sequence: Synthetic oligonucleotide
  Target: SCN10A; (+) strand; PAM type: NRG; PAM sequence: GAG
ctttttcctcacccacccct

SEQ ID NO: 33612 - DNA, 20 bp, Artificial Sequence
  Description of Artificial Sequence: Synthetic oligonucleotide
  Target: SCN10A; (+) strand; PAM type: NRG; PAM sequence: AGG
tttttcctcacccacccctg

SEQ ID NO: 33613 - DNA, 20 bp, Artificial Sequence
  Description of Artificial Sequence: Synthetic oligonucleotide
  Target: SCN10A; (+) strand; PAM type: NRG; PAM sequence: CAG
tcttaaaaacgactatctct

SEQ ID NO: 33614 - DNA, 20 bp, Artificial Sequence
  Description of Artificial Sequence: Synthetic oligonucleotide
  Target: SCN10A; (+) strand; PAM type: NRG; PAM sequence: AGG
cttaaaaacgactatctctc

SEQ ID NO: 33615 - DNA, 20 bp, Artificial Sequence
  Description of Artificial Sequence: Synthetic oligonucleotide
  Target: SCN10A; (+) strand; PAM type: NRG; PAM sequence: GGG
ttaaaaacgactatctctca

SEQ ID NO: 33616 - DNA, 20 bp, Artificial Sequence
  Description of Artificial Sequence: Synthetic oligonucleotide
  Target: SCN10A; (+) strand; PAM type: NRG; PAM sequence: GAG
ctatctctcagggttgttgt

SEQ ID NO: 33617 - DNA, 20 bp, Artificial Sequence
  Description of Artificial Sequence: Synthetic oligonucleotide
  Target: SCN10A; (+) strand; PAM type: NRG; PAM sequence: GAG
ggttgttgtgagcataaaat

SEQ ID NO: 33618 - DNA, 20 bp, Artificial Sequence
  Description of Artificial Sequence: Synthetic oligonucleotide
  Target: SCN10A; (+) strand; PAM type: NRG; PAM sequence: AGG
gttgttgtgagcataaaatg

SEQ ID NO: 33619 - DNA, 20 bp, Artificial Sequence
  Description of Artificial Sequence: Synthetic oligonucleotide
  Target: SCN10A; (+) strand; PAM type: NRG; PAM sequence: AAG
aaaatgaggtgcgttttttc

SEQ ID NO: 33620 - DNA, 20 bp, Artificial Sequence
  Description of Artificial Sequence: Synthetic oligonucleotide
  Target: SCN10A; (+) strand; PAM type: NRG; PAM sequence: CAG
ggtgcgttttttcaagtgtc

SEQ ID NO: 33621 - DNA, 20 bp, Artificial Sequence
  Description of Artificial Sequence: Synthetic oligonucleotide
  Target: SCN10A; (+) strand; PAM type: NRG; PAM sequence: AAG
tgctatgcctgacacattgt

SEQ ID NO: 33622 - DNA, 20 bp, Artificial Sequence
  Description of Artificial Sequence: Synthetic oligonucleotide
  Target: SCN10A; (+) strand; PAM type: NRG; PAM sequence: CAG
cctgacacattgtaagtgct

SEQ ID NO: 33623 - DNA, 20 bp, Artificial Sequence
  Description of Artificial Sequence: Synthetic oligonucleotide
  Target: SCN10A; (+) strand; PAM type: NRG; PAM sequence: AAG
acacattgtaagtgctcagt

SEQ ID NO: 33624 - DNA, 20 bp, Artificial Sequence
  Description of Artificial Sequence: Synthetic oligonucleotide
  Target: SCN10A; (+) strand; PAM type: NRG; PAM sequence: TAG
tgtaagtgctcagtaagtat

SEQ ID NO: 33625 - DNA, 20 bp, Artificial Sequence
  Description of Artificial Sequence: Synthetic oligonucleotide
  Target: SCN10A; (+) strand; PAM type: NRG; PAM sequence: AAG
tgctgttattgttatttgat

SEQ ID NO: 33626 - DNA, 20 bp, Artificial Sequence
  Description of Artificial Sequence: Synthetic oligonucleotide
  Target: SCN10A; (+) strand; PAM type: NRG; PAM sequence: GAG
ctgttattgttatttgataa

SEQ ID NO: 33627 - DNA, 20 bp, Artificial Sequence
  Description of Artificial Sequence: Synthetic oligonucleotide
  Target: SCN10A; (+) strand; PAM type: NRG; PAM sequence: GAG
attgttatttgataagagac

SEQ ID NO: 33628 - DNA, 20 bp, Artificial Sequence
  Description of Artificial Sequence: Synthetic oligonucleotide
  Target: SCN10A; (+) strand; PAM type: NRG; PAM sequence: AGG
ttgttatttgataagagacg

SEQ ID NO: 33629 - DNA, 20 bp, Artificial Sequence
  Description of Artificial Sequence: Synthetic oligonucleotide
  Target: SCN10A; (+) strand; PAM type: NRG; PAM sequence: CAG
tatttgataagagacgagga

SEQ ID NO: 33630 - DNA, 20 bp, Artificial Sequence
  Description of Artificial Sequence: Synthetic oligonucleotide
  Target: SCN10A; (+) strand; PAM type: NRG; PAM sequence: TGG
taagagacgaggacagtgct

SEQ ID NO: 33631 - DNA, 20 bp, Artificial Sequence
  Description of Artificial Sequence: Synthetic oligonucleotide
  Target: SCN10A; (+) strand; PAM type: NRG; PAM sequence: AAG
gagacgaggacagtgcttgg

SEQ ID NO: 33632 - DNA, 20 bp, Artificial Sequence
  Description of Artificial Sequence: Synthetic oligonucleotide
  Target: SCN10A; (+) strand; PAM type: NRG; PAM sequence: TGG
agtgcttggaagtcccctct

SEQ ID NO: 33633 - DNA, 20 bp, Artificial Sequence
  Description of Artificial Sequence: Synthetic oligonucleotide
  Target: SCN10A; (+) strand; PAM type: NRG; PAM sequence: CAG
ttggaagtcccctcttggtg

SEQ ID NO: 33634 - DNA, 20 bp, Artificial Sequence
  Description of Artificial Sequence: Synthetic oligonucleotide
  Target: SCN10A; (+) strand; PAM type: NRG; PAM sequence: AAG
agtcccctcttggtgcagat

SEQ ID NO: 33635 - DNA, 20 bp, Artificial Sequence
  Description of Artificial Sequence: Synthetic oligonucleotide
  Target: SCN10A; (+) strand; PAM type: NRG; PAM sequence: AGG
gtcccctcttggtgcagata

SEQ ID NO: 33636 - DNA, 20 bp, Artificial Sequence
  Description of Artificial Sequence: Synthetic oligonucleotide
  Target: SCN10A; (+) strand; PAM type: NRG; PAM sequence: GGG
tcccctcttggtgcagataa

SEQ ID NO: 33637 - DNA, 20 bp, Artificial Sequence
  Description of Artificial Sequence: Synthetic oligonucleotide
  Target: SCN10A; (+) strand; PAM type: NRG; PAM sequence: GAG
ccctcttggtgcagataagg

SEQ ID NO: 33638 - DNA, 20 bp, Artificial Sequence
  Description of Artificial Sequence: Synthetic oligonucleotide
  Target: SCN10A; (+) strand; PAM type: NRG; PAM sequence: AAG
ttggtgcagataagggagcc

SEQ ID NO: 33639 - DNA, 20 bp, Artificial Sequence
  Description of Artificial Sequence: Synthetic oligonucleotide
  Target: SCN10A; (+) strand; PAM type: NRG; PAM sequence: AGG
tggtgcagataagggagcca

SEQ ID NO: 33640 - DNA, 20 bp, Artificial Sequence
  Description of Artificial Sequence: Synthetic oligonucleotide
  Target: SCN10A; (+) strand; PAM type: NRG; PAM sequence: CAG
cagataagggagccaaggcc

SEQ ID NO: 33641 - DNA, 20 bp, Artificial Sequence
  Description of Artificial Sequence: Synthetic oligonucleotide
  Target: SCN10A; (+) strand; PAM type: NRG; PAM sequence: AAG
taagggagccaaggcccaga

SEQ ID NO: 33642 - DNA, 20 bp, Artificial Sequence
  Description of Artificial Sequence: Synthetic oligonucleotide
  Target: SCN10A; (+) strand; PAM type: NRG; PAM sequence: AGG
aagggagccaaggcccagaa

SEQ ID NO: 33643 - DNA, 20 bp, Artificial Sequence
  Description of Artificial Sequence: Synthetic oligonucleotide
  Target: SCN10A; (+) strand; PAM type: NRG; PAM sequence: GAG
gggagccaaggcccagaaag

SEQ ID NO: 33644 - DNA, 20 bp, Artificial Sequence
  Description of Artificial Sequence: Synthetic oligonucleotide
  Target: SCN10A; (+) strand; PAM type: NRG; PAM sequence: AAG
agccaaggcccagaaaggag

SEQ ID NO: 33645 - DNA, 20 bp, Artificial Sequence
  Description of Artificial Sequence: Synthetic oligonucleotide
  Target: SCN10A; (+) strand; PAM type: NRG; PAM sequence: AGG
gccaaggcccagaaaggaga

SEQ ID NO: 33646 - DNA, 20 bp, Artificial Sequence
  Description of Artificial Sequence: Synthetic oligonucleotide
  Target: SCN10A; (+) strand; PAM type: NRG; PAM sequence: GAG
agaaggcatgtccccactct

SEQ ID NO: 33647 - DNA, 20 bp, Artificial Sequence
  Description of Artificial Sequence: Synthetic oligonucleotide
  Target: SCN10A; (+) strand; PAM type: NRG; PAM sequence: CAG
ggcatgtccccactctgagt

SEQ ID NO: 33648 - DNA, 20 bp, Artificial Sequence
  Description of Artificial Sequence: Synthetic oligonucleotide
  Target: SCN10A; (+) strand; PAM type: NRG; PAM sequence: AAG
ccccactctgagtcagcgaa

SEQ ID NO: 33649 - DNA, 20 bp, Artificial Sequence
  Description of Artificial Sequence: Synthetic oligonucleotide
  Target: SCN10A; (+) strand; PAM type: NRG; PAM sequence: TGG
actctgagtcagcgaaaagc

SEQ ID NO: 33650 - DNA, 20 bp, Artificial Sequence
  Description of Artificial Sequence: Synthetic oligonucleotide
  Target: SCN10A; (+) strand; PAM type: NRG; PAM sequence: GGG
ctctgagtcagcgaaaagct

SEQ ID NO: 33651 - DNA, 20 bp, Artificial Sequence
  Description of Artificial Sequence: Synthetic oligonucleotide
  Target: SCN10A; (+) strand; PAM type: NRG; PAM sequence: GGG
tctgagtcagcgaaaagctg

SEQ ID NO: 33652 - DNA, 20 bp, Artificial Sequence
  Description of Artificial Sequence: Synthetic oligonucleotide
  Target: SCN10A; (+) strand; PAM type: NRG; PAM sequence: CAG
tcagcgaaaagctggggcca

SEQ ID NO: 33653 - DNA, 20 bp, Artificial Sequence
  Description of Artificial Sequence: Synthetic oligonucleotide
  Target: SCN10A; (+) strand; PAM type: NRG; PAM sequence: AAG
aaagctggggccacagaccc

SEQ ID NO: 33654 - DNA, 20 bp, Artificial Sequence
  Description of Artificial Sequence: Synthetic oligonucleotide
  Target: SCN10A; (+) strand; PAM type: NRG; PAM sequence: CAG
gggccacagacccaagtctc

SEQ ID NO: 33655 - DNA, 20 bp, Artificial Sequence
  Description of Artificial Sequence: Synthetic oligonucleotide
  Target: SCN10A; (+) strand; PAM type: NRG; PAM sequence: CAG
gacccaagtctccagtcgcc

SEQ ID NO: 33656 - DNA, 20 bp, Artificial Sequence
  Description of Artificial Sequence: Synthetic oligonucleotide
  Target: SCN10A; (+) strand; PAM type: NRG; PAM sequence: AGG
acccaagtctccagtcgccc

SEQ ID NO: 33657 - DNA, 20 bp, Artificial Sequence
  Description of Artificial Sequence: Synthetic oligonucleotide
  Target: SCN10A; (+) strand; PAM type: NRG; PAM sequence: GAG
ccaagtctccagtcgcccag

SEQ ID NO: 33658 - DNA, 20 bp, Artificial Sequence
  Description of Artificial Sequence: Synthetic oligonucleotide
  Target: SCN10A; (+) strand; PAM type: NRG; PAM sequence: CAG
gtctccagtcgcccaggagt

SEQ ID NO: 33659 - DNA, 20 bp, Artificial Sequence
  Description of Artificial Sequence: Synthetic oligonucleotide
  Target: SCN10A; (+) strand; PAM type: NRG; PAM sequence: AAG
cagaccctgctccctcccac

SEQ ID NO: 33660 - DNA, 20 bp, Artificial Sequence
  Description of Artificial Sequence: Synthetic oligonucleotide
  Target: SCN10A; (+) strand; PAM type: NRG; PAM sequence: AGG
agaccctgctccctcccaca

SEQ ID NO: 33661 - DNA, 20 bp, Artificial Sequence
  Description of Artificial Sequence: Synthetic oligonucleotide
  Target: SCN10A; (+) strand; PAM type: NRG; PAM sequence: CAG
cctgctccctcccacaagga

SEQ ID NO: 33662 - DNA, 20 bp, Artificial Sequence
  Description of Artificial Sequence: Synthetic oligonucleotide
  Target: SCN10A; (+) strand; PAM type: NRG; PAM sequence: AGG
ctgctccctcccacaaggac

SEQ ID NO: 33663 - DNA, 20 bp, Artificial Sequence
  Description of Artificial Sequence: Synthetic oligonucleotide
  Target: SCN10A; (+) strand; PAM type: NRG; PAM sequence: GAG
gctccctcccacaaggacag

SEQ ID NO: 33664 - DNA, 20 bp, Artificial Sequence
  Description of Artificial Sequence: Synthetic oligonucleotide
  Target: SCN10A; (+) strand; PAM type: NRG; PAM sequence: GAG
tccctcccacaaggacagga

SEQ ID NO: 33665 - DNA, 20 bp, Artificial Sequence
  Description of Artificial Sequence: Synthetic oligonucleotide
  Target: SCN10A; (+) strand; PAM type: NRG; PAM sequence: AGG
ccctcccacaaggacaggag

SEQ ID NO: 33666 - DNA, 20 bp, Artificial Sequence
  Description of Artificial Sequence: Synthetic oligonucleotide
  Target: SCN10A; (+) strand; PAM type: NRG; PAM sequence: AAG
tcccacaaggacaggagagg

SEQ ID NO: 33667 - DNA, 20 bp, Artificial Sequence
  Description of Artificial Sequence: Synthetic oligonucleotide
  Target: SCN10A; (+) strand; PAM type: NRG; PAM sequence: AGG
cccacaaggacaggagagga

SEQ ID NO: 33668 - DNA, 20 bp, Artificial Sequence
  Description of Artificial Sequence: Synthetic oligonucleotide
  Target: SCN10A; (+) strand; PAM type: NRG; PAM sequence: GGG
ccacaaggacaggagaggaa

SEQ ID NO: 33669 - DNA, 20 bp, Artificial Sequence
  Description of Artificial Sequence: Synthetic oligonucleotide
  Target: SCN10A; (+) strand; PAM type: NRG; PAM sequence: GGG
cacaaggacaggagaggaag

SEQ ID NO: 33670 - DNA, 20 bp, Artificial Sequence
  Description of Artificial Sequence: Synthetic oligonucleotide
  Target: SCN10A; (+) strand; PAM type: NRG; PAM sequence: GGG
acaaggacaggagaggaagg

SEQ ID NO: 33671 - DNA, 20 bp, Artificial Sequence
  Description of Artificial Sequence: Synthetic oligonucleotide
  Target: SCN10A; (+) strand; PAM type: NRG; PAM sequence: GAG
aaggacaggagaggaagggg

SEQ ID NO: 33672 - DNA, 20 bp, Artificial Sequence
  Description of Artificial Sequence: Synthetic oligonucleotide
  Target: SCN10A; (+) strand; PAM type: NRG; PAM sequence: TGG
acaggagaggaagggggagc

SEQ ID NO: 33673 - DNA, 20 bp, Artificial Sequence
  Description of Artificial Sequence: Synthetic oligonucleotide
  Target: SCN10A; (+) strand; PAM type: NRG; PAM sequence: TGG
gagaggaagggggagctggc

SEQ ID NO: 33674 - DNA, 20 bp, Artificial Sequence
  Description of Artificial Sequence: Synthetic oligonucleotide
  Target: SCN10A; (+) strand; PAM type: NRG; PAM sequence: CAG
gaagggggagctggctggtg

SEQ ID NO: 33675 - DNA, 20 bp, Artificial Sequence
  Description of Artificial Sequence: Synthetic oligonucleotide
  Target: SCN10A; (+) strand; PAM type: NRG; PAM sequence: CAG
gagctggctggtgcagtccc

SEQ ID NO: 33676 - DNA, 20 bp, Artificial Sequence
  Description of Artificial Sequence: Synthetic oligonucleotide
  Target: SCN10A; (+) strand; PAM type: NRG; PAM sequence: GAG
gctggctggtgcagtcccca

SEQ ID NO: 33677 - DNA, 20 bp, Artificial Sequence
  Description of Artificial Sequence: Synthetic oligonucleotide
  Target: SCN10A; (+) strand; PAM type: NRG; PAM sequence: CAG
ctggtgcagtccccagagca

SEQ ID NO: 33678 - DNA, 20 bp, Artificial Sequence
  Description of Artificial Sequence: Synthetic oligonucleotide
  Target: SCN10A; (+) strand; PAM type: NRG; PAM sequence: TGG
cacagtgtcttccctgaatc

SEQ ID NO: 33679 - DNA, 20 bp, Artificial Sequence
  Description of Artificial Sequence: Synthetic oligonucleotide
  Target: SCN10A; (+) strand; PAM type: NRG; PAM sequence: GGG
acagtgtcttccctgaatct

SEQ ID NO: 33680 - DNA, 20 bp, Artificial Sequence
  Description of Artificial Sequence: Synthetic oligonucleotide
  Target: SCN10A; (+) strand; PAM type: NRG; PAM sequence: TGG
gtgtcttccctgaatctggg

SEQ ID NO: 33681 - DNA, 20 bp, Artificial Sequence
  Description of Artificial Sequence: Synthetic oligonucleotide
  Target: SCN10A; (+) strand; PAM type: NRG; PAM sequence: GGG
tgtcttccctgaatctgggt

SEQ ID NO: 33682 - DNA, 20 bp, Artificial Sequence
  Description of Artificial Sequence: Synthetic oligonucleotide
  Target: SCN10A; (+) strand; PAM type: NRG; PAM sequence: GAG
tcttccctgaatctgggtgg

SEQ ID NO: 33683 - DNA, 20 bp, Artificial Sequence
  Description of Artificial Sequence: Synthetic oligonucleotide
  Target: SCN10A; (+) strand; PAM type: NRG; PAM sequence: AAG
atctgggtgggagtttcccc

SEQ ID NO: 33684 - DNA, 20 bp, Artificial Sequence
  Description of Artificial Sequence: Synthetic oligonucleotide
  Target: SCN10A; (+) strand; PAM type: NRG; PAM sequence: AAG
gggagtttccccaagccatc

SEQ ID NO: 33685 - DNA, 20 bp, Artificial Sequence
  Description of Artificial Sequence: Synthetic oligonucleotide
  Target: SCN10A; (+) strand; PAM type: NRG; PAM sequence: GAG
gagtttccccaagccatcaa

SEQ ID NO: 33686 - DNA, 20 bp, Artificial Sequence
  Description of Artificial Sequence: Synthetic oligonucleotide
  Target: SCN10A; (+) strand; PAM type: NRG; PAM sequence: AAG
atcaagagaaaaacattacc

SEQ ID NO: 33687 - DNA, 20 bp, Artificial Sequence
  Description of Artificial Sequence: Synthetic oligonucleotide
  Target: SCN10A; (+) strand; PAM type: NRG; PAM sequence: CGG
aagagaaaaacattaccaag

SEQ ID NO: 33688 - DNA, 20 bp, Artificial Sequence
  Description of Artificial Sequence: Synthetic oligonucleotide
  Target: SCN10A; (+) strand; PAM type: NRG; PAM sequence: AAG
agaaaaacattaccaagcgg

SEQ ID NO: 33689 - DNA, 20 bp, Artificial Sequence
  Description of Artificial Sequence: Synthetic oligonucleotide
  Target: SCN10A; (+) strand; PAM type: NRG; PAM sequence: CAG
attaccaagcggaagctccg

SEQ ID NO: 33690 - DNA, 20 bp, Artificial Sequence
  Description of Artificial Sequence: Synthetic oligonucleotide
  Target: SCN10A; (+) strand; PAM type: NRG; PAM sequence: CAG
caagcggaagctccgcagca

SEQ ID NO: 33691 - DNA, 20 bp, Artificial Sequence
  Description of Artificial Sequence: Synthetic oligonucleotide
  Target: SCN10A; (+) strand; PAM type: NRG; PAM sequence: CAG
cggaagctccgcagcacaga

SEQ ID NO: 33692 - DNA, 20 bp, Artificial Sequence
  Description of Artificial Sequence: Synthetic oligonucleotide
  Target: SCN10A; (+) strand; PAM type: NRG; PAM sequence: AGG
ggaagctccgcagcacagac

SEQ ID NO: 33693 - DNA, 20 bp, Artificial Sequence
  Description of Artificial Sequence: Synthetic oligonucleotide
  Target: SCN10A; (+) strand; PAM type: NRG; PAM sequence: TGG
cacagacaggcttcccttct

SEQ ID NO: 33694 - DNA, 20 bp, Artificial Sequence
  Description of Artificial Sequence: Synthetic oligonucleotide
  Target: SCN10A; (+) strand; PAM type: NRG; PAM sequence: CAG
cttcccttcttggccacgcc

SEQ ID NO: 33695 - DNA, 20 bp, Artificial Sequence
  Description of Artificial Sequence: Synthetic oligonucleotide
  Target: SCN10A; (+) strand; PAM type: NRG; PAM sequence: TAG
ttcttggccacgcccagctc

SEQ ID NO: 33696 - DNA, 20 bp, Artificial Sequence
  Description of Artificial Sequence: Synthetic oligonucleotide
  Target: SCN10A; (+) strand; PAM type: NRG; PAM sequence: CAG
ttggccacgcccagctctag

SEQ ID NO: 33697 - DNA, 20 bp, Artificial Sequence
  Description of Artificial Sequence: Synthetic oligonucleotide
  Target: SCN10A; (+) strand; PAM type: NRG; PAM sequence: CAG
gcccagctctagcagactca

SEQ ID NO: 33698 - DNA, 20 bp, Artificial Sequence
  Description of Artificial Sequence: Synthetic oligonucleotide
  Target: SCN10A; (+) strand; PAM type: NRG; PAM sequence: CAG
gactcacagtgacgatgatg

SEQ ID NO: 33699 - DNA, 20 bp, Artificial Sequence
  Description of Artificial Sequence: Synthetic oligonucleotide
  Target: SCN10A; (+) strand; PAM type: NRG; PAM sequence: AAG
cagtgacgatgatgcagtca

SEQ ID NO: 33700 - DNA, 20 bp, Artificial Sequence
  Description of Artificial Sequence: Synthetic oligonucleotide
  Target: SCN10A; (+) strand; PAM type: NRG; PAM sequence: TGG
caaagatattccacttcttc

SEQ ID NO: 33701 - DNA, 20 bp, Artificial Sequence
  Description of Artificial Sequence: Synthetic oligonucleotide
  Target: SCN10A; (+) strand; PAM type: NRG; PAM sequence: TAG
tccacttcttctggaaataa

SEQ ID NO: 33702 - DNA, 20 bp, Artificial Sequence
  Description of Artificial Sequence: Synthetic oligonucleotide
  Target: SCN10A; (+) strand; PAM type: NRG; PAM sequence: TGG
ttcttctggaaataatagta

SEQ ID NO: 33703 - DNA, 20 bp, Artificial Sequence
  Description of Artificial Sequence: Synthetic oligonucleotide
  Target: SCN10A; (+) strand; PAM type: NRG; PAM sequence: GGG
tcttctggaaataatagtat

SEQ ID NO: 33704 - DNA, 20 bp, Artificial Sequence
  Description of Artificial Sequence: Synthetic oligonucleotide
  Target: SCN10A; (+) strand; PAM type: NRG; PAM sequence: AAG
ggaaataatagtatgggtcg

SEQ ID NO: 33705 - DNA, 20 bp, Artificial Sequence
  Description of Artificial Sequence: Synthetic oligonucleotide
  Target: SCN10A; (+) strand; PAM type: NRG; PAM sequence: AGG
gaaataatagtatgggtcga

SEQ ID NO: 33706 - DNA, 20 bp, Artificial Sequence
  Description of Artificial Sequence: Synthetic oligonucleotide
  Target: SCN10A; (+) strand; PAM type: NRG; PAM sequence: AAG
ggtcgaaggcaatgattttg

SEQ ID NO: 33707 - DNA, 20 bp, Artificial Sequence
  Description of Artificial Sequence: Synthetic oligonucleotide
  Target: SCN10A; (+) strand; PAM type: NRG; PAM sequence: CAG
aatgattttgaagaccattt

SEQ ID NO: 33708 - DNA, 20 bp, Artificial Sequence
  Description of Artificial Sequence: Synthetic oligonucleotide
  Target: SCN10A; (+) strand; PAM type: NRG; PAM sequence: CAG
gattttgaagaccatttcag

SEQ ID NO: 33709 - DNA, 20 bp, Artificial Sequence
  Description of Artificial Sequence: Synthetic oligonucleotide
  Target: SCN10A; (+) strand; PAM type: NRG; PAM sequence: TGG
catttcagcagtaaaaaata

SEQ ID NO: 33710 - DNA, 20 bp, Artificial Sequence
  Description of Artificial Sequence: Synthetic oligonucleotide
  Target: SCN10A; (+) strand; PAM type: NRG; PAM sequence: AAG
cagcagtaaaaaatatggta

SEQ ID NO: 33711 - DNA, 20 bp, Artificial Sequence
  Description of Artificial Sequence: Synthetic oligonucleotide
  Target: SCN10A; (+) strand; PAM type: NRG; PAM sequence: TAG
taaaaaatatggtaaagacc

SEQ ID NO: 33712 - DNA, 20 bp, Artificial Sequence
  Description of Artificial Sequence: Synthetic oligonucleotide
  Target: SCN10A; (+) strand; PAM type: NRG; PAM sequence: AGG
aaaaaatatggtaaagacct

SEQ ID NO: 33713 - DNA, 20 bp, Artificial Sequence
  Description of Artificial Sequence: Synthetic oligonucleotide
  Target: SCN10A; (+) strand; PAM type: NRG; PAM sequence: GAG
aaaatatggtaaagacctag

SEQ ID NO: 33714 - DNA, 20 bp, Artificial Sequence
  Description of Artificial Sequence: Synthetic oligonucleotide
  Target: SCN10A; (+) strand; PAM type: NRG; PAM sequence: TGG
atatggtaaagacctaggag

SEQ ID NO: 33715 - DNA, 20 bp, Artificial Sequence
  Description of Artificial Sequence: Synthetic oligonucleotide
  Target: SCN10A; (+) strand; PAM type: NRG; PAM sequence: AAG
aaagacctaggagtggaaac

SEQ ID NO: 33716 - DNA, 20 bp, Artificial Sequence
  Description of Artificial Sequence: Synthetic oligonucleotide
  Target: SCN10A; (+) strand; PAM type: NRG; PAM sequence: CAG
gtggaaacaagctttcatca

SEQ ID NO: 33717 - DNA, 20 bp, Artificial Sequence
  Description of Artificial Sequence: Synthetic oligonucleotide
  Target: SCN10A; (+) strand; PAM type: NRG; PAM sequence: TGG
gaaacaagctttcatcacag

SEQ ID NO: 33718 - DNA, 20 bp, Artificial Sequence
  Description of Artificial Sequence: Synthetic oligonucleotide
  Target: SCN10A; (+) strand; PAM type: NRG; PAM sequence: GGG
aaacaagctttcatcacagt

SEQ ID NO: 33719 - DNA, 20 bp, Artificial Sequence
  Description of Artificial Sequence: Synthetic oligonucleotide
  Target: SCN10A; (+) strand; PAM type: NRG; PAM sequence: TGG
tttcatcacagtgggatctg

SEQ ID NO: 33720 - DNA, 20 bp, Artificial Sequence
  Description of Artificial Sequence: Synthetic oligonucleotide
  Target: SCN10A; (+) strand; PAM type: NRG; PAM sequence: GGG
ttcatcacagtgggatctgt

SEQ ID NO: 33721 - DNA, 20 bp, Artificial Sequence
  Description of Artificial Sequence: Synthetic oligonucleotide
  Target: SCN10A; (+) strand; PAM type: NRG; PAM sequence: GGG
tcatcacagtgggatctgtg

SEQ ID NO: 33722 - DNA, 20 bp, Artificial Sequence
  Description of Artificial Sequence: Synthetic oligonucleotide
  Target: SCN10A; (+) strand; PAM type: NRG; PAM sequence: CGG
cacagtgggatctgtggggt

SEQ ID NO: 33723 - DNA, 20 bp, Artificial Sequence
  Description of Artificial Sequence: Synthetic oligonucleotide
  Target: SCN10A; (+) strand; PAM type: NRG; PAM sequence: GAG
cagtgggatctgtggggtcg

SEQ ID NO: 33724 - DNA, 20 bp, Artificial Sequence
  Description of Artificial Sequence: Synthetic oligonucleotide
  Target: SCN10A; (+) strand; PAM type: NRG; PAM sequence: AGG
agtgggatctgtggggtcgg

SEQ ID NO: 33725 - DNA, 20 bp, Artificial Sequence
  Description of Artificial Sequence: Synthetic oligonucleotide
  Target: SCN10A; (+) strand; PAM type: NRG; PAM sequence: TGG
gtcggaggcaatgataaaaa

SEQ ID NO: 33726 - DNA, 20 bp, Artificial Sequence
  Description of Artificial Sequence: Synthetic oligonucleotide
  Target: SCN10A; (+) strand; PAM type: NRG; PAM sequence: CAG
ggaggcaatgataaaaatgg

SEQ ID NO: 33727 - DNA, 20 bp, Artificial Sequence
  Description of Artificial Sequence: Synthetic oligonucleotide
  Target: SCN10A; (+) strand; PAM type: NRG; PAM sequence: AAG
gcaatgataaaaatggcagc

SEQ ID NO: 33728 - DNA, 20 bp, Artificial Sequence
  Description of Artificial Sequence: Synthetic oligonucleotide
  Target: SCN10A; (+) strand; PAM type: NRG; PAM sequence: TAG
aaaatgtcttatttacaaaa

SEQ ID NO: 33729 - DNA, 20 bp, Artificial Sequence
  Description of Artificial Sequence: Synthetic oligonucleotide
  Target: SCN10A; (+) strand; PAM type: NRG; PAM sequence: CAG
gaaaatccttttgttttgtt

SEQ ID NO: 33730 - DNA, 20 bp, Artificial Sequence
  Description of Artificial Sequence: Synthetic oligonucleotide
  Target: SCN10A; (+) strand; PAM type: NRG; PAM sequence: TGG
ttcagttgctatgttatctg

SEQ ID NO: 33731 - DNA, 20 bp, Artificial Sequence
  Description of Artificial Sequence: Synthetic oligonucleotide
  Target: SCN10A; (+) strand; PAM type: NRG; PAM sequence: GGG
tcagttgctatgttatctgt

SEQ ID NO: 33732 - DNA, 20 bp, Artificial Sequence
  Description of Artificial Sequence: Synthetic oligonucleotide
  Target: SCN10A; (+) strand; PAM type: NRG; PAM sequence: GAG
tatgttatctgtgggctcct

SEQ ID NO: 33733 - DNA, 20 bp, Artificial Sequence
  Description of Artificial Sequence: Synthetic oligonucleotide
  Target: SCN10A; (+) strand; PAM type: NRG; PAM sequence: AGG
atgttatctgtgggctcctg

SEQ ID NO: 33734 - DNA, 20 bp, Artificial Sequence
  Description of Artificial Sequence: Synthetic oligonucleotide
  Target: SCN10A; (+) strand; PAM type: NRG; PAM sequence: TGG
atctgtgggctcctgaggat

SEQ ID NO: 33735 - DNA, 20 bp, Artificial Sequence
  Description of Artificial Sequence: Synthetic oligonucleotide
  Target: SCN10A; (+) strand; PAM type: NRG; PAM sequence: CAG
gtgggctcctgaggattggc

SEQ ID NO: 33736 - DNA, 20 bp, Artificial Sequence
  Description of Artificial Sequence: Synthetic oligonucleotide
  Target: SCN10A; (+) strand; PAM type: NRG; PAM sequence: AGG
tgggctcctgaggattggcc

SEQ ID NO: 33737 - DNA, 20 bp, Artificial Sequence
  Description of Artificial Sequence: Synthetic oligonucleotide
  Target: SCN10A; (+) strand; PAM type: NRG; PAM sequence: GGG
gggctcctgaggattggcca

SEQ ID NO: 33738 - DNA, 20 bp, Artificial Sequence
  Description of Artificial Sequence: Synthetic oligonucleotide
  Target: SCN10A; (+) strand; PAM type: NRG; PAM sequence: CAG
ctgaggattggccagggtaa

SEQ ID NO: 33739 - DNA, 20 bp, Artificial Sequence
  Description of Artificial Sequence: Synthetic oligonucleotide
  Target: SCN10A; (+) strand; PAM type: NRG; PAM sequence: CAG
cagggtaacagtcaacgtga

SEQ ID NO: 33740 - DNA, 20 bp, Artificial Sequence
  Description of Artificial Sequence: Synthetic oligonucleotide
  Target: SCN10A; (+) strand; PAM type: NRG; PAM sequence: TGG
taacagtcaacgtgacagaa

SEQ ID NO: 33741 - DNA, 20 bp, Artificial Sequence
  Description of Artificial Sequence: Synthetic oligonucleotide
  Target: SCN10A; (+) strand; PAM type: NRG; PAM sequence: GAG
acagtcaacgtgacagaatg

SEQ ID NO: 33742 - DNA, 20 bp, Artificial Sequence
  Description of Artificial Sequence: Synthetic oligonucleotide
  Target: SCN10A; (+) strand; PAM type: NRG; PAM sequence: CAG
agacatttctgcaccattct

SEQ ID NO: 33743 - DNA, 20 bp, Artificial Sequence
  Description of Artificial Sequence: Synthetic oligonucleotide
  Target: SCN10A; (+) strand; PAM type: NRG; PAM sequence: AGG
gacatttctgcaccattctc

SEQ ID NO: 33744 - DNA, 20 bp, Artificial Sequence
  Description of Artificial Sequence: Synthetic oligonucleotide
  Target: SCN10A; (+) strand; PAM type: NRG; PAM sequence: GGG
acatttctgcaccattctca

SEQ ID NO: 33745 - DNA, 20 bp, Artificial Sequence
  Description of Artificial Sequence: Synthetic oligonucleotide
  Target: SCN10A; (+) strand; PAM type: NRG; PAM sequence: GGG
catttctgcaccattctcag

SEQ ID NO: 33746 - DNA, 20 bp, Artificial Sequence
  Description of Artificial Sequence: Synthetic oligonucleotide
  Target: SCN10A; (+) strand; PAM type: NRG; PAM sequence: CAG
ctcaggggctgtgcatgctg

SEQ ID NO: 33747 - DNA, 20 bp, Artificial Sequence
  Description of Artificial Sequence: Synthetic oligonucleotide
  Target: SCN10A; (+) strand; PAM type: NRG; PAM sequence: TGG
ctgcagtttttccacgtgaa

SEQ ID NO: 33748 - DNA, 20 bp, Artificial Sequence
  Description of Artificial Sequence: Synthetic oligonucleotide
  Target: SCN10A; (+) strand; PAM type: NRG; PAM sequence: TGG
cagtttttccacgtgaatgg

SEQ ID NO: 33749 - DNA, 20 bp, Artificial Sequence
  Description of Artificial Sequence: Synthetic oligonucleotide
  Target: SCN10A; (+) strand; PAM type: NRG; PAM sequence: TGG
tttttccacgtgaatggtgg

SEQ ID NO: 33750 - DNA, 20 bp, Artificial Sequence
  Description of Artificial Sequence: Synthetic oligonucleotide
  Target: SCN10A; (+) strand; PAM type: NRG; PAM sequence: GGG
ttttccacgtgaatggtggt

SEQ ID NO: 33751 - DNA, 20 bp, Artificial Sequence
  Description of Artificial Sequence: Synthetic oligonucleotide
  Target: SCN10A; (+) strand; PAM type: NRG; PAM sequence: GAG
ttccacgtgaatggtggtgg

SEQ ID NO: 33752 - DNA, 20 bp, Artificial Sequence
  Description of Artificial Sequence: Synthetic oligonucleotide
  Target: SCN10A; (+) strand; PAM type: NRG; PAM sequence: TGG
cacgtgaatggtggtgggag

SEQ ID NO: 33753 - DNA, 20 bp, Artificial Sequence
  Description of Artificial Sequence: Synthetic oligonucleotide
  Target: SCN10A; (+) strand; PAM type: NRG; PAM sequence: AAG
aatggtggtgggagtggaat

SEQ ID NO: 33754 - DNA, 20 bp, Artificial Sequence
  Description of Artificial Sequence: Synthetic oligonucleotide
  Target: SCN10A; (+) strand; PAM type: NRG; PAM sequence: CGG
ggtggtgggagtggaataag

SEQ ID NO: 33755 - DNA, 20 bp, Artificial Sequence
  Description of Artificial Sequence: Synthetic oligonucleotide
  Target: SCN10A; (+) strand; PAM type: NRG; PAM sequence: TAG
gtgggagtggaataagcgga

SEQ ID NO: 33756 - DNA, 20 bp, Artificial Sequence
  Description of Artificial Sequence: Synthetic oligonucleotide
  Target: SCN10A; (+) strand; PAM type: NRG; PAM sequence: AAG
ggaataagcggatagtcttt

SEQ ID NO: 33757 - DNA, 20 bp, Artificial Sequence
  Description of Artificial Sequence: Synthetic oligonucleotide
  Target: SCN10A; (+) strand; PAM type: NRG; PAM sequence: CAG
ttattataatatcattttgt

SEQ ID NO: 33758 - DNA, 20 bp, Artificial Sequence
  Description of Artificial Sequence: Synthetic oligonucleotide
  Target: SCN10A; (+) strand; PAM type: NRG; PAM sequence: AAG
ataatatcattttgtcagtg

SEQ ID NO: 33759 - DNA, 20 bp, Artificial Sequence
  Description of Artificial Sequence: Synthetic oligonucleotide
  Target: SCN10A; (+) strand; PAM type: NRG; PAM sequence: GAG
aatatcattttgtcagtgaa

SEQ ID NO: 33760 - DNA, 20 bp, Artificial Sequence
  Description of Artificial Sequence: Synthetic oligonucleotide
  Target: SCN10A; (+) strand; PAM type: NRG; PAM sequence: CAG
tcattttgtcagtgaagagt

SEQ ID NO: 33761 - DNA, 20 bp, Artificial Sequence
  Description of Artificial Sequence: Synthetic oligonucleotide
  Target: SCN10A; (+) strand; PAM type: NRG; PAM sequence: TGG
ttgtcagtgaagagtcagtc

SEQ ID NO: 33762 - DNA, 20 bp, Artificial Sequence
  Description of Artificial Sequence: Synthetic oligonucleotide
  Target: SCN10A; (+) strand; PAM type: NRG; PAM sequence: CAG
agtgaagagtcagtctggtt

SEQ ID NO: 33763 - DNA, 20 bp, Artificial Sequence
  Description of Artificial Sequence: Synthetic oligonucleotide
  Target: SCN10A; (+) strand; PAM type: NRG; PAM sequence: TAG
gaagagtcagtctggttcag

SEQ ID NO: 33764 - DNA, 20 bp, Artificial Sequence
  Description of Artificial Sequence: Synthetic oligonucleotide
  Target: SCN10A; (+) strand; PAM type: NRG; PAM sequence: TGG
ggttcagtagttaaaacgtg

SEQ ID NO: 33765 - DNA, 20 bp, Artificial Sequence
  Description of Artificial Sequence: Synthetic oligonucleotide
  Target: SCN10A; (+) strand; PAM type: NRG; PAM sequence: GGG
gttcagtagttaaaacgtgt

SEQ ID NO: 33766 - DNA, 20 bp, Artificial Sequence
  Description of Artificial Sequence: Synthetic oligonucleotide
  Target: SCN10A; (+) strand; PAM type: NRG; PAM sequence: TGG
tagttaaaacgtgtgggttg

SEQ ID NO: 33767 - DNA, 20 bp, Artificial Sequence
  Description of Artificial Sequence: Synthetic oligonucleotide
  Target: SCN10A; (+) strand; PAM type: NRG; PAM sequence: GGG
agttaaaacgtgtgggttgt

SEQ ID NO: 33768 - DNA, 20 bp, Artificial Sequence
  Description of Artificial Sequence: Synthetic oligonucleotide
  Target: SCN10A; (+) strand; PAM type: NRG; PAM sequence: CAG
gtgtgggttgtgggacatca

SEQ ID NO: 33769 - DNA, 20 bp, Artificial Sequence
  Description of Artificial Sequence: Synthetic oligonucleotide
  Target: SCN10A; (+) strand; PAM type: NRG; PAM sequence: TGG
gttgtgggacatcacagacc

SEQ ID NO: 33770 - DNA, 20 bp, Artificial Sequence
  Description of Artificial Sequence: Synthetic oligonucleotide
  Target: SCN10A; (+) strand; PAM type: NRG; PAM sequence: CAG
acagacctggattaaaatcc

SEQ ID NO: 33771 - DNA, 20 bp, Artificial Sequence
  Description of Artificial Sequence: Synthetic oligonucleotide
  Target: SCN10A; (+) strand; PAM type: NRG; PAM sequence: CAG
cctggattaaaatcccagcc

SEQ ID NO: 33772 - DNA, 20 bp, Artificial Sequence
  Description of Artificial Sequence: Synthetic oligonucleotide
  Target: SCN10A; (+) strand; PAM type: NRG; PAM sequence: TAG
atcccagcccagacatttcc

SEQ ID NO: 33773 - DNA, 20 bp, Artificial Sequence
  Description of Artificial Sequence: Synthetic oligonucleotide
  Target: SCN10A; (+) strand; PAM type: NRG; PAM sequence: AAG
agacatttcctagcttatgt

SEQ ID NO: 33774 - DNA, 20 bp, Artificial Sequence
  Description of Artificial Sequence: Synthetic oligonucleotide
  Target: SCN10A; (+) strand; PAM type: NRG; PAM sequence: TGG
tttcctagcttatgtaagct

SEQ ID NO: 33775 - DNA, 20 bp, Artificial Sequence
  Description of Artificial Sequence: Synthetic oligonucleotide
  Target: SCN10A; (+) strand; PAM type: NRG; PAM sequence: TGG
caatttcctcatctgtataa

SEQ ID NO: 33776 - DNA, 20 bp, Artificial Sequence
  Description of Artificial Sequence: Synthetic oligonucleotide
  Target: SCN10A; (+) strand; PAM type: NRG; PAM sequence: GGG
aatttcctcatctgtataat

SEQ ID NO: 33777 - DNA, 20 bp, Artificial Sequence
  Description of Artificial Sequence: Synthetic oligonucleotide
  Target: SCN10A; (+) strand; PAM type: NRG; PAM sequence: GAG
ctgtataatgggcataaaat

SEQ ID NO: 33778 - DNA, 20 bp, Artificial Sequence
  Description of Artificial Sequence: Synthetic oligonucleotide
  Target: SCN10A; (+) strand; PAM type: NRG; PAM sequence: CAG
aaaatgagccaatgcatgtg

SEQ ID NO: 33779 - DNA, 20 bp, Artificial Sequence
  Description of Artificial Sequence: Synthetic oligonucleotide
  Target: SCN10A; (+) strand; PAM type: NRG; PAM sequence: AAG
tgcatgtgcagttcttaaca

SEQ ID NO: 33780 - DNA, 20 bp, Artificial Sequence
  Description of Artificial Sequence: Synthetic oligonucleotide
  Target: SCN10A; (+) strand; PAM type: NRG; PAM sequence: AGG
gcatgtgcagttcttaacaa

SEQ ID NO: 33781 - DNA, 20 bp, Artificial Sequence
  Description of Artificial Sequence: Synthetic oligonucleotide
  Target: SCN10A; (+) strand; PAM type: NRG; PAM sequence: GGG
catgtgcagttcttaacaaa

SEQ ID NO: 33782 - DNA, 20 bp, Artificial Sequence
  Description of Artificial Sequence: Synthetic oligonucleotide
  Target: SCN10A; (+) strand; PAM type: NRG; PAM sequence: TGG
gcagttcttaacaaagggcc

SEQ ID NO: 33783 - DNA, 20 bp, Artificial Sequence
  Description of Artificial Sequence: Synthetic oligonucleotide
  Target: SCN10A; (+) strand; PAM type: NRG; PAM sequence: CAG
gttcttaacaaagggcctgg

SEQ ID NO: 33784 - DNA, 20 bp, Artificial Sequence
  Description of Artificial Sequence: Synthetic oligonucleotide
  Target: SCN10A; (+) strand; PAM type: NRG; PAM sequence: CAG
ttaacaaagggcctggcaga

SEQ ID NO: 33785 - DNA, 20 bp, Artificial Sequence
  Description of Artificial Sequence: Synthetic oligonucleotide
  Target: SCN10A; (+) strand; PAM type: NRG; PAM sequence: AAG
gcagacagtaattcattcat

SEQ ID NO: 33786 - DNA, 20 bp, Artificial Sequence
  Description of Artificial Sequence: Synthetic oligonucleotide
  Target: SCN10A; (+) strand; PAM type: NRG; PAM sequence: CAG
agtaattcattcataagtaa

SEQ ID NO: 33787 - DNA, 20 bp, Artificial Sequence
  Description of Artificial Sequence: Synthetic oligonucleotide
  Target: SCN10A; (+) strand; PAM type: NRG; PAM sequence: TAG
cattcataagtaacagtgac

SEQ ID NO: 33788 - DNA, 20 bp, Artificial Sequence
  Description of Artificial Sequence: Synthetic oligonucleotide
  Target: SCN10A; (+) strand; PAM type: NRG; PAM sequence: AAG
cataagtaacagtgactagt

SEQ ID NO: 33789 - DNA, 20 bp, Artificial Sequence
  Description of Artificial Sequence: Synthetic oligonucleotide
  Target: SCN10A; (+) strand; PAM type: NRG; PAM sequence: AAG
aacaatgattcattgcctct

SEQ ID NO: 33790 - DNA, 20 bp, Artificial Sequence
  Description of Artificial Sequence: Synthetic oligonucleotide
  Target: SCN10A; (+) strand; PAM type: NRG; PAM sequence: TAG
cattgcctctaagattcttt

SEQ ID NO: 33791 - DNA, 20 bp, Artificial Sequence
  Description of Artificial Sequence: Synthetic oligonucleotide
  Target: SCN10A; (+) strand; PAM type: NRG; PAM sequence: AGG
attgcctctaagattctttt

SEQ ID NO: 33792 - DNA, 20 bp, Artificial Sequence
  Description of Artificial Sequence: Synthetic oligonucleotide
  Target: SCN10A; (+) strand; PAM type: NRG; PAM sequence: TAG
gtgtctctaattgtcttaaa

SEQ ID NO: 33793 - DNA, 20 bp, Artificial Sequence
  Description of Artificial Sequence: Synthetic oligonucleotide
  Target: SCN10A; (+) strand; PAM type: NRG; PAM sequence: AGG
tgtctctaattgtcttaaat

SEQ ID NO: 33794 - DNA, 20 bp, Artificial Sequence
  Description of Artificial Sequence: Synthetic oligonucleotide
  Target: SCN10A; (+) strand; PAM type: NRG; PAM sequence: CAG
tctaattgtcttaaatagga

SEQ ID NO: 33795 - DNA, 20 bp, Artificial Sequence
  Description of Artificial Sequence: Synthetic oligonucleotide
  Target: SCN10A; (+) strand; PAM type: NRG; PAM sequence: GAG
taggacagaattctgacact

SEQ ID NO: 33796 - DNA, 20 bp, Artificial Sequence
  Description of Artificial Sequence: Synthetic oligonucleotide
  Target: SCN10A; (+) strand; PAM type: NRG; PAM sequence: GAG
ggacagaattctgacactga

SEQ ID NO: 33797 - DNA, 20 bp, Artificial Sequence
  Description of Artificial Sequence: Synthetic oligonucleotide
  Target: SCN10A; (+) strand; PAM type: NRG; PAM sequence: GAG
acagaattctgacactgaga

SEQ ID NO: 33798 - DNA, 20 bp, Artificial Sequence
  Description of Artificial Sequence: Synthetic oligonucleotide
  Target: SCN10A; (+) strand; PAM type: NRG; PAM sequence: AGG
cagaattctgacactgagag

SEQ ID NO: 33799 - DNA, 20 bp, Artificial Sequence
  Description of Artificial Sequence: Synthetic oligonucleotide
  Target: SCN10A; (+) strand; PAM type: NRG; PAM sequence: CAG
attctgacactgagagaggt

SEQ ID NO: 33800 - DNA, 20 bp, Artificial Sequence
  Description of Artificial Sequence: Synthetic oligonucleotide
  Target: SCN10A; (+) strand; PAM type: NRG; PAM sequence: CAG
acactgagagaggtcagaac

SEQ ID NO: 33801 - DNA, 20 bp, Artificial Sequence
  Description of Artificial Sequence: Synthetic oligonucleotide
  Target: SCN10A; (+) strand; PAM type: NRG; PAM sequence: AGG
cactgagagaggtcagaacc

SEQ ID NO: 33802 - DNA, 20 bp, Artificial Sequence
  Description of Artificial Sequence: Synthetic oligonucleotide
  Target: SCN10A; (+) strand; PAM type: NRG; PAM sequence: CGG
agagaggtcagaaccaggct

SEQ ID NO: 33803 - DNA, 20 bp, Artificial Sequence
  Description of Artificial Sequence: Synthetic oligonucleotide
  Target: SCN10A; (+) strand; PAM type: NRG; PAM sequence: GGG
gagaggtcagaaccaggctc

SEQ ID NO: 33804 - DNA, 20 bp, Artificial Sequence
  Description of Artificial Sequence: Synthetic oligonucleotide
  Target: SCN10A; (+) strand; PAM type: NRG; PAM sequence: CAG
ggctcgggtaacacaacaac

SEQ ID NO: 33805 - DNA, 20 bp, Artificial Sequence
  Description of Artificial Sequence: Synthetic oligonucleotide
  Target: SCN10A; (+) strand; PAM type: NRG; PAM sequence: CAG
tcgggtaacacaacaaccag

SEQ ID NO: 33806 - DNA, 20 bp, Artificial Sequence
  Description of Artificial Sequence: Synthetic oligonucleotide
  Target: SCN10A; (+) strand; PAM type: NRG; PAM sequence: AGG
cgggtaacacaacaaccagc

SEQ ID NO: 33807 - DNA, 20 bp, Artificial Sequence
  Description of Artificial Sequence: Synthetic oligonucleotide
  Target: SCN10A; (+) strand; PAM type: NRG; PAM sequence: GGG
gggtaacacaacaaccagca

SEQ ID NO: 33808 - DNA, 20 bp, Artificial Sequence
  Description of Artificial Sequence: Synthetic oligonucleotide
  Target: SCN10A; (+) strand; PAM type: NRG; PAM sequence: AAG
taacacaacaaccagcaggg

SEQ ID NO: 33809 - DNA, 20 bp, Artificial Sequence
  Description of Artificial Sequence: Synthetic oligonucleotide
  Target: SCN10A; (+) strand; PAM type: NRG; PAM sequence: AGG
aacacaacaaccagcaggga

SEQ ID NO: 33810 - DNA, 20 bp, Artificial Sequence
  Description of Artificial Sequence: Synthetic oligonucleotide
  Target: SCN10A; (+) strand; PAM type: NRG; PAM sequence: GGG
acacaacaaccagcagggaa

SEQ ID NO: 33811 - DNA, 20 bp, Artificial Sequence
  Description of Artificial Sequence: Synthetic oligonucleotide
  Target: SCN10A; (+) strand; PAM type: NRG; PAM sequence: GAG
acaacaaccagcagggaagg

SEQ ID NO: 33812 - DNA, 20 bp, Artificial Sequence
  Description of Artificial Sequence: Synthetic oligonucleotide
  Target: SCN10A; (+) strand; PAM type: NRG; PAM sequence: CAG
caaccagcagggaagggaga

SEQ ID NO: 33813 - DNA, 20 bp, Artificial Sequence
  Description of Artificial Sequence: Synthetic oligonucleotide
  Target: SCN10A; (+) strand; PAM type: NRG; PAM sequence: GAG
accagcagggaagggagaca

SEQ ID NO: 33814 - DNA, 20 bp, Artificial Sequence
  Description of Artificial Sequence: Synthetic oligonucleotide
  Target: SCN10A; (+) strand; PAM type: NRG; PAM sequence: AAG
agcagggaagggagacagag

SEQ ID NO: 33815 - DNA, 20 bp, Artificial Sequence
  Description of Artificial Sequence: Synthetic oligonucleotide
  Target: SCN10A; (+) strand; PAM type: NRG; PAM sequence: AGG
gcagggaagggagacagaga

SEQ ID NO: 33816 - DNA, 20 bp, Artificial Sequence
  Description of Artificial Sequence: Synthetic oligonucleotide
  Target: SCN10A; (+) strand; PAM type: NRG; PAM sequence: GAG
agggaagggagacagagaag

SEQ ID NO: 33817 - DNA, 20 bp, Artificial Sequence
  Description of Artificial Sequence: Synthetic oligonucleotide
  Target: SCN10A; (+) strand; PAM type: NRG; PAM sequence: AGG
gggaagggagacagagaagg

SEQ ID NO: 33818 - DNA, 20 bp, Artificial Sequence
  Description of Artificial Sequence: Synthetic oligonucleotide
  Target: SCN10A; (+) strand; PAM type: NRG; PAM sequence: AAG
agggagacagagaaggagga

SEQ ID NO: 33819 - DNA, 20 bp, Artificial Sequence
  Description of Artificial Sequence: Synthetic oligonucleotide
  Target: SCN10A; (+) strand; PAM type: NRG; PAM sequence: CAG
agaaggaggaaagcaacgac

SEQ ID NO: 33820 - DNA, 20 bp, Artificial Sequence
  Description of Artificial Sequence: Synthetic oligonucleotide
  Target: SCN10A; (+) strand; PAM type: NRG; PAM sequence: AGG
gaaggaggaaagcaacgacc

SEQ ID NO: 33821 - DNA, 20 bp, Artificial Sequence
  Description of Artificial Sequence: Synthetic oligonucleotide
  Target: SCN10A; (+) strand; PAM type: NRG; PAM sequence: GGG
aaggaggaaagcaacgacca

SEQ ID NO: 33822 - DNA, 20 bp, Artificial Sequence
  Description of Artificial Sequence: Synthetic oligonucleotide
  Target: SCN10A; (+) strand; PAM type: NRG; PAM sequence: CAG
aggaaagcaacgaccagggt

SEQ ID NO: 33823 - DNA, 20 bp, Artificial Sequence
  Description of Artificial Sequence: Synthetic oligonucleotide
  Target: SCN10A; (+) strand; PAM type: NRG; PAM sequence: AGG
ggaaagcaacgaccagggtc

SEQ ID NO: 33824 - DNA, 20 bp, Artificial Sequence
  Description of Artificial Sequence: Synthetic oligonucleotide
  Target: SCN10A; (+) strand; PAM type: NRG; PAM sequence: GAG
tccttcatatctttttatct

SEQ ID NO: 33825 - DNA, 20 bp, Artificial Sequence
  Description of Artificial Sequence: Synthetic oligonucleotide
  Target: SCN10A; (+) strand; PAM type: NRG; PAM sequence: CAG
tttttatctgagcccctcac

SEQ ID NO: 33826 - DNA, 20 bp, Artificial Sequence
  Description of Artificial Sequence: Synthetic oligonucleotide
  Target: SCN10A; (+) strand; PAM type: NRG; PAM sequence: GAG
tctgagcccctcaccagcct

SEQ ID NO: 33827 - DNA, 20 bp, Artificial Sequence
  Description of Artificial Sequence: Synthetic oligonucleotide
  Target: SCN10A; (+) strand; PAM type: NRG; PAM sequence: CAG
cccctcaccagcctgagaaa

SEQ ID NO: 33828 - DNA, 20 bp, Artificial Sequence
  Description of Artificial Sequence: Synthetic oligonucleotide
  Target: SCN10A; (+) strand; PAM type: NRG; PAM sequence: TGG
cagacaatgcatccttctta

SEQ ID NO: 33829 - DNA, 20 bp, Artificial Sequence
  Description of Artificial Sequence: Synthetic oligonucleotide
  Target: SCN10A; (+) strand; PAM type: NRG; PAM sequence: GAG
gacaatgcatccttcttatg

SEQ ID NO: 33830 - DNA, 20 bp, Artificial Sequence
  Description of Artificial Sequence: Synthetic oligonucleotide
  Target: SCN10A; (+) strand; PAM type: NRG; PAM sequence: AAG
aatgcatccttcttatggag

SEQ ID NO: 33831 - DNA, 20 bp, Artificial Sequence
  Description of Artificial Sequence: Synthetic oligonucleotide
  Target: SCN10A; (+) strand; PAM type: NRG; PAM sequence: CAG
ccttcttatggagaagaaaa

SEQ ID NO: 33832 - DNA, 20 bp, Artificial Sequence
  Description of Artificial Sequence: Synthetic oligonucleotide
  Target: SCN10A; (+) strand; PAM type: NRG; PAM sequence: AGG
cttcttatggagaagaaaac

SEQ ID NO: 33833 - DNA, 20 bp, Artificial Sequence
  Description of Artificial Sequence: Synthetic oligonucleotide
  Target: SCN10A; (+) strand; PAM type: NRG; PAM sequence: GAG
tatggagaagaaaacaggct

SEQ ID NO: 33834 - DNA, 20 bp, Artificial Sequence
  Description of Artificial Sequence: Synthetic oligonucleotide
  Target: SCN10A; (+) strand; PAM type: NRG; PAM sequence: GAG
tggagaagaaaacaggctga

SEQ ID NO: 33835 - DNA, 20 bp, Artificial Sequence
  Description of Artificial Sequence: Synthetic oligonucleotide
  Target: SCN10A; (+) strand; PAM type: NRG; PAM sequence: AAG
agaaaacaggctgagagttt

SEQ ID NO: 33836 - DNA, 20 bp, Artificial Sequence
  Description of Artificial Sequence: Synthetic oligonucleotide
  Target: SCN10A; (+) strand; PAM type: NRG; PAM sequence: AAG
aagtgactttctcatgccac

SEQ ID NO: 33837 - DNA, 20 bp, Artificial Sequence
  Description of Artificial Sequence: Synthetic oligonucleotide
  Target: SCN10A; (+) strand; PAM type: NRG; PAM sequence: AAG
catgccacaagactgattca

SEQ ID NO: 33838 - DNA, 20 bp, Artificial Sequence
  Description of Artificial Sequence: Synthetic oligonucleotide
  Target: SCN10A; (+) strand; PAM type: NRG; PAM sequence: GAG
tgccacaagactgattcaaa

SEQ ID NO: 33839 - DNA, 20 bp, Artificial Sequence
  Description of Artificial Sequence: Synthetic oligonucleotide
  Target: SCN10A; (+) strand; PAM type: NRG; PAM sequence: TGG
actgattcaaagagtatcta

SEQ ID NO: 33840 - DNA, 20 bp, Artificial Sequence
  Description of Artificial Sequence: Synthetic oligonucleotide
  Target: SCN10A; (+) strand; PAM type: NRG; PAM sequence: GAG
tgattcaaagagtatctatg

SEQ ID NO: 33841 - DNA, 20 bp, Artificial Sequence
  Description of Artificial Sequence: Synthetic oligonucleotide
  Target: SCN10A; (+) strand; PAM type: NRG; PAM sequence: TAG
tatctatggagtgtcccttg

SEQ ID NO: 33842 - DNA, 20 bp, Artificial Sequence
  Description of Artificial Sequence: Synthetic oligonucleotide
  Target: SCN10A; (+) strand; PAM type: NRG; PAM sequence: AGG
atctatggagtgtcccttgt

SEQ ID NO: 33843 - DNA, 20 bp, Artificial Sequence
  Description of Artificial Sequence: Synthetic oligonucleotide
  Target: SCN10A; (+) strand; PAM type: NRG; PAM sequence: AAG
atggagtgtcccttgtaggc

SEQ ID NO: 33844 - DNA, 20 bp, Artificial Sequence
  Description of Artificial Sequence: Synthetic oligonucleotide
  Target: SCN10A; (+) strand; PAM type: NRG; PAM sequence: CAG
agtgtcccttgtaggcaagt

SEQ ID NO: 33845 - DNA, 20 bp, Artificial Sequence
  Description of Artificial Sequence: Synthetic oligonucleotide
  Target: SCN10A; (+) strand; PAM type: NRG; PAM sequence: TGG
cccttgtaggcaagtcagtg

SEQ ID NO: 33846 - DNA, 20 bp, Artificial Sequence
  Description of Artificial Sequence: Synthetic oligonucleotide
  Target: SCN10A; (+) strand; PAM type: NRG; PAM sequence: TGG
gtaggcaagtcagtgtggtg

SEQ ID NO: 33847 - DNA, 20 bp, Artificial Sequence
  Description of Artificial Sequence: Synthetic oligonucleotide
  Target: SCN10A; (+) strand; PAM type: NRG; PAM sequence: TGG
ggcaagtcagtgtggtgtgg

SEQ ID NO: 33848 - DNA, 20 bp, Artificial Sequence
  Description of Artificial Sequence: Synthetic oligonucleotide
  Target: SCN10A; (+) strand; PAM type: NRG; PAM sequence: GGG
gcaagtcagtgtggtgtggt

SEQ ID NO: 33849 - DNA, 20 bp, Artificial Sequence
  Description of Artificial Sequence: Synthetic oligonucleotide
  Target: SCN10A; (+) strand; PAM type: NRG; PAM sequence: GGG
caagtcagtgtggtgtggtg

SEQ ID NO: 33850 - DNA, 20 bp, Artificial Sequence
  Description of Artificial Sequence: Synthetic oligonucleotide
  Target: SCN10A; (+) strand; PAM type: NRG; PAM sequence: GGG
aagtcagtgtggtgtggtgg

SEQ ID NO: 33851 - DNA, 20 bp, Artificial Sequence
  Description of Artificial Sequence: Synthetic oligonucleotide
  Target: SCN10A; (+) strand; PAM type: NRG; PAM sequence: GGG
agtcagtgtggtgtggtggg

SEQ ID NO: 33852 - DNA, 20 bp, Artificial Sequence
  Description of Artificial Sequence: Synthetic oligonucleotide
  Target: SCN10A; (+) strand; PAM type: NRG; PAM sequence: TAG
cagtgtggtgtggtgggggg

SEQ ID NO: 33853 - DNA, 20 bp, Artificial Sequence
  Description of Artificial Sequence: Synthetic oligonucleotide
  Target: SCN10A; (+) strand; PAM type: NRG; PAM sequence: AGG
agtgtggtgtggtggggggt

SEQ ID NO: 33854 - DNA, 20 bp, Artificial Sequence
  Description of Artificial Sequence: Synthetic oligonucleotide
  Target: SCN10A; (+) strand; PAM type: NRG; PAM sequence: GGG
gtgtggtgtggtggggggta

SEQ ID NO: 33855 - DNA, 20 bp, Artificial Sequence
  Description of Artificial Sequence: Synthetic oligonucleotide
  Target: SCN10A; (+) strand; PAM type: NRG; PAM sequence: GAG
gtgtggtggggggtagggtt

SEQ ID NO: 33856 - DNA, 20 bp, Artificial Sequence
  Description of Artificial Sequence: Synthetic oligonucleotide
  Target: SCN10A; (+) strand; PAM type: NRG; PAM sequence: AGG
tgtggtggggggtagggttg

SEQ ID NO: 33857 - DNA, 20 bp, Artificial Sequence
  Description of Artificial Sequence: Synthetic oligonucleotide
  Target: SCN10A; (+) strand; PAM type: NRG; PAM sequence: CAG
ggttgaggtcttgtgtcttc

SEQ ID NO: 33858 - DNA, 20 bp, Artificial Sequence
  Description of Artificial Sequence: Synthetic oligonucleotide
  Target: SCN10A; (+) strand; PAM type: NRG; PAM sequence: GAG
ttgaggtcttgtgtcttcca

SEQ ID NO: 33859 - DNA, 20 bp, Artificial Sequence
  Description of Artificial Sequence: Synthetic oligonucleotide
  Target: SCN10A; (+) strand; PAM type: NRG; PAM sequence: TGG
tcttgtgtcttccagagacc

SEQ ID NO: 33860 - DNA, 20 bp, Artificial Sequence
  Description of Artificial Sequence: Synthetic oligonucleotide
  Target: SCN10A; (+) strand; PAM type: NRG; PAM sequence: GGG
cttgtgtcttccagagacct

SEQ ID NO: 33861 - DNA, 20 bp, Artificial Sequence
  Description of Artificial Sequence: Synthetic oligonucleotide
  Target: SCN10A; (+) strand; PAM type: NRG; PAM sequence: TGG
ccagagacctgggtccaccc

SEQ ID NO: 33862 - DNA, 20 bp, Artificial Sequence
  Description of Artificial Sequence: Synthetic oligonucleotide
  Target: SCN10A; (+) strand; PAM type: NRG; PAM sequence: CAG
caccctggatccaccctcac

SEQ ID NO: 33863 - DNA, 20 bp, Artificial Sequence
  Description of Artificial Sequence: Synthetic oligonucleotide
  Target: SCN10A; (+) strand; PAM type: NRG; PAM sequence: TGG
cctcaccagctatacaattt

SEQ ID NO: 33864 - DNA, 20 bp, Artificial Sequence
  Description of Artificial Sequence: Synthetic oligonucleotide
  Target: SCN10A; (+) strand; PAM type: NRG; PAM sequence: GGG
ctcaccagctatacaatttt

SEQ ID NO: 33865 - DNA, 20 bp, Artificial Sequence
  Description of Artificial Sequence: Synthetic oligonucleotide
  Target: SCN10A; (+) strand; PAM type: NRG; PAM sequence: CAG
accagctatacaattttggg

SEQ ID NO: 33866 - DNA, 20 bp, Artificial Sequence
  Description of Artificial Sequence: Synthetic oligonucleotide
  Target: SCN10A; (+) strand; PAM type: NRG; PAM sequence: AGG
ccagctatacaattttgggc

SEQ ID NO: 33867 - DNA, 20 bp, Artificial Sequence
  Description of Artificial Sequence: Synthetic oligonucleotide
  Target: SCN10A; (+) strand; PAM type: NRG; PAM sequence: GAG
gcaggatatttaacctctct

SEQ ID NO: 33868 - DNA, 20 bp, Artificial Sequence
  Description of Artificial Sequence: Synthetic oligonucleotide
  Target: SCN10A; (+) strand; PAM type: NRG; PAM sequence: TAG
tatttaacctctctgagtct

SEQ ID NO: 33869 - DNA, 20 bp, Artificial Sequence
  Description of Artificial Sequence: Synthetic oligonucleotide
  Target: SCN10A; (+) strand; PAM type: NRG; PAM sequence: GAG
agtgctctcttttgtcatgt

SEQ ID NO: 33870 - DNA, 20 bp, Artificial Sequence
  Description of Artificial Sequence: Synthetic oligonucleotide
  Target: SCN10A; (+) strand; PAM type: NRG; PAM sequence: AGG
gtgctctcttttgtcatgtg

SEQ ID NO: 33871 - DNA, 20 bp, Artificial Sequence
  Description of Artificial Sequence: Synthetic oligonucleotide
  Target: SCN10A; (+) strand; PAM type: NRG; PAM sequence: GGG
tgctctcttttgtcatgtga

SEQ ID NO: 33872 - DNA, 20 bp, Artificial Sequence
  Description of Artificial Sequence: Synthetic oligonucleotide
  Target: SCN10A; (+) strand; PAM type: NRG; PAM sequence: AAG
acactgaaataacattcata

SEQ ID NO: 33873 - DNA, 20 bp, Artificial Sequence
  Description of Artificial Sequence: Synthetic oligonucleotide
  Target: SCN10A; (+) strand; PAM type: NRG; PAM sequence: CAG
ataaagcacctgactcattg

SEQ ID NO: 33874 - DNA, 20 bp, Artificial Sequence
  Description of Artificial Sequence: Synthetic oligonucleotide
  Target: SCN10A; (+) strand; PAM type: NRG; PAM sequence: AGG
taaagcacctgactcattgc

SEQ ID NO: 33875 - DNA, 20 bp, Artificial Sequence
  Description of Artificial Sequence: Synthetic oligonucleotide
  Target: SCN10A; (+) strand; PAM type: NRG; PAM sequence: AAG
cctgactcattgcaggcacc

SEQ ID NO: 33876 - DNA, 20 bp, Artificial Sequence
  Description of Artificial Sequence: Synthetic oligonucleotide
  Target: SCN10A; (+) strand; PAM type: NRG; PAM sequence: AAG
atgactttcttgctttaaaa

SEQ ID NO: 33877 - DNA, 20 bp, Artificial Sequence
  Description of Artificial Sequence: Synthetic oligonucleotide
  Target: SCN10A; (+) strand; PAM type: NRG; PAM sequence: TGG
actttcttgctttaaaaaag

SEQ ID NO: 33878 - DNA, 20 bp, Artificial Sequence
  Description of Artificial Sequence: Synthetic oligonucleotide
  Target: SCN10A; (+) strand; PAM type: NRG; PAM sequence: TGG
ggcactttcctctgacactg

SEQ ID NO: 33879 - DNA, 20 bp, Artificial Sequence
  Description of Artificial Sequence: Synthetic oligonucleotide
  Target: SCN10A; (+) strand; PAM type: NRG; PAM sequence: GGG
gcactttcctctgacactgt

SEQ ID NO: 33880 - DNA, 20 bp, Artificial Sequence
  Description of Artificial Sequence: Synthetic oligonucleotide
  Target: SCN10A; (+) strand; PAM type: NRG; PAM sequence: AAG
tttcctctgacactgtggga

SEQ ID NO: 33881 - DNA, 20 bp, Artificial Sequence
  Description of Artificial Sequence: Synthetic oligonucleotide
  Target: SCN10A; (+) strand; PAM type: NRG; PAM sequence: AGG
ttcctctgacactgtgggaa

SEQ ID NO: 33882 - DNA, 20 bp, Artificial Sequence
  Description of Artificial Sequence: Synthetic oligonucleotide
  Target: SCN10A; (+) strand; PAM type: NRG; PAM sequence: TAG
tgcttccacttttctaactg

SEQ ID NO: 33883 - DNA, 20 bp, Artificial Sequence
  Description of Artificial Sequence: Synthetic oligonucleotide
  Target: SCN10A; (+) strand; PAM type: NRG; PAM sequence: GAG
cacttttctaactgtagaat

SEQ ID NO: 33884 - DNA, 20 bp, Artificial Sequence
  Description of Artificial Sequence: Synthetic oligonucleotide
  Target: SCN10A; (+) strand; PAM type: NRG; PAM sequence: AGG
acttttctaactgtagaatg

SEQ ID NO: 33885 - DNA, 20 bp, Artificial Sequence
  Description of Artificial Sequence: Synthetic oligonucleotide
  Target: SCN10A; (+) strand; PAM type: NRG; PAM sequence: GGG
cttttctaactgtagaatga

SEQ ID NO: 33886 - DNA, 20 bp, Artificial Sequence
  Description of Artificial Sequence: Synthetic oligonucleotide
  Target: SCN10A; (+) strand; PAM type: NRG; PAM sequence: TGG
ctaactgtagaatgagggtg

SEQ ID NO: 33887 - DNA, 20 bp, Artificial Sequence
  Description of Artificial Sequence: Synthetic oligonucleotide
  Target: SCN10A; (+) strand; PAM type: NRG; PAM sequence: GGG
taactgtagaatgagggtgt

SEQ ID NO: 33888 - DNA, 20 bp, Artificial Sequence
  Description of Artificial Sequence: Synthetic oligonucleotide
  Target: SCN10A; (+) strand; PAM type: NRG; PAM sequence: AAG
ggctcaaatgtctattccat

SEQ ID NO: 33889 - DNA, 20 bp, Artificial Sequence
  Description of Artificial Sequence: Synthetic oligonucleotide
  Target: SCN10A; (+) strand; PAM type: NRG; PAM sequence: AGG
gctcaaatgtctattccata

SEQ ID NO: 33890 - DNA, 20 bp, Artificial Sequence
  Description of Artificial Sequence: Synthetic oligonucleotide
  Target: SCN10A; (+) strand; PAM type: NRG; PAM sequence: TGG
ctattccataaggccctctg

SEQ ID NO: 33891 - DNA, 20 bp, Artificial Sequence
  Description of Artificial Sequence: Synthetic oligonucleotide
  Target: SCN10A; (+) strand; PAM type: NRG; PAM sequence: TAG
cataaggccctctgtggtct

SEQ ID NO: 33892 - DNA, 20 bp, Artificial Sequence
  Description of Artificial Sequence: Synthetic oligonucleotide
  Target: SCN10A; (+) strand; PAM type: NRG; PAM sequence: AGG
ataaggccctctgtggtctt

SEQ ID NO: 33893 - DNA, 20 bp, Artificial Sequence
  Description of Artificial Sequence: Synthetic oligonucleotide
  Target: SCN10A; (+) strand; PAM type: NRG; PAM sequence: TGG
gtggtcttaggctgacttct

SEQ ID NO: 33894 - DNA, 20 bp, Artificial Sequence
  Description of Artificial Sequence: Synthetic oligonucleotide
  Target: SCN10A; (+) strand; PAM type: NRG; PAM sequence: GGG
tggtcttaggctgacttctt

SEQ ID NO: 33895 - DNA, 20 bp, Artificial Sequence
  Description of Artificial Sequence: Synthetic oligonucleotide
  Target: SCN10A; (+) strand; PAM type: NRG; PAM sequence: AAG
taggctgacttcttgggaat

SEQ ID NO: 33896 - DNA, 20 bp, Artificial Sequence
  Description of Artificial Sequence: Synthetic oligonucleotide
  Target: SCN10A; (+) strand; PAM type: NRG; PAM sequence: TAG
tttccttttcatatcaactt

SEQ ID NO: 33897 - DNA, 20 bp, Artificial Sequence
  Description of Artificial Sequence: Synthetic oligonucleotide
  Target: SCN10A; (+) strand; PAM type: NRG; PAM sequence: AGG
ttccttttcatatcaacttt

SEQ ID NO: 33898 - DNA, 20 bp, Artificial Sequence
  Description of Artificial Sequence: Synthetic oligonucleotide
  Target: SCN10A; (+) strand; PAM type: NRG; PAM sequence: CAG
tcaactttaggatgtgacct

SEQ ID NO: 33899 - DNA, 20 bp, Artificial Sequence
  Description of Artificial Sequence: Synthetic oligonucleotide
  Target: SCN10A; (+) strand; PAM type: NRG; PAM sequence: TAG
tttaggatgtgacctcagcc

SEQ ID NO: 33900 - DNA, 20 bp, Artificial Sequence
  Description of Artificial Sequence: Synthetic oligonucleotide
  Target: SCN10A; (+) strand; PAM type: NRG; PAM sequence: AGG
ttaggatgtgacctcagcct

SEQ ID NO: 33901 - DNA, 20 bp, Artificial Sequence
  Description of Artificial Sequence: Synthetic oligonucleotide
  Target: SCN10A; (+) strand; PAM type: NRG; PAM sequence: GAG
cctaggtgctgccaaaacat

SEQ ID NO: 33902 - DNA, 20 bp, Artificial Sequence
  Description of Artificial Sequence: Synthetic oligonucleotide
  Target: SCN10A; (+) strand; PAM type: NRG; PAM sequence: AGG
ctaggtgctgccaaaacatg

SEQ ID NO: 33903 - DNA, 20 bp, Artificial Sequence
  Description of Artificial Sequence: Synthetic oligonucleotide
  Target: SCN10A; (+) strand; PAM type: NRG; PAM sequence: CAG
atgctgattccaccatgttc

SEQ ID NO: 33904 - DNA, 20 bp, Artificial Sequence
  Description of Artificial Sequence: Synthetic oligonucleotide
  Target: SCN10A; (+) strand; PAM type: NRG; PAM sequence: CAG
acctactgctgcccctttca

SEQ ID NO: 33905 - DNA, 20 bp, Artificial Sequence
  Description of Artificial Sequence: Synthetic oligonucleotide
  Target: SCN10A; (+) strand; PAM type: NRG; PAM sequence: TGG
tgctgcccctttcacagccc

SEQ ID NO: 33906 - DNA, 20 bp, Artificial Sequence
  Description of Artificial Sequence: Synthetic oligonucleotide
  Target: SCN10A; (+) strand; PAM type: NRG; PAM sequence: TGG
cctttcacagccctggatta

SEQ ID NO: 33907 - DNA, 20 bp, Artificial Sequence
  Description of Artificial Sequence: Synthetic oligonucleotide
  Target: SCN10A; (+) strand; PAM type: NRG; PAM sequence: CGG
ttcacagccctggattatgg

SEQ ID NO: 33908 - DNA, 20 bp, Artificial Sequence
  Description of Artificial Sequence: Synthetic oligonucleotide
  Target: SCN10A; (+) strand; PAM type: NRG; PAM sequence: GAG
cacagccctggattatggcg

SEQ ID NO: 33909 - DNA, 20 bp, Artificial Sequence
  Description of Artificial Sequence: Synthetic oligonucleotide
  Target: SCN10A; (+) strand; PAM type: NRG; PAM sequence: AGG
acagccctggattatggcgg

SEQ ID NO: 33910 - DNA, 20 bp, Artificial Sequence
  Description of Artificial Sequence: Synthetic oligonucleotide
  Target: SCN10A; (+) strand; PAM type: NRG; PAM sequence: GGG
cagccctggattatggcgga

SEQ ID NO: 33911 - DNA, 20 bp, Artificial Sequence
  Description of Artificial Sequence: Synthetic oligonucleotide
  Target: SCN10A; (+) strand; PAM type: NRG; PAM sequence: GAG
gccctggattatggcggagg

SEQ ID NO: 33912 - DNA, 20 bp, Artificial Sequence
  Description of Artificial Sequence: Synthetic oligonucleotide
  Target: SCN10A; (+) strand; PAM type: NRG; PAM sequence: TGG
ctggattatggcggagggag

SEQ ID NO: 33913 - DNA, 20 bp, Artificial Sequence
  Description of Artificial Sequence: Synthetic oligonucleotide
  Target: SCN10A; (+) strand; PAM type: NRG; PAM sequence: TAG
atggcggagggagtggtttc

SEQ ID NO: 33914 - DNA, 20 bp, Artificial Sequence
  Description of Artificial Sequence: Synthetic oligonucleotide
  Target: SCN10A; (+) strand; PAM type: NRG; PAM sequence: AGG
tggcggagggagtggtttct

SEQ ID NO: 33915 - DNA, 20 bp, Artificial Sequence
  Description of Artificial Sequence: Synthetic oligonucleotide
  Target: SCN10A; (+) strand; PAM type: NRG; PAM sequence: GGG
ggcggagggagtggtttcta

SEQ ID NO: 33916 - DNA, 20 bp, Artificial Sequence
  Description of Artificial Sequence: Synthetic oligonucleotide
  Target: SCN10A; (+) strand; PAM type: NRG; PAM sequence: AAG
agggagtggtttctagggac

SEQ ID NO: 33917 - DNA, 20 bp, Artificial Sequence
  Description of Artificial Sequence: Synthetic oligonucleotide
  Target: SCN10A; (+) strand; PAM type: NRG; PAM sequence: TAG
gagtggtttctagggacaag

SEQ ID NO: 33918 - DNA, 20 bp, Artificial Sequence
  Description of Artificial Sequence: Synthetic oligonucleotide
  Target: SCN10A; (+) strand; PAM type: NRG; PAM sequence: TGG
acaagtagtcacatttcctc

SEQ ID NO: 33919 - DNA, 20 bp, Artificial Sequence
  Description of Artificial Sequence: Synthetic oligonucleotide
  Target: SCN10A; (+) strand; PAM type: NRG; PAM sequence: GGG
caagtagtcacatttcctct

SEQ ID NO: 33920 - DNA, 20 bp, Artificial Sequence
  Description of Artificial Sequence: Synthetic oligonucleotide
  Target: SCN10A; (+) strand; PAM type: NRG; PAM sequence: AAG
tgggccttccccctccacct

SEQ ID NO: 33921 - DNA, 20 bp, Artificial Sequence
  Description of Artificial Sequence: Synthetic oligonucleotide
  Target: SCN10A; (+) strand; PAM type: NRG; PAM sequence: CAG
tccccctccacctaagtctg

SEQ ID NO: 33922 - DNA, 20 bp, Artificial Sequence
  Description of Artificial Sequence: Synthetic oligonucleotide
  Target: SCN10A; (+) strand; PAM type: NRG; PAM sequence: AAG
cacctaagtctgcagcctat

SEQ ID NO: 33923 - DNA, 20 bp, Artificial Sequence
  Description of Artificial Sequence: Synthetic oligonucleotide
  Target: SCN10A; (+) strand; PAM type: NRG; PAM sequence: AAG
ctaagtctgcagcctataag

SEQ ID NO: 33924 - DNA, 20 bp, Artificial Sequence
  Description of Artificial Sequence: Synthetic oligonucleotide
  Target: SCN10A; (+) strand; PAM type: NRG; PAM sequence: TGG
gtctgcagcctataagaagc

SEQ ID NO: 33925 - DNA, 20 bp, Artificial Sequence
  Description of Artificial Sequence: Synthetic oligonucleotide
  Target: SCN10A; (+) strand; PAM type: NRG; PAM sequence: AAG
ctataagaagctggacccca

SEQ ID NO: 33926 - DNA, 20 bp, Artificial Sequence
  Description of Artificial Sequence: Synthetic oligonucleotide
  Target: SCN10A; (+) strand; PAM type: NRG; PAM sequence: CAG
aagaagctggaccccaaagc

SEQ ID NO: 33927 - DNA, 20 bp, Artificial Sequence
  Description of Artificial Sequence: Synthetic oligonucleotide
  Target: SCN10A; (+) strand; PAM type: NRG; PAM sequence: CAG
agctggaccccaaagccaga

SEQ ID NO: 33928 - DNA, 20 bp, Artificial Sequence
  Description of Artificial Sequence: Synthetic oligonucleotide
  Target: SCN10A; (+) strand; PAM type: NRG; PAM sequence: TGG
accccaaagccagacagttc

SEQ ID NO: 33929 - DNA, 20 bp, Artificial Sequence
  Description of Artificial Sequence: Synthetic oligonucleotide
  Target: SCN10A; (+) strand; PAM type: NRG; PAM sequence: CAG
ccagacagttctggtgaatc

SEQ ID NO: 33930 - DNA, 20 bp, Artificial Sequence
  Description of Artificial Sequence: Synthetic oligonucleotide
  Target: SCN10A; (+) strand; PAM type: NRG; PAM sequence: TAG
gacagttctggtgaatccag

SEQ ID NO: 33931 - DNA, 20 bp, Artificial Sequence
  Description of Artificial Sequence: Synthetic oligonucleotide
  Target: SCN10A; (+) strand; PAM type: NRG; PAM sequence: AGG
acagttctggtgaatccagt

SEQ ID NO: 33932 - DNA, 20 bp, Artificial Sequence
  Description of Artificial Sequence: Synthetic oligonucleotide
  Target: SCN10A; (+) strand; PAM type: NRG; PAM sequence: CAG
tgaatccagtaggtcacctc

SEQ ID NO: 33933 - DNA, 20 bp, Artificial Sequence
  Description of Artificial Sequence: Synthetic oligonucleotide
  Target: SCN10A; (+) strand; PAM type: NRG; PAM sequence: TGG
ccagtaggtcacctccagct

SEQ ID NO: 33934 - DNA, 20 bp, Artificial Sequence
  Description of Artificial Sequence: Synthetic oligonucleotide
  Target: SCN10A; (+) strand; PAM type: NRG; PAM sequence: TGG
gtaggtcacctccagcttgg

SEQ ID NO: 33935 - DNA, 20 bp, Artificial Sequence
  Description of Artificial Sequence: Synthetic oligonucleotide
  Target: SCN10A; (+) strand; PAM type: NRG; PAM sequence: CGG
cagcttggtggaccctgctg

SEQ ID NO: 33936 - DNA, 20 bp, Artificial Sequence
  Description of Artificial Sequence: Synthetic oligonucleotide
  Target: SCN10A; (+) strand; PAM type: NRG; PAM sequence: AAG
tggaccctgctgcggacatg

SEQ ID NO: 33937 - DNA, 20 bp, Artificial Sequence
  Description of Artificial Sequence: Synthetic oligonucleotide
  Target: SCN10A; (+) strand; PAM type: NRG; PAM sequence: AGG
ggaccctgctgcggacatga

SEQ ID NO: 33938 - DNA, 20 bp, Artificial Sequence
  Description of Artificial Sequence: Synthetic oligonucleotide
  Target: SCN10A; (+) strand; PAM type: NRG; PAM sequence: CAG
ccctgctgcggacatgaagg

SEQ ID NO: 33939 - DNA, 20 bp, Artificial Sequence
  Description of Artificial Sequence: Synthetic oligonucleotide
  Target: SCN10A; (+) strand; PAM type: NRG; PAM sequence: AGG
cctgctgcggacatgaaggc

SEQ ID NO: 33940 - DNA, 20 bp, Artificial Sequence
  Description of Artificial Sequence: Synthetic oligonucleotide
  Target: SCN10A; (+) strand; PAM type: NRG; PAM sequence: TAG
ggcaggatgctgaccctttc

SEQ ID NO: 33941 - DNA, 20 bp, Artificial Sequence
  Description of Artificial Sequence: Synthetic oligonucleotide
  Target: SCN10A; (+) strand; PAM type: NRG; PAM sequence: AAG
acacacacacacacacacgc

SEQ ID NO: 33942 - DNA, 20 bp, Artificial Sequence
  Description of Artificial Sequence: Synthetic oligonucleotide
  Target: SCN10A; (+) strand; PAM type: NRG; PAM sequence: GAG
cacacacacgcaagtcttgt

SEQ ID NO: 33943 - DNA, 20 bp, Artificial Sequence
  Description of Artificial Sequence: Synthetic oligonucleotide
  Target: SCN10A; (+) strand; PAM type: NRG; PAM sequence: AGG
acacacacgcaagtcttgtg

SEQ ID NO: 33944 - DNA, 20 bp, Artificial Sequence
  Description of Artificial Sequence: Synthetic oligonucleotide
  Target: SCN10A; (+) strand; PAM type: NRG; PAM sequence: TGG
cacacgcaagtcttgtgagg

SEQ ID NO: 33945 - DNA, 20 bp, Artificial Sequence
  Description of Artificial Sequence: Synthetic oligonucleotide
  Target: SCN10A; (+) strand; PAM type: NRG; PAM sequence: CAG
tcttgtgaggtggcttaatt

SEQ ID NO: 33946 - DNA, 20 bp, Artificial Sequence
  Description of Artificial Sequence: Synthetic oligonucleotide
  Target: SCN10A; (+) strand; PAM type: NRG; PAM sequence: AGG
cttgtgaggtggcttaattc

SEQ ID NO: 33947 - DNA, 20 bp, Artificial Sequence
  Description of Artificial Sequence: Synthetic oligonucleotide
  Target: SCN10A; (+) strand; PAM type: NRG; PAM sequence: GGG
ttgtgaggtggcttaattca

SEQ ID NO: 33948 - DNA, 20 bp, Artificial Sequence
  Description of Artificial Sequence: Synthetic oligonucleotide
  Target: SCN10A; (+) strand; PAM type: NRG; PAM sequence: GGG
tgtgaggtggcttaattcag

SEQ ID NO: 33949 - DNA, 20 bp, Artificial Sequence
  Description of Artificial Sequence: Synthetic oligonucleotide
  Target: SCN10A; (+) strand; PAM type: NRG; PAM sequence: AAG
ggtggcttaattcaggggtt

SEQ ID NO: 33950 - DNA, 20 bp, Artificial Sequence
  Description of Artificial Sequence: Synthetic oligonucleotide
  Target: SCN10A; (+) strand; PAM type: NRG; PAM sequence: AAG
cttaattcaggggttaagaa

SEQ ID NO: 33951 - DNA, 20 bp, Artificial Sequence
  Description of Artificial Sequence: Synthetic oligonucleotide
  Target: SCN10A; (+) strand; PAM type: NRG; PAM sequence: CGG
aattcaggggttaagaaaag

SEQ ID NO: 33952 - DNA, 20 bp, Artificial Sequence
  Description of Artificial Sequence: Synthetic oligonucleotide
  Target: SCN10A; (+) strand; PAM type: NRG; PAM sequence: GGG
attcaggggttaagaaaagc

SEQ ID NO: 33953 - DNA, 20 bp, Artificial Sequence
  Description of Artificial Sequence: Synthetic oligonucleotide
  Target: SCN10A; (+) strand; PAM type: NRG; PAM sequence: TGG
ggggttaagaaaagcgggct

SEQ ID NO: 33954 - DNA, 20 bp, Artificial Sequence
  Description of Artificial Sequence: Synthetic oligonucleotide
  Target: SCN10A; (+) strand; PAM type: NRG; PAM sequence: CAG
gttaagaaaagcgggcttgg

SEQ ID NO: 33955 - DNA, 20 bp, Artificial Sequence
  Description of Artificial Sequence: Synthetic oligonucleotide
  Target: SCN10A; (+) strand; PAM type: NRG; PAM sequence: CGG
agaaaagcgggcttggcagc

SEQ ID NO: 33956 - DNA, 20 bp, Artificial Sequence
  Description of Artificial Sequence: Synthetic oligonucleotide
  Target: SCN10A; (+) strand; PAM type: NRG; PAM sequence: TGG
ggcttggcagccggtctgtc

SEQ ID NO: 33957 - DNA, 20 bp, Artificial Sequence
  Description of Artificial Sequence: Synthetic oligonucleotide
  Target: SCN10A; (+) strand; PAM type: NRG; PAM sequence: GGG
gcttggcagccggtctgtct

SEQ ID NO: 33958 - DNA, 20 bp, Artificial Sequence
  Description of Artificial Sequence: Synthetic oligonucleotide
  Target: SCN10A; (+) strand; PAM type: NRG; PAM sequence: TGG
tctgggttcaaattctgatg

SEQ ID NO: 33959 - DNA, 20 bp, Artificial Sequence
  Description of Artificial Sequence: Synthetic oligonucleotide
  Target: SCN10A; (+) strand; PAM type: NRG; PAM sequence: TGG
taaactcaactctatgatct

SEQ ID NO: 33960 - DNA, 20 bp, Artificial Sequence
  Description of Artificial Sequence: Synthetic oligonucleotide
  Target: SCN10A; (+) strand; PAM type: NRG; PAM sequence: GGG
aaactcaactctatgatctt

SEQ ID NO: 33961 - DNA, 20 bp, Artificial Sequence
  Description of Artificial Sequence: Synthetic oligonucleotide
  Target: SCN10A; (+) strand; PAM type: NRG; PAM sequence: AAG
ctcaactctatgatcttggg

SEQ ID NO: 33962 - DNA, 20 bp, Artificial Sequence
  Description of Artificial Sequence: Synthetic oligonucleotide
  Target: SCN10A; (+) strand; PAM type: NRG; PAM sequence: TGG
tgcatctccatttttccatc

SEQ ID NO: 33963 - DNA, 20 bp, Artificial Sequence
  Description of Artificial Sequence: Synthetic oligonucleotide
  Target: SCN10A; (+) strand; PAM type: NRG; PAM sequence: GGG
gcatctccatttttccatct

SEQ ID NO: 33964 - DNA, 20 bp, Artificial Sequence
  Description of Artificial Sequence: Synthetic oligonucleotide
  Target: SCN10A; (+) strand; PAM type: NRG; PAM sequence: AAG
ctccatttttccatctggga

SEQ ID NO: 33965 - DNA, 20 bp, Artificial Sequence
  Description of Artificial Sequence: Synthetic oligonucleotide
  Target: SCN10A; (+) strand; PAM type: NRG; PAM sequence: AGG
tccatttttccatctgggaa

SEQ ID NO: 33966 - DNA, 20 bp, Artificial Sequence
  Description of Artificial Sequence: Synthetic oligonucleotide
  Target: SCN10A; (+) strand; PAM type: NRG; PAM sequence: GGG
ccatttttccatctgggaaa

SEQ ID NO: 33967 - DNA, 20 bp, Artificial Sequence
  Description of Artificial Sequence: Synthetic oligonucleotide
  Target: SCN10A; (+) strand; PAM type: NRG; PAM sequence: AAG
catctgggaaagggaataac

SEQ ID NO: 33968 - DNA, 20 bp, Artificial Sequence
  Description of Artificial Sequence: Synthetic oligonucleotide
  Target: SCN10A; (+) strand; PAM type: NRG; PAM sequence: GAG
tctgggaaagggaataacaa

SEQ ID NO: 33969 - DNA, 20 bp, Artificial Sequence
  Description of Artificial Sequence: Synthetic oligonucleotide
  Target: SCN10A; (+) strand; PAM type: NRG; PAM sequence: TAG
taacaagagtgcctaccatg

SEQ ID NO: 33970 - DNA, 20 bp, Artificial Sequence
  Description of Artificial Sequence: Synthetic oligonucleotide
  Target: SCN10A; (+) strand; PAM type: NRG; PAM sequence: AGG
aacaagagtgcctaccatgt

SEQ ID NO: 33971 - DNA, 20 bp, Artificial Sequence
  Description of Artificial Sequence: Synthetic oligonucleotide
  Target: SCN10A; (+) strand; PAM type: NRG; PAM sequence: GGG
acaagagtgcctaccatgta

SEQ ID NO: 33972 - DNA, 20 bp, Artificial Sequence
  Description of Artificial Sequence: Synthetic oligonucleotide
  Target: SCN10A; (+) strand; PAM type: NRG; PAM sequence: GAG
ggttgttgtgaaaataaaat

SEQ ID NO: 33973 - DNA, 20 bp, Artificial Sequence
  Description of Artificial Sequence: Synthetic oligonucleotide
  Target: SCN10A; (+) strand; PAM type: NRG; PAM sequence: GAG
aataaaatgagataatccat

SEQ ID NO: 33974 - DNA, 20 bp, Artificial Sequence
  Description of Artificial Sequence: Synthetic oligonucleotide
  Target: SCN10A; (+) strand; PAM type: NRG; PAM sequence: AAG
aaaatgagataatccatgag

SEQ ID NO: 33975 - DNA, 20 bp, Artificial Sequence
  Description of Artificial Sequence: Synthetic oligonucleotide
  Target: SCN10A; (+) strand; PAM type: NRG; PAM sequence: GAG
ataatccatgagaagcatct

SEQ ID NO: 33976 - DNA, 20 bp, Artificial Sequence
  Description of Artificial Sequence: Synthetic oligonucleotide
  Target: SCN10A; (+) strand; PAM type: NRG; PAM sequence: TGG
gagtattattactattcctg

SEQ ID NO: 33977 - DNA, 20 bp, Artificial Sequence
  Description of Artificial Sequence: Synthetic oligonucleotide
  Target: SCN10A; (+) strand; PAM type: NRG; PAM sequence: GGG
agtattattactattcctgt

SEQ ID NO: 33978 - DNA, 20 bp, Artificial Sequence
  Description of Artificial Sequence: Synthetic oligonucleotide
  Target: SCN10A; (+) strand; PAM type: NRG; PAM sequence: TGG
attattactattcctgtggg

SEQ ID NO: 33979 - DNA, 20 bp, Artificial Sequence
  Description of Artificial Sequence: Synthetic oligonucleotide
  Target: SCN10A; (+) strand; PAM type: NRG; PAM sequence: GGG
ttattactattcctgtgggt

SEQ ID NO: 33980 - DNA, 20 bp, Artificial Sequence
  Description of Artificial Sequence: Synthetic oligonucleotide
  Target: SCN10A; (+) strand; PAM type: NRG; PAM sequence: GGG
tattactattcctgtgggtg

SEQ ID NO: 33981 - DNA, 20 bp, Artificial Sequence
  Description of Artificial Sequence: Synthetic oligonucleotide
  Target: SCN10A; (+) strand; PAM type: NRG; PAM sequence: AAG
actattcctgtgggtggggc

SEQ ID NO: 33982 - DNA, 20 bp, Artificial Sequence
  Description of Artificial Sequence: Synthetic oligonucleotide
  Target: SCN10A; (+) strand; PAM type: NRG; PAM sequence: AGG
ctattcctgtgggtggggca

SEQ ID NO: 33983 - DNA, 20 bp, Artificial Sequence
  Description of Artificial Sequence: Synthetic oligonucleotide
  Target: SCN10A; (+) strand; PAM type: NRG; PAM sequence: TGG
tcctgtgggtggggcaaggt

SEQ ID NO: 33984 - DNA, 20 bp, Artificial Sequence
  Description of Artificial Sequence: Synthetic oligonucleotide
  Target: SCN10A; (+) strand; PAM type: NRG; PAM sequence: GAG
ctgtgggtggggcaaggttg

SEQ ID NO: 33985 - DNA, 20 bp, Artificial Sequence
  Description of Artificial Sequence: Synthetic oligonucleotide
  Target: SCN10A; (+) strand; PAM type: NRG; PAM sequence: CAG
tgggtggggcaaggttggag

SEQ ID NO: 33986 - DNA, 20 bp, Artificial Sequence
  Description of Artificial Sequence: Synthetic oligonucleotide
  Target: SCN10A; (+) strand; PAM type: NRG; PAM sequence: GAG
ggagcagttgttgtccctct

SEQ ID NO: 33987 - DNA, 20 bp, Artificial Sequence
  Description of Artificial Sequence: Synthetic oligonucleotide
  Target: SCN10A; (+) strand; PAM type: NRG; PAM sequence: CAG
cagttgttgtccctctgagt

SEQ ID NO: 33988 - DNA, 20 bp, Artificial Sequence
  Description of Artificial Sequence: Synthetic oligonucleotide
  Target: SCN10A; (+) strand; PAM type: NRG; PAM sequence: CAG
tctgagtcagatactttatc

SEQ ID NO: 33989 - DNA, 20 bp, Artificial Sequence
  Description of Artificial Sequence: Synthetic oligonucleotide
  Target: SCN10A; (+) strand; PAM type: NRG; PAM sequence: TAG
cagatactttatccagtata

SEQ ID NO: 33990 - DNA, 20 bp, Artificial Sequence
  Description of Artificial Sequence: Synthetic oligonucleotide
  Target: SCN10A; (+) strand; PAM type: NRG; PAM sequence: CAG
atccagtatatagtgaaatc

SEQ ID NO: 33991 - DNA, 20 bp, Artificial Sequence
  Description of Artificial Sequence: Synthetic oligonucleotide
  Target: SCN10A; (+) strand; PAM type: NRG; PAM sequence: TGG
gtatatagtgaaatccagta

SEQ ID NO: 33992 - DNA, 20 bp, Artificial Sequence
  Description of Artificial Sequence: Synthetic oligonucleotide
  Target: SCN10A; (+) strand; PAM type: NRG; PAM sequence: AAG
agtatggattgtatcttgtt

SEQ ID NO: 33993 - DNA, 20 bp, Artificial Sequence
  Description of Artificial Sequence: Synthetic oligonucleotide
  Target: SCN10A; (+) strand; PAM type: NRG; PAM sequence: GAG
tatggattgtatcttgttaa

SEQ ID NO: 33994 - DNA, 20 bp, Artificial Sequence
  Description of Artificial Sequence: Synthetic oligonucleotide
  Target: SCN10A; (+) strand; PAM type: NRG; PAM sequence: AAG
taagagtaaataatactaac

SEQ ID NO: 33995 - DNA, 20 bp, Artificial Sequence
  Description of Artificial Sequence: Synthetic oligonucleotide
  Target: SCN10A; (+) strand; PAM type: NRG; PAM sequence: TGG
taaataatactaacaagtga

SEQ ID NO: 33996 - DNA, 20 bp, Artificial Sequence
  Description of Artificial Sequence: Synthetic oligonucleotide
  Target: SCN10A; (+) strand; PAM type: NRG; PAM sequence: GAG
aataatactaacaagtgatg

SEQ ID NO: 33997 - DNA, 20 bp, Artificial Sequence
  Description of Artificial Sequence: Synthetic oligonucleotide
  Target: SCN10A; (+) strand; PAM type: NRG; PAM sequence: AGG
ataatactaacaagtgatgg

SEQ ID NO: 33998 - DNA, 20 bp, Artificial Sequence
  Description of Artificial Sequence: Synthetic oligonucleotide
  Target: SCN10A; (+) strand; PAM type: NRG; PAM sequence: AAG
aagtgatggaggaaaattta

SEQ ID NO: 33999 - DNA, 20 bp, Artificial Sequence
  Description of Artificial Sequence: Synthetic oligonucleotide
  Target: SCN10A; (+) strand; PAM type: NRG; PAM sequence: CAG
tgatggaggaaaatttaaag

SEQ ID NO: 34000 - DNA, 20 bp, Artificial Sequence
  Description of Artificial Sequence: Synthetic oligonucleotide
  Target: SCN10A; (+) strand; PAM type: NRG; PAM sequence: TAG
aagcagcatgatgtctaaac

SEQ ID NO: 34001 - DNA, 20 bp, Artificial Sequence
  Description of Artificial Sequence: Synthetic oligonucleotide
  Target: SCN10A; (+) strand; PAM type: NRG; PAM sequence: AAG
gatgtctaaactagatgcca

SEQ ID NO: 34002 - DNA, 20 bp, Artificial Sequence
  Description of Artificial Sequence: Synthetic oligonucleotide
  Target: SCN10A; (+) strand; PAM type: NRG; PAM sequence: AAG
ctaaactagatgccaaagaa

SEQ ID NO: 34003 - DNA, 20 bp, Artificial Sequence
  Description of Artificial Sequence: Synthetic oligonucleotide
  Target: SCN10A; (+) strand; PAM type: NRG; PAM sequence: CAG
tcctgatgcttttgttacaa

SEQ ID NO: 34004 - DNA, 20 bp, Artificial Sequence
  Description of Artificial Sequence: Synthetic oligonucleotide
  Target: SCN10A; (+) strand; PAM type: NRG; PAM sequence: AAG
ccccaactctttttctcctt

SEQ ID NO: 34005 - DNA, 20 bp, Artificial Sequence
  Description of Artificial Sequence: Synthetic oligonucleotide
  Target: SCN10A; (+) strand; PAM type: NRG; PAM sequence: TGG
agtgacaacattgaaaatcg

SEQ ID NO: 34006 - DNA, 20 bp, Artificial Sequence
  Description of Artificial Sequence: Synthetic oligonucleotide
  Target: SCN10A; (+) strand; PAM type: NRG; PAM sequence: TGG
atcgtggctactgttaattg

SEQ ID NO: 34007 - DNA, 20 bp, Artificial Sequence
  Description of Artificial Sequence: Synthetic oligonucleotide
  Target: SCN10A; (+) strand; PAM type: NRG; PAM sequence: AAG
actgttaattgtggtcataa

SEQ ID NO: 34008 - DNA, 20 bp, Artificial Sequence
  Description of Artificial Sequence: Synthetic oligonucleotide
  Target: SCN10A; (+) strand; PAM type: NRG; PAM sequence: TGG
ggtcataaaagtaattacat

SEQ ID NO: 34009 - DNA, 20 bp, Artificial Sequence
  Description of Artificial Sequence: Synthetic oligonucleotide
  Target: SCN10A; (+) strand; PAM type: NRG; PAM sequence: AAG
cataaaagtaattacattgg

SEQ ID NO: 34010 - DNA, 20 bp, Artificial Sequence
  Description of Artificial Sequence: Synthetic oligonucleotide
  Target: SCN10A; (+) strand; PAM type: NRG; PAM sequence: AGG
ataaaagtaattacattgga

SEQ ID NO: 34011 - DNA, 20 bp, Artificial Sequence
  Description of Artificial Sequence: Synthetic oligonucleotide
  Target: SCN10A; (+) strand; PAM type: NRG; PAM sequence: CAG
gtaattacattggaaggaaa

SEQ ID NO: 34012 - DNA, 20 bp, Artificial Sequence
  Description of Artificial Sequence: Synthetic oligonucleotide
  Target: SCN10A; (+) strand; PAM type: NRG; PAM sequence: AAG
tacattggaaggaaacagac

SEQ ID NO: 34013 - DNA, 20 bp, Artificial Sequence
  Description of Artificial Sequence: Synthetic oligonucleotide
  Target: SCN10A; (+) strand; PAM type: NRG; PAM sequence: AAG
gaaggaaacagacaagtcca

SEQ ID NO: 34014 - DNA, 20 bp, Artificial Sequence
  Description of Artificial Sequence: Synthetic oligonucleotide
  Target: SCN10A; (+) strand; PAM type: NRG; PAM sequence: TAG
acaagtccaaagattgtctt

SEQ ID NO: 34015 - DNA, 20 bp, Artificial Sequence
  Description of Artificial Sequence: Synthetic oligonucleotide
  Target: SCN10A; (+) strand; PAM type: NRG; PAM sequence: AAG
aagattgtctttagataaaa

SEQ ID NO: 34016 - DNA, 20 bp, Artificial Sequence
  Description of Artificial Sequence: Synthetic oligonucleotide
  Target: SCN10A; (+) strand; PAM type: NRG; PAM sequence: AAG
gtgacatttatcctcatttc

SEQ ID NO: 34017 - DNA, 20 bp, Artificial Sequence
  Description of Artificial Sequence: Synthetic oligonucleotide
  Target: SCN10A; (+) strand; PAM type: NRG; PAM sequence: AGG
tgacatttatcctcatttca

SEQ ID NO: 34018 - DNA, 20 bp, Artificial Sequence
  Description of Artificial Sequence: Synthetic oligonucleotide
  Target: SCN10A; (+) strand; PAM type: NRG; PAM sequence: TAG
catttatcctcatttcaagg

SEQ ID NO: 34019 - DNA, 20 bp, Artificial Sequence
  Description of Artificial Sequence: Synthetic oligonucleotide
  Target: SCN10A; (+) strand; PAM type: NRG; PAM sequence: GAG
tttatcctcatttcaaggta

SEQ ID NO: 34020 - DNA, 20 bp, Artificial Sequence
  Description of Artificial Sequence: Synthetic oligonucleotide
  Target: SCN10A; (+) strand; PAM type: NRG; PAM sequence: AGG
ttatcctcatttcaaggtag

SEQ ID NO: 34021 - DNA, 20 bp, Artificial Sequence
  Description of Artificial Sequence: Synthetic oligonucleotide
  Target: SCN10A; (+) strand; PAM type: NRG; PAM sequence: GAG
atttcaaggtagaggcaact

SEQ ID NO: 34022 - DNA, 20 bp, Artificial Sequence
  Description of Artificial Sequence: Synthetic oligonucleotide
  Target: SCN10A; (+) strand; PAM type: NRG; PAM sequence: CAG
aggtagaggcaactgagatc

SEQ ID NO: 34023 - DNA, 20 bp, Artificial Sequence
  Description of Artificial Sequence: Synthetic oligonucleotide
  Target: SCN10A; (+) strand; PAM type: NRG; PAM sequence: AAG
aactgagatccagaaaattc

SEQ ID NO: 34024 - DNA, 20 bp, Artificial Sequence
  Description of Artificial Sequence: Synthetic oligonucleotide
  Target: SCN10A; (+) strand; PAM type: NRG; PAM sequence: TGG
tgagatccagaaaattcaag

SEQ ID NO: 34025 - DNA, 20 bp, Artificial Sequence
  Description of Artificial Sequence: Synthetic oligonucleotide
  Target: SCN10A; (+) strand; PAM type: NRG; PAM sequence: AAG
tggttgtcctatgttttgta

SEQ ID NO: 34026 - DNA, 20 bp, Artificial Sequence
  Description of Artificial Sequence: Synthetic oligonucleotide
  Target: SCN10A; (+) strand; PAM type: NRG; PAM sequence: AGG
ggttgtcctatgttttgtaa

SEQ ID NO: 34027 - DNA, 20 bp, Artificial Sequence
  Description of Artificial Sequence: Synthetic oligonucleotide
  Target: SCN10A; (+) strand; PAM type: NRG; PAM sequence: GGG
gttgtcctatgttttgtaaa

SEQ ID NO: 34028 - DNA, 20 bp, Artificial Sequence
  Description of Artificial Sequence: Synthetic oligonucleotide
  Target: SCN10A; (+) strand; PAM type: NRG; PAM sequence: TAG
tatgttttgtaaagggcaac

SEQ ID NO: 34029 - DNA, 20 bp, Artificial Sequence
  Description of Artificial Sequence: Synthetic oligonucleotide
  Target: SCN10A; (+) strand; PAM type: NRG; PAM sequence: TGG
aaagggcaactagctgcctc

SEQ ID NO: 34030 - DNA, 20 bp, Artificial Sequence
  Description of Artificial Sequence: Synthetic oligonucleotide
  Target: SCN10A; (+) strand; PAM type: NRG; PAM sequence: CAG
caactagctgcctctggctc

SEQ ID NO: 34031 - DNA, 20 bp, Artificial Sequence
  Description of Artificial Sequence: Synthetic oligonucleotide
  Target: SCN10A; (+) strand; PAM type: NRG; PAM sequence: AGG
aactagctgcctctggctcc

SEQ ID NO: 34032 - DNA, 20 bp, Artificial Sequence
  Description of Artificial Sequence: Synthetic oligonucleotide
  Target: SCN10A; (+) strand; PAM type: NRG; PAM sequence: TGG
cctctggctccaggctctcc

SEQ ID NO: 34033 - DNA, 20 bp, Artificial Sequence
  Description of Artificial Sequence: Synthetic oligonucleotide
  Target: SCN10A; (+) strand; PAM type: NRG; PAM sequence: AAG
tcctgtgcttgttcatccca

SEQ ID NO: 34034 - DNA, 20 bp, Artificial Sequence
  Description of Artificial Sequence: Synthetic oligonucleotide
  Target: SCN10A; (+) strand; PAM type: NRG; PAM sequence: CAG
catcccaaagccattcccac

SEQ ID NO: 34035 - DNA, 20 bp, Artificial Sequence
  Description of Artificial Sequence: Synthetic oligonucleotide
  Target: SCN10A; (+) strand; PAM type: NRG; PAM sequence: CAG
caaagccattcccaccagct

SEQ ID NO: 34036 - DNA, 20 bp, Artificial Sequence
  Description of Artificial Sequence: Synthetic oligonucleotide
  Target: SCN10A; (+) strand; PAM type: NRG; PAM sequence: TGG
ccattcccaccagctcagcc

SEQ ID NO: 34037 - DNA, 20 bp, Artificial Sequence
  Description of Artificial Sequence: Synthetic oligonucleotide
  Target: SCN10A; (+) strand; PAM type: NRG; PAM sequence: GGG
cattcccaccagctcagcct

SEQ ID NO: 34038 - DNA, 20 bp, Artificial Sequence
  Description of Artificial Sequence: Synthetic oligonucleotide
  Target: SCN10A; (+) strand; PAM type: NRG; PAM sequence: CAG
cacacttgacctcctgaacc

SEQ ID NO: 34039 - DNA, 20 bp, Artificial Sequence
  Description of Artificial Sequence: Synthetic oligonucleotide
  Target: SCN10A; (+) strand; PAM type: NRG; PAM sequence: CAG
ctgcactgctgctctgctct

SEQ ID NO: 34040 - DNA, 20 bp, Artificial Sequence
  Description of Artificial Sequence: Synthetic oligonucleotide
  Target: SCN10A; (+) strand; PAM type: NRG; PAM sequence: TGG
ctgctctgctctcagctaac

SEQ ID NO: 34041 - DNA, 20 bp, Artificial Sequence
  Description of Artificial Sequence: Synthetic oligonucleotide
  Target: SCN10A; (+) strand; PAM type: NRG; PAM sequence: AAG
ggctcaacacactaaccaat

SEQ ID NO: 34042 - DNA, 20 bp, Artificial Sequence
  Description of Artificial Sequence: Synthetic oligonucleotide
  Target: SCN10A; (+) strand; PAM type: NRG; PAM sequence: AGG
gctcaacacactaaccaata

SEQ ID NO: 34043 - DNA, 20 bp, Artificial Sequence
  Description of Artificial Sequence: Synthetic oligonucleotide
  Target: SCN10A; (+) strand; PAM type: NRG; PAM sequence: GGG
ctcaacacactaaccaataa

SEQ ID NO: 34044 - DNA, 20 bp, Artificial Sequence
  Description of Artificial Sequence: Synthetic oligonucleotide
  Target: SCN10A; (+) strand; PAM type: NRG; PAM sequence: CAG
ccaccccgccccgaccacgc

SEQ ID NO: 34045 - DNA, 20 bp, Artificial Sequence
  Description of Artificial Sequence: Synthetic oligonucleotide
  Target: SCN10A; (+) strand; PAM type: NRG; PAM sequence: GAG
cccgccccgaccacgccagt

SEQ ID NO: 34046 - DNA, 20 bp, Artificial Sequence
  Description of Artificial Sequence: Synthetic oligonucleotide
  Target: SCN10A; (+) strand; PAM type: NRG; PAM sequence: AGG
ccgccccgaccacgccagtg

SEQ ID NO: 34047 - DNA, 20 bp, Artificial Sequence
  Description of Artificial Sequence: Synthetic oligonucleotide
  Target: SCN10A; (+) strand; PAM type: NRG; PAM sequence: GGG
cgccccgaccacgccagtga

SEQ ID NO: 34048 - DNA, 20 bp, Artificial Sequence
  Description of Artificial Sequence: Synthetic oligonucleotide
  Target: SCN10A; (+) strand; PAM type: NRG; PAM sequence: CAG
cccgaccacgccagtgaggg

SEQ ID NO: 34049 - DNA, 20 bp, Artificial Sequence
  Description of Artificial Sequence: Synthetic oligonucleotide
  Target: SCN10A; (+) strand; PAM type: NRG; PAM sequence: CAG
cacgccagtgagggcagtac

SEQ ID NO: 34050 - DNA, 20 bp, Artificial Sequence
  Description of Artificial Sequence: Synthetic oligonucleotide
  Target: SCN10A; (+) strand; PAM type: NRG; PAM sequence: CAG
ccagtgagggcagtaccagc

SEQ ID NO: 34051 - DNA, 20 bp, Artificial Sequence
  Description of Artificial Sequence: Synthetic oligonucleotide
  Target: SCN10A; (+) strand; PAM type: NRG; PAM sequence: GAG
agtgagggcagtaccagcca

SEQ ID NO: 34052 - DNA, 20 bp, Artificial Sequence
  Description of Artificial Sequence: Synthetic oligonucleotide
  Target: SCN10A; (+) strand; PAM type: NRG; PAM sequence: TGG
cactcacgatgttgcctatc

SEQ ID NO: 34053 - DNA, 20 bp, Artificial Sequence
  Description of Artificial Sequence: Synthetic oligonucleotide
  Target: SCN10A; (+) strand; PAM type: NRG; PAM sequence: GAG
ctcacgatgttgcctatctg

SEQ ID NO: 34054 - DNA, 20 bp, Artificial Sequence
  Description of Artificial Sequence: Synthetic oligonucleotide
  Target: SCN10A; (+) strand; PAM type: NRG; PAM sequence: TGG
gatgttgcctatctggagca

SEQ ID NO: 34055 - DNA, 20 bp, Artificial Sequence
  Description of Artificial Sequence: Synthetic oligonucleotide
  Target: SCN10A; (+) strand; PAM type: NRG; PAM sequence: AAG
ctatctggagcatggcttcg

SEQ ID NO: 34056 - DNA, 20 bp, Artificial Sequence
  Description of Artificial Sequence: Synthetic oligonucleotide
  Target: SCN10A; (+) strand; PAM type: NRG; PAM sequence: AGG
tatctggagcatggcttcga

SEQ ID NO: 34057 - DNA, 20 bp, Artificial Sequence
  Description of Artificial Sequence: Synthetic oligonucleotide
  Target: SCN10A; (+) strand; PAM type: NRG; PAM sequence: TAG
ctggagcatggcttcgaagg

SEQ ID NO: 34058 - DNA, 20 bp, Artificial Sequence
  Description of Artificial Sequence: Synthetic oligonucleotide
  Target: SCN10A; (+) strand; PAM type: NRG; PAM sequence: AGG
tggagcatggcttcgaaggt

SEQ ID NO: 34059 - DNA, 20 bp, Artificial Sequence
  Description of Artificial Sequence: Synthetic oligonucleotide
  Target: SCN10A; (+) strand; PAM type: NRG; PAM sequence: GGG
ggagcatggcttcgaaggta

SEQ ID NO: 34060 - DNA, 20 bp, Artificial Sequence
  Description of Artificial Sequence: Synthetic oligonucleotide
  Target: SCN10A; (+) strand; PAM type: NRG; PAM sequence: TGG
cgaaggtagggctcatgcca

SEQ ID NO: 34061 - DNA, 20 bp, Artificial Sequence
  Description of Artificial Sequence: Synthetic oligonucleotide
  Target: SCN10A; (+) strand; PAM type: NRG; PAM sequence: TGG
gctcatgccatggtgctcca

SEQ ID NO: 34062 - DNA, 20 bp, Artificial Sequence
  Description of Artificial Sequence: Synthetic oligonucleotide
  Target: SCN10A; (+) strand; PAM type: NRG; PAM sequence: AAG
catggtgctccatggccatg

SEQ ID NO: 34063 - DNA, 20 bp, Artificial Sequence
  Description of Artificial Sequence: Synthetic oligonucleotide
  Target: SCN10A; (+) strand; PAM type: NRG; PAM sequence: TGG
gtgctccatggccatgaaga

SEQ ID NO: 34064 - DNA, 20 bp, Artificial Sequence
  Description of Artificial Sequence: Synthetic oligonucleotide
  Target: SCN10A; (+) strand; PAM type: NRG; PAM sequence: AAG
tggtgttcaccacgatgcac

SEQ ID NO: 34065 - DNA, 20 bp, Artificial Sequence
  Description of Artificial Sequence: Synthetic oligonucleotide
  Target: SCN10A; (+) strand; PAM type: NRG; PAM sequence: AGG
ggtgttcaccacgatgcaca

SEQ ID NO: 34066 - DNA, 20 bp, Artificial Sequence
  Description of Artificial Sequence: Synthetic oligonucleotide
  Target: SCN10A; (+) strand; PAM type: NRG; PAM sequence: TGG
caccacgatgcacaaggtga

SEQ ID NO: 34067 - DNA, 20 bp, Artificial Sequence
  Description of Artificial Sequence: Synthetic oligonucleotide
  Target: SCN10A; (+) strand; PAM type: NRG; PAM sequence: GAG
acgatgcacaaggtgatggt

SEQ ID NO: 34068 - DNA, 20 bp, Artificial Sequence
  Description of Artificial Sequence: Synthetic oligonucleotide
  Target: SCN10A; (+) strand; PAM type: NRG; PAM sequence: AAG
aggtgatggtgagctctgca

SEQ ID NO: 34069 - DNA, 20 bp, Artificial Sequence
  Description of Artificial Sequence: Synthetic oligonucleotide
  Target: SCN10A; (+) strand; PAM type: NRG; PAM sequence: AGG
ggtgatggtgagctctgcaa

SEQ ID NO: 34070 - DNA, 20 bp, Artificial Sequence
  Description of Artificial Sequence: Synthetic oligonucleotide
  Target: SCN10A; (+) strand; PAM type: NRG; PAM sequence: GGG
gtgatggtgagctctgcaaa

SEQ ID NO: 34071 - DNA, 20 bp, Artificial Sequence
  Description of Artificial Sequence: Synthetic oligonucleotide
  Target: SCN10A; (+) strand; PAM type: NRG; PAM sequence: AAG
tctgcaaagggatccgtcac

SEQ ID NO: 34072 - DNA, 20 bp, Artificial Sequence
  Description of Artificial Sequence: Synthetic oligonucleotide
  Target: SCN10A; (+) strand; PAM type: NRG; PAM sequence: AAG
agggatccgtcacaagccca

SEQ ID NO: 34073 - DNA, 20 bp, Artificial Sequence
  Description of Artificial Sequence: Synthetic oligonucleotide
  Target: SCN10A; (+) strand; PAM type: NRG; PAM sequence: GAG
ggatccgtcacaagcccaaa

SEQ ID NO: 34074 - DNA, 20 bp, Artificial Sequence
  Description of Artificial Sequence: Synthetic oligonucleotide
  Target: SCN10A; (+) strand; PAM type: NRG; PAM sequence: GAG
agcccaaagagaattgtctt

SEQ ID NO: 34075 - DNA, 20 bp, Artificial Sequence
  Description of Artificial Sequence: Synthetic oligonucleotide
  Target: SCN10A; (+) strand; PAM type: NRG; PAM sequence: TGG
tgtcttgagcttcacccaca

SEQ ID NO: 34076 - DNA, 20 bp, Artificial Sequence
  Description of Artificial Sequence: Synthetic oligonucleotide
  Target: SCN10A; (+) strand; PAM type: NRG; PAM sequence: GGG
gtcttgagcttcacccacat

SEQ ID NO: 34077 - DNA, 20 bp, Artificial Sequence
  Description of Artificial Sequence: Synthetic oligonucleotide
  Target: SCN10A; (+) strand; PAM type: NRG; PAM sequence: GGG
tcttgagcttcacccacatg

SEQ ID NO: 34078 - DNA, 20 bp, Artificial Sequence
  Description of Artificial Sequence: Synthetic oligonucleotide
  Target: SCN10A; (+) strand; PAM type: NRG; PAM sequence: CAG
tgagcttcacccacatgggg

SEQ ID NO: 34079 - DNA, 20 bp, Artificial Sequence
  Description of Artificial Sequence: Synthetic oligonucleotide
  Target: SCN10A; (+) strand; PAM type: NRG; PAM sequence: CAG
cccacatggggcagcaatcc

SEQ ID NO: 34080 - DNA, 20 bp, Artificial Sequence
  Description of Artificial Sequence: Synthetic oligonucleotide
  Target: SCN10A; (+) strand; PAM type: NRG; PAM sequence: CAG
atggggcagcaatcccagat

SEQ ID NO: 34081 - DNA, 20 bp, Artificial Sequence
  Description of Artificial Sequence: Synthetic oligonucleotide
  Target: SCN10A; (+) strand; PAM type: NRG; PAM sequence: GAG
atcccagatcagatacttct

SEQ ID NO: 34082 - DNA, 20 bp, Artificial Sequence
  Description of Artificial Sequence: Synthetic oligonucleotide
  Target: SCN10A; (+) strand; PAM type: NRG; PAM sequence: AAG
agatcagatacttctgagac

SEQ ID NO: 34083 - DNA, 20 bp, Artificial Sequence
  Description of Artificial Sequence: Synthetic oligonucleotide
  Target: SCN10A; (+) strand; PAM type: NRG; PAM sequence: TGG
cagatacttctgagacaagc

SEQ ID NO: 34084 - DNA, 20 bp, Artificial Sequence
  Description of Artificial Sequence: Synthetic oligonucleotide
  Target: SCN10A; (+) strand; PAM type: NRG; PAM sequence: AAG
acttctgagacaagctggtc

SEQ ID NO: 34085 - DNA, 20 bp, Artificial Sequence
  Description of Artificial Sequence: Synthetic oligonucleotide
  Target: SCN10A; (+) strand; PAM type: NRG; PAM sequence: CAG
tctgagacaagctggtcaag

SEQ ID NO: 34086 - DNA, 20 bp, Artificial Sequence
  Description of Artificial Sequence: Synthetic oligonucleotide
  Target: SCN10A; (+) strand; PAM type: NRG; PAM sequence: AGG
ctgagacaagctggtcaagc

SEQ ID NO: 34087 - DNA, 20 bp, Artificial Sequence
  Description of Artificial Sequence: Synthetic oligonucleotide
  Target: SCN10A; (+) strand; PAM type: NRG; PAM sequence: GGG
tgagacaagctggtcaagca

SEQ ID NO: 34088 - DNA, 20 bp, Artificial Sequence
  Description of Artificial Sequence: Synthetic oligonucleotide
  Target: SCN10A; (+) strand; PAM type: NRG; PAM sequence: TGG
gacaagctggtcaagcaggg

SEQ ID NO: 34089 - DNA, 20 bp, Artificial Sequence
  Description of Artificial Sequence: Synthetic oligonucleotide
  Target: SCN10A; (+) strand; PAM type: NRG; PAM sequence: GGG
acaagctggtcaagcagggt

SEQ ID NO: 34090 - DNA, 20 bp, Artificial Sequence
  Description of Artificial Sequence: Synthetic oligonucleotide
  Target: SCN10A; (+) strand; PAM type: NRG; PAM sequence: CAG
gcagggtgggcacttctgtt

SEQ ID NO: 34091 - DNA, 20 bp, Artificial Sequence
  Description of Artificial Sequence: Synthetic oligonucleotide
  Target: SCN10A; (+) strand; PAM type: NRG; PAM sequence: GAG
cacttctgttcagactcctc

SEQ ID NO: 34092 - DNA, 20 bp, Artificial Sequence
  Description of Artificial Sequence: Synthetic oligonucleotide
  Target: SCN10A; (+) strand; PAM type: NRG; PAM sequence: TAG
actcctcgagttctgcatta

SEQ ID NO: 34093 - DNA, 20 bp, Artificial Sequence
  Description of Artificial Sequence: Synthetic oligonucleotide
  Target: SCN10A; (+) strand; PAM type: NRG; PAM sequence: TGG
tcgagttctgcattatagtg

SEQ ID NO: 34094 - DNA, 20 bp, Artificial Sequence
  Description of Artificial Sequence: Synthetic oligonucleotide
  Target: SCN10A; (+) strand; PAM type: NRG; PAM sequence: CAG
cattatagtgtggtcaatga

SEQ ID NO: 34095 - DNA, 20 bp, Artificial Sequence
  Description of Artificial Sequence: Synthetic oligonucleotide
  Target: SCN10A; (+) strand; PAM type: NRG; PAM sequence: CAG
gtgtggtcaatgacagctgt

SEQ ID NO: 34096 - DNA, 20 bp, Artificial Sequence
  Description of Artificial Sequence: Synthetic oligonucleotide
  Target: SCN10A; (+) strand; PAM type: NRG; PAM sequence: TGG
ctgtcagccatgtgtcacct

SEQ ID NO: 34097 - DNA, 20 bp, Artificial Sequence
  Description of Artificial Sequence: Synthetic oligonucleotide
  Target: SCN10A; (+) strand; PAM type: NRG; PAM sequence: CGG
caccttggaccccaattctg

SEQ ID NO: 34098 - DNA, 20 bp, Artificial Sequence
  Description of Artificial Sequence: Synthetic oligonucleotide
  Target: SCN10A; (+) strand; PAM type: NRG; PAM sequence: TAG
ccaattctgcggtcatcctc

SEQ ID NO: 34099 - DNA, 20 bp, Artificial Sequence
  Description of Artificial Sequence: Synthetic oligonucleotide
  Target: SCN10A; (+) strand; PAM type: NRG; PAM sequence: AAG
tagaccttgttgttaataat

SEQ ID NO: 34100 - DNA, 20 bp, Artificial Sequence
  Description of Artificial Sequence: Synthetic oligonucleotide
  Target: SCN10A; (+) strand; PAM type: NRG; PAM sequence: CAG
cacctccaacattttgactt

SEQ ID NO: 34101 - DNA, 20 bp, Artificial Sequence
  Description of Artificial Sequence: Synthetic oligonucleotide
  Target: SCN10A; (+) strand; PAM type: NRG; PAM sequence: TGG
ttcagccctctctctgtctc

SEQ ID NO: 34102 - DNA, 20 bp, Artificial Sequence
  Description of Artificial Sequence: Synthetic oligonucleotide
  Target: SCN10A; (+) strand; PAM type: NRG; PAM sequence: TAG
tcctatattttgaactcctt

SEQ ID NO: 34103 - DNA, 20 bp, Artificial Sequence
  Description of Artificial Sequence: Synthetic oligonucleotide
  Target: SCN10A; (+) strand; PAM type: NRG; PAM sequence: CAG
caattaatatctgccccatc

SEQ ID NO: 34104 - DNA, 20 bp, Artificial Sequence
  Description of Artificial Sequence: Synthetic oligonucleotide
  Target: SCN10A; (+) strand; PAM type: NRG; PAM sequence: CAG
tccttacttctcaatttgcc

SEQ ID NO: 34105 - DNA, 20 bp, Artificial Sequence
  Description of Artificial Sequence: Synthetic oligonucleotide
  Target: SCN10A; (+) strand; PAM type: NRG; PAM sequence: TAG
acttctcaatttgcccagct

SEQ ID NO: 34106 - DNA, 20 bp, Artificial Sequence
  Description of Artificial Sequence: Synthetic oligonucleotide
  Target: SCN10A; (+) strand; PAM type: NRG; PAM sequence: TAG
tctctctaactactcccttg

SEQ ID NO: 34107 - DNA, 20 bp, Artificial Sequence
  Description of Artificial Sequence: Synthetic oligonucleotide
  Target: SCN10A; (+) strand; PAM type: NRG; PAM sequence: AGG
ctctctaactactcccttgt

SEQ ID NO: 34108 - DNA, 20 bp, Artificial Sequence
  Description of Artificial Sequence: Synthetic oligonucleotide
  Target: SCN10A; (+) strand; PAM type: NRG; PAM sequence: TGG
cctccttcattgtacttgcc

SEQ ID NO: 34109 - DNA, 20 bp, Artificial Sequence
  Description of Artificial Sequence: Synthetic oligonucleotide
  Target: SCN10A; (+) strand; PAM type: NRG; PAM sequence: TAG
ggcaaaacctgaactgtgaa

SEQ ID NO: 34110 - DNA, 20 bp, Artificial Sequence
  Description of Artificial Sequence: Synthetic oligonucleotide
  Target: SCN10A; (+) strand; PAM type: NRG; PAM sequence: TAG
ctgtgaatagacccaatttg

SEQ ID NO: 34111 - DNA, 20 bp, Artificial Sequence
  Description of Artificial Sequence: Synthetic oligonucleotide
  Target: SCN10A; (+) strand; PAM type: NRG; PAM sequence: CAG
actctgtacttgcacccaac

SEQ ID NO: 34112 - DNA, 20 bp, Artificial Sequence
  Description of Artificial Sequence: Synthetic oligonucleotide
  Target: SCN10A; (+) strand; PAM type: NRG; PAM sequence: TGG
tgtacttgcacccaaccagc

SEQ ID NO: 34113 - DNA, 20 bp, Artificial Sequence
  Description of Artificial Sequence: Synthetic oligonucleotide
  Target: SCN10A; (+) strand; PAM type: NRG; PAM sequence: TGG
tgcacccaaccagctggacc

SEQ ID NO: 34114 - DNA, 20 bp, Artificial Sequence
  Description of Artificial Sequence: Synthetic oligonucleotide
  Target: SCN10A; (+) strand; PAM type: NRG; PAM sequence: TGG
cccaaccagctggacctggc

SEQ ID NO: 34115 - DNA, 20 bp, Artificial Sequence
  Description of Artificial Sequence: Synthetic oligonucleotide
  Target: SCN10A; (+) strand; PAM type: NRG; PAM sequence: TAG
actatgcttaccaaccctcc

SEQ ID NO: 34116 - DNA, 20 bp, Artificial Sequence
  Description of Artificial Sequence: Synthetic oligonucleotide
  Target: SCN10A; (+) strand; PAM type: NRG; PAM sequence: GAG
tatgcttaccaaccctccta

SEQ ID NO: 34117 - DNA, 20 bp, Artificial Sequence
  Description of Artificial Sequence: Synthetic oligonucleotide
  Target: SCN10A; (+) strand; PAM type: NRG; PAM sequence: GAG
caaccctcctagagatctgt

SEQ ID NO: 34118 - DNA, 20 bp, Artificial Sequence
  Description of Artificial Sequence: Synthetic oligonucleotide
  Target: SCN10A; (+) strand; PAM type: NRG; PAM sequence: CAG
tcctagagatctgtgagccc

SEQ ID NO: 34119 - DNA, 20 bp, Artificial Sequence
  Description of Artificial Sequence: Synthetic oligonucleotide
  Target: SCN10A; (+) strand; PAM type: NRG; PAM sequence: CAG
agccccagccttgccctgcc

SEQ ID NO: 34120 - DNA, 20 bp, Artificial Sequence
  Description of Artificial Sequence: Synthetic oligonucleotide
  Target: SCN10A; (+) strand; PAM type: NRG; PAM sequence: TGG
ccttgccctgcccagaaatc

SEQ ID NO: 34121 - DNA, 20 bp, Artificial Sequence
  Description of Artificial Sequence: Synthetic oligonucleotide
  Target: SCN10A; (+) strand; PAM type: NRG; PAM sequence: CAG
attccattccttcattcttc

SEQ ID NO: 34122 - DNA, 20 bp, Artificial Sequence
  Description of Artificial Sequence: Synthetic oligonucleotide
  Target: SCN10A; (+) strand; PAM type: NRG; PAM sequence: CGG
ctcttcccccgtctaacctc

SEQ ID NO: 34123 - DNA, 20 bp, Artificial Sequence
  Description of Artificial Sequence: Synthetic oligonucleotide
  Target: SCN10A; (+) strand; PAM type: NRG; PAM sequence: GAG
tctacttactctctgttgat

SEQ ID NO: 34124 - DNA, 20 bp, Artificial Sequence
  Description of Artificial Sequence: Synthetic oligonucleotide
  Target: SCN10A; (+) strand; PAM type: NRG; PAM sequence: CAG
gagctcccttttatttcact

SEQ ID NO: 34125 - DNA, 20 bp, Artificial Sequence
  Description of Artificial Sequence: Synthetic oligonucleotide
  Target: SCN10A; (+) strand; PAM type: NRG; PAM sequence: TAG
cttttatttcactcagaata

SEQ ID NO: 34126 - DNA, 20 bp, Artificial Sequence
  Description of Artificial Sequence: Synthetic oligonucleotide
  Target: SCN10A; (+) strand; PAM type: NRG; PAM sequence: TAG
atttcactcagaatatagac

SEQ ID NO: 34127 - DNA, 20 bp, Artificial Sequence
  Description of Artificial Sequence: Synthetic oligonucleotide
  Target: SCN10A; (+) strand; PAM type: NRG; PAM sequence: AAG
gaatatagactagttcacaa

SEQ ID NO: 34128 - DNA, 20 bp, Artificial Sequence
  Description of Artificial Sequence: Synthetic oligonucleotide
  Target: SCN10A; (+) strand; PAM type: NRG; PAM sequence: TGG
tcttcctaccactaaatctc

SEQ ID NO: 34129 - DNA, 20 bp, Artificial Sequence
  Description of Artificial Sequence: Synthetic oligonucleotide
  Target: SCN10A; (+) strand; PAM type: NRG; PAM sequence: AAG
taaatctctggcatatctgc

SEQ ID NO: 34130 - DNA, 20 bp, Artificial Sequence
  Description of Artificial Sequence: Synthetic oligonucleotide
  Target: SCN10A; (+) strand; PAM type: NRG; PAM sequence: TGG
ggcatatctgcaagtccacc

SEQ ID NO: 34131 - DNA, 20 bp, Artificial Sequence
  Description of Artificial Sequence: Synthetic oligonucleotide
  Target: SCN10A; (+) strand; PAM type: NRG; PAM sequence: CAG
ttctgtcttcgtgccccaca

SEQ ID NO: 34132 - DNA, 20 bp, Artificial Sequence
  Description of Artificial Sequence: Synthetic oligonucleotide
  Target: SCN10A; (+) strand; PAM type: NRG; PAM sequence: TGG
ttcgtgccccacacagtgcg

SEQ ID NO: 34133 - DNA, 20 bp, Artificial Sequence
  Description of Artificial Sequence: Synthetic oligonucleotide
  Target: SCN10A; (+) strand; PAM type: NRG; PAM sequence: GGG
tcgtgccccacacagtgcgt

SEQ ID NO: 34134 - DNA, 20 bp, Artificial Sequence
  Description of Artificial Sequence: Synthetic oligonucleotide
  Target: SCN10A; (+) strand; PAM type: NRG; PAM sequence: TGG
tgccccacacagtgcgtggg

SEQ ID NO: 34135 - DNA, 20 bp, Artificial Sequence
  Description of Artificial Sequence: Synthetic oligonucleotide
  Target: SCN10A; (+) strand; PAM type: NRG; PAM sequence: CGG
tctacccctcccacttgtgc

SEQ ID NO: 34136 - DNA, 20 bp, Artificial Sequence
  Description of Artificial Sequence: Synthetic oligonucleotide
  Target: SCN10A; (+) strand; PAM type: NRG; PAM sequence: GGG
ctacccctcccacttgtgcc

SEQ ID NO: 34137 - DNA, 20 bp, Artificial Sequence
  Description of Artificial Sequence: Synthetic oligonucleotide
  Target: SCN10A; (+) strand; PAM type: NRG; PAM sequence: AAG
ctttcctctcccacctattc

SEQ ID NO: 34138 - DNA, 20 bp, Artificial Sequence
  Description of Artificial Sequence: Synthetic oligonucleotide
  Target: SCN10A; (+) strand; PAM type: NRG; PAM sequence: AGG
tttcctctcccacctattca

SEQ ID NO: 34139 - DNA, 20 bp, Artificial Sequence
  Description of Artificial Sequence: Synthetic oligonucleotide
  Target: SCN10A; (+) strand; PAM type: NRG; PAM sequence: CAG
tattcaaggcctgcatcatc

SEQ ID NO: 34140 - DNA, 20 bp, Artificial Sequence
  Description of Artificial Sequence: Synthetic oligonucleotide
  Target: SCN10A; (+) strand; PAM type: NRG; PAM sequence: CAG
atccagacctgtctcccttc

SEQ ID NO: 34141 - DNA, 20 bp, Artificial Sequence
  Description of Artificial Sequence: Synthetic oligonucleotide
  Target: SCN10A; (+) strand; PAM type: NRG; PAM sequence: GAG
cccttccagaccattgccat

SEQ ID NO: 34142 - DNA, 20 bp, Artificial Sequence
  Description of Artificial Sequence: Synthetic oligonucleotide
  Target: SCN10A; (+) strand; PAM type: NRG; PAM sequence: CAG
ttccagaccattgccatgag

SEQ ID NO: 34143 - DNA, 20 bp, Artificial Sequence
  Description of Artificial Sequence: Synthetic oligonucleotide
  Target: SCN10A; (+) strand; PAM type: NRG; PAM sequence: AGG
tccagaccattgccatgagc

SEQ ID NO: 34144 - DNA, 20 bp, Artificial Sequence
  Description of Artificial Sequence: Synthetic oligonucleotide
  Target: SCN10A; (+) strand; PAM type: NRG; PAM sequence: CGG
aacatgctttaattatctcg

SEQ ID NO: 34145 - DNA, 20 bp, Artificial Sequence
  Description of Artificial Sequence: Synthetic oligonucleotide
  Target: SCN10A; (+) strand; PAM type: NRG; PAM sequence: AAG
attatctcgcggctttgaaa

SEQ ID NO: 34146 - DNA, 20 bp, Artificial Sequence
  Description of Artificial Sequence: Synthetic oligonucleotide
  Target: SCN10A; (+) strand; PAM type: NRG; PAM sequence: TGG
cggctttgaaaaagtctctc

SEQ ID NO: 34147 - DNA, 20 bp, Artificial Sequence
  Description of Artificial Sequence: Synthetic oligonucleotide
  Target: SCN10A; (+) strand; PAM type: NRG; PAM sequence: CAG
tttcattactgcttctttga

SEQ ID NO: 34148 - DNA, 20 bp, Artificial Sequence
  Description of Artificial Sequence: Synthetic oligonucleotide
  Target: SCN10A; (+) strand; PAM type: NRG; PAM sequence: AAG
ttgacagtaaaattccttgc

SEQ ID NO: 34149 - DNA, 20 bp, Artificial Sequence
  Description of Artificial Sequence: Synthetic oligonucleotide
  Target: SCN10A; (+) strand; PAM type: NRG; PAM sequence: GAG
gacagtaaaattccttgcaa

SEQ ID NO: 34150 - DNA, 20 bp, Artificial Sequence
  Description of Artificial Sequence: Synthetic oligonucleotide
  Target: SCN10A; (+) strand; PAM type: NRG; PAM sequence: CAG
tttctacacttaaccttcta

SEQ ID NO: 34151 - DNA, 20 bp, Artificial Sequence
  Description of Artificial Sequence: Synthetic oligonucleotide
  Target: SCN10A; (+) strand; PAM type: NRG; PAM sequence: CAG
cttacctctttttttctctg

SEQ ID NO: 34152 - DNA, 20 bp, Artificial Sequence
  Description of Artificial Sequence: Synthetic oligonucleotide
  Target: SCN10A; (+) strand; PAM type: NRG; PAM sequence: TGG
ctttttttctctgcagcccc

SEQ ID NO: 34153 - DNA, 20 bp, Artificial Sequence
  Description of Artificial Sequence: Synthetic oligonucleotide
  Target: SCN10A; (+) strand; PAM type: NRG; PAM sequence: CAG
aaattcaaataattgatttc

SEQ ID NO: 34154 - DNA, 20 bp, Artificial Sequence
  Description of Artificial Sequence: Synthetic oligonucleotide
  Target: SCN10A; (+) strand; PAM type: NRG; PAM sequence: CAG
cttacccttataacatttga

SEQ ID NO: 34155 - DNA, 20 bp, Artificial Sequence
  Description of Artificial Sequence: Synthetic oligonucleotide
  Target: SCN10A; (+) strand; PAM type: NRG; PAM sequence: CAG
tatattgttctctttgaaac

SEQ ID NO: 34156 - DNA, 20 bp, Artificial Sequence
  Description of Artificial Sequence: Synthetic oligonucleotide
  Target: SCN10A; (+) strand; PAM type: NRG; PAM sequence: TGG
ctttgaaaccagtgttcatt

SEQ ID NO: 34157 - DNA, 20 bp, Artificial Sequence
  Description of Artificial Sequence: Synthetic oligonucleotide
  Target: SCN10A; (+) strand; PAM type: NRG; PAM sequence: TGG
aaccagtgttcatttggctc

SEQ ID NO: 34158 - DNA, 20 bp, Artificial Sequence
  Description of Artificial Sequence: Synthetic oligonucleotide
  Target: SCN10A; (+) strand; PAM type: NRG; PAM sequence: GGG
accagtgttcatttggctct

SEQ ID NO: 34159 - DNA, 20 bp, Artificial Sequence
  Description of Artificial Sequence: Synthetic oligonucleotide
  Target: SCN10A; (+) strand; PAM type: NRG; PAM sequence: GGG
ccagtgttcatttggctctg

SEQ ID NO: 34160 - DNA, 20 bp, Artificial Sequence
  Description of Artificial Sequence: Synthetic oligonucleotide
  Target: SCN10A; (+) strand; PAM type: NRG; PAM sequence: AAG
ttgtaaatgttgaataactc

SEQ ID NO: 34161 - DNA, 20 bp, Artificial Sequence
  Description of Artificial Sequence: Synthetic oligonucleotide
  Target: SCN10A; (+) strand; PAM type: NRG; PAM sequence: TAG
taactcaagcattctcacct

SEQ ID NO: 34162 - DNA, 20 bp, Artificial Sequence
  Description of Artificial Sequence: Synthetic oligonucleotide
  Target: SCN10A; (+) strand; PAM type: NRG; PAM sequence: TAG
ctctgtgtttttgaatctca

SEQ ID NO: 34163 - DNA, 20 bp, Artificial Sequence
  Description of Artificial Sequence: Synthetic oligonucleotide
  Target: SCN10A; (+) strand; PAM type: NRG; PAM sequence: TAG
tctgatcccttcctgaacac

SEQ ID NO: 34164 - DNA, 20 bp, Artificial Sequence
  Description of Artificial Sequence: Synthetic oligonucleotide
  Target: SCN10A; (+) strand; PAM type: NRG; PAM sequence: AGG
ctgatcccttcctgaacact

SEQ ID NO: 34165 - DNA, 20 bp, Artificial Sequence
  Description of Artificial Sequence: Synthetic oligonucleotide
  Target: SCN10A; (+) strand; PAM type: NRG; PAM sequence: TGG
gcctccgttaaatctccatg

SEQ ID NO: 34166 - DNA, 20 bp, Artificial Sequence
  Description of Artificial Sequence: Synthetic oligonucleotide
  Target: SCN10A; (+) strand; PAM type: NRG; PAM sequence: TGG
tgtaactgtgttcacctcga

SEQ ID NO: 34167 - DNA, 20 bp, Artificial Sequence
  Description of Artificial Sequence: Synthetic oligonucleotide
  Target: SCN10A; (+) strand; PAM type: NRG; PAM sequence: GAG
taactgtgttcacctcgatg

SEQ ID NO: 34168 - DNA, 20 bp, Artificial Sequence
  Description of Artificial Sequence: Synthetic oligonucleotide
  Target: SCN10A; (+) strand; PAM type: NRG; PAM sequence: AGG
aactgtgttcacctcgatgg

SEQ ID NO: 34169 - DNA, 20 bp, Artificial Sequence
  Description of Artificial Sequence: Synthetic oligonucleotide
  Target: SCN10A; (+) strand; PAM type: NRG; PAM sequence: GGG
actgtgttcacctcgatgga

SEQ ID NO: 34170 - DNA, 20 bp, Artificial Sequence
  Description of Artificial Sequence: Synthetic oligonucleotide
  Target: SCN10A; (+) strand; PAM type: NRG; PAM sequence: TAG
ctcgatggagggcaatttct

SEQ ID NO: 34171 - DNA, 20 bp, Artificial Sequence
  Description of Artificial Sequence: Synthetic oligonucleotide
  Target: SCN10A; (+) strand; PAM type: NRG; PAM sequence: TAG
ggagggcaatttcttagctt

SEQ ID NO: 34172 - DNA, 20 bp, Artificial Sequence
  Description of Artificial Sequence: Synthetic oligonucleotide
  Target: SCN10A; (+) strand; PAM type: NRG; PAM sequence: AGG
gagggcaatttcttagcttt

SEQ ID NO: 34173 - DNA, 20 bp, Artificial Sequence
  Description of Artificial Sequence: Synthetic oligonucleotide
  Target: SCN10A; (+) strand; PAM type: NRG; PAM sequence: CGG
aggtttatctataaattcct

SEQ ID NO: 34174 - DNA, 20 bp, Artificial Sequence
  Description of Artificial Sequence: Synthetic oligonucleotide
  Target: SCN10A; (+) strand; PAM type: NRG; PAM sequence: AAG
ttatctataaattcctcggc

SEQ ID NO: 34175 - DNA, 20 bp, Artificial Sequence
  Description of Artificial Sequence: Synthetic oligonucleotide
  Target: SCN10A; (+) strand; PAM type: NRG; PAM sequence: CAG
ggcaagacatgcatcttgaa

SEQ ID NO: 34176 - DNA, 20 bp, Artificial Sequence
  Description of Artificial Sequence: Synthetic oligonucleotide
  Target: SCN10A; (+) strand; PAM type: NRG; PAM sequence: CAG
catgcatcttgaacagatat

SEQ ID NO: 34177 - DNA, 20 bp, Artificial Sequence
  Description of Artificial Sequence: Synthetic oligonucleotide
  Target: SCN10A; (+) strand; PAM type: NRG; PAM sequence: TGG
tgaacagatatcagcctatg

SEQ ID NO: 34178 - DNA, 20 bp, Artificial Sequence
  Description of Artificial Sequence: Synthetic oligonucleotide
  Target: SCN10A; (+) strand; PAM type: NRG; PAM sequence: GGG
gaacagatatcagcctatgt

SEQ ID NO: 34179 - DNA, 20 bp, Artificial Sequence
  Description of Artificial Sequence: Synthetic oligonucleotide
  Target: SCN10A; (+) strand; PAM type: NRG; PAM sequence: AAG
gatatcagcctatgtgggca

SEQ ID NO: 34180 - DNA, 20 bp, Artificial Sequence
  Description of Artificial Sequence: Synthetic oligonucleotide
  Target: SCN10A; (+) strand; PAM type: NRG; PAM sequence: AAG
tcagcctatgtgggcaaaga

SEQ ID NO: 34181 - DNA, 20 bp, Artificial Sequence
  Description of Artificial Sequence: Synthetic oligonucleotide
  Target: SCN10A; (+) strand; PAM type: NRG; PAM sequence: TGG
tccattgtttataataataa

SEQ ID NO: 34182 - DNA, 20 bp, Artificial Sequence
  Description of Artificial Sequence: Synthetic oligonucleotide
  Target: SCN10A; (+) strand; PAM type: NRG; PAM sequence: AAG
atggaaaacaacaactgata

SEQ ID NO: 34183 - DNA, 20 bp, Artificial Sequence
  Description of Artificial Sequence: Synthetic oligonucleotide
  Target: SCN10A; (+) strand; PAM type: NRG; PAM sequence: AAG
aagcataatacattgtgaaa

SEQ ID NO: 34184 - DNA, 20 bp, Artificial Sequence
  Description of Artificial Sequence: Synthetic oligonucleotide
  Target: SCN10A; (+) strand; PAM type: NRG; PAM sequence: GAG
aatacattgtgaaaaagaat

SEQ ID NO: 34185 - DNA, 20 bp, Artificial Sequence
  Description of Artificial Sequence: Synthetic oligonucleotide
  Target: SCN10A; (+) strand; PAM type: NRG; PAM sequence: AGG
atacattgtgaaaaagaatg

SEQ ID NO: 34186 - DNA, 20 bp, Artificial Sequence
  Description of Artificial Sequence: Synthetic oligonucleotide
  Target: SCN10A; (+) strand; PAM type: NRG; PAM sequence: CAG
cattgtgaaaaagaatgagg

SEQ ID NO: 34187 - DNA, 20 bp, Artificial Sequence
  Description of Artificial Sequence: Synthetic oligonucleotide
  Target: SCN10A; (+) strand; PAM type: NRG; PAM sequence: TGG
gaatgaggcagatttatttg

SEQ ID NO: 34188 - DNA, 20 bp, Artificial Sequence
  Description of Artificial Sequence: Synthetic oligonucleotide
  Target: SCN10A; (+) strand; PAM type: NRG; PAM sequence: TAG
cagatttatttgtggtgatg

SEQ ID NO: 34189 - DNA, 20 bp, Artificial Sequence
  Description of Artificial Sequence: Synthetic oligonucleotide
  Target: SCN10A; (+) strand; PAM type: NRG; PAM sequence: TAG
tgtagaaaaatatgtatgtg

SEQ ID NO: 34190 - DNA, 20 bp, Artificial Sequence
  Description of Artificial Sequence: Synthetic oligonucleotide
  Target: SCN10A; (+) strand; PAM type: NRG; PAM sequence: TAG
tgcatgtgcttatatatgca

SEQ ID NO: 34191 - DNA, 20 bp, Artificial Sequence
  Description of Artificial Sequence: Synthetic oligonucleotide
  Target: SCN10A; (+) strand; PAM type: NRG; PAM sequence: AAG
tatgcatagaacattgcttg

SEQ ID NO: 34192 - DNA, 20 bp, Artificial Sequence
  Description of Artificial Sequence: Synthetic oligonucleotide
  Target: SCN10A; (+) strand; PAM type: NRG; PAM sequence: AAG
gaacattgcttgaagaatat

SEQ ID NO: 34193 - DNA, 20 bp, Artificial Sequence
  Description of Artificial Sequence: Synthetic oligonucleotide
  Target: SCN10A; (+) strand; PAM type: NRG; PAM sequence: TGG
ttgaagaatataagataaac

SEQ ID NO: 34194 - DNA, 20 bp, Artificial Sequence
  Description of Artificial Sequence: Synthetic oligonucleotide
  Target: SCN10A; (+) strand; PAM type: NRG; PAM sequence: GAG
gaagaatataagataaactg

SEQ ID NO: 34195 - DNA, 20 bp, Artificial Sequence
  Description of Artificial Sequence: Synthetic oligonucleotide
  Target: SCN10A; (+) strand; PAM type: NRG; PAM sequence: TGG
gaatataagataaactggag

SEQ ID NO: 34196 - DNA, 20 bp, Artificial Sequence
  Description of Artificial Sequence: Synthetic oligonucleotide
  Target: SCN10A; (+) strand; PAM type: NRG; PAM sequence: GGG
aatataagataaactggagt

SEQ ID NO: 34197 - DNA, 20 bp, Artificial Sequence
  Description of Artificial Sequence: Synthetic oligonucleotide
  Target: SCN10A; (+) strand; PAM type: NRG; PAM sequence: GAG
tataagataaactggagtgg

SEQ ID NO: 34198 - DNA, 20 bp, Artificial Sequence
  Description of Artificial Sequence: Synthetic oligonucleotide
  Target: SCN10A; (+) strand; PAM type: NRG; PAM sequence: AGG
ataagataaactggagtggg

SEQ ID NO: 34199 - DNA, 20 bp, Artificial Sequence
  Description of Artificial Sequence: Synthetic oligonucleotide
  Target: SCN10A; (+) strand; PAM type: NRG; PAM sequence: GGG
taagataaactggagtggga

SEQ ID NO: 34200 - DNA, 20 bp, Artificial Sequence
  Description of Artificial Sequence: Synthetic oligonucleotide
  Target: SCN10A; (+) strand; PAM type: NRG; PAM sequence: GGG
aagataaactggagtgggag

SEQ ID NO: 34201 - DNA, 20 bp, Artificial Sequence
  Description of Artificial Sequence: Synthetic oligonucleotide
  Target: SCN10A; (+) strand; PAM type: NRG; PAM sequence: GGG
agataaactggagtgggagg

SEQ ID NO: 34202 - DNA, 20 bp, Artificial Sequence
  Description of Artificial Sequence: Synthetic oligonucleotide
  Target: SCN10A; (+) strand; PAM type: NRG; PAM sequence: GGG
gataaactggagtgggaggg

SEQ ID NO: 34203 - DNA, 20 bp, Artificial Sequence
  Description of Artificial Sequence: Synthetic oligonucleotide
  Target: SCN10A; (+) strand; PAM type: NRG; PAM sequence: CAG
ggagtgggaggggggtgcac

SEQ ID NO: 34204 - DNA, 20 bp, Artificial Sequence
  Description of Artificial Sequence: Synthetic oligonucleotide
  Target: SCN10A; (+) strand; PAM type: NRG; PAM sequence: AGG
gagtgggaggggggtgcacc

SEQ ID NO: 34205 - DNA, 20 bp, Artificial Sequence
  Description of Artificial Sequence: Synthetic oligonucleotide
  Target: SCN10A; (+) strand; PAM type: NRG; PAM sequence: GAG
gtgggaggggggtgcaccag

SEQ ID NO: 34206 - DNA, 20 bp, Artificial Sequence
  Description of Artificial Sequence: Synthetic oligonucleotide
  Target: SCN10A; (+) strand; PAM type: NRG; PAM sequence: TGG
aggggggtgcaccaggagtc

SEQ ID NO: 34207 - DNA, 20 bp, Artificial Sequence
  Description of Artificial Sequence: Synthetic oligonucleotide
  Target: SCN10A; (+) strand; PAM type: NRG; PAM sequence: GGG
ggggggtgcaccaggagtct

SEQ ID NO: 34208 - DNA, 20 bp, Artificial Sequence
  Description of Artificial Sequence: Synthetic oligonucleotide
  Target: SCN10A; (+) strand; PAM type: NRG; PAM sequence: GGG
gggggtgcaccaggagtctg

SEQ ID NO: 34209 - DNA, 20 bp, Artificial Sequence
  Description of Artificial Sequence: Synthetic oligonucleotide
  Target: SCN10A; (+) strand; PAM type: NRG; PAM sequence: GAG
gggtgcaccaggagtctggg

SEQ ID NO: 34210 - DNA, 20 bp, Artificial Sequence
  Description of Artificial Sequence: Synthetic oligonucleotide
  Target: SCN10A; (+) strand; PAM type: NRG; PAM sequence: CAG
tgcaccaggagtctggggag

SEQ ID NO: 34211 - DNA, 20 bp, Artificial Sequence
  Description of Artificial Sequence: Synthetic oligonucleotide
  Target: SCN10A; (+) strand; PAM type: NRG; PAM sequence: AGG
gcaccaggagtctggggagc

SEQ ID NO: 34212 - DNA, 20 bp, Artificial Sequence
  Description of Artificial Sequence: Synthetic oligonucleotide
  Target: SCN10A; (+) strand; PAM type: NRG; PAM sequence: AAG
ccaggagtctggggagcagg

SEQ ID NO: 34213 - DNA, 20 bp, Artificial Sequence
  Description of Artificial Sequence: Synthetic oligonucleotide
  Target: SCN10A; (+) strand; PAM type: NRG; PAM sequence: AGG
caggagtctggggagcagga

SEQ ID NO: 34214 - DNA, 20 bp, Artificial Sequence
  Description of Artificial Sequence: Synthetic oligonucleotide
  Target: SCN10A; (+) strand; PAM type: NRG; PAM sequence: GGG
aggagtctggggagcaggaa

SEQ ID NO: 34215 - DNA, 20 bp, Artificial Sequence
  Description of Artificial Sequence: Synthetic oligonucleotide
  Target: SCN10A; (+) strand; PAM type: NRG; PAM sequence: TAG
tggggagcaggaagggtcta

SEQ ID NO: 34216 - DNA, 20 bp, Artificial Sequence
  Description of Artificial Sequence: Synthetic oligonucleotide
  Target: SCN10A; (+) strand; PAM type: NRG; PAM sequence: TGG
ggagcaggaagggtctatag

SEQ ID NO: 34217 - DNA, 20 bp, Artificial Sequence
  Description of Artificial Sequence: Synthetic oligonucleotide
  Target: SCN10A; (+) strand; PAM type: NRG; PAM sequence: GGG
gagcaggaagggtctatagt

SEQ ID NO: 34218 - DNA, 20 bp, Artificial Sequence
  Description of Artificial Sequence: Synthetic oligonucleotide
  Target: SCN10A; (+) strand; PAM type: NRG; PAM sequence: AAG
caggaagggtctatagtggg

SEQ ID NO: 34219 - DNA, 20 bp, Artificial Sequence
  Description of Artificial Sequence: Synthetic oligonucleotide
  Target: SCN10A; (+) strand; PAM type: NRG; PAM sequence: AGG
aggaagggtctatagtggga

SEQ ID NO: 34220 - DNA, 20 bp, Artificial Sequence
  Description of Artificial Sequence: Synthetic oligonucleotide
  Target: SCN10A; (+) strand; PAM type: NRG; PAM sequence: GAG
gaagggtctatagtgggaag

SEQ ID NO: 34221 - DNA, 20 bp, Artificial Sequence
  Description of Artificial Sequence: Synthetic oligonucleotide
  Target: SCN10A; (+) strand; PAM type: NRG; PAM sequence: TAG
tctatagtgggaaggagaca

SEQ ID NO: 34222 - DNA, 20 bp, Artificial Sequence
  Description of Artificial Sequence: Synthetic oligonucleotide
  Target: SCN10A; (+) strand; PAM type: NRG; PAM sequence: CAG
tgtcattgcatacacacttg

SEQ ID NO: 34223 - DNA, 20 bp, Artificial Sequence
  Description of Artificial Sequence: Synthetic oligonucleotide
  Target: SCN10A; (+) strand; PAM type: NRG; PAM sequence: TAG
gcatacacacttgcagtgtt

SEQ ID NO: 34224 - DNA, 20 bp, Artificial Sequence
  Description of Artificial Sequence: Synthetic oligonucleotide
  Target: SCN10A; (+) strand; PAM type: NRG; PAM sequence: AGG
catacacacttgcagtgttt

SEQ ID NO: 34225 - DNA, 20 bp, Artificial Sequence
  Description of Artificial Sequence: Synthetic oligonucleotide
  Target: SCN10A; (+) strand; PAM type: NRG; PAM sequence: GGG
atacacacttgcagtgttta

SEQ ID NO: 34226 - DNA, 20 bp, Artificial Sequence
  Description of Artificial Sequence: Synthetic oligonucleotide
  Target: SCN10A; (+) strand; PAM type: NRG; PAM sequence: CAG
actatatgcacttgaaaaat

SEQ ID NO: 34227 - DNA, 20 bp, Artificial Sequence
  Description of Artificial Sequence: Synthetic oligonucleotide
  Target: SCN10A; (+) strand; PAM type: NRG; PAM sequence: TAG
atgcacttgaaaaatcagtt

SEQ ID NO: 34228 - DNA, 20 bp, Artificial Sequence
  Description of Artificial Sequence: Synthetic oligonucleotide
  Target: SCN10A; (+) strand; PAM type: NRG; PAM sequence: GAG
gcacttgaaaaatcagttta

SEQ ID NO: 34229 - DNA, 20 bp, Artificial Sequence
  Description of Artificial Sequence: Synthetic oligonucleotide
  Target: SCN10A; (+) strand; PAM type: NRG; PAM sequence: CAG
gtgcccccaaattttgctaa

SEQ ID NO: 34230 - DNA, 20 bp, Artificial Sequence
  Description of Artificial Sequence: Synthetic oligonucleotide
  Target: SCN10A; (+) strand; PAM type: NRG; PAM sequence: TAG
ataatttaaaaatgtgtatg

SEQ ID NO: 34231 - DNA, 20 bp, Artificial Sequence
  Description of Artificial Sequence: Synthetic oligonucleotide
  Target: SCN10A; (+) strand; PAM type: NRG; PAM sequence: AAG
ttaaaaatgtgtatgtagtc

SEQ ID NO: 34232 - DNA, 20 bp, Artificial Sequence
  Description of Artificial Sequence: Synthetic oligonucleotide
  Target: SCN10A; (+) strand; PAM type: NRG; PAM sequence: CAG
tgtatgtagtcaagatttat

SEQ ID NO: 34233 - DNA, 20 bp, Artificial Sequence
  Description of Artificial Sequence: Synthetic oligonucleotide
  Target: SCN10A; (+) strand; PAM type: NRG; PAM sequence: TAG
atgtagtcaagatttatcag

SEQ ID NO: 34234 - DNA, 20 bp, Artificial Sequence
  Description of Artificial Sequence: Synthetic oligonucleotide
  Target: SCN10A; (+) strand; PAM type: NRG; PAM sequence: AAG
ctttttttaaattatacttt

SEQ ID NO: 34235 - DNA, 20 bp, Artificial Sequence
  Description of Artificial Sequence: Synthetic oligonucleotide
  Target: SCN10A; (+) strand; PAM type: NRG; PAM sequence: TAG
ttaaattatactttaagttt

SEQ ID NO: 34236 - DNA, 20 bp, Artificial Sequence
  Description of Artificial Sequence: Synthetic oligonucleotide
  Target: SCN10A; (+) strand; PAM type: NRG; PAM sequence: AGG
taaattatactttaagtttt

SEQ ID NO: 34237 - DNA, 20 bp, Artificial Sequence
  Description of Artificial Sequence: Synthetic oligonucleotide
  Target: SCN10A; (+) strand; PAM type: NRG; PAM sequence: GGG
aaattatactttaagtttta

SEQ ID NO: 34238 - DNA, 20 bp, Artificial Sequence
  Description of Artificial Sequence: Synthetic oligonucleotide
  Target: SCN10A; (+) strand; PAM type: NRG; PAM sequence: CAG
gggtaaatgtgcacattatg

SEQ ID NO: 34239 - DNA, 20 bp, Artificial Sequence
  Description of Artificial Sequence: Synthetic oligonucleotide
  Target: SCN10A; (+) strand; PAM type: NRG; PAM sequence: AGG
ggtaaatgtgcacattatgc

SEQ ID NO: 34240 - DNA, 20 bp, Artificial Sequence
  Description of Artificial Sequence: Synthetic oligonucleotide
  Target: SCN10A; (+) strand; PAM type: NRG; PAM sequence: TAG
aatgtgcacattatgcaggt

SEQ ID NO: 34241 - DNA, 20 bp, Artificial Sequence
  Description of Artificial Sequence: Synthetic oligonucleotide
  Target: SCN10A; (+) strand; PAM type: NRG; PAM sequence: AAG
gcatacatgccttacatatg

SEQ ID NO: 34242 - DNA, 20 bp, Artificial Sequence
  Description of Artificial Sequence: Synthetic oligonucleotide
  Target: SCN10A; (+) strand; PAM type: NRG; PAM sequence: AAG
tatgaagcttttctcactac

SEQ ID NO: 34243 - DNA, 20 bp, Artificial Sequence
  Description of Artificial Sequence: Synthetic oligonucleotide
  Target: SCN10A; (+) strand; PAM type: NRG; PAM sequence: AGG
atgaagcttttctcactaca

SEQ ID NO: 34244 - DNA, 20 bp, Artificial Sequence
  Description of Artificial Sequence: Synthetic oligonucleotide
  Target: SCN10A; (+) strand; PAM type: NRG; PAM sequence: TGG
gcttttctcactacaaggct

SEQ ID NO: 34245 - DNA, 20 bp, Artificial Sequence
  Description of Artificial Sequence: Synthetic oligonucleotide
  Target: SCN10A; (+) strand; PAM type: NRG; PAM sequence: TAG
atgtttttttctttcttttg

SEQ ID NO: 34246 - DNA, 20 bp, Artificial Sequence
  Description of Artificial Sequence: Synthetic oligonucleotide
  Target: SCN10A; (+) strand; PAM type: NRG; PAM sequence: TGG
acttttttcacttaaaactt

SEQ ID NO: 34247 - DNA, 20 bp, Artificial Sequence
  Description of Artificial Sequence: Synthetic oligonucleotide
  Target: SCN10A; (+) strand; PAM type: NRG; PAM sequence: TGG
ggtgcatttgaaatttattt

SEQ ID NO: 34248 - DNA, 20 bp, Artificial Sequence
  Description of Artificial Sequence: Synthetic oligonucleotide
  Target: SCN10A; (+) strand; PAM type: NRG; PAM sequence: GGG
gtgcatttgaaatttatttt

SEQ ID NO: 34249 - DNA, 20 bp, Artificial Sequence
  Description of Artificial Sequence: Synthetic oligonucleotide
  Target: SCN10A; (+) strand; PAM type: NRG; PAM sequence: AAG
tttgaaatttattttgggta

SEQ ID NO: 34250 - DNA, 20 bp, Artificial Sequence
  Description of Artificial Sequence: Synthetic oligonucleotide
  Target: SCN10A; (+) strand; PAM type: NRG; PAM sequence: GAG
tgaaatttattttgggtaaa

SEQ ID NO: 34251 - DNA, 20 bp, Artificial Sequence
  Description of Artificial Sequence: Synthetic oligonucleotide
  Target: SCN10A; (+) strand; PAM type: NRG; PAM sequence: AAG
atttattttgggtaaagagt

SEQ ID NO: 34252 - DNA, 20 bp, Artificial Sequence
  Description of Artificial Sequence: Synthetic oligonucleotide
  Target: SCN10A; (+) strand; PAM type: NRG; PAM sequence: TGG
taaagagtaagatattgatg

SEQ ID NO: 34253 - DNA, 20 bp, Artificial Sequence
  Description of Artificial Sequence: Synthetic oligonucleotide
  Target: SCN10A; (+) strand; PAM type: NRG; PAM sequence: AAG
gaataatttttcattttccc

SEQ ID NO: 34254 - DNA, 20 bp, Artificial Sequence
  Description of Artificial Sequence: Synthetic oligonucleotide
  Target: SCN10A; (+) strand; PAM type: NRG; PAM sequence: CAG
acatgtccatttctcttcca

SEQ ID NO: 34255 - DNA, 20 bp, Artificial Sequence
  Description of Artificial Sequence: Synthetic oligonucleotide
  Target: SCN10A; (+) strand; PAM type: NRG; PAM sequence: CAG
tccatttctcttccacagat

SEQ ID NO: 34256 - DNA, 20 bp, Artificial Sequence
  Description of Artificial Sequence: Synthetic oligonucleotide
  Target: SCN10A; (+) strand; PAM type: NRG; PAM sequence: TGG
atgctgttttaatcactgac

SEQ ID NO: 34257 - DNA, 20 bp, Artificial Sequence
  Description of Artificial Sequence: Synthetic oligonucleotide
  Target: SCN10A; (+) strand; PAM type: NRG; PAM sequence: TAG
tttaatcactgactggattt

SEQ ID NO: 34258 - DNA, 20 bp, Artificial Sequence
  Description of Artificial Sequence: Synthetic oligonucleotide
  Target: SCN10A; (+) strand; PAM type: NRG; PAM sequence: CAG
tgactggattttagaaacta

SEQ ID NO: 34259 - DNA, 20 bp, Artificial Sequence
  Description of Artificial Sequence: Synthetic oligonucleotide
  Target: SCN10A; (+) strand; PAM type: NRG; PAM sequence: TGG
gaaactacagatgtccaaac

SEQ ID NO: 34260 - DNA, 20 bp, Artificial Sequence
  Description of Artificial Sequence: Synthetic oligonucleotide
  Target: SCN10A; (+) strand; PAM type: NRG; PAM sequence: AAG
tacagatgtccaaactggca

SEQ ID NO: 34261 - DNA, 20 bp, Artificial Sequence
  Description of Artificial Sequence: Synthetic oligonucleotide
  Target: SCN10A; (+) strand; PAM type: NRG; PAM sequence: TAG
atgtccaaactggcaaagca

SEQ ID NO: 34262 - DNA, 20 bp, Artificial Sequence
  Description of Artificial Sequence: Synthetic oligonucleotide
  Target: SCN10A; (+) strand; PAM type: NRG; PAM sequence: AAG
tggcaaagcatagttctcta

SEQ ID NO: 34263 - DNA, 20 bp, Artificial Sequence
  Description of Artificial Sequence: Synthetic oligonucleotide
  Target: SCN10A; (+) strand; PAM type: NRG; PAM sequence: AAG
caaagcatagttctctaaag

SEQ ID NO: 34264 - DNA, 20 bp, Artificial Sequence
  Description of Artificial Sequence: Synthetic oligonucleotide
  Target: SCN10A; (+) strand; PAM type: NRG; PAM sequence: TGG
gcatagttctctaaagaagt

SEQ ID NO: 34265 - DNA, 20 bp, Artificial Sequence
  Description of Artificial Sequence: Synthetic oligonucleotide
  Target: SCN10A; (+) strand; PAM type: NRG; PAM sequence: TGG
ctaaagaagttggcacatcc

SEQ ID NO: 34266 - DNA, 20 bp, Artificial Sequence
  Description of Artificial Sequence: Synthetic oligonucleotide
  Target: SCN10A; (+) strand; PAM type: NRG; PAM sequence: GGG
taaagaagttggcacatcct

SEQ ID NO: 34267 - DNA, 20 bp, Artificial Sequence
  Description of Artificial Sequence: Synthetic oligonucleotide
  Target: SCN10A; (+) strand; PAM type: NRG; PAM sequence: TGG
caaaatcaacaatccctgtt

SEQ ID NO: 34268 - DNA, 20 bp, Artificial Sequence
  Description of Artificial Sequence: Synthetic oligonucleotide
  Target: SCN10A; (+) strand; PAM type: NRG; PAM sequence: AAG
acaatccctgtttggaacaa

SEQ ID NO: 34269 - DNA, 20 bp, Artificial Sequence
  Description of Artificial Sequence: Synthetic oligonucleotide
  Target: SCN10A; (+) strand; PAM type: NRG; PAM sequence: AAG
tccctgtttggaacaaaagc

SEQ ID NO: 34270 - DNA, 20 bp, Artificial Sequence
  Description of Artificial Sequence: Synthetic oligonucleotide
  Target: SCN10A; (+) strand; PAM type: NRG; PAM sequence: TGG
aacaaaagcaagaacttccc

SEQ ID NO: 34271 - DNA, 20 bp, Artificial Sequence
  Description of Artificial Sequence: Synthetic oligonucleotide
  Target: SCN10A; (+) strand; PAM type: NRG; PAM sequence: TGG
gaacttccctggacctattt

SEQ ID NO: 34272 - DNA, 20 bp, Artificial Sequence
  Description of Artificial Sequence: Synthetic oligonucleotide
  Target: SCN10A; (+) strand; PAM type: NRG; PAM sequence: AAG
ggacctattttggcactaaa

SEQ ID NO: 34273 - DNA, 20 bp, Artificial Sequence
  Description of Artificial Sequence: Synthetic oligonucleotide
  Target: SCN10A; (+) strand; PAM type: NRG; PAM sequence: AAG
cctattttggcactaaaaag

SEQ ID NO: 34274 - DNA, 20 bp, Artificial Sequence
  Description of Artificial Sequence: Synthetic oligonucleotide
  Target: SCN10A; (+) strand; PAM type: NRG; PAM sequence: CAG
tttggcactaaaaagaagca

SEQ ID NO: 34275 - DNA, 20 bp, Artificial Sequence
  Description of Artificial Sequence: Synthetic oligonucleotide
  Target: SCN10A; (+) strand; PAM type: NRG; PAM sequence: AGG
ttggcactaaaaagaagcac

SEQ ID NO: 34276 - DNA, 20 bp, Artificial Sequence
  Description of Artificial Sequence: Synthetic oligonucleotide
  Target: SCN10A; (+) strand; PAM type: NRG; PAM sequence: AAG
gcactaaaaagaagcacagg

SEQ ID NO: 34277 - DNA, 20 bp, Artificial Sequence
  Description of Artificial Sequence: Synthetic oligonucleotide
  Target: SCN10A; (+) strand; PAM type: NRG; PAM sequence: TAG
ctaaaaagaagcacaggaag

SEQ ID NO: 34278 - DNA, 20 bp, Artificial Sequence
  Description of Artificial Sequence: Synthetic oligonucleotide
  Target: SCN10A; (+) strand; PAM type: NRG; PAM sequence: GAG
cacaggaagtagtcatgaat

SEQ ID NO: 34279 - DNA, 20 bp, Artificial Sequence
  Description of Artificial Sequence: Synthetic oligonucleotide
  Target: SCN10A; (+) strand; PAM type: NRG; PAM sequence: AGG
acaggaagtagtcatgaatg

SEQ ID NO: 34280 - DNA, 20 bp, Artificial Sequence
  Description of Artificial Sequence: Synthetic oligonucleotide
  Target: SCN10A; (+) strand; PAM type: NRG; PAM sequence: TAG
agtcatgaatgaggacactt

SEQ ID NO: 34281 - DNA, 20 bp, Artificial Sequence
  Description of Artificial Sequence: Synthetic oligonucleotide
  Target: SCN10A; (+) strand; PAM type: NRG; PAM sequence: TGG
acactttagatgtgccattt

SEQ ID NO: 34282 - DNA, 20 bp, Artificial Sequence
  Description of Artificial Sequence: Synthetic oligonucleotide
  Target: SCN10A; (+) strand; PAM type: NRG; PAM sequence: CAG
ctttagatgtgccattttgg

SEQ ID NO: 34283 - DNA, 20 bp, Artificial Sequence
  Description of Artificial Sequence: Synthetic oligonucleotide
  Target: SCN10A; (+) strand; PAM type: NRG; PAM sequence: AGG
tttagatgtgccattttggc

SEQ ID NO: 34284 - DNA, 20 bp, Artificial Sequence
  Description of Artificial Sequence: Synthetic oligonucleotide
  Target: SCN10A; (+) strand; PAM type: NRG; PAM sequence: AAG
agatgtgccattttggcagg

SEQ ID NO: 34285 - DNA, 20 bp, Artificial Sequence
  Description of Artificial Sequence: Synthetic oligonucleotide
  Target: SCN10A; (+) strand; PAM type: NRG; PAM sequence: CAG
tgtgccattttggcaggaag

SEQ ID NO: 34286 - DNA, 20 bp, Artificial Sequence
  Description of Artificial Sequence: Synthetic oligonucleotide
  Target: SCN10A; (+) strand; PAM type: NRG; PAM sequence: GAG
ggcaggaagcagccacctgt

SEQ ID NO: 34287 - DNA, 20 bp, Artificial Sequence
  Description of Artificial Sequence: Synthetic oligonucleotide
  Target: SCN10A; (+) strand; PAM type: NRG; PAM sequence: AGG
gcaggaagcagccacctgtg

SEQ ID NO: 34288 - DNA, 20 bp, Artificial Sequence
  Description of Artificial Sequence: Synthetic oligonucleotide
  Target: SCN10A; (+) strand; PAM type: NRG; PAM sequence: TGG
cagccacctgtgaggcatga

SEQ ID NO: 34289 - DNA, 20 bp, Artificial Sequence
  Description of Artificial Sequence: Synthetic oligonucleotide
  Target: SCN10A; (+) strand; PAM type: NRG; PAM sequence: GGG
agccacctgtgaggcatgat

SEQ ID NO: 34290 - DNA, 20 bp, Artificial Sequence
  Description of Artificial Sequence: Synthetic oligonucleotide
  Target: SCN10A; (+) strand; PAM type: NRG; PAM sequence: AAG
cctgtgaggcatgatgggaa

SEQ ID NO: 34291 - DNA, 20 bp, Artificial Sequence
  Description of Artificial Sequence: Synthetic oligonucleotide
  Target: SCN10A; (+) strand; PAM type: NRG; PAM sequence: GAG
tgtgaggcatgatgggaaaa

SEQ ID NO: 34292 - DNA, 20 bp, Artificial Sequence
  Description of Artificial Sequence: Synthetic oligonucleotide
  Target: SCN10A; (+) strand; PAM type: NRG; PAM sequence: GAG
tgaggcatgatgggaaaaga

SEQ ID NO: 34293 - DNA, 20 bp, Artificial Sequence
  Description of Artificial Sequence: Synthetic oligonucleotide
  Target: SCN10A; (+) strand; PAM type: NRG; PAM sequence: AGG
gaggcatgatgggaaaagag

SEQ ID NO: 34294 - DNA, 20 bp, Artificial Sequence
  Description of Artificial Sequence: Synthetic oligonucleotide
  Target: SCN10A; (+) strand; PAM type: NRG; PAM sequence: CAG
aagagaggcatctttgtaaa

SEQ ID NO: 34295 - DNA, 20 bp, Artificial Sequence
  Description of Artificial Sequence: Synthetic oligonucleotide
  Target: SCN10A; (+) strand; PAM type: NRG; PAM sequence: CAG
ttgttgaacttgattgattg

SEQ ID NO: 34296 - DNA, 20 bp, Artificial Sequence
  Description of Artificial Sequence: Synthetic oligonucleotide
  Target: SCN10A; (+) strand; PAM type: NRG; PAM sequence: GAG
gttgaacttgattgattgca

SEQ ID NO: 34297 - DNA, 20 bp, Artificial Sequence
  Description of Artificial Sequence: Synthetic oligonucleotide
  Target: SCN10A; (+) strand; PAM type: NRG; PAM sequence: CAG
cttgattgattgcagagaca

SEQ ID NO: 34298 - DNA, 20 bp, Artificial Sequence
  Description of Artificial Sequence: Synthetic oligonucleotide
  Target: SCN10A; (+) strand; PAM type: NRG; PAM sequence: GAG
tgattgattgcagagacaca

SEQ ID NO: 34299 - DNA, 20 bp, Artificial Sequence
  Description of Artificial Sequence: Synthetic oligonucleotide
  Target: SCN10A; (+) strand; PAM type: NRG; PAM sequence: AAG
tgcagagacacagagactaa

SEQ ID NO: 34300 - DNA, 20 bp, Artificial Sequence
  Description of Artificial Sequence: Synthetic oligonucleotide
  Target: SCN10A; (+) strand; PAM type: NRG; PAM sequence: CAG
gactaaaagtatctacttgc

SEQ ID NO: 34301 - DNA, 20 bp, Artificial Sequence
  Description of Artificial Sequence: Synthetic oligonucleotide
  Target: SCN10A; (+) strand; PAM type: NRG; PAM sequence: TGG
gccagcttaaaacatgacca

SEQ ID NO: 34302 - DNA, 20 bp, Artificial Sequence
  Description of Artificial Sequence: Synthetic oligonucleotide
  Target: SCN10A; (+) strand; PAM type: NRG; PAM sequence: AAG
tgaccatggccccacctcaa

SEQ ID NO: 34303 - DNA, 20 bp, Artificial Sequence
  Description of Artificial Sequence: Synthetic oligonucleotide
  Target: SCN10A; (+) strand; PAM type: NRG; PAM sequence: AGG
gaccatggccccacctcaaa

SEQ ID NO: 34304 - DNA, 20 bp, Artificial Sequence
  Description of Artificial Sequence: Synthetic oligonucleotide
  Target: SCN10A; (+) strand; PAM type: NRG; PAM sequence: CAG
ctcctatataaaattgataa

SEQ ID NO: 34305 - DNA, 20 bp, Artificial Sequence
  Description of Artificial Sequence: Synthetic oligonucleotide
  Target: SCN10A; (+) strand; PAM type: NRG; PAM sequence: GAG
cctatataaaattgataaca

SEQ ID NO: 34306 - DNA, 20 bp, Artificial Sequence
  Description of Artificial Sequence: Synthetic oligonucleotide
  Target: SCN10A; (+) strand; PAM type: NRG; PAM sequence: GAG
tatataaaattgataacaga

SEQ ID NO: 34307 - DNA, 20 bp, Artificial Sequence
  Description of Artificial Sequence: Synthetic oligonucleotide
  Target: SCN10A; (+) strand; PAM type: NRG; PAM sequence: AAG
ccttcatcctgttacgctta

SEQ ID NO: 34308 - DNA, 20 bp, Artificial Sequence
  Description of Artificial Sequence: Synthetic oligonucleotide
  Target: SCN10A; (+) strand; PAM type: NRG; PAM sequence: GAG
ttcatcctgttacgcttaaa

SEQ ID NO: 34309 - DNA, 20 bp, Artificial Sequence
  Description of Artificial Sequence: Synthetic oligonucleotide
  Target: SCN10A; (+) strand; PAM type: NRG; PAM sequence: AGG
tcatcctgttacgcttaaag

SEQ ID NO: 34310 - DNA, 20 bp, Artificial Sequence
  Description of Artificial Sequence: Synthetic oligonucleotide
  Target: SCN10A; (+) strand; PAM type: NRG; PAM sequence: CAG
ccccctgctcctgttaacac

SEQ ID NO: 34311 - DNA, 20 bp, Artificial Sequence
  Description of Artificial Sequence: Synthetic oligonucleotide
  Target: SCN10A; (+) strand; PAM type: NRG; PAM sequence: CAG
tgcattctctcctgccactg

SEQ ID NO: 34312 - DNA, 20 bp, Artificial Sequence
  Description of Artificial Sequence: Synthetic oligonucleotide
  Target: SCN10A; (+) strand; PAM type: NRG; PAM sequence: AGG
gcattctctcctgccactgc

SEQ ID NO: 34313 - DNA, 20 bp, Artificial Sequence
  Description of Artificial Sequence: Synthetic oligonucleotide
  Target: SCN10A; (+) strand; PAM type: NRG; PAM sequence: GAG
attctctcctgccactgcag

SEQ ID NO: 34314 - DNA, 20 bp, Artificial Sequence
  Description of Artificial Sequence: Synthetic oligonucleotide
  Target: SCN10A; (+) strand; PAM type: NRG; PAM sequence: CAG
ccctttcttcccttaatctt

SEQ ID NO: 34315 - DNA, 20 bp, Artificial Sequence
  Description of Artificial Sequence: Synthetic oligonucleotide
  Target: SCN10A; (+) strand; PAM type: NRG; PAM sequence: CAG
ttcagtctctcttattctcc

SEQ ID NO: 34316 - DNA, 20 bp, Artificial Sequence
  Description of Artificial Sequence: Synthetic oligonucleotide
  Target: SCN10A; (+) strand; PAM type: NRG; PAM sequence: TAG
ttctcccagatccttcccat

SEQ ID NO: 34317 - DNA, 20 bp, Artificial Sequence
  Description of Artificial Sequence: Synthetic oligonucleotide
  Target: SCN10A; (+) strand; PAM type: NRG; PAM sequence: AAG
ccccaaacacaaaaaccaaa

SEQ ID NO: 34318 - DNA, 20 bp, Artificial Sequence
  Description of Artificial Sequence: Synthetic oligonucleotide
  Target: SCN10A; (+) strand; PAM type: NRG; PAM sequence: TAG
tttcaattctccctactccc

SEQ ID NO: 34319 - DNA, 20 bp, Artificial Sequence
  Description of Artificial Sequence: Synthetic oligonucleotide
  Target: SCN10A; (+) strand; PAM type: NRG; PAM sequence: CAG
ttactatctccttttcctca

SEQ ID NO: 34320 - DNA, 20 bp, Artificial Sequence
  Description of Artificial Sequence: Synthetic oligonucleotide
  Target: SCN10A; (+) strand; PAM type: NRG; PAM sequence: AGG
tactatctccttttcctcac

SEQ ID NO: 34321 - DNA, 20 bp, Artificial Sequence
  Description of Artificial Sequence: Synthetic oligonucleotide
  Target: SCN10A; (+) strand; PAM type: NRG; PAM sequence: AAG
tcacctctcacccgctcttt

SEQ ID NO: 34322 - DNA, 20 bp, Artificial Sequence
  Description of Artificial Sequence: Synthetic oligonucleotide
  Target: SCN10A; (+) strand; PAM type: NRG; PAM sequence: TAG
tccattaatcctcttttgct

SEQ ID NO: 34323 - DNA, 20 bp, Artificial Sequence
  Description of Artificial Sequence: Synthetic oligonucleotide
  Target: SCN10A; (+) strand; PAM type: NRG; PAM sequence: AAG
ctcttttgcttagatcacca

SEQ ID NO: 34324 - DNA, 20 bp, Artificial Sequence
  Description of Artificial Sequence: Synthetic oligonucleotide
  Target: SCN10A; (+) strand; PAM type: NRG; PAM sequence: AAG
caaagacatccatgtgacta

SEQ ID NO: 34325 - DNA, 20 bp, Artificial Sequence
  Description of Artificial Sequence: Synthetic oligonucleotide
  Target: SCN10A; (+) strand; PAM type: NRG; PAM sequence: TGG
atccatgtgactaaagcccc

SEQ ID NO: 34326 - DNA, 20 bp, Artificial Sequence
  Description of Artificial Sequence: Synthetic oligonucleotide
  Target: SCN10A; (+) strand; PAM type: NRG; PAM sequence: CAG
cattttacctgacctttcca

SEQ ID NO: 34327 - DNA, 20 bp, Artificial Sequence
  Description of Artificial Sequence: Synthetic oligonucleotide
  Target: SCN10A; (+) strand; PAM type: NRG; PAM sequence: TGG
ttccacagcattgcctctgt

SEQ ID NO: 34328 - DNA, 20 bp, Artificial Sequence
  Description of Artificial Sequence: Synthetic oligonucleotide
  Target: SCN10A; (+) strand; PAM type: NRG; PAM sequence: AAG
tggcctttctattctttctg

SEQ ID NO: 34329 - DNA, 20 bp, Artificial Sequence
  Description of Artificial Sequence: Synthetic oligonucleotide
  Target: SCN10A; (+) strand; PAM type: NRG; PAM sequence: TGG
tctgaagaaatttttactct

SEQ ID NO: 34330 - DNA, 20 bp, Artificial Sequence
  Description of Artificial Sequence: Synthetic oligonucleotide
  Target: SCN10A; (+) strand; PAM type: NRG; PAM sequence: TAG
ggctctgcattgtattcttc

SEQ ID NO: 34331 - DNA, 20 bp, Artificial Sequence
  Description of Artificial Sequence: Synthetic oligonucleotide
  Target: SCN10A; (+) strand; PAM type: NRG; PAM sequence: CAG
tatttctgtaccttcctttt

SEQ ID NO: 34332 - DNA, 20 bp, Artificial Sequence
  Description of Artificial Sequence: Synthetic oligonucleotide
  Target: SCN10A; (+) strand; PAM type: NRG; PAM sequence: TGG
tccttttcagtctcctctgc

SEQ ID NO: 34333 - DNA, 20 bp, Artificial Sequence
  Description of Artificial Sequence: Synthetic oligonucleotide
  Target: SCN10A; (+) strand; PAM type: NRG; PAM sequence: GGG
ccttttcagtctcctctgct

SEQ ID NO: 34334 - DNA, 20 bp, Artificial Sequence
  Description of Artificial Sequence: Synthetic oligonucleotide
  Target: SCN10A; (+) strand; PAM type: NRG; PAM sequence: TAG
ctgcttaactattaaacatt

SEQ ID NO: 34335 - DNA, 20 bp, Artificial Sequence
  Description of Artificial Sequence: Synthetic oligonucleotide
  Target: SCN10A; (+) strand; PAM type: NRG; PAM sequence: TAG
ctattaaacatttagtttgt

SEQ ID NO: 34336 - DNA, 20 bp, Artificial Sequence
  Description of Artificial Sequence: Synthetic oligonucleotide
  Target: SCN10A; (+) strand; PAM type: NRG; PAM sequence: GAG
agtttgttagaactgtgtct

SEQ ID NO: 34337 - DNA, 20 bp, Artificial Sequence
  Description of Artificial Sequence: Synthetic oligonucleotide
  Target: SCN10A; (+) strand; PAM type: NRG; PAM sequence: AGG
gtttgttagaactgtgtctg

SEQ ID NO: 34338 - DNA, 20 bp, Artificial Sequence
  Description of Artificial Sequence: Synthetic oligonucleotide
  Target: SCN10A; (+) strand; PAM type: NRG; PAM sequence: CAG
cccttctgtgttaactcatc

SEQ ID NO: 34339 - DNA, 20 bp, Artificial Sequence
  Description of Artificial Sequence: Synthetic oligonucleotide
  Target: SCN10A; (+) strand; PAM type: NRG; PAM sequence: AAG
atatgccatctttgtcatct

SEQ ID NO: 34340 - DNA, 20 bp, Artificial Sequence
  Description of Artificial Sequence: Synthetic oligonucleotide
  Target: SCN10A; (+) strand; PAM type: NRG; PAM sequence: TAG
catctttgtcatctaagttc

SEQ ID NO: 34341 - DNA, 20 bp, Artificial Sequence
  Description of Artificial Sequence: Synthetic oligonucleotide
  Target: SCN10A; (+) strand; PAM type: NRG; PAM sequence: AAG
ttctagacccctatatccta

SEQ ID NO: 34342 - DNA, 20 bp, Artificial Sequence
  Description of Artificial Sequence: Synthetic oligonucleotide
  Target: SCN10A; (+) strand; PAM type: NRG; PAM sequence: TGG
tcctaaagtcaacttcctac

SEQ ID NO: 34343 - DNA, 20 bp, Artificial Sequence
  Description of Artificial Sequence: Synthetic oligonucleotide
  Target: SCN10A; (+) strand; PAM type: NRG; PAM sequence: TAG
tcctactggacacccctacc

SEQ ID NO: 34344 - DNA, 20 bp, Artificial Sequence
  Description of Artificial Sequence: Synthetic oligonucleotide
  Target: SCN10A; (+) strand; PAM type: NRG; PAM sequence: AAG
cacccctacctagatgctcc

SEQ ID NO: 34345 - DNA, 20 bp, Artificial Sequence
  Description of Artificial Sequence: Synthetic oligonucleotide
  Target: SCN10A; (+) strand; PAM type: NRG; PAM sequence: AGG
acccctacctagatgctcca

SEQ ID NO: 34346 - DNA, 20 bp, Artificial Sequence
  Description of Artificial Sequence: Synthetic oligonucleotide
  Target: SCN10A; (+) strand; PAM type: NRG; PAM sequence: GGG
cccctacctagatgctccaa

SEQ ID NO: 34347 - DNA, 20 bp, Artificial Sequence
  Description of Artificial Sequence: Synthetic oligonucleotide
  Target: SCN10A; (+) strand; PAM type: NRG; PAM sequence: CAG
acctgaaacccaatatatcc

SEQ ID NO: 34348 - DNA, 20 bp, Artificial Sequence
  Description of Artificial Sequence: Synthetic oligonucleotide
  Target: SCN10A; (+) strand; PAM type: NRG; PAM sequence: AAG
tctttcatctttccccatta

SEQ ID NO: 34349 - DNA, 20 bp, Artificial Sequence
  Description of Artificial Sequence: Synthetic oligonucleotide
  Target: SCN10A; (+) strand; PAM type: NRG; PAM sequence: GAG
ccctaaaatgctccctttat

SEQ ID NO: 34350 - DNA, 20 bp, Artificial Sequence
  Description of Artificial Sequence: Synthetic oligonucleotide
  Target: SCN10A; (+) strand; PAM type: NRG; PAM sequence: CAG
ccctttatgagttattgtat

SEQ ID NO: 34351 - DNA, 20 bp, Artificial Sequence
  Description of Artificial Sequence: Synthetic oligonucleotide
  Target: SCN10A; (+) strand; PAM type: NRG; PAM sequence: AAG
ttattgtatcagcatatctt

SEQ ID NO: 34352 - DNA, 20 bp, Artificial Sequence
  Description of Artificial Sequence: Synthetic oligonucleotide
  Target: SCN10A; (+) strand; PAM type: NRG; PAM sequence: AGG
tattgtatcagcatatctta

SEQ ID NO: 34353 - DNA, 20 bp, Artificial Sequence
  Description of Artificial Sequence: Synthetic oligonucleotide
  Target: SCN10A; (+) strand; PAM type: NRG; PAM sequence: CAG
atatcttaaggcacttatac

SEQ ID NO: 34354 - DNA, 20 bp, Artificial Sequence
  Description of Artificial Sequence: Synthetic oligonucleotide
  Target: SCN10A; (+) strand; PAM type: NRG; PAM sequence: AAG
ccagaaccatatgcatcatc

SEQ ID NO: 34355 - DNA, 20 bp, Artificial Sequence
  Description of Artificial Sequence: Synthetic oligonucleotide
  Target: SCN10A; (+) strand; PAM type: NRG; PAM sequence: TAG
gtcctgaatcttatgcccct

SEQ ID NO: 34356 - DNA, 20 bp, Artificial Sequence
  Description of Artificial Sequence: Synthetic oligonucleotide
  Target: SCN10A; (+) strand; PAM type: NRG; PAM sequence: TAG
tgaatcttatgccccttaga

SEQ ID NO: 34357 - DNA, 20 bp, Artificial Sequence
  Description of Artificial Sequence: Synthetic oligonucleotide
  Target: SCN10A; (+) strand; PAM type: NRG; PAM sequence: CAG
catatccttccatttcccat

SEQ ID NO: 34358 - DNA, 20 bp, Artificial Sequence
  Description of Artificial Sequence: Synthetic oligonucleotide
  Target: SCN10A; (+) strand; PAM type: NRG; PAM sequence: CAG
cagccccactgtcactaccc

SEQ ID NO: 34359 - DNA, 20 bp, Artificial Sequence
  Description of Artificial Sequence: Synthetic oligonucleotide
  Target: SCN10A; (+) strand; PAM type: NRG; PAM sequence: GAG
gccccactgtcactacccca

SEQ ID NO: 34360 - DNA, 20 bp, Artificial Sequence
  Description of Artificial Sequence: Synthetic oligonucleotide
  Target: SCN10A; (+) strand; PAM type: NRG; PAM sequence: AAG
ctgtcactaccccagagttc

SEQ ID NO: 34361 - DNA, 20 bp, Artificial Sequence
  Description of Artificial Sequence: Synthetic oligonucleotide
  Target: SCN10A; (+) strand; PAM type: NRG; PAM sequence: TGG
aagcactgccatcttgtact

SEQ ID NO: 34362 - DNA, 20 bp, Artificial Sequence
  Description of Artificial Sequence: Synthetic oligonucleotide
  Target: SCN10A; (+) strand; PAM type: NRG; PAM sequence: TGG
gtacttggcttcctcctaac

SEQ ID NO: 34363 - DNA, 20 bp, Artificial Sequence
  Description of Artificial Sequence: Synthetic oligonucleotide
  Target: SCN10A; (+) strand; PAM type: NRG; PAM sequence: AAG
acttcccctcttatatctac

SEQ ID NO: 34364 - DNA, 20 bp, Artificial Sequence
  Description of Artificial Sequence: Synthetic oligonucleotide
  Target: SCN10A; (+) strand; PAM type: NRG; PAM sequence: CAG
ctcttatatctacaagtatc

SEQ ID NO: 34365 - DNA, 20 bp, Artificial Sequence
  Description of Artificial Sequence: Synthetic oligonucleotide
  Target: SCN10A; (+) strand; PAM type: NRG; PAM sequence: GAG
cttatatctacaagtatcca

SEQ ID NO: 34366 - DNA, 20 bp, Artificial Sequence
  Description of Artificial Sequence: Synthetic oligonucleotide
  Target: SCN10A; (+) strand; PAM type: NRG; PAM sequence: TGG
ccctgcctccaatcctttaa

SEQ ID NO: 34367 - DNA, 20 bp, Artificial Sequence
  Description of Artificial Sequence: Synthetic oligonucleotide
  Target: SCN10A; (+) strand; PAM type: NRG; PAM sequence: TAG
taatggcacctcactcctct

SEQ ID NO: 34368 - DNA, 20 bp, Artificial Sequence
  Description of Artificial Sequence: Synthetic oligonucleotide
  Target: SCN10A; (+) strand; PAM type: NRG; PAM sequence: AAG
acctcactcctcttagcatg

SEQ ID NO: 34369 - DNA, 20 bp, Artificial Sequence
  Description of Artificial Sequence: Synthetic oligonucleotide
  Target: SCN10A; (+) strand; PAM type: NRG; PAM sequence: CAG
gaagtcccatatccttaatg

SEQ ID NO: 34370 - DNA, 20 bp, Artificial Sequence
  Description of Artificial Sequence: Synthetic oligonucleotide
  Target: SCN10A; (+) strand; PAM type: NRG; PAM sequence: TAG
cccatatccttaatgcagtc

SEQ ID NO: 34371 - DNA, 20 bp, Artificial Sequence
  Description of Artificial Sequence: Synthetic oligonucleotide
  Target: SCN10A; (+) strand; PAM type: NRG; PAM sequence: AGG
ccatatccttaatgcagtct

SEQ ID NO: 34372 - DNA, 20 bp, Artificial Sequence
  Description of Artificial Sequence: Synthetic oligonucleotide
  Target: SCN10A; (+) strand; PAM type: NRG; PAM sequence: GAG
atatccttaatgcagtctag

SEQ ID NO: 34373 - DNA, 20 bp, Artificial Sequence
  Description of Artificial Sequence: Synthetic oligonucleotide
  Target: SCN10A; (+) strand; PAM type: NRG; PAM sequence: TGG
aatgcagtctaggagtttct

SEQ ID NO: 34374 - DNA, 20 bp, Artificial Sequence
  Description of Artificial Sequence: Synthetic oligonucleotide
  Target: SCN10A; (+) strand; PAM type: NRG; PAM sequence: GGG
atgcagtctaggagtttctt

SEQ ID NO: 34375 - DNA, 20 bp, Artificial Sequence
  Description of Artificial Sequence: Synthetic oligonucleotide
  Target: SCN10A; (+) strand; PAM type: NRG; PAM sequence: TGG
tctaggagtttcttgggatc

SEQ ID NO: 34376 - DNA, 20 bp, Artificial Sequence
  Description of Artificial Sequence: Synthetic oligonucleotide
  Target: SCN10A; (+) strand; PAM type: NRG; PAM sequence: TAG
ctggccccaactcatccctc

SEQ ID NO: 34377 - DNA, 20 bp, Artificial Sequence
  Description of Artificial Sequence: Synthetic oligonucleotide
  Target: SCN10A; (+) strand; PAM type: NRG; PAM sequence: CAG
catccctctagccttatttt

SEQ ID NO: 34378 - DNA, 20 bp, Artificial Sequence
  Description of Artificial Sequence: Synthetic oligonucleotide
  Target: SCN10A; (+) strand; PAM type: NRG; PAM sequence: TGG
agccttattttcagttctcc

SEQ ID NO: 34379 - DNA, 20 bp, Artificial Sequence
  Description of Artificial Sequence: Synthetic oligonucleotide
  Target: SCN10A; (+) strand; PAM type: NRG; PAM sequence: TAG
tttcagttctcctggttctc

SEQ ID NO: 34380 - DNA, 20 bp, Artificial Sequence
  Description of Artificial Sequence: Synthetic oligonucleotide
  Target: SCN10A; (+) strand; PAM type: NRG; PAM sequence: AGG
ttcagttctcctggttctct

SEQ ID NO: 34381 - DNA, 20 bp, Artificial Sequence
  Description of Artificial Sequence: Synthetic oligonucleotide
  Target: SCN10A; (+) strand; PAM type: NRG; PAM sequence: CAG
tctcctggttctctaggtta

SEQ ID NO: 34382 - DNA, 20 bp, Artificial Sequence
  Description of Artificial Sequence: Synthetic oligonucleotide
  Target: SCN10A; (+) strand; PAM type: NRG; PAM sequence: TAG
tctctaggttacagctacat

SEQ ID NO: 34383 - DNA, 20 bp, Artificial Sequence
  Description of Artificial Sequence: Synthetic oligonucleotide
  Target: SCN10A; (+) strand; PAM type: NRG; PAM sequence: AGG
ctctaggttacagctacatt

SEQ ID NO: 34384 - DNA, 20 bp, Artificial Sequence
  Description of Artificial Sequence: Synthetic oligonucleotide
  Target: SCN10A; (+) strand; PAM type: NRG; PAM sequence: CAG
ttattctctcttctgctttg

SEQ ID NO: 34385 - DNA, 20 bp, Artificial Sequence
  Description of Artificial Sequence: Synthetic oligonucleotide
  Target: SCN10A; (+) strand; PAM type: NRG; PAM sequence: CAG
cttctgctttgcagtccttt

SEQ ID NO: 34386 - DNA, 20 bp, Artificial Sequence
  Description of Artificial Sequence: Synthetic oligonucleotide
  Target: SCN10A; (+) strand; PAM type: NRG; PAM sequence: TGG
gctttgcagtcctttcagcc

SEQ ID NO: 34387 - DNA, 20 bp, Artificial Sequence
  Description of Artificial Sequence: Synthetic oligonucleotide
  Target: SCN10A; (+) strand; PAM type: NRG; PAM sequence: GGG
ctttgcagtcctttcagcct

SEQ ID NO: 34388 - DNA, 20 bp, Artificial Sequence
  Description of Artificial Sequence: Synthetic oligonucleotide
  Target: SCN10A; (+) strand; PAM type: NRG; PAM sequence: TGG
ttcagcctgggataattccc

SEQ ID NO: 34389 - DNA, 20 bp, Artificial Sequence
  Description of Artificial Sequence: Synthetic oligonucleotide
  Target: SCN10A; (+) strand; PAM type: NRG; PAM sequence: CAG
ctgggataattccctggctc

SEQ ID NO: 34390 - DNA, 20 bp, Artificial Sequence
  Description of Artificial Sequence: Synthetic oligonucleotide
  Target: SCN10A; (+) strand; PAM type: NRG; PAM sequence: AGG
tgggataattccctggctcc

SEQ ID NO: 34391 - DNA, 20 bp, Artificial Sequence
  Description of Artificial Sequence: Synthetic oligonucleotide
  Target: SCN10A; (+) strand; PAM type: NRG; PAM sequence: TAG
aaatcttaccatatttcact

SEQ ID NO: 34392 - DNA, 20 bp, Artificial Sequence
  Description of Artificial Sequence: Synthetic oligonucleotide
  Target: SCN10A; (+) strand; PAM type: NRG; PAM sequence: AAG
gtatcctgcacttcctcttt

SEQ ID NO: 34393 - DNA, 20 bp, Artificial Sequence
  Description of Artificial Sequence: Synthetic oligonucleotide
  Target: SCN10A; (+) strand; PAM type: NRG; PAM sequence: AGG
tatcctgcacttcctcttta

SEQ ID NO: 34394 - DNA, 20 bp, Artificial Sequence
  Description of Artificial Sequence: Synthetic oligonucleotide
  Target: SCN10A; (+) strand; PAM type: NRG; PAM sequence: CAG
ctttaaggcactcaccactc

SEQ ID NO: 34395 - DNA, 20 bp, Artificial Sequence
  Description of Artificial Sequence: Synthetic oligonucleotide
  Target: SCN10A; (+) strand; PAM type: NRG; PAM sequence: AAG
aaggcactcaccactccagt

SEQ ID NO: 34396 - DNA, 20 bp, Artificial Sequence
  Description of Artificial Sequence: Synthetic oligonucleotide
  Target: SCN10A; (+) strand; PAM type: NRG; PAM sequence: CAG
gtaagctcactgctgtgacc

SEQ ID NO: 34397 - DNA, 20 bp, Artificial Sequence
  Description of Artificial Sequence: Synthetic oligonucleotide
  Target: SCN10A; (+) strand; PAM type: NRG; PAM sequence: TGG
cactgctgtgacccagcttc

SEQ ID NO: 34398 - DNA, 20 bp, Artificial Sequence
  Description of Artificial Sequence: Synthetic oligonucleotide
  Target: SCN10A; (+) strand; PAM type: NRG; PAM sequence: TGG
tgacccagcttctggaattc

SEQ ID NO: 34399 - DNA, 20 bp, Artificial Sequence
  Description of Artificial Sequence: Synthetic oligonucleotide
  Target: SCN10A; (+) strand; PAM type: NRG; PAM sequence: TGG
cagcttctggaattctggct

SEQ ID NO: 34400 - DNA, 20 bp, Artificial Sequence
  Description of Artificial Sequence: Synthetic oligonucleotide
  Target: SCN10A; (+) strand; PAM type: NRG; PAM sequence: CAG
tggaattctggcttggacaa

SEQ ID NO: 34401 - DNA, 20 bp, Artificial Sequence
  Description of Artificial Sequence: Synthetic oligonucleotide
  Target: SCN10A; (+) strand; PAM type: NRG; PAM sequence: CAG
cttggacaacagtgaaatct

SEQ ID NO: 34402 - DNA, 20 bp, Artificial Sequence
  Description of Artificial Sequence: Synthetic oligonucleotide
  Target: SCN10A; (+) strand; PAM type: NRG; PAM sequence: AAG
gaaatctcagcttgcatgcc

SEQ ID NO: 34403 - DNA, 20 bp, Artificial Sequence
  Description of Artificial Sequence: Synthetic oligonucleotide
  Target: SCN10A; (+) strand; PAM type: NRG; PAM sequence: TAG
ctcagcttgcatgccaagca

SEQ ID NO: 34404 - DNA, 20 bp, Artificial Sequence
  Description of Artificial Sequence: Synthetic oligonucleotide
  Target: SCN10A; (+) strand; PAM type: NRG; PAM sequence: AAG
agcttgcatgccaagcatag

SEQ ID NO: 34405 - DNA, 20 bp, Artificial Sequence
  Description of Artificial Sequence: Synthetic oligonucleotide
  Target: SCN10A; (+) strand; PAM type: NRG; PAM sequence: AGG
gcttgcatgccaagcataga

SEQ ID NO: 34406 - DNA, 20 bp, Artificial Sequence
  Description of Artificial Sequence: Synthetic oligonucleotide
  Target: SCN10A; (+) strand; PAM type: NRG; PAM sequence: GAG
atagaaggttcacatgcttt

SEQ ID NO: 34407 - DNA, 20 bp, Artificial Sequence
  Description of Artificial Sequence: Synthetic oligonucleotide
  Target: SCN10A; (+) strand; PAM type: NRG; PAM sequence: CAG
aggttcacatgctttgagtt

SEQ ID NO: 34408 - DNA, 20 bp, Artificial Sequence
  Description of Artificial Sequence: Synthetic oligonucleotide
  Target: SCN10A; (+) strand; PAM type: NRG; PAM sequence: TGG
gtgaattgtcaaactcctgt

SEQ ID NO: 34409 - DNA, 20 bp, Artificial Sequence
  Description of Artificial Sequence: Synthetic oligonucleotide
  Target: SCN10A; (+) strand; PAM type: NRG; PAM sequence: TGG
ttgtcaaactcctgttggtt

SEQ ID NO: 34410 - DNA, 20 bp, Artificial Sequence
  Description of Artificial Sequence: Synthetic oligonucleotide
  Target: SCN10A; (+) strand; PAM type: NRG; PAM sequence: GGG
tgtcaaactcctgttggttt

SEQ ID NO: 34411 - DNA, 20 bp, Artificial Sequence
  Description of Artificial Sequence: Synthetic oligonucleotide
  Target: SCN10A; (+) strand; PAM type: NRG; PAM sequence: AAG
ggtttgggccaaactttctt

SEQ ID NO: 34412 - DNA, 20 bp, Artificial Sequence
  Description of Artificial Sequence: Synthetic oligonucleotide
  Target: SCN10A; (+) strand; PAM type: NRG; PAM sequence: AAG
cttaagcataatccctctta

SEQ ID NO: 34413 - DNA, 20 bp, Artificial Sequence
  Description of Artificial Sequence: Synthetic oligonucleotide
  Target: SCN10A; (+) strand; PAM type: NRG; PAM sequence: GAG
taagcataatccctcttaaa

SEQ ID NO: 34414 - DNA, 20 bp, Artificial Sequence
  Description of Artificial Sequence: Synthetic oligonucleotide
  Target: SCN10A; (+) strand; PAM type: NRG; PAM sequence: AGG
aagcataatccctcttaaag

SEQ ID NO: 34415 - DNA, 20 bp, Artificial Sequence
  Description of Artificial Sequence: Synthetic oligonucleotide
  Target: SCN10A; (+) strand; PAM type: NRG; PAM sequence: TGG
cataatccctcttaaagagg

SEQ ID NO: 34416 - DNA, 20 bp, Artificial Sequence
  Description of Artificial Sequence: Synthetic oligonucleotide
  Target: SCN10A; (+) strand; PAM type: NRG; PAM sequence: TGG
tataaatcctattacgactc

SEQ ID NO: 34417 - DNA, 20 bp, Artificial Sequence
  Description of Artificial Sequence: Synthetic oligonucleotide
  Target: SCN10A; (+) strand; PAM type: NRG; PAM sequence: CAG
aaatcctattacgactctgg

SEQ ID NO: 34418 - DNA, 20 bp, Artificial Sequence
  Description of Artificial Sequence: Synthetic oligonucleotide
  Target: SCN10A; (+) strand; PAM type: NRG; PAM sequence: AAG
attacgactctggcagcatg

SEQ ID NO: 34419 - DNA, 20 bp, Artificial Sequence
  Description of Artificial Sequence: Synthetic oligonucleotide
  Target: SCN10A; (+) strand; PAM type: NRG; PAM sequence: CAG
tggcagcatgaagcatcctt

SEQ ID NO: 34420 - DNA, 20 bp, Artificial Sequence
  Description of Artificial Sequence: Synthetic oligonucleotide
  Target: SCN10A; (+) strand; PAM type: NRG; PAM sequence: AGG
ggcagcatgaagcatccttc

SEQ ID NO: 34421 - DNA, 20 bp, Artificial Sequence
  Description of Artificial Sequence: Synthetic oligonucleotide
  Target: SCN10A; (+) strand; PAM type: NRG; PAM sequence: CAG
taatgaatataacatccaac

SEQ ID NO: 34422 - DNA, 20 bp, Artificial Sequence
  Description of Artificial Sequence: Synthetic oligonucleotide
  Target: SCN10A; (+) strand; PAM type: NRG; PAM sequence: GAG
atgaatataacatccaacca

SEQ ID NO: 34423 - DNA, 20 bp, Artificial Sequence
  Description of Artificial Sequence: Synthetic oligonucleotide
  Target: SCN10A; (+) strand; PAM type: NRG; PAM sequence: AAG
aatataacatccaaccagag

SEQ ID NO: 34424 - DNA, 20 bp, Artificial Sequence
  Description of Artificial Sequence: Synthetic oligonucleotide
  Target: SCN10A; (+) strand; PAM type: NRG; PAM sequence: CAG
aagatgatgtgccctatgct

SEQ ID NO: 34425 - DNA, 20 bp, Artificial Sequence
  Description of Artificial Sequence: Synthetic oligonucleotide
  Target: SCN10A; (+) strand; PAM type: NRG; PAM sequence: AAG
tgacctcttttatttaacct

SEQ ID NO: 34426 - DNA, 20 bp, Artificial Sequence
  Description of Artificial Sequence: Synthetic oligonucleotide
  Target: SCN10A; (+) strand; PAM type: NRG; PAM sequence: AGG
gacctcttttatttaaccta

SEQ ID NO: 34427 - DNA, 20 bp, Artificial Sequence
  Description of Artificial Sequence: Synthetic oligonucleotide
  Target: SCN10A; (+) strand; PAM type: NRG; PAM sequence: CAG
aacctaaggtttcctctcct

SEQ ID NO: 34428 - DNA, 20 bp, Artificial Sequence
  Description of Artificial Sequence: Synthetic oligonucleotide
  Target: SCN10A; (+) strand; PAM type: NRG; PAM sequence: TGG
ttaaaacatcattgtttctc

SEQ ID NO: 34429 - DNA, 20 bp, Artificial Sequence
  Description of Artificial Sequence: Synthetic oligonucleotide
  Target: SCN10A; (+) strand; PAM type: NRG; PAM sequence: CAG
cctttcttactctactgtca

SEQ ID NO: 34430 - DNA, 20 bp, Artificial Sequence
  Description of Artificial Sequence: Synthetic oligonucleotide
  Target: SCN10A; (+) strand; PAM type: NRG; PAM sequence: GAG
actgtcacagcatcttcctt

SEQ ID NO: 34431 - DNA, 20 bp, Artificial Sequence
  Description of Artificial Sequence: Synthetic oligonucleotide
  Target: SCN10A; (+) strand; PAM type: NRG; PAM sequence: AGG
ctgtcacagcatcttccttg

SEQ ID NO: 34432 - DNA, 20 bp, Artificial Sequence
  Description of Artificial Sequence: Synthetic oligonucleotide
  Target: SCN10A; (+) strand; PAM type: NRG; PAM sequence: GGG
tgtcacagcatcttccttga

SEQ ID NO: 34433 - DNA, 20 bp, Artificial Sequence
  Description of Artificial Sequence: Synthetic oligonucleotide
  Target: SCN10A; (+) strand; PAM type: NRG; PAM sequence: GGG
gtcacagcatcttccttgag

SEQ ID NO: 34434 - DNA, 20 bp, Artificial Sequence
  Description of Artificial Sequence: Synthetic oligonucleotide
  Target: SCN10A; (+) strand; PAM type: NRG; PAM sequence: AAG
acagcatcttccttgagggg

SEQ ID NO: 34435 - DNA, 20 bp, Artificial Sequence
  Description of Artificial Sequence: Synthetic oligonucleotide
  Target: SCN10A; (+) strand; PAM type: NRG; PAM sequence: CAG
cttattttcttcctttttat

SEQ ID NO: 34436 - DNA, 20 bp, Artificial Sequence
  Description of Artificial Sequence: Synthetic oligonucleotide
  Target: SCN10A; (+) strand; PAM type: NRG; PAM sequence: TAG
cagttcacactgttataaat

SEQ ID NO: 34437 - DNA, 20 bp, Artificial Sequence
  Description of Artificial Sequence: Synthetic oligonucleotide
  Target: SCN10A; (+) strand; PAM type: NRG; PAM sequence: TGG
ttgtgcatgcacttgtcttc

SEQ ID NO: 34438 - DNA, 20 bp, Artificial Sequence
  Description of Artificial Sequence: Synthetic oligonucleotide
  Target: SCN10A; (+) strand; PAM type: NRG; PAM sequence: GGG
tgtgcatgcacttgtcttct

SEQ ID NO: 34439 - DNA, 20 bp, Artificial Sequence
  Description of Artificial Sequence: Synthetic oligonucleotide
  Target: SCN10A; (+) strand; PAM type: NRG; PAM sequence: TGG
tgcacttgtcttctgggtaa

SEQ ID NO: 34440 - DNA, 20 bp, Artificial Sequence
  Description of Artificial Sequence: Synthetic oligonucleotide
  Target: SCN10A; (+) strand; PAM type: NRG; PAM sequence: GAG
cacttgtcttctgggtaatg

SEQ ID NO: 34441 - DNA, 20 bp, Artificial Sequence
  Description of Artificial Sequence: Synthetic oligonucleotide
  Target: SCN10A; (+) strand; PAM type: NRG; PAM sequence: AGG
acttgtcttctgggtaatgg

SEQ ID NO: 34442 - DNA, 20 bp, Artificial Sequence
  Description of Artificial Sequence: Synthetic oligonucleotide
  Target: SCN10A; (+) strand; PAM type: NRG; PAM sequence: CAG
gtcttctgggtaatggaggt

SEQ ID NO: 34443 - DNA, 20 bp, Artificial Sequence
  Description of Artificial Sequence: Synthetic oligonucleotide
  Target: SCN10A; (+) strand; PAM type: NRG; PAM sequence: AGG
tcttctgggtaatggaggtc

SEQ ID NO: 34444 - DNA, 20 bp, Artificial Sequence
  Description of Artificial Sequence: Synthetic oligonucleotide
  Target: SCN10A; (+) strand; PAM type: NRG; PAM sequence: GAG
ggtaatggaggtcaggctgt

SEQ ID NO: 34445 - DNA, 20 bp, Artificial Sequence
  Description of Artificial Sequence: Synthetic oligonucleotide
  Target: SCN10A; (+) strand; PAM type: NRG; PAM sequence: CAG
aggtcaggctgtgagcaaaa

SEQ ID NO: 34446 - DNA, 20 bp, Artificial Sequence
  Description of Artificial Sequence: Synthetic oligonucleotide
  Target: SCN10A; (+) strand; PAM type: NRG; PAM sequence: TAG
cagacacatctccgccctca

SEQ ID NO: 34447 - DNA, 20 bp, Artificial Sequence
  Description of Artificial Sequence: Synthetic oligonucleotide
  Target: SCN10A; (+) strand; PAM type: NRG; PAM sequence: TAG
ccctcatagattttacaacc

SEQ ID NO: 34448 - DNA, 20 bp, Artificial Sequence
  Description of Artificial Sequence: Synthetic oligonucleotide
  Target: SCN10A; (+) strand; PAM type: NRG; PAM sequence: TAG
tacaacctagtaaatcataa

SEQ ID NO: 34449 - DNA, 20 bp, Artificial Sequence
  Description of Artificial Sequence: Synthetic oligonucleotide
  Target: SCN10A; (+) strand; PAM type: NRG; PAM sequence: GAG
tcataatagccaaatgtgat

SEQ ID NO: 34450 - DNA, 20 bp, Artificial Sequence
  Description of Artificial Sequence: Synthetic oligonucleotide
  Target: SCN10A; (+) strand; PAM type: NRG; PAM sequence: CAG
gatgagtatttactacatgc

SEQ ID NO: 34451 - DNA, 20 bp, Artificial Sequence
  Description of Artificial Sequence: Synthetic oligonucleotide
  Target: SCN10A; (+) strand; PAM type: NRG; PAM sequence: TGG
tatttactacatgccagtcg

SEQ ID NO: 34452 - DNA, 20 bp, Artificial Sequence
  Description of Artificial Sequence: Synthetic oligonucleotide
  Target: SCN10A; (+) strand; PAM type: NRG; PAM sequence: AAG
tacatgccagtcgtggttct

SEQ ID NO: 34453 - DNA, 20 bp, Artificial Sequence
  Description of Artificial Sequence: Synthetic oligonucleotide
  Target: SCN10A; (+) strand; PAM type: NRG; PAM sequence: AAG
taatcctcacaaaactctac

SEQ ID NO: 34454 - DNA, 20 bp, Artificial Sequence
  Description of Artificial Sequence: Synthetic oligonucleotide
  Target: SCN10A; (+) strand; PAM type: NRG; PAM sequence: AAG
ctcacaaaactctacaagat

SEQ ID NO: 34455 - DNA, 20 bp, Artificial Sequence
  Description of Artificial Sequence: Synthetic oligonucleotide
  Target: SCN10A; (+) strand; PAM type: NRG; PAM sequence: CAG
agtatattctcactacttta

SEQ ID NO: 34456 - DNA, 20 bp, Artificial Sequence
  Description of Artificial Sequence: Synthetic oligonucleotide
  Target: SCN10A; (+) strand; PAM type: NRG; PAM sequence: AGG
gtatattctcactactttac

SEQ ID NO: 34457 - DNA, 20 bp, Artificial Sequence
  Description of Artificial Sequence: Synthetic oligonucleotide
  Target: SCN10A; (+) strand; PAM type: NRG; PAM sequence: GAG
actttacaggctaaaaatct

SEQ ID NO: 34458 - DNA, 20 bp, Artificial Sequence
  Description of Artificial Sequence: Synthetic oligonucleotide
  Target: SCN10A; (+) strand; PAM type: NRG; PAM sequence: AGG
ctttacaggctaaaaatctg

SEQ ID NO: 34459 - DNA, 20 bp, Artificial Sequence
  Description of Artificial Sequence: Synthetic oligonucleotide
  Target: SCN10A; (+) strand; PAM type: NRG; PAM sequence: CAG
caggctaaaaatctgaggca

SEQ ID NO: 34460 - DNA, 20 bp, Artificial Sequence
  Description of Artificial Sequence: Synthetic oligonucleotide
  Target: SCN10A; (+) strand; PAM type: NRG; PAM sequence: AAG
taaaaatctgaggcacagaa

SEQ ID NO: 34461 - DNA, 20 bp, Artificial Sequence
  Description of Artificial Sequence: Synthetic oligonucleotide
  Target: SCN10A; (+) strand; PAM type: NRG; PAM sequence: AAG
gaggcacagaaaagttactg

SEQ ID NO: 34462 - DNA, 20 bp, Artificial Sequence
  Description of Artificial Sequence: Synthetic oligonucleotide
  Target: SCN10A; (+) strand; PAM type: NRG; PAM sequence: AAG
agaaaagttactgaagctcc

SEQ ID NO: 34463 - DNA, 20 bp, Artificial Sequence
  Description of Artificial Sequence: Synthetic oligonucleotide
  Target: SCN10A; (+) strand; PAM type: NRG; PAM sequence: AGG
gaaaagttactgaagctcca

SEQ ID NO: 34464 - DNA, 20 bp, Artificial Sequence
  Description of Artificial Sequence: Synthetic oligonucleotide
  Target: SCN10A; (+) strand; PAM type: NRG; PAM sequence: AAG
aaggtcacactgtgtaccat

SEQ ID NO: 34465 - DNA, 20 bp, Artificial Sequence
  Description of Artificial Sequence: Synthetic oligonucleotide
  Target: SCN10A; (+) strand; PAM type: NRG; PAM sequence: TGG
gtcacactgtgtaccataag

SEQ ID NO: 34466 - DNA, 20 bp, Artificial Sequence
  Description of Artificial Sequence: Synthetic oligonucleotide
  Target: SCN10A; (+) strand; PAM type: NRG; PAM sequence: AAG
acactgtgtaccataagtgg

SEQ ID NO: 34467 - DNA, 20 bp, Artificial Sequence
  Description of Artificial Sequence: Synthetic oligonucleotide
  Target: SCN10A; (+) strand; PAM type: NRG; PAM sequence: GAG
actgtgtaccataagtggaa

SEQ ID NO: 34468 - DNA, 20 bp, Artificial Sequence
  Description of Artificial Sequence: Synthetic oligonucleotide
  Target: SCN10A; (+) strand; PAM type: NRG; PAM sequence: TAG
tgtaccataagtggaagagc

SEQ ID NO: 34469 - DNA, 20 bp, Artificial Sequence
  Description of Artificial Sequence: Synthetic oligonucleotide
  Target: SCN10A; (+) strand; PAM type: NRG; PAM sequence: AGG
gtaccataagtggaagagct

SEQ ID NO: 34470 - DNA, 20 bp, Artificial Sequence
  Description of Artificial Sequence: Synthetic oligonucleotide
  Target: SCN10A; (+) strand; PAM type: NRG; PAM sequence: CAG
gaagagctaggatgcaaacc

SEQ ID NO: 34471 - DNA, 20 bp, Artificial Sequence
  Description of Artificial Sequence: Synthetic oligonucleotide
  Target: SCN10A; (+) strand; PAM type: NRG; PAM sequence: AGG
aagagctaggatgcaaaccc

SEQ ID NO: 34472 - DNA, 20 bp, Artificial Sequence
  Description of Artificial Sequence: Synthetic oligonucleotide
  Target: SCN10A; (+) strand; PAM type: NRG; PAM sequence: CAG
agctaggatgcaaacccagg

SEQ ID NO: 34473 - DNA, 20 bp, Artificial Sequence
  Description of Artificial Sequence: Synthetic oligonucleotide
  Target: SCN10A; (+) strand; PAM type: NRG; PAM sequence: CGG
aggatgcaaacccaggcagc

SEQ ID NO: 34474 - DNA, 20 bp, Artificial Sequence
  Description of Artificial Sequence: Synthetic oligonucleotide
  Target: SCN10A; (+) strand; PAM type: NRG; PAM sequence: GGG
ggatgcaaacccaggcagcc

SEQ ID NO: 34475 - DNA, 20 bp, Artificial Sequence
  Description of Artificial Sequence: Synthetic oligonucleotide
  Target: SCN10A; (+) strand; PAM type: NRG; PAM sequence: CAG
aaacccaggcagccgggttc

SEQ ID NO: 34476 - DNA, 20 bp, Artificial Sequence
  Description of Artificial Sequence: Synthetic oligonucleotide
  Target: SCN10A; (+) strand; PAM type: NRG; PAM sequence: GAG
acccaggcagccgggttcca

SEQ ID NO: 34477 - DNA, 20 bp, Artificial Sequence
  Description of Artificial Sequence: Synthetic oligonucleotide
  Target: SCN10A; (+) strand; PAM type: NRG; PAM sequence: CAG
caggcagccgggttccagag

SEQ ID NO: 34478 - DNA, 20 bp, Artificial Sequence
  Description of Artificial Sequence: Synthetic oligonucleotide
  Target: SCN10A; (+) strand; PAM type: NRG; PAM sequence: TGG
ttcttttgtcttacctacac

SEQ ID NO: 34479 - DNA, 20 bp, Artificial Sequence
  Description of Artificial Sequence: Synthetic oligonucleotide
  Target: SCN10A; (+) strand; PAM type: NRG; PAM sequence: GGG
tcttttgtcttacctacact

SEQ ID NO: 34480 - DNA, 20 bp, Artificial Sequence
  Description of Artificial Sequence: Synthetic oligonucleotide
  Target: SCN10A; (+) strand; PAM type: NRG; PAM sequence: TGG
tacctacactgggatgtgtt

SEQ ID NO: 34481 - DNA, 20 bp, Artificial Sequence
  Description of Artificial Sequence: Synthetic oligonucleotide
  Target: SCN10A; (+) strand; PAM type: NRG; PAM sequence: GGG
acctacactgggatgtgttt

SEQ ID NO: 34482 - DNA, 20 bp, Artificial Sequence
  Description of Artificial Sequence: Synthetic oligonucleotide
  Target: SCN10A; (+) strand; PAM type: NRG; PAM sequence: CAG
ttgttgctatctcattcttg

SEQ ID NO: 34483 - DNA, 20 bp, Artificial Sequence
  Description of Artificial Sequence: Synthetic oligonucleotide
  Target: SCN10A; (+) strand; PAM type: NRG; PAM sequence: CAG
gtgtctgcgaactttctcct

SEQ ID NO: 34484 - DNA, 20 bp, Artificial Sequence
  Description of Artificial Sequence: Synthetic oligonucleotide
  Target: SCN10A; (+) strand; PAM type: NRG; PAM sequence: TAG
tttctcctcagcttcttaca

SEQ ID NO: 34485 - DNA, 20 bp, Artificial Sequence
  Description of Artificial Sequence: Synthetic oligonucleotide
  Target: SCN10A; (+) strand; PAM type: NRG; PAM sequence: TGG
attcaaatttctgttcttct

SEQ ID NO: 34486 - DNA, 20 bp, Artificial Sequence
  Description of Artificial Sequence: Synthetic oligonucleotide
  Target: SCN10A; (+) strand; PAM type: NRG; PAM sequence: GAG
tcaaatttctgttcttcttg

SEQ ID NO: 34487 - DNA, 20 bp, Artificial Sequence
  Description of Artificial Sequence: Synthetic oligonucleotide
  Target: SCN10A; (+) strand; PAM type: NRG; PAM sequence: GAG
aaatttctgttcttcttgga

SEQ ID NO: 34488 - DNA, 20 bp, Artificial Sequence
  Description of Artificial Sequence: Synthetic oligonucleotide
  Target: SCN10A; (+) strand; PAM type: NRG; PAM sequence: TAG
tttcatgtccccttccctgc

SEQ ID NO: 34489 - DNA, 20 bp, Artificial Sequence
  Description of Artificial Sequence: Synthetic oligonucleotide
  Target: SCN10A; (+) strand; PAM type: NRG; PAM sequence: AGG
ttcatgtccccttccctgct

SEQ ID NO: 34490 - DNA, 20 bp, Artificial Sequence
  Description of Artificial Sequence: Synthetic oligonucleotide
  Target: SCN10A; (+) strand; PAM type: NRG; PAM sequence: TAG
tccccttccctgctaggatg

SEQ ID NO: 34491 - DNA, 20 bp, Artificial Sequence
  Description of Artificial Sequence: Synthetic oligonucleotide
  Target: SCN10A; (+) strand; PAM type: NRG; PAM sequence: GAG
tgctaggatgtagattccat

SEQ ID NO: 34492 - DNA, 20 bp, Artificial Sequence
  Description of Artificial Sequence: Synthetic oligonucleotide
  Target: SCN10A; (+) strand; PAM type: NRG; PAM sequence: AAG
gatgtagattccatgagcgc

SEQ ID NO: 34493 - DNA, 20 bp, Artificial Sequence
  Description of Artificial Sequence: Synthetic oligonucleotide
  Target: SCN10A; (+) strand; PAM type: NRG; PAM sequence: CAG
ccatgagcgcaagcttatat

SEQ ID NO: 34494 - DNA, 20 bp, Artificial Sequence
  Description of Artificial Sequence: Synthetic oligonucleotide
  Target: SCN10A; (+) strand; PAM type: NRG; PAM sequence: CAG
atcagttcaccactgaatcc

SEQ ID NO: 34495 - DNA, 20 bp, Artificial Sequence
  Description of Artificial Sequence: Synthetic oligonucleotide
  Target: SCN10A; (+) strand; PAM type: NRG; PAM sequence: AAG
ccactgaatcccagcacctg

SEQ ID NO: 34496 - DNA, 20 bp, Artificial Sequence
  Description of Artificial Sequence: Synthetic oligonucleotide
  Target: SCN10A; (+) strand; PAM type: NRG; PAM sequence: CAG
aagcaatgccacacacacaa

SEQ ID NO: 34497 - DNA, 20 bp, Artificial Sequence
  Description of Artificial Sequence: Synthetic oligonucleotide
  Target: SCN10A; (+) strand; PAM type: NRG; PAM sequence: AGG
agcaatgccacacacacaac

SEQ ID NO: 34498 - DNA, 20 bp, Artificial Sequence
  Description of Artificial Sequence: Synthetic oligonucleotide
  Target: SCN10A; (+) strand; PAM type: NRG; PAM sequence: GGG
gcaatgccacacacacaaca

SEQ ID NO: 34499 - DNA, 20 bp, Artificial Sequence
  Description of Artificial Sequence: Synthetic oligonucleotide
  Target: SCN10A; (+) strand; PAM type: NRG; PAM sequence: GGG
caatgccacacacacaacag

SEQ ID NO: 34500 - DNA, 20 bp, Artificial Sequence
  Description of Artificial Sequence: Synthetic oligonucleotide
  Target: SCN10A; (+) strand; PAM type: NRG; PAM sequence: AAG
ctcaacaaatgcttgttgat

SEQ ID NO: 34501 - DNA, 20 bp, Artificial Sequence
  Description of Artificial Sequence: Synthetic oligonucleotide
  Target: SCN10A; (+) strand; PAM type: NRG; PAM sequence: GAG
caacaaatgcttgttgataa

SEQ ID NO: 34502 - DNA, 20 bp, Artificial Sequence
  Description of Artificial Sequence: Synthetic oligonucleotide
  Target: SCN10A; (+) strand; PAM type: NRG; PAM sequence: AAG
gttgataagagaataaatga

SEQ ID NO: 34503 - DNA, 20 bp, Artificial Sequence
  Description of Artificial Sequence: Synthetic oligonucleotide
  Target: SCN10A; (+) strand; PAM type: NRG; PAM sequence: AAG
gataagagaataaatgaaag

SEQ ID NO: 34504 - DNA, 20 bp, Artificial Sequence
  Description of Artificial Sequence: Synthetic oligonucleotide
  Target: SCN10A; (+) strand; PAM type: NRG; PAM sequence: GAG
taagagaataaatgaaagaa

SEQ ID NO: 34505 - DNA, 20 bp, Artificial Sequence
  Description of Artificial Sequence: Synthetic oligonucleotide
  Target: SCN10A; (+) strand; PAM type: NRG; PAM sequence: GAG
agagaataaatgaaagaaga

SEQ ID NO: 34506 - DNA, 20 bp, Artificial Sequence
  Description of Artificial Sequence: Synthetic oligonucleotide
  Target: SCN10A; (+) strand; PAM type: NRG; PAM sequence: AAG
gaataaatgaaagaagagag

SEQ ID NO: 34507 - DNA, 20 bp, Artificial Sequence
  Description of Artificial Sequence: Synthetic oligonucleotide
  Target: SCN10A; (+) strand; PAM type: NRG; PAM sequence: AGG
aataaatgaaagaagagaga

SEQ ID NO: 34508 - DNA, 20 bp, Artificial Sequence
  Description of Artificial Sequence: Synthetic oligonucleotide
  Target: SCN10A; (+) strand; PAM type: NRG; PAM sequence: GAG
taaatgaaagaagagagaag

SEQ ID NO: 34509 - DNA, 20 bp, Artificial Sequence
  Description of Artificial Sequence: Synthetic oligonucleotide
  Target: SCN10A; (+) strand; PAM type: NRG; PAM sequence: AGG
aaatgaaagaagagagaagg

SEQ ID NO: 34510 - DNA, 20 bp, Artificial Sequence
  Description of Artificial Sequence: Synthetic oligonucleotide
  Target: SCN10A; (+) strand; PAM type: NRG; PAM sequence: AAG
tgaaagaagagagaaggagg

SEQ ID NO: 34511 - DNA, 20 bp, Artificial Sequence
  Description of Artificial Sequence: Synthetic oligonucleotide
  Target: SCN10A; (+) strand; PAM type: NRG; PAM sequence: CAG
gagagaaggaggaagcttaa

SEQ ID NO: 34512 - DNA, 20 bp, Artificial Sequence
  Description of Artificial Sequence: Synthetic oligonucleotide
  Target: SCN10A; (+) strand; PAM type: NRG; PAM sequence: GAG
gaggaagcttaacagttttc

SEQ ID NO: 34513 - DNA, 20 bp, Artificial Sequence
  Description of Artificial Sequence: Synthetic oligonucleotide
  Target: SCN10A; (+) strand; PAM type: NRG; PAM sequence: TAG
gtttgctgtttgatgactaa

SEQ ID NO: 34514 - DNA, 20 bp, Artificial Sequence
  Description of Artificial Sequence: Synthetic oligonucleotide
  Target: SCN10A; (+) strand; PAM type: NRG; PAM sequence: AAG
aaaacaaacaaacaaaaacc

SEQ ID NO: 34515 - DNA, 20 bp, Artificial Sequence
  Description of Artificial Sequence: Synthetic oligonucleotide
  Target: SCN10A; (+) strand; PAM type: NRG; PAM sequence: TGG
caaaaaccaagaaacctatc

SEQ ID NO: 34516 - DNA, 20 bp, Artificial Sequence
  Description of Artificial Sequence: Synthetic oligonucleotide
  Target: SCN10A; (+) strand; PAM type: NRG; PAM sequence: AAG
accaagaaacctatctggcc

SEQ ID NO: 34517 - DNA, 20 bp, Artificial Sequence
  Description of Artificial Sequence: Synthetic oligonucleotide
  Target: SCN10A; (+) strand; PAM type: NRG; PAM sequence: AAG
agaaacctatctggccaaga

SEQ ID NO: 34518 - DNA, 20 bp, Artificial Sequence
  Description of Artificial Sequence: Synthetic oligonucleotide
  Target: SCN10A; (+) strand; PAM type: NRG; PAM sequence: TGG
tctggccaagaaagaaattg

SEQ ID NO: 34519 - DNA, 20 bp, Artificial Sequence
  Description of Artificial Sequence: Synthetic oligonucleotide
  Target: SCN10A; (+) strand; PAM type: NRG; PAM sequence: GGG
ctggccaagaaagaaattgt

SEQ ID NO: 34520 - DNA, 20 bp, Artificial Sequence
  Description of Artificial Sequence: Synthetic oligonucleotide
  Target: SCN10A; (+) strand; PAM type: NRG; PAM sequence: TAG
caagaaagaaattgtgggaa

SEQ ID NO: 34521 - DNA, 20 bp, Artificial Sequence
  Description of Artificial Sequence: Synthetic oligonucleotide
  Target: SCN10A; (+) strand; PAM type: NRG; PAM sequence: CAG
gaaagaaattgtgggaatag

SEQ ID NO: 34522 - DNA, 20 bp, Artificial Sequence
  Description of Artificial Sequence: Synthetic oligonucleotide
  Target: SCN10A; (+) strand; PAM type: NRG; PAM sequence: TGG
aaattgtgggaatagcagct

SEQ ID NO: 34523 - DNA, 20 bp, Artificial Sequence
  Description of Artificial Sequence: Synthetic oligonucleotide
  Target: SCN10A; (+) strand; PAM type: NRG; PAM sequence: TAG
ttctatgccatgaaaaatgt

SEQ ID NO: 34524 - DNA, 20 bp, Artificial Sequence
  Description of Artificial Sequence: Synthetic oligonucleotide
  Target: SCN10A; (+) strand; PAM type: NRG; PAM sequence: AAG
tatgccatgaaaaatgttag

SEQ ID NO: 34525 - DNA, 20 bp, Artificial Sequence
  Description of Artificial Sequence: Synthetic oligonucleotide
  Target: SCN10A; (+) strand; PAM type: NRG; PAM sequence: CAG
catgaaaaatgttagaagta

SEQ ID NO: 34526 - DNA, 20 bp, Artificial Sequence
  Description of Artificial Sequence: Synthetic oligonucleotide
  Target: SCN10A; (+) strand; PAM type: NRG; PAM sequence: CAG
acagactctattacaatgaa

SEQ ID NO: 34527 - DNA, 20 bp, Artificial Sequence
  Description of Artificial Sequence: Synthetic oligonucleotide
  Target: SCN10A; (+) strand; PAM type: NRG; PAM sequence: GAG
gatattaaataattatcaat

SEQ ID NO: 34528 - DNA, 20 bp, Artificial Sequence
  Description of Artificial Sequence: Synthetic oligonucleotide
  Target: SCN10A; (+) strand; PAM type: NRG; PAM sequence: TAG
ttatcaatgagaaaaaataa

SEQ ID NO: 34529 - DNA, 20 bp, Artificial Sequence
  Description of Artificial Sequence: Synthetic oligonucleotide
  Target: SCN10A; (+) strand; PAM type: NRG; PAM sequence: AAG
tcaatgagaaaaaataatag

SEQ ID NO: 34530 - DNA, 20 bp, Artificial Sequence
  Description of Artificial Sequence: Synthetic oligonucleotide
  Target: SCN10A; (+) strand; PAM type: NRG; PAM sequence: GAG
aatgagaaaaaataatagaa

SEQ ID NO: 34531 - DNA, 20 bp, Artificial Sequence
  Description of Artificial Sequence: Synthetic oligonucleotide
  Target: SCN10A; (+) strand; PAM type: NRG; PAM sequence: GAG
tgagaaaaaataatagaaga

SEQ ID NO: 34532 - DNA, 20 bp, Artificial Sequence
  Description of Artificial Sequence: Synthetic oligonucleotide
  Target: SCN10A; (+) strand; PAM type: NRG; PAM sequence: GAG
agtctgtacacgttgttgtt

SEQ ID NO: 34533 - DNA, 20 bp, Artificial Sequence
  Description of Artificial Sequence: Synthetic oligonucleotide
  Target: SCN10A; (+) strand; PAM type: NRG; PAM sequence: GAG
acacgttgttgttgagaaat

SEQ ID NO: 34534 - DNA, 20 bp, Artificial Sequence
  Description of Artificial Sequence: Synthetic oligonucleotide
  Target: SCN10A; (+) strand; PAM type: NRG; PAM sequence: AAG
aaatgagtacacatttctca

SEQ ID NO: 34535 - DNA, 20 bp, Artificial Sequence
  Description of Artificial Sequence: Synthetic oligonucleotide
  Target: SCN10A; (+) strand; PAM type: NRG; PAM sequence: CAG
catttctcaaagcacaaact

SEQ ID NO: 34536 - DNA, 20 bp, Artificial Sequence
  Description of Artificial Sequence: Synthetic oligonucleotide
  Target: SCN10A; (+) strand; PAM type: NRG; PAM sequence: AGG
atttctcaaagcacaaactc

SEQ ID NO: 34537 - DNA, 20 bp, Artificial Sequence
  Description of Artificial Sequence: Synthetic oligonucleotide
  Target: SCN10A; (+) strand; PAM type: NRG; PAM sequence: AAG
aagcacaaactcaggtatgc

SEQ ID NO: 34538 - DNA, 20 bp, Artificial Sequence
  Description of Artificial Sequence: Synthetic oligonucleotide
  Target: SCN10A; (+) strand; PAM type: NRG; PAM sequence: TAG
ggtatgcaagaaatgtaact

SEQ ID NO: 34539 - DNA, 20 bp, Artificial Sequence
  Description of Artificial Sequence: Synthetic oligonucleotide
  Target: SCN10A; (+) strand; PAM type: NRG; PAM sequence: AAG
ttgaattcaatttatgcttc

SEQ ID NO: 34540 - DNA, 20 bp, Artificial Sequence
  Description of Artificial Sequence: Synthetic oligonucleotide
  Target: SCN10A; (+) strand; PAM type: NRG; PAM sequence: TGG
tatgcttcaagtcctcacca

SEQ ID NO: 34541 - DNA, 20 bp, Artificial Sequence
  Description of Artificial Sequence: Synthetic oligonucleotide
  Target: SCN10A; (+) strand; PAM type: NRG; PAM sequence: GGG
atgcttcaagtcctcaccat

SEQ ID NO: 34542 - DNA, 20 bp, Artificial Sequence
  Description of Artificial Sequence: Synthetic oligonucleotide
  Target: SCN10A; (+) strand; PAM type: NRG; PAM sequence: AAG
catgggaactgtctcttgtt

SEQ ID NO: 34543 - DNA, 20 bp, Artificial Sequence
  Description of Artificial Sequence: Synthetic oligonucleotide
  Target: SCN10A; (+) strand; PAM type: NRG; PAM sequence: TGG
gtctcttgttaagtcaatgt

SEQ ID NO: 34544 - DNA, 20 bp, Artificial Sequence
  Description of Artificial Sequence: Synthetic oligonucleotide
  Target: SCN10A; (+) strand; PAM type: NRG; PAM sequence: GGG
tctcttgttaagtcaatgtt

SEQ ID NO: 34545 - DNA, 20 bp, Artificial Sequence
  Description of Artificial Sequence: Synthetic oligonucleotide
  Target: SCN10A; (+) strand; PAM type: NRG; PAM sequence: GAG
tgggtactatttcaatatct

SEQ ID NO: 34546 - DNA, 20 bp, Artificial Sequence
  Description of Artificial Sequence: Synthetic oligonucleotide
  Target: SCN10A; (+) strand; PAM type: NRG; PAM sequence: GAG
caatatctgagtctgtgtct

SEQ ID NO: 34547 - DNA, 20 bp, Artificial Sequence
  Description of Artificial Sequence: Synthetic oligonucleotide
  Target: SCN10A; (+) strand; PAM type: NRG; PAM sequence: TAG
gagtctgtgtctgagttttg

SEQ ID NO: 34548 - DNA, 20 bp, Artificial Sequence
  Description of Artificial Sequence: Synthetic oligonucleotide
  Target: SCN10A; (+) strand; PAM type: NRG; PAM sequence: AGG
agtctgtgtctgagttttgt

SEQ ID NO: 34549 - DNA, 20 bp, Artificial Sequence
  Description of Artificial Sequence: Synthetic oligonucleotide
  Target: SCN10A; (+) strand; PAM type: NRG; PAM sequence: GGG
gtctgtgtctgagttttgta

SEQ ID NO: 34550 - DNA, 20 bp, Artificial Sequence
  Description of Artificial Sequence: Synthetic oligonucleotide
  Target: SCN10A; (+) strand; PAM type: NRG; PAM sequence: TGG
agttttgtagggctcaaacc

SEQ ID NO: 34551 - DNA, 20 bp, Artificial Sequence
  Description of Artificial Sequence: Synthetic oligonucleotide
  Target: SCN10A; (+) strand; PAM type: NRG; PAM sequence: GAG
ttttgtagggctcaaacctg

SEQ ID NO: 34552 - DNA, 20 bp, Artificial Sequence
  Description of Artificial Sequence: Synthetic oligonucleotide
  Target: SCN10A; (+) strand; PAM type: NRG; PAM sequence: AGG
tttgtagggctcaaacctgg

SEQ ID NO: 34553 - DNA, 20 bp, Artificial Sequence
  Description of Artificial Sequence: Synthetic oligonucleotide
  Target: SCN10A; (+) strand; PAM type: NRG; PAM sequence: GAG
tgtagggctcaaacctggag

SEQ ID NO: 34554 - DNA, 20 bp, Artificial Sequence
  Description of Artificial Sequence: Synthetic oligonucleotide
  Target: SCN10A; (+) strand; PAM type: NRG; PAM sequence: GAG
tagggctcaaacctggagga

SEQ ID NO: 34555 - DNA, 20 bp, Artificial Sequence
  Description of Artificial Sequence: Synthetic oligonucleotide
  Target: SCN10A; (+) strand; PAM type: NRG; PAM sequence: GAG
ctcaaacctggaggagagtt

SEQ ID NO: 34556 - DNA, 20 bp, Artificial Sequence
  Description of Artificial Sequence: Synthetic oligonucleotide
  Target: SCN10A; (+) strand; PAM type: NRG; PAM sequence: TGG
aacctggaggagagttgagc

SEQ ID NO: 34557 - DNA, 20 bp, Artificial Sequence
  Description of Artificial Sequence: Synthetic oligonucleotide
  Target: SCN10A; (+) strand; PAM type: NRG; PAM sequence: AAG
gctggtcctttgtcattgct

SEQ ID NO: 34558 - DNA, 20 bp, Artificial Sequence
  Description of Artificial Sequence: Synthetic oligonucleotide
  Target: SCN10A; (+) strand; PAM type: NRG; PAM sequence: GAG
ttgctaagcgtattttgcct

SEQ ID NO: 34559 - DNA, 20 bp, Artificial Sequence
  Description of Artificial Sequence: Synthetic oligonucleotide
  Target: SCN10A; (+) strand; PAM type: NRG; PAM sequence: TAG
agcgtattttgcctgagttg

SEQ ID NO: 34560 - DNA, 20 bp, Artificial Sequence
  Description of Artificial Sequence: Synthetic oligonucleotide
  Target: SCN10A; (+) strand; PAM type: NRG; PAM sequence: TGG
cctgagttgtagctcccatc

SEQ ID NO: 34561 - DNA, 20 bp, Artificial Sequence
  Description of Artificial Sequence: Synthetic oligonucleotide
  Target: SCN10A; (+) strand; PAM type: NRG; PAM sequence: TGG
tgtagctcccatctggtccc

SEQ ID NO: 34562 - DNA, 20 bp, Artificial Sequence
  Description of Artificial Sequence: Synthetic oligonucleotide
  Target: SCN10A; (+) strand; PAM type: NRG; PAM sequence: TGG
agctcccatctggtccctgg

SEQ ID NO: 34563 - DNA, 20 bp, Artificial Sequence
  Description of Artificial Sequence: Synthetic oligonucleotide
  Target: SCN10A; (+) strand; PAM type: NRG; PAM sequence: GGG
gctcccatctggtccctggt

SEQ ID NO: 34564 - DNA, 20 bp, Artificial Sequence
  Description of Artificial Sequence: Synthetic oligonucleotide
  Target: SCN10A; (+) strand; PAM type: NRG; PAM sequence: GAG
tcccatctggtccctggtgg

SEQ ID NO: 34565 - DNA, 20 bp, Artificial Sequence
  Description of Artificial Sequence: Synthetic oligonucleotide
  Target: SCN10A; (+) strand; PAM type: NRG; PAM sequence: GAG
ccatctggtccctggtggga

SEQ ID NO: 34566 - DNA, 20 bp, Artificial Sequence
  Description of Artificial Sequence: Synthetic oligonucleotide
  Target: SCN10A; (+) strand; PAM type: NRG; PAM sequence: AAG
ccctggtgggagagtccatg

SEQ ID NO: 34567 - DNA, 20 bp, Artificial Sequence
  Description of Artificial Sequence: Synthetic oligonucleotide
  Target: SCN10A; (+) strand; PAM type: NRG; PAM sequence: TGG
ggtgggagagtccatgaaga

SEQ ID NO: 34568 - DNA, 20 bp, Artificial Sequence
  Description of Artificial Sequence: Synthetic oligonucleotide
  Target: SCN10A; (+) strand; PAM type: NRG; PAM sequence: TAG
gaagatggctcttctctctc

SEQ ID NO: 34569 - DNA, 20 bp, Artificial Sequence
  Description of Artificial Sequence: Synthetic oligonucleotide
  Target: SCN10A; (+) strand; PAM type: NRG; PAM sequence: TGG
ctctctctagtttccctcta

SEQ ID NO: 34570 - DNA, 20 bp, Artificial Sequence
  Description of Artificial Sequence: Synthetic oligonucleotide
  Target: SCN10A; (+) strand; PAM type: NRG; PAM sequence: GGG
tctctctagtttccctctat

SEQ ID NO: 34571 - DNA, 20 bp, Artificial Sequence
  Description of Artificial Sequence: Synthetic oligonucleotide
  Target: SCN10A; (+) strand; PAM type: NRG; PAM sequence: TAG
gtctcactcatctttttcca

SEQ ID NO: 34572 - DNA, 20 bp, Artificial Sequence
  Description of Artificial Sequence: Synthetic oligonucleotide
  Target: SCN10A; (+) strand; PAM type: NRG; PAM sequence: TGG
tctttttccatagccttcac

SEQ ID NO: 34573 - DNA, 20 bp, Artificial Sequence
  Description of Artificial Sequence: Synthetic oligonucleotide
  Target: SCN10A; (+) strand; PAM type: NRG; PAM sequence: GGG
ctttttccatagccttcact

SEQ ID NO: 34574 - DNA, 20 bp, Artificial Sequence
  Description of Artificial Sequence: Synthetic oligonucleotide
  Target: SCN10A; (+) strand; PAM type: NRG; PAM sequence: GGG
tttttccatagccttcactg

SEQ ID NO: 34575 - DNA, 20 bp, Artificial Sequence
  Description of Artificial Sequence: Synthetic oligonucleotide
  Target: SCN10A; (+) strand; PAM type: NRG; PAM sequence: GGG
ttttccatagccttcactgg

SEQ ID NO: 34576 - DNA, 20 bp, Artificial Sequence
  Description of Artificial Sequence: Synthetic oligonucleotide
  Target: SCN10A; (+) strand; PAM type: NRG; PAM sequence: AAG
catagccttcactgggggct

SEQ ID NO: 34577 - DNA, 20 bp, Artificial Sequence
  Description of Artificial Sequence: Synthetic oligonucleotide
  Target: SCN10A; (+) strand; PAM type: NRG; PAM sequence: CAG
ctgggggctaagtcatcacc

SEQ ID NO: 34578 - DNA, 20 bp, Artificial Sequence
  Description of Artificial Sequence: Synthetic oligonucleotide
  Target: SCN10A; (+) strand; PAM type: NRG; PAM sequence: TGG
ccagctcctctctgccattc

SEQ ID NO: 34579 - DNA, 20 bp, Artificial Sequence
  Description of Artificial Sequence: Synthetic oligonucleotide
  Target: SCN10A; (+) strand; PAM type: NRG; PAM sequence: GAG
agctcctctctgccattctg

SEQ ID NO: 34580 - DNA, 20 bp, Artificial Sequence
  Description of Artificial Sequence: Synthetic oligonucleotide
  Target: SCN10A; (+) strand; PAM type: NRG; PAM sequence: CAG
tctctgccattctggagcca

SEQ ID NO: 34581 - DNA, 20 bp, Artificial Sequence
  Description of Artificial Sequence: Synthetic oligonucleotide
  Target: SCN10A; (+) strand; PAM type: NRG; PAM sequence: AGG
ctctgccattctggagccac

SEQ ID NO: 34582 - DNA, 20 bp, Artificial Sequence
  Description of Artificial Sequence: Synthetic oligonucleotide
  Target: SCN10A; (+) strand; PAM type: NRG; PAM sequence: GGG
tctgccattctggagccaca

SEQ ID NO: 34583 - DNA, 20 bp, Artificial Sequence
  Description of Artificial Sequence: Synthetic oligonucleotide
  Target: SCN10A; (+) strand; PAM type: NRG; PAM sequence: GAG
ggagccacagggctctctct

SEQ ID NO: 34584 - DNA, 20 bp, Artificial Sequence
  Description of Artificial Sequence: Synthetic oligonucleotide
  Target: SCN10A; (+) strand; PAM type: NRG; PAM sequence: AGG
gagccacagggctctctctg

SEQ ID NO: 34585 - DNA, 20 bp, Artificial Sequence
  Description of Artificial Sequence: Synthetic oligonucleotide
  Target: SCN10A; (+) strand; PAM type: NRG; PAM sequence: CAG
ggctctctctgaggctgctt

SEQ ID NO: 34586 - DNA, 20 bp, Artificial Sequence
  Description of Artificial Sequence: Synthetic oligonucleotide
  Target: SCN10A; (+) strand; PAM type: NRG; PAM sequence: AGG
gctctctctgaggctgcttc

SEQ ID NO: 34587 - DNA, 20 bp, Artificial Sequence
  Description of Artificial Sequence: Synthetic oligonucleotide
  Target: SCN10A; (+) strand; PAM type: NRG; PAM sequence: AAG
cttcaggccttctctaacct

SEQ ID NO: 34588 - DNA, 20 bp, Artificial Sequence
  Description of Artificial Sequence: Synthetic oligonucleotide
  Target: SCN10A; (+) strand; PAM type: NRG; PAM sequence: AGG
ttcaggccttctctaaccta

SEQ ID NO: 34589 - DNA, 20 bp, Artificial Sequence
  Description of Artificial Sequence: Synthetic oligonucleotide
  Target: SCN10A; (+) strand; PAM type: NRG; PAM sequence: AAG
ctctaacctaaggttgacct

SEQ ID NO: 34590 - DNA, 20 bp, Artificial Sequence
  Description of Artificial Sequence: Synthetic oligonucleotide
  Target: SCN10A; (+) strand; PAM type: NRG; PAM sequence: AAG
acctaaggttgacctaagct

SEQ ID NO: 34591 - DNA, 20 bp, Artificial Sequence
  Description of Artificial Sequence: Synthetic oligonucleotide
  Target: SCN10A; (+) strand; PAM type: NRG; PAM sequence: AGG
cctaaggttgacctaagcta

SEQ ID NO: 34592 - DNA, 20 bp, Artificial Sequence
  Description of Artificial Sequence: Synthetic oligonucleotide
  Target: SCN10A; (+) strand; PAM type: NRG; PAM sequence: CAG
aagctaaggttgcctttccc

SEQ ID NO: 34593 - DNA, 20 bp, Artificial Sequence
  Description of Artificial Sequence: Synthetic oligonucleotide
  Target: SCN10A; (+) strand; PAM type: NRG; PAM sequence: CAG
cctttcttactctactctca

SEQ ID NO: 34594 - DNA, 20 bp, Artificial Sequence
  Description of Artificial Sequence: Synthetic oligonucleotide
  Target: SCN10A; (+) strand; PAM type: NRG; PAM sequence: GAG
actctcacagtatcttcctt

SEQ ID NO: 34595 - DNA, 20 bp, Artificial Sequence
  Description of Artificial Sequence: Synthetic oligonucleotide
  Target: SCN10A; (+) strand; PAM type: NRG; PAM sequence: CGG
ctcacagtatcttccttgag

SEQ ID NO: 34596 - DNA, 20 bp, Artificial Sequence
  Description of Artificial Sequence: Synthetic oligonucleotide
  Target: SCN10A; (+) strand; PAM type: NRG; PAM sequence: AAG
acagtatcttccttgagcgg

SEQ ID NO: 34597 - DNA, 20 bp, Artificial Sequence
  Description of Artificial Sequence: Synthetic oligonucleotide
  Target: SCN10A; (+) strand; PAM type: NRG; PAM sequence: AAG
gcggaagtctatcctacccc

SEQ ID NO: 34598 - DNA, 20 bp, Artificial Sequence
  Description of Artificial Sequence: Synthetic oligonucleotide
  Target: SCN10A; (+) strand; PAM type: NRG; PAM sequence: CAG
cttattttcttcctttttat

SEQ ID NO: 34599 - DNA, 20 bp, Artificial Sequence
  Description of Artificial Sequence: Synthetic oligonucleotide
  Target: SCN10A; (+) strand; PAM type: NRG; PAM sequence: AAG
tatcagtttacaccactata

SEQ ID NO: 34600 - DNA, 20 bp, Artificial Sequence
  Description of Artificial Sequence: Synthetic oligonucleotide
  Target: SCN10A; (+) strand; PAM type: NRG; PAM sequence: TAG
cagtttacaccactataaag

SEQ ID NO: 34601 - DNA, 20 bp, Artificial Sequence
  Description of Artificial Sequence: Synthetic oligonucleotide
  Target: SCN10A; (+) strand; PAM type: NRG; PAM sequence: CAG
tataaagtagcatcaccccc

SEQ ID NO: 34602 - DNA, 20 bp, Artificial Sequence
  Description of Artificial Sequence: Synthetic oligonucleotide
  Target: SCN10A; (+) strand; PAM type: NRG; PAM sequence: TAG
ttgttaatgcactgctcttc

SEQ ID NO: 34603 - DNA, 20 bp, Artificial Sequence
  Description of Artificial Sequence: Synthetic oligonucleotide
  Target: SCN10A; (+) strand; PAM type: NRG; PAM sequence: AGG
tgttaatgcactgctcttct

SEQ ID NO: 34604 - DNA, 20 bp, Artificial Sequence
  Description of Artificial Sequence: Synthetic oligonucleotide
  Target: SCN10A; (+) strand; PAM type: NRG; PAM sequence: TGG
tgcactgctcttctaggtaa

SEQ ID NO: 34605 - DNA, 20 bp, Artificial Sequence
  Description of Artificial Sequence: Synthetic oligonucleotide
  Target: SCN10A; (+) strand; PAM type: NRG; PAM sequence: GAG
cactgctcttctaggtaatg

SEQ ID NO: 34606 - DNA, 20 bp, Artificial Sequence
  Description of Artificial Sequence: Synthetic oligonucleotide
  Target: SCN10A; (+) strand; PAM type: NRG; PAM sequence: CAG
tcttctaggtaatggagatc

SEQ ID NO: 34607 - DNA, 20 bp, Artificial Sequence
  Description of Artificial Sequence: Synthetic oligonucleotide
  Target: SCN10A; (+) strand; PAM type: NRG; PAM sequence: GAG
ggtaatggagatccagctgt

SEQ ID NO: 34608 - DNA, 20 bp, Artificial Sequence
  Description of Artificial Sequence: Synthetic oligonucleotide
  Target: SCN10A; (+) strand; PAM type: NRG; PAM sequence: CAG
agatccagctgtgagcaaaa

SEQ ID NO: 34609 - DNA, 20 bp, Artificial Sequence
  Description of Artificial Sequence: Synthetic oligonucleotide
  Target: SCN10A; (+) strand; PAM type: NRG; PAM sequence: TGG
cagatacatctctgcatatc

SEQ ID NO: 34610 - DNA, 20 bp, Artificial Sequence
  Description of Artificial Sequence: Synthetic oligonucleotide
  Target: SCN10A; (+) strand; PAM type: NRG; PAM sequence: TGG
ctgcatatctggtaaattac

SEQ ID NO: 34611 - DNA, 20 bp, Artificial Sequence
  Description of Artificial Sequence: Synthetic oligonucleotide
  Target: SCN10A; (+) strand; PAM type: NRG; PAM sequence: TAG
atatctggtaaattactggc

SEQ ID NO: 34612 - DNA, 20 bp, Artificial Sequence
  Description of Artificial Sequence: Synthetic oligonucleotide
  Target: SCN10A; (+) strand; PAM type: NRG; PAM sequence: CAG
tactggctagttctactcta

SEQ ID NO: 34613 - DNA, 20 bp, Artificial Sequence
  Description of Artificial Sequence: Synthetic oligonucleotide
  Target: SCN10A; (+) strand; PAM type: NRG; PAM sequence: AAG
gtgcatgtgaatctctctct

SEQ ID NO: 34614 - DNA, 20 bp, Artificial Sequence
  Description of Artificial Sequence: Synthetic oligonucleotide
  Target: SCN10A; (+) strand; PAM type: NRG; PAM sequence: AGG
tgcatgtgaatctctctcta

SEQ ID NO: 34615 - DNA, 20 bp, Artificial Sequence
  Description of Artificial Sequence: Synthetic oligonucleotide
  Target: SCN10A; (+) strand; PAM type: NRG; PAM sequence: TGG
tctctaaggcttgccacctc

SEQ ID NO: 34616 - DNA, 20 bp, Artificial Sequence
  Description of Artificial Sequence: Synthetic oligonucleotide
  Target: SCN10A; (+) strand; PAM type: NRG; PAM sequence: TAG
ttgccacctctggctttacc

SEQ ID NO: 34617 - DNA, 20 bp, Artificial Sequence
  Description of Artificial Sequence: Synthetic oligonucleotide
  Target: SCN10A; (+) strand; PAM type: NRG; PAM sequence: AAG
cacctctggctttacctaga

SEQ ID NO: 34618 - DNA, 20 bp, Artificial Sequence
  Description of Artificial Sequence: Synthetic oligonucleotide
  Target: SCN10A; (+) strand; PAM type: NRG; PAM sequence: TAG
ctctggctttacctagaaag

SEQ ID NO: 34619 - DNA, 20 bp, Artificial Sequence
  Description of Artificial Sequence: Synthetic oligonucleotide
  Target: SCN10A; (+) strand; PAM type: NRG; PAM sequence: AGG
tctggctttacctagaaagt

SEQ ID NO: 34620 - DNA, 20 bp, Artificial Sequence
  Description of Artificial Sequence: Synthetic oligonucleotide
  Target: SCN10A; (+) strand; PAM type: NRG; PAM sequence: GGG
ctggctttacctagaaagta

SEQ ID NO: 34621 - DNA, 20 bp, Artificial Sequence
  Description of Artificial Sequence: Synthetic oligonucleotide
  Target: SCN10A; (+) strand; PAM type: NRG; PAM sequence: TGG
ctagaaagtagggcacacat

SEQ ID NO: 34622 - DNA, 20 bp, Artificial Sequence
  Description of Artificial Sequence: Synthetic oligonucleotide
  Target: SCN10A; (+) strand; PAM type: NRG; PAM sequence: TGG
aaatccctcaaacatttttt

SEQ ID NO: 34623 - DNA, 20 bp, Artificial Sequence
  Description of Artificial Sequence: Synthetic oligonucleotide
  Target: SCN10A; (+) strand; PAM type: NRG; PAM sequence: TAG
accacttcttcccctcaaat

SEQ ID NO: 34624 - DNA, 20 bp, Artificial Sequence
  Description of Artificial Sequence: Synthetic oligonucleotide
  Target: SCN10A; (+) strand; PAM type: NRG; PAM sequence: AGG
ccacttcttcccctcaaatt

SEQ ID NO: 34625 - DNA, 20 bp, Artificial Sequence
  Description of Artificial Sequence: Synthetic oligonucleotide
  Target: SCN10A; (+) strand; PAM type: NRG; PAM sequence: CAG
cttcccctcaaattaggatt

SEQ ID NO: 34626 - DNA, 20 bp, Artificial Sequence
  Description of Artificial Sequence: Synthetic oligonucleotide
  Target: SCN10A; (+) strand; PAM type: NRG; PAM sequence: TAG
cctcaaattaggattcagcc

SEQ ID NO: 34627 - DNA, 20 bp, Artificial Sequence
  Description of Artificial Sequence: Synthetic oligonucleotide
  Target: SCN10A; (+) strand; PAM type: NRG; PAM sequence: AGG
ctcaaattaggattcagcct

SEQ ID NO: 34628 - DNA, 20 bp, Artificial Sequence
  Description of Artificial Sequence: Synthetic oligonucleotide
  Target: SCN10A; (+) strand; PAM type: NRG; PAM sequence: GGG
tcaaattaggattcagccta

SEQ ID NO: 34629 - DNA, 20 bp, Artificial Sequence
  Description of Artificial Sequence: Synthetic oligonucleotide
  Target: SCN10A; (+) strand; PAM type: NRG; PAM sequence: TGG
attaggattcagcctagggc

SEQ ID NO: 34630 - DNA, 20 bp, Artificial Sequence
  Description of Artificial Sequence: Synthetic oligonucleotide
  Target: SCN10A; (+) strand; PAM type: NRG; PAM sequence: GGG
ttaggattcagcctagggct

SEQ ID NO: 34631 - DNA, 20 bp, Artificial Sequence
  Description of Artificial Sequence: Synthetic oligonucleotide
  Target: SCN10A; (+) strand; PAM type: NRG; PAM sequence: GAG
aggattcagcctagggctgg

SEQ ID NO: 34632 - DNA, 20 bp, Artificial Sequence
  Description of Artificial Sequence: Synthetic oligonucleotide
  Target: SCN10A; (+) strand; PAM type: NRG; PAM sequence: AGG
ggattcagcctagggctggg

SEQ ID NO: 34633 - DNA, 20 bp, Artificial Sequence
  Description of Artificial Sequence: Synthetic oligonucleotide
  Target: SCN10A; (+) strand; PAM type: NRG; PAM sequence: CAG
agggctgggaggaaaacaca

SEQ ID NO: 34634 - DNA, 20 bp, Artificial Sequence
  Description of Artificial Sequence: Synthetic oligonucleotide
  Target: SCN10A; (+) strand; PAM type: NRG; PAM sequence: AGG
gggctgggaggaaaacacac

SEQ ID NO: 34635 - DNA, 20 bp, Artificial Sequence
  Description of Artificial Sequence: Synthetic oligonucleotide
  Target: SCN10A; (+) strand; PAM type: NRG; PAM sequence: CAG
aaacacacaggactccttct

SEQ ID NO: 34636 - DNA, 20 bp, Artificial Sequence
  Description of Artificial Sequence: Synthetic oligonucleotide
  Target: SCN10A; (+) strand; PAM type: NRG; PAM sequence: AGG
aacacacaggactccttctc

SEQ ID NO: 34637 - DNA, 20 bp, Artificial Sequence
  Description of Artificial Sequence: Synthetic oligonucleotide
  Target: SCN10A; (+) strand; PAM type: NRG; PAM sequence: GGG
acacacaggactccttctca

SEQ ID NO: 34638 - DNA, 20 bp, Artificial Sequence
  Description of Artificial Sequence: Synthetic oligonucleotide
  Target: SCN10A; (+) strand; PAM type: NRG; PAM sequence: GGG
cacacaggactccttctcag

SEQ ID NO: 34639 - DNA, 20 bp, Artificial Sequence
  Description of Artificial Sequence: Synthetic oligonucleotide
  Target: SCN10A; (+) strand; PAM type: NRG; PAM sequence: CAG
actccttctcaggggcacac

SEQ ID NO: 34640 - DNA, 20 bp, Artificial Sequence
  Description of Artificial Sequence: Synthetic oligonucleotide
  Target: SCN10A; (+) strand; PAM type: NRG; PAM sequence: AAG
tcaggggcacaccagcactc

SEQ ID NO: 34641 - DNA, 20 bp, Artificial Sequence
  Description of Artificial Sequence: Synthetic oligonucleotide
  Target: SCN10A; (+) strand; PAM type: NRG; PAM sequence: CAG
aagctcccttacaactcctc

SEQ ID NO: 34642 - DNA, 20 bp, Artificial Sequence
  Description of Artificial Sequence: Synthetic oligonucleotide
  Target: SCN10A; (+) strand; PAM type: NRG; PAM sequence: TAG
cccttacaactcctccagcc

SEQ ID NO: 34643 - DNA, 20 bp, Artificial Sequence
  Description of Artificial Sequence: Synthetic oligonucleotide
  Target: SCN10A; (+) strand; PAM type: NRG; PAM sequence: AGG
ccttacaactcctccagcct

SEQ ID NO: 34644 - DNA, 20 bp, Artificial Sequence
  Description of Artificial Sequence: Synthetic oligonucleotide
  Target: SCN10A; (+) strand; PAM type: NRG; PAM sequence: CAG
acaactcctccagcctaggt

SEQ ID NO: 34645 - DNA, 20 bp, Artificial Sequence
  Description of Artificial Sequence: Synthetic oligonucleotide
  Target: SCN10A; (+) strand; PAM type: NRG; PAM sequence: TAG
ctaggtcagtttaatttgtc

SEQ ID NO: 34646 - DNA, 20 bp, Artificial Sequence
  Description of Artificial Sequence: Synthetic oligonucleotide
  Target: SCN10A; (+) strand; PAM type: NRG; PAM sequence: AGG
taggtcagtttaatttgtct

SEQ ID NO: 34647 - DNA, 20 bp, Artificial Sequence
  Description of Artificial Sequence: Synthetic oligonucleotide
  Target: SCN10A; (+) strand; PAM type: NRG; PAM sequence: GGG
aggtcagtttaatttgtcta

SEQ ID NO: 34648 - DNA, 20 bp, Artificial Sequence
  Description of Artificial Sequence: Synthetic oligonucleotide
  Target: SCN10A; (+) strand; PAM type: NRG; PAM sequence: GGG
ggtcagtttaatttgtctag

SEQ ID NO: 34649 - DNA, 20 bp, Artificial Sequence
  Description of Artificial Sequence: Synthetic oligonucleotide
  Target: SCN10A; (+) strand; PAM type: NRG; PAM sequence: GAG
tcagtttaatttgtctaggg

SEQ ID NO: 34650 - DNA, 20 bp, Artificial Sequence
  Description of Artificial Sequence: Synthetic oligonucleotide
  Target: SCN10A; (+) strand; PAM type: NRG; PAM sequence: AAG
tttaatttgtctaggggagt

SEQ ID NO: 34651 - DNA, 20 bp, Artificial Sequence
  Description of Artificial Sequence: Synthetic oligonucleotide
  Target: SCN10A; (+) strand; PAM type: NRG; PAM sequence: TGG
gtctaggggagtaagataac

SEQ ID NO: 34652 - DNA, 20 bp, Artificial Sequence
  Description of Artificial Sequence: Synthetic oligonucleotide
  Target: SCN10A; (+) strand; PAM type: NRG; PAM sequence: AAG
taagataactggaaatgatg

SEQ ID NO: 34653 - DNA, 20 bp, Artificial Sequence
  Description of Artificial Sequence: Synthetic oligonucleotide
  Target: SCN10A; (+) strand; PAM type: NRG; PAM sequence: AGG
aagataactggaaatgatga

SEQ ID NO: 34654 - DNA, 20 bp, Artificial Sequence
  Description of Artificial Sequence: Synthetic oligonucleotide
  Target: SCN10A; (+) strand; PAM type: NRG; PAM sequence: AAG
ggttgcattctccataccct

SEQ ID NO: 34655 - DNA, 20 bp, Artificial Sequence
  Description of Artificial Sequence: Synthetic oligonucleotide
  Target: SCN10A; (+) strand; PAM type: NRG; PAM sequence: AGG
gttgcattctccatacccta

SEQ ID NO: 34656 - DNA, 20 bp, Artificial Sequence
  Description of Artificial Sequence: Synthetic oligonucleotide
  Target: SCN10A; (+) strand; PAM type: NRG; PAM sequence: AAG
tccataccctaaggcaaaaa

SEQ ID NO: 34657 - DNA, 20 bp, Artificial Sequence
  Description of Artificial Sequence: Synthetic oligonucleotide
  Target: SCN10A; (+) strand; PAM type: NRG; PAM sequence: AGG
ccataccctaaggcaaaaaa

SEQ ID NO: 34658 - DNA, 20 bp, Artificial Sequence
  Description of Artificial Sequence: Synthetic oligonucleotide
  Target: SCN10A; (+) strand; PAM type: NRG; PAM sequence: TGG
accctaaggcaaaaaaaggc

SEQ ID NO: 34659 - DNA, 20 bp, Artificial Sequence
  Description of Artificial Sequence: Synthetic oligonucleotide
  Target: SCN10A; (+) strand; PAM type: NRG; PAM sequence: TAG
aaggcaaaaaaaggctggat

SEQ ID NO: 34660 - DNA, 20 bp, Artificial Sequence
  Description of Artificial Sequence: Synthetic oligonucleotide
  Target: SCN10A; (+) strand; PAM type: NRG; PAM sequence: CAG
aaaaaaaggctggattagaa

SEQ ID NO: 34661 - DNA, 20 bp, Artificial Sequence
  Description of Artificial Sequence: Synthetic oligonucleotide
  Target: SCN10A; (+) strand; PAM type: NRG; PAM sequence: AAG
ttagaacagacctcctgctc

SEQ ID NO: 34662 - DNA, 20 bp, Artificial Sequence
  Description of Artificial Sequence: Synthetic oligonucleotide
  Target: SCN10A; (+) strand; PAM type: NRG; PAM sequence: AGG
tagaacagacctcctgctca

SEQ ID NO: 34663 - DNA, 20 bp, Artificial Sequence
  Description of Artificial Sequence: Synthetic oligonucleotide
  Target: SCN10A; (+) strand; PAM type: NRG; PAM sequence: TAG
acagacctcctgctcaaggt

SEQ ID NO: 34664 - DNA, 20 bp, Artificial Sequence
  Description of Artificial Sequence: Synthetic oligonucleotide
  Target: SCN10A; (+) strand; PAM type: NRG; PAM sequence: GAG
agacctcctgctcaaggtta

SEQ ID NO: 34665 - DNA, 20 bp, Artificial Sequence
  Description of Artificial Sequence: Synthetic oligonucleotide
  Target: SCN10A; (+) strand; PAM type: NRG; PAM sequence: AGG
gacctcctgctcaaggttag

SEQ ID NO: 34666 - DNA, 20 bp, Artificial Sequence
  Description of Artificial Sequence: Synthetic oligonucleotide
  Target: SCN10A; (+) strand; PAM type: NRG; PAM sequence: GGG
acctcctgctcaaggttaga

SEQ ID NO: 34667 - DNA, 20 bp, Artificial Sequence
  Description of Artificial Sequence: Synthetic oligonucleotide
  Target: SCN10A; (+) strand; PAM type: NRG; PAM sequence: TGG
agggatgcaatcacgctcta

SEQ ID NO: 34668 - DNA, 20 bp, Artificial Sequence
  Description of Artificial Sequence: Synthetic oligonucleotide
  Target: SCN10A; (+) strand; PAM type: NRG; PAM sequence: AAG
tgcaatcacgctctatggca

SEQ ID NO: 34669 - DNA, 20 bp, Artificial Sequence
  Description of Artificial Sequence: Synthetic oligonucleotide
  Target: SCN10A; (+) strand; PAM type: NRG; PAM sequence: TGG
acgctctatggcaaagtgtg

SEQ ID NO: 34670 - DNA, 20 bp, Artificial Sequence
  Description of Artificial Sequence: Synthetic oligonucleotide
  Target: SCN10A; (+) strand; PAM type: NRG; PAM sequence: TAG
tctatggcaaagtgtgtgga

SEQ ID NO: 34671 - DNA, 20 bp, Artificial Sequence
  Description of Artificial Sequence: Synthetic oligonucleotide
  Target: SCN10A; (+) strand; PAM type: NRG; PAM sequence: AGG
ctatggcaaagtgtgtggat

SEQ ID NO: 34672 - DNA, 20 bp, Artificial Sequence
  Description of Artificial Sequence: Synthetic oligonucleotide
  Target: SCN10A; (+) strand; PAM type: NRG; PAM sequence: TGG
tggcaaagtgtgtggatagg

SEQ ID NO: 34673 - DNA, 20 bp, Artificial Sequence
  Description of Artificial Sequence: Synthetic oligonucleotide
  Target: SCN10A; (+) strand; PAM type: NRG; PAM sequence: TGG
cactctcttcctctaccctt

SEQ ID NO: 34674 - DNA, 20 bp, Artificial Sequence
  Description of Artificial Sequence: Synthetic oligonucleotide
  Target: SCN10A; (+) strand; PAM type: NRG; PAM sequence: TGG
tcttcctctaccctttggct

SEQ ID NO: 34675 - DNA, 20 bp, Artificial Sequence
  Description of Artificial Sequence: Synthetic oligonucleotide
  Target: SCN10A; (+) strand; PAM type: NRG; PAM sequence: TAG
ctaccctttggcttggaact

SEQ ID NO: 34676 - DNA, 20 bp, Artificial Sequence
  Description of Artificial Sequence: Synthetic oligonucleotide
  Target: SCN10A; (+) strand; PAM type: NRG; PAM sequence: TGG
ttggaacttagatacattgc

SEQ ID NO: 34677 - DNA, 20 bp, Artificial Sequence
  Description of Artificial Sequence: Synthetic oligonucleotide
  Target: SCN10A; (+) strand; PAM type: NRG; PAM sequence: GGG
tggaacttagatacattgct

SEQ ID NO: 34678 - DNA, 20 bp, Artificial Sequence
  Description of Artificial Sequence: Synthetic oligonucleotide
  Target: SCN10A; (+) strand; PAM type: NRG; PAM sequence: GGG
ggaacttagatacattgctg

SEQ ID NO: 34679 - DNA, 20 bp, Artificial Sequence
  Description of Artificial Sequence: Synthetic oligonucleotide
  Target: SCN10A; (+) strand; PAM type: NRG; PAM sequence: GAG
aacttagatacattgctggg

SEQ ID NO: 34680 - DNA, 20 bp, Artificial Sequence
  Description of Artificial Sequence: Synthetic oligonucleotide
  Target: SCN10A; (+) strand; PAM type: NRG; PAM sequence: GAG
gatacattgctggggagact

SEQ ID NO: 34681 - DNA, 20 bp, Artificial Sequence
  Description of Artificial Sequence: Synthetic oligonucleotide
  Target: SCN10A; (+) strand; PAM type: NRG; PAM sequence: TGG
acattgctggggagactgag

SEQ ID NO: 34682 - DNA, 20 bp, Artificial Sequence
  Description of Artificial Sequence: Synthetic oligonucleotide
  Target: SCN10A; (+) strand; PAM type: NRG; PAM sequence: TGG
tgagtggattcccacttgat

SEQ ID NO: 34683 - DNA, 20 bp, Artificial Sequence
  Description of Artificial Sequence: Synthetic oligonucleotide
  Target: SCN10A; (+) strand; PAM type: NRG; PAM sequence: TAG
gtggattcccacttgattgg

SEQ ID NO: 34684 - DNA, 20 bp, Artificial Sequence
  Description of Artificial Sequence: Synthetic oligonucleotide
  Target: SCN10A; (+) strand; PAM type: NRG; PAM sequence: AAG
tggtagaattctaaattaac

SEQ ID NO: 34685 - DNA, 20 bp, Artificial Sequence
  Description of Artificial Sequence: Synthetic oligonucleotide
  Target: SCN10A; (+) strand; PAM type: NRG; PAM sequence: AGG
ggtagaattctaaattaaca

SEQ ID NO: 34686 - DNA, 20 bp, Artificial Sequence
  Description of Artificial Sequence: Synthetic oligonucleotide
  Target: SCN10A; (+) strand; PAM type: NRG; PAM sequence: TAG
attctaaattaacaaggact

SEQ ID NO: 34687 - DNA, 20 bp, Artificial Sequence
  Description of Artificial Sequence: Synthetic oligonucleotide
  Target: SCN10A; (+) strand; PAM type: NRG; PAM sequence: TGG
tagttaaattgactgattaa

SEQ ID NO: 34688 - DNA, 20 bp, Artificial Sequence
  Description of Artificial Sequence: Synthetic oligonucleotide
  Target: SCN10A; (+) strand; PAM type: NRG; PAM sequence: CAG
ttaaattgtctaccaatatt

SEQ ID NO: 34689 - DNA, 20 bp, Artificial Sequence
  Description of Artificial Sequence: Synthetic oligonucleotide
  Target: SCN10A; (+) strand; PAM type: NRG; PAM sequence: TGG
taccaatattcagcataatg

SEQ ID NO: 34690 - DNA, 20 bp, Artificial Sequence
  Description of Artificial Sequence: Synthetic oligonucleotide
  Target: SCN10A; (+) strand; PAM type: NRG; PAM sequence: GGG
accaatattcagcataatgt

SEQ ID NO: 34691 - DNA, 20 bp, Artificial Sequence
  Description of Artificial Sequence: Synthetic oligonucleotide
  Target: SCN10A; (+) strand; PAM type: NRG; PAM sequence: AAG
agcataatgtgggcttgaac

SEQ ID NO: 34692 - DNA, 20 bp, Artificial Sequence
  Description of Artificial Sequence: Synthetic oligonucleotide
  Target: SCN10A; (+) strand; PAM type: NRG; PAM sequence: AAG
aaattaaattacaactgtgt

SEQ ID NO: 34693 - DNA, 20 bp, Artificial Sequence
  Description of Artificial Sequence: Synthetic oligonucleotide
  Target: SCN10A; (+) strand; PAM type: NRG; PAM sequence: AAG
tataattatgaaaccatgaa

SEQ ID NO: 34694 - DNA, 20 bp, Artificial Sequence
  Description of Artificial Sequence: Synthetic oligonucleotide
  Target: SCN10A; (+) strand; PAM type: NRG; PAM sequence: AGG
ataattatgaaaccatgaaa

SEQ ID NO: 34695 - DNA, 20 bp, Artificial Sequence
  Description of Artificial Sequence: Synthetic oligonucleotide
  Target: SCN10A; (+) strand; PAM type: NRG; PAM sequence: TGG
aaaggataattttgccatgt

SEQ ID NO: 34696 - DNA, 20 bp, Artificial Sequence
  Description of Artificial Sequence: Synthetic oligonucleotide
  Target: SCN10A; (+) strand; PAM type: NRG; PAM sequence: AAG
ttttgccatgttggaaaatt

SEQ ID NO: 34697 - DNA, 20 bp, Artificial Sequence
  Description of Artificial Sequence: Synthetic oligonucleotide
  Target: SCN10A; (+) strand; PAM type: NRG; PAM sequence: AGG
tttgccatgttggaaaatta

SEQ ID NO: 34698 - DNA, 20 bp, Artificial Sequence
  Description of Artificial Sequence: Synthetic oligonucleotide
  Target: SCN10A; (+) strand; PAM type: NRG; PAM sequence: TGG
ccatgttggaaaattaagga

SEQ ID NO: 34699 - DNA, 20 bp, Artificial Sequence
  Description of Artificial Sequence: Synthetic oligonucleotide
  Target: SCN10A; (+) strand; PAM type: NRG; PAM sequence: CGG
tggttaaatttcttgtacac

SEQ ID NO: 34700 - DNA, 20 bp, Artificial Sequence
  Description of Artificial Sequence: Synthetic oligonucleotide
  Target: SCN10A; (+) strand; PAM type: NRG; PAM sequence: GAG
gttaaatttcttgtacaccg

SEQ ID NO: 34701 - DNA, 20 bp, Artificial Sequence
  Description of Artificial Sequence: Synthetic oligonucleotide
  Target: SCN10A; (+) strand; PAM type: NRG; PAM sequence: GAG
taaatttcttgtacaccgga

SEQ ID NO: 34702 - DNA, 20 bp, Artificial Sequence
  Description of Artificial Sequence: Synthetic oligonucleotide
  Target: SCN10A; (+) strand; PAM type: NRG; PAM sequence: TGG
tttcttgtacaccggagagc

SEQ ID NO: 34703 - DNA, 20 bp, Artificial Sequence
  Description of Artificial Sequence: Synthetic oligonucleotide
  Target: SCN10A; (+) strand; PAM type: NRG; PAM sequence: CAG
tgaaattctctgatgcctgc

SEQ ID NO: 34704 - DNA, 20 bp, Artificial Sequence
  Description of Artificial Sequence: Synthetic oligonucleotide
  Target: SCN10A; (+) strand; PAM type: NRG; PAM sequence: TAG
ccagatcacttttaaaaatc

SEQ ID NO: 34705 - DNA, 20 bp, Artificial Sequence
  Description of Artificial Sequence: Synthetic oligonucleotide
  Target: SCN10A; (+) strand; PAM type: NRG; PAM sequence: AAG
ctagttttgtgatgcatgca

SEQ ID NO: 34706 - DNA, 20 bp, Artificial Sequence
  Description of Artificial Sequence: Synthetic oligonucleotide
  Target: SCN10A; (+) strand; PAM type: NRG; PAM sequence: CAG
gttttgtgatgcatgcaaag

SEQ ID NO: 34707 - DNA, 20 bp, Artificial Sequence
  Description of Artificial Sequence: Synthetic oligonucleotide
  Target: SCN10A; (+) strand; PAM type: NRG; PAM sequence: AAG
aagcagatgctaatttgaac

SEQ ID NO: 34708 - DNA, 20 bp, Artificial Sequence
  Description of Artificial Sequence: Synthetic oligonucleotide
  Target: SCN10A; (+) strand; PAM type: NRG; PAM sequence: GAG
gcagatgctaatttgaacaa

SEQ ID NO: 34709 - DNA, 20 bp, Artificial Sequence
  Description of Artificial Sequence: Synthetic oligonucleotide
  Target: SCN10A; (+) strand; PAM type: NRG; PAM sequence: GAG
tgctaatttgaacaagagat

SEQ ID NO: 34710 - DNA, 20 bp, Artificial Sequence
  Description of Artificial Sequence: Synthetic oligonucleotide
  Target: SCN10A; (+) strand; PAM type: NRG; PAM sequence: TAG
aatttgaacaagagatgagc

SEQ ID NO: 34711 - DNA, 20 bp, Artificial Sequence
  Description of Artificial Sequence: Synthetic oligonucleotide
  Target: SCN10A; (+) strand; PAM type: NRG; PAM sequence: AGG
atttgaacaagagatgagct

SEQ ID NO: 34712 - DNA, 20 bp, Artificial Sequence
  Description of Artificial Sequence: Synthetic oligonucleotide
  Target: SCN10A; (+) strand; PAM type: NRG; PAM sequence: AAG
ctaaaaaaccacattgataa

SEQ ID NO: 34713 - DNA, 20 bp, Artificial Sequence
  Description of Artificial Sequence: Synthetic oligonucleotide
  Target: SCN10A; (+) strand; PAM type: NRG; PAM sequence: TGG
aaaaccacattgataaaaga

SEQ ID NO: 34714 - DNA, 20 bp, Artificial Sequence
  Description of Artificial Sequence: Synthetic oligonucleotide
  Target: SCN10A; (+) strand; PAM type: NRG; PAM sequence: TGG
accacattgataaaagatgg

SEQ ID NO: 34715 - DNA, 20 bp, Artificial Sequence
  Description of Artificial Sequence: Synthetic oligonucleotide
  Target: SCN10A; (+) strand; PAM type: NRG; PAM sequence: GGG
ccacattgataaaagatggt

SEQ ID NO: 34716 - DNA, 20 bp, Artificial Sequence
  Description of Artificial Sequence: Synthetic oligonucleotide
  Target: SCN10A; (+) strand; PAM type: NRG; PAM sequence: GGG
cacattgataaaagatggtg

SEQ ID NO: 34717 - DNA, 20 bp, Artificial Sequence
  Description of Artificial Sequence: Synthetic oligonucleotide
  Target: SCN10A; (+) strand; PAM type: NRG; PAM sequence: AAG
gataaaagatggtggggcct

SEQ ID NO: 34718 - DNA, 20 bp, Artificial Sequence
  Description of Artificial Sequence: Synthetic oligonucleotide
  Target: SCN10A; (+) strand; PAM type: NRG; PAM sequence: AAG
gatggtggggcctaagacat

SEQ ID NO: 34719 - DNA, 20 bp, Artificial Sequence
  Description of Artificial Sequence: Synthetic oligonucleotide
  Target: SCN10A; (+) strand; PAM type: NRG; PAM sequence: GAG
ggggcctaagacataagaat

SEQ ID NO: 34720 - DNA, 20 bp, Artificial Sequence
  Description of Artificial Sequence: Synthetic oligonucleotide
  Target: SCN10A; (+) strand; PAM type: NRG; PAM sequence: AGG
gggcctaagacataagaatg

SEQ ID NO: 34721 - DNA, 20 bp, Artificial Sequence
  Description of Artificial Sequence: Synthetic oligonucleotide
  Target: SCN10A; (+) strand; PAM type: NRG; PAM sequence: GAG
gcctaagacataagaatgag

SEQ ID NO: 34722 - DNA, 20 bp, Artificial Sequence
  Description of Artificial Sequence: Synthetic oligonucleotide
  Target: SCN10A; (+) strand; PAM type: NRG; PAM sequence: TAG
gacataagaatgaggagtat

SEQ ID NO: 34723 - DNA, 20 bp, Artificial Sequence
  Description of Artificial Sequence: Synthetic oligonucleotide
  Target: SCN10A; (+) strand; PAM type: NRG; PAM sequence: AGG
acataagaatgaggagtatt

SEQ ID NO: 34724 - DNA, 20 bp, Artificial Sequence
  Description of Artificial Sequence: Synthetic oligonucleotide
  Target: SCN10A; (+) strand; PAM type: NRG; PAM sequence: CAG
atgaggagtattaggaattc

SEQ ID NO: 34725 - DNA, 20 bp, Artificial Sequence
  Description of Artificial Sequence: Synthetic oligonucleotide
  Target: SCN10A; (+) strand; PAM type: NRG; PAM sequence: CAG
gtattaggaattccagtaca

SEQ ID NO: 34726 - DNA, 20 bp, Artificial Sequence
  Description of Artificial Sequence: Synthetic oligonucleotide
  Target: SCN10A; (+) strand; PAM type: NRG; PAM sequence: GAG
attaggaattccagtacaca

SEQ ID NO: 34727 - DNA, 20 bp, Artificial Sequence
  Description of Artificial Sequence: Synthetic oligonucleotide
  Target: SCN10A; (+) strand; PAM type: NRG; PAM sequence: TGG
ggaattccagtacacagaga

SEQ ID NO: 34728 - DNA, 20 bp, Artificial Sequence
  Description of Artificial Sequence: Synthetic oligonucleotide
  Target: SCN10A; (+) strand; PAM type: NRG; PAM sequence: GAG
agagatggacgctttgacac

SEQ ID NO: 34729 - DNA, 20 bp, Artificial Sequence
  Description of Artificial Sequence: Synthetic oligonucleotide
  Target: SCN10A; (+) strand; PAM type: NRG; PAM sequence: TAG
atggacgctttgacacgagt

SEQ ID NO: 34730 - DNA, 20 bp, Artificial Sequence
  Description of Artificial Sequence: Synthetic oligonucleotide
  Target: SCN10A; (+) strand; PAM type: NRG; PAM sequence: GAG
ggacgctttgacacgagtta

SEQ ID NO: 34731 - DNA, 20 bp, Artificial Sequence
  Description of Artificial Sequence: Synthetic oligonucleotide
  Target: SCN10A; (+) strand; PAM type: NRG; PAM sequence: TGG
cattgcttctgctgctcaca

SEQ ID NO: 34732 - DNA, 20 bp, Artificial Sequence
  Description of Artificial Sequence: Synthetic oligonucleotide
  Target: SCN10A; (+) strand; PAM type: NRG; PAM sequence: GGG
attgcttctgctgctcacat

SEQ ID NO: 34733 - DNA, 20 bp, Artificial Sequence
  Description of Artificial Sequence: Synthetic oligonucleotide
  Target: SCN10A; (+) strand; PAM type: NRG; PAM sequence: CAG
catgggaattcatcatgaca

SEQ ID NO: 34734 - DNA, 20 bp, Artificial Sequence
  Description of Artificial Sequence: Synthetic oligonucleotide
  Target: SCN10A; (+) strand; PAM type: NRG; PAM sequence: TGG
gggaattcatcatgacacag

SEQ ID NO: 34735 - DNA, 20 bp, Artificial Sequence
  Description of Artificial Sequence: Synthetic oligonucleotide
  Target: SCN10A; (+) strand; PAM type: NRG; PAM sequence: CAG
gacacagtggatgaacaatg

SEQ ID NO: 34736 - DNA, 20 bp, Artificial Sequence
  Description of Artificial Sequence: Synthetic oligonucleotide
  Target: SCN10A; (+) strand; PAM type: NRG; PAM sequence: GAG
cagtggatgaacaatgcagt

SEQ ID NO: 34737 - DNA, 20 bp, Artificial Sequence
  Description of Artificial Sequence: Synthetic oligonucleotide
  Target: SCN10A; (+) strand; PAM type: NRG; PAM sequence: CAG
tggatgaacaatgcagtgag

SEQ ID NO: 34738 - DNA, 20 bp, Artificial Sequence
  Description of Artificial Sequence: Synthetic oligonucleotide
  Target: SCN10A; (+) strand; PAM type: NRG; PAM sequence: AAG
agtgagcagcacttaccctc

SEQ ID NO: 34739 - DNA, 20 bp, Artificial Sequence
  Description of Artificial Sequence: Synthetic oligonucleotide
  Target: SCN10A; (+) strand; PAM type: NRG; PAM sequence: AGG
gtgagcagcacttaccctca

SEQ ID NO: 34740 - DNA, 20 bp, Artificial Sequence
  Description of Artificial Sequence: Synthetic oligonucleotide
  Target: SCN10A; (+) strand; PAM type: NRG; PAM sequence: CGG
gcagcacttaccctcaagga

SEQ ID NO: 34741 - DNA, 20 bp, Artificial Sequence
  Description of Artificial Sequence: Synthetic oligonucleotide
  Target: SCN10A; (+) strand; PAM type: NRG; PAM sequence: GAG
agcacttaccctcaaggacg

SEQ ID NO: 34742 - DNA, 20 bp, Artificial Sequence
  Description of Artificial Sequence: Synthetic oligonucleotide
  Target: SCN10A; (+) strand; PAM type: NRG; PAM sequence: AGG
gcacttaccctcaaggacgg

SEQ ID NO: 34743 - DNA, 20 bp, Artificial Sequence
  Description of Artificial Sequence: Synthetic oligonucleotide
  Target: SCN10A; (+) strand; PAM type: NRG; PAM sequence: TGG
tgacaacactcattgccctt

SEQ ID NO: 34744 - DNA, 20 bp, Artificial Sequence
  Description of Artificial Sequence: Synthetic oligonucleotide
  Target: SCN10A; (+) strand; PAM type: NRG; PAM sequence: GGG
gacaacactcattgcccttt

SEQ ID NO: 34745 - DNA, 20 bp, Artificial Sequence
  Description of Artificial Sequence: Synthetic oligonucleotide
  Target: SCN10A; (+) strand; PAM type: NRG; PAM sequence: CGG
cactcattgccctttgggcc

SEQ ID NO: 34746 - DNA, 20 bp, Artificial Sequence
  Description of Artificial Sequence: Synthetic oligonucleotide
  Target: SCN10A; (+) strand; PAM type: NRG; PAM sequence: AAG
cattgccctttgggcccgga

SEQ ID NO: 34747 - DNA, 20 bp, Artificial Sequence
  Description of Artificial Sequence: Synthetic oligonucleotide
  Target: SCN10A; (+) strand; PAM type: NRG; PAM sequence: AGG
attgccctttgggcccggaa

SEQ ID NO: 34748 - DNA, 20 bp, Artificial Sequence
  Description of Artificial Sequence: Synthetic oligonucleotide
  Target: SCN10A; (+) strand; PAM type: NRG; PAM sequence: AAG
gggcccggaaaggttcatct

SEQ ID NO: 34749 - DNA, 20 bp, Artificial Sequence
  Description of Artificial Sequence: Synthetic oligonucleotide
  Target: SCN10A; (+) strand; PAM type: NRG; PAM sequence: AAG
catctaagtattctgctgac

SEQ ID NO: 34750 - DNA, 20 bp, Artificial Sequence
  Description of Artificial Sequence: Synthetic oligonucleotide
  Target: SCN10A; (+) strand; PAM type: NRG; PAM sequence: AAG
taagtattctgctgacaaga

SEQ ID NO: 34751 - DNA, 20 bp, Artificial Sequence
  Description of Artificial Sequence: Synthetic oligonucleotide
  Target: SCN10A; (+) strand; PAM type: NRG; PAM sequence: GAG
tcctgcatcgaatgcctgtt

SEQ ID NO: 34752 - DNA, 20 bp, Artificial Sequence
  Description of Artificial Sequence: Synthetic oligonucleotide
  Target: SCN10A; (+) strand; PAM type: NRG; PAM sequence: CAG
aatgcctgttgagacacaaa

SEQ ID NO: 34753 - DNA, 20 bp, Artificial Sequence
  Description of Artificial Sequence: Synthetic oligonucleotide
  Target: SCN10A; (+) strand; PAM type: NRG; PAM sequence: GAG
tgcctgttgagacacaaaca

SEQ ID NO: 34754 - DNA, 20 bp, Artificial Sequence
  Description of Artificial Sequence: Synthetic oligonucleotide
  Target: SCN10A; (+) strand; PAM type: NRG; PAM sequence: CAG
tgttgagacacaaacagagt

SEQ ID NO: 34755 - DNA, 20 bp, Artificial Sequence
  Description of Artificial Sequence: Synthetic oligonucleotide
  Target: SCN10A; (+) strand; PAM type: NRG; PAM sequence: AGG
gttgagacacaaacagagtc

SEQ ID NO: 34756 - DNA, 20 bp, Artificial Sequence
  Description of Artificial Sequence: Synthetic oligonucleotide
  Target: SCN10A; (+) strand; PAM type: NRG; PAM sequence: TGG
cctttaacctgacatcttca

SEQ ID NO: 34757 - DNA, 20 bp, Artificial Sequence
  Description of Artificial Sequence: Synthetic oligonucleotide
  Target: SCN10A; (+) strand; PAM type: NRG; PAM sequence: AAG
aacctgacatcttcatggca

SEQ ID NO: 34758 - DNA, 20 bp, Artificial Sequence
  Description of Artificial Sequence: Synthetic oligonucleotide
  Target: SCN10A; (+) strand; PAM type: NRG; PAM sequence: TGG
tgacatcttcatggcaaagt

SEQ ID NO: 34759 - DNA, 20 bp, Artificial Sequence
  Description of Artificial Sequence: Synthetic oligonucleotide
  Target: SCN10A; (+) strand; PAM type: NRG; PAM sequence: CAG
catggcaaagttggatcatt

SEQ ID NO: 34760 - DNA, 20 bp, Artificial Sequence
  Description of Artificial Sequence: Synthetic oligonucleotide
  Target: SCN10A; (+) strand; PAM type: NRG; PAM sequence: TGG
tggatcattcagcctcttat

SEQ ID NO: 34761 - DNA, 20 bp, Artificial Sequence
  Description of Artificial Sequence: Synthetic oligonucleotide
  Target: SCN10A; (+) strand; PAM type: NRG; PAM sequence: TAG
ttattggccaatctcatata

SEQ ID NO: 34762 - DNA, 20 bp, Artificial Sequence
  Description of Artificial Sequence: Synthetic oligonucleotide
  Target: SCN10A; (+) strand; PAM type: NRG; PAM sequence: CAG
atatagtcatatgtcactta

SEQ ID NO: 34763 - DNA, 20 bp, Artificial Sequence
  Description of Artificial Sequence: Synthetic oligonucleotide
  Target: SCN10A; (+) strand; PAM type: NRG; PAM sequence: TAG
agtcatatgtcacttacaga

SEQ ID NO: 34764 - DNA, 20 bp, Artificial Sequence
  Description of Artificial Sequence: Synthetic oligonucleotide
  Target: SCN10A; (+) strand; PAM type: NRG; PAM sequence: GAG
tcatatgtcacttacagata

SEQ ID NO: 34765 - DNA, 20 bp, Artificial Sequence
  Description of Artificial Sequence: Synthetic oligonucleotide
  Target: SCN10A; (+) strand; PAM type: NRG; PAM sequence: TAG
tgttctgacaaatacatcat

SEQ ID NO: 34766 - DNA, 20 bp, Artificial Sequence
  Description of Artificial Sequence: Synthetic oligonucleotide
  Target: SCN10A; (+) strand; PAM type: NRG; PAM sequence: AGG
gttctgacaaatacatcatt

SEQ ID NO: 34767 - DNA, 20 bp, Artificial Sequence
  Description of Artificial Sequence: Synthetic oligonucleotide
  Target: SCN10A; (+) strand; PAM type: NRG; PAM sequence: TAG
atttacacaaacaaatgcta

SEQ ID NO: 34768 - DNA, 20 bp, Artificial Sequence
  Description of Artificial Sequence: Synthetic oligonucleotide
  Target: SCN10A; (+) strand; PAM type: NRG; PAM sequence: TAG
gctatagccttctatacatc

SEQ ID NO: 34769 - DNA, 20 bp, Artificial Sequence
  Description of Artificial Sequence: Synthetic oligonucleotide
  Target: SCN10A; (+) strand; PAM type: NRG; PAM sequence: AGG
ctatagccttctatacatct

SEQ ID NO: 34770 - DNA, 20 bp, Artificial Sequence
  Description of Artificial Sequence: Synthetic oligonucleotide
  Target: SCN10A; (+) strand; PAM type: NRG; PAM sequence: TAG
ttctatacatctaggctaaa

SEQ ID NO: 34771 - DNA, 20 bp, Artificial Sequence
  Description of Artificial Sequence: Synthetic oligonucleotide
  Target: SCN10A; (+) strand; PAM type: NRG; PAM sequence: TGG
tacatctaggctaaatagtg

SEQ ID NO: 34772 - DNA, 20 bp, Artificial Sequence
  Description of Artificial Sequence: Synthetic oligonucleotide
  Target: SCN10A; (+) strand; PAM type: NRG; PAM sequence: TAG
atagtgtggcctattgctcc

SEQ ID NO: 34773 - DNA, 20 bp, Artificial Sequence
  Description of Artificial Sequence: Synthetic oligonucleotide
  Target: SCN10A; (+) strand; PAM type: NRG; PAM sequence: AGG
tagtgtggcctattgctcct

SEQ ID NO: 34774 - DNA, 20 bp, Artificial Sequence
  Description of Artificial Sequence: Synthetic oligonucleotide
  Target: SCN10A; (+) strand; PAM type: NRG; PAM sequence: CAG
tcctaggctacaaatctgta

SEQ ID NO: 34775 - DNA, 20 bp, Artificial Sequence
  Description of Artificial Sequence: Synthetic oligonucleotide
  Target: SCN10A; (+) strand; PAM type: NRG; PAM sequence: AAG
atgttattgctgaatactgt

SEQ ID NO: 34776 - DNA, 20 bp, Artificial Sequence
  Description of Artificial Sequence: Synthetic oligonucleotide
  Target: SCN10A; (+) strand; PAM type: NRG; PAM sequence: CAG
ctgaatactgtaagtataaa

SEQ ID NO: 34777 - DNA, 20 bp, Artificial Sequence
  Description of Artificial Sequence: Synthetic oligonucleotide
  Target: SCN10A; (+) strand; PAM type: NRG; PAM sequence: AAG
ataaacagttaataaacata

SEQ ID NO: 34778 - DNA, 20 bp, Artificial Sequence
  Description of Artificial Sequence: Synthetic oligonucleotide
  Target: SCN10A; (+) strand; PAM type: NRG; PAM sequence: AAG
acagttaataaacataaaga

SEQ ID NO: 34779 - DNA, 20 bp, Artificial Sequence
  Description of Artificial Sequence: Synthetic oligonucleotide
  Target: SCN10A; (+) strand; PAM type: NRG; PAM sequence: AAG
aaacataaagaaagtttata

SEQ ID NO: 34780 - DNA, 20 bp, Artificial Sequence
  Description of Artificial Sequence: Synthetic oligonucleotide
  Target: SCN10A; (+) strand; PAM type: NRG; PAM sequence: GAG
tttataaagcttccaaccat

SEQ ID NO: 34781 - DNA, 20 bp, Artificial Sequence
  Description of Artificial Sequence: Synthetic oligonucleotide
  Target: SCN10A; (+) strand; PAM type: NRG; PAM sequence: AGG
ttataaagcttccaaccatg

SEQ ID NO: 34782 - DNA, 20 bp, Artificial Sequence
  Description of Artificial Sequence: Synthetic oligonucleotide
  Target: SCN10A; (+) strand; PAM type: NRG; PAM sequence: AAG
agcttccaaccatgaggact

SEQ ID NO: 34783 - DNA, 20 bp, Artificial Sequence
  Description of Artificial Sequence: Synthetic oligonucleotide
  Target: SCN10A; (+) strand; PAM type: NRG; PAM sequence: TAG
gaggactaagcaaatgatac

SEQ ID NO: 34784 - DNA, 20 bp, Artificial Sequence
  Description of Artificial Sequence: Synthetic oligonucleotide
  Target: SCN10A; (+) strand; PAM type: NRG; PAM sequence: TAG
gactaagcaaatgatactag

SEQ ID NO: 34785 - DNA, 20 bp, Artificial Sequence
  Description of Artificial Sequence: Synthetic oligonucleotide
  Target: SCN10A; (+) strand; PAM type: NRG; PAM sequence: CAG
cactatttattgttatctgt

SEQ ID NO: 34786 - DNA, 20 bp, Artificial Sequence
  Description of Artificial Sequence: Synthetic oligonucleotide
  Target: SCN10A; (+) strand; PAM type: NRG; PAM sequence: TAG
gtcagacatgtataaaaatg

SEQ ID NO: 34787 - DNA, 20 bp, Artificial Sequence
  Description of Artificial Sequence: Synthetic oligonucleotide
  Target: SCN10A; (+) strand; PAM type: NRG; PAM sequence: AGG
tcagacatgtataaaaatgt

SEQ ID NO: 34788 - DNA, 20 bp, Artificial Sequence
  Description of Artificial Sequence: Synthetic oligonucleotide
  Target: SCN10A; (+) strand; PAM type: NRG; PAM sequence: CAG
tgttatttcatttaaccctc

SEQ ID NO: 34789 - DNA, 20 bp, Artificial Sequence
  Description of Artificial Sequence: Synthetic oligonucleotide
  Target: SCN10A; (+) strand; PAM type: NRG; PAM sequence: TAG
catttaaccctccagctatt

SEQ ID NO: 34790 - DNA, 20 bp, Artificial Sequence
  Description of Artificial Sequence: Synthetic oligonucleotide
  Target: SCN10A; (+) strand; PAM type: NRG; PAM sequence: AAG
ctatttagaaacctttttac

SEQ ID NO: 34791 - DNA, 20 bp, Artificial Sequence
  Description of Artificial Sequence: Synthetic oligonucleotide
  Target: SCN10A; (+) strand; PAM type: NRG; PAM sequence: AGG
tatttagaaacctttttaca

SEQ ID NO: 34792 - DNA, 20 bp, Artificial Sequence
  Description of Artificial Sequence: Synthetic oligonucleotide
  Target: SCN10A; (+) strand; PAM type: NRG; PAM sequence: GGG
atttagaaacctttttacaa

SEQ ID NO: 34793 - DNA, 20 bp, Artificial Sequence
  Description of Artificial Sequence: Synthetic oligonucleotide
  Target: SCN10A; (+) strand; PAM type: NRG; PAM sequence: GGG
tttagaaacctttttacaag

SEQ ID NO: 34794 - DNA, 20 bp, Artificial Sequence
  Description of Artificial Sequence: Synthetic oligonucleotide
  Target: SCN10A; (+) strand; PAM type: NRG; PAM sequence: GAG
tagaaacctttttacaaggg

SEQ ID NO: 34795 - DNA, 20 bp, Artificial Sequence
  Description of Artificial Sequence: Synthetic oligonucleotide
  Target: SCN10A; (+) strand; PAM type: NRG; PAM sequence: AAG
acctttttacaaggggagat

SEQ ID NO: 34796 - DNA, 20 bp, Artificial Sequence
  Description of Artificial Sequence: Synthetic oligonucleotide
  Target: SCN10A; (+) strand; PAM type: NRG; PAM sequence: AGG
cctttttacaaggggagata

SEQ ID NO: 34797 - DNA, 20 bp, Artificial Sequence
  Description of Artificial Sequence: Synthetic oligonucleotide
  Target: SCN10A; (+) strand; PAM type: NRG; PAM sequence: GAG
tttttacaaggggagataag

SEQ ID NO: 34798 - DNA, 20 bp, Artificial Sequence
  Description of Artificial Sequence: Synthetic oligonucleotide
  Target: SCN10A; (+) strand; PAM type: NRG; PAM sequence: AGG
ttttacaaggggagataagg

SEQ ID NO: 34799 - DNA, 20 bp, Artificial Sequence
  Description of Artificial Sequence: Synthetic oligonucleotide
  Target: SCN10A; (+) strand; PAM type: NRG; PAM sequence: TGG
caaggggagataaggaggct

SEQ ID NO: 34800 - DNA, 20 bp, Artificial Sequence
  Description of Artificial Sequence: Synthetic oligonucleotide
  Target: SCN10A; (+) strand; PAM type: NRG; PAM sequence: AAG
aaggaggcttggataattta

SEQ ID NO: 34801 - DNA, 20 bp, Artificial Sequence
  Description of Artificial Sequence: Synthetic oligonucleotide
  Target: SCN10A; (+) strand; PAM type: NRG; PAM sequence: AGG
aggaggcttggataatttaa

SEQ ID NO: 34802 - DNA, 20 bp, Artificial Sequence
  Description of Artificial Sequence: Synthetic oligonucleotide
  Target: SCN10A; (+) strand; PAM type: NRG; PAM sequence: CAG
aggacttgctaaatgtgact

SEQ ID NO: 34803 - DNA, 20 bp, Artificial Sequence
  Description of Artificial Sequence: Synthetic oligonucleotide
  Target: SCN10A; (+) strand; PAM type: NRG; PAM sequence: AGG
ggacttgctaaatgtgactc

SEQ ID NO: 34804 - DNA, 20 bp, Artificial Sequence
  Description of Artificial Sequence: Synthetic oligonucleotide
  Target: SCN10A; (+) strand; PAM type: NRG; PAM sequence: TGG
cttgctaaatgtgactcagg

SEQ ID NO: 34805 - DNA, 20 bp, Artificial Sequence
  Description of Artificial Sequence: Synthetic oligonucleotide
  Target: SCN10A; (+) strand; PAM type: NRG; PAM sequence: TGG
aatgtgactcaggtggtaac

SEQ ID NO: 34806 - DNA, 20 bp, Artificial Sequence
  Description of Artificial Sequence: Synthetic oligonucleotide
  Target: SCN10A; (+) strand; PAM type: NRG; PAM sequence: CAG
gactcaggtggtaactggca

SEQ ID NO: 34807 - DNA, 20 bp, Artificial Sequence
  Description of Artificial Sequence: Synthetic oligonucleotide
  Target: SCN10A; (+) strand; PAM type: NRG; PAM sequence: TGG
caggtggtaactggcacagt

SEQ ID NO: 34808 - DNA, 20 bp, Artificial Sequence
  Description of Artificial Sequence: Synthetic oligonucleotide
  Target: SCN10A; (+) strand; PAM type: NRG; PAM sequence: GGG
aggtggtaactggcacagtt

SEQ ID NO: 34809 - DNA, 20 bp, Artificial Sequence
  Description of Artificial Sequence: Synthetic oligonucleotide
  Target: SCN10A; (+) strand; PAM type: NRG; PAM sequence: TAG
gcacagttgggactaaaata

SEQ ID NO: 34810 - DNA, 20 bp, Artificial Sequence
  Description of Artificial Sequence: Synthetic oligonucleotide
  Target: SCN10A; (+) strand; PAM type: NRG; PAM sequence: AGG
cacagttgggactaaaatat

SEQ ID NO: 34811 - DNA, 20 bp, Artificial Sequence
  Description of Artificial Sequence: Synthetic oligonucleotide
  Target: SCN10A; (+) strand; PAM type: NRG; PAM sequence: CAG
aaatataggtccatactaaa

SEQ ID NO: 34812 - DNA, 20 bp, Artificial Sequence
  Description of Artificial Sequence: Synthetic oligonucleotide
  Target: SCN10A; (+) strand; PAM type: NRG; PAM sequence: AAG
tataggtccatactaaacag

SEQ ID NO: 34813 - DNA, 20 bp, Artificial Sequence
  Description of Artificial Sequence: Synthetic oligonucleotide
  Target: SCN10A; (+) strand; PAM type: NRG; PAM sequence: AGG
ataggtccatactaaacaga

SEQ ID NO: 34814 - DNA, 20 bp, Artificial Sequence
  Description of Artificial Sequence: Synthetic oligonucleotide
  Target: SCN10A; (+) strand; PAM type: NRG; PAM sequence: GGG
taggtccatactaaacagaa

SEQ ID NO: 34815 - DNA, 20 bp, Artificial Sequence
  Description of Artificial Sequence: Synthetic oligonucleotide
  Target: SCN10A; (+) strand; PAM type: NRG; PAM sequence: AAG
atactaaacagaagggccta

SEQ ID NO: 34816 - DNA, 20 bp, Artificial Sequence
  Description of Artificial Sequence: Synthetic oligonucleotide
  Target: SCN10A; (+) strand; PAM type: NRG; PAM sequence: GAG
actaaacagaagggcctaaa

SEQ ID NO: 34817 - DNA, 20 bp, Artificial Sequence
  Description of Artificial Sequence: Synthetic oligonucleotide
  Target: SCN10A; (+) strand; PAM type: NRG; PAM sequence: TAG
ctaaagagtcaatctttcac

SEQ ID NO: 34818 - DNA, 20 bp, Artificial Sequence
  Description of Artificial Sequence: Synthetic oligonucleotide
  Target: SCN10A; (+) strand; PAM type: NRG; PAM sequence: TGG
gagtcaatctttcactagcc

SEQ ID NO: 34819 - DNA, 20 bp, Artificial Sequence
  Description of Artificial Sequence: Synthetic oligonucleotide
  Target: SCN10A; (+) strand; PAM type: NRG; PAM sequence: TAG
cactagcctggtaatttaac

SEQ ID NO: 34820 - DNA, 20 bp, Artificial Sequence
  Description of Artificial Sequence: Synthetic oligonucleotide
  Target: SCN10A; (+) strand; PAM type: NRG; PAM sequence: AAG
taatttaactagaatgaatc

SEQ ID NO: 34821 - DNA, 20 bp, Artificial Sequence
  Description of Artificial Sequence: Synthetic oligonucleotide
  Target: SCN10A; (+) strand; PAM type: NRG; PAM sequence: AGG
aatttaactagaatgaatca

SEQ ID NO: 34822 - DNA, 20 bp, Artificial Sequence
  Description of Artificial Sequence: Synthetic oligonucleotide
  Target: SCN10A; (+) strand; PAM type: NRG; PAM sequence: CAG
taactagaatgaatcaaggt

SEQ ID NO: 34823 - DNA, 20 bp, Artificial Sequence
  Description of Artificial Sequence: Synthetic oligonucleotide
  Target: SCN10A; (+) strand; PAM type: NRG; PAM sequence: TAG
tgaatcaaggtcagaatatc

SEQ ID NO: 34824 - DNA, 20 bp, Artificial Sequence
  Description of Artificial Sequence: Synthetic oligonucleotide
  Target: SCN10A; (+) strand; PAM type: NRG; PAM sequence: CAG
atctagacacatgataatct

SEQ ID NO: 34825 - DNA, 20 bp, Artificial Sequence
  Description of Artificial Sequence: Synthetic oligonucleotide
  Target: SCN10A; (+) strand; PAM type: NRG; PAM sequence: AGG
tctagacacatgataatctc

SEQ ID NO: 34826 - DNA, 20 bp, Artificial Sequence
  Description of Artificial Sequence: Synthetic oligonucleotide
  Target: SCN10A; (+) strand; PAM type: NRG; PAM sequence: CAG
acacatgataatctcaggaa

SEQ ID NO: 34827 - DNA, 20 bp, Artificial Sequence
  Description of Artificial Sequence: Synthetic oligonucleotide
  Target: SCN10A; (+) strand; PAM type: NRG; PAM sequence: GAG
acatgataatctcaggaaca

SEQ ID NO: 34828 - DNA, 20 bp, Artificial Sequence
  Description of Artificial Sequence: Synthetic oligonucleotide
  Target: SCN10A; (+) strand; PAM type: NRG; PAM sequence: AAG
gataatctcaggaacagaga

SEQ ID NO: 34829 - DNA, 20 bp, Artificial Sequence
  Description of Artificial Sequence: Synthetic oligonucleotide
  Target: SCN10A; (+) strand; PAM type: NRG; PAM sequence: AGG
ataatctcaggaacagagaa

SEQ ID NO: 34830 - DNA, 20 bp, Artificial Sequence
  Description of Artificial Sequence: Synthetic oligonucleotide
  Target: SCN10A; (+) strand; PAM type: NRG; PAM sequence: GAG
aatctcaggaacagagaaag

SEQ ID NO: 34831 - DNA, 20 bp, Artificial Sequence
  Description of Artificial Sequence: Synthetic oligonucleotide
  Target: SCN10A; (+) strand; PAM type: NRG; PAM sequence: AGG
atctcaggaacagagaaagg

SEQ ID NO: 34832 - DNA, 20 bp, Artificial Sequence
  Description of Artificial Sequence: Synthetic oligonucleotide
  Target: SCN10A; (+) strand; PAM type: NRG; PAM sequence: GGG
tctcaggaacagagaaagga

SEQ ID NO: 34833 - DNA, 20 bp, Artificial Sequence
  Description of Artificial Sequence: Synthetic oligonucleotide
  Target: SCN10A; (+) strand; PAM type: NRG; PAM sequence: TGG
caggaacagagaaaggaggg

SEQ ID NO: 34834 - DNA, 20 bp, Artificial Sequence
  Description of Artificial Sequence: Synthetic oligonucleotide
  Target: SCN10A; (+) strand; PAM type: NRG; PAM sequence: GGG
aggaacagagaaaggagggt

SEQ ID NO: 34835 - DNA, 20 bp, Artificial Sequence
  Description of Artificial Sequence: Synthetic oligonucleotide
  Target: SCN10A; (+) strand; PAM type: NRG; PAM sequence: GGG
ggaacagagaaaggagggtg

SEQ ID NO: 34836 - DNA, 20 bp, Artificial Sequence
  Description of Artificial Sequence: Synthetic oligonucleotide
  Target: SCN10A; (+) strand; PAM type: NRG; PAM sequence: GGG
gaacagagaaaggagggtgg

SEQ ID NO: 34837 - DNA, 20 bp, Artificial Sequence
  Description of Artificial Sequence: Synthetic oligonucleotide
  Target: SCN10A; (+) strand; PAM type: NRG; PAM sequence: AAG
ggagggtgggggcccatcac

SEQ ID NO: 34838 - DNA, 20 bp, Artificial Sequence
  Description of Artificial Sequence: Synthetic oligonucleotide
  Target: SCN10A; (+) strand; PAM type: NRG; PAM sequence: GAG
agggtgggggcccatcacaa

SEQ ID NO: 34839 - DNA, 20 bp, Artificial Sequence
  Description of Artificial Sequence: Synthetic oligonucleotide
  Target: SCN10A; (+) strand; PAM type: NRG; PAM sequence: GAG
ggtgggggcccatcacaaga

SEQ ID NO: 34840 - DNA, 20 bp, Artificial Sequence
  Description of Artificial Sequence: Synthetic oligonucleotide
  Target: SCN10A; (+) strand; PAM type: NRG; PAM sequence: AGG
gtgggggcccatcacaagag

SEQ ID NO: 34841 - DNA, 20 bp, Artificial Sequence
  Description of Artificial Sequence: Synthetic oligonucleotide
  Target: SCN10A; (+) strand; PAM type: NRG; PAM sequence: CAG
aagagaggcataaatgcctt

SEQ ID NO: 34842 - DNA, 20 bp, Artificial Sequence
  Description of Artificial Sequence: Synthetic oligonucleotide
  Target: SCN10A; (+) strand; PAM type: NRG; PAM sequence: GAG
gaggcataaatgccttcagt

SEQ ID NO: 34843 - DNA, 20 bp, Artificial Sequence
  Description of Artificial Sequence: Synthetic oligonucleotide
  Target: SCN10A; (+) strand; PAM type: NRG; PAM sequence: AGG
aggcataaatgccttcagtg

SEQ ID NO: 34844 - DNA, 20 bp, Artificial Sequence
  Description of Artificial Sequence: Synthetic oligonucleotide
  Target: SCN10A; (+) strand; PAM type: NRG; PAM sequence: TAG
gccttcagtgaggcattttc

SEQ ID NO: 34845 - DNA, 20 bp, Artificial Sequence
  Description of Artificial Sequence: Synthetic oligonucleotide
  Target: SCN10A; (+) strand; PAM type: NRG; PAM sequence: GAG
cttcagtgaggcattttcta

SEQ ID NO: 34846 - DNA, 20 bp, Artificial Sequence
  Description of Artificial Sequence: Synthetic oligonucleotide
  Target: SCN10A; (+) strand; PAM type: NRG; PAM sequence: CAG
ctagagtgctaatgcactcc

SEQ ID NO: 34847 - DNA, 20 bp, Artificial Sequence
  Description of Artificial Sequence: Synthetic oligonucleotide
  Target: SCN10A; (+) strand; PAM type: NRG; PAM sequence: GAG
agtgctaatgcactcccagc

SEQ ID NO: 34848 - DNA, 20 bp, Artificial Sequence
  Description of Artificial Sequence: Synthetic oligonucleotide
  Target: SCN10A; (+) strand; PAM type: NRG; PAM sequence: CAG
tgcactcccagcgagccctg

SEQ ID NO: 34849 - DNA, 20 bp, Artificial Sequence
  Description of Artificial Sequence: Synthetic oligonucleotide
  Target: SCN10A; (+) strand; PAM type: NRG; PAM sequence: AGG
gcactcccagcgagccctgc

SEQ ID NO: 34850 - DNA, 20 bp, Artificial Sequence
  Description of Artificial Sequence: Synthetic oligonucleotide
  Target: SCN10A; (+) strand; PAM type: NRG; PAM sequence: AAG
tgcaggatgcctttgacttt

SEQ ID NO: 34851 - DNA, 20 bp, Artificial Sequence
  Description of Artificial Sequence: Synthetic oligonucleotide
  Target: SCN10A; (+) strand; PAM type: NRG; PAM sequence: AGG
gcaggatgcctttgacttta

SEQ ID NO: 34852 - DNA, 20 bp, Artificial Sequence
  Description of Artificial Sequence: Synthetic oligonucleotide
  Target: SCN10A; (+) strand; PAM type: NRG; PAM sequence: TGG
ttgactttaaggctctgttt

SEQ ID NO: 34853 - DNA, 20 bp, Artificial Sequence
  Description of Artificial Sequence: Synthetic oligonucleotide
  Target: SCN10A; (+) strand; PAM type: NRG; PAM sequence: TGG
tttggtgattccatttgccc

SEQ ID NO: 34854 - DNA, 20 bp, Artificial Sequence
  Description of Artificial Sequence: Synthetic oligonucleotide
  Target: SCN10A; (+) strand; PAM type: NRG; PAM sequence: GAG
tggtgattccatttgccctg

SEQ ID NO: 34855 - DNA, 20 bp, Artificial Sequence
  Description of Artificial Sequence: Synthetic oligonucleotide
  Target: SCN10A; (+) strand; PAM type: NRG; PAM sequence: TGG
ttctccactgtctctgttcc

SEQ ID NO: 34856 - DNA, 20 bp, Artificial Sequence
  Description of Artificial Sequence: Synthetic oligonucleotide
  Target: SCN10A; (+) strand; PAM type: NRG; PAM sequence: GGG
tctccactgtctctgttcct

SEQ ID NO: 34857 - DNA, 20 bp, Artificial Sequence
  Description of Artificial Sequence: Synthetic oligonucleotide
  Target: SCN10A; (+) strand; PAM type: NRG; PAM sequence: GGG
ctccactgtctctgttcctg

SEQ ID NO: 34858 - DNA, 20 bp, Artificial Sequence
  Description of Artificial Sequence: Synthetic oligonucleotide
  Target: SCN10A; (+) strand; PAM type: NRG; PAM sequence: GAG
ccactgtctctgttcctggg

SEQ ID NO: 34859 - DNA, 20 bp, Artificial Sequence
  Description of Artificial Sequence: Synthetic oligonucleotide
  Target: SCN10A; (+) strand; PAM type: NRG; PAM sequence: AGG
cactgtctctgttcctgggg

SEQ ID NO: 34860 - DNA, 20 bp, Artificial Sequence
  Description of Artificial Sequence: Synthetic oligonucleotide
  Target: SCN10A; (+) strand; PAM type: NRG; PAM sequence: GGG
actgtctctgttcctgggga

SEQ ID NO: 34861 - DNA, 20 bp, Artificial Sequence
  Description of Artificial Sequence: Synthetic oligonucleotide
  Target: SCN10A; (+) strand; PAM type: NRG; PAM sequence: GAG
tgtctctgttcctggggagg

SEQ ID NO: 34862 - DNA, 20 bp, Artificial Sequence
  Description of Artificial Sequence: Synthetic oligonucleotide
  Target: SCN10A; (+) strand; PAM type: NRG; PAM sequence: TGG
aatgtgttatccttaccctc

SEQ ID NO: 34863 - DNA, 20 bp, Artificial Sequence
  Description of Artificial Sequence: Synthetic oligonucleotide
  Target: SCN10A; (+) strand; PAM type: NRG; PAM sequence: TGG
ttatccttaccctctggttc

SEQ ID NO: 34864 - DNA, 20 bp, Artificial Sequence
  Description of Artificial Sequence: Synthetic oligonucleotide
  Target: SCN10A; (+) strand; PAM type: NRG; PAM sequence: CAG
ccttaccctctggttctggc

SEQ ID NO: 34865 - DNA, 20 bp, Artificial Sequence
  Description of Artificial Sequence: Synthetic oligonucleotide
  Target: SCN10A; (+) strand; PAM type: NRG; PAM sequence: AGG
cttaccctctggttctggcc

SEQ ID NO: 34866 - DNA, 20 bp, Artificial Sequence
  Description of Artificial Sequence: Synthetic oligonucleotide
  Target: SCN10A; (+) strand; PAM type: NRG; PAM sequence: TGG
cctctggttctggccaggtt

SEQ ID NO: 34867 - DNA, 20 bp, Artificial Sequence
  Description of Artificial Sequence: Synthetic oligonucleotide
  Target: SCN10A; (+) strand; PAM type: NRG; PAM sequence: TGG
ttctggccaggtttggttaa

SEQ ID NO: 34868 - DNA, 20 bp, Artificial Sequence
  Description of Artificial Sequence: Synthetic oligonucleotide
  Target: SCN10A; (+) strand; PAM type: NRG; PAM sequence: GGG
tctggccaggtttggttaat

SEQ ID NO: 34869 - DNA, 20 bp, Artificial Sequence
  Description of Artificial Sequence: Synthetic oligonucleotide
  Target: SCN10A; (+) strand; PAM type: NRG; PAM sequence: GAG
tggccaggtttggttaatgg

SEQ ID NO: 34870 - DNA, 20 bp, Artificial Sequence
  Description of Artificial Sequence: Synthetic oligonucleotide
  Target: SCN10A; (+) strand; PAM type: NRG; PAM sequence: TAG
ggtttggttaatgggagaca

SEQ ID NO: 34871 - DNA, 20 bp, Artificial Sequence
  Description of Artificial Sequence: Synthetic oligonucleotide
  Target: SCN10A; (+) strand; PAM type: NRG; PAM sequence: AGG
gtttggttaatgggagacat

SEQ ID NO: 34872 - DNA, 20 bp, Artificial Sequence
  Description of Artificial Sequence: Synthetic oligonucleotide
  Target: SCN10A; (+) strand; PAM type: NRG; PAM sequence: CAG
tggttaatgggagacatagg

SEQ ID NO: 34873 - DNA, 20 bp, Artificial Sequence
  Description of Artificial Sequence: Synthetic oligonucleotide
  Target: SCN10A; (+) strand; PAM type: NRG; PAM sequence: AGG
ggttaatgggagacataggc

SEQ ID NO: 34874 - DNA, 20 bp, Artificial Sequence
  Description of Artificial Sequence: Synthetic oligonucleotide
  Target: SCN10A; (+) strand; PAM type: NRG; PAM sequence: AAG
gagacataggcaggacattc

SEQ ID NO: 34875 - DNA, 20 bp, Artificial Sequence
  Description of Artificial Sequence: Synthetic oligonucleotide
  Target: SCN10A; (+) strand; PAM type: NRG; PAM sequence: AGG
agacataggcaggacattca

SEQ ID NO: 34876 - DNA, 20 bp, Artificial Sequence
  Description of Artificial Sequence: Synthetic oligonucleotide
  Target: SCN10A; (+) strand; PAM type: NRG; PAM sequence: TAG
ataggcaggacattcaagga

SEQ ID NO: 34877 - DNA, 20 bp, Artificial Sequence
  Description of Artificial Sequence: Synthetic oligonucleotide
  Target: SCN10A; (+) strand; PAM type: NRG; PAM sequence: AAG
ggcaggacattcaaggatag

SEQ ID NO: 34878 - DNA, 20 bp, Artificial Sequence
  Description of Artificial Sequence: Synthetic oligonucleotide
  Target: SCN10A; (+) strand; PAM type: NRG; PAM sequence: AGG
gcaggacattcaaggataga

SEQ ID NO: 34879 - DNA, 20 bp, Artificial Sequence
  Description of Artificial Sequence: Synthetic oligonucleotide
  Target: SCN10A; (+) strand; PAM type: NRG; PAM sequence: GAG
aggacattcaaggatagaag

SEQ ID NO: 34880 - DNA, 20 bp, Artificial Sequence
  Description of Artificial Sequence: Synthetic oligonucleotide
  Target: SCN10A; (+) strand; PAM type: NRG; PAM sequence: GAG
gacattcaaggatagaagga

SEQ ID NO: 34881 - DNA, 20 bp, Artificial Sequence
  Description of Artificial Sequence: Synthetic oligonucleotide
  Target: SCN10A; (+) strand; PAM type: NRG; PAM sequence: AAG
tcaaggatagaaggagagac

SEQ ID NO: 34882 - DNA, 20 bp, Artificial Sequence
  Description of Artificial Sequence: Synthetic oligonucleotide
  Target: SCN10A; (+) strand; PAM type: NRG; PAM sequence: CAG
ggatagaaggagagacaagt

SEQ ID NO: 34883 - DNA, 20 bp, Artificial Sequence
  Description of Artificial Sequence: Synthetic oligonucleotide
  Target: SCN10A; (+) strand; PAM type: NRG; PAM sequence: AGG
gatagaaggagagacaagtc

SEQ ID NO: 34884 - DNA, 20 bp, Artificial Sequence
  Description of Artificial Sequence: Synthetic oligonucleotide
  Target: SCN10A; (+) strand; PAM type: NRG; PAM sequence: TGG
acaagtcaggtattttcccc

SEQ ID NO: 34885 - DNA, 20 bp, Artificial Sequence
  Description of Artificial Sequence: Synthetic oligonucleotide
  Target: SCN10A; (+) strand; PAM type: NRG; PAM sequence: TGG
gcttcttctctcctgtgcta

SEQ ID NO: 34886 - DNA, 20 bp, Artificial Sequence
  Description of Artificial Sequence: Synthetic oligonucleotide
  Target: SCN10A; (+) strand; PAM type: NRG; PAM sequence: GAG
ttctctcctgtgctatggct

SEQ ID NO: 34887 - DNA, 20 bp, Artificial Sequence
  Description of Artificial Sequence: Synthetic oligonucleotide
  Target: SCN10A; (+) strand; PAM type: NRG; PAM sequence: TAG
tctcctgtgctatggctgag

SEQ ID NO: 34888 - DNA, 20 bp, Artificial Sequence
  Description of Artificial Sequence: Synthetic oligonucleotide
  Target: SCN10A; (+) strand; PAM type: NRG; PAM sequence: CAG
cctgtgctatggctgagtag

SEQ ID NO: 34889 - DNA, 20 bp, Artificial Sequence
  Description of Artificial Sequence: Synthetic oligonucleotide
  Target: SCN10A; (+) strand; PAM type: NRG; PAM sequence: GAG
tgtgctatggctgagtagca

SEQ ID NO: 34890 - DNA, 20 bp, Artificial Sequence
  Description of Artificial Sequence: Synthetic oligonucleotide
  Target: SCN10A; (+) strand; PAM type: NRG; PAM sequence: AAG
cagagctgtgatcctctact

SEQ ID NO: 34891 - DNA, 20 bp, Artificial Sequence
  Description of Artificial Sequence: Synthetic oligonucleotide
  Target: SCN10A; (+) strand; PAM type: NRG; PAM sequence: AAG
tgatcctctactaagatcac

SEQ ID NO: 34892 - DNA, 20 bp, Artificial Sequence
  Description of Artificial Sequence: Synthetic oligonucleotide
  Target: SCN10A; (+) strand; PAM type: NRG; PAM sequence: CAG
actaagatcacaagttctgc

SEQ ID NO: 34893 - DNA, 20 bp, Artificial Sequence
  Description of Artificial Sequence: Synthetic oligonucleotide
  Target: SCN10A; (+) strand; PAM type: NRG; PAM sequence: AGG
ctaagatcacaagttctgcc

SEQ ID NO: 34894 - DNA, 20 bp, Artificial Sequence
  Description of Artificial Sequence: Synthetic oligonucleotide
  Target: SCN10A; (+) strand; PAM type: NRG; PAM sequence: CAG
agatcacaagttctgccagg

SEQ ID NO: 34895 - DNA, 20 bp, Artificial Sequence
  Description of Artificial Sequence: Synthetic oligonucleotide
  Target: SCN10A; (+) strand; PAM type: NRG; PAM sequence: GAG
aggcagcctctctgacacat

SEQ ID NO: 34896 - DNA, 20 bp, Artificial Sequence
  Description of Artificial Sequence: Synthetic oligonucleotide
  Target: SCN10A; (+) strand; PAM type: NRG; PAM sequence: AGG
ggcagcctctctgacacatg

SEQ ID NO: 34897 - DNA, 20 bp, Artificial Sequence
  Description of Artificial Sequence: Synthetic oligonucleotide
  Target: SCN10A; (+) strand; PAM type: NRG; PAM sequence: GGG
gcagcctctctgacacatga

SEQ ID NO: 34898 - DNA, 20 bp, Artificial Sequence
  Description of Artificial Sequence: Synthetic oligonucleotide
  Target: SCN10A; (+) strand; PAM type: NRG; PAM sequence: CAG
gcctctctgacacatgaggg

SEQ ID NO: 34899 - DNA, 20 bp, Artificial Sequence
  Description of Artificial Sequence: Synthetic oligonucleotide
  Target: SCN10A; (+) strand; PAM type: NRG; PAM sequence: TAG
catgagggcagctgctgctg

SEQ ID NO: 34900 - DNA, 20 bp, Artificial Sequence
  Description of Artificial Sequence: Synthetic oligonucleotide
  Target: SCN10A; (+) strand; PAM type: NRG; PAM sequence: TGG
ctgctgctgtagtctaattc

SEQ ID NO: 34901 - DNA, 20 bp, Artificial Sequence
  Description of Artificial Sequence: Synthetic oligonucleotide
  Target: SCN10A; (+) strand; PAM type: NRG; PAM sequence: CAG
ggtcctttccttcatccctt

SEQ ID NO: 34902 - DNA, 20 bp, Artificial Sequence
  Description of Artificial Sequence: Synthetic oligonucleotide
  Target: SCN10A; (+) strand; PAM type: NRG; PAM sequence: TAG
tttccttcatcccttcagcc

SEQ ID NO: 34903 - DNA, 20 bp, Artificial Sequence
  Description of Artificial Sequence: Synthetic oligonucleotide
  Target: SCN10A; (+) strand; PAM type: NRG; PAM sequence: AGG
ttccttcatcccttcagcct

SEQ ID NO: 34904 - DNA, 20 bp, Artificial Sequence
  Description of Artificial Sequence: Synthetic oligonucleotide
  Target: SCN10A; (+) strand; PAM type: NRG; PAM sequence: CAG
ccttcagcctaggcatgtaa

SEQ ID NO: 34905 - DNA, 20 bp, Artificial Sequence
  Description of Artificial Sequence: Synthetic oligonucleotide
  Target: SCN10A; (+) strand; PAM type: NRG; PAM sequence: TAG
taacagcttccccctgttac

SEQ ID NO: 34906 - DNA, 20 bp, Artificial Sequence
  Description of Artificial Sequence: Synthetic oligonucleotide
  Target: SCN10A; (+) strand; PAM type: NRG; PAM sequence: TAG
ttccccctgttactagtttc

SEQ ID NO: 34907 - DNA, 20 bp, Artificial Sequence
  Description of Artificial Sequence: Synthetic oligonucleotide
  Target: SCN10A; (+) strand; PAM type: NRG; PAM sequence: AGG
tccccctgttactagtttct

SEQ ID NO: 34908 - DNA, 20 bp, Artificial Sequence
  Description of Artificial Sequence: Synthetic oligonucleotide
  Target: SCN10A; (+) strand; PAM type: NRG; PAM sequence: AAG
ctgtcccttattcattccct

SEQ ID NO: 34909 - DNA, 20 bp, Artificial Sequence
  Description of Artificial Sequence: Synthetic oligonucleotide
  Target: SCN10A; (+) strand; PAM type: NRG; PAM sequence: CAG
ccttattcattccctaagcc

SEQ ID NO: 34910 - DNA, 20 bp, Artificial Sequence
  Description of Artificial Sequence: Synthetic oligonucleotide
  Target: SCN10A; (+) strand; PAM type: NRG; PAM sequence: TAG
ctttactaaactctctctat

SEQ ID NO: 34911 - DNA, 20 bp, Artificial Sequence
  Description of Artificial Sequence: Synthetic oligonucleotide
  Target: SCN10A; (+) strand; PAM type: NRG; PAM sequence: CGG
aactctctctattagcccat

SEQ ID NO: 34912 - DNA, 20 bp, Artificial Sequence
  Description of Artificial Sequence: Synthetic oligonucleotide
  Target: SCN10A; (+) strand; PAM type: NRG; PAM sequence: GAG
ctctctctattagcccatcg

SEQ ID NO: 34913 - DNA, 20 bp, Artificial Sequence
  Description of Artificial Sequence: Synthetic oligonucleotide
  Target: SCN10A; (+) strand; PAM type: NRG; PAM sequence: TGG
tctctattagcccatcggag

SEQ ID NO: 34914 - DNA, 20 bp, Artificial Sequence
  Description of Artificial Sequence: Synthetic oligonucleotide
  Target: SCN10A; (+) strand; PAM type: NRG; PAM sequence: TGG
gtggtccatctgtttcttgc

SEQ ID NO: 34915 - DNA, 20 bp, Artificial Sequence
  Description of Artificial Sequence: Synthetic oligonucleotide
  Target: SCN10A; (+) strand; PAM type: NRG; PAM sequence: GGG
tggtccatctgtttcttgct

SEQ ID NO: 34916 - DNA, 20 bp, Artificial Sequence
  Description of Artificial Sequence: Synthetic oligonucleotide
  Target: SCN10A; (+) strand; PAM type: NRG; PAM sequence: GAG
accctgaatcacatgacatt

SEQ ID NO: 34917 - DNA, 20 bp, Artificial Sequence
  Description of Artificial Sequence: Synthetic oligonucleotide
  Target: SCN10A; (+) strand; PAM type: NRG; PAM sequence: CAG
tgaatcacatgacattgagt

SEQ ID NO: 34918 - DNA, 20 bp, Artificial Sequence
  Description of Artificial Sequence: Synthetic oligonucleotide
  Target: SCN10A; (+) strand; PAM type: NRG; PAM sequence: GAG
aatcacatgacattgagtca

SEQ ID NO: 34919 - DNA, 20 bp, Artificial Sequence
  Description of Artificial Sequence: Synthetic oligonucleotide
  Target: SCN10A; (+) strand; PAM type: NRG; PAM sequence: GAG
atgacattgagtcagagact

SEQ ID NO: 34920 - DNA, 20 bp, Artificial Sequence
  Description of Artificial Sequence: Synthetic oligonucleotide
  Target: SCN10A; (+) strand; PAM type: NRG; PAM sequence: AAG
attgagtcagagactgagct

SEQ ID NO: 34921 - DNA, 20 bp, Artificial Sequence
  Description of Artificial Sequence: Synthetic oligonucleotide
  Target: SCN10A; (+) strand; PAM type: NRG; PAM sequence: AGG
ttgagtcagagactgagcta

SEQ ID NO: 34922 - DNA, 20 bp, Artificial Sequence
  Description of Artificial Sequence: Synthetic oligonucleotide
  Target: SCN10A; (+) strand; PAM type: NRG; PAM sequence: AAG
gactgagctaaggcaactct

SEQ ID NO: 34923 - DNA, 20 bp, Artificial Sequence
  Description of Artificial Sequence: Synthetic oligonucleotide
  Target: SCN10A; (+) strand; PAM type: NRG; PAM sequence: CAG
actctaagacttatctgtat

SEQ ID NO: 34924 - DNA, 20 bp, Artificial Sequence
  Description of Artificial Sequence: Synthetic oligonucleotide
  Target: SCN10A; (+) strand; PAM type: NRG; PAM sequence: TGG
ctaagacttatctgtatcag

SEQ ID NO: 34925 - DNA, 20 bp, Artificial Sequence
  Description of Artificial Sequence: Synthetic oligonucleotide
  Target: SCN10A; (+) strand; PAM type: NRG; PAM sequence: TGG
gtatcagtggaaccatttat

SEQ ID NO: 34926 - DNA, 20 bp, Artificial Sequence
  Description of Artificial Sequence: Synthetic oligonucleotide
  Target: SCN10A; (+) strand; PAM type: NRG; PAM sequence: TGG
ctgcaattgcgctgtatccc

SEQ ID NO: 34927 - DNA, 20 bp, Artificial Sequence
  Description of Artificial Sequence: Synthetic oligonucleotide
  Target: SCN10A; (+) strand; PAM type: NRG; PAM sequence: TAG
aattgcgctgtatccctggc

SEQ ID NO: 34928 - DNA, 20 bp, Artificial Sequence
  Description of Artificial Sequence: Synthetic oligonucleotide
  Target: SCN10A; (+) strand; PAM type: NRG; PAM sequence: CAG
gcgctgtatccctggctagc

SEQ ID NO: 34929 - DNA, 20 bp, Artificial Sequence
  Description of Artificial Sequence: Synthetic oligonucleotide
  Target: SCN10A; (+) strand; PAM type: NRG; PAM sequence: GAG
gctgtatccctggctagcca

SEQ ID NO: 34930 - DNA, 20 bp, Artificial Sequence
  Description of Artificial Sequence: Synthetic oligonucleotide
  Target: SCN10A; (+) strand; PAM type: NRG; PAM sequence: GAG
tgtatccctggctagccaga

SEQ ID NO: 34931 - DNA, 20 bp, Artificial Sequence
  Description of Artificial Sequence: Synthetic oligonucleotide
  Target: SCN10A; (+) strand; PAM type: NRG; PAM sequence: AGG
gtatccctggctagccagag

SEQ ID NO: 34932 - DNA, 20 bp, Artificial Sequence
  Description of Artificial Sequence: Synthetic oligonucleotide
  Target: SCN10A; (+) strand; PAM type: NRG; PAM sequence: GGG
tatccctggctagccagaga

SEQ ID NO: 34933 - DNA, 20 bp, Artificial Sequence
  Description of Artificial Sequence: Synthetic oligonucleotide
  Target: SCN10A; (+) strand; PAM type: NRG; PAM sequence: TAG
agagggcaaatgaaaaacac

SEQ ID NO: 34934 - DNA, 20 bp, Artificial Sequence
  Description of Artificial Sequence: Synthetic oligonucleotide
  Target: SCN10A; (+) strand; PAM type: NRG; PAM sequence: TGG
agaaacatcattgctgaaac

SEQ ID NO: 34935 - DNA, 20 bp, Artificial Sequence
  Description of Artificial Sequence: Synthetic oligonucleotide
  Target: SCN10A; (+) strand; PAM type: NRG; PAM sequence: GAG
aaacatcattgctgaaactg

SEQ ID NO: 34936 - DNA, 20 bp, Artificial Sequence
  Description of Artificial Sequence: Synthetic oligonucleotide
  Target: SCN10A; (+) strand; PAM type: NRG; PAM sequence: AGG
aacatcattgctgaaactgg

SEQ ID NO: 34937 - DNA, 20 bp, Artificial Sequence
  Description of Artificial Sequence: Synthetic oligonucleotide
  Target: SCN10A; (+) strand; PAM type: NRG; PAM sequence: GGG
acatcattgctgaaactgga

SEQ ID NO: 34938 - DNA, 20 bp, Artificial Sequence
  Description of Artificial Sequence: Synthetic oligonucleotide
  Target: SCN10A; (+) strand; PAM type: NRG; PAM sequence: GGG
catcattgctgaaactggag

SEQ ID NO: 34939 - DNA, 20 bp, Artificial Sequence
  Description of Artificial Sequence: Synthetic oligonucleotide
  Target: SCN10A; (+) strand; PAM type: NRG; PAM sequence: GAG
tcattgctgaaactggaggg

SEQ ID NO: 34940 - DNA, 20 bp, Artificial Sequence
  Description of Artificial Sequence: Synthetic oligonucleotide
  Target: SCN10A; (+) strand; PAM type: NRG; PAM sequence: GAG
attgctgaaactggagggga

SEQ ID NO: 34941 - DNA, 20 bp, Artificial Sequence
  Description of Artificial Sequence: Synthetic oligonucleotide
  Target: SCN10A; (+) strand; PAM type: NRG; PAM sequence: CAG
ggagagctcacattaactca

SEQ ID NO: 34942 - DNA, 20 bp, Artificial Sequence
  Description of Artificial Sequence: Synthetic oligonucleotide
  Target: SCN10A; (+) strand; PAM type: NRG; PAM sequence: GAG
ctcacagctcccaatccaat

SEQ ID NO: 34943 - DNA, 20 bp, Artificial Sequence
  Description of Artificial Sequence: Synthetic oligonucleotide
  Target: SCN10A; (+) strand; PAM type: NRG; PAM sequence: AGG
tcacagctcccaatccaatg

SEQ ID NO: 34944 - DNA, 20 bp, Artificial Sequence
  Description of Artificial Sequence: Synthetic oligonucleotide
  Target: SCN10A; (+) strand; PAM type: NRG; PAM sequence: AAG
actctgcgattattctatta

SEQ ID NO: 34945 - DNA, 20 bp, Artificial Sequence
  Description of Artificial Sequence: Synthetic oligonucleotide
  Target: SCN10A; (+) strand; PAM type: NRG; PAM sequence: GAG
tctgcgattattctattaaa

SEQ ID NO: 34946 - DNA, 20 bp, Artificial Sequence
  Description of Artificial Sequence: Synthetic oligonucleotide
  Target: SCN10A; (+) strand; PAM type: NRG; PAM sequence: TGG
attattctattaaagagtgc

SEQ ID NO: 34947 - DNA, 20 bp, Artificial Sequence
  Description of Artificial Sequence: Synthetic oligonucleotide
  Target: SCN10A; (+) strand; PAM type: NRG; PAM sequence: CAG
ttctattaaagagtgctggc

SEQ ID NO: 34948 - DNA, 20 bp, Artificial Sequence
  Description of Artificial Sequence: Synthetic oligonucleotide
  Target: SCN10A; (+) strand; PAM type: NRG; PAM sequence: TAG
attaaagagtgctggccagt

SEQ ID NO: 34949 - DNA, 20 bp, Artificial Sequence
  Description of Artificial Sequence: Synthetic oligonucleotide
  Target: SCN10A; (+) strand; PAM type: NRG; PAM sequence: TGG
gttgcctaatttgctcattt

SEQ ID NO: 34950 - DNA, 20 bp, Artificial Sequence
  Description of Artificial Sequence: Synthetic oligonucleotide
  Target: SCN10A; (+) strand; PAM type: NRG; PAM sequence: GAG
tggcaaattatttcttctgt

SEQ ID NO: 34951 - DNA, 20 bp, Artificial Sequence
  Description of Artificial Sequence: Synthetic oligonucleotide
  Target: SCN10A; (+) strand; PAM type: NRG; PAM sequence: AAG
aattatttcttctgtgagta

SEQ ID NO: 34952 - DNA, 20 bp, Artificial Sequence
  Description of Artificial Sequence: Synthetic oligonucleotide
  Target: SCN10A; (+) strand; PAM type: NRG; PAM sequence: AAG
atttcttctgtgagtaaagc

SEQ ID NO: 34953 - DNA, 20 bp, Artificial Sequence
  Description of Artificial Sequence: Synthetic oligonucleotide
  Target: SCN10A; (+) strand; PAM type: NRG; PAM sequence: AGG
tttcttctgtgagtaaagca

SEQ ID NO: 34954 - DNA, 20 bp, Artificial Sequence
  Description of Artificial Sequence: Synthetic oligonucleotide
  Target: SCN10A; (+) strand; PAM type: NRG; PAM sequence: CAG
aggaatactgtgcttctatt

SEQ ID NO: 34955 - DNA, 20 bp, Artificial Sequence
  Description of Artificial Sequence: Synthetic oligonucleotide
  Target: SCN10A; (+) strand; PAM type: NRG; PAM sequence: AAG
cttctattcagatctgtcct

SEQ ID NO: 34956 - DNA, 20 bp, Artificial Sequence
  Description of Artificial Sequence: Synthetic oligonucleotide
  Target: SCN10A; (+) strand; PAM type: NRG; PAM sequence: TGG
agaaacttcctgaatttctc

SEQ ID NO: 34957 - DNA, 20 bp, Artificial Sequence
  Description of Artificial Sequence: Synthetic oligonucleotide
  Target: SCN10A; (+) strand; PAM type: NRG; PAM sequence: GGG
gaaacttcctgaatttctct

SEQ ID NO: 34958 - DNA, 20 bp, Artificial Sequence
  Description of Artificial Sequence: Synthetic oligonucleotide
  Target: SCN10A; (+) strand; PAM type: NRG; PAM sequence: CAG
ttctctgggtgccatttgcc

SEQ ID NO: 34959 - DNA, 20 bp, Artificial Sequence
  Description of Artificial Sequence: Synthetic oligonucleotide
  Target: SCN10A; (+) strand; PAM type: NRG; PAM sequence: TAG
tgggtgccatttgcccagcc

SEQ ID NO: 34960 - DNA, 20 bp, Artificial Sequence
  Description of Artificial Sequence: Synthetic oligonucleotide
  Target: SCN10A; (+) strand; PAM type: NRG; PAM sequence: AAG
gtgccatttgcccagcctag

SEQ ID NO: 34961 - DNA, 20 bp, Artificial Sequence
  Description of Artificial Sequence: Synthetic oligonucleotide
  Target: SCN10A; (+) strand; PAM type: NRG; PAM sequence: GAG
gccatttgcccagcctagaa

SEQ ID NO: 34962 - DNA, 20 bp, Artificial Sequence
  Description of Artificial Sequence: Synthetic oligonucleotide
  Target: SCN10A; (+) strand; PAM type: NRG; PAM sequence: TAG
ccagcctagaagagtttgca

SEQ ID NO: 34963 - DNA, 20 bp, Artificial Sequence
  Description of Artificial Sequence: Synthetic oligonucleotide
  Target: SCN10A; (+) strand; PAM type: NRG; PAM sequence: GAG
agcctagaagagtttgcata

SEQ ID NO: 34964 - DNA, 20 bp, Artificial Sequence
  Description of Artificial Sequence: Synthetic oligonucleotide
  Target: SCN10A; (+) strand; PAM type: NRG; PAM sequence: AAG
aagagtttgcatagagccat

SEQ ID NO: 34965 - DNA, 20 bp, Artificial Sequence
  Description of Artificial Sequence: Synthetic oligonucleotide
  Target: SCN10A; (+) strand; PAM type: NRG; PAM sequence: CAG
agtttgcatagagccataag

SEQ ID NO: 34966 - DNA, 20 bp, Artificial Sequence
  Description of Artificial Sequence: Synthetic oligonucleotide
  Target: SCN10A; (+) strand; PAM type: NRG; PAM sequence: AGG
gtttgcatagagccataagc

SEQ ID NO: 34967 - DNA, 20 bp, Artificial Sequence
  Description of Artificial Sequence: Synthetic oligonucleotide
  Target: SCN10A; (+) strand; PAM type: NRG; PAM sequence: AAG
tgcatagagccataagcagg

SEQ ID NO: 34968 - DNA, 20 bp, Artificial Sequence
  Description of Artificial Sequence: Synthetic oligonucleotide
  Target: SCN10A; (+) strand; PAM type: NRG; PAM sequence: GAG
catagagccataagcaggaa

SEQ ID NO: 34969 - DNA, 20 bp, Artificial Sequence
  Description of Artificial Sequence: Synthetic oligonucleotide
  Target: SCN10A; (+) strand; PAM type: NRG; PAM sequence: AAG
agagccataagcaggaagag

SEQ ID NO: 34970 - DNA, 20 bp, Artificial Sequence
  Description of Artificial Sequence: Synthetic oligonucleotide
  Target: SCN10A; (+) strand; PAM type: NRG; PAM sequence: AGG
gagccataagcaggaagaga

SEQ ID NO: 34971 - DNA, 20 bp, Artificial Sequence
  Description of Artificial Sequence: Synthetic oligonucleotide
  Target: SCN10A; (+) strand; PAM type: NRG; PAM sequence: GGG
agccataagcaggaagagaa

SEQ ID NO: 34972 - DNA, 20 bp, Artificial Sequence
  Description of Artificial Sequence: Synthetic oligonucleotide
  Target: SCN10A; (+) strand; PAM type: NRG; PAM sequence: CAG
gcaggaagagaagggtcctt

SEQ ID NO: 34973 - DNA, 20 bp, Artificial Sequence
  Description of Artificial Sequence: Synthetic oligonucleotide
  Target: SCN10A; (+) strand; PAM type: NRG; PAM sequence: AAG
ttttctcatacctgtccaac

SEQ ID NO: 34974 - DNA, 20 bp, Artificial Sequence
  Description of Artificial Sequence: Synthetic oligonucleotide
  Target: SCN10A; (+) strand; PAM type: NRG; PAM sequence: AAG
ctcatacctgtccaacaaga

SEQ ID NO: 34975 - DNA, 20 bp, Artificial Sequence
  Description of Artificial Sequence: Synthetic oligonucleotide
  Target: SCN10A; (+) strand; PAM type: NRG; PAM sequence: CAG
atacctgtccaacaagaaag

SEQ ID NO: 34976 - DNA, 20 bp, Artificial Sequence
  Description of Artificial Sequence: Synthetic oligonucleotide
  Target: SCN10A; (+) strand; PAM type: NRG; PAM sequence: AGG
tacctgtccaacaagaaagc

SEQ ID NO: 34977 - DNA, 20 bp, Artificial Sequence
  Description of Artificial Sequence: Synthetic oligonucleotide
  Target: SCN10A; (+) strand; PAM type: NRG; PAM sequence: GAG
aagaaagcaggcctatcact

SEQ ID NO: 34978 - DNA, 20 bp, Artificial Sequence
  Description of Artificial Sequence: Synthetic oligonucleotide
  Target: SCN10A; (+) strand; PAM type: NRG; PAM sequence: AGG
agaaagcaggcctatcactg

SEQ ID NO: 34979 - DNA, 20 bp, Artificial Sequence
  Description of Artificial Sequence: Synthetic oligonucleotide
  Target: SCN10A; (+) strand; PAM type: NRG; PAM sequence: CAG
aagcaggcctatcactgagg

SEQ ID NO: 34980 - DNA, 20 bp, Artificial Sequence
  Description of Artificial Sequence: Synthetic oligonucleotide
  Target: SCN10A; (+) strand; PAM type: NRG; PAM sequence: GAG
atcactgaggcagtgatgtt

SEQ ID NO: 34981 - DNA, 20 bp, Artificial Sequence
  Description of Artificial Sequence: Synthetic oligonucleotide
  Target: SCN10A; (+) strand; PAM type: NRG; PAM sequence: TGG
actgaggcagtgatgttgag

SEQ ID NO: 34982 - DNA, 20 bp, Artificial Sequence
  Description of Artificial Sequence: Synthetic oligonucleotide
  Target: SCN10A; (+) strand; PAM type: NRG; PAM sequence: GGG
ctgaggcagtgatgttgagt

SEQ ID NO: 34983 - DNA, 20 bp, Artificial Sequence
  Description of Artificial Sequence: Synthetic oligonucleotide
  Target: SCN10A; (+) strand; PAM type: NRG; PAM sequence: GGG
tgaggcagtgatgttgagtg

SEQ ID NO: 34984 - DNA, 20 bp, Artificial Sequence
  Description of Artificial Sequence: Synthetic oligonucleotide
  Target: SCN10A; (+) strand; PAM type: NRG; PAM sequence: CAG
gcagtgatgttgagtgggga

SEQ ID NO: 34985 - DNA, 20 bp, Artificial Sequence
  Description of Artificial Sequence: Synthetic oligonucleotide
  Target: SCN10A; (+) strand; PAM type: NRG; PAM sequence: GAG
agtgatgttgagtggggaca

SEQ ID NO: 34986 - DNA, 20 bp, Artificial Sequence
  Description of Artificial Sequence: Synthetic oligonucleotide
  Target: SCN10A; (+) strand; PAM type: NRG; PAM sequence: AAG
gatgttgagtggggacagag

SEQ ID NO: 34987 - DNA, 20 bp, Artificial Sequence
  Description of Artificial Sequence: Synthetic oligonucleotide
  Target: SCN10A; (+) strand; PAM type: NRG; PAM sequence: AAG
ggggacagagaagcactgat

SEQ ID NO: 34988 - DNA, 20 bp, Artificial Sequence
  Description of Artificial Sequence: Synthetic oligonucleotide
  Target: SCN10A; (+) strand; PAM type: NRG; PAM sequence: TGG
agaagcactgataagaaata

SEQ ID NO: 34989 - DNA, 20 bp, Artificial Sequence
  Description of Artificial Sequence: Synthetic oligonucleotide
  Target: SCN10A; (+) strand; PAM type: NRG; PAM sequence: GGG
gaagcactgataagaaatat

SEQ ID NO: 34990 - DNA, 20 bp, Artificial Sequence
  Description of Artificial Sequence: Synthetic oligonucleotide
  Target: SCN10A; (+) strand; PAM type: NRG; PAM sequence: GGG
aagcactgataagaaatatg

SEQ ID NO: 34991 - DNA, 20 bp, Artificial Sequence
  Description of Artificial Sequence: Synthetic oligonucleotide
  Target: SCN10A; (+) strand; PAM type: NRG; PAM sequence: TGG
ataagaaatatggggtcaaa

SEQ ID NO: 34992 - DNA, 20 bp, Artificial Sequence
  Description of Artificial Sequence: Synthetic oligonucleotide
  Target: SCN10A; (+) strand; PAM type: NRG; PAM sequence: CAG
tataatttgcatcactactg

SEQ ID NO: 34993 - DNA, 20 bp, Artificial Sequence
  Description of Artificial Sequence: Synthetic oligonucleotide
  Target: SCN10A; (+) strand; PAM type: NRG; PAM sequence: CAG
atcactactgcagaataaac

SEQ ID NO: 34994 - DNA, 20 bp, Artificial Sequence
  Description of Artificial Sequence: Synthetic oligonucleotide
  Target: SCN10A; (+) strand; PAM type: NRG; PAM sequence: AGG
tcactactgcagaataaacc

SEQ ID NO: 34995 - DNA, 20 bp, Artificial Sequence
  Description of Artificial Sequence: Synthetic oligonucleotide
  Target: SCN10A; (+) strand; PAM type: NRG; PAM sequence: CAG
ccaggaaacctgtttgacct

SEQ ID NO: 34996 - DNA, 20 bp, Artificial Sequence
  Description of Artificial Sequence: Synthetic oligonucleotide
  Target: SCN10A; (+) strand; PAM type: NRG; PAM sequence: AGG
caggaaacctgtttgacctc

SEQ ID NO: 34997 - DNA, 20 bp, Artificial Sequence
  Description of Artificial Sequence: Synthetic oligonucleotide
  Target: SCN10A; (+) strand; PAM type: NRG; PAM sequence: TGG
actcaatctctctctctctc

SEQ ID NO: 34998 - DNA, 20 bp, Artificial Sequence
  Description of Artificial Sequence: Synthetic oligonucleotide
  Target: SCN10A; (+) strand; PAM type: NRG; PAM sequence: GGG
ctcaatctctctctctctct

SEQ ID NO: 34999 - DNA, 20 bp, Artificial Sequence
  Description of Artificial Sequence: Synthetic oligonucleotide
  Target: SCN10A; (+) strand; PAM type: NRG; PAM sequence: AAG
catcttctatgtctgtaaaa

SEQ ID NO: 35000 - DNA, 20 bp, Artificial Sequence
  Description of Artificial Sequence: Synthetic oligonucleotide
  Target: SCN10A; (+) strand; PAM type: NRG; PAM sequence: AGG
atcttctatgtctgtaaaaa

SEQ ID NO: 35001 - DNA, 20 bp, Artificial Sequence
  Description of Artificial Sequence: Synthetic oligonucleotide
  Target: SCN10A; (+) strand; PAM type: NRG; PAM sequence: GAG
cttctatgtctgtaaaaaag

SEQ ID NO: 35002 - DNA, 20 bp, Artificial Sequence
  Description of Artificial Sequence: Synthetic oligonucleotide
  Target: SCN10A; (+) strand; PAM type: NRG; PAM sequence: TAG
ctatgtctgtaaaaaaggag

SEQ ID NO: 35003 - DNA, 20 bp, Artificial Sequence
  Description of Artificial Sequence: Synthetic oligonucleotide
  Target: SCN10A; (+) strand; PAM type: NRG; PAM sequence: TGG
tctgtaaaaaaggagtagaa

SEQ ID NO: 35004 - DNA, 20 bp, Artificial Sequence
  Description of Artificial Sequence: Synthetic oligonucleotide
  Target: SCN10A; (+) strand; PAM type: NRG; PAM sequence: GGG
ctgtaaaaaaggagtagaat

SEQ ID NO: 35005 - DNA, 20 bp, Artificial Sequence
  Description of Artificial Sequence: Synthetic oligonucleotide
  Target: SCN10A; (+) strand; PAM type: NRG; PAM sequence: GGG
tgtaaaaaaggagtagaatg

SEQ ID NO: 35006 - DNA, 20 bp, Artificial Sequence
  Description of Artificial Sequence: Synthetic oligonucleotide
  Target: SCN10A; (+) strand; PAM type: NRG; PAM sequence: GAG
taaaaaaggagtagaatggg

SEQ ID NO: 35007 - DNA, 20 bp, Artificial Sequence
  Description of Artificial Sequence: Synthetic oligonucleotide
  Target: SCN10A; (+) strand; PAM type: NRG; PAM sequence: AGG
aaaaaaggagtagaatgggg

SEQ ID NO: 35008 - DNA, 20 bp, Artificial Sequence
  Description of Artificial Sequence: Synthetic oligonucleotide
  Target: SCN10A; (+) strand; PAM type: NRG; PAM sequence: TGG
ggagtagaatggggaggcat

SEQ ID NO: 35009 - DNA, 20 bp, Artificial Sequence
  Description of Artificial Sequence: Synthetic oligonucleotide
  Target: SCN10A; (+) strand; PAM type: NRG; PAM sequence: CAG
tagaatggggaggcattgga

SEQ ID NO: 35010 - DNA, 20 bp, Artificial Sequence
  Description of Artificial Sequence: Synthetic oligonucleotide
  Target: SCN10A; (+) strand; PAM type: NRG; PAM sequence: AGG
agaatggggaggcattggac

SEQ ID NO: 35011 - DNA, 20 bp, Artificial Sequence
  Description of Artificial Sequence: Synthetic oligonucleotide
  Target: SCN10A; (+) strand; PAM type: NRG; PAM sequence: TGG
ggaggcattggacaggatga

SEQ ID NO: 35012 - DNA, 20 bp, Artificial Sequence
  Description of Artificial Sequence: Synthetic oligonucleotide
  Target: SCN10A; (+) strand; PAM type: NRG; PAM sequence: AAG
attggacaggatgatggcta

SEQ ID NO: 35013 - DNA, 20 bp, Artificial Sequence
  Description of Artificial Sequence: Synthetic oligonucleotide
  Target: SCN10A; (+) strand; PAM type: NRG; PAM sequence: TGG
tggctaaagatcccttccat

SEQ ID NO: 35014 - DNA, 20 bp, Artificial Sequence
  Description of Artificial Sequence: Synthetic oligonucleotide
  Target: SCN10A; (+) strand; PAM type: NRG; PAM sequence: CAG
tcccttccattggtgatact

SEQ ID NO: 35015 - DNA, 20 bp, Artificial Sequence
  Description of Artificial Sequence: Synthetic oligonucleotide
  Target: SCN10A; (+) strand; PAM type: NRG; PAM sequence: AGG
cccttccattggtgatactc

SEQ ID NO: 35016 - DNA, 20 bp, Artificial Sequence
  Description of Artificial Sequence: Synthetic oligonucleotide
  Target: SCN10A; (+) strand; PAM type: NRG; PAM sequence: TGG
ttggtgatactcaggcttct

SEQ ID NO: 35017 - DNA, 20 bp, Artificial Sequence
  Description of Artificial Sequence: Synthetic oligonucleotide
  Target: SCN10A; (+) strand; PAM type: NRG; PAM sequence: AAG
atactcaggcttcttggctc

SEQ ID NO: 35018 - DNA, 20 bp, Artificial Sequence
  Description of Artificial Sequence: Synthetic oligonucleotide
  Target: SCN10A; (+) strand; PAM type: NRG; PAM sequence: AGG
tactcaggcttcttggctca

SEQ ID NO: 35019 - DNA, 20 bp, Artificial Sequence
  Description of Artificial Sequence: Synthetic oligonucleotide
  Target: SCN10A; (+) strand; PAM type: NRG; PAM sequence: TAG
gcttcttggctcaaggcttc

SEQ ID NO: 35020 - DNA, 20 bp, Artificial Sequence
  Description of Artificial Sequence: Synthetic oligonucleotide
  Target: SCN10A; (+) strand; PAM type: NRG; PAM sequence: AGG
cttcttggctcaaggcttct

SEQ ID NO: 35021 - DNA, 20 bp, Artificial Sequence
  Description of Artificial Sequence: Synthetic oligonucleotide
  Target: SCN10A; (+) strand; PAM type: NRG; PAM sequence: TGG
cttggctcaaggcttctagg

SEQ ID NO: 35022 - DNA, 20 bp, Artificial Sequence
  Description of Artificial Sequence: Synthetic oligonucleotide
  Target: SCN10A; (+) strand; PAM type: NRG; PAM sequence: AAG
ggctcaaggcttctaggtgg

SEQ ID NO: 35023 - DNA, 20 bp, Artificial Sequence
  Description of Artificial Sequence: Synthetic oligonucleotide
  Target: SCN10A; (+) strand; PAM type: NRG; PAM sequence: CAG
caaggcttctaggtggaaga

SEQ ID NO: 35024 - DNA, 20 bp, Artificial Sequence
  Description of Artificial Sequence: Synthetic oligonucleotide
  Target: SCN10A; (+) strand; PAM type: NRG; PAM sequence: GAG
ttctaggtggaagacagcct

SEQ ID NO: 35025 - DNA, 20 bp, Artificial Sequence
  Description of Artificial Sequence: Synthetic oligonucleotide
  Target: SCN10A; (+) strand; PAM type: NRG; PAM sequence: AGG
tctaggtggaagacagcctg

SEQ ID NO: 35026 - DNA, 20 bp, Artificial Sequence
  Description of Artificial Sequence: Synthetic oligonucleotide
  Target: SCN10A; (+) strand; PAM type: NRG; PAM sequence: GGG
ctaggtggaagacagcctga

SEQ ID NO: 35027 - DNA, 20 bp, Artificial Sequence
  Description of Artificial Sequence: Synthetic oligonucleotide
  Target: SCN10A; (+) strand; PAM type: NRG; PAM sequence: GAG
aggtggaagacagcctgagg

SEQ ID NO: 35028 - DNA, 20 bp, Artificial Sequence
  Description of Artificial Sequence: Synthetic oligonucleotide
  Target: SCN10A; (+) strand; PAM type: NRG; PAM sequence: AAG
agacagcctgagggagtctg

SEQ ID NO: 35029 - DNA, 20 bp, Artificial Sequence
  Description of Artificial Sequence: Synthetic oligonucleotide
  Target: SCN10A; (+) strand; PAM type: NRG; PAM sequence: GAG
gaagcattcacaaactcacc

SEQ ID NO: 35030 - DNA, 20 bp, Artificial Sequence
  Description of Artificial Sequence: Synthetic oligonucleotide
  Target: SCN10A; (+) strand; PAM type: NRG; PAM sequence: CAG
caaactcaccgagacatcga

SEQ ID NO: 35031 - DNA, 20 bp, Artificial Sequence
  Description of Artificial Sequence: Synthetic oligonucleotide
  Target: SCN10A; (+) strand; PAM type: NRG; PAM sequence: CAG
caccgagacatcgacagctc

SEQ ID NO: 35032 - DNA, 20 bp, Artificial Sequence
  Description of Artificial Sequence: Synthetic oligonucleotide
  Target: SCN10A; (+) strand; PAM type: NRG; PAM sequence: AGG
accgagacatcgacagctcc

SEQ ID NO: 35033 - DNA, 20 bp, Artificial Sequence
  Description of Artificial Sequence: Synthetic oligonucleotide
  Target: SCN10A; (+) strand; PAM type: NRG; PAM sequence: GGG
ccgagacatcgacagctcca

SEQ ID NO: 35034 - DNA, 20 bp, Artificial Sequence
  Description of Artificial Sequence: Synthetic oligonucleotide
  Target: SCN10A; (+) strand; PAM type: NRG; PAM sequence: GGG
cgagacatcgacagctccag

SEQ ID NO: 35035 - DNA, 20 bp, Artificial Sequence
  Description of Artificial Sequence: Synthetic oligonucleotide
  Target: SCN10A; (+) strand; PAM type: NRG; PAM sequence: AAG
acatcgacagctccaggggc

SEQ ID NO: 35036 - DNA, 20 bp, Artificial Sequence
  Description of Artificial Sequence: Synthetic oligonucleotide
  Target: SCN10A; (+) strand; PAM type: NRG; PAM sequence: TAG
agctccaggggcaagctcac

SEQ ID NO: 35037 - DNA, 20 bp, Artificial Sequence
  Description of Artificial Sequence: Synthetic oligonucleotide
  Target: SCN10A; (+) strand; PAM type: NRG; PAM sequence: TGG
tccaggggcaagctcactag

SEQ ID NO: 35038 - DNA, 20 bp, Artificial Sequence
  Description of Artificial Sequence: Synthetic oligonucleotide
  Target: SCN10A; (+) strand; PAM type: NRG; PAM sequence: GGG
ccaggggcaagctcactagt

SEQ ID NO: 35039 - DNA, 20 bp, Artificial Sequence
  Description of Artificial Sequence: Synthetic oligonucleotide
  Target: SCN10A; (+) strand; PAM type: NRG; PAM sequence: CGG
ggggcaagctcactagtggg

SEQ ID NO: 35040 - DNA, 20 bp, Artificial Sequence
  Description of Artificial Sequence: Synthetic oligonucleotide
  Target: SCN10A; (+) strand; PAM type: NRG; PAM sequence: CGG
gcaagctcactagtgggcgg

SEQ ID NO: 35041 - DNA, 20 bp, Artificial Sequence
  Description of Artificial Sequence: Synthetic oligonucleotide
  Target: SCN10A; (+) strand; PAM type: NRG; PAM sequence: TGG
gctcactagtgggcggcggt

SEQ ID NO: 35042 - DNA, 20 bp, Artificial Sequence
  Description of Artificial Sequence: Synthetic oligonucleotide
  Target: SCN10A; (+) strand; PAM type: NRG; PAM sequence: TGG
gtgttcatcttctccatgcc

SEQ ID NO: 35043 - DNA, 20 bp, Artificial Sequence
  Description of Artificial Sequence: Synthetic oligonucleotide
  Target: SCN10A; (+) strand; PAM type: NRG; PAM sequence: GAG
gttcatcttctccatgcctg

SEQ ID NO: 35044 - DNA, 20 bp, Artificial Sequence
  Description of Artificial Sequence: Synthetic oligonucleotide
  Target: SCN10A; (+) strand; PAM type: NRG; PAM sequence: CAG
atcttctccatgcctggagt

SEQ ID NO: 35045 - DNA, 20 bp, Artificial Sequence
  Description of Artificial Sequence: Synthetic oligonucleotide
  Target: SCN10A; (+) strand; PAM type: NRG; PAM sequence: AGG
tcttctccatgcctggagtc

SEQ ID NO: 35046 - DNA, 20 bp, Artificial Sequence
  Description of Artificial Sequence: Synthetic oligonucleotide
  Target: SCN10A; (+) strand; PAM type: NRG; PAM sequence: GGG
cttctccatgcctggagtca

SEQ ID NO: 35047 - DNA, 20 bp, Artificial Sequence
  Description of Artificial Sequence: Synthetic oligonucleotide
  Target: SCN10A; (+) strand; PAM type: NRG; PAM sequence: TGG
atgcctggagtcagggttgc

SEQ ID NO: 35048 - DNA, 20 bp, Artificial Sequence
  Description of Artificial Sequence: Synthetic oligonucleotide
  Target: SCN10A; (+) strand; PAM type: NRG; PAM sequence: GGG
tgcctggagtcagggttgct

SEQ ID NO: 35049 - DNA, 20 bp, Artificial Sequence
  Description of Artificial Sequence: Synthetic oligonucleotide
  Target: SCN10A; (+) strand; PAM type: NRG; PAM sequence: GAG
ggagtcagggttgctgggtt

SEQ ID NO: 35050 - DNA, 20 bp, Artificial Sequence
  Description of Artificial Sequence: Synthetic oligonucleotide
  Target: SCN10A; (+) strand; PAM type: NRG; PAM sequence: AGG
gagtcagggttgctgggttg

SEQ ID NO: 35051 - DNA, 20 bp, Artificial Sequence
  Description of Artificial Sequence: Synthetic oligonucleotide
  Target: SCN10A; (+) strand; PAM type: NRG; PAM sequence: AAG
tcagggttgctgggttgagg

SEQ ID NO: 35052 - DNA, 20 bp, Artificial Sequence
  Description of Artificial Sequence: Synthetic oligonucleotide
  Target: SCN10A; (+) strand; PAM type: NRG; PAM sequence: GAG
agggttgctgggttgaggaa

SEQ ID NO: 35053 - DNA, 20 bp, Artificial Sequence
  Description of Artificial Sequence: Synthetic oligonucleotide
  Target: SCN10A; (+) strand; PAM type: NRG; PAM sequence: AGG
gggttgctgggttgaggaag

SEQ ID NO: 35054 - DNA, 20 bp, Artificial Sequence
  Description of Artificial Sequence: Synthetic oligonucleotide
  Target: SCN10A; (+) strand; PAM type: NRG; PAM sequence: GGG
ggttgctgggttgaggaaga

SEQ ID NO: 35055 - DNA, 20 bp, Artificial Sequence
  Description of Artificial Sequence: Synthetic oligonucleotide
  Target: SCN10A; (+) strand; PAM type: NRG; PAM sequence: TAG
gggttgaggaagagggcttc

SEQ ID NO: 35056 - DNA, 20 bp, Artificial Sequence
  Description of Artificial Sequence: Synthetic oligonucleotide
  Target: SCN10A; (+) strand; PAM type: NRG; PAM sequence: AGG
ggttgaggaagagggcttct

SEQ ID NO: 35057 - DNA, 20 bp, Artificial Sequence
  Description of Artificial Sequence: Synthetic oligonucleotide
  Target: SCN10A; (+) strand; PAM type: NRG; PAM sequence: GGG
gttgaggaagagggcttcta

SEQ ID NO: 35058 - DNA, 20 bp, Artificial Sequence
  Description of Artificial Sequence: Synthetic oligonucleotide
  Target: SCN10A; (+) strand; PAM type: NRG; PAM sequence: GAG
tgaggaagagggcttctagg

SEQ ID NO: 35059 - DNA, 20 bp, Artificial Sequence
  Description of Artificial Sequence: Synthetic oligonucleotide
  Target: SCN10A; (+) strand; PAM type: NRG; PAM sequence: AGG
gaggaagagggcttctaggg

SEQ ID NO: 35060 - DNA, 20 bp, Artificial Sequence
  Description of Artificial Sequence: Synthetic oligonucleotide
  Target: SCN10A; (+) strand; PAM type: NRG; PAM sequence: GGG
aggaagagggcttctaggga

SEQ ID NO: 35061 - DNA, 20 bp, Artificial Sequence
  Description of Artificial Sequence: Synthetic oligonucleotide
  Target: SCN10A; (+) strand; PAM type: NRG; PAM sequence: GGG
ggaagagggcttctagggag

SEQ ID NO: 35062 - DNA, 20 bp, Artificial Sequence
  Description of Artificial Sequence: Synthetic oligonucleotide
  Target: SCN10A; (+) strand; PAM type: NRG; PAM sequence: GGG
gaagagggcttctagggagg

SEQ ID NO: 35063 - DNA, 20 bp, Artificial Sequence
  Description of Artificial Sequence: Synthetic oligonucleotide
  Target: SCN10A; (+) strand; PAM type: NRG; PAM sequence: TGG
ttctagggagggggccttgc

SEQ ID NO: 35064 - DNA, 20 bp, Artificial Sequence
  Description of Artificial Sequence: Synthetic oligonucleotide
  Target: SCN10A; (+) strand; PAM type: NRG; PAM sequence: CAG
agggagggggccttgctggc

SEQ ID NO: 35065 - DNA, 20 bp, Artificial Sequence
  Description of Artificial Sequence: Synthetic oligonucleotide
  Target: SCN10A; (+) strand; PAM type: NRG; PAM sequence: CAG
tgctggccagcacccccacc

SEQ ID NO: 35066 - DNA, 20 bp, Artificial Sequence
  Description of Artificial Sequence: Synthetic oligonucleotide
  Target: SCN10A; (+) strand; PAM type: NRG; PAM sequence: CAG
tggccagcacccccacccag

SEQ ID NO: 35067 - DNA, 20 bp, Artificial Sequence
  Description of Artificial Sequence: Synthetic oligonucleotide
  Target: SCN10A; (+) strand; PAM type: NRG; PAM sequence: CAG
ccagcacccccacccagcag

SEQ ID NO: 35068 - DNA, 20 bp, Artificial Sequence
  Description of Artificial Sequence: Synthetic oligonucleotide
  Target: SCN10A; (+) strand; PAM type: NRG; PAM sequence: GAG
agcacccccacccagcagca

SEQ ID NO: 35069 - DNA, 20 bp, Artificial Sequence
  Description of Artificial Sequence: Synthetic oligonucleotide
  Target: SCN10A; (+) strand; PAM type: NRG; PAM sequence: GAG
cacccccacccagcagcaga

SEQ ID NO: 35070 - DNA, 20 bp, Artificial Sequence
  Description of Artificial Sequence: Synthetic oligonucleotide
  Target: SCN10A; (+) strand; PAM type: NRG; PAM sequence: TGG
ccagcagcagagagccccga

SEQ ID NO: 35071 - DNA, 20 bp, Artificial Sequence
  Description of Artificial Sequence: Synthetic oligonucleotide
  Target: SCN10A; (+) strand; PAM type: NRG; PAM sequence: TGG
gagagccccgatggctttcg

SEQ ID NO: 35072 - DNA, 20 bp, Artificial Sequence
  Description of Artificial Sequence: Synthetic oligonucleotide
  Target: SCN10A; (+) strand; PAM type: NRG; PAM sequence: CAG
ccgatggctttcgtggtctc

SEQ ID NO: 35073 - DNA, 20 bp, Artificial Sequence
  Description of Artificial Sequence: Synthetic oligonucleotide
  Target: SCN10A; (+) strand; PAM type: NRG; PAM sequence: AGG
cgatggctttcgtggtctcc

SEQ ID NO: 35074 - DNA, 20 bp, Artificial Sequence
  Description of Artificial Sequence: Synthetic oligonucleotide
  Target: SCN10A; (+) strand; PAM type: NRG; PAM sequence: AAG
ggctttcgtggtctccagga

SEQ ID NO: 35075 - DNA, 20 bp, Artificial Sequence
  Description of Artificial Sequence: Synthetic oligonucleotide
  Target: SCN10A; (+) strand; PAM type: NRG; PAM sequence: CAG
tccatcatctgtgactccct

SEQ ID NO: 35076 - DNA, 20 bp, Artificial Sequence
  Description of Artificial Sequence: Synthetic oligonucleotide
  Target: SCN10A; (+) strand; PAM type: NRG; PAM sequence: AGG
ccatcatctgtgactccctc

SEQ ID NO: 35077 - DNA, 20 bp, Artificial Sequence
  Description of Artificial Sequence: Synthetic oligonucleotide
  Target: SCN10A; (+) strand; PAM type: NRG; PAM sequence: GGG
catcatctgtgactccctca

SEQ ID NO: 35078 - DNA, 20 bp, Artificial Sequence
  Description of Artificial Sequence: Synthetic oligonucleotide
  Target: SCN10A; (+) strand; PAM type: NRG; PAM sequence: GAG
tcatctgtgactccctcagg

SEQ ID NO: 35079 - DNA, 20 bp, Artificial Sequence
  Description of Artificial Sequence: Synthetic oligonucleotide
  Target: SCN10A; (+) strand; PAM type: NRG; PAM sequence: GAG
ctgtgactccctcagggagt

SEQ ID NO: 35080 - DNA, 20 bp, Artificial Sequence
  Description of Artificial Sequence: Synthetic oligonucleotide
  Target: SCN10A; (+) strand; PAM type: NRG; PAM sequence: CGG
cctcagggagtgagatatct

SEQ ID NO: 35081 - DNA, 20 bp, Artificial Sequence
  Description of Artificial Sequence: Synthetic oligonucleotide
  Target: SCN10A; (+) strand; PAM type: NRG; PAM sequence: CAG
agggagtgagatatctcggc

SEQ ID NO: 35082 - DNA, 20 bp, Artificial Sequence
  Description of Artificial Sequence: Synthetic oligonucleotide
  Target: SCN10A; (+) strand; PAM type: NRG; PAM sequence: AGG
gggagtgagatatctcggcc

SEQ ID NO: 35083 - DNA, 20 bp, Artificial Sequence
  Description of Artificial Sequence: Synthetic oligonucleotide
  Target: SCN10A; (+) strand; PAM type: NRG; PAM sequence: GGG
ggagtgagatatctcggcca

SEQ ID NO: 35084 - DNA, 20 bp, Artificial Sequence
  Description of Artificial Sequence: Synthetic oligonucleotide
  Target: SCN10A; (+) strand; PAM type: NRG; PAM sequence: GGG
gagtgagatatctcggccag

SEQ ID NO: 35085 - DNA, 20 bp, Artificial Sequence
  Description of Artificial Sequence: Synthetic oligonucleotide
  Target: SCN10A; (+) strand; PAM type: NRG; PAM sequence: CGG
agatatctcggccaggggac

SEQ ID NO: 35086 - DNA, 20 bp, Artificial Sequence
  Description of Artificial Sequence: Synthetic oligonucleotide
  Target: SCN10A; (+) strand; PAM type: NRG; PAM sequence: TGG
ctcggccaggggaccggaaa

SEQ ID NO: 35087 - DNA, 20 bp, Artificial Sequence
  Description of Artificial Sequence: Synthetic oligonucleotide
  Target: SCN10A; (+) strand; PAM type: NRG; PAM sequence: TAG
atggaacacactgccatgac

SEQ ID NO: 35088 - DNA, 20 bp, Artificial Sequence
  Description of Artificial Sequence: Synthetic oligonucleotide
  Target: SCN10A; (+) strand; PAM type: NRG; PAM sequence: CGG
acacactgccatgactagcc

SEQ ID NO: 35089 - DNA, 20 bp, Artificial Sequence
  Description of Artificial Sequence: Synthetic oligonucleotide
  Target: SCN10A; (+) strand; PAM type: NRG; PAM sequence: CAG
atgactagcccggcgttttc

SEQ ID NO: 35090 - DNA, 20 bp, Artificial Sequence
  Description of Artificial Sequence: Synthetic oligonucleotide
  Target: SCN10A; (+) strand; PAM type: NRG; PAM sequence: GAG
gactagcccggcgttttcca

SEQ ID NO: 35091 - DNA, 20 bp, Artificial Sequence
  Description of Artificial Sequence: Synthetic oligonucleotide
  Target: SCN10A; (+) strand; PAM type: NRG; PAM sequence: AGG
actagcccggcgttttccag

SEQ ID NO: 35092 - DNA, 20 bp, Artificial Sequence
  Description of Artificial Sequence: Synthetic oligonucleotide
  Target: SCN10A; (+) strand; PAM type: NRG; PAM sequence: GAG
gcccggcgttttccagaggc

SEQ ID NO: 35093 - DNA, 20 bp, Artificial Sequence
  Description of Artificial Sequence: Synthetic oligonucleotide
  Target: SCN10A; (+) strand; PAM type: NRG; PAM sequence: AGG
cccggcgttttccagaggcg

SEQ ID NO: 35094 - DNA, 20 bp, Artificial Sequence
  Description of Artificial Sequence: Synthetic oligonucleotide
  Target: SCN10A; (+) strand; PAM type: NRG; PAM sequence: TAG
cgttttccagaggcgaggcc

SEQ ID NO: 35095 - DNA, 20 bp, Artificial Sequence
  Description of Artificial Sequence: Synthetic oligonucleotide
  Target: SCN10A; (+) strand; PAM type: NRG; PAM sequence: AAG
tccagaggcgaggcctagaa

SEQ ID NO: 35096 - DNA, 20 bp, Artificial Sequence
  Description of Artificial Sequence: Synthetic oligonucleotide
  Target: SCN10A; (+) strand; PAM type: NRG; PAM sequence: TGG
aggcgaggcctagaaaagac

SEQ ID NO: 35097 - DNA, 20 bp, Artificial Sequence
  Description of Artificial Sequence: Synthetic oligonucleotide
  Target: SCN10A; (+) strand; PAM type: NRG; PAM sequence: GGG
ggcgaggcctagaaaagact

SEQ ID NO: 35098 - DNA, 20 bp, Artificial Sequence
  Description of Artificial Sequence: Synthetic oligonucleotide
  Target: SCN10A; (+) strand; PAM type: NRG; PAM sequence: AAG
aaagactgggcattgcccca

SEQ ID NO: 35099 - DNA, 20 bp, Artificial Sequence
  Description of Artificial Sequence: Synthetic oligonucleotide
  Target: SCN10A; (+) strand; PAM type: NRG; PAM sequence: AGG
aagactgggcattgccccaa

SEQ ID NO: 35100 - DNA, 20 bp, Artificial Sequence
  Description of Artificial Sequence: Synthetic oligonucleotide
  Target: SCN10A; (+) strand; PAM type: NRG; PAM sequence: GAG
gactgggcattgccccaaag

SEQ ID NO: 35101 - DNA, 20 bp, Artificial Sequence
  Description of Artificial Sequence: Synthetic oligonucleotide
  Target: SCN10A; (+) strand; PAM type: NRG; PAM sequence: AAG
gggcattgccccaaaggagc

SEQ ID NO: 35102 - DNA, 20 bp, Artificial Sequence
  Description of Artificial Sequence: Synthetic oligonucleotide
  Target: SCN10A; (+) strand; PAM type: NRG; PAM sequence: AAG
cattgccccaaaggagcaag

SEQ ID NO: 35103 - DNA, 20 bp, Artificial Sequence
  Description of Artificial Sequence: Synthetic oligonucleotide
  Target: SCN10A; (+) strand; PAM type: NRG; PAM sequence: AGG
attgccccaaaggagcaaga

SEQ ID NO: 35104 - DNA, 20 bp, Artificial Sequence
  Description of Artificial Sequence: Synthetic oligonucleotide
  Target: SCN10A; (+) strand; PAM type: NRG; PAM sequence: TGG
ccccaaaggagcaagaaggc

SEQ ID NO: 35105 - DNA, 20 bp, Artificial Sequence
  Description of Artificial Sequence: Synthetic oligonucleotide
  Target: SCN10A; (+) strand; PAM type: NRG; PAM sequence: TGG
ggagcaagaaggctggaaac

SEQ ID NO: 35106 - DNA, 20 bp, Artificial Sequence
  Description of Artificial Sequence: Synthetic oligonucleotide
  Target: SCN10A; (+) strand; PAM type: NRG; PAM sequence: TGG
aaggctggaaactggtcctc

SEQ ID NO: 35107 - DNA, 20 bp, Artificial Sequence
  Description of Artificial Sequence: Synthetic oligonucleotide
  Target: SCN10A; (+) strand; PAM type: NRG; PAM sequence: GGG
aggctggaaactggtcctct

SEQ ID NO: 35108 - DNA, 20 bp, Artificial Sequence
  Description of Artificial Sequence: Synthetic oligonucleotide
  Target: SCN10A; (+) strand; PAM type: NRG; PAM sequence: TAG
aactggtcctctgggaaatc

SEQ ID NO: 35109 - DNA, 20 bp, Artificial Sequence
  Description of Artificial Sequence: Synthetic oligonucleotide
  Target: SCN10A; (+) strand; PAM type: NRG; PAM sequence: GAG
ctggtcctctgggaaatcta

SEQ ID NO: 35110 - DNA, 20 bp, Artificial Sequence
  Description of Artificial Sequence: Synthetic oligonucleotide
  Target: SCN10A; (+) strand; PAM type: NRG; PAM sequence: CAG
cccctgtctttatgaccttt

SEQ ID NO: 35111 - DNA, 20 bp, Artificial Sequence
  Description of Artificial Sequence: Synthetic oligonucleotide
  Target: SCN10A; (+) strand; PAM type: NRG; PAM sequence: AAG
tttatgacctttcagtcact

SEQ ID NO: 35112 - DNA, 20 bp, Artificial Sequence
  Description of Artificial Sequence: Synthetic oligonucleotide
  Target: SCN10A; (+) strand; PAM type: NRG; PAM sequence: AAG
gacctttcagtcactaagta

SEQ ID NO: 35113 - DNA, 20 bp, Artificial Sequence
  Description of Artificial Sequence: Synthetic oligonucleotide
  Target: SCN10A; (+) strand; PAM type: NRG; PAM sequence: AGG
acctttcagtcactaagtaa

SEQ ID NO: 35114 - DNA, 20 bp, Artificial Sequence
  Description of Artificial Sequence: Synthetic oligonucleotide
  Target: SCN10A; (+) strand; PAM type: NRG; PAM sequence: AAG
ctaagtaaaggcacaaatct

SEQ ID NO: 35115 - DNA, 20 bp, Artificial Sequence
  Description of Artificial Sequence: Synthetic oligonucleotide
  Target: SCN10A; (+) strand; PAM type: NRG; PAM sequence: AGG
taagtaaaggcacaaatcta

SEQ ID NO: 35116 - DNA, 20 bp, Artificial Sequence
  Description of Artificial Sequence: Synthetic oligonucleotide
  Target: SCN10A; (+) strand; PAM type: NRG; PAM sequence: GGG
aagtaaaggcacaaatctaa

SEQ ID NO: 35117 - DNA, 20 bp, Artificial Sequence
  Description of Artificial Sequence: Synthetic oligonucleotide
  Target: SCN10A; (+) strand; PAM type: NRG; PAM sequence: GGG
agtaaaggcacaaatctaag

SEQ ID NO: 35118 - DNA, 20 bp, Artificial Sequence
  Description of Artificial Sequence: Synthetic oligonucleotide
  Target: SCN10A; (+) strand; PAM type: NRG; PAM sequence: TAG
cacaaatctaaggggtattc

SEQ ID NO: 35119 - DNA, 20 bp, Artificial Sequence
  Description of Artificial Sequence: Synthetic oligonucleotide
  Target: SCN10A; (+) strand; PAM type: NRG; PAM sequence: AGG
acaaatctaaggggtattct

SEQ ID NO: 35120 - DNA, 20 bp, Artificial Sequence
  Description of Artificial Sequence: Synthetic oligonucleotide
  Target: SCN10A; (+) strand; PAM type: NRG; PAM sequence: TGG
aggggtattctaggtatgca

SEQ ID NO: 35121 - DNA, 20 bp, Artificial Sequence
  Description of Artificial Sequence: Synthetic oligonucleotide
  Target: SCN10A; (+) strand; PAM type: NRG; PAM sequence: TGG
ggtattctaggtatgcatgg

SEQ ID NO: 35122 - DNA, 20 bp, Artificial Sequence
  Description of Artificial Sequence: Synthetic oligonucleotide
  Target: SCN10A; (+) strand; PAM type: NRG; PAM sequence: GGG
gtattctaggtatgcatggt

SEQ ID NO: 35123 - DNA, 20 bp, Artificial Sequence
  Description of Artificial Sequence: Synthetic oligonucleotide
  Target: SCN10A; (+) strand; PAM type: NRG; PAM sequence: GGG
tattctaggtatgcatggtg

SEQ ID NO: 35124 - DNA, 20 bp, Artificial Sequence
  Description of Artificial Sequence: Synthetic oligonucleotide
  Target: SCN10A; (+) strand; PAM type: NRG; PAM sequence: AAG
aggtatgcatggtggggaaa

SEQ ID NO: 35125 - DNA, 20 bp, Artificial Sequence
  Description of Artificial Sequence: Synthetic oligonucleotide
  Target: SCN10A; (+) strand; PAM type: NRG; PAM sequence: AAG
catggtggggaaaaagaaaa

SEQ ID NO: 35126 - DNA, 20 bp, Artificial Sequence
  Description of Artificial Sequence: Synthetic oligonucleotide
  Target: SCN10A; (+) strand; PAM type: NRG; PAM sequence: AGG
atggtggggaaaaagaaaaa

SEQ ID NO: 35127 - DNA, 20 bp, Artificial Sequence
  Description of Artificial Sequence: Synthetic oligonucleotide
  Target: SCN10A; (+) strand; PAM type: NRG; PAM sequence: GAG
ggtggggaaaaagaaaaaag

SEQ ID NO: 35128 - DNA, 20 bp, Artificial Sequence
  Description of Artificial Sequence: Synthetic oligonucleotide
  Target: SCN10A; (+) strand; PAM type: NRG; PAM sequence: TAG
aaaaagaaaaaaggagactc

SEQ ID NO: 35129 - DNA, 20 bp, Artificial Sequence
  Description of Artificial Sequence: Synthetic oligonucleotide
  Target: SCN10A; (+) strand; PAM type: NRG; PAM sequence: TAG
agaaaaaaggagactctaga

SEQ ID NO: 35130 - DNA, 20 bp, Artificial Sequence
  Description of Artificial Sequence: Synthetic oligonucleotide
  Target: SCN10A; (+) strand; PAM type: NRG; PAM sequence: CGG
aggagactctagatagactc

SEQ ID NO: 35131 - DNA, 20 bp, Artificial Sequence
  Description of Artificial Sequence: Synthetic oligonucleotide
  Target: SCN10A; (+) strand; PAM type: NRG; PAM sequence: GGG
ggagactctagatagactcc

SEQ ID NO: 35132 - DNA, 20 bp, Artificial Sequence
  Description of Artificial Sequence: Synthetic oligonucleotide
  Target: SCN10A; (+) strand; PAM type: NRG; PAM sequence: AAG
actctagatagactccggga

SEQ ID NO: 35133 - DNA, 20 bp, Artificial Sequence
  Description of Artificial Sequence: Synthetic oligonucleotide
  Target: SCN10A; (+) strand; PAM type: NRG; PAM sequence: CAG
agatagactccgggaaagac

SEQ ID NO: 35134 - DNA, 20 bp, Artificial Sequence
  Description of Artificial Sequence: Synthetic oligonucleotide
  Target: SCN10A; (+) strand; PAM type: NRG; PAM sequence: AGG
gatagactccgggaaagacc

SEQ ID NO: 35135 - DNA, 20 bp, Artificial Sequence
  Description of Artificial Sequence: Synthetic oligonucleotide
  Target: SCN10A; (+) strand; PAM type: NRG; PAM sequence: GAG
tagactccgggaaagaccag

SEQ ID NO: 35136 - DNA, 20 bp, Artificial Sequence
  Description of Artificial Sequence: Synthetic oligonucleotide
  Target: SCN10A; (+) strand; PAM type: NRG; PAM sequence: GAG
gactccgggaaagaccagga

SEQ ID NO: 35137 - DNA, 20 bp, Artificial Sequence
  Description of Artificial Sequence: Synthetic oligonucleotide
  Target: SCN10A; (+) strand; PAM type: NRG; PAM sequence: GAG
ctccgggaaagaccaggaga

SEQ ID NO: 35138 - DNA, 20 bp, Artificial Sequence
  Description of Artificial Sequence: Synthetic oligonucleotide
  Target: SCN10A; (+) strand; PAM type: NRG; PAM sequence: AGG
tccgggaaagaccaggagag

SEQ ID NO: 35139 - DNA, 20 bp, Artificial Sequence
  Description of Artificial Sequence: Synthetic oligonucleotide
  Target: SCN10A; (+) strand; PAM type: NRG; PAM sequence: GAG
cgggaaagaccaggagagag

SEQ ID NO: 35140 - DNA, 20 bp, Artificial Sequence
  Description of Artificial Sequence: Synthetic oligonucleotide
  Target: SCN10A; (+) strand; PAM type: NRG; PAM sequence: GAG
ggaaagaccaggagagagga

SEQ ID NO: 35141 - DNA, 20 bp, Artificial Sequence
  Description of Artificial Sequence: Synthetic oligonucleotide
  Target: SCN10A; (+) strand; PAM type: NRG; PAM sequence: CAG
ccaggagagaggagagatta

SEQ ID NO: 35142 - DNA, 20 bp, Artificial Sequence
  Description of Artificial Sequence: Synthetic oligonucleotide
  Target: SCN10A; (+) strand; PAM type: NRG; PAM sequence: CAG
gattacagcgtgctgatgct

SEQ ID NO: 35143 - DNA, 20 bp, Artificial Sequence
  Description of Artificial Sequence: Synthetic oligonucleotide
  Target: SCN10A; (+) strand; PAM type: NRG; PAM sequence: TAG
gcgtgctgatgctcagcaaa

SEQ ID NO: 35144 - DNA, 20 bp, Artificial Sequence
  Description of Artificial Sequence: Synthetic oligonucleotide
  Target: SCN10A; (+) strand; PAM type: NRG; PAM sequence: AGG
cgtgctgatgctcagcaaat

SEQ ID NO: 35145 - DNA, 20 bp, Artificial Sequence
  Description of Artificial Sequence: Synthetic oligonucleotide
  Target: SCN10A; (+) strand; PAM type: NRG; PAM sequence: TGG
gctcagcaaataggttatca

SEQ ID NO: 35146 - DNA, 20 bp, Artificial Sequence
  Description of Artificial Sequence: Synthetic oligonucleotide
  Target: SCN10A; (+) strand; PAM type: NRG; PAM sequence: CAG
agcaaataggttatcatggt

SEQ ID NO: 35147 - DNA, 20 bp, Artificial Sequence
  Description of Artificial Sequence: Synthetic oligonucleotide
  Target: SCN10A; (+) strand; PAM type: NRG; PAM sequence: AGG
gcaaataggttatcatggtc

SEQ ID NO: 35148 - DNA, 20 bp, Artificial Sequence
  Description of Artificial Sequence: Synthetic oligonucleotide
  Target: SCN10A; (+) strand; PAM type: NRG; PAM sequence: CAG
tatcatggtcaggaacatgt

SEQ ID NO: 35149 - DNA, 20 bp, Artificial Sequence
  Description of Artificial Sequence: Synthetic oligonucleotide
  Target: SCN10A; (+) strand; PAM type: NRG; PAM sequence: GAG
tcatggtcaggaacatgtca

SEQ ID NO: 35150 - DNA, 20 bp, Artificial Sequence
  Description of Artificial Sequence: Synthetic oligonucleotide
  Target: SCN10A; (+) strand; PAM type: NRG; PAM sequence: AGG
catggtcaggaacatgtcag

SEQ ID NO: 35151 - DNA, 20 bp, Artificial Sequence
  Description of Artificial Sequence: Synthetic oligonucleotide
  Target: SCN10A; (+) strand; PAM type: NRG; PAM sequence: TGG
tcagaggaaaccttgtcacc

SEQ ID NO: 35152 - DNA, 20 bp, Artificial Sequence
  Description of Artificial Sequence: Synthetic oligonucleotide
  Target: SCN10A; (+) strand; PAM type: NRG; PAM sequence: TAG
aggaaaccttgtcacctgga

SEQ ID NO: 35153 - DNA, 20 bp, Artificial Sequence
  Description of Artificial Sequence: Synthetic oligonucleotide
  Target: SCN10A; (+) strand; PAM type: NRG; PAM sequence: CAG
accttgtcacctggatagtt

SEQ ID NO: 35154 - DNA, 20 bp, Artificial Sequence
  Description of Artificial Sequence: Synthetic oligonucleotide
  Target: SCN10A; (+) strand; PAM type: NRG; PAM sequence: TGG
ttcagttgattgccaacctt

SEQ ID NO: 35155 - DNA, 20 bp, Artificial Sequence
  Description of Artificial Sequence: Synthetic oligonucleotide
  Target: SCN10A; (+) strand; PAM type: NRG; PAM sequence: CAG
tgattgccaacctttggcca

SEQ ID NO: 35156 - DNA, 20 bp, Artificial Sequence
  Description of Artificial Sequence: Synthetic oligonucleotide
  Target: SCN10A; (+) strand; PAM type: NRG; PAM sequence: AGG
gattgccaacctttggccac

SEQ ID NO: 35157 - DNA, 20 bp, Artificial Sequence
  Description of Artificial Sequence: Synthetic oligonucleotide
  Target: SCN10A; (+) strand; PAM type: NRG; PAM sequence: GGG
attgccaacctttggccaca

SEQ ID NO: 35158 - DNA, 20 bp, Artificial Sequence
  Description of Artificial Sequence: Synthetic oligonucleotide
  Target: SCN10A; (+) strand; PAM type: NRG; PAM sequence: TAG
ccaacctttggccacagggc

SEQ ID NO: 35159 - DNA, 20 bp, Artificial Sequence
  Description of Artificial Sequence: Synthetic oligonucleotide
  Target: SCN10A; (+) strand; PAM type: NRG; PAM sequence: AAG
tttggccacagggctagaca

SEQ ID NO: 35160 - DNA, 20 bp, Artificial Sequence
  Description of Artificial Sequence: Synthetic oligonucleotide
  Target: SCN10A; (+) strand; PAM type: NRG; PAM sequence: AAG
gggctagacaaagctgtcct

SEQ ID NO: 35161 - DNA, 20 bp, Artificial Sequence
  Description of Artificial Sequence: Synthetic oligonucleotide
  Target: SCN10A; (+) strand; PAM type: NRG; PAM sequence: AAG
agttcacttttccacatgca

SEQ ID NO: 35162 - DNA, 20 bp, Artificial Sequence
  Description of Artificial Sequence: Synthetic oligonucleotide
  Target: SCN10A; (+) strand; PAM type: NRG; PAM sequence: AAG
cacatgcaaagttgtgacct

SEQ ID NO: 35163 - DNA, 20 bp, Artificial Sequence
  Description of Artificial Sequence: Synthetic oligonucleotide
  Target: SCN10A; (+) strand; PAM type: NRG; PAM sequence: AGG
acatgcaaagttgtgaccta

SEQ ID NO: 35164 - DNA, 20 bp, Artificial Sequence
  Description of Artificial Sequence: Synthetic oligonucleotide
  Target: SCN10A; (+) strand; PAM type: NRG; PAM sequence: GAG
atgcaaagttgtgacctaag

SEQ ID NO: 35165 - DNA, 20 bp, Artificial Sequence
  Description of Artificial Sequence: Synthetic oligonucleotide
  Target: SCN10A; (+) strand; PAM type: NRG; PAM sequence: AGG
tgcaaagttgtgacctaagg

SEQ ID NO: 35166 - DNA, 20 bp, Artificial Sequence
  Description of Artificial Sequence: Synthetic oligonucleotide
  Target: SCN10A; (+) strand; PAM type: NRG; PAM sequence: CAG
aaggaggctactatgcacac

SEQ ID NO: 35167 - DNA, 20 bp, Artificial Sequence
  Description of Artificial Sequence: Synthetic oligonucleotide
  Target: SCN10A; (+) strand; PAM type: NRG; PAM sequence: TGG
gctactatgcacaccagtac

SEQ ID NO: 35168 - DNA, 20 bp, Artificial Sequence
  Description of Artificial Sequence: Synthetic oligonucleotide
  Target: SCN10A; (+) strand; PAM type: NRG; PAM sequence: TGG
caccagtactggaacatact

SEQ ID NO: 35169 - DNA, 20 bp, Artificial Sequence
  Description of Artificial Sequence: Synthetic oligonucleotide
  Target: SCN10A; (+) strand; PAM type: NRG; PAM sequence: AAG
agtactggaacatacttggt

SEQ ID NO: 35170 - DNA, 20 bp, Artificial Sequence
  Description of Artificial Sequence: Synthetic oligonucleotide
  Target: SCN10A; (+) strand; PAM type: NRG; PAM sequence: TGG
actggaacatacttggtaag

SEQ ID NO: 35171 - DNA, 20 bp, Artificial Sequence
  Description of Artificial Sequence: Synthetic oligonucleotide
  Target: SCN10A; (+) strand; PAM type: NRG; PAM sequence: AAG
taagtggttgttgaatgaat

SEQ ID NO: 35172 - DNA, 20 bp, Artificial Sequence
  Description of Artificial Sequence: Synthetic oligonucleotide
  Target: SCN10A; (+) strand; PAM type: NRG; PAM sequence: TAG
gcacttcattgtctgaaaat

SEQ ID NO: 35173 - DNA, 20 bp, Artificial Sequence
  Description of Artificial Sequence: Synthetic oligonucleotide
  Target: SCN10A; (+) strand; PAM type: NRG; PAM sequence: AGG
cacttcattgtctgaaaatt

SEQ ID NO: 35174 - DNA, 20 bp, Artificial Sequence
  Description of Artificial Sequence: Synthetic oligonucleotide
  Target: SCN10A; (+) strand; PAM type: NRG; PAM sequence: TAG
ttcattgtctgaaaattagg

SEQ ID NO: 35175 - DNA, 20 bp, Artificial Sequence
  Description of Artificial Sequence: Synthetic oligonucleotide
  Target: SCN10A; (+) strand; PAM type: NRG; PAM sequence: TAG
aattaggtagtacaattcat

SEQ ID NO: 35176 - DNA, 20 bp, Artificial Sequence
  Description of Artificial Sequence: Synthetic oligonucleotide
  Target: SCN10A; (+) strand; PAM type: NRG; PAM sequence: GAG
gatcccatctgtatgaatgt

SEQ ID NO: 35177 - DNA, 20 bp, Artificial Sequence
  Description of Artificial Sequence: Synthetic oligonucleotide
  Target: SCN10A; (+) strand; PAM type: NRG; PAM sequence: GAG
tcccatctgtatgaatgtga

SEQ ID NO: 35178 - DNA, 20 bp, Artificial Sequence
  Description of Artificial Sequence: Synthetic oligonucleotide
  Target: SCN10A; (+) strand; PAM type: NRG; PAM sequence: AAG
atgtgagagtttgtgttgca

SEQ ID NO: 35179 - DNA, 20 bp, Artificial Sequence
  Description of Artificial Sequence: Synthetic oligonucleotide
  Target: SCN10A; (+) strand; PAM type: NRG; PAM sequence: AGG
tgtgagagtttgtgttgcaa

SEQ ID NO: 35180 - DNA, 20 bp, Artificial Sequence
  Description of Artificial Sequence: Synthetic oligonucleotide
  Target: SCN10A; (+) strand; PAM type: NRG; PAM sequence: GAG
tgagagtttgtgttgcaaag

SEQ ID NO: 35181 - DNA, 20 bp, Artificial Sequence
  Description of Artificial Sequence: Synthetic oligonucleotide
  Target: SCN10A; (+) strand; PAM type: NRG; PAM sequence: AGG
gagagtttgtgttgcaaagg

SEQ ID NO: 35182 - DNA, 20 bp, Artificial Sequence
  Description of Artificial Sequence: Synthetic oligonucleotide
  Target: SCN10A; (+) strand; PAM type: NRG; PAM sequence: GAG
gagtttgtgttgcaaaggag

SEQ ID NO: 35183 - DNA, 20 bp, Artificial Sequence
  Description of Artificial Sequence: Synthetic oligonucleotide
  Target: SCN10A; (+) strand; PAM type: NRG; PAM sequence: AAG
tgtgttgcaaaggaggagac

SEQ ID NO: 35184 - DNA, 20 bp, Artificial Sequence
  Description of Artificial Sequence: Synthetic oligonucleotide
  Target: SCN10A; (+) strand; PAM type: NRG; PAM sequence: GAG
tgttgcaaaggaggagacaa

SEQ ID NO: 35185 - DNA, 20 bp, Artificial Sequence
  Description of Artificial Sequence: Synthetic oligonucleotide
  Target: SCN10A; (+) strand; PAM type: NRG; PAM sequence: CAG
aggaggagacaagagctgta

SEQ ID NO: 35186 - DNA, 20 bp, Artificial Sequence
  Description of Artificial Sequence: Synthetic oligonucleotide
  Target: SCN10A; (+) strand; PAM type: NRG; PAM sequence: GAG
caagagctgtacagtgcaat

SEQ ID NO: 35187 - DNA, 20 bp, Artificial Sequence
  Description of Artificial Sequence: Synthetic oligonucleotide
  Target: SCN10A; (+) strand; PAM type: NRG; PAM sequence: TAG
tgtacagtgcaatgagtttc

SEQ ID NO: 35188 - DNA, 20 bp, Artificial Sequence
  Description of Artificial Sequence: Synthetic oligonucleotide
  Target: SCN10A; (+) strand; PAM type: NRG; PAM sequence: AGG
gtacagtgcaatgagtttct

SEQ ID NO: 35189 - DNA, 20 bp, Artificial Sequence
  Description of Artificial Sequence: Synthetic oligonucleotide
  Target: SCN10A; (+) strand; PAM type: NRG; PAM sequence: GAG
atgagtttctaggatccctc

SEQ ID NO: 35190 - DNA, 20 bp, Artificial Sequence
  Description of Artificial Sequence: Synthetic oligonucleotide
  Target: SCN10A; (+) strand; PAM type: NRG; PAM sequence: AGG
tgagtttctaggatccctcg

SEQ ID NO: 35191 - DNA, 20 bp, Artificial Sequence
  Description of Artificial Sequence: Synthetic oligonucleotide
  Target: SCN10A; (+) strand; PAM type: NRG; PAM sequence: CAG
aggatccctcgaggcttgaa

SEQ ID NO: 35192 - DNA, 20 bp, Artificial Sequence
  Description of Artificial Sequence: Synthetic oligonucleotide
  Target: SCN10A; (+) strand; PAM type: NRG; PAM sequence: TGG
gaggcttgaacagtcaacaa

SEQ ID NO: 35193 - DNA, 20 bp, Artificial Sequence
  Description of Artificial Sequence: Synthetic oligonucleotide
  Target: SCN10A; (+) strand; PAM type: NRG; PAM sequence: GAG
ggcttgaacagtcaacaatg

SEQ ID NO: 35194 - DNA, 20 bp, Artificial Sequence
  Description of Artificial Sequence: Synthetic oligonucleotide
  Target: SCN10A; (+) strand; PAM type: NRG; PAM sequence: GAG
cttgaacagtcaacaatgga

SEQ ID NO: 35195 - DNA, 20 bp, Artificial Sequence
  Description of Artificial Sequence: Synthetic oligonucleotide
  Target: SCN10A; (+) strand; PAM type: NRG; PAM sequence: AAG
agtcaacaatggagagactg

SEQ ID NO: 35196 - DNA, 20 bp, Artificial Sequence
  Description of Artificial Sequence: Synthetic oligonucleotide
  Target: SCN10A; (+) strand; PAM type: NRG; PAM sequence: AGG
gtcaacaatggagagactga

SEQ ID NO: 35197 - DNA, 20 bp, Artificial Sequence
  Description of Artificial Sequence: Synthetic oligonucleotide
  Target: SCN10A; (+) strand; PAM type: NRG; PAM sequence: AAG
aacaatggagagactgaagg

SEQ ID NO: 35198 - DNA, 20 bp, Artificial Sequence
  Description of Artificial Sequence: Synthetic oligonucleotide
  Target: SCN10A; (+) strand; PAM type: NRG; PAM sequence: AGG
acaatggagagactgaagga

SEQ ID NO: 35199 - DNA, 20 bp, Artificial Sequence
  Description of Artificial Sequence: Synthetic oligonucleotide
  Target: SCN10A; (+) strand; PAM type: NRG; PAM sequence: GGG
caatggagagactgaaggaa

SEQ ID NO: 35200 - DNA, 20 bp, Artificial Sequence
  Description of Artificial Sequence: Synthetic oligonucleotide
  Target: SCN10A; (+) strand; PAM type: NRG; PAM sequence: CAG
agagactgaaggaagggttg

SEQ ID NO: 35201 - DNA, 20 bp, Artificial Sequence
  Description of Artificial Sequence: Synthetic oligonucleotide
  Target: SCN10A; (+) strand; PAM type: NRG; PAM sequence: TGG
agggttgcagcctaatttcc

SEQ ID NO: 35202 - DNA, 20 bp, Artificial Sequence
  Description of Artificial Sequence: Synthetic oligonucleotide
  Target: SCN10A; (+) strand; PAM type: NRG; PAM sequence: AAG
gttgcagcctaatttcctgg

SEQ ID NO: 35203 - DNA, 20 bp, Artificial Sequence
  Description of Artificial Sequence: Synthetic oligonucleotide
  Target: SCN10A; (+) strand; PAM type: NRG; PAM sequence: GAG
tcccatcaaaatcttccatt

SEQ ID NO: 35204 - DNA, 20 bp, Artificial Sequence
  Description of Artificial Sequence: Synthetic oligonucleotide
  Target: SCN10A; (+) strand; PAM type: NRG; PAM sequence: AGG
cccatcaaaatcttccattg

SEQ ID NO: 35205 - DNA, 20 bp, Artificial Sequence
  Description of Artificial Sequence: Synthetic oligonucleotide
  Target: SCN10A; (+) strand; PAM type: NRG; PAM sequence: GGG
ccatcaaaatcttccattga

SEQ ID NO: 35206 - DNA, 20 bp, Artificial Sequence
  Description of Artificial Sequence: Synthetic oligonucleotide
  Target: SCN10A; (+) strand; PAM type: NRG; PAM sequence: TGG
cttccattgagggaactgtg

SEQ ID NO: 35207 - DNA, 20 bp, Artificial Sequence
  Description of Artificial Sequence: Synthetic oligonucleotide
  Target: SCN10A; (+) strand; PAM type: NRG; PAM sequence: AAG
tgagggaactgtgtggctta

SEQ ID NO: 35208 - DNA, 20 bp, Artificial Sequence
  Description of Artificial Sequence: Synthetic oligonucleotide
  Target: SCN10A; (+) strand; PAM type: NRG; PAM sequence: CAG
actgtgtggcttaaagttgc

SEQ ID NO: 35209 - DNA, 20 bp, Artificial Sequence
  Description of Artificial Sequence: Synthetic oligonucleotide
  Target: SCN10A; (+) strand; PAM type: NRG; PAM sequence: GAG
tgtgtggcttaaagttgcca

SEQ ID NO: 35210 - DNA, 20 bp, Artificial Sequence
  Description of Artificial Sequence: Synthetic oligonucleotide
  Target: SCN10A; (+) strand; PAM type: NRG; PAM sequence: AAG
ggcttaaagttgccagagaa

SEQ ID NO: 35211 - DNA, 20 bp, Artificial Sequence
  Description of Artificial Sequence: Synthetic oligonucleotide
  Target: SCN10A; (+) strand; PAM type: NRG; PAM sequence: GAG
cttaaagttgccagagaaaa

SEQ ID NO: 35212 - DNA, 20 bp, Artificial Sequence
  Description of Artificial Sequence: Synthetic oligonucleotide
  Target: SCN10A; (+) strand; PAM type: NRG; PAM sequence: CAG
aaagagctaattcataaacc

SEQ ID NO: 35213 - DNA, 20 bp, Artificial Sequence
  Description of Artificial Sequence: Synthetic oligonucleotide
  Target: SCN10A; (+) strand; PAM type: NRG; PAM sequence: GAG
agagctaattcataaaccca

SEQ ID NO: 35214 - DNA, 20 bp, Artificial Sequence
  Description of Artificial Sequence: Synthetic oligonucleotide
  Target: SCN10A; (+) strand; PAM type: NRG; PAM sequence: CAG
attcataaacccagagccct

SEQ ID NO: 35215 - DNA, 20 bp, Artificial Sequence
  Description of Artificial Sequence: Synthetic oligonucleotide
  Target: SCN10A; (+) strand; PAM type: NRG; PAM sequence: GAG
tcataaacccagagccctca

SEQ ID NO: 35216 - DNA, 20 bp, Artificial Sequence
  Description of Artificial Sequence: Synthetic oligonucleotide
  Target: SCN10A; (+) strand; PAM type: NRG; PAM sequence: TAG
acccagagccctcagagaat

SEQ ID NO: 35217 - DNA, 20 bp, Artificial Sequence
  Description of Artificial Sequence: Synthetic oligonucleotide
  Target: SCN10A; (+) strand; PAM type: NRG; PAM sequence: TGG
ccctcagagaattagtgtgc

SEQ ID NO: 35218 - DNA, 20 bp, Artificial Sequence
  Description of Artificial Sequence: Synthetic oligonucleotide
  Target: SCN10A; (+) strand; PAM type: NRG; PAM sequence: GGG
cctcagagaattagtgtgct

SEQ ID NO: 35219 - DNA, 20 bp, Artificial Sequence
  Description of Artificial Sequence: Synthetic oligonucleotide
  Target: SCN10A; (+) strand; PAM type: NRG; PAM sequence: TAG
agagaattagtgtgctgggt

SEQ ID NO: 35220 - DNA, 20 bp, Artificial Sequence
  Description of Artificial Sequence: Synthetic oligonucleotide
  Target: SCN10A; (+) strand; PAM type: NRG; PAM sequence: AGG
gagaattagtgtgctgggtt

SEQ ID NO: 35221 - DNA, 20 bp, Artificial Sequence
  Description of Artificial Sequence: Synthetic oligonucleotide
  Target: SCN10A; (+) strand; PAM type: NRG; PAM sequence: TAG
aattagtgtgctgggttagg

SEQ ID NO: 35222 - DNA, 20 bp, Artificial Sequence
  Description of Artificial Sequence: Synthetic oligonucleotide
  Target: SCN10A; (+) strand; PAM type: NRG; PAM sequence: TAG
ttaggtagttcccatgacca

SEQ ID NO: 35223 - DNA, 20 bp, Artificial Sequence
  Description of Artificial Sequence: Synthetic oligonucleotide
  Target: SCN10A; (+) strand; PAM type: NRG; PAM sequence: CAG
taaaccatcatttgtgtcct

SEQ ID NO: 35224 - DNA, 20 bp, Artificial Sequence
  Description of Artificial Sequence: Synthetic oligonucleotide
  Target: SCN10A; (+) strand; PAM type: NRG; PAM sequence: AGG
aaaccatcatttgtgtcctc

SEQ ID NO: 35225 - DNA, 20 bp, Artificial Sequence
  Description of Artificial Sequence: Synthetic oligonucleotide
  Target: SCN10A; (+) strand; PAM type: NRG; PAM sequence: TGG
ccatcatttgtgtcctcagg

SEQ ID NO: 35226 - DNA, 20 bp, Artificial Sequence
  Description of Artificial Sequence: Synthetic oligonucleotide
  Target: SCN10A; (+) strand; PAM type: NRG; PAM sequence: TAG
ttgtgtcctcaggtggtcta

SEQ ID NO: 35227 - DNA, 20 bp, Artificial Sequence
  Description of Artificial Sequence: Synthetic oligonucleotide
  Target: SCN10A; (+) strand; PAM type: NRG; PAM sequence: AAG
cttaactcctttttattact

SEQ ID NO: 35228 - DNA, 20 bp, Artificial Sequence
  Description of Artificial Sequence: Synthetic oligonucleotide
  Target: SCN10A; (+) strand; PAM type: NRG; PAM sequence: AAG
tttttattactaagctacta

SEQ ID NO: 35229 - DNA, 20 bp, Artificial Sequence
  Description of Artificial Sequence: Synthetic oligonucleotide
  Target: SCN10A; (+) strand; PAM type: NRG; PAM sequence: TGG
ttattactaagctactaaag

SEQ ID NO: 35230 - DNA, 20 bp, Artificial Sequence
  Description of Artificial Sequence: Synthetic oligonucleotide
  Target: SCN10A; (+) strand; PAM type: NRG; PAM sequence: GAG
attactaagctactaaagtg

SEQ ID NO: 35231 - DNA, 20 bp, Artificial Sequence
  Description of Artificial Sequence: Synthetic oligonucleotide
  Target: SCN10A; (+) strand; PAM type: NRG; PAM sequence: TGG
aagtggagaatcttgccaat

SEQ ID NO: 35232 - DNA, 20 bp, Artificial Sequence
  Description of Artificial Sequence: Synthetic oligonucleotide
  Target: SCN10A; (+) strand; PAM type: NRG; PAM sequence: GGG
agtggagaatcttgccaatt

SEQ ID NO: 35233 - DNA, 20 bp, Artificial Sequence
  Description of Artificial Sequence: Synthetic oligonucleotide
  Target: SCN10A; (+) strand; PAM type: NRG; PAM sequence: GGG
gtggagaatcttgccaattg

SEQ ID NO: 35234 - DNA, 20 bp, Artificial Sequence
  Description of Artificial Sequence: Synthetic oligonucleotide
  Target: SCN10A; (+) strand; PAM type: NRG; PAM sequence: CAG
ttactaatccccttatctca

SEQ ID NO: 35235 - DNA, 20 bp, Artificial Sequence
  Description of Artificial Sequence: Synthetic oligonucleotide
  Target: SCN10A; (+) strand; PAM type: NRG; PAM sequence: AAG
ccccttatctcacagaactg

SEQ ID NO: 35236 - DNA, 20 bp, Artificial Sequence
  Description of Artificial Sequence: Synthetic oligonucleotide
  Target: SCN10A; (+) strand; PAM type: NRG; PAM sequence: AAG
tttcctctcttgataatttg

SEQ ID NO: 35237 - DNA, 20 bp, Artificial Sequence
  Description of Artificial Sequence: Synthetic oligonucleotide
  Target: SCN10A; (+) strand; PAM type: NRG; PAM sequence: TAG
atttgaagcctgatcctgtt

SEQ ID NO: 35238 - DNA, 20 bp, Artificial Sequence
  Description of Artificial Sequence: Synthetic oligonucleotide
  Target: SCN10A; (+) strand; PAM type: NRG; PAM sequence: AAG
tgtttagcaaccattattaa

SEQ ID NO: 35239 - DNA, 20 bp, Artificial Sequence
  Description of Artificial Sequence: Synthetic oligonucleotide
  Target: SCN10A; (+) strand; PAM type: NRG; PAM sequence: CAG
agcaaccattattaaaagct

SEQ ID NO: 35240 - DNA, 20 bp, Artificial Sequence
  Description of Artificial Sequence: Synthetic oligonucleotide
  Target: SCN10A; (+) strand; PAM type: NRG; PAM sequence: TAG
taaaagctcagtattataaa

SEQ ID NO: 35241 - DNA, 20 bp, Artificial Sequence
  Description of Artificial Sequence: Synthetic oligonucleotide
  Target: SCN10A; (+) strand; PAM type: NRG; PAM sequence: GAG
aaagctcagtattataaata

SEQ ID NO: 35242 - DNA, 20 bp, Artificial Sequence
  Description of Artificial Sequence: Synthetic oligonucleotide
  Target: SCN10A; (+) strand; PAM type: NRG; PAM sequence: AAG
tctgcctgtaatacatgccc

SEQ ID NO: 35243 - DNA, 20 bp, Artificial Sequence
  Description of Artificial Sequence: Synthetic oligonucleotide
  Target: SCN10A; (+) strand; PAM type: NRG; PAM sequence: AGG
ctgcctgtaatacatgccca

SEQ ID NO: 35244 - DNA, 20 bp, Artificial Sequence
  Description of Artificial Sequence: Synthetic oligonucleotide
  Target: SCN10A; (+) strand; PAM type: NRG; PAM sequence: TAG
taatacatgcccaaggacta

SEQ ID NO: 35245 - DNA, 20 bp, Artificial Sequence
  Description of Artificial Sequence: Synthetic oligonucleotide
  Target: SCN10A; (+) strand; PAM type: NRG; PAM sequence: AAG
aaaaatccttccaatttttg

SEQ ID NO: 35246 - DNA, 20 bp, Artificial Sequence
  Description of Artificial Sequence: Synthetic oligonucleotide
  Target: SCN10A; (+) strand; PAM type: NRG; PAM sequence: GAG
ttccaatttttgaagcaaat

SEQ ID NO: 35247 - DNA, 20 bp, Artificial Sequence
  Description of Artificial Sequence: Synthetic oligonucleotide
  Target: SCN10A; (+) strand; PAM type: NRG; PAM sequence: AAG
aaaattgacacatccatatt

SEQ ID NO: 35248 - DNA, 20 bp, Artificial Sequence
  Description of Artificial Sequence: Synthetic oligonucleotide
  Target: SCN10A; (+) strand; PAM type: NRG; PAM sequence: AGG
aaattgacacatccatatta

SEQ ID NO: 35249 - DNA, 20 bp, Artificial Sequence
  Description of Artificial Sequence: Synthetic oligonucleotide
  Target: SCN10A; (+) strand; PAM type: NRG; PAM sequence: AAG
ttgacacatccatattaagg

SEQ ID NO: 35250 - DNA, 20 bp, Artificial Sequence
  Description of Artificial Sequence: Synthetic oligonucleotide
  Target: SCN10A; (+) strand; PAM type: NRG; PAM sequence: AGG
tgacacatccatattaagga

SEQ ID NO: 35251 - DNA, 20 bp, Artificial Sequence
  Description of Artificial Sequence: Synthetic oligonucleotide
  Target: SCN10A; (+) strand; PAM type: NRG; PAM sequence: GGG
gacacatccatattaaggaa

SEQ ID NO: 35252 - DNA, 20 bp, Artificial Sequence
  Description of Artificial Sequence: Synthetic oligonucleotide
  Target: SCN10A; (+) strand; PAM type: NRG; PAM sequence: GAG
atactacattatttgcactt

SEQ ID NO: 35253 - DNA, 20 bp, Artificial Sequence
  Description of Artificial Sequence: Synthetic oligonucleotide
  Target: SCN10A; (+) strand; PAM type: NRG; PAM sequence: AAG
attatttgcacttgagcacc

SEQ ID NO: 35254 - DNA, 20 bp, Artificial Sequence
  Description of Artificial Sequence: Synthetic oligonucleotide
  Target: SCN10A; (+) strand; PAM type: NRG; PAM sequence: AAG
gagcaccaagcaaaccaatg

SEQ ID NO: 35255 - DNA, 20 bp, Artificial Sequence
  Description of Artificial Sequence: Synthetic oligonucleotide
  Target: SCN10A; (+) strand; PAM type: NRG; PAM sequence: GAG
agcaaaccaatgaagaaact

SEQ ID NO: 35256 - DNA, 20 bp, Artificial Sequence
  Description of Artificial Sequence: Synthetic oligonucleotide
  Target: SCN10A; (+) strand; PAM type: NRG; PAM sequence: AAG
aaaccaatgaagaaactgag

SEQ ID NO: 35257 - DNA, 20 bp, Artificial Sequence
  Description of Artificial Sequence: Synthetic oligonucleotide
  Target: SCN10A; (+) strand; PAM type: NRG; PAM sequence: TGG
agaaactgagaagaaaattt

SEQ ID NO: 35258 - DNA, 20 bp, Artificial Sequence
  Description of Artificial Sequence: Synthetic oligonucleotide
  Target: SCN10A; (+) strand; PAM type: NRG; PAM sequence: CAG
aattttggttgcatatttga

SEQ ID NO: 35259 - DNA, 20 bp, Artificial Sequence
  Description of Artificial Sequence: Synthetic oligonucleotide
  Target: SCN10A; (+) strand; PAM type: NRG; PAM sequence: CAG
tttggttgcatatttgacag

SEQ ID NO: 35260 - DNA, 20 bp, Artificial Sequence
  Description of Artificial Sequence: Synthetic oligonucleotide
  Target: SCN10A; (+) strand; PAM type: NRG; PAM sequence: TGG
atttgacagcagtgtctcct

SEQ ID NO: 35261 - DNA, 20 bp, Artificial Sequence
  Description of Artificial Sequence: Synthetic oligonucleotide
  Target: SCN10A; (+) strand; PAM type: NRG; PAM sequence: GAG
agcagtgtctccttggccac

SEQ ID NO: 35262 - DNA, 20 bp, Artificial Sequence
  Description of Artificial Sequence: Synthetic oligonucleotide
  Target: SCN10A; (+) strand; PAM type: NRG; PAM sequence: TAG
tccttggccacgagttattt

SEQ ID NO: 35263 - DNA, 20 bp, Artificial Sequence
  Description of Artificial Sequence: Synthetic oligonucleotide
  Target: SCN10A; (+) strand; PAM type: NRG; PAM sequence: AAG
ccacgagttattttagaatt

SEQ ID NO: 35264 - DNA, 20 bp, Artificial Sequence
  Description of Artificial Sequence: Synthetic oligonucleotide
  Target: SCN10A; (+) strand; PAM type: NRG; PAM sequence: AGG
cacgagttattttagaatta

SEQ ID NO: 35265 - DNA, 20 bp, Artificial Sequence
  Description of Artificial Sequence: Synthetic oligonucleotide
  Target: SCN10A; (+) strand; PAM type: NRG; PAM sequence: TGG
agaattaaggttttgacaaa

SEQ ID NO: 35266 - DNA, 20 bp, Artificial Sequence
  Description of Artificial Sequence: Synthetic oligonucleotide
  Target: SCN10A; (+) strand; PAM type: NRG; PAM sequence: TGG
attaaggttttgacaaatgg

SEQ ID NO: 35267 - DNA, 20 bp, Artificial Sequence
  Description of Artificial Sequence: Synthetic oligonucleotide
  Target: SCN10A; (+) strand; PAM type: NRG; PAM sequence: GGG
ttaaggttttgacaaatggt

SEQ ID NO: 35268 - DNA, 20 bp, Artificial Sequence
  Description of Artificial Sequence: Synthetic oligonucleotide
  Target: SCN10A; (+) strand; PAM type: NRG; PAM sequence: GAG
aatggtgggcaatgtcttct

SEQ ID NO: 35269 - DNA, 20 bp, Artificial Sequence
  Description of Artificial Sequence: Synthetic oligonucleotide
  Target: SCN10A; (+) strand; PAM type: NRG; PAM sequence: AAG
gggcaatgtcttctgagtat

SEQ ID NO: 35270 - DNA, 20 bp, Artificial Sequence
  Description of Artificial Sequence: Synthetic oligonucleotide
  Target: SCN10A; (+) strand; PAM type: NRG; PAM sequence: TAG
tgtcttctgagtataagcat

SEQ ID NO: 35271 - DNA, 20 bp, Artificial Sequence
  Description of Artificial Sequence: Synthetic oligonucleotide
  Target: SCN10A; (+) strand; PAM type: NRG; PAM sequence: GAG
tttaaaattcatcctctaac

SEQ ID NO: 35272 - DNA, 20 bp, Artificial Sequence
  Description of Artificial Sequence: Synthetic oligonucleotide
  Target: SCN10A; (+) strand; PAM type: NRG; PAM sequence: TGG
catcctctaacgagaccaac

SEQ ID NO: 35273 - DNA, 20 bp, Artificial Sequence
  Description of Artificial Sequence: Synthetic oligonucleotide
  Target: SCN10A; (+) strand; PAM type: NRG; PAM sequence: TGG
attttccacaaaaaccctcc

SEQ ID NO: 35274 - DNA, 20 bp, Artificial Sequence
  Description of Artificial Sequence: Synthetic oligonucleotide
  Target: SCN10A; (+) strand; PAM type: NRG; PAM sequence: GGG
ttttccacaaaaaccctcct

SEQ ID NO: 35275 - DNA, 20 bp, Artificial Sequence
  Description of Artificial Sequence: Synthetic oligonucleotide
  Target: SCN10A; (+) strand; PAM type: NRG; PAM sequence: TGG
ttcctctatttaatttctat

SEQ ID NO: 35276 - DNA, 20 bp, Artificial Sequence
  Description of Artificial Sequence: Synthetic oligonucleotide
  Target: SCN10A; (+) strand; PAM type: NRG; PAM sequence: TGG
aatttctattggttataaaa

SEQ ID NO: 35277 - DNA, 20 bp, Artificial Sequence
  Description of Artificial Sequence: Synthetic oligonucleotide
  Target: SCN10A; (+) strand; PAM type: NRG; PAM sequence: TAG
tattggttataaaatggctt

SEQ ID NO: 35278 - DNA, 20 bp, Artificial Sequence
  Description of Artificial Sequence: Synthetic oligonucleotide
  Target: SCN10A; (+) strand; PAM type: NRG; PAM sequence: TAG
gctttagataaaaactgcat

SEQ ID NO: 35279 - DNA, 20 bp, Artificial Sequence
  Description of Artificial Sequence: Synthetic oligonucleotide
  Target: SCN10A; (+) strand; PAM type: NRG; PAM sequence: AGG
ctttagataaaaactgcatt

SEQ ID NO: 35280 - DNA, 20 bp, Artificial Sequence
  Description of Artificial Sequence: Synthetic oligonucleotide
  Target: SCN10A; (+) strand; PAM type: NRG; PAM sequence: TGG
atttaccacatgaatgtacc

SEQ ID NO: 35281 - DNA, 20 bp, Artificial Sequence
  Description of Artificial Sequence: Synthetic oligonucleotide
  Target: SCN10A; (+) strand; PAM type: NRG; PAM sequence: GGG
tttaccacatgaatgtacct

SEQ ID NO: 35282 - DNA, 20 bp, Artificial Sequence
  Description of Artificial Sequence: Synthetic oligonucleotide
  Target: SCN10A; (+) strand; PAM type: NRG; PAM sequence: AAG
cacatgaatgtacctgggaa

SEQ ID NO: 35283 - DNA, 20 bp, Artificial Sequence
  Description of Artificial Sequence: Synthetic oligonucleotide
  Target: SCN10A; (+) strand; PAM type: NRG; PAM sequence: GAG
catgaatgtacctgggaaaa

SEQ ID NO: 35284 - DNA, 20 bp, Artificial Sequence
  Description of Artificial Sequence: Synthetic oligonucleotide
  Target: SCN10A; (+) strand; PAM type: NRG; PAM sequence: AGG
atgaatgtacctgggaaaag

SEQ ID NO: 35285 - DNA, 20 bp, Artificial Sequence
  Description of Artificial Sequence: Synthetic oligonucleotide
  Target: SCN10A; (+) strand; PAM type: NRG; PAM sequence: GGG
tgaatgtacctgggaaaaga

SEQ ID NO: 35286 - DNA, 20 bp, Artificial Sequence
  Description of Artificial Sequence: Synthetic oligonucleotide
  Target: SCN10A; (+) strand; PAM type: NRG; PAM sequence: GAG
aatgtacctgggaaaagagg

SEQ ID NO: 35287 - DNA, 20 bp, Artificial Sequence
  Description of Artificial Sequence: Synthetic oligonucleotide
  Target: SCN10A; (+) strand; PAM type: NRG; PAM sequence: GAG
tgtacctgggaaaagaggga

SEQ ID NO: 35288 - DNA, 20 bp, Artificial Sequence
  Description of Artificial Sequence: Synthetic oligonucleotide
  Target: SCN10A; (+) strand; PAM type: NRG; PAM sequence: AGG
gtacctgggaaaagagggag

SEQ ID NO: 35289 - DNA, 20 bp, Artificial Sequence
  Description of Artificial Sequence: Synthetic oligonucleotide
  Target: SCN10A; (+) strand; PAM type: NRG; PAM sequence: GAG
gagggagaggatgccttcct

SEQ ID NO: 35290 - DNA, 20 bp, Artificial Sequence
  Description of Artificial Sequence: Synthetic oligonucleotide
  Target: SCN10A; (+) strand; PAM type: NRG; PAM sequence: TGG
ggagaggatgccttcctgag

SEQ ID NO: 35291 - DNA, 20 bp, Artificial Sequence
  Description of Artificial Sequence: Synthetic oligonucleotide
  Target: SCN10A; (+) strand; PAM type: NRG; PAM sequence: GGG
gagaggatgccttcctgagt

SEQ ID NO: 35292 - DNA, 20 bp, Artificial Sequence
  Description of Artificial Sequence: Synthetic oligonucleotide
  Target: SCN10A; (+) strand; PAM type: NRG; PAM sequence: TAG
gtgggctccaataaatcaat

SEQ ID NO: 35293 - DNA, 20 bp, Artificial Sequence
  Description of Artificial Sequence: Synthetic oligonucleotide
  Target: SCN10A; (+) strand; PAM type: NRG; PAM sequence: AAG
caataaatcaattagcatta

SEQ ID NO: 35294 - DNA, 20 bp, Artificial Sequence
  Description of Artificial Sequence: Synthetic oligonucleotide
  Target: SCN10A; (+) strand; PAM type: NRG; PAM sequence: AAG
taaatcaattagcattaaag

SEQ ID NO: 35295 - DNA, 20 bp, Artificial Sequence
  Description of Artificial Sequence: Synthetic oligonucleotide
  Target: SCN10A; (+) strand; PAM type: NRG; PAM sequence: TGG
gcattaaagaagtacttaaa

SEQ ID NO: 35296 - DNA, 20 bp, Artificial Sequence
  Description of Artificial Sequence: Synthetic oligonucleotide
  Target: SCN10A; (+) strand; PAM type: NRG; PAM sequence: CAG
atacatgttgttctttctgc

SEQ ID NO: 35297 - DNA, 20 bp, Artificial Sequence
  Description of Artificial Sequence: Synthetic oligonucleotide
  Target: SCN10A; (+) strand; PAM type: NRG; PAM sequence: AGG
tacatgttgttctttctgcc

SEQ ID NO: 35298 - DNA, 20 bp, Artificial Sequence
  Description of Artificial Sequence: Synthetic oligonucleotide
  Target: SCN10A; (+) strand; PAM type: NRG; PAM sequence: AAG
actcctccccaaactctctc

SEQ ID NO: 35299 - DNA, 20 bp, Artificial Sequence
  Description of Artificial Sequence: Synthetic oligonucleotide
  Target: SCN10A; (+) strand; PAM type: NRG; PAM sequence: TAG
tctctcaagtcttcaattac

SEQ ID NO: 35300 - DNA, 20 bp, Artificial Sequence
  Description of Artificial Sequence: Synthetic oligonucleotide
  Target: SCN10A; (+) strand; PAM type: NRG; PAM sequence: AAG
ctcaagtcttcaattactag

SEQ ID NO: 35301 - DNA, 20 bp, Artificial Sequence
  Description of Artificial Sequence: Synthetic oligonucleotide
  Target: SCN10A; (+) strand; PAM type: NRG; PAM sequence: CAG
atcccaattatgccttcctc

SEQ ID NO: 35302 - DNA, 20 bp, Artificial Sequence
  Description of Artificial Sequence: Synthetic oligonucleotide
  Target: SCN10A; (+) strand; PAM type: NRG; PAM sequence: AGG
tcccaattatgccttcctcc

SEQ ID NO: 35303 - DNA, 20 bp, Artificial Sequence
  Description of Artificial Sequence: Synthetic oligonucleotide
  Target: SCN10A; (+) strand; PAM type: NRG; PAM sequence: AAG
caattatgccttcctccagg

SEQ ID NO: 35304 - DNA, 20 bp, Artificial Sequence
  Description of Artificial Sequence: Synthetic oligonucleotide
  Target: SCN10A; (+) strand; PAM type: NRG; PAM sequence: CAG
agccttttctgatacctatc

SEQ ID NO: 35305 - DNA, 20 bp, Artificial Sequence
  Description of Artificial Sequence: Synthetic oligonucleotide
  Target: SCN10A; (+) strand; PAM type: NRG; PAM sequence: AAG
tgatacctatccagccccat

SEQ ID NO: 35306 - DNA, 20 bp, Artificial Sequence
  Description of Artificial Sequence: Synthetic oligonucleotide
  Target: SCN10A; (+) strand; PAM type: NRG; PAM sequence: GAG
atacctatccagccccataa

SEQ ID NO: 35307 - DNA, 20 bp, Artificial Sequence
  Description of Artificial Sequence: Synthetic oligonucleotide
  Target: SCN10A; (+) strand; PAM type: NRG; PAM sequence: TGG
cctatccagccccataagag

SEQ ID NO: 35308 - DNA, 20 bp, Artificial Sequence
  Description of Artificial Sequence: Synthetic oligonucleotide
  Target: SCN10A; (+) strand; PAM type: NRG; PAM sequence: TAG
ctaatacactatttaacaca

SEQ ID NO: 35309 - DNA, 20 bp, Artificial Sequence
  Description of Artificial Sequence: Synthetic oligonucleotide
  Target: SCN10A; (+) strand; PAM type: NRG; PAM sequence: TGG
atctgcctcctccacccaaa

SEQ ID NO: 35310 - DNA, 20 bp, Artificial Sequence
  Description of Artificial Sequence: Synthetic oligonucleotide
  Target: SCN10A; (+) strand; PAM type: NRG; PAM sequence: TAG
tccacccaaatggaaatcct

SEQ ID NO: 35311 - DNA, 20 bp, Artificial Sequence
  Description of Artificial Sequence: Synthetic oligonucleotide
  Target: SCN10A; (+) strand; PAM type: NRG; PAM sequence: AGG
ccacccaaatggaaatcctt

SEQ ID NO: 35312 - DNA, 20 bp, Artificial Sequence
  Description of Artificial Sequence: Synthetic oligonucleotide
  Target: SCN10A; (+) strand; PAM type: NRG; PAM sequence: GGG
cacccaaatggaaatcctta

SEQ ID NO: 35313 - DNA, 20 bp, Artificial Sequence
  Description of Artificial Sequence: Synthetic oligonucleotide
  Target: SCN10A; (+) strand; PAM type: NRG; PAM sequence: AAG
aaatggaaatccttagggaa

SEQ ID NO: 35314 - DNA, 20 bp, Artificial Sequence
  Description of Artificial Sequence: Synthetic oligonucleotide
  Target: SCN10A; (+) strand; PAM type: NRG; PAM sequence: TAG
ttagggaaaagaacatgttc

SEQ ID NO: 35315 - DNA, 20 bp, Artificial Sequence
  Description of Artificial Sequence: Synthetic oligonucleotide
  Target: SCN10A; (+) strand; PAM type: NRG; PAM sequence: AAG
tctagtcatctctttatacc

SEQ ID NO: 35316 - DNA, 20 bp, Artificial Sequence
  Description of Artificial Sequence: Synthetic oligonucleotide
  Target: SCN10A; (+) strand; PAM type: NRG; PAM sequence: TAG
atctctttataccaagcacc

SEQ ID NO: 35317 - DNA, 20 bp, Artificial Sequence
  Description of Artificial Sequence: Synthetic oligonucleotide
  Target: SCN10A; (+) strand; PAM type: NRG; PAM sequence: AAG
cctagtattgttgaatgaac

SEQ ID NO: 35318 - DNA, 20 bp, Artificial Sequence
  Description of Artificial Sequence: Synthetic oligonucleotide
  Target: SCN10A; (+) strand; PAM type: NRG; PAM sequence: CAG
attgttgaatgaacaagtta

SEQ ID NO: 35319 - DNA, 20 bp, Artificial Sequence
  Description of Artificial Sequence: Synthetic oligonucleotide
  Target: SCN10A; (+) strand; PAM type: NRG; PAM sequence: AAG
ctcctcttttttccctttga

SEQ ID NO: 35320 - DNA, 20 bp, Artificial Sequence
  Description of Artificial Sequence: Synthetic oligonucleotide
  Target: SCN10A; (+) strand; PAM type: NRG; PAM sequence: AAG
tcttttttccctttgaaagt

SEQ ID NO: 35321 - DNA, 20 bp, Artificial Sequence
  Description of Artificial Sequence: Synthetic oligonucleotide
  Target: SCN10A; (+) strand; PAM type: NRG; PAM sequence: TGG
cctttgaaagtaagcatcac

SEQ ID NO: 35322 - DNA, 20 bp, Artificial Sequence
  Description of Artificial Sequence: Synthetic oligonucleotide
  Target: SCN10A; (+) strand; PAM type: NRG; PAM sequence: GAG
tttgaaagtaagcatcactg

SEQ ID NO: 35323 - DNA, 20 bp, Artificial Sequence
  Description of Artificial Sequence: Synthetic oligonucleotide
  Target: SCN10A; (+) strand; PAM type: NRG; PAM sequence: GAG
tgaaagtaagcatcactgga

SEQ ID NO: 35324 - DNA, 20 bp, Artificial Sequence
  Description of Artificial Sequence: Synthetic oligonucleotide
  Target: SCN10A; (+) strand; PAM type: NRG; PAM sequence: AAG
gtaagcatcactggagagac

SEQ ID NO: 35325 - DNA, 20 bp, Artificial Sequence
  Description of Artificial Sequence: Synthetic oligonucleotide
  Target: SCN10A; (+) strand; PAM type: NRG; PAM sequence: TGG
caagcacacataccaattat

SEQ ID NO: 35326 - DNA, 20 bp, Artificial Sequence
  Description of Artificial Sequence: Synthetic oligonucleotide
  Target: SCN10A; (+) strand; PAM type: NRG; PAM sequence: AAG
ataccaattattggacatcc

SEQ ID NO: 35327 - DNA, 20 bp, Artificial Sequence
  Description of Artificial Sequence: Synthetic oligonucleotide
  Target: SCN10A; (+) strand; PAM type: NRG; PAM sequence: TGG
catccaagtgctaatctgtg

SEQ ID NO: 35328 - DNA, 20 bp, Artificial Sequence
  Description of Artificial Sequence: Synthetic oligonucleotide
  Target: SCN10A; (+) strand; PAM type: NRG; PAM sequence: GGG
atccaagtgctaatctgtgt

SEQ ID NO: 35329 - DNA, 20 bp, Artificial Sequence
  Description of Artificial Sequence: Synthetic oligonucleotide
  Target: SCN10A; (+) strand; PAM type: NRG; PAM sequence: GGG
tccaagtgctaatctgtgtg

SEQ ID NO: 35330 - DNA, 20 bp, Artificial Sequence
  Description of Artificial Sequence: Synthetic oligonucleotide
  Target: SCN10A; (+) strand; PAM type: NRG; PAM sequence: CAG
gctaatctgtgtggggctga

SEQ ID NO: 35331 - DNA, 20 bp, Artificial Sequence
  Description of Artificial Sequence: Synthetic oligonucleotide
  Target: SCN10A; (+) strand; PAM type: NRG; PAM sequence: TGG
tctgtgtggggctgacagaa

SEQ ID NO: 35332 - DNA, 20 bp, Artificial Sequence
  Description of Artificial Sequence: Synthetic oligonucleotide
  Target: SCN10A; (+) strand; PAM type: NRG; PAM sequence: GGG
ctgtgtggggctgacagaat

SEQ ID NO: 35333 - DNA, 20 bp, Artificial Sequence
  Description of Artificial Sequence: Synthetic oligonucleotide
  Target: SCN10A; (+) strand; PAM type: NRG; PAM sequence: GGG
tgtgtggggctgacagaatg

SEQ ID NO: 35334 - DNA, 20 bp, Artificial Sequence
  Description of Artificial Sequence: Synthetic oligonucleotide
  Target: SCN10A; (+) strand; PAM type: NRG; PAM sequence: GGG
gtgtggggctgacagaatgg

SEQ ID NO: 35335 - DNA, 20 bp, Artificial Sequence
  Description of Artificial Sequence: Synthetic oligonucleotide
  Target: SCN10A; (+) strand; PAM type: NRG; PAM sequence: AAG
tgacagaatgggggaaatta

SEQ ID NO: 35336 - DNA, 20 bp, Artificial Sequence
  Description of Artificial Sequence: Synthetic oligonucleotide
  Target: SCN10A; (+) strand; PAM type: NRG; PAM sequence: CAG
ggggaaattaaagcccaatt

SEQ ID NO: 35337 - DNA, 20 bp, Artificial Sequence
  Description of Artificial Sequence: Synthetic oligonucleotide
  Target: SCN10A; (+) strand; PAM type: NRG; PAM sequence: TGG
cagtgtcattgacatttcca

SEQ ID NO: 35338 - DNA, 20 bp, Artificial Sequence
  Description of Artificial Sequence: Synthetic oligonucleotide
  Target: SCN10A; (+) strand; PAM type: NRG; PAM sequence: AAG
tgtcattgacatttccatgg

SEQ ID NO: 35339 - DNA, 20 bp, Artificial Sequence
  Description of Artificial Sequence: Synthetic oligonucleotide
  Target: SCN10A; (+) strand; PAM type: NRG; PAM sequence: CAG
gaactgtgccccatgtatgc

SEQ ID NO: 35340 - DNA, 20 bp, Artificial Sequence
  Description of Artificial Sequence: Synthetic oligonucleotide
  Target: SCN10A; (+) strand; PAM type: NRG; PAM sequence: AGG
aactgtgccccatgtatgcc

SEQ ID NO: 35341 - DNA, 20 bp, Artificial Sequence
  Description of Artificial Sequence: Synthetic oligonucleotide
  Target: SCN10A; (+) strand; PAM type: NRG; PAM sequence: AAG
gtatgccaggtgctgctcaa

SEQ ID NO: 35342 - DNA, 20 bp, Artificial Sequence
  Description of Artificial Sequence: Synthetic oligonucleotide
  Target: SCN10A; (+) strand; PAM type: NRG; PAM sequence: AGG
tatgccaggtgctgctcaaa

SEQ ID NO: 35343 - DNA, 20 bp, Artificial Sequence
  Description of Artificial Sequence: Synthetic oligonucleotide
  Target: SCN10A; (+) strand; PAM type: NRG; PAM sequence: GGG
atgccaggtgctgctcaaaa

SEQ ID NO: 35344 - DNA, 20 bp, Artificial Sequence
  Description of Artificial Sequence: Synthetic oligonucleotide
  Target: SCN10A; (+) strand; PAM type: NRG; PAM sequence: GGG
tgccaggtgctgctcaaaag

SEQ ID NO: 35345 - DNA, 20 bp, Artificial Sequence
  Description of Artificial Sequence: Synthetic oligonucleotide
  Target: SCN10A; (+) strand; PAM type: NRG; PAM sequence: AAG
ggtgctgctcaaaaggggca

SEQ ID NO: 35346 - DNA, 20 bp, Artificial Sequence
  Description of Artificial Sequence: Synthetic oligonucleotide
  Target: SCN10A; (+) strand; PAM type: NRG; PAM sequence: AAG
ctgctcaaaaggggcaaagc

SEQ ID NO: 35347 - DNA, 20 bp, Artificial Sequence
  Description of Artificial Sequence: Synthetic oligonucleotide
  Target: SCN10A; (+) strand; PAM type: NRG; PAM sequence: AAG
tcaaaaggggcaaagcaaga

SEQ ID NO: 35348 - DNA, 20 bp, Artificial Sequence
  Description of Artificial Sequence: Synthetic oligonucleotide
  Target: SCN10A; (+) strand; PAM type: NRG; PAM sequence: GAG
aaaaggggcaaagcaagaaa

SEQ ID NO: 35349 - DNA, 20 bp, Artificial Sequence
  Description of Artificial Sequence: Synthetic oligonucleotide
  Target: SCN10A; (+) strand; PAM type: NRG; PAM sequence: AGG
aaaggggcaaagcaagaaag

SEQ ID NO: 35350 - DNA, 20 bp, Artificial Sequence
  Description of Artificial Sequence: Synthetic oligonucleotide
  Target: SCN10A; (+) strand; PAM type: NRG; PAM sequence: GAG
aggggcaaagcaagaaagag

SEQ ID NO: 35351 - DNA, 20 bp, Artificial Sequence
  Description of Artificial Sequence: Synthetic oligonucleotide
  Target: SCN10A; (+) strand; PAM type: NRG; PAM sequence: AGG
ggggcaaagcaagaaagagg

SEQ ID NO: 35352 - DNA, 20 bp, Artificial Sequence
  Description of Artificial Sequence: Synthetic oligonucleotide
  Target: SCN10A; (+) strand; PAM type: NRG; PAM sequence: GGG
gggcaaagcaagaaagagga

SEQ ID NO: 35353 - DNA, 20 bp, Artificial Sequence
  Description of Artificial Sequence: Synthetic oligonucleotide
  Target: SCN10A; (+) strand; PAM type: NRG; PAM sequence: CAG
aagcaagaaagaggagggca

SEQ ID NO: 35354 - DNA, 20 bp, Artificial Sequence
  Description of Artificial Sequence: Synthetic oligonucleotide
  Target: SCN10A; (+) strand; PAM type: NRG; PAM sequence: CAG
gaaagaggagggcacagatg

SEQ ID NO: 35355 - DNA, 20 bp, Artificial Sequence
  Description of Artificial Sequence: Synthetic oligonucleotide
  Target: SCN10A; (+) strand; PAM type: NRG; PAM sequence: AAG
acagatgcagataaatgctg

SEQ ID NO: 35356 - DNA, 20 bp, Artificial Sequence
  Description of Artificial Sequence: Synthetic oligonucleotide
  Target: SCN10A; (+) strand; PAM type: NRG; PAM sequence: TGG
tgcagataaatgctgaagtg

SEQ ID NO: 35357 - DNA, 20 bp, Artificial Sequence
  Description of Artificial Sequence: Synthetic oligonucleotide
  Target: SCN10A; (+) strand; PAM type: NRG; PAM sequence: GAG
ctgaagtgtggatgtgtcat

SEQ ID NO: 35358 - DNA, 20 bp, Artificial Sequence
  Description of Artificial Sequence: Synthetic oligonucleotide
  Target: SCN10A; (+) strand; PAM type: NRG; PAM sequence: AGG
tgaagtgtggatgtgtcatg

SEQ ID NO: 35359 - DNA, 20 bp, Artificial Sequence
  Description of Artificial Sequence: Synthetic oligonucleotide
  Target: SCN10A; (+) strand; PAM type: NRG; PAM sequence: CAG
gtgtggatgtgtcatgaggt

SEQ ID NO: 35360 - DNA, 20 bp, Artificial Sequence
  Description of Artificial Sequence: Synthetic oligonucleotide
  Target: SCN10A; (+) strand; PAM type: NRG; PAM sequence: AAG
catgaggtcagtgtgcatgc

SEQ ID NO: 35361 - DNA, 20 bp, Artificial Sequence
  Description of Artificial Sequence: Synthetic oligonucleotide
  Target: SCN10A; (+) strand; PAM type: NRG; PAM sequence: GAG
gtatatgcacacataaatct

SEQ ID NO: 35362 - DNA, 20 bp, Artificial Sequence
  Description of Artificial Sequence: Synthetic oligonucleotide
  Target: SCN10A; (+) strand; PAM type: NRG; PAM sequence: AGG
tatatgcacacataaatctg

SEQ ID NO: 35363 - DNA, 20 bp, Artificial Sequence
  Description of Artificial Sequence: Synthetic oligonucleotide
  Target: SCN10A; (+) strand; PAM type: NRG; PAM sequence: GGG
atatgcacacataaatctga

SEQ ID NO: 35364 - DNA, 20 bp, Artificial Sequence
  Description of Artificial Sequence: Synthetic oligonucleotide
  Target: SCN10A; (+) strand; PAM type: NRG; PAM sequence: TGG
gcacacataaatctgagggt

SEQ ID NO: 35365 - DNA, 20 bp, Artificial Sequence
  Description of Artificial Sequence: Synthetic oligonucleotide
  Target: SCN10A; (+) strand; PAM type: NRG; PAM sequence: GAG
acacataaatctgagggttg

SEQ ID NO: 35366 - DNA, 20 bp, Artificial Sequence
  Description of Artificial Sequence: Synthetic oligonucleotide
  Target: SCN10A; (+) strand; PAM type: NRG; PAM sequence: GAG
acataaatctgagggttgga

SEQ ID NO: 35367 - DNA, 20 bp, Artificial Sequence
  Description of Artificial Sequence: Synthetic oligonucleotide
  Target: SCN10A; (+) strand; PAM type: NRG; PAM sequence: TGG
aaatctgagggttggagaga

SEQ ID NO: 35368 - DNA, 20 bp, Artificial Sequence
  Description of Artificial Sequence: Synthetic oligonucleotide
  Target: SCN10A; (+) strand; PAM type: NRG; PAM sequence: AAG
ggagagatggtattgcaaaa

SEQ ID NO: 35369 - DNA, 20 bp, Artificial Sequence
  Description of Artificial Sequence: Synthetic oligonucleotide
  Target: SCN10A; (+) strand; PAM type: NRG; PAM sequence: CGG
caaaaaagtaaaatatcctt

SEQ ID NO: 35370 - DNA, 20 bp, Artificial Sequence
  Description of Artificial Sequence: Synthetic oligonucleotide
  Target: SCN10A; (+) strand; PAM type: NRG; PAM sequence: TAG
aagtaaaatatccttcggct

SEQ ID NO: 35371 - DNA, 20 bp, Artificial Sequence
  Description of Artificial Sequence: Synthetic oligonucleotide
  Target: SCN10A; (+) strand; PAM type: NRG; PAM sequence: CAG
aaatatccttcggcttagca

SEQ ID NO: 35372 - DNA, 20 bp, Artificial Sequence
  Description of Artificial Sequence: Synthetic oligonucleotide
  Target: SCN10A; (+) strand; PAM type: NRG; PAM sequence: AGG
aatatccttcggcttagcac

SEQ ID NO: 35373 - DNA, 20 bp, Artificial Sequence
  Description of Artificial Sequence: Synthetic oligonucleotide
  Target: SCN10A; (+) strand; PAM type: NRG; PAM sequence: AAG
ccttcggcttagcacaggaa

SEQ ID NO: 35374 - DNA, 20 bp, Artificial Sequence
  Description of Artificial Sequence: Synthetic oligonucleotide
  Target: SCN10A; (+) strand; PAM type: NRG; PAM sequence: GAG
ttcggcttagcacaggaaaa

SEQ ID NO: 35375 - DNA, 20 bp, Artificial Sequence
  Description of Artificial Sequence: Synthetic oligonucleotide
  Target: SCN10A; (+) strand; PAM type: NRG; PAM sequence: GAG
ttagcacaggaaaagagatt

SEQ ID NO: 35376 - DNA, 20 bp, Artificial Sequence
  Description of Artificial Sequence: Synthetic oligonucleotide
  Target: SCN10A; (+) strand; PAM type: NRG; PAM sequence: GAG
agcacaggaaaagagattga

SEQ ID NO: 35377 - DNA, 20 bp, Artificial Sequence
  Description of Artificial Sequence: Synthetic oligonucleotide
  Target: SCN10A; (+) strand; PAM type: NRG; PAM sequence: AGG
gcacaggaaaagagattgag

SEQ ID NO: 35378 - DNA, 20 bp, Artificial Sequence
  Description of Artificial Sequence: Synthetic oligonucleotide
  Target: SCN10A; (+) strand; PAM type: NRG; PAM sequence: GGG
cacaggaaaagagattgaga

SEQ ID NO: 35379 - DNA, 20 bp, Artificial Sequence
  Description of Artificial Sequence: Synthetic oligonucleotide
  Target: SCN10A; (+) strand; PAM type: NRG; PAM sequence: AAG
aggaaaagagattgagaggg

SEQ ID NO: 35380 - DNA, 20 bp, Artificial Sequence
  Description of Artificial Sequence: Synthetic oligonucleotide
  Target: SCN10A; (+) strand; PAM type: NRG; PAM sequence: GAG
aaagagattgagagggaagt

SEQ ID NO: 35381 - DNA, 20 bp, Artificial Sequence
  Description of Artificial Sequence: Synthetic oligonucleotide
  Target: SCN10A; (+) strand; PAM type: NRG; PAM sequence: GAG
agagattgagagggaagtga

SEQ ID NO: 35382 - DNA, 20 bp, Artificial Sequence
  Description of Artificial Sequence: Synthetic oligonucleotide
  Target: SCN10A; (+) strand; PAM type: NRG; PAM sequence: AGG
gagattgagagggaagtgag

SEQ ID NO: 35383 - DNA, 20 bp, Artificial Sequence
  Description of Artificial Sequence: Synthetic oligonucleotide
  Target: SCN10A; (+) strand; PAM type: NRG; PAM sequence: AAG
agagggaagtgagaggtata

SEQ ID NO: 35384 - DNA, 20 bp, Artificial Sequence
  Description of Artificial Sequence: Synthetic oligonucleotide
  Target: SCN10A; (+) strand; PAM type: NRG; PAM sequence: TAG
aggtataaagcataaaaaaa

SEQ ID NO: 35385 - DNA, 20 bp, Artificial Sequence
  Description of Artificial Sequence: Synthetic oligonucleotide
  Target: SCN10A; (+) strand; PAM type: NRG; PAM sequence: TAG
gatccccttttccacactgt

SEQ ID NO: 35386 - DNA, 20 bp, Artificial Sequence
  Description of Artificial Sequence: Synthetic oligonucleotide
  Target: SCN10A; (+) strand; PAM type: NRG; PAM sequence: TGG
ccttttccacactgttagtg

SEQ ID NO: 35387 - DNA, 20 bp, Artificial Sequence
  Description of Artificial Sequence: Synthetic oligonucleotide
  Target: SCN10A; (+) strand; PAM type: NRG; PAM sequence: GAG
ttttccacactgttagtgtg

SEQ ID NO: 35388 - DNA, 20 bp, Artificial Sequence
  Description of Artificial Sequence: Synthetic oligonucleotide
  Target: SCN10A; (+) strand; PAM type: NRG; PAM sequence: CAG
tgtggagccaccctcccaca

SEQ ID NO: 35389 - DNA, 20 bp, Artificial Sequence
  Description of Artificial Sequence: Synthetic oligonucleotide
  Target: SCN10A; (+) strand; PAM type: NRG; PAM sequence: CAG
ggagccaccctcccacacag

SEQ ID NO: 35390 - DNA, 20 bp, Artificial Sequence
  Description of Artificial Sequence: Synthetic oligonucleotide
  Target: SCN10A; (+) strand; PAM type: NRG; PAM sequence: CAG
acacagcagatattatctgt

SEQ ID NO: 35391 - DNA, 20 bp, Artificial Sequence
  Description of Artificial Sequence: Synthetic oligonucleotide
  Target: SCN10A; (+) strand; PAM type: NRG; PAM sequence: TAG
gatattatctgtcagaccta

SEQ ID NO: 35392 - DNA, 20 bp, Artificial Sequence
  Description of Artificial Sequence: Synthetic oligonucleotide
  Target: SCN10A; (+) strand; PAM type: NRG; PAM sequence: AAG
ttatctgtcagacctataga

SEQ ID NO: 35393 - DNA, 20 bp, Artificial Sequence
  Description of Artificial Sequence: Synthetic oligonucleotide
  Target: SCN10A; (+) strand; PAM type: NRG; PAM sequence: AGG
tatctgtcagacctatagaa

SEQ ID NO: 35394 - DNA, 20 bp, Artificial Sequence
  Description of Artificial Sequence: Synthetic oligonucleotide
  Target: SCN10A; (+) strand; PAM type: NRG; PAM sequence: GGG
atctgtcagacctatagaaa

SEQ ID NO: 35395 - DNA, 20 bp, Artificial Sequence
  Description of Artificial Sequence: Synthetic oligonucleotide
  Target: SCN10A; (+) strand; PAM type: NRG; PAM sequence: TGG
acctatagaaagggcatatt

SEQ ID NO: 35396 - DNA, 20 bp, Artificial Sequence
  Description of Artificial Sequence: Synthetic oligonucleotide
  Target: SCN10A; (+) strand; PAM type: NRG; PAM sequence: GGG
cctatagaaagggcatattt

SEQ ID NO: 35397 - DNA, 20 bp, Artificial Sequence
  Description of Artificial Sequence: Synthetic oligonucleotide
  Target: SCN10A; (+) strand; PAM type: NRG; PAM sequence: GGG
ctatagaaagggcatatttg

SEQ ID NO: 35398 - DNA, 20 bp, Artificial Sequence
  Description of Artificial Sequence: Synthetic oligonucleotide
  Target: SCN10A; (+) strand; PAM type: NRG; PAM sequence: AAG
aaagggcatatttggggtaa

SEQ ID NO: 35399 - DNA, 20 bp, Artificial Sequence
  Description of Artificial Sequence: Synthetic oligonucleotide
  Target: SCN10A; (+) strand; PAM type: NRG; PAM sequence: AGG
aagggcatatttggggtaaa

SEQ ID NO: 35400 - DNA, 20 bp, Artificial Sequence
  Description of Artificial Sequence: Synthetic oligonucleotide
  Target: SCN10A; (+) strand; PAM type: NRG; PAM sequence: AAG
tttggggtaaaaggactttc

SEQ ID NO: 35401 - DNA, 20 bp, Artificial Sequence
  Description of Artificial Sequence: Synthetic oligonucleotide
  Target: SCN10A; (+) strand; PAM type: NRG; PAM sequence: AGG
ttggggtaaaaggactttca

SEQ ID NO: 35402 - DNA, 20 bp, Artificial Sequence
  Description of Artificial Sequence: Synthetic oligonucleotide
  Target: SCN10A; (+) strand; PAM type: NRG; PAM sequence: GGG
tggggtaaaaggactttcaa

SEQ ID NO: 35403 - DNA, 20 bp, Artificial Sequence
  Description of Artificial Sequence: Synthetic oligonucleotide
  Target: SCN10A; (+) strand; PAM type: NRG; PAM sequence: GGG
ggggtaaaaggactttcaag

SEQ ID NO: 35404 - DNA, 20 bp, Artificial Sequence
  Description of Artificial Sequence: Synthetic oligonucleotide
  Target: SCN10A; (+) strand; PAM type: NRG; PAM sequence: CAG
gtaaaaggactttcaagggg

SEQ ID NO: 35405 - DNA, 20 bp, Artificial Sequence
  Description of Artificial Sequence: Synthetic oligonucleotide
  Target: SCN10A; (+) strand; PAM type: NRG; PAM sequence: AGG
taaaaggactttcaaggggc

SEQ ID NO: 35406 - DNA, 20 bp, Artificial Sequence
  Description of Artificial Sequence: Synthetic oligonucleotide
  Target: SCN10A; (+) strand; PAM type: NRG; PAM sequence: AAG
aaggactttcaaggggcagg

SEQ ID NO: 35407 - DNA, 20 bp, Artificial Sequence
  Description of Artificial Sequence: Synthetic oligonucleotide
  Target: SCN10A; (+) strand; PAM type: NRG; PAM sequence: AGG
aggactttcaaggggcagga

SEQ ID NO: 35408 - DNA, 20 bp, Artificial Sequence
  Description of Artificial Sequence: Synthetic oligonucleotide
  Target: SCN10A; (+) strand; PAM type: NRG; PAM sequence: TGG
actttcaaggggcaggaagg

SEQ ID NO: 35409 - DNA, 20 bp, Artificial Sequence
  Description of Artificial Sequence: Synthetic oligonucleotide
  Target: SCN10A; (+) strand; PAM type: NRG; PAM sequence: TGG
ttcaaggggcaggaaggtgg

SEQ ID NO: 35410 - DNA, 20 bp, Artificial Sequence
  Description of Artificial Sequence: Synthetic oligonucleotide
  Target: SCN10A; (+) strand; PAM type: NRG; PAM sequence: GGG
tcaaggggcaggaaggtggt

SEQ ID NO: 35411 - DNA, 20 bp, Artificial Sequence
  Description of Artificial Sequence: Synthetic oligonucleotide
  Target: SCN10A; (+) strand; PAM type: NRG; PAM sequence: GAG
aaggggcaggaaggtggtgg

SEQ ID NO: 35412 - DNA, 20 bp, Artificial Sequence
  Description of Artificial Sequence: Synthetic oligonucleotide
  Target: SCN10A; (+) strand; PAM type: NRG; PAM sequence: AGG
aggggcaggaaggtggtggg

SEQ ID NO: 35413 - DNA, 20 bp, Artificial Sequence
  Description of Artificial Sequence: Synthetic oligonucleotide
  Target: SCN10A; (+) strand; PAM type: NRG; PAM sequence: AAG
ggcaggaaggtggtgggagg

SEQ ID NO: 35414 - DNA, 20 bp, Artificial Sequence
  Description of Artificial Sequence: Synthetic oligonucleotide
  Target: SCN10A; (+) strand; PAM type: NRG; PAM sequence: TGG
gaaggtggtgggaggaagcg

SEQ ID NO: 35415 - DNA, 20 bp, Artificial Sequence
  Description of Artificial Sequence: Synthetic oligonucleotide
  Target: SCN10A; (+) strand; PAM type: NRG; PAM sequence: GAG
gtggtgggaggaagcgtggc

SEQ ID NO: 35416 - DNA, 20 bp, Artificial Sequence
  Description of Artificial Sequence: Synthetic oligonucleotide
  Target: SCN10A; (+) strand; PAM type: NRG; PAM sequence: AGG
tggtgggaggaagcgtggcg

SEQ ID NO: 35417 - DNA, 20 bp, Artificial Sequence
  Description of Artificial Sequence: Synthetic oligonucleotide
  Target: SCN10A; (+) strand; PAM type: NRG; PAM sequence: AAG
gggaggaagcgtggcgagga

SEQ ID NO: 35418 - DNA, 20 bp, Artificial Sequence
  Description of Artificial Sequence: Synthetic oligonucleotide
  Target: SCN10A; (+) strand; PAM type: NRG; PAM sequence: CAG
aagcgtggcgaggaaagttg

SEQ ID NO: 35419 - DNA, 20 bp, Artificial Sequence
  Description of Artificial Sequence: Synthetic oligonucleotide
  Target: SCN10A; (+) strand; PAM type: NRG; PAM sequence: TAG
gaaagttgcagtgcaaattt

SEQ ID NO: 35420 - DNA, 20 bp, Artificial Sequence
  Description of Artificial Sequence: Synthetic oligonucleotide
  Target: SCN10A; (+) strand; PAM type: NRG; PAM sequence: GAG
aagttgcagtgcaaatttta

SEQ ID NO: 35421 - DNA, 20 bp, Artificial Sequence
  Description of Artificial Sequence: Synthetic oligonucleotide
  Target: SCN10A; (+) strand; PAM type: NRG; PAM sequence: TGG
ttgcagtgcaaattttagag

SEQ ID NO: 35422 - DNA, 20 bp, Artificial Sequence
  Description of Artificial Sequence: Synthetic oligonucleotide
  Target: SCN10A; (+) strand; PAM type: NRG; PAM sequence: GGG
tgcagtgcaaattttagagt

SEQ ID NO: 35423 - DNA, 20 bp, Artificial Sequence
  Description of Artificial Sequence: Synthetic oligonucleotide
  Target: SCN10A; (+) strand; PAM type: NRG; PAM sequence: GAG
cagtgcaaattttagagtgg

SEQ ID NO: 35424 - DNA, 20 bp, Artificial Sequence
  Description of Artificial Sequence: Synthetic oligonucleotide
  Target: SCN10A; (+) strand; PAM type: NRG; PAM sequence: AGG
agtgcaaattttagagtggg

SEQ ID NO: 35425 - DNA, 20 bp, Artificial Sequence
  Description of Artificial Sequence: Synthetic oligonucleotide
  Target: SCN10A; (+) strand; PAM type: NRG; PAM sequence: CAG
gcaaattttagagtgggagg

SEQ ID NO: 35426 - DNA, 20 bp, Artificial Sequence
  Description of Artificial Sequence: Synthetic oligonucleotide
  Target: SCN10A; (+) strand; PAM type: NRG; PAM sequence: AAG
attttagagtgggaggcaga

SEQ ID NO: 35427 - DNA, 20 bp, Artificial Sequence
  Description of Artificial Sequence: Synthetic oligonucleotide
  Target: SCN10A; (+) strand; PAM type: NRG; PAM sequence: TGG
tgggaggcagaaagttatta

SEQ ID NO: 35428 - DNA, 20 bp, Artificial Sequence
  Description of Artificial Sequence: Synthetic oligonucleotide
  Target: SCN10A; (+) strand; PAM type: NRG; PAM sequence: GGG
gggaggcagaaagttattat

SEQ ID NO: 35429 - DNA, 20 bp, Artificial Sequence
  Description of Artificial Sequence: Synthetic oligonucleotide
  Target: SCN10A; (+) strand; PAM type: NRG; PAM sequence: GGG
ggaggcagaaagttattatg

SEQ ID NO: 35430 - DNA, 20 bp, Artificial Sequence
  Description of Artificial Sequence: Synthetic oligonucleotide
  Target: SCN10A; (+) strand; PAM type: NRG; PAM sequence: GGG
gaggcagaaagttattatgg

SEQ ID NO: 35431 - DNA, 20 bp, Artificial Sequence
  Description of Artificial Sequence: Synthetic oligonucleotide
  Target: SCN10A; (+) strand; PAM type: NRG; PAM sequence: GGG
aggcagaaagttattatggg

SEQ ID NO: 35432 - DNA, 20 bp, Artificial Sequence
  Description of Artificial Sequence: Synthetic oligonucleotide
  Target: SCN10A; (+) strand; PAM type: NRG; PAM sequence: AAG
gaaagttattatggggggaa

SEQ ID NO: 35433 - DNA, 20 bp, Artificial Sequence
  Description of Artificial Sequence: Synthetic oligonucleotide
  Target: SCN10A; (+) strand; PAM type: NRG; PAM sequence: CAG
tggggggaaaagaattgcta

SEQ ID NO: 35434 - DNA, 20 bp, Artificial Sequence
  Description of Artificial Sequence: Synthetic oligonucleotide
  Target: SCN10A; (+) strand; PAM type: NRG; PAM sequence: AGG
ggggggaaaagaattgctac

SEQ ID NO: 35435 - DNA, 20 bp, Artificial Sequence
  Description of Artificial Sequence: Synthetic oligonucleotide
  Target: SCN10A; (+) strand; PAM type: NRG; PAM sequence: GGG
gggggaaaagaattgctaca

SEQ ID NO: 35436 - DNA, 20 bp, Artificial Sequence
  Description of Artificial Sequence: Synthetic oligonucleotide
  Target: SCN10A; (+) strand; PAM type: NRG; PAM sequence: GAG
aaagaattgctacagggtct

SEQ ID NO: 35437 - DNA, 20 bp, Artificial Sequence
  Description of Artificial Sequence: Synthetic oligonucleotide
  Target: SCN10A; (+) strand; PAM type: NRG; PAM sequence: AGG
aagaattgctacagggtctg

SEQ ID NO: 35438 - DNA, 20 bp, Artificial Sequence
  Description of Artificial Sequence: Synthetic oligonucleotide
  Target: SCN10A; (+) strand; PAM type: NRG; PAM sequence: GAG
attgctacagggtctgaggt

SEQ ID NO: 35439 - DNA, 20 bp, Artificial Sequence
  Description of Artificial Sequence: Synthetic oligonucleotide
  Target: SCN10A; (+) strand; PAM type: NRG; PAM sequence: AGG
ttgctacagggtctgaggtg

SEQ ID NO: 35440 - DNA, 20 bp, Artificial Sequence
  Description of Artificial Sequence: Synthetic oligonucleotide
  Target: SCN10A; (+) strand; PAM type: NRG; PAM sequence: AAG
gggtctgaggtgaggtgctg

SEQ ID NO: 35441 - DNA, 20 bp, Artificial Sequence
  Description of Artificial Sequence: Synthetic oligonucleotide
  Target: SCN10A; (+) strand; PAM type: NRG; PAM sequence: CAG
tgaggtgctgaagccattcc

SEQ ID NO: 35442 - DNA, 20 bp, Artificial Sequence
  Description of Artificial Sequence: Synthetic oligonucleotide
  Target: SCN10A; (+) strand; PAM type: NRG; PAM sequence: AGG
gaggtgctgaagccattccc

SEQ ID NO: 35443 - DNA, 20 bp, Artificial Sequence
  Description of Artificial Sequence: Synthetic oligonucleotide
  Target: SCN10A; (+) strand; PAM type: NRG; PAM sequence: TGG
tgctgaagccattcccaggc

SEQ ID NO: 35444 - DNA, 20 bp, Artificial Sequence
  Description of Artificial Sequence: Synthetic oligonucleotide
  Target: SCN10A; (+) strand; PAM type: NRG; PAM sequence: CAG
tcccaggctggattgtgtca

SEQ ID NO: 35445 - DNA, 20 bp, Artificial Sequence
  Description of Artificial Sequence: Synthetic oligonucleotide
  Target: SCN10A; (+) strand; PAM type: NRG; PAM sequence: GAG
ccaggctggattgtgtcaca

SEQ ID NO: 35446 - DNA, 20 bp, Artificial Sequence
  Description of Artificial Sequence: Synthetic oligonucleotide
  Target: SCN10A; (+) strand; PAM type: NRG; PAM sequence: TGG
gctggattgtgtcacagaga

SEQ ID NO: 35447 - DNA, 20 bp, Artificial Sequence
  Description of Artificial Sequence: Synthetic oligonucleotide
  Target: SCN10A; (+) strand; PAM type: NRG; PAM sequence: GGG
ctggattgtgtcacagagat

SEQ ID NO: 35448 - DNA, 20 bp, Artificial Sequence
  Description of Artificial Sequence: Synthetic oligonucleotide
  Target: SCN10A; (+) strand; PAM type: NRG; PAM sequence: TGG
tgtgtcacagagatgggtgc

SEQ ID NO: 35449 - DNA, 20 bp, Artificial Sequence
  Description of Artificial Sequence: Synthetic oligonucleotide
  Target: SCN10A; (+) strand; PAM type: NRG; PAM sequence: CAG
ggaaacttttctgataacaa

SEQ ID NO: 35450 - DNA, 20 bp, Artificial Sequence
  Description of Artificial Sequence: Synthetic oligonucleotide
  Target: SCN10A; (+) strand; PAM type: NRG; PAM sequence: AGG
gaaacttttctgataacaac

SEQ ID NO: 35451 - DNA, 20 bp, Artificial Sequence
  Description of Artificial Sequence: Synthetic oligonucleotide
  Target: SCN10A; (+) strand; PAM type: NRG; PAM sequence: CAG
tttctgataacaacaggtga

SEQ ID NO: 35452 - DNA, 20 bp, Artificial Sequence
  Description of Artificial Sequence: Synthetic oligonucleotide
  Target: SCN10A; (+) strand; PAM type: NRG; PAM sequence: CAG
acaggtgacagcttgaattg

SEQ ID NO: 35453 - DNA, 20 bp, Artificial Sequence
  Description of Artificial Sequence: Synthetic oligonucleotide
  Target: SCN10A; (+) strand; PAM type: NRG; PAM sequence: AGG
caggtgacagcttgaattgc

SEQ ID NO: 35454 - DNA, 20 bp, Artificial Sequence
  Description of Artificial Sequence: Synthetic oligonucleotide
  Target: SCN10A; (+) strand; PAM type: NRG; PAM sequence: TAG
cagcttgaattgcaggacct

SEQ ID NO: 35455 - DNA, 20 bp, Artificial Sequence
  Description of Artificial Sequence: Synthetic oligonucleotide
  Target: SCN10A; (+) strand; PAM type: NRG; PAM sequence: AGG
agcttgaattgcaggacctt

SEQ ID NO: 35456 - DNA, 20 bp, Artificial Sequence
  Description of Artificial Sequence: Synthetic oligonucleotide
  Target: SCN10A; (+) strand; PAM type: NRG; PAM sequence: AAG
ttgaattgcaggaccttagg

SEQ ID NO: 35457 - DNA, 20 bp, Artificial Sequence
  Description of Artificial Sequence: Synthetic oligonucleotide
  Target: SCN10A; (+) strand; PAM type: NRG; PAM sequence: AGG
tgaattgcaggaccttagga

SEQ ID NO: 35458 - DNA, 20 bp, Artificial Sequence
  Description of Artificial Sequence: Synthetic oligonucleotide
  Target: SCN10A; (+) strand; PAM type: NRG; PAM sequence: GAG
aattgcaggaccttaggaag

SEQ ID NO: 35459 - DNA, 20 bp, Artificial Sequence
  Description of Artificial Sequence: Synthetic oligonucleotide
  Target: SCN10A; (+) strand; PAM type: NRG; PAM sequence: AGG
attgcaggaccttaggaagg

SEQ ID NO: 35460 - DNA, 20 bp, Artificial Sequence
  Description of Artificial Sequence: Synthetic oligonucleotide
  Target: SCN10A; (+) strand; PAM type: NRG; PAM sequence: CAG
caggaccttaggaaggaggt

SEQ ID NO: 35461 - DNA, 20 bp, Artificial Sequence
  Description of Artificial Sequence: Synthetic oligonucleotide
  Target: SCN10A; (+) strand; PAM type: NRG; PAM sequence: AAG
aataattatataaaattgtg

SEQ ID NO: 35462 - DNA, 20 bp, Artificial Sequence
  Description of Artificial Sequence: Synthetic oligonucleotide
  Target: SCN10A; (+) strand; PAM type: NRG; PAM sequence: AAG
agtgtcaattaaaaaaaact

SEQ ID NO: 35463 - DNA, 20 bp, Artificial Sequence
  Description of Artificial Sequence: Synthetic oligonucleotide
  Target: SCN10A; (+) strand; PAM type: NRG; PAM sequence: CAG
taaaaaccacctcgacgcat

SEQ ID NO: 35464 - DNA, 20 bp, Artificial Sequence
  Description of Artificial Sequence: Synthetic oligonucleotide
  Target: SCN10A; (+) strand; PAM type: NRG; PAM sequence: AAG
tcgacgcatcagaaaaaaaa

SEQ ID NO: 35465 - DNA, 20 bp, Artificial Sequence
  Description of Artificial Sequence: Synthetic oligonucleotide
  Target: SCN10A; (+) strand; PAM type: NRG; PAM sequence: AGG
cgacgcatcagaaaaaaaaa

SEQ ID NO: 35466 - DNA, 20 bp, Artificial Sequence
  Description of Artificial Sequence: Synthetic oligonucleotide
  Target: SCN10A; (+) strand; PAM type: NRG; PAM sequence: AAG
agaaaaaaaaaaggtgcatg

SEQ ID NO: 35467 - DNA, 20 bp, Artificial Sequence
  Description of Artificial Sequence: Synthetic oligonucleotide
  Target: SCN10A; (+) strand; PAM type: NRG; PAM sequence: AGG
gaaaaaaaaaaggtgcatga

SEQ ID NO: 35468 - DNA, 20 bp, Artificial Sequence
  Description of Artificial Sequence: Synthetic oligonucleotide
  Target: SCN10A; (+) strand; PAM type: NRG; PAM sequence: CAG
aaaaggtgcatgaaggatct

SEQ ID NO: 35469 - DNA, 20 bp, Artificial Sequence
  Description of Artificial Sequence: Synthetic oligonucleotide
  Target: SCN10A; (+) strand; PAM type: NRG; PAM sequence: CGG
catgaaggatctcagcacca

SEQ ID NO: 35470 - DNA, 20 bp, Artificial Sequence
  Description of Artificial Sequence: Synthetic oligonucleotide
  Target: SCN10A; (+) strand; PAM type: NRG; PAM sequence: CAG
aaggatctcagcaccacgga

SEQ ID NO: 35471 - DNA, 20 bp, Artificial Sequence
  Description of Artificial Sequence: Synthetic oligonucleotide
  Target: SCN10A; (+) strand; PAM type: NRG; PAM sequence: AGG
aggatctcagcaccacggac

SEQ ID NO: 35472 - DNA, 20 bp, Artificial Sequence
  Description of Artificial Sequence: Synthetic oligonucleotide
  Target: SCN10A; (+) strand; PAM type: NRG; PAM sequence: GGG
ggatctcagcaccacggaca

SEQ ID NO: 35473 - DNA, 20 bp, Artificial Sequence
  Description of Artificial Sequence: Synthetic oligonucleotide
  Target: SCN10A; (+) strand; PAM type: NRG; PAM sequence: TAG
ggacagggaaccttgcactc

SEQ ID NO: 35474 - DNA, 20 bp, Artificial Sequence
  Description of Artificial Sequence: Synthetic oligonucleotide
  Target: SCN10A; (+) strand; PAM type: NRG; PAM sequence: CAG
aaccttgcactctagaactg

SEQ ID NO: 35475 - DNA, 20 bp, Artificial Sequence
  Description of Artificial Sequence: Synthetic oligonucleotide
  Target: SCN10A; (+) strand; PAM type: NRG; PAM sequence: CAG
tgcactctagaactgcagac

SEQ ID NO: 35476 - DNA, 20 bp, Artificial Sequence
  Description of Artificial Sequence: Synthetic oligonucleotide
  Target: SCN10A; (+) strand; PAM type: NRG; PAM sequence: GAG
cactctagaactgcagacca

SEQ ID NO: 35477 - DNA, 20 bp, Artificial Sequence
  Description of Artificial Sequence: Synthetic oligonucleotide
  Target: SCN10A; (+) strand; PAM type: NRG; PAM sequence: CAG
agaactgcagaccagagcct

SEQ ID NO: 35478 - DNA, 20 bp, Artificial Sequence
  Description of Artificial Sequence: Synthetic oligonucleotide
  Target: SCN10A; (+) strand; PAM type: NRG; PAM sequence: AAG
actgcagaccagagcctcag

SEQ ID NO: 35479 - DNA, 20 bp, Artificial Sequence
  Description of Artificial Sequence: Synthetic oligonucleotide
  Target: SCN10A; (+) strand; PAM type: NRG; PAM sequence: AGG
ctgcagaccagagcctcaga

SEQ ID NO: 35480 - DNA, 20 bp, Artificial Sequence
  Description of Artificial Sequence: Synthetic oligonucleotide
  Target: SCN10A; (+) strand; PAM type: NRG; PAM sequence: AAG
cagaccagagcctcagaagg

SEQ ID NO: 35481 - DNA, 20 bp, Artificial Sequence
  Description of Artificial Sequence: Synthetic oligonucleotide
  Target: SCN10A; (+) strand; PAM type: NRG; PAM sequence: CAG
aagctgacctttgatgtccg

SEQ ID NO: 35482 - DNA, 20 bp, Artificial Sequence
  Description of Artificial Sequence: Synthetic oligonucleotide
  Target: SCN10A; (+) strand; PAM type: NRG; PAM sequence: AAG
ttgatgtccgcagacacctt

SEQ ID NO: 35483 - DNA, 20 bp, Artificial Sequence
  Description of Artificial Sequence: Synthetic oligonucleotide
  Target: SCN10A; (+) strand; PAM type: NRG; PAM sequence: TGG
gtccgcagacaccttaagat

SEQ ID NO: 35484 - DNA, 20 bp, Artificial Sequence
  Description of Artificial Sequence: Synthetic oligonucleotide
  Target: SCN10A; (+) strand; PAM type: NRG; PAM sequence: CAG
caccttaagattggcatgtt

SEQ ID NO: 35485 - DNA, 20 bp, Artificial Sequence
  Description of Artificial Sequence: Synthetic oligonucleotide
  Target: SCN10A; (+) strand; PAM type: NRG; PAM sequence: TGG
taagattggcatgttcagta

SEQ ID NO: 35486 - DNA, 20 bp, Artificial Sequence
  Description of Artificial Sequence: Synthetic oligonucleotide
  Target: SCN10A; (+) strand; PAM type: NRG; PAM sequence: GGG
aagattggcatgttcagtat

SEQ ID NO: 35487 - DNA, 20 bp, Artificial Sequence
  Description of Artificial Sequence: Synthetic oligonucleotide
  Target: SCN10A; (+) strand; PAM type: NRG; PAM sequence: CGG
ttcccacctttcctacaaac

SEQ ID NO: 35488 - DNA, 20 bp, Artificial Sequence
  Description of Artificial Sequence: Synthetic oligonucleotide
  Target: SCN10A; (+) strand; PAM type: NRG; PAM sequence: GGG
tcccacctttcctacaaacc

SEQ ID NO: 35489 - DNA, 20 bp, Artificial Sequence
  Description of Artificial Sequence: Synthetic oligonucleotide
  Target: SCN10A; (+) strand; PAM type: NRG; PAM sequence: GGG
cccacctttcctacaaaccg

SEQ ID NO: 35490 - DNA, 20 bp, Artificial Sequence
  Description of Artificial Sequence: Synthetic oligonucleotide
  Target: SCN10A; (+) strand; PAM type: NRG; PAM sequence: CAG
acaaaccggggttcttcctc

SEQ ID NO: 35491 - DNA, 20 bp, Artificial Sequence
  Description of Artificial Sequence: Synthetic oligonucleotide
  Target: SCN10A; (+) strand; PAM type: NRG; PAM sequence: TGG
ttcctccagtgtcctcatct

SEQ ID NO: 35492 - DNA, 20 bp, Artificial Sequence
  Description of Artificial Sequence: Synthetic oligonucleotide
  Target: SCN10A; (+) strand; PAM type: NRG; PAM sequence: TGG
gattgcccaatcctgaaacc

SEQ ID NO: 35493 - DNA, 20 bp, Artificial Sequence
  Description of Artificial Sequence: Synthetic oligonucleotide
  Target: SCN10A; (+) strand; PAM type: NRG; PAM sequence: GGG
attgcccaatcctgaaacct

SEQ ID NO: 35494 - DNA, 20 bp, Artificial Sequence
  Description of Artificial Sequence: Synthetic oligonucleotide
  Target: SCN10A; (+) strand; PAM type: NRG; PAM sequence: GAG
tgcccaatcctgaaacctgg

SEQ ID NO: 35495 - DNA, 20 bp, Artificial Sequence
  Description of Artificial Sequence: Synthetic oligonucleotide
  Target: SCN10A; (+) strand; PAM type: NRG; PAM sequence: TGG
ctgaaacctgggagtcaaat

SEQ ID NO: 35496 - DNA, 20 bp, Artificial Sequence
  Description of Artificial Sequence: Synthetic oligonucleotide
  Target: SCN10A; (+) strand; PAM type: NRG; PAM sequence: CAG
actcccctttcctttttcca

SEQ ID NO: 35497 - DNA, 20 bp, Artificial Sequence
  Description of Artificial Sequence: Synthetic oligonucleotide
  Target: SCN10A; (+) strand; PAM type: NRG; PAM sequence: AAG
tcttgttgatccacttccct

SEQ ID NO: 35498 - DNA, 20 bp, Artificial Sequence
  Description of Artificial Sequence: Synthetic oligonucleotide
  Target: SCN10A; (+) strand; PAM type: NRG; PAM sequence: AGG
cttgttgatccacttcccta

SEQ ID NO: 35499 - DNA, 20 bp, Artificial Sequence
  Description of Artificial Sequence: Synthetic oligonucleotide
  Target: SCN10A; (+) strand; PAM type: NRG; PAM sequence: TAG
catctataattacactttcc

SEQ ID NO: 35500 - DNA, 20 bp, Artificial Sequence
  Description of Artificial Sequence: Synthetic oligonucleotide
  Target: SCN10A; (+) strand; PAM type: NRG; PAM sequence: AAG
taattacactttcctagttt

SEQ ID NO: 35501 - DNA, 20 bp, Artificial Sequence
  Description of Artificial Sequence: Synthetic oligonucleotide
  Target: SCN10A; (+) strand; PAM type: NRG; PAM sequence: TGG
cctagtttaagacaccattt

SEQ ID NO: 35502 - DNA, 20 bp, Artificial Sequence
  Description of Artificial Sequence: Synthetic oligonucleotide
  Target: SCN10A; (+) strand; PAM type: NRG; PAM sequence: GAG
tagtttaagacaccattttg

SEQ ID NO: 35503 - DNA, 20 bp, Artificial Sequence
  Description of Artificial Sequence: Synthetic oligonucleotide
  Target: SCN10A; (+) strand; PAM type: NRG; PAM sequence: AGG
agtttaagacaccattttgg

SEQ ID NO: 35504 - DNA, 20 bp, Artificial Sequence
  Description of Artificial Sequence: Synthetic oligonucleotide
  Target: SCN10A; (+) strand; PAM type: NRG; PAM sequence: GGG
gtttaagacaccattttgga

SEQ ID NO: 35505 - DNA, 20 bp, Artificial Sequence
  Description of Artificial Sequence: Synthetic oligonucleotide
  Target: SCN10A; (+) strand; PAM type: NRG; PAM sequence: GGG
tttaagacaccattttggag

SEQ ID NO: 35506 - DNA, 20 bp, Artificial Sequence
  Description of Artificial Sequence: Synthetic oligonucleotide
  Target: SCN10A; (+) strand; PAM type: NRG; PAM sequence: TGG
caccattttggaggggtgtc

SEQ ID NO: 35507 - DNA, 20 bp, Artificial Sequence
  Description of Artificial Sequence: Synthetic oligonucleotide
  Target: SCN10A; (+) strand; PAM type: NRG; PAM sequence: TAG
gaggggtgtctggatccttt

SEQ ID NO: 35508 - DNA, 20 bp, Artificial Sequence
  Description of Artificial Sequence: Synthetic oligonucleotide
  Target: SCN10A; (+) strand; PAM type: NRG; PAM sequence: AGG
aggggtgtctggatcctttt

SEQ ID NO: 35509 - DNA, 20 bp, Artificial Sequence
  Description of Artificial Sequence: Synthetic oligonucleotide
  Target: SCN10A; (+) strand; PAM type: NRG; PAM sequence: CAG
ccttttaggctctatgcctc

SEQ ID NO: 35510 - DNA, 20 bp, Artificial Sequence
  Description of Artificial Sequence: Synthetic oligonucleotide
  Target: SCN10A; (+) strand; PAM type: NRG; PAM sequence: CGG
ccactccaactcattgtcta

SEQ ID NO: 35511 - DNA, 20 bp, Artificial Sequence
  Description of Artificial Sequence: Synthetic oligonucleotide
  Target: SCN10A; (+) strand; PAM type: NRG; PAM sequence: CAG
ctccaactcattgtctacgg

SEQ ID NO: 35512 - DNA, 20 bp, Artificial Sequence
  Description of Artificial Sequence: Synthetic oligonucleotide
  Target: SCN10A; (+) strand; PAM type: NRG; PAM sequence: TGG
attgtctacggcagctgcaa

SEQ ID NO: 35513 - DNA, 20 bp, Artificial Sequence
  Description of Artificial Sequence: Synthetic oligonucleotide
  Target: SCN10A; (+) strand; PAM type: NRG; PAM sequence: TGG
gtctacggcagctgcaatgg

SEQ ID NO: 35514 - DNA, 20 bp, Artificial Sequence
  Description of Artificial Sequence: Synthetic oligonucleotide
  Target: SCN10A; (+) strand; PAM type: NRG; PAM sequence: GGG
tctacggcagctgcaatggt

SEQ ID NO: 35515 - DNA, 20 bp, Artificial Sequence
  Description of Artificial Sequence: Synthetic oligonucleotide
  Target: SCN10A; (+) strand; PAM type: NRG; PAM sequence: TAG
ctgcaatggtgggtaatctt

SEQ ID NO: 35516 - DNA, 20 bp, Artificial Sequence
  Description of Artificial Sequence: Synthetic oligonucleotide
  Target: SCN10A; (+) strand; PAM type: NRG; PAM sequence: GAG
gcaatggtgggtaatcttta

SEQ ID NO: 35517 - DNA, 20 bp, Artificial Sequence
  Description of Artificial Sequence: Synthetic oligonucleotide
  Target: SCN10A; (+) strand; PAM type: NRG; PAM sequence: GAG
aatctttagagcacaaacct

SEQ ID NO: 35518 - DNA, 20 bp, Artificial Sequence
  Description of Artificial Sequence: Synthetic oligonucleotide
  Target: SCN10A; (+) strand; PAM type: NRG; PAM sequence: TGG
agcctcttaccatcctgcgc

SEQ ID NO: 35519 - DNA, 20 bp, Artificial Sequence
  Description of Artificial Sequence: Synthetic oligonucleotide
  Target: SCN10A; (+) strand; PAM type: NRG; PAM sequence: AAG
taccatcctgcgctggttgt

SEQ ID NO: 35520 - DNA, 20 bp, Artificial Sequence
  Description of Artificial Sequence: Synthetic oligonucleotide
  Target: SCN10A; (+) strand; PAM type: NRG; PAM sequence: AGG
accatcctgcgctggttgta

SEQ ID NO: 35521 - DNA, 20 bp, Artificial Sequence
  Description of Artificial Sequence: Synthetic oligonucleotide
  Target: SCN10A; (+) strand; PAM type: NRG; PAM sequence: CAG
cctgcgctggttgtaaggat

SEQ ID NO: 35522 - DNA, 20 bp, Artificial Sequence
  Description of Artificial Sequence: Synthetic oligonucleotide
  Target: SCN10A; (+) strand; PAM type: NRG; PAM sequence: GAG
tgcgctggttgtaaggatca

SEQ ID NO: 35523 - DNA, 20 bp, Artificial Sequence
  Description of Artificial Sequence: Synthetic oligonucleotide
  Target: SCN10A; (+) strand; PAM type: NRG; PAM sequence: CGG
gctggttgtaaggatcagag

SEQ ID NO: 35524 - DNA, 20 bp, Artificial Sequence
  Description of Artificial Sequence: Synthetic oligonucleotide
  Target: SCN10A; (+) strand; PAM type: NRG; PAM sequence: GGG
ctggttgtaaggatcagagc

SEQ ID NO: 35525 - DNA, 20 bp, Artificial Sequence
  Description of Artificial Sequence: Synthetic oligonucleotide
  Target: SCN10A; (+) strand; PAM type: NRG; PAM sequence: GGG
tggttgtaaggatcagagcg

SEQ ID NO: 35526 - DNA, 20 bp, Artificial Sequence
  Description of Artificial Sequence: Synthetic oligonucleotide
  Target: SCN10A; (+) strand; PAM type: NRG; PAM sequence: TGG
gggtgatttgttgtcttctg

SEQ ID NO: 35527 - DNA, 20 bp, Artificial Sequence
  Description of Artificial Sequence: Synthetic oligonucleotide
  Target: SCN10A; (+) strand; PAM type: NRG; PAM sequence: GAG
gtgatttgttgtcttctgtg

SEQ ID NO: 35528 - DNA, 20 bp, Artificial Sequence
  Description of Artificial Sequence: Synthetic oligonucleotide
  Target: SCN10A; (+) strand; PAM type: NRG; PAM sequence: TGG
gtggagccctctgacactct

SEQ ID NO: 35529 - DNA, 20 bp, Artificial Sequence
  Description of Artificial Sequence: Synthetic oligonucleotide
  Target: SCN10A; (+) strand; PAM type: NRG; PAM sequence: TGG
tattctatgccttctctcac

SEQ ID NO: 35530 - DNA, 20 bp, Artificial Sequence
  Description of Artificial Sequence: Synthetic oligonucleotide
  Target: SCN10A; (+) strand; PAM type: NRG; PAM sequence: TGG
ccttctctcactggcatttt

SEQ ID NO: 35531 - DNA, 20 bp, Artificial Sequence
  Description of Artificial Sequence: Synthetic oligonucleotide
  Target: SCN10A; (+) strand; PAM type: NRG; PAM sequence: GAG
ttctctcactggcatttttg

SEQ ID NO: 35532 - DNA, 20 bp, Artificial Sequence
  Description of Artificial Sequence: Synthetic oligonucleotide
  Target: SCN10A; (+) strand; PAM type: NRG; PAM sequence: AGG
tctctcactggcatttttgg

SEQ ID NO: 35533 - DNA, 20 bp, Artificial Sequence
  Description of Artificial Sequence: Synthetic oligonucleotide
  Target: SCN10A; (+) strand; PAM type: NRG; PAM sequence: AAG
actggcatttttggaggtta

SEQ ID NO: 35534 - DNA, 20 bp, Artificial Sequence
  Description of Artificial Sequence: Synthetic oligonucleotide
  Target: SCN10A; (+) strand; PAM type: NRG; PAM sequence: AGG
ctggcatttttggaggttaa

SEQ ID NO: 35535 - DNA, 20 bp, Artificial Sequence
  Description of Artificial Sequence: Synthetic oligonucleotide
  Target: SCN10A; (+) strand; PAM type: NRG; PAM sequence: TGG
aggttaaaggtgatccattg

SEQ ID NO: 35536 - DNA, 20 bp, Artificial Sequence
  Description of Artificial Sequence: Synthetic oligonucleotide
  Target: SCN10A; (+) strand; PAM type: NRG; PAM sequence: GGG
ggttaaaggtgatccattgt

SEQ ID NO: 35537 - DNA, 20 bp, Artificial Sequence
  Description of Artificial Sequence: Synthetic oligonucleotide
  Target: SCN10A; (+) strand; PAM type: NRG; PAM sequence: GAG
ttaaaggtgatccattgtgg

SEQ ID NO: 35538 - DNA, 20 bp, Artificial Sequence
  Description of Artificial Sequence: Synthetic oligonucleotide
  Target: SCN10A; (+) strand; PAM type: NRG; PAM sequence: TGG
aaggtgatccattgtgggag

SEQ ID NO: 35539 - DNA, 20 bp, Artificial Sequence
  Description of Artificial Sequence: Synthetic oligonucleotide
  Target: SCN10A; (+) strand; PAM type: NRG; PAM sequence: GAG
ggtgatccattgtgggagtg

SEQ ID NO: 35540 - DNA, 20 bp, Artificial Sequence
  Description of Artificial Sequence: Synthetic oligonucleotide
  Target: SCN10A; (+) strand; PAM type: NRG; PAM sequence: GAG
tgatccattgtgggagtgga

SEQ ID NO: 35541 - DNA, 20 bp, Artificial Sequence
  Description of Artificial Sequence: Synthetic oligonucleotide
  Target: SCN10A; (+) strand; PAM type: NRG; PAM sequence: GAG
atccattgtgggagtggaga

SEQ ID NO: 35542 - DNA, 20 bp, Artificial Sequence
  Description of Artificial Sequence: Synthetic oligonucleotide
  Target: SCN10A; (+) strand; PAM type: NRG; PAM sequence: AGG
tccattgtgggagtggagag

SEQ ID NO: 35543 - DNA, 20 bp, Artificial Sequence
  Description of Artificial Sequence: Synthetic oligonucleotide
  Target: SCN10A; (+) strand; PAM type: NRG; PAM sequence: TAG
agagaggttgtgtcaatccc

SEQ ID NO: 35544 - DNA, 20 bp, Artificial Sequence
  Description of Artificial Sequence: Synthetic oligonucleotide
  Target: SCN10A; (+) strand; PAM type: NRG; PAM sequence: TAG
gtgtcaatccctagtgctgc

SEQ ID NO: 35545 - DNA, 20 bp, Artificial Sequence
  Description of Artificial Sequence: Synthetic oligonucleotide
  Target: SCN10A; (+) strand; PAM type: NRG; PAM sequence: AAG
tagtgctgctagcacctgcg

SEQ ID NO: 35546 - DNA, 20 bp, Artificial Sequence
  Description of Artificial Sequence: Synthetic oligonucleotide
  Target: SCN10A; (+) strand; PAM type: NRG; PAM sequence: GAG
gtgctgctagcacctgcgaa

SEQ ID NO: 35547 - DNA, 20 bp, Artificial Sequence
  Description of Artificial Sequence: Synthetic oligonucleotide
  Target: SCN10A; (+) strand; PAM type: NRG; PAM sequence: GAG
gctgctagcacctgcgaaga

SEQ ID NO: 35548 - DNA, 20 bp, Artificial Sequence
  Description of Artificial Sequence: Synthetic oligonucleotide
  Target: SCN10A; (+) strand; PAM type: NRG; PAM sequence: CAG
tagcacctgcgaagagagaa

SEQ ID NO: 35549 - DNA, 20 bp, Artificial Sequence
  Description of Artificial Sequence: Synthetic oligonucleotide
  Target: SCN10A; (+) strand; PAM type: NRG; PAM sequence: CAG
cacctgcgaagagagaacag

SEQ ID NO: 35550 - DNA, 20 bp, Artificial Sequence
  Description of Artificial Sequence: Synthetic oligonucleotide
  Target: SCN10A; (+) strand; PAM type: NRG; PAM sequence: AGG
acctgcgaagagagaacagc

SEQ ID NO: 35551 - DNA, 20 bp, Artificial Sequence
  Description of Artificial Sequence: Synthetic oligonucleotide
  Target: SCN10A; (+) strand; PAM type: NRG; PAM sequence: TAG
cgaagagagaacagcaggtg

SEQ ID NO: 35552 - DNA, 20 bp, Artificial Sequence
  Description of Artificial Sequence: Synthetic oligonucleotide
  Target: SCN10A; (+) strand; PAM type: NRG; PAM sequence: TAG
agaacagcaggtgtagccaa

SEQ ID NO: 35553 - DNA, 20 bp, Artificial Sequence
  Description of Artificial Sequence: Synthetic oligonucleotide
  Target: SCN10A; (+) strand; PAM type: NRG; PAM sequence: TGG
tgtagccaatagtatttgct

SEQ ID NO: 35554 - DNA, 20 bp, Artificial Sequence
  Description of Artificial Sequence: Synthetic oligonucleotide
  Target: SCN10A; (+) strand; PAM type: NRG; PAM sequence: TAG
caatagtatttgcttggact

SEQ ID NO: 35555 - DNA, 20 bp, Artificial Sequence
  Description of Artificial Sequence: Synthetic oligonucleotide
  Target: SCN10A; (+) strand; PAM type: NRG; PAM sequence: CAG
cttagcatgaatgtgtcccc

SEQ ID NO: 35556 - DNA, 20 bp, Artificial Sequence
  Description of Artificial Sequence: Synthetic oligonucleotide
  Target: SCN10A; (+) strand; PAM type: NRG; PAM sequence: TGG
atgaatgtgtcccccagaca

SEQ ID NO: 35557 - DNA, 20 bp, Artificial Sequence
  Description of Artificial Sequence: Synthetic oligonucleotide
  Target: SCN10A; (+) strand; PAM type: NRG; PAM sequence: GGG
tgaatgtgtcccccagacat

SEQ ID NO: 35558 - DNA, 20 bp, Artificial Sequence
  Description of Artificial Sequence: Synthetic oligonucleotide
  Target: SCN10A; (+) strand; PAM type: NRG; PAM sequence: GGG
gaatgtgtcccccagacatg

SEQ ID NO: 35559 - DNA, 20 bp, Artificial Sequence
  Description of Artificial Sequence: Synthetic oligonucleotide
  Target: SCN10A; (+) strand; PAM type: NRG; PAM sequence: CAG
gtcccccagacatggggtgc

SEQ ID NO: 35560 - DNA, 20 bp, Artificial Sequence
  Description of Artificial Sequence: Synthetic oligonucleotide
  Target: SCN10A; (+) strand; PAM type: NRG; PAM sequence: AGG
tcccccagacatggggtgcc

SEQ ID NO: 35561 - DNA, 20 bp, Artificial Sequence
  Description of Artificial Sequence: Synthetic oligonucleotide
  Target: SCN10A; (+) strand; PAM type: NRG; PAM sequence: GGG
cccccagacatggggtgcca

SEQ ID NO: 35562 - DNA, 20 bp, Artificial Sequence
  Description of Artificial Sequence: Synthetic oligonucleotide
  Target: SCN10A; (+) strand; PAM type: NRG; PAM sequence: GGG
ccccagacatggggtgccag

SEQ ID NO: 35563 - DNA, 20 bp, Artificial Sequence
  Description of Artificial Sequence: Synthetic oligonucleotide
  Target: SCN10A; (+) strand; PAM type: NRG; PAM sequence: GAG
agacatggggtgccaggggt

SEQ ID NO: 35564 - DNA, 20 bp, Artificial Sequence
  Description of Artificial Sequence: Synthetic oligonucleotide
  Target: SCN10A; (+) strand; PAM type: NRG; PAM sequence: GAG
acatggggtgccaggggtga

SEQ ID NO: 35565 - DNA, 20 bp, Artificial Sequence
  Description of Artificial Sequence: Synthetic oligonucleotide
  Target: SCN10A; (+) strand; PAM type: NRG; PAM sequence: CAG
caggggtgagagatctgaaa

SEQ ID NO: 35566 - DNA, 20 bp, Artificial Sequence
  Description of Artificial Sequence: Synthetic oligonucleotide
  Target: SCN10A; (+) strand; PAM type: NRG; PAM sequence: GAG
ggggtgagagatctgaaaca

SEQ ID NO: 35567 - DNA, 20 bp, Artificial Sequence
  Description of Artificial Sequence: Synthetic oligonucleotide
  Target: SCN10A; (+) strand; PAM type: NRG; PAM sequence: AAG
gtgagagatctgaaacagag

SEQ ID NO: 35568 - DNA, 20 bp, Artificial Sequence
  Description of Artificial Sequence: Synthetic oligonucleotide
  Target: SCN10A; (+) strand; PAM type: NRG; PAM sequence: AAG
gatctgaaacagagaagctg

SEQ ID NO: 35569 - DNA, 20 bp, Artificial Sequence
  Description of Artificial Sequence: Synthetic oligonucleotide
  Target: SCN10A; (+) strand; PAM type: NRG; PAM sequence: AGG
atctgaaacagagaagctga

SEQ ID NO: 35570 - DNA, 20 bp, Artificial Sequence
  Description of Artificial Sequence: Synthetic oligonucleotide
  Target: SCN10A; (+) strand; PAM type: NRG; PAM sequence: GGG
tctgaaacagagaagctgaa

SEQ ID NO: 35571 - DNA, 20 bp, Artificial Sequence
  Description of Artificial Sequence: Synthetic oligonucleotide
  Target: SCN10A; (+) strand; PAM type: NRG; PAM sequence: TAG
aaacagagaagctgaagggt

SEQ ID NO: 35572 - DNA, 20 bp, Artificial Sequence
  Description of Artificial Sequence: Synthetic oligonucleotide
  Target: SCN10A; (+) strand; PAM type: NRG; PAM sequence: AGG
aacagagaagctgaagggtt

SEQ ID NO: 35573 - DNA, 20 bp, Artificial Sequence
  Description of Artificial Sequence: Synthetic oligonucleotide
  Target: SCN10A; (+) strand; PAM type: NRG; PAM sequence: CAG
agaagctgaagggttaggac

SEQ ID NO: 35574 - DNA, 20 bp, Artificial Sequence
  Description of Artificial Sequence: Synthetic oligonucleotide
  Target: SCN10A; (+) strand; PAM type: NRG; PAM sequence: AGG
gaagctgaagggttaggacc

SEQ ID NO: 35575 - DNA, 20 bp, Artificial Sequence
  Description of Artificial Sequence: Synthetic oligonucleotide
  Target: SCN10A; (+) strand; PAM type: NRG; PAM sequence: GGG
aagctgaagggttaggacca

SEQ ID NO: 35576 - DNA, 20 bp, Artificial Sequence
  Description of Artificial Sequence: Synthetic oligonucleotide
  Target: SCN10A; (+) strand; PAM type: NRG; PAM sequence: TGG
ctgaagggttaggaccaggg

SEQ ID NO: 35577 - DNA, 20 bp, Artificial Sequence
  Description of Artificial Sequence: Synthetic oligonucleotide
  Target: SCN10A; (+) strand; PAM type: NRG; PAM sequence: TGG
aagggttaggaccagggtgg

SEQ ID NO: 35578 - DNA, 20 bp, Artificial Sequence
  Description of Artificial Sequence: Synthetic oligonucleotide
  Target: SCN10A; (+) strand; PAM type: NRG; PAM sequence: TGG
ggttaggaccagggtggtgg

SEQ ID NO: 35579 - DNA, 20 bp, Artificial Sequence
  Description of Artificial Sequence: Synthetic oligonucleotide
  Target: SCN10A; (+) strand; PAM type: NRG; PAM sequence: GGG
gttaggaccagggtggtggt

SEQ ID NO: 35580 - DNA, 20 bp, Artificial Sequence
  Description of Artificial Sequence: Synthetic oligonucleotide
  Target: SCN10A; (+) strand; PAM type: NRG; PAM sequence: TAG
gaccagggtggtggtgggat

SEQ ID NO: 35581 - DNA, 20 bp, Artificial Sequence
  Description of Artificial Sequence: Synthetic oligonucleotide
  Target: SCN10A; (+) strand; PAM type: NRG; PAM sequence: AGG
accagggtggtggtgggatt

SEQ ID NO: 35582 - DNA, 20 bp, Artificial Sequence
  Description of Artificial Sequence: Synthetic oligonucleotide
  Target: SCN10A; (+) strand; PAM type: NRG; PAM sequence: TGG
gtggtggtgggattaggcca

SEQ ID NO: 35583 - DNA, 20 bp, Artificial Sequence
  Description of Artificial Sequence: Synthetic oligonucleotide
  Target: SCN10A; (+) strand; PAM type: NRG; PAM sequence: CAG
gtggtgggattaggccatgg

SEQ ID NO: 35584 - DNA, 20 bp, Artificial Sequence
  Description of Artificial Sequence: Synthetic oligonucleotide
  Target: SCN10A; (+) strand; PAM type: NRG; PAM sequence: AGG
tggtgggattaggccatggc

SEQ ID NO: 35585 - DNA, 20 bp, Artificial Sequence
  Description of Artificial Sequence: Synthetic oligonucleotide
  Target: SCN10A; (+) strand; PAM type: NRG; PAM sequence: CAG
ggattaggccatggcaggaa

SEQ ID NO: 35586 - DNA, 20 bp, Artificial Sequence
  Description of Artificial Sequence: Synthetic oligonucleotide
  Target: SCN10A; (+) strand; PAM type: NRG; PAM sequence: CGG
catggcaggaacagacacct

SEQ ID NO: 35587 - DNA, 20 bp, Artificial Sequence
  Description of Artificial Sequence: Synthetic oligonucleotide
  Target: SCN10A; (+) strand; PAM type: NRG; PAM sequence: GGG
atggcaggaacagacacctc

SEQ ID NO: 35588 - DNA, 20 bp, Artificial Sequence
  Description of Artificial Sequence: Synthetic oligonucleotide
  Target: SCN10A; (+) strand; PAM type: NRG; PAM sequence: TGG
gggtcacccccactcattca

SEQ ID NO: 35589 - DNA, 20 bp, Artificial Sequence
  Description of Artificial Sequence: Synthetic oligonucleotide
  Target: SCN10A; (+) strand; PAM type: NRG; PAM sequence: GGG
ggtcacccccactcattcat

SEQ ID NO: 35590 - DNA, 20 bp, Artificial Sequence
  Description of Artificial Sequence: Synthetic oligonucleotide
  Target: SCN10A; (+) strand; PAM type: NRG; PAM sequence: GGG
gtcacccccactcattcatg

SEQ ID NO: 35591 - DNA, 20 bp, Artificial Sequence
  Description of Artificial Sequence: Synthetic oligonucleotide
  Target: SCN10A; (+) strand; PAM type: NRG; PAM sequence: TGG
tcattcatggggtactctgt

SEQ ID NO: 35592 - DNA, 20 bp, Artificial Sequence
  Description of Artificial Sequence: Synthetic oligonucleotide
  Target: SCN10A; (+) strand; PAM type: NRG; PAM sequence: CAG
tactctgttggtgccccacc

SEQ ID NO: 35593 - DNA, 20 bp, Artificial Sequence
  Description of Artificial Sequence: Synthetic oligonucleotide
  Target: SCN10A; (+) strand; PAM type: NRG; PAM sequence: CAG
cccacccagatccctttcac

SEQ ID NO: 35594 - DNA, 20 bp, Artificial Sequence
  Description of Artificial Sequence: Synthetic oligonucleotide
  Target: SCN10A; (+) strand; PAM type: NRG; PAM sequence: AGG
ccacccagatccctttcacc

SEQ ID NO: 35595 - DNA, 20 bp, Artificial Sequence
  Description of Artificial Sequence: Synthetic oligonucleotide
  Target: SCN10A; (+) strand; PAM type: NRG; PAM sequence: CAG
ccagatccctttcaccaggt

SEQ ID NO: 35596 - DNA, 20 bp, Artificial Sequence
  Description of Artificial Sequence: Synthetic oligonucleotide
  Target: SCN10A; (+) strand; PAM type: NRG; PAM sequence: CAG
tccctttcaccaggtcagca

SEQ ID NO: 35597 - DNA, 20 bp, Artificial Sequence
  Description of Artificial Sequence: Synthetic oligonucleotide
  Target: SCN10A; (+) strand; PAM type: NRG; PAM sequence: GAG
caggtcagcacagctatccc

SEQ ID NO: 35598 - DNA, 20 bp, Artificial Sequence
  Description of Artificial Sequence: Synthetic oligonucleotide
  Target: SCN10A; (+) strand; PAM type: NRG; PAM sequence: TGG
gctatcccgagctgcttgca

SEQ ID NO: 35599 - DNA, 20 bp, Artificial Sequence
  Description of Artificial Sequence: Synthetic oligonucleotide
  Target: SCN10A; (+) strand; PAM type: NRG; PAM sequence: CAG
atcccgagctgcttgcatgg

SEQ ID NO: 35600 - DNA, 20 bp, Artificial Sequence
  Description of Artificial Sequence: Synthetic oligonucleotide
  Target: SCN10A; (+) strand; PAM type: NRG; PAM sequence: CAG
ccgagctgcttgcatggcag

SEQ ID NO: 35601 - DNA, 20 bp, Artificial Sequence
  Description of Artificial Sequence: Synthetic oligonucleotide
  Target: SCN10A; (+) strand; PAM type: NRG; PAM sequence: TGG
gcttgcatggcagcagctga

SEQ ID NO: 35602 - DNA, 20 bp, Artificial Sequence
  Description of Artificial Sequence: Synthetic oligonucleotide
  Target: SCN10A; (+) strand; PAM type: NRG; PAM sequence: CAG
cagctgatggctcatacttg

SEQ ID NO: 35603 - DNA, 20 bp, Artificial Sequence
  Description of Artificial Sequence: Synthetic oligonucleotide
  Target: SCN10A; (+) strand; PAM type: NRG; PAM sequence: AAG
cttgcagcattctacaaaaa

SEQ ID NO: 35604 - DNA, 20 bp, Artificial Sequence
  Description of Artificial Sequence: Synthetic oligonucleotide
  Target: SCN10A; (+) strand; PAM type: NRG; PAM sequence: TGG
tctacaaaaaaagtctcttt

SEQ ID NO: 35605 - DNA, 20 bp, Artificial Sequence
  Description of Artificial Sequence: Synthetic oligonucleotide
  Target: SCN10A; (+) strand; PAM type: NRG; PAM sequence: TGG
ctcttttggctgcctgcttc

SEQ ID NO: 35606 - DNA, 20 bp, Artificial Sequence
  Description of Artificial Sequence: Synthetic oligonucleotide
  Target: SCN10A; (+) strand; PAM type: NRG; PAM sequence: GGG
tcttttggctgcctgcttct

SEQ ID NO: 35607 - DNA, 20 bp, Artificial Sequence
  Description of Artificial Sequence: Synthetic oligonucleotide
  Target: SCN10A; (+) strand; PAM type: NRG; PAM sequence: TAG
ttggctgcctgcttctggga

SEQ ID NO: 35608 - DNA, 20 bp, Artificial Sequence
  Description of Artificial Sequence: Synthetic oligonucleotide
  Target: SCN10A; (+) strand; PAM type: NRG; PAM sequence: AGG
tggctgcctgcttctgggat

SEQ ID NO: 35609 - DNA, 20 bp, Artificial Sequence
  Description of Artificial Sequence: Synthetic oligonucleotide
  Target: SCN10A; (+) strand; PAM type: NRG; PAM sequence: TGG
gcctgcttctgggataggta

SEQ ID NO: 35610 - DNA, 20 bp, Artificial Sequence
  Description of Artificial Sequence: Synthetic oligonucleotide
  Target: SCN10A; (+) strand; PAM type: NRG; PAM sequence: GGG
cctgcttctgggataggtat

SEQ ID NO: 35611 - DNA, 20 bp, Artificial Sequence
  Description of Artificial Sequence: Synthetic oligonucleotide
  Target: SCN10A; (+) strand; PAM type: NRG; PAM sequence: GGG
ctgcttctgggataggtatg

SEQ ID NO: 35612 - DNA, 20 bp, Artificial Sequence
  Description of Artificial Sequence: Synthetic oligonucleotide
  Target: SCN10A; (+) strand; PAM type: NRG; PAM sequence: GAG
gcttctgggataggtatggg

SEQ ID NO: 35613 - DNA, 20 bp, Artificial Sequence
  Description of Artificial Sequence: Synthetic oligonucleotide
  Target: SCN10A; (+) strand; PAM type: NRG; PAM sequence: AGG
cttctgggataggtatgggg

SEQ ID NO: 35614 - DNA, 20 bp, Artificial Sequence
  Description of Artificial Sequence: Synthetic oligonucleotide
  Target: SCN10A; (+) strand; PAM type: NRG; PAM sequence: GGG
ttctgggataggtatgggga

SEQ ID NO: 35615 - DNA, 20 bp, Artificial Sequence
  Description of Artificial Sequence: Synthetic oligonucleotide
  Target: SCN10A; (+) strand; PAM type: NRG; PAM sequence: AAG
atggggagggtaaaaaaaaa

SEQ ID NO: 35616 - DNA, 20 bp, Artificial Sequence
  Description of Artificial Sequence: Synthetic oligonucleotide
  Target: SCN10A; (+) strand; PAM type: NRG; PAM sequence: TGG
ggagggtaaaaaaaaaaagc

SEQ ID NO: 35617 - DNA, 20 bp, Artificial Sequence
  Description of Artificial Sequence: Synthetic oligonucleotide
  Target: SCN10A; (+) strand; PAM type: NRG; PAM sequence: AAG
aaagctggcccccttgcctc

SEQ ID NO: 35618 - DNA, 20 bp, Artificial Sequence
  Description of Artificial Sequence: Synthetic oligonucleotide
  Target: SCN10A; (+) strand; PAM type: NRG; PAM sequence: AGG
aagctggcccccttgcctca

SEQ ID NO: 35619 - DNA, 20 bp, Artificial Sequence
  Description of Artificial Sequence: Synthetic oligonucleotide
  Target: SCN10A; (+) strand; PAM type: NRG; PAM sequence: TAG
ctggcccccttgcctcaagg

SEQ ID NO: 35620 - DNA, 20 bp, Artificial Sequence
  Description of Artificial Sequence: Synthetic oligonucleotide
  Target: SCN10A; (+) strand; PAM type: NRG; PAM sequence: AGG
tggcccccttgcctcaaggt

SEQ ID NO: 35621 - DNA, 20 bp, Artificial Sequence
  Description of Artificial Sequence: Synthetic oligonucleotide
  Target: SCN10A; (+) strand; PAM type: NRG; PAM sequence: TGG
cctcaaggtaggactaactg

SEQ ID NO: 35622 - DNA, 20 bp, Artificial Sequence
  Description of Artificial Sequence: Synthetic oligonucleotide
  Target: SCN10A; (+) strand; PAM type: NRG; PAM sequence: CAG
aggtaggactaactgtggta

SEQ ID NO: 35623 - DNA, 20 bp, Artificial Sequence
  Description of Artificial Sequence: Synthetic oligonucleotide
  Target: SCN10A; (+) strand; PAM type: NRG; PAM sequence: AGG
ggtaggactaactgtggtac

SEQ ID NO: 35624 - DNA, 20 bp, Artificial Sequence
  Description of Artificial Sequence: Synthetic oligonucleotide
  Target: SCN10A; (+) strand; PAM type: NRG; PAM sequence: CAG
ctgtggtacaggtcatgccc

SEQ ID NO: 35625 - DNA, 20 bp, Artificial Sequence
  Description of Artificial Sequence: Synthetic oligonucleotide
  Target: SCN10A; (+) strand; PAM type: NRG; PAM sequence: GAG
gtggtacaggtcatgcccca

SEQ ID NO: 35626 - DNA, 20 bp, Artificial Sequence
  Description of Artificial Sequence: Synthetic oligonucleotide
  Target: SCN10A; (+) strand; PAM type: NRG; PAM sequence: TGG
tcatgccccagagttcccca

SEQ ID NO: 35627 - DNA, 20 bp, Artificial Sequence
  Description of Artificial Sequence: Synthetic oligonucleotide
  Target: SCN10A; (+) strand; PAM type: NRG; PAM sequence: GGG
catgccccagagttccccat

SEQ ID NO: 35628 - DNA, 20 bp, Artificial Sequence
  Description of Artificial Sequence: Synthetic oligonucleotide
  Target: SCN10A; (+) strand; PAM type: NRG; PAM sequence: AAG
ccagagttccccatgggatc

SEQ ID NO: 35629 - DNA, 20 bp, Artificial Sequence
  Description of Artificial Sequence: Synthetic oligonucleotide
  Target: SCN10A; (+) strand; PAM type: NRG; PAM sequence: AAG
ttccccatgggatcaagctg

SEQ ID NO: 35630 - DNA, 20 bp, Artificial Sequence
  Description of Artificial Sequence: Synthetic oligonucleotide
  Target: SCN10A; (+) strand; PAM type: NRG; PAM sequence: TGG
ccatgggatcaagctgaagc

SEQ ID NO: 35631 - DNA, 20 bp, Artificial Sequence
  Description of Artificial Sequence: Synthetic oligonucleotide
  Target: SCN10A; (+) strand; PAM type: NRG; PAM sequence: TAG
atcaagctgaagctggtctc

SEQ ID NO: 35632 - DNA, 20 bp, Artificial Sequence
  Description of Artificial Sequence: Synthetic oligonucleotide
  Target: SCN10A; (+) strand; PAM type: NRG; PAM sequence: GAG
gctgaagctggtctctagct

SEQ ID NO: 35633 - DNA, 20 bp, Artificial Sequence
  Description of Artificial Sequence: Synthetic oligonucleotide
  Target: SCN10A; (+) strand; PAM type: NRG; PAM sequence: TAG
agctgagaacactccttgtt

SEQ ID NO: 35634 - DNA, 20 bp, Artificial Sequence
  Description of Artificial Sequence: Synthetic oligonucleotide
  Target: SCN10A; (+) strand; PAM type: NRG; PAM sequence: GAG
tgcttcattcgctttctcct

SEQ ID NO: 35635 - DNA, 20 bp, Artificial Sequence
  Description of Artificial Sequence: Synthetic oligonucleotide
  Target: SCN10A; (+) strand; PAM type: NRG; PAM sequence: GAG
cttcattcgctttctcctga

SEQ ID NO: 35636 - DNA, 20 bp, Artificial Sequence
  Description of Artificial Sequence: Synthetic oligonucleotide
  Target: SCN10A; (+) strand; PAM type: NRG; PAM sequence: TAG
tcctgagagcactccctcaa

SEQ ID NO: 35637 - DNA, 20 bp, Artificial Sequence
  Description of Artificial Sequence: Synthetic oligonucleotide
  Target: SCN10A; (+) strand; PAM type: NRG; PAM sequence: AGG
cctgagagcactccctcaat

SEQ ID NO: 35638 - DNA, 20 bp, Artificial Sequence
  Description of Artificial Sequence: Synthetic oligonucleotide
  Target: SCN10A; (+) strand; PAM type: NRG; PAM sequence: AAG
cctcaataggtcacttgcac

SEQ ID NO: 35639 - DNA, 20 bp, Artificial Sequence
  Description of Artificial Sequence: Synthetic oligonucleotide
  Target: SCN10A; (+) strand; PAM type: NRG; PAM sequence: TAG
cttgcacaagaatcctcact

SEQ ID NO: 35640 - DNA, 20 bp, Artificial Sequence
  Description of Artificial Sequence: Synthetic oligonucleotide
  Target: SCN10A; (+) strand; PAM type: NRG; PAM sequence: GAG
cctcacttagcttcttcttt

SEQ ID NO: 35641 - DNA, 20 bp, Artificial Sequence
  Description of Artificial Sequence: Synthetic oligonucleotide
  Target: SCN10A; (+) strand; PAM type: NRG; PAM sequence: TGG
tgagaaaacctgatctaata

SEQ ID NO: 35642 - DNA, 20 bp, Artificial Sequence
  Description of Artificial Sequence: Synthetic oligonucleotide
  Target: SCN10A; (+) strand; PAM type: NRG; PAM sequence: GAG
cctgatctaatatggtccct

SEQ ID NO: 35643 - DNA, 20 bp, Artificial Sequence
  Description of Artificial Sequence: Synthetic oligonucleotide
  Target: SCN10A; (+) strand; PAM type: NRG; PAM sequence: AGG
ctgatctaatatggtccctg

SEQ ID NO: 35644 - DNA, 20 bp, Artificial Sequence
  Description of Artificial Sequence: Synthetic oligonucleotide
  Target: SCN10A; (+) strand; PAM type: NRG; PAM sequence: AAG
tctaatatggtccctgaggc

SEQ ID NO: 35645 - DNA, 20 bp, Artificial Sequence
  Description of Artificial Sequence: Synthetic oligonucleotide
  Target: SCN10A; (+) strand; PAM type: NRG; PAM sequence: TAG
aggcaagatgattcctccta

SEQ ID NO: 35646 - DNA, 20 bp, Artificial Sequence
  Description of Artificial Sequence: Synthetic oligonucleotide
  Target: SCN10A; (+) strand; PAM type: NRG; PAM sequence: CGG
tcctcctatagctccctaaa

SEQ ID NO: 35647 - DNA, 20 bp, Artificial Sequence
  Description of Artificial Sequence: Synthetic oligonucleotide
  Target: SCN10A; (+) strand; PAM type: NRG; PAM sequence: AAG
cctaaacggtgccctaattg

SEQ ID NO: 35648 - DNA, 20 bp, Artificial Sequence
  Description of Artificial Sequence: Synthetic oligonucleotide
  Target: SCN10A; (+) strand; PAM type: NRG; PAM sequence: TGG
aaacggtgccctaattgaag

SEQ ID NO: 35649 - DNA, 20 bp, Artificial Sequence
  Description of Artificial Sequence: Synthetic oligonucleotide
  Target: SCN10A; (+) strand; PAM type: NRG; PAM sequence: TAG
ggtgccctaattgaagtggc

SEQ ID NO: 35650 - DNA, 20 bp, Artificial Sequence
  Description of Artificial Sequence: Synthetic oligonucleotide
  Target: SCN10A; (+) strand; PAM type: NRG; PAM sequence: CAG
cctaattgaagtggctagtc

SEQ ID NO: 35651 - DNA, 20 bp, Artificial Sequence
  Description of Artificial Sequence: Synthetic oligonucleotide
  Target: SCN10A; (+) strand; PAM type: NRG; PAM sequence: CAG
ttgaagtggctagtccagaa

SEQ ID NO: 35652 - DNA, 20 bp, Artificial Sequence
  Description of Artificial Sequence: Synthetic oligonucleotide
  Target: SCN10A; (+) strand; PAM type: NRG; PAM sequence: AAG
gctagtccagaacagtatcc

SEQ ID NO: 35653 - DNA, 20 bp, Artificial Sequence
  Description of Artificial Sequence: Synthetic oligonucleotide
  Target: SCN10A; (+) strand; PAM type: NRG; PAM sequence: TGG
tccagaacagtatccaagaa

SEQ ID NO: 35654 - DNA, 20 bp, Artificial Sequence
  Description of Artificial Sequence: Synthetic oligonucleotide
  Target: SCN10A; (+) strand; PAM type: NRG; PAM sequence: CAG
gaacagtatccaagaatgga

SEQ ID NO: 35655 - DNA, 20 bp, Artificial Sequence
  Description of Artificial Sequence: Synthetic oligonucleotide
  Target: SCN10A; (+) strand; PAM type: NRG; PAM sequence: AAG
agtctgcaaccttcttcaca

SEQ ID NO: 35656 - DNA, 20 bp, Artificial Sequence
  Description of Artificial Sequence: Synthetic oligonucleotide
  Target: SCN10A; (+) strand; PAM type: NRG; PAM sequence: CGG
cacaaacctcctgctccttc

SEQ ID NO: 35657 - DNA, 20 bp, Artificial Sequence
  Description of Artificial Sequence: Synthetic oligonucleotide
  Target: SCN10A; (+) strand; PAM type: NRG; PAM sequence: GAG
caaacctcctgctccttccg

SEQ ID NO: 35658 - DNA, 20 bp, Artificial Sequence
  Description of Artificial Sequence: Synthetic oligonucleotide
  Target: SCN10A; (+) strand; PAM type: NRG; PAM sequence: GAG
tgctccttccggagcatctc

SEQ ID NO: 35659 - DNA, 20 bp, Artificial Sequence
  Description of Artificial Sequence: Synthetic oligonucleotide
  Target: SCN10A; (+) strand; PAM type: NRG; PAM sequence: AGG
gctccttccggagcatctcg

SEQ ID NO: 35660 - DNA, 20 bp, Artificial Sequence
  Description of Artificial Sequence: Synthetic oligonucleotide
  Target: SCN10A; (+) strand; PAM type: NRG; PAM sequence: GGG
ctccttccggagcatctcga

SEQ ID NO: 35661 - DNA, 20 bp, Artificial Sequence
  Description of Artificial Sequence: Synthetic oligonucleotide
  Target: SCN10A; (+) strand; PAM type: NRG; PAM sequence: TGG
ggagcatctcgagggcctcc

SEQ ID NO: 35662 - DNA, 20 bp, Artificial Sequence
  Description of Artificial Sequence: Synthetic oligonucleotide
  Target: SCN10A; (+) strand; PAM type: NRG; PAM sequence: CAG
ctcctttgcttcaatttcat

SEQ ID NO: 35663 - DNA, 20 bp, Artificial Sequence
  Description of Artificial Sequence: Synthetic oligonucleotide
  Target: SCN10A; (+) strand; PAM type: NRG; PAM sequence: TGG
ctttgcttcaatttcatcag

SEQ ID NO: 35664 - DNA, 20 bp, Artificial Sequence
  Description of Artificial Sequence: Synthetic oligonucleotide
  Target: SCN10A; (+) strand; PAM type: NRG; PAM sequence: TGG
caatttcatcagtggttgcc

SEQ ID NO: 35665 - DNA, 20 bp, Artificial Sequence
  Description of Artificial Sequence: Synthetic oligonucleotide
  Target: SCN10A; (+) strand; PAM type: NRG; PAM sequence: TGG
gttctgctcctcatacgcca

SEQ ID NO: 35666 - DNA, 20 bp, Artificial Sequence
  Description of Artificial Sequence: Synthetic oligonucleotide
  Target: SCN10A; (+) strand; PAM type: NRG; PAM sequence: CAG
ctcatacgccatggtgacta

SEQ ID NO: 35667 - DNA, 20 bp, Artificial Sequence
  Description of Artificial Sequence: Synthetic oligonucleotide
  Target: SCN10A; (+) strand; PAM type: NRG; PAM sequence: AAG
acgccatggtgactacagcc

SEQ ID NO: 35668 - DNA, 20 bp, Artificial Sequence
  Description of Artificial Sequence: Synthetic oligonucleotide
  Target: SCN10A; (+) strand; PAM type: NRG; PAM sequence: AAG
tggtgactacagccaagatc

SEQ ID NO: 35669 - DNA, 20 bp, Artificial Sequence
  Description of Artificial Sequence: Synthetic oligonucleotide
  Target: SCN10A; (+) strand; PAM type: NRG; PAM sequence: CAG
acagccaagatcaagttgac

SEQ ID NO: 35670 - DNA, 20 bp, Artificial Sequence
  Description of Artificial Sequence: Synthetic oligonucleotide
  Target: SCN10A; (+) strand; PAM type: NRG; PAM sequence: AGG
cagccaagatcaagttgacc

SEQ ID NO: 35671 - DNA, 20 bp, Artificial Sequence
  Description of Artificial Sequence: Synthetic oligonucleotide
  Target: SCN10A; (+) strand; PAM type: NRG; PAM sequence: TAG
ccaagatcaagttgaccagg

SEQ ID NO: 35672 - DNA, 20 bp, Artificial Sequence
  Description of Artificial Sequence: Synthetic oligonucleotide
  Target: SCN10A; (+) strand; PAM type: NRG; PAM sequence: AAG
gatcaagttgaccaggtaga

SEQ ID NO: 35673 - DNA, 20 bp, Artificial Sequence
  Description of Artificial Sequence: Synthetic oligonucleotide
  Target: SCN10A; (+) strand; PAM type: NRG; PAM sequence: CAG
ttgaccaggtagaaagatcc

SEQ ID NO: 35674 - DNA, 20 bp, Artificial Sequence
  Description of Artificial Sequence: Synthetic oligonucleotide
  Target: SCN10A; (+) strand; PAM type: NRG; PAM sequence: AGG
tgaccaggtagaaagatccc

SEQ ID NO: 35675 - DNA, 20 bp, Artificial Sequence
  Description of Artificial Sequence: Synthetic oligonucleotide
  Target: SCN10A; (+) strand; PAM type: NRG; PAM sequence: AAG
ccaggtagaaagatcccagg

SEQ ID NO: 35676 - DNA, 20 bp, Artificial Sequence
  Description of Artificial Sequence: Synthetic oligonucleotide
  Target: SCN10A; (+) strand; PAM type: NRG; PAM sequence: GAG
aaagatcccaggaagattac

SEQ ID NO: 35677 - DNA, 20 bp, Artificial Sequence
  Description of Artificial Sequence: Synthetic oligonucleotide
  Target: SCN10A; (+) strand; PAM type: NRG; PAM sequence: AAG
ggaagattacgagcacaaaa

SEQ ID NO: 35678 - DNA, 20 bp, Artificial Sequence
  Description of Artificial Sequence: Synthetic oligonucleotide
  Target: SCN10A; (+) strand; PAM type: NRG; PAM sequence: TAG
cgagcacaaaaaagatcata

SEQ ID NO: 35679 - DNA, 20 bp, Artificial Sequence
  Description of Artificial Sequence: Synthetic oligonucleotide
  Target: SCN10A; (+) strand; PAM type: NRG; PAM sequence: CAG
aaagatcatatagattttcc

SEQ ID NO: 35680 - DNA, 20 bp, Artificial Sequence
  Description of Artificial Sequence: Synthetic oligonucleotide
  Target: SCN10A; (+) strand; PAM type: NRG; PAM sequence: AAG
gatcatatagattttcccag

SEQ ID NO: 35681 - DNA, 20 bp, Artificial Sequence
  Description of Artificial Sequence: Synthetic oligonucleotide
  Target: SCN10A; (+) strand; PAM type: NRG; PAM sequence: CAG
tagattttcccagaagtcct

SEQ ID NO: 35682 - DNA, 20 bp, Artificial Sequence
  Description of Artificial Sequence: Synthetic oligonucleotide
  Target: SCN10A; (+) strand; PAM type: NRG; PAM sequence: AGG
agattttcccagaagtcctc

SEQ ID NO: 35683 - DNA, 20 bp, Artificial Sequence
  Description of Artificial Sequence: Synthetic oligonucleotide
  Target: SCN10A; (+) strand; PAM type: NRG; PAM sequence: GGG
gattttcccagaagtcctca

SEQ ID NO: 35684 - DNA, 20 bp, Artificial Sequence
  Description of Artificial Sequence: Synthetic oligonucleotide
  Target: SCN10A; (+) strand; PAM type: NRG; PAM sequence: CAG
ccagaagtcctcagggtctg

SEQ ID NO: 35685 - DNA, 20 bp, Artificial Sequence
  Description of Artificial Sequence: Synthetic oligonucleotide
  Target: SCN10A; (+) strand; PAM type: NRG; PAM sequence: AGG
cagaagtcctcagggtctgc

SEQ ID NO: 35686 - DNA, 20 bp, Artificial Sequence
  Description of Artificial Sequence: Synthetic oligonucleotide
  Target: SCN10A; (+) strand; PAM type: NRG; PAM sequence: AAG
tcctcagggtctgcaggttc

SEQ ID NO: 35687 - DNA, 20 bp, Artificial Sequence
  Description of Artificial Sequence: Synthetic oligonucleotide
  Target: SCN10A; (+) strand; PAM type: NRG; PAM sequence: AGG
cctcagggtctgcaggttca

SEQ ID NO: 35688 - DNA, 20 bp, Artificial Sequence
  Description of Artificial Sequence: Synthetic oligonucleotide
  Target: SCN10A; (+) strand; PAM type: NRG; PAM sequence: GGG
ctcagggtctgcaggttcaa

SEQ ID NO: 35689 - DNA, 20 bp, Artificial Sequence
  Description of Artificial Sequence: Synthetic oligonucleotide
  Target: SCN10A; (+) strand; PAM type: NRG; PAM sequence: AAG
gggtctgcaggttcaaggga

SEQ ID NO: 35690 - DNA, 20 bp, Artificial Sequence
  Description of Artificial Sequence: Synthetic oligonucleotide
  Target: SCN10A; (+) strand; PAM type: NRG; PAM sequence: AAG
tctgcaggttcaagggaaag

SEQ ID NO: 35691 - DNA, 20 bp, Artificial Sequence
  Description of Artificial Sequence: Synthetic oligonucleotide
  Target: SCN10A; (+) strand; PAM type: NRG; PAM sequence: GAG
tgcaggttcaagggaaagaa

SEQ ID NO: 35692 - DNA, 20 bp, Artificial Sequence
  Description of Artificial Sequence: Synthetic oligonucleotide
  Target: SCN10A; (+) strand; PAM type: NRG; PAM sequence: TAG
agaagagaaacctgtaccca

SEQ ID NO: 35693 - DNA, 20 bp, Artificial Sequence
  Description of Artificial Sequence: Synthetic oligonucleotide
  Target: SCN10A; (+) strand; PAM type: NRG; PAM sequence: TGG
aaacctgtacccatagcaca

SEQ ID NO: 35694 - DNA, 20 bp, Artificial Sequence
  Description of Artificial Sequence: Synthetic oligonucleotide
  Target: SCN10A; (+) strand; PAM type: NRG; PAM sequence: AAG
gcacatggacccctgaattt

SEQ ID NO: 35695 - DNA, 20 bp, Artificial Sequence
  Description of Artificial Sequence: Synthetic oligonucleotide
  Target: SCN10A; (+) strand; PAM type: NRG; PAM sequence: CAG
atggacccctgaatttaagt

SEQ ID NO: 35696 - DNA, 20 bp, Artificial Sequence
  Description of Artificial Sequence: Synthetic oligonucleotide
  Target: SCN10A; (+) strand; PAM type: NRG; PAM sequence: CAG
gaatttaagtcagcctcctc

SEQ ID NO: 35697 - DNA, 20 bp, Artificial Sequence
  Description of Artificial Sequence: Synthetic oligonucleotide
  Target: SCN10A; (+) strand; PAM type: NRG; PAM sequence: AGG
aatttaagtcagcctcctcc

SEQ ID NO: 35698 - DNA, 20 bp, Artificial Sequence
  Description of Artificial Sequence: Synthetic oligonucleotide
  Target: SCN10A; (+) strand; PAM type: NRG; PAM sequence: AAG
aagtcagcctcctccaggaa

SEQ ID NO: 35699 - DNA, 20 bp, Artificial Sequence
  Description of Artificial Sequence: Synthetic oligonucleotide
  Target: SCN10A; (+) strand; PAM type: NRG; PAM sequence: CAG
agcctcctccaggaaaagca

SEQ ID NO: 35700 - DNA, 20 bp, Artificial Sequence
  Description of Artificial Sequence: Synthetic oligonucleotide
  Target: SCN10A; (+) strand; PAM type: NRG; PAM sequence: CAG
ccaggaaaagcacagccatg

SEQ ID NO: 35701 - DNA, 20 bp, Artificial Sequence
  Description of Artificial Sequence: Synthetic oligonucleotide
  Target: SCN10A; (+) strand; PAM type: NRG; PAM sequence: CAG
cagccatgcagctgacccac

SEQ ID NO: 35702 - DNA, 20 bp, Artificial Sequence
  Description of Artificial Sequence: Synthetic oligonucleotide
  Target: SCN10A; (+) strand; PAM type: NRG; PAM sequence: AAG
tgacccaccagcctccaacc

SEQ ID NO: 35703 - DNA, 20 bp, Artificial Sequence
  Description of Artificial Sequence: Synthetic oligonucleotide
  Target: SCN10A; (+) strand; PAM type: NRG; PAM sequence: TGG
agcctccaaccaagtctgcg

SEQ ID NO: 35704 - DNA, 20 bp, Artificial Sequence
  Description of Artificial Sequence: Synthetic oligonucleotide
  Target: SCN10A; (+) strand; PAM type: NRG; PAM sequence: GGG
gcctccaaccaagtctgcgt

SEQ ID NO: 35705 - DNA, 20 bp, Artificial Sequence
  Description of Artificial Sequence: Synthetic oligonucleotide
  Target: SCN10A; (+) strand; PAM type: NRG; PAM sequence: GGG
cctccaaccaagtctgcgtg

SEQ ID NO: 35706 - DNA, 20 bp, Artificial Sequence
  Description of Artificial Sequence: Synthetic oligonucleotide
  Target: SCN10A; (+) strand; PAM type: NRG; PAM sequence: GGG
ctccaaccaagtctgcgtgg

SEQ ID NO: 35707 - DNA, 20 bp, Artificial Sequence
  Description of Artificial Sequence: Synthetic oligonucleotide
  Target: SCN10A; (+) strand; PAM type: NRG; PAM sequence: CAG
caagtctgcgtgggggaatg

SEQ ID NO: 35708 - DNA, 20 bp, Artificial Sequence
  Description of Artificial Sequence: Synthetic oligonucleotide
  Target: SCN10A; (+) strand; PAM type: NRG; PAM sequence: CAG
ctgcgtgggggaatgcagct

SEQ ID NO: 35709 - DNA, 20 bp, Artificial Sequence
  Description of Artificial Sequence: Synthetic oligonucleotide
  Target: SCN10A; (+) strand; PAM type: NRG; PAM sequence: TGG
gaatgcagctcagtacctgc

SEQ ID NO: 35710 - DNA, 20 bp, Artificial Sequence
  Description of Artificial Sequence: Synthetic oligonucleotide
  Target: SCN10A; (+) strand; PAM type: NRG; PAM sequence: TAG
tgcagctcagtacctgctgg

SEQ ID NO: 35711 - DNA, 20 bp, Artificial Sequence
  Description of Artificial Sequence: Synthetic oligonucleotide
  Target: SCN10A; (+) strand; PAM type: NRG; PAM sequence: GAG
cagctcagtacctgctggta

SEQ ID NO: 35712 - DNA, 20 bp, Artificial Sequence
  Description of Artificial Sequence: Synthetic oligonucleotide
  Target: SCN10A; (+) strand; PAM type: NRG; PAM sequence: AGG
agctcagtacctgctggtag

SEQ ID NO: 35713 - DNA, 20 bp, Artificial Sequence
  Description of Artificial Sequence: Synthetic oligonucleotide
  Target: SCN10A; (+) strand; PAM type: NRG; PAM sequence: CAG
cctgctggtagaggcgttcc

SEQ ID NO: 35714 - DNA, 20 bp, Artificial Sequence
  Description of Artificial Sequence: Synthetic oligonucleotide
  Target: SCN10A; (+) strand; PAM type: NRG; PAM sequence: AGG
ctgctggtagaggcgttccc

SEQ ID NO: 35715 - DNA, 20 bp, Artificial Sequence
  Description of Artificial Sequence: Synthetic oligonucleotide
  Target: SCN10A; (+) strand; PAM type: NRG; PAM sequence: GAG
tcccaggaatcctgtgtcat

SEQ ID NO: 35716 - DNA, 20 bp, Artificial Sequence
  Description of Artificial Sequence: Synthetic oligonucleotide
  Target: SCN10A; (+) strand; PAM type: NRG; PAM sequence: AGG
cccaggaatcctgtgtcatg

SEQ ID NO: 35717 - DNA, 20 bp, Artificial Sequence
  Description of Artificial Sequence: Synthetic oligonucleotide
  Target: SCN10A; (+) strand; PAM type: NRG; PAM sequence: CGG
aggaatcctgtgtcatgagg

SEQ ID NO: 35718 - DNA, 20 bp, Artificial Sequence
  Description of Artificial Sequence: Synthetic oligonucleotide
  Target: SCN10A; (+) strand; PAM type: NRG; PAM sequence: CAG
tcctgtgtcatgaggcggaa

SEQ ID NO: 35719 - DNA, 20 bp, Artificial Sequence
  Description of Artificial Sequence: Synthetic oligonucleotide
  Target: SCN10A; (+) strand; PAM type: NRG; PAM sequence: GAG
gtgtcatgaggcggaacagt

SEQ ID NO: 35720 - DNA, 20 bp, Artificial Sequence
  Description of Artificial Sequence: Synthetic oligonucleotide
  Target: SCN10A; (+) strand; PAM type: NRG; PAM sequence: GAG
gtcatgaggcggaacagtga

SEQ ID NO: 35721 - DNA, 20 bp, Artificial Sequence
  Description of Artificial Sequence: Synthetic oligonucleotide
  Target: SCN10A; (+) strand; PAM type: NRG; PAM sequence: AGG
tcatgaggcggaacagtgag

SEQ ID NO: 35722 - DNA, 20 bp, Artificial Sequence
  Description of Artificial Sequence: Synthetic oligonucleotide
  Target: SCN10A; (+) strand; PAM type: NRG; PAM sequence: AAG
gaggcggaacagtgagagga

SEQ ID NO: 35723 - DNA, 20 bp, Artificial Sequence
  Description of Artificial Sequence: Synthetic oligonucleotide
  Target: SCN10A; (+) strand; PAM type: NRG; PAM sequence: AAG
gaacagtgagaggaaagccc

SEQ ID NO: 35724 - DNA, 20 bp, Artificial Sequence
  Description of Artificial Sequence: Synthetic oligonucleotide
  Target: SCN10A; (+) strand; PAM type: NRG; PAM sequence: AAG
gtgagaggaaagcccaagca

SEQ ID NO: 35725 - DNA, 20 bp, Artificial Sequence
  Description of Artificial Sequence: Synthetic oligonucleotide
  Target: SCN10A; (+) strand; PAM type: NRG; PAM sequence: AGG
tgagaggaaagcccaagcaa

SEQ ID NO: 35726 - DNA, 20 bp, Artificial Sequence
  Description of Artificial Sequence: Synthetic oligonucleotide
  Target: SCN10A; (+) strand; PAM type: NRG; PAM sequence: AAG
aagcccaagcaaaggaatca

SEQ ID NO: 35727 - DNA, 20 bp, Artificial Sequence
  Description of Artificial Sequence: Synthetic oligonucleotide
  Target: SCN10A; (+) strand; PAM type: NRG; PAM sequence: TGG
ccaagcaaaggaatcaaagc

SEQ ID NO: 35728 - DNA, 20 bp, Artificial Sequence
  Description of Artificial Sequence: Synthetic oligonucleotide
  Target: SCN10A; (+) strand; PAM type: NRG; PAM sequence: TAG
caaaggaatcaaagctggtg

SEQ ID NO: 35729 - DNA, 20 bp, Artificial Sequence
  Description of Artificial Sequence: Synthetic oligonucleotide
  Target: SCN10A; (+) strand; PAM type: NRG; PAM sequence: CGG
aagctggtgtagttaaaatc

SEQ ID NO: 35730 - DNA, 20 bp, Artificial Sequence
  Description of Artificial Sequence: Synthetic oligonucleotide
  Target: SCN10A; (+) strand; PAM type: NRG; PAM sequence: GGG
agctggtgtagttaaaatcc

SEQ ID NO: 35731 - DNA, 20 bp, Artificial Sequence
  Description of Artificial Sequence: Synthetic oligonucleotide
  Target: SCN10A; (+) strand; PAM type: NRG; PAM sequence: CAG
gtagttaaaatccgggttgt

SEQ ID NO: 35732 - DNA, 20 bp, Artificial Sequence
  Description of Artificial Sequence: Synthetic oligonucleotide
  Target: SCN10A; (+) strand; PAM type: NRG; PAM sequence: AAG
gttaaaatccgggttgtcag

SEQ ID NO: 35733 - DNA, 20 bp, Artificial Sequence
  Description of Artificial Sequence: Synthetic oligonucleotide
  Target: SCN10A; (+) strand; PAM type: NRG; PAM sequence: AAG
tccgggttgtcagaagtttt

SEQ ID NO: 35734 - DNA, 20 bp, Artificial Sequence
  Description of Artificial Sequence: Synthetic oligonucleotide
  Target: SCN10A; (+) strand; PAM type: NRG; PAM sequence: AGG
ccgggttgtcagaagtttta

SEQ ID NO: 35735 - DNA, 20 bp, Artificial Sequence
  Description of Artificial Sequence: Synthetic oligonucleotide
  Target: SCN10A; (+) strand; PAM type: NRG; PAM sequence: CAG
ggttgtcagaagttttaagg

SEQ ID NO: 35736 - DNA, 20 bp, Artificial Sequence
  Description of Artificial Sequence: Synthetic oligonucleotide
  Target: SCN10A; (+) strand; PAM type: NRG; PAM sequence: CAG
tttaaggcagatataaccat

SEQ ID NO: 35737 - DNA, 20 bp, Artificial Sequence
  Description of Artificial Sequence: Synthetic oligonucleotide
  Target: SCN10A; (+) strand; PAM type: NRG; PAM sequence: AGG
ttaaggcagatataaccatc

SEQ ID NO: 35738 - DNA, 20 bp, Artificial Sequence
  Description of Artificial Sequence: Synthetic oligonucleotide
  Target: SCN10A; (+) strand; PAM type: NRG; PAM sequence: GGG
taaggcagatataaccatca

SEQ ID NO: 35739 - DNA, 20 bp, Artificial Sequence
  Description of Artificial Sequence: Synthetic oligonucleotide
  Target: SCN10A; (+) strand; PAM type: NRG; PAM sequence: CAG
ggcagatataaccatcaggg

SEQ ID NO: 35740 - DNA, 20 bp, Artificial Sequence
  Description of Artificial Sequence: Synthetic oligonucleotide
  Target: SCN10A; (+) strand; PAM type: NRG; PAM sequence: TGG
agatataaccatcagggcag

SEQ ID NO: 35741 - DNA, 20 bp, Artificial Sequence
  Description of Artificial Sequence: Synthetic oligonucleotide
  Target: SCN10A; (+) strand; PAM type: NRG; PAM sequence: CAG
aaccatcagggcagtggctg

SEQ ID NO: 35742 - DNA, 20 bp, Artificial Sequence
  Description of Artificial Sequence: Synthetic oligonucleotide
  Target: SCN10A; (+) strand; PAM type: NRG; PAM sequence: AAG
atcagggcagtggctgcagc

SEQ ID NO: 35743 - DNA, 20 bp, Artificial Sequence
  Description of Artificial Sequence: Synthetic oligonucleotide
  Target: SCN10A; (+) strand; PAM type: NRG; PAM sequence: CAG
ggcagtggctgcagcaagaa

SEQ ID NO: 35744 - DNA, 20 bp, Artificial Sequence
  Description of Artificial Sequence: Synthetic oligonucleotide
  Target: SCN10A; (+) strand; PAM type: NRG; PAM sequence: GAG
cagtggctgcagcaagaaca

SEQ ID NO: 35745 - DNA, 20 bp, Artificial Sequence
  Description of Artificial Sequence: Synthetic oligonucleotide
  Target: SCN10A; (+) strand; PAM type: NRG; PAM sequence: AAG
tggctgcagcaagaacagag

SEQ ID NO: 35746 - DNA, 20 bp, Artificial Sequence
  Description of Artificial Sequence: Synthetic oligonucleotide
  Target: SCN10A; (+) strand; PAM type: NRG; PAM sequence: AGG
ggctgcagcaagaacagaga

SEQ ID NO: 35747 - DNA, 20 bp, Artificial Sequence
  Description of Artificial Sequence: Synthetic oligonucleotide
  Target: SCN10A; (+) strand; PAM type: NRG; PAM sequence: CAG
aggtcatcccctgcttattg

SEQ ID NO: 35748 - DNA, 20 bp, Artificial Sequence
  Description of Artificial Sequence: Synthetic oligonucleotide
  Target: SCN10A; (+) strand; PAM type: NRG; PAM sequence: AAG
atcccctgcttattgcagac

SEQ ID NO: 35749 - DNA, 20 bp, Artificial Sequence
  Description of Artificial Sequence: Synthetic oligonucleotide
  Target: SCN10A; (+) strand; PAM type: NRG; PAM sequence: AGG
tcccctgcttattgcagaca

SEQ ID NO: 35750 - DNA, 20 bp, Artificial Sequence
  Description of Artificial Sequence: Synthetic oligonucleotide
  Target: SCN10A; (+) strand; PAM type: NRG; PAM sequence: TAG
cctgcttattgcagacaagg

SEQ ID NO: 35751 - DNA, 20 bp, Artificial Sequence
  Description of Artificial Sequence: Synthetic oligonucleotide
  Target: SCN10A; (+) strand; PAM type: NRG; PAM sequence: CAG
ttattgcagacaaggtagcc

SEQ ID NO: 35752 - DNA, 20 bp, Artificial Sequence
  Description of Artificial Sequence: Synthetic oligonucleotide
  Target: SCN10A; (+) strand; PAM type: NRG; PAM sequence: AGG
tattgcagacaaggtagccc

SEQ ID NO: 35753 - DNA, 20 bp, Artificial Sequence
  Description of Artificial Sequence: Synthetic oligonucleotide
  Target: SCN10A; (+) strand; PAM type: NRG; PAM sequence: GGG
attgcagacaaggtagccca

SEQ ID NO: 35754 - DNA, 20 bp, Artificial Sequence
  Description of Artificial Sequence: Synthetic oligonucleotide
  Target: SCN10A; (+) strand; PAM type: NRG; PAM sequence: GAG
acaaggtagcccagggctgc

SEQ ID NO: 35755 - DNA, 20 bp, Artificial Sequence
  Description of Artificial Sequence: Synthetic oligonucleotide
  Target: SCN10A; (+) strand; PAM type: NRG; PAM sequence: CAG
ccagggctgcgagacaacca

SEQ ID NO: 35756 - DNA, 20 bp, Artificial Sequence
  Description of Artificial Sequence: Synthetic oligonucleotide
  Target: SCN10A; (+) strand; PAM type: NRG; PAM sequence: GAG
agggctgcgagacaaccaca

SEQ ID NO: 35757 - DNA, 20 bp, Artificial Sequence
  Description of Artificial Sequence: Synthetic oligonucleotide
  Target: SCN10A; (+) strand; PAM type: NRG; PAM sequence: CAG
acaaccacagagttttatgt

SEQ ID NO: 35758 - DNA, 20 bp, Artificial Sequence
  Description of Artificial Sequence: Synthetic oligonucleotide
  Target: SCN10A; (+) strand; PAM type: NRG; PAM sequence: GAG
aaccacagagttttatgtca

SEQ ID NO: 35759 - DNA, 20 bp, Artificial Sequence
  Description of Artificial Sequence: Synthetic oligonucleotide
  Target: SCN10A; (+) strand; PAM type: NRG; PAM sequence: CAG
cagagttttatgtcagagat

SEQ ID NO: 35760 - DNA, 20 bp, Artificial Sequence
  Description of Artificial Sequence: Synthetic oligonucleotide
  Target: SCN10A; (+) strand; PAM type: NRG; PAM sequence: GAG
gagttttatgtcagagatca

SEQ ID NO: 35761 - DNA, 20 bp, Artificial Sequence
  Description of Artificial Sequence: Synthetic oligonucleotide
  Target: SCN10A; (+) strand; PAM type: NRG; PAM sequence: AAG
tatgtcagagatcagagttc

SEQ ID NO: 35762 - DNA, 20 bp, Artificial Sequence
  Description of Artificial Sequence: Synthetic oligonucleotide
  Target: SCN10A; (+) strand; PAM type: NRG; PAM sequence: TAG
agagatcagagttcaagacc

SEQ ID NO: 35763 - DNA, 20 bp, Artificial Sequence
  Description of Artificial Sequence: Synthetic oligonucleotide
  Target: SCN10A; (+) strand; PAM type: NRG; PAM sequence: TAG
agacctagtcttcctcttat

SEQ ID NO: 35764 - DNA, 20 bp, Artificial Sequence
  Description of Artificial Sequence: Synthetic oligonucleotide
  Target: SCN10A; (+) strand; PAM type: NRG; PAM sequence: CAG
cctagtcttcctcttattag

SEQ ID NO: 35765 - DNA, 20 bp, Artificial Sequence
  Description of Artificial Sequence: Synthetic oligonucleotide
  Target: SCN10A; (+) strand; PAM type: NRG; PAM sequence: AGG
ctagtcttcctcttattagc

SEQ ID NO: 35766 - DNA, 20 bp, Artificial Sequence
  Description of Artificial Sequence: Synthetic oligonucleotide
  Target: SCN10A; (+) strand; PAM type: NRG; PAM sequence: TGG
tcttattagcaggatgatct

SEQ ID NO: 35767 - DNA, 20 bp, Artificial Sequence
  Description of Artificial Sequence: Synthetic oligonucleotide
  Target: SCN10A; (+) strand; PAM type: NRG; PAM sequence: TGG
gcaggatgatcttggacact

SEQ ID NO: 35768 - DNA, 20 bp, Artificial Sequence
  Description of Artificial Sequence: Synthetic oligonucleotide
  Target: SCN10A; (+) strand; PAM type: NRG; PAM sequence: TAG
tcttggacacttggtctgtt

SEQ ID NO: 35769 - DNA, 20 bp, Artificial Sequence
  Description of Artificial Sequence: Synthetic oligonucleotide
  Target: SCN10A; (+) strand; PAM type: NRG; PAM sequence: AGG
cttggacacttggtctgttt

SEQ ID NO: 35770 - DNA, 20 bp, Artificial Sequence
  Description of Artificial Sequence: Synthetic oligonucleotide
  Target: SCN10A; (+) strand; PAM type: NRG; PAM sequence: TGG
cacttggtctgtttaggtat

SEQ ID NO: 35771 - DNA, 20 bp, Artificial Sequence
  Description of Artificial Sequence: Synthetic oligonucleotide
  Target: SCN10A; (+) strand; PAM type: NRG; PAM sequence: CGG
ggtttctgttatccataaaa

SEQ ID NO: 35772 - DNA, 20 bp, Artificial Sequence
  Description of Artificial Sequence: Synthetic oligonucleotide
  Target: SCN10A; (+) strand; PAM type: NRG; PAM sequence: GGG
gtttctgttatccataaaac

SEQ ID NO: 35773 - DNA, 20 bp, Artificial Sequence
  Description of Artificial Sequence: Synthetic oligonucleotide
  Target: SCN10A; (+) strand; PAM type: NRG; PAM sequence: GGG
tttctgttatccataaaacg

SEQ ID NO: 35774 - DNA, 20 bp, Artificial Sequence
  Description of Artificial Sequence: Synthetic oligonucleotide
  Target: SCN10A; (+) strand; PAM type: NRG; PAM sequence: CAG
ggacgctaatactttcacgt

SEQ ID NO: 35775 - DNA, 20 bp, Artificial Sequence
  Description of Artificial Sequence: Synthetic oligonucleotide
  Target: SCN10A; (+) strand; PAM type: NRG; PAM sequence: CAG
tcacgtcagaatttcataca

SEQ ID NO: 35776 - DNA, 20 bp, Artificial Sequence
  Description of Artificial Sequence: Synthetic oligonucleotide
  Target: SCN10A; (+) strand; PAM type: NRG; PAM sequence: AGG
cacgtcagaatttcatacac

SEQ ID NO: 35777 - DNA, 20 bp, Artificial Sequence
  Description of Artificial Sequence: Synthetic oligonucleotide
  Target: SCN10A; (+) strand; PAM type: NRG; PAM sequence: GGG
acgtcagaatttcatacaca

SEQ ID NO: 35778 - DNA, 20 bp, Artificial Sequence
  Description of Artificial Sequence: Synthetic oligonucleotide
  Target: SCN10A; (+) strand; PAM type: NRG; PAM sequence: GGG
cgtcagaatttcatacacag

SEQ ID NO: 35779 - DNA, 20 bp, Artificial Sequence
  Description of Artificial Sequence: Synthetic oligonucleotide
  Target: SCN10A; (+) strand; PAM type: NRG; PAM sequence: GAG
tcagaatttcatacacaggg

SEQ ID NO: 35780 - DNA, 20 bp, Artificial Sequence
  Description of Artificial Sequence: Synthetic oligonucleotide
  Target: SCN10A; (+) strand; PAM type: NRG; PAM sequence: TGG
gaatttcatacacaggggag

SEQ ID NO: 35781 - DNA, 20 bp, Artificial Sequence
  Description of Artificial Sequence: Synthetic oligonucleotide
  Target: SCN10A; (+) strand; PAM type: NRG; PAM sequence: TGG
tcatacacaggggagtggcc

SEQ ID NO: 35782 - DNA, 20 bp, Artificial Sequence
  Description of Artificial Sequence: Synthetic oligonucleotide
  Target: SCN10A; (+) strand; PAM type: NRG; PAM sequence: GGG
catacacaggggagtggcct

SEQ ID NO: 35783 - DNA, 20 bp, Artificial Sequence
  Description of Artificial Sequence: Synthetic oligonucleotide
  Target: SCN10A; (+) strand; PAM type: NRG; PAM sequence: GGG
atacacaggggagtggcctg

SEQ ID NO: 35784 - DNA, 20 bp, Artificial Sequence
  Description of Artificial Sequence: Synthetic oligonucleotide
  Target: SCN10A; (+) strand; PAM type: NRG; PAM sequence: AAG
cacaggggagtggcctgggg

SEQ ID NO: 35785 - DNA, 20 bp, Artificial Sequence
  Description of Artificial Sequence: Synthetic oligonucleotide
  Target: SCN10A; (+) strand; PAM type: NRG; PAM sequence: AGG
acaggggagtggcctgggga

SEQ ID NO: 35786 - DNA, 20 bp, Artificial Sequence
  Description of Artificial Sequence: Synthetic oligonucleotide
  Target: SCN10A; (+) strand; PAM type: NRG; PAM sequence: CAG
ggggagtggcctggggaagg

SEQ ID NO: 35787 - DNA, 20 bp, Artificial Sequence
  Description of Artificial Sequence: Synthetic oligonucleotide
  Target: SCN10A; (+) strand; PAM type: NRG; PAM sequence: CAG
ggggaaggcagctgactgcc

SEQ ID NO: 35788 - DNA, 20 bp, Artificial Sequence
  Description of Artificial Sequence: Synthetic oligonucleotide
  Target: SCN10A; (+) strand; PAM type: NRG; PAM sequence: AAG
ctgcccagacacgatactat

SEQ ID NO: 35789 - DNA, 20 bp, Artificial Sequence
  Description of Artificial Sequence: Synthetic oligonucleotide
  Target: SCN10A; (+) strand; PAM type: NRG; PAM sequence: CAG
cgatactataagctctttgc

SEQ ID NO: 35790 - DNA, 20 bp, Artificial Sequence
  Description of Artificial Sequence: Synthetic oligonucleotide
  Target: SCN10A; (+) strand; PAM type: NRG; PAM sequence: CAG
agctctttgccagttcatac

SEQ ID NO: 35791 - DNA, 20 bp, Artificial Sequence
  Description of Artificial Sequence: Synthetic oligonucleotide
  Target: SCN10A; (+) strand; PAM type: NRG; PAM sequence: AGG
gctctttgccagttcatacc

SEQ ID NO: 35792 - DNA, 20 bp, Artificial Sequence
  Description of Artificial Sequence: Synthetic oligonucleotide
  Target: SCN10A; (+) strand; PAM type: NRG; PAM sequence: GGG
ctctttgccagttcatacca

SEQ ID NO: 35793 - DNA, 20 bp, Artificial Sequence
  Description of Artificial Sequence: Synthetic oligonucleotide
  Target: SCN10A; (+) strand; PAM type: NRG; PAM sequence: GAG
ccagttcataccagggaaat

SEQ ID NO: 35794 - DNA, 20 bp, Artificial Sequence
  Description of Artificial Sequence: Synthetic oligonucleotide
  Target: SCN10A; (+) strand; PAM type: NRG; PAM sequence: GAG
agttcataccagggaaatga

SEQ ID NO: 35795 - DNA, 20 bp, Artificial Sequence
  Description of Artificial Sequence: Synthetic oligonucleotide
  Target: SCN10A; (+) strand; PAM type: NRG; PAM sequence: CAG
cataccagggaaatgagagt

SEQ ID NO: 35796 - DNA, 20 bp, Artificial Sequence
  Description of Artificial Sequence: Synthetic oligonucleotide
  Target: SCN10A; (+) strand; PAM type: NRG; PAM sequence: TAG
accagggaaatgagagtcag

SEQ ID NO: 35797 - DNA, 20 bp, Artificial Sequence
  Description of Artificial Sequence: Synthetic oligonucleotide
  Target: SCN10A; (+) strand; PAM type: NRG; PAM sequence: CAG
gagagtcagtagcaataacg

SEQ ID NO: 35798 - DNA, 20 bp, Artificial Sequence
  Description of Artificial Sequence: Synthetic oligonucleotide
  Target: SCN10A; (+) strand; PAM type: NRG; PAM sequence: GAG
ataacgcagacttaaaacct

SEQ ID NO: 35799 - DNA, 20 bp, Artificial Sequence
  Description of Artificial Sequence: Synthetic oligonucleotide
  Target: SCN10A; (+) strand; PAM type: NRG; PAM sequence: TGG
gacttaaaacctgagcctgt

SEQ ID NO: 35800 - DNA, 20 bp, Artificial Sequence
  Description of Artificial Sequence: Synthetic oligonucleotide
  Target: SCN10A; (+) strand; PAM type: NRG; PAM sequence: CAG
gagcctgttggcatcatctg

SEQ ID NO: 35801 - DNA, 20 bp, Artificial Sequence
  Description of Artificial Sequence: Synthetic oligonucleotide
  Target: SCN10A; (+) strand; PAM type: NRG; PAM sequence: GAG
gcctgttggcatcatctgca

SEQ ID NO: 35802 - DNA, 20 bp, Artificial Sequence
  Description of Artificial Sequence: Synthetic oligonucleotide
  Target: SCN10A; (+) strand; PAM type: NRG; PAM sequence: AAG
catctgcagagttgtctatc

SEQ ID NO: 35803 - DNA, 20 bp, Artificial Sequence
  Description of Artificial Sequence: Synthetic oligonucleotide
  Target: SCN10A; (+) strand; PAM type: NRG; PAM sequence: AGG
atctgcagagttgtctatca

SEQ ID NO: 35804 - DNA, 20 bp, Artificial Sequence
  Description of Artificial Sequence: Synthetic oligonucleotide
  Target: SCN10A; (+) strand; PAM type: NRG; PAM sequence: GGG
tctgcagagttgtctatcaa

SEQ ID NO: 35805 - DNA, 20 bp, Artificial Sequence
  Description of Artificial Sequence: Synthetic oligonucleotide
  Target: SCN10A; (+) strand; PAM type: NRG; PAM sequence: GAG
tgcagagttgtctatcaagg

SEQ ID NO: 35806 - DNA, 20 bp, Artificial Sequence
  Description of Artificial Sequence: Synthetic oligonucleotide
  Target: SCN10A; (+) strand; PAM type: NRG; PAM sequence: AGG
gcagagttgtctatcaaggg

SEQ ID NO: 35807 - DNA, 20 bp, Artificial Sequence
  Description of Artificial Sequence: Synthetic oligonucleotide
  Target: SCN10A; (+) strand; PAM type: NRG; PAM sequence: TAG
tatcaagggaggtctcacat

SEQ ID NO: 35808 - DNA, 20 bp, Artificial Sequence
  Description of Artificial Sequence: Synthetic oligonucleotide
  Target: SCN10A; (+) strand; PAM type: NRG; PAM sequence: AAG
agggaggtctcacattagcc

SEQ ID NO: 35809 - DNA, 20 bp, Artificial Sequence
  Description of Artificial Sequence: Synthetic oligonucleotide
  Target: SCN10A; (+) strand; PAM type: NRG; PAM sequence: CAG
cactgattaattatatgtaa

SEQ ID NO: 35810 - DNA, 20 bp, Artificial Sequence
  Description of Artificial Sequence: Synthetic oligonucleotide
  Target: SCN10A; (+) strand; PAM type: NRG; PAM sequence: TGG
tgattaattatatgtaacag

SEQ ID NO: 35811 - DNA, 20 bp, Artificial Sequence
  Description of Artificial Sequence: Synthetic oligonucleotide
  Target: SCN10A; (+) strand; PAM type: NRG; PAM sequence: GAG
aataacactttccacttact

SEQ ID NO: 35812 - DNA, 20 bp, Artificial Sequence
  Description of Artificial Sequence: Synthetic oligonucleotide
  Target: SCN10A; (+) strand; PAM type: NRG; PAM sequence: AAG
gtgttcttctctctcccttt

SEQ ID NO: 35813 - DNA, 20 bp, Artificial Sequence
  Description of Artificial Sequence: Synthetic oligonucleotide
  Target: SCN10A; (+) strand; PAM type: NRG; PAM sequence: CAG
cactcaatgttctttcttta

SEQ ID NO: 35814 - DNA, 20 bp, Artificial Sequence
  Description of Artificial Sequence: Synthetic oligonucleotide
  Target: SCN10A; (+) strand; PAM type: NRG; PAM sequence: AAG
aatgttctttctttacagat

SEQ ID NO: 35815 - DNA, 20 bp, Artificial Sequence
  Description of Artificial Sequence: Synthetic oligonucleotide
  Target: SCN10A; (+) strand; PAM type: NRG; PAM sequence: AGG
atgttctttctttacagata

SEQ ID NO: 35816 - DNA, 20 bp, Artificial Sequence
  Description of Artificial Sequence: Synthetic oligonucleotide
  Target: SCN10A; (+) strand; PAM type: NRG; PAM sequence: TGG
ttctttacagataaggaatc

SEQ ID NO: 35817 - DNA, 20 bp, Artificial Sequence
  Description of Artificial Sequence: Synthetic oligonucleotide
  Target: SCN10A; (+) strand; PAM type: NRG; PAM sequence: GGG
tctttacagataaggaatct

SEQ ID NO: 35818 - DNA, 20 bp, Artificial Sequence
  Description of Artificial Sequence: Synthetic oligonucleotide
  Target: SCN10A; (+) strand; PAM type: NRG; PAM sequence: GGG
ctttacagataaggaatctg

SEQ ID NO: 35819 - DNA, 20 bp, Artificial Sequence
  Description of Artificial Sequence: Synthetic oligonucleotide
  Target: SCN10A; (+) strand; PAM type: NRG; PAM sequence: GGG
tttacagataaggaatctgg

SEQ ID NO: 35820 - DNA, 20 bp, Artificial Sequence
  Description of Artificial Sequence: Synthetic oligonucleotide
  Target: SCN10A; (+) strand; PAM type: NRG; PAM sequence: CAG
cagataaggaatctgggggt

SEQ ID NO: 35821 - DNA, 20 bp, Artificial Sequence
  Description of Artificial Sequence: Synthetic oligonucleotide
  Target: SCN10A; (+) strand; PAM type: NRG; PAM sequence: AAG
taaggaatctgggggtcaga

SEQ ID NO: 35822 - DNA, 20 bp, Artificial Sequence
  Description of Artificial Sequence: Synthetic oligonucleotide
  Target: SCN10A; (+) strand; PAM type: NRG; PAM sequence: AAG
ggaatctgggggtcagaaag

SEQ ID NO: 35823 - DNA, 20 bp, Artificial Sequence
  Description of Artificial Sequence: Synthetic oligonucleotide
  Target: SCN10A; (+) strand; PAM type: NRG; PAM sequence: CAG
tctgggggtcagaaagaagt

SEQ ID NO: 35824 - DNA, 20 bp, Artificial Sequence
  Description of Artificial Sequence: Synthetic oligonucleotide
  Target: SCN10A; (+) strand; PAM type: NRG; PAM sequence: CAG
gtcagttgcctaaaactacg

SEQ ID NO: 35825 - DNA, 20 bp, Artificial Sequence
  Description of Artificial Sequence: Synthetic oligonucleotide
  Target: SCN10A; (+) strand; PAM type: NRG; PAM sequence: AGG
tcagttgcctaaaactacgc

SEQ ID NO: 35826 - DNA, 20 bp, Artificial Sequence
  Description of Artificial Sequence: Synthetic oligonucleotide
  Target: SCN10A; (+) strand; PAM type: NRG; PAM sequence: AAG
ggtgtcaatatatttattaa

SEQ ID NO: 35827 - DNA, 20 bp, Artificial Sequence
  Description of Artificial Sequence: Synthetic oligonucleotide
  Target: SCN10A; (+) strand; PAM type: NRG; PAM sequence: AGG
gtgtcaatatatttattaaa

SEQ ID NO: 35828 - DNA, 20 bp, Artificial Sequence
  Description of Artificial Sequence: Synthetic oligonucleotide
  Target: SCN10A; (+) strand; PAM type: NRG; PAM sequence: GAG
gtcaatatatttattaaaag

SEQ ID NO: 35829 - DNA, 20 bp, Artificial Sequence
  Description of Artificial Sequence: Synthetic oligonucleotide
  Target: SCN10A; (+) strand; PAM type: NRG; PAM sequence: AAG
aaaggagaaatataactgtc

SEQ ID NO: 35830 - DNA, 20 bp, Artificial Sequence
  Description of Artificial Sequence: Synthetic oligonucleotide
  Target: SCN10A; (+) strand; PAM type: NRG; PAM sequence: TAG
ggagaaatataactgtcaag

SEQ ID NO: 35831 - DNA, 20 bp, Artificial Sequence
  Description of Artificial Sequence: Synthetic oligonucleotide
  Target: SCN10A; (+) strand; PAM type: NRG; PAM sequence: GAG
tgtcaagtagcccaatactt

SEQ ID NO: 35832 - DNA, 20 bp, Artificial Sequence
  Description of Artificial Sequence: Synthetic oligonucleotide
  Target: SCN10A; (+) strand; PAM type: NRG; PAM sequence: CAG
aagtagcccaatacttgagt

SEQ ID NO: 35833 - DNA, 20 bp, Artificial Sequence
  Description of Artificial Sequence: Synthetic oligonucleotide
  Target: SCN10A; (+) strand; PAM type: NRG; PAM sequence: TAG
gcccaatacttgagtcagcc

SEQ ID NO: 35834 - DNA, 20 bp, Artificial Sequence
  Description of Artificial Sequence: Synthetic oligonucleotide
  Target: SCN10A; (+) strand; PAM type: NRG; PAM sequence: AAG
gtcagcctagcctcctcctg

SEQ ID NO: 35835 - DNA, 20 bp, Artificial Sequence
  Description of Artificial Sequence: Synthetic oligonucleotide
  Target: SCN10A; (+) strand; PAM type: NRG; PAM sequence: TGG
gcctagcctcctcctgaaga

SEQ ID NO: 35836 - DNA, 20 bp, Artificial Sequence
  Description of Artificial Sequence: Synthetic oligonucleotide
  Target: SCN10A; (+) strand; PAM type: NRG; PAM sequence: AAG
cctcctgaagatggcctatg

SEQ ID NO: 35837 - DNA, 20 bp, Artificial Sequence
  Description of Artificial Sequence: Synthetic oligonucleotide
  Target: SCN10A; (+) strand; PAM type: NRG; PAM sequence: AGG
ctcctgaagatggcctatga

SEQ ID NO: 35838 - DNA, 20 bp, Artificial Sequence
  Description of Artificial Sequence: Synthetic oligonucleotide
  Target: SCN10A; (+) strand; PAM type: NRG; PAM sequence: AAG
ctgaagatggcctatgaagg

SEQ ID NO: 35839 - DNA, 20 bp, Artificial Sequence
  Description of Artificial Sequence: Synthetic oligonucleotide
  Target: SCN10A; (+) strand; PAM type: NRG; PAM sequence: AGG
tgaagatggcctatgaagga

SEQ ID NO: 35840 - DNA, 20 bp, Artificial Sequence
  Description of Artificial Sequence: Synthetic oligonucleotide
  Target: SCN10A; (+) strand; PAM type: NRG; PAM sequence: CAG
gatggcctatgaaggaaggc

SEQ ID NO: 35841 - DNA, 20 bp, Artificial Sequence
  Description of Artificial Sequence: Synthetic oligonucleotide
  Target: SCN10A; (+) strand; PAM type: NRG; PAM sequence: TGG
ccagattaaaaatgactgcc

SEQ ID NO: 35842 - DNA, 20 bp, Artificial Sequence
  Description of Artificial Sequence: Synthetic oligonucleotide
  Target: SCN10A; (+) strand; PAM type: NRG; PAM sequence: GAG
attaaaaatgactgcctggt

SEQ ID NO: 35843 - DNA, 20 bp, Artificial Sequence
  Description of Artificial Sequence: Synthetic oligonucleotide
  Target: SCN10A; (+) strand; PAM type: NRG; PAM sequence: GAG
atgactgcctggtgagtatt

SEQ ID NO: 35844 - DNA, 20 bp, Artificial Sequence
  Description of Artificial Sequence: Synthetic oligonucleotide
  Target: SCN10A; (+) strand; PAM type: NRG; PAM sequence: AGG
tgactgcctggtgagtattg

SEQ ID NO: 35845 - DNA, 20 bp, Artificial Sequence
  Description of Artificial Sequence: Synthetic oligonucleotide
  Target: SCN10A; (+) strand; PAM type: NRG; PAM sequence: TGG
ctgcctggtgagtattgagg

SEQ ID NO: 35846 - DNA, 20 bp, Artificial Sequence
  Description of Artificial Sequence: Synthetic oligonucleotide
  Target: SCN10A; (+) strand; PAM type: NRG; PAM sequence: GGG
tgcctggtgagtattgaggt

SEQ ID NO: 35847 - DNA, 20 bp, Artificial Sequence
  Description of Artificial Sequence: Synthetic oligonucleotide
  Target: SCN10A; (+) strand; PAM type: NRG; PAM sequence: TAG
ctccttcctctctctcataa

SEQ ID NO: 35848 - DNA, 20 bp, Artificial Sequence
  Description of Artificial Sequence: Synthetic oligonucleotide
  Target: SCN10A; (+) strand; PAM type: NRG; PAM sequence: AGG
tccttcctctctctcataat

SEQ ID NO: 35849 - DNA, 20 bp, Artificial Sequence
  Description of Artificial Sequence: Synthetic oligonucleotide
  Target: SCN10A; (+) strand; PAM type: NRG; PAM sequence: GAG
cttcctctctctcataatag

SEQ ID NO: 35850 - DNA, 20 bp, Artificial Sequence
  Description of Artificial Sequence: Synthetic oligonucleotide
  Target: SCN10A; (+) strand; PAM type: NRG; PAM sequence: AGG
ttcctctctctcataatagg

SEQ ID NO: 35851 - DNA, 20 bp, Artificial Sequence
  Description of Artificial Sequence: Synthetic oligonucleotide
  Target: SCN10A; (+) strand; PAM type: NRG; PAM sequence: GAG
ctctctcataataggaggat

SEQ ID NO: 35852 - DNA, 20 bp, Artificial Sequence
  Description of Artificial Sequence: Synthetic oligonucleotide
  Target: SCN10A; (+) strand; PAM type: NRG; PAM sequence: AAG
taggaggatgagtcgatgtc

SEQ ID NO: 35853 - DNA, 20 bp, Artificial Sequence
  Description of Artificial Sequence: Synthetic oligonucleotide
  Target: SCN10A; (+) strand; PAM type: NRG; PAM sequence: AAG
gaggatgagtcgatgtcaag

SEQ ID NO: 35854 - DNA, 20 bp, Artificial Sequence
  Description of Artificial Sequence: Synthetic oligonucleotide
  Target: SCN10A; (+) strand; PAM type: NRG; PAM sequence: CAG
cgatgtcaagaagcatctgt

SEQ ID NO: 35855 - DNA, 20 bp, Artificial Sequence
  Description of Artificial Sequence: Synthetic oligonucleotide
  Target: SCN10A; (+) strand; PAM type: NRG; PAM sequence: CAG
tcaagaagcatctgtcagct

SEQ ID NO: 35856 - DNA, 20 bp, Artificial Sequence
  Description of Artificial Sequence: Synthetic oligonucleotide
  Target: SCN10A; (+) strand; PAM type: NRG; PAM sequence: AGG
caagaagcatctgtcagctc

SEQ ID NO: 35857 - DNA, 20 bp, Artificial Sequence
  Description of Artificial Sequence: Synthetic oligonucleotide
  Target: SCN10A; (+) strand; PAM type: NRG; PAM sequence: GGG
aagaagcatctgtcagctca

SEQ ID NO: 35858 - DNA, 20 bp, Artificial Sequence
  Description of Artificial Sequence: Synthetic oligonucleotide
  Target: SCN10A; (+) strand; PAM type: NRG; PAM sequence: GAG
gaagcatctgtcagctcagg

SEQ ID NO: 35859 - DNA, 20 bp, Artificial Sequence
  Description of Artificial Sequence: Synthetic oligonucleotide
  Target: SCN10A; (+) strand; PAM type: NRG; PAM sequence: AAG
ctgtcagctcagggagcgta

SEQ ID NO: 35860 - DNA, 20 bp, Artificial Sequence
  Description of Artificial Sequence: Synthetic oligonucleotide
  Target: SCN10A; (+) strand; PAM type: NRG; PAM sequence: TAG
taaagtgctctcatccaccc

SEQ ID NO: 35861 - DNA, 20 bp, Artificial Sequence
  Description of Artificial Sequence: Synthetic oligonucleotide
  Target: SCN10A; (+) strand; PAM type: NRG; PAM sequence: CAG
agtgctctcatccaccctag

SEQ ID NO: 35862 - DNA, 20 bp, Artificial Sequence
  Description of Artificial Sequence: Synthetic oligonucleotide
  Target: SCN10A; (+) strand; PAM type: NRG; PAM sequence: GAG
tgctctcatccaccctagca

SEQ ID NO: 35863 - DNA, 20 bp, Artificial Sequence
  Description of Artificial Sequence: Synthetic oligonucleotide
  Target: SCN10A; (+) strand; PAM type: NRG; PAM sequence: TGG
ctcatccaccctagcagaga

SEQ ID NO: 35864 - DNA, 20 bp, Artificial Sequence
  Description of Artificial Sequence: Synthetic oligonucleotide
  Target: SCN10A; (+) strand; PAM type: NRG; PAM sequence: CAG
agatggcctgatcaatgaaa

SEQ ID NO: 35865 - DNA, 20 bp, Artificial Sequence
  Description of Artificial Sequence: Synthetic oligonucleotide
  Target: SCN10A; (+) strand; PAM type: NRG; PAM sequence: AAG
aaacagcaatgcctcgtttg

SEQ ID NO: 35866 - DNA, 20 bp, Artificial Sequence
  Description of Artificial Sequence: Synthetic oligonucleotide
  Target: SCN10A; (+) strand; PAM type: NRG; PAM sequence: CAG
gcaatgcctcgtttgaagtc

SEQ ID NO: 35867 - DNA, 20 bp, Artificial Sequence
  Description of Artificial Sequence: Synthetic oligonucleotide
  Target: SCN10A; (+) strand; PAM type: NRG; PAM sequence: TGG
ctgcattccttgtgaataca

SEQ ID NO: 35868 - DNA, 20 bp, Artificial Sequence
  Description of Artificial Sequence: Synthetic oligonucleotide
  Target: SCN10A; (+) strand; PAM type: NRG; PAM sequence: CAG
acatggaattcttttactcc

SEQ ID NO: 35869 - DNA, 20 bp, Artificial Sequence
  Description of Artificial Sequence: Synthetic oligonucleotide
  Target: SCN10A; (+) strand; PAM type: NRG; PAM sequence: AGG
catggaattcttttactccc

SEQ ID NO: 35870 - DNA, 20 bp, Artificial Sequence
  Description of Artificial Sequence: Synthetic oligonucleotide
  Target: SCN10A; (+) strand; PAM type: NRG; PAM sequence: TGG
tctccatgaactccaacctc

SEQ ID NO: 35871 - DNA, 20 bp, Artificial Sequence
  Description of Artificial Sequence: Synthetic oligonucleotide
  Target: SCN10A; (+) strand; PAM type: NRG; PAM sequence: GGG
ctccatgaactccaacctct

SEQ ID NO: 35872 - DNA, 20 bp, Artificial Sequence
  Description of Artificial Sequence: Synthetic oligonucleotide
  Target: SCN10A; (+) strand; PAM type: NRG; PAM sequence: GGG
tccatgaactccaacctctg

SEQ ID NO: 35873 - DNA, 20 bp, Artificial Sequence
  Description of Artificial Sequence: Synthetic oligonucleotide
  Target: SCN10A; (+) strand; PAM type: NRG; PAM sequence: CAG
ctctggggctctccttatcc

SEQ ID NO: 35874 - DNA, 20 bp, Artificial Sequence
  Description of Artificial Sequence: Synthetic oligonucleotide
  Target: SCN10A; (+) strand; PAM type: NRG; PAM sequence: TGG
catgtgaacaacccatacca

SEQ ID NO: 35875 - DNA, 20 bp, Artificial Sequence
  Description of Artificial Sequence: Synthetic oligonucleotide
  Target: SCN10A; (+) strand; PAM type: NRG; PAM sequence: TAG
gaacaacccataccatggat

SEQ ID NO: 35876 - DNA, 20 bp, Artificial Sequence
  Description of Artificial Sequence: Synthetic oligonucleotide
  Target: SCN10A; (+) strand; PAM type: NRG; PAM sequence: GAG
acaacccataccatggatta

SEQ ID NO: 35877 - DNA, 20 bp, Artificial Sequence
  Description of Artificial Sequence: Synthetic oligonucleotide
  Target: SCN10A; (+) strand; PAM type: NRG; PAM sequence: CAG
tctgacaacttaattctaat

SEQ ID NO: 35878 - DNA, 20 bp, Artificial Sequence
  Description of Artificial Sequence: Synthetic oligonucleotide
  Target: SCN10A; (+) strand; PAM type: NRG; PAM sequence: AAG
acttaattctaatcagttcc

SEQ ID NO: 35879 - DNA, 20 bp, Artificial Sequence
  Description of Artificial Sequence: Synthetic oligonucleotide
  Target: SCN10A; (+) strand; PAM type: NRG; PAM sequence: AAG
gtctatctccacttcgattg

SEQ ID NO: 35880 - DNA, 20 bp, Artificial Sequence
  Description of Artificial Sequence: Synthetic oligonucleotide
  Target: SCN10A; (+) strand; PAM type: NRG; PAM sequence: AAG
ccacttcgattgaagattgc

SEQ ID NO: 35881 - DNA, 20 bp, Artificial Sequence
  Description of Artificial Sequence: Synthetic oligonucleotide
  Target: SCN10A; (+) strand; PAM type: NRG; PAM sequence: TGG
attgaagattgcaagttccc

SEQ ID NO: 35882 - DNA, 20 bp, Artificial Sequence
  Description of Artificial Sequence: Synthetic oligonucleotide
  Target: SCN10A; (+) strand; PAM type: NRG; PAM sequence: TAG
ttgcaagttccctggctttg

SEQ ID NO: 35883 - DNA, 20 bp, Artificial Sequence
  Description of Artificial Sequence: Synthetic oligonucleotide
  Target: SCN10A; (+) strand; PAM type: NRG; PAM sequence: AAG
gctttgtagacccacattta

SEQ ID NO: 35884 - DNA, 20 bp, Artificial Sequence
  Description of Artificial Sequence: Synthetic oligonucleotide
  Target: SCN10A; (+) strand; PAM type: NRG; PAM sequence: TAG
tgtagacccacatttaaaga

SEQ ID NO: 35885 - DNA, 20 bp, Artificial Sequence
  Description of Artificial Sequence: Synthetic oligonucleotide
  Target: SCN10A; (+) strand; PAM type: NRG; PAM sequence: AGG
gtagacccacatttaaagat

SEQ ID NO: 35886 - DNA, 20 bp, Artificial Sequence
  Description of Artificial Sequence: Synthetic oligonucleotide
  Target: SCN10A; (+) strand; PAM type: NRG; PAM sequence: TGG
cacatttaaagataggctct

SEQ ID NO: 35887 - DNA, 20 bp, Artificial Sequence
  Description of Artificial Sequence: Synthetic oligonucleotide
  Target: SCN10A; (+) strand; PAM type: NRG; PAM sequence: AAG
ggctcttggtttgctcttcc

SEQ ID NO: 35888 - DNA, 20 bp, Artificial Sequence
  Description of Artificial Sequence: Synthetic oligonucleotide
  Target: SCN10A; (+) strand; PAM type: NRG; PAM sequence: AGG
gctcttggtttgctcttcca

SEQ ID NO: 35889 - DNA, 20 bp, Artificial Sequence
  Description of Artificial Sequence: Synthetic oligonucleotide
  Target: SCN10A; (+) strand; PAM type: NRG; PAM sequence: GGG
ctcttggtttgctcttccaa

SEQ ID NO: 35890 - DNA, 20 bp, Artificial Sequence
  Description of Artificial Sequence: Synthetic oligonucleotide
  Target: SCN10A; (+) strand; PAM type: NRG; PAM sequence: GGG
tcttggtttgctcttccaag

SEQ ID NO: 35891 - DNA, 20 bp, Artificial Sequence
  Description of Artificial Sequence: Synthetic oligonucleotide
  Target: SCN10A; (+) strand; PAM type: NRG; PAM sequence: TAG
ggtttgctcttccaaggggc

SEQ ID NO: 35892 - DNA, 20 bp, Artificial Sequence
  Description of Artificial Sequence: Synthetic oligonucleotide
  Target: SCN10A; (+) strand; PAM type: NRG; PAM sequence: AGG
gtttgctcttccaaggggct

SEQ ID NO: 35893 - DNA, 20 bp, Artificial Sequence
  Description of Artificial Sequence: Synthetic oligonucleotide
  Target: SCN10A; (+) strand; PAM type: NRG; PAM sequence: TAG
gctaggcaacccatttcctg

SEQ ID NO: 35894 - DNA, 20 bp, Artificial Sequence
  Description of Artificial Sequence: Synthetic oligonucleotide
  Target: SCN10A; (+) strand; PAM type: NRG; PAM sequence: AGG
ctaggcaacccatttcctgt

SEQ ID NO: 35895 - DNA, 20 bp, Artificial Sequence
  Description of Artificial Sequence: Synthetic oligonucleotide
  Target: SCN10A; (+) strand; PAM type: NRG; PAM sequence: GAG
taggtttcttaattaactct

SEQ ID NO: 35896 - DNA, 20 bp, Artificial Sequence
  Description of Artificial Sequence: Synthetic oligonucleotide
  Target: SCN10A; (+) strand; PAM type: NRG; PAM sequence: AGG
aggtttcttaattaactctg

SEQ ID NO: 35897 - DNA, 20 bp, Artificial Sequence
  Description of Artificial Sequence: Synthetic oligonucleotide
  Target: SCN10A; (+) strand; PAM type: NRG; PAM sequence: GGG
ggtttcttaattaactctga

SEQ ID NO: 35898 - DNA, 20 bp, Artificial Sequence
  Description of Artificial Sequence: Synthetic oligonucleotide
  Target: SCN10A; (+) strand; PAM type: NRG; PAM sequence: CAG
ttcttaattaactctgaggg

SEQ ID NO: 35899 - DNA, 20 bp, Artificial Sequence
  Description of Artificial Sequence: Synthetic oligonucleotide
  Target: SCN10A; (+) strand; PAM type: NRG; PAM sequence: TAG
ccttgtttctatgtcttctg

SEQ ID NO: 35900 - DNA, 20 bp, Artificial Sequence
  Description of Artificial Sequence: Synthetic oligonucleotide
  Target: SCN10A; (+) strand; PAM type: NRG; PAM sequence: TAG
tcttctgtagaaatccacca

SEQ ID NO: 35901 - DNA, 20 bp, Artificial Sequence
  Description of Artificial Sequence: Synthetic oligonucleotide
  Target: SCN10A; (+) strand; PAM type: NRG; PAM sequence: CAG
ccatagccactgcatataaa

SEQ ID NO: 35902 - DNA, 20 bp, Artificial Sequence
  Description of Artificial Sequence: Synthetic oligonucleotide
  Target: SCN10A; (+) strand; PAM type: NRG; PAM sequence: GAG
tataaacagttcactgctct

SEQ ID NO: 35903 - DNA, 20 bp, Artificial Sequence
  Description of Artificial Sequence: Synthetic oligonucleotide
  Target: SCN10A; (+) strand; PAM type: NRG; PAM sequence: AGG
ataaacagttcactgctctg

SEQ ID NO: 35904 - DNA, 20 bp, Artificial Sequence
  Description of Artificial Sequence: Synthetic oligonucleotide
  Target: SCN10A; (+) strand; PAM type: NRG; PAM sequence: GAG
cactgctctgaggattaaat

SEQ ID NO: 35905 - DNA, 20 bp, Artificial Sequence
  Description of Artificial Sequence: Synthetic oligonucleotide
  Target: SCN10A; (+) strand; PAM type: NRG; PAM sequence: TAG
gattaaatgagatcactgta

SEQ ID NO: 35906 - DNA, 20 bp, Artificial Sequence
  Description of Artificial Sequence: Synthetic oligonucleotide
  Target: SCN10A; (+) strand; PAM type: NRG; PAM sequence: TAG
tagtgtcttgcacttctgca

SEQ ID NO: 35907 - DNA, 20 bp, Artificial Sequence
  Description of Artificial Sequence: Synthetic oligonucleotide
  Target: SCN10A; (+) strand; PAM type: NRG; PAM sequence: AAG
aatattgtatataaactgca

SEQ ID NO: 35908 - DNA, 20 bp, Artificial Sequence
  Description of Artificial Sequence: Synthetic oligonucleotide
  Target: SCN10A; (+) strand; PAM type: NRG; PAM sequence: AGG
atattgtatataaactgcaa

SEQ ID NO: 35909 - DNA, 20 bp, Artificial Sequence
  Description of Artificial Sequence: Synthetic oligonucleotide
  Target: SCN10A; (+) strand; PAM type: NRG; PAM sequence: TGG
attcctattgtttttaacct

SEQ ID NO: 35910 - DNA, 20 bp, Artificial Sequence
  Description of Artificial Sequence: Synthetic oligonucleotide
  Target: SCN10A; (+) strand; PAM type: NRG; PAM sequence: AAG
cctattgtttttaaccttgg

SEQ ID NO: 35911 - DNA, 20 bp, Artificial Sequence
  Description of Artificial Sequence: Synthetic oligonucleotide
  Target: SCN10A; (+) strand; PAM type: NRG; PAM sequence: AAG
ttaaccttggaagctgctga

SEQ ID NO: 35912 - DNA, 20 bp, Artificial Sequence
  Description of Artificial Sequence: Synthetic oligonucleotide
  Target: SCN10A; (+) strand; PAM type: NRG; PAM sequence: AGG
taaccttggaagctgctgaa

SEQ ID NO: 35913 - DNA, 20 bp, Artificial Sequence
  Description of Artificial Sequence: Synthetic oligonucleotide
  Target: SCN10A; (+) strand; PAM type: NRG; PAM sequence: TGG
aagctgctgaaaggataaac

SEQ ID NO: 35914 - DNA, 20 bp, Artificial Sequence
  Description of Artificial Sequence: Synthetic oligonucleotide
  Target: SCN10A; (+) strand; PAM type: NRG; PAM sequence: TGG
ataaactggaataatatatg

SEQ ID NO: 35915 - DNA, 20 bp, Artificial Sequence
  Description of Artificial Sequence: Synthetic oligonucleotide
  Target: SCN10A; (+) strand; PAM type: NRG; PAM sequence: AAG
aactggaataatatatgtgg

SEQ ID NO: 35916 - DNA, 20 bp, Artificial Sequence
  Description of Artificial Sequence: Synthetic oligonucleotide
  Target: SCN10A; (+) strand; PAM type: NRG; PAM sequence: TGG
gaaaattatcaactattttc

SEQ ID NO: 35917 - DNA, 20 bp, Artificial Sequence
  Description of Artificial Sequence: Synthetic oligonucleotide
  Target: SCN10A; (+) strand; PAM type: NRG; PAM sequence: GAG
tggtatccattttctgcctt

SEQ ID NO: 35918 - DNA, 20 bp, Artificial Sequence
  Description of Artificial Sequence: Synthetic oligonucleotide
  Target: SCN10A; (+) strand; PAM type: NRG; PAM sequence: CAG
gacccctgaccttcctccca

SEQ ID NO: 35919 - DNA, 20 bp, Artificial Sequence
  Description of Artificial Sequence: Synthetic oligonucleotide
  Target: SCN10A; (+) strand; PAM type: NRG; PAM sequence: TGG
ccttcctcccacagtgccat

SEQ ID NO: 35920 - DNA, 20 bp, Artificial Sequence
  Description of Artificial Sequence: Synthetic oligonucleotide
  Target: SCN10A; (+) strand; PAM type: NRG; PAM sequence: TGG
cacagtgccattggccaatg

SEQ ID NO: 35921 - DNA, 20 bp, Artificial Sequence
  Description of Artificial Sequence: Synthetic oligonucleotide
  Target: SCN10A; (+) strand; PAM type: NRG; PAM sequence: GGG
acagtgccattggccaatgt

SEQ ID NO: 35922 - DNA, 20 bp, Artificial Sequence
  Description of Artificial Sequence: Synthetic oligonucleotide
  Target: SCN10A; (+) strand; PAM type: NRG; PAM sequence: CAG
ggccaatgtgggcctttcct

SEQ ID NO: 35923 - DNA, 20 bp, Artificial Sequence
  Description of Artificial Sequence: Synthetic oligonucleotide
  Target: SCN10A; (+) strand; PAM type: NRG; PAM sequence: AGG
gccaatgtgggcctttcctc

SEQ ID NO: 35924 - DNA, 20 bp, Artificial Sequence
  Description of Artificial Sequence: Synthetic oligonucleotide
  Target: SCN10A; (+) strand; PAM type: NRG; PAM sequence: TGG
tgggcctttcctcaggactc

SEQ ID NO: 35925 - DNA, 20 bp, Artificial Sequence
  Description of Artificial Sequence: Synthetic oligonucleotide
  Target: SCN10A; (+) strand; PAM type: NRG; PAM sequence: CAG
tcaggactctggcttctctg

SEQ ID NO: 35926 - DNA, 20 bp, Artificial Sequence
  Description of Artificial Sequence: Synthetic oligonucleotide
  Target: SCN10A; (+) strand; PAM type: NRG; PAM sequence: CAG
ctggcttctctgcagcccca

SEQ ID NO: 35927 - DNA, 20 bp, Artificial Sequence
  Description of Artificial Sequence: Synthetic oligonucleotide
  Target: SCN10A; (+) strand; PAM type: NRG; PAM sequence: GAG
ggcttctctgcagccccaca

SEQ ID NO: 35928 - DNA, 20 bp, Artificial Sequence
  Description of Artificial Sequence: Synthetic oligonucleotide
  Target: SCN10A; (+) strand; PAM type: NRG; PAM sequence: AGG
gcttctctgcagccccacag

SEQ ID NO: 35929 - DNA, 20 bp, Artificial Sequence
  Description of Artificial Sequence: Synthetic oligonucleotide
  Target: SCN10A; (+) strand; PAM type: NRG; PAM sequence: CAG
ctgcagccccacagaggacc

SEQ ID NO: 35930 - DNA, 20 bp, Artificial Sequence
  Description of Artificial Sequence: Synthetic oligonucleotide
  Target: SCN10A; (+) strand; PAM type: NRG; PAM sequence: AGG
tgcagccccacagaggaccc

SEQ ID NO: 35931 - DNA, 20 bp, Artificial Sequence
  Description of Artificial Sequence: Synthetic oligonucleotide
  Target: SCN10A; (+) strand; PAM type: NRG; PAM sequence: TAG
ccccacagaggacccaggtt

SEQ ID NO: 35932 - DNA, 20 bp, Artificial Sequence
  Description of Artificial Sequence: Synthetic oligonucleotide
  Target: SCN10A; (+) strand; PAM type: NRG; PAM sequence: CGG
ggacccaggtttagctttca

SEQ ID NO: 35933 - DNA, 20 bp, Artificial Sequence
  Description of Artificial Sequence: Synthetic oligonucleotide
  Target: SCN10A; (+) strand; PAM type: NRG; PAM sequence: CGG
ttagctttcacggcatgccc

SEQ ID NO: 35934 - DNA, 20 bp, Artificial Sequence
  Description of Artificial Sequence: Synthetic oligonucleotide
  Target: SCN10A; (+) strand; PAM type: NRG; PAM sequence: CAG
gctttcacggcatgccccgg

SEQ ID NO: 35935 - DNA, 20 bp, Artificial Sequence
  Description of Artificial Sequence: Synthetic oligonucleotide
  Target: SCN10A; (+) strand; PAM type: NRG; PAM sequence: AGG
ctttcacggcatgccccggc

SEQ ID NO: 35936 - DNA, 20 bp, Artificial Sequence
  Description of Artificial Sequence: Synthetic oligonucleotide
  Target: SCN10A; (+) strand; PAM type: NRG; PAM sequence: GGG
tttcacggcatgccccggca

SEQ ID NO: 35937 - DNA, 20 bp, Artificial Sequence
  Description of Artificial Sequence: Synthetic oligonucleotide
  Target: SCN10A; (+) strand; PAM type: NRG; PAM sequence: GAG
ttcactctgtccgttatcct

SEQ ID NO: 35938 - DNA, 20 bp, Artificial Sequence
  Description of Artificial Sequence: Synthetic oligonucleotide
  Target: SCN10A; (+) strand; PAM type: NRG; PAM sequence: TGG
ctctgtccgttatcctgagc

SEQ ID NO: 35939 - DNA, 20 bp, Artificial Sequence
  Description of Artificial Sequence: Synthetic oligonucleotide
  Target: SCN10A; (+) strand; PAM type: NRG; PAM sequence: CAG
ctggcctctctctgccatcc

SEQ ID NO: 35940 - DNA, 20 bp, Artificial Sequence
  Description of Artificial Sequence: Synthetic oligonucleotide
  Target: SCN10A; (+) strand; PAM type: NRG; PAM sequence: TGG
ctctctctgccatcccagcc

SEQ ID NO: 35941 - DNA, 20 bp, Artificial Sequence
  Description of Artificial Sequence: Synthetic oligonucleotide
  Target: SCN10A; (+) strand; PAM type: NRG; PAM sequence: TGG
tggtccactcccccactgcc

SEQ ID NO: 35942 - DNA, 20 bp, Artificial Sequence
  Description of Artificial Sequence: Synthetic oligonucleotide
  Target: SCN10A; (+) strand; PAM type: NRG; PAM sequence: TGG
ccactcccccactgcctggc

SEQ ID NO: 35943 - DNA, 20 bp, Artificial Sequence
  Description of Artificial Sequence: Synthetic oligonucleotide
  Target: SCN10A; (+) strand; PAM type: NRG; PAM sequence: TAG
cctggctggcacctgcccaa

SEQ ID NO: 35944 - DNA, 20 bp, Artificial Sequence
  Description of Artificial Sequence: Synthetic oligonucleotide
  Target: SCN10A; (+) strand; PAM type: NRG; PAM sequence: CAG
ggctggcacctgcccaatag

SEQ ID NO: 35945 - DNA, 20 bp, Artificial Sequence
  Description of Artificial Sequence: Synthetic oligonucleotide
  Target: SCN10A; (+) strand; PAM type: NRG; PAM sequence: AGG
gctggcacctgcccaatagc

SEQ ID NO: 35946 - DNA, 20 bp, Artificial Sequence
  Description of Artificial Sequence: Synthetic oligonucleotide
  Target: SCN10A; (+) strand; PAM type: NRG; PAM sequence: TGG
cacctgcccaatagcaggcc

SEQ ID NO: 35947 - DNA, 20 bp, Artificial Sequence
  Description of Artificial Sequence: Synthetic oligonucleotide
  Target: SCN10A; (+) strand; PAM type: NRG; PAM sequence: CAG
caatagcaggcctggcctct

SEQ ID NO: 35948 - DNA, 20 bp, Artificial Sequence
  Description of Artificial Sequence: Synthetic oligonucleotide
  Target: SCN10A; (+) strand; PAM type: NRG; PAM sequence: AGG
aatagcaggcctggcctctc

SEQ ID NO: 35949 - DNA, 20 bp, Artificial Sequence
  Description of Artificial Sequence: Synthetic oligonucleotide
  Target: SCN10A; (+) strand; PAM type: NRG; PAM sequence: GGG
atagcaggcctggcctctca

SEQ ID NO: 35950 - DNA, 20 bp, Artificial Sequence
  Description of Artificial Sequence: Synthetic oligonucleotide
  Target: SCN10A; (+) strand; PAM type: NRG; PAM sequence: GAG
agcaggcctggcctctcagg

SEQ ID NO: 35951 - DNA, 20 bp, Artificial Sequence
  Description of Artificial Sequence: Synthetic oligonucleotide
  Target: SCN10A; (+) strand; PAM type: NRG; PAM sequence: GAG
gcctggcctctcagggagct

SEQ ID NO: 35952 - DNA, 20 bp, Artificial Sequence
  Description of Artificial Sequence: Synthetic oligonucleotide
  Target: SCN10A; (+) strand; PAM type: NRG; PAM sequence: TAG
cctctcagggagctgagctg

SEQ ID NO: 35953 - DNA, 20 bp, Artificial Sequence
  Description of Artificial Sequence: Synthetic oligonucleotide
  Target: SCN10A; (+) strand; PAM type: NRG; PAM sequence: GAG
tctcagggagctgagctgta

SEQ ID NO: 35954 - DNA, 20 bp, Artificial Sequence
  Description of Artificial Sequence: Synthetic oligonucleotide
  Target: SCN10A; (+) strand; PAM type: NRG; PAM sequence: AGG
ctcagggagctgagctgtag

SEQ ID NO: 35955 - DNA, 20 bp, Artificial Sequence
  Description of Artificial Sequence: Synthetic oligonucleotide
  Target: SCN10A; (+) strand; PAM type: NRG; PAM sequence: TAG
agctgagctgtagaggtgtg

SEQ ID NO: 35956 - DNA, 20 bp, Artificial Sequence
  Description of Artificial Sequence: Synthetic oligonucleotide
  Target: SCN10A; (+) strand; PAM type: NRG; PAM sequence: TGG
gagctgtagaggtgtgtaga

SEQ ID NO: 35957 - DNA, 20 bp, Artificial Sequence
  Description of Artificial Sequence: Synthetic oligonucleotide
  Target: SCN10A; (+) strand; PAM type: NRG; PAM sequence: AAG
cccaacaactttaccacaaa

SEQ ID NO: 35958 - DNA, 20 bp, Artificial Sequence
  Description of Artificial Sequence: Synthetic oligonucleotide
  Target: SCN10A; (+) strand; PAM type: NRG; PAM sequence: AGG
ccaacaactttaccacaaaa

SEQ ID NO: 35959 - DNA, 20 bp, Artificial Sequence
  Description of Artificial Sequence: Synthetic oligonucleotide
  Target: SCN10A; (+) strand; PAM type: NRG; PAM sequence: GAG
ctttaccacaaaaaggactt

SEQ ID NO: 35960 - DNA, 20 bp, Artificial Sequence
  Description of Artificial Sequence: Synthetic oligonucleotide
  Target: SCN10A; (+) strand; PAM type: NRG; PAM sequence: TGG
aaaaaggacttgagctgctc

SEQ ID NO: 35961 - DNA, 20 bp, Artificial Sequence
  Description of Artificial Sequence: Synthetic oligonucleotide
  Target: SCN10A; (+) strand; PAM type: NRG; PAM sequence: GAG
aaaggacttgagctgctctg

SEQ ID NO: 35962 - DNA, 20 bp, Artificial Sequence
  Description of Artificial Sequence: Synthetic oligonucleotide
  Target: SCN10A; (+) strand; PAM type: NRG; PAM sequence: GAG
tgctctggagccattgcctt

SEQ ID NO: 35963 - DNA, 20 bp, Artificial Sequence
  Description of Artificial Sequence: Synthetic oligonucleotide
  Target: SCN10A; (+) strand; PAM type: NRG; PAM sequence: TAG
ccttgagaaatgccattatc

SEQ ID NO: 35964 - DNA, 20 bp, Artificial Sequence
  Description of Artificial Sequence: Synthetic oligonucleotide
  Target: SCN10A; (+) strand; PAM type: NRG; PAM sequence: CAG
gagaaatgccattatctaga

SEQ ID NO: 35965 - DNA, 20 bp, Artificial Sequence
  Description of Artificial Sequence: Synthetic oligonucleotide
  Target: SCN10A; (+) strand; PAM type: NRG; PAM sequence: AAG
aaatgccattatctagacag

SEQ ID NO: 35966 - DNA, 20 bp, Artificial Sequence
  Description of Artificial Sequence: Synthetic oligonucleotide
  Target: SCN10A; (+) strand; PAM type: NRG; PAM sequence: AGG
aatgccattatctagacaga

SEQ ID NO: 35967 - DNA, 20 bp, Artificial Sequence
  Description of Artificial Sequence: Synthetic oligonucleotide
  Target: SCN10A; (+) strand; PAM type: NRG; PAM sequence: GAG
tatctagacagaaggatgct

SEQ ID NO: 35968 - DNA, 20 bp, Artificial Sequence
  Description of Artificial Sequence: Synthetic oligonucleotide
  Target: SCN10A; (+) strand; PAM type: NRG; PAM sequence: AGG
atctagacagaaggatgctg

SEQ ID NO: 35969 - DNA, 20 bp, Artificial Sequence
  Description of Artificial Sequence: Synthetic oligonucleotide
  Target: SCN10A; (+) strand; PAM type: NRG; PAM sequence: GGG
tctagacagaaggatgctga

SEQ ID NO: 35970 - DNA, 20 bp, Artificial Sequence
  Description of Artificial Sequence: Synthetic oligonucleotide
  Target: SCN10A; (+) strand; PAM type: NRG; PAM sequence: GGG
ctagacagaaggatgctgag

SEQ ID NO: 35971 - DNA, 20 bp, Artificial Sequence
  Description of Artificial Sequence: Synthetic oligonucleotide
  Target: SCN10A; (+) strand; PAM type: NRG; PAM sequence: TGG
gaaggatgctgaggggctct

SEQ ID NO: 35972 - DNA, 20 bp, Artificial Sequence
  Description of Artificial Sequence: Synthetic oligonucleotide
  Target: SCN10A; (+) strand; PAM type: NRG; PAM sequence: AAG
ggggctcttggtttacattt

SEQ ID NO: 35973 - DNA, 20 bp, Artificial Sequence
  Description of Artificial Sequence: Synthetic oligonucleotide
  Target: SCN10A; (+) strand; PAM type: NRG; PAM sequence: AAG
cttggtttacatttaagtca

SEQ ID NO: 35974 - DNA, 20 bp, Artificial Sequence
  Description of Artificial Sequence: Synthetic oligonucleotide
  Target: SCN10A; (+) strand; PAM type: NRG; PAM sequence: AGG
ttggtttacatttaagtcaa

SEQ ID NO: 35975 - DNA, 20 bp, Artificial Sequence
  Description of Artificial Sequence: Synthetic oligonucleotide
  Target: SCN10A; (+) strand; PAM type: NRG; PAM sequence: CAG
aggcaaatgaaaactgatgt

SEQ ID NO: 35976 - DNA, 20 bp, Artificial Sequence
  Description of Artificial Sequence: Synthetic oligonucleotide
  Target: SCN10A; (+) strand; PAM type: NRG; PAM sequence: GAG
tgtcagaacaaccctctcat

SEQ ID NO: 35977 - DNA, 20 bp, Artificial Sequence
  Description of Artificial Sequence: Synthetic oligonucleotide
  Target: SCN10A; (+) strand; PAM type: NRG; PAM sequence: AAG
aacaaccctctcatgagcca

SEQ ID NO: 35978 - DNA, 20 bp, Artificial Sequence
  Description of Artificial Sequence: Synthetic oligonucleotide
  Target: SCN10A; (+) strand; PAM type: NRG; PAM sequence: AAG
gagccaaagaaccaaatgcc

SEQ ID NO: 35979 - DNA, 20 bp, Artificial Sequence
  Description of Artificial Sequence: Synthetic oligonucleotide
  Target: SCN10A; (+) strand; PAM type: NRG; PAM sequence: AAG
aatgccaagtgcatttgtga

SEQ ID NO: 35980 - DNA, 20 bp, Artificial Sequence
  Description of Artificial Sequence: Synthetic oligonucleotide
  Target: SCN10A; (+) strand; PAM type: NRG; PAM sequence: CAG
caagtgcatttgtgaaagaa

SEQ ID NO: 35981 - DNA, 20 bp, Artificial Sequence
  Description of Artificial Sequence: Synthetic oligonucleotide
  Target: SCN10A; (+) strand; PAM type: NRG; PAM sequence: AAG
catttgtgaaagaacagtcc

SEQ ID NO: 35982 - DNA, 20 bp, Artificial Sequence
  Description of Artificial Sequence: Synthetic oligonucleotide
  Target: SCN10A; (+) strand; PAM type: NRG; PAM sequence: AGG
atttgtgaaagaacagtcca

SEQ ID NO: 35983 - DNA, 20 bp, Artificial Sequence
  Description of Artificial Sequence: Synthetic oligonucleotide
  Target: SCN10A; (+) strand; PAM type: NRG; PAM sequence: CAG
caaatgctcctgcttgtttc

SEQ ID NO: 35984 - DNA, 20 bp, Artificial Sequence
  Description of Artificial Sequence: Synthetic oligonucleotide
  Target: SCN10A; (+) strand; PAM type: NRG; PAM sequence: CAG
tcctgcttgtttccagtcct

SEQ ID NO: 35985 - DNA, 20 bp, Artificial Sequence
  Description of Artificial Sequence: Synthetic oligonucleotide
  Target: SCN10A; (+) strand; PAM type: NRG; PAM sequence: GAG
tccagtcctcagctccaact

SEQ ID NO: 35986 - DNA, 20 bp, Artificial Sequence
  Description of Artificial Sequence: Synthetic oligonucleotide
  Target: SCN10A; (+) strand; PAM type: NRG; PAM sequence: TAG
gtcctcagctccaactgaga

SEQ ID NO: 35987 - DNA, 20 bp, Artificial Sequence
  Description of Artificial Sequence: Synthetic oligonucleotide
  Target: SCN10A; (+) strand; PAM type: NRG; PAM sequence: TAG
tccaactgagatagttttcc

SEQ ID NO: 35988 - DNA, 20 bp, Artificial Sequence
  Description of Artificial Sequence: Synthetic oligonucleotide
  Target: SCN10A; (+) strand; PAM type: NRG; PAM sequence: GAG
actgagatagttttcctagt

SEQ ID NO: 35989 - DNA, 20 bp, Artificial Sequence
  Description of Artificial Sequence: Synthetic oligonucleotide
  Target: SCN10A; (+) strand; PAM type: NRG; PAM sequence: AAG
gttttcctagtgagctgatg

SEQ ID NO: 35990 - DNA, 20 bp, Artificial Sequence
  Description of Artificial Sequence: Synthetic oligonucleotide
  Target: SCN10A; (+) strand; PAM type: NRG; PAM sequence: AGG
ttttcctagtgagctgatga

SEQ ID NO: 35991 - DNA, 20 bp, Artificial Sequence
  Description of Artificial Sequence: Synthetic oligonucleotide
  Target: SCN10A; (+) strand; PAM type: NRG; PAM sequence: TGG
tcctagtgagctgatgaagg

SEQ ID NO: 35992 - DNA, 20 bp, Artificial Sequence
  Description of Artificial Sequence: Synthetic oligonucleotide
  Target: SCN10A; (+) strand; PAM type: NRG; PAM sequence: GAG
ctagtgagctgatgaaggtg

SEQ ID NO: 35993 - DNA, 20 bp, Artificial Sequence
  Description of Artificial Sequence: Synthetic oligonucleotide
  Target: SCN10A; (+) strand; PAM type: NRG; PAM sequence: CAG
gatgaaggtggagcctcatg

SEQ ID NO: 35994 - DNA, 20 bp, Artificial Sequence
  Description of Artificial Sequence: Synthetic oligonucleotide
  Target: SCN10A; (+) strand; PAM type: NRG; PAM sequence: AGG
atgaaggtggagcctcatgc

SEQ ID NO: 35995 - DNA, 20 bp, Artificial Sequence
  Description of Artificial Sequence: Synthetic oligonucleotide
  Target: SCN10A; (+) strand; PAM type: NRG; PAM sequence: CAG
agcctcatgcaggctccaca

SEQ ID NO: 35996 - DNA, 20 bp, Artificial Sequence
  Description of Artificial Sequence: Synthetic oligonucleotide
  Target: SCN10A; (+) strand; PAM type: NRG; PAM sequence: AGG
gcctcatgcaggctccacac

SEQ ID NO: 35997 - DNA, 20 bp, Artificial Sequence
  Description of Artificial Sequence: Synthetic oligonucleotide
  Target: SCN10A; (+) strand; PAM type: NRG; PAM sequence: TGG
aggctccacacaggtcgacc

SEQ ID NO: 35998 - DNA, 20 bp, Artificial Sequence
  Description of Artificial Sequence: Synthetic oligonucleotide
  Target: SCN10A; (+) strand; PAM type: NRG; PAM sequence: GGG
ggctccacacaggtcgacct

SEQ ID NO: 35999 - DNA, 20 bp, Artificial Sequence
  Description of Artificial Sequence: Synthetic oligonucleotide
  Target: SCN10A; (+) strand; PAM type: NRG; PAM sequence: TGG
acaggtcgacctgggcaaca

SEQ ID NO: 36000 - DNA, 20 bp, Artificial Sequence
  Description of Artificial Sequence: Synthetic oligonucleotide
  Target: SCN10A; (+) strand; PAM type: NRG; PAM sequence: GAG
aggtcgacctgggcaacatg

SEQ ID NO: 36001 - DNA, 20 bp, Artificial Sequence
  Description of Artificial Sequence: Synthetic oligonucleotide
  Target: SCN10A; (+) strand; PAM type: NRG; PAM sequence: CAG
cctgggcaacatggagccgt

SEQ ID NO: 36002 - DNA, 20 bp, Artificial Sequence
  Description of Artificial Sequence: Synthetic oligonucleotide
  Target: SCN10A; (+) strand; PAM type: NRG; PAM sequence: CAG
acatggagccgtcagcctct

SEQ ID NO: 36003 - DNA, 20 bp, Artificial Sequence
  Description of Artificial Sequence: Synthetic oligonucleotide
  Target: SCN10A; (+) strand; PAM type: NRG; PAM sequence: AGG
catggagccgtcagcctctc

SEQ ID NO: 36004 - DNA, 20 bp, Artificial Sequence
  Description of Artificial Sequence: Synthetic oligonucleotide
  Target: SCN10A; (+) strand; PAM type: NRG; PAM sequence: TGG
gccgtcagcctctcaggcac

SEQ ID NO: 36005 - DNA, 20 bp, Artificial Sequence
  Description of Artificial Sequence: Synthetic oligonucleotide
  Target: SCN10A; (+) strand; PAM type: NRG; PAM sequence: GGG
ccgtcagcctctcaggcact

SEQ ID NO: 36006 - DNA, 20 bp, Artificial Sequence
  Description of Artificial Sequence: Synthetic oligonucleotide
  Target: SCN10A; (+) strand; PAM type: NRG; PAM sequence: GGG
cgtcagcctctcaggcactg

SEQ ID NO: 36007 - DNA, 20 bp, Artificial Sequence
  Description of Artificial Sequence: Synthetic oligonucleotide
  Target: SCN10A; (+) strand; PAM type: NRG; PAM sequence: GGG
gtcagcctctcaggcactgg

SEQ ID NO: 36008 - DNA, 20 bp, Artificial Sequence
  Description of Artificial Sequence: Synthetic oligonucleotide
  Target: SCN10A; (+) strand; PAM type: NRG; PAM sequence: GAG
tcaggcactgggggtgttgt

SEQ ID NO: 36009 - DNA, 20 bp, Artificial Sequence
  Description of Artificial Sequence: Synthetic oligonucleotide
  Target: SCN10A; (+) strand; PAM type: NRG; PAM sequence: AAG
gttgtgagctctgcttttcc

SEQ ID NO: 36010 - DNA, 20 bp, Artificial Sequence
  Description of Artificial Sequence: Synthetic oligonucleotide
  Target: SCN10A; (+) strand; PAM type: NRG; PAM sequence: CAG
gctctgcttttccaagctct

SEQ ID NO: 36011 - DNA, 20 bp, Artificial Sequence
  Description of Artificial Sequence: Synthetic oligonucleotide
  Target: SCN10A; (+) strand; PAM type: NRG; PAM sequence: TGG
cttttccaagctctcagcca

SEQ ID NO: 36012 - DNA, 20 bp, Artificial Sequence
  Description of Artificial Sequence: Synthetic oligonucleotide
  Target: SCN10A; (+) strand; PAM type: NRG; PAM sequence: GAG
tttccaagctctcagccatg

SEQ ID NO: 36013 - DNA, 20 bp, Artificial Sequence
  Description of Artificial Sequence: Synthetic oligonucleotide
  Target: SCN10A; (+) strand; PAM type: NRG; PAM sequence: AGG
ttccaagctctcagccatgg

SEQ ID NO: 36014 - DNA, 20 bp, Artificial Sequence
  Description of Artificial Sequence: Synthetic oligonucleotide
  Target: SCN10A; (+) strand; PAM type: NRG; PAM sequence: TGG
caagctctcagccatggagg

SEQ ID NO: 36015 - DNA, 20 bp, Artificial Sequence
  Description of Artificial Sequence: Synthetic oligonucleotide
  Target: SCN10A; (+) strand; PAM type: NRG; PAM sequence: GGG
aagctctcagccatggaggt

SEQ ID NO: 36016 - DNA, 20 bp, Artificial Sequence
  Description of Artificial Sequence: Synthetic oligonucleotide
  Target: SCN10A; (+) strand; PAM type: NRG; PAM sequence: GAG
tctcagccatggaggtgggt

SEQ ID NO: 36017 - DNA, 20 bp, Artificial Sequence
  Description of Artificial Sequence: Synthetic oligonucleotide
  Target: SCN10A; (+) strand; PAM type: NRG; PAM sequence: TGG
agccatggaggtgggtgaga

SEQ ID NO: 36018 - DNA, 20 bp, Artificial Sequence
  Description of Artificial Sequence: Synthetic oligonucleotide
  Target: SCN10A; (+) strand; PAM type: NRG; PAM sequence: GGG
gccatggaggtgggtgagat

SEQ ID NO: 36019 - DNA, 20 bp, Artificial Sequence
  Description of Artificial Sequence: Synthetic oligonucleotide
  Target: SCN10A; (+) strand; PAM type: NRG; PAM sequence: AAG
cctttttgatcttttgccta

SEQ ID NO: 36020 - DNA, 20 bp, Artificial Sequence
  Description of Artificial Sequence: Synthetic oligonucleotide
  Target: SCN10A; (+) strand; PAM type: NRG; PAM sequence: CAG
tttctgctcatgccttcctc

SEQ ID NO: 36021 - DNA, 20 bp, Artificial Sequence
  Description of Artificial Sequence: Synthetic oligonucleotide
  Target: SCN10A; (+) strand; PAM type: NRG; PAM sequence: TGG
ctgctcatgccttcctccag

SEQ ID NO: 36022 - DNA, 20 bp, Artificial Sequence
  Description of Artificial Sequence: Synthetic oligonucleotide
  Target: SCN10A; (+) strand; PAM type: NRG; PAM sequence: AAG
atgccttcctccagtggcca

SEQ ID NO: 36023 - DNA, 20 bp, Artificial Sequence
  Description of Artificial Sequence: Synthetic oligonucleotide
  Target: SCN10A; (+) strand; PAM type: NRG; PAM sequence: CAG
ccttcctccagtggccaaag

SEQ ID NO: 36024 - DNA, 20 bp, Artificial Sequence
  Description of Artificial Sequence: Synthetic oligonucleotide
  Target: SCN10A; (+) strand; PAM type: NRG; PAM sequence: CAG
tcctccagtggccaaagcag

SEQ ID NO: 36025 - DNA, 20 bp, Artificial Sequence
  Description of Artificial Sequence: Synthetic oligonucleotide
  Target: SCN10A; (+) strand; PAM type: NRG; PAM sequence: AGG
cctccagtggccaaagcagc

SEQ ID NO: 36026 - DNA, 20 bp, Artificial Sequence
  Description of Artificial Sequence: Synthetic oligonucleotide
  Target: SCN10A; (+) strand; PAM type: NRG; PAM sequence: CAG
ccagtggccaaagcagcagg

SEQ ID NO: 36027 - DNA, 20 bp, Artificial Sequence
  Description of Artificial Sequence: Synthetic oligonucleotide
  Target: SCN10A; (+) strand; PAM type: NRG; PAM sequence: GAG
agtggccaaagcagcaggca

SEQ ID NO: 36028 - DNA, 20 bp, Artificial Sequence
  Description of Artificial Sequence: Synthetic oligonucleotide
  Target: SCN10A; (+) strand; PAM type: NRG; PAM sequence: GAG
ccaaagcagcaggcagagct

SEQ ID NO: 36029 - DNA, 20 bp, Artificial Sequence
  Description of Artificial Sequence: Synthetic oligonucleotide
  Target: SCN10A; (+) strand; PAM type: NRG; PAM sequence: AGG
caaagcagcaggcagagctg

SEQ ID NO: 36030 - DNA, 20 bp, Artificial Sequence
  Description of Artificial Sequence: Synthetic oligonucleotide
  Target: SCN10A; (+) strand; PAM type: NRG; PAM sequence: GGG
aaagcagcaggcagagctga

SEQ ID NO: 36031 - DNA, 20 bp, Artificial Sequence
  Description of Artificial Sequence: Synthetic oligonucleotide
  Target: SCN10A; (+) strand; PAM type: NRG; PAM sequence: GGG
aagcagcaggcagagctgag

SEQ ID NO: 36032 - DNA, 20 bp, Artificial Sequence
  Description of Artificial Sequence: Synthetic oligonucleotide
  Target: SCN10A; (+) strand; PAM type: NRG; PAM sequence: TAG
gctgaggggtcctcatccct

SEQ ID NO: 36033 - DNA, 20 bp, Artificial Sequence
  Description of Artificial Sequence: Synthetic oligonucleotide
  Target: SCN10A; (+) strand; PAM type: NRG; PAM sequence: TGG
tcacattctgttctgccacc

SEQ ID NO: 36034 - DNA, 20 bp, Artificial Sequence
  Description of Artificial Sequence: Synthetic oligonucleotide
  Target: SCN10A; (+) strand; PAM type: NRG; PAM sequence: TGG
ttctgttctgccacctggaa

SEQ ID NO: 36035 - DNA, 20 bp, Artificial Sequence
  Description of Artificial Sequence: Synthetic oligonucleotide
  Target: SCN10A; (+) strand; PAM type: NRG; PAM sequence: CAG
gaaactatctcgtattcacc

SEQ ID NO: 36036 - DNA, 20 bp, Artificial Sequence
  Description of Artificial Sequence: Synthetic oligonucleotide
  Target: SCN10A; (+) strand; PAM type: NRG; PAM sequence: TGG
tatctcgtattcacccagcc

SEQ ID NO: 36037 - DNA, 20 bp, Artificial Sequence
  Description of Artificial Sequence: Synthetic oligonucleotide
  Target: SCN10A; (+) strand; PAM type: NRG; PAM sequence: GAG
tctcgtattcacccagcctg

SEQ ID NO: 36038 - DNA, 20 bp, Artificial Sequence
  Description of Artificial Sequence: Synthetic oligonucleotide
  Target: SCN10A; (+) strand; PAM type: NRG; PAM sequence: AAG
gacatcctacctgcccttga

SEQ ID NO: 36039 - DNA, 20 bp, Artificial Sequence
  Description of Artificial Sequence: Synthetic oligonucleotide
  Target: SCN10A; (+) strand; PAM type: NRG; PAM sequence: CAG
ctcacctcaaacaccacctc

SEQ ID NO: 36040 - DNA, 20 bp, Artificial Sequence
  Description of Artificial Sequence: Synthetic oligonucleotide
  Target: SCN10A; (+) strand; PAM type: NRG; PAM sequence: AGG
tcacctcaaacaccacctcc

SEQ ID NO: 36041 - DNA, 20 bp, Artificial Sequence
  Description of Artificial Sequence: Synthetic oligonucleotide
  Target: SCN10A; (+) strand; PAM type: NRG; PAM sequence: AAG
cctcaaacaccacctccagg

SEQ ID NO: 36042 - DNA, 20 bp, Artificial Sequence
  Description of Artificial Sequence: Synthetic oligonucleotide
  Target: SCN10A; (+) strand; PAM type: NRG; PAM sequence: CAG
gccacctcactgtgtttgcc

SEQ ID NO: 36043 - DNA, 20 bp, Artificial Sequence
  Description of Artificial Sequence: Synthetic oligonucleotide
  Target: SCN10A; (+) strand; PAM type: NRG; PAM sequence: AAG
ctgtgtttgcccagcctatg

SEQ ID NO: 36044 - DNA, 20 bp, Artificial Sequence
  Description of Artificial Sequence: Synthetic oligonucleotide
  Target: SCN10A; (+) strand; PAM type: NRG; PAM sequence: TAG
tgcccagcctatgaagcctc

SEQ ID NO: 36045 - DNA, 20 bp, Artificial Sequence
  Description of Artificial Sequence: Synthetic oligonucleotide
  Target: SCN10A; (+) strand; PAM type: NRG; PAM sequence: AAG
agcctatgaagcctctagta

SEQ ID NO: 36046 - DNA, 20 bp, Artificial Sequence
  Description of Artificial Sequence: Synthetic oligonucleotide
  Target: SCN10A; (+) strand; PAM type: NRG; PAM sequence: CAG
agtaaagaacttgttttcca

SEQ ID NO: 36047 - DNA, 20 bp, Artificial Sequence
  Description of Artificial Sequence: Synthetic oligonucleotide
  Target: SCN10A; (+) strand; PAM type: NRG; PAM sequence: AGG
gtaaagaacttgttttccac

SEQ ID NO: 36048 - DNA, 20 bp, Artificial Sequence
  Description of Artificial Sequence: Synthetic oligonucleotide
  Target: SCN10A; (+) strand; PAM type: NRG; PAM sequence: GGG
taaagaacttgttttccaca

SEQ ID NO: 36049 - DNA, 20 bp, Artificial Sequence
  Description of Artificial Sequence: Synthetic oligonucleotide
  Target: SCN10A; (+) strand; PAM type: NRG; PAM sequence: TAG
agaacttgttttccacaggg

SEQ ID NO: 36050 - DNA, 20 bp, Artificial Sequence
  Description of Artificial Sequence: Synthetic oligonucleotide
  Target: SCN10A; (+) strand; PAM type: NRG; PAM sequence: GAG
gcatctttatgtctatgaat

SEQ ID NO: 36051 - DNA, 20 bp, Artificial Sequence
  Description of Artificial Sequence: Synthetic oligonucleotide
  Target: SCN10A; (+) strand; PAM type: NRG; PAM sequence: TAG
atgaatgagaaattgcaaac

SEQ ID NO: 36052 - DNA, 20 bp, Artificial Sequence
  Description of Artificial Sequence: Synthetic oligonucleotide
  Target: SCN10A; (+) strand; PAM type: NRG; PAM sequence: CAG
aatgagaaattgcaaactag

SEQ ID NO: 36053 - DNA, 20 bp, Artificial Sequence
  Description of Artificial Sequence: Synthetic oligonucleotide
  Target: SCN10A; (+) strand; PAM type: NRG; PAM sequence: TAG
aattgcaaactagcagctta

SEQ ID NO: 36054 - DNA, 20 bp, Artificial Sequence
  Description of Artificial Sequence: Synthetic oligonucleotide
  Target: SCN10A; (+) strand; PAM type: NRG; PAM sequence: AGG
attgcaaactagcagcttat

SEQ ID NO: 36055 - DNA, 20 bp, Artificial Sequence
  Description of Artificial Sequence: Synthetic oligonucleotide
  Target: SCN10A; (+) strand; PAM type: NRG; PAM sequence: TGG
caaactagcagcttataggc

SEQ ID NO: 36056 - DNA, 20 bp, Artificial Sequence
  Description of Artificial Sequence: Synthetic oligonucleotide
  Target: SCN10A; (+) strand; PAM type: NRG; PAM sequence: TGG
agcagcttataggctggatt

SEQ ID NO: 36057 - DNA, 20 bp, Artificial Sequence
  Description of Artificial Sequence: Synthetic oligonucleotide
  Target: SCN10A; (+) strand; PAM type: NRG; PAM sequence: CAG
tataggctggatttggccca

SEQ ID NO: 36058 - DNA, 20 bp, Artificial Sequence
  Description of Artificial Sequence: Synthetic oligonucleotide
  Target: SCN10A; (+) strand; PAM type: NRG; PAM sequence: TGG
gcccacagaaatattttgtt

SEQ ID NO: 36059 - DNA, 20 bp, Artificial Sequence
  Description of Artificial Sequence: Synthetic oligonucleotide
  Target: SCN10A; (+) strand; PAM type: NRG; PAM sequence: TAG
ttgtttggcccaacaatatg

SEQ ID NO: 36060 - DNA, 20 bp, Artificial Sequence
  Description of Artificial Sequence: Synthetic oligonucleotide
  Target: SCN10A; (+) strand; PAM type: NRG; PAM sequence: TGG
aacaatatgtagacattttt

SEQ ID NO: 36061 - DNA, 20 bp, Artificial Sequence
  Description of Artificial Sequence: Synthetic oligonucleotide
  Target: SCN10A; (+) strand; PAM type: NRG; PAM sequence: TAG
tatgtagacattttttggaa

SEQ ID NO: 36062 - DNA, 20 bp, Artificial Sequence
  Description of Artificial Sequence: Synthetic oligonucleotide
  Target: SCN10A; (+) strand; PAM type: NRG; PAM sequence: AGG
atgtagacattttttggaat

SEQ ID NO: 36063 - DNA, 20 bp, Artificial Sequence
  Description of Artificial Sequence: Synthetic oligonucleotide
  Target: SCN10A; (+) strand; PAM type: NRG; PAM sequence: TAG
tagacattttttggaatagg

SEQ ID NO: 36064 - DNA, 20 bp, Artificial Sequence
  Description of Artificial Sequence: Synthetic oligonucleotide
  Target: SCN10A; (+) strand; PAM type: NRG; PAM sequence: CGG
gaataggtagccaatgttta

SEQ ID NO: 36065 - DNA, 20 bp, Artificial Sequence
  Description of Artificial Sequence: Synthetic oligonucleotide
  Target: SCN10A; (+) strand; PAM type: NRG; PAM sequence: TGG
aggtagccaatgtttacggt

SEQ ID NO: 36066 - DNA, 20 bp, Artificial Sequence
  Description of Artificial Sequence: Synthetic oligonucleotide
  Target: SCN10A; (+) strand; PAM type: NRG; PAM sequence: GGG
ggtagccaatgtttacggtt

SEQ ID NO: 36067 - DNA, 20 bp, Artificial Sequence
  Description of Artificial Sequence: Synthetic oligonucleotide
  Target: SCN10A; (+) strand; PAM type: NRG; PAM sequence: GAG
tagccaatgtttacggttgg

SEQ ID NO: 36068 - DNA, 20 bp, Artificial Sequence
  Description of Artificial Sequence: Synthetic oligonucleotide
  Target: SCN10A; (+) strand; PAM type: NRG; PAM sequence: AAG
atttcctatctctattttaa

SEQ ID NO: 36069 - DNA, 20 bp, Artificial Sequence
  Description of Artificial Sequence: Synthetic oligonucleotide
  Target: SCN10A; (+) strand; PAM type: NRG; PAM sequence: TGG
cctatctctattttaaaagt

SEQ ID NO: 36070 - DNA, 20 bp, Artificial Sequence
  Description of Artificial Sequence: Synthetic oligonucleotide
  Target: SCN10A; (+) strand; PAM type: NRG; PAM sequence: AAG
atctctattttaaaagttgg

SEQ ID NO: 36071 - DNA, 20 bp, Artificial Sequence
  Description of Artificial Sequence: Synthetic oligonucleotide
  Target: SCN10A; (+) strand; PAM type: NRG; PAM sequence: GAG
ctctattttaaaagttggaa

SEQ ID NO: 36072 - DNA, 20 bp, Artificial Sequence
  Description of Artificial Sequence: Synthetic oligonucleotide
  Target: SCN10A; (+) strand; PAM type: NRG; PAM sequence: TGG
attttaaaagttggaagagc

SEQ ID NO: 36073 - DNA, 20 bp, Artificial Sequence
  Description of Artificial Sequence: Synthetic oligonucleotide
  Target: SCN10A; (+) strand; PAM type: NRG; PAM sequence: CAG
aaagttggaagagctggaaa

SEQ ID NO: 36074 - DNA, 20 bp, Artificial Sequence
  Description of Artificial Sequence: Synthetic oligonucleotide
  Target: SCN10A; (+) strand; PAM type: NRG; PAM sequence: TGG
agtgaacccacatttccaca

SEQ ID NO: 36075 - DNA, 20 bp, Artificial Sequence
  Description of Artificial Sequence: Synthetic oligonucleotide
  Target: SCN10A; (+) strand; PAM type: NRG; PAM sequence: AAG
catttccacatggcaaccaa

SEQ ID NO: 36076 - DNA, 20 bp, Artificial Sequence
  Description of Artificial Sequence: Synthetic oligonucleotide
  Target: SCN10A; (+) strand; PAM type: NRG; PAM sequence: TGG
tccacatggcaaccaaaagc

SEQ ID NO: 36077 - DNA, 20 bp, Artificial Sequence
  Description of Artificial Sequence: Synthetic oligonucleotide
  Target: SCN10A; (+) strand; PAM type: NRG; PAM sequence: GAG
tggcaaccaaaagctggacc

SEQ ID NO: 36078 - DNA, 20 bp, Artificial Sequence
  Description of Artificial Sequence: Synthetic oligonucleotide
  Target: SCN10A; (+) strand; PAM type: NRG; PAM sequence: CAG
caaccaaaagctggaccgag

SEQ ID NO: 36079 - DNA, 20 bp, Artificial Sequence
  Description of Artificial Sequence: Synthetic oligonucleotide
  Target: SCN10A; (+) strand; PAM type: NRG; PAM sequence: TGG
ccaaaagctggaccgagcag

SEQ ID NO: 36080 - DNA, 20 bp, Artificial Sequence
  Description of Artificial Sequence: Synthetic oligonucleotide
  Target: SCN10A; (+) strand; PAM type: NRG; PAM sequence: GGG
caaaagctggaccgagcagt

SEQ ID NO: 36081 - DNA, 20 bp, Artificial Sequence
  Description of Artificial Sequence: Synthetic oligonucleotide
  Target: SCN10A; (+) strand; PAM type: NRG; PAM sequence: GGG
aaaagctggaccgagcagtg

SEQ ID NO: 36082 - DNA, 20 bp, Artificial Sequence
  Description of Artificial Sequence: Synthetic oligonucleotide
  Target: SCN10A; (+) strand; PAM type: NRG; PAM sequence: TAG
agcagtggggctgtcccctt

SEQ ID NO: 36083 - DNA, 20 bp, Artificial Sequence
  Description of Artificial Sequence: Synthetic oligonucleotide
  Target: SCN10A; (+) strand; PAM type: NRG; PAM sequence: GAG
cagtggggctgtccccttta

SEQ ID NO: 36084 - DNA, 20 bp, Artificial Sequence
  Description of Artificial Sequence: Synthetic oligonucleotide
  Target: SCN10A; (+) strand; PAM type: NRG; PAM sequence: AGG
agtggggctgtcccctttag

SEQ ID NO: 36085 - DNA, 20 bp, Artificial Sequence
  Description of Artificial Sequence: Synthetic oligonucleotide
  Target: SCN10A; (+) strand; PAM type: NRG; PAM sequence: GAG
tggggctgtcccctttagag

SEQ ID NO: 36086 - DNA, 20 bp, Artificial Sequence
  Description of Artificial Sequence: Synthetic oligonucleotide
  Target: SCN10A; (+) strand; PAM type: NRG; PAM sequence: AGG
ggggctgtcccctttagagg

SEQ ID NO: 36087 - DNA, 20 bp, Artificial Sequence
  Description of Artificial Sequence: Synthetic oligonucleotide
  Target: SCN10A; (+) strand; PAM type: NRG; PAM sequence: CAG
ttagaggaggcatgaactct

SEQ ID NO: 36088 - DNA, 20 bp, Artificial Sequence
  Description of Artificial Sequence: Synthetic oligonucleotide
  Target: SCN10A; (+) strand; PAM type: NRG; PAM sequence: TAG
aggcatgaactctcagctcc

SEQ ID NO: 36089 - DNA, 20 bp, Artificial Sequence
  Description of Artificial Sequence: Synthetic oligonucleotide
  Target: SCN10A; (+) strand; PAM type: NRG; PAM sequence: AGG
ggcatgaactctcagctcct

SEQ ID NO: 36090 - DNA, 20 bp, Artificial Sequence
  Description of Artificial Sequence: Synthetic oligonucleotide
  Target: SCN10A; (+) strand; PAM type: NRG; PAM sequence: TGG
tcagctcctaggttccctcc

SEQ ID NO: 36091 - DNA, 20 bp, Artificial Sequence
  Description of Artificial Sequence: Synthetic oligonucleotide
  Target: SCN10A; (+) strand; PAM type: NRG; PAM sequence: TGG
ctcatttgttgttatgaatc

SEQ ID NO: 36092 - DNA, 20 bp, Artificial Sequence
  Description of Artificial Sequence: Synthetic oligonucleotide
  Target: SCN10A; (+) strand; PAM type: NRG; PAM sequence: AAG
gttatgaatctggcctctgt

SEQ ID NO: 36093 - DNA, 20 bp, Artificial Sequence
  Description of Artificial Sequence: Synthetic oligonucleotide
  Target: SCN10A; (+) strand; PAM type: NRG; PAM sequence: AAG
tgtaagaattcgaaattgca

SEQ ID NO: 36094 - DNA, 20 bp, Artificial Sequence
  Description of Artificial Sequence: Synthetic oligonucleotide
  Target: SCN10A; (+) strand; PAM type: NRG; PAM sequence: GAG
gtgttttttcctctacttgt

SEQ ID NO: 36095 - DNA, 20 bp, Artificial Sequence
  Description of Artificial Sequence: Synthetic oligonucleotide
  Target: SCN10A; (+) strand; PAM type: NRG; PAM sequence: AGG
tgttttttcctctacttgtg

SEQ ID NO: 36096 - DNA, 20 bp, Artificial Sequence
  Description of Artificial Sequence: Synthetic oligonucleotide
  Target: SCN10A; (+) strand; PAM type: NRG; PAM sequence: GGG
gttttttcctctacttgtga

SEQ ID NO: 36097 - DNA, 20 bp, Artificial Sequence
  Description of Artificial Sequence: Synthetic oligonucleotide
  Target: SCN10A; (+) strand; PAM type: NRG; PAM sequence: TGG
ctctacttgtgagggtaatg

SEQ ID NO: 36098 - DNA, 20 bp, Artificial Sequence
  Description of Artificial Sequence: Synthetic oligonucleotide
  Target: SCN10A; (+) strand; PAM type: NRG; PAM sequence: TAG
ttgtgagggtaatgtggcta

SEQ ID NO: 36099 - DNA, 20 bp, Artificial Sequence
  Description of Artificial Sequence: Synthetic oligonucleotide
  Target: SCN10A; (+) strand; PAM type: NRG; PAM sequence: TGG
agggtaatgtggctatagaa

SEQ ID NO: 36100 - DNA, 20 bp, Artificial Sequence
  Description of Artificial Sequence: Synthetic oligonucleotide
  Target: SCN10A; (+) strand; PAM type: NRG; PAM sequence: GAG
ggtaatgtggctatagaatg

SEQ ID NO: 36101 - DNA, 20 bp, Artificial Sequence
  Description of Artificial Sequence: Synthetic oligonucleotide
  Target: SCN10A; (+) strand; PAM type: NRG; PAM sequence: TAG
atgtggctatagaatggagt

SEQ ID NO: 36102 - DNA, 20 bp, Artificial Sequence
  Description of Artificial Sequence: Synthetic oligonucleotide
  Target: SCN10A; (+) strand; PAM type: NRG; PAM sequence: AAG
tggagttagctgtgatgatt

SEQ ID NO: 36103 - DNA, 20 bp, Artificial Sequence
  Description of Artificial Sequence: Synthetic oligonucleotide
  Target: SCN10A; (+) strand; PAM type: NRG; PAM sequence: TAG
ttagctgtgatgattaagtg

SEQ ID NO: 36104 - DNA, 20 bp, Artificial Sequence
  Description of Artificial Sequence: Synthetic oligonucleotide
  Target: SCN10A; (+) strand; PAM type: NRG; PAM sequence: GAG
agctgtgatgattaagtgta

SEQ ID NO: 36105 - DNA, 20 bp, Artificial Sequence
  Description of Artificial Sequence: Synthetic oligonucleotide
  Target: SCN10A; (+) strand; PAM type: NRG; PAM sequence: AAG
gtagagcatttgacacaaat

SEQ ID NO: 36106 - DNA, 20 bp, Artificial Sequence
  Description of Artificial Sequence: Synthetic oligonucleotide
  Target: SCN10A; (+) strand; PAM type: NRG; PAM sequence: TGG
catttgacacaaataagtat

SEQ ID NO: 36107 - DNA, 20 bp, Artificial Sequence
  Description of Artificial Sequence: Synthetic oligonucleotide
  Target: SCN10A; (+) strand; PAM type: NRG; PAM sequence: TGG
aataagtattggttccttcc

SEQ ID NO: 36108 - DNA, 20 bp, Artificial Sequence
  Description of Artificial Sequence: Synthetic oligonucleotide
  Target: SCN10A; (+) strand; PAM type: NRG; PAM sequence: GGG
ataagtattggttccttcct

SEQ ID NO: 36109 - DNA, 20 bp, Artificial Sequence
  Description of Artificial Sequence: Synthetic oligonucleotide
  Target: SCN10A; (+) strand; PAM type: NRG; PAM sequence: GGG
taagtattggttccttcctg

SEQ ID NO: 36110 - DNA, 20 bp, Artificial Sequence
  Description of Artificial Sequence: Synthetic oligonucleotide
  Target: SCN10A; (+) strand; PAM type: NRG; PAM sequence: TAG
gtattggttccttcctgggg

SEQ ID NO: 36111 - DNA, 20 bp, Artificial Sequence
  Description of Artificial Sequence: Synthetic oligonucleotide
  Target: SCN10A; (+) strand; PAM type: NRG; PAM sequence: TGG
gggtagattatttattaaaa

SEQ ID NO: 36112 - DNA, 20 bp, Artificial Sequence
  Description of Artificial Sequence: Synthetic oligonucleotide
  Target: SCN10A; (+) strand; PAM type: NRG; PAM sequence: CAG
ccctttccaatgtgactttt

SEQ ID NO: 36113 - DNA, 20 bp, Artificial Sequence
  Description of Artificial Sequence: Synthetic oligonucleotide
  Target: SCN10A; (+) strand; PAM type: NRG; PAM sequence: GAG
acttttcagctctttccatt

SEQ ID NO: 36114 - DNA, 20 bp, Artificial Sequence
  Description of Artificial Sequence: Synthetic oligonucleotide
  Target: SCN10A; (+) strand; PAM type: NRG; PAM sequence: AAG
gctctttccattgagtgatg

SEQ ID NO: 36115 - DNA, 20 bp, Artificial Sequence
  Description of Artificial Sequence: Synthetic oligonucleotide
  Target: SCN10A; (+) strand; PAM type: NRG; PAM sequence: TGG
aagtctatttctctgtctct

SEQ ID NO: 36116 - DNA, 20 bp, Artificial Sequence
  Description of Artificial Sequence: Synthetic oligonucleotide
  Target: SCN10A; (+) strand; PAM type: NRG; PAM sequence: TGG
tctgtctcttggatctctac

SEQ ID NO: 36117 - DNA, 20 bp, Artificial Sequence
  Description of Artificial Sequence: Synthetic oligonucleotide
  Target: SCN10A; (+) strand; PAM type: NRG; PAM sequence: TAG
tactggactgcaacttgctt

SEQ ID NO: 36118 - DNA, 20 bp, Artificial Sequence
  Description of Artificial Sequence: Synthetic oligonucleotide
  Target: SCN10A; (+) strand; PAM type: NRG; PAM sequence: AAG
gactgcaacttgctttagtc

SEQ ID NO: 36119 - DNA, 20 bp, Artificial Sequence
  Description of Artificial Sequence: Synthetic oligonucleotide
  Target: SCN10A; (+) strand; PAM type: NRG; PAM sequence: CAG
tgctttagtcaagaatgtat

SEQ ID NO: 36120 - DNA, 20 bp, Artificial Sequence
  Description of Artificial Sequence: Synthetic oligonucleotide
  Target: SCN10A; (+) strand; PAM type: NRG; PAM sequence: AAG
gaatgtatcagaatgtacaa

SEQ ID NO: 36121 - DNA, 20 bp, Artificial Sequence
  Description of Artificial Sequence: Synthetic oligonucleotide
  Target: SCN10A; (+) strand; PAM type: NRG; PAM sequence: AGG
aatgtatcagaatgtacaaa

SEQ ID NO: 36122 - DNA, 20 bp, Artificial Sequence
  Description of Artificial Sequence: Synthetic oligonucleotide
  Target: SCN10A; (+) strand; PAM type: NRG; PAM sequence: TGG
gtacaaaaggtacattgtgt

SEQ ID NO: 36123 - DNA, 20 bp, Artificial Sequence
  Description of Artificial Sequence: Synthetic oligonucleotide
  Target: SCN10A; (+) strand; PAM type: NRG; PAM sequence: AAG
aggtacattgtgttggttct

SEQ ID NO: 36124 - DNA, 20 bp, Artificial Sequence
  Description of Artificial Sequence: Synthetic oligonucleotide
  Target: SCN10A; (+) strand; PAM type: NRG; PAM sequence: TAG
cattgtgttggttctaagcc

SEQ ID NO: 36125 - DNA, 20 bp, Artificial Sequence
  Description of Artificial Sequence: Synthetic oligonucleotide
  Target: SCN10A; (+) strand; PAM type: NRG; PAM sequence: AGG
attgtgttggttctaagcct

SEQ ID NO: 36126 - DNA, 20 bp, Artificial Sequence
  Description of Artificial Sequence: Synthetic oligonucleotide
  Target: SCN10A; (+) strand; PAM type: NRG; PAM sequence: AAG
tggttctaagcctaggcctg

SEQ ID NO: 36127 - DNA, 20 bp, Artificial Sequence
  Description of Artificial Sequence: Synthetic oligonucleotide
  Target: SCN10A; (+) strand; PAM type: NRG; PAM sequence: AAG
ttctaagcctaggcctgaag

SEQ ID NO: 36128 - DNA, 20 bp, Artificial Sequence
  Description of Artificial Sequence: Synthetic oligonucleotide
  Target: SCN10A; (+) strand; PAM type: NRG; PAM sequence: TGG
gcaaacttccactgtttttc

SEQ ID NO: 36129 - DNA, 20 bp, Artificial Sequence
  Description of Artificial Sequence: Synthetic oligonucleotide
  Target: SCN10A; (+) strand; PAM type: NRG; PAM sequence: GGG
caaacttccactgtttttct

SEQ ID NO: 36130 - DNA, 20 bp, Artificial Sequence
  Description of Artificial Sequence: Synthetic oligonucleotide
  Target: SCN10A; (+) strand; PAM type: NRG; PAM sequence: GAG
ttttctgggaacactgccat

SEQ ID NO: 36131 - DNA, 20 bp, Artificial Sequence
  Description of Artificial Sequence: Synthetic oligonucleotide
  Target: SCN10A; (+) strand; PAM type: NRG; PAM sequence: CAG
tgggaacactgccatgagaa

SEQ ID NO: 36132 - DNA, 20 bp, Artificial Sequence
  Description of Artificial Sequence: Synthetic oligonucleotide
  Target: SCN10A; (+) strand; PAM type: NRG; PAM sequence: AGG
gggaacactgccatgagaac

SEQ ID NO: 36133 - DNA, 20 bp, Artificial Sequence
  Description of Artificial Sequence: Synthetic oligonucleotide
  Target: SCN10A; (+) strand; PAM type: NRG; PAM sequence: CAG
cactgccatgagaacaggcc

SEQ ID NO: 36134 - DNA, 20 bp, Artificial Sequence
  Description of Artificial Sequence: Synthetic oligonucleotide
  Target: SCN10A; (+) strand; PAM type: NRG; PAM sequence: AGG
actgccatgagaacaggccc

SEQ ID NO: 36135 - DNA, 20 bp, Artificial Sequence
  Description of Artificial Sequence: Synthetic oligonucleotide
  Target: SCN10A; (+) strand; PAM type: NRG; PAM sequence: TGG
caggcccaggctaacctgtt

SEQ ID NO: 36136 - DNA, 20 bp, Artificial Sequence
  Description of Artificial Sequence: Synthetic oligonucleotide
  Target: SCN10A; (+) strand; PAM type: NRG; PAM sequence: GGG
aggcccaggctaacctgttt

SEQ ID NO: 36137 - DNA, 20 bp, Artificial Sequence
  Description of Artificial Sequence: Synthetic oligonucleotide
  Target: SCN10A; (+) strand; PAM type: NRG; PAM sequence: GGG
ggcccaggctaacctgtttg

SEQ ID NO: 36138 - DNA, 20 bp, Artificial Sequence
  Description of Artificial Sequence: Synthetic oligonucleotide
  Target: SCN10A; (+) strand; PAM type: NRG; PAM sequence: GGG
gcccaggctaacctgtttgg

SEQ ID NO: 36139 - DNA, 20 bp, Artificial Sequence
  Description of Artificial Sequence: Synthetic oligonucleotide
  Target: SCN10A; (+) strand; PAM type: NRG; PAM sequence: GAG
aggctaacctgtttgggggt

SEQ ID NO: 36140 - DNA, 20 bp, Artificial Sequence
  Description of Artificial Sequence: Synthetic oligonucleotide
  Target: SCN10A; (+) strand; PAM type: NRG; PAM sequence: GAG
gctaacctgtttgggggtga

SEQ ID NO: 36141 - DNA, 20 bp, Artificial Sequence
  Description of Artificial Sequence: Synthetic oligonucleotide
  Target: SCN10A; (+) strand; PAM type: NRG; PAM sequence: AGG
ctaacctgtttgggggtgag

SEQ ID NO: 36142 - DNA, 20 bp, Artificial Sequence
  Description of Artificial Sequence: Synthetic oligonucleotide
  Target: SCN10A; (+) strand; PAM type: NRG; PAM sequence: GAG
ttgggggtgagaggccacat

SEQ ID NO: 36143 - DNA, 20 bp, Artificial Sequence
  Description of Artificial Sequence: Synthetic oligonucleotide
  Target: SCN10A; (+) strand; PAM type: NRG; PAM sequence: CAG
ggggtgagaggccacatgag

SEQ ID NO: 36144 - DNA, 20 bp, Artificial Sequence
  Description of Artificial Sequence: Synthetic oligonucleotide
  Target: SCN10A; (+) strand; PAM type: NRG; PAM sequence: GAG
ggtgagaggccacatgagca

SEQ ID NO: 36145 - DNA, 20 bp, Artificial Sequence
  Description of Artificial Sequence: Synthetic oligonucleotide
  Target: SCN10A; (+) strand; PAM type: NRG; PAM sequence: CAG
agaggccacatgagcagaga

SEQ ID NO: 36146 - DNA, 20 bp, Artificial Sequence
  Description of Artificial Sequence: Synthetic oligonucleotide
  Target: SCN10A; (+) strand; PAM type: NRG; PAM sequence: AGG
gaggccacatgagcagagac

SEQ ID NO: 36147 - DNA, 20 bp, Artificial Sequence
  Description of Artificial Sequence: Synthetic oligonucleotide
  Target: SCN10A; (+) strand; PAM type: NRG; PAM sequence: TAG
tgagcagagacaggacgtcc

SEQ ID NO: 36148 - DNA, 20 bp, Artificial Sequence
  Description of Artificial Sequence: Synthetic oligonucleotide
  Target: SCN10A; (+) strand; PAM type: NRG; PAM sequence: CAG
agagacaggacgtcctagac

SEQ ID NO: 36149 - DNA, 20 bp, Artificial Sequence
  Description of Artificial Sequence: Synthetic oligonucleotide
  Target: SCN10A; (+) strand; PAM type: NRG; PAM sequence: AAG
gtcctagaccagccatctcc

SEQ ID NO: 36150 - DNA, 20 bp, Artificial Sequence
  Description of Artificial Sequence: Synthetic oligonucleotide
  Target: SCN10A; (+) strand; PAM type: NRG; PAM sequence: GAG
ctgtctgcatatgcatgaat

SEQ ID NO: 36151 - DNA, 20 bp, Artificial Sequence
  Description of Artificial Sequence: Synthetic oligonucleotide
  Target: SCN10A; (+) strand; PAM type: NRG; PAM sequence: TAG
tgcatatgcatgaatgagcc

SEQ ID NO: 36152 - DNA, 20 bp, Artificial Sequence
  Description of Artificial Sequence: Synthetic oligonucleotide
  Target: SCN10A; (+) strand; PAM type: NRG; PAM sequence: CAG
acccaatgcccatctgatcc

SEQ ID NO: 36153 - DNA, 20 bp, Artificial Sequence
  Description of Artificial Sequence: Synthetic oligonucleotide
  Target: SCN10A; (+) strand; PAM type: NRG; PAM sequence: CAG
cagtccaaaatgctgatgca

SEQ ID NO: 36154 - DNA, 20 bp, Artificial Sequence
  Description of Artificial Sequence: Synthetic oligonucleotide
  Target: SCN10A; (+) strand; PAM type: NRG; PAM sequence: TGG
tgttttaattcacaaaattt

SEQ ID NO: 36155 - DNA, 20 bp, Artificial Sequence
  Description of Artificial Sequence: Synthetic oligonucleotide
  Target: SCN10A; (+) strand; PAM type: NRG; PAM sequence: GGG
gttttaattcacaaaatttt

SEQ ID NO: 36156 - DNA, 20 bp, Artificial Sequence
  Description of Artificial Sequence: Synthetic oligonucleotide
  Target: SCN10A; (+) strand; PAM type: NRG; PAM sequence: GGG
ttttaattcacaaaattttg

SEQ ID NO: 36157 - DNA, 20 bp, Artificial Sequence
  Description of Artificial Sequence: Synthetic oligonucleotide
  Target: SCN10A; (+) strand; PAM type: NRG; PAM sequence: CAG
ttttggggtcatttgttaca

SEQ ID NO: 36158 - DNA, 20 bp, Artificial Sequence
  Description of Artificial Sequence: Synthetic oligonucleotide
  Target: SCN10A; (+) strand; PAM type: NRG; PAM sequence: AAG
ggtcatttgttacacagcga

SEQ ID NO: 36159 - DNA, 20 bp, Artificial Sequence
  Description of Artificial Sequence: Synthetic oligonucleotide
  Target: SCN10A; (+) strand; PAM type: NRG; PAM sequence: GAG
ctcatacattccctccccat

SEQ ID NO: 36160 - DNA, 20 bp, Artificial Sequence
  Description of Artificial Sequence: Synthetic oligonucleotide
  Target: SCN10A; (+) strand; PAM type: NRG; PAM sequence: TGG
cattccctccccatgagctc

SEQ ID NO: 36161 - DNA, 20 bp, Artificial Sequence
  Description of Artificial Sequence: Synthetic oligonucleotide
  Target: SCN10A; (+) strand; PAM type: NRG; PAM sequence: GGG
attccctccccatgagctct

SEQ ID NO: 36162 - DNA, 20 bp, Artificial Sequence
  Description of Artificial Sequence: Synthetic oligonucleotide
  Target: SCN10A; (+) strand; PAM type: NRG; PAM sequence: TGG
cctccccatgagctctgggt

SEQ ID NO: 36163 - DNA, 20 bp, Artificial Sequence
  Description of Artificial Sequence: Synthetic oligonucleotide
  Target: SCN10A; (+) strand; PAM type: NRG; PAM sequence: AAG
ccatgagctctgggttggca

SEQ ID NO: 36164 - DNA, 20 bp, Artificial Sequence
  Description of Artificial Sequence: Synthetic oligonucleotide
  Target: SCN10A; (+) strand; PAM type: NRG; PAM sequence: AGG
catgagctctgggttggcaa

SEQ ID NO: 36165 - DNA, 20 bp, Artificial Sequence
  Description of Artificial Sequence: Synthetic oligonucleotide
  Target: SCN10A; (+) strand; PAM type: NRG; PAM sequence: CAG
atttatttatacatctttcc

SEQ ID NO: 36166 - DNA, 20 bp, Artificial Sequence
  Description of Artificial Sequence: Synthetic oligonucleotide
  Target: SCN10A; (+) strand; PAM type: NRG; PAM sequence: AGG
tttatttatacatctttccc

SEQ ID NO: 36167 - DNA, 20 bp, Artificial Sequence
  Description of Artificial Sequence: Synthetic oligonucleotide
  Target: SCN10A; (+) strand; PAM type: NRG; PAM sequence: AAG
atctgtgcccataatatgcc

SEQ ID NO: 36168 - DNA, 20 bp, Artificial Sequence
  Description of Artificial Sequence: Synthetic oligonucleotide
  Target: SCN10A; (+) strand; PAM type: NRG; PAM sequence: AGG
tctgtgcccataatatgcca

SEQ ID NO: 36169 - DNA, 20 bp, Artificial Sequence
  Description of Artificial Sequence: Synthetic oligonucleotide
  Target: SCN10A; (+) strand; PAM type: NRG; PAM sequence: AAG
gcccataatatgccaaggac

SEQ ID NO: 36170 - DNA, 20 bp, Artificial Sequence
  Description of Artificial Sequence: Synthetic oligonucleotide
  Target: SCN10A; (+) strand; PAM type: NRG; PAM sequence: TGG
ataatatgccaaggacaaga

SEQ ID NO: 36171 - DNA, 20 bp, Artificial Sequence
  Description of Artificial Sequence: Synthetic oligonucleotide
  Target: SCN10A; (+) strand; PAM type: NRG; PAM sequence: GAG
aatatgccaaggacaagatg

SEQ ID NO: 36172 - DNA, 20 bp, Artificial Sequence
  Description of Artificial Sequence: Synthetic oligonucleotide
  Target: SCN10A; (+) strand; PAM type: NRG; PAM sequence: AAG
atgccaaggacaagatggag

SEQ ID NO: 36173 - DNA, 20 bp, Artificial Sequence
  Description of Artificial Sequence: Synthetic oligonucleotide
  Target: SCN10A; (+) strand; PAM type: NRG; PAM sequence: AGG
tgccaaggacaagatggaga

SEQ ID NO: 36174 - DNA, 20 bp, Artificial Sequence
  Description of Artificial Sequence: Synthetic oligonucleotide
  Target: SCN10A; (+) strand; PAM type: NRG; PAM sequence: TGG
caagatggagaaggaattgt

SEQ ID NO: 36175 - DNA, 20 bp, Artificial Sequence
  Description of Artificial Sequence: Synthetic oligonucleotide
  Target: SCN10A; (+) strand; PAM type: NRG; PAM sequence: GGG
aagatggagaaggaattgtt

SEQ ID NO: 36176 - DNA, 20 bp, Artificial Sequence
  Description of Artificial Sequence: Synthetic oligonucleotide
  Target: SCN10A; (+) strand; PAM type: NRG; PAM sequence: AAG
gggcactcgtgctttgtcat

SEQ ID NO: 36177 - DNA, 20 bp, Artificial Sequence
  Description of Artificial Sequence: Synthetic oligonucleotide
  Target: SCN10A; (+) strand; PAM type: NRG; PAM sequence: TGG
actcgtgctttgtcataagt

SEQ ID NO: 36178 - DNA, 20 bp, Artificial Sequence
  Description of Artificial Sequence: Synthetic oligonucleotide
  Target: SCN10A; (+) strand; PAM type: NRG; PAM sequence: GGG
ctcgtgctttgtcataagtt

SEQ ID NO: 36179 - DNA, 20 bp, Artificial Sequence
  Description of Artificial Sequence: Synthetic oligonucleotide
  Target: SCN10A; (+) strand; PAM type: NRG; PAM sequence: GAG
ataagttgggaactcaccct

SEQ ID NO: 36180 - DNA, 20 bp, Artificial Sequence
  Description of Artificial Sequence: Synthetic oligonucleotide
  Target: SCN10A; (+) strand; PAM type: NRG; PAM sequence: CAG
gttgggaactcaccctgagt

SEQ ID NO: 36181 - DNA, 20 bp, Artificial Sequence
  Description of Artificial Sequence: Synthetic oligonucleotide
  Target: SCN10A; (+) strand; PAM type: NRG; PAM sequence: CAG
gagtcagatccattgccaca

SEQ ID NO: 36182 - DNA, 20 bp, Artificial Sequence
  Description of Artificial Sequence: Synthetic oligonucleotide
  Target: SCN10A; (+) strand; PAM type: NRG; PAM sequence: AAG
cagatccattgccacacagt

SEQ ID NO: 36183 - DNA, 20 bp, Artificial Sequence
  Description of Artificial Sequence: Synthetic oligonucleotide
  Target: SCN10A; (+) strand; PAM type: NRG; PAM sequence: AGG
agatccattgccacacagta

SEQ ID NO: 36184 - DNA, 20 bp, Artificial Sequence
  Description of Artificial Sequence: Synthetic oligonucleotide
  Target: SCN10A; (+) strand; PAM type: NRG; PAM sequence: GGG
gatccattgccacacagtaa

SEQ ID NO: 36185 - DNA, 20 bp, Artificial Sequence
  Description of Artificial Sequence: Synthetic oligonucleotide
  Target: SCN10A; (+) strand; PAM type: NRG; PAM sequence: GGG
atccattgccacacagtaag

SEQ ID NO: 36186 - DNA, 20 bp, Artificial Sequence
  Description of Artificial Sequence: Synthetic oligonucleotide
  Target: SCN10A; (+) strand; PAM type: NRG; PAM sequence: CAG
attgccacacagtaaggggt

SEQ ID NO: 36187 - DNA, 20 bp, Artificial Sequence
  Description of Artificial Sequence: Synthetic oligonucleotide
  Target: SCN10A; (+) strand; PAM type: NRG; PAM sequence: AAG
gccacacagtaaggggtcag

SEQ ID NO: 36188 - DNA, 20 bp, Artificial Sequence
  Description of Artificial Sequence: Synthetic oligonucleotide
  Target: SCN10A; (+) strand; PAM type: NRG; PAM sequence: TAG
aagtgcctcgcttatttatg

SEQ ID NO: 36189 - DNA, 20 bp, Artificial Sequence
  Description of Artificial Sequence: Synthetic oligonucleotide
  Target: SCN10A; (+) strand; PAM type: NRG; PAM sequence: AAG
atttatgtagatatctgctg

SEQ ID NO: 36190 - DNA, 20 bp, Artificial Sequence
  Description of Artificial Sequence: Synthetic oligonucleotide
  Target: SCN10A; (+) strand; PAM type: NRG; PAM sequence: AAG
atgtagatatctgctgaaga

SEQ ID NO: 36191 - DNA, 20 bp, Artificial Sequence
  Description of Artificial Sequence: Synthetic oligonucleotide
  Target: SCN10A; (+) strand; PAM type: NRG; PAM sequence: AGG
tgtagatatctgctgaagaa

SEQ ID NO: 36192 - DNA, 20 bp, Artificial Sequence
  Description of Artificial Sequence: Synthetic oligonucleotide
  Target: SCN10A; (+) strand; PAM type: NRG; PAM sequence: AAG
agatatctgctgaagaaagg

SEQ ID NO: 36193 - DNA, 20 bp, Artificial Sequence
  Description of Artificial Sequence: Synthetic oligonucleotide
  Target: SCN10A; (+) strand; PAM type: NRG; PAM sequence: AAG
tctgctgaagaaaggaagaa

SEQ ID NO: 36194 - DNA, 20 bp, Artificial Sequence
  Description of Artificial Sequence: Synthetic oligonucleotide
  Target: SCN10A; (+) strand; PAM type: NRG; PAM sequence: AAG
ctgaagaaaggaagaaaaga

SEQ ID NO: 36195 - DNA, 20 bp, Artificial Sequence
  Description of Artificial Sequence: Synthetic oligonucleotide
  Target: SCN10A; (+) strand; PAM type: NRG; PAM sequence: CAG
aggaagaaaagaaagcctca

SEQ ID NO: 36196 - DNA, 20 bp, Artificial Sequence
  Description of Artificial Sequence: Synthetic oligonucleotide
  Target: SCN10A; (+) strand; PAM type: NRG; PAM sequence: TGG
agaaaagaaagcctcacaga

SEQ ID NO: 36197 - DNA, 20 bp, Artificial Sequence
  Description of Artificial Sequence: Synthetic oligonucleotide
  Target: SCN10A; (+) strand; PAM type: NRG; PAM sequence: AAG
ggttctgaaccctccaaccc

SEQ ID NO: 36198 - DNA, 20 bp, Artificial Sequence
  Description of Artificial Sequence: Synthetic oligonucleotide
  Target: SCN10A; (+) strand; PAM type: NRG; PAM sequence: TGG
cctccaacccaagccttgtg

SEQ ID NO: 36199 - DNA, 20 bp, Artificial Sequence
  Description of Artificial Sequence: Synthetic oligonucleotide
  Target: SCN10A; (+) strand; PAM type: NRG; PAM sequence: AAG
gtggtgaatgcaatattccc

SEQ ID NO: 36200 - DNA, 20 bp, Artificial Sequence
  Description of Artificial Sequence: Synthetic oligonucleotide
  Target: SCN10A; (+) strand; PAM type: NRG; PAM sequence: AAG
caatattcccaagtcttcca

SEQ ID NO: 36201 - DNA, 20 bp, Artificial Sequence
  Description of Artificial Sequence: Synthetic oligonucleotide
  Target: SCN10A; (+) strand; PAM type: NRG; PAM sequence: GAG
attcccaagtcttccaaagt

SEQ ID NO: 36202 - DNA, 20 bp, Artificial Sequence
  Description of Artificial Sequence: Synthetic oligonucleotide
  Target: SCN10A; (+) strand; PAM type: NRG; PAM sequence: TGG
tcttccaaagtgagctcctt

SEQ ID NO: 36203 - DNA, 20 bp, Artificial Sequence
  Description of Artificial Sequence: Synthetic oligonucleotide
  Target: SCN10A; (+) strand; PAM type: NRG; PAM sequence: CAG
ctcctttggctacatgtact

SEQ ID NO: 36204 - DNA, 20 bp, Artificial Sequence
  Description of Artificial Sequence: Synthetic oligonucleotide
  Target: SCN10A; (+) strand; PAM type: NRG; PAM sequence: TGG
ctttggctacatgtactcag

SEQ ID NO: 36205 - DNA, 20 bp, Artificial Sequence
  Description of Artificial Sequence: Synthetic oligonucleotide
  Target: SCN10A; (+) strand; PAM type: NRG; PAM sequence: GGG
tttggctacatgtactcagt

SEQ ID NO: 36206 - DNA, 20 bp, Artificial Sequence
  Description of Artificial Sequence: Synthetic oligonucleotide
  Target: SCN10A; (+) strand; PAM type: NRG; PAM sequence: TGG
catgtactcagtgggcatgc

SEQ ID NO: 36207 - DNA, 20 bp, Artificial Sequence
  Description of Artificial Sequence: Synthetic oligonucleotide
  Target: SCN10A; (+) strand; PAM type: NRG; PAM sequence: GGG
atgtactcagtgggcatgct

SEQ ID NO: 36208 - DNA, 20 bp, Artificial Sequence
  Description of Artificial Sequence: Synthetic oligonucleotide
  Target: SCN10A; (+) strand; PAM type: NRG; PAM sequence: TGG
agtgggcatgctgggccaca

SEQ ID NO: 36209 - DNA, 20 bp, Artificial Sequence
  Description of Artificial Sequence: Synthetic oligonucleotide
  Target: SCN10A; (+) strand; PAM type: NRG; PAM sequence: AAG
gggcatgctgggccacatgg

SEQ ID NO: 36210 - DNA, 20 bp, Artificial Sequence
  Description of Artificial Sequence: Synthetic oligonucleotide
  Target: SCN10A; (+) strand; PAM type: NRG; PAM sequence: AAG
tgggccacatggaagttgta

SEQ ID NO: 36211 - DNA, 20 bp, Artificial Sequence
  Description of Artificial Sequence: Synthetic oligonucleotide
  Target: SCN10A; (+) strand; PAM type: NRG; PAM sequence: AAG
gttgtaaagtcacatctgaa

SEQ ID NO: 36212 - DNA, 20 bp, Artificial Sequence
  Description of Artificial Sequence: Synthetic oligonucleotide
  Target: SCN10A; (+) strand; PAM type: NRG; PAM sequence: GAG
tgtaaagtcacatctgaaaa

SEQ ID NO: 36213 - DNA, 20 bp, Artificial Sequence
  Description of Artificial Sequence: Synthetic oligonucleotide
  Target: SCN10A; (+) strand; PAM type: NRG; PAM sequence: AAG
aaagtcacatctgaaaagag

SEQ ID NO: 36214 - DNA, 20 bp, Artificial Sequence
  Description of Artificial Sequence: Synthetic oligonucleotide
  Target: SCN10A; (+) strand; PAM type: NRG; PAM sequence: GAG
agtcacatctgaaaagagaa

SEQ ID NO: 36215 - DNA, 20 bp, Artificial Sequence
  Description of Artificial Sequence: Synthetic oligonucleotide
  Target: SCN10A; (+) strand; PAM type: NRG; PAM sequence: AAG
catctgaaaagagaagagct

SEQ ID NO: 36216 - DNA, 20 bp, Artificial Sequence
  Description of Artificial Sequence: Synthetic oligonucleotide
  Target: SCN10A; (+) strand; PAM type: NRG; PAM sequence: CAG
ctgaaaagagaagagctaag

SEQ ID NO: 36217 - DNA, 20 bp, Artificial Sequence
  Description of Artificial Sequence: Synthetic oligonucleotide
  Target: SCN10A; (+) strand; PAM type: NRG; PAM sequence: CGG
gaagagctaagcagtgactt

SEQ ID NO: 36218 - DNA, 20 bp, Artificial Sequence
  Description of Artificial Sequence: Synthetic oligonucleotide
  Target: SCN10A; (+) strand; PAM type: NRG; PAM sequence: CAG
cttcggctctcaatctcccc

SEQ ID NO: 36219 - DNA, 20 bp, Artificial Sequence
  Description of Artificial Sequence: Synthetic oligonucleotide
  Target: SCN10A; (+) strand; PAM type: NRG; PAM sequence: CAG
cggctctcaatctcccccag

SEQ ID NO: 36220 - DNA, 20 bp, Artificial Sequence
  Description of Artificial Sequence: Synthetic oligonucleotide
  Target: SCN10A; (+) strand; PAM type: NRG; PAM sequence: GAG
gctctcaatctcccccagca

SEQ ID NO: 36221 - DNA, 20 bp, Artificial Sequence
  Description of Artificial Sequence: Synthetic oligonucleotide
  Target: SCN10A; (+) strand; PAM type: NRG; PAM sequence: AGG
ctctcaatctcccccagcag

SEQ ID NO: 36222 - DNA, 20 bp, Artificial Sequence
  Description of Artificial Sequence: Synthetic oligonucleotide
  Target: SCN10A; (+) strand; PAM type: NRG; PAM sequence: TAG
tcaatctcccccagcagagg

SEQ ID NO: 36223 - DNA, 20 bp, Artificial Sequence
  Description of Artificial Sequence: Synthetic oligonucleotide
  Target: SCN10A; (+) strand; PAM type: NRG; PAM sequence: TAG
gaggtagaatgacttgcctc

SEQ ID NO: 36224 - DNA, 20 bp, Artificial Sequence
  Description of Artificial Sequence: Synthetic oligonucleotide
  Target: SCN10A; (+) strand; PAM type: NRG; PAM sequence: TGG
atgacttgcctctagattta

SEQ ID NO: 36225 - DNA, 20 bp, Artificial Sequence
  Description of Artificial Sequence: Synthetic oligonucleotide
  Target: SCN10A; (+) strand; PAM type: NRG; PAM sequence: AAG
tttatggctcatttccttgc

SEQ ID NO: 36226 - DNA, 20 bp, Artificial Sequence
  Description of Artificial Sequence: Synthetic oligonucleotide
  Target: SCN10A; (+) strand; PAM type: NRG; PAM sequence: GAG
tatggctcatttccttgcaa

SEQ ID NO: 36227 - DNA, 20 bp, Artificial Sequence
  Description of Artificial Sequence: Synthetic oligonucleotide
  Target: SCN10A; (+) strand; PAM type: NRG; PAM sequence: AGG
atggctcatttccttgcaag

SEQ ID NO: 36228 - DNA, 20 bp, Artificial Sequence
  Description of Artificial Sequence: Synthetic oligonucleotide
  Target: SCN10A; (+) strand; PAM type: NRG; PAM sequence: GGG
tggctcatttccttgcaaga

SEQ ID NO: 36229 - DNA, 20 bp, Artificial Sequence
  Description of Artificial Sequence: Synthetic oligonucleotide
  Target: SCN10A; (+) strand; PAM type: NRG; PAM sequence: GAG
ttccttgcaagagggatgct

SEQ ID NO: 36230 - DNA, 20 bp, Artificial Sequence
  Description of Artificial Sequence: Synthetic oligonucleotide
  Target: SCN10A; (+) strand; PAM type: NRG; PAM sequence: CAG
gcaagagggatgctgagcaa

SEQ ID NO: 36231 - DNA, 20 bp, Artificial Sequence
  Description of Artificial Sequence: Synthetic oligonucleotide
  Target: SCN10A; (+) strand; PAM type: NRG; PAM sequence: AGG
caagagggatgctgagcaac

SEQ ID NO: 36232 - DNA, 20 bp, Artificial Sequence
  Description of Artificial Sequence: Synthetic oligonucleotide
  Target: SCN10A; (+) strand; PAM type: NRG; PAM sequence: TAG
ggatgctgagcaacaggaaa

SEQ ID NO: 36233 - DNA, 20 bp, Artificial Sequence
  Description of Artificial Sequence: Synthetic oligonucleotide
  Target: SCN10A; (+) strand; PAM type: NRG; PAM sequence: AAG
acaggaaatagaatacccaa

SEQ ID NO: 36234 - DNA, 20 bp, Artificial Sequence
  Description of Artificial Sequence: Synthetic oligonucleotide
  Target: SCN10A; (+) strand; PAM type: NRG; PAM sequence: AAG
ccaaaagtaaaacacaactc

SEQ ID NO: 36235 - DNA, 20 bp, Artificial Sequence
  Description of Artificial Sequence: Synthetic oligonucleotide
  Target: SCN10A; (+) strand; PAM type: NRG; PAM sequence: GAG
aaaagtaaaacacaactcaa

SEQ ID NO: 36236 - DNA, 20 bp, Artificial Sequence
  Description of Artificial Sequence: Synthetic oligonucleotide
  Target: SCN10A; (+) strand; PAM type: NRG; PAM sequence: TGG
acaactcaagagaaccattt

SEQ ID NO: 36237 - DNA, 20 bp, Artificial Sequence
  Description of Artificial Sequence: Synthetic oligonucleotide
  Target: SCN10A; (+) strand; PAM type: NRG; PAM sequence: CAG
actcaagagaaccattttgg

SEQ ID NO: 36238 - DNA, 20 bp, Artificial Sequence
  Description of Artificial Sequence: Synthetic oligonucleotide
  Target: SCN10A; (+) strand; PAM type: NRG; PAM sequence: AGG
ctcaagagaaccattttggc

SEQ ID NO: 36239 - DNA, 20 bp, Artificial Sequence
  Description of Artificial Sequence: Synthetic oligonucleotide
  Target: SCN10A; (+) strand; PAM type: NRG; PAM sequence: AAG
agagaaccattttggcagga

SEQ ID NO: 36240 - DNA, 20 bp, Artificial Sequence
  Description of Artificial Sequence: Synthetic oligonucleotide
  Target: SCN10A; (+) strand; PAM type: NRG; PAM sequence: AGG
gagaaccattttggcaggaa

SEQ ID NO: 36241 - DNA, 20 bp, Artificial Sequence
  Description of Artificial Sequence: Synthetic oligonucleotide
  Target: SCN10A; (+) strand; PAM type: NRG; PAM sequence: GGG
agaaccattttggcaggaaa

SEQ ID NO: 36242 - DNA, 20 bp, Artificial Sequence
  Description of Artificial Sequence: Synthetic oligonucleotide
  Target: SCN10A; (+) strand; PAM type: NRG; PAM sequence: GGG
gaaccattttggcaggaaag

SEQ ID NO: 36243 - DNA, 20 bp, Artificial Sequence
  Description of Artificial Sequence: Synthetic oligonucleotide
  Target: SCN10A; (+) strand; PAM type: NRG; PAM sequence: GAG
accattttggcaggaaaggg

SEQ ID NO: 36244 - DNA, 20 bp, Artificial Sequence
  Description of Artificial Sequence: Synthetic oligonucleotide
  Target: SCN10A; (+) strand; PAM type: NRG; PAM sequence: CAG
tatatgtctatacacacaca

SEQ ID NO: 36245 - DNA, 20 bp, Artificial Sequence
  Description of Artificial Sequence: Synthetic oligonucleotide
  Target: SCN10A; (+) strand; PAM type: NRG; PAM sequence: AGG
atatgtctatacacacacac

SEQ ID NO: 36246 - DNA, 20 bp, Artificial Sequence
  Description of Artificial Sequence: Synthetic oligonucleotide
  Target: SCN10A; (+) strand; PAM type: NRG; PAM sequence: GGG
tatgtctatacacacacaca

SEQ ID NO: 36247 - DNA, 20 bp, Artificial Sequence
  Description of Artificial Sequence: Synthetic oligonucleotide
  Target: SCN10A; (+) strand; PAM type: NRG; PAM sequence: GGG
atgtctatacacacacacag

SEQ ID NO: 36248 - DNA, 20 bp, Artificial Sequence
  Description of Artificial Sequence: Synthetic oligonucleotide
  Target: SCN10A; (+) strand; PAM type: NRG; PAM sequence: AAG
ccctgtccctatatgatacc

SEQ ID NO: 36249 - DNA, 20 bp, Artificial Sequence
  Description of Artificial Sequence: Synthetic oligonucleotide
  Target: SCN10A; (+) strand; PAM type: NRG; PAM sequence: AGG
cctgtccctatatgatacca

SEQ ID NO: 36250 - DNA, 20 bp, Artificial Sequence
  Description of Artificial Sequence: Synthetic oligonucleotide
  Target: SCN10A; (+) strand; PAM type: NRG; PAM sequence: GGG
ctgtccctatatgataccaa

SEQ ID NO: 36251 - DNA, 20 bp, Artificial Sequence
  Description of Artificial Sequence: Synthetic oligonucleotide
  Target: SCN10A; (+) strand; PAM type: NRG; PAM sequence: CAG
tatgataccaagggtccaac

SEQ ID NO: 36252 - DNA, 20 bp, Artificial Sequence
  Description of Artificial Sequence: Synthetic oligonucleotide
  Target: SCN10A; (+) strand; PAM type: NRG; PAM sequence: TGG
ccaagggtccaaccagacct

SEQ ID NO: 36253 - DNA, 20 bp, Artificial Sequence
  Description of Artificial Sequence: Synthetic oligonucleotide
  Target: SCN10A; (+) strand; PAM type: NRG; PAM sequence: TGG
caaccagaccttggtcccta

SEQ ID NO: 36254 - DNA, 20 bp, Artificial Sequence
  Description of Artificial Sequence: Synthetic oligonucleotide
  Target: SCN10A; (+) strand; PAM type: NRG; PAM sequence: AAG
ccagaccttggtccctatgg

SEQ ID NO: 36255 - DNA, 20 bp, Artificial Sequence
  Description of Artificial Sequence: Synthetic oligonucleotide
  Target: SCN10A; (+) strand; PAM type: NRG; PAM sequence: GAG
agaccttggtccctatggaa

SEQ ID NO: 36256 - DNA, 20 bp, Artificial Sequence
  Description of Artificial Sequence: Synthetic oligonucleotide
  Target: SCN10A; (+) strand; PAM type: NRG; PAM sequence: GAG
actccactcacgttttctgt

SEQ ID NO: 36257 - DNA, 20 bp, Artificial Sequence
  Description of Artificial Sequence: Synthetic oligonucleotide
  Target: SCN10A; (+) strand; PAM type: NRG; PAM sequence: GAG
actcacgttttctgtgagat

SEQ ID NO: 36258 - DNA, 20 bp, Artificial Sequence
  Description of Artificial Sequence: Synthetic oligonucleotide
  Target: SCN10A; (+) strand; PAM type: NRG; PAM sequence: TAG
cacgttttctgtgagatgag

SEQ ID NO: 36259 - DNA, 20 bp, Artificial Sequence
  Description of Artificial Sequence: Synthetic oligonucleotide
  Target: SCN10A; (+) strand; PAM type: NRG; PAM sequence: TGG
ttttctgtgagatgagtagt

SEQ ID NO: 36260 - DNA, 20 bp, Artificial Sequence
  Description of Artificial Sequence: Synthetic oligonucleotide
  Target: SCN10A; (+) strand; PAM type: NRG; PAM sequence: CAG
gtagttggttgtctcattga

SEQ ID NO: 36261 - DNA, 20 bp, Artificial Sequence
  Description of Artificial Sequence: Synthetic oligonucleotide
  Target: SCN10A; (+) strand; PAM type: NRG; PAM sequence: GAG
ttcttgacacatttattttt

SEQ ID NO: 36262 - DNA, 20 bp, Artificial Sequence
  Description of Artificial Sequence: Synthetic oligonucleotide
  Target: SCN10A; (+) strand; PAM type: NRG; PAM sequence: AGG
tcttgacacatttatttttg

SEQ ID NO: 36263 - DNA, 20 bp, Artificial Sequence
  Description of Artificial Sequence: Synthetic oligonucleotide
  Target: SCN10A; (+) strand; PAM type: NRG; PAM sequence: AAG
tatttttgaggttgcccttg

SEQ ID NO: 36264 - DNA, 20 bp, Artificial Sequence
  Description of Artificial Sequence: Synthetic oligonucleotide
  Target: SCN10A; (+) strand; PAM type: NRG; PAM sequence: GAG
tttttgaggttgcccttgaa

SEQ ID NO: 36265 - DNA, 20 bp, Artificial Sequence
  Description of Artificial Sequence: Synthetic oligonucleotide
  Target: SCN10A; (+) strand; PAM type: NRG; PAM sequence: CAG
aggttgcccttgaagagttg

SEQ ID NO: 36266 - DNA, 20 bp, Artificial Sequence
  Description of Artificial Sequence: Synthetic oligonucleotide
  Target: SCN10A; (+) strand; PAM type: NRG; PAM sequence: AAG
tgaagagttgcagccccacc

SEQ ID NO: 36267 - DNA, 20 bp, Artificial Sequence
  Description of Artificial Sequence: Synthetic oligonucleotide
  Target: SCN10A; (+) strand; PAM type: NRG; PAM sequence: AGG
gaagagttgcagccccacca

SEQ ID NO: 36268 - DNA, 20 bp, Artificial Sequence
  Description of Artificial Sequence: Synthetic oligonucleotide
  Target: SCN10A; (+) strand; PAM type: NRG; PAM sequence: TAG
cccaccaaggcaaaaacact

SEQ ID NO: 36269 - DNA, 20 bp, Artificial Sequence
  Description of Artificial Sequence: Synthetic oligonucleotide
  Target: SCN10A; (+) strand; PAM type: NRG; PAM sequence: AGG
ccaccaaggcaaaaacactt

SEQ ID NO: 36270 - DNA, 20 bp, Artificial Sequence
  Description of Artificial Sequence: Synthetic oligonucleotide
  Target: SCN10A; (+) strand; PAM type: NRG; PAM sequence: CAG
ccaaggcaaaaacacttagg

SEQ ID NO: 36271 - DNA, 20 bp, Artificial Sequence
  Description of Artificial Sequence: Synthetic oligonucleotide
  Target: SCN10A; (+) strand; PAM type: NRG; PAM sequence: AAG
aggcaaaaacacttaggcag

SEQ ID NO: 36272 - DNA, 20 bp, Artificial Sequence
  Description of Artificial Sequence: Synthetic oligonucleotide
  Target: SCN10A; (+) strand; PAM type: NRG; PAM sequence: TGG
aaaaacacttaggcagaaga

SEQ ID NO: 36273 - DNA, 20 bp, Artificial Sequence
  Description of Artificial Sequence: Synthetic oligonucleotide
  Target: SCN10A; (+) strand; PAM type: NRG; PAM sequence: GAG
acacttaggcagaagatggt

SEQ ID NO: 36274 - DNA, 20 bp, Artificial Sequence
  Description of Artificial Sequence: Synthetic oligonucleotide
  Target: SCN10A; (+) strand; PAM type: NRG; PAM sequence: AGG
cacttaggcagaagatggtg

SEQ ID NO: 36275 - DNA, 20 bp, Artificial Sequence
  Description of Artificial Sequence: Synthetic oligonucleotide
  Target: SCN10A; (+) strand; PAM type: NRG; PAM sequence: TGG
taggcagaagatggtgagga

SEQ ID NO: 36276 - DNA, 20 bp, Artificial Sequence
  Description of Artificial Sequence: Synthetic oligonucleotide
  Target: SCN10A; (+) strand; PAM type: NRG; PAM sequence: CAG
gatggtgaggatggtcacat

SEQ ID NO: 36277 - DNA, 20 bp, Artificial Sequence
  Description of Artificial Sequence: Synthetic oligonucleotide
  Target: SCN10A; (+) strand; PAM type: NRG; PAM sequence: CAG
gtgaggatggtcacatcagc

SEQ ID NO: 36278 - DNA, 20 bp, Artificial Sequence
  Description of Artificial Sequence: Synthetic oligonucleotide
  Target: SCN10A; (+) strand; PAM type: NRG; PAM sequence: GAG
catcagccagtttcttcact

SEQ ID NO: 36279 - DNA, 20 bp, Artificial Sequence
  Description of Artificial Sequence: Synthetic oligonucleotide
  Target: SCN10A; (+) strand; PAM type: NRG; PAM sequence: CAG
agtttcttcactgagtgaat

SEQ ID NO: 36280 - DNA, 20 bp, Artificial Sequence
  Description of Artificial Sequence: Synthetic oligonucleotide
  Target: SCN10A; (+) strand; PAM type: NRG; PAM sequence: AGG
gtttcttcactgagtgaatc

SEQ ID NO: 36281 - DNA, 20 bp, Artificial Sequence
  Description of Artificial Sequence: Synthetic oligonucleotide
  Target: SCN10A; (+) strand; PAM type: NRG; PAM sequence: GGG
tttcttcactgagtgaatca

SEQ ID NO: 36282 - DNA, 20 bp, Artificial Sequence
  Description of Artificial Sequence: Synthetic oligonucleotide
  Target: SCN10A; (+) strand; PAM type: NRG; PAM sequence: CAG
agggcccccacaatgacctt

SEQ ID NO: 36283 - DNA, 20 bp, Artificial Sequence
  Description of Artificial Sequence: Synthetic oligonucleotide
  Target: SCN10A; (+) strand; PAM type: NRG; PAM sequence: AGG
gggcccccacaatgaccttc

SEQ ID NO: 36284 - DNA, 20 bp, Artificial Sequence
  Description of Artificial Sequence: Synthetic oligonucleotide
  Target: SCN10A; (+) strand; PAM type: NRG; PAM sequence: CGG
cacaatgaccttcaggcctg

SEQ ID NO: 36285 - DNA, 20 bp, Artificial Sequence
  Description of Artificial Sequence: Synthetic oligonucleotide
  Target: SCN10A; (+) strand; PAM type: NRG; PAM sequence: GGG
acaatgaccttcaggcctgc

SEQ ID NO: 36286 - DNA, 20 bp, Artificial Sequence
  Description of Artificial Sequence: Synthetic oligonucleotide
  Target: SCN10A; (+) strand; PAM type: NRG; PAM sequence: AAG
atgaccttcaggcctgcggg

SEQ ID NO: 36287 - DNA, 20 bp, Artificial Sequence
  Description of Artificial Sequence: Synthetic oligonucleotide
  Target: SCN10A; (+) strand; PAM type: NRG; PAM sequence: CAG
tcaggcctgcgggaagatga

SEQ ID NO: 36288 - DNA, 20 bp, Artificial Sequence
  Description of Artificial Sequence: Synthetic oligonucleotide
  Target: SCN10A; (+) strand; PAM type: NRG; PAM sequence: TGG
ggcctgcgggaagatgacag

SEQ ID NO: 36289 - DNA, 20 bp, Artificial Sequence
  Description of Artificial Sequence: Synthetic oligonucleotide
  Target: SCN10A; (+) strand; PAM type: NRG; PAM sequence: TGG
atgacagtggtatgaccaca

SEQ ID NO: 36290 - DNA, 20 bp, Artificial Sequence
  Description of Artificial Sequence: Synthetic oligonucleotide
  Target: SCN10A; (+) strand; PAM type: NRG; PAM sequence: GAG
agtggtatgaccacatggat

SEQ ID NO: 36291 - DNA, 20 bp, Artificial Sequence
  Description of Artificial Sequence: Synthetic oligonucleotide
  Target: SCN10A; (+) strand; PAM type: NRG; PAM sequence: AGG
gtggtatgaccacatggatg

SEQ ID NO: 36292 - DNA, 20 bp, Artificial Sequence
  Description of Artificial Sequence: Synthetic oligonucleotide
  Target: SCN10A; (+) strand; PAM type: NRG; PAM sequence: TAG
gtatgaccacatggatgagg

SEQ ID NO: 36293 - DNA, 20 bp, Artificial Sequence
  Description of Artificial Sequence: Synthetic oligonucleotide
  Target: SCN10A; (+) strand; PAM type: NRG; PAM sequence: CGG
catggatgaggtagcacaca

SEQ ID NO: 36294 - DNA, 20 bp, Artificial Sequence
  Description of Artificial Sequence: Synthetic oligonucleotide
  Target: SCN10A; (+) strand; PAM type: NRG; PAM sequence: GAG
tggatgaggtagcacacacg

SEQ ID NO: 36295 - DNA, 20 bp, Artificial Sequence
  Description of Artificial Sequence: Synthetic oligonucleotide
  Target: SCN10A; (+) strand; PAM type: NRG; PAM sequence: TAG
cggagcacacttcttcatct

SEQ ID NO: 36296 - DNA, 20 bp, Artificial Sequence
  Description of Artificial Sequence: Synthetic oligonucleotide
  Target: SCN10A; (+) strand; PAM type: NRG; PAM sequence: CAG
tcctccttcatctctacata

SEQ ID NO: 36297 - DNA, 20 bp, Artificial Sequence
  Description of Artificial Sequence: Synthetic oligonucleotide
  Target: SCN10A; (+) strand; PAM type: NRG; PAM sequence: AGG
cctccttcatctctacatac

SEQ ID NO: 36298 - DNA, 20 bp, Artificial Sequence
  Description of Artificial Sequence: Synthetic oligonucleotide
  Target: SCN10A; (+) strand; PAM type: NRG; PAM sequence: GAG
tccttcatctctacatacag

SEQ ID NO: 36299 - DNA, 20 bp, Artificial Sequence
  Description of Artificial Sequence: Synthetic oligonucleotide
  Target: SCN10A; (+) strand; PAM type: NRG; PAM sequence: AAG
catctctacatacaggagtg

SEQ ID NO: 36300 - DNA, 20 bp, Artificial Sequence
  Description of Artificial Sequence: Synthetic oligonucleotide
  Target: SCN10A; (+) strand; PAM type: NRG; PAM sequence: CAG
agtgaagtatgtacacactc

SEQ ID NO: 36301 - DNA, 20 bp, Artificial Sequence
  Description of Artificial Sequence: Synthetic oligonucleotide
  Target: SCN10A; (+) strand; PAM type: NRG; PAM sequence: AGG
gtgaagtatgtacacactcc

SEQ ID NO: 36302 - DNA, 20 bp, Artificial Sequence
  Description of Artificial Sequence: Synthetic oligonucleotide
  Target: SCN10A; (+) strand; PAM type: NRG; PAM sequence: GGG
tgaagtatgtacacactcca

SEQ ID NO: 36303 - DNA, 20 bp, Artificial Sequence
  Description of Artificial Sequence: Synthetic oligonucleotide
  Target: SCN10A; (+) strand; PAM type: NRG; PAM sequence: CAG
agtatgtacacactccaggg

SEQ ID NO: 36304 - DNA, 20 bp, Artificial Sequence
  Description of Artificial Sequence: Synthetic oligonucleotide
  Target: SCN10A; (+) strand; PAM type: NRG; PAM sequence: AAG
acacactccagggcagttcc

SEQ ID NO: 36305 - DNA, 20 bp, Artificial Sequence
  Description of Artificial Sequence: Synthetic oligonucleotide
  Target: SCN10A; (+) strand; PAM type: NRG; PAM sequence: AAG
tccaagacctttctcatccg

SEQ ID NO: 36306 - DNA, 20 bp, Artificial Sequence
  Description of Artificial Sequence: Synthetic oligonucleotide
  Target: SCN10A; (+) strand; PAM type: NRG; PAM sequence: GAG
ccgaagcttgcatttactct

SEQ ID NO: 36307 - DNA, 20 bp, Artificial Sequence
  Description of Artificial Sequence: Synthetic oligonucleotide
  Target: SCN10A; (+) strand; PAM type: NRG; PAM sequence: GAG
gaagcttgcatttactctga

SEQ ID NO: 36308 - DNA, 20 bp, Artificial Sequence
  Description of Artificial Sequence: Synthetic oligonucleotide
  Target: SCN10A; (+) strand; PAM type: NRG; PAM sequence: AGG
aagcttgcatttactctgag

SEQ ID NO: 36309 - DNA, 20 bp, Artificial Sequence
  Description of Artificial Sequence: Synthetic oligonucleotide
  Target: SCN10A; (+) strand; PAM type: NRG; PAM sequence: CAG
cttgcatttactctgagagg

SEQ ID NO: 36310 - DNA, 20 bp, Artificial Sequence
  Description of Artificial Sequence: Synthetic oligonucleotide
  Target: SCN10A; (+) strand; PAM type: NRG; PAM sequence: AGG
ttgcatttactctgagaggc

SEQ ID NO: 36311 - DNA, 20 bp, Artificial Sequence
  Description of Artificial Sequence: Synthetic oligonucleotide
  Target: SCN10A; (+) strand; PAM type: NRG; PAM sequence: CAG
catttactctgagaggcagg

SEQ ID NO: 36312 - DNA, 20 bp, Artificial Sequence
  Description of Artificial Sequence: Synthetic oligonucleotide
  Target: SCN10A; (+) strand; PAM type: NRG; PAM sequence: GAG
tttactctgagaggcaggca

SEQ ID NO: 36313 - DNA, 20 bp, Artificial Sequence
  Description of Artificial Sequence: Synthetic oligonucleotide
  Target: SCN10A; (+) strand; PAM type: NRG; PAM sequence: GAG
tactctgagaggcaggcaga

SEQ ID NO: 36314 - DNA, 20 bp, Artificial Sequence
  Description of Artificial Sequence: Synthetic oligonucleotide
  Target: SCN10A; (+) strand; PAM type: NRG; PAM sequence: CAG
ctgagaggcaggcagagagt

SEQ ID NO: 36315 - DNA, 20 bp, Artificial Sequence
  Description of Artificial Sequence: Synthetic oligonucleotide
  Target: SCN10A; (+) strand; PAM type: NRG; PAM sequence: AGG
tgagaggcaggcagagagtc

SEQ ID NO: 36316 - DNA, 20 bp, Artificial Sequence
  Description of Artificial Sequence: Synthetic oligonucleotide
  Target: SCN10A; (+) strand; PAM type: NRG; PAM sequence: GGG
gagaggcaggcagagagtca

SEQ ID NO: 36317 - DNA, 20 bp, Artificial Sequence
  Description of Artificial Sequence: Synthetic oligonucleotide
  Target: SCN10A; (+) strand; PAM type: NRG; PAM sequence: GGG
agaggcaggcagagagtcag

SEQ ID NO: 36318 - DNA, 20 bp, Artificial Sequence
  Description of Artificial Sequence: Synthetic oligonucleotide
  Target: SCN10A; (+) strand; PAM type: NRG; PAM sequence: AAG
caggggctattctcattata

SEQ ID NO: 36319 - DNA, 20 bp, Artificial Sequence
  Description of Artificial Sequence: Synthetic oligonucleotide
  Target: SCN10A; (+) strand; PAM type: NRG; PAM sequence: GAG
attataaagacgatgcaact

SEQ ID NO: 36320 - DNA, 20 bp, Artificial Sequence
  Description of Artificial Sequence: Synthetic oligonucleotide
  Target: SCN10A; (+) strand; PAM type: NRG; PAM sequence: CAG
aagacgatgcaactgagacc

SEQ ID NO: 36321 - DNA, 20 bp, Artificial Sequence
  Description of Artificial Sequence: Synthetic oligonucleotide
  Target: SCN10A; (+) strand; PAM type: NRG; PAM sequence: AGG
agacgatgcaactgagaccc

SEQ ID NO: 36322 - DNA, 20 bp, Artificial Sequence
  Description of Artificial Sequence: Synthetic oligonucleotide
  Target: SCN10A; (+) strand; PAM type: NRG; PAM sequence: GAG
aatgcattttttatcatctt

SEQ ID NO: 36323 - DNA, 20 bp, Artificial Sequence
  Description of Artificial Sequence: Synthetic oligonucleotide
  Target: SCN10A; (+) strand; PAM type: NRG; PAM sequence: AGG
atgcattttttatcatcttg

SEQ ID NO: 36324 - DNA, 20 bp, Artificial Sequence
  Description of Artificial Sequence: Synthetic oligonucleotide
  Target: SCN10A; (+) strand; PAM type: NRG; PAM sequence: TAG
gctaataaaattcctgacac

SEQ ID NO: 36325 - DNA, 20 bp, Artificial Sequence
  Description of Artificial Sequence: Synthetic oligonucleotide
  Target: SCN10A; (+) strand; PAM type: NRG; PAM sequence: GAG
caatttaaataatttatgct

SEQ ID NO: 36326 - DNA, 20 bp, Artificial Sequence
  Description of Artificial Sequence: Synthetic oligonucleotide
  Target: SCN10A; (+) strand; PAM type: NRG; PAM sequence: CAG
tgctgagtacctactttttc

SEQ ID NO: 36327 - DNA, 20 bp, Artificial Sequence
  Description of Artificial Sequence: Synthetic oligonucleotide
  Target: SCN10A; (+) strand; PAM type: NRG; PAM sequence: AGG
gctgagtacctactttttcc

SEQ ID NO: 36328 - DNA, 20 bp, Artificial Sequence
  Description of Artificial Sequence: Synthetic oligonucleotide
  Target: SCN10A; (+) strand; PAM type: NRG; PAM sequence: TAG
actttttccaggcactgtgc

SEQ ID NO: 36329 - DNA, 20 bp, Artificial Sequence
  Description of Artificial Sequence: Synthetic oligonucleotide
  Target: SCN10A; (+) strand; PAM type: NRG; PAM sequence: AGG
ctttttccaggcactgtgct

SEQ ID NO: 36330 - DNA, 20 bp, Artificial Sequence
  Description of Artificial Sequence: Synthetic oligonucleotide
  Target: SCN10A; (+) strand; PAM type: NRG; PAM sequence: AAG
caggcactgtgctaggcatg

SEQ ID NO: 36331 - DNA, 20 bp, Artificial Sequence
  Description of Artificial Sequence: Synthetic oligonucleotide
  Target: SCN10A; (+) strand; PAM type: NRG; PAM sequence: CAG
tgaagctactaacttcaccc

SEQ ID NO: 36332 - DNA, 20 bp, Artificial Sequence
  Description of Artificial Sequence: Synthetic oligonucleotide
  Target: SCN10A; (+) strand; PAM type: NRG; PAM sequence: TGG
ctaacttcaccccagtaatt

SEQ ID NO: 36333 - DNA, 20 bp, Artificial Sequence
  Description of Artificial Sequence: Synthetic oligonucleotide
  Target: SCN10A; (+) strand; PAM type: NRG; PAM sequence: TGG
tctgtctttctgcatgcatc

SEQ ID NO: 36334 - DNA, 20 bp, Artificial Sequence
  Description of Artificial Sequence: Synthetic oligonucleotide
  Target: SCN10A; (+) strand; PAM type: NRG; PAM sequence: GGG
ctgtctttctgcatgcatct

SEQ ID NO: 36335 - DNA, 20 bp, Artificial Sequence
  Description of Artificial Sequence: Synthetic oligonucleotide
  Target: SCN10A; (+) strand; PAM type: NRG; PAM sequence: GAG
gtctttctgcatgcatctgg

SEQ ID NO: 36336 - DNA, 20 bp, Artificial Sequence
  Description of Artificial Sequence: Synthetic oligonucleotide
  Target: SCN10A; (+) strand; PAM type: NRG; PAM sequence: AGG
tctttctgcatgcatctggg

SEQ ID NO: 36337 - DNA, 20 bp, Artificial Sequence
  Description of Artificial Sequence: Synthetic oligonucleotide
  Target: SCN10A; (+) strand; PAM type: NRG; PAM sequence: CAG
ttctgcatgcatctgggagg

SEQ ID NO: 36338 - DNA, 20 bp, Artificial Sequence
  Description of Artificial Sequence: Synthetic oligonucleotide
  Target: SCN10A; (+) strand; PAM type: NRG; PAM sequence: GAG
atgcatctgggaggcagctt

SEQ ID NO: 36339 - DNA, 20 bp, Artificial Sequence
  Description of Artificial Sequence: Synthetic oligonucleotide
  Target: SCN10A; (+) strand; PAM type: NRG; PAM sequence: TGG
ctgggaggcagcttgagact

SEQ ID NO: 36340 - DNA, 20 bp, Artificial Sequence
  Description of Artificial Sequence: Synthetic oligonucleotide
  Target: SCN10A; (+) strand; PAM type: NRG; PAM sequence: GGG
tgggaggcagcttgagactt

SEQ ID NO: 36341 - DNA, 20 bp, Artificial Sequence
  Description of Artificial Sequence: Synthetic oligonucleotide
  Target: SCN10A; (+) strand; PAM type: NRG; PAM sequence: GAG
acatgaacctcactgtgtgt

SEQ ID NO: 36342 - DNA, 20 bp, Artificial Sequence
  Description of Artificial Sequence: Synthetic oligonucleotide
  Target: SCN10A; (+) strand; PAM type: NRG; PAM sequence: GAG
gtgtgtgtgtgtgtgtgtgt

SEQ ID NO: 36343 - DNA, 20 bp, Artificial Sequence
  Description of Artificial Sequence: Synthetic oligonucleotide
  Target: SCN10A; (+) strand; PAM type: NRG; PAM sequence: GAG
gtgtgtgtgtgtgtgtgtga

SEQ ID NO: 36344 - DNA, 20 bp, Artificial Sequence
  Description of Artificial Sequence: Synthetic oligonucleotide
  Target: SCN10A; (+) strand; PAM type: NRG; PAM sequence: GAG
gtgtgtgtgtgtgtgtgaga

SEQ ID NO: 36345 - DNA, 20 bp, Artificial Sequence
  Description of Artificial Sequence: Synthetic oligonucleotide
  Target: SCN10A; (+) strand; PAM type: NRG; PAM sequence: GAG
gtgtgtgtgtgtgtgagaga

SEQ ID NO: 36346 - DNA, 20 bp, Artificial Sequence
  Description of Artificial Sequence: Synthetic oligonucleotide
  Target: SCN10A; (+) strand; PAM type: NRG; PAM sequence: GAG
gtgtgtgtgtgtgagagaga

SEQ ID NO: 36347 - DNA, 20 bp, Artificial Sequence
  Description of Artificial Sequence: Synthetic oligonucleotide
  Target: SCN10A; (+) strand; PAM type: NRG; PAM sequence: GAG
gtgtgtgtgtgagagagaga

SEQ ID NO: 36348 - DNA, 20 bp, Artificial Sequence
  Description of Artificial Sequence: Synthetic oligonucleotide
  Target: SCN10A; (+) strand; PAM type: NRG; PAM sequence: GAG
gtgtgtgtgagagagagaga

SEQ ID NO: 36349 - DNA, 20 bp, Artificial Sequence
  Description of Artificial Sequence: Synthetic oligonucleotide
  Target: SCN10A; (+) strand; PAM type: NRG; PAM sequence: GAG
gtgtgtgagagagagagaga

SEQ ID NO: 36350 - DNA, 20 bp, Artificial Sequence
  Description of Artificial Sequence: Synthetic oligonucleotide
  Target: SCN10A; (+) strand; PAM type: NRG; PAM sequence: GAG
gtgtgagagagagagagaga

SEQ ID NO: 36351 - DNA, 20 bp, Artificial Sequence
  Description of Artificial Sequence: Synthetic oligonucleotide
  Target: SCN10A; (+) strand; PAM type: NRG; PAM sequence: GAG
gtgagagagagagagagaga

SEQ ID NO: 36352 - DNA, 20 bp, Artificial Sequence
  Description of Artificial Sequence: Synthetic oligonucleotide
  Target: SCN10A; (+) strand; PAM type: NRG; PAM sequence: GAG
gagagagagagagagagaga

SEQ ID NO: 36353 - DNA, 20 bp, Artificial Sequence
  Description of Artificial Sequence: Synthetic oligonucleotide
  Target: SCN10A; (+) strand; PAM type: NRG; PAM sequence: GAG
gagagagagagagagagaga

SEQ ID NO: 36354 - DNA, 20 bp, Artificial Sequence
  Description of Artificial Sequence: Synthetic oligonucleotide
  Target: SCN10A; (+) strand; PAM type: NRG; PAM sequence: GAG
gagagagagagagagagaga

SEQ ID NO: 36355 - DNA, 20 bp, Artificial Sequence
  Description of Artificial Sequence: Synthetic oligonucleotide
  Target: SCN10A; (+) strand; PAM type: NRG; PAM sequence: AAG
gagagagagagagagagaga

SEQ ID NO: 36356 - DNA, 20 bp, Artificial Sequence
  Description of Artificial Sequence: Synthetic oligonucleotide
  Target: SCN10A; (+) strand; PAM type: NRG; PAM sequence: GAG
gagagagagagagagagaaa

SEQ ID NO: 36357 - DNA, 20 bp, Artificial Sequence
  Description of Artificial Sequence: Synthetic oligonucleotide
  Target: SCN10A; (+) strand; PAM type: NRG; PAM sequence: GAG
gagagagagagagagaaaga

SEQ ID NO: 36358 - DNA, 20 bp, Artificial Sequence
  Description of Artificial Sequence: Synthetic oligonucleotide
  Target: SCN10A; (+) strand; PAM type: NRG; PAM sequence: GAG
gagagagagagagaaagaga

SEQ ID NO: 36359 - DNA, 20 bp, Artificial Sequence
  Description of Artificial Sequence: Synthetic oligonucleotide
  Target: SCN10A; (+) strand; PAM type: NRG; PAM sequence: GAG
gagagagagagaaagagaga

SEQ ID NO: 36360 - DNA, 20 bp, Artificial Sequence
  Description of Artificial Sequence: Synthetic oligonucleotide
  Target: SCN10A; (+) strand; PAM type: NRG; PAM sequence: GAG
gagagagagaaagagagaga

SEQ ID NO: 36361 - DNA, 20 bp, Artificial Sequence
  Description of Artificial Sequence: Synthetic oligonucleotide
  Target: SCN10A; (+) strand; PAM type: NRG; PAM sequence: GAG
gagagagaaagagagagaga

SEQ ID NO: 36362 - DNA, 20 bp, Artificial Sequence
  Description of Artificial Sequence: Synthetic oligonucleotide
  Target: SCN10A; (+) strand; PAM type: NRG; PAM sequence: GAG
gagagaaagagagagagaga

SEQ ID NO: 36363 - DNA, 20 bp, Artificial Sequence
  Description of Artificial Sequence: Synthetic oligonucleotide
  Target: SCN10A; (+) strand; PAM type: NRG; PAM sequence: AAG
agagagagagagagagatgc

SEQ ID NO: 36364 - DNA, 20 bp, Artificial Sequence
  Description of Artificial Sequence: Synthetic oligonucleotide
  Target: SCN10A; (+) strand; PAM type: NRG; PAM sequence: GAG
agagagagagagagatgcaa

SEQ ID NO: 36365 - DNA, 20 bp, Artificial Sequence
  Description of Artificial Sequence: Synthetic oligonucleotide
  Target: SCN10A; (+) strand; PAM type: NRG; PAM sequence: GAG
agagagagagagatgcaaga

SEQ ID NO: 36366 - DNA, 20 bp, Artificial Sequence
  Description of Artificial Sequence: Synthetic oligonucleotide
  Target: SCN10A; (+) strand; PAM type: NRG; PAM sequence: TAG
agagagagatgcaagagaga

SEQ ID NO: 36367 - DNA, 20 bp, Artificial Sequence
  Description of Artificial Sequence: Synthetic oligonucleotide
  Target: SCN10A; (+) strand; PAM type: NRG; PAM sequence: GAG
agagagatgcaagagagata

SEQ ID NO: 36368 - DNA, 20 bp, Artificial Sequence
  Description of Artificial Sequence: Synthetic oligonucleotide
  Target: SCN10A; (+) strand; PAM type: NRG; PAM sequence: TAG
gagatagagtgaaacaaaaa

SEQ ID NO: 36369 - DNA, 20 bp, Artificial Sequence
  Description of Artificial Sequence: Synthetic oligonucleotide
  Target: SCN10A; (+) strand; PAM type: NRG; PAM sequence: AAG
gagtgaaacaaaaatagacc

SEQ ID NO: 36370 - DNA, 20 bp, Artificial Sequence
  Description of Artificial Sequence: Synthetic oligonucleotide
  Target: SCN10A; (+) strand; PAM type: NRG; PAM sequence: GAG
gtgaaacaaaaatagaccaa

SEQ ID NO: 36371 - DNA, 20 bp, Artificial Sequence
  Description of Artificial Sequence: Synthetic oligonucleotide
  Target: SCN10A; (+) strand; PAM type: NRG; PAM sequence: AAG
aacaaaaatagaccaagaga

SEQ ID NO: 36372 - DNA, 20 bp, Artificial Sequence
  Description of Artificial Sequence: Synthetic oligonucleotide
  Target: SCN10A; (+) strand; PAM type: NRG; PAM sequence: AAG
aatagaccaagagaaagaaa

SEQ ID NO: 36373 - DNA, 20 bp, Artificial Sequence
  Description of Artificial Sequence: Synthetic oligonucleotide
  Target: SCN10A; (+) strand; PAM type: NRG; PAM sequence: AAG
gaccaagagaaagaaaaaga

SEQ ID NO: 36374 - DNA, 20 bp, Artificial Sequence
  Description of Artificial Sequence: Synthetic oligonucleotide
  Target: SCN10A; (+) strand; PAM type: NRG; PAM sequence: GAG
ccaagagaaagaaaaagaaa

SEQ ID NO: 36375 - DNA, 20 bp, Artificial Sequence
  Description of Artificial Sequence: Synthetic oligonucleotide
  Target: SCN10A; (+) strand; PAM type: NRG; PAM sequence: CAG
gaaagaaaaagaaagagaca

SEQ ID NO: 36376 - DNA, 20 bp, Artificial Sequence
  Description of Artificial Sequence: Synthetic oligonucleotide
  Target: SCN10A; (+) strand; PAM type: NRG; PAM sequence: GAG
aagaaaaagaaagagacaca

SEQ ID NO: 36377 - DNA, 20 bp, Artificial Sequence
  Description of Artificial Sequence: Synthetic oligonucleotide
  Target: SCN10A; (+) strand; PAM type: NRG; PAM sequence: CAG
aagaaagagacacagagaaa

SEQ ID NO: 36378 - DNA, 20 bp, Artificial Sequence
  Description of Artificial Sequence: Synthetic oligonucleotide
  Target: SCN10A; (+) strand; PAM type: NRG; PAM sequence: GAG
gaaagagacacagagaaaca

SEQ ID NO: 36379 - DNA, 20 bp, Artificial Sequence
  Description of Artificial Sequence: Synthetic oligonucleotide
  Target: SCN10A; (+) strand; PAM type: NRG; PAM sequence: GAG
aagagacacagagaaacaga

SEQ ID NO: 36380 - DNA, 20 bp, Artificial Sequence
  Description of Artificial Sequence: Synthetic oligonucleotide
  Target: SCN10A; (+) strand; PAM type: NRG; PAM sequence: AGG
agagacacagagaaacagag

SEQ ID NO: 36381 - DNA, 20 bp, Artificial Sequence
  Description of Artificial Sequence: Synthetic oligonucleotide
  Target: SCN10A; (+) strand; PAM type: NRG; PAM sequence: GAG
acacagagaaacagagaggt

SEQ ID NO: 36382 - DNA, 20 bp, Artificial Sequence
  Description of Artificial Sequence: Synthetic oligonucleotide
  Target: SCN10A; (+) strand; PAM type: NRG; PAM sequence: TAG
gagaaacagagaggtgagtt

SEQ ID NO: 36383 - DNA, 20 bp, Artificial Sequence
  Description of Artificial Sequence: Synthetic oligonucleotide
  Target: SCN10A; (+) strand; PAM type: NRG; PAM sequence: TAG
cagagaggtgagtttagcaa

SEQ ID NO: 36384 - DNA, 20 bp, Artificial Sequence
  Description of Artificial Sequence: Synthetic oligonucleotide
  Target: SCN10A; (+) strand; PAM type: NRG; PAM sequence: AAG
gaggtgagtttagcaataga

SEQ ID NO: 36385 - DNA, 20 bp, Artificial Sequence
  Description of Artificial Sequence: Synthetic oligonucleotide
  Target: SCN10A; (+) strand; PAM type: NRG; PAM sequence: GAG
ggtgagtttagcaatagaaa

SEQ ID NO: 36386 - DNA, 20 bp, Artificial Sequence
  Description of Artificial Sequence: Synthetic oligonucleotide
  Target: SCN10A; (+) strand; PAM type: NRG; PAM sequence: AAG
tagcaatagaaagagactat

SEQ ID NO: 36387 - DNA, 20 bp, Artificial Sequence
  Description of Artificial Sequence: Synthetic oligonucleotide
  Target: SCN10A; (+) strand; PAM type: NRG; PAM sequence: GAG
aagagactataagaaacact

SEQ ID NO: 36388 - DNA, 20 bp, Artificial Sequence
  Description of Artificial Sequence: Synthetic oligonucleotide
  Target: SCN10A; (+) strand; PAM type: NRG; PAM sequence: CAG
gactataagaaacactgaga

SEQ ID NO: 36389 - DNA, 20 bp, Artificial Sequence
  Description of Artificial Sequence: Synthetic oligonucleotide
  Target: SCN10A; (+) strand; PAM type: NRG; PAM sequence: TGG
agaaacactgagacagtcac

SEQ ID NO: 36390 - DNA, 20 bp, Artificial Sequence
  Description of Artificial Sequence: Synthetic oligonucleotide
  Target: SCN10A; (+) strand; PAM type: NRG; PAM sequence: GGG
gaaacactgagacagtcact

SEQ ID NO: 36391 - DNA, 20 bp, Artificial Sequence
  Description of Artificial Sequence: Synthetic oligonucleotide
  Target: SCN10A; (+) strand; PAM type: NRG; PAM sequence: GGG
aaacactgagacagtcactg

SEQ ID NO: 36392 - DNA, 20 bp, Artificial Sequence
  Description of Artificial Sequence: Synthetic oligonucleotide
  Target: SCN10A; (+) strand; PAM type: NRG; PAM sequence: TAG
gacagtcactggggcataaa

SEQ ID NO: 36393 - DNA, 20 bp, Artificial Sequence
  Description of Artificial Sequence: Synthetic oligonucleotide
  Target: SCN10A; (+) strand; PAM type: NRG; PAM sequence: AAG
gcataaatagaacttgtgcc

SEQ ID NO: 36394 - DNA, 20 bp, Artificial Sequence
  Description of Artificial Sequence: Synthetic oligonucleotide
  Target: SCN10A; (+) strand; PAM type: NRG; PAM sequence: CAG
aatagaacttgtgccaagca

SEQ ID NO: 36395 - DNA, 20 bp, Artificial Sequence
  Description of Artificial Sequence: Synthetic oligonucleotide
  Target: SCN10A; (+) strand; PAM type: NRG; PAM sequence: TGG
gaacttgtgccaagcacagc

SEQ ID NO: 36396 - DNA, 20 bp, Artificial Sequence
  Description of Artificial Sequence: Synthetic oligonucleotide
  Target: SCN10A; (+) strand; PAM type: NRG; PAM sequence: CAG
cttgtgccaagcacagctgg

SEQ ID NO: 36397 - DNA, 20 bp, Artificial Sequence
  Description of Artificial Sequence: Synthetic oligonucleotide
  Target: SCN10A; (+) strand; PAM type: NRG; PAM sequence: AAG
gccaagcacagctggcagca

SEQ ID NO: 36398 - DNA, 20 bp, Artificial Sequence
  Description of Artificial Sequence: Synthetic oligonucleotide
  Target: SCN10A; (+) strand; PAM type: NRG; PAM sequence: AAG
aagcacagctggcagcaaag

SEQ ID NO: 36399 - DNA, 20 bp, Artificial Sequence
  Description of Artificial Sequence: Synthetic oligonucleotide
  Target: SCN10A; (+) strand; PAM type: NRG; PAM sequence: AGG
agcacagctggcagcaaaga

SEQ ID NO: 36400 - DNA, 20 bp, Artificial Sequence
  Description of Artificial Sequence: Synthetic oligonucleotide
  Target: SCN10A; (+) strand; PAM type: NRG; PAM sequence: AAG
aaggatacacctgcttgttt

SEQ ID NO: 36401 - DNA, 20 bp, Artificial Sequence
  Description of Artificial Sequence: Synthetic oligonucleotide
  Target: SCN10A; (+) strand; PAM type: NRG; PAM sequence: AGG
aggatacacctgcttgttta

SEQ ID NO: 36402 - DNA, 20 bp, Artificial Sequence
  Description of Artificial Sequence: Synthetic oligonucleotide
  Target: SCN10A; (+) strand; PAM type: NRG; PAM sequence: GAG
gatacacctgcttgtttaag

SEQ ID NO: 36403 - DNA, 20 bp, Artificial Sequence
  Description of Artificial Sequence: Synthetic oligonucleotide
  Target: SCN10A; (+) strand; PAM type: NRG; PAM sequence: AGG
atacacctgcttgtttaagg

SEQ ID NO: 36404 - DNA, 20 bp, Artificial Sequence
  Description of Artificial Sequence: Synthetic oligonucleotide
  Target: SCN10A; (+) strand; PAM type: NRG; PAM sequence: GGG
tacacctgcttgtttaagga

SEQ ID NO: 36405 - DNA, 20 bp, Artificial Sequence
  Description of Artificial Sequence: Synthetic oligonucleotide
  Target: SCN10A; (+) strand; PAM type: NRG; PAM sequence: TGG
ggagggatgatttgttgctc

SEQ ID NO: 36406 - DNA, 20 bp, Artificial Sequence
  Description of Artificial Sequence: Synthetic oligonucleotide
  Target: SCN10A; (+) strand; PAM type: NRG; PAM sequence: AAG
ggatgatttgttgctctggt

SEQ ID NO: 36407 - DNA, 20 bp, Artificial Sequence
  Description of Artificial Sequence: Synthetic oligonucleotide
  Target: SCN10A; (+) strand; PAM type: NRG; PAM sequence: TGG
gtaagtaaaatcaacttctt

SEQ ID NO: 36408 - DNA, 20 bp, Artificial Sequence
  Description of Artificial Sequence: Synthetic oligonucleotide
  Target: SCN10A; (+) strand; PAM type: NRG; PAM sequence: GGG
taagtaaaatcaacttcttt

SEQ ID NO: 36409 - DNA, 20 bp, Artificial Sequence
  Description of Artificial Sequence: Synthetic oligonucleotide
  Target: SCN10A; (+) strand; PAM type: NRG; PAM sequence: GAG
agtaaaatcaacttctttgg

SEQ ID NO: 36410 - DNA, 20 bp, Artificial Sequence
  Description of Artificial Sequence: Synthetic oligonucleotide
  Target: SCN10A; (+) strand; PAM type: NRG; PAM sequence: GAG
taaaatcaacttctttggga

SEQ ID NO: 36411 - DNA, 20 bp, Artificial Sequence
  Description of Artificial Sequence: Synthetic oligonucleotide
  Target: SCN10A; (+) strand; PAM type: NRG; PAM sequence: CAG
aatcaacttctttgggagag

SEQ ID NO: 36412 - DNA, 20 bp, Artificial Sequence
  Description of Artificial Sequence: Synthetic oligonucleotide
  Target: SCN10A; (+) strand; PAM type: NRG; PAM sequence: CAG
tctttgggagagcagcttcg

SEQ ID NO: 36413 - DNA, 20 bp, Artificial Sequence
  Description of Artificial Sequence: Synthetic oligonucleotide
  Target: SCN10A; (+) strand; PAM type: NRG; PAM sequence: AGG
ctttgggagagcagcttcgc

SEQ ID NO: 36414 - DNA, 20 bp, Artificial Sequence
  Description of Artificial Sequence: Synthetic oligonucleotide
  Target: SCN10A; (+) strand; PAM type: NRG; PAM sequence: TAG
tgggagagcagcttcgcagg

SEQ ID NO: 36415 - DNA, 20 bp, Artificial Sequence
  Description of Artificial Sequence: Synthetic oligonucleotide
  Target: SCN10A; (+) strand; PAM type: NRG; PAM sequence: CAG
gagagcagcttcgcaggtag

SEQ ID NO: 36416 - DNA, 20 bp, Artificial Sequence
  Description of Artificial Sequence: Synthetic oligonucleotide
  Target: SCN10A; (+) strand; PAM type: NRG; PAM sequence: AAG
gcagcttcgcaggtagcaga

SEQ ID NO: 36417 - DNA, 20 bp, Artificial Sequence
  Description of Artificial Sequence: Synthetic oligonucleotide
  Target: SCN10A; (+) strand; PAM type: NRG; PAM sequence: GAG
agcttcgcaggtagcagaaa

SEQ ID NO: 36418 - DNA, 20 bp, Artificial Sequence
  Description of Artificial Sequence: Synthetic oligonucleotide
  Target: SCN10A; (+) strand; PAM type: NRG; PAM sequence: CAG
gtagcagaaagagctctgac

SEQ ID NO: 36419 - DNA, 20 bp, Artificial Sequence
  Description of Artificial Sequence: Synthetic oligonucleotide
  Target: SCN10A; (+) strand; PAM type: NRG; PAM sequence: AGG
tagcagaaagagctctgacc

SEQ ID NO: 36420 - DNA, 20 bp, Artificial Sequence
  Description of Artificial Sequence: Synthetic oligonucleotide
  Target: SCN10A; (+) strand; PAM type: NRG; PAM sequence: GGG
agcagaaagagctctgacca

SEQ ID NO: 36421 - DNA, 20 bp, Artificial Sequence
  Description of Artificial Sequence: Synthetic oligonucleotide
  Target: SCN10A; (+) strand; PAM type: NRG; PAM sequence: AAG
agaaagagctctgaccaggg

SEQ ID NO: 36422 - DNA, 20 bp, Artificial Sequence
  Description of Artificial Sequence: Synthetic oligonucleotide
  Target: SCN10A; (+) strand; PAM type: NRG; PAM sequence: TAG
ctctgaccagggaagcaatc

SEQ ID NO: 36423 - DNA, 20 bp, Artificial Sequence
  Description of Artificial Sequence: Synthetic oligonucleotide
  Target: SCN10A; (+) strand; PAM type: NRG; PAM sequence: AGG
tctgaccagggaagcaatct

SEQ ID NO: 36424 - DNA, 20 bp, Artificial Sequence
  Description of Artificial Sequence: Synthetic oligonucleotide
  Target: SCN10A; (+) strand; PAM type: NRG; PAM sequence: TGG
agcaatctaggatttatttt

SEQ ID NO: 36425 - DNA, 20 bp, Artificial Sequence
  Description of Artificial Sequence: Synthetic oligonucleotide
  Target: SCN10A; (+) strand; PAM type: NRG; PAM sequence: TAG
atctaggatttatttttggt

SEQ ID NO: 36426 - DNA, 20 bp, Artificial Sequence
  Description of Artificial Sequence: Synthetic oligonucleotide
  Target: SCN10A; (+) strand; PAM type: NRG; PAM sequence: TGG
ttatttttggttagtcattt

SEQ ID NO: 36427 - DNA, 20 bp, Artificial Sequence
  Description of Artificial Sequence: Synthetic oligonucleotide
  Target: SCN10A; (+) strand; PAM type: NRG; PAM sequence: CAG
ttttggttagtcattttggt

SEQ ID NO: 36428 - DNA, 20 bp, Artificial Sequence
  Description of Artificial Sequence: Synthetic oligonucleotide
  Target: SCN10A; (+) strand; PAM type: NRG; PAM sequence: GAG
tggtcagcaaataatccact

SEQ ID NO: 36429 - DNA, 20 bp, Artificial Sequence
  Description of Artificial Sequence: Synthetic oligonucleotide
  Target: SCN10A; (+) strand; PAM type: NRG; PAM sequence: CAG
ccactgagcactacatgtgt

SEQ ID NO: 36430 - DNA, 20 bp, Artificial Sequence
  Description of Artificial Sequence: Synthetic oligonucleotide
  Target: SCN10A; (+) strand; PAM type: NRG; PAM sequence: TGG
gcactacatgtgtcagtccc

SEQ ID NO: 36431 - DNA, 20 bp, Artificial Sequence
  Description of Artificial Sequence: Synthetic oligonucleotide
  Target: SCN10A; (+) strand; PAM type: NRG; PAM sequence: TGG
acatgtgtcagtccctggac

SEQ ID NO: 36432 - DNA, 20 bp, Artificial Sequence
  Description of Artificial Sequence: Synthetic oligonucleotide
  Target: SCN10A; (+) strand; PAM type: NRG; PAM sequence: GGG
catgtgtcagtccctggact

SEQ ID NO: 36433 - DNA, 20 bp, Artificial Sequence
  Description of Artificial Sequence: Synthetic oligonucleotide
  Target: SCN10A; (+) strand; PAM type: NRG; PAM sequence: GAG
tgtgtcagtccctggactgg

SEQ ID NO: 36434 - DNA, 20 bp, Artificial Sequence
  Description of Artificial Sequence: Synthetic oligonucleotide
  Target: SCN10A; (+) strand; PAM type: NRG; PAM sequence: GAG
cagtccctggactgggagct

SEQ ID NO: 36435 - DNA, 20 bp, Artificial Sequence
  Description of Artificial Sequence: Synthetic oligonucleotide
  Target: SCN10A; (+) strand; PAM type: NRG; PAM sequence: TGG
ctggactgggagctgagtga

SEQ ID NO: 36436 - DNA, 20 bp, Artificial Sequence
  Description of Artificial Sequence: Synthetic oligonucleotide
  Target: SCN10A; (+) strand; PAM type: NRG; PAM sequence: AAG
ctgggagctgagtgatggct

SEQ ID NO: 36437 - DNA, 20 bp, Artificial Sequence
  Description of Artificial Sequence: Synthetic oligonucleotide
  Target: SCN10A; (+) strand; PAM type: NRG; PAM sequence: AGG
tgggagctgagtgatggcta

SEQ ID NO: 36438 - DNA, 20 bp, Artificial Sequence
  Description of Artificial Sequence: Synthetic oligonucleotide
  Target: SCN10A; (+) strand; PAM type: NRG; PAM sequence: CAG
gagctgagtgatggctaagg

SEQ ID NO: 36439 - DNA, 20 bp, Artificial Sequence
  Description of Artificial Sequence: Synthetic oligonucleotide
  Target: SCN10A; (+) strand; PAM type: NRG; PAM sequence: CAG
ctgagtgatggctaaggcag

SEQ ID NO: 36440 - DNA, 20 bp, Artificial Sequence
  Description of Artificial Sequence: Synthetic oligonucleotide
  Target: SCN10A; (+) strand; PAM type: NRG; PAM sequence: GAG
ggctaaggcagcagcatgtc

SEQ ID NO: 36441 - DNA, 20 bp, Artificial Sequence
  Description of Artificial Sequence: Synthetic oligonucleotide
  Target: SCN10A; (+) strand; PAM type: NRG; PAM sequence: GAG
agtgccgttgtctgacaatt

SEQ ID NO: 36442 - DNA, 20 bp, Artificial Sequence
  Description of Artificial Sequence: Synthetic oligonucleotide
  Target: SCN10A; (+) strand; PAM type: NRG; PAM sequence: AGG
gtgccgttgtctgacaattg

SEQ ID NO: 36443 - DNA, 20 bp, Artificial Sequence
  Description of Artificial Sequence: Synthetic oligonucleotide
  Target: SCN10A; (+) strand; PAM type: NRG; PAM sequence: GGG
tgccgttgtctgacaattga

SEQ ID NO: 36444 - DNA, 20 bp, Artificial Sequence
  Description of Artificial Sequence: Synthetic oligonucleotide
  Target: SCN10A; (+) strand; PAM type: NRG; PAM sequence: GGG
gccgttgtctgacaattgag

SEQ ID NO: 36445 - DNA, 20 bp, Artificial Sequence
  Description of Artificial Sequence: Synthetic oligonucleotide
  Target: SCN10A; (+) strand; PAM type: NRG; PAM sequence: AAG
ttgtctgacaattgagggga

SEQ ID NO: 36446 - DNA, 20 bp, Artificial Sequence
  Description of Artificial Sequence: Synthetic oligonucleotide
  Target: SCN10A; (+) strand; PAM type: NRG; PAM sequence: TAG
acaattgaggggaaagtctg

SEQ ID NO: 36447 - DNA, 20 bp, Artificial Sequence
  Description of Artificial Sequence: Synthetic oligonucleotide
  Target: SCN10A; (+) strand; PAM type: NRG; PAM sequence: GAG
ggaaagtctgtagcattact

SEQ ID NO: 36448 - DNA, 20 bp, Artificial Sequence
  Description of Artificial Sequence: Synthetic oligonucleotide
  Target: SCN10A; (+) strand; PAM type: NRG; PAM sequence: CAG
aagtctgtagcattactgag

SEQ ID NO: 36449 - DNA, 20 bp, Artificial Sequence
  Description of Artificial Sequence: Synthetic oligonucleotide
  Target: SCN10A; (+) strand; PAM type: NRG; PAM sequence: TGG
ctgtagcattactgagcaga

SEQ ID NO: 36450 - DNA, 20 bp, Artificial Sequence
  Description of Artificial Sequence: Synthetic oligonucleotide
  Target: SCN10A; (+) strand; PAM type: NRG; PAM sequence: GGG
tgtagcattactgagcagat

SEQ ID NO: 36451 - DNA, 20 bp, Artificial Sequence
  Description of Artificial Sequence: Synthetic oligonucleotide
  Target: SCN10A; (+) strand; PAM type: NRG; PAM sequence: CAG
ttactgagcagatgggcaca

SEQ ID NO: 36452 - DNA, 20 bp, Artificial Sequence
  Description of Artificial Sequence: Synthetic oligonucleotide
  Target: SCN10A; (+) strand; PAM type: NRG; PAM sequence: AGG
tactgagcagatgggcacac

SEQ ID NO: 36453 - DNA, 20 bp, Artificial Sequence
  Description of Artificial Sequence: Synthetic oligonucleotide
  Target: SCN10A; (+) strand; PAM type: NRG; PAM sequence: GGG
actgagcagatgggcacaca

SEQ ID NO: 36454 - DNA, 20 bp, Artificial Sequence
  Description of Artificial Sequence: Synthetic oligonucleotide
  Target: SCN10A; (+) strand; PAM type: NRG; PAM sequence: GGG
ctgagcagatgggcacacag

SEQ ID NO: 36455 - DNA, 20 bp, Artificial Sequence
  Description of Artificial Sequence: Synthetic oligonucleotide
  Target: SCN10A; (+) strand; PAM type: NRG; PAM sequence: GAG
gagcagatgggcacacaggg

SEQ ID NO: 36456 - DNA, 20 bp, Artificial Sequence
  Description of Artificial Sequence: Synthetic oligonucleotide
  Target: SCN10A; (+) strand; PAM type: NRG; PAM sequence: CAG
cagatgggcacacaggggag

SEQ ID NO: 36457 - DNA, 20 bp, Artificial Sequence
  Description of Artificial Sequence: Synthetic oligonucleotide
  Target: SCN10A; (+) strand; PAM type: NRG; PAM sequence: AAG
aggggagcagcccttaactg

SEQ ID NO: 36458 - DNA, 20 bp, Artificial Sequence
  Description of Artificial Sequence: Synthetic oligonucleotide
  Target: SCN10A; (+) strand; PAM type: NRG; PAM sequence: CAG
gcagcccttaactgaagttc

SEQ ID NO: 36459 - DNA, 20 bp, Artificial Sequence
  Description of Artificial Sequence: Synthetic oligonucleotide
  Target: SCN10A; (+) strand; PAM type: NRG; PAM sequence: GAG
agcccttaactgaagttcca

SEQ ID NO: 36460 - DNA, 20 bp, Artificial Sequence
  Description of Artificial Sequence: Synthetic oligonucleotide
  Target: SCN10A; (+) strand; PAM type: NRG; PAM sequence: AGG
gcccttaactgaagttccag

SEQ ID NO: 36461 - DNA, 20 bp, Artificial Sequence
  Description of Artificial Sequence: Synthetic oligonucleotide
  Target: SCN10A; (+) strand; PAM type: NRG; PAM sequence: TGG
cttaactgaagttccagagg

SEQ ID NO: 36462 - DNA, 20 bp, Artificial Sequence
  Description of Artificial Sequence: Synthetic oligonucleotide
  Target: SCN10A; (+) strand; PAM type: NRG; PAM sequence: GGG
ttaactgaagttccagaggt

SEQ ID NO: 36463 - DNA, 20 bp, Artificial Sequence
  Description of Artificial Sequence: Synthetic oligonucleotide
  Target: SCN10A; (+) strand; PAM type: NRG; PAM sequence: TGG
tgaagttccagaggtgggaa

SEQ ID NO: 36464 - DNA, 20 bp, Artificial Sequence
  Description of Artificial Sequence: Synthetic oligonucleotide
  Target: SCN10A; (+) strand; PAM type: NRG; PAM sequence: GGG
gaagttccagaggtgggaat

SEQ ID NO: 36465 - DNA, 20 bp, Artificial Sequence
  Description of Artificial Sequence: Synthetic oligonucleotide
  Target: SCN10A; (+) strand; PAM type: NRG; PAM sequence: GGG
aagttccagaggtgggaatg

SEQ ID NO: 36466 - DNA, 20 bp, Artificial Sequence
  Description of Artificial Sequence: Synthetic oligonucleotide
  Target: SCN10A; (+) strand; PAM type: NRG; PAM sequence: TGG
ttccagaggtgggaatgggg

SEQ ID NO: 36467 - DNA, 20 bp, Artificial Sequence
  Description of Artificial Sequence: Synthetic oligonucleotide
  Target: SCN10A; (+) strand; PAM type: NRG; PAM sequence: GGG
tccagaggtgggaatggggt

SEQ ID NO: 36468 - DNA, 20 bp, Artificial Sequence
  Description of Artificial Sequence: Synthetic oligonucleotide
  Target: SCN10A; (+) strand; PAM type: NRG; PAM sequence: TGG
agaggtgggaatggggtggg

SEQ ID NO: 36469 - DNA, 20 bp, Artificial Sequence
  Description of Artificial Sequence: Synthetic oligonucleotide
  Target: SCN10A; (+) strand; PAM type: NRG; PAM sequence: GAG
aggtgggaatggggtgggtg

SEQ ID NO: 36470 - DNA, 20 bp, Artificial Sequence
  Description of Artificial Sequence: Synthetic oligonucleotide
  Target: SCN10A; (+) strand; PAM type: NRG; PAM sequence: GAG
gaatggggtgggtggagtgt

SEQ ID NO: 36471 - DNA, 20 bp, Artificial Sequence
  Description of Artificial Sequence: Synthetic oligonucleotide
  Target: SCN10A; (+) strand; PAM type: NRG; PAM sequence: AGG
aatggggtgggtggagtgtg

SEQ ID NO: 36472 - DNA, 20 bp, Artificial Sequence
  Description of Artificial Sequence: Synthetic oligonucleotide
  Target: SCN10A; (+) strand; PAM type: NRG; PAM sequence: AAG
ggggtgggtggagtgtgagg

SEQ ID NO: 36473 - DNA, 20 bp, Artificial Sequence
  Description of Artificial Sequence: Synthetic oligonucleotide
  Target: SCN10A; (+) strand; PAM type: NRG; PAM sequence: AGG
gggtgggtggagtgtgagga

SEQ ID NO: 36474 - DNA, 20 bp, Artificial Sequence
  Description of Artificial Sequence: Synthetic oligonucleotide
  Target: SCN10A; (+) strand; PAM type: NRG; PAM sequence: TGG
tgggtggagtgtgaggaagg

SEQ ID NO: 36475 - DNA, 20 bp, Artificial Sequence
  Description of Artificial Sequence: Synthetic oligonucleotide
  Target: SCN10A; (+) strand; PAM type: NRG; PAM sequence: GGG
gggtggagtgtgaggaaggt

SEQ ID NO: 36476 - DNA, 20 bp, Artificial Sequence
  Description of Artificial Sequence: Synthetic oligonucleotide
  Target: SCN10A; (+) strand; PAM type: NRG; PAM sequence: CAG
tgtgaggaaggtgggaaaac

SEQ ID NO: 36477 - DNA, 20 bp, Artificial Sequence
  Description of Artificial Sequence: Synthetic oligonucleotide
  Target: SCN10A; (+) strand; PAM type: NRG; PAM sequence: AGG
gtgaggaaggtgggaaaacc

SEQ ID NO: 36478 - DNA, 20 bp, Artificial Sequence
  Description of Artificial Sequence: Synthetic oligonucleotide
  Target: SCN10A; (+) strand; PAM type: NRG; PAM sequence: GGG
tgaggaaggtgggaaaacca

SEQ ID NO: 36479 - DNA, 20 bp, Artificial Sequence
  Description of Artificial Sequence: Synthetic oligonucleotide
  Target: SCN10A; (+) strand; PAM type: NRG; PAM sequence: GAG
aggaaggtgggaaaaccagg

SEQ ID NO: 36480 - DNA, 20 bp, Artificial Sequence
  Description of Artificial Sequence: Synthetic oligonucleotide
  Target: SCN10A; (+) strand; PAM type: NRG; PAM sequence: AGG
ggaaggtgggaaaaccaggg

SEQ ID NO: 36481 - DNA, 20 bp, Artificial Sequence
  Description of Artificial Sequence: Synthetic oligonucleotide
  Target: SCN10A; (+) strand; PAM type: NRG; PAM sequence: GAG
aaggtgggaaaaccagggag

SEQ ID NO: 36482 - DNA, 20 bp, Artificial Sequence
  Description of Artificial Sequence: Synthetic oligonucleotide
  Target: SCN10A; (+) strand; PAM type: NRG; PAM sequence: AGG
aggtgggaaaaccagggagg

SEQ ID NO: 36483 - DNA, 20 bp, Artificial Sequence
  Description of Artificial Sequence: Synthetic oligonucleotide
  Target: SCN10A; (+) strand; PAM type: NRG; PAM sequence: TGG
ccagggaggaggtaaaacct

SEQ ID NO: 36484 - DNA, 20 bp, Artificial Sequence
  Description of Artificial Sequence: Synthetic oligonucleotide
  Target: SCN10A; (+) strand; PAM type: NRG; PAM sequence: CAG
gggaggaggtaaaaccttgg

SEQ ID NO: 36485 - DNA, 20 bp, Artificial Sequence
  Description of Artificial Sequence: Synthetic oligonucleotide
  Target: SCN10A; (+) strand; PAM type: NRG; PAM sequence: GAG
gaggaggtaaaaccttggca

SEQ ID NO: 36486 - DNA, 20 bp, Artificial Sequence
  Description of Artificial Sequence: Synthetic oligonucleotide
  Target: SCN10A; (+) strand; PAM type: NRG; PAM sequence: GAG
taaaaccttggcagagccct

SEQ ID NO: 36487 - DNA, 20 bp, Artificial Sequence
  Description of Artificial Sequence: Synthetic oligonucleotide
  Target: SCN10A; (+) strand; PAM type: NRG; PAM sequence: AGG
aaaaccttggcagagccctg

SEQ ID NO: 36488 - DNA, 20 bp, Artificial Sequence
  Description of Artificial Sequence: Synthetic oligonucleotide
  Target: SCN10A; (+) strand; PAM type: NRG; PAM sequence: GAG
ttggcagagccctgaggaat

SEQ ID NO: 36489 - DNA, 20 bp, Artificial Sequence
  Description of Artificial Sequence: Synthetic oligonucleotide
  Target: SCN10A; (+) strand; PAM type: NRG; PAM sequence: GAG
gagccctgaggaatgagtgt

SEQ ID NO: 36490 - DNA, 20 bp, Artificial Sequence
  Description of Artificial Sequence: Synthetic oligonucleotide
  Target: SCN10A; (+) strand; PAM type: NRG; PAM sequence: GAG
ctgaggaatgagtgtgagtt

SEQ ID NO: 36491 - DNA, 20 bp, Artificial Sequence
  Description of Artificial Sequence: Synthetic oligonucleotide
  Target: SCN10A; (+) strand; PAM type: NRG; PAM sequence: AAG
gaatgagtgtgagttgagta

SEQ ID NO: 36492 - DNA, 20 bp, Artificial Sequence
  Description of Artificial Sequence: Synthetic oligonucleotide
  Target: SCN10A; (+) strand; PAM type: NRG; PAM sequence: GAG
atgagtgtgagttgagtaaa

SEQ ID NO: 36493 - DNA, 20 bp, Artificial Sequence
  Description of Artificial Sequence: Synthetic oligonucleotide
  Target: SCN10A; (+) strand; PAM type: NRG; PAM sequence: GAG
gagtgtgagttgagtaaaga

SEQ ID NO: 36494 - DNA, 20 bp, Artificial Sequence
  Description of Artificial Sequence: Synthetic oligonucleotide
  Target: SCN10A; (+) strand; PAM type: NRG; PAM sequence: AGG
agtgtgagttgagtaaagag

SEQ ID NO: 36495 - DNA, 20 bp, Artificial Sequence
  Description of Artificial Sequence: Synthetic oligonucleotide
  Target: SCN10A; (+) strand; PAM type: NRG; PAM sequence: GAG
tgtgagttgagtaaagagag

SEQ ID NO: 36496 - DNA, 20 bp, Artificial Sequence
  Description of Artificial Sequence: Synthetic oligonucleotide
  Target: SCN10A; (+) strand; PAM type: NRG; PAM sequence: AGG
gtgagttgagtaaagagagg

SEQ ID NO: 36497 - DNA, 20 bp, Artificial Sequence
  Description of Artificial Sequence: Synthetic oligonucleotide
  Target: SCN10A; (+) strand; PAM type: NRG; PAM sequence: AAG
agttgagtaaagagaggagg

SEQ ID NO: 36498 - DNA, 20 bp, Artificial Sequence
  Description of Artificial Sequence: Synthetic oligonucleotide
  Target: SCN10A; (+) strand; PAM type: NRG; PAM sequence: AGG
gttgagtaaagagaggagga

SEQ ID NO: 36499 - DNA, 20 bp, Artificial Sequence
  Description of Artificial Sequence: Synthetic oligonucleotide
  Target: SCN10A; (+) strand; PAM type: NRG; PAM sequence: CAG
agagaggaggaaggatatcc

SEQ ID NO: 36500 - DNA, 20 bp, Artificial Sequence
  Description of Artificial Sequence: Synthetic oligonucleotide
  Target: SCN10A; (+) strand; PAM type: NRG; PAM sequence: AAG
gaggaggaaggatatcccag

SEQ ID NO: 36501 - DNA, 20 bp, Artificial Sequence
  Description of Artificial Sequence: Synthetic oligonucleotide
  Target: SCN10A; (+) strand; PAM type: NRG; PAM sequence: AAG
gaggaaggatatcccagaag

SEQ ID NO: 36502 - DNA, 20 bp, Artificial Sequence
  Description of Artificial Sequence: Synthetic oligonucleotide
  Target: SCN10A; (+) strand; PAM type: NRG; PAM sequence: AGG
aggaaggatatcccagaaga

SEQ ID NO: 36503 - DNA, 20 bp, Artificial Sequence
  Description of Artificial Sequence: Synthetic oligonucleotide
  Target: SCN10A; (+) strand; PAM type: NRG; PAM sequence: GGG
ggaaggatatcccagaagaa

SEQ ID NO: 36504 - DNA, 20 bp, Artificial Sequence
  Description of Artificial Sequence: Synthetic oligonucleotide
  Target: SCN10A; (+) strand; PAM type: NRG; PAM sequence: GGG
gaaggatatcccagaagaag

SEQ ID NO: 36505 - DNA, 20 bp, Artificial Sequence
  Description of Artificial Sequence: Synthetic oligonucleotide
  Target: SCN10A; (+) strand; PAM type: NRG; PAM sequence: CAG
ggatatcccagaagaagggg

SEQ ID NO: 36506 - DNA, 20 bp, Artificial Sequence
  Description of Artificial Sequence: Synthetic oligonucleotide
  Target: SCN10A; (+) strand; PAM type: NRG; PAM sequence: CAG
tcccagaagaaggggcagca

SEQ ID NO: 36507 - DNA, 20 bp, Artificial Sequence
  Description of Artificial Sequence: Synthetic oligonucleotide
  Target: SCN10A; (+) strand; PAM type: NRG; PAM sequence: TAG
cagaagaaggggcagcacag

SEQ ID NO: 36508 - DNA, 20 bp, Artificial Sequence
  Description of Artificial Sequence: Synthetic oligonucleotide
  Target: SCN10A; (+) strand; PAM type: NRG; PAM sequence: AAG
aagaaggggcagcacagtag

SEQ ID NO: 36509 - DNA, 20 bp, Artificial Sequence
  Description of Artificial Sequence: Synthetic oligonucleotide
  Target: SCN10A; (+) strand; PAM type: NRG; PAM sequence: AGG
agaaggggcagcacagtaga

SEQ ID NO: 36510 - DNA, 20 bp, Artificial Sequence
  Description of Artificial Sequence: Synthetic oligonucleotide
  Target: SCN10A; (+) strand; PAM type: NRG; PAM sequence: TGG
ggggcagcacagtagaaggc

SEQ ID NO: 36511 - DNA, 20 bp, Artificial Sequence
  Description of Artificial Sequence: Synthetic oligonucleotide
  Target: SCN10A; (+) strand; PAM type: NRG; PAM sequence: GGG
gggcagcacagtagaaggct

SEQ ID NO: 36512 - DNA, 20 bp, Artificial Sequence
  Description of Artificial Sequence: Synthetic oligonucleotide
  Target: SCN10A; (+) strand; PAM type: NRG; PAM sequence: GAG
gcagcacagtagaaggctgg

SEQ ID NO: 36513 - DNA, 20 bp, Artificial Sequence
  Description of Artificial Sequence: Synthetic oligonucleotide
  Target: SCN10A; (+) strand; PAM type: NRG; PAM sequence: AGG
cagcacagtagaaggctggg

SEQ ID NO: 36514 - DNA, 20 bp, Artificial Sequence
  Description of Artificial Sequence: Synthetic oligonucleotide
  Target: SCN10A; (+) strand; PAM type: NRG; PAM sequence: GAG
acagtagaaggctgggaggt

SEQ ID NO: 36515 - DNA, 20 bp, Artificial Sequence
  Description of Artificial Sequence: Synthetic oligonucleotide
  Target: SCN10A; (+) strand; PAM type: NRG; PAM sequence: TGG
gaaggctgggaggtgagcaa

SEQ ID NO: 36516 - DNA, 20 bp, Artificial Sequence
  Description of Artificial Sequence: Synthetic oligonucleotide
  Target: SCN10A; (+) strand; PAM type: NRG; PAM sequence: TGG
ctgggaggtgagcaatggtg

SEQ ID NO: 36517 - DNA, 20 bp, Artificial Sequence
  Description of Artificial Sequence: Synthetic oligonucleotide
  Target: SCN10A; (+) strand; PAM type: NRG; PAM sequence: GAG
gggaggtgagcaatggtgtg

SEQ ID NO: 36518 - DNA, 20 bp, Artificial Sequence
  Description of Artificial Sequence: Synthetic oligonucleotide
  Target: SCN10A; (+) strand; PAM type: NRG; PAM sequence: CAG
gcaatggtgtggagtatttg

SEQ ID NO: 36519 - DNA, 20 bp, Artificial Sequence
  Description of Artificial Sequence: Synthetic oligonucleotide
  Target: SCN10A; (+) strand; PAM type: NRG; PAM sequence: TAG
gtggagtatttgcagaaccg

SEQ ID NO: 36520 - DNA, 20 bp, Artificial Sequence
  Description of Artificial Sequence: Synthetic oligonucleotide
  Target: SCN10A; (+) strand; PAM type: NRG; PAM sequence: AGG
tggagtatttgcagaaccgt

SEQ ID NO: 36521 - DNA, 20 bp, Artificial Sequence
  Description of Artificial Sequence: Synthetic oligonucleotide
  Target: SCN10A; (+) strand; PAM type: NRG; PAM sequence: TGG
agtatttgcagaaccgtagg

SEQ ID NO: 36522 - DNA, 20 bp, Artificial Sequence
  Description of Artificial Sequence: Synthetic oligonucleotide
  Target: SCN10A; (+) strand; PAM type: NRG; PAM sequence: CAG
gcagaaccgtaggtggattc

SEQ ID NO: 36523 - DNA, 20 bp, Artificial Sequence
  Description of Artificial Sequence: Synthetic oligonucleotide
  Target: SCN10A; (+) strand; PAM type: NRG; PAM sequence: GAG
agaaccgtaggtggattcca

SEQ ID NO: 36524 - DNA, 20 bp, Artificial Sequence
  Description of Artificial Sequence: Synthetic oligonucleotide
  Target: SCN10A; (+) strand; PAM type: NRG; PAM sequence: TGG
cgtaggtggattccagagca

SEQ ID NO: 36525 - DNA, 20 bp, Artificial Sequence
  Description of Artificial Sequence: Synthetic oligonucleotide
  Target: SCN10A; (+) strand; PAM type: NRG; PAM sequence: GAG
ggtggattccagagcatggt

SEQ ID NO: 36526 - DNA, 20 bp, Artificial Sequence
  Description of Artificial Sequence: Synthetic oligonucleotide
  Target: SCN10A; (+) strand; PAM type: NRG; PAM sequence: GAG
tccagagcatggtgagatgt

SEQ ID NO: 36527 - DNA, 20 bp, Artificial Sequence
  Description of Artificial Sequence: Synthetic oligonucleotide
  Target: SCN10A; (+) strand; PAM type: NRG; PAM sequence: AGG
ccagagcatggtgagatgtg

SEQ ID NO: 36528 - DNA, 20 bp, Artificial Sequence
  Description of Artificial Sequence: Synthetic oligonucleotide
  Target: SCN10A; (+) strand; PAM type: NRG; PAM sequence: GAG
agagcatggtgagatgtgag

SEQ ID NO: 36529 - DNA, 20 bp, Artificial Sequence
  Description of Artificial Sequence: Synthetic oligonucleotide
  Target: SCN10A; (+) strand; PAM type: NRG; PAM sequence: GAG
agcatggtgagatgtgagga

SEQ ID NO: 36530 - DNA, 20 bp, Artificial Sequence
  Description of Artificial Sequence: Synthetic oligonucleotide
  Target: SCN10A; (+) strand; PAM type: NRG; PAM sequence: AGG
gcatggtgagatgtgaggag

SEQ ID NO: 36531 - DNA, 20 bp, Artificial Sequence
  Description of Artificial Sequence: Synthetic oligonucleotide
  Target: SCN10A; (+) strand; PAM type: NRG; PAM sequence: GAG
ggtgagatgtgaggagaggt

SEQ ID NO: 36532 - DNA, 20 bp, Artificial Sequence
  Description of Artificial Sequence: Synthetic oligonucleotide
  Target: SCN10A; (+) strand; PAM type: NRG; PAM sequence: GAG
tgagatgtgaggagaggtga

SEQ ID NO: 36533 - DNA, 20 bp, Artificial Sequence
  Description of Artificial Sequence: Synthetic oligonucleotide
  Target: SCN10A; (+) strand; PAM type: NRG; PAM sequence: GAG
tgtgaggagaggtgagagat

SEQ ID NO: 36534 - DNA, 20 bp, Artificial Sequence
  Description of Artificial Sequence: Synthetic oligonucleotide
  Target: SCN10A; (+) strand; PAM type: NRG; PAM sequence: AGG
gtgaggagaggtgagagatg

SEQ ID NO: 36535 - DNA, 20 bp, Artificial Sequence
  Description of Artificial Sequence: Synthetic oligonucleotide
  Target: SCN10A; (+) strand; PAM type: NRG; PAM sequence: CAG
aggagaggtgagagatgagg

SEQ ID NO: 36536 - DNA, 20 bp, Artificial Sequence
  Description of Artificial Sequence: Synthetic oligonucleotide
  Target: SCN10A; (+) strand; PAM type: NRG; PAM sequence: AAG
agaggtgagagatgaggcag

SEQ ID NO: 36537 - DNA, 20 bp, Artificial Sequence
  Description of Artificial Sequence: Synthetic oligonucleotide
  Target: SCN10A; (+) strand; PAM type: NRG; PAM sequence: GAG
aggtgagagatgaggcagaa

SEQ ID NO: 36538 - DNA, 20 bp, Artificial Sequence
  Description of Artificial Sequence: Synthetic oligonucleotide
  Target: SCN10A; (+) strand; PAM type: NRG; PAM sequence: CAG
gagagatgaggcagaagaga

SEQ ID NO: 36539 - DNA, 20 bp, Artificial Sequence
  Description of Artificial Sequence: Synthetic oligonucleotide
  Target: SCN10A; (+) strand; PAM type: NRG; PAM sequence: TGG
atgaggcagaagagacagta

SEQ ID NO: 36540 - DNA, 20 bp, Artificial Sequence
  Description of Artificial Sequence: Synthetic oligonucleotide
  Target: SCN10A; (+) strand; PAM type: NRG; PAM sequence: CAG
ggcagaagagacagtatgga

SEQ ID NO: 36541 - DNA, 20 bp, Artificial Sequence
  Description of Artificial Sequence: Synthetic oligonucleotide
  Target: SCN10A; (+) strand; PAM type: NRG; PAM sequence: CAG
aagagacagtatggacagac

SEQ ID NO: 36542 - DNA, 20 bp, Artificial Sequence
  Description of Artificial Sequence: Synthetic oligonucleotide
  Target: SCN10A; (+) strand; PAM type: NRG; PAM sequence: AGG
agagacagtatggacagacc

SEQ ID NO: 36543 - DNA, 20 bp, Artificial Sequence
  Description of Artificial Sequence: Synthetic oligonucleotide
  Target: SCN10A; (+) strand; PAM type: NRG; PAM sequence: AAG
acagaccaggtcttgcaaat

SEQ ID NO: 36544 - DNA, 20 bp, Artificial Sequence
  Description of Artificial Sequence: Synthetic oligonucleotide
  Target: SCN10A; (+) strand; PAM type: NRG; PAM sequence: CAG
caggtcttgcaaataagact

SEQ ID NO: 36545 - DNA, 20 bp, Artificial Sequence
  Description of Artificial Sequence: Synthetic oligonucleotide
  Target: SCN10A; (+) strand; PAM type: NRG; PAM sequence: AGG
aggtcttgcaaataagactc

SEQ ID NO: 36546 - DNA, 20 bp, Artificial Sequence
  Description of Artificial Sequence: Synthetic oligonucleotide
  Target: SCN10A; (+) strand; PAM type: NRG; PAM sequence: GGG
ggtcttgcaaataagactca

SEQ ID NO: 36547 - DNA, 20 bp, Artificial Sequence
  Description of Artificial Sequence: Synthetic oligonucleotide
  Target: SCN10A; (+) strand; PAM type: NRG; PAM sequence: CAG
aataagactcagggtcttcc

SEQ ID NO: 36548 - DNA, 20 bp, Artificial Sequence
  Description of Artificial Sequence: Synthetic oligonucleotide
  Target: SCN10A; (+) strand; PAM type: NRG; PAM sequence: GAG
gactcagggtcttcccagtt

SEQ ID NO: 36549 - DNA, 20 bp, Artificial Sequence
  Description of Artificial Sequence: Synthetic oligonucleotide
  Target: SCN10A; (+) strand; PAM type: NRG; PAM sequence: GAG
ctcagggtcttcccagttga

SEQ ID NO: 36550 - DNA, 20 bp, Artificial Sequence
  Description of Artificial Sequence: Synthetic oligonucleotide
  Target: SCN10A; (+) strand; PAM type: NRG; PAM sequence: AAG
gggtcttcccagttgagagt

SEQ ID NO: 36551 - DNA, 20 bp, Artificial Sequence
  Description of Artificial Sequence: Synthetic oligonucleotide
  Target: SCN10A; (+) strand; PAM type: NRG; PAM sequence: GAG
cttcccagttgagagtaagt

SEQ ID NO: 36552 - DNA, 20 bp, Artificial Sequence
  Description of Artificial Sequence: Synthetic oligonucleotide
  Target: SCN10A; (+) strand; PAM type: NRG; PAM sequence: GAG
tcccagttgagagtaagtga

SEQ ID NO: 36553 - DNA, 20 bp, Artificial Sequence
  Description of Artificial Sequence: Synthetic oligonucleotide
  Target: SCN10A; (+) strand; PAM type: NRG; PAM sequence: GAG
ccagttgagagtaagtgaga

SEQ ID NO: 36554 - DNA, 20 bp, Artificial Sequence
  Description of Artificial Sequence: Synthetic oligonucleotide
  Target: SCN10A; (+) strand; PAM type: NRG; PAM sequence: AAG
gagtaagtgagagagatatg

SEQ ID NO: 36555 - DNA, 20 bp, Artificial Sequence
  Description of Artificial Sequence: Synthetic oligonucleotide
  Target: SCN10A; (+) strand; PAM type: NRG; PAM sequence: AGG
agtaagtgagagagatatga

SEQ ID NO: 36556 - DNA, 20 bp, Artificial Sequence
  Description of Artificial Sequence: Synthetic oligonucleotide
  Target: SCN10A; (+) strand; PAM type: NRG; PAM sequence: GGG
gtaagtgagagagatatgaa

SEQ ID NO: 36557 - DNA, 20 bp, Artificial Sequence
  Description of Artificial Sequence: Synthetic oligonucleotide
  Target: SCN10A; (+) strand; PAM type: NRG; PAM sequence: GGG
taagtgagagagatatgaag

SEQ ID NO: 36558 - DNA, 20 bp, Artificial Sequence
  Description of Artificial Sequence: Synthetic oligonucleotide
  Target: SCN10A; (+) strand; PAM type: NRG; PAM sequence: CAG
gtgagagagatatgaagggg

SEQ ID NO: 36559 - DNA, 20 bp, Artificial Sequence
  Description of Artificial Sequence: Synthetic oligonucleotide
  Target: SCN10A; (+) strand; PAM type: NRG; PAM sequence: AGG
tgagagagatatgaaggggc

SEQ ID NO: 36560 - DNA, 20 bp, Artificial Sequence
  Description of Artificial Sequence: Synthetic oligonucleotide
  Target: SCN10A; (+) strand; PAM type: NRG; PAM sequence: CAG
gagatatgaaggggcaggac

SEQ ID NO: 36561 - DNA, 20 bp, Artificial Sequence
  Description of Artificial Sequence: Synthetic oligonucleotide
  Target: SCN10A; (+) strand; PAM type: NRG; PAM sequence: AGG
agatatgaaggggcaggacc

SEQ ID NO: 36562 - DNA, 20 bp, Artificial Sequence
  Description of Artificial Sequence: Synthetic oligonucleotide
  Target: SCN10A; (+) strand; PAM type: NRG; PAM sequence: GGG
gatatgaaggggcaggacca

SEQ ID NO: 36563 - DNA, 20 bp, Artificial Sequence
  Description of Artificial Sequence: Synthetic oligonucleotide
  Target: SCN10A; (+) strand; PAM type: NRG; PAM sequence: AAG
gcaggaccagggctctcttc

SEQ ID NO: 36564 - DNA, 20 bp, Artificial Sequence
  Description of Artificial Sequence: Synthetic oligonucleotide
  Target: SCN10A; (+) strand; PAM type: NRG; PAM sequence: GAG
aggaccagggctctcttcaa

SEQ ID NO: 36565 - DNA, 20 bp, Artificial Sequence
  Description of Artificial Sequence: Synthetic oligonucleotide
  Target: SCN10A; (+) strand; PAM type: NRG; PAM sequence: AGG
ggaccagggctctcttcaag

SEQ ID NO: 36566 - DNA, 20 bp, Artificial Sequence
  Description of Artificial Sequence: Synthetic oligonucleotide
  Target: SCN10A; (+) strand; PAM type: NRG; PAM sequence: CAG
ctctcttcaagaggtgtgtc

SEQ ID NO: 36567 - DNA, 20 bp, Artificial Sequence
  Description of Artificial Sequence: Synthetic oligonucleotide
  Target: SCN10A; (+) strand; PAM type: NRG; PAM sequence: TGG
tcttcaagaggtgtgtccag

SEQ ID NO: 36568 - DNA, 20 bp, Artificial Sequence
  Description of Artificial Sequence: Synthetic oligonucleotide
  Target: SCN10A; (+) strand; PAM type: NRG; PAM sequence: GGG
cttcaagaggtgtgtccagt

SEQ ID NO: 36569 - DNA, 20 bp, Artificial Sequence
  Description of Artificial Sequence: Synthetic oligonucleotide
  Target: SCN10A; (+) strand; PAM type: NRG; PAM sequence: TGG
gaggtgtgtccagtgggaat

SEQ ID NO: 36570 - DNA, 20 bp, Artificial Sequence
  Description of Artificial Sequence: Synthetic oligonucleotide
  Target: SCN10A; (+) strand; PAM type: NRG; PAM sequence: CAG
gtgtgtccagtgggaattgg

SEQ ID NO: 36571 - DNA, 20 bp, Artificial Sequence
  Description of Artificial Sequence: Synthetic oligonucleotide
  Target: SCN10A; (+) strand; PAM type: NRG; PAM sequence: GAG
gtgtccagtgggaattggca

SEQ ID NO: 36572 - DNA, 20 bp, Artificial Sequence
  Description of Artificial Sequence: Synthetic oligonucleotide
  Target: SCN10A; (+) strand; PAM type: NRG; PAM sequence: GAG
gtccagtgggaattggcaga

SEQ ID NO: 36573 - DNA, 20 bp, Artificial Sequence
  Description of Artificial Sequence: Synthetic oligonucleotide
  Target: SCN10A; (+) strand; PAM type: NRG; PAM sequence: CAG
gagtttcctatctttccctg

SEQ ID NO: 36574 - DNA, 20 bp, Artificial Sequence
  Description of Artificial Sequence: Synthetic oligonucleotide
  Target: SCN10A; (+) strand; PAM type: NRG; PAM sequence: GAG
gtttcctatctttccctgca

SEQ ID NO: 36575 - DNA, 20 bp, Artificial Sequence
  Description of Artificial Sequence: Synthetic oligonucleotide
  Target: SCN10A; (+) strand; PAM type: NRG; PAM sequence: CAG
cctatctttccctgcagagc

SEQ ID NO: 36576 - DNA, 20 bp, Artificial Sequence
  Description of Artificial Sequence: Synthetic oligonucleotide
  Target: SCN10A; (+) strand; PAM type: NRG; PAM sequence: AAG
ctttccctgcagagccagac

SEQ ID NO: 36577 - DNA, 20 bp, Artificial Sequence
  Description of Artificial Sequence: Synthetic oligonucleotide
  Target: SCN10A; (+) strand; PAM type: NRG; PAM sequence: TGG
ctgcagagccagacaagaaa

SEQ ID NO: 36578 - DNA, 20 bp, Artificial Sequence
  Description of Artificial Sequence: Synthetic oligonucleotide
  Target: SCN10A; (+) strand; PAM type: NRG; PAM sequence: TAG
cagagccagacaagaaatgg

SEQ ID NO: 36579 - DNA, 20 bp, Artificial Sequence
  Description of Artificial Sequence: Synthetic oligonucleotide
  Target: SCN10A; (+) strand; PAM type: NRG; PAM sequence: AAG
ccagacaagaaatggtagaa

SEQ ID NO: 36580 - DNA, 20 bp, Artificial Sequence
  Description of Artificial Sequence: Synthetic oligonucleotide
  Target: SCN10A; (+) strand; PAM type: NRG; PAM sequence: TAG
ggtagaaaagacttccactc

SEQ ID NO: 36581 - DNA, 20 bp, Artificial Sequence
  Description of Artificial Sequence: Synthetic oligonucleotide
  Target: SCN10A; (+) strand; PAM type: NRG; PAM sequence: TGG
aaaagacttccactctagaa

SEQ ID NO: 36582 - DNA, 20 bp, Artificial Sequence
  Description of Artificial Sequence: Synthetic oligonucleotide
  Target: SCN10A; (+) strand; PAM type: NRG; PAM sequence: GGG
aaagacttccactctagaat

SEQ ID NO: 36583 - DNA, 20 bp, Artificial Sequence
  Description of Artificial Sequence: Synthetic oligonucleotide
  Target: SCN10A; (+) strand; PAM type: NRG; PAM sequence: CAG
agaatgggtgtttctgttta

SEQ ID NO: 36584 - DNA, 20 bp, Artificial Sequence
  Description of Artificial Sequence: Synthetic oligonucleotide
  Target: SCN10A; (+) strand; PAM type: NRG; PAM sequence: AAG
gggtgtttctgtttacagat

SEQ ID NO: 36585 - DNA, 20 bp, Artificial Sequence
  Description of Artificial Sequence: Synthetic oligonucleotide
  Target: SCN10A; (+) strand; PAM type: NRG; PAM sequence: GAG
gtgtttctgtttacagataa

SEQ ID NO: 36586 - DNA, 20 bp, Artificial Sequence
  Description of Artificial Sequence: Synthetic oligonucleotide
  Target: SCN10A; (+) strand; PAM type: NRG; PAM sequence: TGG
cagataagagaacgaattct

SEQ ID NO: 36587 - DNA, 20 bp, Artificial Sequence
  Description of Artificial Sequence: Synthetic oligonucleotide
  Target: SCN10A; (+) strand; PAM type: NRG; PAM sequence: GGG
agataagagaacgaattctt

SEQ ID NO: 36588 - DNA, 20 bp, Artificial Sequence
  Description of Artificial Sequence: Synthetic oligonucleotide
  Target: SCN10A; (+) strand; PAM type: NRG; PAM sequence: GGG
gataagagaacgaattcttg

SEQ ID NO: 36589 - DNA, 20 bp, Artificial Sequence
  Description of Artificial Sequence: Synthetic oligonucleotide
  Target: SCN10A; (+) strand; PAM type: NRG; PAM sequence: GAG
agagaacgaattcttggggt

SEQ ID NO: 36590 - DNA, 20 bp, Artificial Sequence
  Description of Artificial Sequence: Synthetic oligonucleotide
  Target: SCN10A; (+) strand; PAM type: NRG; PAM sequence: GAG
agaacgaattcttggggtga

SEQ ID NO: 36591 - DNA, 20 bp, Artificial Sequence
  Description of Artificial Sequence: Synthetic oligonucleotide
  Target: SCN10A; (+) strand; PAM type: NRG; PAM sequence: AGG
gaacgaattcttggggtgag

SEQ ID NO: 36592 - DNA, 20 bp, Artificial Sequence
  Description of Artificial Sequence: Synthetic oligonucleotide
  Target: SCN10A; (+) strand; PAM type: NRG; PAM sequence: GAG
acgaattcttggggtgagag

SEQ ID NO: 36593 - DNA, 20 bp, Artificial Sequence
  Description of Artificial Sequence: Synthetic oligonucleotide
  Target: SCN10A; (+) strand; PAM type: NRG; PAM sequence: GAG
gaattcttggggtgagagga

SEQ ID NO: 36594 - DNA, 20 bp, Artificial Sequence
  Description of Artificial Sequence: Synthetic oligonucleotide
  Target: SCN10A; (+) strand; PAM type: NRG; PAM sequence: CAG
ggtgagaggagagaacctat

SEQ ID NO: 36595 - DNA, 20 bp, Artificial Sequence
  Description of Artificial Sequence: Synthetic oligonucleotide
  Target: SCN10A; (+) strand; PAM type: NRG; PAM sequence: AGG
gtgagaggagagaacctatc

SEQ ID NO: 36596 - DNA, 20 bp, Artificial Sequence
  Description of Artificial Sequence: Synthetic oligonucleotide
  Target: SCN10A; (+) strand; PAM type: NRG; PAM sequence: CAG
ggagagaacctatcaggcca

SEQ ID NO: 36597 - DNA, 20 bp, Artificial Sequence
  Description of Artificial Sequence: Synthetic oligonucleotide
  Target: SCN10A; (+) strand; PAM type: NRG; PAM sequence: GAG
agagaacctatcaggccaca

SEQ ID NO: 36598 - DNA, 20 bp, Artificial Sequence
  Description of Artificial Sequence: Synthetic oligonucleotide
  Target: SCN10A; (+) strand; PAM type: NRG; PAM sequence: AGG
gagaacctatcaggccacag

SEQ ID NO: 36599 - DNA, 20 bp, Artificial Sequence
  Description of Artificial Sequence: Synthetic oligonucleotide
  Target: SCN10A; (+) strand; PAM type: NRG; PAM sequence: GGG
agaacctatcaggccacaga

SEQ ID NO: 36600 - DNA, 20 bp, Artificial Sequence
  Description of Artificial Sequence: Synthetic oligonucleotide
  Target: SCN10A; (+) strand; PAM type: NRG; PAM sequence: GGG
gaacctatcaggccacagag

SEQ ID NO: 36601 - DNA, 20 bp, Artificial Sequence
  Description of Artificial Sequence: Synthetic oligonucleotide
  Target: SCN10A; (+) strand; PAM type: NRG; PAM sequence: AAG
cctatcaggccacagagggg

SEQ ID NO: 36602 - DNA, 20 bp, Artificial Sequence
  Description of Artificial Sequence: Synthetic oligonucleotide
  Target: SCN10A; (+) strand; PAM type: NRG; PAM sequence: AAG
ggccacagaggggaagcatc

SEQ ID NO: 36603 - DNA, 20 bp, Artificial Sequence
  Description of Artificial Sequence: Synthetic oligonucleotide
  Target: SCN10A; (+) strand; PAM type: NRG; PAM sequence: CAG
ggaagcatcaagtcccattt

SEQ ID NO: 36604 - DNA, 20 bp, Artificial Sequence
  Description of Artificial Sequence: Synthetic oligonucleotide
  Target: SCN10A; (+) strand; PAM type: NRG; PAM sequence: AAG
gcatcaagtcccatttcaga

SEQ ID NO: 36605 - DNA, 20 bp, Artificial Sequence
  Description of Artificial Sequence: Synthetic oligonucleotide
  Target: SCN10A; (+) strand; PAM type: NRG; PAM sequence: TGG
cagaaagtttgccttgtctc

SEQ ID NO: 36606 - DNA, 20 bp, Artificial Sequence
  Description of Artificial Sequence: Synthetic oligonucleotide
  Target: SCN10A; (+) strand; PAM type: NRG; PAM sequence: TGG
catcctcaccatcaacctca

SEQ ID NO: 36607 - DNA, 20 bp, Artificial Sequence
  Description of Artificial Sequence: Synthetic oligonucleotide
  Target: SCN10A; (+) strand; PAM type: NRG; PAM sequence: GGG
atcctcaccatcaacctcat

SEQ ID NO: 36608 - DNA, 20 bp, Artificial Sequence
  Description of Artificial Sequence: Synthetic oligonucleotide
  Target: SCN10A; (+) strand; PAM type: NRG; PAM sequence: GGG
tcctcaccatcaacctcatg

SEQ ID NO: 36609 - DNA, 20 bp, Artificial Sequence
  Description of Artificial Sequence: Synthetic oligonucleotide
  Target: SCN10A; (+) strand; PAM type: NRG; PAM sequence: GGG
cctcaccatcaacctcatgg

SEQ ID NO: 36610 - DNA, 20 bp, Artificial Sequence
  Description of Artificial Sequence: Synthetic oligonucleotide
  Target: SCN10A; (+) strand; PAM type: NRG; PAM sequence: AAG
catcaacctcatgggggctg

SEQ ID NO: 36611 - DNA, 20 bp, Artificial Sequence
  Description of Artificial Sequence: Synthetic oligonucleotide
  Target: SCN10A; (+) strand; PAM type: NRG; PAM sequence: GAG
tcaacctcatgggggctgaa

SEQ ID NO: 36612 - DNA, 20 bp, Artificial Sequence
  Description of Artificial Sequence: Synthetic oligonucleotide
  Target: SCN10A; (+) strand; PAM type: NRG; PAM sequence: TAG
acctcatgggggctgaagag

SEQ ID NO: 36613 - DNA, 20 bp, Artificial Sequence
  Description of Artificial Sequence: Synthetic oligonucleotide
  Target: SCN10A; (+) strand; PAM type: NRG; PAM sequence: TGG
gggggctgaagagtagtcgc

SEQ ID NO: 36614 - DNA, 20 bp, Artificial Sequence
  Description of Artificial Sequence: Synthetic oligonucleotide
  Target: SCN10A; (+) strand; PAM type: NRG; PAM sequence: GGG
ggggctgaagagtagtcgct

SEQ ID NO: 36615 - DNA, 20 bp, Artificial Sequence
  Description of Artificial Sequence: Synthetic oligonucleotide
  Target: SCN10A; (+) strand; PAM type: NRG; PAM sequence: TGG
aagagtagtcgctgggctac

SEQ ID NO: 36616 - DNA, 20 bp, Artificial Sequence
  Description of Artificial Sequence: Synthetic oligonucleotide
  Target: SCN10A; (+) strand; PAM type: NRG; PAM sequence: CAG
agtcgctgggctactggtga

SEQ ID NO: 36617 - DNA, 20 bp, Artificial Sequence
  Description of Artificial Sequence: Synthetic oligonucleotide
  Target: SCN10A; (+) strand; PAM type: NRG; PAM sequence: TGG
cgctgggctactggtgacag

SEQ ID NO: 36618 - DNA, 20 bp, Artificial Sequence
  Description of Artificial Sequence: Synthetic oligonucleotide
  Target: SCN10A; (+) strand; PAM type: NRG; PAM sequence: GAG
ctgggctactggtgacagtg

SEQ ID NO: 36619 - DNA, 20 bp, Artificial Sequence
  Description of Artificial Sequence: Synthetic oligonucleotide
  Target: SCN10A; (+) strand; PAM type: NRG; PAM sequence: TAG
actggtgacagtggagatct

SEQ ID NO: 36620 - DNA, 20 bp, Artificial Sequence
  Description of Artificial Sequence: Synthetic oligonucleotide
  Target: SCN10A; (+) strand; PAM type: NRG; PAM sequence: GAG
tggtgacagtggagatctta

SEQ ID NO: 36621 - DNA, 20 bp, Artificial Sequence
  Description of Artificial Sequence: Synthetic oligonucleotide
  Target: SCN10A; (+) strand; PAM type: NRG; PAM sequence: AGG
ggtgacagtggagatcttag

SEQ ID NO: 36622 - DNA, 20 bp, Artificial Sequence
  Description of Artificial Sequence: Synthetic oligonucleotide
  Target: SCN10A; (+) strand; PAM type: NRG; PAM sequence: GAG
tcttagaggccccacacaat

SEQ ID NO: 36623 - DNA, 20 bp, Artificial Sequence
  Description of Artificial Sequence: Synthetic oligonucleotide
  Target: SCN10A; (+) strand; PAM type: NRG; PAM sequence: TGG
ccccacacaatgagctttga

SEQ ID NO: 36624 - DNA, 20 bp, Artificial Sequence
  Description of Artificial Sequence: Synthetic oligonucleotide
  Target: SCN10A; (+) strand; PAM type: NRG; PAM sequence: CAG
tacttttgtttctgaattct

SEQ ID NO: 36625 - DNA, 20 bp, Artificial Sequence
  Description of Artificial Sequence: Synthetic oligonucleotide
  Target: SCN10A; (+) strand; PAM type: NRG; PAM sequence: AAG
tttctgaattctcagtaatc

SEQ ID NO: 36626 - DNA, 20 bp, Artificial Sequence
  Description of Artificial Sequence: Synthetic oligonucleotide
  Target: SCN10A; (+) strand; PAM type: NRG; PAM sequence: TGG
tgcctaattcttttttcctc

SEQ ID NO: 36627 - DNA, 20 bp, Artificial Sequence
  Description of Artificial Sequence: Synthetic oligonucleotide
  Target: SCN10A; (+) strand; PAM type: NRG; PAM sequence: GGG
gcctaattcttttttcctct

SEQ ID NO: 36628 - DNA, 20 bp, Artificial Sequence
  Description of Artificial Sequence: Synthetic oligonucleotide
  Target: SCN10A; (+) strand; PAM type: NRG; PAM sequence: AAG
ttttttcctctgggtgtcta

SEQ ID NO: 36629 - DNA, 20 bp, Artificial Sequence
  Description of Artificial Sequence: Synthetic oligonucleotide
  Target: SCN10A; (+) strand; PAM type: NRG; PAM sequence: CAG
ttcctctgggtgtctaaaga

SEQ ID NO: 36630 - DNA, 20 bp, Artificial Sequence
  Description of Artificial Sequence: Synthetic oligonucleotide
  Target: SCN10A; (+) strand; PAM type: NRG; PAM sequence: AGG
tcctctgggtgtctaaagac

SEQ ID NO: 36631 - DNA, 20 bp, Artificial Sequence
  Description of Artificial Sequence: Synthetic oligonucleotide
  Target: SCN10A; (+) strand; PAM type: NRG; PAM sequence: TAG
ggtgtctaaagacaggattt

SEQ ID NO: 36632 - DNA, 20 bp, Artificial Sequence
  Description of Artificial Sequence: Synthetic oligonucleotide
  Target: SCN10A; (+) strand; PAM type: NRG; PAM sequence: CGG
aagacaggattttagaccta

SEQ ID NO: 36633 - DNA, 20 bp, Artificial Sequence
  Description of Artificial Sequence: Synthetic oligonucleotide
  Target: SCN10A; (+) strand; PAM type: NRG; PAM sequence: CAG
ggattttagacctacggaaa

SEQ ID NO: 36634 - DNA, 20 bp, Artificial Sequence
  Description of Artificial Sequence: Synthetic oligonucleotide
  Target: SCN10A; (+) strand; PAM type: NRG; PAM sequence: AAG
ttagacctacggaaacagtg

SEQ ID NO: 36635 - DNA, 20 bp, Artificial Sequence
  Description of Artificial Sequence: Synthetic oligonucleotide
  Target: SCN10A; (+) strand; PAM type: NRG; PAM sequence: TGG
tacggaaacagtgaagatac

SEQ ID NO: 36636 - DNA, 20 bp, Artificial Sequence
  Description of Artificial Sequence: Synthetic oligonucleotide
  Target: SCN10A; (+) strand; PAM type: NRG; PAM sequence: GGG
acggaaacagtgaagatact

SEQ ID NO: 36637 - DNA, 20 bp, Artificial Sequence
  Description of Artificial Sequence: Synthetic oligonucleotide
  Target: SCN10A; (+) strand; PAM type: NRG; PAM sequence: AAG
ctcccttcctccccatttcc

SEQ ID NO: 36638 - DNA, 20 bp, Artificial Sequence
  Description of Artificial Sequence: Synthetic oligonucleotide
  Target: SCN10A; (+) strand; PAM type: NRG; PAM sequence: TAG
catttccaagtttaatcctt

SEQ ID NO: 36639 - DNA, 20 bp, Artificial Sequence
  Description of Artificial Sequence: Synthetic oligonucleotide
  Target: SCN10A; (+) strand; PAM type: NRG; PAM sequence: AAG
caagtttaatcctttagttt

SEQ ID NO: 36640 - DNA, 20 bp, Artificial Sequence
  Description of Artificial Sequence: Synthetic oligonucleotide
  Target: SCN10A; (+) strand; PAM type: NRG; PAM sequence: AGG
aagtttaatcctttagttta

SEQ ID NO: 36641 - DNA, 20 bp, Artificial Sequence
  Description of Artificial Sequence: Synthetic oligonucleotide
  Target: SCN10A; (+) strand; PAM type: NRG; PAM sequence: GAG
gtataaataaaaattcaact

SEQ ID NO: 36642 - DNA, 20 bp, Artificial Sequence
  Description of Artificial Sequence: Synthetic oligonucleotide
  Target: SCN10A; (+) strand; PAM type: NRG; PAM sequence: AGG
tataaataaaaattcaactg

SEQ ID NO: 36643 - DNA, 20 bp, Artificial Sequence
  Description of Artificial Sequence: Synthetic oligonucleotide
  Target: SCN10A; (+) strand; PAM type: NRG; PAM sequence: GGG
ataaataaaaattcaactga

SEQ ID NO: 36644 - DNA, 20 bp, Artificial Sequence
  Description of Artificial Sequence: Synthetic oligonucleotide
  Target: SCN10A; (+) strand; PAM type: NRG; PAM sequence: GGG
taaataaaaattcaactgag

SEQ ID NO: 36645 - DNA, 20 bp, Artificial Sequence
  Description of Artificial Sequence: Synthetic oligonucleotide
  Target: SCN10A; (+) strand; PAM type: NRG; PAM sequence: CAG
tcttgcctgaatcccacaac

SEQ ID NO: 36646 - DNA, 20 bp, Artificial Sequence
  Description of Artificial Sequence: Synthetic oligonucleotide
  Target: SCN10A; (+) strand; PAM type: NRG; PAM sequence: CAG
cctgaatcccacaaccagaa

SEQ ID NO: 36647 - DNA, 20 bp, Artificial Sequence
  Description of Artificial Sequence: Synthetic oligonucleotide
  Target: SCN10A; (+) strand; PAM type: NRG; PAM sequence: AAG
aatcccacaaccagaacaga

SEQ ID NO: 36648 - DNA, 20 bp, Artificial Sequence
  Description of Artificial Sequence: Synthetic oligonucleotide
  Target: SCN10A; (+) strand; PAM type: NRG; PAM sequence: AAG
cacaaccagaacagaaagtg

SEQ ID NO: 36649 - DNA, 20 bp, Artificial Sequence
  Description of Artificial Sequence: Synthetic oligonucleotide
  Target: SCN10A; (+) strand; PAM type: NRG; PAM sequence: GAG
tcctgttacgtattgattgt

SEQ ID NO: 36650 - DNA, 20 bp, Artificial Sequence
  Description of Artificial Sequence: Synthetic oligonucleotide
  Target: SCN10A; (+) strand; PAM type: NRG; PAM sequence: AGG
cctgttacgtattgattgtg

SEQ ID NO: 36651 - DNA, 20 bp, Artificial Sequence
  Description of Artificial Sequence: Synthetic oligonucleotide
  Target: SCN10A; (+) strand; PAM type: NRG; PAM sequence: TGG
gtattgattgtgaggccatg

SEQ ID NO: 36652 - DNA, 20 bp, Artificial Sequence
  Description of Artificial Sequence: Synthetic oligonucleotide
  Target: SCN10A; (+) strand; PAM type: NRG; PAM sequence: TGG
ttgtgaggccatgtggtatg

SEQ ID NO: 36653 - DNA, 20 bp, Artificial Sequence
  Description of Artificial Sequence: Synthetic oligonucleotide
  Target: SCN10A; (+) strand; PAM type: NRG; PAM sequence: GGG
tgtgaggccatgtggtatgt

SEQ ID NO: 36654 - DNA, 20 bp, Artificial Sequence
  Description of Artificial Sequence: Synthetic oligonucleotide
  Target: SCN10A; (+) strand; PAM type: NRG; PAM sequence: AAG
gaggccatgtggtatgtggg

SEQ ID NO: 36655 - DNA, 20 bp, Artificial Sequence
  Description of Artificial Sequence: Synthetic oligonucleotide
  Target: SCN10A; (+) strand; PAM type: NRG; PAM sequence: GAG
ggccatgtggtatgtgggaa

SEQ ID NO: 36656 - DNA, 20 bp, Artificial Sequence
  Description of Artificial Sequence: Synthetic oligonucleotide
  Target: SCN10A; (+) strand; PAM type: NRG; PAM sequence: TGG
gtggtatgtgggaagagcac

SEQ ID NO: 36657 - DNA, 20 bp, Artificial Sequence
  Description of Artificial Sequence: Synthetic oligonucleotide
  Target: SCN10A; (+) strand; PAM type: NRG; PAM sequence: TAG
atgtgggaagagcactggcc

SEQ ID NO: 36658 - DNA, 20 bp, Artificial Sequence
  Description of Artificial Sequence: Synthetic oligonucleotide
  Target: SCN10A; (+) strand; PAM type: NRG; PAM sequence: AGG
tgtgggaagagcactggcct

SEQ ID NO: 36659 - DNA, 20 bp, Artificial Sequence
  Description of Artificial Sequence: Synthetic oligonucleotide
  Target: SCN10A; (+) strand; PAM type: NRG; PAM sequence: GAG
tgggaagagcactggcctag

SEQ ID NO: 36660 - DNA, 20 bp, Artificial Sequence
  Description of Artificial Sequence: Synthetic oligonucleotide
  Target: SCN10A; (+) strand; PAM type: NRG; PAM sequence: TGG
aagagcactggcctaggagt

SEQ ID NO: 36661 - DNA, 20 bp, Artificial Sequence
  Description of Artificial Sequence: Synthetic oligonucleotide
  Target: SCN10A; (+) strand; PAM type: NRG; PAM sequence: GGG
agagcactggcctaggagtt

SEQ ID NO: 36662 - DNA, 20 bp, Artificial Sequence
  Description of Artificial Sequence: Synthetic oligonucleotide
  Target: SCN10A; (+) strand; PAM type: NRG; PAM sequence: TAG
tggcctaggagttgggacaa

SEQ ID NO: 36663 - DNA, 20 bp, Artificial Sequence
  Description of Artificial Sequence: Synthetic oligonucleotide
  Target: SCN10A; (+) strand; PAM type: NRG; PAM sequence: AGG
ggcctaggagttgggacaat

SEQ ID NO: 36664 - DNA, 20 bp, Artificial Sequence
  Description of Artificial Sequence: Synthetic oligonucleotide
  Target: SCN10A; (+) strand; PAM type: NRG; PAM sequence: CAG
gagttgggacaataggcttc

SEQ ID NO: 36665 - DNA, 20 bp, Artificial Sequence
  Description of Artificial Sequence: Synthetic oligonucleotide
  Target: SCN10A; (+) strand; PAM type: NRG; PAM sequence: AGG
agttgggacaataggcttcc

SEQ ID NO: 36666 - DNA, 20 bp, Artificial Sequence
  Description of Artificial Sequence: Synthetic oligonucleotide
  Target: SCN10A; (+) strand; PAM type: NRG; PAM sequence: TAG
caggtcacactgtctcttac

SEQ ID NO: 36667 - DNA, 20 bp, Artificial Sequence
  Description of Artificial Sequence: Synthetic oligonucleotide
  Target: SCN10A; (+) strand; PAM type: NRG; PAM sequence: AAG
cacactgtctcttactagtg

SEQ ID NO: 36668 - DNA, 20 bp, Artificial Sequence
  Description of Artificial Sequence: Synthetic oligonucleotide
  Target: SCN10A; (+) strand; PAM type: NRG; PAM sequence: GAG
cactgtctcttactagtgaa

SEQ ID NO: 36669 - DNA, 20 bp, Artificial Sequence
  Description of Artificial Sequence: Synthetic oligonucleotide
  Target: SCN10A; (+) strand; PAM type: NRG; PAM sequence: AGG
actgtctcttactagtgaag

SEQ ID NO: 36670 - DNA, 20 bp, Artificial Sequence
  Description of Artificial Sequence: Synthetic oligonucleotide
  Target: SCN10A; (+) strand; PAM type: NRG; PAM sequence: TGG
tcttactagtgaagaggcct

SEQ ID NO: 36671 - DNA, 20 bp, Artificial Sequence
  Description of Artificial Sequence: Synthetic oligonucleotide
  Target: SCN10A; (+) strand; PAM type: NRG; PAM sequence: GGG
cttactagtgaagaggcctt

SEQ ID NO: 36672 - DNA, 20 bp, Artificial Sequence
  Description of Artificial Sequence: Synthetic oligonucleotide
  Target: SCN10A; (+) strand; PAM type: NRG; PAM sequence: CAG
ggtttatgtttcctatactc

SEQ ID NO: 36673 - DNA, 20 bp, Artificial Sequence
  Description of Artificial Sequence: Synthetic oligonucleotide
  Target: SCN10A; (+) strand; PAM type: NRG; PAM sequence: AGG
gtttatgtttcctatactcc

SEQ ID NO: 36674 - DNA, 20 bp, Artificial Sequence
  Description of Artificial Sequence: Synthetic oligonucleotide
  Target: SCN10A; (+) strand; PAM type: NRG; PAM sequence: CAG
gtttcctatactccaggcct

SEQ ID NO: 36675 - DNA, 20 bp, Artificial Sequence
  Description of Artificial Sequence: Synthetic oligonucleotide
  Target: SCN10A; (+) strand; PAM type: NRG; PAM sequence: AAG
cctcagttcctttgtcttgt

SEQ ID NO: 36676 - DNA, 20 bp, Artificial Sequence
  Description of Artificial Sequence: Synthetic oligonucleotide
  Target: SCN10A; (+) strand; PAM type: NRG; PAM sequence: TGG
cagttcctttgtcttgtaag

SEQ ID NO: 36677 - DNA, 20 bp, Artificial Sequence
  Description of Artificial Sequence: Synthetic oligonucleotide
  Target: SCN10A; (+) strand; PAM type: NRG; PAM sequence: GGG
agttcctttgtcttgtaagt

SEQ ID NO: 36678 - DNA, 20 bp, Artificial Sequence
  Description of Artificial Sequence: Synthetic oligonucleotide
  Target: SCN10A; (+) strand; PAM type: NRG; PAM sequence: GGG
gttcctttgtcttgtaagtg

SEQ ID NO: 36679 - DNA, 20 bp, Artificial Sequence
  Description of Artificial Sequence: Synthetic oligonucleotide
  Target: SCN10A; (+) strand; PAM type: NRG; PAM sequence: TAG
tgtcttgtaagtggggacaa

SEQ ID NO: 36680 - DNA, 20 bp, Artificial Sequence
  Description of Artificial Sequence: Synthetic oligonucleotide
  Target: SCN10A; (+) strand; PAM type: NRG; PAM sequence: TGG
ggggacaatagtctttgccc

SEQ ID NO: 36681 - DNA, 20 bp, Artificial Sequence
  Description of Artificial Sequence: Synthetic oligonucleotide
  Target: SCN10A; (+) strand; PAM type: NRG; PAM sequence: CAG
gtctttgccctggaacctta

SEQ ID NO: 36682 - DNA, 20 bp, Artificial Sequence
  Description of Artificial Sequence: Synthetic oligonucleotide
  Target: SCN10A; (+) strand; PAM type: NRG; PAM sequence: AGG
tctttgccctggaaccttac

SEQ ID NO: 36683 - DNA, 20 bp, Artificial Sequence
  Description of Artificial Sequence: Synthetic oligonucleotide
  Target: SCN10A; (+) strand; PAM type: NRG; PAM sequence: GGG
ctttgccctggaaccttaca

SEQ ID NO: 36684 - DNA, 20 bp, Artificial Sequence
  Description of Artificial Sequence: Synthetic oligonucleotide
  Target: SCN10A; (+) strand; PAM type: NRG; PAM sequence: TAG
tacagggttcttgtgaaaat

SEQ ID NO: 36685 - DNA, 20 bp, Artificial Sequence
  Description of Artificial Sequence: Synthetic oligonucleotide
  Target: SCN10A; (+) strand; PAM type: NRG; PAM sequence: GAG
cagggttcttgtgaaaatta

SEQ ID NO: 36686 - DNA, 20 bp, Artificial Sequence
  Description of Artificial Sequence: Synthetic oligonucleotide
  Target: SCN10A; (+) strand; PAM type: NRG; PAM sequence: AAG
ggttcttgtgaaaattagag

SEQ ID NO: 36687 - DNA, 20 bp, Artificial Sequence
  Description of Artificial Sequence: Synthetic oligonucleotide
  Target: SCN10A; (+) strand; PAM type: NRG; PAM sequence: AGG
gttcttgtgaaaattagaga

SEQ ID NO: 36688 - DNA, 20 bp, Artificial Sequence
  Description of Artificial Sequence: Synthetic oligonucleotide
  Target: SCN10A; (+) strand; PAM type: NRG; PAM sequence: GGG
ttcttgtgaaaattagagaa

SEQ ID NO: 36689 - DNA, 20 bp, Artificial Sequence
  Description of Artificial Sequence: Synthetic oligonucleotide
  Target: SCN10A; (+) strand; PAM type: NRG; PAM sequence: GAG
cttgtgaaaattagagaagg

SEQ ID NO: 36690 - DNA, 20 bp, Artificial Sequence
  Description of Artificial Sequence: Synthetic oligonucleotide
  Target: SCN10A; (+) strand; PAM type: NRG; PAM sequence: TAG
tgaaaattagagaagggagt

SEQ ID NO: 36691 - DNA, 20 bp, Artificial Sequence
  Description of Artificial Sequence: Synthetic oligonucleotide
  Target: SCN10A; (+) strand; PAM type: NRG; PAM sequence: AGG
gaaaattagagaagggagtt

SEQ ID NO: 36692 - DNA, 20 bp, Artificial Sequence
  Description of Artificial Sequence: Synthetic oligonucleotide
  Target: SCN10A; (+) strand; PAM type: NRG; PAM sequence: TGG
tctgtgaataaatgctcacc

SEQ ID NO: 36693 - DNA, 20 bp, Artificial Sequence
  Description of Artificial Sequence: Synthetic oligonucleotide
  Target: SCN10A; (+) strand; PAM type: NRG; PAM sequence: GGG
ctgtgaataaatgctcacct

SEQ ID NO: 36694 - DNA, 20 bp, Artificial Sequence
  Description of Artificial Sequence: Synthetic oligonucleotide
  Target: SCN10A; (+) strand; PAM type: NRG; PAM sequence: CAG
taaatgctcacctgggatca

SEQ ID NO: 36695 - DNA, 20 bp, Artificial Sequence
  Description of Artificial Sequence: Synthetic oligonucleotide
  Target: SCN10A; (+) strand; PAM type: NRG; PAM sequence: AAG
gaaactgtttttaatgctct

SEQ ID NO: 36696 - DNA, 20 bp, Artificial Sequence
  Description of Artificial Sequence: Synthetic oligonucleotide
  Target: SCN10A; (+) strand; PAM type: NRG; PAM sequence: CAG
ctaagaactctgaatgtccg

SEQ ID NO: 36697 - DNA, 20 bp, Artificial Sequence
  Description of Artificial Sequence: Synthetic oligonucleotide
  Target: SCN10A; (+) strand; PAM type: NRG; PAM sequence: AGG
taagaactctgaatgtccgc

SEQ ID NO: 36698 - DNA, 20 bp, Artificial Sequence
  Description of Artificial Sequence: Synthetic oligonucleotide
  Target: SCN10A; (+) strand; PAM type: NRG; PAM sequence: GAG
ctctgaatgtccgcaggcct

SEQ ID NO: 36699 - DNA, 20 bp, Artificial Sequence
  Description of Artificial Sequence: Synthetic oligonucleotide
  Target: SCN10A; (+) strand; PAM type: NRG; PAM sequence: CGG
tccgcaggcctgagatccca

SEQ ID NO: 36700 - DNA, 20 bp, Artificial Sequence
  Description of Artificial Sequence: Synthetic oligonucleotide
  Target: SCN10A; (+) strand; PAM type: NRG; PAM sequence: GAG
cgcaggcctgagatcccacg

SEQ ID NO: 36701 - DNA, 20 bp, Artificial Sequence
  Description of Artificial Sequence: Synthetic oligonucleotide
  Target: SCN10A; (+) strand; PAM type: NRG; PAM sequence: TAG
ttgctgtgccaacatatctg

SEQ ID NO: 36702 - DNA, 20 bp, Artificial Sequence
  Description of Artificial Sequence: Synthetic oligonucleotide
  Target: SCN10A; (+) strand; PAM type: NRG; PAM sequence: AGG
tgctgtgccaacatatctgt

SEQ ID NO: 36703 - DNA, 20 bp, Artificial Sequence
  Description of Artificial Sequence: Synthetic oligonucleotide
  Target: SCN10A; (+) strand; PAM type: NRG; PAM sequence: CAG
tgccaacatatctgtaggac

SEQ ID NO: 36704 - DNA, 20 bp, Artificial Sequence
  Description of Artificial Sequence: Synthetic oligonucleotide
  Target: SCN10A; (+) strand; PAM type: NRG; PAM sequence: AAG
caacatatctgtaggaccag

SEQ ID NO: 36705 - DNA, 20 bp, Artificial Sequence
  Description of Artificial Sequence: Synthetic oligonucleotide
  Target: SCN10A; (+) strand; PAM type: NRG; PAM sequence: TAG
atatctgtaggaccagaagt

SEQ ID NO: 36706 - DNA, 20 bp, Artificial Sequence
  Description of Artificial Sequence: Synthetic oligonucleotide
  Target: SCN10A; (+) strand; PAM type: NRG; PAM sequence: CAG
ctgtaggaccagaagttagt

SEQ ID NO: 36707 - DNA, 20 bp, Artificial Sequence
  Description of Artificial Sequence: Synthetic oligonucleotide
  Target: SCN10A; (+) strand; PAM type: NRG; PAM sequence: AAG
aagttagtcagcatctctgc

SEQ ID NO: 36708 - DNA, 20 bp, Artificial Sequence
  Description of Artificial Sequence: Synthetic oligonucleotide
  Target: SCN10A; (+) strand; PAM type: NRG; PAM sequence: AAG
tagtcagcatctctgcaagc

SEQ ID NO: 36709 - DNA, 20 bp, Artificial Sequence
  Description of Artificial Sequence: Synthetic oligonucleotide
  Target: SCN10A; (+) strand; PAM type: NRG; PAM sequence: AGG
agtcagcatctctgcaagca

SEQ ID NO: 36710 - DNA, 20 bp, Artificial Sequence
  Description of Artificial Sequence: Synthetic oligonucleotide
  Target: SCN10A; (+) strand; PAM type: NRG; PAM sequence: GGG
gtcagcatctctgcaagcaa

SEQ ID NO: 36711 - DNA, 20 bp, Artificial Sequence
  Description of Artificial Sequence: Synthetic oligonucleotide
  Target: SCN10A; (+) strand; PAM type: NRG; PAM sequence: TGG
atctctgcaagcaagggtcc

SEQ ID NO: 36712 - DNA, 20 bp, Artificial Sequence
  Description of Artificial Sequence: Synthetic oligonucleotide
  Target: SCN10A; (+) strand; PAM type: NRG; PAM sequence: GGG
tctctgcaagcaagggtcct

SEQ ID NO: 36713 - DNA, 20 bp, Artificial Sequence
  Description of Artificial Sequence: Synthetic oligonucleotide
  Target: SCN10A; (+) strand; PAM type: NRG; PAM sequence: GGG
ctctgcaagcaagggtcctg

SEQ ID NO: 36714 - DNA, 20 bp, Artificial Sequence
  Description of Artificial Sequence: Synthetic oligonucleotide
  Target: SCN10A; (+) strand; PAM type: NRG; PAM sequence: CAG
aagggtcctggggatgcatg

SEQ ID NO: 36715 - DNA, 20 bp, Artificial Sequence
  Description of Artificial Sequence: Synthetic oligonucleotide
  Target: SCN10A; (+) strand; PAM type: NRG; PAM sequence: AAG
gggatgcatgcagcataaat

SEQ ID NO: 36716 - DNA, 20 bp, Artificial Sequence
  Description of Artificial Sequence: Synthetic oligonucleotide
  Target: SCN10A; (+) strand; PAM type: NRG; PAM sequence: AGG
ggatgcatgcagcataaata

SEQ ID NO: 36717 - DNA, 20 bp, Artificial Sequence
  Description of Artificial Sequence: Synthetic oligonucleotide
  Target: SCN10A; (+) strand; PAM type: NRG; PAM sequence: TGG
cagcataaataaggataacc

SEQ ID NO: 36718 - DNA, 20 bp, Artificial Sequence
  Description of Artificial Sequence: Synthetic oligonucleotide
  Target: SCN10A; (+) strand; PAM type: NRG; PAM sequence: GGG
agcataaataaggataacct

SEQ ID NO: 36719 - DNA, 20 bp, Artificial Sequence
  Description of Artificial Sequence: Synthetic oligonucleotide
  Target: SCN10A; (+) strand; PAM type: NRG; PAM sequence: GGG
gcataaataaggataacctg

SEQ ID NO: 36720 - DNA, 20 bp, Artificial Sequence
  Description of Artificial Sequence: Synthetic oligonucleotide
  Target: SCN10A; (+) strand; PAM type: NRG; PAM sequence: TAG
aggataacctggggtatcat

SEQ ID NO: 36721 - DNA, 20 bp, Artificial Sequence
  Description of Artificial Sequence: Synthetic oligonucleotide
  Target: SCN10A; (+) strand; PAM type: NRG; PAM sequence: TAG
aacctggggtatcattagcc

SEQ ID NO: 36722 - DNA, 20 bp, Artificial Sequence
  Description of Artificial Sequence: Synthetic oligonucleotide
  Target: SCN10A; (+) strand; PAM type: NRG; PAM sequence: AAG
tggggtatcattagcctaga

SEQ ID NO: 36723 - DNA, 20 bp, Artificial Sequence
  Description of Artificial Sequence: Synthetic oligonucleotide
  Target: SCN10A; (+) strand; PAM type: NRG; PAM sequence: AGG
ggggtatcattagcctagaa

SEQ ID NO: 36724 - DNA, 20 bp, Artificial Sequence
  Description of Artificial Sequence: Synthetic oligonucleotide
  Target: SCN10A; (+) strand; PAM type: NRG; PAM sequence: CAG
tcattagcctagaaaggatg

SEQ ID NO: 36725 - DNA, 20 bp, Artificial Sequence
  Description of Artificial Sequence: Synthetic oligonucleotide
  Target: SCN10A; (+) strand; PAM type: NRG; PAM sequence: TGG
agcctagaaaggatgcagaa

SEQ ID NO: 36726 - DNA, 20 bp, Artificial Sequence
  Description of Artificial Sequence: Synthetic oligonucleotide
  Target: SCN10A; (+) strand; PAM type: NRG; PAM sequence: TAG
aaggatgcagaatggacact

SEQ ID NO: 36727 - DNA, 20 bp, Artificial Sequence
  Description of Artificial Sequence: Synthetic oligonucleotide
  Target: SCN10A; (+) strand; PAM type: NRG; PAM sequence: TAG
cagaatggacacttagaatc

SEQ ID NO: 36728 - DNA, 20 bp, Artificial Sequence
  Description of Artificial Sequence: Synthetic oligonucleotide
  Target: SCN10A; (+) strand; PAM type: NRG; PAM sequence: TAG
tctagtgacactgccatcta

SEQ ID NO: 36729 - DNA, 20 bp, Artificial Sequence
  Description of Artificial Sequence: Synthetic oligonucleotide
  Target: SCN10A; (+) strand; PAM type: NRG; PAM sequence: CAG
ttcattattgcaacatcttt

SEQ ID NO: 36730 - DNA, 20 bp, Artificial Sequence
  Description of Artificial Sequence: Synthetic oligonucleotide
  Target: SCN10A; (+) strand; PAM type: NRG; PAM sequence: GAG
cattattgcaacatctttca

SEQ ID NO: 36731 - DNA, 20 bp, Artificial Sequence
  Description of Artificial Sequence: Synthetic oligonucleotide
  Target: SCN10A; (+) strand; PAM type: NRG; PAM sequence: TGG
tattgcaacatctttcagag

SEQ ID NO: 36732 - DNA, 20 bp, Artificial Sequence
  Description of Artificial Sequence: Synthetic oligonucleotide
  Target: SCN10A; (+) strand; PAM type: NRG; PAM sequence: GAG
tctttcagagtggacccttt

SEQ ID NO: 36733 - DNA, 20 bp, Artificial Sequence
  Description of Artificial Sequence: Synthetic oligonucleotide
  Target: SCN10A; (+) strand; PAM type: NRG; PAM sequence: AAG
ttcagagtggaccctttgag

SEQ ID NO: 36734 - DNA, 20 bp, Artificial Sequence
  Description of Artificial Sequence: Synthetic oligonucleotide
  Target: SCN10A; (+) strand; PAM type: NRG; PAM sequence: TAG
tgagaagatgcattgtgatc

SEQ ID NO: 36735 - DNA, 20 bp, Artificial Sequence
  Description of Artificial Sequence: Synthetic oligonucleotide
  Target: SCN10A; (+) strand; PAM type: NRG; PAM sequence: AGG
gagaagatgcattgtgatct

SEQ ID NO: 36736 - DNA, 20 bp, Artificial Sequence
  Description of Artificial Sequence: Synthetic oligonucleotide
  Target: SCN10A; (+) strand; PAM type: NRG; PAM sequence: TGG
gatctaggcaacactgcatg

SEQ ID NO: 36737 - DNA, 20 bp, Artificial Sequence
  Description of Artificial Sequence: Synthetic oligonucleotide
  Target: SCN10A; (+) strand; PAM type: NRG; PAM sequence: CGG
taggcaacactgcatgtgga

SEQ ID NO: 36738 - DNA, 20 bp, Artificial Sequence
  Description of Artificial Sequence: Synthetic oligonucleotide
  Target: SCN10A; (+) strand; PAM type: NRG; PAM sequence: CAG
tgtggacggatcttcaaaca

SEQ ID NO: 36739 - DNA, 20 bp, Artificial Sequence
  Description of Artificial Sequence: Synthetic oligonucleotide
  Target: SCN10A; (+) strand; PAM type: NRG; PAM sequence: AGG
gtggacggatcttcaaacac

SEQ ID NO: 36740 - DNA, 20 bp, Artificial Sequence
  Description of Artificial Sequence: Synthetic oligonucleotide
  Target: SCN10A; (+) strand; PAM type: NRG; PAM sequence: GAG
ggacggatcttcaaacacag

SEQ ID NO: 36741 - DNA, 20 bp, Artificial Sequence
  Description of Artificial Sequence: Synthetic oligonucleotide
  Target: SCN10A; (+) strand; PAM type: NRG; PAM sequence: CAG
aacacaggagtttgaccaac

SEQ ID NO: 36742 - DNA, 20 bp, Artificial Sequence
  Description of Artificial Sequence: Synthetic oligonucleotide
  Target: SCN10A; (+) strand; PAM type: NRG; PAM sequence: CAG
gtttgaccaaccagtctcct

SEQ ID NO: 36743 - DNA, 20 bp, Artificial Sequence
  Description of Artificial Sequence: Synthetic oligonucleotide
  Target: SCN10A; (+) strand; PAM type: NRG; PAM sequence: CAG
ctcctcagacactgatttct

SEQ ID NO: 36744 - DNA, 20 bp, Artificial Sequence
  Description of Artificial Sequence: Synthetic oligonucleotide
  Target: SCN10A; (+) strand; PAM type: NRG; PAM sequence: AAG
ctcagacactgatttctcag

SEQ ID NO: 36745 - DNA, 20 bp, Artificial Sequence
  Description of Artificial Sequence: Synthetic oligonucleotide
  Target: SCN10A; (+) strand; PAM type: NRG; PAM sequence: AGG
tcagacactgatttctcaga

SEQ ID NO: 36746 - DNA, 20 bp, Artificial Sequence
  Description of Artificial Sequence: Synthetic oligonucleotide
  Target: SCN10A; (+) strand; PAM type: NRG; PAM sequence: GAG
agacactgatttctcagaag

SEQ ID NO: 36747 - DNA, 20 bp, Artificial Sequence
  Description of Artificial Sequence: Synthetic oligonucleotide
  Target: SCN10A; (+) strand; PAM type: NRG; PAM sequence: CAG
tcagaaggagaccgccatgt

SEQ ID NO: 36748 - DNA, 20 bp, Artificial Sequence
  Description of Artificial Sequence: Synthetic oligonucleotide
  Target: SCN10A; (+) strand; PAM type: NRG; PAM sequence: AGG
cagaaggagaccgccatgtc

SEQ ID NO: 36749 - DNA, 20 bp, Artificial Sequence
  Description of Artificial Sequence: Synthetic oligonucleotide
  Target: SCN10A; (+) strand; PAM type: NRG; PAM sequence: GGG
agaaggagaccgccatgtca

SEQ ID NO: 36750 - DNA, 20 bp, Artificial Sequence
  Description of Artificial Sequence: Synthetic oligonucleotide
  Target: SCN10A; (+) strand; PAM type: NRG; PAM sequence: GGG
gaaggagaccgccatgtcag

SEQ ID NO: 36751 - DNA, 20 bp, Artificial Sequence
  Description of Artificial Sequence: Synthetic oligonucleotide
  Target: SCN10A; (+) strand; PAM type: NRG; PAM sequence: GGG
aaggagaccgccatgtcagg

SEQ ID NO: 36752 - DNA, 20 bp, Artificial Sequence
  Description of Artificial Sequence: Synthetic oligonucleotide
  Target: SCN10A; (+) strand; PAM type: NRG; PAM sequence: GGG
aggagaccgccatgtcaggg

SEQ ID NO: 36753 - DNA, 20 bp, Artificial Sequence
  Description of Artificial Sequence: Synthetic oligonucleotide
  Target: SCN10A; (+) strand; PAM type: NRG; PAM sequence: AAG
ccgccatgtcaggggggtac

SEQ ID NO: 36754 - DNA, 20 bp, Artificial Sequence
  Description of Artificial Sequence: Synthetic oligonucleotide
  Target: SCN10A; (+) strand; PAM type: NRG; PAM sequence: AGG
cgccatgtcaggggggtaca

SEQ ID NO: 36755 - DNA, 20 bp, Artificial Sequence
  Description of Artificial Sequence: Synthetic oligonucleotide
  Target: SCN10A; (+) strand; PAM type: NRG; PAM sequence: TGG
atgtcaggggggtacaaggc

SEQ ID NO: 36756 - DNA, 20 bp, Artificial Sequence
  Description of Artificial Sequence: Synthetic oligonucleotide
  Target: SCN10A; (+) strand; PAM type: NRG; PAM sequence: GGG
tgtcaggggggtacaaggct

SEQ ID NO: 36757 - DNA, 20 bp, Artificial Sequence
  Description of Artificial Sequence: Synthetic oligonucleotide
  Target: SCN10A; (+) strand; PAM type: NRG; PAM sequence: CAG
ccttttctgatccactgtga

SEQ ID NO: 36758 - DNA, 20 bp, Artificial Sequence
  Description of Artificial Sequence: Synthetic oligonucleotide
  Target: SCN10A; (+) strand; PAM type: NRG; PAM sequence: AGG
cttttctgatccactgtgac

SEQ ID NO: 36759 - DNA, 20 bp, Artificial Sequence
  Description of Artificial Sequence: Synthetic oligonucleotide
  Target: SCN10A; (+) strand; PAM type: NRG; PAM sequence: CAG
tgacaggctaactgttatct

SEQ ID NO: 36760 - DNA, 20 bp, Artificial Sequence
  Description of Artificial Sequence: Synthetic oligonucleotide
  Target: SCN10A; (+) strand; PAM type: NRG; PAM sequence: GAG
ctaactgttatctcagattt

SEQ ID NO: 36761 - DNA, 20 bp, Artificial Sequence
  Description of Artificial Sequence: Synthetic oligonucleotide
  Target: SCN10A; (+) strand; PAM type: NRG; PAM sequence: AGG
taactgttatctcagatttg

SEQ ID NO: 36762 - DNA, 20 bp, Artificial Sequence
  Description of Artificial Sequence: Synthetic oligonucleotide
  Target: SCN10A; (+) strand; PAM type: NRG; PAM sequence: TGG
aggtctctgacatctcctca

SEQ ID NO: 36763 - DNA, 20 bp, Artificial Sequence
  Description of Artificial Sequence: Synthetic oligonucleotide
  Target: SCN10A; (+) strand; PAM type: NRG; PAM sequence: GGG
ggtctctgacatctcctcat

SEQ ID NO: 36764 - DNA, 20 bp, Artificial Sequence
  Description of Artificial Sequence: Synthetic oligonucleotide
  Target: SCN10A; (+) strand; PAM type: NRG; PAM sequence: TGG
ctgacatctcctcatgggca

SEQ ID NO: 36765 - DNA, 20 bp, Artificial Sequence
  Description of Artificial Sequence: Synthetic oligonucleotide
  Target: SCN10A; (+) strand; PAM type: NRG; PAM sequence: GGG
tgacatctcctcatgggcat

SEQ ID NO: 36766 - DNA, 20 bp, Artificial Sequence
  Description of Artificial Sequence: Synthetic oligonucleotide
  Target: SCN10A; (+) strand; PAM type: NRG; PAM sequence: TGG
catgggcatgggactaatct

SEQ ID NO: 36767 - DNA, 20 bp, Artificial Sequence
  Description of Artificial Sequence: Synthetic oligonucleotide
  Target: SCN10A; (+) strand; PAM type: NRG; PAM sequence: AAG
ggcatgggactaatcttgga

SEQ ID NO: 36768 - DNA, 20 bp, Artificial Sequence
  Description of Artificial Sequence: Synthetic oligonucleotide
  Target: SCN10A; (+) strand; PAM type: NRG; PAM sequence: AAG
atcttggaaagcaacccccg

SEQ ID NO: 36769 - DNA, 20 bp, Artificial Sequence
  Description of Artificial Sequence: Synthetic oligonucleotide
  Target: SCN10A; (+) strand; PAM type: NRG; PAM sequence: CGG
ttggaaagcaacccccgaag

SEQ ID NO: 36770 - DNA, 20 bp, Artificial Sequence
  Description of Artificial Sequence: Synthetic oligonucleotide
  Target: SCN10A; (+) strand; PAM type: NRG; PAM sequence: TGG
acccccgaagcggtactctg

SEQ ID NO: 36771 - DNA, 20 bp, Artificial Sequence
  Description of Artificial Sequence: Synthetic oligonucleotide
  Target: SCN10A; (+) strand; PAM type: NRG; PAM sequence: AAG
ccgaagcggtactctgtggc

SEQ ID NO: 36772 - DNA, 20 bp, Artificial Sequence
  Description of Artificial Sequence: Synthetic oligonucleotide
  Target: SCN10A; (+) strand; PAM type: NRG; PAM sequence: CAG
gtactctgtggcaagaaccc

SEQ ID NO: 36773 - DNA, 20 bp, Artificial Sequence
  Description of Artificial Sequence: Synthetic oligonucleotide
  Target: SCN10A; (+) strand; PAM type: NRG; PAM sequence: AGG
tactctgtggcaagaacccc

SEQ ID NO: 36774 - DNA, 20 bp, Artificial Sequence
  Description of Artificial Sequence: Synthetic oligonucleotide
  Target: SCN10A; (+) strand; PAM type: NRG; PAM sequence: GAG
caggccatacaattccaaat

SEQ ID NO: 36775 - DNA, 20 bp, Artificial Sequence
  Description of Artificial Sequence: Synthetic oligonucleotide
  Target: SCN10A; (+) strand; PAM type: NRG; PAM sequence: AGG
aggccatacaattccaaatg

SEQ ID NO: 36776 - DNA, 20 bp, Artificial Sequence
  Description of Artificial Sequence: Synthetic oligonucleotide
  Target: SCN10A; (+) strand; PAM type: NRG; PAM sequence: AAG
ccatacaattccaaatgagg

SEQ ID NO: 36777 - DNA, 20 bp, Artificial Sequence
  Description of Artificial Sequence: Synthetic oligonucleotide
  Target: SCN10A; (+) strand; PAM type: NRG; PAM sequence: GAG
ccaaatgaggaagctgaact

SEQ ID NO: 36778 - DNA, 20 bp, Artificial Sequence
  Description of Artificial Sequence: Synthetic oligonucleotide
  Target: SCN10A; (+) strand; PAM type: NRG; PAM sequence: AAG
gaggaagctgaactgagatg

SEQ ID NO: 36779 - DNA, 20 bp, Artificial Sequence
  Description of Artificial Sequence: Synthetic oligonucleotide
  Target: SCN10A; (+) strand; PAM type: NRG; PAM sequence: CAG
ctgagatgaagaaccttctt

SEQ ID NO: 36780 - DNA, 20 bp, Artificial Sequence
  Description of Artificial Sequence: Synthetic oligonucleotide
  Target: SCN10A; (+) strand; PAM type: NRG; PAM sequence: GAG
gagatgaagaaccttcttca

SEQ ID NO: 36781 - DNA, 20 bp, Artificial Sequence
  Description of Artificial Sequence: Synthetic oligonucleotide
  Target: SCN10A; (+) strand; PAM type: NRG; PAM sequence: GAG
aagaaccttcttcagagtgt

SEQ ID NO: 36782 - DNA, 20 bp, Artificial Sequence
  Description of Artificial Sequence: Synthetic oligonucleotide
  Target: SCN10A; (+) strand; PAM type: NRG; PAM sequence: TGG
ccttcttcagagtgtgagcc

SEQ ID NO: 36783 - DNA, 20 bp, Artificial Sequence
  Description of Artificial Sequence: Synthetic oligonucleotide
  Target: SCN10A; (+) strand; PAM type: NRG; PAM sequence: AAG
gtgagcctggatacacccat

SEQ ID NO: 36784 - DNA, 20 bp, Artificial Sequence
  Description of Artificial Sequence: Synthetic oligonucleotide
  Target: SCN10A; (+) strand; PAM type: NRG; PAM sequence: TGG
atacacccataagccccaca

SEQ ID NO: 36785 - DNA, 20 bp, Artificial Sequence
  Description of Artificial Sequence: Synthetic oligonucleotide
  Target: SCN10A; (+) strand; PAM type: NRG; PAM sequence: TAG
tttattttattttatttcaa

SEQ ID NO: 36786 - DNA, 20 bp, Artificial Sequence
  Description of Artificial Sequence: Synthetic oligonucleotide
  Target: SCN10A; (+) strand; PAM type: NRG; PAM sequence: GAG
tattttatttcaatagtttt

SEQ ID NO: 36787 - DNA, 20 bp, Artificial Sequence
  Description of Artificial Sequence: Synthetic oligonucleotide
  Target: SCN10A; (+) strand; PAM type: NRG; PAM sequence: AGG
attttatttcaatagttttg

SEQ ID NO: 36788 - DNA, 20 bp, Artificial Sequence
  Description of Artificial Sequence: Synthetic oligonucleotide
  Target: SCN10A; (+) strand; PAM type: NRG; PAM sequence: GGG
ttttatttcaatagttttga

SEQ ID NO: 36789 - DNA, 20 bp, Artificial Sequence
  Description of Artificial Sequence: Synthetic oligonucleotide
  Target: SCN10A; (+) strand; PAM type: NRG; PAM sequence: CAG
tttcaatagttttgagggaa

SEQ ID NO: 36790 - DNA, 20 bp, Artificial Sequence
  Description of Artificial Sequence: Synthetic oligonucleotide
  Target: SCN10A; (+) strand; PAM type: NRG; PAM sequence: AGG
ttcaatagttttgagggaac

SEQ ID NO: 36791 - DNA, 20 bp, Artificial Sequence
  Description of Artificial Sequence: Synthetic oligonucleotide
  Target: SCN10A; (+) strand; PAM type: NRG; PAM sequence: TGG
aatagttttgagggaacagg

SEQ ID NO: 36792 - DNA, 20 bp, Artificial Sequence
  Description of Artificial Sequence: Synthetic oligonucleotide
  Target: SCN10A; (+) strand; PAM type: NRG; PAM sequence: TGG
ttgagggaacaggtggtttt

SEQ ID NO: 36793 - DNA, 20 bp, Artificial Sequence
  Description of Artificial Sequence: Synthetic oligonucleotide
  Target: SCN10A; (+) strand; PAM type: NRG; PAM sequence: AAG
tggtttttggttacatgaat

SEQ ID NO: 36794 - DNA, 20 bp, Artificial Sequence
  Description of Artificial Sequence: Synthetic oligonucleotide
  Target: SCN10A; (+) strand; PAM type: NRG; PAM sequence: TAG
gttctttatttgtatttcaa

SEQ ID NO: 36795 - DNA, 20 bp, Artificial Sequence
  Description of Artificial Sequence: Synthetic oligonucleotide
  Target: SCN10A; (+) strand; PAM type: NRG; PAM sequence: TGG
tatttgtatttcaatagttt

SEQ ID NO: 36796 - DNA, 20 bp, Artificial Sequence
  Description of Artificial Sequence: Synthetic oligonucleotide
  Target: SCN10A; (+) strand; PAM type: NRG; PAM sequence: GGG
atttgtatttcaatagtttt

SEQ ID NO: 36797 - DNA, 20 bp, Artificial Sequence
  Description of Artificial Sequence: Synthetic oligonucleotide
  Target: SCN10A; (+) strand; PAM type: NRG; PAM sequence: CAG
atttcaatagttttgggaaa

SEQ ID NO: 36798 - DNA, 20 bp, Artificial Sequence
  Description of Artificial Sequence: Synthetic oligonucleotide
  Target: SCN10A; (+) strand; PAM type: NRG; PAM sequence: AGG
tttcaatagttttgggaaac

SEQ ID NO: 36799 - DNA, 20 bp, Artificial Sequence
  Description of Artificial Sequence: Synthetic oligonucleotide
  Target: SCN10A; (+) strand; PAM type: NRG; PAM sequence: TGG
caatagttttgggaaacagg

SEQ ID NO: 36800 - DNA, 20 bp, Artificial Sequence
  Description of Artificial Sequence: Synthetic oligonucleotide
  Target: SCN10A; (+) strand; PAM type: NRG; PAM sequence: TGG
ttttgggaaacaggtggtgt

SEQ ID NO: 36801 - DNA, 20 bp, Artificial Sequence
  Description of Artificial Sequence: Synthetic oligonucleotide
  Target: SCN10A; (+) strand; PAM type: NRG; PAM sequence: GGG
tttgggaaacaggtggtgtt

SEQ ID NO: 36802 - DNA, 20 bp, Artificial Sequence
  Description of Artificial Sequence: Synthetic oligonucleotide
  Target: SCN10A; (+) strand; PAM type: NRG; PAM sequence: CAG
acaggtggtgttgggttgca

SEQ ID NO: 36803 - DNA, 20 bp, Artificial Sequence
  Description of Artificial Sequence: Synthetic oligonucleotide
  Target: SCN10A; (+) strand; PAM type: NRG; PAM sequence: GAG
attctttaacgctgatttct

SEQ ID NO: 36804 - DNA, 20 bp, Artificial Sequence
  Description of Artificial Sequence: Synthetic oligonucleotide
  Target: SCN10A; (+) strand; PAM type: NRG; PAM sequence: TGG
aacgctgatttctgagattt

SEQ ID NO: 36805 - DNA, 20 bp, Artificial Sequence
  Description of Artificial Sequence: Synthetic oligonucleotide
  Target: SCN10A; (+) strand; PAM type: NRG; PAM sequence: GAG
attttggtgcaccatcaccc

SEQ ID NO: 36806 - DNA, 20 bp, Artificial Sequence
  Description of Artificial Sequence: Synthetic oligonucleotide
  Target: SCN10A; (+) strand; PAM type: NRG; PAM sequence: CAG
ttggtgcaccatcacccgag

SEQ ID NO: 36807 - DNA, 20 bp, Artificial Sequence
  Description of Artificial Sequence: Synthetic oligonucleotide
  Target: SCN10A; (+) strand; PAM type: NRG; PAM sequence: CAG
cgagcagtgtacactgtacc

SEQ ID NO: 36808 - DNA, 20 bp, Artificial Sequence
  Description of Artificial Sequence: Synthetic oligonucleotide
  Target: SCN10A; (+) strand; PAM type: NRG; PAM sequence: TAG
tgtacactgtacccagtgtg

SEQ ID NO: 36809 - DNA, 20 bp, Artificial Sequence
  Description of Artificial Sequence: Synthetic oligonucleotide
  Target: SCN10A; (+) strand; PAM type: NRG; PAM sequence: AAG
ttcgtctcacctttcctccc

SEQ ID NO: 36810 - DNA, 20 bp, Artificial Sequence
  Description of Artificial Sequence: Synthetic oligonucleotide
  Target: SCN10A; (+) strand; PAM type: NRG; PAM sequence: AAG
cctttcctcccaagtcccca

SEQ ID NO: 36811 - DNA, 20 bp, Artificial Sequence
  Description of Artificial Sequence: Synthetic oligonucleotide
  Target: SCN10A; (+) strand; PAM type: NRG; PAM sequence: CAG
gttatgcctttgcatcctca

SEQ ID NO: 36812 - DNA, 20 bp, Artificial Sequence
  Description of Artificial Sequence: Synthetic oligonucleotide
  Target: SCN10A; (+) strand; PAM type: NRG; PAM sequence: TAG
gcctttgcatcctcacagct

SEQ ID NO: 36813 - DNA, 20 bp, Artificial Sequence
  Description of Artificial Sequence: Synthetic oligonucleotide
  Target: SCN10A; (+) strand; PAM type: NRG; PAM sequence: AAG
cttagctcctgcttgtaatt

SEQ ID NO: 36814 - DNA, 20 bp, Artificial Sequence
  Description of Artificial Sequence: Synthetic oligonucleotide
  Target: SCN10A; (+) strand; PAM type: NRG; PAM sequence: GAG
atgcttgactttctattcct

SEQ ID NO: 36815 - DNA, 20 bp, Artificial Sequence
  Description of Artificial Sequence: Synthetic oligonucleotide
  Target: SCN10A; (+) strand; PAM type: NRG; PAM sequence: TAG
tattcctgagttacttcatt

SEQ ID NO: 36816 - DNA, 20 bp, Artificial Sequence
  Description of Artificial Sequence: Synthetic oligonucleotide
  Target: SCN10A; (+) strand; PAM type: NRG; PAM sequence: TAG
agttacttcatttagaataa

SEQ ID NO: 36817 - DNA, 20 bp, Artificial Sequence
  Description of Artificial Sequence: Synthetic oligonucleotide
  Target: SCN10A; (+) strand; PAM type: NRG; PAM sequence: CAG
taatagtctccaactccatc

SEQ ID NO: 36818 - DNA, 20 bp, Artificial Sequence
  Description of Artificial Sequence: Synthetic oligonucleotide
  Target: SCN10A; (+) strand; PAM type: NRG; PAM sequence: GAG
tttcattcctttttacaact

SEQ ID NO: 36819 - DNA, 20 bp, Artificial Sequence
  Description of Artificial Sequence: Synthetic oligonucleotide
  Target: SCN10A; (+) strand; PAM type: NRG; PAM sequence: TAG
cattcctttttacaactgag

SEQ ID NO: 36820 - DNA, 20 bp, Artificial Sequence
  Description of Artificial Sequence: Synthetic oligonucleotide
  Target: SCN10A; (+) strand; PAM type: NRG; PAM sequence: TGG
tacaactgagtagtattcca

SEQ ID NO: 36821 - DNA, 20 bp, Artificial Sequence
  Description of Artificial Sequence: Synthetic oligonucleotide
  Target: SCN10A; (+) strand; PAM type: NRG; PAM sequence: TGG
tattttctttatgcacttgt

SEQ ID NO: 36822 - DNA, 20 bp, Artificial Sequence
  Description of Artificial Sequence: Synthetic oligonucleotide
  Target: SCN10A; (+) strand; PAM type: NRG; PAM sequence: TGG
tttatgcacttgttggttga

SEQ ID NO: 36823 - DNA, 20 bp, Artificial Sequence
  Description of Artificial Sequence: Synthetic oligonucleotide
  Target: SCN10A; (+) strand; PAM type: NRG; PAM sequence: GGG
ttatgcacttgttggttgat

SEQ ID NO: 36824 - DNA, 20 bp, Artificial Sequence
  Description of Artificial Sequence: Synthetic oligonucleotide
  Target: SCN10A; (+) strand; PAM type: NRG; PAM sequence: TAG
cttgttggttgatgggcatt

SEQ ID NO: 36825 - DNA, 20 bp, Artificial Sequence
  Description of Artificial Sequence: Synthetic oligonucleotide
  Target: SCN10A; (+) strand; PAM type: NRG; PAM sequence: AGG
ttgttggttgatgggcattt

SEQ ID NO: 36826 - DNA, 20 bp, Artificial Sequence
  Description of Artificial Sequence: Synthetic oligonucleotide
  Target: SCN10A; (+) strand; PAM type: NRG; PAM sequence: TGG
tggttgatgggcatttaggc

SEQ ID NO: 36827 - DNA, 20 bp, Artificial Sequence
  Description of Artificial Sequence: Synthetic oligonucleotide
  Target: SCN10A; (+) strand; PAM type: NRG; PAM sequence: CAG
aggctggttccatatttttg

SEQ ID NO: 36828 - DNA, 20 bp, Artificial Sequence
  Description of Artificial Sequence: Synthetic oligonucleotide
  Target: SCN10A; (+) strand; PAM type: NRG; PAM sequence: AAG
gttgtaaactgtgctgctat

SEQ ID NO: 36829 - DNA, 20 bp, Artificial Sequence
  Description of Artificial Sequence: Synthetic oligonucleotide
  Target: SCN10A; (+) strand; PAM type: NRG; PAM sequence: AAG
tgctataagcatgcatatgc

SEQ ID NO: 36830 - DNA, 20 bp, Artificial Sequence
  Description of Artificial Sequence: Synthetic oligonucleotide
  Target: SCN10A; (+) strand; PAM type: NRG; PAM sequence: TGG
tgcaagtgtctttttaataa

SEQ ID NO: 36831 - DNA, 20 bp, Artificial Sequence
  Description of Artificial Sequence: Synthetic oligonucleotide
  Target: SCN10A; (+) strand; PAM type: NRG; PAM sequence: TGG
aataatggcttattttcctc

SEQ ID NO: 36832 - DNA, 20 bp, Artificial Sequence
  Description of Artificial Sequence: Synthetic oligonucleotide
  Target: SCN10A; (+) strand; PAM type: NRG; PAM sequence: GGG
ataatggcttattttcctct

SEQ ID NO: 36833 - DNA, 20 bp, Artificial Sequence
  Description of Artificial Sequence: Synthetic oligonucleotide
  Target: SCN10A; (+) strand; PAM type: NRG; PAM sequence: TAG
atggcttattttcctctggg

SEQ ID NO: 36834 - DNA, 20 bp, Artificial Sequence
  Description of Artificial Sequence: Synthetic oligonucleotide
  Target: SCN10A; (+) strand; PAM type: NRG; PAM sequence: CAG
ttttcctctgggtagatacc

SEQ ID NO: 36835 - DNA, 20 bp, Artificial Sequence
  Description of Artificial Sequence: Synthetic oligonucleotide
  Target: SCN10A; (+) strand; PAM type: NRG; PAM sequence: TAG
tcctctgggtagatacccag

SEQ ID NO: 36836 - DNA, 20 bp, Artificial Sequence
  Description of Artificial Sequence: Synthetic oligonucleotide
  Target: SCN10A; (+) strand; PAM type: NRG; PAM sequence: TGG
tctgggtagatacccagtag

SEQ ID NO: 36837 - DNA, 20 bp, Artificial Sequence
  Description of Artificial Sequence: Synthetic oligonucleotide
  Target: SCN10A; (+) strand; PAM type: NRG; PAM sequence: GGG
ctgggtagatacccagtagt

SEQ ID NO: 36838 - DNA, 20 bp, Artificial Sequence
  Description of Artificial Sequence: Synthetic oligonucleotide
  Target: SCN10A; (+) strand; PAM type: NRG; PAM sequence: TGG
atacccagtagtgggattgc

SEQ ID NO: 36839 - DNA, 20 bp, Artificial Sequence
  Description of Artificial Sequence: Synthetic oligonucleotide
  Target: SCN10A; (+) strand; PAM type: NRG; PAM sequence: TGG
agtgggattgctggaccaaa

SEQ ID NO: 36840 - DNA, 20 bp, Artificial Sequence
  Description of Artificial Sequence: Synthetic oligonucleotide
  Target: SCN10A; (+) strand; PAM type: NRG; PAM sequence: TAG
gggattgctggaccaaatgg

SEQ ID NO: 36841 - DNA, 20 bp, Artificial Sequence
  Description of Artificial Sequence: Synthetic oligonucleotide
  Target: SCN10A; (+) strand; PAM type: NRG; PAM sequence: TAG
ccaaatggtagttctacttt

SEQ ID NO: 36842 - DNA, 20 bp, Artificial Sequence
  Description of Artificial Sequence: Synthetic oligonucleotide
  Target: SCN10A; (+) strand; PAM type: NRG; PAM sequence: AAG
agttctacttttagttcttt

SEQ ID NO: 36843 - DNA, 20 bp, Artificial Sequence
  Description of Artificial Sequence: Synthetic oligonucleotide
  Target: SCN10A; (+) strand; PAM type: NRG; PAM sequence: AGG
gttctacttttagttcttta

SEQ ID NO: 36844 - DNA, 20 bp, Artificial Sequence
  Description of Artificial Sequence: Synthetic oligonucleotide
  Target: SCN10A; (+) strand; PAM type: NRG; PAM sequence: TAG
aatctccataacgttttcct

SEQ ID NO: 36845 - DNA, 20 bp, Artificial Sequence
  Description of Artificial Sequence: Synthetic oligonucleotide
  Target: SCN10A; (+) strand; PAM type: NRG; PAM sequence: TGG
ctccataacgttttccttag

SEQ ID NO: 36846 - DNA, 20 bp, Artificial Sequence
  Description of Artificial Sequence: Synthetic oligonucleotide
  Target: SCN10A; (+) strand; PAM type: NRG; PAM sequence: TAG
gttttccttagtggttgtac

SEQ ID NO: 36847 - DNA, 20 bp, Artificial Sequence
  Description of Artificial Sequence: Synthetic oligonucleotide
  Target: SCN10A; (+) strand; PAM type: NRG; PAM sequence: CAG
gtactagtttacattcccac

SEQ ID NO: 36848 - DNA, 20 bp, Artificial Sequence
  Description of Artificial Sequence: Synthetic oligonucleotide
  Target: SCN10A; (+) strand; PAM type: NRG; PAM sequence: CAG
ctagtttacattcccaccag

SEQ ID NO: 36849 - DNA, 20 bp, Artificial Sequence
  Description of Artificial Sequence: Synthetic oligonucleotide
  Target: SCN10A; (+) strand; PAM type: NRG; PAM sequence: TGG
tgccaacatctattattttt

SEQ ID NO: 36850 - DNA, 20 bp, Artificial Sequence
  Description of Artificial Sequence: Synthetic oligonucleotide
  Target: SCN10A; (+) strand; PAM type: NRG; PAM sequence: TGG
catctattattttttggtta

SEQ ID NO: 36851 - DNA, 20 bp, Artificial Sequence
  Description of Artificial Sequence: Synthetic oligonucleotide
  Target: SCN10A; (+) strand; PAM type: NRG; PAM sequence: CAG
tttggttatggccattcttg

SEQ ID NO: 36852 - DNA, 20 bp, Artificial Sequence
  Description of Artificial Sequence: Synthetic oligonucleotide
  Target: SCN10A; (+) strand; PAM type: NRG; PAM sequence: AGG
ttggttatggccattcttgc

SEQ ID NO: 36853 - DNA, 20 bp, Artificial Sequence
  Description of Artificial Sequence: Synthetic oligonucleotide
  Target: SCN10A; (+) strand; PAM type: NRG; PAM sequence: GAG
ggttatggccattcttgcag

SEQ ID NO: 36854 - DNA, 20 bp, Artificial Sequence
  Description of Artificial Sequence: Synthetic oligonucleotide
  Target: SCN10A; (+) strand; PAM type: NRG; PAM sequence: AAG
atggccattcttgcaggagt

SEQ ID NO: 36855 - DNA, 20 bp, Artificial Sequence
  Description of Artificial Sequence: Synthetic oligonucleotide
  Target: SCN10A; (+) strand; PAM type: NRG; PAM sequence: AGG
tggccattcttgcaggagta

SEQ ID NO: 36856 - DNA, 20 bp, Artificial Sequence
  Description of Artificial Sequence: Synthetic oligonucleotide
  Target: SCN10A; (+) strand; PAM type: NRG; PAM sequence: TGG
ccattcttgcaggagtaagg

SEQ ID NO: 36857 - DNA, 20 bp, Artificial Sequence
  Description of Artificial Sequence: Synthetic oligonucleotide
  Target: SCN10A; (+) strand; PAM type: NRG; PAM sequence: TGG
agtaaggtggtatctcattg

SEQ ID NO: 36858 - DNA, 20 bp, Artificial Sequence
  Description of Artificial Sequence: Synthetic oligonucleotide
  Target: SCN10A; (+) strand; PAM type: NRG; PAM sequence: GAG
ccctgataattaatgatgtt

SEQ ID NO: 36859 - DNA, 20 bp, Artificial Sequence
  Description of Artificial Sequence: Synthetic oligonucleotide
  Target: SCN10A; (+) strand; PAM type: NRG; PAM sequence: TGG
catttttttttcctgttcat

SEQ ID NO: 36860 - DNA, 20 bp, Artificial Sequence
  Description of Artificial Sequence: Synthetic oligonucleotide
  Target: SCN10A; (+) strand; PAM type: NRG; PAM sequence: GAG
ccatttatatatcttctttt

SEQ ID NO: 36861 - DNA, 20 bp, Artificial Sequence
  Description of Artificial Sequence: Synthetic oligonucleotide
  Target: SCN10A; (+) strand; PAM type: NRG; PAM sequence: TGG
tcttgtcctttgcccacttt

SEQ ID NO: 36862 - DNA, 20 bp, Artificial Sequence
  Description of Artificial Sequence: Synthetic oligonucleotide
  Target: SCN10A; (+) strand; PAM type: NRG; PAM sequence: TGG
gtcctttgcccacttttgga

SEQ ID NO: 36863 - DNA, 20 bp, Artificial Sequence
  Description of Artificial Sequence: Synthetic oligonucleotide
  Target: SCN10A; (+) strand; PAM type: NRG; PAM sequence: GGG
tcctttgcccacttttggat

SEQ ID NO: 36864 - DNA, 20 bp, Artificial Sequence
  Description of Artificial Sequence: Synthetic oligonucleotide
  Target: SCN10A; (+) strand; PAM type: NRG; PAM sequence: TAG
tgatttatttgtgtttctta

SEQ ID NO: 36865 - DNA, 20 bp, Artificial Sequence
  Description of Artificial Sequence: Synthetic oligonucleotide
  Target: SCN10A; (+) strand; PAM type: NRG; PAM sequence: TGG
tttgtgtttcttatagatgc

SEQ ID NO: 36866 - DNA, 20 bp, Artificial Sequence
  Description of Artificial Sequence: Synthetic oligonucleotide
  Target: SCN10A; (+) strand; PAM type: NRG; PAM sequence: TAG
ttcttatagatgctggatat

SEQ ID NO: 36867 - DNA, 20 bp, Artificial Sequence
  Description of Artificial Sequence: Synthetic oligonucleotide
  Target: SCN10A; (+) strand; PAM type: NRG; PAM sequence: TGG
gctggatattagtcttttgc

SEQ ID NO: 36868 - DNA, 20 bp, Artificial Sequence
  Description of Artificial Sequence: Synthetic oligonucleotide
  Target: SCN10A; (+) strand; PAM type: NRG; PAM sequence: AAG
ggatattagtcttttgctgg

SEQ ID NO: 36869 - DNA, 20 bp, Artificial Sequence
  Description of Artificial Sequence: Synthetic oligonucleotide
  Target: SCN10A; (+) strand; PAM type: NRG; PAM sequence: TAG
ttagtcttttgctggaagca

SEQ ID NO: 36870 - DNA, 20 bp, Artificial Sequence
  Description of Artificial Sequence: Synthetic oligonucleotide
  Target: SCN10A; (+) strand; PAM type: NRG; PAM sequence: AAG
tgctggaagcatagataaca

SEQ ID NO: 36871 - DNA, 20 bp, Artificial Sequence
  Description of Artificial Sequence: Synthetic oligonucleotide
  Target: SCN10A; (+) strand; PAM type: NRG; PAM sequence: TGG
aagatttttctctcatccta

SEQ ID NO: 36872 - DNA, 20 bp, Artificial Sequence
  Description of Artificial Sequence: Synthetic oligonucleotide
  Target: SCN10A; (+) strand; PAM type: NRG; PAM sequence: GGG
agatttttctctcatcctat

SEQ ID NO: 36873 - DNA, 20 bp, Artificial Sequence
  Description of Artificial Sequence: Synthetic oligonucleotide
  Target: SCN10A; (+) strand; PAM type: NRG; PAM sequence: TGG
ctatgggttgtctgtttact

SEQ ID NO: 36874 - DNA, 20 bp, Artificial Sequence
  Description of Artificial Sequence: Synthetic oligonucleotide
  Target: SCN10A; (+) strand; PAM type: NRG; PAM sequence: CAG
ttatttctcttgctgtgcaa

SEQ ID NO: 36875 - DNA, 20 bp, Artificial Sequence
  Description of Artificial Sequence: Synthetic oligonucleotide
  Target: SCN10A; (+) strand; PAM type: NRG; PAM sequence: TAG
cttgctgtgcaacagctttt

SEQ ID NO: 36876 - DNA, 20 bp, Artificial Sequence
  Description of Artificial Sequence: Synthetic oligonucleotide
  Target: SCN10A; (+) strand; PAM type: NRG; PAM sequence: TAG
caacagctttttagtttaat

SEQ ID NO: 36877 - DNA, 20 bp, Artificial Sequence
  Description of Artificial Sequence: Synthetic oligonucleotide
  Target: SCN10A; (+) strand; PAM type: NRG; PAM sequence: TGG
ctatttatttttgtttttgt

SEQ ID NO: 36878 - DNA, 20 bp, Artificial Sequence
  Description of Artificial Sequence: Synthetic oligonucleotide
  Target: SCN10A; (+) strand; PAM type: NRG; PAM sequence: TGG
tgtttttgttggatttgctt

SEQ ID NO: 36879 - DNA, 20 bp, Artificial Sequence
  Description of Artificial Sequence: Synthetic oligonucleotide
  Target: SCN10A; (+) strand; PAM type: NRG; PAM sequence: GGG
gtttttgttggatttgcttt

SEQ ID NO: 36880 - DNA, 20 bp, Artificial Sequence
  Description of Artificial Sequence: Synthetic oligonucleotide
  Target: SCN10A; (+) strand; PAM type: NRG; PAM sequence: TGG
ttggatttgctttgggtcct

SEQ ID NO: 36881 - DNA, 20 bp, Artificial Sequence
  Description of Artificial Sequence: Synthetic oligonucleotide
  Target: SCN10A; (+) strand; PAM type: NRG; PAM sequence: CAG
atttgctttgggtccttggt

SEQ ID NO: 36882 - DNA, 20 bp, Artificial Sequence
  Description of Artificial Sequence: Synthetic oligonucleotide
  Target: SCN10A; (+) strand; PAM type: NRG; PAM sequence: AGG
tttgctttgggtccttggtc

SEQ ID NO: 36883 - DNA, 20 bp, Artificial Sequence
  Description of Artificial Sequence: Synthetic oligonucleotide
  Target: SCN10A; (+) strand; PAM type: NRG; PAM sequence: AAG
tggtcaggaacgttttgcct

SEQ ID NO: 36884 - DNA, 20 bp, Artificial Sequence
  Description of Artificial Sequence: Synthetic oligonucleotide
  Target: SCN10A; (+) strand; PAM type: NRG; PAM sequence: TAG
gttttgcctaagccaatgtc

SEQ ID NO: 36885 - DNA, 20 bp, Artificial Sequence
  Description of Artificial Sequence: Synthetic oligonucleotide
  Target: SCN10A; (+) strand; PAM type: NRG; PAM sequence: AAG
ttgcctaagccaatgtctag

SEQ ID NO: 36886 - DNA, 20 bp, Artificial Sequence
  Description of Artificial Sequence: Synthetic oligonucleotide
  Target: SCN10A; (+) strand; PAM type: NRG; PAM sequence: GAG
gcctaagccaatgtctagaa

SEQ ID NO: 36887 - DNA, 20 bp, Artificial Sequence
  Description of Artificial Sequence: Synthetic oligonucleotide
  Target: SCN10A; (+) strand; PAM type: NRG; PAM sequence: TAG
gtttttccaatgttatcttc

SEQ ID NO: 36888 - DNA, 20 bp, Artificial Sequence
  Description of Artificial Sequence: Synthetic oligonucleotide
  Target: SCN10A; (+) strand; PAM type: NRG; PAM sequence: CAG
tctagaattttttataattt

SEQ ID NO: 36889 - DNA, 20 bp, Artificial Sequence
  Description of Artificial Sequence: Synthetic oligonucleotide
  Target: SCN10A; (+) strand; PAM type: NRG; PAM sequence: AGG
ctagaattttttataatttc

SEQ ID NO: 36890 - DNA, 20 bp, Artificial Sequence
  Description of Artificial Sequence: Synthetic oligonucleotide
  Target: SCN10A; (+) strand; PAM type: NRG; PAM sequence: TAG
ttttttataatttcaggtct

SEQ ID NO: 36891 - DNA, 20 bp, Artificial Sequence
  Description of Artificial Sequence: Synthetic oligonucleotide
  Target: SCN10A; (+) strand; PAM type: NRG; PAM sequence: AAG
taatttcaggtcttagattt

SEQ ID NO: 36892 - DNA, 20 bp, Artificial Sequence
  Description of Artificial Sequence: Synthetic oligonucleotide
  Target: SCN10A; (+) strand; PAM type: NRG; PAM sequence: AAG
tcttgaattgatttttgtat

SEQ ID NO: 36893 - DNA, 20 bp, Artificial Sequence
  Description of Artificial Sequence: Synthetic oligonucleotide
  Target: SCN10A; (+) strand; PAM type: NRG; PAM sequence: AGG
cttgaattgatttttgtata

SEQ ID NO: 36894 - DNA, 20 bp, Artificial Sequence
  Description of Artificial Sequence: Synthetic oligonucleotide
  Target: SCN10A; (+) strand; PAM type: NRG; PAM sequence: GAG
aattgatttttgtataaggt

SEQ ID NO: 36895 - DNA, 20 bp, Artificial Sequence
  Description of Artificial Sequence: Synthetic oligonucleotide
  Target: SCN10A; (+) strand; PAM type: NRG; PAM sequence: GAG
ttgatttttgtataaggtga

SEQ ID NO: 36896 - DNA, 20 bp, Artificial Sequence
  Description of Artificial Sequence: Synthetic oligonucleotide
  Target: SCN10A; (+) strand; PAM type: NRG; PAM sequence: AAG
tttgtataaggtgagagatg

SEQ ID NO: 36897 - DNA, 20 bp, Artificial Sequence
  Description of Artificial Sequence: Synthetic oligonucleotide
  Target: SCN10A; (+) strand; PAM type: NRG; PAM sequence: CAG
taaggtgagagatgaagatt

SEQ ID NO: 36898 - DNA, 20 bp, Artificial Sequence
  Description of Artificial Sequence: Synthetic oligonucleotide
  Target: SCN10A; (+) strand; PAM type: NRG; PAM sequence: TGG
cagtttctttcttccacatg

SEQ ID NO: 36899 - DNA, 20 bp, Artificial Sequence
  Description of Artificial Sequence: Synthetic oligonucleotide
  Target: SCN10A; (+) strand; PAM type: NRG; PAM sequence: CAG
atgtggcttgctaattatcc

SEQ ID NO: 36900 - DNA, 20 bp, Artificial Sequence
  Description of Artificial Sequence: Synthetic oligonucleotide
  Target: SCN10A; (+) strand; PAM type: NRG; PAM sequence: TAG
tcccagcaccatttgttgaa

SEQ ID NO: 36901 - DNA, 20 bp, Artificial Sequence
  Description of Artificial Sequence: Synthetic oligonucleotide
  Target: SCN10A; (+) strand; PAM type: NRG; PAM sequence: AGG
cccagcaccatttgttgaat

SEQ ID NO: 36902 - DNA, 20 bp, Artificial Sequence
  Description of Artificial Sequence: Synthetic oligonucleotide
  Target: SCN10A; (+) strand; PAM type: NRG; PAM sequence: GGG
ccagcaccatttgttgaata

SEQ ID NO: 36903 - DNA, 20 bp, Artificial Sequence
  Description of Artificial Sequence: Synthetic oligonucleotide
  Target: SCN10A; (+) strand; PAM type: NRG; PAM sequence: AAG
cgtttttgtttgctttttca

SEQ ID NO: 36904 - DNA, 20 bp, Artificial Sequence
  Description of Artificial Sequence: Synthetic oligonucleotide
  Target: SCN10A; (+) strand; PAM type: NRG; PAM sequence: CAG
ttgtttgctttttcaaagat

SEQ ID NO: 36905 - DNA, 20 bp, Artificial Sequence
  Description of Artificial Sequence: Synthetic oligonucleotide
  Target: SCN10A; (+) strand; PAM type: NRG; PAM sequence: AAG
ttcaaagatcagttgcttgt

SEQ ID NO: 36906 - DNA, 20 bp, Artificial Sequence
  Description of Artificial Sequence: Synthetic oligonucleotide
  Target: SCN10A; (+) strand; PAM type: NRG; PAM sequence: TGG
atcagttgcttgtaagtatt

SEQ ID NO: 36907 - DNA, 20 bp, Artificial Sequence
  Description of Artificial Sequence: Synthetic oligonucleotide
  Target: SCN10A; (+) strand; PAM type: NRG; PAM sequence: GAG
aagtatttggctttatttct

SEQ ID NO: 36908 - DNA, 20 bp, Artificial Sequence
  Description of Artificial Sequence: Synthetic oligonucleotide
  Target: SCN10A; (+) strand; PAM type: NRG; PAM sequence: TGG
agttctctattcttttccat

SEQ ID NO: 36909 - DNA, 20 bp, Artificial Sequence
  Description of Artificial Sequence: Synthetic oligonucleotide
  Target: SCN10A; (+) strand; PAM type: NRG; PAM sequence: CAG
ctatgtgcttatttttatac

SEQ ID NO: 36910 - DNA, 20 bp, Artificial Sequence
  Description of Artificial Sequence: Synthetic oligonucleotide
  Target: SCN10A; (+) strand; PAM type: NRG; PAM sequence: TGG
ataccagtatcatgctgttt

SEQ ID NO: 36911 - DNA, 20 bp, Artificial Sequence
  Description of Artificial Sequence: Synthetic oligonucleotide
  Target: SCN10A; (+) strand; PAM type: NRG; PAM sequence: CAG
agtatcatgctgttttggta

SEQ ID NO: 36912 - DNA, 20 bp, Artificial Sequence
  Description of Artificial Sequence: Synthetic oligonucleotide
  Target: SCN10A; (+) strand; PAM type: NRG; PAM sequence: AGG
gtatcatgctgttttggtac

SEQ ID NO: 36913 - DNA, 20 bp, Artificial Sequence
  Description of Artificial Sequence: Synthetic oligonucleotide
  Target: SCN10A; (+) strand; PAM type: NRG; PAM sequence: TAG
ttttggtacaggctatacta

SEQ ID NO: 36914 - DNA, 20 bp, Artificial Sequence
  Description of Artificial Sequence: Synthetic oligonucleotide
  Target: SCN10A; (+) strand; PAM type: NRG; PAM sequence: TAG
caggctatactatagccttg

SEQ ID NO: 36915 - DNA, 20 bp, Artificial Sequence
  Description of Artificial Sequence: Synthetic oligonucleotide
  Target: SCN10A; (+) strand; PAM type: NRG; PAM sequence: TAG
tatactatagccttgtagta

SEQ ID NO: 36916 - DNA, 20 bp, Artificial Sequence
  Description of Artificial Sequence: Synthetic oligonucleotide
  Target: SCN10A; (+) strand; PAM type: NRG; PAM sequence: CAG
cttgtagtatagtttgaaat

SEQ ID NO: 36917 - DNA, 20 bp, Artificial Sequence
  Description of Artificial Sequence: Synthetic oligonucleotide
  Target: SCN10A; (+) strand; PAM type: NRG; PAM sequence: AAG
agtatagtttgaaatcagct

SEQ ID NO: 36918 - DNA, 20 bp, Artificial Sequence
  Description of Artificial Sequence: Synthetic oligonucleotide
  Target: SCN10A; (+) strand; PAM type: NRG; PAM sequence: AGG
gtatagtttgaaatcagcta

SEQ ID NO: 36919 - DNA, 20 bp, Artificial Sequence
  Description of Artificial Sequence: Synthetic oligonucleotide
  Target: SCN10A; (+) strand; PAM type: NRG; PAM sequence: CAG
atcagctaaggtgatgcctc

SEQ ID NO: 36920 - DNA, 20 bp, Artificial Sequence
  Description of Artificial Sequence: Synthetic oligonucleotide
  Target: SCN10A; (+) strand; PAM type: NRG; PAM sequence: TAG
ccagatttgttattcttgct

SEQ ID NO: 36921 - DNA, 20 bp, Artificial Sequence
  Description of Artificial Sequence: Synthetic oligonucleotide
  Target: SCN10A; (+) strand; PAM type: NRG; PAM sequence: TGG
attcttgcttagtcttgctt

SEQ ID NO: 36922 - DNA, 20 bp, Artificial Sequence
  Description of Artificial Sequence: Synthetic oligonucleotide
  Target: SCN10A; (+) strand; PAM type: NRG; PAM sequence: TGG
ttagtcttgctttggctatg

SEQ ID NO: 36923 - DNA, 20 bp, Artificial Sequence
  Description of Artificial Sequence: Synthetic oligonucleotide
  Target: SCN10A; (+) strand; PAM type: NRG; PAM sequence: TGG
tggctatgtggattcctttt

SEQ ID NO: 36924 - DNA, 20 bp, Artificial Sequence
  Description of Artificial Sequence: Synthetic oligonucleotide
  Target: SCN10A; (+) strand; PAM type: NRG; PAM sequence: TAG
ttttggttccctatgaattt

SEQ ID NO: 36925 - DNA, 20 bp, Artificial Sequence
  Description of Artificial Sequence: Synthetic oligonucleotide
  Target: SCN10A; (+) strand; PAM type: NRG; PAM sequence: AGG
tttggttccctatgaatttt

SEQ ID NO: 36926 - DNA, 20 bp, Artificial Sequence
  Description of Artificial Sequence: Synthetic oligonucleotide
  Target: SCN10A; (+) strand; PAM type: NRG; PAM sequence: GGG
ttggttccctatgaatttta

SEQ ID NO: 36927 - DNA, 20 bp, Artificial Sequence
  Description of Artificial Sequence: Synthetic oligonucleotide
  Target: SCN10A; (+) strand; PAM type: NRG; PAM sequence: AAG
ttgttatttctatttctgtg

SEQ ID NO: 36928 - DNA, 20 bp, Artificial Sequence
  Description of Artificial Sequence: Synthetic oligonucleotide
  Target: SCN10A; (+) strand; PAM type: NRG; PAM sequence: TGG
tatttctgtgaagaatgatg

SEQ ID NO: 36929 - DNA, 20 bp, Artificial Sequence
  Description of Artificial Sequence: Synthetic oligonucleotide
  Target: SCN10A; (+) strand; PAM type: NRG; PAM sequence: TGG
agaatgatgtggtacttcaa

SEQ ID NO: 36930 - DNA, 20 bp, Artificial Sequence
  Description of Artificial Sequence: Synthetic oligonucleotide
  Target: SCN10A; (+) strand; PAM type: NRG; PAM sequence: TGG
ttgaatctgtatattgcttt

SEQ ID NO: 36931 - DNA, 20 bp, Artificial Sequence
  Description of Artificial Sequence: Synthetic oligonucleotide
  Target: SCN10A; (+) strand; PAM type: NRG; PAM sequence: CAG
aatctgtatattgcttttgg

SEQ ID NO: 36932 - DNA, 20 bp, Artificial Sequence
  Description of Artificial Sequence: Synthetic oligonucleotide
  Target: SCN10A; (+) strand; PAM type: NRG; PAM sequence: AAG
tgtatattgcttttggcagt

SEQ ID NO: 36933 - DNA, 20 bp, Artificial Sequence
  Description of Artificial Sequence: Synthetic oligonucleotide
  Target: SCN10A; (+) strand; PAM type: NRG; PAM sequence: AGG
gtatattgcttttggcagta

SEQ ID NO: 36934 - DNA, 20 bp, Artificial Sequence
  Description of Artificial Sequence: Synthetic oligonucleotide
  Target: SCN10A; (+) strand; PAM type: NRG; PAM sequence: GAG
tattgattttatccatccat

SEQ ID NO: 36935 - DNA, 20 bp, Artificial Sequence
  Description of Artificial Sequence: Synthetic oligonucleotide
  Target: SCN10A; (+) strand; PAM type: NRG; PAM sequence: TGG
attttatccatccatgagca

SEQ ID NO: 36936 - DNA, 20 bp, Artificial Sequence
  Description of Artificial Sequence: Synthetic oligonucleotide
  Target: SCN10A; (+) strand; PAM type: NRG; PAM sequence: GGG
ttttatccatccatgagcat

SEQ ID NO: 36937 - DNA, 20 bp, Artificial Sequence
  Description of Artificial Sequence: Synthetic oligonucleotide
  Target: SCN10A; (+) strand; PAM type: NRG; PAM sequence: TAG
gtgtcatctgtgatttattt

SEQ ID NO: 36938 - DNA, 20 bp, Artificial Sequence
  Description of Artificial Sequence: Synthetic oligonucleotide
  Target: SCN10A; (+) strand; PAM type: NRG; PAM sequence: CAG
tcatctgtgatttattttag

SEQ ID NO: 36939 - DNA, 20 bp, Artificial Sequence
  Description of Artificial Sequence: Synthetic oligonucleotide
  Target: SCN10A; (+) strand; PAM type: NRG; PAM sequence: TAG
tttattttagcagtgttttg

SEQ ID NO: 36940 - DNA, 20 bp, Artificial Sequence
  Description of Artificial Sequence: Synthetic oligonucleotide
  Target: SCN10A; (+) strand; PAM type: NRG; PAM sequence: TAG
gtgttttgtagttttccttg

SEQ ID NO: 36941 - DNA, 20 bp, Artificial Sequence
  Description of Artificial Sequence: Synthetic oligonucleotide
  Target: SCN10A; (+) strand; PAM type: NRG; PAM sequence: TGG
gtagaaatctttcacctttt

SEQ ID NO: 36942 - DNA, 20 bp, Artificial Sequence
  Description of Artificial Sequence: Synthetic oligonucleotide
  Target: SCN10A; (+) strand; PAM type: NRG; PAM sequence: TAG
aaatctttcacctttttggt

SEQ ID NO: 36943 - DNA, 20 bp, Artificial Sequence
  Description of Artificial Sequence: Synthetic oligonucleotide
  Target: SCN10A; (+) strand; PAM type: NRG; PAM sequence: AGG
aatctttcacctttttggtt

SEQ ID NO: 36944 - DNA, 20 bp, Artificial Sequence
  Description of Artificial Sequence: Synthetic oligonucleotide
  Target: SCN10A; (+) strand; PAM type: NRG; PAM sequence: AAG
ttttggttaggtatattcct

SEQ ID NO: 36945 - DNA, 20 bp, Artificial Sequence
  Description of Artificial Sequence: Synthetic oligonucleotide
  Target: SCN10A; (+) strand; PAM type: NRG; PAM sequence: CAG
ttatttttgttttttttttg

SEQ ID NO: 36946 - DNA, 20 bp, Artificial Sequence
  Description of Artificial Sequence: Synthetic oligonucleotide
  Target: SCN10A; (+) strand; PAM type: NRG; PAM sequence: AAG
tttttttgcagctgttgtaa

SEQ ID NO: 36947 - DNA, 20 bp, Artificial Sequence
  Description of Artificial Sequence: Synthetic oligonucleotide
  Target: SCN10A; (+) strand; PAM type: NRG; PAM sequence: AGG
ttttttgcagctgttgtaaa

SEQ ID NO: 36948 - DNA, 20 bp, Artificial Sequence
  Description of Artificial Sequence: Synthetic oligonucleotide
  Target: SCN10A; (+) strand; PAM type: NRG; PAM sequence: GGG
tttttgcagctgttgtaaaa

SEQ ID NO: 36949 - DNA, 20 bp, Artificial Sequence
  Description of Artificial Sequence: Synthetic oligonucleotide
  Target: SCN10A; (+) strand; PAM type: NRG; PAM sequence: GAG
cagctgttgtaaaagggatt

SEQ ID NO: 36950 - DNA, 20 bp, Artificial Sequence
  Description of Artificial Sequence: Synthetic oligonucleotide
  Target: SCN10A; (+) strand; PAM type: NRG; PAM sequence: CAG
tgagttcttgatttgttcct

SEQ ID NO: 36951 - DNA, 20 bp, Artificial Sequence
  Description of Artificial Sequence: Synthetic oligonucleotide
  Target: SCN10A; (+) strand; PAM type: NRG; PAM sequence: TGG
tcttgatttgttcctcagct

SEQ ID NO: 36952 - DNA, 20 bp, Artificial Sequence
  Description of Artificial Sequence: Synthetic oligonucleotide
  Target: SCN10A; (+) strand; PAM type: NRG; PAM sequence: TGG
ttgttcctcagcttggtttc

SEQ ID NO: 36953 - DNA, 20 bp, Artificial Sequence
  Description of Artificial Sequence: Synthetic oligonucleotide
  Target: SCN10A; (+) strand; PAM type: NRG; PAM sequence: TGG
ttcctcagcttggtttctgg

SEQ ID NO: 36954 - DNA, 20 bp, Artificial Sequence
  Description of Artificial Sequence: Synthetic oligonucleotide
  Target: SCN10A; (+) strand; PAM type: NRG; PAM sequence: CAG
gcttggtttctggtggtgta

SEQ ID NO: 36955 - DNA, 20 bp, Artificial Sequence
  Description of Artificial Sequence: Synthetic oligonucleotide
  Target: SCN10A; (+) strand; PAM type: NRG; PAM sequence: TAG
tggtttctggtggtgtacag

SEQ ID NO: 36956 - DNA, 20 bp, Artificial Sequence
  Description of Artificial Sequence: Synthetic oligonucleotide
  Target: SCN10A; (+) strand; PAM type: NRG; PAM sequence: TAG
actttactgaattcatttat

SEQ ID NO: 36957 - DNA, 20 bp, Artificial Sequence
  Description of Artificial Sequence: Synthetic oligonucleotide
  Target: SCN10A; (+) strand; PAM type: NRG; PAM sequence: TAG
ctgaattcatttattagatc

SEQ ID NO: 36958 - DNA, 20 bp, Artificial Sequence
  Description of Artificial Sequence: Synthetic oligonucleotide
  Target: SCN10A; (+) strand; PAM type: NRG; PAM sequence: AGG
tgaattcatttattagatct

SEQ ID NO: 36959 - DNA, 20 bp, Artificial Sequence
  Description of Artificial Sequence: Synthetic oligonucleotide
  Target: SCN10A; (+) strand; PAM type: NRG; PAM sequence: GAG
aattcatttattagatctag

SEQ ID NO: 36960 - DNA, 20 bp, Artificial Sequence
  Description of Artificial Sequence: Synthetic oligonucleotide
  Target: SCN10A; (+) strand; PAM type: NRG; PAM sequence: TGG
tattagatctaggagctttt

SEQ ID NO: 36961 - DNA, 20 bp, Artificial Sequence
  Description of Artificial Sequence: Synthetic oligonucleotide
  Target: SCN10A; (+) strand; PAM type: NRG; PAM sequence: GAG
gatctaggagctttttggat

SEQ ID NO: 36962 - DNA, 20 bp, Artificial Sequence
  Description of Artificial Sequence: Synthetic oligonucleotide
  Target: SCN10A; (+) strand; PAM type: NRG; PAM sequence: TAG
gagctttttggatgagtctt

SEQ ID NO: 36963 - DNA, 20 bp, Artificial Sequence
  Description of Artificial Sequence: Synthetic oligonucleotide
  Target: SCN10A; (+) strand; PAM type: NRG; PAM sequence: AGG
agctttttggatgagtcttt

SEQ ID NO: 36964 - DNA, 20 bp, Artificial Sequence
  Description of Artificial Sequence: Synthetic oligonucleotide
  Target: SCN10A; (+) strand; PAM type: NRG; PAM sequence: GGG
gctttttggatgagtcttta

SEQ ID NO: 36965 - DNA, 20 bp, Artificial Sequence
  Description of Artificial Sequence: Synthetic oligonucleotide
  Target: SCN10A; (+) strand; PAM type: NRG; PAM sequence: TAG
gatgagtctttagggtttcc

SEQ ID NO: 36966 - DNA, 20 bp, Artificial Sequence
  Description of Artificial Sequence: Synthetic oligonucleotide
  Target: SCN10A; (+) strand; PAM type: NRG; PAM sequence: AGG
atgagtctttagggtttcct

SEQ ID NO: 36967 - DNA, 20 bp, Artificial Sequence
  Description of Artificial Sequence: Synthetic oligonucleotide
  Target: SCN10A; (+) strand; PAM type: NRG; PAM sequence: TGG
taggcatacgatcatatcat

SEQ ID NO: 36968 - DNA, 20 bp, Artificial Sequence
  Description of Artificial Sequence: Synthetic oligonucleotide
  Target: SCN10A; (+) strand; PAM type: NRG; PAM sequence: CAG
acgatcatatcattggtgaa

SEQ ID NO: 36969 - DNA, 20 bp, Artificial Sequence
  Description of Artificial Sequence: Synthetic oligonucleotide
  Target: SCN10A; (+) strand; PAM type: NRG; PAM sequence: CAG
atatcattggtgaacagcaa

SEQ ID NO: 36970 - DNA, 20 bp, Artificial Sequence
  Description of Artificial Sequence: Synthetic oligonucleotide
  Target: SCN10A; (+) strand; PAM type: NRG; PAM sequence: TGG
tgacttcccctttactgatt

SEQ ID NO: 36971 - DNA, 20 bp, Artificial Sequence
  Description of Artificial Sequence: Synthetic oligonucleotide
  Target: SCN10A; (+) strand; PAM type: NRG; PAM sequence: TGG
tttctcttgtctgattgctc

SEQ ID NO: 36972 - DNA, 20 bp, Artificial Sequence
  Description of Artificial Sequence: Synthetic oligonucleotide
  Target: SCN10A; (+) strand; PAM type: NRG; PAM sequence: TAG
tcttgtctgattgctctggc

SEQ ID NO: 36973 - DNA, 20 bp, Artificial Sequence
  Description of Artificial Sequence: Synthetic oligonucleotide
  Target: SCN10A; (+) strand; PAM type: NRG; PAM sequence: AGG
cttgtctgattgctctggct

SEQ ID NO: 36974 - DNA, 20 bp, Artificial Sequence
  Description of Artificial Sequence: Synthetic oligonucleotide
  Target: SCN10A; (+) strand; PAM type: NRG; PAM sequence: CAG
attgctctggctaggacttc

SEQ ID NO: 36975 - DNA, 20 bp, Artificial Sequence
  Description of Artificial Sequence: Synthetic oligonucleotide
  Target: SCN10A; (+) strand; PAM type: NRG; PAM sequence: TGG
taggacttccagtactatgt

SEQ ID NO: 36976 - DNA, 20 bp, Artificial Sequence
  Description of Artificial Sequence: Synthetic oligonucleotide
  Target: SCN10A; (+) strand; PAM type: NRG; PAM sequence: TAG
acttccagtactatgttgga

SEQ ID NO: 36977 - DNA, 20 bp, Artificial Sequence
  Description of Artificial Sequence: Synthetic oligonucleotide
  Target: SCN10A; (+) strand; PAM type: NRG; PAM sequence: TGG
agtactatgttggatagaaa

SEQ ID NO: 36978 - DNA, 20 bp, Artificial Sequence
  Description of Artificial Sequence: Synthetic oligonucleotide
  Target: SCN10A; (+) strand; PAM type: NRG; PAM sequence: AAG
atgttggatagaaatggtga

SEQ ID NO: 36979 - DNA, 20 bp, Artificial Sequence
  Description of Artificial Sequence: Synthetic oligonucleotide
  Target: SCN10A; (+) strand; PAM type: NRG; PAM sequence: TGG
ttggatagaaatggtgaaag

SEQ ID NO: 36980 - DNA, 20 bp, Artificial Sequence
  Description of Artificial Sequence: Synthetic oligonucleotide
  Target: SCN10A; (+) strand; PAM type: NRG; PAM sequence: GGG
tggatagaaatggtgaaagt

SEQ ID NO: 36981 - DNA, 20 bp, Artificial Sequence
  Description of Artificial Sequence: Synthetic oligonucleotide
  Target: SCN10A; (+) strand; PAM type: NRG; PAM sequence: CAG
tgggcatccttgtcttgttt

SEQ ID NO: 36982 - DNA, 20 bp, Artificial Sequence
  Description of Artificial Sequence: Synthetic oligonucleotide
  Target: SCN10A; (+) strand; PAM type: NRG; PAM sequence: CAG
ccttgtcttgtttcagttct

SEQ ID NO: 36983 - DNA, 20 bp, Artificial Sequence
  Description of Artificial Sequence: Synthetic oligonucleotide
  Target: SCN10A; (+) strand; PAM type: NRG; PAM sequence: AGG
cttgtcttgtttcagttctc

SEQ ID NO: 36984 - DNA, 20 bp, Artificial Sequence
  Description of Artificial Sequence: Synthetic oligonucleotide
  Target: SCN10A; (+) strand; PAM type: NRG; PAM sequence: GGG
ttgtcttgtttcagttctca

SEQ ID NO: 36985 - DNA, 20 bp, Artificial Sequence
  Description of Artificial Sequence: Synthetic oligonucleotide
  Target: SCN10A; (+) strand; PAM type: NRG; PAM sequence: GGG
tgtcttgtttcagttctcag

SEQ ID NO: 36986 - DNA, 20 bp, Artificial Sequence
  Description of Artificial Sequence: Synthetic oligonucleotide
  Target: SCN10A; (+) strand; PAM type: NRG; PAM sequence: GGG
gtcttgtttcagttctcagg

SEQ ID NO: 36987 - DNA, 20 bp, Artificial Sequence
  Description of Artificial Sequence: Synthetic oligonucleotide
  Target: SCN10A; (+) strand; PAM type: NRG; PAM sequence: TGG
gctttcaacttttccctgtt

SEQ ID NO: 36988 - DNA, 20 bp, Artificial Sequence
  Description of Artificial Sequence: Synthetic oligonucleotide
  Target: SCN10A; (+) strand; PAM type: NRG; PAM sequence: TGG
ttccctgtttggtataatgt

SEQ ID NO: 36989 - DNA, 20 bp, Artificial Sequence
  Description of Artificial Sequence: Synthetic oligonucleotide
  Target: SCN10A; (+) strand; PAM type: NRG; PAM sequence: TGG
gtttggtataatgttggctg

SEQ ID NO: 36990 - DNA, 20 bp, Artificial Sequence
  Description of Artificial Sequence: Synthetic oligonucleotide
  Target: SCN10A; (+) strand; PAM type: NRG; PAM sequence: TAG
tgttggctgtggatttgtca

SEQ ID NO: 36991 - DNA, 20 bp, Artificial Sequence
  Description of Artificial Sequence: Synthetic oligonucleotide
  Target: SCN10A; (+) strand; PAM type: NRG; PAM sequence: TGG
ggctgtggatttgtcataga

SEQ ID NO: 36992 - DNA, 20 bp, Artificial Sequence
  Description of Artificial Sequence: Synthetic oligonucleotide
  Target: SCN10A; (+) strand; PAM type: NRG; PAM sequence: TGG
atagatggcttttattacct

SEQ ID NO: 36993 - DNA, 20 bp, Artificial Sequence
  Description of Artificial Sequence: Synthetic oligonucleotide
  Target: SCN10A; (+) strand; PAM type: NRG; PAM sequence: GAG
agatggcttttattaccttg

SEQ ID NO: 36994 - DNA, 20 bp, Artificial Sequence
  Description of Artificial Sequence: Synthetic oligonucleotide
  Target: SCN10A; (+) strand; PAM type: NRG; PAM sequence: TGG
atgtcccttctatgccaatt

SEQ ID NO: 36995 - DNA, 20 bp, Artificial Sequence
  Description of Artificial Sequence: Synthetic oligonucleotide
  Target: SCN10A; (+) strand; PAM type: NRG; PAM sequence: GAG
ccttctatgccaatttggtt

SEQ ID NO: 36996 - DNA, 20 bp, Artificial Sequence
  Description of Artificial Sequence: Synthetic oligonucleotide
  Target: SCN10A; (+) strand; PAM type: NRG; PAM sequence: AGG
cttctatgccaatttggttg

SEQ ID NO: 36997 - DNA, 20 bp, Artificial Sequence
  Description of Artificial Sequence: Synthetic oligonucleotide
  Target: SCN10A; (+) strand; PAM type: NRG; PAM sequence: GGG
ttctatgccaatttggttga

SEQ ID NO: 36998 - DNA, 20 bp, Artificial Sequence
  Description of Artificial Sequence: Synthetic oligonucleotide
  Target: SCN10A; (+) strand; PAM type: NRG; PAM sequence: TGG
gttgagggttttaatcataa

SEQ ID NO: 36999 - DNA, 20 bp, Artificial Sequence
  Description of Artificial Sequence: Synthetic oligonucleotide
  Target: SCN10A; (+) strand; PAM type: NRG; PAM sequence: GGG
ttgagggttttaatcataat

SEQ ID NO: 37000 - DNA, 20 bp, Artificial Sequence
  Description of Artificial Sequence: Synthetic oligonucleotide
  Target: SCN10A; (+) strand; PAM type: NRG; PAM sequence: TGG
ttttaatcataatgggatgc

SEQ ID NO: 37001 - DNA, 20 bp, Artificial Sequence
  Description of Artificial Sequence: Synthetic oligonucleotide
  Target: SCN10A; (+) strand; PAM type: NRG; PAM sequence: GAG
atgcttttcctgcacctatt

SEQ ID NO: 37002 - DNA, 20 bp, Artificial Sequence
  Description of Artificial Sequence: Synthetic oligonucleotide
  Target: SCN10A; (+) strand; PAM type: NRG; PAM sequence: CAG
aattctgtttatgtgacgtg

SEQ ID NO: 37003 - DNA, 20 bp, Artificial Sequence
  Description of Artificial Sequence: Synthetic oligonucleotide
  Target: SCN10A; (+) strand; PAM type: NRG; PAM sequence: TGG
ttaaatcatccctacctccc

SEQ ID NO: 37004 - DNA, 20 bp, Artificial Sequence
  Description of Artificial Sequence: Synthetic oligonucleotide
  Target: SCN10A; (+) strand; PAM type: NRG; PAM sequence: TGG
gtatgaaacccccttgatca

SEQ ID NO: 37005 - DNA, 20 bp, Artificial Sequence
  Description of Artificial Sequence: Synthetic oligonucleotide
  Target: SCN10A; (+) strand; PAM type: NRG; PAM sequence: TGG
gatcatggtgtgttatcttt

SEQ ID NO: 37006 - DNA, 20 bp, Artificial Sequence
  Description of Artificial Sequence: Synthetic oligonucleotide
  Target: SCN10A; (+) strand; PAM type: NRG; PAM sequence: TGG
gttatcttttggatatgtgt

SEQ ID NO: 37007 - DNA, 20 bp, Artificial Sequence
  Description of Artificial Sequence: Synthetic oligonucleotide
  Target: SCN10A; (+) strand; PAM type: NRG; PAM sequence: TAG
ggatatgtgttggattcaat

SEQ ID NO: 37008 - DNA, 20 bp, Artificial Sequence
  Description of Artificial Sequence: Synthetic oligonucleotide
  Target: SCN10A; (+) strand; PAM type: NRG; PAM sequence: TAG
atgtgttggattcaattagc

SEQ ID NO: 37009 - DNA, 20 bp, Artificial Sequence
  Description of Artificial Sequence: Synthetic oligonucleotide
  Target: SCN10A; (+) strand; PAM type: NRG; PAM sequence: GAG
caattagctagcattttgtt

SEQ ID NO: 37010 - DNA, 20 bp, Artificial Sequence
  Description of Artificial Sequence: Synthetic oligonucleotide
  Target: SCN10A; (+) strand; PAM type: NRG; PAM sequence: AGG
aattagctagcattttgttg

SEQ ID NO: 37011 - DNA, 20 bp, Artificial Sequence
  Description of Artificial Sequence: Synthetic oligonucleotide
  Target: SCN10A; (+) strand; PAM type: NRG; PAM sequence: CAG
atttttgcatctatgttcat

SEQ ID NO: 37012 - DNA, 20 bp, Artificial Sequence
  Description of Artificial Sequence: Synthetic oligonucleotide
  Target: SCN10A; (+) strand; PAM type: NRG; PAM sequence: AGG
tttttgcatctatgttcatc

SEQ ID NO: 37013 - DNA, 20 bp, Artificial Sequence
  Description of Artificial Sequence: Synthetic oligonucleotide
  Target: SCN10A; (+) strand; PAM type: NRG; PAM sequence: GGG
ttttgcatctatgttcatca

SEQ ID NO: 37014 - DNA, 20 bp, Artificial Sequence
  Description of Artificial Sequence: Synthetic oligonucleotide
  Target: SCN10A; (+) strand; PAM type: NRG; PAM sequence: TAG
ttcatcagggatattgtctg

SEQ ID NO: 37015 - DNA, 20 bp, Artificial Sequence
  Description of Artificial Sequence: Synthetic oligonucleotide
  Target: SCN10A; (+) strand; PAM type: NRG; PAM sequence: AAG
tgtctgtagttcttttttaa

SEQ ID NO: 37016 - DNA, 20 bp, Artificial Sequence
  Description of Artificial Sequence: Synthetic oligonucleotide
  Target: SCN10A; (+) strand; PAM type: NRG; PAM sequence: TGG
cttttttaaaagtccttttc

SEQ ID NO: 37017 - DNA, 20 bp, Artificial Sequence
  Description of Artificial Sequence: Synthetic oligonucleotide
  Target: SCN10A; (+) strand; PAM type: NRG; PAM sequence: TGG
taaaagtccttttctggttt

SEQ ID NO: 37018 - DNA, 20 bp, Artificial Sequence
  Description of Artificial Sequence: Synthetic oligonucleotide
  Target: SCN10A; (+) strand; PAM type: NRG; PAM sequence: TAG
tccttttctggttttggtat

SEQ ID NO: 37019 - DNA, 20 bp, Artificial Sequence
  Description of Artificial Sequence: Synthetic oligonucleotide
  Target: SCN10A; (+) strand; PAM type: NRG; PAM sequence: AGG
ccttttctggttttggtatt

SEQ ID NO: 37020 - DNA, 20 bp, Artificial Sequence
  Description of Artificial Sequence: Synthetic oligonucleotide
  Target: SCN10A; (+) strand; PAM type: NRG; PAM sequence: GGG
cttttctggttttggtatta

SEQ ID NO: 37021 - DNA, 20 bp, Artificial Sequence
  Description of Artificial Sequence: Synthetic oligonucleotide
  Target: SCN10A; (+) strand; PAM type: NRG; PAM sequence: TGG
ttttggtattagggtgatac

SEQ ID NO: 37022 - DNA, 20 bp, Artificial Sequence
  Description of Artificial Sequence: Synthetic oligonucleotide
  Target: SCN10A; (+) strand; PAM type: NRG; PAM sequence: TAG
actggcttcataaaatgatt

SEQ ID NO: 37023 - DNA, 20 bp, Artificial Sequence
  Description of Artificial Sequence: Synthetic oligonucleotide
  Target: SCN10A; (+) strand; PAM type: NRG; PAM sequence: AGG
ctggcttcataaaatgattt

SEQ ID NO: 37024 - DNA, 20 bp, Artificial Sequence
  Description of Artificial Sequence: Synthetic oligonucleotide
  Target: SCN10A; (+) strand; PAM type: NRG; PAM sequence: GAG
ggcttcataaaatgatttag

SEQ ID NO: 37025 - DNA, 20 bp, Artificial Sequence
  Description of Artificial Sequence: Synthetic oligonucleotide
  Target: SCN10A; (+) strand; PAM type: NRG; PAM sequence: AGG
gcttcataaaatgatttagg

SEQ ID NO: 37026 - DNA, 20 bp, Artificial Sequence
  Description of Artificial Sequence: Synthetic oligonucleotide
  Target: SCN10A; (+) strand; PAM type: NRG; PAM sequence: TGG
ttccctctttctgcatcttt

SEQ ID NO: 37027 - DNA, 20 bp, Artificial Sequence
  Description of Artificial Sequence: Synthetic oligonucleotide
  Target: SCN10A; (+) strand; PAM type: NRG; PAM sequence: TAG
tctttctgcatcttttggaa

SEQ ID NO: 37028 - DNA, 20 bp, Artificial Sequence
  Description of Artificial Sequence: Synthetic oligonucleotide
  Target: SCN10A; (+) strand; PAM type: NRG; PAM sequence: TGG
tggaatagtttcaataaaat

SEQ ID NO: 37029 - DNA, 20 bp, Artificial Sequence
  Description of Artificial Sequence: Synthetic oligonucleotide
  Target: SCN10A; (+) strand; PAM type: NRG; PAM sequence: TAG
attcttctttgaatgtctga

SEQ ID NO: 37030 - DNA, 20 bp, Artificial Sequence
  Description of Artificial Sequence: Synthetic oligonucleotide
  Target: SCN10A; (+) strand; PAM type: NRG; PAM sequence: CAG
tttgaatgtctgatagaatt

SEQ ID NO: 37031 - DNA, 20 bp, Artificial Sequence
  Description of Artificial Sequence: Synthetic oligonucleotide
  Target: SCN10A; (+) strand; PAM type: NRG; PAM sequence: CAG
atagaattcagctgtgaatc

SEQ ID NO: 37032 - DNA, 20 bp, Artificial Sequence
  Description of Artificial Sequence: Synthetic oligonucleotide
  Target: SCN10A; (+) strand; PAM type: NRG; PAM sequence: TGG
ctgtgaatccagtctgctcc

SEQ ID NO: 37033 - DNA, 20 bp, Artificial Sequence
  Description of Artificial Sequence: Synthetic oligonucleotide
  Target: SCN10A; (+) strand; PAM type: NRG; PAM sequence: TGG
gctcctggactttttttcct

SEQ ID NO: 37034 - DNA, 20 bp, Artificial Sequence
  Description of Artificial Sequence: Synthetic oligonucleotide
  Target: SCN10A; (+) strand; PAM type: NRG; PAM sequence: TGG
tcaatctcgctacttgttat

SEQ ID NO: 37035 - DNA, 20 bp, Artificial Sequence
  Description of Artificial Sequence: Synthetic oligonucleotide
  Target: SCN10A; (+) strand; PAM type: NRG; PAM sequence: TAG
ctacttgttattggtctgtt

SEQ ID NO: 37036 - DNA, 20 bp, Artificial Sequence
  Description of Artificial Sequence: Synthetic oligonucleotide
  Target: SCN10A; (+) strand; PAM type: NRG; PAM sequence: GAG
acttgttattggtctgttta

SEQ ID NO: 37037 - DNA, 20 bp, Artificial Sequence
  Description of Artificial Sequence: Synthetic oligonucleotide
  Target: SCN10A; (+) strand; PAM type: NRG; PAM sequence: AAG
attactttctgatttaatct

SEQ ID NO: 37038 - DNA, 20 bp, Artificial Sequence
  Description of Artificial Sequence: Synthetic oligonucleotide
  Target: SCN10A; (+) strand; PAM type: NRG; PAM sequence: CAG
ctttctgatttaatctaaga

SEQ ID NO: 37039 - DNA, 20 bp, Artificial Sequence
  Description of Artificial Sequence: Synthetic oligonucleotide
  Target: SCN10A; (+) strand; PAM type: NRG; PAM sequence: CAG
ctaagacagttgtatatttc

SEQ ID NO: 37040 - DNA, 20 bp, Artificial Sequence
  Description of Artificial Sequence: Synthetic oligonucleotide
  Target: SCN10A; (+) strand; PAM type: NRG; PAM sequence: AGG
taagacagttgtatatttcc

SEQ ID NO: 37041 - DNA, 20 bp, Artificial Sequence
  Description of Artificial Sequence: Synthetic oligonucleotide
  Target: SCN10A; (+) strand; PAM type: NRG; PAM sequence: TAG
ttcatctcctctaaattttc

SEQ ID NO: 37042 - DNA, 20 bp, Artificial Sequence
  Description of Artificial Sequence: Synthetic oligonucleotide
  Target: SCN10A; (+) strand; PAM type: NRG; PAM sequence: AAG
ttttctagtttgtgcaaata

SEQ ID NO: 37043 - DNA, 20 bp, Artificial Sequence
  Description of Artificial Sequence: Synthetic oligonucleotide
  Target: SCN10A; (+) strand; PAM type: NRG; PAM sequence: AGG
tttctagtttgtgcaaataa

SEQ ID NO: 37044 - DNA, 20 bp, Artificial Sequence
  Description of Artificial Sequence: Synthetic oligonucleotide
  Target: SCN10A; (+) strand; PAM type: NRG; PAM sequence: TAG
tgtgcaaataaaggtgttca

SEQ ID NO: 37045 - DNA, 20 bp, Artificial Sequence
  Description of Artificial Sequence: Synthetic oligonucleotide
  Target: SCN10A; (+) strand; PAM type: NRG; PAM sequence: TAG
gcaaataaaggtgttcatag

SEQ ID NO: 37046 - DNA, 20 bp, Artificial Sequence
  Description of Artificial Sequence: Synthetic oligonucleotide
  Target: SCN10A; (+) strand; PAM type: NRG; PAM sequence: TGG
attttttttttgtatttctg

SEQ ID NO: 37047 - DNA, 20 bp, Artificial Sequence
  Description of Artificial Sequence: Synthetic oligonucleotide
  Target: SCN10A; (+) strand; PAM type: NRG; PAM sequence: CAG
tttttgtatttctgtggtat

SEQ ID NO: 37048 - DNA, 20 bp, Artificial Sequence
  Description of Artificial Sequence: Synthetic oligonucleotide
  Target: SCN10A; (+) strand; PAM type: NRG; PAM sequence: GAG
ctcccattttatttctaatt

SEQ ID NO: 37049 - DNA, 20 bp, Artificial Sequence
  Description of Artificial Sequence: Synthetic oligonucleotide
  Target: SCN10A; (+) strand; PAM type: NRG; PAM sequence: TGG
tatttctaattgagcttatt

SEQ ID NO: 37050 - DNA, 20 bp, Artificial Sequence
  Description of Artificial Sequence: Synthetic oligonucleotide
  Target: SCN10A; (+) strand; PAM type: NRG; PAM sequence: TGG
gatcttctctcttcttttct

SEQ ID NO: 37051 - DNA, 20 bp, Artificial Sequence
  Description of Artificial Sequence: Synthetic oligonucleotide
  Target: SCN10A; (+) strand; PAM type: NRG; PAM sequence: TGG
ttcttggttaatcttgccaa

SEQ ID NO: 37052 - DNA, 20 bp, Artificial Sequence
  Description of Artificial Sequence: Synthetic oligonucleotide
  Target: SCN10A; (+) strand; PAM type: NRG; PAM sequence: AAG
caattttctatatcttttta

SEQ ID NO: 37053 - DNA, 20 bp, Artificial Sequence
  Description of Artificial Sequence: Synthetic oligonucleotide
  Target: SCN10A; (+) strand; PAM type: NRG; PAM sequence: TAG
atttttatttgaatttcatt

SEQ ID NO: 37054 - DNA, 20 bp, Artificial Sequence
  Description of Artificial Sequence: Synthetic oligonucleotide
  Target: SCN10A; (+) strand; PAM type: NRG; PAM sequence: TGG
gttattccttttcttctgct

SEQ ID NO: 37055 - DNA, 20 bp, Artificial Sequence
  Description of Artificial Sequence: Synthetic oligonucleotide
  Target: SCN10A; (+) strand; PAM type: NRG; PAM sequence: TGG
tccttttcttctgcttggtt

SEQ ID NO: 37056 - DNA, 20 bp, Artificial Sequence
  Description of Artificial Sequence: Synthetic oligonucleotide
  Target: SCN10A; (+) strand; PAM type: NRG; PAM sequence: GGG
ccttttcttctgcttggttt

SEQ ID NO: 37057 - DNA, 20 bp, Artificial Sequence
  Description of Artificial Sequence: Synthetic oligonucleotide
  Target: SCN10A; (+) strand; PAM type: NRG; PAM sequence: GAG
tcttgtttctctaattcctt

SEQ ID NO: 37058 - DNA, 20 bp, Artificial Sequence
  Description of Artificial Sequence: Synthetic oligonucleotide
  Target: SCN10A; (+) strand; PAM type: NRG; PAM sequence: AGG
cttgtttctctaattccttg

SEQ ID NO: 37059 - DNA, 20 bp, Artificial Sequence
  Description of Artificial Sequence: Synthetic oligonucleotide
  Target: SCN10A; (+) strand; PAM type: NRG; PAM sequence: TAG
aattccttgaggtgtgacct

SEQ ID NO: 37060 - DNA, 20 bp, Artificial Sequence
  Description of Artificial Sequence: Synthetic oligonucleotide
  Target: SCN10A; (+) strand; PAM type: NRG; PAM sequence: TAG
ctctttcatactttttgatg

SEQ ID NO: 37061 - DNA, 20 bp, Artificial Sequence
  Description of Artificial Sequence: Synthetic oligonucleotide
  Target: SCN10A; (+) strand; PAM type: NRG; PAM sequence: AGG
tctttcatactttttgatgt

SEQ ID NO: 37062 - DNA, 20 bp, Artificial Sequence
  Description of Artificial Sequence: Synthetic oligonucleotide
  Target: SCN10A; (+) strand; PAM type: NRG; PAM sequence: GAG
atgtaggtatttaatgctat

SEQ ID NO: 37063 - DNA, 20 bp, Artificial Sequence
  Description of Artificial Sequence: Synthetic oligonucleotide
  Target: SCN10A; (+) strand; PAM type: NRG; PAM sequence: TAG
aatgctatgagctttcctct

SEQ ID NO: 37064 - DNA, 20 bp, Artificial Sequence
  Description of Artificial Sequence: Synthetic oligonucleotide
  Target: SCN10A; (+) strand; PAM type: NRG; PAM sequence: TAG
ctttcctcttagcactgctt

SEQ ID NO: 37065 - DNA, 20 bp, Artificial Sequence
  Description of Artificial Sequence: Synthetic oligonucleotide
  Target: SCN10A; (+) strand; PAM type: NRG; PAM sequence: CAG
gcactgctttagctgtatcc

SEQ ID NO: 37066 - DNA, 20 bp, Artificial Sequence
  Description of Artificial Sequence: Synthetic oligonucleotide
  Target: SCN10A; (+) strand; PAM type: NRG; PAM sequence: GAG
actgctttagctgtatccca

SEQ ID NO: 37067 - DNA, 20 bp, Artificial Sequence
  Description of Artificial Sequence: Synthetic oligonucleotide
  Target: SCN10A; (+) strand; PAM type: NRG; PAM sequence: AGG
ctgctttagctgtatcccag

SEQ ID NO: 37068 - DNA, 20 bp, Artificial Sequence
  Description of Artificial Sequence: Synthetic oligonucleotide
  Target: SCN10A; (+) strand; PAM type: NRG; PAM sequence: AAG
tgtatcccagaggttttgat

SEQ ID NO: 37069 - DNA, 20 bp, Artificial Sequence
  Description of Artificial Sequence: Synthetic oligonucleotide
  Target: SCN10A; (+) strand; PAM type: NRG; PAM sequence: CAG
gttgtgtgactattatcatt

SEQ ID NO: 37070 - DNA, 20 bp, Artificial Sequence
  Description of Artificial Sequence: Synthetic oligonucleotide
  Target: SCN10A; (+) strand; PAM type: NRG; PAM sequence: AAG
ttgatttcattgttgaccca

SEQ ID NO: 37071 - DNA, 20 bp, Artificial Sequence
  Description of Artificial Sequence: Synthetic oligonucleotide
  Target: SCN10A; (+) strand; PAM type: NRG; PAM sequence: AAG
tgttgacccaaagatcattc

SEQ ID NO: 37072 - DNA, 20 bp, Artificial Sequence
  Description of Artificial Sequence: Synthetic oligonucleotide
  Target: SCN10A; (+) strand; PAM type: NRG; PAM sequence: GAG
ttgacccaaagatcattcaa

SEQ ID NO: 37073 - DNA, 20 bp, Artificial Sequence
  Description of Artificial Sequence: Synthetic oligonucleotide
  Target: SCN10A; (+) strand; PAM type: NRG; PAM sequence: CAG
acccaaagatcattcaagag

SEQ ID NO: 37074 - DNA, 20 bp, Artificial Sequence
  Description of Artificial Sequence: Synthetic oligonucleotide
  Target: SCN10A; (+) strand; PAM type: NRG; PAM sequence: TAG
tcattcaagagcagattgtt

SEQ ID NO: 37075 - DNA, 20 bp, Artificial Sequence
  Description of Artificial Sequence: Synthetic oligonucleotide
  Target: SCN10A; (+) strand; PAM type: NRG; PAM sequence: TAG
ttagttttcatgtatttgta

SEQ ID NO: 37076 - DNA, 20 bp, Artificial Sequence
  Description of Artificial Sequence: Synthetic oligonucleotide
  Target: SCN10A; (+) strand; PAM type: NRG; PAM sequence: GAG
tcatgtatttgtatagtttt

SEQ ID NO: 37077 - DNA, 20 bp, Artificial Sequence
  Description of Artificial Sequence: Synthetic oligonucleotide
  Target: SCN10A; (+) strand; PAM type: NRG; PAM sequence: AGG
catgtatttgtatagttttg

SEQ ID NO: 37078 - DNA, 20 bp, Artificial Sequence
  Description of Artificial Sequence: Synthetic oligonucleotide
  Target: SCN10A; (+) strand; PAM type: NRG; PAM sequence: GGG
atgtatttgtatagttttga

SEQ ID NO: 37079 - DNA, 20 bp, Artificial Sequence
  Description of Artificial Sequence: Synthetic oligonucleotide
  Target: SCN10A; (+) strand; PAM type: NRG; PAM sequence: TGG
atagttttgagggtttcttt

SEQ ID NO: 37080 - DNA, 20 bp, Artificial Sequence
  Description of Artificial Sequence: Synthetic oligonucleotide
  Target: SCN10A; (+) strand; PAM type: NRG; PAM sequence: GAG
agttttgagggtttcttttg

SEQ ID NO: 37081 - DNA, 20 bp, Artificial Sequence
  Description of Artificial Sequence: Synthetic oligonucleotide
  Target: SCN10A; (+) strand; PAM type: NRG; PAM sequence: GAG
tttcttttggagttaactcc

SEQ ID NO: 37082 - DNA, 20 bp, Artificial Sequence
  Description of Artificial Sequence: Synthetic oligonucleotide
  Target: SCN10A; (+) strand; PAM type: NRG; PAM sequence: AGG
ttcttttggagttaactccg

SEQ ID NO: 37083 - DNA, 20 bp, Artificial Sequence
  Description of Artificial Sequence: Synthetic oligonucleotide
  Target: SCN10A; (+) strand; PAM type: NRG; PAM sequence: GAG
ggtttattcgactgtgctct

SEQ ID NO: 37084 - DNA, 20 bp, Artificial Sequence
  Description of Artificial Sequence: Synthetic oligonucleotide
  Target: SCN10A; (+) strand; PAM type: NRG; PAM sequence: GAG
tttattcgactgtgctctga

SEQ ID NO: 37085 - DNA, 20 bp, Artificial Sequence
  Description of Artificial Sequence: Synthetic oligonucleotide
  Target: SCN10A; (+) strand; PAM type: NRG; PAM sequence: AGG
ttattcgactgtgctctgag

SEQ ID NO: 37086 - DNA, 20 bp, Artificial Sequence
  Description of Artificial Sequence: Synthetic oligonucleotide
  Target: SCN10A; (+) strand; PAM type: NRG; PAM sequence: GAG
tctattttcttaaatttatt

SEQ ID NO: 37087 - DNA, 20 bp, Artificial Sequence
  Description of Artificial Sequence: Synthetic oligonucleotide
  Target: SCN10A; (+) strand; PAM type: NRG; PAM sequence: TGG
ttgttatgttatctatcacg

SEQ ID NO: 37088 - DNA, 20 bp, Artificial Sequence
  Description of Artificial Sequence: Synthetic oligonucleotide
  Target: SCN10A; (+) strand; PAM type: NRG; PAM sequence: TAG
atctatcacgtggtctatct

SEQ ID NO: 37089 - DNA, 20 bp, Artificial Sequence
  Description of Artificial Sequence: Synthetic oligonucleotide
  Target: SCN10A; (+) strand; PAM type: NRG; PAM sequence: GAG
ctatcacgtggtctatctta

SEQ ID NO: 37090 - DNA, 20 bp, Artificial Sequence
  Description of Artificial Sequence: Synthetic oligonucleotide
  Target: SCN10A; (+) strand; PAM type: NRG; PAM sequence: AAG
atattccatgtgctgatgaa

SEQ ID NO: 37091 - DNA, 20 bp, Artificial Sequence
  Description of Artificial Sequence: Synthetic oligonucleotide
  Target: SCN10A; (+) strand; PAM type: NRG; PAM sequence: CAG
tgaaaagaatgtatattctg

SEQ ID NO: 37092 - DNA, 20 bp, Artificial Sequence
  Description of Artificial Sequence: Synthetic oligonucleotide
  Target: SCN10A; (+) strand; PAM type: NRG; PAM sequence: TGG
atgtatattctgcagttgtt

SEQ ID NO: 37093 - DNA, 20 bp, Artificial Sequence
  Description of Artificial Sequence: Synthetic oligonucleotide
  Target: SCN10A; (+) strand; PAM type: NRG; PAM sequence: TAG
tatattctgcagttgtttgg

SEQ ID NO: 37094 - DNA, 20 bp, Artificial Sequence
  Description of Artificial Sequence: Synthetic oligonucleotide
  Target: SCN10A; (+) strand; PAM type: NRG; PAM sequence: AAG
atgttttttaaatatctgtt

SEQ ID NO: 37095 - DNA, 20 bp, Artificial Sequence
  Description of Artificial Sequence: Synthetic oligonucleotide
  Target: SCN10A; (+) strand; PAM type: NRG; PAM sequence: TAG
tctgttaagtccatttgttc

SEQ ID NO: 37096 - DNA, 20 bp, Artificial Sequence
  Description of Artificial Sequence: Synthetic oligonucleotide
  Target: SCN10A; (+) strand; PAM type: NRG; PAM sequence: AGG
ctgttaagtccatttgttct

SEQ ID NO: 37097 - DNA, 20 bp, Artificial Sequence
  Description of Artificial Sequence: Synthetic oligonucleotide
  Target: SCN10A; (+) strand; PAM type: NRG; PAM sequence: CAG
agtccatttgttctaggtta

SEQ ID NO: 37098 - DNA, 20 bp, Artificial Sequence
  Description of Artificial Sequence: Synthetic oligonucleotide
  Target: SCN10A; (+) strand; PAM type: NRG; PAM sequence: AAG
tttgttctaggttacagttt

SEQ ID NO: 37099 - DNA, 20 bp, Artificial Sequence
  Description of Artificial Sequence: Synthetic oligonucleotide
  Target: SCN10A; (+) strand; PAM type: NRG; PAM sequence: TAG
ttctgtcttgatgacctgtc

SEQ ID NO: 37100 - DNA, 20 bp, Artificial Sequence
  Description of Artificial Sequence: Synthetic oligonucleotide
  Target: SCN10A; (+) strand; PAM type: NRG; PAM sequence: CAG
gatgacctgtctagtgctgt

SEQ ID NO: 37101 - DNA, 20 bp, Artificial Sequence
  Description of Artificial Sequence: Synthetic oligonucleotide
  Target: SCN10A; (+) strand; PAM type: NRG; PAM sequence: TGG
gacctgtctagtgctgtcag

SEQ ID NO: 37102 - DNA, 20 bp, Artificial Sequence
  Description of Artificial Sequence: Synthetic oligonucleotide
  Target: SCN10A; (+) strand; PAM type: NRG; PAM sequence: TAG
ttgctgtctatttcatttct

SEQ ID NO: 37103 - DNA, 20 bp, Artificial Sequence
  Description of Artificial Sequence: Synthetic oligonucleotide
  Target: SCN10A; (+) strand; PAM type: NRG; PAM sequence: AGG
tgctgtctatttcatttctt

SEQ ID NO: 37104 - DNA, 20 bp, Artificial Sequence
  Description of Artificial Sequence: Synthetic oligonucleotide
  Target: SCN10A; (+) strand; PAM type: NRG; PAM sequence: TAG
tctatttcatttcttaggtc

SEQ ID NO: 37105 - DNA, 20 bp, Artificial Sequence
  Description of Artificial Sequence: Synthetic oligonucleotide
  Target: SCN10A; (+) strand; PAM type: NRG; PAM sequence: TAG
atttcatttcttaggtctag

SEQ ID NO: 37106 - DNA, 20 bp, Artificial Sequence
  Description of Artificial Sequence: Synthetic oligonucleotide
  Target: SCN10A; (+) strand; PAM type: NRG; PAM sequence: TGG
tagtaattgttttataaatt

SEQ ID NO: 37107 - DNA, 20 bp, Artificial Sequence
  Description of Artificial Sequence: Synthetic oligonucleotide
  Target: SCN10A; (+) strand; PAM type: NRG; PAM sequence: GGG
agtaattgttttataaattt

SEQ ID NO: 37108 - DNA, 20 bp, Artificial Sequence
  Description of Artificial Sequence: Synthetic oligonucleotide
  Target: SCN10A; (+) strand; PAM type: NRG; PAM sequence: GAG
taattgttttataaatttgg

SEQ ID NO: 37109 - DNA, 20 bp, Artificial Sequence
  Description of Artificial Sequence: Synthetic oligonucleotide
  Target: SCN10A; (+) strand; PAM type: NRG; PAM sequence: CAG
ttttataaatttgggagctc

SEQ ID NO: 37110 - DNA, 20 bp, Artificial Sequence
  Description of Artificial Sequence: Synthetic oligonucleotide
  Target: SCN10A; (+) strand; PAM type: NRG; PAM sequence: TAG
aaatttgggagctccagtgt

SEQ ID NO: 37111 - DNA, 20 bp, Artificial Sequence
  Description of Artificial Sequence: Synthetic oligonucleotide
  Target: SCN10A; (+) strand; PAM type: NRG; PAM sequence: AGG
aatttgggagctccagtgtt

SEQ ID NO: 37112 - DNA, 20 bp, Artificial Sequence
  Description of Artificial Sequence: Synthetic oligonucleotide
  Target: SCN10A; (+) strand; PAM type: NRG; PAM sequence: TAG
gtgttaggtgcatatgtatt

SEQ ID NO: 37113 - DNA, 20 bp, Artificial Sequence
  Description of Artificial Sequence: Synthetic oligonucleotide
  Target: SCN10A; (+) strand; PAM type: NRG; PAM sequence: AGG
tgttaggtgcatatgtattt

SEQ ID NO: 37114 - DNA, 20 bp, Artificial Sequence
  Description of Artificial Sequence: Synthetic oligonucleotide
  Target: SCN10A; (+) strand; PAM type: NRG; PAM sequence: TAG
ggattatgatatttttccat

SEQ ID NO: 37115 - DNA, 20 bp, Artificial Sequence
  Description of Artificial Sequence: Synthetic oligonucleotide
  Target: SCN10A; (+) strand; PAM type: NRG; PAM sequence: AAG
tttttaactgttgttgcttt

SEQ ID NO: 37116 - DNA, 20 bp, Artificial Sequence
  Description of Artificial Sequence: Synthetic oligonucleotide
  Target: SCN10A; (+) strand; PAM type: NRG; PAM sequence: AGG
ttttaactgttgttgcttta

SEQ ID NO: 37117 - DNA, 20 bp, Artificial Sequence
  Description of Artificial Sequence: Synthetic oligonucleotide
  Target: SCN10A; (+) strand; PAM type: NRG; PAM sequence: AAG
aggtctgttttctctgatat

SEQ ID NO: 37118 - DNA, 20 bp, Artificial Sequence
  Description of Artificial Sequence: Synthetic oligonucleotide
  Target: SCN10A; (+) strand; PAM type: NRG; PAM sequence: TAG
tgttttctctgatataagaa

SEQ ID NO: 37119 - DNA, 20 bp, Artificial Sequence
  Description of Artificial Sequence: Synthetic oligonucleotide
  Target: SCN10A; (+) strand; PAM type: NRG; PAM sequence: TGG
tagctactcctgcttgcttt

SEQ ID NO: 37120 - DNA, 20 bp, Artificial Sequence
  Description of Artificial Sequence: Synthetic oligonucleotide
  Target: SCN10A; (+) strand; PAM type: NRG; PAM sequence: TGG
gcttttggtttccatttgca

SEQ ID NO: 37121 - DNA, 20 bp, Artificial Sequence
  Description of Artificial Sequence: Synthetic oligonucleotide
  Target: SCN10A; (+) strand; PAM type: NRG; PAM sequence: AAG
ttttcccatctctttacctt

SEQ ID NO: 37122 - DNA, 20 bp, Artificial Sequence
  Description of Artificial Sequence: Synthetic oligonucleotide
  Target: SCN10A; (+) strand; PAM type: NRG; PAM sequence: TGG
ctctttaccttaagtttatg

SEQ ID NO: 37123 - DNA, 20 bp, Artificial Sequence
  Description of Artificial Sequence: Synthetic oligonucleotide
  Target: SCN10A; (+) strand; PAM type: NRG; PAM sequence: TAG
ttatgtggctccttatgtgt

SEQ ID NO: 37124 - DNA, 20 bp, Artificial Sequence
  Description of Artificial Sequence: Synthetic oligonucleotide
  Target: SCN10A; (+) strand; PAM type: NRG; PAM sequence: AGG
tatgtggctccttatgtgtt

SEQ ID NO: 37125 - DNA, 20 bp, Artificial Sequence
  Description of Artificial Sequence: Synthetic oligonucleotide
  Target: SCN10A; (+) strand; PAM type: NRG; PAM sequence: GAG
tggctccttatgtgttaggt

SEQ ID NO: 37126 - DNA, 20 bp, Artificial Sequence
  Description of Artificial Sequence: Synthetic oligonucleotide
  Target: SCN10A; (+) strand; PAM type: NRG; PAM sequence: AAG
tgtgttaggtgagtctcttg

SEQ ID NO: 37127 - DNA, 20 bp, Artificial Sequence
  Description of Artificial Sequence: Synthetic oligonucleotide
  Target: SCN10A; (+) strand; PAM type: NRG; PAM sequence: CAG
ttaggtgagtctcttgaaga

SEQ ID NO: 37128 - DNA, 20 bp, Artificial Sequence
  Description of Artificial Sequence: Synthetic oligonucleotide
  Target: SCN10A; (+) strand; PAM type: NRG; PAM sequence: TAG
ggtgagtctcttgaagacag

SEQ ID NO: 37129 - DNA, 20 bp, Artificial Sequence
  Description of Artificial Sequence: Synthetic oligonucleotide
  Target: SCN10A; (+) strand; PAM type: NRG; PAM sequence: TGG
tcttgaagacagtagatact

SEQ ID NO: 37130 - DNA, 20 bp, Artificial Sequence
  Description of Artificial Sequence: Synthetic oligonucleotide
  Target: SCN10A; (+) strand; PAM type: NRG; PAM sequence: TGG
gaagacagtagatacttggt

SEQ ID NO: 37131 - DNA, 20 bp, Artificial Sequence
  Description of Artificial Sequence: Synthetic oligonucleotide
  Target: SCN10A; (+) strand; PAM type: NRG; PAM sequence: TGG
gacagtagatacttggttgg

SEQ ID NO: 37132 - DNA, 20 bp, Artificial Sequence
  Description of Artificial Sequence: Synthetic oligonucleotide
  Target: SCN10A; (+) strand; PAM type: NRG; PAM sequence: AAG
tctgcccttctgtatatttt

SEQ ID NO: 37133 - DNA, 20 bp, Artificial Sequence
  Description of Artificial Sequence: Synthetic oligonucleotide
  Target: SCN10A; (+) strand; PAM type: NRG; PAM sequence: TGG
gcccttctgtatattttaag

SEQ ID NO: 37134 - DNA, 20 bp, Artificial Sequence
  Description of Artificial Sequence: Synthetic oligonucleotide
  Target: SCN10A; (+) strand; PAM type: NRG; PAM sequence: TAG
tatattttaagtggatcatt

SEQ ID NO: 37135 - DNA, 20 bp, Artificial Sequence
  Description of Artificial Sequence: Synthetic oligonucleotide
  Target: SCN10A; (+) strand; PAM type: NRG; PAM sequence: AGG
atattttaagtggatcattt

SEQ ID NO: 37136 - DNA, 20 bp, Artificial Sequence
  Description of Artificial Sequence: Synthetic oligonucleotide
  Target: SCN10A; (+) strand; PAM type: NRG; PAM sequence: GGG
tattttaagtggatcattta

SEQ ID NO: 37137 - DNA, 20 bp, Artificial Sequence
  Description of Artificial Sequence: Synthetic oligonucleotide
  Target: SCN10A; (+) strand; PAM type: NRG; PAM sequence: CAG
agggcatttacactcaacat

SEQ ID NO: 37138 - DNA, 20 bp, Artificial Sequence
  Description of Artificial Sequence: Synthetic oligonucleotide
  Target: SCN10A; (+) strand; PAM type: NRG; PAM sequence: GAG
ttacactcaacatcagtatt

SEQ ID NO: 37139 - DNA, 20 bp, Artificial Sequence
  Description of Artificial Sequence: Synthetic oligonucleotide
  Target: SCN10A; (+) strand; PAM type: NRG; PAM sequence: GAG
caacatcagtattgagatgt

SEQ ID NO: 37140 - DNA, 20 bp, Artificial Sequence
  Description of Artificial Sequence: Synthetic oligonucleotide
  Target: SCN10A; (+) strand; PAM type: NRG; PAM sequence: AGG
aacatcagtattgagatgtg

SEQ ID NO: 37141 - DNA, 20 bp, Artificial Sequence
  Description of Artificial Sequence: Synthetic oligonucleotide
  Target: SCN10A; (+) strand; PAM type: NRG; PAM sequence: TAG
tactcttctattcattatgc

SEQ ID NO: 37142 - DNA, 20 bp, Artificial Sequence
  Description of Artificial Sequence: Synthetic oligonucleotide
  Target: SCN10A; (+) strand; PAM type: NRG; PAM sequence: TAG
tttattgtgttattgtttta

SEQ ID NO: 37143 - DNA, 20 bp, Artificial Sequence
  Description of Artificial Sequence: Synthetic oligonucleotide
  Target: SCN10A; (+) strand; PAM type: NRG; PAM sequence: AGG
ttattgtgttattgttttat

SEQ ID NO: 37144 - DNA, 20 bp, Artificial Sequence
  Description of Artificial Sequence: Synthetic oligonucleotide
  Target: SCN10A; (+) strand; PAM type: NRG; PAM sequence: AAG
tcctttgatatttatgcttt

SEQ ID NO: 37145 - DNA, 20 bp, Artificial Sequence
  Description of Artificial Sequence: Synthetic oligonucleotide
  Target: SCN10A; (+) strand; PAM type: NRG; PAM sequence: AGG
cctttgatatttatgcttta

SEQ ID NO: 37146 - DNA, 20 bp, Artificial Sequence
  Description of Artificial Sequence: Synthetic oligonucleotide
  Target: SCN10A; (+) strand; PAM type: NRG; PAM sequence: GAG
tttgatatttatgctttaag

SEQ ID NO: 37147 - DNA, 20 bp, Artificial Sequence
  Description of Artificial Sequence: Synthetic oligonucleotide
  Target: SCN10A; (+) strand; PAM type: NRG; PAM sequence: AGG
ttgatatttatgctttaagg

SEQ ID NO: 37148 - DNA, 20 bp, Artificial Sequence
  Description of Artificial Sequence: Synthetic oligonucleotide
  Target: SCN10A; (+) strand; PAM type: NRG; PAM sequence: TGG
gctttaaggaggttctattt

SEQ ID NO: 37149 - DNA, 20 bp, Artificial Sequence
  Description of Artificial Sequence: Synthetic oligonucleotide
  Target: SCN10A; (+) strand; PAM type: NRG; PAM sequence: AAG
gttctattttggtgtatttt

SEQ ID NO: 37150 - DNA, 20 bp, Artificial Sequence
  Description of Artificial Sequence: Synthetic oligonucleotide
  Target: SCN10A; (+) strand; PAM type: NRG; PAM sequence: AGG
ttctattttggtgtatttta

SEQ ID NO: 37151 - DNA, 20 bp, Artificial Sequence
  Description of Artificial Sequence: Synthetic oligonucleotide
  Target: SCN10A; (+) strand; PAM type: NRG; PAM sequence: AAG
gtattttaaggttttatttc

SEQ ID NO: 37152 - DNA, 20 bp, Artificial Sequence
  Description of Artificial Sequence: Synthetic oligonucleotide
  Target: SCN10A; (+) strand; PAM type: NRG; PAM sequence: TAG
taaggttttatttcaagatt

SEQ ID NO: 37153 - DNA, 20 bp, Artificial Sequence
  Description of Artificial Sequence: Synthetic oligonucleotide
  Target: SCN10A; (+) strand; PAM type: NRG; PAM sequence: TAG
tcaagatttagaattccttt

SEQ ID NO: 37154 - DNA, 20 bp, Artificial Sequence
  Description of Artificial Sequence: Synthetic oligonucleotide
  Target: SCN10A; (+) strand; PAM type: NRG; PAM sequence: TAG
attccttttagcatttcttg

SEQ ID NO: 37155 - DNA, 20 bp, Artificial Sequence
  Description of Artificial Sequence: Synthetic oligonucleotide
  Target: SCN10A; (+) strand; PAM type: NRG; PAM sequence: TGG
tttagcatttcttgtagtgc

SEQ ID NO: 37156 - DNA, 20 bp, Artificial Sequence
  Description of Artificial Sequence: Synthetic oligonucleotide
  Target: SCN10A; (+) strand; PAM type: NRG; PAM sequence: TGG
catttcttgtagtgctggct

SEQ ID NO: 37157 - DNA, 20 bp, Artificial Sequence
  Description of Artificial Sequence: Synthetic oligonucleotide
  Target: SCN10A; (+) strand; PAM type: NRG; PAM sequence: TAG
ttcttgtagtgctggcttgg

SEQ ID NO: 37158 - DNA, 20 bp, Artificial Sequence
  Description of Artificial Sequence: Synthetic oligonucleotide
  Target: SCN10A; (+) strand; PAM type: NRG; PAM sequence: TGG
ttgtagtgctggcttggtag

SEQ ID NO: 37159 - DNA, 20 bp, Artificial Sequence
  Description of Artificial Sequence: Synthetic oligonucleotide
  Target: SCN10A; (+) strand; PAM type: NRG; PAM sequence: AAG
ttatcttgtcttcacttatg

SEQ ID NO: 37160 - DNA, 20 bp, Artificial Sequence
  Description of Artificial Sequence: Synthetic oligonucleotide
  Target: SCN10A; (+) strand; PAM type: NRG; PAM sequence: TAG
ttgtcttcacttatgaagct

SEQ ID NO: 37161 - DNA, 20 bp, Artificial Sequence
  Description of Artificial Sequence: Synthetic oligonucleotide
  Target: SCN10A; (+) strand; PAM type: NRG; PAM sequence: TGG
ttctcttcatacaatattct

SEQ ID NO: 37162 - DNA, 20 bp, Artificial Sequence
  Description of Artificial Sequence: Synthetic oligonucleotide
  Target: SCN10A; (+) strand; PAM type: NRG; PAM sequence: TGG
cttcatacaatattcttggc

SEQ ID NO: 37163 - DNA, 20 bp, Artificial Sequence
  Description of Artificial Sequence: Synthetic oligonucleotide
  Target: SCN10A; (+) strand; PAM type: NRG; PAM sequence: CAG
ggctggcaattattttgttt

SEQ ID NO: 37164 - DNA, 20 bp, Artificial Sequence
  Description of Artificial Sequence: Synthetic oligonucleotide
  Target: SCN10A; (+) strand; PAM type: NRG; PAM sequence: AGG
gctggcaattattttgtttc

SEQ ID NO: 37165 - DNA, 20 bp, Artificial Sequence
  Description of Artificial Sequence: Synthetic oligonucleotide
  Target: SCN10A; (+) strand; PAM type: NRG; PAM sequence: GAG
tggcaattattttgtttcag

SEQ ID NO: 37166 - DNA, 20 bp, Artificial Sequence
  Description of Artificial Sequence: Synthetic oligonucleotide
  Target: SCN10A; (+) strand; PAM type: NRG; PAM sequence: AGG
ggcaattattttgtttcagg

SEQ ID NO: 37167 - DNA, 20 bp, Artificial Sequence
  Description of Artificial Sequence: Synthetic oligonucleotide
  Target: SCN10A; (+) strand; PAM type: NRG; PAM sequence: AAG
tattttgtttcaggaggcta

SEQ ID NO: 37168 - DNA, 20 bp, Artificial Sequence
  Description of Artificial Sequence: Synthetic oligonucleotide
  Target: SCN10A; (+) strand; PAM type: NRG; PAM sequence: TGG
ttgtttcaggaggctaaaga

SEQ ID NO: 37169 - DNA, 20 bp, Artificial Sequence
  Description of Artificial Sequence: Synthetic oligonucleotide
  Target: SCN10A; (+) strand; PAM type: NRG; PAM sequence: GGG
tgtttcaggaggctaaagat

SEQ ID NO: 37170 - DNA, 20 bp, Artificial Sequence
  Description of Artificial Sequence: Synthetic oligonucleotide
  Target: SCN10A; (+) strand; PAM type: NRG; PAM sequence: TGG
gatgggaccctaatcccttc

SEQ ID NO: 37171 - DNA, 20 bp, Artificial Sequence
  Description of Artificial Sequence: Synthetic oligonucleotide
  Target: SCN10A; (+) strand; PAM type: NRG; PAM sequence: AAG
cctaatcccttctggcttgc

SEQ ID NO: 37172 - DNA, 20 bp, Artificial Sequence
  Description of Artificial Sequence: Synthetic oligonucleotide
  Target: SCN10A; (+) strand; PAM type: NRG; PAM sequence: AGG
ctaatcccttctggcttgca

SEQ ID NO: 37173 - DNA, 20 bp, Artificial Sequence
  Description of Artificial Sequence: Synthetic oligonucleotide
  Target: SCN10A; (+) strand; PAM type: NRG; PAM sequence: CAG
ccttctggcttgcaaggttt

SEQ ID NO: 37174 - DNA, 20 bp, Artificial Sequence
  Description of Artificial Sequence: Synthetic oligonucleotide
  Target: SCN10A; (+) strand; PAM type: NRG; PAM sequence: GAG
tggcttgcaaggtttcagtt

SEQ ID NO: 37175 - DNA, 20 bp, Artificial Sequence
  Description of Artificial Sequence: Synthetic oligonucleotide
  Target: SCN10A; (+) strand; PAM type: NRG; PAM sequence: CAG
gctgttaatcttatgtaaat

SEQ ID NO: 37176 - DNA, 20 bp, Artificial Sequence
  Description of Artificial Sequence: Synthetic oligonucleotide
  Target: SCN10A; (+) strand; PAM type: NRG; PAM sequence: TAG
atcagataacctttccttta

SEQ ID NO: 37177 - DNA, 20 bp, Artificial Sequence
  Description of Artificial Sequence: Synthetic oligonucleotide
  Target: SCN10A; (+) strand; PAM type: NRG; PAM sequence: AGG
tcagataacctttcctttat

SEQ ID NO: 37178 - DNA, 20 bp, Artificial Sequence
  Description of Artificial Sequence: Synthetic oligonucleotide
  Target: SCN10A; (+) strand; PAM type: NRG; PAM sequence: GAG
ctttcctttataggttatct

SEQ ID NO: 37179 - DNA, 20 bp, Artificial Sequence
  Description of Artificial Sequence: Synthetic oligonucleotide
  Target: SCN10A; (+) strand; PAM type: NRG; PAM sequence: AGG
tttcctttataggttatctg

SEQ ID NO: 37180 - DNA, 20 bp, Artificial Sequence
  Description of Artificial Sequence: Synthetic oligonucleotide
  Target: SCN10A; (+) strand; PAM type: NRG; PAM sequence: CAG
tatctgaggcttttgtctca

SEQ ID NO: 37181 - DNA, 20 bp, Artificial Sequence
  Description of Artificial Sequence: Synthetic oligonucleotide
  Target: SCN10A; (+) strand; PAM type: NRG; PAM sequence: AAG
gcttttgtctcacagctctt

SEQ ID NO: 37182 - DNA, 20 bp, Artificial Sequence
  Description of Artificial Sequence: Synthetic oligonucleotide
  Target: SCN10A; (+) strand; PAM type: NRG; PAM sequence: TAG
tcttttctttgtcttgactt

SEQ ID NO: 37183 - DNA, 20 bp, Artificial Sequence
  Description of Artificial Sequence: Synthetic oligonucleotide
  Target: SCN10A; (+) strand; PAM type: NRG; PAM sequence: TAG
taacctgatgtctatttgcc

SEQ ID NO: 37184 - DNA, 20 bp, Artificial Sequence
  Description of Artificial Sequence: Synthetic oligonucleotide
  Target: SCN10A; (+) strand; PAM type: NRG; PAM sequence: AGG
aacctgatgtctatttgcct

SEQ ID NO: 37185 - DNA, 20 bp, Artificial Sequence
  Description of Artificial Sequence: Synthetic oligonucleotide
  Target: SCN10A; (+) strand; PAM type: NRG; PAM sequence: CAG
atcttttttgtgacacattt

SEQ ID NO: 37186 - DNA, 20 bp, Artificial Sequence
  Description of Artificial Sequence: Synthetic oligonucleotide
  Target: SCN10A; (+) strand; PAM type: NRG; PAM sequence: GAG
cttttttgtgacacatttca

SEQ ID NO: 37187 - DNA, 20 bp, Artificial Sequence
  Description of Artificial Sequence: Synthetic oligonucleotide
  Target: SCN10A; (+) strand; PAM type: NRG; PAM sequence: AGG
ttttttgtgacacatttcag

SEQ ID NO: 37188 - DNA, 20 bp, Artificial Sequence
  Description of Artificial Sequence: Synthetic oligonucleotide
  Target: SCN10A; (+) strand; PAM type: NRG; PAM sequence: GAG
acatttcagaggtattcttt

SEQ ID NO: 37189 - DNA, 20 bp, Artificial Sequence
  Description of Artificial Sequence: Synthetic oligonucleotide
  Target: SCN10A; (+) strand; PAM type: NRG; PAM sequence: TGG
ttctttgagcttcttgtatt

SEQ ID NO: 37190 - DNA, 20 bp, Artificial Sequence
  Description of Artificial Sequence: Synthetic oligonucleotide
  Target: SCN10A; (+) strand; PAM type: NRG; PAM sequence: AAG
tggatatctatatttctaac

SEQ ID NO: 37191 - DNA, 20 bp, Artificial Sequence
  Description of Artificial Sequence: Synthetic oligonucleotide
  Target: SCN10A; (+) strand; PAM type: NRG; PAM sequence: AGG
ggatatctatatttctaaca

SEQ ID NO: 37192 - DNA, 20 bp, Artificial Sequence
  Description of Artificial Sequence: Synthetic oligonucleotide
  Target: SCN10A; (+) strand; PAM type: NRG; PAM sequence: CAG
atctatatttctaacaaggc

SEQ ID NO: 37193 - DNA, 20 bp, Artificial Sequence
  Description of Artificial Sequence: Synthetic oligonucleotide
  Target: SCN10A; (+) strand; PAM type: NRG; PAM sequence: AGG
tctatatttctaacaaggcc

SEQ ID NO: 37194 - DNA, 20 bp, Artificial Sequence
  Description of Artificial Sequence: Synthetic oligonucleotide
  Target: SCN10A; (+) strand; PAM type: NRG; PAM sequence: GGG
ctatatttctaacaaggcca

SEQ ID NO: 37195 - DNA, 20 bp, Artificial Sequence
  Description of Artificial Sequence: Synthetic oligonucleotide
  Target: SCN10A; (+) strand; PAM type: NRG; PAM sequence: AAG
tatttctaacaaggccaggg

SEQ ID NO: 37196 - DNA, 20 bp, Artificial Sequence
  Description of Artificial Sequence: Synthetic oligonucleotide
  Target: SCN10A; (+) strand; PAM type: NRG; PAM sequence: AAG
cctcaattattccctcaaat

SEQ ID NO: 37197 - DNA, 20 bp, Artificial Sequence
  Description of Artificial Sequence: Synthetic oligonucleotide
  Target: SCN10A; (+) strand; PAM type: NRG; PAM sequence: TAG
aaataagttttccaaacttt

SEQ ID NO: 37198 - DNA, 20 bp, Artificial Sequence
  Description of Artificial Sequence: Synthetic oligonucleotide
  Target: SCN10A; (+) strand; PAM type: NRG; PAM sequence: TGG
tttagatttctattcttcct

SEQ ID NO: 37199 - DNA, 20 bp, Artificial Sequence
  Description of Artificial Sequence: Synthetic oligonucleotide
  Target: SCN10A; (+) strand; PAM type: NRG; PAM sequence: GGG
ttagatttctattcttcctt

SEQ ID NO: 37200 - DNA, 20 bp, Artificial Sequence
  Description of Artificial Sequence: Synthetic oligonucleotide
  Target: SCN10A; (+) strand; PAM type: NRG; PAM sequence: TAG
ttgggaacacccattattct

SEQ ID NO: 37201 - DNA, 20 bp, Artificial Sequence
  Description of Artificial Sequence: Synthetic oligonucleotide
  Target: SCN10A; (+) strand; PAM type: NRG; PAM sequence: AGG
tgggaacacccattattctt

SEQ ID NO: 37202 - DNA, 20 bp, Artificial Sequence
  Description of Artificial Sequence: Synthetic oligonucleotide
  Target: SCN10A; (+) strand; PAM type: NRG; PAM sequence: TGG
acacccattattcttaggtt

SEQ ID NO: 37203 - DNA, 20 bp, Artificial Sequence
  Description of Artificial Sequence: Synthetic oligonucleotide
  Target: SCN10A; (+) strand; PAM type: NRG; PAM sequence: TGG
tcacatgattccaaatttat

SEQ ID NO: 37204 - DNA, 20 bp, Artificial Sequence
  Description of Artificial Sequence: Synthetic oligonucleotide
  Target: SCN10A; (+) strand; PAM type: NRG; PAM sequence: TAG
ttctttctttttgtgtgtct

SEQ ID NO: 37205 - DNA, 20 bp, Artificial Sequence
  Description of Artificial Sequence: Synthetic oligonucleotide
  Target: SCN10A; (+) strand; PAM type: NRG; PAM sequence: TGG
tctttttgtgtgtcttagtt

SEQ ID NO: 37206 - DNA, 20 bp, Artificial Sequence
  Description of Artificial Sequence: Synthetic oligonucleotide
  Target: SCN10A; (+) strand; PAM type: NRG; PAM sequence: GGG
ctttttgtgtgtcttagttt

SEQ ID NO: 37207 - DNA, 20 bp, Artificial Sequence
  Description of Artificial Sequence: Synthetic oligonucleotide
  Target: SCN10A; (+) strand; PAM type: NRG; PAM sequence: AAG
tcttagtttgggtctattaa

SEQ ID NO: 37208 - DNA, 20 bp, Artificial Sequence
  Description of Artificial Sequence: Synthetic oligonucleotide
  Target: SCN10A; (+) strand; PAM type: NRG; PAM sequence: GAG
ctattaaaagctttgtcttc

SEQ ID NO: 37209 - DNA, 20 bp, Artificial Sequence
  Description of Artificial Sequence: Synthetic oligonucleotide
  Target: SCN10A; (+) strand; PAM type: NRG; PAM sequence: AAG
agctttgtcttcgagctctg

SEQ ID NO: 37210 - DNA, 20 bp, Artificial Sequence
  Description of Artificial Sequence: Synthetic oligonucleotide
  Target: SCN10A; (+) strand; PAM type: NRG; PAM sequence: TAG
gttctttcttctacttgttc

SEQ ID NO: 37211 - DNA, 20 bp, Artificial Sequence
  Description of Artificial Sequence: Synthetic oligonucleotide
  Target: SCN10A; (+) strand; PAM type: NRG; PAM sequence: AAG
actgcattttgtatttctct

SEQ ID NO: 37212 - DNA, 20 bp, Artificial Sequence
  Description of Artificial Sequence: Synthetic oligonucleotide
  Target: SCN10A; (+) strand; PAM type: NRG; PAM sequence: GAG
cattttgtatttctctaagt

SEQ ID NO: 37213 - DNA, 20 bp, Artificial Sequence
  Description of Artificial Sequence: Synthetic oligonucleotide
  Target: SCN10A; (+) strand; PAM type: NRG; PAM sequence: CAG
ctaagtgagtcttccatttc

SEQ ID NO: 37214 - DNA, 20 bp, Artificial Sequence
  Description of Artificial Sequence: Synthetic oligonucleotide
  Target: SCN10A; (+) strand; PAM type: NRG; PAM sequence: AAG
agtgagtcttccatttccag

SEQ ID NO: 37215 - DNA, 20 bp, Artificial Sequence
  Description of Artificial Sequence: Synthetic oligonucleotide
  Target: SCN10A; (+) strand; PAM type: NRG; PAM sequence: TGG
tttctttatatctatttctc

SEQ ID NO: 37216 - DNA, 20 bp, Artificial Sequence
  Description of Artificial Sequence: Synthetic oligonucleotide
  Target: SCN10A; (+) strand; PAM type: NRG; PAM sequence: GAG
tctttatatctatttctctg

SEQ ID NO: 37217 - DNA, 20 bp, Artificial Sequence
  Description of Artificial Sequence: Synthetic oligonucleotide
  Target: SCN10A; (+) strand; PAM type: NRG; PAM sequence: AAG
gttgttttaaaaatttcttt

SEQ ID NO: 37218 - DNA, 20 bp, Artificial Sequence
  Description of Artificial Sequence: Synthetic oligonucleotide
  Target: SCN10A; (+) strand; PAM type: NRG; PAM sequence: TGG
ttttaaaaatttctttaagt

SEQ ID NO: 37219 - DNA, 20 bp, Artificial Sequence
  Description of Artificial Sequence: Synthetic oligonucleotide
  Target: SCN10A; (+) strand; PAM type: NRG; PAM sequence: TGG
agttggtttttatctttctc

SEQ ID NO: 37220 - DNA, 20 bp, Artificial Sequence
  Description of Artificial Sequence: Synthetic oligonucleotide
  Target: SCN10A; (+) strand; PAM type: NRG; PAM sequence: CAG
tccttgaatcacttaataat

SEQ ID NO: 37221 - DNA, 20 bp, Artificial Sequence
  Description of Artificial Sequence: Synthetic oligonucleotide
  Target: SCN10A; (+) strand; PAM type: NRG; PAM sequence: GAG
attctttttttttttttttt

SEQ ID NO: 37222 - DNA, 20 bp, Artificial Sequence
  Description of Artificial Sequence: Synthetic oligonucleotide
  Target: SCN10A; (+) strand; PAM type: NRG; PAM sequence: TGG
ttttttttttttttttgaga

SEQ ID NO: 37223 - DNA, 20 bp, Artificial Sequence
  Description of Artificial Sequence: Synthetic oligonucleotide
  Target: SCN10A; (+) strand; PAM type: NRG; PAM sequence: CAG
ggattttcactcttgttgcc

SEQ ID NO: 37224 - DNA, 20 bp, Artificial Sequence
  Description of Artificial Sequence: Synthetic oligonucleotide
  Target: SCN10A; (+) strand; PAM type: NRG; PAM sequence: AGG
gattttcactcttgttgccc

SEQ ID NO: 37225 - DNA, 20 bp, Artificial Sequence
  Description of Artificial Sequence: Synthetic oligonucleotide
  Target: SCN10A; (+) strand; PAM type: NRG; PAM sequence: TGG
ttcactcttgttgcccaggc

SEQ ID NO: 37226 - DNA, 20 bp, Artificial Sequence
  Description of Artificial Sequence: Synthetic oligonucleotide
  Target: SCN10A; (+) strand; PAM type: NRG; PAM sequence: GAG
cactcttgttgcccaggctg

SEQ ID NO: 37227 - DNA, 20 bp, Artificial Sequence
  Description of Artificial Sequence: Synthetic oligonucleotide
  Target: SCN10A; (+) strand; PAM type: NRG; PAM sequence: TGG
ttgcccaggctggagtgcaa

SEQ ID NO: 37228 - DNA, 20 bp, Artificial Sequence
  Description of Artificial Sequence: Synthetic oligonucleotide
  Target: SCN10A; (+) strand; PAM type: NRG; PAM sequence: CAG
ggagtgcaatggcgcgatct

SEQ ID NO: 37229 - DNA, 20 bp, Artificial Sequence
  Description of Artificial Sequence: Synthetic oligonucleotide
  Target: SCN10A; (+) strand; PAM type: NRG; PAM sequence: CAG
tcaccgcaacctctgcctcc

SEQ ID NO: 37230 - DNA, 20 bp, Artificial Sequence
  Description of Artificial Sequence: Synthetic oligonucleotide
  Target: SCN10A; (+) strand; PAM type: NRG; PAM sequence: AGG
caccgcaacctctgcctccc

SEQ ID NO: 37231 - DNA, 20 bp, Artificial Sequence
  Description of Artificial Sequence: Synthetic oligonucleotide
  Target: SCN10A; (+) strand; PAM type: NRG; PAM sequence: AAG
aacctctgcctcccaggttc

SEQ ID NO: 37232 - DNA, 20 bp, Artificial Sequence
  Description of Artificial Sequence: Synthetic oligonucleotide
  Target: SCN10A; (+) strand; PAM type: NRG; PAM sequence: CAG
ttcaagcaattctcctgcct

SEQ ID NO: 37233 - DNA, 20 bp, Artificial Sequence
  Description of Artificial Sequence: Synthetic oligonucleotide
  Target: SCN10A; (+) strand; PAM type: NRG; PAM sequence: GAG
ttctcctgcctcagtctcct

SEQ ID NO: 37234 - DNA, 20 bp, Artificial Sequence
  Description of Artificial Sequence: Synthetic oligonucleotide
  Target: SCN10A; (+) strand; PAM type: NRG; PAM sequence: TAG
tcctgcctcagtctcctgag

SEQ ID NO: 37235 - DNA, 20 bp, Artificial Sequence
  Description of Artificial Sequence: Synthetic oligonucleotide
  Target: SCN10A; (+) strand; PAM type: NRG; PAM sequence: TGG
gcctcagtctcctgagtagc

SEQ ID NO: 37236 - DNA, 20 bp, Artificial Sequence
  Description of Artificial Sequence: Synthetic oligonucleotide
  Target: SCN10A; (+) strand; PAM type: NRG; PAM sequence: GGG
cctcagtctcctgagtagct

SEQ ID NO: 37237 - DNA, 20 bp, Artificial Sequence
  Description of Artificial Sequence: Synthetic oligonucleotide
  Target: SCN10A; (+) strand; PAM type: NRG; PAM sequence: CAG
ctcctgagtagctgggatta

SEQ ID NO: 37238 - DNA, 20 bp, Artificial Sequence
  Description of Artificial Sequence: Synthetic oligonucleotide
  Target: SCN10A; (+) strand; PAM type: NRG; PAM sequence: AGG
tcctgagtagctgggattac

SEQ ID NO: 37239 - DNA, 20 bp, Artificial Sequence
  Description of Artificial Sequence: Synthetic oligonucleotide
  Target: SCN10A; (+) strand; PAM type: NRG; PAM sequence: TAG
caggcatgcaccaccacatc

SEQ ID NO: 37240 - DNA, 20 bp, Artificial Sequence
  Description of Artificial Sequence: Synthetic oligonucleotide
  Target: SCN10A; (+) strand; PAM type: NRG; PAM sequence: TAG
ctagctaattttgtattttt

SEQ ID NO: 37241 - DNA, 20 bp, Artificial Sequence
  Description of Artificial Sequence: Synthetic oligonucleotide
  Target: SCN10A; (+) strand; PAM type: NRG; PAM sequence: TAG
gctaattttgtattttttag

SEQ ID NO: 37242 - DNA, 20 bp, Artificial Sequence
  Description of Artificial Sequence: Synthetic oligonucleotide
  Target: SCN10A; (+) strand; PAM type: NRG; PAM sequence: GAG
taattttgtattttttagta

SEQ ID NO: 37243 - DNA, 20 bp, Artificial Sequence
  Description of Artificial Sequence: Synthetic oligonucleotide
  Target: SCN10A; (+) strand; PAM type: NRG; PAM sequence: CGG
tttgtattttttagtagaga

SEQ ID NO: 37244 - DNA, 20 bp, Artificial Sequence
  Description of Artificial Sequence: Synthetic oligonucleotide
  Target: SCN10A; (+) strand; PAM type: NRG; PAM sequence: GGG
ttgtattttttagtagagac

SEQ ID NO: 37245 - DNA, 20 bp, Artificial Sequence
  Description of Artificial Sequence: Synthetic oligonucleotide
  Target: SCN10A; (+) strand; PAM type: NRG; PAM sequence: GGG
tgtattttttagtagagacg

SEQ ID NO: 37246 - DNA, 20 bp, Artificial Sequence
  Description of Artificial Sequence: Synthetic oligonucleotide
  Target: SCN10A; (+) strand; PAM type: NRG; PAM sequence: TGG
gagacggggtttctccatgt

SEQ ID NO: 37247 - DNA, 20 bp, Artificial Sequence
  Description of Artificial Sequence: Synthetic oligonucleotide
  Target: SCN10A; (+) strand; PAM type: NRG; PAM sequence: CAG
gggtttctccatgttggctt

SEQ ID NO: 37248 - DNA, 20 bp, Artificial Sequence
  Description of Artificial Sequence: Synthetic oligonucleotide
  Target: SCN10A; (+) strand; PAM type: NRG; PAM sequence: AGG
ggtttctccatgttggcttc

SEQ ID NO: 37249 - DNA, 20 bp, Artificial Sequence
  Description of Artificial Sequence: Synthetic oligonucleotide
  Target: SCN10A; (+) strand; PAM type: NRG; PAM sequence: TGG
tctccatgttggcttcaggc

SEQ ID NO: 37250 - DNA, 20 bp, Artificial Sequence
  Description of Artificial Sequence: Synthetic oligonucleotide
  Target: SCN10A; (+) strand; PAM type: NRG; PAM sequence: CAG
tggtcttgaacttctgacct

SEQ ID NO: 37251 - DNA, 20 bp, Artificial Sequence
  Description of Artificial Sequence: Synthetic oligonucleotide
  Target: SCN10A; (+) strand; PAM type: NRG; PAM sequence: AGG
ggtcttgaacttctgacctc

SEQ ID NO: 37252 - DNA, 20 bp, Artificial Sequence
  Description of Artificial Sequence: Synthetic oligonucleotide
  Target: SCN10A; (+) strand; PAM type: NRG; PAM sequence: TGG
ctcaggtgatctgcccacct

SEQ ID NO: 37253 - DNA, 20 bp, Artificial Sequence
  Description of Artificial Sequence: Synthetic oligonucleotide
  Target: SCN10A; (+) strand; PAM type: NRG; PAM sequence: AAG
ctgcccaccttggcctccca

SEQ ID NO: 37254 - DNA, 20 bp, Artificial Sequence
  Description of Artificial Sequence: Synthetic oligonucleotide
  Target: SCN10A; (+) strand; PAM type: NRG; PAM sequence: GAG
ccttggcctcccaaagtgct

SEQ ID NO: 37255 - DNA, 20 bp, Artificial Sequence
  Description of Artificial Sequence: Synthetic oligonucleotide
  Target: SCN10A; (+) strand; PAM type: NRG; PAM sequence: CAG
ctcccaaagtgctgagatta

SEQ ID NO: 37256 - DNA, 20 bp, Artificial Sequence
  Description of Artificial Sequence: Synthetic oligonucleotide
  Target: SCN10A; (+) strand; PAM type: NRG; PAM sequence: AGG
tcccaaagtgctgagattac

SEQ ID NO: 37257 - DNA, 20 bp, Artificial Sequence
  Description of Artificial Sequence: Synthetic oligonucleotide
  Target: SCN10A; (+) strand; PAM type: NRG; PAM sequence: GAG
agtgctgagattacaggcgt

SEQ ID NO: 37258 - DNA, 20 bp, Artificial Sequence
  Description of Artificial Sequence: Synthetic oligonucleotide
  Target: SCN10A; (+) strand; PAM type: NRG; PAM sequence: CAG
caggcgtgagctactgtgcc

SEQ ID NO: 37259 - DNA, 20 bp, Artificial Sequence
  Description of Artificial Sequence: Synthetic oligonucleotide
  Target: SCN10A; (+) strand; PAM type: NRG; PAM sequence: TGG
ccagccctgaattctttatc

SEQ ID NO: 37260 - DNA, 20 bp, Artificial Sequence
  Description of Artificial Sequence: Synthetic oligonucleotide
  Target: SCN10A; (+) strand; PAM type: NRG; PAM sequence: CAG
gaattctttatctggcaatt

SEQ ID NO: 37261 - DNA, 20 bp, Artificial Sequence
  Description of Artificial Sequence: Synthetic oligonucleotide
  Target: SCN10A; (+) strand; PAM type: NRG; PAM sequence: GAG
attctttatctggcaattca

SEQ ID NO: 37262 - DNA, 20 bp, Artificial Sequence
  Description of Artificial Sequence: Synthetic oligonucleotide
  Target: SCN10A; (+) strand; PAM type: NRG; PAM sequence: TAG
gcaattcagagatttcttct

SEQ ID NO: 37263 - DNA, 20 bp, Artificial Sequence
  Description of Artificial Sequence: Synthetic oligonucleotide
  Target: SCN10A; (+) strand; PAM type: NRG; PAM sequence: TGG
tcagagatttcttcttagtt

SEQ ID NO: 37264 - DNA, 20 bp, Artificial Sequence
  Description of Artificial Sequence: Synthetic oligonucleotide
  Target: SCN10A; (+) strand; PAM type: NRG; PAM sequence: TGG
tcttagtttggatccattgt

SEQ ID NO: 37265 - DNA, 20 bp, Artificial Sequence
  Description of Artificial Sequence: Synthetic oligonucleotide
  Target: SCN10A; (+) strand; PAM type: NRG; PAM sequence: GGG
cttagtttggatccattgtt

SEQ ID NO: 37266 - DNA, 20 bp, Artificial Sequence
  Description of Artificial Sequence: Synthetic oligonucleotide
  Target: SCN10A; (+) strand; PAM type: NRG; PAM sequence: GGG
ttagtttggatccattgttg

SEQ ID NO: 37267 - DNA, 20 bp, Artificial Sequence
  Description of Artificial Sequence: Synthetic oligonucleotide
  Target: SCN10A; (+) strand; PAM type: NRG; PAM sequence: GAG
agtttggatccattgttggg

SEQ ID NO: 37268 - DNA, 20 bp, Artificial Sequence
  Description of Artificial Sequence: Synthetic oligonucleotide
  Target: SCN10A; (+) strand; PAM type: NRG; PAM sequence: TAG
tggatccattgttggggagc

SEQ ID NO: 37269 - DNA, 20 bp, Artificial Sequence
  Description of Artificial Sequence: Synthetic oligonucleotide
  Target: SCN10A; (+) strand; PAM type: NRG; PAM sequence: GAG
gggagctagtttgatctttt

SEQ ID NO: 37270 - DNA, 20 bp, Artificial Sequence
  Description of Artificial Sequence: Synthetic oligonucleotide
  Target: SCN10A; (+) strand; PAM type: NRG; PAM sequence: AGG
ggagctagtttgatcttttg

SEQ ID NO: 37271 - DNA, 20 bp, Artificial Sequence
  Description of Artificial Sequence: Synthetic oligonucleotide
  Target: SCN10A; (+) strand; PAM type: NRG; PAM sequence: GGG
gagctagtttgatcttttga

SEQ ID NO: 37272 - DNA, 20 bp, Artificial Sequence
  Description of Artificial Sequence: Synthetic oligonucleotide
  Target: SCN10A; (+) strand; PAM type: NRG; PAM sequence: GGG
agctagtttgatcttttgag

SEQ ID NO: 37273 - DNA, 20 bp, Artificial Sequence
  Description of Artificial Sequence: Synthetic oligonucleotide
  Target: SCN10A; (+) strand; PAM type: NRG; PAM sequence: CAG
accctcttttgtcatattac

SEQ ID NO: 37274 - DNA, 20 bp, Artificial Sequence
  Description of Artificial Sequence: Synthetic oligonucleotide
  Target: SCN10A; (+) strand; PAM type: NRG; PAM sequence: TGG
tattaccagaattgcttttc

SEQ ID NO: 37275 - DNA, 20 bp, Artificial Sequence
  Description of Artificial Sequence: Synthetic oligonucleotide
  Target: SCN10A; (+) strand; PAM type: NRG; PAM sequence: GAG
tttctggttccttctcattt

SEQ ID NO: 37276 - DNA, 20 bp, Artificial Sequence
  Description of Artificial Sequence: Synthetic oligonucleotide
  Target: SCN10A; (+) strand; PAM type: NRG; PAM sequence: TAG
ctggttccttctcatttgag

SEQ ID NO: 37277 - DNA, 20 bp, Artificial Sequence
  Description of Artificial Sequence: Synthetic oligonucleotide
  Target: SCN10A; (+) strand; PAM type: NRG; PAM sequence: CAG
ctcatttgagtagactattt

SEQ ID NO: 37278 - DNA, 20 bp, Artificial Sequence
  Description of Artificial Sequence: Synthetic oligonucleotide
  Target: SCN10A; (+) strand; PAM type: NRG; PAM sequence: GAG
catttgagtagactatttca

SEQ ID NO: 37279 - DNA, 20 bp, Artificial Sequence
  Description of Artificial Sequence: Synthetic oligonucleotide
  Target: SCN10A; (+) strand; PAM type: NRG; PAM sequence: AAG
gagtagactatttcagagaa

SEQ ID NO: 37280 - DNA, 20 bp, Artificial Sequence
  Description of Artificial Sequence: Synthetic oligonucleotide
  Target: SCN10A; (+) strand; PAM type: NRG; PAM sequence: TGG
actatttcagagaaaagatc

SEQ ID NO: 37281 - DNA, 20 bp, Artificial Sequence
  Description of Artificial Sequence: Synthetic oligonucleotide
  Target: SCN10A; (+) strand; PAM type: NRG; PAM sequence: TGG
agaaaagatctggaactgaa

SEQ ID NO: 37282 - DNA, 20 bp, Artificial Sequence
  Description of Artificial Sequence: Synthetic oligonucleotide
  Target: SCN10A; (+) strand; PAM type: NRG; PAM sequence: CAG
ggaactgaatggctgttgtg

SEQ ID NO: 37283 - DNA, 20 bp, Artificial Sequence
  Description of Artificial Sequence: Synthetic oligonucleotide
  Target: SCN10A; (+) strand; PAM type: NRG; PAM sequence: TGG
gtgcagattcttttgtttca

SEQ ID NO: 37284 - DNA, 20 bp, Artificial Sequence
  Description of Artificial Sequence: Synthetic oligonucleotide
  Target: SCN10A; (+) strand; PAM type: NRG; PAM sequence: GGG
tgcagattcttttgtttcat

SEQ ID NO: 37285 - DNA, 20 bp, Artificial Sequence
  Description of Artificial Sequence: Synthetic oligonucleotide
  Target: SCN10A; (+) strand; PAM type: NRG; PAM sequence: TGG
tcatgggtgatctcttgatg

SEQ ID NO: 37286 - DNA, 20 bp, Artificial Sequence
  Description of Artificial Sequence: Synthetic oligonucleotide
  Target: SCN10A; (+) strand; PAM type: NRG; PAM sequence: TGG
tggtgctctccccaatcccc

SEQ ID NO: 37287 - DNA, 20 bp, Artificial Sequence
  Description of Artificial Sequence: Synthetic oligonucleotide
  Target: SCN10A; (+) strand; PAM type: NRG; PAM sequence: GGG
ggtgctctccccaatcccct

SEQ ID NO: 37288 - DNA, 20 bp, Artificial Sequence
  Description of Artificial Sequence: Synthetic oligonucleotide
  Target: SCN10A; (+) strand; PAM type: NRG; PAM sequence: GGG
gtgctctccccaatcccctg

SEQ ID NO: 37289 - DNA, 20 bp, Artificial Sequence
  Description of Artificial Sequence: Synthetic oligonucleotide
  Target: SCN10A; (+) strand; PAM type: NRG; PAM sequence: TGG
tctccccaatcccctgggga

SEQ ID NO: 37290 - DNA, 20 bp, Artificial Sequence
  Description of Artificial Sequence: Synthetic oligonucleotide
  Target: SCN10A; (+) strand; PAM type: NRG; PAM sequence: GGG
ctccccaatcccctggggat

SEQ ID NO: 37291 - DNA, 20 bp, Artificial Sequence
  Description of Artificial Sequence: Synthetic oligonucleotide
  Target: SCN10A; (+) strand; PAM type: NRG; PAM sequence: GGG
tccccaatcccctggggatg

SEQ ID NO: 37292 - DNA, 20 bp, Artificial Sequence
  Description of Artificial Sequence: Synthetic oligonucleotide
  Target: SCN10A; (+) strand; PAM type: NRG; PAM sequence: GAG
ccctggggatggggcttcct

SEQ ID NO: 37293 - DNA, 20 bp, Artificial Sequence
  Description of Artificial Sequence: Synthetic oligonucleotide
  Target: SCN10A; (+) strand; PAM type: NRG; PAM sequence: GAG
ctggggatggggcttcctga

SEQ ID NO: 37294 - DNA, 20 bp, Artificial Sequence
  Description of Artificial Sequence: Synthetic oligonucleotide
  Target: SCN10A; (+) strand; PAM type: NRG; PAM sequence: TGG
ggatggggcttcctgagagc

SEQ ID NO: 37295 - DNA, 20 bp, Artificial Sequence
  Description of Artificial Sequence: Synthetic oligonucleotide
  Target: SCN10A; (+) strand; PAM type: NRG; PAM sequence: CAG
gcttcctgagagctggactg

SEQ ID NO: 37296 - DNA, 20 bp, Artificial Sequence
  Description of Artificial Sequence: Synthetic oligonucleotide
  Target: SCN10A; (+) strand; PAM type: NRG; PAM sequence: TGG
agtgatcgttattgttcttc

SEQ ID NO: 37297 - DNA, 20 bp, Artificial Sequence
  Description of Artificial Sequence: Synthetic oligonucleotide
  Target: SCN10A; (+) strand; PAM type: NRG; PAM sequence: GGG
gtgatcgttattgttcttct

SEQ ID NO: 37298 - DNA, 20 bp, Artificial Sequence
  Description of Artificial Sequence: Synthetic oligonucleotide
  Target: SCN10A; (+) strand; PAM type: NRG; PAM sequence: TAG
cgttattgttcttctgggcc

SEQ ID NO: 37299 - DNA, 20 bp, Artificial Sequence
  Description of Artificial Sequence: Synthetic oligonucleotide
  Target: SCN10A; (+) strand; PAM type: NRG; PAM sequence: CAG
ttcttctgggcctagccaca

SEQ ID NO: 37300 - DNA, 20 bp, Artificial Sequence
  Description of Artificial Sequence: Synthetic oligonucleotide
  Target: SCN10A; (+) strand; PAM type: NRG; PAM sequence: GAG
cttctgggcctagccacaca

SEQ ID NO: 37301 - DNA, 20 bp, Artificial Sequence
  Description of Artificial Sequence: Synthetic oligonucleotide
  Target: SCN10A; (+) strand; PAM type: NRG; PAM sequence: AGG
ttctgggcctagccacacag

SEQ ID NO: 37302 - DNA, 20 bp, Artificial Sequence
  Description of Artificial Sequence: Synthetic oligonucleotide
  Target: SCN10A; (+) strand; PAM type: NRG; PAM sequence: GGG
tctgggcctagccacacaga

SEQ ID NO: 37303 - DNA, 20 bp, Artificial Sequence
  Description of Artificial Sequence: Synthetic oligonucleotide
  Target: SCN10A; (+) strand; PAM type: NRG; PAM sequence: GGG
ctgggcctagccacacagag

SEQ ID NO: 37304 - DNA, 20 bp, Artificial Sequence
  Description of Artificial Sequence: Synthetic oligonucleotide
  Target: SCN10A; (+) strand; PAM type: NRG; PAM sequence: CAG
tagccacacagaggggctac

SEQ ID NO: 37305 - DNA, 20 bp, Artificial Sequence
  Description of Artificial Sequence: Synthetic oligonucleotide
  Target: SCN10A; (+) strand; PAM type: NRG; PAM sequence: AGG
agccacacagaggggctacc

SEQ ID NO: 37306 - DNA, 20 bp, Artificial Sequence
  Description of Artificial Sequence: Synthetic oligonucleotide
  Target: SCN10A; (+) strand; PAM type: NRG; PAM sequence: TGG
acagaggggctaccaggctc

SEQ ID NO: 37307 - DNA, 20 bp, Artificial Sequence
  Description of Artificial Sequence: Synthetic oligonucleotide
  Target: SCN10A; (+) strand; PAM type: NRG; PAM sequence: GGG
cagaggggctaccaggctct

SEQ ID NO: 37308 - DNA, 20 bp, Artificial Sequence
  Description of Artificial Sequence: Synthetic oligonucleotide
  Target: SCN10A; (+) strand; PAM type: NRG; PAM sequence: GGG
agaggggctaccaggctctg

SEQ ID NO: 37309 - DNA, 20 bp, Artificial Sequence
  Description of Artificial Sequence: Synthetic oligonucleotide
  Target: SCN10A; (+) strand; PAM type: NRG; PAM sequence: TAG
ggggctaccaggctctgggg

SEQ ID NO: 37310 - DNA, 20 bp, Artificial Sequence
  Description of Artificial Sequence: Synthetic oligonucleotide
  Target: SCN10A; (+) strand; PAM type: NRG; PAM sequence: TGG
accaggctctggggtagtac

SEQ ID NO: 37311 - DNA, 20 bp, Artificial Sequence
  Description of Artificial Sequence: Synthetic oligonucleotide
  Target: SCN10A; (+) strand; PAM type: NRG; PAM sequence: GGG
ccaggctctggggtagtact

SEQ ID NO: 37312 - DNA, 20 bp, Artificial Sequence
  Description of Artificial Sequence: Synthetic oligonucleotide
  Target: SCN10A; (+) strand; PAM type: NRG; PAM sequence: AAG
tagtactgggaaatgcctgc

SEQ ID NO: 37313 - DNA, 20 bp, Artificial Sequence
  Description of Artificial Sequence: Synthetic oligonucleotide
  Target: SCN10A; (+) strand; PAM type: NRG; PAM sequence: GAG
gtactgggaaatgcctgcaa

SEQ ID NO: 37314 - DNA, 20 bp, Artificial Sequence
  Description of Artificial Sequence: Synthetic oligonucleotide
  Target: SCN10A; (+) strand; PAM type: NRG; PAM sequence: AAG
ctgtgatgtgattgatcttg

SEQ ID NO: 37315 - DNA, 20 bp, Artificial Sequence
  Description of Artificial Sequence: Synthetic oligonucleotide
  Target: SCN10A; (+) strand; PAM type: NRG; PAM sequence: CAG
tgattgatcttgaagtctcc

SEQ ID NO: 37316 - DNA, 20 bp, Artificial Sequence
  Description of Artificial Sequence: Synthetic oligonucleotide
  Target: SCN10A; (+) strand; PAM type: NRG; PAM sequence: TGG
atcttgaagtctcccagcca

SEQ ID NO: 37317 - DNA, 20 bp, Artificial Sequence
  Description of Artificial Sequence: Synthetic oligonucleotide
  Target: SCN10A; (+) strand; PAM type: NRG; PAM sequence: CAG
agtctcccagccatggatat

SEQ ID NO: 37318 - DNA, 20 bp, Artificial Sequence
  Description of Artificial Sequence: Synthetic oligonucleotide
  Target: SCN10A; (+) strand; PAM type: NRG; PAM sequence: TGG
atggatatcagcatctgttc

SEQ ID NO: 37319 - DNA, 20 bp, Artificial Sequence
  Description of Artificial Sequence: Synthetic oligonucleotide
  Target: SCN10A; (+) strand; PAM type: NRG; PAM sequence: AAG
tatcagcatctgttctggtg

SEQ ID NO: 37320 - DNA, 20 bp, Artificial Sequence
  Description of Artificial Sequence: Synthetic oligonucleotide
  Target: SCN10A; (+) strand; PAM type: NRG; PAM sequence: AGG
atcagcatctgttctggtga

SEQ ID NO: 37321 - DNA, 20 bp, Artificial Sequence
  Description of Artificial Sequence: Synthetic oligonucleotide
  Target: SCN10A; (+) strand; PAM type: NRG; PAM sequence: TGG
agcatctgttctggtgaagg

SEQ ID NO: 37322 - DNA, 20 bp, Artificial Sequence
  Description of Artificial Sequence: Synthetic oligonucleotide
  Target: SCN10A; (+) strand; PAM type: NRG; PAM sequence: CAG
atctgttctggtgaaggtgg

SEQ ID NO: 37323 - DNA, 20 bp, Artificial Sequence
  Description of Artificial Sequence: Synthetic oligonucleotide
  Target: SCN10A; (+) strand; PAM type: NRG; PAM sequence: GAG
ctgttctggtgaaggtggca

SEQ ID NO: 37324 - DNA, 20 bp, Artificial Sequence
  Description of Artificial Sequence: Synthetic oligonucleotide
  Target: SCN10A; (+) strand; PAM type: NRG; PAM sequence: AGG
tgttctggtgaaggtggcag

SEQ ID NO: 37325 - DNA, 20 bp, Artificial Sequence
  Description of Artificial Sequence: Synthetic oligonucleotide
  Target: SCN10A; (+) strand; PAM type: NRG; PAM sequence: AAG
gtgaaggtggcagaggaatg

SEQ ID NO: 37326 - DNA, 20 bp, Artificial Sequence
  Description of Artificial Sequence: Synthetic oligonucleotide
  Target: SCN10A; (+) strand; PAM type: NRG; PAM sequence: TAG
aaggtggcagaggaatgaag

SEQ ID NO: 37327 - DNA, 20 bp, Artificial Sequence
  Description of Artificial Sequence: Synthetic oligonucleotide
  Target: SCN10A; (+) strand; PAM type: NRG; PAM sequence: GAG
ggtggcagaggaatgaagta

SEQ ID NO: 37328 - DNA, 20 bp, Artificial Sequence
  Description of Artificial Sequence: Synthetic oligonucleotide
  Target: SCN10A; (+) strand; PAM type: NRG; PAM sequence: GAG
aggaatgaagtagagtctgt

SEQ ID NO: 37329 - DNA, 20 bp, Artificial Sequence
  Description of Artificial Sequence: Synthetic oligonucleotide
  Target: SCN10A; (+) strand; PAM type: NRG; PAM sequence: GAG
gaatgaagtagagtctgtga

SEQ ID NO: 37330 - DNA, 20 bp, Artificial Sequence
  Description of Artificial Sequence: Synthetic oligonucleotide
  Target: SCN10A; (+) strand; PAM type: NRG; PAM sequence: TAG
agtagagtctgtgagagtcc

SEQ ID NO: 37331 - DNA, 20 bp, Artificial Sequence
  Description of Artificial Sequence: Synthetic oligonucleotide
  Target: SCN10A; (+) strand; PAM type: NRG; PAM sequence: AGG
gtagagtctgtgagagtcct

SEQ ID NO: 37332 - DNA, 20 bp, Artificial Sequence
  Description of Artificial Sequence: Synthetic oligonucleotide
  Target: SCN10A; (+) strand; PAM type: NRG; PAM sequence: TAG
tctgtgagagtcctaggctg

SEQ ID NO: 37333 - DNA, 20 bp, Artificial Sequence
  Description of Artificial Sequence: Synthetic oligonucleotide
  Target: SCN10A; (+) strand; PAM type: NRG; PAM sequence: TAG
tgagagtcctaggctgtaga

SEQ ID NO: 37334 - DNA, 20 bp, Artificial Sequence
  Description of Artificial Sequence: Synthetic oligonucleotide
  Target: SCN10A; (+) strand; PAM type: NRG; PAM sequence: TAG
tcctaggctgtagatagatt

SEQ ID NO: 37335 - DNA, 20 bp, Artificial Sequence
  Description of Artificial Sequence: Synthetic oligonucleotide
  Target: SCN10A; (+) strand; PAM type: NRG; PAM sequence: TGG
tgtagatagatttagtgtgc

SEQ ID NO: 37336 - DNA, 20 bp, Artificial Sequence
  Description of Artificial Sequence: Synthetic oligonucleotide
  Target: SCN10A; (+) strand; PAM type: NRG; PAM sequence: TAG
gtgctggctttcttgaatgc

SEQ ID NO: 37337 - DNA, 20 bp, Artificial Sequence
  Description of Artificial Sequence: Synthetic oligonucleotide
  Target: SCN10A; (+) strand; PAM type: NRG; PAM sequence: TAG
ttcttgaatgctagttatgt

SEQ ID NO: 37338 - DNA, 20 bp, Artificial Sequence
  Description of Artificial Sequence: Synthetic oligonucleotide
  Target: SCN10A; (+) strand; PAM type: NRG; PAM sequence: CAG
ttgaatgctagttatgttag

SEQ ID NO: 37339 - DNA, 20 bp, Artificial Sequence
  Description of Artificial Sequence: Synthetic oligonucleotide
  Target: SCN10A; (+) strand; PAM type: NRG; PAM sequence: AAG
tgctagttatgttagcagtg

SEQ ID NO: 37340 - DNA, 20 bp, Artificial Sequence
  Description of Artificial Sequence: Synthetic oligonucleotide
  Target: SCN10A; (+) strand; PAM type: NRG; PAM sequence: TGG
ttagcagtgaagttgtcata

SEQ ID NO: 37341 - DNA, 20 bp, Artificial Sequence
  Description of Artificial Sequence: Synthetic oligonucleotide
  Target: SCN10A; (+) strand; PAM type: NRG; PAM sequence: CAG
cagtgaagttgtcatatgga

SEQ ID NO: 37342 - DNA, 20 bp, Artificial Sequence
  Description of Artificial Sequence: Synthetic oligonucleotide
  Target: SCN10A; (+) strand; PAM type: NRG; PAM sequence: CAG
agttgtcatatggacagact

SEQ ID NO: 37343 - DNA, 20 bp, Artificial Sequence
  Description of Artificial Sequence: Synthetic oligonucleotide
  Target: SCN10A; (+) strand; PAM type: NRG; PAM sequence: AGG
gttgtcatatggacagactc

SEQ ID NO: 37344 - DNA, 20 bp, Artificial Sequence
  Description of Artificial Sequence: Synthetic oligonucleotide
  Target: SCN10A; (+) strand; PAM type: NRG; PAM sequence: TGG
atggacagactcaggacgtc

SEQ ID NO: 37345 - DNA, 20 bp, Artificial Sequence
  Description of Artificial Sequence: Synthetic oligonucleotide
  Target: SCN10A; (+) strand; PAM type: NRG; PAM sequence: TAG
acagactcaggacgtctggt

SEQ ID NO: 37346 - DNA, 20 bp, Artificial Sequence
  Description of Artificial Sequence: Synthetic oligonucleotide
  Target: SCN10A; (+) strand; PAM type: NRG; PAM sequence: CAG
actcaggacgtctggttagc

SEQ ID NO: 37347 - DNA, 20 bp, Artificial Sequence
  Description of Artificial Sequence: Synthetic oligonucleotide
  Target: SCN10A; (+) strand; PAM type: NRG; PAM sequence: AGG
ctcaggacgtctggttagcc

SEQ ID NO: 37348 - DNA, 20 bp, Artificial Sequence
  Description of Artificial Sequence: Synthetic oligonucleotide
  Target: SCN10A; (+) strand; PAM type: NRG; PAM sequence: CAG
tctggttagccaggatgttg

SEQ ID NO: 37349 - DNA, 20 bp, Artificial Sequence
  Description of Artificial Sequence: Synthetic oligonucleotide
  Target: SCN10A; (+) strand; PAM type: NRG; PAM sequence: AGG
ctggttagccaggatgttgc

SEQ ID NO: 37350 - DNA, 20 bp, Artificial Sequence
  Description of Artificial Sequence: Synthetic oligonucleotide
  Target: SCN10A; (+) strand; PAM type: NRG; PAM sequence: CAG
gttagccaggatgttgcagg

SEQ ID NO: 37351 - DNA, 20 bp, Artificial Sequence
  Description of Artificial Sequence: Synthetic oligonucleotide
  Target: SCN10A; (+) strand; PAM type: NRG; PAM sequence: TGG
gatgttgcaggcagtgcaac

SEQ ID NO: 37352 - DNA, 20 bp, Artificial Sequence
  Description of Artificial Sequence: Synthetic oligonucleotide
  Target: SCN10A; (+) strand; PAM type: NRG; PAM sequence: TGG
ggttgttgttttctttttcc

SEQ ID NO: 37353 - DNA, 20 bp, Artificial Sequence
  Description of Artificial Sequence: Synthetic oligonucleotide
  Target: SCN10A; (+) strand; PAM type: NRG; PAM sequence: GGG
gttgttgttttctttttcct

SEQ ID NO: 37354 - DNA, 20 bp, Artificial Sequence
  Description of Artificial Sequence: Synthetic oligonucleotide
  Target: SCN10A; (+) strand; PAM type: NRG; PAM sequence: AAG
ttttctttttcctgggatca

SEQ ID NO: 37355 - DNA, 20 bp, Artificial Sequence
  Description of Artificial Sequence: Synthetic oligonucleotide
  Target: SCN10A; (+) strand; PAM type: NRG; PAM sequence: GAG
gatcaaagttattctgtcat

SEQ ID NO: 37356 - DNA, 20 bp, Artificial Sequence
  Description of Artificial Sequence: Synthetic oligonucleotide
  Target: SCN10A; (+) strand; PAM type: NRG; PAM sequence: TGG
tctgtcatgagttgctttaa

SEQ ID NO: 37357 - DNA, 20 bp, Artificial Sequence
  Description of Artificial Sequence: Synthetic oligonucleotide
  Target: SCN10A; (+) strand; PAM type: NRG; PAM sequence: GAG
atgagttgctttaatggcct

SEQ ID NO: 37358 - DNA, 20 bp, Artificial Sequence
  Description of Artificial Sequence: Synthetic oligonucleotide
  Target: SCN10A; (+) strand; PAM type: NRG; PAM sequence: CAG
ggcctgagctgtttgacctc

SEQ ID NO: 37359 - DNA, 20 bp, Artificial Sequence
  Description of Artificial Sequence: Synthetic oligonucleotide
  Target: SCN10A; (+) strand; PAM type: NRG; PAM sequence: CGG
tgagctgtttgacctccagc

SEQ ID NO: 37360 - DNA, 20 bp, Artificial Sequence
  Description of Artificial Sequence: Synthetic oligonucleotide
  Target: SCN10A; (+) strand; PAM type: NRG; PAM sequence: TAG
gctgtttgacctccagccgg

SEQ ID NO: 37361 - DNA, 20 bp, Artificial Sequence
  Description of Artificial Sequence: Synthetic oligonucleotide
  Target: SCN10A; (+) strand; PAM type: NRG; PAM sequence: AGG
ctgtttgacctccagccggt

SEQ ID NO: 37362 - DNA, 20 bp, Artificial Sequence
  Description of Artificial Sequence: Synthetic oligonucleotide
  Target: SCN10A; (+) strand; PAM type: NRG; PAM sequence: AAG
agccggtaggtgatgctttc

SEQ ID NO: 37363 - DNA, 20 bp, Artificial Sequence
  Description of Artificial Sequence: Synthetic oligonucleotide
  Target: SCN10A; (+) strand; PAM type: NRG; PAM sequence: GAG
ccggtaggtgatgctttcaa

SEQ ID NO: 37364 - DNA, 20 bp, Artificial Sequence
  Description of Artificial Sequence: Synthetic oligonucleotide
  Target: SCN10A; (+) strand; PAM type: NRG; PAM sequence: GAG
ggtaggtgatgctttcaaga

SEQ ID NO: 37365 - DNA, 20 bp, Artificial Sequence
  Description of Artificial Sequence: Synthetic oligonucleotide
  Target: SCN10A; (+) strand; PAM type: NRG; PAM sequence: TAG
tgatgctttcaagagagcac

SEQ ID NO: 37366 - DNA, 20 bp, Artificial Sequence
  Description of Artificial Sequence: Synthetic oligonucleotide
  Target: SCN10A; (+) strand; PAM type: NRG; PAM sequence: TAG
tcaagagagcactagtgcat

SEQ ID NO: 37367 - DNA, 20 bp, Artificial Sequence
  Description of Artificial Sequence: Synthetic oligonucleotide
  Target: SCN10A; (+) strand; PAM type: NRG; PAM sequence: TAG
agagagcactagtgcattag

SEQ ID NO: 37368 - DNA, 20 bp, Artificial Sequence
  Description of Artificial Sequence: Synthetic oligonucleotide
  Target: SCN10A; (+) strand; PAM type: NRG; PAM sequence: AAG
gagcactagtgcattagtag

SEQ ID NO: 37369 - DNA, 20 bp, Artificial Sequence
  Description of Artificial Sequence: Synthetic oligonucleotide
  Target: SCN10A; (+) strand; PAM type: NRG; PAM sequence: AGG
agcactagtgcattagtaga

SEQ ID NO: 37370 - DNA, 20 bp, Artificial Sequence
  Description of Artificial Sequence: Synthetic oligonucleotide
  Target: SCN10A; (+) strand; PAM type: NRG; PAM sequence: GGG
gcactagtgcattagtagaa

SEQ ID NO: 37371 - DNA, 20 bp, Artificial Sequence
  Description of Artificial Sequence: Synthetic oligonucleotide
  Target: SCN10A; (+) strand; PAM type: NRG; PAM sequence: GGG
cactagtgcattagtagaag

SEQ ID NO: 37372 - DNA, 20 bp, Artificial Sequence
  Description of Artificial Sequence: Synthetic oligonucleotide
  Target: SCN10A; (+) strand; PAM type: NRG; PAM sequence: GGG
actagtgcattagtagaagg

SEQ ID NO: 37373 - DNA, 20 bp, Artificial Sequence
  Description of Artificial Sequence: Synthetic oligonucleotide
  Target: SCN10A; (+) strand; PAM type: NRG; PAM sequence: AAG
cattagtagaagggggatct

SEQ ID NO: 37374 - DNA, 20 bp, Artificial Sequence
  Description of Artificial Sequence: Synthetic oligonucleotide
  Target: SCN10A; (+) strand; PAM type: NRG; PAM sequence: AAG
gggggatctaagctcaccct

SEQ ID NO: 37375 - DNA, 20 bp, Artificial Sequence
  Description of Artificial Sequence: Synthetic oligonucleotide
  Target: SCN10A; (+) strand; PAM type: NRG; PAM sequence: TGG
gatctaagctcaccctaagt

SEQ ID NO: 37376 - DNA, 20 bp, Artificial Sequence
  Description of Artificial Sequence: Synthetic oligonucleotide
  Target: SCN10A; (+) strand; PAM type: NRG; PAM sequence: CAG
taagctcaccctaagttggc

SEQ ID NO: 37377 - DNA, 20 bp, Artificial Sequence
  Description of Artificial Sequence: Synthetic oligonucleotide
  Target: SCN10A; (+) strand; PAM type: NRG; PAM sequence: AGG
aagctcaccctaagttggcc

SEQ ID NO: 37378 - DNA, 20 bp, Artificial Sequence
  Description of Artificial Sequence: Synthetic oligonucleotide
  Target: SCN10A; (+) strand; PAM type: NRG; PAM sequence: GGG
agctcaccctaagttggcca

SEQ ID NO: 37379 - DNA, 20 bp, Artificial Sequence
  Description of Artificial Sequence: Synthetic oligonucleotide
  Target: SCN10A; (+) strand; PAM type: NRG; PAM sequence: TAG
gttggccagggtaaatattt

SEQ ID NO: 37380 - DNA, 20 bp, Artificial Sequence
  Description of Artificial Sequence: Synthetic oligonucleotide
  Target: SCN10A; (+) strand; PAM type: NRG; PAM sequence: TAG
gggtaaatattttagtttct

SEQ ID NO: 37381 - DNA, 20 bp, Artificial Sequence
  Description of Artificial Sequence: Synthetic oligonucleotide
  Target: SCN10A; (+) strand; PAM type: NRG; PAM sequence: AGG
ggtaaatattttagtttctt

SEQ ID NO: 37382 - DNA, 20 bp, Artificial Sequence
  Description of Artificial Sequence: Synthetic oligonucleotide
  Target: SCN10A; (+) strand; PAM type: NRG; PAM sequence: GAG
attttagtttcttaggtgat

SEQ ID NO: 37383 - DNA, 20 bp, Artificial Sequence
  Description of Artificial Sequence: Synthetic oligonucleotide
  Target: SCN10A; (+) strand; PAM type: NRG; PAM sequence: CAG
ttagtttcttaggtgatgag

SEQ ID NO: 37384 - DNA, 20 bp, Artificial Sequence
  Description of Artificial Sequence: Synthetic oligonucleotide
  Target: SCN10A; (+) strand; PAM type: NRG; PAM sequence: AGG
tagtttcttaggtgatgagc

SEQ ID NO: 37385 - DNA, 20 bp, Artificial Sequence
  Description of Artificial Sequence: Synthetic oligonucleotide
  Target: SCN10A; (+) strand; PAM type: NRG; PAM sequence: GGG
agtttcttaggtgatgagca

SEQ ID NO: 37386 - DNA, 20 bp, Artificial Sequence
  Description of Artificial Sequence: Synthetic oligonucleotide
  Target: SCN10A; (+) strand; PAM type: NRG; PAM sequence: AAG
aggtgatgagcagggccata

SEQ ID NO: 37387 - DNA, 20 bp, Artificial Sequence
  Description of Artificial Sequence: Synthetic oligonucleotide
  Target: SCN10A; (+) strand; PAM type: NRG; PAM sequence: GAG
agcagggccataaagcttcc

SEQ ID NO: 37388 - DNA, 20 bp, Artificial Sequence
  Description of Artificial Sequence: Synthetic oligonucleotide
  Target: SCN10A; (+) strand; PAM type: NRG; PAM sequence: GAG
cagggccataaagcttccga

SEQ ID NO: 37389 - DNA, 20 bp, Artificial Sequence
  Description of Artificial Sequence: Synthetic oligonucleotide
  Target: SCN10A; (+) strand; PAM type: NRG; PAM sequence: TGG
ataaagcttccgagagtttc

SEQ ID NO: 37390 - DNA, 20 bp, Artificial Sequence
  Description of Artificial Sequence: Synthetic oligonucleotide
  Target: SCN10A; (+) strand; PAM type: NRG; PAM sequence: GGG
taaagcttccgagagtttct

SEQ ID NO: 37391 - DNA, 20 bp, Artificial Sequence
  Description of Artificial Sequence: Synthetic oligonucleotide
  Target: SCN10A; (+) strand; PAM type: NRG; PAM sequence: CAG
gagtttctgggttttgtgtt

SEQ ID NO: 37392 - DNA, 20 bp, Artificial Sequence
  Description of Artificial Sequence: Synthetic oligonucleotide
  Target: SCN10A; (+) strand; PAM type: NRG; PAM sequence: AAG
gggttttgtgttcagctacc

SEQ ID NO: 37393 - DNA, 20 bp, Artificial Sequence
  Description of Artificial Sequence: Synthetic oligonucleotide
  Target: SCN10A; (+) strand; PAM type: NRG; PAM sequence: AGG
ggttttgtgttcagctacca

SEQ ID NO: 37394 - DNA, 20 bp, Artificial Sequence
  Description of Artificial Sequence: Synthetic oligonucleotide
  Target: SCN10A; (+) strand; PAM type: NRG; PAM sequence: CAG
tttgtgttcagctaccaagg

SEQ ID NO: 37395 - DNA, 20 bp, Artificial Sequence
  Description of Artificial Sequence: Synthetic oligonucleotide
  Target: SCN10A; (+) strand; PAM type: NRG; PAM sequence: AGG
ttgtgttcagctaccaaggc

SEQ ID NO: 37396 - DNA, 20 bp, Artificial Sequence
  Description of Artificial Sequence: Synthetic oligonucleotide
  Target: SCN10A; (+) strand; PAM type: NRG; PAM sequence: TAG
tgttcagctaccaaggcagg

SEQ ID NO: 37397 - DNA, 20 bp, Artificial Sequence
  Description of Artificial Sequence: Synthetic oligonucleotide
  Target: SCN10A; (+) strand; PAM type: NRG; PAM sequence: AGG
gttcagctaccaaggcaggt

SEQ ID NO: 37398 - DNA, 20 bp, Artificial Sequence
  Description of Artificial Sequence: Synthetic oligonucleotide
  Target: SCN10A; (+) strand; PAM type: NRG; PAM sequence: GGG
ttcagctaccaaggcaggta

SEQ ID NO: 37399 - DNA, 20 bp, Artificial Sequence
  Description of Artificial Sequence: Synthetic oligonucleotide
  Target: SCN10A; (+) strand; PAM type: NRG; PAM sequence: CAG
ggcaggtagggaaataccat

SEQ ID NO: 37400 - DNA, 20 bp, Artificial Sequence
  Description of Artificial Sequence: Synthetic oligonucleotide
  Target: SCN10A; (+) strand; PAM type: NRG; PAM sequence: AGG
gcaggtagggaaataccatc

SEQ ID NO: 37401 - DNA, 20 bp, Artificial Sequence
  Description of Artificial Sequence: Synthetic oligonucleotide
  Target: SCN10A; (+) strand; PAM type: NRG; PAM sequence: TGG
ggtagggaaataccatcagg

SEQ ID NO: 37402 - DNA, 20 bp, Artificial Sequence
  Description of Artificial Sequence: Synthetic oligonucleotide
  Target: SCN10A; (+) strand; PAM type: NRG; PAM sequence: GGG
gtagggaaataccatcaggt

SEQ ID NO: 37403 - DNA, 20 bp, Artificial Sequence
  Description of Artificial Sequence: Synthetic oligonucleotide
  Target: SCN10A; (+) strand; PAM type: NRG; PAM sequence: GGG
tagggaaataccatcaggtg

SEQ ID NO: 37404 - DNA, 20 bp, Artificial Sequence
  Description of Artificial Sequence: Synthetic oligonucleotide
  Target: SCN10A; (+) strand; PAM type: NRG; PAM sequence: GGG
agggaaataccatcaggtgg

SEQ ID NO: 37405 - DNA, 20 bp, Artificial Sequence
  Description of Artificial Sequence: Synthetic oligonucleotide
  Target: SCN10A; (+) strand; PAM type: NRG; PAM sequence: CAG
gaaataccatcaggtggggg

SEQ ID NO: 37406 - DNA, 20 bp, Artificial Sequence
  Description of Artificial Sequence: Synthetic oligonucleotide
  Target: SCN10A; (+) strand; PAM type: NRG; PAM sequence: AGG
aaataccatcaggtgggggc

SEQ ID NO: 37407 - DNA, 20 bp, Artificial Sequence
  Description of Artificial Sequence: Synthetic oligonucleotide
  Target: SCN10A; (+) strand; PAM type: NRG; PAM sequence: GGG
aataccatcaggtgggggca

SEQ ID NO: 37408 - DNA, 20 bp, Artificial Sequence
  Description of Artificial Sequence: Synthetic oligonucleotide
  Target: SCN10A; (+) strand; PAM type: NRG; PAM sequence: GGG
ataccatcaggtgggggcag

SEQ ID NO: 37409 - DNA, 20 bp, Artificial Sequence
  Description of Artificial Sequence: Synthetic oligonucleotide
  Target: SCN10A; (+) strand; PAM type: NRG; PAM sequence: TAG
ccatcaggtgggggcagggg

SEQ ID NO: 37410 - DNA, 20 bp, Artificial Sequence
  Description of Artificial Sequence: Synthetic oligonucleotide
  Target: SCN10A; (+) strand; PAM type: NRG; PAM sequence: AGG
catcaggtgggggcaggggt

SEQ ID NO: 37411 - DNA, 20 bp, Artificial Sequence
  Description of Artificial Sequence: Synthetic oligonucleotide
  Target: SCN10A; (+) strand; PAM type: NRG; PAM sequence: GAG
aggtgggggcaggggtaggt

SEQ ID NO: 37412 - DNA, 20 bp, Artificial Sequence
  Description of Artificial Sequence: Synthetic oligonucleotide
  Target: SCN10A; (+) strand; PAM type: NRG; PAM sequence: TAG
ggggcaggggtaggtgagtc

SEQ ID NO: 37413 - DNA, 20 bp, Artificial Sequence
  Description of Artificial Sequence: Synthetic oligonucleotide
  Target: SCN10A; (+) strand; PAM type: NRG; PAM sequence: CAG
ggggtaggtgagtctagact

SEQ ID NO: 37414 - DNA, 20 bp, Artificial Sequence
  Description of Artificial Sequence: Synthetic oligonucleotide
  Target: SCN10A; (+) strand; PAM type: NRG; PAM sequence: TGG
gtctagactcagacccttct

SEQ ID NO: 37415 - DNA, 20 bp, Artificial Sequence
  Description of Artificial Sequence: Synthetic oligonucleotide
  Target: SCN10A; (+) strand; PAM type: NRG; PAM sequence: GGG
tctagactcagacccttctt

SEQ ID NO: 37416 - DNA, 20 bp, Artificial Sequence
  Description of Artificial Sequence: Synthetic oligonucleotide
  Target: SCN10A; (+) strand; PAM type: NRG; PAM sequence: TAG
agactcagacccttcttggg

SEQ ID NO: 37417 - DNA, 20 bp, Artificial Sequence
  Description of Artificial Sequence: Synthetic oligonucleotide
  Target: SCN10A; (+) strand; PAM type: NRG; PAM sequence: AGG
gactcagacccttcttgggt

SEQ ID NO: 37418 - DNA, 20 bp, Artificial Sequence
  Description of Artificial Sequence: Synthetic oligonucleotide
  Target: SCN10A; (+) strand; PAM type: NRG; PAM sequence: GGG
actcagacccttcttgggta

SEQ ID NO: 37419 - DNA, 20 bp, Artificial Sequence
  Description of Artificial Sequence: Synthetic oligonucleotide
  Target: SCN10A; (+) strand; PAM type: NRG; PAM sequence: TGG
ttcttgggtagggattgctg

SEQ ID NO: 37420 - DNA, 20 bp, Artificial Sequence
  Description of Artificial Sequence: Synthetic oligonucleotide
  Target: SCN10A; (+) strand; PAM type: NRG; PAM sequence: TGG
agggattgctgtggccactg

SEQ ID NO: 37421 - DNA, 20 bp, Artificial Sequence
  Description of Artificial Sequence: Synthetic oligonucleotide
  Target: SCN10A; (+) strand; PAM type: NRG; PAM sequence: TGG
gattgctgtggccactgtgg

SEQ ID NO: 37422 - DNA, 20 bp, Artificial Sequence
  Description of Artificial Sequence: Synthetic oligonucleotide
  Target: SCN10A; (+) strand; PAM type: NRG; PAM sequence: TGG
gctgtggccactgtggtgga

SEQ ID NO: 37423 - DNA, 20 bp, Artificial Sequence
  Description of Artificial Sequence: Synthetic oligonucleotide
  Target: SCN10A; (+) strand; PAM type: NRG; PAM sequence: GGG
ctgtggccactgtggtggat

SEQ ID NO: 37424 - DNA, 20 bp, Artificial Sequence
  Description of Artificial Sequence: Synthetic oligonucleotide
  Target: SCN10A; (+) strand; PAM type: NRG; PAM sequence: GGG
tgtggccactgtggtggatg

SEQ ID NO: 37425 - DNA, 20 bp, Artificial Sequence
  Description of Artificial Sequence: Synthetic oligonucleotide
  Target: SCN10A; (+) strand; PAM type: NRG; PAM sequence: GGG
gtggccactgtggtggatgg

SEQ ID NO: 37426 - DNA, 20 bp, Artificial Sequence
  Description of Artificial Sequence: Synthetic oligonucleotide
  Target: SCN10A; (+) strand; PAM type: NRG; PAM sequence: TGG
ccactgtggtggatgggggt

SEQ ID NO: 37427 - DNA, 20 bp, Artificial Sequence
  Description of Artificial Sequence: Synthetic oligonucleotide
  Target: SCN10A; (+) strand; PAM type: NRG; PAM sequence: CAG
ggtggatgggggttggttct

SEQ ID NO: 37428 - DNA, 20 bp, Artificial Sequence
  Description of Artificial Sequence: Synthetic oligonucleotide
  Target: SCN10A; (+) strand; PAM type: NRG; PAM sequence: AGG
gtggatgggggttggttctc

SEQ ID NO: 37429 - DNA, 20 bp, Artificial Sequence
  Description of Artificial Sequence: Synthetic oligonucleotide
  Target: SCN10A; (+) strand; PAM type: NRG; PAM sequence: CAG
atgggggttggttctcaggc

SEQ ID NO: 37430 - DNA, 20 bp, Artificial Sequence
  Description of Artificial Sequence: Synthetic oligonucleotide
  Target: SCN10A; (+) strand; PAM type: NRG; PAM sequence: TGG
ggggttggttctcaggccag

SEQ ID NO: 37431 - DNA, 20 bp, Artificial Sequence
  Description of Artificial Sequence: Synthetic oligonucleotide
  Target: SCN10A; (+) strand; PAM type: NRG; PAM sequence: GGG
gggttggttctcaggccagt

SEQ ID NO: 37432 - DNA, 20 bp, Artificial Sequence
  Description of Artificial Sequence: Synthetic oligonucleotide
  Target: SCN10A; (+) strand; PAM type: NRG; PAM sequence: GGG
ggttggttctcaggccagtg

SEQ ID NO: 37433 - DNA, 20 bp, Artificial Sequence
  Description of Artificial Sequence: Synthetic oligonucleotide
  Target: SCN10A; (+) strand; PAM type: NRG; PAM sequence: CAG
aggccagtggggttgtgttc

SEQ ID NO: 37434 - DNA, 20 bp, Artificial Sequence
  Description of Artificial Sequence: Synthetic oligonucleotide
  Target: SCN10A; (+) strand; PAM type: NRG; PAM sequence: GAG
gccagtggggttgtgttcca

SEQ ID NO: 37435 - DNA, 20 bp, Artificial Sequence
  Description of Artificial Sequence: Synthetic oligonucleotide
  Target: SCN10A; (+) strand; PAM type: NRG; PAM sequence: AGG
ccagtggggttgtgttccag

SEQ ID NO: 37436 - DNA, 20 bp, Artificial Sequence
  Description of Artificial Sequence: Synthetic oligonucleotide
  Target: SCN10A; (+) strand; PAM type: NRG; PAM sequence: GGG
cagtggggttgtgttccaga

SEQ ID NO: 37437 - DNA, 20 bp, Artificial Sequence
  Description of Artificial Sequence: Synthetic oligonucleotide
  Target: SCN10A; (+) strand; PAM type: NRG; PAM sequence: TGG
ttgtgttccagagggaattt

SEQ ID NO: 37438 - DNA, 20 bp, Artificial Sequence
  Description of Artificial Sequence: Synthetic oligonucleotide
  Target: SCN10A; (+) strand; PAM type: NRG; PAM sequence: TAG
tggctgcctctgctgtgcca

SEQ ID NO: 37439 - DNA, 20 bp, Artificial Sequence
  Description of Artificial Sequence: Synthetic oligonucleotide
  Target: SCN10A; (+) strand; PAM type: NRG; PAM sequence: GAG
gctgcctctgctgtgccata

SEQ ID NO: 37440 - DNA, 20 bp, Artificial Sequence
  Description of Artificial Sequence: Synthetic oligonucleotide
  Target: SCN10A; (+) strand; PAM type: NRG; PAM sequence: CAG
tgctgtgccatagagttctc

SEQ ID NO: 37441 - DNA, 20 bp, Artificial Sequence
  Description of Artificial Sequence: Synthetic oligonucleotide
  Target: SCN10A; (+) strand; PAM type: NRG; PAM sequence: AGG
gctgtgccatagagttctcc

SEQ ID NO: 37442 - DNA, 20 bp, Artificial Sequence
  Description of Artificial Sequence: Synthetic oligonucleotide
  Target: SCN10A; (+) strand; PAM type: NRG; PAM sequence: GGG
ctgtgccatagagttctcca

SEQ ID NO: 37443 - DNA, 20 bp, Artificial Sequence
  Description of Artificial Sequence: Synthetic oligonucleotide
  Target: SCN10A; (+) strand; PAM type: NRG; PAM sequence: AAG
tgccatagagttctccaggg

SEQ ID NO: 37444 - DNA, 20 bp, Artificial Sequence
  Description of Artificial Sequence: Synthetic oligonucleotide
  Target: SCN10A; (+) strand; PAM type: NRG; PAM sequence: TGG
catagagttctccagggaag

SEQ ID NO: 37445 - DNA, 20 bp, Artificial Sequence
  Description of Artificial Sequence: Synthetic oligonucleotide
  Target: SCN10A; (+) strand; PAM type: NRG; PAM sequence: GGG
atagagttctccagggaagt

SEQ ID NO: 37446 - DNA, 20 bp, Artificial Sequence
  Description of Artificial Sequence: Synthetic oligonucleotide
  Target: SCN10A; (+) strand; PAM type: NRG; PAM sequence: GGG
tagagttctccagggaagtg

SEQ ID NO: 37447 - DNA, 20 bp, Artificial Sequence
  Description of Artificial Sequence: Synthetic oligonucleotide
  Target: SCN10A; (+) strand; PAM type: NRG; PAM sequence: GGG
agagttctccagggaagtgg

SEQ ID NO: 37448 - DNA, 20 bp, Artificial Sequence
  Description of Artificial Sequence: Synthetic oligonucleotide
  Target: SCN10A; (+) strand; PAM type: NRG; PAM sequence: TAG
ttctccagggaagtggggga

SEQ ID NO: 37449 - DNA, 20 bp, Artificial Sequence
  Description of Artificial Sequence: Synthetic oligonucleotide
  Target: SCN10A; (+) strand; PAM type: NRG; PAM sequence: TAG
gggaagtgggggatagctgc

SEQ ID NO: 37450 - DNA, 20 bp, Artificial Sequence
  Description of Artificial Sequence: Synthetic oligonucleotide
  Target: SCN10A; (+) strand; PAM type: NRG; PAM sequence: GAG
agtgggggatagctgctagt

SEQ ID NO: 37451 - DNA, 20 bp, Artificial Sequence
  Description of Artificial Sequence: Synthetic oligonucleotide
  Target: SCN10A; (+) strand; PAM type: NRG; PAM sequence: GAG
tgggggatagctgctagtga

SEQ ID NO: 37452 - DNA, 20 bp, Artificial Sequence
  Description of Artificial Sequence: Synthetic oligonucleotide
  Target: SCN10A; (+) strand; PAM type: NRG; PAM sequence: AGG
gggggatagctgctagtgag

SEQ ID NO: 37453 - DNA, 20 bp, Artificial Sequence
  Description of Artificial Sequence: Synthetic oligonucleotide
  Target: SCN10A; (+) strand; PAM type: NRG; PAM sequence: TAG
tgctagtgagaggcctcacc

SEQ ID NO: 37454 - DNA, 20 bp, Artificial Sequence
  Description of Artificial Sequence: Synthetic oligonucleotide
  Target: SCN10A; (+) strand; PAM type: NRG; PAM sequence: TAG
ggcctcacctagctctcatg

SEQ ID NO: 37455 - DNA, 20 bp, Artificial Sequence
  Description of Artificial Sequence: Synthetic oligonucleotide
  Target: SCN10A; (+) strand; PAM type: NRG; PAM sequence: TGG
tcacctagctctcatgtagt

SEQ ID NO: 37456 - DNA, 20 bp, Artificial Sequence
  Description of Artificial Sequence: Synthetic oligonucleotide
  Target: SCN10A; (+) strand; PAM type: NRG; PAM sequence: GAG
ctagctctcatgtagttggt

SEQ ID NO: 37457 - DNA, 20 bp, Artificial Sequence
  Description of Artificial Sequence: Synthetic oligonucleotide
  Target: SCN10A; (+) strand; PAM type: NRG; PAM sequence: AGG
tagctctcatgtagttggtg

SEQ ID NO: 37458 - DNA, 20 bp, Artificial Sequence
  Description of Artificial Sequence: Synthetic oligonucleotide
  Target: SCN10A; (+) strand; PAM type: NRG; PAM sequence: TGG
tctcatgtagttggtgaggc

SEQ ID NO: 37459 - DNA, 20 bp, Artificial Sequence
  Description of Artificial Sequence: Synthetic oligonucleotide
  Target: SCN10A; (+) strand; PAM type: NRG; PAM sequence: CAG
tgaggctggtcttgctcctg

SEQ ID NO: 37460 - DNA, 20 bp, Artificial Sequence
  Description of Artificial Sequence: Synthetic oligonucleotide
  Target: SCN10A; (+) strand; PAM type: NRG; PAM sequence: CAG
tgctcctgcagtgccctact

SEQ ID NO: 37461 - DNA, 20 bp, Artificial Sequence
  Description of Artificial Sequence: Synthetic oligonucleotide
  Target: SCN10A; (+) strand; PAM type: NRG; PAM sequence: CAG
gccctactcagaccttgccc

SEQ ID NO: 37462 - DNA, 20 bp, Artificial Sequence
  Description of Artificial Sequence: Synthetic oligonucleotide
  Target: SCN10A; (+) strand; PAM type: NRG; PAM sequence: AGG
ccctactcagaccttgcccc

SEQ ID NO: 37463 - DNA, 20 bp, Artificial Sequence
  Description of Artificial Sequence: Synthetic oligonucleotide
  Target: SCN10A; (+) strand; PAM type: NRG; PAM sequence: GAG
cagaccttgccccaggctgt

SEQ ID NO: 37464 - DNA, 20 bp, Artificial Sequence
  Description of Artificial Sequence: Synthetic oligonucleotide
  Target: SCN10A; (+) strand; PAM type: NRG; PAM sequence: GAG
aggctgtgagcttccccact

SEQ ID NO: 37465 - DNA, 20 bp, Artificial Sequence
  Description of Artificial Sequence: Synthetic oligonucleotide
  Target: SCN10A; (+) strand; PAM type: NRG; PAM sequence: AAG
tgtgagcttccccactgaga

SEQ ID NO: 37466 - DNA, 20 bp, Artificial Sequence
  Description of Artificial Sequence: Synthetic oligonucleotide
  Target: SCN10A; (+) strand; PAM type: NRG; PAM sequence: AAG
agcttccccactgagaaaga

SEQ ID NO: 37467 - DNA, 20 bp, Artificial Sequence
  Description of Artificial Sequence: Synthetic oligonucleotide
  Target: SCN10A; (+) strand; PAM type: NRG; PAM sequence: TGG
gagaaagaaagcatgacttt

SEQ ID NO: 37468 - DNA, 20 bp, Artificial Sequence
  Description of Artificial Sequence: Synthetic oligonucleotide
  Target: SCN10A; (+) strand; PAM type: NRG; PAM sequence: CAG
catccctcactgtctgcttg

SEQ ID NO: 37469 - DNA, 20 bp, Artificial Sequence
  Description of Artificial Sequence: Synthetic oligonucleotide
  Target: SCN10A; (+) strand; PAM type: NRG; PAM sequence: TGG
tgcagttcccatttgccccc

SEQ ID NO: 37470 - DNA, 20 bp, Artificial Sequence
  Description of Artificial Sequence: Synthetic oligonucleotide
  Target: SCN10A; (+) strand; PAM type: NRG; PAM sequence: AAG
ttgccccctggattctgctc

SEQ ID NO: 37471 - DNA, 20 bp, Artificial Sequence
  Description of Artificial Sequence: Synthetic oligonucleotide
  Target: SCN10A; (+) strand; PAM type: NRG; PAM sequence: CAG
tgctcaagaaaatttgtgcc

SEQ ID NO: 37472 - DNA, 20 bp, Artificial Sequence
  Description of Artificial Sequence: Synthetic oligonucleotide
  Target: SCN10A; (+) strand; PAM type: NRG; PAM sequence: TAG
gttgaaattattactaattt

SEQ ID NO: 37473 - DNA, 20 bp, Artificial Sequence
  Description of Artificial Sequence: Synthetic oligonucleotide
  Target: SCN10A; (+) strand; PAM type: NRG; PAM sequence: TGG
tgacccctccctgattccac

SEQ ID NO: 37474 - DNA, 20 bp, Artificial Sequence
  Description of Artificial Sequence: Synthetic oligonucleotide
  Target: SCN10A; (+) strand; PAM type: NRG; PAM sequence: AAG
ttccactggctgccttcccc

SEQ ID NO: 37475 - DNA, 20 bp, Artificial Sequence
  Description of Artificial Sequence: Synthetic oligonucleotide
  Target: SCN10A; (+) strand; PAM type: NRG; PAM sequence: AGG
tccactggctgccttcccca

SEQ ID NO: 37476 - DNA, 20 bp, Artificial Sequence
  Description of Artificial Sequence: Synthetic oligonucleotide
  Target: SCN10A; (+) strand; PAM type: NRG; PAM sequence: GGG
ccactggctgccttccccaa

SEQ ID NO: 37477 - DNA, 20 bp, Artificial Sequence
  Description of Artificial Sequence: Synthetic oligonucleotide
  Target: SCN10A; (+) strand; PAM type: NRG; PAM sequence: GAG
ccttccccaagggtgcctgt

SEQ ID NO: 37478 - DNA, 20 bp, Artificial Sequence
  Description of Artificial Sequence: Synthetic oligonucleotide
  Target: SCN10A; (+) strand; PAM type: NRG; PAM sequence: TAG
ccaagggtgcctgtgagaca

SEQ ID NO: 37479 - DNA, 20 bp, Artificial Sequence
  Description of Artificial Sequence: Synthetic oligonucleotide
  Target: SCN10A; (+) strand; PAM type: NRG; PAM sequence: CAG
gggtgcctgtgagacatagt

SEQ ID NO: 37480 - DNA, 20 bp, Artificial Sequence
  Description of Artificial Sequence: Synthetic oligonucleotide
  Target: SCN10A; (+) strand; PAM type: NRG; PAM sequence: AGG
ggtgcctgtgagacatagtc

SEQ ID NO: 37481 - DNA, 20 bp, Artificial Sequence
  Description of Artificial Sequence: Synthetic oligonucleotide
  Target: SCN10A; (+) strand; PAM type: NRG; PAM sequence: GGG
gtgcctgtgagacatagtca

SEQ ID NO: 37482 - DNA, 20 bp, Artificial Sequence
  Description of Artificial Sequence: Synthetic oligonucleotide
  Target: SCN10A; (+) strand; PAM type: NRG; PAM sequence: TGG
ctgtgagacatagtcaggga

SEQ ID NO: 37483 - DNA, 20 bp, Artificial Sequence
  Description of Artificial Sequence: Synthetic oligonucleotide
  Target: SCN10A; (+) strand; PAM type: NRG; PAM sequence: TGG
atagtcagggatggattccc

SEQ ID NO: 37484 - DNA, 20 bp, Artificial Sequence
  Description of Artificial Sequence: Synthetic oligonucleotide
  Target: SCN10A; (+) strand; PAM type: NRG; PAM sequence: AAG
gggatggattccctggtctc

SEQ ID NO: 37485 - DNA, 20 bp, Artificial Sequence
  Description of Artificial Sequence: Synthetic oligonucleotide
  Target: SCN10A; (+) strand; PAM type: NRG; PAM sequence: TGG
tggattccctggtctcaagc

SEQ ID NO: 37486 - DNA, 20 bp, Artificial Sequence
  Description of Artificial Sequence: Synthetic oligonucleotide
  Target: SCN10A; (+) strand; PAM type: NRG; PAM sequence: GAG
gattccctggtctcaagctg

SEQ ID NO: 37487 - DNA, 20 bp, Artificial Sequence
  Description of Artificial Sequence: Synthetic oligonucleotide
  Target: SCN10A; (+) strand; PAM type: NRG; PAM sequence: TGG
cctggtctcaagctggagac

SEQ ID NO: 37488 - DNA, 20 bp, Artificial Sequence
  Description of Artificial Sequence: Synthetic oligonucleotide
  Target: SCN10A; (+) strand; PAM type: NRG; PAM sequence: GGG
ctggtctcaagctggagact

SEQ ID NO: 37489 - DNA, 20 bp, Artificial Sequence
  Description of Artificial Sequence: Synthetic oligonucleotide
  Target: SCN10A; (+) strand; PAM type: NRG; PAM sequence: GAG
ggtctcaagctggagactgg

SEQ ID NO: 37490 - DNA, 20 bp, Artificial Sequence
  Description of Artificial Sequence: Synthetic oligonucleotide
  Target: SCN10A; (+) strand; PAM type: NRG; PAM sequence: AAG
tggagactgggagtgcctac

SEQ ID NO: 37491 - DNA, 20 bp, Artificial Sequence
  Description of Artificial Sequence: Synthetic oligonucleotide
  Target: SCN10A; (+) strand; PAM type: NRG; PAM sequence: AGG
ggagactgggagtgcctaca

SEQ ID NO: 37492 - DNA, 20 bp, Artificial Sequence
  Description of Artificial Sequence: Synthetic oligonucleotide
  Target: SCN10A; (+) strand; PAM type: NRG; PAM sequence: TGG
ttctacttttatattttgtg

SEQ ID NO: 37493 - DNA, 20 bp, Artificial Sequence
  Description of Artificial Sequence: Synthetic oligonucleotide
  Target: SCN10A; (+) strand; PAM type: NRG; PAM sequence: CAG
tcctaaatttatttacattc

SEQ ID NO: 37494 - DNA, 20 bp, Artificial Sequence
  Description of Artificial Sequence: Synthetic oligonucleotide
  Target: SCN10A; (+) strand; PAM type: NRG; PAM sequence: AGG
cctaaatttatttacattcc

SEQ ID NO: 37495 - DNA, 20 bp, Artificial Sequence
  Description of Artificial Sequence: Synthetic oligonucleotide
  Target: SCN10A; (+) strand; PAM type: NRG; PAM sequence: AAG
aatttatttacattccaggt

SEQ ID NO: 37496 - DNA, 20 bp, Artificial Sequence
  Description of Artificial Sequence: Synthetic oligonucleotide
  Target: SCN10A; (+) strand; PAM type: NRG; PAM sequence: AGG
atttatttacattccaggta

SEQ ID NO: 37497 - DNA, 20 bp, Artificial Sequence
  Description of Artificial Sequence: Synthetic oligonucleotide
  Target: SCN10A; (+) strand; PAM type: NRG; PAM sequence: GGG
tttatttacattccaggtaa

SEQ ID NO: 37498 - DNA, 20 bp, Artificial Sequence
  Description of Artificial Sequence: Synthetic oligonucleotide
  Target: SCN10A; (+) strand; PAM type: NRG; PAM sequence: TGG
taaattcttctcctgtgatc

SEQ ID NO: 37499 - DNA, 20 bp, Artificial Sequence
  Description of Artificial Sequence: Synthetic oligonucleotide
  Target: SCN10A; (+) strand; PAM type: NRG; PAM sequence: CAG
tctcctgtgatctggatttt

SEQ ID NO: 37500 - DNA, 20 bp, Artificial Sequence
  Description of Artificial Sequence: Synthetic oligonucleotide
  Target: SCN10A; (+) strand; PAM type: NRG; PAM sequence: CAG
atctggattttcagattacc

SEQ ID NO: 37501 - DNA, 20 bp, Artificial Sequence
  Description of Artificial Sequence: Synthetic oligonucleotide
  Target: SCN10A; (+) strand; PAM type: NRG; PAM sequence: TGG
ggattttcagattacccagt

SEQ ID NO: 37502 - DNA, 20 bp, Artificial Sequence
  Description of Artificial Sequence: Synthetic oligonucleotide
  Target: SCN10A; (+) strand; PAM type: NRG; PAM sequence: GGG
gattttcagattacccagtt

SEQ ID NO: 37503 - DNA, 20 bp, Artificial Sequence
  Description of Artificial Sequence: Synthetic oligonucleotide
  Target: SCN10A; (+) strand; PAM type: NRG; PAM sequence: TGG
acccagttgggatgtatgtt

SEQ ID NO: 37504 - DNA, 20 bp, Artificial Sequence
  Description of Artificial Sequence: Synthetic oligonucleotide
  Target: SCN10A; (+) strand; PAM type: NRG; PAM sequence: GAG
ccagttgggatgtatgtttg

SEQ ID NO: 37505 - DNA, 20 bp, Artificial Sequence
  Description of Artificial Sequence: Synthetic oligonucleotide
  Target: SCN10A; (+) strand; PAM type: NRG; PAM sequence: AGG
cagttgggatgtatgtttgg

SEQ ID NO: 37506 - DNA, 20 bp, Artificial Sequence
  Description of Artificial Sequence: Synthetic oligonucleotide
  Target: SCN10A; (+) strand; PAM type: NRG; PAM sequence: CAG
ttgggatgtatgtttggagg

SEQ ID NO: 37507 - DNA, 20 bp, Artificial Sequence
  Description of Artificial Sequence: Synthetic oligonucleotide
  Target: SCN10A; (+) strand; PAM type: NRG; PAM sequence: AGG
tgggatgtatgtttggaggc

SEQ ID NO: 37508 - DNA, 20 bp, Artificial Sequence
  Description of Artificial Sequence: Synthetic oligonucleotide
  Target: SCN10A; (+) strand; PAM type: NRG; PAM sequence: TGG
ggtttccccccctcacactt

SEQ ID NO: 37509 - DNA, 20 bp, Artificial Sequence
  Description of Artificial Sequence: Synthetic oligonucleotide
  Target: SCN10A; (+) strand; PAM type: NRG; PAM sequence: GGG
gtttccccccctcacacttt

SEQ ID NO: 37510 - DNA, 20 bp, Artificial Sequence
  Description of Artificial Sequence: Synthetic oligonucleotide
  Target: SCN10A; (+) strand; PAM type: NRG; PAM sequence: GAG
ttccccccctcacactttgg

SEQ ID NO: 37511 - DNA, 20 bp, Artificial Sequence
  Description of Artificial Sequence: Synthetic oligonucleotide
  Target: SCN10A; (+) strand; PAM type: NRG; PAM sequence: CAG
cctcacactttgggagctca

SEQ ID NO: 37512 - DNA, 20 bp, Artificial Sequence
  Description of Artificial Sequence: Synthetic oligonucleotide
  Target: SCN10A; (+) strand; PAM type: NRG; PAM sequence: CAG
acagtttttcacctgtcttg

SEQ ID NO: 37513 - DNA, 20 bp, Artificial Sequence
  Description of Artificial Sequence: Synthetic oligonucleotide
  Target: SCN10A; (+) strand; PAM type: NRG; PAM sequence: CAG
cacctgtcttgcagaatttc

SEQ ID NO: 37514 - DNA, 20 bp, Artificial Sequence
  Description of Artificial Sequence: Synthetic oligonucleotide
  Target: SCN10A; (+) strand; PAM type: NRG; PAM sequence: CAG
ctgtcttgcagaatttccag

SEQ ID NO: 37515 - DNA, 20 bp, Artificial Sequence
  Description of Artificial Sequence: Synthetic oligonucleotide
  Target: SCN10A; (+) strand; PAM type: NRG; PAM sequence: AAG
gcagtgtgccacttatttaa

SEQ ID NO: 37516 - DNA, 20 bp, Artificial Sequence
  Description of Artificial Sequence: Synthetic oligonucleotide
  Target: SCN10A; (+) strand; PAM type: NRG; PAM sequence: AGG
cagtgtgccacttatttaaa

SEQ ID NO: 37517 - DNA, 20 bp, Artificial Sequence
  Description of Artificial Sequence: Synthetic oligonucleotide
  Target: SCN10A; (+) strand; PAM type: NRG; PAM sequence: CAG
aaaggatctatgaattcttt

SEQ ID NO: 37518 - DNA, 20 bp, Artificial Sequence
  Description of Artificial Sequence: Synthetic oligonucleotide
  Target: SCN10A; (+) strand; PAM type: NRG; PAM sequence: TGG
atgaattctttcagttctcc

SEQ ID NO: 37519 - DNA, 20 bp, Artificial Sequence
  Description of Artificial Sequence: Synthetic oligonucleotide
  Target: SCN10A; (+) strand; PAM type: NRG; PAM sequence: CAG
gttctcctggtatattcctg

SEQ ID NO: 37520 - DNA, 20 bp, Artificial Sequence
  Description of Artificial Sequence: Synthetic oligonucleotide
  Target: SCN10A; (+) strand; PAM type: NRG; PAM sequence: TGG
ctcctggtatattcctgcag

SEQ ID NO: 37521 - DNA, 20 bp, Artificial Sequence
  Description of Artificial Sequence: Synthetic oligonucleotide
  Target: SCN10A; (+) strand; PAM type: NRG; PAM sequence: TGG
tatattcctgcagtggttct

SEQ ID NO: 37522 - DNA, 20 bp, Artificial Sequence
  Description of Artificial Sequence: Synthetic oligonucleotide
  Target: SCN10A; (+) strand; PAM type: NRG; PAM sequence: GAG
tattcctgcagtggttcttg

SEQ ID NO: 37523 - DNA, 20 bp, Artificial Sequence
  Description of Artificial Sequence: Synthetic oligonucleotide
  Target: SCN10A; (+) strand; PAM type: NRG; PAM sequence: TGG
gttcttggagcaaacgttca

SEQ ID NO: 37524 - DNA, 20 bp, Artificial Sequence
  Description of Artificial Sequence: Synthetic oligonucleotide
  Target: SCN10A; (+) strand; PAM type: NRG; PAM sequence: GAG
ggagcaaacgttcatggtgt

SEQ ID NO: 37525 - DNA, 20 bp, Artificial Sequence
  Description of Artificial Sequence: Synthetic oligonucleotide
  Target: SCN10A; (+) strand; PAM type: NRG; PAM sequence: AAG
tgagtctccacactctgtcc

SEQ ID NO: 37526 - DNA, 20 bp, Artificial Sequence
  Description of Artificial Sequence: Synthetic oligonucleotide
  Target: SCN10A; (+) strand; PAM type: NRG; PAM sequence: TGG
gtctccacactctgtccaag

SEQ ID NO: 37527 - DNA, 20 bp, Artificial Sequence
  Description of Artificial Sequence: Synthetic oligonucleotide
  Target: SCN10A; (+) strand; PAM type: NRG; PAM sequence: GGG
tctccacactctgtccaagt

SEQ ID NO: 37528 - DNA, 20 bp, Artificial Sequence
  Description of Artificial Sequence: Synthetic oligonucleotide
  Target: SCN10A; (+) strand; PAM type: NRG; PAM sequence: TAG
tccaagtgggacctgcatgt

SEQ ID NO: 37529 - DNA, 20 bp, Artificial Sequence
  Description of Artificial Sequence: Synthetic oligonucleotide
  Target: SCN10A; (+) strand; PAM type: NRG; PAM sequence: CAG
cccctctcctatcacacatg

SEQ ID NO: 37530 - DNA, 20 bp, Artificial Sequence
  Description of Artificial Sequence: Synthetic oligonucleotide
  Target: SCN10A; (+) strand; PAM type: NRG; PAM sequence: TAG
atcacacatgcagatctgca

SEQ ID NO: 37531 - DNA, 20 bp, Artificial Sequence
  Description of Artificial Sequence: Synthetic oligonucleotide
  Target: SCN10A; (+) strand; PAM type: NRG; PAM sequence: GAG
cacacatgcagatctgcata

SEQ ID NO: 37532 - DNA, 20 bp, Artificial Sequence
  Description of Artificial Sequence: Synthetic oligonucleotide
  Target: SCN10A; (+) strand; PAM type: NRG; PAM sequence: CAG
gcatagagatatactcacgc

SEQ ID NO: 37533 - DNA, 20 bp, Artificial Sequence
  Description of Artificial Sequence: Synthetic oligonucleotide
  Target: SCN10A; (+) strand; PAM type: NRG; PAM sequence: AGG
catagagatatactcacgcc

SEQ ID NO: 37534 - DNA, 20 bp, Artificial Sequence
  Description of Artificial Sequence: Synthetic oligonucleotide
  Target: SCN10A; (+) strand; PAM type: NRG; PAM sequence: GGG
atagagatatactcacgcca

SEQ ID NO: 37535 - DNA, 20 bp, Artificial Sequence
  Description of Artificial Sequence: Synthetic oligonucleotide
  Target: SCN10A; (+) strand; PAM type: NRG; PAM sequence: CAG
agggtaatgacgctaaaatc

SEQ ID NO: 37536 - DNA, 20 bp, Artificial Sequence
  Description of Artificial Sequence: Synthetic oligonucleotide
  Target: SCN10A; (+) strand; PAM type: NRG; PAM sequence: CAG
taatgacgctaaaatccagc

SEQ ID NO: 37537 - DNA, 20 bp, Artificial Sequence
  Description of Artificial Sequence: Synthetic oligonucleotide
  Target: SCN10A; (+) strand; PAM type: NRG; PAM sequence: AAG
gctaaaatccagccagttcc

SEQ ID NO: 37538 - DNA, 20 bp, Artificial Sequence
  Description of Artificial Sequence: Synthetic oligonucleotide
  Target: SCN10A; (+) strand; PAM type: NRG; PAM sequence: AGG
ctaaaatccagccagttcca

SEQ ID NO: 37539 - DNA, 20 bp, Artificial Sequence
  Description of Artificial Sequence: Synthetic oligonucleotide
  Target: SCN10A; (+) strand; PAM type: NRG; PAM sequence: CAG
agccagttccaaggatctct

SEQ ID NO: 37540 - DNA, 20 bp, Artificial Sequence
  Description of Artificial Sequence: Synthetic oligonucleotide
  Target: SCN10A; (+) strand; PAM type: NRG; PAM sequence: AGG
gccagttccaaggatctctc

SEQ ID NO: 37541 - DNA, 20 bp, Artificial Sequence
  Description of Artificial Sequence: Synthetic oligonucleotide
  Target: SCN10A; (+) strand; PAM type: NRG; PAM sequence: TAG
ctcaggtacgtgaactcatt

SEQ ID NO: 37542 - DNA, 20 bp, Artificial Sequence
  Description of Artificial Sequence: Synthetic oligonucleotide
  Target: SCN10A; (+) strand; PAM type: NRG; PAM sequence: CAG
tttagacaaaatcctcttgc

SEQ ID NO: 37543 - DNA, 20 bp, Artificial Sequence
  Description of Artificial Sequence: Synthetic oligonucleotide
  Target: SCN10A; (+) strand; PAM type: NRG; PAM sequence: AAG
ctcttgccagtatctttatc

SEQ ID NO: 37544 - DNA, 20 bp, Artificial Sequence
  Description of Artificial Sequence: Synthetic oligonucleotide
  Target: SCN10A; (+) strand; PAM type: NRG; PAM sequence: AGG
tcttgccagtatctttatca

SEQ ID NO: 37545 - DNA, 20 bp, Artificial Sequence
  Description of Artificial Sequence: Synthetic oligonucleotide
  Target: SCN10A; (+) strand; PAM type: NRG; PAM sequence: AAG
gtatctttatcaaggcttca

SEQ ID NO: 37546 - DNA, 20 bp, Artificial Sequence
  Description of Artificial Sequence: Synthetic oligonucleotide
  Target: SCN10A; (+) strand; PAM type: NRG; PAM sequence: AGG
tatctttatcaaggcttcaa

SEQ ID NO: 37547 - DNA, 20 bp, Artificial Sequence
  Description of Artificial Sequence: Synthetic oligonucleotide
  Target: SCN10A; (+) strand; PAM type: NRG; PAM sequence: CAG
ggcttcaaaggtgtaaatga

SEQ ID NO: 37548 - DNA, 20 bp, Artificial Sequence
  Description of Artificial Sequence: Synthetic oligonucleotide
  Target: SCN10A; (+) strand; PAM type: NRG; PAM sequence: AAG
caaaggtgtaaatgacagtg

SEQ ID NO: 37549 - DNA, 20 bp, Artificial Sequence
  Description of Artificial Sequence: Synthetic oligonucleotide
  Target: SCN10A; (+) strand; PAM type: NRG; PAM sequence: TGG
aatgacagtgaagacatatc

SEQ ID NO: 37550 - DNA, 20 bp, Artificial Sequence
  Description of Artificial Sequence: Synthetic oligonucleotide
  Target: SCN10A; (+) strand; PAM type: NRG; PAM sequence: GGG
atgacagtgaagacatatct

SEQ ID NO: 37551 - DNA, 20 bp, Artificial Sequence
  Description of Artificial Sequence: Synthetic oligonucleotide
  Target: SCN10A; (+) strand; PAM type: NRG; PAM sequence: AAG
acagtgaagacatatctggg

SEQ ID NO: 37552 - DNA, 20 bp, Artificial Sequence
  Description of Artificial Sequence: Synthetic oligonucleotide
  Target: SCN10A; (+) strand; PAM type: NRG; PAM sequence: AGG
cagtgaagacatatctggga

SEQ ID NO: 37553 - DNA, 20 bp, Artificial Sequence
  Description of Artificial Sequence: Synthetic oligonucleotide
  Target: SCN10A; (+) strand; PAM type: NRG; PAM sequence: GAG
gtgaagacatatctgggaag

SEQ ID NO: 37554 - DNA, 20 bp, Artificial Sequence
  Description of Artificial Sequence: Synthetic oligonucleotide
  Target: SCN10A; (+) strand; PAM type: NRG; PAM sequence: AGG
tgaagacatatctgggaagg

SEQ ID NO: 37555 - DNA, 20 bp, Artificial Sequence
  Description of Artificial Sequence: Synthetic oligonucleotide
  Target: SCN10A; (+) strand; PAM type: NRG; PAM sequence: GGG
gaagacatatctgggaagga

SEQ ID NO: 37556 - DNA, 20 bp, Artificial Sequence
  Description of Artificial Sequence: Synthetic oligonucleotide
  Target: SCN10A; (+) strand; PAM type: NRG; PAM sequence: TAG
gacatatctgggaaggaggg

SEQ ID NO: 37557 - DNA, 20 bp, Artificial Sequence
  Description of Artificial Sequence: Synthetic oligonucleotide
  Target: SCN10A; (+) strand; PAM type: NRG; PAM sequence: AAG
atctgggaaggagggtagaa

SEQ ID NO: 37558 - DNA, 20 bp, Artificial Sequence
  Description of Artificial Sequence: Synthetic oligonucleotide
  Target: SCN10A; (+) strand; PAM type: NRG; PAM sequence: AGG
tctgggaaggagggtagaaa

SEQ ID NO: 37559 - DNA, 20 bp, Artificial Sequence
  Description of Artificial Sequence: Synthetic oligonucleotide
  Target: SCN10A; (+) strand; PAM type: NRG; PAM sequence: GAG
tgggaaggagggtagaaaag

SEQ ID NO: 37560 - DNA, 20 bp, Artificial Sequence
  Description of Artificial Sequence: Synthetic oligonucleotide
  Target: SCN10A; (+) strand; PAM type: NRG; PAM sequence: TGG
aaggagtgtcaactgtgcca

SEQ ID NO: 37561 - DNA, 20 bp, Artificial Sequence
  Description of Artificial Sequence: Synthetic oligonucleotide
  Target: SCN10A; (+) strand; PAM type: NRG; PAM sequence: GAG
ggagtgtcaactgtgccatg

SEQ ID NO: 37562 - DNA, 20 bp, Artificial Sequence
  Description of Artificial Sequence: Synthetic oligonucleotide
  Target: SCN10A; (+) strand; PAM type: NRG; PAM sequence: CAG
actgtgccatggagtgtact

SEQ ID NO: 37563 - DNA, 20 bp, Artificial Sequence
  Description of Artificial Sequence: Synthetic oligonucleotide
  Target: SCN10A; (+) strand; PAM type: NRG; PAM sequence: AGG
ctgtgccatggagtgtactc

SEQ ID NO: 37564 - DNA, 20 bp, Artificial Sequence
  Description of Artificial Sequence: Synthetic oligonucleotide
  Target: SCN10A; (+) strand; PAM type: NRG; PAM sequence: GGG
tgtgccatggagtgtactca

SEQ ID NO: 37565 - DNA, 20 bp, Artificial Sequence
  Description of Artificial Sequence: Synthetic oligonucleotide
  Target: SCN10A; (+) strand; PAM type: NRG; PAM sequence: GGG
gtgccatggagtgtactcag

SEQ ID NO: 37566 - DNA, 20 bp, Artificial Sequence
  Description of Artificial Sequence: Synthetic oligonucleotide
  Target: SCN10A; (+) strand; PAM type: NRG; PAM sequence: GGG
tgccatggagtgtactcagg

SEQ ID NO: 37567 - DNA, 20 bp, Artificial Sequence
  Description of Artificial Sequence: Synthetic oligonucleotide
  Target: SCN10A; (+) strand; PAM type: NRG; PAM sequence: CAG
actcagggggttccttcttc

SEQ ID NO: 37568 - DNA, 20 bp, Artificial Sequence
  Description of Artificial Sequence: Synthetic oligonucleotide
  Target: SCN10A; (+) strand; PAM type: NRG; PAM sequence: AGG
ctcagggggttccttcttcc

SEQ ID NO: 37569 - DNA, 20 bp, Artificial Sequence
  Description of Artificial Sequence: Synthetic oligonucleotide
  Target: SCN10A; (+) strand; PAM type: NRG; PAM sequence: GAG
cagggggttccttcttccag

SEQ ID NO: 37570 - DNA, 20 bp, Artificial Sequence
  Description of Artificial Sequence: Synthetic oligonucleotide
  Target: SCN10A; (+) strand; PAM type: NRG; PAM sequence: AGG
agggggttccttcttccagg

SEQ ID NO: 37571 - DNA, 20 bp, Artificial Sequence
  Description of Artificial Sequence: Synthetic oligonucleotide
  Target: SCN10A; (+) strand; PAM type: NRG; PAM sequence: GGG
gggggttccttcttccagga

SEQ ID NO: 37572 - DNA, 20 bp, Artificial Sequence
  Description of Artificial Sequence: Synthetic oligonucleotide
  Target: SCN10A; (+) strand; PAM type: NRG; PAM sequence: GAG
gggttccttcttccaggagg

SEQ ID NO: 37573 - DNA, 20 bp, Artificial Sequence
  Description of Artificial Sequence: Synthetic oligonucleotide
  Target: SCN10A; (+) strand; PAM type: NRG; PAM sequence: AGG
ggttccttcttccaggaggg

SEQ ID NO: 37574 - DNA, 20 bp, Artificial Sequence
  Description of Artificial Sequence: Synthetic oligonucleotide
  Target: SCN10A; (+) strand; PAM type: NRG; PAM sequence: GGG
gttccttcttccaggaggga

SEQ ID NO: 37575 - DNA, 20 bp, Artificial Sequence
  Description of Artificial Sequence: Synthetic oligonucleotide
  Target: SCN10A; (+) strand; PAM type: NRG; PAM sequence: AAG
tgacctgctctgactgctcc

SEQ ID NO: 37576 - DNA, 20 bp, Artificial Sequence
  Description of Artificial Sequence: Synthetic oligonucleotide
  Target: SCN10A; (+) strand; PAM type: NRG; PAM sequence: AAG
gctccaagaaaaaacatgca

SEQ ID NO: 37577 - DNA, 20 bp, Artificial Sequence
  Description of Artificial Sequence: Synthetic oligonucleotide
  Target: SCN10A; (+) strand; PAM type: NRG; PAM sequence: AAG
aacatgcaaagaatatcacc

SEQ ID NO: 37578 - DNA, 20 bp, Artificial Sequence
  Description of Artificial Sequence: Synthetic oligonucleotide
  Target: SCN10A; (+) strand; PAM type: NRG; PAM sequence: AGG
acatgcaaagaatatcacca

SEQ ID NO: 37579 - DNA, 20 bp, Artificial Sequence
  Description of Artificial Sequence: Synthetic oligonucleotide
  Target: SCN10A; (+) strand; PAM type: NRG; PAM sequence: GAG
aagaatatcaccaaggtgat

SEQ ID NO: 37580 - DNA, 20 bp, Artificial Sequence
  Description of Artificial Sequence: Synthetic oligonucleotide
  Target: SCN10A; (+) strand; PAM type: NRG; PAM sequence: AGG
agaatatcaccaaggtgatg

SEQ ID NO: 37581 - DNA, 20 bp, Artificial Sequence
  Description of Artificial Sequence: Synthetic oligonucleotide
  Target: SCN10A; (+) strand; PAM type: NRG; PAM sequence: GGG
gaatatcaccaaggtgatga

SEQ ID NO: 37582 - DNA, 20 bp, Artificial Sequence
  Description of Artificial Sequence: Synthetic oligonucleotide
  Target: SCN10A; (+) strand; PAM type: NRG; PAM sequence: GGG
aatatcaccaaggtgatgag

SEQ ID NO: 37583 - DNA, 20 bp, Artificial Sequence
  Description of Artificial Sequence: Synthetic oligonucleotide
  Target: SCN10A; (+) strand; PAM type: NRG; PAM sequence: GGG
atatcaccaaggtgatgagg

SEQ ID NO: 37584 - DNA, 20 bp, Artificial Sequence
  Description of Artificial Sequence: Synthetic oligonucleotide
  Target: SCN10A; (+) strand; PAM type: NRG; PAM sequence: AAG
tcaccaaggtgatgaggggg

SEQ ID NO: 37585 - DNA, 20 bp, Artificial Sequence
  Description of Artificial Sequence: Synthetic oligonucleotide
  Target: SCN10A; (+) strand; PAM type: NRG; PAM sequence: AAG
ccaaggtgatgagggggaag

SEQ ID NO: 37586 - DNA, 20 bp, Artificial Sequence
  Description of Artificial Sequence: Synthetic oligonucleotide
  Target: SCN10A; (+) strand; PAM type: NRG; PAM sequence: AGG
caaggtgatgagggggaaga

SEQ ID NO: 37587 - DNA, 20 bp, Artificial Sequence
  Description of Artificial Sequence: Synthetic oligonucleotide
  Target: SCN10A; (+) strand; PAM type: NRG; PAM sequence: AAG
gtgatgagggggaagaaggt

SEQ ID NO: 37588 - DNA, 20 bp, Artificial Sequence
  Description of Artificial Sequence: Synthetic oligonucleotide
  Target: SCN10A; (+) strand; PAM type: NRG; PAM sequence: AGG
tgatgagggggaagaaggta

SEQ ID NO: 37589 - DNA, 20 bp, Artificial Sequence
  Description of Artificial Sequence: Synthetic oligonucleotide
  Target: SCN10A; (+) strand; PAM type: NRG; PAM sequence: GAG
atgagggggaagaaggtaag

SEQ ID NO: 37590 - DNA, 20 bp, Artificial Sequence
  Description of Artificial Sequence: Synthetic oligonucleotide
  Target: SCN10A; (+) strand; PAM type: NRG; PAM sequence: GAG
gagggggaagaaggtaagga

SEQ ID NO: 37591 - DNA, 20 bp, Artificial Sequence
  Description of Artificial Sequence: Synthetic oligonucleotide
  Target: SCN10A; (+) strand; PAM type: NRG; PAM sequence: AGG
agggggaagaaggtaaggag

SEQ ID NO: 37592 - DNA, 20 bp, Artificial Sequence
  Description of Artificial Sequence: Synthetic oligonucleotide
  Target: SCN10A; (+) strand; PAM type: NRG; PAM sequence: AAG
agaaggtaaggagaggaaac

SEQ ID NO: 37593 - DNA, 20 bp, Artificial Sequence
  Description of Artificial Sequence: Synthetic oligonucleotide
  Target: SCN10A; (+) strand; PAM type: NRG; PAM sequence: CAG
taaggagaggaaacaagaca

SEQ ID NO: 37594 - DNA, 20 bp, Artificial Sequence
  Description of Artificial Sequence: Synthetic oligonucleotide
  Target: SCN10A; (+) strand; PAM type: NRG; PAM sequence: GAG
gaggaaacaagacacagact

SEQ ID NO: 37595 - DNA, 20 bp, Artificial Sequence
  Description of Artificial Sequence: Synthetic oligonucleotide
  Target: SCN10A; (+) strand; PAM type: NRG; PAM sequence: AGG
aggaaacaagacacagactg

SEQ ID NO: 37596 - DNA, 20 bp, Artificial Sequence
  Description of Artificial Sequence: Synthetic oligonucleotide
  Target: SCN10A; (+) strand; PAM type: NRG; PAM sequence: GGG
ggaaacaagacacagactga

SEQ ID NO: 37597 - DNA, 20 bp, Artificial Sequence
  Description of Artificial Sequence: Synthetic oligonucleotide
  Target: SCN10A; (+) strand; PAM type: NRG; PAM sequence: AAG
aagacacagactgagggaaa

SEQ ID NO: 37598 - DNA, 20 bp, Artificial Sequence
  Description of Artificial Sequence: Synthetic oligonucleotide
  Target: SCN10A; (+) strand; PAM type: NRG; PAM sequence: AAG
acacagactgagggaaaaag

SEQ ID NO: 37599 - DNA, 20 bp, Artificial Sequence
  Description of Artificial Sequence: Synthetic oligonucleotide
  Target: SCN10A; (+) strand; PAM type: NRG; PAM sequence: AGG
cacagactgagggaaaaaga

SEQ ID NO: 37600 - DNA, 20 bp, Artificial Sequence
  Description of Artificial Sequence: Synthetic oligonucleotide
  Target: SCN10A; (+) strand; PAM type: NRG; PAM sequence: GGG
acagactgagggaaaaagaa

SEQ ID NO: 37601 - DNA, 20 bp, Artificial Sequence
  Description of Artificial Sequence: Synthetic oligonucleotide
  Target: SCN10A; (+) strand; PAM type: NRG; PAM sequence: TAG
aaaaagaagggccacacaaa

SEQ ID NO: 37602 - DNA, 20 bp, Artificial Sequence
  Description of Artificial Sequence: Synthetic oligonucleotide
  Target: SCN10A; (+) strand; PAM type: NRG; PAM sequence: TGG
agaagggccacacaaataga

SEQ ID NO: 37603 - DNA, 20 bp, Artificial Sequence
  Description of Artificial Sequence: Synthetic oligonucleotide
  Target: SCN10A; (+) strand; PAM type: NRG; PAM sequence: GAG
aagggccacacaaatagatg

SEQ ID NO: 37604 - DNA, 20 bp, Artificial Sequence
  Description of Artificial Sequence: Synthetic oligonucleotide
  Target: SCN10A; (+) strand; PAM type: NRG; PAM sequence: TGG
ggccacacaaatagatggag

SEQ ID NO: 37605 - DNA, 20 bp, Artificial Sequence
  Description of Artificial Sequence: Synthetic oligonucleotide
  Target: SCN10A; (+) strand; PAM type: NRG; PAM sequence: GGG
gccacacaaatagatggagt

SEQ ID NO: 37606 - DNA, 20 bp, Artificial Sequence
  Description of Artificial Sequence: Synthetic oligonucleotide
  Target: SCN10A; (+) strand; PAM type: NRG; PAM sequence: GGG
ccacacaaatagatggagtg

SEQ ID NO: 37607 - DNA, 20 bp, Artificial Sequence
  Description of Artificial Sequence: Synthetic oligonucleotide
  Target: SCN10A; (+) strand; PAM type: NRG; PAM sequence: GAG
acacaaatagatggagtggg

SEQ ID NO: 37608 - DNA, 20 bp, Artificial Sequence
  Description of Artificial Sequence: Synthetic oligonucleotide
  Target: SCN10A; (+) strand; PAM type: NRG; PAM sequence: AGG
cacaaatagatggagtgggg

SEQ ID NO: 37609 - DNA, 20 bp, Artificial Sequence
  Description of Artificial Sequence: Synthetic oligonucleotide
  Target: SCN10A; (+) strand; PAM type: NRG; PAM sequence: GGG
acaaatagatggagtgggga

SEQ ID NO: 37610 - DNA, 20 bp, Artificial Sequence
  Description of Artificial Sequence: Synthetic oligonucleotide
  Target: SCN10A; (+) strand; PAM type: NRG; PAM sequence: TGG
ggagtggggagggatgtgtg

SEQ ID NO: 37611 - DNA, 20 bp, Artificial Sequence
  Description of Artificial Sequence: Synthetic oligonucleotide
  Target: SCN10A; (+) strand; PAM type: NRG; PAM sequence: TGG
tggggagggatgtgtgtggc

SEQ ID NO: 37612 - DNA, 20 bp, Artificial Sequence
  Description of Artificial Sequence: Synthetic oligonucleotide
  Target: SCN10A; (+) strand; PAM type: NRG; PAM sequence: GGG
ggggagggatgtgtgtggct

SEQ ID NO: 37613 - DNA, 20 bp, Artificial Sequence
  Description of Artificial Sequence: Synthetic oligonucleotide
  Target: SCN10A; (+) strand; PAM type: NRG; PAM sequence: CAG
agggatgtgtgtggctggga

SEQ ID NO: 37614 - DNA, 20 bp, Artificial Sequence
  Description of Artificial Sequence: Synthetic oligonucleotide
  Target: SCN10A; (+) strand; PAM type: NRG; PAM sequence: CAG
atgtgtgtggctgggacagc

SEQ ID NO: 37615 - DNA, 20 bp, Artificial Sequence
  Description of Artificial Sequence: Synthetic oligonucleotide
  Target: SCN10A; (+) strand; PAM type: NRG; PAM sequence: CAG
tgtgtggctgggacagccag

SEQ ID NO: 37616 - DNA, 20 bp, Artificial Sequence
  Description of Artificial Sequence: Synthetic oligonucleotide
  Target: SCN10A; (+) strand; PAM type: NRG; PAM sequence: TGG
gccagcagcttctgctgttc

SEQ ID NO: 37617 - DNA, 20 bp, Artificial Sequence
  Description of Artificial Sequence: Synthetic oligonucleotide
  Target: SCN10A; (+) strand; PAM type: NRG; PAM sequence: GGG
ccagcagcttctgctgttct

SEQ ID NO: 37618 - DNA, 20 bp, Artificial Sequence
  Description of Artificial Sequence: Synthetic oligonucleotide
  Target: SCN10A; (+) strand; PAM type: NRG; PAM sequence: GGG
cagcagcttctgctgttctg

SEQ ID NO: 37619 - DNA, 20 bp, Artificial Sequence
  Description of Artificial Sequence: Synthetic oligonucleotide
  Target: SCN10A; (+) strand; PAM type: NRG; PAM sequence: TAG
agcttctgctgttctggggt

SEQ ID NO: 37620 - DNA, 20 bp, Artificial Sequence
  Description of Artificial Sequence: Synthetic oligonucleotide
  Target: SCN10A; (+) strand; PAM type: NRG; PAM sequence: AGG
gcttctgctgttctggggtt

SEQ ID NO: 37621 - DNA, 20 bp, Artificial Sequence
  Description of Artificial Sequence: Synthetic oligonucleotide
  Target: SCN10A; (+) strand; PAM type: NRG; PAM sequence: CAG
tctgctgttctggggttagg

SEQ ID NO: 37622 - DNA, 20 bp, Artificial Sequence
  Description of Artificial Sequence: Synthetic oligonucleotide
  Target: SCN10A; (+) strand; PAM type: NRG; PAM sequence: GAG
tgctgttctggggttaggca

SEQ ID NO: 37623 - DNA, 20 bp, Artificial Sequence
  Description of Artificial Sequence: Synthetic oligonucleotide
  Target: SCN10A; (+) strand; PAM type: NRG; PAM sequence: AGG
gctgttctggggttaggcag

SEQ ID NO: 37624 - DNA, 20 bp, Artificial Sequence
  Description of Artificial Sequence: Synthetic oligonucleotide
  Target: SCN10A; (+) strand; PAM type: NRG; PAM sequence: GGG
ctgttctggggttaggcaga

SEQ ID NO: 37625 - DNA, 20 bp, Artificial Sequence
  Description of Artificial Sequence: Synthetic oligonucleotide
  Target: SCN10A; (+) strand; PAM type: NRG; PAM sequence: CAG
ttctggggttaggcagaggg

SEQ ID NO: 37626 - DNA, 20 bp, Artificial Sequence
  Description of Artificial Sequence: Synthetic oligonucleotide
  Target: SCN10A; (+) strand; PAM type: NRG; PAM sequence: TAG
tggggttaggcagagggcag

SEQ ID NO: 37627 - DNA, 20 bp, Artificial Sequence
  Description of Artificial Sequence: Synthetic oligonucleotide
  Target: SCN10A; (+) strand; PAM type: NRG; PAM sequence: CGG
ggttaggcagagggcagtag

SEQ ID NO: 37628 - DNA, 20 bp, Artificial Sequence
  Description of Artificial Sequence: Synthetic oligonucleotide
  Target: SCN10A; (+) strand; PAM type: NRG; PAM sequence: GGG
gttaggcagagggcagtagc

SEQ ID NO: 37629 - DNA, 20 bp, Artificial Sequence
  Description of Artificial Sequence: Synthetic oligonucleotide
  Target: SCN10A; (+) strand; PAM type: NRG; PAM sequence: AAG
gcagagggcagtagcgggtg

SEQ ID NO: 37630 - DNA, 20 bp, Artificial Sequence
  Description of Artificial Sequence: Synthetic oligonucleotide
  Target: SCN10A; (+) strand; PAM type: NRG; PAM sequence: GAG
agagggcagtagcgggtgaa

SEQ ID NO: 37631 - DNA, 20 bp, Artificial Sequence
  Description of Artificial Sequence: Synthetic oligonucleotide
  Target: SCN10A; (+) strand; PAM type: NRG; PAM sequence: AAG
ggcagtagcgggtgaagagc

SEQ ID NO: 37632 - DNA, 20 bp, Artificial Sequence
  Description of Artificial Sequence: Synthetic oligonucleotide
  Target: SCN10A; (+) strand; PAM type: NRG; PAM sequence: AGG
gcagtagcgggtgaagagca

SEQ ID NO: 37633 - DNA, 20 bp, Artificial Sequence
  Description of Artificial Sequence: Synthetic oligonucleotide
  Target: SCN10A; (+) strand; PAM type: NRG; PAM sequence: CAG
attctcctgtttatgtctgc

SEQ ID NO: 37634 - DNA, 20 bp, Artificial Sequence
  Description of Artificial Sequence: Synthetic oligonucleotide
  Target: SCN10A; (+) strand; PAM type: NRG; PAM sequence: AGG
ttctcctgtttatgtctgcc

SEQ ID NO: 37635 - DNA, 20 bp, Artificial Sequence
  Description of Artificial Sequence: Synthetic oligonucleotide
  Target: SCN10A; (+) strand; PAM type: NRG; PAM sequence: GGG
tctcctgtttatgtctgcca

SEQ ID NO: 37636 - DNA, 20 bp, Artificial Sequence
  Description of Artificial Sequence: Synthetic oligonucleotide
  Target: SCN10A; (+) strand; PAM type: NRG; PAM sequence: AAG
ccagggcctccctatcctgc

SEQ ID NO: 37637 - DNA, 20 bp, Artificial Sequence
  Description of Artificial Sequence: Synthetic oligonucleotide
  Target: SCN10A; (+) strand; PAM type: NRG; PAM sequence: AAG
gggcctccctatcctgcaag

SEQ ID NO: 37638 - DNA, 20 bp, Artificial Sequence
  Description of Artificial Sequence: Synthetic oligonucleotide
  Target: SCN10A; (+) strand; PAM type: NRG; PAM sequence: TGG
ctccctatcctgcaagaagc

SEQ ID NO: 37639 - DNA, 20 bp, Artificial Sequence
  Description of Artificial Sequence: Synthetic oligonucleotide
  Target: SCN10A; (+) strand; PAM type: NRG; PAM sequence: GAG
ccctatcctgcaagaagctg

SEQ ID NO: 37640 - DNA, 20 bp, Artificial Sequence
  Description of Artificial Sequence: Synthetic oligonucleotide
  Target: SCN10A; (+) strand; PAM type: NRG; PAM sequence: AGG
cctatcctgcaagaagctgg

SEQ ID NO: 37641 - DNA, 20 bp, Artificial Sequence
  Description of Artificial Sequence: Synthetic oligonucleotide
  Target: SCN10A; (+) strand; PAM type: NRG; PAM sequence: CAG
gaggctcatctaaaaactcc

SEQ ID NO: 37642 - DNA, 20 bp, Artificial Sequence
  Description of Artificial Sequence: Synthetic oligonucleotide
  Target: SCN10A; (+) strand; PAM type: NRG; PAM sequence: TAG
atctaaaaactcccagtttt

SEQ ID NO: 37643 - DNA, 20 bp, Artificial Sequence
  Description of Artificial Sequence: Synthetic oligonucleotide
  Target: SCN10A; (+) strand; PAM type: NRG; PAM sequence: TGG
aactcccagtttttagaaac

SEQ ID NO: 37644 - DNA, 20 bp, Artificial Sequence
  Description of Artificial Sequence: Synthetic oligonucleotide
  Target: SCN10A; (+) strand; PAM type: NRG; PAM sequence: GAG
ctcccagtttttagaaactg

SEQ ID NO: 37645 - DNA, 20 bp, Artificial Sequence
  Description of Artificial Sequence: Synthetic oligonucleotide
  Target: SCN10A; (+) strand; PAM type: NRG; PAM sequence: CAG
agtttttagaaactggagtg

SEQ ID NO: 37646 - DNA, 20 bp, Artificial Sequence
  Description of Artificial Sequence: Synthetic oligonucleotide
  Target: SCN10A; (+) strand; PAM type: NRG; PAM sequence: GAG
aaactggagtgcagactgat

SEQ ID NO: 37647 - DNA, 20 bp, Artificial Sequence
  Description of Artificial Sequence: Synthetic oligonucleotide
  Target: SCN10A; (+) strand; PAM type: NRG; PAM sequence: TGG
ctggagtgcagactgatgag

SEQ ID NO: 37648 - DNA, 20 bp, Artificial Sequence
  Description of Artificial Sequence: Synthetic oligonucleotide
  Target: SCN10A; (+) strand; PAM type: NRG; PAM sequence: CAG
gactgatgagtggtaactga

SEQ ID NO: 37649 - DNA, 20 bp, Artificial Sequence
  Description of Artificial Sequence: Synthetic oligonucleotide
  Target: SCN10A; (+) strand; PAM type: NRG; PAM sequence: GAG
ctgatgagtggtaactgaca

SEQ ID NO: 37650 - DNA, 20 bp, Artificial Sequence
  Description of Artificial Sequence: Synthetic oligonucleotide
  Target: SCN10A; (+) strand; PAM type: NRG; PAM sequence: CAG
atgagtggtaactgacagag

SEQ ID NO: 37651 - DNA, 20 bp, Artificial Sequence
  Description of Artificial Sequence: Synthetic oligonucleotide
  Target: SCN10A; (+) strand; PAM type: NRG; PAM sequence: AAG
gtaactgacagagcagacct

SEQ ID NO: 37652 - DNA, 20 bp, Artificial Sequence
  Description of Artificial Sequence: Synthetic oligonucleotide
  Target: SCN10A; (+) strand; PAM type: NRG; PAM sequence: AAG
ctgacagagcagacctaaga

SEQ ID NO: 37653 - DNA, 20 bp, Artificial Sequence
  Description of Artificial Sequence: Synthetic oligonucleotide
  Target: SCN10A; (+) strand; PAM type: NRG; PAM sequence: TGG
gacctaagaaagctgaaaac

SEQ ID NO: 37654 - DNA, 20 bp, Artificial Sequence
  Description of Artificial Sequence: Synthetic oligonucleotide
  Target: SCN10A; (+) strand; PAM type: NRG; PAM sequence: AAG
agaaagctgaaaactggctg

SEQ ID NO: 37655 - DNA, 20 bp, Artificial Sequence
  Description of Artificial Sequence: Synthetic oligonucleotide
  Target: SCN10A; (+) strand; PAM type: NRG; PAM sequence: CAG
aagctgaaaactggctgaag

SEQ ID NO: 37656 - DNA, 20 bp, Artificial Sequence
  Description of Artificial Sequence: Synthetic oligonucleotide
  Target: SCN10A; (+) strand; PAM type: NRG; PAM sequence: AGG
agctgaaaactggctgaagc

SEQ ID NO: 37657 - DNA, 20 bp, Artificial Sequence
  Description of Artificial Sequence: Synthetic oligonucleotide
  Target: SCN10A; (+) strand; PAM type: NRG; PAM sequence: GGG
gctgaaaactggctgaagca

SEQ ID NO: 37658 - DNA, 20 bp, Artificial Sequence
  Description of Artificial Sequence: Synthetic oligonucleotide
  Target: SCN10A; (+) strand; PAM type: NRG; PAM sequence: CAG
tggctgaagcagggaatacc

SEQ ID NO: 37659 - DNA, 20 bp, Artificial Sequence
  Description of Artificial Sequence: Synthetic oligonucleotide
  Target: SCN10A; (+) strand; PAM type: NRG; PAM sequence: AAG
ctgaagcagggaatacccag

SEQ ID NO: 37660 - DNA, 20 bp, Artificial Sequence
  Description of Artificial Sequence: Synthetic oligonucleotide
  Target: SCN10A; (+) strand; PAM type: NRG; PAM sequence: AAG
agcagggaatacccagaagc

SEQ ID NO: 37661 - DNA, 20 bp, Artificial Sequence
  Description of Artificial Sequence: Synthetic oligonucleotide
  Target: SCN10A; (+) strand; PAM type: NRG; PAM sequence: AAG
ggaatacccagaagcaagcc

SEQ ID NO: 37662 - DNA, 20 bp, Artificial Sequence
  Description of Artificial Sequence: Synthetic oligonucleotide
  Target: SCN10A; (+) strand; PAM type: NRG; PAM sequence: CAG
aagcaagccaagctatgctg

SEQ ID NO: 37663 - DNA, 20 bp, Artificial Sequence
  Description of Artificial Sequence: Synthetic oligonucleotide
  Target: SCN10A; (+) strand; PAM type: NRG; PAM sequence: GAG
gcaagccaagctatgctgca

SEQ ID NO: 37664 - DNA, 20 bp, Artificial Sequence
  Description of Artificial Sequence: Synthetic oligonucleotide
  Target: SCN10A; (+) strand; PAM type: NRG; PAM sequence: CAG
caagctatgctgcagagccc

SEQ ID NO: 37665 - DNA, 20 bp, Artificial Sequence
  Description of Artificial Sequence: Synthetic oligonucleotide
  Target: SCN10A; (+) strand; PAM type: NRG; PAM sequence: TGG
tgcagagccccagaactgct

SEQ ID NO: 37666 - DNA, 20 bp, Artificial Sequence
  Description of Artificial Sequence: Synthetic oligonucleotide
  Target: SCN10A; (+) strand; PAM type: NRG; PAM sequence: TAG
ccccagaactgcttggaact

SEQ ID NO: 37667 - DNA, 20 bp, Artificial Sequence
  Description of Artificial Sequence: Synthetic oligonucleotide
  Target: SCN10A; (+) strand; PAM type: NRG; PAM sequence: GAG
ccagaactgcttggaactta

SEQ ID NO: 37668 - DNA, 20 bp, Artificial Sequence
  Description of Artificial Sequence: Synthetic oligonucleotide
  Target: SCN10A; (+) strand; PAM type: NRG; PAM sequence: AAG
gcttggaacttagagatgct

SEQ ID NO: 37669 - DNA, 20 bp, Artificial Sequence
  Description of Artificial Sequence: Synthetic oligonucleotide
  Target: SCN10A; (+) strand; PAM type: NRG; PAM sequence: AAG
gagatgctaagtatctctga

SEQ ID NO: 37670 - DNA, 20 bp, Artificial Sequence
  Description of Artificial Sequence: Synthetic oligonucleotide
  Target: SCN10A; (+) strand; PAM type: NRG; PAM sequence: AAG
tgctaagtatctctgaaagc

SEQ ID NO: 37671 - DNA, 20 bp, Artificial Sequence
  Description of Artificial Sequence: Synthetic oligonucleotide
  Target: SCN10A; (+) strand; PAM type: NRG; PAM sequence: AGG
gctaagtatctctgaaagca

SEQ ID NO: 37672 - DNA, 20 bp, Artificial Sequence
  Description of Artificial Sequence: Synthetic oligonucleotide
  Target: SCN10A; (+) strand; PAM type: NRG; PAM sequence: TGG
gtatctctgaaagcaaggtt

SEQ ID NO: 37673 - DNA, 20 bp, Artificial Sequence
  Description of Artificial Sequence: Synthetic oligonucleotide
  Target: SCN10A; (+) strand; PAM type: NRG; PAM sequence: GGG
tatctctgaaagcaaggttt

SEQ ID NO: 37674 - DNA, 20 bp, Artificial Sequence
  Description of Artificial Sequence: Synthetic oligonucleotide
  Target: SCN10A; (+) strand; PAM type: NRG; PAM sequence: GGG
atctctgaaagcaaggtttg

SEQ ID NO: 37675 - DNA, 20 bp, Artificial Sequence
  Description of Artificial Sequence: Synthetic oligonucleotide
  Target: SCN10A; (+) strand; PAM type: NRG; PAM sequence: GGG
tctctgaaagcaaggtttgg

SEQ ID NO: 37676 - DNA, 20 bp, Artificial Sequence
  Description of Artificial Sequence: Synthetic oligonucleotide
  Target: SCN10A; (+) strand; PAM type: NRG; PAM sequence: GAG
tctgaaagcaaggtttgggg

SEQ ID NO: 37677 - DNA, 20 bp, Artificial Sequence
  Description of Artificial Sequence: Synthetic oligonucleotide
  Target: SCN10A; (+) strand; PAM type: NRG; PAM sequence: AGG
ctgaaagcaaggtttggggg

SEQ ID NO: 37678 - DNA, 20 bp, Artificial Sequence
  Description of Artificial Sequence: Synthetic oligonucleotide
  Target: SCN10A; (+) strand; PAM type: NRG; PAM sequence: GGG
tgaaagcaaggtttggggga

SEQ ID NO: 37679 - DNA, 20 bp, Artificial Sequence
  Description of Artificial Sequence: Synthetic oligonucleotide
  Target: SCN10A; (+) strand; PAM type: NRG; PAM sequence: AAG
aaggtttgggggagggtgat

SEQ ID NO: 37680 - DNA, 20 bp, Artificial Sequence
  Description of Artificial Sequence: Synthetic oligonucleotide
  Target: SCN10A; (+) strand; PAM type: NRG; PAM sequence: TAG
gtttgggggagggtgataag

SEQ ID NO: 37681 - DNA, 20 bp, Artificial Sequence
  Description of Artificial Sequence: Synthetic oligonucleotide
  Target: SCN10A; (+) strand; PAM type: NRG; PAM sequence: AGG
tttgggggagggtgataagt

SEQ ID NO: 37682 - DNA, 20 bp, Artificial Sequence
  Description of Artificial Sequence: Synthetic oligonucleotide
  Target: SCN10A; (+) strand; PAM type: NRG; PAM sequence: GGG
ttgggggagggtgataagta

SEQ ID NO: 37683 - DNA, 20 bp, Artificial Sequence
  Description of Artificial Sequence: Synthetic oligonucleotide
  Target: SCN10A; (+) strand; PAM type: NRG; PAM sequence: AAG
agggtgataagtagggctga

SEQ ID NO: 37684 - DNA, 20 bp, Artificial Sequence
  Description of Artificial Sequence: Synthetic oligonucleotide
  Target: SCN10A; (+) strand; PAM type: NRG; PAM sequence: AAG
gggctgaaagaattgcttga

SEQ ID NO: 37685 - DNA, 20 bp, Artificial Sequence
  Description of Artificial Sequence: Synthetic oligonucleotide
  Target: SCN10A; (+) strand; PAM type: NRG; PAM sequence: CAG
aattgcttgaaagtttttta

SEQ ID NO: 37686 - DNA, 20 bp, Artificial Sequence
  Description of Artificial Sequence: Synthetic oligonucleotide
  Target: SCN10A; (+) strand; PAM type: NRG; PAM sequence: AGG
attgcttgaaagttttttac

SEQ ID NO: 37687 - DNA, 20 bp, Artificial Sequence
  Description of Artificial Sequence: Synthetic oligonucleotide
  Target: SCN10A; (+) strand; PAM type: NRG; PAM sequence: CAG
tgaaagttttttacaggaac

SEQ ID NO: 37688 - DNA, 20 bp, Artificial Sequence
  Description of Artificial Sequence: Synthetic oligonucleotide
  Target: SCN10A; (+) strand; PAM type: NRG; PAM sequence: GAG
gttttttacaggaaccagtt

SEQ ID NO: 37689 - DNA, 20 bp, Artificial Sequence
  Description of Artificial Sequence: Synthetic oligonucleotide
  Target: SCN10A; (+) strand; PAM type: NRG; PAM sequence: TAG
caggaaccagttgagctttc

SEQ ID NO: 37690 - DNA, 20 bp, Artificial Sequence
  Description of Artificial Sequence: Synthetic oligonucleotide
  Target: SCN10A; (+) strand; PAM type: NRG; PAM sequence: GAG
ctttatgccatccattcaat

SEQ ID NO: 37691 - DNA, 20 bp, Artificial Sequence
  Description of Artificial Sequence: Synthetic oligonucleotide
  Target: SCN10A; (+) strand; PAM type: NRG; PAM sequence: CAG
atgagaaactgtttctgctc

SEQ ID NO: 37692 - DNA, 20 bp, Artificial Sequence
  Description of Artificial Sequence: Synthetic oligonucleotide
  Target: SCN10A; (+) strand; PAM type: NRG; PAM sequence: TGG
aactgtttctgctccagaaa

SEQ ID NO: 37693 - DNA, 20 bp, Artificial Sequence
  Description of Artificial Sequence: Synthetic oligonucleotide
  Target: SCN10A; (+) strand; PAM type: NRG; PAM sequence: TGG
tttctgctccagaaatggat

SEQ ID NO: 37694 - DNA, 20 bp, Artificial Sequence
  Description of Artificial Sequence: Synthetic oligonucleotide
  Target: SCN10A; (+) strand; PAM type: NRG; PAM sequence: AAG
gattggatgctcattttctt

SEQ ID NO: 37695 - DNA, 20 bp, Artificial Sequence
  Description of Artificial Sequence: Synthetic oligonucleotide
  Target: SCN10A; (+) strand; PAM type: NRG; PAM sequence: GAG
ttggatgctcattttcttaa

SEQ ID NO: 37696 - DNA, 20 bp, Artificial Sequence
  Description of Artificial Sequence: Synthetic oligonucleotide
  Target: SCN10A; (+) strand; PAM type: NRG; PAM sequence: AAG
gctcattttcttaagagttg

SEQ ID NO: 37697 - DNA, 20 bp, Artificial Sequence
  Description of Artificial Sequence: Synthetic oligonucleotide
  Target: SCN10A; (+) strand; PAM type: NRG; PAM sequence: AAG
cattttcttaagagttgaag

SEQ ID NO: 37698 - DNA, 20 bp, Artificial Sequence
  Description of Artificial Sequence: Synthetic oligonucleotide
  Target: SCN10A; (+) strand; PAM type: NRG; PAM sequence: GAG
ttttcttaagagttgaagaa

SEQ ID NO: 37699 - DNA, 20 bp, Artificial Sequence
  Description of Artificial Sequence: Synthetic oligonucleotide
  Target: SCN10A; (+) strand; PAM type: NRG; PAM sequence: AGG
tttcttaagagttgaagaag

SEQ ID NO: 37700 - DNA, 20 bp, Artificial Sequence
  Description of Artificial Sequence: Synthetic oligonucleotide
  Target: SCN10A; (+) strand; PAM type: NRG; PAM sequence: GGG
ttcttaagagttgaagaaga

SEQ ID NO: 37701 - DNA, 20 bp, Artificial Sequence
  Description of Artificial Sequence: Synthetic oligonucleotide
  Target: SCN10A; (+) strand; PAM type: NRG; PAM sequence: CAG
agagttgaagaagagggaaa

SEQ ID NO: 37702 - DNA, 20 bp, Artificial Sequence
  Description of Artificial Sequence: Synthetic oligonucleotide
  Target: SCN10A; (+) strand; PAM type: NRG; PAM sequence: AAG
catactgaaaaatgcatata

SEQ ID NO: 37703 - DNA, 20 bp, Artificial Sequence
  Description of Artificial Sequence: Synthetic oligonucleotide
  Target: SCN10A; (+) strand; PAM type: NRG; PAM sequence: AAG
tgaaaaatgcatataaagaa

SEQ ID NO: 37704 - DNA, 20 bp, Artificial Sequence
  Description of Artificial Sequence: Synthetic oligonucleotide
  Target: SCN10A; (+) strand; PAM type: NRG; PAM sequence: AAG
aagaaaagtttacctactga

SEQ ID NO: 37705 - DNA, 20 bp, Artificial Sequence
  Description of Artificial Sequence: Synthetic oligonucleotide
  Target: SCN10A; (+) strand; PAM type: NRG; PAM sequence: AGG
agaaaagtttacctactgaa

SEQ ID NO: 37706 - DNA, 20 bp, Artificial Sequence
  Description of Artificial Sequence: Synthetic oligonucleotide
  Target: SCN10A; (+) strand; PAM type: NRG; PAM sequence: AAG
attcacttctgctcctcgtt

SEQ ID NO: 37707 - DNA, 20 bp, Artificial Sequence
  Description of Artificial Sequence: Synthetic oligonucleotide
  Target: SCN10A; (+) strand; PAM type: NRG; PAM sequence: CAG
tctgctcctcgttaagtttc

SEQ ID NO: 37708 - DNA, 20 bp, Artificial Sequence
  Description of Artificial Sequence: Synthetic oligonucleotide
  Target: SCN10A; (+) strand; PAM type: NRG; PAM sequence: AAG
gctcctcgttaagtttccag

SEQ ID NO: 37709 - DNA, 20 bp, Artificial Sequence
  Description of Artificial Sequence: Synthetic oligonucleotide
  Target: SCN10A; (+) strand; PAM type: NRG; PAM sequence: TGG
taagtttccagaagataatc

SEQ ID NO: 37710 - DNA, 20 bp, Artificial Sequence
  Description of Artificial Sequence: Synthetic oligonucleotide
  Target: SCN10A; (+) strand; PAM type: NRG; PAM sequence: TAG
ttccagaagataatctggtt

SEQ ID NO: 37711 - DNA, 20 bp, Artificial Sequence
  Description of Artificial Sequence: Synthetic oligonucleotide
  Target: SCN10A; (+) strand; PAM type: NRG; PAM sequence: GAG
ccagaagataatctggttta

SEQ ID NO: 37712 - DNA, 20 bp, Artificial Sequence
  Description of Artificial Sequence: Synthetic oligonucleotide
  Target: SCN10A; (+) strand; PAM type: NRG; PAM sequence: AAG
aatctggtttagagcccatg

SEQ ID NO: 37713 - DNA, 20 bp, Artificial Sequence
  Description of Artificial Sequence: Synthetic oligonucleotide
  Target: SCN10A; (+) strand; PAM type: NRG; PAM sequence: CAG
tgctgcacttttaacatgaa

SEQ ID NO: 37714 - DNA, 20 bp, Artificial Sequence
  Description of Artificial Sequence: Synthetic oligonucleotide
  Target: SCN10A; (+) strand; PAM type: NRG; PAM sequence: CAG
gcacttttaacatgaacagc

SEQ ID NO: 37715 - DNA, 20 bp, Artificial Sequence
  Description of Artificial Sequence: Synthetic oligonucleotide
  Target: SCN10A; (+) strand; PAM type: NRG; PAM sequence: AAG
tttaacatgaacagccagcc

SEQ ID NO: 37716 - DNA, 20 bp, Artificial Sequence
  Description of Artificial Sequence: Synthetic oligonucleotide
  Target: SCN10A; (+) strand; PAM type: NRG; PAM sequence: AGG
ttaacatgaacagccagcca

SEQ ID NO: 37717 - DNA, 20 bp, Artificial Sequence
  Description of Artificial Sequence: Synthetic oligonucleotide
  Target: SCN10A; (+) strand; PAM type: NRG; PAM sequence: GAG
aacatgaacagccagccaag

SEQ ID NO: 37718 - DNA, 20 bp, Artificial Sequence
  Description of Artificial Sequence: Synthetic oligonucleotide
  Target: SCN10A; (+) strand; PAM type: NRG; PAM sequence: CAG
aacagccagccaaggagcat

SEQ ID NO: 37719 - DNA, 20 bp, Artificial Sequence
  Description of Artificial Sequence: Synthetic oligonucleotide
  Target: SCN10A; (+) strand; PAM type: NRG; PAM sequence: AGG
acagccagccaaggagcatc

SEQ ID NO: 37720 - DNA, 20 bp, Artificial Sequence
  Description of Artificial Sequence: Synthetic oligonucleotide
  Target: SCN10A; (+) strand; PAM type: NRG; PAM sequence: AAG
caaggagcatcaggaatttg

SEQ ID NO: 37721 - DNA, 20 bp, Artificial Sequence
  Description of Artificial Sequence: Synthetic oligonucleotide
  Target: SCN10A; (+) strand; PAM type: NRG; PAM sequence: AGG
aaggagcatcaggaatttga

SEQ ID NO: 37722 - DNA, 20 bp, Artificial Sequence
  Description of Artificial Sequence: Synthetic oligonucleotide
  Target: SCN10A; (+) strand; PAM type: NRG; PAM sequence: CAG
ttgaaggatgcttctaacac

SEQ ID NO: 37723 - DNA, 20 bp, Artificial Sequence
  Description of Artificial Sequence: Synthetic oligonucleotide
  Target: SCN10A; (+) strand; PAM type: NRG; PAM sequence: AAG
gcttctaacaccagaaacca

SEQ ID NO: 37724 - DNA, 20 bp, Artificial Sequence
  Description of Artificial Sequence: Synthetic oligonucleotide
  Target: SCN10A; (+) strand; PAM type: NRG; PAM sequence: AAG
caactgaaaaaaaaaaaaaa

SEQ ID NO: 37725 - DNA, 20 bp, Artificial Sequence
  Description of Artificial Sequence: Synthetic oligonucleotide
  Target: SCN10A; (+) strand; PAM type: NRG; PAM sequence: AAG
gaaaaaaaaaaaaaaaagaa

SEQ ID NO: 37726 - DNA, 20 bp, Artificial Sequence
  Description of Artificial Sequence: Synthetic oligonucleotide
  Target: SCN10A; (+) strand; PAM type: NRG; PAM sequence: AAG
aaaaaaaaaaaagaaaagaa

SEQ ID NO: 37727 - DNA, 20 bp, Artificial Sequence
  Description of Artificial Sequence: Synthetic oligonucleotide
  Target: SCN10A; (+) strand; PAM type: NRG; PAM sequence: AAG
aaaaaaagaaaagaaaagaa

SEQ ID NO: 37728 - DNA, 20 bp, Artificial Sequence
  Description of Artificial Sequence: Synthetic oligonucleotide
  Target: SCN10A; (+) strand; PAM type: NRG; PAM sequence: AAG
agaaaagaaaagaaaagaaa

SEQ ID NO: 37729 - DNA, 20 bp, Artificial Sequence
  Description of Artificial Sequence: Synthetic oligonucleotide
  Target: SCN10A; (+) strand; PAM type: NRG; PAM sequence: GAG
aaaagaaaagaaaagaaaaa

SEQ ID NO: 37730 - DNA, 20 bp, Artificial Sequence
  Description of Artificial Sequence: Synthetic oligonucleotide
  Target: SCN10A; (+) strand; PAM type: NRG; PAM sequence: AAG
gaaaagaaaaagagacaata

SEQ ID NO: 37731 - DNA, 20 bp, Artificial Sequence
  Description of Artificial Sequence: Synthetic oligonucleotide
  Target: SCN10A; (+) strand; PAM type: NRG; PAM sequence: GAG
aaagaaaaagagacaataaa

SEQ ID NO: 37732 - DNA, 20 bp, Artificial Sequence
  Description of Artificial Sequence: Synthetic oligonucleotide
  Target: SCN10A; (+) strand; PAM type: NRG; PAM sequence: AGG
aagaaaaagagacaataaag

SEQ ID NO: 37733 - DNA, 20 bp, Artificial Sequence
  Description of Artificial Sequence: Synthetic oligonucleotide
  Target: SCN10A; (+) strand; PAM type: NRG; PAM sequence: GGG
agaaaaagagacaataaaga

SEQ ID NO: 37734 - DNA, 20 bp, Artificial Sequence
  Description of Artificial Sequence: Synthetic oligonucleotide
  Target: SCN10A; (+) strand; PAM type: NRG; PAM sequence: CAG
aaaagagacaataaagaggg

SEQ ID NO: 37735 - DNA, 20 bp, Artificial Sequence
  Description of Artificial Sequence: Synthetic oligonucleotide
  Target: SCN10A; (+) strand; PAM type: NRG; PAM sequence: AAG
agagacaataaagagggcag

SEQ ID NO: 37736 - DNA, 20 bp, Artificial Sequence
  Description of Artificial Sequence: Synthetic oligonucleotide
  Target: SCN10A; (+) strand; PAM type: NRG; PAM sequence: AAG
gacaataaagagggcagaag

SEQ ID NO: 37737 - DNA, 20 bp, Artificial Sequence
  Description of Artificial Sequence: Synthetic oligonucleotide
  Target: SCN10A; (+) strand; PAM type: NRG; PAM sequence: GAG
caataaagagggcagaagaa

SEQ ID NO: 37738 - DNA, 20 bp, Artificial Sequence
  Description of Artificial Sequence: Synthetic oligonucleotide
  Target: SCN10A; (+) strand; PAM type: NRG; PAM sequence: TAG
aaagagggcagaagaagagt

SEQ ID NO: 37739 - DNA, 20 bp, Artificial Sequence
  Description of Artificial Sequence: Synthetic oligonucleotide
  Target: SCN10A; (+) strand; PAM type: NRG; PAM sequence: GAG
agagggcagaagaagagtta

SEQ ID NO: 37740 - DNA, 20 bp, Artificial Sequence
  Description of Artificial Sequence: Synthetic oligonucleotide
  Target: SCN10A; (+) strand; PAM type: NRG; PAM sequence: TGG
ttagagaaataaaactgtat

SEQ ID NO: 37741 - DNA, 20 bp, Artificial Sequence
  Description of Artificial Sequence: Synthetic oligonucleotide
  Target: SCN10A; (+) strand; PAM type: NRG; PAM sequence: CAG
agaaataaaactgtattggc

SEQ ID NO: 37742 - DNA, 20 bp, Artificial Sequence
  Description of Artificial Sequence: Synthetic oligonucleotide
  Target: SCN10A; (+) strand; PAM type: NRG; PAM sequence: AGG
gaaataaaactgtattggcc

SEQ ID NO: 37743 - DNA, 20 bp, Artificial Sequence
  Description of Artificial Sequence: Synthetic oligonucleotide
  Target: SCN10A; (+) strand; PAM type: NRG; PAM sequence: TGG
actgtattggccaggcgctg

SEQ ID NO: 37744 - DNA, 20 bp, Artificial Sequence
  Description of Artificial Sequence: Synthetic oligonucleotide
  Target: SCN10A; (+) strand; PAM type: NRG; PAM sequence: CAG
gtggctcacgcctgtaatcg

SEQ ID NO: 37745 - DNA, 20 bp, Artificial Sequence
  Description of Artificial Sequence: Synthetic oligonucleotide
  Target: SCN10A; (+) strand; PAM type: NRG; PAM sequence: TGG
cgcctgtaatcgcagcactt

SEQ ID NO: 37746 - DNA, 20 bp, Artificial Sequence
  Description of Artificial Sequence: Synthetic oligonucleotide
  Target: SCN10A; (+) strand; PAM type: NRG; PAM sequence: GGG
gcctgtaatcgcagcacttt

SEQ ID NO: 37747 - DNA, 20 bp, Artificial Sequence
  Description of Artificial Sequence: Synthetic oligonucleotide
  Target: SCN10A; (+) strand; PAM type: NRG; PAM sequence: GAG
ctgtaatcgcagcactttgg

SEQ ID NO: 37748 - DNA, 20 bp, Artificial Sequence
  Description of Artificial Sequence: Synthetic oligonucleotide
  Target: SCN10A; (+) strand; PAM type: NRG; PAM sequence: AGG
tgtaatcgcagcactttggg

SEQ ID NO: 37749 - DNA, 20 bp, Artificial Sequence
  Description of Artificial Sequence: Synthetic oligonucleotide
  Target: SCN10A; (+) strand; PAM type: NRG; PAM sequence: GAG
tcgcagcactttgggaggcc

SEQ ID NO: 37750 - DNA, 20 bp, Artificial Sequence
  Description of Artificial Sequence: Synthetic oligonucleotide
  Target: SCN10A; (+) strand; PAM type: NRG; PAM sequence: AGG
cgcagcactttgggaggccg

SEQ ID NO: 37751 - DNA, 20 bp, Artificial Sequence
  Description of Artificial Sequence: Synthetic oligonucleotide
  Target: SCN10A; (+) strand; PAM type: NRG; PAM sequence: CGG
agcactttgggaggccgagg

SEQ ID NO: 37752 - DNA, 20 bp, Artificial Sequence
  Description of Artificial Sequence: Synthetic oligonucleotide
  Target: SCN10A; (+) strand; PAM type: NRG; PAM sequence: GGG
gcactttgggaggccgaggc

SEQ ID NO: 37753 - DNA, 20 bp, Artificial Sequence
  Description of Artificial Sequence: Synthetic oligonucleotide
  Target: SCN10A; (+) strand; PAM type: NRG; PAM sequence: CAG
ctttgggaggccgaggcggg

SEQ ID NO: 37754 - DNA, 20 bp, Artificial Sequence
  Description of Artificial Sequence: Synthetic oligonucleotide
  Target: SCN10A; (+) strand; PAM type: NRG; PAM sequence: GAG
ggccgaggcgggcagattac

SEQ ID NO: 37755 - DNA, 20 bp, Artificial Sequence
  Description of Artificial Sequence: Synthetic oligonucleotide
  Target: SCN10A; (+) strand; PAM type: NRG; PAM sequence: AGG
gccgaggcgggcagattacg

SEQ ID NO: 37756 - DNA, 20 bp, Artificial Sequence
  Description of Artificial Sequence: Synthetic oligonucleotide
  Target: SCN10A; (+) strand; PAM type: NRG; PAM sequence: CAG
aggcgggcagattacgaggt

SEQ ID NO: 37757 - DNA, 20 bp, Artificial Sequence
  Description of Artificial Sequence: Synthetic oligonucleotide
  Target: SCN10A; (+) strand; PAM type: NRG; PAM sequence: AGG
ggcgggcagattacgaggtc

SEQ ID NO: 37758 - DNA, 20 bp, Artificial Sequence
  Description of Artificial Sequence: Synthetic oligonucleotide
  Target: SCN10A; (+) strand; PAM type: NRG; PAM sequence: GAG
cgggcagattacgaggtcag

SEQ ID NO: 37759 - DNA, 20 bp, Artificial Sequence
  Description of Artificial Sequence: Synthetic oligonucleotide
  Target: SCN10A; (+) strand; PAM type: NRG; PAM sequence: GAG
gattacgaggtcaggagatc

SEQ ID NO: 37760 - DNA, 20 bp, Artificial Sequence
  Description of Artificial Sequence: Synthetic oligonucleotide
  Target: SCN10A; (+) strand; PAM type: NRG; PAM sequence: TGG
tcaggagatcgagaccatcc

SEQ ID NO: 37761 - DNA, 20 bp, Artificial Sequence
  Description of Artificial Sequence: Synthetic oligonucleotide
  Target: SCN10A; (+) strand; PAM type: NRG; PAM sequence: CGG
cgagaccatcctggctaacg

SEQ ID NO: 37762 - DNA, 20 bp, Artificial Sequence
  Description of Artificial Sequence: Synthetic oligonucleotide
  Target: SCN10A; (+) strand; PAM type: NRG; PAM sequence: TAG
ctactaaaaatacaaaaaat

SEQ ID NO: 37763 - DNA, 20 bp, Artificial Sequence
  Description of Artificial Sequence: Synthetic oligonucleotide
  Target: SCN10A; (+) strand; PAM type: NRG; PAM sequence: CGG
taaaaatacaaaaaattagc

SEQ ID NO: 37764 - DNA, 20 bp, Artificial Sequence
  Description of Artificial Sequence: Synthetic oligonucleotide
  Target: SCN10A; (+) strand; PAM type: NRG; PAM sequence: GGG
aaaaatacaaaaaattagcc

SEQ ID NO: 37765 - DNA, 20 bp, Artificial Sequence
  Description of Artificial Sequence: Synthetic oligonucleotide
  Target: SCN10A; (+) strand; PAM type: NRG; PAM sequence: TGG
aaaaaattagccgggcgcct

SEQ ID NO: 37766 - DNA, 20 bp, Artificial Sequence
  Description of Artificial Sequence: Synthetic oligonucleotide
  Target: SCN10A; (+) strand; PAM type: NRG; PAM sequence: CGG
aaattagccgggcgccttgg

SEQ ID NO: 37767 - DNA, 20 bp, Artificial Sequence
  Description of Artificial Sequence: Synthetic oligonucleotide
  Target: SCN10A; (+) strand; PAM type: NRG; PAM sequence: GGG
aattagccgggcgccttggc

SEQ ID NO: 37768 - DNA, 20 bp, Artificial Sequence
  Description of Artificial Sequence: Synthetic oligonucleotide
  Target: SCN10A; (+) strand; PAM type: NRG; PAM sequence: TAG
ggcgccttggcgggcacctg

SEQ ID NO: 37769 - DNA, 20 bp, Artificial Sequence
  Description of Artificial Sequence: Synthetic oligonucleotide
  Target: SCN10A; (+) strand; PAM type: NRG; PAM sequence: CAG
ttggcgggcacctgtagttc

SEQ ID NO: 37770 - DNA, 20 bp, Artificial Sequence
  Description of Artificial Sequence: Synthetic oligonucleotide
  Target: SCN10A; (+) strand; PAM type: NRG; PAM sequence: CGG
acctgtagttccagctactc

SEQ ID NO: 37771 - DNA, 20 bp, Artificial Sequence
  Description of Artificial Sequence: Synthetic oligonucleotide
  Target: SCN10A; (+) strand; PAM type: NRG; PAM sequence: GAG
ctgtagttccagctactccg

SEQ ID NO: 37772 - DNA, 20 bp, Artificial Sequence
  Description of Artificial Sequence: Synthetic oligonucleotide
  Target: SCN10A; (+) strand; PAM type: NRG; PAM sequence: AGG
tgtagttccagctactccgg

SEQ ID NO: 37773 - DNA, 20 bp, Artificial Sequence
  Description of Artificial Sequence: Synthetic oligonucleotide
  Target: SCN10A; (+) strand; PAM type: NRG; PAM sequence: GAG
ttccagctactccggaggct

SEQ ID NO: 37774 - DNA, 20 bp, Artificial Sequence
  Description of Artificial Sequence: Synthetic oligonucleotide
  Target: SCN10A; (+) strand; PAM type: NRG; PAM sequence: AGG
tccagctactccggaggctg

SEQ ID NO: 37775 - DNA, 20 bp, Artificial Sequence
  Description of Artificial Sequence: Synthetic oligonucleotide
  Target: SCN10A; (+) strand; PAM type: NRG; PAM sequence: CGG
agctactccggaggctgagg

SEQ ID NO: 37776 - DNA, 20 bp, Artificial Sequence
  Description of Artificial Sequence: Synthetic oligonucleotide
  Target: SCN10A; (+) strand; PAM type: NRG; PAM sequence: GGG
gctactccggaggctgaggc

SEQ ID NO: 37777 - DNA, 20 bp, Artificial Sequence
  Description of Artificial Sequence: Synthetic oligonucleotide
  Target: SCN10A; (+) strand; PAM type: NRG; PAM sequence: GAG
tactccggaggctgaggcgg

SEQ ID NO: 37778 - DNA, 20 bp, Artificial Sequence
  Description of Artificial Sequence: Synthetic oligonucleotide
  Target: SCN10A; (+) strand; PAM type: NRG; PAM sequence: TGG
cggaggctgaggcgggagaa

SEQ ID NO: 37779 - DNA, 20 bp, Artificial Sequence
  Description of Artificial Sequence: Synthetic oligonucleotide
  Target: SCN10A; (+) strand; PAM type: NRG; PAM sequence: CGG
gcgggagaatggcgtgaacc

SEQ ID NO: 37780 - DNA, 20 bp, Artificial Sequence
  Description of Artificial Sequence: Synthetic oligonucleotide
  Target: SCN10A; (+) strand; PAM type: NRG; PAM sequence: GGG
cgggagaatggcgtgaaccc

SEQ ID NO: 37781 - DNA, 20 bp, Artificial Sequence
  Description of Artificial Sequence: Synthetic oligonucleotide
  Target: SCN10A; (+) strand; PAM type: NRG; PAM sequence: GAG
ggagaatggcgtgaacccgg

SEQ ID NO: 37782 - DNA, 20 bp, Artificial Sequence
  Description of Artificial Sequence: Synthetic oligonucleotide
  Target: SCN10A; (+) strand; PAM type: NRG; PAM sequence: AGG
gagaatggcgtgaacccggg

SEQ ID NO: 37783 - DNA, 20 bp, Artificial Sequence
  Description of Artificial Sequence: Synthetic oligonucleotide
  Target: SCN10A; (+) strand; PAM type: NRG; PAM sequence: CGG
aatggcgtgaacccgggagg

SEQ ID NO: 37784 - DNA, 20 bp, Artificial Sequence
  Description of Artificial Sequence: Synthetic oligonucleotide
  Target: SCN10A; (+) strand; PAM type: NRG; PAM sequence: GAG
tggcgtgaacccgggaggcg

SEQ ID NO: 37785 - DNA, 20 bp, Artificial Sequence
  Description of Artificial Sequence: Synthetic oligonucleotide
  Target: SCN10A; (+) strand; PAM type: NRG; PAM sequence: CAG
aacccgggaggcggagcttg

SEQ ID NO: 37786 - DNA, 20 bp, Artificial Sequence
  Description of Artificial Sequence: Synthetic oligonucleotide
  Target: SCN10A; (+) strand; PAM type: NRG; PAM sequence: GAG
cgggaggcggagcttgcagt

SEQ ID NO: 37787 - DNA, 20 bp, Artificial Sequence
  Description of Artificial Sequence: Synthetic oligonucleotide
  Target: SCN10A; (+) strand; PAM type: NRG; PAM sequence: TAG
ggcggagcttgcagtgagcc

SEQ ID NO: 37788 - DNA, 20 bp, Artificial Sequence
  Description of Artificial Sequence: Synthetic oligonucleotide
  Target: SCN10A; (+) strand; PAM type: NRG; PAM sequence: CAG
tagatcgcgtcactgcactc

SEQ ID NO: 37789 - DNA, 20 bp, Artificial Sequence
  Description of Artificial Sequence: Synthetic oligonucleotide
  Target: SCN10A; (+) strand; PAM type: NRG; PAM sequence: TGG
cgcgtcactgcactccagtc

SEQ ID NO: 37790 - DNA, 20 bp, Artificial Sequence
  Description of Artificial Sequence: Synthetic oligonucleotide
  Target: SCN10A; (+) strand; PAM type: NRG; PAM sequence: GGG
gcgtcactgcactccagtct

SEQ ID NO: 37791 - DNA, 20 bp, Artificial Sequence
  Description of Artificial Sequence: Synthetic oligonucleotide
  Target: SCN10A; (+) strand; PAM type: NRG; PAM sequence: CAG
ctgcactccagtctgggtga

SEQ ID NO: 37792 - DNA, 20 bp, Artificial Sequence
  Description of Artificial Sequence: Synthetic oligonucleotide
  Target: SCN10A; (+) strand; PAM type: NRG; PAM sequence: GAG
gcactccagtctgggtgaca

SEQ ID NO: 37793 - DNA, 20 bp, Artificial Sequence
  Description of Artificial Sequence: Synthetic oligonucleotide
  Target: SCN10A; (+) strand; PAM type: NRG; PAM sequence: AAG
tccagtctgggtgacagagc

SEQ ID NO: 37794 - DNA, 20 bp, Artificial Sequence
  Description of Artificial Sequence: Synthetic oligonucleotide
  Target: SCN10A; (+) strand; PAM type: NRG; PAM sequence: CAG
ctccaaaacaacaacaacaa

SEQ ID NO: 37795 - DNA, 20 bp, Artificial Sequence
  Description of Artificial Sequence: Synthetic oligonucleotide
  Target: SCN10A; (+) strand; PAM type: NRG; PAM sequence: TAG
aaaacctgtactaatatttt

SEQ ID NO: 37796 - DNA, 20 bp, Artificial Sequence
  Description of Artificial Sequence: Synthetic oligonucleotide
  Target: SCN10A; (+) strand; PAM type: NRG; PAM sequence: GAG
aacctgtactaatattttta

SEQ ID NO: 37797 - DNA, 20 bp, Artificial Sequence
  Description of Artificial Sequence: Synthetic oligonucleotide
  Target: SCN10A; (+) strand; PAM type: NRG; PAM sequence: GAG
cctgtactaatatttttaga

SEQ ID NO: 37798 - DNA, 20 bp, Artificial Sequence
  Description of Artificial Sequence: Synthetic oligonucleotide
  Target: SCN10A; (+) strand; PAM type: NRG; PAM sequence: AAG
actaatatttttagagagtt

SEQ ID NO: 37799 - DNA, 20 bp, Artificial Sequence
  Description of Artificial Sequence: Synthetic oligonucleotide
  Target: SCN10A; (+) strand; PAM type: NRG; PAM sequence: GAG
taatatttttagagagttaa

SEQ ID NO: 37800 - DNA, 20 bp, Artificial Sequence
  Description of Artificial Sequence: Synthetic oligonucleotide
  Target: SCN10A; (+) strand; PAM type: NRG; PAM sequence: AGG
aatatttttagagagttaag

SEQ ID NO: 37801 - DNA, 20 bp, Artificial Sequence
  Description of Artificial Sequence: Synthetic oligonucleotide
  Target: SCN10A; (+) strand; PAM type: NRG; PAM sequence: GAG
tttttagagagttaagaggt

SEQ ID NO: 37802 - DNA, 20 bp, Artificial Sequence
  Description of Artificial Sequence: Synthetic oligonucleotide
  Target: SCN10A; (+) strand; PAM type: NRG; PAM sequence: AAG
ttagagagttaagaggtgag

SEQ ID NO: 37803 - DNA, 20 bp, Artificial Sequence
  Description of Artificial Sequence: Synthetic oligonucleotide
  Target: SCN10A; (+) strand; PAM type: NRG; PAM sequence: GAG
agagagttaagaggtgagaa

SEQ ID NO: 37804 - DNA, 20 bp, Artificial Sequence
  Description of Artificial Sequence: Synthetic oligonucleotide
  Target: SCN10A; (+) strand; PAM type: NRG; PAM sequence: AGG
gagagttaagaggtgagaag

SEQ ID NO: 37805 - DNA, 20 bp, Artificial Sequence
  Description of Artificial Sequence: Synthetic oligonucleotide
  Target: SCN10A; (+) strand; PAM type: NRG; PAM sequence: TAG
gtgagaagaggctccacgta

SEQ ID NO: 37806 - DNA, 20 bp, Artificial Sequence
  Description of Artificial Sequence: Synthetic oligonucleotide
  Target: SCN10A; (+) strand; PAM type: NRG; PAM sequence: AAG
agaggctccacgtatagaac

SEQ ID NO: 37807 - DNA, 20 bp, Artificial Sequence
  Description of Artificial Sequence: Synthetic oligonucleotide
  Target: SCN10A; (+) strand; PAM type: NRG; PAM sequence: GAG
aggctccacgtatagaacaa

SEQ ID NO: 37808 - DNA, 20 bp, Artificial Sequence
  Description of Artificial Sequence: Synthetic oligonucleotide
  Target: SCN10A; (+) strand; PAM type: NRG; PAM sequence: CAG
ctccacgtatagaacaagag

SEQ ID NO: 37809 - DNA, 20 bp, Artificial Sequence
  Description of Artificial Sequence: Synthetic oligonucleotide
  Target: SCN10A; (+) strand; PAM type: NRG; PAM sequence: AAG
cacgtatagaacaagagcag

SEQ ID NO: 37810 - DNA, 20 bp, Artificial Sequence
  Description of Artificial Sequence: Synthetic oligonucleotide
  Target: SCN10A; (+) strand; PAM type: NRG; PAM sequence: AGG
acgtatagaacaagagcaga

SEQ ID NO: 37811 - DNA, 20 bp, Artificial Sequence
  Description of Artificial Sequence: Synthetic oligonucleotide
  Target: SCN10A; (+) strand; PAM type: NRG; PAM sequence: AAG
caagagcagaaggatgtaaa

SEQ ID NO: 37812 - DNA, 20 bp, Artificial Sequence
  Description of Artificial Sequence: Synthetic oligonucleotide
  Target: SCN10A; (+) strand; PAM type: NRG; PAM sequence: AAG
ggatgtaaaaagtaccttca

SEQ ID NO: 37813 - DNA, 20 bp, Artificial Sequence
  Description of Artificial Sequence: Synthetic oligonucleotide
  Target: SCN10A; (+) strand; PAM type: NRG; PAM sequence: TGG
aagtaccttcaaagacaaaa

SEQ ID NO: 37814 - DNA, 20 bp, Artificial Sequence
  Description of Artificial Sequence: Synthetic oligonucleotide
  Target: SCN10A; (+) strand; PAM type: NRG; PAM sequence: TAG
ttttgaaaacaaaaatatga

SEQ ID NO: 37815 - DNA, 20 bp, Artificial Sequence
  Description of Artificial Sequence: Synthetic oligonucleotide
  Target: SCN10A; (+) strand; PAM type: NRG; PAM sequence: AAG
aaacaaaaatatgatagcaa

SEQ ID NO: 37816 - DNA, 20 bp, Artificial Sequence
  Description of Artificial Sequence: Synthetic oligonucleotide
  Target: SCN10A; (+) strand; PAM type: NRG; PAM sequence: TAG
tagcaaaagtaaaacactaa

SEQ ID NO: 37817 - DNA, 20 bp, Artificial Sequence
  Description of Artificial Sequence: Synthetic oligonucleotide
  Target: SCN10A; (+) strand; PAM type: NRG; PAM sequence: AGG
agcaaaagtaaaacactaat

SEQ ID NO: 37818 - DNA, 20 bp, Artificial Sequence
  Description of Artificial Sequence: Synthetic oligonucleotide
  Target: SCN10A; (+) strand; PAM type: NRG; PAM sequence: CGG
aaaagtaaaacactaatagg

SEQ ID NO: 37819 - DNA, 20 bp, Artificial Sequence
  Description of Artificial Sequence: Synthetic oligonucleotide
  Target: SCN10A; (+) strand; PAM type: NRG; PAM sequence: AAG
aataggcggacttgtaaata

SEQ ID NO: 37820 - DNA, 20 bp, Artificial Sequence
  Description of Artificial Sequence: Synthetic oligonucleotide
  Target: SCN10A; (+) strand; PAM type: NRG; PAM sequence: TGG
cggacttgtaaataaagttt

SEQ ID NO: 37821 - DNA, 20 bp, Artificial Sequence
  Description of Artificial Sequence: Synthetic oligonucleotide
  Target: SCN10A; (+) strand; PAM type: NRG; PAM sequence: CAG
ataaagttttggaaatctca

SEQ ID NO: 37822 - DNA, 20 bp, Artificial Sequence
  Description of Artificial Sequence: Synthetic oligonucleotide
  Target: SCN10A; (+) strand; PAM type: NRG; PAM sequence: AGG
taaagttttggaaatctcac

SEQ ID NO: 37823 - DNA, 20 bp, Artificial Sequence
  Description of Artificial Sequence: Synthetic oligonucleotide
  Target: SCN10A; (+) strand; PAM type: NRG; PAM sequence: AAG
agttttggaaatctcacagg

SEQ ID NO: 37824 - DNA, 20 bp, Artificial Sequence
  Description of Artificial Sequence: Synthetic oligonucleotide
  Target: SCN10A; (+) strand; PAM type: NRG; PAM sequence: TGG
tttggaaatctcacaggaag

SEQ ID NO: 37825 - DNA, 20 bp, Artificial Sequence
  Description of Artificial Sequence: Synthetic oligonucleotide
  Target: SCN10A; (+) strand; PAM type: NRG; PAM sequence: AAG
tcacaggaagtggaacaaaa

SEQ ID NO: 37826 - DNA, 20 bp, Artificial Sequence
  Description of Artificial Sequence: Synthetic oligonucleotide
  Target: SCN10A; (+) strand; PAM type: NRG; PAM sequence: CAG
caggaagtggaacaaaaaag

SEQ ID NO: 37827 - DNA, 20 bp, Artificial Sequence
  Description of Artificial Sequence: Synthetic oligonucleotide
  Target: SCN10A; (+) strand; PAM type: NRG; PAM sequence: TGG
gtggaacaaaaaagcagaaa

SEQ ID NO: 37828 - DNA, 20 bp, Artificial Sequence
  Description of Artificial Sequence: Synthetic oligonucleotide
  Target: SCN10A; (+) strand; PAM type: NRG; PAM sequence: TAG
aacaaaaaagcagaaatgga

SEQ ID NO: 37829 - DNA, 20 bp, Artificial Sequence
  Description of Artificial Sequence: Synthetic oligonucleotide
  Target: SCN10A; (+) strand; PAM type: NRG; PAM sequence: AGG
acaaaaaagcagaaatggat

SEQ ID NO: 37830 - DNA, 20 bp, Artificial Sequence
  Description of Artificial Sequence: Synthetic oligonucleotide
  Target: SCN10A; (+) strand; PAM type: NRG; PAM sequence: AAG
aaaaagcagaaatggatagg

SEQ ID NO: 37831 - DNA, 20 bp, Artificial Sequence
  Description of Artificial Sequence: Synthetic oligonucleotide
  Target: SCN10A; (+) strand; PAM type: NRG; PAM sequence: AAG
aatggataggaagtgataaa

SEQ ID NO: 37832 - DNA, 20 bp, Artificial Sequence
  Description of Artificial Sequence: Synthetic oligonucleotide
  Target: SCN10A; (+) strand; PAM type: NRG; PAM sequence: TAG
gtgataaaaagtttgaaaat

SEQ ID NO: 37833 - DNA, 20 bp, Artificial Sequence
  Description of Artificial Sequence: Synthetic oligonucleotide
  Target: SCN10A; (+) strand; PAM type: NRG; PAM sequence: GAG
gataaaaagtttgaaaatta

SEQ ID NO: 37834 - DNA, 20 bp, Artificial Sequence
  Description of Artificial Sequence: Synthetic oligonucleotide
  Target: SCN10A; (+) strand; PAM type: NRG; PAM sequence: CAG
aagtttgaaaattagagaat

SEQ ID NO: 37835 - DNA, 20 bp, Artificial Sequence
  Description of Artificial Sequence: Synthetic oligonucleotide
  Target: SCN10A; (+) strand; PAM type: NRG; PAM sequence: TAG
tgaaaattagagaatcagac

SEQ ID NO: 37836 - DNA, 20 bp, Artificial Sequence
  Description of Artificial Sequence: Synthetic oligonucleotide
  Target: SCN10A; (+) strand; PAM type: NRG; PAM sequence: AGG
gaaaattagagaatcagact

SEQ ID NO: 37837 - DNA, 20 bp, Artificial Sequence
  Description of Artificial Sequence: Synthetic oligonucleotide
  Target: SCN10A; (+) strand; PAM type: NRG; PAM sequence: GAG
aaattagagaatcagactag

SEQ ID NO: 37838 - DNA, 20 bp, Artificial Sequence
  Description of Artificial Sequence: Synthetic oligonucleotide
  Target: SCN10A; (+) strand; PAM type: NRG; PAM sequence: AGG
aattagagaatcagactagg

SEQ ID NO: 37839 - DNA, 20 bp, Artificial Sequence
  Description of Artificial Sequence: Synthetic oligonucleotide
  Target: SCN10A; (+) strand; PAM type: NRG; PAM sequence: TAG
gaggtatattgtttgactaa

SEQ ID NO: 37840 - DNA, 20 bp, Artificial Sequence
  Description of Artificial Sequence: Synthetic oligonucleotide
  Target: SCN10A; (+) strand; PAM type: NRG; PAM sequence: AGG
aggtatattgtttgactaat

SEQ ID NO: 37841 - DNA, 20 bp, Artificial Sequence
  Description of Artificial Sequence: Synthetic oligonucleotide
  Target: SCN10A; (+) strand; PAM type: NRG; PAM sequence: GAG
gtatattgtttgactaatag

SEQ ID NO: 37842 - DNA, 20 bp, Artificial Sequence
  Description of Artificial Sequence: Synthetic oligonucleotide
  Target: SCN10A; (+) strand; PAM type: NRG; PAM sequence: AGG
tatattgtttgactaatagg

SEQ ID NO: 37843 - DNA, 20 bp, Artificial Sequence
  Description of Artificial Sequence: Synthetic oligonucleotide
  Target: SCN10A; (+) strand; PAM type: NRG; PAM sequence: TAG
tgtttgactaataggaggtc

SEQ ID NO: 37844 - DNA, 20 bp, Artificial Sequence
  Description of Artificial Sequence: Synthetic oligonucleotide
  Target: SCN10A; (+) strand; PAM type: NRG; PAM sequence: AAG
tgactaataggaggtctaga

SEQ ID NO: 37845 - DNA, 20 bp, Artificial Sequence
  Description of Artificial Sequence: Synthetic oligonucleotide
  Target: SCN10A; (+) strand; PAM type: NRG; PAM sequence: TAG
taggaggtctagaaagaaat

SEQ ID NO: 37846 - DNA, 20 bp, Artificial Sequence
  Description of Artificial Sequence: Synthetic oligonucleotide
  Target: SCN10A; (+) strand; PAM type: NRG; PAM sequence: AAG
gaggtctagaaagaaattag

SEQ ID NO: 37847 - DNA, 20 bp, Artificial Sequence
  Description of Artificial Sequence: Synthetic oligonucleotide
  Target: SCN10A; (+) strand; PAM type: NRG; PAM sequence: GAG
gaaagaaattagaagacaat

SEQ ID NO: 37848 - DNA, 20 bp, Artificial Sequence
  Description of Artificial Sequence: Synthetic oligonucleotide
  Target: SCN10A; (+) strand; PAM type: NRG; PAM sequence: AAG
gaaattagaagacaatgagc

SEQ ID NO: 37849 - DNA, 20 bp, Artificial Sequence
  Description of Artificial Sequence: Synthetic oligonucleotide
  Target: SCN10A; (+) strand; PAM type: NRG; PAM sequence: AGG
aaattagaagacaatgagca

SEQ ID NO: 37850 - DNA, 20 bp, Artificial Sequence
  Description of Artificial Sequence: Synthetic oligonucleotide
  Target: SCN10A; (+) strand; PAM type: NRG; PAM sequence: AAG
tgagcaaggccttcaaaatt

SEQ ID NO: 37851 - DNA, 20 bp, Artificial Sequence
  Description of Artificial Sequence: Synthetic oligonucleotide
  Target: SCN10A; (+) strand; PAM type: NRG; PAM sequence: GAG
agcaaggccttcaaaattaa

SEQ ID NO: 37852 - DNA, 20 bp, Artificial Sequence
  Description of Artificial Sequence: Synthetic oligonucleotide
  Target: SCN10A; (+) strand; PAM type: NRG; PAM sequence: AGG
gcaaggccttcaaaattaag

SEQ ID NO: 37853 - DNA, 20 bp, Artificial Sequence
  Description of Artificial Sequence: Synthetic oligonucleotide
  Target: SCN10A; (+) strand; PAM type: NRG; PAM sequence: GGG
caaggccttcaaaattaaga

SEQ ID NO: 37854 - DNA, 20 bp, Artificial Sequence
  Description of Artificial Sequence: Synthetic oligonucleotide
  Target: SCN10A; (+) strand; PAM type: NRG; PAM sequence: CAG
gagggaaataatttctaata

SEQ ID NO: 37855 - DNA, 20 bp, Artificial Sequence
  Description of Artificial Sequence: Synthetic oligonucleotide
  Target: SCN10A; (+) strand; PAM type: NRG; PAM sequence: AAG
ggaaataatttctaatacag

SEQ ID NO: 37856 - DNA, 20 bp, Artificial Sequence
  Description of Artificial Sequence: Synthetic oligonucleotide
  Target: SCN10A; (+) strand; PAM type: NRG; PAM sequence: TAG
ctaatacagaagtctttccc

SEQ ID NO: 37857 - DNA, 20 bp, Artificial Sequence
  Description of Artificial Sequence: Synthetic oligonucleotide
  Target: SCN10A; (+) strand; PAM type: NRG; PAM sequence: AAG
tttccctagccaaactgtca

SEQ ID NO: 37858 - DNA, 20 bp, Artificial Sequence
  Description of Artificial Sequence: Synthetic oligonucleotide
  Target: SCN10A; (+) strand; PAM type: NRG; PAM sequence: AAG
ccctagccaaactgtcaaag

SEQ ID NO: 37859 - DNA, 20 bp, Artificial Sequence
  Description of Artificial Sequence: Synthetic oligonucleotide
  Target: SCN10A; (+) strand; PAM type: NRG; PAM sequence: AGG
cctagccaaactgtcaaaga

SEQ ID NO: 37860 - DNA, 20 bp, Artificial Sequence
  Description of Artificial Sequence: Synthetic oligonucleotide
  Target: SCN10A; (+) strand; PAM type: NRG; PAM sequence: TAG
agccaaactgtcaaagaagg

SEQ ID NO: 37861 - DNA, 20 bp, Artificial Sequence
  Description of Artificial Sequence: Synthetic oligonucleotide
  Target: SCN10A; (+) strand; PAM type: NRG; PAM sequence: AAG
caaagaaggtagaatatatg

SEQ ID NO: 37862 - DNA, 20 bp, Artificial Sequence
  Description of Artificial Sequence: Synthetic oligonucleotide
  Target: SCN10A; (+) strand; PAM type: NRG; PAM sequence: TGG
aggtagaatatatgaagtct

SEQ ID NO: 37863 - DNA, 20 bp, Artificial Sequence
  Description of Artificial Sequence: Synthetic oligonucleotide
  Target: SCN10A; (+) strand; PAM type: NRG; PAM sequence: GGG
ggtagaatatatgaagtctt

SEQ ID NO: 37864 - DNA, 20 bp, Artificial Sequence
  Description of Artificial Sequence: Synthetic oligonucleotide
  Target: SCN10A; (+) strand; PAM type: NRG; PAM sequence: TAG
gtcttgggaaatgtacttct

SEQ ID NO: 37865 - DNA, 20 bp, Artificial Sequence
  Description of Artificial Sequence: Synthetic oligonucleotide
  Target: SCN10A; (+) strand; PAM type: NRG; PAM sequence: AAG
tcttagttacccttctaata

SEQ ID NO: 37866 - DNA, 20 bp, Artificial Sequence
  Description of Artificial Sequence: Synthetic oligonucleotide
  Target: SCN10A; (+) strand; PAM type: NRG; PAM sequence: TAG
tacccttctaataaagttac

SEQ ID NO: 37867 - DNA, 20 bp, Artificial Sequence
  Description of Artificial Sequence: Synthetic oligonucleotide
  Target: SCN10A; (+) strand; PAM type: NRG; PAM sequence: AAG
ccttctaataaagttactag

SEQ ID NO: 37868 - DNA, 20 bp, Artificial Sequence
  Description of Artificial Sequence: Synthetic oligonucleotide
  Target: SCN10A; (+) strand; PAM type: NRG; PAM sequence: TGG
ctaataaagttactagaagc

SEQ ID NO: 37869 - DNA, 20 bp, Artificial Sequence
  Description of Artificial Sequence: Synthetic oligonucleotide
  Target: SCN10A; (+) strand; PAM type: NRG; PAM sequence: GGG
taataaagttactagaagct

SEQ ID NO: 37870 - DNA, 20 bp, Artificial Sequence
  Description of Artificial Sequence: Synthetic oligonucleotide
  Target: SCN10A; (+) strand; PAM type: NRG; PAM sequence: TGG
aagttactagaagctgggca

SEQ ID NO: 37871 - DNA, 20 bp, Artificial Sequence
  Description of Artificial Sequence: Synthetic oligonucleotide
  Target: SCN10A; (+) strand; PAM type: NRG; PAM sequence: TGG
ttactagaagctgggcatgg

SEQ ID NO: 37872 - DNA, 20 bp, Artificial Sequence
  Description of Artificial Sequence: Synthetic oligonucleotide
  Target: SCN10A; (+) strand; PAM type: NRG; PAM sequence: TAG
ggcatggtggtatgtacctg

SEQ ID NO: 37873 - DNA, 20 bp, Artificial Sequence
  Description of Artificial Sequence: Synthetic oligonucleotide
  Target: SCN10A; (+) strand; PAM type: NRG; PAM sequence: TGG
tacctgtagtcctaactact

SEQ ID NO: 37874 - DNA, 20 bp, Artificial Sequence
  Description of Artificial Sequence: Synthetic oligonucleotide
  Target: SCN10A; (+) strand; PAM type: NRG; PAM sequence: GGG
acctgtagtcctaactactt

SEQ ID NO: 37875 - DNA, 20 bp, Artificial Sequence
  Description of Artificial Sequence: Synthetic oligonucleotide
  Target: SCN10A; (+) strand; PAM type: NRG; PAM sequence: GAG
ctgtagtcctaactacttgg

SEQ ID NO: 37876 - DNA, 20 bp, Artificial Sequence
  Description of Artificial Sequence: Synthetic oligonucleotide
  Target: SCN10A; (+) strand; PAM type: NRG; PAM sequence: AGG
tgtagtcctaactacttggg

SEQ ID NO: 37877 - DNA, 20 bp, Artificial Sequence
  Description of Artificial Sequence: Synthetic oligonucleotide
  Target: SCN10A; (+) strand; PAM type: NRG; PAM sequence: GAG
tcctaactacttgggaggtt

SEQ ID NO: 37878 - DNA, 20 bp, Artificial Sequence
  Description of Artificial Sequence: Synthetic oligonucleotide
  Target: SCN10A; (+) strand; PAM type: NRG; PAM sequence: AGG
cctaactacttgggaggttg

SEQ ID NO: 37879 - DNA, 20 bp, Artificial Sequence
  Description of Artificial Sequence: Synthetic oligonucleotide
  Target: SCN10A; (+) strand; PAM type: NRG; PAM sequence: CAG
aactacttgggaggttgagg

SEQ ID NO: 37880 - DNA, 20 bp, Artificial Sequence
  Description of Artificial Sequence: Synthetic oligonucleotide
  Target: SCN10A; (+) strand; PAM type: NRG; PAM sequence: AGG
actacttgggaggttgaggc

SEQ ID NO: 37881 - DNA, 20 bp, Artificial Sequence
  Description of Artificial Sequence: Synthetic oligonucleotide
  Target: SCN10A; (+) strand; PAM type: NRG; PAM sequence: GAG
tacttgggaggttgaggcag

SEQ ID NO: 37882 - DNA, 20 bp, Artificial Sequence
  Description of Artificial Sequence: Synthetic oligonucleotide
  Target: SCN10A; (+) strand; PAM type: NRG; PAM sequence: AGG
acttgggaggttgaggcagg

SEQ ID NO: 37883 - DNA, 20 bp, Artificial Sequence
  Description of Artificial Sequence: Synthetic oligonucleotide
  Target: SCN10A; (+) strand; PAM type: NRG; PAM sequence: CAG
gcaggaggatcacttgaacc

SEQ ID NO: 37884 - DNA, 20 bp, Artificial Sequence
  Description of Artificial Sequence: Synthetic oligonucleotide
  Target: SCN10A; (+) strand; PAM type: NRG; PAM sequence: AGG
caggaggatcacttgaaccc

SEQ ID NO: 37885 - DNA, 20 bp, Artificial Sequence
  Description of Artificial Sequence: Synthetic oligonucleotide
  Target: SCN10A; (+) strand; PAM type: NRG; PAM sequence: GAG
ggaggatcacttgaacccag

SEQ ID NO: 37886 - DNA, 20 bp, Artificial Sequence
  Description of Artificial Sequence: Synthetic oligonucleotide
  Target: SCN10A; (+) strand; PAM type: NRG; PAM sequence: GAG
tcacttgaacccaggagttt

SEQ ID NO: 37887 - DNA, 20 bp, Artificial Sequence
  Description of Artificial Sequence: Synthetic oligonucleotide
  Target: SCN10A; (+) strand; PAM type: NRG; PAM sequence: AGG
cacttgaacccaggagtttg

SEQ ID NO: 37888 - DNA, 20 bp, Artificial Sequence
  Description of Artificial Sequence: Synthetic oligonucleotide
  Target: SCN10A; (+) strand; PAM type: NRG; PAM sequence: CAG
acccaggagtttgaggccaa

SEQ ID NO: 37889 - DNA, 20 bp, Artificial Sequence
  Description of Artificial Sequence: Synthetic oligonucleotide
  Target: SCN10A; (+) strand; PAM type: NRG; PAM sequence: TGG
ggagtttgaggccaacagcc

SEQ ID NO: 37890 - DNA, 20 bp, Artificial Sequence
  Description of Artificial Sequence: Synthetic oligonucleotide
  Target: SCN10A; (+) strand; PAM type: NRG; PAM sequence: GGG
gagtttgaggccaacagcct

SEQ ID NO: 37891 - DNA, 20 bp, Artificial Sequence
  Description of Artificial Sequence: Synthetic oligonucleotide
  Target: SCN10A; (+) strand; PAM type: NRG; PAM sequence: CAG
tttgaggccaacagcctggg

SEQ ID NO: 37892 - DNA, 20 bp, Artificial Sequence
  Description of Artificial Sequence: Synthetic oligonucleotide
  Target: SCN10A; (+) strand; PAM type: NRG; PAM sequence: TAG
ggccaacagcctgggcagca

SEQ ID NO: 37893 - DNA, 20 bp, Artificial Sequence
  Description of Artificial Sequence: Synthetic oligonucleotide
  Target: SCN10A; (+) strand; PAM type: NRG; PAM sequence: GAG
ccaacagcctgggcagcata

SEQ ID NO: 37894 - DNA, 20 bp, Artificial Sequence
  Description of Artificial Sequence: Synthetic oligonucleotide
  Target: SCN10A; (+) strand; PAM type: NRG; PAM sequence: GAG
aacagcctgggcagcataga

SEQ ID NO: 37895 - DNA, 20 bp, Artificial Sequence
  Description of Artificial Sequence: Synthetic oligonucleotide
  Target: SCN10A; (+) strand; PAM type: NRG; PAM sequence: TAG
gtcttaaaaaaaaatgttac

SEQ ID NO: 37896 - DNA, 20 bp, Artificial Sequence
  Description of Artificial Sequence: Synthetic oligonucleotide
  Target: SCN10A; (+) strand; PAM type: NRG; PAM sequence: GAG
cttaaaaaaaaatgttacta

SEQ ID NO: 37897 - DNA, 20 bp, Artificial Sequence
  Description of Artificial Sequence: Synthetic oligonucleotide
  Target: SCN10A; (+) strand; PAM type: NRG; PAM sequence: AGG
ttaaaaaaaaatgttactag

SEQ ID NO: 37898 - DNA, 20 bp, Artificial Sequence
  Description of Artificial Sequence: Synthetic oligonucleotide
  Target: SCN10A; (+) strand; PAM type: NRG; PAM sequence: AAG
aggatatgctccattcaaac

SEQ ID NO: 37899 - DNA, 20 bp, Artificial Sequence
  Description of Artificial Sequence: Synthetic oligonucleotide
  Target: SCN10A; (+) strand; PAM type: NRG; PAM sequence: CAG
caagaaacatatatgcgatc

SEQ ID NO: 37900 - DNA, 20 bp, Artificial Sequence
  Description of Artificial Sequence: Synthetic oligonucleotide
  Target: SCN10A; (+) strand; PAM type: NRG; PAM sequence: AGG
aagaaacatatatgcgatcc

SEQ ID NO: 37901 - DNA, 20 bp, Artificial Sequence
  Description of Artificial Sequence: Synthetic oligonucleotide
  Target: SCN10A; (+) strand; PAM type: NRG; PAM sequence: GGG
agaaacatatatgcgatcca

SEQ ID NO: 37902 - DNA, 20 bp, Artificial Sequence
  Description of Artificial Sequence: Synthetic oligonucleotide
  Target: SCN10A; (+) strand; PAM type: NRG; PAM sequence: AAG
aacatatatgcgatccaggg

SEQ ID NO: 37903 - DNA, 20 bp, Artificial Sequence
  Description of Artificial Sequence: Synthetic oligonucleotide
  Target: SCN10A; (+) strand; PAM type: NRG; PAM sequence: GAG
catatatgcgatccagggaa

SEQ ID NO: 37904 - DNA, 20 bp, Artificial Sequence
  Description of Artificial Sequence: Synthetic oligonucleotide
  Target: SCN10A; (+) strand; PAM type: NRG; PAM sequence: AGG
atatatgcgatccagggaag

SEQ ID NO: 37905 - DNA, 20 bp, Artificial Sequence
  Description of Artificial Sequence: Synthetic oligonucleotide
  Target: SCN10A; (+) strand; PAM type: NRG; PAM sequence: AAG
gcgatccagggaagaggcaa

SEQ ID NO: 37906 - DNA, 20 bp, Artificial Sequence
  Description of Artificial Sequence: Synthetic oligonucleotide
  Target: SCN10A; (+) strand; PAM type: NRG; PAM sequence: AGG
cgatccagggaagaggcaaa

SEQ ID NO: 37907 - DNA, 20 bp, Artificial Sequence
  Description of Artificial Sequence: Synthetic oligonucleotide
  Target: SCN10A; (+) strand; PAM type: NRG; PAM sequence: AAG
aggcaaaaggaatccaaaaa

SEQ ID NO: 37908 - DNA, 20 bp, Artificial Sequence
  Description of Artificial Sequence: Synthetic oligonucleotide
  Target: SCN10A; (+) strand; PAM type: NRG; PAM sequence: AAG
aggaatccaaaaaaagaatg

SEQ ID NO: 37909 - DNA, 20 bp, Artificial Sequence
  Description of Artificial Sequence: Synthetic oligonucleotide
  Target: SCN10A; (+) strand; PAM type: NRG; PAM sequence: AAG
aatccaaaaaaagaatgaag

SEQ ID NO: 37910 - DNA, 20 bp, Artificial Sequence
  Description of Artificial Sequence: Synthetic oligonucleotide
  Target: SCN10A; (+) strand; PAM type: NRG; PAM sequence: TAG
aatgaagaagaaaaaatctc

SEQ ID NO: 37911 - DNA, 20 bp, Artificial Sequence
  Description of Artificial Sequence: Synthetic oligonucleotide
  Target: SCN10A; (+) strand; PAM type: NRG; PAM sequence: CAG
aagaaaaaatctctagaaaa

SEQ ID NO: 37912 - DNA, 20 bp, Artificial Sequence
  Description of Artificial Sequence: Synthetic oligonucleotide
  Target: SCN10A; (+) strand; PAM type: NRG; PAM sequence: CAG
tctagaaaacagctgtgcat

SEQ ID NO: 37913 - DNA, 20 bp, Artificial Sequence
  Description of Artificial Sequence: Synthetic oligonucleotide
  Target: SCN10A; (+) strand; PAM type: NRG; PAM sequence: AGG
ctagaaaacagctgtgcatc

SEQ ID NO: 37914 - DNA, 20 bp, Artificial Sequence
  Description of Artificial Sequence: Synthetic oligonucleotide
  Target: SCN10A; (+) strand; PAM type: NRG; PAM sequence: TAG
aaacagctgtgcatcaggcc

SEQ ID NO: 37915 - DNA, 20 bp, Artificial Sequence
  Description of Artificial Sequence: Synthetic oligonucleotide
  Target: SCN10A; (+) strand; PAM type: NRG; PAM sequence: TAG
catcaggcctagaaaacatc

SEQ ID NO: 37916 - DNA, 20 bp, Artificial Sequence
  Description of Artificial Sequence: Synthetic oligonucleotide
  Target: SCN10A; (+) strand; PAM type: NRG; PAM sequence: AGG
atcaggcctagaaaacatct

SEQ ID NO: 37917 - DNA, 20 bp, Artificial Sequence
  Description of Artificial Sequence: Synthetic oligonucleotide
  Target: SCN10A; (+) strand; PAM type: NRG; PAM sequence: CAG
ggcctagaaaacatctaggt

SEQ ID NO: 37918 - DNA, 20 bp, Artificial Sequence
  Description of Artificial Sequence: Synthetic oligonucleotide
  Target: SCN10A; (+) strand; PAM type: NRG; PAM sequence: GAG
gaaaacatctaggtcagaat

SEQ ID NO: 37919 - DNA, 20 bp, Artificial Sequence
  Description of Artificial Sequence: Synthetic oligonucleotide
  Target: SCN10A; (+) strand; PAM type: NRG; PAM sequence: AGG
aaaacatctaggtcagaatg

SEQ ID NO: 37920 - DNA, 20 bp, Artificial Sequence
  Description of Artificial Sequence: Synthetic oligonucleotide
  Target: SCN10A; (+) strand; PAM type: NRG; PAM sequence: CAG
acatctaggtcagaatgagg

SEQ ID NO: 37921 - DNA, 20 bp, Artificial Sequence
  Description of Artificial Sequence: Synthetic oligonucleotide
  Target: SCN10A; (+) strand; PAM type: NRG; PAM sequence: AAG
tctaggtcagaatgaggcag

SEQ ID NO: 37922 - DNA, 20 bp, Artificial Sequence
  Description of Artificial Sequence: Synthetic oligonucleotide
  Target: SCN10A; (+) strand; PAM type: NRG; PAM sequence: AAG
tcagaatgaggcagaagatg

SEQ ID NO: 37923 - DNA, 20 bp, Artificial Sequence
  Description of Artificial Sequence: Synthetic oligonucleotide
  Target: SCN10A; (+) strand; PAM type: NRG; PAM sequence: TAG
aggcagaagatgaagtactc

SEQ ID NO: 37924 - DNA, 20 bp, Artificial Sequence
  Description of Artificial Sequence: Synthetic oligonucleotide
  Target: SCN10A; (+) strand; PAM type: NRG; PAM sequence: TAG
tactctagctgtgattccca

SEQ ID NO: 37925 - DNA, 20 bp, Artificial Sequence
  Description of Artificial Sequence: Synthetic oligonucleotide
  Target: SCN10A; (+) strand; PAM type: NRG; PAM sequence: AGG
actctagctgtgattcccat

SEQ ID NO: 37926 - DNA, 20 bp, Artificial Sequence
  Description of Artificial Sequence: Synthetic oligonucleotide
  Target: SCN10A; (+) strand; PAM type: NRG; PAM sequence: AAG
tgatgtgtgcaaataaattg

SEQ ID NO: 37927 - DNA, 20 bp, Artificial Sequence
  Description of Artificial Sequence: Synthetic oligonucleotide
  Target: SCN10A; (+) strand; PAM type: NRG; PAM sequence: TGG
tgaagcaacaattaaacatc

SEQ ID NO: 37928 - DNA, 20 bp, Artificial Sequence
  Description of Artificial Sequence: Synthetic oligonucleotide
  Target: SCN10A; (+) strand; PAM type: NRG; PAM sequence: GAG
aagcaacaattaaacatctg

SEQ ID NO: 37929 - DNA, 20 bp, Artificial Sequence
  Description of Artificial Sequence: Synthetic oligonucleotide
  Target: SCN10A; (+) strand; PAM type: NRG; PAM sequence: AAG
caacaattaaacatctggag

SEQ ID NO: 37930 - DNA, 20 bp, Artificial Sequence
  Description of Artificial Sequence: Synthetic oligonucleotide
  Target: SCN10A; (+) strand; PAM type: NRG; PAM sequence: GAG
acaattaaacatctggagaa

SEQ ID NO: 37931 - DNA, 20 bp, Artificial Sequence
  Description of Artificial Sequence: Synthetic oligonucleotide
  Target: SCN10A; (+) strand; PAM type: NRG; PAM sequence: TGG
taaacatctggagaagagtt

SEQ ID NO: 37932 - DNA, 20 bp, Artificial Sequence
  Description of Artificial Sequence: Synthetic oligonucleotide
  Target: SCN10A; (+) strand; PAM type: NRG; PAM sequence: GGG
aaacatctggagaagagttt

SEQ ID NO: 37933 - DNA, 20 bp, Artificial Sequence
  Description of Artificial Sequence: Synthetic oligonucleotide
  Target: SCN10A; (+) strand; PAM type: NRG; PAM sequence: TAG
agaagagtttgggaacaaat

SEQ ID NO: 37934 - DNA, 20 bp, Artificial Sequence
  Description of Artificial Sequence: Synthetic oligonucleotide
  Target: SCN10A; (+) strand; PAM type: NRG; PAM sequence: AGG
gaagagtttgggaacaaatt

SEQ ID NO: 37935 - DNA, 20 bp, Artificial Sequence
  Description of Artificial Sequence: Synthetic oligonucleotide
  Target: SCN10A; (+) strand; PAM type: NRG; PAM sequence: GGG
aagagtttgggaacaaatta

SEQ ID NO: 37936 - DNA, 20 bp, Artificial Sequence
  Description of Artificial Sequence: Synthetic oligonucleotide
  Target: SCN10A; (+) strand; PAM type: NRG; PAM sequence: TAG
gggaacaaattagggataaa

SEQ ID NO: 37937 - DNA, 20 bp, Artificial Sequence
  Description of Artificial Sequence: Synthetic oligonucleotide
  Target: SCN10A; (+) strand; PAM type: NRG; PAM sequence: GAG
ttagggataaatagaaaact

SEQ ID NO: 37938 - DNA, 20 bp, Artificial Sequence
  Description of Artificial Sequence: Synthetic oligonucleotide
  Target: SCN10A; (+) strand; PAM type: NRG; PAM sequence: AAG
ataaaatccttattaactcc

SEQ ID NO: 37939 - DNA, 20 bp, Artificial Sequence
  Description of Artificial Sequence: Synthetic oligonucleotide
  Target: SCN10A; (+) strand; PAM type: NRG; PAM sequence: AGG
taaaatccttattaactcca

SEQ ID NO: 37940 - DNA, 20 bp, Artificial Sequence
  Description of Artificial Sequence: Synthetic oligonucleotide
  Target: SCN10A; (+) strand; PAM type: NRG; PAM sequence: AAG
atccttattaactccaagga

SEQ ID NO: 37941 - DNA, 20 bp, Artificial Sequence
  Description of Artificial Sequence: Synthetic oligonucleotide
  Target: SCN10A; (+) strand; PAM type: NRG; PAM sequence: AAG
aagcaaaaacattgtgcaaa

SEQ ID NO: 37942 - DNA, 20 bp, Artificial Sequence
  Description of Artificial Sequence: Synthetic oligonucleotide
  Target: SCN10A; (+) strand; PAM type: NRG; PAM sequence: AGG
agcaaaaacattgtgcaaaa

SEQ ID NO: 37943 - DNA, 20 bp, Artificial Sequence
  Description of Artificial Sequence: Synthetic oligonucleotide
  Target: SCN10A; (+) strand; PAM type: NRG; PAM sequence: TAG
cattgtgcaaaaaggaaata

SEQ ID NO: 37944 - DNA, 20 bp, Artificial Sequence
  Description of Artificial Sequence: Synthetic oligonucleotide
  Target: SCN10A; (+) strand; PAM type: NRG; PAM sequence: AAG
gcaaaaaggaaatatagtca

SEQ ID NO: 37945 - DNA, 20 bp, Artificial Sequence
  Description of Artificial Sequence: Synthetic oligonucleotide
  Target: SCN10A; (+) strand; PAM type: NRG; PAM sequence: CAG
tcaaagtacactgcatgaca

SEQ ID NO: 37946 - DNA, 20 bp, Artificial Sequence
  Description of Artificial Sequence: Synthetic oligonucleotide
  Target: SCN10A; (+) strand; PAM type: NRG; PAM sequence: CAG
ctgcatgacacagctgtaaa

SEQ ID NO: 37947 - DNA, 20 bp, Artificial Sequence
  Description of Artificial Sequence: Synthetic oligonucleotide
  Target: SCN10A; (+) strand; PAM type: NRG; PAM sequence: TAG
agctgtaaacagtgtttact

SEQ ID NO: 37948 - DNA, 20 bp, Artificial Sequence
  Description of Artificial Sequence: Synthetic oligonucleotide
  Target: SCN10A; (+) strand; PAM type: NRG; PAM sequence: TAG
atgtaatgtaattatatatg

SEQ ID NO: 37949 - DNA, 20 bp, Artificial Sequence
  Description of Artificial Sequence: Synthetic oligonucleotide
  Target: SCN10A; (+) strand; PAM type: NRG; PAM sequence: TGG
ttatatatgtagtcatacaa

SEQ ID NO: 37950 - DNA, 20 bp, Artificial Sequence
  Description of Artificial Sequence: Synthetic oligonucleotide
  Target: SCN10A; (+) strand; PAM type: NRG; PAM sequence: AAG
attatctgatgatctaactg

SEQ ID NO: 37951 - DNA, 20 bp, Artificial Sequence
  Description of Artificial Sequence: Synthetic oligonucleotide
  Target: SCN10A; (+) strand; PAM type: NRG; PAM sequence: CAG
agattacaatataactgtaa

SEQ ID NO: 37952 - DNA, 20 bp, Artificial Sequence
  Description of Artificial Sequence: Synthetic oligonucleotide
  Target: SCN10A; (+) strand; PAM type: NRG; PAM sequence: AGG
gattacaatataactgtaac

SEQ ID NO: 37953 - DNA, 20 bp, Artificial Sequence
  Description of Artificial Sequence: Synthetic oligonucleotide
  Target: SCN10A; (+) strand; PAM type: NRG; PAM sequence: AAG
tacaatataactgtaacagg

SEQ ID NO: 37954 - DNA, 20 bp, Artificial Sequence
  Description of Artificial Sequence: Synthetic oligonucleotide
  Target: SCN10A; (+) strand; PAM type: NRG; PAM sequence: GAG
tataactgtaacaggaagat

SEQ ID NO: 37955 - DNA, 20 bp, Artificial Sequence
  Description of Artificial Sequence: Synthetic oligonucleotide
  Target: SCN10A; (+) strand; PAM type: NRG; PAM sequence: AGG
ataactgtaacaggaagatg

SEQ ID NO: 37956 - DNA, 20 bp, Artificial Sequence
  Description of Artificial Sequence: Synthetic oligonucleotide
  Target: SCN10A; (+) strand; PAM type: NRG; PAM sequence: GGG
taactgtaacaggaagatga

SEQ ID NO: 37957 - DNA, 20 bp, Artificial Sequence
  Description of Artificial Sequence: Synthetic oligonucleotide
  Target: SCN10A; (+) strand; PAM type: NRG; PAM sequence: GAG
tgtaacaggaagatgagggt

SEQ ID NO: 37958 - DNA, 20 bp, Artificial Sequence
  Description of Artificial Sequence: Synthetic oligonucleotide
  Target: SCN10A; (+) strand; PAM type: NRG; PAM sequence: GAG
taacaggaagatgagggtga

SEQ ID NO: 37959 - DNA, 20 bp, Artificial Sequence
  Description of Artificial Sequence: Synthetic oligonucleotide
  Target: SCN10A; (+) strand; PAM type: NRG; PAM sequence: AGG
aacaggaagatgagggtgag

SEQ ID NO: 37960 - DNA, 20 bp, Artificial Sequence
  Description of Artificial Sequence: Synthetic oligonucleotide
  Target: SCN10A; (+) strand; PAM type: NRG; PAM sequence: GAG
agatgagggtgagaggaaat

SEQ ID NO: 37961 - DNA, 20 bp, Artificial Sequence
  Description of Artificial Sequence: Synthetic oligonucleotide
  Target: SCN10A; (+) strand; PAM type: NRG; PAM sequence: TGG
ggtgagaggaaatgagtttg

SEQ ID NO: 37962 - DNA, 20 bp, Artificial Sequence
  Description of Artificial Sequence: Synthetic oligonucleotide
  Target: SCN10A; (+) strand; PAM type: NRG; PAM sequence: TGG
aggaaatgagtttgtggatg

SEQ ID NO: 37963 - DNA, 20 bp, Artificial Sequence
  Description of Artificial Sequence: Synthetic oligonucleotide
  Target: SCN10A; (+) strand; PAM type: NRG; PAM sequence: AAG
gagtttgtggatgtggcctt

SEQ ID NO: 37964 - DNA, 20 bp, Artificial Sequence
  Description of Artificial Sequence: Synthetic oligonucleotide
  Target: SCN10A; (+) strand; PAM type: NRG; PAM sequence: TAG
ccttaagttttttctcataa

SEQ ID NO: 37965 - DNA, 20 bp, Artificial Sequence
  Description of Artificial Sequence: Synthetic oligonucleotide
  Target: SCN10A; (+) strand; PAM type: NRG; PAM sequence: AGG
cttaagttttttctcataat

SEQ ID NO: 37966 - DNA, 20 bp, Artificial Sequence
  Description of Artificial Sequence: Synthetic oligonucleotide
  Target: SCN10A; (+) strand; PAM type: NRG; PAM sequence: AAG
aagttttttctcataatagg

SEQ ID NO: 37967 - DNA, 20 bp, Artificial Sequence
  Description of Artificial Sequence: Synthetic oligonucleotide
  Target: SCN10A; (+) strand; PAM type: NRG; PAM sequence: CAG
aggaagccaataaataacat

SEQ ID NO: 37968 - DNA, 20 bp, Artificial Sequence
  Description of Artificial Sequence: Synthetic oligonucleotide
  Target: SCN10A; (+) strand; PAM type: NRG; PAM sequence: TAG
gaaattgaaaaattaaaaat

SEQ ID NO: 37969 - DNA, 20 bp, Artificial Sequence
  Description of Artificial Sequence: Synthetic oligonucleotide
  Target: SCN10A; (+) strand; PAM type: NRG; PAM sequence: GAG
aaattaaaaattagtattat

SEQ ID NO: 37970 - DNA, 20 bp, Artificial Sequence
  Description of Artificial Sequence: Synthetic oligonucleotide
  Target: SCN10A; (+) strand; PAM type: NRG; PAM sequence: TGG
tagtattatgagtatattat

SEQ ID NO: 37971 - DNA, 20 bp, Artificial Sequence
  Description of Artificial Sequence: Synthetic oligonucleotide
  Target: SCN10A; (+) strand; PAM type: NRG; PAM sequence: GAG
gtattatgagtatattattg

SEQ ID NO: 37972 - DNA, 20 bp, Artificial Sequence
  Description of Artificial Sequence: Synthetic oligonucleotide
  Target: SCN10A; (+) strand; PAM type: NRG; PAM sequence: TAG
tatgagtatattattggaga

SEQ ID NO: 37973 - DNA, 20 bp, Artificial Sequence
  Description of Artificial Sequence: Synthetic oligonucleotide
  Target: SCN10A; (+) strand; PAM type: NRG; PAM sequence: AGG
atgagtatattattggagat

SEQ ID NO: 37974 - DNA, 20 bp, Artificial Sequence
  Description of Artificial Sequence: Synthetic oligonucleotide
  Target: SCN10A; (+) strand; PAM type: NRG; PAM sequence: GGG
tgagtatattattggagata

SEQ ID NO: 37975 - DNA, 20 bp, Artificial Sequence
  Description of Artificial Sequence: Synthetic oligonucleotide
  Target: SCN10A; (+) strand; PAM type: NRG; PAM sequence: GAG
agtatattattggagatagg

SEQ ID NO: 37976 - DNA, 20 bp, Artificial Sequence
  Description of Artificial Sequence: Synthetic oligonucleotide
  Target: SCN10A; (+) strand; PAM type: NRG; PAM sequence: AGG
gtatattattggagataggg

SEQ ID NO: 37977 - DNA, 20 bp, Artificial Sequence
  Description of Artificial Sequence: Synthetic oligonucleotide
  Target: SCN10A; (+) strand; PAM type: NRG; PAM sequence: CAG
tattggagatagggaggtat

SEQ ID NO: 37978 - DNA, 20 bp, Artificial Sequence
  Description of Artificial Sequence: Synthetic oligonucleotide
  Target: SCN10A; (+) strand; PAM type: NRG; PAM sequence: AAG
tggagatagggaggtatcag

SEQ ID NO: 37979 - DNA, 20 bp, Artificial Sequence
  Description of Artificial Sequence: Synthetic oligonucleotide
  Target: SCN10A; (+) strand; PAM type: NRG; PAM sequence: CAG
tagggaggtatcagaagaca

SEQ ID NO: 37980 - DNA, 20 bp, Artificial Sequence
  Description of Artificial Sequence: Synthetic oligonucleotide
  Target: SCN10A; (+) strand; PAM type: NRG; PAM sequence: AGG
agggaggtatcagaagacac

SEQ ID NO: 37981 - DNA, 20 bp, Artificial Sequence
  Description of Artificial Sequence: Synthetic oligonucleotide
  Target: SCN10A; (+) strand; PAM type: NRG; PAM sequence: AAG
tcagaagacacaggtaaaaa

SEQ ID NO: 37982 - DNA, 20 bp, Artificial Sequence
  Description of Artificial Sequence: Synthetic oligonucleotide
  Target: SCN10A; (+) strand; PAM type: NRG; PAM sequence: AAG
acacaggtaaaaaaagctaa

SEQ ID NO: 37983 - DNA, 20 bp, Artificial Sequence
  Description of Artificial Sequence: Synthetic oligonucleotide
  Target: SCN10A; (+) strand; PAM type: NRG; PAM sequence: TGG
caggtaaaaaaagctaaaag

SEQ ID NO: 37984 - DNA, 20 bp, Artificial Sequence
  Description of Artificial Sequence: Synthetic oligonucleotide
  Target: SCN10A; (+) strand; PAM type: NRG; PAM sequence: TGG
gtaaaaaaagctaaaagtgg

SEQ ID NO: 37985 - DNA, 20 bp, Artificial Sequence
  Description of Artificial Sequence: Synthetic oligonucleotide
  Target: SCN10A; (+) strand; PAM type: NRG; PAM sequence: TGG
aagctaaaagtggtggcctc

SEQ ID NO: 37986 - DNA, 20 bp, Artificial Sequence
  Description of Artificial Sequence: Synthetic oligonucleotide
  Target: SCN10A; (+) strand; PAM type: NRG; PAM sequence: AAG
taaaagtggtggcctctgga

SEQ ID NO: 37987 - DNA, 20 bp, Artificial Sequence
  Description of Artificial Sequence: Synthetic oligonucleotide
  Target: SCN10A; (+) strand; PAM type: NRG; PAM sequence: AAG
aagtggtggcctctggaaag

SEQ ID NO: 37988 - DNA, 20 bp, Artificial Sequence
  Description of Artificial Sequence: Synthetic oligonucleotide
  Target: SCN10A; (+) strand; PAM type: NRG; PAM sequence: GAG
gtggtggcctctggaaagaa

SEQ ID NO: 37989 - DNA, 20 bp, Artificial Sequence
  Description of Artificial Sequence: Synthetic oligonucleotide
  Target: SCN10A; (+) strand; PAM type: NRG; PAM sequence: GAG
ggcctctggaaagaagagat

SEQ ID NO: 37990 - DNA, 20 bp, Artificial Sequence
  Description of Artificial Sequence: Synthetic oligonucleotide
  Target: SCN10A; (+) strand; PAM type: NRG; PAM sequence: CAG
gaaattgctgttttttttgt

SEQ ID NO: 37991 - DNA, 20 bp, Artificial Sequence
  Description of Artificial Sequence: Synthetic oligonucleotide
  Target: SCN10A; (+) strand; PAM type: NRG; PAM sequence: AAG
aacatatatgtcttaaataa

SEQ ID NO: 37992 - DNA, 20 bp, Artificial Sequence
  Description of Artificial Sequence: Synthetic oligonucleotide
  Target: SCN10A; (+) strand; PAM type: NRG; PAM sequence: AAG
tatgtcttaaataaaagtaa

SEQ ID NO: 37993 - DNA, 20 bp, Artificial Sequence
  Description of Artificial Sequence: Synthetic oligonucleotide
  Target: SCN10A; (+) strand; PAM type: NRG; PAM sequence: AAG
cttaaataaaagtaaaagtc

SEQ ID NO: 37994 - DNA, 20 bp, Artificial Sequence
  Description of Artificial Sequence: Synthetic oligonucleotide
  Target: SCN10A; (+) strand; PAM type: NRG; PAM sequence: AAG
aaagtaaaagtcaagttaaa

SEQ ID NO: 37995 - DNA, 20 bp, Artificial Sequence
  Description of Artificial Sequence: Synthetic oligonucleotide
  Target: SCN10A; (+) strand; PAM type: NRG; PAM sequence: GAG
taattttttttcacatctgt

SEQ ID NO: 37996 - DNA, 20 bp, Artificial Sequence
  Description of Artificial Sequence: Synthetic oligonucleotide
  Target: SCN10A; (+) strand; PAM type: NRG; PAM sequence: GAG
attttttttcacatctgtga

SEQ ID NO: 37997 - DNA, 20 bp, Artificial Sequence
  Description of Artificial Sequence: Synthetic oligonucleotide
  Target: SCN10A; (+) strand; PAM type: NRG; PAM sequence: AGG
ttttttttcacatctgtgag

SEQ ID NO: 37998 - DNA, 20 bp, Artificial Sequence
  Description of Artificial Sequence: Synthetic oligonucleotide
  Target: SCN10A; (+) strand; PAM type: NRG; PAM sequence: GAG
ttttttcacatctgtgagag

SEQ ID NO: 37999 - DNA, 20 bp, Artificial Sequence
  Description of Artificial Sequence: Synthetic oligonucleotide
  Target: SCN10A; (+) strand; PAM type: NRG; PAM sequence: TAG
aaatcgtgtttgaaatcatt

SEQ ID NO: 38000 - DNA, 20 bp, Artificial Sequence
  Description of Artificial Sequence: Synthetic oligonucleotide
  Target: SCN10A; (+) strand; PAM type: NRG; PAM sequence: AGG
aatcgtgtttgaaatcattt

SEQ ID NO: 38001 - DNA, 20 bp, Artificial Sequence
  Description of Artificial Sequence: Synthetic oligonucleotide
  Target: SCN10A; (+) strand; PAM type: NRG; PAM sequence: TGG
atcatttaggaatctatatc

SEQ ID NO: 38002 - DNA, 20 bp, Artificial Sequence
  Description of Artificial Sequence: Synthetic oligonucleotide
  Target: SCN10A; (+) strand; PAM type: NRG; PAM sequence: TAG
ggaatctatatctggttgca

SEQ ID NO: 38003 - DNA, 20 bp, Artificial Sequence
  Description of Artificial Sequence: Synthetic oligonucleotide
  Target: SCN10A; (+) strand; PAM type: NRG; PAM sequence: GAG
atctggttgcatagctgctt

SEQ ID NO: 38004 - DNA, 20 bp, Artificial Sequence
  Description of Artificial Sequence: Synthetic oligonucleotide
  Target: SCN10A; (+) strand; PAM type: NRG; PAM sequence: CAG
tgcatagctgcttgagctgt

SEQ ID NO: 38005 - DNA, 20 bp, Artificial Sequence
  Description of Artificial Sequence: Synthetic oligonucleotide
  Target: SCN10A; (+) strand; PAM type: NRG; PAM sequence: TGG
tgtcagcttccatatcttgt

SEQ ID NO: 38006 - DNA, 20 bp, Artificial Sequence
  Description of Artificial Sequence: Synthetic oligonucleotide
  Target: SCN10A; (+) strand; PAM type: NRG; PAM sequence: TAG
actctttatgttttctaaat

SEQ ID NO: 38007 - DNA, 20 bp, Artificial Sequence
  Description of Artificial Sequence: Synthetic oligonucleotide
  Target: SCN10A; (+) strand; PAM type: NRG; PAM sequence: CAG
taaattagaaaatcttaact

SEQ ID NO: 38008 - DNA, 20 bp, Artificial Sequence
  Description of Artificial Sequence: Synthetic oligonucleotide
  Target: SCN10A; (+) strand; PAM type: NRG; PAM sequence: TAG
aaaatcttaactcagaatta

SEQ ID NO: 38009 - DNA, 20 bp, Artificial Sequence
  Description of Artificial Sequence: Synthetic oligonucleotide
  Target: SCN10A; (+) strand; PAM type: NRG; PAM sequence: AGG
aaatcttaactcagaattat

SEQ ID NO: 38010 - DNA, 20 bp, Artificial Sequence
  Description of Artificial Sequence: Synthetic oligonucleotide
  Target: SCN10A; (+) strand; PAM type: NRG; PAM sequence: TGG
aactcagaattataggttgt

SEQ ID NO: 38011 - DNA, 20 bp, Artificial Sequence
  Description of Artificial Sequence: Synthetic oligonucleotide
  Target: SCN10A; (+) strand; PAM type: NRG; PAM sequence: GGG
actcagaattataggttgtt

SEQ ID NO: 38012 - DNA, 20 bp, Artificial Sequence
  Description of Artificial Sequence: Synthetic oligonucleotide
  Target: SCN10A; (+) strand; PAM type: NRG; PAM sequence: AAG
cagaattataggttgttggg

SEQ ID NO: 38013 - DNA, 20 bp, Artificial Sequence
  Description of Artificial Sequence: Synthetic oligonucleotide
  Target: SCN10A; (+) strand; PAM type: NRG; PAM sequence: TGG
aggttgttgggaagctttga

SEQ ID NO: 38014 - DNA, 20 bp, Artificial Sequence
  Description of Artificial Sequence: Synthetic oligonucleotide
  Target: SCN10A; (+) strand; PAM type: NRG; PAM sequence: TGG
gaagctttgatggatatttc

SEQ ID NO: 38015 - DNA, 20 bp, Artificial Sequence
  Description of Artificial Sequence: Synthetic oligonucleotide
  Target: SCN10A; (+) strand; PAM type: NRG; PAM sequence: CAG
ctggtttgtcaaatcaaaca

SEQ ID NO: 38016 - DNA, 20 bp, Artificial Sequence
  Description of Artificial Sequence: Synthetic oligonucleotide
  Target: SCN10A; (+) strand; PAM type: NRG; PAM sequence: CAG
tgtcaaatcaaacacagacc

SEQ ID NO: 38017 - DNA, 20 bp, Artificial Sequence
  Description of Artificial Sequence: Synthetic oligonucleotide
  Target: SCN10A; (+) strand; PAM type: NRG; PAM sequence: TGG
aaacacagacccagaaatta

SEQ ID NO: 38018 - DNA, 20 bp, Artificial Sequence
  Description of Artificial Sequence: Synthetic oligonucleotide
  Target: SCN10A; (+) strand; PAM type: NRG; PAM sequence: GAG
acacagacccagaaattatg

SEQ ID NO: 38019 - DNA, 20 bp, Artificial Sequence
  Description of Artificial Sequence: Synthetic oligonucleotide
  Target: SCN10A; (+) strand; PAM type: NRG; PAM sequence: GAG
acagacccagaaattatgga

SEQ ID NO: 38020 - DNA, 20 bp, Artificial Sequence
  Description of Artificial Sequence: Synthetic oligonucleotide
  Target: SCN10A; (+) strand; PAM type: NRG; PAM sequence: GAG
agacccagaaattatggaga

SEQ ID NO: 38021 - DNA, 20 bp, Artificial Sequence
  Description of Artificial Sequence: Synthetic oligonucleotide
  Target: SCN10A; (+) strand; PAM type: NRG; PAM sequence: AAG
tatggagagagtgctctcta

SEQ ID NO: 38022 - DNA, 20 bp, Artificial Sequence
  Description of Artificial Sequence: Synthetic oligonucleotide
  Target: SCN10A; (+) strand; PAM type: NRG; PAM sequence: CAG
tgctctctaaagactatttt

SEQ ID NO: 38023 - DNA, 20 bp, Artificial Sequence
  Description of Artificial Sequence: Synthetic oligonucleotide
  Target: SCN10A; (+) strand; PAM type: NRG; PAM sequence: CAG
gactattttcagtgcttcac

SEQ ID NO: 38024 - DNA, 20 bp, Artificial Sequence
  Description of Artificial Sequence: Synthetic oligonucleotide
  Target: SCN10A; (+) strand; PAM type: NRG; PAM sequence: AAG
tattttcagtgcttcaccag

SEQ ID NO: 38025 - DNA, 20 bp, Artificial Sequence
  Description of Artificial Sequence: Synthetic oligonucleotide
  Target: SCN10A; (+) strand; PAM type: NRG; PAM sequence: AGG
attttcagtgcttcaccaga

SEQ ID NO: 38026 - DNA, 20 bp, Artificial Sequence
  Description of Artificial Sequence: Synthetic oligonucleotide
  Target: SCN10A; (+) strand; PAM type: NRG; PAM sequence: AAG
tcagtgcttcaccagaaggc

SEQ ID NO: 38027 - DNA, 20 bp, Artificial Sequence
  Description of Artificial Sequence: Synthetic oligonucleotide
  Target: SCN10A; (+) strand; PAM type: NRG; PAM sequence: CAG
tcaccagaaggcaagtgccc

SEQ ID NO: 38028 - DNA, 20 bp, Artificial Sequence
  Description of Artificial Sequence: Synthetic oligonucleotide
  Target: SCN10A; (+) strand; PAM type: NRG; PAM sequence: CAG
aggcaagtgccccagctcaa

SEQ ID NO: 38029 - DNA, 20 bp, Artificial Sequence
  Description of Artificial Sequence: Synthetic oligonucleotide
  Target: SCN10A; (+) strand; PAM type: NRG; PAM sequence: CAG
caagtgccccagctcaacag

SEQ ID NO: 38030 - DNA, 20 bp, Artificial Sequence
  Description of Artificial Sequence: Synthetic oligonucleotide
  Target: SCN10A; (+) strand; PAM type: NRG; PAM sequence: TGG
cccagctcaacagcagctaa

SEQ ID NO: 38031 - DNA, 20 bp, Artificial Sequence
  Description of Artificial Sequence: Synthetic oligonucleotide
  Target: SCN10A; (+) strand; PAM type: NRG; PAM sequence: GAG
cagctcaacagcagctaatg

SEQ ID NO: 38032 - DNA, 20 bp, Artificial Sequence
  Description of Artificial Sequence: Synthetic oligonucleotide
  Target: SCN10A; (+) strand; PAM type: NRG; PAM sequence: TGG
atggagttgcatcctctctt

SEQ ID NO: 38033 - DNA, 20 bp, Artificial Sequence
  Description of Artificial Sequence: Synthetic oligonucleotide
  Target: SCN10A; (+) strand; PAM type: NRG; PAM sequence: TGG
gagttgcatcctctctttgg

SEQ ID NO: 38034 - DNA, 20 bp, Artificial Sequence
  Description of Artificial Sequence: Synthetic oligonucleotide
  Target: SCN10A; (+) strand; PAM type: NRG; PAM sequence: TGG
atcctctctttggtggtatt

SEQ ID NO: 38035 - DNA, 20 bp, Artificial Sequence
  Description of Artificial Sequence: Synthetic oligonucleotide
  Target: SCN10A; (+) strand; PAM type: NRG; PAM sequence: AAG
ttggtggtatttggctctgc

SEQ ID NO: 38036 - DNA, 20 bp, Artificial Sequence
  Description of Artificial Sequence: Synthetic oligonucleotide
  Target: SCN10A; (+) strand; PAM type: NRG; PAM sequence: AGG
tggtggtatttggctctgca

SEQ ID NO: 38037 - DNA, 20 bp, Artificial Sequence
  Description of Artificial Sequence: Synthetic oligonucleotide
  Target: SCN10A; (+) strand; PAM type: NRG; PAM sequence: TGG
tgcaaggtatttcttgatgt

SEQ ID NO: 38038 - DNA, 20 bp, Artificial Sequence
  Description of Artificial Sequence: Synthetic oligonucleotide
  Target: SCN10A; (+) strand; PAM type: NRG; PAM sequence: GGG
gcaaggtatttcttgatgtt

SEQ ID NO: 38039 - DNA, 20 bp, Artificial Sequence
  Description of Artificial Sequence: Synthetic oligonucleotide
  Target: SCN10A; (+) strand; PAM type: NRG; PAM sequence: CAG
tatttcttgatgttgggttg

SEQ ID NO: 38040 - DNA, 20 bp, Artificial Sequence
  Description of Artificial Sequence: Synthetic oligonucleotide
  Target: SCN10A; (+) strand; PAM type: NRG; PAM sequence: CAG
tgatgttgggttgcagcatt

SEQ ID NO: 38041 - DNA, 20 bp, Artificial Sequence
  Description of Artificial Sequence: Synthetic oligonucleotide
  Target: SCN10A; (+) strand; PAM type: NRG; PAM sequence: AAG
attcagatgtaatttttaat

SEQ ID NO: 38042 - DNA, 20 bp, Artificial Sequence
  Description of Artificial Sequence: Synthetic oligonucleotide
  Target: SCN10A; (+) strand; PAM type: NRG; PAM sequence: AAG
agcccaatgtgttatttcct

SEQ ID NO: 38043 - DNA, 20 bp, Artificial Sequence
  Description of Artificial Sequence: Synthetic oligonucleotide
  Target: SCN10A; (+) strand; PAM type: NRG; PAM sequence: TGG
tatttcctaagtgctttttc

SEQ ID NO: 38044 - DNA, 20 bp, Artificial Sequence
  Description of Artificial Sequence: Synthetic oligonucleotide
  Target: SCN10A; (+) strand; PAM type: NRG; PAM sequence: AAG
agtgctttttctggtgaatg

SEQ ID NO: 38045 - DNA, 20 bp, Artificial Sequence
  Description of Artificial Sequence: Synthetic oligonucleotide
  Target: SCN10A; (+) strand; PAM type: NRG; PAM sequence: TGG
tggtgaatgaagaaaatcat

SEQ ID NO: 38046 - DNA, 20 bp, Artificial Sequence
  Description of Artificial Sequence: Synthetic oligonucleotide
  Target: SCN10A; (+) strand; PAM type: NRG; PAM sequence: GGG
ggtgaatgaagaaaatcatt

SEQ ID NO: 38047 - DNA, 20 bp, Artificial Sequence
  Description of Artificial Sequence: Synthetic oligonucleotide
  Target: SCN10A; (+) strand; PAM type: NRG; PAM sequence: TGG
tgaagaaaatcattgggtat

SEQ ID NO: 38048 - DNA, 20 bp, Artificial Sequence
  Description of Artificial Sequence: Synthetic oligonucleotide
  Target: SCN10A; (+) strand; PAM type: NRG; PAM sequence: GGG
gaagaaaatcattgggtatt

SEQ ID NO: 38049 - DNA, 20 bp, Artificial Sequence
  Description of Artificial Sequence: Synthetic oligonucleotide
  Target: SCN10A; (+) strand; PAM type: NRG; PAM sequence: AAG
aatcattgggtattgggaaa

SEQ ID NO: 38050 - DNA, 20 bp, Artificial Sequence
  Description of Artificial Sequence: Synthetic oligonucleotide
  Target: SCN10A; (+) strand; PAM type: NRG; PAM sequence: AAG
ttgggtattgggaaaaagtc

SEQ ID NO: 38051 - DNA, 20 bp, Artificial Sequence
  Description of Artificial Sequence: Synthetic oligonucleotide
  Target: SCN10A; (+) strand; PAM type: NRG; PAM sequence: CAG
ttgggaaaaagtcaagttct

SEQ ID NO: 38052 - DNA, 20 bp, Artificial Sequence
  Description of Artificial Sequence: Synthetic oligonucleotide
  Target: SCN10A; (+) strand; PAM type: NRG; PAM sequence: GAG
aagtcaagttctcagccgtt

SEQ ID NO: 38053 - DNA, 20 bp, Artificial Sequence
  Description of Artificial Sequence: Synthetic oligonucleotide
  Target: SCN10A; (+) strand; PAM type: NRG; PAM sequence: CAG
ttgttacaaatcccgatatt

SEQ ID NO: 38054 - DNA, 20 bp, Artificial Sequence
  Description of Artificial Sequence: Synthetic oligonucleotide
  Target: SCN10A; (+) strand; PAM type: NRG; PAM sequence: AGG
tgttacaaatcccgatattc

SEQ ID NO: 38055 - DNA, 20 bp, Artificial Sequence
  Description of Artificial Sequence: Synthetic oligonucleotide
  Target: SCN10A; (+) strand; PAM type: NRG; PAM sequence: AAG
atattcaggctctgaaaaca

SEQ ID NO: 38056 - DNA, 20 bp, Artificial Sequence
  Description of Artificial Sequence: Synthetic oligonucleotide
  Target: SCN10A; (+) strand; PAM type: NRG; PAM sequence: TGG
cataatattcaaattctgaa

SEQ ID NO: 38057 - DNA, 20 bp, Artificial Sequence
  Description of Artificial Sequence: Synthetic oligonucleotide
  Target: SCN10A; (+) strand; PAM type: NRG; PAM sequence: GAG
caaattctgaatggatcact

SEQ ID NO: 38058 - DNA, 20 bp, Artificial Sequence
  Description of Artificial Sequence: Synthetic oligonucleotide
  Target: SCN10A; (+) strand; PAM type: NRG; PAM sequence: TGG
ccaacttgtattcataaaaa

SEQ ID NO: 38059 - DNA, 20 bp, Artificial Sequence
  Description of Artificial Sequence: Synthetic oligonucleotide
  Target: SCN10A; (+) strand; PAM type: NRG; PAM sequence: AAG
ttatttttaaaactctgtgt

SEQ ID NO: 38060 - DNA, 20 bp, Artificial Sequence
  Description of Artificial Sequence: Synthetic oligonucleotide
  Target: SCN10A; (+) strand; PAM type: NRG; PAM sequence: CAG
tgtaagcccttcccatttgc

SEQ ID NO: 38061 - DNA, 20 bp, Artificial Sequence
  Description of Artificial Sequence: Synthetic oligonucleotide
  Target: SCN10A; (+) strand; PAM type: NRG; PAM sequence: AAG
cccttcccatttgccagcca

SEQ ID NO: 38062 - DNA, 20 bp, Artificial Sequence
  Description of Artificial Sequence: Synthetic oligonucleotide
  Target: SCN10A; (+) strand; PAM type: NRG; PAM sequence: CAG
atttgccagccaaagcaatt

SEQ ID NO: 38063 - DNA, 20 bp, Artificial Sequence
  Description of Artificial Sequence: Synthetic oligonucleotide
  Target: SCN10A; (+) strand; PAM type: NRG; PAM sequence: TGG
ccagccaaagcaattcagtg

SEQ ID NO: 38064 - DNA, 20 bp, Artificial Sequence
  Description of Artificial Sequence: Synthetic oligonucleotide
  Target: SCN10A; (+) strand; PAM type: NRG; PAM sequence: GGG
cagccaaagcaattcagtgt

SEQ ID NO: 38065 - DNA, 20 bp, Artificial Sequence
  Description of Artificial Sequence: Synthetic oligonucleotide
  Target: SCN10A; (+) strand; PAM type: NRG; PAM sequence: GAG
gccaaagcaattcagtgtgg

SEQ ID NO: 38066 - DNA, 20 bp, Artificial Sequence
  Description of Artificial Sequence: Synthetic oligonucleotide
  Target: SCN10A; (+) strand; PAM type: NRG; PAM sequence: GAG
caaagcaattcagtgtggga

SEQ ID NO: 38067 - DNA, 20 bp, Artificial Sequence
  Description of Artificial Sequence: Synthetic oligonucleotide
  Target: SCN10A; (+) strand; PAM type: NRG; PAM sequence: CAG
agcaattcagtgtgggagag

SEQ ID NO: 38068 - DNA, 20 bp, Artificial Sequence
  Description of Artificial Sequence: Synthetic oligonucleotide
  Target: SCN10A; (+) strand; PAM type: NRG; PAM sequence: CAG
ctcttactcacttttcattt

SEQ ID NO: 38069 - DNA, 20 bp, Artificial Sequence
  Description of Artificial Sequence: Synthetic oligonucleotide
  Target: SCN10A; (+) strand; PAM type: NRG; PAM sequence: CAG
actcacttttcatttcagcc

SEQ ID NO: 38070 - DNA, 20 bp, Artificial Sequence
  Description of Artificial Sequence: Synthetic oligonucleotide
  Target: SCN10A; (+) strand; PAM type: NRG; PAM sequence: TAG
cacttttcatttcagcccag

SEQ ID NO: 38071 - DNA, 20 bp, Artificial Sequence
  Description of Artificial Sequence: Synthetic oligonucleotide
  Target: SCN10A; (+) strand; PAM type: NRG; PAM sequence: AGG
acttttcatttcagcccagt

SEQ ID NO: 38072 - DNA, 20 bp, Artificial Sequence
  Description of Artificial Sequence: Synthetic oligonucleotide
  Target: SCN10A; (+) strand; PAM type: NRG; PAM sequence: AAG
catttcagcccagtaggcca

SEQ ID NO: 38073 - DNA, 20 bp, Artificial Sequence
  Description of Artificial Sequence: Synthetic oligonucleotide
  Target: SCN10A; (+) strand; PAM type: NRG; PAM sequence: GAG
tttcagcccagtaggccaaa

SEQ ID NO: 38074 - DNA, 20 bp, Artificial Sequence
  Description of Artificial Sequence: Synthetic oligonucleotide
  Target: SCN10A; (+) strand; PAM type: NRG; PAM sequence: AAG
aggccaaagagatgtacact

SEQ ID NO: 38075 - DNA, 20 bp, Artificial Sequence
  Description of Artificial Sequence: Synthetic oligonucleotide
  Target: SCN10A; (+) strand; PAM type: NRG; PAM sequence: CAG
gtacactaagtgaccacaat

SEQ ID NO: 38076 - DNA, 20 bp, Artificial Sequence
  Description of Artificial Sequence: Synthetic oligonucleotide
  Target: SCN10A; (+) strand; PAM type: NRG; PAM sequence: CAG
atttccactgtgtacctcaa

SEQ ID NO: 38077 - DNA, 20 bp, Artificial Sequence
  Description of Artificial Sequence: Synthetic oligonucleotide
  Target: SCN10A; (+) strand; PAM type: NRG; PAM sequence: CAG
tgtgtacctcaacagcaaat

SEQ ID NO: 38078 - DNA, 20 bp, Artificial Sequence
  Description of Artificial Sequence: Synthetic oligonucleotide
  Target: SCN10A; (+) strand; PAM type: NRG; PAM sequence: TGG
ctcaacagcaaatcagaatc

SEQ ID NO: 38079 - DNA, 20 bp, Artificial Sequence
  Description of Artificial Sequence: Synthetic oligonucleotide
  Target: SCN10A; (+) strand; PAM type: NRG; PAM sequence: GAG
caacagcaaatcagaatctg

SEQ ID NO: 38080 - DNA, 20 bp, Artificial Sequence
  Description of Artificial Sequence: Synthetic oligonucleotide
  Target: SCN10A; (+) strand; PAM type: NRG; PAM sequence: AGG
aacagcaaatcagaatctgg

SEQ ID NO: 38081 - DNA, 20 bp, Artificial Sequence
  Description of Artificial Sequence: Synthetic oligonucleotide
  Target: SCN10A; (+) strand; PAM type: NRG; PAM sequence: CAG
cagaatctggaggcatatta

SEQ ID NO: 38082 - DNA, 20 bp, Artificial Sequence
  Description of Artificial Sequence: Synthetic oligonucleotide
  Target: SCN10A; (+) strand; PAM type: NRG; PAM sequence: CAG
ggaggcatattacagacccc

SEQ ID NO: 38083 - DNA, 20 bp, Artificial Sequence
  Description of Artificial Sequence: Synthetic oligonucleotide
  Target: SCN10A; (+) strand; PAM type: NRG; PAM sequence: AAG
cccagctgcgttccgtgaat

SEQ ID NO: 38084 - DNA, 20 bp, Artificial Sequence
  Description of Artificial Sequence: Synthetic oligonucleotide
  Target: SCN10A; (+) strand; PAM type: NRG; PAM sequence: AGG
ccagctgcgttccgtgaata

SEQ ID NO: 38085 - DNA, 20 bp, Artificial Sequence
  Description of Artificial Sequence: Synthetic oligonucleotide
  Target: SCN10A; (+) strand; PAM type: NRG; PAM sequence: TAG
tccgtgaataaggtatgcac

SEQ ID NO: 38086 - DNA, 20 bp, Artificial Sequence
  Description of Artificial Sequence: Synthetic oligonucleotide
  Target: SCN10A; (+) strand; PAM type: NRG; PAM sequence: TGG
aataaggtatgcactagcat

SEQ ID NO: 38087 - DNA, 20 bp, Artificial Sequence
  Description of Artificial Sequence: Synthetic oligonucleotide
  Target: SCN10A; (+) strand; PAM type: NRG; PAM sequence: GGG
ataaggtatgcactagcatt

SEQ ID NO: 38088 - DNA, 20 bp, Artificial Sequence
  Description of Artificial Sequence: Synthetic oligonucleotide
  Target: SCN10A; (+) strand; PAM type: NRG; PAM sequence: TGG
tatgcactagcattgggatc

SEQ ID NO: 38089 - DNA, 20 bp, Artificial Sequence
  Description of Artificial Sequence: Synthetic oligonucleotide
  Target: SCN10A; (+) strand; PAM type: NRG; PAM sequence: GGG
atgcactagcattgggatct

SEQ ID NO: 38090 - DNA, 20 bp, Artificial Sequence
  Description of Artificial Sequence: Synthetic oligonucleotide
  Target: SCN10A; (+) strand; PAM type: NRG; PAM sequence: GAG
gcactagcattgggatctgg

SEQ ID NO: 38091 - DNA, 20 bp, Artificial Sequence
  Description of Artificial Sequence: Synthetic oligonucleotide
  Target: SCN10A; (+) strand; PAM type: NRG; PAM sequence: CAG
ctagcattgggatctgggag

SEQ ID NO: 38092 - DNA, 20 bp, Artificial Sequence
  Description of Artificial Sequence: Synthetic oligonucleotide
  Target: SCN10A; (+) strand; PAM type: NRG; PAM sequence: TGG
tgggagcagcatcttctatc

SEQ ID NO: 38093 - DNA, 20 bp, Artificial Sequence
  Description of Artificial Sequence: Synthetic oligonucleotide
  Target: SCN10A; (+) strand; PAM type: NRG; PAM sequence: TAG
agcagcatcttctatctgga

SEQ ID NO: 38094 - DNA, 20 bp, Artificial Sequence
  Description of Artificial Sequence: Synthetic oligonucleotide
  Target: SCN10A; (+) strand; PAM type: NRG; PAM sequence: TGG
acctttccttgctgaccatg

SEQ ID NO: 38095 - DNA, 20 bp, Artificial Sequence
  Description of Artificial Sequence: Synthetic oligonucleotide
  Target: SCN10A; (+) strand; PAM type: NRG; PAM sequence: TGG
ttccttgctgaccatgtggc

SEQ ID NO: 38096 - DNA, 20 bp, Artificial Sequence
  Description of Artificial Sequence: Synthetic oligonucleotide
  Target: SCN10A; (+) strand; PAM type: NRG; PAM sequence: GAG
ccttgctgaccatgtggctg

SEQ ID NO: 38097 - DNA, 20 bp, Artificial Sequence
  Description of Artificial Sequence: Synthetic oligonucleotide
  Target: SCN10A; (+) strand; PAM type: NRG; PAM sequence: TGG
tgtggctggagtttcttcaa

SEQ ID NO: 38098 - DNA, 20 bp, Artificial Sequence
  Description of Artificial Sequence: Synthetic oligonucleotide
  Target: SCN10A; (+) strand; PAM type: NRG; PAM sequence: AAG
acctttcctcttttaaaaaa

SEQ ID NO: 38099 - DNA, 20 bp, Artificial Sequence
  Description of Artificial Sequence: Synthetic oligonucleotide
  Target: SCN10A; (+) strand; PAM type: NRG; PAM sequence: TGG
cctcttttaaaaaaaagttt

SEQ ID NO: 38100 - DNA, 20 bp, Artificial Sequence
  Description of Artificial Sequence: Synthetic oligonucleotide
  Target: SCN10A; (+) strand; PAM type: NRG; PAM sequence: AAG
ttaccactttcaccattttt

SEQ ID NO: 38101 - DNA, 20 bp, Artificial Sequence
  Description of Artificial Sequence: Synthetic oligonucleotide
  Target: SCN10A; (+) strand; PAM type: NRG; PAM sequence: TAG
ccatttttaagtacacaatt

SEQ ID NO: 38102 - DNA, 20 bp, Artificial Sequence
  Description of Artificial Sequence: Synthetic oligonucleotide
  Target: SCN10A; (+) strand; PAM type: NRG; PAM sequence: TGG
tttttaagtacacaatttag

SEQ ID NO: 38103 - DNA, 20 bp, Artificial Sequence
  Description of Artificial Sequence: Synthetic oligonucleotide
  Target: SCN10A; (+) strand; PAM type: NRG; PAM sequence: AAG
gtacacaatttagtggcatt

SEQ ID NO: 38104 - DNA, 20 bp, Artificial Sequence
  Description of Artificial Sequence: Synthetic oligonucleotide
  Target: SCN10A; (+) strand; PAM type: NRG; PAM sequence: CAG
ttagtggcattaagtacatt

SEQ ID NO: 38105 - DNA, 20 bp, Artificial Sequence
  Description of Artificial Sequence: Synthetic oligonucleotide
  Target: SCN10A; (+) strand; PAM type: NRG; PAM sequence: TGG
attaagtacattcagtattg

SEQ ID NO: 38106 - DNA, 20 bp, Artificial Sequence
  Description of Artificial Sequence: Synthetic oligonucleotide
  Target: SCN10A; (+) strand; PAM type: NRG; PAM sequence: CAG
aacttttttataatcccgaa

SEQ ID NO: 38107 - DNA, 20 bp, Artificial Sequence
  Description of Artificial Sequence: Synthetic oligonucleotide
  Target: SCN10A; (+) strand; PAM type: NRG; PAM sequence: TGG
aactccccattccccctctc

SEQ ID NO: 38108 - DNA, 20 bp, Artificial Sequence
  Description of Artificial Sequence: Synthetic oligonucleotide
  Target: SCN10A; (+) strand; PAM type: NRG; PAM sequence: TAG
ctccatgaatttgcctgttc

SEQ ID NO: 38109 - DNA, 20 bp, Artificial Sequence
  Description of Artificial Sequence: Synthetic oligonucleotide
  Target: SCN10A; (+) strand; PAM type: NRG; PAM sequence: AGG
tccatgaatttgcctgttct

SEQ ID NO: 38110 - DNA, 20 bp, Artificial Sequence
  Description of Artificial Sequence: Synthetic oligonucleotide
  Target: SCN10A; (+) strand; PAM type: NRG; PAM sequence: AAG
cctgttctaggtacctacta

SEQ ID NO: 38111 - DNA, 20 bp, Artificial Sequence
  Description of Artificial Sequence: Synthetic oligonucleotide
  Target: SCN10A; (+) strand; PAM type: NRG; PAM sequence: AGG
ctgttctaggtacctactaa

SEQ ID NO: 38112 - DNA, 20 bp, Artificial Sequence
  Description of Artificial Sequence: Synthetic oligonucleotide
  Target: SCN10A; (+) strand; PAM type: NRG; PAM sequence: TGG
ttctaggtacctactaaagg

SEQ ID NO: 38113 - DNA, 20 bp, Artificial Sequence
  Description of Artificial Sequence: Synthetic oligonucleotide
  Target: SCN10A; (+) strand; PAM type: NRG; PAM sequence: GAG
acatttgttcttttgcgttt

SEQ ID NO: 38114 - DNA, 20 bp, Artificial Sequence
  Description of Artificial Sequence: Synthetic oligonucleotide
  Target: SCN10A; (+) strand; PAM type: NRG; PAM sequence: TAG
tgcgtttgagttattttact

SEQ ID NO: 38115 - DNA, 20 bp, Artificial Sequence
  Description of Artificial Sequence: Synthetic oligonucleotide
  Target: SCN10A; (+) strand; PAM type: NRG; PAM sequence: TGG
acaatgctttgtcaatgttg

SEQ ID NO: 38116 - DNA, 20 bp, Artificial Sequence
  Description of Artificial Sequence: Synthetic oligonucleotide
  Target: SCN10A; (+) strand; PAM type: NRG; PAM sequence: CAG
gtcaatgttgtggcatgtat

SEQ ID NO: 38117 - DNA, 20 bp, Artificial Sequence
  Description of Artificial Sequence: Synthetic oligonucleotide
  Target: SCN10A; (+) strand; PAM type: NRG; PAM sequence: TGG
tttatccattcatctgttga

SEQ ID NO: 38118 - DNA, 20 bp, Artificial Sequence
  Description of Artificial Sequence: Synthetic oligonucleotide
  Target: SCN10A; (+) strand; PAM type: NRG; PAM sequence: TGG
catctgttgatggacatatt

SEQ ID NO: 38119 - DNA, 20 bp, Artificial Sequence
  Description of Artificial Sequence: Synthetic oligonucleotide
  Target: SCN10A; (+) strand; PAM type: NRG; PAM sequence: TAG
aataacgctgctacaaacat

SEQ ID NO: 38120 - DNA, 20 bp, Artificial Sequence
  Description of Artificial Sequence: Synthetic oligonucleotide
  Target: SCN10A; (+) strand; PAM type: NRG; PAM sequence: AAG
tgctacaaacattagtgcat

SEQ ID NO: 38121 - DNA, 20 bp, Artificial Sequence
  Description of Artificial Sequence: Synthetic oligonucleotide
  Target: SCN10A; (+) strand; PAM type: NRG; PAM sequence: AAG
ataagccaacatacctttta

SEQ ID NO: 38122 - DNA, 20 bp, Artificial Sequence
  Description of Artificial Sequence: Synthetic oligonucleotide
  Target: SCN10A; (+) strand; PAM type: NRG; PAM sequence: TAG
accttttaaagtctgtttca

SEQ ID NO: 38123 - DNA, 20 bp, Artificial Sequence
  Description of Artificial Sequence: Synthetic oligonucleotide
  Target: SCN10A; (+) strand; PAM type: NRG; PAM sequence: AGG
ccttttaaagtctgtttcat

SEQ ID NO: 38124 - DNA, 20 bp, Artificial Sequence
  Description of Artificial Sequence: Synthetic oligonucleotide
  Target: SCN10A; (+) strand; PAM type: NRG; PAM sequence: CAG
aaactaatttttaattaaac

SEQ ID NO: 38125 - DNA, 20 bp, Artificial Sequence
  Description of Artificial Sequence: Synthetic oligonucleotide
  Target: SCN10A; (+) strand; PAM type: NRG; PAM sequence: GAG
actaatttttaattaaacca

SEQ ID NO: 38126 - DNA, 20 bp, Artificial Sequence
  Description of Artificial Sequence: Synthetic oligonucleotide
  Target: SCN10A; (+) strand; PAM type: NRG; PAM sequence: GAG
taatttttaattaaaccaga

SEQ ID NO: 38127 - DNA, 20 bp, Artificial Sequence
  Description of Artificial Sequence: Synthetic oligonucleotide
  Target: SCN10A; (+) strand; PAM type: NRG; PAM sequence: TAG
gagagctcttcttttaaaat

SEQ ID NO: 38128 - DNA, 20 bp, Artificial Sequence
  Description of Artificial Sequence: Synthetic oligonucleotide
  Target: SCN10A; (+) strand; PAM type: NRG; PAM sequence: TAG
aaaattagcttcatgataaa

SEQ ID NO: 38129 - DNA, 20 bp, Artificial Sequence
  Description of Artificial Sequence: Synthetic oligonucleotide
  Target: SCN10A; (+) strand; PAM type: NRG; PAM sequence: AAG
ttcatgataaatagaacaaa

SEQ ID NO: 38130 - DNA, 20 bp, Artificial Sequence
  Description of Artificial Sequence: Synthetic oligonucleotide
  Target: SCN10A; (+) strand; PAM type: NRG; PAM sequence: GAG
aaatagaacaaaaagtcact

SEQ ID NO: 38131 - DNA, 20 bp, Artificial Sequence
  Description of Artificial Sequence: Synthetic oligonucleotide
  Target: SCN10A; (+) strand; PAM type: NRG; PAM sequence: TAG
ctgagtctttcccatatata

SEQ ID NO: 38132 - DNA, 20 bp, Artificial Sequence
  Description of Artificial Sequence: Synthetic oligonucleotide
  Target: SCN10A; (+) strand; PAM type: NRG; PAM sequence: AAG
tctttcccatatatatagtg

SEQ ID NO: 38133 - DNA, 20 bp, Artificial Sequence
  Description of Artificial Sequence: Synthetic oligonucleotide
  Target: SCN10A; (+) strand; PAM type: NRG; PAM sequence: TAG
gctgacaacttacttattca

SEQ ID NO: 38134 - DNA, 20 bp, Artificial Sequence
  Description of Artificial Sequence: Synthetic oligonucleotide
  Target: SCN10A; (+) strand; PAM type: NRG; PAM sequence: CAG
atgtctgctcgtatacctaa

SEQ ID NO: 38135 - DNA, 20 bp, Artificial Sequence
  Description of Artificial Sequence: Synthetic oligonucleotide
  Target: SCN10A; (+) strand; PAM type: NRG; PAM sequence: CAG
cagtcattgactttaaatgc

SEQ ID NO: 38136 - DNA, 20 bp, Artificial Sequence
  Description of Artificial Sequence: Synthetic oligonucleotide
  Target: SCN10A; (+) strand; PAM type: NRG; PAM sequence: AAG
ttaaatgccagtcacattat

SEQ ID NO: 38137 - DNA, 20 bp, Artificial Sequence
  Description of Artificial Sequence: Synthetic oligonucleotide
  Target: SCN10A; (+) strand; PAM type: NRG; PAM sequence: AGG
taaatgccagtcacattata

SEQ ID NO: 38138 - DNA, 20 bp, Artificial Sequence
  Description of Artificial Sequence: Synthetic oligonucleotide
  Target: SCN10A; (+) strand; PAM type: NRG; PAM sequence: AAG
ggaatgcaatacttctaatt

SEQ ID NO: 38139 - DNA, 20 bp, Artificial Sequence
  Description of Artificial Sequence: Synthetic oligonucleotide
  Target: SCN10A; (+) strand; PAM type: NRG; PAM sequence: AGG
gaatgcaatacttctaatta

SEQ ID NO: 38140 - DNA, 20 bp, Artificial Sequence
  Description of Artificial Sequence: Synthetic oligonucleotide
  Target: SCN10A; (+) strand; PAM type: NRG; PAM sequence: TGG
cacaatatttgtaattgatt

SEQ ID NO: 38141 - DNA, 20 bp, Artificial Sequence
  Description of Artificial Sequence: Synthetic oligonucleotide
  Target: SCN10A; (+) strand; PAM type: NRG; PAM sequence: TGG
tttgtaattgatttggaaac

SEQ ID NO: 38142 - DNA, 20 bp, Artificial Sequence
  Description of Artificial Sequence: Synthetic oligonucleotide
  Target: SCN10A; (+) strand; PAM type: NRG; PAM sequence: CAG
aaactggttttgtatcttac

SEQ ID NO: 38143 - DNA, 20 bp, Artificial Sequence
  Description of Artificial Sequence: Synthetic oligonucleotide
  Target: SCN10A; (+) strand; PAM type: NRG; PAM sequence: CAG
ctggttttgtatcttaccag

SEQ ID NO: 38144 - DNA, 20 bp, Artificial Sequence
  Description of Artificial Sequence: Synthetic oligonucleotide
  Target: SCN10A; (+) strand; PAM type: NRG; PAM sequence: AGG
tggttttgtatcttaccagc

SEQ ID NO: 38145 - DNA, 20 bp, Artificial Sequence
  Description of Artificial Sequence: Synthetic oligonucleotide
  Target: SCN10A; (+) strand; PAM type: NRG; PAM sequence: GAG
gttttgtatcttaccagcag

SEQ ID NO: 38146 - DNA, 20 bp, Artificial Sequence
  Description of Artificial Sequence: Synthetic oligonucleotide
  Target: SCN10A; (+) strand; PAM type: NRG; PAM sequence: GAG
attgtgcttatttttgatat

SEQ ID NO: 38147 - DNA, 20 bp, Artificial Sequence
  Description of Artificial Sequence: Synthetic oligonucleotide
  Target: SCN10A; (+) strand; PAM type: NRG; PAM sequence: AGG
ttgtgcttatttttgatatg

SEQ ID NO: 38148 - DNA, 20 bp, Artificial Sequence
  Description of Artificial Sequence: Synthetic oligonucleotide
  Target: SCN10A; (+) strand; PAM type: NRG; PAM sequence: TAG
gaggatgaatgatgactcta

SEQ ID NO: 38149 - DNA, 20 bp, Artificial Sequence
  Description of Artificial Sequence: Synthetic oligonucleotide
  Target: SCN10A; (+) strand; PAM type: NRG; PAM sequence: TGG
aaattttcacaattttatac

SEQ ID NO: 38150 - DNA, 20 bp, Artificial Sequence
  Description of Artificial Sequence: Synthetic oligonucleotide
  Target: SCN10A; (+) strand; PAM type: NRG; PAM sequence: GGG
aattttcacaattttatact

SEQ ID NO: 38151 - DNA, 20 bp, Artificial Sequence
  Description of Artificial Sequence: Synthetic oligonucleotide
  Target: SCN10A; (+) strand; PAM type: NRG; PAM sequence: AAG
ttcacaattttatactggga

SEQ ID NO: 38152 - DNA, 20 bp, Artificial Sequence
  Description of Artificial Sequence: Synthetic oligonucleotide
  Target: SCN10A; (+) strand; PAM type: NRG; PAM sequence: TAG
aaagccttattttgtgcttg

SEQ ID NO: 38153 - DNA, 20 bp, Artificial Sequence
  Description of Artificial Sequence: Synthetic oligonucleotide
  Target: SCN10A; (+) strand; PAM type: NRG; PAM sequence: TAG
gccttattttgtgcttgtag

SEQ ID NO: 38154 - DNA, 20 bp, Artificial Sequence
  Description of Artificial Sequence: Synthetic oligonucleotide
  Target: SCN10A; (+) strand; PAM type: NRG; PAM sequence: GAG
cttattttgtgcttgtagta

SEQ ID NO: 38155 - DNA, 20 bp, Artificial Sequence
  Description of Artificial Sequence: Synthetic oligonucleotide
  Target: SCN10A; (+) strand; PAM type: NRG; PAM sequence: TGG
ttgtagtagagatattcaat

SEQ ID NO: 38156 - DNA, 20 bp, Artificial Sequence
  Description of Artificial Sequence: Synthetic oligonucleotide
  Target: SCN10A; (+) strand; PAM type: NRG; PAM sequence: AAG
gagatattcaattggtttaa

SEQ ID NO: 38157 - DNA, 20 bp, Artificial Sequence
  Description of Artificial Sequence: Synthetic oligonucleotide
  Target: SCN10A; (+) strand; PAM type: NRG; PAM sequence: TGG
atattcaattggtttaaaag

SEQ ID NO: 38158 - DNA, 20 bp, Artificial Sequence
  Description of Artificial Sequence: Synthetic oligonucleotide
  Target: SCN10A; (+) strand; PAM type: NRG; PAM sequence: GGG
tattcaattggtttaaaagt

SEQ ID NO: 38159 - DNA, 20 bp, Artificial Sequence
  Description of Artificial Sequence: Synthetic oligonucleotide
  Target: SCN10A; (+) strand; PAM type: NRG; PAM sequence: GGG
attcaattggtttaaaagtg

SEQ ID NO: 38160 - DNA, 20 bp, Artificial Sequence
  Description of Artificial Sequence: Synthetic oligonucleotide
  Target: SCN10A; (+) strand; PAM type: NRG; PAM sequence: TGG
gtggggttgataaactttat

SEQ ID NO: 38161 - DNA, 20 bp, Artificial Sequence
  Description of Artificial Sequence: Synthetic oligonucleotide
  Target: SCN10A; (+) strand; PAM type: NRG; PAM sequence: TGG
aactttattggaaaataata

SEQ ID NO: 38162 - DNA, 20 bp, Artificial Sequence
  Description of Artificial Sequence: Synthetic oligonucleotide
  Target: SCN10A; (+) strand; PAM type: NRG; PAM sequence: AAG
tttattggaaaataatatgg

SEQ ID NO: 38163 - DNA, 20 bp, Artificial Sequence
  Description of Artificial Sequence: Synthetic oligonucleotide
  Target: SCN10A; (+) strand; PAM type: NRG; PAM sequence: TAG
aaataatatggaagttttga

SEQ ID NO: 38164 - DNA, 20 bp, Artificial Sequence
  Description of Artificial Sequence: Synthetic oligonucleotide
  Target: SCN10A; (+) strand; PAM type: NRG; PAM sequence: TAG
tcattacttgacaaaaacgt

SEQ ID NO: 38165 - DNA, 20 bp, Artificial Sequence
  Description of Artificial Sequence: Synthetic oligonucleotide
  Target: SCN10A; (+) strand; PAM type: NRG; PAM sequence: CAG
ttacttgacaaaaacgttag

SEQ ID NO: 38166 - DNA, 20 bp, Artificial Sequence
  Description of Artificial Sequence: Synthetic oligonucleotide
  Target: SCN10A; (+) strand; PAM type: NRG; PAM sequence: TGG
aacgttagcagataataaat

SEQ ID NO: 38167 - DNA, 20 bp, Artificial Sequence
  Description of Artificial Sequence: Synthetic oligonucleotide
  Target: SCN10A; (+) strand; PAM type: NRG; PAM sequence: GGG
acgttagcagataataaatt

SEQ ID NO: 38168 - DNA, 20 bp, Artificial Sequence
  Description of Artificial Sequence: Synthetic oligonucleotide
  Target: SCN10A; (+) strand; PAM type: NRG; PAM sequence: TAG
gcagataataaattgggtac

SEQ ID NO: 38169 - DNA, 20 bp, Artificial Sequence
  Description of Artificial Sequence: Synthetic oligonucleotide
  Target: SCN10A; (+) strand; PAM type: NRG; PAM sequence: AGG
cagataataaattgggtact

SEQ ID NO: 38170 - DNA, 20 bp, Artificial Sequence
  Description of Artificial Sequence: Synthetic oligonucleotide
  Target: SCN10A; (+) strand; PAM type: NRG; PAM sequence: AAG
taaattgggtactaggacaa

SEQ ID NO: 38171 - DNA, 20 bp, Artificial Sequence
  Description of Artificial Sequence: Synthetic oligonucleotide
  Target: SCN10A; (+) strand; PAM type: NRG; PAM sequence: AGG
aaattgggtactaggacaaa

SEQ ID NO: 38172 - DNA, 20 bp, Artificial Sequence
  Description of Artificial Sequence: Synthetic oligonucleotide
  Target: SCN10A; (+) strand; PAM type: NRG; PAM sequence: TGG
tactaggacaaaaggatcat

SEQ ID NO: 38173 - DNA, 20 bp, Artificial Sequence
  Description of Artificial Sequence: Synthetic oligonucleotide
  Target: SCN10A; (+) strand; PAM type: NRG; PAM sequence: TGG
attatcattattcattgtca

SEQ ID NO: 38174 - DNA, 20 bp, Artificial Sequence
  Description of Artificial Sequence: Synthetic oligonucleotide
  Target: SCN10A; (+) strand; PAM type: NRG; PAM sequence: TGG
ttttcttatatatttttgtc

SEQ ID NO: 38175 - DNA, 20 bp, Artificial Sequence
  Description of Artificial Sequence: Synthetic oligonucleotide
  Target: SCN10A; (+) strand; PAM type: NRG; PAM sequence: TGG
tatatatttttgtctggttt

SEQ ID NO: 38176 - DNA, 20 bp, Artificial Sequence
  Description of Artificial Sequence: Synthetic oligonucleotide
  Target: SCN10A; (+) strand; PAM type: NRG; PAM sequence: GGG
atatatttttgtctggtttt

SEQ ID NO: 38177 - DNA, 20 bp, Artificial Sequence
  Description of Artificial Sequence: Synthetic oligonucleotide
  Target: SCN10A; (+) strand; PAM type: NRG; PAM sequence: GAG
atatttttgtctggttttgg

SEQ ID NO: 38178 - DNA, 20 bp, Artificial Sequence
  Description of Artificial Sequence: Synthetic oligonucleotide
  Target: SCN10A; (+) strand; PAM type: NRG; PAM sequence: CAG
tccacttgtctcatgacaaa

SEQ ID NO: 38179 - DNA, 20 bp, Artificial Sequence
  Description of Artificial Sequence: Synthetic oligonucleotide
  Target: SCN10A; (+) strand; PAM type: NRG; PAM sequence: TGG
catgctttgtatttttacaa

SEQ ID NO: 38180 - DNA, 20 bp, Artificial Sequence
  Description of Artificial Sequence: Synthetic oligonucleotide
  Target: SCN10A; (+) strand; PAM type: NRG; PAM sequence: GAG
tgctttgtatttttacaatg

SEQ ID NO: 38181 - DNA, 20 bp, Artificial Sequence
  Description of Artificial Sequence: Synthetic oligonucleotide
  Target: SCN10A; (+) strand; PAM type: NRG; PAM sequence: AGG
gctttgtatttttacaatgg

SEQ ID NO: 38182 - DNA, 20 bp, Artificial Sequence
  Description of Artificial Sequence: Synthetic oligonucleotide
  Target: SCN10A; (+) strand; PAM type: NRG; PAM sequence: TAG
tgtgaccttatttcacattg

SEQ ID NO: 38183 - DNA, 20 bp, Artificial Sequence
  Description of Artificial Sequence: Synthetic oligonucleotide
  Target: SCN10A; (+) strand; PAM type: NRG; PAM sequence: AGG
gtgaccttatttcacattgt

SEQ ID NO: 38184 - DNA, 20 bp, Artificial Sequence
  Description of Artificial Sequence: Synthetic oligonucleotide
  Target: SCN10A; (+) strand; PAM type: NRG; PAM sequence: CAG
ttatcattattgttatgctt

SEQ ID NO: 38185 - DNA, 20 bp, Artificial Sequence
  Description of Artificial Sequence: Synthetic oligonucleotide
  Target: SCN10A; (+) strand; PAM type: NRG; PAM sequence: AAG
gcttcagaaaaccactttcg

SEQ ID NO: 38186 - DNA, 20 bp, Artificial Sequence
  Description of Artificial Sequence: Synthetic oligonucleotide
  Target: SCN10A; (+) strand; PAM type: NRG; PAM sequence: AAG
ttgaattgtgatattatgca

SEQ ID NO: 38187 - DNA, 20 bp, Artificial Sequence
  Description of Artificial Sequence: Synthetic oligonucleotide
  Target: SCN10A; (+) strand; PAM type: NRG; PAM sequence: CAG
tgtgatattatgcaaagcga

SEQ ID NO: 38188 - DNA, 20 bp, Artificial Sequence
  Description of Artificial Sequence: Synthetic oligonucleotide
  Target: SCN10A; (+) strand; PAM type: NRG; PAM sequence: TGG
atgcaaagcgacagtaataa

SEQ ID NO: 38189 - DNA, 20 bp, Artificial Sequence
  Description of Artificial Sequence: Synthetic oligonucleotide
  Target: SCN10A; (+) strand; PAM type: NRG; PAM sequence: AAG
acagtaataatggcaaatgc

SEQ ID NO: 38190 - DNA, 20 bp, Artificial Sequence
  Description of Artificial Sequence: Synthetic oligonucleotide
  Target: SCN10A; (+) strand; PAM type: NRG; PAM sequence: AAG
atggcaaatgcaagtctgac

SEQ ID NO: 38191 - DNA, 20 bp, Artificial Sequence
  Description of Artificial Sequence: Synthetic oligonucleotide
  Target: SCN10A; (+) strand; PAM type: NRG; PAM sequence: CAG
tgacaagtgtaaataactgt

SEQ ID NO: 38192 - DNA, 20 bp, Artificial Sequence
  Description of Artificial Sequence: Synthetic oligonucleotide
  Target: SCN10A; (+) strand; PAM type: NRG; PAM sequence: AGG
gacaagtgtaaataactgtc

SEQ ID NO: 38193 - DNA, 20 bp, Artificial Sequence
  Description of Artificial Sequence: Synthetic oligonucleotide
  Target: SCN10A; (+) strand; PAM type: NRG; PAM sequence: TAG
caggtgacaataaaatacat

SEQ ID NO: 38194 - DNA, 20 bp, Artificial Sequence
  Description of Artificial Sequence: Synthetic oligonucleotide
  Target: SCN10A; (+) strand; PAM type: NRG; PAM sequence: AAG
gacaataaaatacattagtc

SEQ ID NO: 38195 - DNA, 20 bp, Artificial Sequence
  Description of Artificial Sequence: Synthetic oligonucleotide
  Target: SCN10A; (+) strand; PAM type: NRG; PAM sequence: CAG
ttaaccattatgaatgaaat

SEQ ID NO: 38196 - DNA, 20 bp, Artificial Sequence
  Description of Artificial Sequence: Synthetic oligonucleotide
  Target: SCN10A; (+) strand; PAM type: NRG; PAM sequence: AAG
atgaatgaaatcagtttttg

SEQ ID NO: 38197 - DNA, 20 bp, Artificial Sequence
  Description of Artificial Sequence: Synthetic oligonucleotide
  Target: SCN10A; (+) strand; PAM type: NRG; PAM sequence: AAG
actgtttttgaaaacataaa

SEQ ID NO: 38198 - DNA, 20 bp, Artificial Sequence
  Description of Artificial Sequence: Synthetic oligonucleotide
  Target: SCN10A; (+) strand; PAM type: NRG; PAM sequence: TAG
tttttgaaaacataaaaagt

SEQ ID NO: 38199 - DNA, 20 bp, Artificial Sequence
  Description of Artificial Sequence: Synthetic oligonucleotide
  Target: SCN10A; (+) strand; PAM type: NRG; PAM sequence: TAG
taataattaatcttacatgt

SEQ ID NO: 38200 - DNA, 20 bp, Artificial Sequence
  Description of Artificial Sequence: Synthetic oligonucleotide
  Target: SCN10A; (+) strand; PAM type: NRG; PAM sequence: TAG
attttaaaattatatgtgca

SEQ ID NO: 38201 - DNA, 20 bp, Artificial Sequence
  Description of Artificial Sequence: Synthetic oligonucleotide
  Target: SCN10A; (+) strand; PAM type: NRG; PAM sequence: GAG
tttaaaattatatgtgcata

SEQ ID NO: 38202 - DNA, 20 bp, Artificial Sequence
  Description of Artificial Sequence: Synthetic oligonucleotide
  Target: SCN10A; (+) strand; PAM type: NRG; PAM sequence: TAG
tatatgtgcatagagatcct

SEQ ID NO: 38203 - DNA, 20 bp, Artificial Sequence
  Description of Artificial Sequence: Synthetic oligonucleotide
  Target: SCN10A; (+) strand; PAM type: NRG; PAM sequence: GAG
agatccttagatcacttgtt

SEQ ID NO: 38204 - DNA, 20 bp, Artificial Sequence
  Description of Artificial Sequence: Synthetic oligonucleotide
  Target: SCN10A; (+) strand; PAM type: NRG; PAM sequence: TAG
tcacttgttgagaaacattg

SEQ ID NO: 38205 - DNA, 20 bp, Artificial Sequence
  Description of Artificial Sequence: Synthetic oligonucleotide
  Target: SCN10A; (+) strand; PAM type: NRG; PAM sequence: AGG
cacttgttgagaaacattgt

SEQ ID NO: 38206 - DNA, 20 bp, Artificial Sequence
  Description of Artificial Sequence: Synthetic oligonucleotide
  Target: SCN10A; (+) strand; PAM type: NRG; PAM sequence: GAG
cttgttgagaaacattgtag

SEQ ID NO: 38207 - DNA, 20 bp, Artificial Sequence
  Description of Artificial Sequence: Synthetic oligonucleotide
  Target: SCN10A; (+) strand; PAM type: NRG; PAM sequence: TGG
ttgagaaacattgtaggaga

SEQ ID NO: 38208 - DNA, 20 bp, Artificial Sequence
  Description of Artificial Sequence: Synthetic oligonucleotide
  Target: SCN10A; (+) strand; PAM type: NRG; PAM sequence: GAG
gagaaacattgtaggagatg

SEQ ID NO: 38209 - DNA, 20 bp, Artificial Sequence
  Description of Artificial Sequence: Synthetic oligonucleotide
  Target: SCN10A; (+) strand; PAM type: NRG; PAM sequence: GAG
gaaacattgtaggagatgga

SEQ ID NO: 38210 - DNA, 20 bp, Artificial Sequence
  Description of Artificial Sequence: Synthetic oligonucleotide
  Target: SCN10A; (+) strand; PAM type: NRG; PAM sequence: GAG
aacattgtaggagatggaga

SEQ ID NO: 38211 - DNA, 20 bp, Artificial Sequence
  Description of Artificial Sequence: Synthetic oligonucleotide
  Target: SCN10A; (+) strand; PAM type: NRG; PAM sequence: AAG
atgaattgctctgctaaaca

SEQ ID NO: 38212 - DNA, 20 bp, Artificial Sequence
  Description of Artificial Sequence: Synthetic oligonucleotide
  Target: SCN10A; (+) strand; PAM type: NRG; PAM sequence: AAG
attgctctgctaaacaaagt

SEQ ID NO: 38213 - DNA, 20 bp, Artificial Sequence
  Description of Artificial Sequence: Synthetic oligonucleotide
  Target: SCN10A; (+) strand; PAM type: NRG; PAM sequence: AAG
ctgctaaacaaagtaagaat

SEQ ID NO: 38214 - DNA, 20 bp, Artificial Sequence
  Description of Artificial Sequence: Synthetic oligonucleotide
  Target: SCN10A; (+) strand; PAM type: NRG; PAM sequence: TGG
taaacaaagtaagaataagt

SEQ ID NO: 38215 - DNA, 20 bp, Artificial Sequence
  Description of Artificial Sequence: Synthetic oligonucleotide
  Target: SCN10A; (+) strand; PAM type: NRG; PAM sequence: GAG
aacaaagtaagaataagttg

SEQ ID NO: 38216 - DNA, 20 bp, Artificial Sequence
  Description of Artificial Sequence: Synthetic oligonucleotide
  Target: SCN10A; (+) strand; PAM type: NRG; PAM sequence: CAG
taagaataagttggagttcc

SEQ ID NO: 38217 - DNA, 20 bp, Artificial Sequence
  Description of Artificial Sequence: Synthetic oligonucleotide
  Target: SCN10A; (+) strand; PAM type: NRG; PAM sequence: AGG
aagaataagttggagttccc

SEQ ID NO: 38218 - DNA, 20 bp, Artificial Sequence
  Description of Artificial Sequence: Synthetic oligonucleotide
  Target: SCN10A; (+) strand; PAM type: NRG; PAM sequence: GGG
agaataagttggagttccca

SEQ ID NO: 38219 - DNA, 20 bp, Artificial Sequence
  Description of Artificial Sequence: Synthetic oligonucleotide
  Target: SCN10A; (+) strand; PAM type: NRG; PAM sequence: GAG
tggagttcccagggacaatt

SEQ ID NO: 38220 - DNA, 20 bp, Artificial Sequence
  Description of Artificial Sequence: Synthetic oligonucleotide
  Target: SCN10A; (+) strand; PAM type: NRG; PAM sequence: AGG
ggagttcccagggacaattg

SEQ ID NO: 38221 - DNA, 20 bp, Artificial Sequence
  Description of Artificial Sequence: Synthetic oligonucleotide
  Target: SCN10A; (+) strand; PAM type: NRG; PAM sequence: GAG
agttcccagggacaattgag

SEQ ID NO: 38222 - DNA, 20 bp, Artificial Sequence
  Description of Artificial Sequence: Synthetic oligonucleotide
  Target: SCN10A; (+) strand; PAM type: NRG; PAM sequence: GAG
ttcccagggacaattgagga

SEQ ID NO: 38223 - DNA, 20 bp, Artificial Sequence
  Description of Artificial Sequence: Synthetic oligonucleotide
  Target: SCN10A; (+) strand; PAM type: NRG; PAM sequence: GAG
cccagggacaattgaggaga

SEQ ID NO: 38224 - DNA, 20 bp, Artificial Sequence
  Description of Artificial Sequence: Synthetic oligonucleotide
  Target: SCN10A; (+) strand; PAM type: NRG; PAM sequence: TGG
gggacaattgaggagagagt

SEQ ID NO: 38225 - DNA, 20 bp, Artificial Sequence
  Description of Artificial Sequence: Synthetic oligonucleotide
  Target: SCN10A; (+) strand; PAM type: NRG; PAM sequence: AAG
gagagagttggaacatccca

SEQ ID NO: 38226 - DNA, 20 bp, Artificial Sequence
  Description of Artificial Sequence: Synthetic oligonucleotide
  Target: SCN10A; (+) strand; PAM type: NRG; PAM sequence: AGG
agagagttggaacatcccaa

SEQ ID NO: 38227 - DNA, 20 bp, Artificial Sequence
  Description of Artificial Sequence: Synthetic oligonucleotide
  Target: SCN10A; (+) strand; PAM type: NRG; PAM sequence: GGG
gagagttggaacatcccaaa

SEQ ID NO: 38228 - DNA, 20 bp, Artificial Sequence
  Description of Artificial Sequence: Synthetic oligonucleotide
  Target: SCN10A; (+) strand; PAM type: NRG; PAM sequence: CAG
gttggaacatcccaaaggga

SEQ ID NO: 38229 - DNA, 20 bp, Artificial Sequence
  Description of Artificial Sequence: Synthetic oligonucleotide
  Target: SCN10A; (+) strand; PAM type: NRG; PAM sequence: AAG
cccaaagggacagtttatga

SEQ ID NO: 38230 - DNA, 20 bp, Artificial Sequence
  Description of Artificial Sequence: Synthetic oligonucleotide
  Target: SCN10A; (+) strand; PAM type: NRG; PAM sequence: AAG
aaagggacagtttatgaaag

SEQ ID NO: 38231 - DNA, 20 bp, Artificial Sequence
  Description of Artificial Sequence: Synthetic oligonucleotide
  Target: SCN10A; (+) strand; PAM type: NRG; PAM sequence: CAG
cagtttatgaaagaagatta

SEQ ID NO: 38232 - DNA, 20 bp, Artificial Sequence
  Description of Artificial Sequence: Synthetic oligonucleotide
  Target: SCN10A; (+) strand; PAM type: NRG; PAM sequence: AGG
agtttatgaaagaagattac

SEQ ID NO: 38233 - DNA, 20 bp, Artificial Sequence
  Description of Artificial Sequence: Synthetic oligonucleotide
  Target: SCN10A; (+) strand; PAM type: NRG; PAM sequence: CAG
tatgaaagaagattacaggc

SEQ ID NO: 38234 - DNA, 20 bp, Artificial Sequence
  Description of Artificial Sequence: Synthetic oligonucleotide
  Target: SCN10A; (+) strand; PAM type: NRG; PAM sequence: TAG
gattacaggccagcctcatt

SEQ ID NO: 38235 - DNA, 20 bp, Artificial Sequence
  Description of Artificial Sequence: Synthetic oligonucleotide
  Target: SCN10A; (+) strand; PAM type: NRG; PAM sequence: TAG
gccagcctcatttagcaaaa

SEQ ID NO: 38236 - DNA, 20 bp, Artificial Sequence
  Description of Artificial Sequence: Synthetic oligonucleotide
  Target: SCN10A; (+) strand; PAM type: NRG; PAM sequence: CAG
gaaatacacctaattgaatc

SEQ ID NO: 38237 - DNA, 20 bp, Artificial Sequence
  Description of Artificial Sequence: Synthetic oligonucleotide
  Target: SCN10A; (+) strand; PAM type: NRG; PAM sequence: CAG
attgaatccagcaaaatgat

SEQ ID NO: 38238 - DNA, 20 bp, Artificial Sequence
  Description of Artificial Sequence: Synthetic oligonucleotide
  Target: SCN10A; (+) strand; PAM type: NRG; PAM sequence: TGG
aatccagcaaaatgatcagc

SEQ ID NO: 38239 - DNA, 20 bp, Artificial Sequence
  Description of Artificial Sequence: Synthetic oligonucleotide
  Target: SCN10A; (+) strand; PAM type: NRG; PAM sequence: TAG
tcagctggaaccattaaaaa

SEQ ID NO: 38240 - DNA, 20 bp, Artificial Sequence
  Description of Artificial Sequence: Synthetic oligonucleotide
  Target: SCN10A; (+) strand; PAM type: NRG; PAM sequence: TAG
aaatagactaacaaacctgt

SEQ ID NO: 38241 - DNA, 20 bp, Artificial Sequence
  Description of Artificial Sequence: Synthetic oligonucleotide
  Target: SCN10A; (+) strand; PAM type: NRG; PAM sequence: CAG
ctaacaaacctgttagttta

SEQ ID NO: 38242 - DNA, 20 bp, Artificial Sequence
  Description of Artificial Sequence: Synthetic oligonucleotide
  Target: SCN10A; (+) strand; PAM type: NRG; PAM sequence: CAG
ttacagatttactatactaa

SEQ ID NO: 38243 - DNA, 20 bp, Artificial Sequence
  Description of Artificial Sequence: Synthetic oligonucleotide
  Target: SCN10A; (+) strand; PAM type: NRG; PAM sequence: AAG
tttactatactaacagatga

SEQ ID NO: 38244 - DNA, 20 bp, Artificial Sequence
  Description of Artificial Sequence: Synthetic oligonucleotide
  Target: SCN10A; (+) strand; PAM type: NRG; PAM sequence: TAG
aataaatataaaaatactga

SEQ ID NO: 38245 - DNA, 20 bp, Artificial Sequence
  Description of Artificial Sequence: Synthetic oligonucleotide
  Target: SCN10A; (+) strand; PAM type: NRG; PAM sequence: AAG
aaatataaaaatactgatag

SEQ ID NO: 38246 - DNA, 20 bp, Artificial Sequence
  Description of Artificial Sequence: Synthetic oligonucleotide
  Target: SCN10A; (+) strand; PAM type: NRG; PAM sequence: AAG
ccaacacccattcatgatga

SEQ ID NO: 38247 - DNA, 20 bp, Artificial Sequence
  Description of Artificial Sequence: Synthetic oligonucleotide
  Target: SCN10A; (+) strand; PAM type: NRG; PAM sequence: AAG
tgatgaaagtctcaacaaac

SEQ ID NO: 38248 - DNA, 20 bp, Artificial Sequence
  Description of Artificial Sequence: Synthetic oligonucleotide
  Target: SCN10A; (+) strand; PAM type: NRG; PAM sequence: TGG
aagtctcaacaaacaagaaa

SEQ ID NO: 38249 - DNA, 20 bp, Artificial Sequence
  Description of Artificial Sequence: Synthetic oligonucleotide
  Target: SCN10A; (+) strand; PAM type: NRG; PAM sequence: AAG
atggaaaaaattgatataaa

SEQ ID NO: 38250 - DNA, 20 bp, Artificial Sequence
  Description of Artificial Sequence: Synthetic oligonucleotide
  Target: SCN10A; (+) strand; PAM type: NRG; PAM sequence: GAG
ttgatataaaaagtaattat

SEQ ID NO: 38251 - DNA, 20 bp, Artificial Sequence
  Description of Artificial Sequence: Synthetic oligonucleotide
  Target: SCN10A; (+) strand; PAM type: NRG; PAM sequence: TAG
gactctcataaacatcataa

SEQ ID NO: 38252 - DNA, 20 bp, Artificial Sequence
  Description of Artificial Sequence: Synthetic oligonucleotide
  Target: SCN10A; (+) strand; PAM type: NRG; PAM sequence: TAG
acatcataatagtgaaacat

SEQ ID NO: 38253 - DNA, 20 bp, Artificial Sequence
  Description of Artificial Sequence: Synthetic oligonucleotide
  Target: SCN10A; (+) strand; PAM type: NRG; PAM sequence: AAG
tcataatagtgaaacattag

SEQ ID NO: 38254 - DNA, 20 bp, Artificial Sequence
  Description of Artificial Sequence: Synthetic oligonucleotide
  Target: SCN10A; (+) strand; PAM type: NRG; PAM sequence: AAG
gaagcacacactttaaaatc

SEQ ID NO: 38255 - DNA, 20 bp, Artificial Sequence
  Description of Artificial Sequence: Synthetic oligonucleotide
  Target: SCN10A; (+) strand; PAM type: NRG; PAM sequence: GAG
agcacacactttaaaatcaa

SEQ ID NO: 38256 - DNA, 20 bp, Artificial Sequence
  Description of Artificial Sequence: Synthetic oligonucleotide
  Target: SCN10A; (+) strand; PAM type: NRG; PAM sequence: TAG
aataaatatgctcactgtca

SEQ ID NO: 38257 - DNA, 20 bp, Artificial Sequence
  Description of Artificial Sequence: Synthetic oligonucleotide
  Target: SCN10A; (+) strand; PAM type: NRG; PAM sequence: AAG
tttgaattaccatcttgttg

SEQ ID NO: 38258 - DNA, 20 bp, Artificial Sequence
  Description of Artificial Sequence: Synthetic oligonucleotide
  Target: SCN10A; (+) strand; PAM type: NRG; PAM sequence: AGG
ttgaattaccatcttgttga

SEQ ID NO: 38259 - DNA, 20 bp, Artificial Sequence
  Description of Artificial Sequence: Synthetic oligonucleotide
  Target: SCN10A; (+) strand; PAM type: NRG; PAM sequence: CGG
taccatcttgttgaaggtcc

SEQ ID NO: 38260 - DNA, 20 bp, Artificial Sequence
  Description of Artificial Sequence: Synthetic oligonucleotide
  Target: SCN10A; (+) strand; PAM type: NRG; PAM sequence: AAG
aaggtcccggccaattcaat

SEQ ID NO: 38261 - DNA, 20 bp, Artificial Sequence
  Description of Artificial Sequence: Synthetic oligonucleotide
  Target: SCN10A; (+) strand; PAM type: NRG; PAM sequence: CAG
tcccggccaattcaataaga

SEQ ID NO: 38262 - DNA, 20 bp, Artificial Sequence
  Description of Artificial Sequence: Synthetic oligonucleotide
  Target: SCN10A; (+) strand; PAM type: NRG; PAM sequence: AGG
cccggccaattcaataagac

SEQ ID NO: 38263 - DNA, 20 bp, Artificial Sequence
  Description of Artificial Sequence: Synthetic oligonucleotide
  Target: SCN10A; (+) strand; PAM type: NRG; PAM sequence: AAG
ataagacaggaaaaataaaa

SEQ ID NO: 38264 - DNA, 20 bp, Artificial Sequence
  Description of Artificial Sequence: Synthetic oligonucleotide
  Target: SCN10A; (+) strand; PAM type: NRG; PAM sequence: TGG
agacaggaaaaataaaaaag

SEQ ID NO: 38265 - DNA, 20 bp, Artificial Sequence
  Description of Artificial Sequence: Synthetic oligonucleotide
  Target: SCN10A; (+) strand; PAM type: NRG; PAM sequence: AAG
gaaaaataaaaaagtggtat

SEQ ID NO: 38266 - DNA, 20 bp, Artificial Sequence
  Description of Artificial Sequence: Synthetic oligonucleotide
  Target: SCN10A; (+) strand; PAM type: NRG; PAM sequence: AAG
aaagtggtataagaatcata

SEQ ID NO: 38267 - DNA, 20 bp, Artificial Sequence
  Description of Artificial Sequence: Synthetic oligonucleotide
  Target: SCN10A; (+) strand; PAM type: NRG; PAM sequence: AGG
aagtggtataagaatcataa

SEQ ID NO: 38268 - DNA, 20 bp, Artificial Sequence
  Description of Artificial Sequence: Synthetic oligonucleotide
  Target: SCN10A; (+) strand; PAM type: NRG; PAM sequence: AAG
tggtataagaatcataaagg

SEQ ID NO: 38269 - DNA, 20 bp, Artificial Sequence
  Description of Artificial Sequence: Synthetic oligonucleotide
  Target: SCN10A; (+) strand; PAM type: NRG; PAM sequence: AAG
agaatcataaaggaagaaac

SEQ ID NO: 38270 - DNA, 20 bp, Artificial Sequence
  Description of Artificial Sequence: Synthetic oligonucleotide
  Target: SCN10A; (+) strand; PAM type: NRG; PAM sequence: CAG
aacaagtttgtcattatttg

SEQ ID NO: 38271 - DNA, 20 bp, Artificial Sequence
  Description of Artificial Sequence: Synthetic oligonucleotide
  Target: SCN10A; (+) strand; PAM type: NRG; PAM sequence: TAG
agataatataactgtctaaa

SEQ ID NO: 38272 - DNA, 20 bp, Artificial Sequence
  Description of Artificial Sequence: Synthetic oligonucleotide
  Target: SCN10A; (+) strand; PAM type: NRG; PAM sequence: AGG
gataatataactgtctaaat

SEQ ID NO: 38273 - DNA, 20 bp, Artificial Sequence
  Description of Artificial Sequence: Synthetic oligonucleotide
  Target: SCN10A; (+) strand; PAM type: NRG; PAM sequence: AAG
aatataactgtctaaatagg

SEQ ID NO: 38274 - DNA, 20 bp, Artificial Sequence
  Description of Artificial Sequence: Synthetic oligonucleotide
  Target: SCN10A; (+) strand; PAM type: NRG; PAM sequence: AAG
actgtctaaataggaagtcc

SEQ ID NO: 38275 - DNA, 20 bp, Artificial Sequence
  Description of Artificial Sequence: Synthetic oligonucleotide
  Target: SCN10A; (+) strand; PAM type: NRG; PAM sequence: AGG
ctgtctaaataggaagtcca

SEQ ID NO: 38276 - DNA, 20 bp, Artificial Sequence
  Description of Artificial Sequence: Synthetic oligonucleotide
  Target: SCN10A; (+) strand; PAM type: NRG; PAM sequence: GGG
tgtctaaataggaagtccaa

SEQ ID NO: 38277 - DNA, 20 bp, Artificial Sequence
  Description of Artificial Sequence: Synthetic oligonucleotide
  Target: SCN10A; (+) strand; PAM type: NRG; PAM sequence: CAG
aggaagtccaagggaatcta

SEQ ID NO: 38278 - DNA, 20 bp, Artificial Sequence
  Description of Artificial Sequence: Synthetic oligonucleotide
  Target: SCN10A; (+) strand; PAM type: NRG; PAM sequence: AAG
ctacagaaaaatttaacttt

SEQ ID NO: 38279 - DNA, 20 bp, Artificial Sequence
  Description of Artificial Sequence: Synthetic oligonucleotide
  Target: SCN10A; (+) strand; PAM type: NRG; PAM sequence: AGG
tacagaaaaatttaacttta

SEQ ID NO: 38280 - DNA, 20 bp, Artificial Sequence
  Description of Artificial Sequence: Synthetic oligonucleotide
  Target: SCN10A; (+) strand; PAM type: NRG; PAM sequence: GAG
cagaaaaatttaactttaag

SEQ ID NO: 38281 - DNA, 20 bp, Artificial Sequence
  Description of Artificial Sequence: Synthetic oligonucleotide
  Target: SCN10A; (+) strand; PAM type: NRG; PAM sequence: CAG
aaatttaactttaaggagct

SEQ ID NO: 38282 - DNA, 20 bp, Artificial Sequence
  Description of Artificial Sequence: Synthetic oligonucleotide
  Target: SCN10A; (+) strand; PAM type: NRG; PAM sequence: CAG
tttaactttaaggagctcag

SEQ ID NO: 38283 - DNA, 20 bp, Artificial Sequence
  Description of Artificial Sequence: Synthetic oligonucleotide
  Target: SCN10A; (+) strand; PAM type: NRG; PAM sequence: AGG
ttaactttaaggagctcagc

SEQ ID NO: 38284 - DNA, 20 bp, Artificial Sequence
  Description of Artificial Sequence: Synthetic oligonucleotide
  Target: SCN10A; (+) strand; PAM type: NRG; PAM sequence: GGG
taactttaaggagctcagca

SEQ ID NO: 38285 - DNA, 20 bp, Artificial Sequence
  Description of Artificial Sequence: Synthetic oligonucleotide
  Target: SCN10A; (+) strand; PAM type: NRG; PAM sequence: TGG
aaggagctcagcagggttgc

SEQ ID NO: 38286 - DNA, 20 bp, Artificial Sequence
  Description of Artificial Sequence: Synthetic oligonucleotide
  Target: SCN10A; (+) strand; PAM type: NRG; PAM sequence: TAG
ctggatgcaaaatcactata

SEQ ID NO: 38287 - DNA, 20 bp, Artificial Sequence
  Description of Artificial Sequence: Synthetic oligonucleotide
  Target: SCN10A; (+) strand; PAM type: NRG; PAM sequence: AAG
atatagaaattaataatatt

SEQ ID NO: 38288 - DNA, 20 bp, Artificial Sequence
  Description of Artificial Sequence: Synthetic oligonucleotide
  Target: SCN10A; (+) strand; PAM type: NRG; PAM sequence: CAG
agaaattaataatattaaga

SEQ ID NO: 38289 - DNA, 20 bp, Artificial Sequence
  Description of Artificial Sequence: Synthetic oligonucleotide
  Target: SCN10A; (+) strand; PAM type: NRG; PAM sequence: TAG
ttaataatattaagacagtt

SEQ ID NO: 38290 - DNA, 20 bp, Artificial Sequence
  Description of Artificial Sequence: Synthetic oligonucleotide
  Target: SCN10A; (+) strand; PAM type: NRG; PAM sequence: AAG
taagacagtttagcaataat

SEQ ID NO: 38291 - DNA, 20 bp, Artificial Sequence
  Description of Artificial Sequence: Synthetic oligonucleotide
  Target: SCN10A; (+) strand; PAM type: NRG; PAM sequence: TAG
tagcaataataagtattcaa

SEQ ID NO: 38292 - DNA, 20 bp, Artificial Sequence
  Description of Artificial Sequence: Synthetic oligonucleotide
  Target: SCN10A; (+) strand; PAM type: NRG; PAM sequence: AGG
agcaataataagtattcaat

SEQ ID NO: 38293 - DNA, 20 bp, Artificial Sequence
  Description of Artificial Sequence: Synthetic oligonucleotide
  Target: SCN10A; (+) strand; PAM type: NRG; PAM sequence: GGG
gcaataataagtattcaata

SEQ ID NO: 38294 - DNA, 20 bp, Artificial Sequence
  Description of Artificial Sequence: Synthetic oligonucleotide
  Target: SCN10A; (+) strand; PAM type: NRG; PAM sequence: TAG
aaccaaaattgcaatgtacc

SEQ ID NO: 38295 - DNA, 20 bp, Artificial Sequence
  Description of Artificial Sequence: Synthetic oligonucleotide
  Target: SCN10A; (+) strand; PAM type: NRG; PAM sequence: AGG
accaaaattgcaatgtacct

SEQ ID NO: 38296 - DNA, 20 bp, Artificial Sequence
  Description of Artificial Sequence: Synthetic oligonucleotide
  Target: SCN10A; (+) strand; PAM type: NRG; PAM sequence: AAG
attgcaatgtacctaggaaa

SEQ ID NO: 38297 - DNA, 20 bp, Artificial Sequence
  Description of Artificial Sequence: Synthetic oligonucleotide
  Target: SCN10A; (+) strand; PAM type: NRG; PAM sequence: TAG
gaaaaagacattataaaatg

SEQ ID NO: 38298 - DNA, 20 bp, Artificial Sequence
  Description of Artificial Sequence: Synthetic oligonucleotide
  Target: SCN10A; (+) strand; PAM type: NRG; PAM sequence: AAG
taaaatgtagaaaaatatta

SEQ ID NO: 38299 - DNA, 20 bp, Artificial Sequence
  Description of Artificial Sequence: Synthetic oligonucleotide
  Target: SCN10A; (+) strand; PAM type: NRG; PAM sequence: AAG
aatgtagaaaaatattaaag

SEQ ID NO: 38300 - DNA, 20 bp, Artificial Sequence
  Description of Artificial Sequence: Synthetic oligonucleotide
  Target: SCN10A; (+) strand; PAM type: NRG; PAM sequence: AAG
aaagaagacctgtataaatt

SEQ ID NO: 38301 - DNA, 20 bp, Artificial Sequence
  Description of Artificial Sequence: Synthetic oligonucleotide
  Target: SCN10A; (+) strand; PAM type: NRG; PAM sequence: GAG
agaagacctgtataaattaa

SEQ ID NO: 38302 - DNA, 20 bp, Artificial Sequence
  Description of Artificial Sequence: Synthetic oligonucleotide
  Target: SCN10A; (+) strand; PAM type: NRG; PAM sequence: TGG
agatctgccatactgatgtg

SEQ ID NO: 38303 - DNA, 20 bp, Artificial Sequence
  Description of Artificial Sequence: Synthetic oligonucleotide
  Target: SCN10A; (+) strand; PAM type: NRG; PAM sequence: GGG
gatctgccatactgatgtgt

SEQ ID NO: 38304 - DNA, 20 bp, Artificial Sequence
  Description of Artificial Sequence: Synthetic oligonucleotide
  Target: SCN10A; (+) strand; PAM type: NRG; PAM sequence: AAG
ctgccatactgatgtgtggg

SEQ ID NO: 38305 - DNA, 20 bp, Artificial Sequence
  Description of Artificial Sequence: Synthetic oligonucleotide
  Target: SCN10A; (+) strand; PAM type: NRG; PAM sequence: AGG
tgccatactgatgtgtggga

SEQ ID NO: 38306 - DNA, 20 bp, Artificial Sequence
  Description of Artificial Sequence: Synthetic oligonucleotide
  Target: SCN10A; (+) strand; PAM type: NRG; PAM sequence: TGG
aaggcttcgtattgtaaatg

SEQ ID NO: 38307 - DNA, 20 bp, Artificial Sequence
  Description of Artificial Sequence: Synthetic oligonucleotide
  Target: SCN10A; (+) strand; PAM type: NRG; PAM sequence: TGG
aaatgtggcgattcttcctg

SEQ ID NO: 38308 - DNA, 20 bp, Artificial Sequence
  Description of Artificial Sequence: Synthetic oligonucleotide
  Target: SCN10A; (+) strand; PAM type: NRG; PAM sequence: CAG
cctgtggtgataaatcaatt

SEQ ID NO: 38309 - DNA, 20 bp, Artificial Sequence
  Description of Artificial Sequence: Synthetic oligonucleotide
  Target: SCN10A; (+) strand; PAM type: NRG; PAM sequence: AAG
attcagtgcattaccaaaca

SEQ ID NO: 38310 - DNA, 20 bp, Artificial Sequence
  Description of Artificial Sequence: Synthetic oligonucleotide
  Target: SCN10A; (+) strand; PAM type: NRG; PAM sequence: CAG
attaccaaacaaagtttcca

SEQ ID NO: 38311 - DNA, 20 bp, Artificial Sequence
  Description of Artificial Sequence: Synthetic oligonucleotide
  Target: SCN10A; (+) strand; PAM type: NRG; PAM sequence: GAG
taccaaacaaagtttccaca

SEQ ID NO: 38312 - DNA, 20 bp, Artificial Sequence
  Description of Artificial Sequence: Synthetic oligonucleotide
  Target: SCN10A; (+) strand; PAM type: NRG; PAM sequence: AAG
caaagtttccacagagttgt

SEQ ID NO: 38313 - DNA, 20 bp, Artificial Sequence
  Description of Artificial Sequence: Synthetic oligonucleotide
  Target: SCN10A; (+) strand; PAM type: NRG; PAM sequence: AAG
tttccacagagttgtaagaa

SEQ ID NO: 38314 - DNA, 20 bp, Artificial Sequence
  Description of Artificial Sequence: Synthetic oligonucleotide
  Target: SCN10A; (+) strand; PAM type: NRG; PAM sequence: GAG
tccacagagttgtaagaaaa

SEQ ID NO: 38315 - DNA, 20 bp, Artificial Sequence
  Description of Artificial Sequence: Synthetic oligonucleotide
  Target: SCN10A; (+) strand; PAM type: NRG; PAM sequence: TGG
cagagttgtaagaaaagagc

SEQ ID NO: 38316 - DNA, 20 bp, Artificial Sequence
  Description of Artificial Sequence: Synthetic oligonucleotide
  Target: SCN10A; (+) strand; PAM type: NRG; PAM sequence: TGG
atgtgacccttaaactgata

SEQ ID NO: 38317 - DNA, 20 bp, Artificial Sequence
  Description of Artificial Sequence: Synthetic oligonucleotide
  Target: SCN10A; (+) strand; PAM type: NRG; PAM sequence: AAG
acccttaaactgatatggaa

SEQ ID NO: 38318 - DNA, 20 bp, Artificial Sequence
  Description of Artificial Sequence: Synthetic oligonucleotide
  Target: SCN10A; (+) strand; PAM type: NRG; PAM sequence: AAG
taaactgatatggaaaagta

SEQ ID NO: 38319 - DNA, 20 bp, Artificial Sequence
  Description of Artificial Sequence: Synthetic oligonucleotide
  Target: SCN10A; (+) strand; PAM type: NRG; PAM sequence: AAG
atatggaaaagtaaagaaac

SEQ ID NO: 38320 - DNA, 20 bp, Artificial Sequence
  Description of Artificial Sequence: Synthetic oligonucleotide
  Target: SCN10A; (+) strand; PAM type: NRG; PAM sequence: AAG
caagaaccaaaataattttc

SEQ ID NO: 38321 - DNA, 20 bp, Artificial Sequence
  Description of Artificial Sequence: Synthetic oligonucleotide
  Target: SCN10A; (+) strand; PAM type: NRG; PAM sequence: AAG
gaaccaaaataattttcaag

SEQ ID NO: 38322 - DNA, 20 bp, Artificial Sequence
  Description of Artificial Sequence: Synthetic oligonucleotide
  Target: SCN10A; (+) strand; PAM type: NRG; PAM sequence: AAG
taattttcaagaagacaaat

SEQ ID NO: 38323 - DNA, 20 bp, Artificial Sequence
  Description of Artificial Sequence: Synthetic oligonucleotide
  Target: SCN10A; (+) strand; PAM type: NRG; PAM sequence: AGG
aattttcaagaagacaaata

SEQ ID NO: 38324 - DNA, 20 bp, Artificial Sequence
  Description of Artificial Sequence: Synthetic oligonucleotide
  Target: SCN10A; (+) strand; PAM type: NRG; PAM sequence: GAG
ttttcaagaagacaaataag

SEQ ID NO: 38325 - DNA, 20 bp, Artificial Sequence
  Description of Artificial Sequence: Synthetic oligonucleotide
  Target: SCN10A; (+) strand; PAM type: NRG; PAM sequence: AGG
tttcaagaagacaaataagg

SEQ ID NO: 38326 - DNA, 20 bp, Artificial Sequence
  Description of Artificial Sequence: Synthetic oligonucleotide
  Target: SCN10A; (+) strand; PAM type: NRG; PAM sequence: GGG
ttcaagaagacaaataagga

SEQ ID NO: 38327 - DNA, 20 bp, Artificial Sequence
  Description of Artificial Sequence: Synthetic oligonucleotide
  Target: SCN10A; (+) strand; PAM type: NRG; PAM sequence: GGG
tcaagaagacaaataaggag

SEQ ID NO: 38328 - DNA, 20 bp, Artificial Sequence
  Description of Artificial Sequence: Synthetic oligonucleotide
  Target: SCN10A; (+) strand; PAM type: NRG; PAM sequence: CAG
ggaggggcatgtgaatcgac

SEQ ID NO: 38329 - DNA, 20 bp, Artificial Sequence
  Description of Artificial Sequence: Synthetic oligonucleotide
  Target: SCN10A; (+) strand; PAM type: NRG; PAM sequence: AGG
gaggggcatgtgaatcgacc

SEQ ID NO: 38330 - DNA, 20 bp, Artificial Sequence
  Description of Artificial Sequence: Synthetic oligonucleotide
  Target: SCN10A; (+) strand; PAM type: NRG; PAM sequence: TAG
gaccaggtcaaatcttacta

SEQ ID NO: 38331 - DNA, 20 bp, Artificial Sequence
  Description of Artificial Sequence: Synthetic oligonucleotide
  Target: SCN10A; (+) strand; PAM type: NRG; PAM sequence: GAG
ccaggtcaaatcttactata

SEQ ID NO: 38332 - DNA, 20 bp, Artificial Sequence
  Description of Artificial Sequence: Synthetic oligonucleotide
  Target: SCN10A; (+) strand; PAM type: NRG; PAM sequence: TGG
atagagcatttaaatccacg

SEQ ID NO: 38333 - DNA, 20 bp, Artificial Sequence
  Description of Artificial Sequence: Synthetic oligonucleotide
  Target: SCN10A; (+) strand; PAM type: NRG; PAM sequence: CAG
aaatccacgtggtgttgact

SEQ ID NO: 38334 - DNA, 20 bp, Artificial Sequence
  Description of Artificial Sequence: Synthetic oligonucleotide
  Target: SCN10A; (+) strand; PAM type: NRG; PAM sequence: AGG
aatccacgtggtgttgactc

SEQ ID NO: 38335 - DNA, 20 bp, Artificial Sequence
  Description of Artificial Sequence: Synthetic oligonucleotide
  Target: SCN10A; (+) strand; PAM type: NRG; PAM sequence: GAG
ttgactcaggatgtgacaat

SEQ ID NO: 38336 - DNA, 20 bp, Artificial Sequence
  Description of Artificial Sequence: Synthetic oligonucleotide
  Target: SCN10A; (+) strand; PAM type: NRG; PAM sequence: TGG
ggatgtgacaatgagattac

SEQ ID NO: 38337 - DNA, 20 bp, Artificial Sequence
  Description of Artificial Sequence: Synthetic oligonucleotide
  Target: SCN10A; (+) strand; PAM type: NRG; PAM sequence: GGG
gatgtgacaatgagattact

SEQ ID NO: 38338 - DNA, 20 bp, Artificial Sequence
  Description of Artificial Sequence: Synthetic oligonucleotide
  Target: SCN10A; (+) strand; PAM type: NRG; PAM sequence: GAG
tgtgacaatgagattactgg

SEQ ID NO: 38339 - DNA, 20 bp, Artificial Sequence
  Description of Artificial Sequence: Synthetic oligonucleotide
  Target: SCN10A; (+) strand; PAM type: NRG; PAM sequence: CAG
aatgagattactgggagaaa

SEQ ID NO: 38340 - DNA, 20 bp, Artificial Sequence
  Description of Artificial Sequence: Synthetic oligonucleotide
  Target: SCN10A; (+) strand; PAM type: NRG; PAM sequence: CAG
attactgggagaaacagatt

SEQ ID NO: 38341 - DNA, 20 bp, Artificial Sequence
  Description of Artificial Sequence: Synthetic oligonucleotide
  Target: SCN10A; (+) strand; PAM type: NRG; PAM sequence: TAG
actgggagaaacagattcag

SEQ ID NO: 38342 - DNA, 20 bp, Artificial Sequence
  Description of Artificial Sequence: Synthetic oligonucleotide
  Target: SCN10A; (+) strand; PAM type: NRG; PAM sequence: TGG
agaaacagattcagtagaca

SEQ ID NO: 38343 - DNA, 20 bp, Artificial Sequence
  Description of Artificial Sequence: Synthetic oligonucleotide
  Target: SCN10A; (+) strand; PAM type: NRG; PAM sequence: GGG
gaaacagattcagtagacat

SEQ ID NO: 38344 - DNA, 20 bp, Artificial Sequence
  Description of Artificial Sequence: Synthetic oligonucleotide
  Target: SCN10A; (+) strand; PAM type: NRG; PAM sequence: TGG
attcagtagacatgggaatc

SEQ ID NO: 38345 - DNA, 20 bp, Artificial Sequence
  Description of Artificial Sequence: Synthetic oligonucleotide
  Target: SCN10A; (+) strand; PAM type: NRG; PAM sequence: TGG
agacatgggaatctggtgca

SEQ ID NO: 38346 - DNA, 20 bp, Artificial Sequence
  Description of Artificial Sequence: Synthetic oligonucleotide
  Target: SCN10A; (+) strand; PAM type: NRG; PAM sequence: CAG
catgggaatctggtgcatgg

SEQ ID NO: 38347 - DNA, 20 bp, Artificial Sequence
  Description of Artificial Sequence: Synthetic oligonucleotide
  Target: SCN10A; (+) strand; PAM type: NRG; PAM sequence: AAG
gggaatctggtgcatggcag

SEQ ID NO: 38348 - DNA, 20 bp, Artificial Sequence
  Description of Artificial Sequence: Synthetic oligonucleotide
  Target: SCN10A; (+) strand; PAM type: NRG; PAM sequence: CAG
aatctggtgcatggcagaag

SEQ ID NO: 38349 - DNA, 20 bp, Artificial Sequence
  Description of Artificial Sequence: Synthetic oligonucleotide
  Target: SCN10A; (+) strand; PAM type: NRG; PAM sequence: TGG
ctggtgcatggcagaagcag

SEQ ID NO: 38350 - DNA, 20 bp, Artificial Sequence
  Description of Artificial Sequence: Synthetic oligonucleotide
  Target: SCN10A; (+) strand; PAM type: NRG; PAM sequence: TAG
gtgcatggcagaagcagtgg

SEQ ID NO: 38351 - DNA, 20 bp, Artificial Sequence
  Description of Artificial Sequence: Synthetic oligonucleotide
  Target: SCN10A; (+) strand; PAM type: NRG; PAM sequence: AGG
tgcatggcagaagcagtggt

SEQ ID NO: 38352 - DNA, 20 bp, Artificial Sequence
  Description of Artificial Sequence: Synthetic oligonucleotide
  Target: SCN10A; (+) strand; PAM type: NRG; PAM sequence: TGG
aagcagtggtaggaaccact

SEQ ID NO: 38353 - DNA, 20 bp, Artificial Sequence
  Description of Artificial Sequence: Synthetic oligonucleotide
  Target: SCN10A; (+) strand; PAM type: NRG; PAM sequence: GGG
agcagtggtaggaaccactt

SEQ ID NO: 38354 - DNA, 20 bp, Artificial Sequence
  Description of Artificial Sequence: Synthetic oligonucleotide
  Target: SCN10A; (+) strand; PAM type: NRG; PAM sequence: TGG
tgatgtattgaaaaaaatgt

SEQ ID NO: 38355 - DNA, 20 bp, Artificial Sequence
  Description of Artificial Sequence: Synthetic oligonucleotide
  Target: SCN10A; (+) strand; PAM type: NRG; PAM sequence: TGG
aaatgttggaataatccata

SEQ ID NO: 38356 - DNA, 20 bp, Artificial Sequence
  Description of Artificial Sequence: Synthetic oligonucleotide
  Target: SCN10A; (+) strand; PAM type: NRG; PAM sequence: TGG
taatccatatggaaaaatat

SEQ ID NO: 38357 - DNA, 20 bp, Artificial Sequence
  Description of Artificial Sequence: Synthetic oligonucleotide
  Target: SCN10A; (+) strand; PAM type: NRG; PAM sequence: AAG
tccatatggaaaaatattgg

SEQ ID NO: 38358 - DNA, 20 bp, Artificial Sequence
  Description of Artificial Sequence: Synthetic oligonucleotide
  Target: SCN10A; (+) strand; PAM type: NRG; PAM sequence: TAG
acacatacaaaaataaattc

SEQ ID NO: 38359 - DNA, 20 bp, Artificial Sequence
  Description of Artificial Sequence: Synthetic oligonucleotide
  Target: SCN10A; (+) strand; PAM type: NRG; PAM sequence: AGG
cacatacaaaaataaattct

SEQ ID NO: 38360 - DNA, 20 bp, Artificial Sequence
  Description of Artificial Sequence: Synthetic oligonucleotide
  Target: SCN10A; (+) strand; PAM type: NRG; PAM sequence: GAG
catacaaaaataaattctag

SEQ ID NO: 38361 - DNA, 20 bp, Artificial Sequence
  Description of Artificial Sequence: Synthetic oligonucleotide
  Target: SCN10A; (+) strand; PAM type: NRG; PAM sequence: TAG
gagattgaaatacctaaatg

SEQ ID NO: 38362 - DNA, 20 bp, Artificial Sequence
  Description of Artificial Sequence: Synthetic oligonucleotide
  Target: SCN10A; (+) strand; PAM type: NRG; PAM sequence: AAG
ttgaaatacctaaatgtaga

SEQ ID NO: 38363 - DNA, 20 bp, Artificial Sequence
  Description of Artificial Sequence: Synthetic oligonucleotide
  Target: SCN10A; (+) strand; PAM type: NRG; PAM sequence: AGG
tgaaatacctaaatgtagaa

SEQ ID NO: 38364 - DNA, 20 bp, Artificial Sequence
  Description of Artificial Sequence: Synthetic oligonucleotide
  Target: SCN10A; (+) strand; PAM type: NRG; PAM sequence: GAG
gaaaggaaaactgtaacttt

SEQ ID NO: 38365 - DNA, 20 bp, Artificial Sequence
  Description of Artificial Sequence: Synthetic oligonucleotide
  Target: SCN10A; (+) strand; PAM type: NRG; PAM sequence: AGG
aaaggaaaactgtaactttg

SEQ ID NO: 38366 - DNA, 20 bp, Artificial Sequence
  Description of Artificial Sequence: Synthetic oligonucleotide
  Target: SCN10A; (+) strand; PAM type: NRG; PAM sequence: GAG
aggaaaactgtaactttgag

SEQ ID NO: 38367 - DNA, 20 bp, Artificial Sequence
  Description of Artificial Sequence: Synthetic oligonucleotide
  Target: SCN10A; (+) strand; PAM type: NRG; PAM sequence: CAG
gtaactttgaggagaaaaca

SEQ ID NO: 38368 - DNA, 20 bp, Artificial Sequence
  Description of Artificial Sequence: Synthetic oligonucleotide
  Target: SCN10A; (+) strand; PAM type: NRG; PAM sequence: AGG
taactttgaggagaaaacac

SEQ ID NO: 38369 - DNA, 20 bp, Artificial Sequence
  Description of Artificial Sequence: Synthetic oligonucleotide
  Target: SCN10A; (+) strand; PAM type: NRG; PAM sequence: TGG
aacacaggataatatcttta

SEQ ID NO: 38370 - DNA, 20 bp, Artificial Sequence
  Description of Artificial Sequence: Synthetic oligonucleotide
  Target: SCN10A; (+) strand; PAM type: NRG; PAM sequence: TGG
tatctttatggaatactata

SEQ ID NO: 38371 - DNA, 20 bp, Artificial Sequence
  Description of Artificial Sequence: Synthetic oligonucleotide
  Target: SCN10A; (+) strand; PAM type: NRG; PAM sequence: TAG
gcaataaaaaatgaatgaat

SEQ ID NO: 38372 - DNA, 20 bp, Artificial Sequence
  Description of Artificial Sequence: Synthetic oligonucleotide
  Target: SCN10A; (+) strand; PAM type: NRG; PAM sequence: AGG
caataaaaaatgaatgaatt

SEQ ID NO: 38373 - DNA, 20 bp, Artificial Sequence
  Description of Artificial Sequence: Synthetic oligonucleotide
  Target: SCN10A; (+) strand; PAM type: NRG; PAM sequence: TGG
taggtctacatgtatccatt

SEQ ID NO: 38374 - DNA, 20 bp, Artificial Sequence
  Description of Artificial Sequence: Synthetic oligonucleotide
  Target: SCN10A; (+) strand; PAM type: NRG; PAM sequence: GGG
aggtctacatgtatccattt

SEQ ID NO: 38375 - DNA, 20 bp, Artificial Sequence
  Description of Artificial Sequence: Synthetic oligonucleotide
  Target: SCN10A; (+) strand; PAM type: NRG; PAM sequence: CAG
aaaacataattttaaaacat

SEQ ID NO: 38376 - DNA, 20 bp, Artificial Sequence
  Description of Artificial Sequence: Synthetic oligonucleotide
  Target: SCN10A; (+) strand; PAM type: NRG; PAM sequence: AAG
taattttaaaacatcagata

SEQ ID NO: 38377 - DNA, 20 bp, Artificial Sequence
  Description of Artificial Sequence: Synthetic oligonucleotide
  Target: SCN10A; (+) strand; PAM type: NRG; PAM sequence: CAG
gcacacatataaaatgataa

SEQ ID NO: 38378 - DNA, 20 bp, Artificial Sequence
  Description of Artificial Sequence: Synthetic oligonucleotide
  Target: SCN10A; (+) strand; PAM type: NRG; PAM sequence: AAG
aacagttccataaatttgaa

SEQ ID NO: 38379 - DNA, 20 bp, Artificial Sequence
  Description of Artificial Sequence: Synthetic oligonucleotide
  Target: SCN10A; (+) strand; PAM type: NRG; PAM sequence: CAG
aaatcaatactttatgcatg

SEQ ID NO: 38380 - DNA, 20 bp, Artificial Sequence
  Description of Artificial Sequence: Synthetic oligonucleotide
  Target: SCN10A; (+) strand; PAM type: NRG; PAM sequence: CAG
aacacccacttccccgtttg

SEQ ID NO: 38381 - DNA, 20 bp, Artificial Sequence
  Description of Artificial Sequence: Synthetic oligonucleotide
  Target: SCN10A; (+) strand; PAM type: NRG; PAM sequence: TAG
acccacttccccgtttgcag

SEQ ID NO: 38382 - DNA, 20 bp, Artificial Sequence
  Description of Artificial Sequence: Synthetic oligonucleotide
  Target: SCN10A; (+) strand; PAM type: NRG; PAM sequence: CAG
ttccccgtttgcagtagatt

SEQ ID NO: 38383 - DNA, 20 bp, Artificial Sequence
  Description of Artificial Sequence: Synthetic oligonucleotide
  Target: SCN10A; (+) strand; PAM type: NRG; PAM sequence: CAG
tcatttcacatgttctttgc

SEQ ID NO: 38384 - DNA, 20 bp, Artificial Sequence
  Description of Artificial Sequence: Synthetic oligonucleotide
  Target: SCN10A; (+) strand; PAM type: NRG; PAM sequence: AGG
catttcacatgttctttgcc

SEQ ID NO: 38385 - DNA, 20 bp, Artificial Sequence
  Description of Artificial Sequence: Synthetic oligonucleotide
  Target: SCN10A; (+) strand; PAM type: NRG; PAM sequence: GAG
tcacatgttctttgccaggt

SEQ ID NO: 38386 - DNA, 20 bp, Artificial Sequence
  Description of Artificial Sequence: Synthetic oligonucleotide
  Target: SCN10A; (+) strand; PAM type: NRG; PAM sequence: AAG
caaattgctataatttgtca

SEQ ID NO: 38387 - DNA, 20 bp, Artificial Sequence
  Description of Artificial Sequence: Synthetic oligonucleotide
  Target: SCN10A; (+) strand; PAM type: NRG; PAM sequence: AGG
aaattgctataatttgtcaa

SEQ ID NO: 38388 - DNA, 20 bp, Artificial Sequence
  Description of Artificial Sequence: Synthetic oligonucleotide
  Target: SCN10A; (+) strand; PAM type: NRG; PAM sequence: CAG
ataatttgtcaaaggttttc

SEQ ID NO: 38389 - DNA, 20 bp, Artificial Sequence
  Description of Artificial Sequence: Synthetic oligonucleotide
  Target: SCN10A; (+) strand; PAM type: NRG; PAM sequence: TAG
ttccagaatattgttatgct

SEQ ID NO: 38390 - DNA, 20 bp, Artificial Sequence
  Description of Artificial Sequence: Synthetic oligonucleotide
  Target: SCN10A; (+) strand; PAM type: NRG; PAM sequence: GAG
ccagaatattgttatgctta

SEQ ID NO: 38391 - DNA, 20 bp, Artificial Sequence
  Description of Artificial Sequence: Synthetic oligonucleotide
  Target: SCN10A; (+) strand; PAM type: NRG; PAM sequence: AGG
cagaatattgttatgcttag

SEQ ID NO: 38392 - DNA, 20 bp, Artificial Sequence
  Description of Artificial Sequence: Synthetic oligonucleotide
  Target: SCN10A; (+) strand; PAM type: NRG; PAM sequence: GAG
atattgttatgcttagaggt

SEQ ID NO: 38393 - DNA, 20 bp, Artificial Sequence
  Description of Artificial Sequence: Synthetic oligonucleotide
  Target: SCN10A; (+) strand; PAM type: NRG; PAM sequence: TAG
atgcttagaggtgagtgtcc

SEQ ID NO: 38394 - DNA, 20 bp, Artificial Sequence
  Description of Artificial Sequence: Synthetic oligonucleotide
  Target: SCN10A; (+) strand; PAM type: NRG; PAM sequence: AGG
tgcttagaggtgagtgtcct

SEQ ID NO: 38395 - DNA, 20 bp, Artificial Sequence
  Description of Artificial Sequence: Synthetic oligonucleotide
  Target: SCN10A; (+) strand; PAM type: NRG; PAM sequence: GGG
gcttagaggtgagtgtccta

SEQ ID NO: 38396 - DNA, 20 bp, Artificial Sequence
  Description of Artificial Sequence: Synthetic oligonucleotide
  Target: SCN10A; (+) strand; PAM type: NRG; PAM sequence: AAG
tgagtgtcctagggtcatca

SEQ ID NO: 38397 - DNA, 20 bp, Artificial Sequence
  Description of Artificial Sequence: Synthetic oligonucleotide
  Target: SCN10A; (+) strand; PAM type: NRG; PAM sequence: GAG
agtgtcctagggtcatcaaa

SEQ ID NO: 38398 - DNA, 20 bp, Artificial Sequence
  Description of Artificial Sequence: Synthetic oligonucleotide
  Target: SCN10A; (+) strand; PAM type: NRG; PAM sequence: CAG
cttcaatgattctctgaaac

SEQ ID NO: 38399 - DNA, 20 bp, Artificial Sequence
  Description of Artificial Sequence: Synthetic oligonucleotide
  Target: SCN10A; (+) strand; PAM type: NRG; PAM sequence: AGG
ttcaatgattctctgaaacc

SEQ ID NO: 38400 - DNA, 20 bp, Artificial Sequence
  Description of Artificial Sequence: Synthetic oligonucleotide
  Target: SCN10A; (+) strand; PAM type: NRG; PAM sequence: GGG
tcaatgattctctgaaacca

SEQ ID NO: 38401 - DNA, 20 bp, Artificial Sequence
  Description of Artificial Sequence: Synthetic oligonucleotide
  Target: SCN10A; (+) strand; PAM type: NRG; PAM sequence: TGG
gattctctgaaaccagggca

SEQ ID NO: 38402 - DNA, 20 bp, Artificial Sequence
  Description of Artificial Sequence: Synthetic oligonucleotide
  Target: SCN10A; (+) strand; PAM type: NRG; PAM sequence: GGG
attctctgaaaccagggcat

SEQ ID NO: 38403 - DNA, 20 bp, Artificial Sequence
  Description of Artificial Sequence: Synthetic oligonucleotide
  Target: SCN10A; (+) strand; PAM type: NRG; PAM sequence: GGG
ttctctgaaaccagggcatg

SEQ ID NO: 38404 - DNA, 20 bp, Artificial Sequence
  Description of Artificial Sequence: Synthetic oligonucleotide
  Target: SCN10A; (+) strand; PAM type: NRG; PAM sequence: GAG
ctctgaaaccagggcatggg

SEQ ID NO: 38405 - DNA, 20 bp, Artificial Sequence
  Description of Artificial Sequence: Synthetic oligonucleotide
  Target: SCN10A; (+) strand; PAM type: NRG; PAM sequence: GAG
ctgaaaccagggcatgggga

SEQ ID NO: 38406 - DNA, 20 bp, Artificial Sequence
  Description of Artificial Sequence: Synthetic oligonucleotide
  Target: SCN10A; (+) strand; PAM type: NRG; PAM sequence: TAG
aaaccagggcatggggagag

SEQ ID NO: 38407 - DNA, 20 bp, Artificial Sequence
  Description of Artificial Sequence: Synthetic oligonucleotide
  Target: SCN10A; (+) strand; PAM type: NRG; PAM sequence: AGG
aaccagggcatggggagagt

SEQ ID NO: 38408 - DNA, 20 bp, Artificial Sequence
  Description of Artificial Sequence: Synthetic oligonucleotide
  Target: SCN10A; (+) strand; PAM type: NRG; PAM sequence: AAG
agggcatggggagagtagga

SEQ ID NO: 38409 - DNA, 20 bp, Artificial Sequence
  Description of Artificial Sequence: Synthetic oligonucleotide
  Target: SCN10A; (+) strand; PAM type: NRG; PAM sequence: TAG
tggggagagtaggaaagttc

SEQ ID NO: 38410 - DNA, 20 bp, Artificial Sequence
  Description of Artificial Sequence: Synthetic oligonucleotide
  Target: SCN10A; (+) strand; PAM type: NRG; PAM sequence: TGG
cccctgctctctttaccttc

SEQ ID NO: 38411 - DNA, 20 bp, Artificial Sequence
  Description of Artificial Sequence: Synthetic oligonucleotide
  Target: SCN10A; (+) strand; PAM type: NRG; PAM sequence: GAG
taccttctggtgcccaatct

SEQ ID NO: 38412 - DNA, 20 bp, Artificial Sequence
  Description of Artificial Sequence: Synthetic oligonucleotide
  Target: SCN10A; (+) strand; PAM type: NRG; PAM sequence: AGG
accttctggtgcccaatctg

SEQ ID NO: 38413 - DNA, 20 bp, Artificial Sequence
  Description of Artificial Sequence: Synthetic oligonucleotide
  Target: SCN10A; (+) strand; PAM type: NRG; PAM sequence: AAG
ttctggtgcccaatctgagg

SEQ ID NO: 38414 - DNA, 20 bp, Artificial Sequence
  Description of Artificial Sequence: Synthetic oligonucleotide
  Target: SCN10A; (+) strand; PAM type: NRG; PAM sequence: TAG
ccaatctgaggaagaacctc

SEQ ID NO: 38415 - DNA, 20 bp, Artificial Sequence
  Description of Artificial Sequence: Synthetic oligonucleotide
  Target: SCN10A; (+) strand; PAM type: NRG; PAM sequence: AAG
agaacctctagtttcttccc

SEQ ID NO: 38416 - DNA, 20 bp, Artificial Sequence
  Description of Artificial Sequence: Synthetic oligonucleotide
  Target: SCN10A; (+) strand; PAM type: NRG; PAM sequence: AAG
tctagtttcttcccaagcaa

SEQ ID NO: 38417 - DNA, 20 bp, Artificial Sequence
  Description of Artificial Sequence: Synthetic oligonucleotide
  Target: SCN10A; (+) strand; PAM type: NRG; PAM sequence: GAG
tagtttcttcccaagcaaaa

SEQ ID NO: 38418 - DNA, 20 bp, Artificial Sequence
  Description of Artificial Sequence: Synthetic oligonucleotide
  Target: SCN10A; (+) strand; PAM type: NRG; PAM sequence: AGG
agtttcttcccaagcaaaag

SEQ ID NO: 38419 - DNA, 20 bp, Artificial Sequence
  Description of Artificial Sequence: Synthetic oligonucleotide
  Target: SCN10A; (+) strand; PAM type: NRG; PAM sequence: GGG
gtttcttcccaagcaaaaga

SEQ ID NO: 38420 - DNA, 20 bp, Artificial Sequence
  Description of Artificial Sequence: Synthetic oligonucleotide
  Target: SCN10A; (+) strand; PAM type: NRG; PAM sequence: GGG
tttcttcccaagcaaaagag

SEQ ID NO: 38421 - DNA, 20 bp, Artificial Sequence
  Description of Artificial Sequence: Synthetic oligonucleotide
  Target: SCN10A; (+) strand; PAM type: NRG; PAM sequence: TAG
tcccaagcaaaagaggggat

SEQ ID NO: 38422 - DNA, 20 bp, Artificial Sequence
  Description of Artificial Sequence: Synthetic oligonucleotide
  Target: SCN10A; (+) strand; PAM type: NRG; PAM sequence: TGG
caaaagaggggattagaaaa

SEQ ID NO: 38423 - DNA, 20 bp, Artificial Sequence
  Description of Artificial Sequence: Synthetic oligonucleotide
  Target: SCN10A; (+) strand; PAM type: NRG; PAM sequence: AAG
atctatctttatctttccac

SEQ ID NO: 38424 - DNA, 20 bp, Artificial Sequence
  Description of Artificial Sequence: Synthetic oligonucleotide
  Target: SCN10A; (+) strand; PAM type: NRG; PAM sequence: CAG
tatctttatctttccacaag

SEQ ID NO: 38425 - DNA, 20 bp, Artificial Sequence
  Description of Artificial Sequence: Synthetic oligonucleotide
  Target: SCN10A; (+) strand; PAM type: NRG; PAM sequence: CAG
tttatctttccacaagcaga

SEQ ID NO: 38426 - DNA, 20 bp, Artificial Sequence
  Description of Artificial Sequence: Synthetic oligonucleotide
  Target: SCN10A; (+) strand; PAM type: NRG; PAM sequence: TAG
tctttccacaagcagacaga

SEQ ID NO: 38427 - DNA, 20 bp, Artificial Sequence
  Description of Artificial Sequence: Synthetic oligonucleotide
  Target: SCN10A; (+) strand; PAM type: NRG; PAM sequence: AGG
ctttccacaagcagacagat

SEQ ID NO: 38428 - DNA, 20 bp, Artificial Sequence
  Description of Artificial Sequence: Synthetic oligonucleotide
  Target: SCN10A; (+) strand; PAM type: NRG; PAM sequence: CAG
tccacaagcagacagatagg

SEQ ID NO: 38429 - DNA, 20 bp, Artificial Sequence
  Description of Artificial Sequence: Synthetic oligonucleotide
  Target: SCN10A; (+) strand; PAM type: NRG; PAM sequence: AGG
ccacaagcagacagataggc

SEQ ID NO: 38430 - DNA, 20 bp, Artificial Sequence
  Description of Artificial Sequence: Synthetic oligonucleotide
  Target: SCN10A; (+) strand; PAM type: NRG; PAM sequence: CAG
cagacagataggcaggcacg

SEQ ID NO: 38431 - DNA, 20 bp, Artificial Sequence
  Description of Artificial Sequence: Synthetic oligonucleotide
  Target: SCN10A; (+) strand; PAM type: NRG; PAM sequence: AAG
cagataggcaggcacgcaga

SEQ ID NO: 38432 - DNA, 20 bp, Artificial Sequence
  Description of Artificial Sequence: Synthetic oligonucleotide
  Target: SCN10A; (+) strand; PAM type: NRG; PAM sequence: TAG
ggcaggcacgcagaaagaca

SEQ ID NO: 38433 - DNA, 20 bp, Artificial Sequence
  Description of Artificial Sequence: Synthetic oligonucleotide
  Target: SCN10A; (+) strand; PAM type: NRG; PAM sequence: GAG
caggcacgcagaaagacata

SEQ ID NO: 38434 - DNA, 20 bp, Artificial Sequence
  Description of Artificial Sequence: Synthetic oligonucleotide
  Target: SCN10A; (+) strand; PAM type: NRG; PAM sequence: CAG
agacatagagctaccattat

SEQ ID NO: 38435 - DNA, 20 bp, Artificial Sequence
  Description of Artificial Sequence: Synthetic oligonucleotide
  Target: SCN10A; (+) strand; PAM type: NRG; PAM sequence: CAG
catagagctaccattatcag

SEQ ID NO: 38436 - DNA, 20 bp, Artificial Sequence
  Description of Artificial Sequence: Synthetic oligonucleotide
  Target: SCN10A; (+) strand; PAM type: NRG; PAM sequence: AGG
atagagctaccattatcagc

SEQ ID NO: 38437 - DNA, 20 bp, Artificial Sequence
  Description of Artificial Sequence: Synthetic oligonucleotide
  Target: SCN10A; (+) strand; PAM type: NRG; PAM sequence: AAG
tatcagcaggtaattgtgca

SEQ ID NO: 38438 - DNA, 20 bp, Artificial Sequence
  Description of Artificial Sequence: Synthetic oligonucleotide
  Target: SCN10A; (+) strand; PAM type: NRG; PAM sequence: CAG
attgtgcaaagctaatgttt

SEQ ID NO: 38439 - DNA, 20 bp, Artificial Sequence
  Description of Artificial Sequence: Synthetic oligonucleotide
  Target: SCN10A; (+) strand; PAM type: NRG; PAM sequence: AAG
tgcaaagctaatgtttcagc

SEQ ID NO: 38440 - DNA, 20 bp, Artificial Sequence
  Description of Artificial Sequence: Synthetic oligonucleotide
  Target: SCN10A; (+) strand; PAM type: NRG; PAM sequence: AGG
gcaaagctaatgtttcagca

SEQ ID NO: 38441 - DNA, 20 bp, Artificial Sequence
  Description of Artificial Sequence: Synthetic oligonucleotide
  Target: SCN10A; (+) strand; PAM type: NRG; PAM sequence: TGG
aatgtttcagcaaggaataa

SEQ ID NO: 38442 - DNA, 20 bp, Artificial Sequence
  Description of Artificial Sequence: Synthetic oligonucleotide
  Target: SCN10A; (+) strand; PAM type: NRG; PAM sequence: AAG
gtttcagcaaggaataatgg

SEQ ID NO: 38443 - DNA, 20 bp, Artificial Sequence
  Description of Artificial Sequence: Synthetic oligonucleotide
  Target: SCN10A; (+) strand; PAM type: NRG; PAM sequence: AGG
tttcagcaaggaataatgga

SEQ ID NO: 38444 - DNA, 20 bp, Artificial Sequence
  Description of Artificial Sequence: Synthetic oligonucleotide
  Target: SCN10A; (+) strand; PAM type: NRG; PAM sequence: GGG
ttcagcaaggaataatggaa

SEQ ID NO: 38445 - DNA, 20 bp, Artificial Sequence
  Description of Artificial Sequence: Synthetic oligonucleotide
  Target: SCN10A; (+) strand; PAM type: NRG; PAM sequence: GAG
cagcaaggaataatggaagg

SEQ ID NO: 38446 - DNA, 20 bp, Artificial Sequence
  Description of Artificial Sequence: Synthetic oligonucleotide
  Target: SCN10A; (+) strand; PAM type: NRG; PAM sequence: AGG
agcaaggaataatggaaggg

SEQ ID NO: 38447 - DNA, 20 bp, Artificial Sequence
  Description of Artificial Sequence: Synthetic oligonucleotide
  Target: SCN10A; (+) strand; PAM type: NRG; PAM sequence: GGG
gcaaggaataatggaaggga

SEQ ID NO: 38448 - DNA, 20 bp, Artificial Sequence
  Description of Artificial Sequence: Synthetic oligonucleotide
  Target: SCN10A; (+) strand; PAM type: NRG; PAM sequence: AAG
aggaataatggaagggaggg

SEQ ID NO: 38449 - DNA, 20 bp, Artificial Sequence
  Description of Artificial Sequence: Synthetic oligonucleotide
  Target: SCN10A; (+) strand; PAM type: NRG; PAM sequence: AAG
taatggaagggagggaagat

SEQ ID NO: 38450 - DNA, 20 bp, Artificial Sequence
  Description of Artificial Sequence: Synthetic oligonucleotide
  Target: SCN10A; (+) strand; PAM type: NRG; PAM sequence: AGG
aatggaagggagggaagata

SEQ ID NO: 38451 - DNA, 20 bp, Artificial Sequence
  Description of Artificial Sequence: Synthetic oligonucleotide
  Target: SCN10A; (+) strand; PAM type: NRG; PAM sequence: AAG
agggagggaagataaggaaa

SEQ ID NO: 38452 - DNA, 20 bp, Artificial Sequence
  Description of Artificial Sequence: Synthetic oligonucleotide
  Target: SCN10A; (+) strand; PAM type: NRG; PAM sequence: AAG
ataaggaaaaagattgtgtt

SEQ ID NO: 38453 - DNA, 20 bp, Artificial Sequence
  Description of Artificial Sequence: Synthetic oligonucleotide
  Target: SCN10A; (+) strand; PAM type: NRG; PAM sequence: TGG
aaaagattgtgttaagaaca

SEQ ID NO: 38454 - DNA, 20 bp, Artificial Sequence
  Description of Artificial Sequence: Synthetic oligonucleotide
  Target: SCN10A; (+) strand; PAM type: NRG; PAM sequence: AAG
tgtgttaagaacatggcaat

SEQ ID NO: 38455 - DNA, 20 bp, Artificial Sequence
  Description of Artificial Sequence: Synthetic oligonucleotide
  Target: SCN10A; (+) strand; PAM type: NRG; PAM sequence: TGG
taagaacatggcaataagat

SEQ ID NO: 38456 - DNA, 20 bp, Artificial Sequence
  Description of Artificial Sequence: Synthetic oligonucleotide
  Target: SCN10A; (+) strand; PAM type: NRG; PAM sequence: TGG
attggtttctgattcctcac

SEQ ID NO: 38457 - DNA, 20 bp, Artificial Sequence
  Description of Artificial Sequence: Synthetic oligonucleotide
  Target: SCN10A; (+) strand; PAM type: NRG; PAM sequence: AAG
acaatttaatgctttttcaa

SEQ ID NO: 38458 - DNA, 20 bp, Artificial Sequence
  Description of Artificial Sequence: Synthetic oligonucleotide
  Target: SCN10A; (+) strand; PAM type: NRG; PAM sequence: CAG
aatgctttttcaaaagtata

SEQ ID NO: 38459 - DNA, 20 bp, Artificial Sequence
  Description of Artificial Sequence: Synthetic oligonucleotide
  Target: SCN10A; (+) strand; PAM type: NRG; PAM sequence: TGG
aaagtatacagcatgatctt

SEQ ID NO: 38460 - DNA, 20 bp, Artificial Sequence
  Description of Artificial Sequence: Synthetic oligonucleotide
  Target: SCN10A; (+) strand; PAM type: NRG; PAM sequence: GAG
agtatacagcatgatctttg

SEQ ID NO: 38461 - DNA, 20 bp, Artificial Sequence
  Description of Artificial Sequence: Synthetic oligonucleotide
  Target: SCN10A; (+) strand; PAM type: NRG; PAM sequence: CAG
cagcatgatctttggagccc

SEQ ID NO: 38462 - DNA, 20 bp, Artificial Sequence
  Description of Artificial Sequence: Synthetic oligonucleotide
  Target: SCN10A; (+) strand; PAM type: NRG; PAM sequence: AAG
ttggagccccagtctatccc

SEQ ID NO: 38463 - DNA, 20 bp, Artificial Sequence
  Description of Artificial Sequence: Synthetic oligonucleotide
  Target: SCN10A; (+) strand; PAM type: NRG; PAM sequence: AGG
tggagccccagtctatccca

SEQ ID NO: 38464 - DNA, 20 bp, Artificial Sequence
  Description of Artificial Sequence: Synthetic oligonucleotide
  Target: SCN10A; (+) strand; PAM type: NRG; PAM sequence: TGG
ggacatttattatcttcctc

SEQ ID NO: 38465 - DNA, 20 bp, Artificial Sequence
  Description of Artificial Sequence: Synthetic oligonucleotide
  Target: SCN10A; (+) strand; PAM type: NRG; PAM sequence: GGG
gacatttattatcttcctct

SEQ ID NO: 38466 - DNA, 20 bp, Artificial Sequence
  Description of Artificial Sequence: Synthetic oligonucleotide
  Target: SCN10A; (+) strand; PAM type: NRG; PAM sequence: CAG
attatcttcctctgggttct

SEQ ID NO: 38467 - DNA, 20 bp, Artificial Sequence
  Description of Artificial Sequence: Synthetic oligonucleotide
  Target: SCN10A; (+) strand; PAM type: NRG; PAM sequence: TAG
cctctgggttctcagcaaca

SEQ ID NO: 38468 - DNA, 20 bp, Artificial Sequence
  Description of Artificial Sequence: Synthetic oligonucleotide
  Target: SCN10A; (+) strand; PAM type: NRG; PAM sequence: AGG
ctctgggttctcagcaacat

SEQ ID NO: 38469 - DNA, 20 bp, Artificial Sequence
  Description of Artificial Sequence: Synthetic oligonucleotide
  Target: SCN10A; (+) strand; PAM type: NRG; PAM sequence: TGG
gcaacataggaaacaactaa

SEQ ID NO: 38470 - DNA, 20 bp, Artificial Sequence
  Description of Artificial Sequence: Synthetic oligonucleotide
  Target: SCN10A; (+) strand; PAM type: NRG; PAM sequence: AAG
ttatcaatttgcatttcaaa

SEQ ID NO: 38471 - DNA, 20 bp, Artificial Sequence
  Description of Artificial Sequence: Synthetic oligonucleotide
  Target: SCN10A; (+) strand; PAM type: NRG; PAM sequence: TAG
tgcatttcaaaaagaaaatc

SEQ ID NO: 38472 - DNA, 20 bp, Artificial Sequence
  Description of Artificial Sequence: Synthetic oligonucleotide
  Target: SCN10A; (+) strand; PAM type: NRG; PAM sequence: GAG
tctagtctgattatttccac

SEQ ID NO: 38473 - DNA, 20 bp, Artificial Sequence
  Description of Artificial Sequence: Synthetic oligonucleotide
  Target: SCN10A; (+) strand; PAM type: NRG; PAM sequence: AGG
ctagtctgattatttccacg

SEQ ID NO: 38474 - DNA, 20 bp, Artificial Sequence
  Description of Artificial Sequence: Synthetic oligonucleotide
  Target: SCN10A; (+) strand; PAM type: NRG; PAM sequence: AAG
ctgattatttccacgaggcc

SEQ ID NO: 38475 - DNA, 20 bp, Artificial Sequence
  Description of Artificial Sequence: Synthetic oligonucleotide
  Target: SCN10A; (+) strand; PAM type: NRG; PAM sequence: AGG
tgattatttccacgaggcca

SEQ ID NO: 38476 - DNA, 20 bp, Artificial Sequence
  Description of Artificial Sequence: Synthetic oligonucleotide
  Target: SCN10A; (+) strand; PAM type: NRG; PAM sequence: CAG
atacctgtcacataaattcc

SEQ ID NO: 38477 - DNA, 20 bp, Artificial Sequence
  Description of Artificial Sequence: Synthetic oligonucleotide
  Target: SCN10A; (+) strand; PAM type: NRG; PAM sequence: AGG
tacctgtcacataaattccc

SEQ ID NO: 38478 - DNA, 20 bp, Artificial Sequence
  Description of Artificial Sequence: Synthetic oligonucleotide
  Target: SCN10A; (+) strand; PAM type: NRG; PAM sequence: TAG
ttcccaggattgtgaccata

SEQ ID NO: 38479 - DNA, 20 bp, Artificial Sequence
  Description of Artificial Sequence: Synthetic oligonucleotide
  Target: SCN10A; (+) strand; PAM type: NRG; PAM sequence: AGG
tcccaggattgtgaccatat

SEQ ID NO: 38480 - DNA, 20 bp, Artificial Sequence
  Description of Artificial Sequence: Synthetic oligonucleotide
  Target: SCN10A; (+) strand; PAM type: NRG; PAM sequence: TAG
caggattgtgaccatatagg

SEQ ID NO: 38481 - DNA, 20 bp, Artificial Sequence
  Description of Artificial Sequence: Synthetic oligonucleotide
  Target: SCN10A; (+) strand; PAM type: NRG; PAM sequence: TAG
tgtatatgttatacttttca

SEQ ID NO: 38482 - DNA, 20 bp, Artificial Sequence
  Description of Artificial Sequence: Synthetic oligonucleotide
  Target: SCN10A; (+) strand; PAM type: NRG; PAM sequence: AAG
cttttcatagtgtgcatata

SEQ ID NO: 38483 - DNA, 20 bp, Artificial Sequence
  Description of Artificial Sequence: Synthetic oligonucleotide
  Target: SCN10A; (+) strand; PAM type: NRG; PAM sequence: AGG
ttttcatagtgtgcatataa

SEQ ID NO: 38484 - DNA, 20 bp, Artificial Sequence
  Description of Artificial Sequence: Synthetic oligonucleotide
  Target: SCN10A; (+) strand; PAM type: NRG; PAM sequence: GGG
tttcatagtgtgcatataaa

SEQ ID NO: 38485 - DNA, 20 bp, Artificial Sequence
  Description of Artificial Sequence: Synthetic oligonucleotide
  Target: SCN10A; (+) strand; PAM type: NRG; PAM sequence: CAG
tataaagggaattatgtcaa

SEQ ID NO: 38486 - DNA, 20 bp, Artificial Sequence
  Description of Artificial Sequence: Synthetic oligonucleotide
  Target: SCN10A; (+) strand; PAM type: NRG; PAM sequence: CAG
agggaattatgtcaacagtt

SEQ ID NO: 38487 - DNA, 20 bp, Artificial Sequence
  Description of Artificial Sequence: Synthetic oligonucleotide
  Target: SCN10A; (+) strand; PAM type: NRG; PAM sequence: AAG
agttaatacaaaatctccta

SEQ ID NO: 38488 - DNA, 20 bp, Artificial Sequence
  Description of Artificial Sequence: Synthetic oligonucleotide
  Target: SCN10A; (+) strand; PAM type: NRG; PAM sequence: TGG
atacaaaatctcctaaagaa

SEQ ID NO: 38489 - DNA, 20 bp, Artificial Sequence
  Description of Artificial Sequence: Synthetic oligonucleotide
  Target: SCN10A; (+) strand; PAM type: NRG; PAM sequence: TGG
agaatggatttgataattac

SEQ ID NO: 38490 - DNA, 20 bp, Artificial Sequence
  Description of Artificial Sequence: Synthetic oligonucleotide
  Target: SCN10A; (+) strand; PAM type: NRG; PAM sequence: GGG
gaatggatttgataattact

SEQ ID NO: 38491 - DNA, 20 bp, Artificial Sequence
  Description of Artificial Sequence: Synthetic oligonucleotide
  Target: SCN10A; (+) strand; PAM type: NRG; PAM sequence: TGG
gatttgataattactgggaa

SEQ ID NO: 38492 - DNA, 20 bp, Artificial Sequence
  Description of Artificial Sequence: Synthetic oligonucleotide
  Target: SCN10A; (+) strand; PAM type: NRG; PAM sequence: AAG
tgataattactgggaatgga

SEQ ID NO: 38493 - DNA, 20 bp, Artificial Sequence
  Description of Artificial Sequence: Synthetic oligonucleotide
  Target: SCN10A; (+) strand; PAM type: NRG; PAM sequence: AGG
gataattactgggaatggaa

SEQ ID NO: 38494 - DNA, 20 bp, Artificial Sequence
  Description of Artificial Sequence: Synthetic oligonucleotide
  Target: SCN10A; (+) strand; PAM type: NRG; PAM sequence: TGG
gaatggaaaggatccaactt

SEQ ID NO: 38495 - DNA, 20 bp, Artificial Sequence
  Description of Artificial Sequence: Synthetic oligonucleotide
  Target: SCN10A; (+) strand; PAM type: NRG; PAM sequence: AAG
tggaaaggatccaactttgg

SEQ ID NO: 38496 - DNA, 20 bp, Artificial Sequence
  Description of Artificial Sequence: Synthetic oligonucleotide
  Target: SCN10A; (+) strand; PAM type: NRG; PAM sequence: TGG
tccaactttggaagacgatt

SEQ ID NO: 38497 - DNA, 20 bp, Artificial Sequence
  Description of Artificial Sequence: Synthetic oligonucleotide
  Target: SCN10A; (+) strand; PAM type: NRG; PAM sequence: TGG
aaatgtacacccctttgacc

SEQ ID NO: 38498 - DNA, 20 bp, Artificial Sequence
  Description of Artificial Sequence: Synthetic oligonucleotide
  Target: SCN10A; (+) strand; PAM type: NRG; PAM sequence: TAG
tgacctggcaattctacttc

SEQ ID NO: 38499 - DNA, 20 bp, Artificial Sequence
  Description of Artificial Sequence: Synthetic oligonucleotide
  Target: SCN10A; (+) strand; PAM type: NRG; PAM sequence: AAG
ttactcatattatgtgtaca

SEQ ID NO: 38500 - DNA, 20 bp, Artificial Sequence
  Description of Artificial Sequence: Synthetic oligonucleotide
  Target: SCN10A; (+) strand; PAM type: NRG; PAM sequence: AAG
gtgtacaaagatacatgtgt

SEQ ID NO: 38501 - DNA, 20 bp, Artificial Sequence
  Description of Artificial Sequence: Synthetic oligonucleotide
  Target: SCN10A; (+) strand; PAM type: NRG; PAM sequence: AGG
tgtacaaagatacatgtgta

SEQ ID NO: 38502 - DNA, 20 bp, Artificial Sequence
  Description of Artificial Sequence: Synthetic oligonucleotide
  Target: SCN10A; (+) strand; PAM type: NRG; PAM sequence: TGG
ctcaccaaaaaattaatatg

SEQ ID NO: 38503 - DNA, 20 bp, Artificial Sequence
  Description of Artificial Sequence: Synthetic oligonucleotide
  Target: SCN10A; (+) strand; PAM type: NRG; PAM sequence: TGG
accaaaaaattaatatgtgg

SEQ ID NO: 38504 - DNA, 20 bp, Artificial Sequence
  Description of Artificial Sequence: Synthetic oligonucleotide
  Target: SCN10A; (+) strand; PAM type: NRG; PAM sequence: GAG
aatatgtggtggcaaaatat

SEQ ID NO: 38505 - DNA, 20 bp, Artificial Sequence
  Description of Artificial Sequence: Synthetic oligonucleotide
  Target: SCN10A; (+) strand; PAM type: NRG; PAM sequence: AGG
atatgtggtggcaaaatatg

SEQ ID NO: 38506 - DNA, 20 bp, Artificial Sequence
  Description of Artificial Sequence: Synthetic oligonucleotide
  Target: SCN10A; (+) strand; PAM type: NRG; PAM sequence: TAG
taaatgtgaatgtctatcaa

SEQ ID NO: 38507 - DNA, 20 bp, Artificial Sequence
  Description of Artificial Sequence: Synthetic oligonucleotide
  Target: SCN10A; (+) strand; PAM type: NRG; PAM sequence: AGG
aaatgtgaatgtctatcaat

SEQ ID NO: 38508 - DNA, 20 bp, Artificial Sequence
  Description of Artificial Sequence: Synthetic oligonucleotide
  Target: SCN10A; (+) strand; PAM type: NRG; PAM sequence: TAG
aatgtctatcaataggaaaa

SEQ ID NO: 38509 - DNA, 20 bp, Artificial Sequence
  Description of Artificial Sequence: Synthetic oligonucleotide
  Target: SCN10A; (+) strand; PAM type: NRG; PAM sequence: CAG
ccatgcaaatgaaatctgtt

SEQ ID NO: 38510 - DNA, 20 bp, Artificial Sequence
  Description of Artificial Sequence: Synthetic oligonucleotide
  Target: SCN10A; (+) strand; PAM type: NRG; PAM sequence: CAG
ttcagctaatttctataaaa

SEQ ID NO: 38511 - DNA, 20 bp, Artificial Sequence
  Description of Artificial Sequence: Synthetic oligonucleotide
  Target: SCN10A; (+) strand; PAM type: NRG; PAM sequence: TGG
ttctataaaacagctgctgc

SEQ ID NO: 38512 - DNA, 20 bp, Artificial Sequence
  Description of Artificial Sequence: Synthetic oligonucleotide
  Target: SCN10A; (+) strand; PAM type: NRG; PAM sequence: GGG
tctataaaacagctgctgct

SEQ ID NO: 38513 - DNA, 20 bp, Artificial Sequence
  Description of Artificial Sequence: Synthetic oligonucleotide
  Target: SCN10A; (+) strand; PAM type: NRG; PAM sequence: TGG
agctgctgctgggatttttt

SEQ ID NO: 38514 - DNA, 20 bp, Artificial Sequence
  Description of Artificial Sequence: Synthetic oligonucleotide
  Target: SCN10A; (+) strand; PAM type: NRG; PAM sequence: GGG
gctgctgctgggattttttt

SEQ ID NO: 38515 - DNA, 20 bp, Artificial Sequence
  Description of Artificial Sequence: Synthetic oligonucleotide
  Target: SCN10A; (+) strand; PAM type: NRG; PAM sequence: GGG
ctgctgctgggatttttttg

SEQ ID NO: 38516 - DNA, 20 bp, Artificial Sequence
  Description of Artificial Sequence: Synthetic oligonucleotide
  Target: SCN10A; (+) strand; PAM type: NRG; PAM sequence: TAG
tggggatgtcattgaattta

SEQ ID NO: 38517 - DNA, 20 bp, Artificial Sequence
  Description of Artificial Sequence: Synthetic oligonucleotide
  Target: SCN10A; (+) strand; PAM type: NRG; PAM sequence: TGG
attgaatttatagactaatt

SEQ ID NO: 38518 - DNA, 20 bp, Artificial Sequence
  Description of Artificial Sequence: Synthetic oligonucleotide
  Target: SCN10A; (+) strand; PAM type: NRG; PAM sequence: GGG
ttgaatttatagactaattt

SEQ ID NO: 38519 - DNA, 20 bp, Artificial Sequence
  Description of Artificial Sequence: Synthetic oligonucleotide
  Target: SCN10A; (+) strand; PAM type: NRG; PAM sequence: CAG
aatttatagactaatttggg

SEQ ID NO: 38520 - DNA, 20 bp, Artificial Sequence
  Description of Artificial Sequence: Synthetic oligonucleotide
  Target: SCN10A; (+) strand; PAM type: NRG; PAM sequence: CAG
caattatgaatcttctaatc

SEQ ID NO: 38521 - DNA, 20 bp, Artificial Sequence
  Description of Artificial Sequence: Synthetic oligonucleotide
  Target: SCN10A; (+) strand; PAM type: NRG; PAM sequence: GAG
atcttctaatccagtcacat

SEQ ID NO: 38522 - DNA, 20 bp, Artificial Sequence
  Description of Artificial Sequence: Synthetic oligonucleotide
  Target: SCN10A; (+) strand; PAM type: NRG; PAM sequence: TAG
gagacatcctttaattcatt

SEQ ID NO: 38523 - DNA, 20 bp, Artificial Sequence
  Description of Artificial Sequence: Synthetic oligonucleotide
  Target: SCN10A; (+) strand; PAM type: NRG; PAM sequence: AGG
agacatcctttaattcattt

SEQ ID NO: 38524 - DNA, 20 bp, Artificial Sequence
  Description of Artificial Sequence: Synthetic oligonucleotide
  Target: SCN10A; (+) strand; PAM type: NRG; PAM sequence: TAG
aataatgctgtattattttt

SEQ ID NO: 38525 - DNA, 20 bp, Artificial Sequence
  Description of Artificial Sequence: Synthetic oligonucleotide
  Target: SCN10A; (+) strand; PAM type: NRG; PAM sequence: AAG
ctgtattattttttagtata

SEQ ID NO: 38526 - DNA, 20 bp, Artificial Sequence
  Description of Artificial Sequence: Synthetic oligonucleotide
  Target: SCN10A; (+) strand; PAM type: NRG; PAM sequence: AGG
tgtattattttttagtataa

SEQ ID NO: 38527 - DNA, 20 bp, Artificial Sequence
  Description of Artificial Sequence: Synthetic oligonucleotide
  Target: SCN10A; (+) strand; PAM type: NRG; PAM sequence: CAG
tcttgtgcatatttttacaa

SEQ ID NO: 38528 - DNA, 20 bp, Artificial Sequence
  Description of Artificial Sequence: Synthetic oligonucleotide
  Target: SCN10A; (+) strand; PAM type: NRG; PAM sequence: TGG
catatttttacaacagcatt

SEQ ID NO: 38529 - DNA, 20 bp, Artificial Sequence
  Description of Artificial Sequence: Synthetic oligonucleotide
  Target: SCN10A; (+) strand; PAM type: NRG; PAM sequence: TAG
acaacagcatttggatttat

SEQ ID NO: 38530 - DNA, 20 bp, Artificial Sequence
  Description of Artificial Sequence: Synthetic oligonucleotide
  Target: SCN10A; (+) strand; PAM type: NRG; PAM sequence: TAG
ttcatttgttatcctttttc

SEQ ID NO: 38531 - DNA, 20 bp, Artificial Sequence
  Description of Artificial Sequence: Synthetic oligonucleotide
  Target: SCN10A; (+) strand; PAM type: NRG; PAM sequence: TAG
tatcctttttctagttttgt

SEQ ID NO: 38532 - DNA, 20 bp, Artificial Sequence
  Description of Artificial Sequence: Synthetic oligonucleotide
  Target: SCN10A; (+) strand; PAM type: NRG; PAM sequence: AGG
atcctttttctagttttgtt

SEQ ID NO: 38533 - DNA, 20 bp, Artificial Sequence
  Description of Artificial Sequence: Synthetic oligonucleotide
  Target: SCN10A; (+) strand; PAM type: NRG; PAM sequence: CAG
gtctttaaataatttctttt

SEQ ID NO: 38534 - DNA, 20 bp, Artificial Sequence
  Description of Artificial Sequence: Synthetic oligonucleotide
  Target: SCN10A; (+) strand; PAM type: NRG; PAM sequence: TAG
atgtctttaactgcactctc

SEQ ID NO: 38535 - DNA, 20 bp, Artificial Sequence
  Description of Artificial Sequence: Synthetic oligonucleotide
  Target: SCN10A; (+) strand; PAM type: NRG; PAM sequence: AGG
tgtctttaactgcactctct

SEQ ID NO: 38536 - DNA, 20 bp, Artificial Sequence
  Description of Artificial Sequence: Synthetic oligonucleotide
  Target: SCN10A; (+) strand; PAM type: NRG; PAM sequence: TAG
ccctcgaaattatataattt

SEQ ID NO: 38537 - DNA, 20 bp, Artificial Sequence
  Description of Artificial Sequence: Synthetic oligonucleotide
  Target: SCN10A; (+) strand; PAM type: NRG; PAM sequence: TAG
aattatataattttagttta

SEQ ID NO: 38538 - DNA, 20 bp, Artificial Sequence
  Description of Artificial Sequence: Synthetic oligonucleotide
  Target: SCN10A; (+) strand; PAM type: NRG; PAM sequence: AAG
ttatagtttgtcttttgtcc

SEQ ID NO: 38539 - DNA, 20 bp, Artificial Sequence
  Description of Artificial Sequence: Synthetic oligonucleotide
  Target: SCN10A; (+) strand; PAM type: NRG; PAM sequence: AAG
cttttgtccaagaattcttt

SEQ ID NO: 38540 - DNA, 20 bp, Artificial Sequence
  Description of Artificial Sequence: Synthetic oligonucleotide
  Target: SCN10A; (+) strand; PAM type: NRG; PAM sequence: GAG
tttgtccaagaattctttaa

SEQ ID NO: 38541 - DNA, 20 bp, Artificial Sequence
  Description of Artificial Sequence: Synthetic oligonucleotide
  Target: SCN10A; (+) strand; PAM type: NRG; PAM sequence: GAG
tgtccaagaattctttaaga

SEQ ID NO: 38542 - DNA, 20 bp, Artificial Sequence
  Description of Artificial Sequence: Synthetic oligonucleotide
  Target: SCN10A; (+) strand; PAM type: NRG; PAM sequence: AAG
agagatttttaaaaattatc

SEQ ID NO: 38543 - DNA, 20 bp, Artificial Sequence
  Description of Artificial Sequence: Synthetic oligonucleotide
  Target: SCN10A; (+) strand; PAM type: NRG; PAM sequence: TGG
gatttttaaaaattatcaag

SEQ ID NO: 38544 - DNA, 20 bp, Artificial Sequence
  Description of Artificial Sequence: Synthetic oligonucleotide
  Target: SCN10A; (+) strand; PAM type: NRG; PAM sequence: AAG
tttaaaaattatcaagtgga

SEQ ID NO: 38545 - DNA, 20 bp, Artificial Sequence
  Description of Artificial Sequence: Synthetic oligonucleotide
  Target: SCN10A; (+) strand; PAM type: NRG; PAM sequence: TGG
tcctctcatttcattaaatt

SEQ ID NO: 38546 - DNA, 20 bp, Artificial Sequence
  Description of Artificial Sequence: Synthetic oligonucleotide
  Target: SCN10A; (+) strand; PAM type: NRG; PAM sequence: CAG
taactctatttcattatgat

SEQ ID NO: 38547 - DNA, 20 bp, Artificial Sequence
  Description of Artificial Sequence: Synthetic oligonucleotide
  Target: SCN10A; (+) strand; PAM type: NRG; PAM sequence: GAG
actctatttcattatgatca

SEQ ID NO: 38548 - DNA, 20 bp, Artificial Sequence
  Description of Artificial Sequence: Synthetic oligonucleotide
  Target: SCN10A; (+) strand; PAM type: NRG; PAM sequence: TGG
tctatattatttccactttc

SEQ ID NO: 38549 - DNA, 20 bp, Artificial Sequence
  Description of Artificial Sequence: Synthetic oligonucleotide
  Target: SCN10A; (+) strand; PAM type: NRG; PAM sequence: GAG
tatattatttccactttctg

SEQ ID NO: 38550 - DNA, 20 bp, Artificial Sequence
  Description of Artificial Sequence: Synthetic oligonucleotide
  Target: SCN10A; (+) strand; PAM type: NRG; PAM sequence: GAG
tccactttctggagcttatt

SEQ ID NO: 38551 - DNA, 20 bp, Artificial Sequence
  Description of Artificial Sequence: Synthetic oligonucleotide
  Target: SCN10A; (+) strand; PAM type: NRG; PAM sequence: AGG
ccactttctggagcttattg

SEQ ID NO: 38552 - DNA, 20 bp, Artificial Sequence
  Description of Artificial Sequence: Synthetic oligonucleotide
  Target: SCN10A; (+) strand; PAM type: NRG; PAM sequence: TGG
gcttattgaggtttttgtca

SEQ ID NO: 38553 - DNA, 20 bp, Artificial Sequence
  Description of Artificial Sequence: Synthetic oligonucleotide
  Target: SCN10A; (+) strand; PAM type: NRG; PAM sequence: TGG
ttttgtcatggcttaatatt

SEQ ID NO: 38554 - DNA, 20 bp, Artificial Sequence
  Description of Artificial Sequence: Synthetic oligonucleotide
  Target: SCN10A; (+) strand; PAM type: NRG; PAM sequence: TGG
aatatttggtttgatatgtt

SEQ ID NO: 38555 - DNA, 20 bp, Artificial Sequence
  Description of Artificial Sequence: Synthetic oligonucleotide
  Target: SCN10A; (+) strand; PAM type: NRG; PAM sequence: AAG
gatatgtttggttttttgaa

SEQ ID NO: 38556 - DNA, 20 bp, Artificial Sequence
  Description of Artificial Sequence: Synthetic oligonucleotide
  Target: SCN10A; (+) strand; PAM type: NRG; PAM sequence: AGG
atatgtttggttttttgaaa

SEQ ID NO: 38557 - DNA, 20 bp, Artificial Sequence
  Description of Artificial Sequence: Synthetic oligonucleotide
  Target: SCN10A; (+) strand; PAM type: NRG; PAM sequence: GAG
atgtttggttttttgaaaag

SEQ ID NO: 38558 - DNA, 20 bp, Artificial Sequence
  Description of Artificial Sequence: Synthetic oligonucleotide
  Target: SCN10A; (+) strand; PAM type: NRG; PAM sequence: AGG
tgtttggttttttgaaaagg

SEQ ID NO: 38559 - DNA, 20 bp, Artificial Sequence
  Description of Artificial Sequence: Synthetic oligonucleotide
  Target: SCN10A; (+) strand; PAM type: NRG; PAM sequence: TAG
ggaggtgcattttctattgt

SEQ ID NO: 38560 - DNA, 20 bp, Artificial Sequence
  Description of Artificial Sequence: Synthetic oligonucleotide
  Target: SCN10A; (+) strand; PAM type: NRG; PAM sequence: AGG
gaggtgcattttctattgtt

SEQ ID NO: 38561 - DNA, 20 bp, Artificial Sequence
  Description of Artificial Sequence: Synthetic oligonucleotide
  Target: SCN10A; (+) strand; PAM type: NRG; PAM sequence: GGG
aggtgcattttctattgtta

SEQ ID NO: 38562 - DNA, 20 bp, Artificial Sequence
  Description of Artificial Sequence: Synthetic oligonucleotide
  Target: SCN10A; (+) strand; PAM type: NRG; PAM sequence: AAG
tgcattttctattgttaggg

SEQ ID NO: 38563 - DNA, 20 bp, Artificial Sequence
  Description of Artificial Sequence: Synthetic oligonucleotide
  Target: SCN10A; (+) strand; PAM type: NRG; PAM sequence: AGG
gcattttctattgttaggga

SEQ ID NO: 38564 - DNA, 20 bp, Artificial Sequence
  Description of Artificial Sequence: Synthetic oligonucleotide
  Target: SCN10A; (+) strand; PAM type: NRG; PAM sequence: TAG
ttttctattgttagggaagg

SEQ ID NO: 38565 - DNA, 20 bp, Artificial Sequence
  Description of Artificial Sequence: Synthetic oligonucleotide
  Target: SCN10A; (+) strand; PAM type: NRG; PAM sequence: CAG
gtagtttgctatatattaat

SEQ ID NO: 38566 - DNA, 20 bp, Artificial Sequence
  Description of Artificial Sequence: Synthetic oligonucleotide
  Target: SCN10A; (+) strand; PAM type: NRG; PAM sequence: TAG
cattatattaattatattac

SEQ ID NO: 38567 - DNA, 20 bp, Artificial Sequence
  Description of Artificial Sequence: Synthetic oligonucleotide
  Target: SCN10A; (+) strand; PAM type: NRG; PAM sequence: AGG
attatattaattatattact

SEQ ID NO: 38568 - DNA, 20 bp, Artificial Sequence
  Description of Artificial Sequence: Synthetic oligonucleotide
  Target: SCN10A; (+) strand; PAM type: NRG; PAM sequence: TGG
taatacatttgatctgttat

SEQ ID NO: 38569 - DNA, 20 bp, Artificial Sequence
  Description of Artificial Sequence: Synthetic oligonucleotide
  Target: SCN10A; (+) strand; PAM type: NRG; PAM sequence: AAG
ttgccatcttatttgttgca

SEQ ID NO: 38570 - DNA, 20 bp, Artificial Sequence
  Description of Artificial Sequence: Synthetic oligonucleotide
  Target: SCN10A; (+) strand; PAM type: NRG; PAM sequence: TAG
tcttatttgttgcaaagata

SEQ ID NO: 38571 - DNA, 20 bp, Artificial Sequence
  Description of Artificial Sequence: Synthetic oligonucleotide
  Target: SCN10A; (+) strand; PAM type: NRG; PAM sequence: GAG
ctatttcatgctttttgacc

SEQ ID NO: 38572 - DNA, 20 bp, Artificial Sequence
  Description of Artificial Sequence: Synthetic oligonucleotide
  Target: SCN10A; (+) strand; PAM type: NRG; PAM sequence: TGG
tttctctgatattaaaatca

SEQ ID NO: 38573 - DNA, 20 bp, Artificial Sequence
  Description of Artificial Sequence: Synthetic oligonucleotide
  Target: SCN10A; (+) strand; PAM type: NRG; PAM sequence: TAG
tcttttgaattctataattt

SEQ ID NO: 38574 - DNA, 20 bp, Artificial Sequence
  Description of Artificial Sequence: Synthetic oligonucleotide
  Target: SCN10A; (+) strand; PAM type: NRG; PAM sequence: GAG
tagcctttctgtatcaccgt

SEQ ID NO: 38575 - DNA, 20 bp, Artificial Sequence
  Description of Artificial Sequence: Synthetic oligonucleotide
  Target: SCN10A; (+) strand; PAM type: NRG; PAM sequence: AGG
agcctttctgtatcaccgtg

SEQ ID NO: 38576 - DNA, 20 bp, Artificial Sequence
  Description of Artificial Sequence: Synthetic oligonucleotide
  Target: SCN10A; (+) strand; PAM type: NRG; PAM sequence: GAG
cctttctgtatcaccgtgag

SEQ ID NO: 38577 - DNA, 20 bp, Artificial Sequence
  Description of Artificial Sequence: Synthetic oligonucleotide
  Target: SCN10A; (+) strand; PAM type: NRG; PAM sequence: TAG
agtattttttttattcaaca

SEQ ID NO: 38578 - DNA, 20 bp, Artificial Sequence
  Description of Artificial Sequence: Synthetic oligonucleotide
  Target: SCN10A; (+) strand; PAM type: NRG; PAM sequence: GAG
tattttttttattcaacata

SEQ ID NO: 38579 - DNA, 20 bp, Artificial Sequence
  Description of Artificial Sequence: Synthetic oligonucleotide
  Target: SCN10A; (+) strand; PAM type: NRG; PAM sequence: TGG
ttttttattcaacatagagt

SEQ ID NO: 38580 - DNA, 20 bp, Artificial Sequence
  Description of Artificial Sequence: Synthetic oligonucleotide
  Target: SCN10A; (+) strand; PAM type: NRG; PAM sequence: GGG
tttttattcaacatagagtt

SEQ ID NO: 38581 - DNA, 20 bp, Artificial Sequence
  Description of Artificial Sequence: Synthetic oligonucleotide
  Target: SCN10A; (+) strand; PAM type: NRG; PAM sequence: TAG
ggtattgctttgtaatgtaa

SEQ ID NO: 38582 - DNA, 20 bp, Artificial Sequence
  Description of Artificial Sequence: Synthetic oligonucleotide
  Target: SCN10A; (+) strand; PAM type: NRG; PAM sequence: AGG
gtattgctttgtaatgtaat

SEQ ID NO: 38583 - DNA, 20 bp, Artificial Sequence
  Description of Artificial Sequence: Synthetic oligonucleotide
  Target: SCN10A; (+) strand; PAM type: NRG; PAM sequence: TAG
gtaataggcatttttaaaaa

SEQ ID NO: 38584 - DNA, 20 bp, Artificial Sequence
  Description of Artificial Sequence: Synthetic oligonucleotide
  Target: SCN10A; (+) strand; PAM type: NRG; PAM sequence: AGG
taataggcatttttaaaaat

SEQ ID NO: 38585 - DNA, 20 bp, Artificial Sequence
  Description of Artificial Sequence: Synthetic oligonucleotide
  Target: SCN10A; (+) strand; PAM type: NRG; PAM sequence: GAG
aggcatttttaaaaataggt

SEQ ID NO: 38586 - DNA, 20 bp, Artificial Sequence
  Description of Artificial Sequence: Synthetic oligonucleotide
  Target: SCN10A; (+) strand; PAM type: NRG; PAM sequence: TAG
gagtaaaatccatttatatt

SEQ ID NO: 38587 - DNA, 20 bp, Artificial Sequence
  Description of Artificial Sequence: Synthetic oligonucleotide
  Target: SCN10A; (+) strand; PAM type: NRG; PAM sequence: CAG
atttatatttagtgacatga

SEQ ID NO: 38588 - DNA, 20 bp, Artificial Sequence
  Description of Artificial Sequence: Synthetic oligonucleotide
  Target: SCN10A; (+) strand; PAM type: NRG; PAM sequence: TAG
agtgacatgacagatttgct

SEQ ID NO: 38589 - DNA, 20 bp, Artificial Sequence
  Description of Artificial Sequence: Synthetic oligonucleotide
  Target: SCN10A; (+) strand; PAM type: NRG; PAM sequence: TAG
atgacagatttgcttagtct

SEQ ID NO: 38590 - DNA, 20 bp, Artificial Sequence
  Description of Artificial Sequence: Synthetic oligonucleotide
  Target: SCN10A; (+) strand; PAM type: NRG; PAM sequence: TAG
attatttcatatgacgtatt

SEQ ID NO: 38591 - DNA, 20 bp, Artificial Sequence
  Description of Artificial Sequence: Synthetic oligonucleotide
  Target: SCN10A; (+) strand; PAM type: NRG; PAM sequence: TAG
gtatttagtttttaaaatat

SEQ ID NO: 38592 - DNA, 20 bp, Artificial Sequence
  Description of Artificial Sequence: Synthetic oligonucleotide
  Target: SCN10A; (+) strand; PAM type: NRG; PAM sequence: AGG
tatttagtttttaaaatatt

SEQ ID NO: 38593 - DNA, 20 bp, Artificial Sequence
  Description of Artificial Sequence: Synthetic oligonucleotide
  Target: SCN10A; (+) strand; PAM type: NRG; PAM sequence: TGG
tagtttttaaaatattaggt

SEQ ID NO: 38594 - DNA, 20 bp, Artificial Sequence
  Description of Artificial Sequence: Synthetic oligonucleotide
  Target: SCN10A; (+) strand; PAM type: NRG; PAM sequence: AAG
aaaatattaggttggtacaa

SEQ ID NO: 38595 - DNA, 20 bp, Artificial Sequence
  Description of Artificial Sequence: Synthetic oligonucleotide
  Target: SCN10A; (+) strand; PAM type: NRG; PAM sequence: TGG
ggttggtacaaaagtaattg

SEQ ID NO: 38596 - DNA, 20 bp, Artificial Sequence
  Description of Artificial Sequence: Synthetic oligonucleotide
  Target: SCN10A; (+) strand; PAM type: NRG; PAM sequence: TGG
tgaaatttgccgtttgatat

SEQ ID NO: 38597 - DNA, 20 bp, Artificial Sequence
  Description of Artificial Sequence: Synthetic oligonucleotide
  Target: SCN10A; (+) strand; PAM type: NRG; PAM sequence: TAG
tgtttattttatatttattt

SEQ ID NO: 38598 - DNA, 20 bp, Artificial Sequence
  Description of Artificial Sequence: Synthetic oligonucleotide
  Target: SCN10A; (+) strand; PAM type: NRG; PAM sequence: TGG
tttatatttattttagacta

SEQ ID NO: 38599 - DNA, 20 bp, Artificial Sequence
  Description of Artificial Sequence: Synthetic oligonucleotide
  Target: SCN10A; (+) strand; PAM type: NRG; PAM sequence: AAG
tggaaattatgttatacaaa

SEQ ID NO: 38600 - DNA, 20 bp, Artificial Sequence
  Description of Artificial Sequence: Synthetic oligonucleotide
  Target: SCN10A; (+) strand; PAM type: NRG; PAM sequence: GAG
gttatacaaaaagcaaattc

SEQ ID NO: 38601 - DNA, 20 bp, Artificial Sequence
  Description of Artificial Sequence: Synthetic oligonucleotide
  Target: SCN10A; (+) strand; PAM type: NRG; PAM sequence: GAG
ttcgagcgattttcttattt

SEQ ID NO: 38602 - DNA, 20 bp, Artificial Sequence
  Description of Artificial Sequence: Synthetic oligonucleotide
  Target: SCN10A; (+) strand; PAM type: NRG; PAM sequence: TGG
tttcttatttgagttcaaaa

SEQ ID NO: 38603 - DNA, 20 bp, Artificial Sequence
  Description of Artificial Sequence: Synthetic oligonucleotide
  Target: SCN10A; (+) strand; PAM type: NRG; PAM sequence: GGG
ttcttatttgagttcaaaat

SEQ ID NO: 38604 - DNA, 20 bp, Artificial Sequence
  Description of Artificial Sequence: Synthetic oligonucleotide
  Target: SCN10A; (+) strand; PAM type: NRG; PAM sequence: AAG
tgagttcaaaatgggttgta

SEQ ID NO: 38605 - DNA, 20 bp, Artificial Sequence
  Description of Artificial Sequence: Synthetic oligonucleotide
  Target: SCN10A; (+) strand; PAM type: NRG; PAM sequence: CAG
gttcaaaatgggttgtaaag

SEQ ID NO: 38606 - DNA, 20 bp, Artificial Sequence
  Description of Artificial Sequence: Synthetic oligonucleotide
  Target: SCN10A; (+) strand; PAM type: NRG; PAM sequence: CAG
caaaatgggttgtaaagcag

SEQ ID NO: 38607 - DNA, 20 bp, Artificial Sequence
  Description of Artificial Sequence: Synthetic oligonucleotide
  Target: SCN10A; (+) strand; PAM type: NRG; PAM sequence: GAG
aaatgggttgtaaagcagca

SEQ ID NO: 38608 - DNA, 20 bp, Artificial Sequence
  Description of Artificial Sequence: Synthetic oligonucleotide
  Target: SCN10A; (+) strand; PAM type: NRG; PAM sequence: TGG
ctcaacatcaacaacgcatt

SEQ ID NO: 38609 - DNA, 20 bp, Artificial Sequence
  Description of Artificial Sequence: Synthetic oligonucleotide
  Target: SCN10A; (+) strand; PAM type: NRG; PAM sequence: CAG
catcaacaacgcatttggcc

SEQ ID NO: 38610 - DNA, 20 bp, Artificial Sequence
  Description of Artificial Sequence: Synthetic oligonucleotide
  Target: SCN10A; (+) strand; PAM type: NRG; PAM sequence: AGG
atcaacaacgcatttggccc

SEQ ID NO: 38611 - DNA, 20 bp, Artificial Sequence
  Description of Artificial Sequence: Synthetic oligonucleotide
  Target: SCN10A; (+) strand; PAM type: NRG; PAM sequence: GGG
tcaacaacgcatttggccca

SEQ ID NO: 38612 - DNA, 20 bp, Artificial Sequence
  Description of Artificial Sequence: Synthetic oligonucleotide
  Target: SCN10A; (+) strand; PAM type: NRG; PAM sequence: AAG
tggcccagggattgctaaca

SEQ ID NO: 38613 - DNA, 20 bp, Artificial Sequence
  Description of Artificial Sequence: Synthetic oligonucleotide
  Target: SCN10A; (+) strand; PAM type: NRG; PAM sequence: AGG
ggcccagggattgctaacaa

SEQ ID NO: 38614 - DNA, 20 bp, Artificial Sequence
  Description of Artificial Sequence: Synthetic oligonucleotide
  Target: SCN10A; (+) strand; PAM type: NRG; PAM sequence: CAG
agggattgctaacaaaggta

SEQ ID NO: 38615 - DNA, 20 bp, Artificial Sequence
  Description of Artificial Sequence: Synthetic oligonucleotide
  Target: SCN10A; (+) strand; PAM type: NRG; PAM sequence: CAG
ttgctaacaaaggtacagtg

SEQ ID NO: 38616 - DNA, 20 bp, Artificial Sequence
  Description of Artificial Sequence: Synthetic oligonucleotide
  Target: SCN10A; (+) strand; PAM type: NRG; PAM sequence: TGG
ctaacaaaggtacagtgcag

SEQ ID NO: 38617 - DNA, 20 bp, Artificial Sequence
  Description of Artificial Sequence: Synthetic oligonucleotide
  Target: SCN10A; (+) strand; PAM type: NRG; PAM sequence: TGG
acaaaggtacagtgcagtgg

SEQ ID NO: 38618 - DNA, 20 bp, Artificial Sequence
  Description of Artificial Sequence: Synthetic oligonucleotide
  Target: SCN10A; (+) strand; PAM type: NRG; PAM sequence: AAG
gtacagtgcagtggtggttc

SEQ ID NO: 38619 - DNA, 20 bp, Artificial Sequence
  Description of Artificial Sequence: Synthetic oligonucleotide
  Target: SCN10A; (+) strand; PAM type: NRG; PAM sequence: AAG
cagtgcagtggtggttcaag

SEQ ID NO: 38620 - DNA, 20 bp, Artificial Sequence
  Description of Artificial Sequence: Synthetic oligonucleotide
  Target: SCN10A; (+) strand; PAM type: NRG; PAM sequence: AAG
gtggttcaagaagttttgca

SEQ ID NO: 38621 - DNA, 20 bp, Artificial Sequence
  Description of Artificial Sequence: Synthetic oligonucleotide
  Target: SCN10A; (+) strand; PAM type: NRG; PAM sequence: AGG
tggttcaagaagttttgcaa

SEQ ID NO: 38622 - DNA, 20 bp, Artificial Sequence
  Description of Artificial Sequence: Synthetic oligonucleotide
  Target: SCN10A; (+) strand; PAM type: NRG; PAM sequence: GAG
gttcaagaagttttgcaaag

SEQ ID NO: 38623 - DNA, 20 bp, Artificial Sequence
  Description of Artificial Sequence: Synthetic oligonucleotide
  Target: SCN10A; (+) strand; PAM type: NRG; PAM sequence: GAG
agaagttttgcaaaggagat

SEQ ID NO: 38624 - DNA, 20 bp, Artificial Sequence
  Description of Artificial Sequence: Synthetic oligonucleotide
  Target: SCN10A; (+) strand; PAM type: NRG; PAM sequence: AAG
caaaggagatgagaaccttg

SEQ ID NO: 38625 - DNA, 20 bp, Artificial Sequence
  Description of Artificial Sequence: Synthetic oligonucleotide
  Target: SCN10A; (+) strand; PAM type: NRG; PAM sequence: GAG
gagatgagaaccttgaagat

SEQ ID NO: 38626 - DNA, 20 bp, Artificial Sequence
  Description of Artificial Sequence: Synthetic oligonucleotide
  Target: SCN10A; (+) strand; PAM type: NRG; PAM sequence: AGG
agatgagaaccttgaagatg

SEQ ID NO: 38627 - DNA, 20 bp, Artificial Sequence
  Description of Artificial Sequence: Synthetic oligonucleotide
  Target: SCN10A; (+) strand; PAM type: NRG; PAM sequence: GAG
atgagaaccttgaagatgag

SEQ ID NO: 38628 - DNA, 20 bp, Artificial Sequence
  Description of Artificial Sequence: Synthetic oligonucleotide
  Target: SCN10A; (+) strand; PAM type: NRG; PAM sequence: GAG
gagaaccttgaagatgagga

SEQ ID NO: 38629 - DNA, 20 bp, Artificial Sequence
  Description of Artificial Sequence: Synthetic oligonucleotide
  Target: SCN10A; (+) strand; PAM type: NRG; PAM sequence: TAG
aaccttgaagatgaggagag

SEQ ID NO: 38630 - DNA, 20 bp, Artificial Sequence
  Description of Artificial Sequence: Synthetic oligonucleotide
  Target: SCN10A; (+) strand; PAM type: NRG; PAM sequence: TGG
cttgaagatgaggagagtag

SEQ ID NO: 38631 - DNA, 20 bp, Artificial Sequence
  Description of Artificial Sequence: Synthetic oligonucleotide
  Target: SCN10A; (+) strand; PAM type: NRG; PAM sequence: TGG
aagatgaggagagtagtggc

SEQ ID NO: 38632 - DNA, 20 bp, Artificial Sequence
  Description of Artificial Sequence: Synthetic oligonucleotide
  Target: SCN10A; (+) strand; PAM type: NRG; PAM sequence: TGG
ggagagtagtggctggccat

SEQ ID NO: 38633 - DNA, 20 bp, Artificial Sequence
  Description of Artificial Sequence: Synthetic oligonucleotide
  Target: SCN10A; (+) strand; PAM type: NRG; PAM sequence: AAG
gagtagtggctggccattgg

SEQ ID NO: 38634 - DNA, 20 bp, Artificial Sequence
  Description of Artificial Sequence: Synthetic oligonucleotide
  Target: SCN10A; (+) strand; PAM type: NRG; PAM sequence: GAG
gaagttgacaatgaccaatt

SEQ ID NO: 38635 - DNA, 20 bp, Artificial Sequence
  Description of Artificial Sequence: Synthetic oligonucleotide
  Target: SCN10A; (+) strand; PAM type: NRG; PAM sequence: GAG
agttgacaatgaccaattga

SEQ ID NO: 38636 - DNA, 20 bp, Artificial Sequence
  Description of Artificial Sequence: Synthetic oligonucleotide
  Target: SCN10A; (+) strand; PAM type: NRG; PAM sequence: AAG
ccaattgagagcaatcatcg

SEQ ID NO: 38637 - DNA, 20 bp, Artificial Sequence
  Description of Artificial Sequence: Synthetic oligonucleotide
  Target: SCN10A; (+) strand; PAM type: NRG; PAM sequence: AAG
tgatcctcttacaactgcac

SEQ ID NO: 38638 - DNA, 20 bp, Artificial Sequence
  Description of Artificial Sequence: Synthetic oligonucleotide
  Target: SCN10A; (+) strand; PAM type: NRG; PAM sequence: AAG
tcctcttacaactgcacaag

SEQ ID NO: 38639 - DNA, 20 bp, Artificial Sequence
  Description of Artificial Sequence: Synthetic oligonucleotide
  Target: SCN10A; (+) strand; PAM type: NRG; PAM sequence: GAG
ttacaactgcacaagaagct

SEQ ID NO: 38640 - DNA, 20 bp, Artificial Sequence
  Description of Artificial Sequence: Synthetic oligonucleotide
  Target: SCN10A; (+) strand; PAM type: NRG; PAM sequence: AGG
tacaactgcacaagaagctg

SEQ ID NO: 38641 - DNA, 20 bp, Artificial Sequence
  Description of Artificial Sequence: Synthetic oligonucleotide
  Target: SCN10A; (+) strand; PAM type: NRG; PAM sequence: AAG
aactgcacaagaagctgagg

SEQ ID NO: 38642 - DNA, 20 bp, Artificial Sequence
  Description of Artificial Sequence: Synthetic oligonucleotide
  Target: SCN10A; (+) strand; PAM type: NRG; PAM sequence: CGG
actcatcgttgaccattcta

SEQ ID NO: 38643 - DNA, 20 bp, Artificial Sequence
  Description of Artificial Sequence: Synthetic oligonucleotide
  Target: SCN10A; (+) strand; PAM type: NRG; PAM sequence: CGG
ttgaccattctacggtcatt

SEQ ID NO: 38644 - DNA, 20 bp, Artificial Sequence
  Description of Artificial Sequence: Synthetic oligonucleotide
  Target: SCN10A; (+) strand; PAM type: NRG; PAM sequence: CAG
accattctacggtcattcgg

SEQ ID NO: 38645 - DNA, 20 bp, Artificial Sequence
  Description of Artificial Sequence: Synthetic oligonucleotide
  Target: SCN10A; (+) strand; PAM type: NRG; PAM sequence: AAG
ctacggtcattcggcagttg

SEQ ID NO: 38646 - DNA, 20 bp, Artificial Sequence
  Description of Artificial Sequence: Synthetic oligonucleotide
  Target: SCN10A; (+) strand; PAM type: NRG; PAM sequence: TGG
attcggcagttgaagcaaat

SEQ ID NO: 38647 - DNA, 20 bp, Artificial Sequence
  Description of Artificial Sequence: Synthetic oligonucleotide
  Target: SCN10A; (+) strand; PAM type: NRG; PAM sequence: AAG
ggcagttgaagcaaattgga

SEQ ID NO: 38648 - DNA, 20 bp, Artificial Sequence
  Description of Artificial Sequence: Synthetic oligonucleotide
  Target: SCN10A; (+) strand; PAM type: NRG; PAM sequence: AGG
gcagttgaagcaaattggaa

SEQ ID NO: 38649 - DNA, 20 bp, Artificial Sequence
  Description of Artificial Sequence: Synthetic oligonucleotide
  Target: SCN10A; (+) strand; PAM type: NRG; PAM sequence: CAG
agcaaattggaaaggtgaaa

SEQ ID NO: 38650 - DNA, 20 bp, Artificial Sequence
  Description of Artificial Sequence: Synthetic oligonucleotide
  Target: SCN10A; (+) strand; PAM type: NRG; PAM sequence: TGG
aggtgaaacagctccataaa

SEQ ID NO: 38651 - DNA, 20 bp, Artificial Sequence
  Description of Artificial Sequence: Synthetic oligonucleotide
  Target: SCN10A; (+) strand; PAM type: NRG; PAM sequence: GGG
ggtgaaacagctccataaat

SEQ ID NO: 38652 - DNA, 20 bp, Artificial Sequence
  Description of Artificial Sequence: Synthetic oligonucleotide
  Target: SCN10A; (+) strand; PAM type: NRG; PAM sequence: AAG
tccataaatgggtgcctcat

SEQ ID NO: 38653 - DNA, 20 bp, Artificial Sequence
  Description of Artificial Sequence: Synthetic oligonucleotide
  Target: SCN10A; (+) strand; PAM type: NRG; PAM sequence: AAG
aaatgggtgcctcataagct

SEQ ID NO: 38654 - DNA, 20 bp, Artificial Sequence
  Description of Artificial Sequence: Synthetic oligonucleotide
  Target: SCN10A; (+) strand; PAM type: NRG; PAM sequence: AGG
aatgggtgcctcataagcta

SEQ ID NO: 38655 - DNA, 20 bp, Artificial Sequence
  Description of Artificial Sequence: Synthetic oligonucleotide
  Target: SCN10A; (+) strand; PAM type: NRG; PAM sequence: AAG
tttaaaaaatcgtcattttg

SEQ ID NO: 38656 - DNA, 20 bp, Artificial Sequence
  Description of Artificial Sequence: Synthetic oligonucleotide
  Target: SCN10A; (+) strand; PAM type: NRG; PAM sequence: CAG
aaaatgaactatttcttaat

SEQ ID NO: 38657 - DNA, 20 bp, Artificial Sequence
  Description of Artificial Sequence: Synthetic oligonucleotide
  Target: SCN10A; (+) strand; PAM type: NRG; PAM sequence: AAG
agattgtgatgtgcgataaa

SEQ ID NO: 38658 - DNA, 20 bp, Artificial Sequence
  Description of Artificial Sequence: Synthetic oligonucleotide
  Target: SCN10A; (+) strand; PAM type: NRG; PAM sequence: TGG
agtgaattttacttgacaac

SEQ ID NO: 38659 - DNA, 20 bp, Artificial Sequence
  Description of Artificial Sequence: Synthetic oligonucleotide
  Target: SCN10A; (+) strand; PAM type: NRG; PAM sequence: CAG
acttgacaactggcaatgac

SEQ ID NO: 38660 - DNA, 20 bp, Artificial Sequence
  Description of Artificial Sequence: Synthetic oligonucleotide
  Target: SCN10A; (+) strand; PAM type: NRG; PAM sequence: TGG
acaactggcaatgaccagct

SEQ ID NO: 38661 - DNA, 20 bp, Artificial Sequence
  Description of Artificial Sequence: Synthetic oligonucleotide
  Target: SCN10A; (+) strand; PAM type: NRG; PAM sequence: TGG
actggcaatgaccagcttgg

SEQ ID NO: 38662 - DNA, 20 bp, Artificial Sequence
  Description of Artificial Sequence: Synthetic oligonucleotide
  Target: SCN10A; (+) strand; PAM type: NRG; PAM sequence: TGG
gcaatgaccagcttggtggc

SEQ ID NO: 38663 - DNA, 20 bp, Artificial Sequence
  Description of Artificial Sequence: Synthetic oligonucleotide
  Target: SCN10A; (+) strand; PAM type: NRG; PAM sequence: GAG
accagcttggtggctggact

SEQ ID NO: 38664 - DNA, 20 bp, Artificial Sequence
  Description of Artificial Sequence: Synthetic oligonucleotide
  Target: SCN10A; (+) strand; PAM type: NRG; PAM sequence: AAG
agcttggtggctggactgag

SEQ ID NO: 38665 - DNA, 20 bp, Artificial Sequence
  Description of Artificial Sequence: Synthetic oligonucleotide
  Target: SCN10A; (+) strand; PAM type: NRG; PAM sequence: AAG
ttggtggctggactgagaag

SEQ ID NO: 38666 - DNA, 20 bp, Artificial Sequence
  Description of Artificial Sequence: Synthetic oligonucleotide
  Target: SCN10A; (+) strand; PAM type: NRG; PAM sequence: AAG
tggactgagaagaagctcca

SEQ ID NO: 38667 - DNA, 20 bp, Artificial Sequence
  Description of Artificial Sequence: Synthetic oligonucleotide
  Target: SCN10A; (+) strand; PAM type: NRG; PAM sequence: AAG
aacccaacttgcaccaaaaa

SEQ ID NO: 38668 - DNA, 20 bp, Artificial Sequence
  Description of Artificial Sequence: Synthetic oligonucleotide
  Target: SCN10A; (+) strand; PAM type: NRG; PAM sequence: TGG
acttgcaccaaaaaaagtcg

SEQ ID NO: 38669 - DNA, 20 bp, Artificial Sequence
  Description of Artificial Sequence: Synthetic oligonucleotide
  Target: SCN10A; (+) strand; PAM type: NRG; PAM sequence: TGG
aaaaagtcgtggtcactgct

SEQ ID NO: 38670 - DNA, 20 bp, Artificial Sequence
  Description of Artificial Sequence: Synthetic oligonucleotide
  Target: SCN10A; (+) strand; PAM type: NRG; PAM sequence: TGG
aagtcgtggtcactgcttgg

SEQ ID NO: 38671 - DNA, 20 bp, Artificial Sequence
  Description of Artificial Sequence: Synthetic oligonucleotide
  Target: SCN10A; (+) strand; PAM type: NRG; PAM sequence: CGG
actgcttggtggtctgctgc

SEQ ID NO: 38672 - DNA, 20 bp, Artificial Sequence
  Description of Artificial Sequence: Synthetic oligonucleotide
  Target: SCN10A; (+) strand; PAM type: NRG; PAM sequence: CAG
gctgccggtctgatctacta

SEQ ID NO: 38673 - DNA, 20 bp, Artificial Sequence
  Description of Artificial Sequence: Synthetic oligonucleotide
  Target: SCN10A; (+) strand; PAM type: NRG; PAM sequence: CAG
tactacagctttctgaatcc

SEQ ID NO: 38674 - DNA, 20 bp, Artificial Sequence
  Description of Artificial Sequence: Synthetic oligonucleotide
  Target: SCN10A; (+) strand; PAM type: NRG; PAM sequence: AAG
cagctttctgaatcccagca

SEQ ID NO: 38675 - DNA, 20 bp, Artificial Sequence
  Description of Artificial Sequence: Synthetic oligonucleotide
  Target: SCN10A; (+) strand; PAM type: NRG; PAM sequence: GAG
ccagcaaagccattacatct

SEQ ID NO: 38676 - DNA, 20 bp, Artificial Sequence
  Description of Artificial Sequence: Synthetic oligonucleotide
  Target: SCN10A; (+) strand; PAM type: NRG; PAM sequence: CAG
ttacatctgagaaatatgtt

SEQ ID NO: 38677 - DNA, 20 bp, Artificial Sequence
  Description of Artificial Sequence: Synthetic oligonucleotide
  Target: SCN10A; (+) strand; PAM type: NRG; PAM sequence: GAG
aatatgttcagcaaatcgat

SEQ ID NO: 38678 - DNA, 20 bp, Artificial Sequence
  Description of Artificial Sequence: Synthetic oligonucleotide
  Target: SCN10A; (+) strand; PAM type: NRG; PAM sequence: CAG
cagcaaatcgatgagatgca

SEQ ID NO: 38679 - DNA, 20 bp, Artificial Sequence
  Description of Artificial Sequence: Synthetic oligonucleotide
  Target: SCN10A; (+) strand; PAM type: NRG; PAM sequence: AAG
tgagatgcacagaaaactgc

SEQ ID NO: 38680 - DNA, 20 bp, Artificial Sequence
  Description of Artificial Sequence: Synthetic oligonucleotide
  Target: SCN10A; (+) strand; PAM type: NRG; PAM sequence: AGG
gagatgcacagaaaactgca

SEQ ID NO: 38681 - DNA, 20 bp, Artificial Sequence
  Description of Artificial Sequence: Synthetic oligonucleotide
  Target: SCN10A; (+) strand; PAM type: NRG; PAM sequence: CAG
acagaaaactgcaaggcctg

SEQ ID NO: 38682 - DNA, 20 bp, Artificial Sequence
  Description of Artificial Sequence: Synthetic oligonucleotide
  Target: SCN10A; (+) strand; PAM type: NRG; PAM sequence: TGG
aaaactgcaaggcctgcagc

SEQ ID NO: 38683 - DNA, 20 bp, Artificial Sequence
  Description of Artificial Sequence: Synthetic oligonucleotide
  Target: SCN10A; (+) strand; PAM type: NRG; PAM sequence: TGG
gcaaggcctgcagctggcat

SEQ ID NO: 38684 - DNA, 20 bp, Artificial Sequence
  Description of Artificial Sequence: Synthetic oligonucleotide
  Target: SCN10A; (+) strand; PAM type: NRG; PAM sequence: CAG
ctgcagctggcattggtcaa

SEQ ID NO: 38685 - DNA, 20 bp, Artificial Sequence
  Description of Artificial Sequence: Synthetic oligonucleotide
  Target: SCN10A; (+) strand; PAM type: NRG; PAM sequence: AAG
agctggcattggtcaacaga

SEQ ID NO: 38686 - DNA, 20 bp, Artificial Sequence
  Description of Artificial Sequence: Synthetic oligonucleotide
  Target: SCN10A; (+) strand; PAM type: NRG; PAM sequence: AGG
gctggcattggtcaacagaa

SEQ ID NO: 38687 - DNA, 20 bp, Artificial Sequence
  Description of Artificial Sequence: Synthetic oligonucleotide
  Target: SCN10A; (+) strand; PAM type: NRG; PAM sequence: GGG
ctggcattggtcaacagaaa

SEQ ID NO: 38688 - DNA, 20 bp, Artificial Sequence
  Description of Artificial Sequence: Synthetic oligonucleotide
  Target: SCN10A; (+) strand; PAM type: NRG; PAM sequence: CAG
actgcatgtcacacaaccaa

SEQ ID NO: 38689 - DNA, 20 bp, Artificial Sequence
  Description of Artificial Sequence: Synthetic oligonucleotide
  Target: SCN10A; (+) strand; PAM type: NRG; PAM sequence: AAG
acaaccaacagttacttcaa

SEQ ID NO: 38690 - DNA, 20 bp, Artificial Sequence
  Description of Artificial Sequence: Synthetic oligonucleotide
  Target: SCN10A; (+) strand; PAM type: NRG; PAM sequence: TGG
acttcaaaagttgaatgaat

SEQ ID NO: 38691 - DNA, 20 bp, Artificial Sequence
  Description of Artificial Sequence: Synthetic oligonucleotide
  Target: SCN10A; (+) strand; PAM type: NRG; PAM sequence: GGG
cttcaaaagttgaatgaatt

SEQ ID NO: 38692 - DNA, 20 bp, Artificial Sequence
  Description of Artificial Sequence: Synthetic oligonucleotide
  Target: SCN10A; (+) strand; PAM type: NRG; PAM sequence: AAG
gttgaatgaattgggctatg

SEQ ID NO: 38693 - DNA, 20 bp, Artificial Sequence
  Description of Artificial Sequence: Synthetic oligonucleotide
  Target: SCN10A; (+) strand; PAM type: NRG; PAM sequence: AAG
caaccaactaccacttcttc

SEQ ID NO: 38694 - DNA, 20 bp, Artificial Sequence
  Description of Artificial Sequence: Synthetic oligonucleotide
  Target: SCN10A; (+) strand; PAM type: NRG; PAM sequence: CAG
agcatctgaacaactttttg

SEQ ID NO: 38695 - DNA, 20 bp, Artificial Sequence
  Description of Artificial Sequence: Synthetic oligonucleotide
  Target: SCN10A; (+) strand; PAM type: NRG; PAM sequence: AGG
gcatctgaacaactttttgc

SEQ ID NO: 38696 - DNA, 20 bp, Artificial Sequence
  Description of Artificial Sequence: Synthetic oligonucleotide
  Target: SCN10A; (+) strand; PAM type: NRG; PAM sequence: CAG
aggtgaaacacttccataac

SEQ ID NO: 38697 - DNA, 20 bp, Artificial Sequence
  Description of Artificial Sequence: Synthetic oligonucleotide
  Target: SCN10A; (+) strand; PAM type: NRG; PAM sequence: CGG
tgaaacacttccataaccag

SEQ ID NO: 38698 - DNA, 20 bp, Artificial Sequence
  Description of Artificial Sequence: Synthetic oligonucleotide
  Target: SCN10A; (+) strand; PAM type: NRG; PAM sequence: GGG
gaaacacttccataaccagc

SEQ ID NO: 38699 - DNA, 20 bp, Artificial Sequence
  Description of Artificial Sequence: Synthetic oligonucleotide
  Target: SCN10A; (+) strand; PAM type: NRG; PAM sequence: CAG
cttccataaccagcgggatg

SEQ ID NO: 38700 - DNA, 20 bp, Artificial Sequence
  Description of Artificial Sequence: Synthetic oligonucleotide
  Target: SCN10A; (+) strand; PAM type: NRG; PAM sequence: AAG
ggatgcagaaaatgccttcc

SEQ ID NO: 38701 - DNA, 20 bp, Artificial Sequence
  Description of Artificial Sequence: Synthetic oligonucleotide
  Target: SCN10A; (+) strand; PAM type: NRG; PAM sequence: GAG
atgcagaaaatgccttccaa

SEQ ID NO: 38702 - DNA, 20 bp, Artificial Sequence
  Description of Artificial Sequence: Synthetic oligonucleotide
  Target: SCN10A; (+) strand; PAM type: NRG; PAM sequence: AAG
caagagttcattgaatccca

SEQ ID NO: 38703 - DNA, 20 bp, Artificial Sequence
  Description of Artificial Sequence: Synthetic oligonucleotide
  Target: SCN10A; (+) strand; PAM type: NRG; PAM sequence: TGG
gttcattgaatcccaaagca

SEQ ID NO: 38704 - DNA, 20 bp, Artificial Sequence
  Description of Artificial Sequence: Synthetic oligonucleotide
  Target: SCN10A; (+) strand; PAM type: NRG; PAM sequence: CAG
aagcatggatttttatgcta

SEQ ID NO: 38705 - DNA, 20 bp, Artificial Sequence
  Description of Artificial Sequence: Synthetic oligonucleotide
  Target: SCN10A; (+) strand; PAM type: NRG; PAM sequence: AGG
agcatggatttttatgctac

SEQ ID NO: 38706 - DNA, 20 bp, Artificial Sequence
  Description of Artificial Sequence: Synthetic oligonucleotide
  Target: SCN10A; (+) strand; PAM type: NRG; PAM sequence: TGG
taaacaaactcatttctcat

SEQ ID NO: 38707 - DNA, 20 bp, Artificial Sequence
  Description of Artificial Sequence: Synthetic oligonucleotide
  Target: SCN10A; (+) strand; PAM type: NRG; PAM sequence: TGG
caaaaatgtgttgattgtaa

SEQ ID NO: 38708 - DNA, 20 bp, Artificial Sequence
  Description of Artificial Sequence: Synthetic oligonucleotide
  Target: SCN10A; (+) strand; PAM type: NRG; PAM sequence: AAG
ggttcctactttgattaata

SEQ ID NO: 38709 - DNA, 20 bp, Artificial Sequence
  Description of Artificial Sequence: Synthetic oligonucleotide
  Target: SCN10A; (+) strand; PAM type: NRG; PAM sequence: GAG
tgattaataaagatgtgttt

SEQ ID NO: 38710 - DNA, 20 bp, Artificial Sequence
  Description of Artificial Sequence: Synthetic oligonucleotide
  Target: SCN10A; (+) strand; PAM type: NRG; PAM sequence: TAG
aataaagatgtgtttgagcc

SEQ ID NO: 38711 - DNA, 20 bp, Artificial Sequence
  Description of Artificial Sequence: Synthetic oligonucleotide
  Target: SCN10A; (+) strand; PAM type: NRG; PAM sequence: TGG
ttataatgatttaatattta

SEQ ID NO: 38712 - DNA, 20 bp, Artificial Sequence
  Description of Artificial Sequence: Synthetic oligonucleotide
  Target: SCN10A; (+) strand; PAM type: NRG; PAM sequence: TGG
ttttgtaccttttcattatt

SEQ ID NO: 38713 - DNA, 20 bp, Artificial Sequence
  Description of Artificial Sequence: Synthetic oligonucleotide
  Target: SCN10A; (+) strand; PAM type: NRG; PAM sequence: CAG
tttttgatgtacaattcttc

SEQ ID NO: 38714 - DNA, 20 bp, Artificial Sequence
  Description of Artificial Sequence: Synthetic oligonucleotide
  Target: SCN10A; (+) strand; PAM type: NRG; PAM sequence: TAG
tgtacaattcttccagtatt

SEQ ID NO: 38715 - DNA, 20 bp, Artificial Sequence
  Description of Artificial Sequence: Synthetic oligonucleotide
  Target: SCN10A; (+) strand; PAM type: NRG; PAM sequence: GAG
tacaattcttccagtattta

SEQ ID NO: 38716 - DNA, 20 bp, Artificial Sequence
  Description of Artificial Sequence: Synthetic oligonucleotide
  Target: SCN10A; (+) strand; PAM type: NRG; PAM sequence: TAG
tattatttgttacaaatata

SEQ ID NO: 38717 - DNA, 20 bp, Artificial Sequence
  Description of Artificial Sequence: Synthetic oligonucleotide
  Target: SCN10A; (+) strand; PAM type: NRG; PAM sequence: AAG
tacaaatatatagattacta

SEQ ID NO: 38718 - DNA, 20 bp, Artificial Sequence
  Description of Artificial Sequence: Synthetic oligonucleotide
  Target: SCN10A; (+) strand; PAM type: NRG; PAM sequence: GAG
caaatatatagattactaaa

SEQ ID NO: 38719 - DNA, 20 bp, Artificial Sequence
  Description of Artificial Sequence: Synthetic oligonucleotide
  Target: SCN10A; (+) strand; PAM type: NRG; PAM sequence: TAG
aagagtttgtatctttatcc

SEQ ID NO: 38720 - DNA, 20 bp, Artificial Sequence
  Description of Artificial Sequence: Synthetic oligonucleotide
  Target: SCN10A; (+) strand; PAM type: NRG; PAM sequence: TGG
agtttgtatctttatcctag

SEQ ID NO: 38721 - DNA, 20 bp, Artificial Sequence
  Description of Artificial Sequence: Synthetic oligonucleotide
  Target: SCN10A; (+) strand; PAM type: NRG; PAM sequence: AAG
atcctagtggttgtctttat

SEQ ID NO: 38722 - DNA, 20 bp, Artificial Sequence
  Description of Artificial Sequence: Synthetic oligonucleotide
  Target: SCN10A; (+) strand; PAM type: NRG; PAM sequence: TAG
accgtgtaatacattgtcct

SEQ ID NO: 38723 - DNA, 20 bp, Artificial Sequence
  Description of Artificial Sequence: Synthetic oligonucleotide
  Target: SCN10A; (+) strand; PAM type: NRG; PAM sequence: TGG
caaaatctctcatttccatt

SEQ ID NO: 38724 - DNA, 20 bp, Artificial Sequence
  Description of Artificial Sequence: Synthetic oligonucleotide
  Target: SCN10A; (+) strand; PAM type: NRG; PAM sequence: AAG
gtgcttacctttgtactgtc

SEQ ID NO: 38725 - DNA, 20 bp, Artificial Sequence
  Description of Artificial Sequence: Synthetic oligonucleotide
  Target: SCN10A; (+) strand; PAM type: NRG; PAM sequence: TAG
tctttaacttcttgttatta

SEQ ID NO: 38726 - DNA, 20 bp, Artificial Sequence
  Description of Artificial Sequence: Synthetic oligonucleotide
  Target: SCN10A; (+) strand; PAM type: NRG; PAM sequence: AAG
ttaacttcttgttattatag

SEQ ID NO: 38727 - DNA, 20 bp, Artificial Sequence
  Description of Artificial Sequence: Synthetic oligonucleotide
  Target: SCN10A; (+) strand; PAM type: NRG; PAM sequence: CAG
acttcttgttattatagaag

SEQ ID NO: 38728 - DNA, 20 bp, Artificial Sequence
  Description of Artificial Sequence: Synthetic oligonucleotide
  Target: SCN10A; (+) strand; PAM type: NRG; PAM sequence: CAG
tcttgttattatagaagcag

SEQ ID NO: 38729 - DNA, 20 bp, Artificial Sequence
  Description of Artificial Sequence: Synthetic oligonucleotide
  Target: SCN10A; (+) strand; PAM type: NRG; PAM sequence: AAG
gttattatagaagcagcagt

SEQ ID NO: 38730 - DNA, 20 bp, Artificial Sequence
  Description of Artificial Sequence: Synthetic oligonucleotide
  Target: SCN10A; (+) strand; PAM type: NRG; PAM sequence: CAG
ttgtatcatgtcaacacttg

SEQ ID NO: 38731 - DNA, 20 bp, Artificial Sequence
  Description of Artificial Sequence: Synthetic oligonucleotide
  Target: SCN10A; (+) strand; PAM type: NRG; PAM sequence: AGG
tgtatcatgtcaacacttgc

SEQ ID NO: 38732 - DNA, 20 bp, Artificial Sequence
  Description of Artificial Sequence: Synthetic oligonucleotide
  Target: SCN10A; (+) strand; PAM type: NRG; PAM sequence: GGG
gtatcatgtcaacacttgca

SEQ ID NO: 38733 - DNA, 20 bp, Artificial Sequence
  Description of Artificial Sequence: Synthetic oligonucleotide
  Target: SCN10A; (+) strand; PAM type: NRG; PAM sequence: TGG
gtcaacacttgcagggcctc

SEQ ID NO: 38734 - DNA, 20 bp, Artificial Sequence
  Description of Artificial Sequence: Synthetic oligonucleotide
  Target: SCN10A; (+) strand; PAM type: NRG; PAM sequence: GGG
tcaacacttgcagggcctct

SEQ ID NO: 38735 - DNA, 20 bp, Artificial Sequence
  Description of Artificial Sequence: Synthetic oligonucleotide
  Target: SCN10A; (+) strand; PAM type: NRG; PAM sequence: GGG
caacacttgcagggcctctg

SEQ ID NO: 38736 - DNA, 20 bp, Artificial Sequence
  Description of Artificial Sequence: Synthetic oligonucleotide
  Target: SCN10A; (+) strand; PAM type: NRG; PAM sequence: TGG
gcagggcctctggggcttgt

SEQ ID NO: 38737 - DNA, 20 bp, Artificial Sequence
  Description of Artificial Sequence: Synthetic oligonucleotide
  Target: SCN10A; (+) strand; PAM type: NRG; PAM sequence: GGG
cagggcctctggggcttgtt

SEQ ID NO: 38738 - DNA, 20 bp, Artificial Sequence
  Description of Artificial Sequence: Synthetic oligonucleotide
  Target: SCN10A; (+) strand; PAM type: NRG; PAM sequence: CAG
ggcctctggggcttgttggg

SEQ ID NO: 38739 - DNA, 20 bp, Artificial Sequence
  Description of Artificial Sequence: Synthetic oligonucleotide
  Target: SCN10A; (+) strand; PAM type: NRG; PAM sequence: CGG
ctctggggcttgttgggcag

SEQ ID NO: 38740 - DNA, 20 bp, Artificial Sequence
  Description of Artificial Sequence: Synthetic oligonucleotide
  Target: SCN10A; (+) strand; PAM type: NRG; PAM sequence: GGG
tctggggcttgttgggcagc

SEQ ID NO: 38741 - DNA, 20 bp, Artificial Sequence
  Description of Artificial Sequence: Synthetic oligonucleotide
  Target: SCN10A; (+) strand; PAM type: NRG; PAM sequence: GGG
ctggggcttgttgggcagcg

SEQ ID NO: 38742 - DNA, 20 bp, Artificial Sequence
  Description of Artificial Sequence: Synthetic oligonucleotide
  Target: SCN10A; (+) strand; PAM type: NRG; PAM sequence: GGG
tggggcttgttgggcagcgg

SEQ ID NO: 38743 - DNA, 20 bp, Artificial Sequence
  Description of Artificial Sequence: Synthetic oligonucleotide
  Target: SCN10A; (+) strand; PAM type: NRG; PAM sequence: CGG
ggcttgttgggcagcggggg

SEQ ID NO: 38744 - DNA, 20 bp, Artificial Sequence
  Description of Artificial Sequence: Synthetic oligonucleotide
  Target: SCN10A; (+) strand; PAM type: NRG; PAM sequence: TGG
ttctcatttttatccccctc

SEQ ID NO: 38745 - DNA, 20 bp, Artificial Sequence
  Description of Artificial Sequence: Synthetic oligonucleotide
  Target: SCN10A; (+) strand; PAM type: NRG; PAM sequence: GAG
ctcatttttatccccctctg

SEQ ID NO: 38746 - DNA, 20 bp, Artificial Sequence
  Description of Artificial Sequence: Synthetic oligonucleotide
  Target: SCN10A; (+) strand; PAM type: NRG; PAM sequence: AGG
tcatttttatccccctctgg

SEQ ID NO: 38747 - DNA, 20 bp, Artificial Sequence
  Description of Artificial Sequence: Synthetic oligonucleotide
  Target: SCN10A; (+) strand; PAM type: NRG; PAM sequence: TGG
atccccctctggaggcaccg

SEQ ID NO: 38748 - DNA, 20 bp, Artificial Sequence
  Description of Artificial Sequence: Synthetic oligonucleotide
  Target: SCN10A; (+) strand; PAM type: NRG; PAM sequence: AAG
ttaacaaaccctgatctgct

SEQ ID NO: 38749 - DNA, 20 bp, Artificial Sequence
  Description of Artificial Sequence: Synthetic oligonucleotide
  Target: SCN10A; (+) strand; PAM type: NRG; PAM sequence: TGG
accacttctccacccacttt

SEQ ID NO: 38750 - DNA, 20 bp, Artificial Sequence
  Description of Artificial Sequence: Synthetic oligonucleotide
  Target: SCN10A; (+) strand; PAM type: NRG; PAM sequence: AAG
ccacccacttttggtcttcc

SEQ ID NO: 38751 - DNA, 20 bp, Artificial Sequence
  Description of Artificial Sequence: Synthetic oligonucleotide
  Target: SCN10A; (+) strand; PAM type: NRG; PAM sequence: TGG
cccccgtgctgtcattctat

SEQ ID NO: 38752 - DNA, 20 bp, Artificial Sequence
  Description of Artificial Sequence: Synthetic oligonucleotide
  Target: SCN10A; (+) strand; PAM type: NRG; PAM sequence: GAG
tgtcattctattggcatttt

SEQ ID NO: 38753 - DNA, 20 bp, Artificial Sequence
  Description of Artificial Sequence: Synthetic oligonucleotide
  Target: SCN10A; (+) strand; PAM type: NRG; PAM sequence: GAG
tcattctattggcattttga

SEQ ID NO: 38754 - DNA, 20 bp, Artificial Sequence
  Description of Artificial Sequence: Synthetic oligonucleotide
  Target: SCN10A; (+) strand; PAM type: NRG; PAM sequence: AGG
cattctattggcattttgag

SEQ ID NO: 38755 - DNA, 20 bp, Artificial Sequence
  Description of Artificial Sequence: Synthetic oligonucleotide
  Target: SCN10A; (+) strand; PAM type: NRG; PAM sequence: GGG
attctattggcattttgaga

SEQ ID NO: 38756 - DNA, 20 bp, Artificial Sequence
  Description of Artificial Sequence: Synthetic oligonucleotide
  Target: SCN10A; (+) strand; PAM type: NRG; PAM sequence: TGG
ctattggcattttgagaggg

SEQ ID NO: 38757 - DNA, 20 bp, Artificial Sequence
  Description of Artificial Sequence: Synthetic oligonucleotide
  Target: SCN10A; (+) strand; PAM type: NRG; PAM sequence: GGG
tattggcattttgagagggt

SEQ ID NO: 38758 - DNA, 20 bp, Artificial Sequence
  Description of Artificial Sequence: Synthetic oligonucleotide
  Target: SCN10A; (+) strand; PAM type: NRG; PAM sequence: GGG
attggcattttgagagggtg

SEQ ID NO: 38759 - DNA, 20 bp, Artificial Sequence
  Description of Artificial Sequence: Synthetic oligonucleotide
  Target: SCN10A; (+) strand; PAM type: NRG; PAM sequence: AAG
gttttacattaaaactccaa

SEQ ID NO: 38760 - DNA, 20 bp, Artificial Sequence
  Description of Artificial Sequence: Synthetic oligonucleotide
  Target: SCN10A; (+) strand; PAM type: NRG; PAM sequence: AAG
ttacattaaaactccaaaag

SEQ ID NO: 38761 - DNA, 20 bp, Artificial Sequence
  Description of Artificial Sequence: Synthetic oligonucleotide
  Target: SCN10A; (+) strand; PAM type: NRG; PAM sequence: TAG
ttaaaactccaaaagaagca

SEQ ID NO: 38762 - DNA, 20 bp, Artificial Sequence
  Description of Artificial Sequence: Synthetic oligonucleotide
  Target: SCN10A; (+) strand; PAM type: NRG; PAM sequence: TAG
gattttgtgatttctctact

SEQ ID NO: 38763 - DNA, 20 bp, Artificial Sequence
  Description of Artificial Sequence: Synthetic oligonucleotide
  Target: SCN10A; (+) strand; PAM type: NRG; PAM sequence: CAG
catcttctgatttatatttt

SEQ ID NO: 38764 - DNA, 20 bp, Artificial Sequence
  Description of Artificial Sequence: Synthetic oligonucleotide
  Target: SCN10A; (+) strand; PAM type: NRG; PAM sequence: TGG
gtgttctgcattttttgcaa

SEQ ID NO: 38765 - DNA, 20 bp, Artificial Sequence
  Description of Artificial Sequence: Synthetic oligonucleotide
  Target: SCN10A; (+) strand; PAM type: NRG; PAM sequence: TGG
catttattttaaaaaattat

SEQ ID NO: 38766 - DNA, 20 bp, Artificial Sequence
  Description of Artificial Sequence: Synthetic oligonucleotide
  Target: SCN10A; (+) strand; PAM type: NRG; PAM sequence: GGG
atttattttaaaaaattatt

SEQ ID NO: 38767 - DNA, 20 bp, Artificial Sequence
  Description of Artificial Sequence: Synthetic oligonucleotide
  Target: SCN10A; (+) strand; PAM type: NRG; PAM sequence: TAG
taaaacaaatgtttgtgtat

SEQ ID NO: 38768 - DNA, 20 bp, Artificial Sequence
  Description of Artificial Sequence: Synthetic oligonucleotide
  Target: SCN10A; (+) strand; PAM type: NRG; PAM sequence: CAG
acaaatgtttgtgtattagt

SEQ ID NO: 38769 - DNA, 20 bp, Artificial Sequence
  Description of Artificial Sequence: Synthetic oligonucleotide
  Target: SCN10A; (+) strand; PAM type: NRG; PAM sequence: TAG
gttgccttaacaaaatacca

SEQ ID NO: 38770 - DNA, 20 bp, Artificial Sequence
  Description of Artificial Sequence: Synthetic oligonucleotide
  Target: SCN10A; (+) strand; PAM type: NRG; PAM sequence: TGG
cttaacaaaataccatagac

SEQ ID NO: 38771 - DNA, 20 bp, Artificial Sequence
  Description of Artificial Sequence: Synthetic oligonucleotide
  Target: SCN10A; (+) strand; PAM type: NRG; PAM sequence: GGG
ttaacaaaataccatagact

SEQ ID NO: 38772 - DNA, 20 bp, Artificial Sequence
  Description of Artificial Sequence: Synthetic oligonucleotide
  Target: SCN10A; (+) strand; PAM type: NRG; PAM sequence: TGG
acaaaataccatagactggg

SEQ ID NO: 38773 - DNA, 20 bp, Artificial Sequence
  Description of Artificial Sequence: Synthetic oligonucleotide
  Target: SCN10A; (+) strand; PAM type: NRG; PAM sequence: CAG
agactgggtggcttatgcaa

SEQ ID NO: 38774 - DNA, 20 bp, Artificial Sequence
  Description of Artificial Sequence: Synthetic oligonucleotide
  Target: SCN10A; (+) strand; PAM type: NRG; PAM sequence: TGG
aatttattttctcacaaatc

SEQ ID NO: 38775 - DNA, 20 bp, Artificial Sequence
  Description of Artificial Sequence: Synthetic oligonucleotide
  Target: SCN10A; (+) strand; PAM type: NRG; PAM sequence: GAG
tttattttctcacaaatctg

SEQ ID NO: 38776 - DNA, 20 bp, Artificial Sequence
  Description of Artificial Sequence: Synthetic oligonucleotide
  Target: SCN10A; (+) strand; PAM type: NRG; PAM sequence: AGG
ttattttctcacaaatctgg

SEQ ID NO: 38777 - DNA, 20 bp, Artificial Sequence
  Description of Artificial Sequence: Synthetic oligonucleotide
  Target: SCN10A; (+) strand; PAM type: NRG; PAM sequence: AAG
tctcacaaatctggaggttg

SEQ ID NO: 38778 - DNA, 20 bp, Artificial Sequence
  Description of Artificial Sequence: Synthetic oligonucleotide
  Target: SCN10A; (+) strand; PAM type: NRG; PAM sequence: GAG
aaatctggaggttgaagcct

SEQ ID NO: 38779 - DNA, 20 bp, Artificial Sequence
  Description of Artificial Sequence: Synthetic oligonucleotide
  Target: SCN10A; (+) strand; PAM type: NRG; PAM sequence: TGG
tggaggttgaagcctgagat

SEQ ID NO: 38780 - DNA, 20 bp, Artificial Sequence
  Description of Artificial Sequence: Synthetic oligonucleotide
  Target: SCN10A; (+) strand; PAM type: NRG; PAM sequence: GGG
ggaggttgaagcctgagatt

SEQ ID NO: 38781 - DNA, 20 bp, Artificial Sequence
  Description of Artificial Sequence: Synthetic oligonucleotide
  Target: SCN10A; (+) strand; PAM type: NRG; PAM sequence: CAG
gaagcctgagattgggatgt

SEQ ID NO: 38782 - DNA, 20 bp, Artificial Sequence
  Description of Artificial Sequence: Synthetic oligonucleotide
  Target: SCN10A; (+) strand; PAM type: NRG; PAM sequence: TAG
ctgagattgggatgtcagca

SEQ ID NO: 38783 - DNA, 20 bp, Artificial Sequence
  Description of Artificial Sequence: Synthetic oligonucleotide
  Target: SCN10A; (+) strand; PAM type: NRG; PAM sequence: TGG
gattgggatgtcagcatagt

SEQ ID NO: 38784 - DNA, 20 bp, Artificial Sequence
  Description of Artificial Sequence: Synthetic oligonucleotide
  Target: SCN10A; (+) strand; PAM type: NRG; PAM sequence: GGG
attgggatgtcagcatagtt

SEQ ID NO: 38785 - DNA, 20 bp, Artificial Sequence
  Description of Artificial Sequence: Synthetic oligonucleotide
  Target: SCN10A; (+) strand; PAM type: NRG; PAM sequence: TGG
gatgtcagcatagttgggtc

SEQ ID NO: 38786 - DNA, 20 bp, Artificial Sequence
  Description of Artificial Sequence: Synthetic oligonucleotide
  Target: SCN10A; (+) strand; PAM type: NRG; PAM sequence: GGG
atgtcagcatagttgggtct

SEQ ID NO: 38787 - DNA, 20 bp, Artificial Sequence
  Description of Artificial Sequence: Synthetic oligonucleotide
  Target: SCN10A; (+) strand; PAM type: NRG; PAM sequence: AAG
cagcatagttgggtctggga

SEQ ID NO: 38788 - DNA, 20 bp, Artificial Sequence
  Description of Artificial Sequence: Synthetic oligonucleotide
  Target: SCN10A; (+) strand; PAM type: NRG; PAM sequence: TAG
tctgggaaagactctctttc

SEQ ID NO: 38789 - DNA, 20 bp, Artificial Sequence
  Description of Artificial Sequence: Synthetic oligonucleotide
  Target: SCN10A; (+) strand; PAM type: NRG; PAM sequence: TAG
aagactctctttctagctta

SEQ ID NO: 38790 - DNA, 20 bp, Artificial Sequence
  Description of Artificial Sequence: Synthetic oligonucleotide
  Target: SCN10A; (+) strand; PAM type: NRG; PAM sequence: AAG
tgtccttgtgttctcacaca

SEQ ID NO: 38791 - DNA, 20 bp, Artificial Sequence
  Description of Artificial Sequence: Synthetic oligonucleotide
  Target: SCN10A; (+) strand; PAM type: NRG; PAM sequence: AGG
gtccttgtgttctcacacaa

SEQ ID NO: 38792 - DNA, 20 bp, Artificial Sequence
  Description of Artificial Sequence: Synthetic oligonucleotide
  Target: SCN10A; (+) strand; PAM type: NRG; PAM sequence: GGG
tccttgtgttctcacacaaa

SEQ ID NO: 38793 - DNA, 20 bp, Artificial Sequence
  Description of Artificial Sequence: Synthetic oligonucleotide
  Target: SCN10A; (+) strand; PAM type: NRG; PAM sequence: GGG
ccttgtgttctcacacaaag

SEQ ID NO: 38794 - DNA, 20 bp, Artificial Sequence
  Description of Artificial Sequence: Synthetic oligonucleotide
  Target: SCN10A; (+) strand; PAM type: NRG; PAM sequence: GAG
ttgtgttctcacacaaaggg

SEQ ID NO: 38795 - DNA, 20 bp, Artificial Sequence
  Description of Artificial Sequence: Synthetic oligonucleotide
  Target: SCN10A; (+) strand; PAM type: NRG; PAM sequence: AAG
gttctcacacaaaggggaga

SEQ ID NO: 38796 - DNA, 20 bp, Artificial Sequence
  Description of Artificial Sequence: Synthetic oligonucleotide
  Target: SCN10A; (+) strand; PAM type: NRG; PAM sequence: AAG
aagctgtctctttctcttat

SEQ ID NO: 38797 - DNA, 20 bp, Artificial Sequence
  Description of Artificial Sequence: Synthetic oligonucleotide
  Target: SCN10A; (+) strand; PAM type: NRG; PAM sequence: AGG
agctgtctctttctcttata

SEQ ID NO: 38798 - DNA, 20 bp, Artificial Sequence
  Description of Artificial Sequence: Synthetic oligonucleotide
  Target: SCN10A; (+) strand; PAM type: NRG; PAM sequence: CAG
tctttctcttataaggacac

SEQ ID NO: 38799 - DNA, 20 bp, Artificial Sequence
  Description of Artificial Sequence: Synthetic oligonucleotide
  Target: SCN10A; (+) strand; PAM type: NRG; PAM sequence: AAG
ggacaccagttctaccactt

SEQ ID NO: 38800 - DNA, 20 bp, Artificial Sequence
  Description of Artificial Sequence: Synthetic oligonucleotide
  Target: SCN10A; (+) strand; PAM type: NRG; PAM sequence: AGG
gacaccagttctaccactta

SEQ ID NO: 38801 - DNA, 20 bp, Artificial Sequence
  Description of Artificial Sequence: Synthetic oligonucleotide
  Target: SCN10A; (+) strand; PAM type: NRG; PAM sequence: GGG
acaccagttctaccacttaa

SEQ ID NO: 38802 - DNA, 20 bp, Artificial Sequence
  Description of Artificial Sequence: Synthetic oligonucleotide
  Target: SCN10A; (+) strand; PAM type: NRG; PAM sequence: TAG
atttaacccaatcacctcct

SEQ ID NO: 38803 - DNA, 20 bp, Artificial Sequence
  Description of Artificial Sequence: Synthetic oligonucleotide
  Target: SCN10A; (+) strand; PAM type: NRG; PAM sequence: GAG
ttaacccaatcacctcctta

SEQ ID NO: 38804 - DNA, 20 bp, Artificial Sequence
  Description of Artificial Sequence: Synthetic oligonucleotide
  Target: SCN10A; (+) strand; PAM type: NRG; PAM sequence: AGG
taacccaatcacctccttag

SEQ ID NO: 38805 - DNA, 20 bp, Artificial Sequence
  Description of Artificial Sequence: Synthetic oligonucleotide
  Target: SCN10A; (+) strand; PAM type: NRG; PAM sequence: TAG
tagaggcccaatctccaaca

SEQ ID NO: 38806 - DNA, 20 bp, Artificial Sequence
  Description of Artificial Sequence: Synthetic oligonucleotide
  Target: SCN10A; (+) strand; PAM type: NRG; PAM sequence: TGG
caatctccaacatagcaaca

SEQ ID NO: 38807 - DNA, 20 bp, Artificial Sequence
  Description of Artificial Sequence: Synthetic oligonucleotide
  Target: SCN10A; (+) strand; PAM type: NRG; PAM sequence: GGG
aatctccaacatagcaacat

SEQ ID NO: 38808 - DNA, 20 bp, Artificial Sequence
  Description of Artificial Sequence: Synthetic oligonucleotide
  Target: SCN10A; (+) strand; PAM type: NRG; PAM sequence: GGG
atctccaacatagcaacatg

SEQ ID NO: 38809 - DNA, 20 bp, Artificial Sequence
  Description of Artificial Sequence: Synthetic oligonucleotide
  Target: SCN10A; (+) strand; PAM type: NRG; PAM sequence: GGG
tctccaacatagcaacatgg

SEQ ID NO: 38810 - DNA, 20 bp, Artificial Sequence
  Description of Artificial Sequence: Synthetic oligonucleotide
  Target: SCN10A; (+) strand; PAM type: NRG; PAM sequence: GGG
ctccaacatagcaacatggg

SEQ ID NO: 38811 - DNA, 20 bp, Artificial Sequence
  Description of Artificial Sequence: Synthetic oligonucleotide
  Target: SCN10A; (+) strand; PAM type: NRG; PAM sequence: GAG
tgtttcaacatttgaatttt

SEQ ID NO: 38812 - DNA, 20 bp, Artificial Sequence
  Description of Artificial Sequence: Synthetic oligonucleotide
  Target: SCN10A; (+) strand; PAM type: NRG; PAM sequence: AGG
gtttcaacatttgaattttg

SEQ ID NO: 38813 - DNA, 20 bp, Artificial Sequence
  Description of Artificial Sequence: Synthetic oligonucleotide
  Target: SCN10A; (+) strand; PAM type: NRG; PAM sequence: GGG
tttcaacatttgaattttga

SEQ ID NO: 38814 - DNA, 20 bp, Artificial Sequence
  Description of Artificial Sequence: Synthetic oligonucleotide
  Target: SCN10A; (+) strand; PAM type: NRG; PAM sequence: GGG
ttcaacatttgaattttgag

SEQ ID NO: 38815 - DNA, 20 bp, Artificial Sequence
  Description of Artificial Sequence: Synthetic oligonucleotide
  Target: SCN10A; (+) strand; PAM type: NRG; PAM sequence: TAG
aggggacaaaattcactcca

SEQ ID NO: 38816 - DNA, 20 bp, Artificial Sequence
  Description of Artificial Sequence: Synthetic oligonucleotide
  Target: SCN10A; (+) strand; PAM type: NRG; PAM sequence: CAG
ggacaaaattcactccatag

SEQ ID NO: 38817 - DNA, 20 bp, Artificial Sequence
  Description of Artificial Sequence: Synthetic oligonucleotide
  Target: SCN10A; (+) strand; PAM type: NRG; PAM sequence: TGG
caactacccatgccataaaa

SEQ ID NO: 38818 - DNA, 20 bp, Artificial Sequence
  Description of Artificial Sequence: Synthetic oligonucleotide
  Target: SCN10A; (+) strand; PAM type: NRG; PAM sequence: CAG
gccataaaatggaacgtgac

SEQ ID NO: 38819 - DNA, 20 bp, Artificial Sequence
  Description of Artificial Sequence: Synthetic oligonucleotide
  Target: SCN10A; (+) strand; PAM type: NRG; PAM sequence: CAG
gaacgtgaccagcacttcac

SEQ ID NO: 38820 - DNA, 20 bp, Artificial Sequence
  Description of Artificial Sequence: Synthetic oligonucleotide
  Target: SCN10A; (+) strand; PAM type: NRG; PAM sequence: TGG
acatcctccctcttctgccc

SEQ ID NO: 38821 - DNA, 20 bp, Artificial Sequence
  Description of Artificial Sequence: Synthetic oligonucleotide
  Target: SCN10A; (+) strand; PAM type: NRG; PAM sequence: GAG
atcctccctcttctgccctg

SEQ ID NO: 38822 - DNA, 20 bp, Artificial Sequence
  Description of Artificial Sequence: Synthetic oligonucleotide
  Target: SCN10A; (+) strand; PAM type: NRG; PAM sequence: AGG
tcctccctcttctgccctgg

SEQ ID NO: 38823 - DNA, 20 bp, Artificial Sequence
  Description of Artificial Sequence: Synthetic oligonucleotide
  Target: SCN10A; (+) strand; PAM type: NRG; PAM sequence: TGG
gccactattctcctaatttt

SEQ ID NO: 38824 - DNA, 20 bp, Artificial Sequence
  Description of Artificial Sequence: Synthetic oligonucleotide
  Target: SCN10A; (+) strand; PAM type: NRG; PAM sequence: AAG
attgatgctttttacttcat

SEQ ID NO: 38825 - DNA, 20 bp, Artificial Sequence
  Description of Artificial Sequence: Synthetic oligonucleotide
  Target: SCN10A; (+) strand; PAM type: NRG; PAM sequence: TAG
gtatgcattcctaaacaaaa

SEQ ID NO: 38826 - DNA, 20 bp, Artificial Sequence
  Description of Artificial Sequence: Synthetic oligonucleotide
  Target: SCN10A; (+) strand; PAM type: NRG; PAM sequence: TAG
cattcctaaacaaaatagtt

SEQ ID NO: 38827 - DNA, 20 bp, Artificial Sequence
  Description of Artificial Sequence: Synthetic oligonucleotide
  Target: SCN10A; (+) strand; PAM type: NRG; PAM sequence: TGG
tttatgtaatcctttgcatt

SEQ ID NO: 38828 - DNA, 20 bp, Artificial Sequence
  Description of Artificial Sequence: Synthetic oligonucleotide
  Target: SCN10A; (+) strand; PAM type: NRG; PAM sequence: AAG
ttgttcaatattactttctt

SEQ ID NO: 38829 - DNA, 20 bp, Artificial Sequence
  Description of Artificial Sequence: Synthetic oligonucleotide
  Target: SCN10A; (+) strand; PAM type: NRG; PAM sequence: CAG
gactcatccttattgttgtg

SEQ ID NO: 38830 - DNA, 20 bp, Artificial Sequence
  Description of Artificial Sequence: Synthetic oligonucleotide
  Target: SCN10A; (+) strand; PAM type: NRG; PAM sequence: AAG
cttattgttgtgcagcacta

SEQ ID NO: 38831 - DNA, 20 bp, Artificial Sequence
  Description of Artificial Sequence: Synthetic oligonucleotide
  Target: SCN10A; (+) strand; PAM type: NRG; PAM sequence: AAG
ttattaatttttattgctgt

SEQ ID NO: 38832 - DNA, 20 bp, Artificial Sequence
  Description of Artificial Sequence: Synthetic oligonucleotide
  Target: SCN10A; (+) strand; PAM type: NRG; PAM sequence: TAG
tgctgtaagttttctcattt

SEQ ID NO: 38833 - DNA, 20 bp, Artificial Sequence
  Description of Artificial Sequence: Synthetic oligonucleotide
  Target: SCN10A; (+) strand; PAM type: NRG; PAM sequence: CAG
tttctcattttagaatataa

SEQ ID NO: 38834 - DNA, 20 bp, Artificial Sequence
  Description of Artificial Sequence: Synthetic oligonucleotide
  Target: SCN10A; (+) strand; PAM type: NRG; PAM sequence: TAG
attttagaatataacagaaa

SEQ ID NO: 38835 - DNA, 20 bp, Artificial Sequence
  Description of Artificial Sequence: Synthetic oligonucleotide
  Target: SCN10A; (+) strand; PAM type: NRG; PAM sequence: AAG
agaaatagttaatgtactca

SEQ ID NO: 38836 - DNA, 20 bp, Artificial Sequence
  Description of Artificial Sequence: Synthetic oligonucleotide
  Target: SCN10A; (+) strand; PAM type: NRG; PAM sequence: TGG
gttaatgtactcaaagttta

SEQ ID NO: 38837 - DNA, 20 bp, Artificial Sequence
  Description of Artificial Sequence: Synthetic oligonucleotide
  Target: SCN10A; (+) strand; PAM type: NRG; PAM sequence: GAG
ctcaaagtttatggacattt

SEQ ID NO: 38838 - DNA, 20 bp, Artificial Sequence
  Description of Artificial Sequence: Synthetic oligonucleotide
  Target: SCN10A; (+) strand; PAM type: NRG; PAM sequence: TGG
aaagtttatggacatttgag

SEQ ID NO: 38839 - DNA, 20 bp, Artificial Sequence
  Description of Artificial Sequence: Synthetic oligonucleotide
  Target: SCN10A; (+) strand; PAM type: NRG; PAM sequence: CGG
atggacatttgagtggtttc

SEQ ID NO: 38840 - DNA, 20 bp, Artificial Sequence
  Description of Artificial Sequence: Synthetic oligonucleotide
  Target: SCN10A; (+) strand; PAM type: NRG; PAM sequence: TGG
catttgagtggtttccggtt

SEQ ID NO: 38841 - DNA, 20 bp, Artificial Sequence
  Description of Artificial Sequence: Synthetic oligonucleotide
  Target: SCN10A; (+) strand; PAM type: NRG; PAM sequence: GGG
atttgagtggtttccggttt

SEQ ID NO: 38842 - DNA, 20 bp, Artificial Sequence
  Description of Artificial Sequence: Synthetic oligonucleotide
  Target: SCN10A; (+) strand; PAM type: NRG; PAM sequence: GGG
tttgagtggtttccggtttg

SEQ ID NO: 38843 - DNA, 20 bp, Artificial Sequence
  Description of Artificial Sequence: Synthetic oligonucleotide
  Target: SCN10A; (+) strand; PAM type: NRG; PAM sequence: TGG
tttccggtttggggttttta

SEQ ID NO: 38844 - DNA, 20 bp, Artificial Sequence
  Description of Artificial Sequence: Synthetic oligonucleotide
  Target: SCN10A; (+) strand; PAM type: NRG; PAM sequence: GGG
ttccggtttggggtttttat

SEQ ID NO: 38845 - DNA, 20 bp, Artificial Sequence
  Description of Artificial Sequence: Synthetic oligonucleotide
  Target: SCN10A; (+) strand; PAM type: NRG; PAM sequence: TAG
aatgttcataaactttcttg

SEQ ID NO: 38846 - DNA, 20 bp, Artificial Sequence
  Description of Artificial Sequence: Synthetic oligonucleotide
  Target: SCN10A; (+) strand; PAM type: NRG; PAM sequence: TGG
actttcttgtagctgtaatc

SEQ ID NO: 38847 - DNA, 20 bp, Artificial Sequence
  Description of Artificial Sequence: Synthetic oligonucleotide
  Target: SCN10A; (+) strand; PAM type: NRG; PAM sequence: AAG
agctgtaatctggtgtccac

SEQ ID NO: 38848 - DNA, 20 bp, Artificial Sequence
  Description of Artificial Sequence: Synthetic oligonucleotide
  Target: SCN10A; (+) strand; PAM type: NRG; PAM sequence: TAG
gtacatatttctgttaaaca

SEQ ID NO: 38849 - DNA, 20 bp, Artificial Sequence
  Description of Artificial Sequence: Synthetic oligonucleotide
  Target: SCN10A; (+) strand; PAM type: NRG; PAM sequence: AGG
tacatatttctgttaaacat

SEQ ID NO: 38850 - DNA, 20 bp, Artificial Sequence
  Description of Artificial Sequence: Synthetic oligonucleotide
  Target: SCN10A; (+) strand; PAM type: NRG; PAM sequence: AAG
tctgttaaacataggtacct

SEQ ID NO: 38851 - DNA, 20 bp, Artificial Sequence
  Description of Artificial Sequence: Synthetic oligonucleotide
  Target: SCN10A; (+) strand; PAM type: NRG; PAM sequence: AGG
ctgttaaacataggtaccta

SEQ ID NO: 38852 - DNA, 20 bp, Artificial Sequence
  Description of Artificial Sequence: Synthetic oligonucleotide
  Target: SCN10A; (+) strand; PAM type: NRG; PAM sequence: GGG
tgttaaacataggtacctaa

SEQ ID NO: 38853 - DNA, 20 bp, Artificial Sequence
  Description of Artificial Sequence: Synthetic oligonucleotide
  Target: SCN10A; (+) strand; PAM type: NRG; PAM sequence: TAG
ataggtacctaagggtgtaa

SEQ ID NO: 38854 - DNA, 20 bp, Artificial Sequence
  Description of Artificial Sequence: Synthetic oligonucleotide
  Target: SCN10A; (+) strand; PAM type: NRG; PAM sequence: AAG
ggtacctaagggtgtaatag

SEQ ID NO: 38855 - DNA, 20 bp, Artificial Sequence
  Description of Artificial Sequence: Synthetic oligonucleotide
  Target: SCN10A; (+) strand; PAM type: NRG; PAM sequence: CAG
aagggtgtaatagaagaata

SEQ ID NO: 38856 - DNA, 20 bp, Artificial Sequence
  Description of Artificial Sequence: Synthetic oligonucleotide
  Target: SCN10A; (+) strand; PAM type: NRG; PAM sequence: TAG
atgtatgcttacacctttac

SEQ ID NO: 38857 - DNA, 20 bp, Artificial Sequence
  Description of Artificial Sequence: Synthetic oligonucleotide
  Target: SCN10A; (+) strand; PAM type: NRG; PAM sequence: AAG
ataataccccttgctttcca

SEQ ID NO: 38858 - DNA, 20 bp, Artificial Sequence
  Description of Artificial Sequence: Synthetic oligonucleotide
  Target: SCN10A; (+) strand; PAM type: NRG; PAM sequence: GAG
aataccccttgctttccaaa

SEQ ID NO: 38859 - DNA, 20 bp, Artificial Sequence
  Description of Artificial Sequence: Synthetic oligonucleotide
  Target: SCN10A; (+) strand; PAM type: NRG; PAM sequence: AGG
ataccccttgctttccaaag

SEQ ID NO: 38860 - DNA, 20 bp, Artificial Sequence
  Description of Artificial Sequence: Synthetic oligonucleotide
  Target: SCN10A; (+) strand; PAM type: NRG; PAM sequence: CAG
gtccaaatttacactcccac

SEQ ID NO: 38861 - DNA, 20 bp, Artificial Sequence
  Description of Artificial Sequence: Synthetic oligonucleotide
  Target: SCN10A; (+) strand; PAM type: NRG; PAM sequence: CAG
caaatttacactcccaccag

SEQ ID NO: 38862 - DNA, 20 bp, Artificial Sequence
  Description of Artificial Sequence: Synthetic oligonucleotide
  Target: SCN10A; (+) strand; PAM type: NRG; PAM sequence: GAG
cactcccaccagcagtgtgt

SEQ ID NO: 38863 - DNA, 20 bp, Artificial Sequence
  Description of Artificial Sequence: Synthetic oligonucleotide
  Target: SCN10A; (+) strand; PAM type: NRG; PAM sequence: TGG
tccatgtcattcccaatact

SEQ ID NO: 38864 - DNA, 20 bp, Artificial Sequence
  Description of Artificial Sequence: Synthetic oligonucleotide
  Target: SCN10A; (+) strand; PAM type: NRG; PAM sequence: CAG
atgaacatgtaataaaatct

SEQ ID NO: 38865 - DNA, 20 bp, Artificial Sequence
  Description of Artificial Sequence: Synthetic oligonucleotide
  Target: SCN10A; (+) strand; PAM type: NRG; PAM sequence: AAG
gcaactctttgatttaaaaa

SEQ ID NO: 38866 - DNA, 20 bp, Artificial Sequence
  Description of Artificial Sequence: Synthetic oligonucleotide
  Target: SCN10A; (+) strand; PAM type: NRG; PAM sequence: AGG
caactctttgatttaaaaaa

SEQ ID NO: 38867 - DNA, 20 bp, Artificial Sequence
  Description of Artificial Sequence: Synthetic oligonucleotide
  Target: SCN10A; (+) strand; PAM type: NRG; PAM sequence: AAG
ctttgatttaaaaaaaggtt

SEQ ID NO: 38868 - DNA, 20 bp, Artificial Sequence
  Description of Artificial Sequence: Synthetic oligonucleotide
  Target: SCN10A; (+) strand; PAM type: NRG; PAM sequence: TGG
agaatactttcatatgttta

SEQ ID NO: 38869 - DNA, 20 bp, Artificial Sequence
  Description of Artificial Sequence: Synthetic oligonucleotide
  Target: SCN10A; (+) strand; PAM type: NRG; PAM sequence: TGG
ttcatatgtttatggccatt

SEQ ID NO: 38870 - DNA, 20 bp, Artificial Sequence
  Description of Artificial Sequence: Synthetic oligonucleotide
  Target: SCN10A; (+) strand; PAM type: NRG; PAM sequence: AAG
tttggatttccacttttgta

SEQ ID NO: 38871 - DNA, 20 bp, Artificial Sequence
  Description of Artificial Sequence: Synthetic oligonucleotide
  Target: SCN10A; (+) strand; PAM type: NRG; PAM sequence: AAG
caaattttgtgctattttac

SEQ ID NO: 38872 - DNA, 20 bp, Artificial Sequence
  Description of Artificial Sequence: Synthetic oligonucleotide
  Target: SCN10A; (+) strand; PAM type: NRG; PAM sequence: TGG
attttgtgctattttacaag

SEQ ID NO: 38873 - DNA, 20 bp, Artificial Sequence
  Description of Artificial Sequence: Synthetic oligonucleotide
  Target: SCN10A; (+) strand; PAM type: NRG; PAM sequence: TAG
acatttttctaattgatttg

SEQ ID NO: 38874 - DNA, 20 bp, Artificial Sequence
  Description of Artificial Sequence: Synthetic oligonucleotide
  Target: SCN10A; (+) strand; PAM type: NRG; PAM sequence: GAG
atttttctaattgatttgta

SEQ ID NO: 38875 - DNA, 20 bp, Artificial Sequence
  Description of Artificial Sequence: Synthetic oligonucleotide
  Target: SCN10A; (+) strand; PAM type: NRG; PAM sequence: AAG
gagttcattactctgaatat

SEQ ID NO: 38876 - DNA, 20 bp, Artificial Sequence
  Description of Artificial Sequence: Synthetic oligonucleotide
  Target: SCN10A; (+) strand; PAM type: NRG; PAM sequence: AAG
cttgctttttcatgctctta

SEQ ID NO: 38877 - DNA, 20 bp, Artificial Sequence
  Description of Artificial Sequence: Synthetic oligonucleotide
  Target: SCN10A; (+) strand; PAM type: NRG; PAM sequence: TAG
ctgatgaacattcttaatta

SEQ ID NO: 38878 - DNA, 20 bp, Artificial Sequence
  Description of Artificial Sequence: Synthetic oligonucleotide
  Target: SCN10A; (+) strand; PAM type: NRG; PAM sequence: CAG
tatagtatactaaaatgtat

SEQ ID NO: 38879 - DNA, 20 bp, Artificial Sequence
  Description of Artificial Sequence: Synthetic oligonucleotide
  Target: SCN10A; (+) strand; PAM type: NRG; PAM sequence: TAG
tgtatcagttttttcctgta

SEQ ID NO: 38880 - DNA, 20 bp, Artificial Sequence
  Description of Artificial Sequence: Synthetic oligonucleotide
  Target: SCN10A; (+) strand; PAM type: NRG; PAM sequence: TAG
tcagttttttcctgtatagt

SEQ ID NO: 38881 - DNA, 20 bp, Artificial Sequence
  Description of Artificial Sequence: Synthetic oligonucleotide
  Target: SCN10A; (+) strand; PAM type: NRG; PAM sequence: AAG
ttcttgtgtcatatgtaata

SEQ ID NO: 38882 - DNA, 20 bp, Artificial Sequence
  Description of Artificial Sequence: Synthetic oligonucleotide
  Target: SCN10A; (+) strand; PAM type: NRG; PAM sequence: TAG
atatgtaataaagtttttct

SEQ ID NO: 38883 - DNA, 20 bp, Artificial Sequence
  Description of Artificial Sequence: Synthetic oligonucleotide
  Target: SCN10A; (+) strand; PAM type: NRG; PAM sequence: GAG
aataaagtttttcttagtct

SEQ ID NO: 38884 - DNA, 20 bp, Artificial Sequence
  Description of Artificial Sequence: Synthetic oligonucleotide
  Target: SCN10A; (+) strand; PAM type: NRG; PAM sequence: AGG
ataaagtttttcttagtctg

SEQ ID NO: 38885 - DNA, 20 bp, Artificial Sequence
  Description of Artificial Sequence: Synthetic oligonucleotide
  Target: SCN10A; (+) strand; PAM type: NRG; PAM sequence: AAG
tttcttagtctgaggtcata

SEQ ID NO: 38886 - DNA, 20 bp, Artificial Sequence
  Description of Artificial Sequence: Synthetic oligonucleotide
  Target: SCN10A; (+) strand; PAM type: NRG; PAM sequence: AAG
ctttgttttttcctttcaaa

SEQ ID NO: 38887 - DNA, 20 bp, Artificial Sequence
  Description of Artificial Sequence: Synthetic oligonucleotide
  Target: SCN10A; (+) strand; PAM type: NRG; PAM sequence: AAG
aaagcttatccaccacgatc

SEQ ID NO: 38888 - DNA, 20 bp, Artificial Sequence
  Description of Artificial Sequence: Synthetic oligonucleotide
  Target: SCN10A; (+) strand; PAM type: NRG; PAM sequence: CGG
cttatccaccacgatcaagt

SEQ ID NO: 38889 - DNA, 20 bp, Artificial Sequence
  Description of Artificial Sequence: Synthetic oligonucleotide
  Target: SCN10A; (+) strand; PAM type: NRG; PAM sequence: TGG
gatcaagtcggcttcatacc

SEQ ID NO: 38890 - DNA, 20 bp, Artificial Sequence
  Description of Artificial Sequence: Synthetic oligonucleotide
  Target: SCN10A; (+) strand; PAM type: NRG; PAM sequence: GGG
atcaagtcggcttcatacct

SEQ ID NO: 38891 - DNA, 20 bp, Artificial Sequence
  Description of Artificial Sequence: Synthetic oligonucleotide
  Target: SCN10A; (+) strand; PAM type: NRG; PAM sequence: AAG
cggcttcatacctgggatca

SEQ ID NO: 38892 - DNA, 20 bp, Artificial Sequence
  Description of Artificial Sequence: Synthetic oligonucleotide
  Target: SCN10A; (+) strand; PAM type: NRG; PAM sequence: TGG
ttcatacctgggatcaaagc

SEQ ID NO: 38893 - DNA, 20 bp, Artificial Sequence
  Description of Artificial Sequence: Synthetic oligonucleotide
  Target: SCN10A; (+) strand; PAM type: NRG; PAM sequence: AAG
aaagctggttcaacatacgc

SEQ ID NO: 38894 - DNA, 20 bp, Artificial Sequence
  Description of Artificial Sequence: Synthetic oligonucleotide
  Target: SCN10A; (+) strand; PAM type: NRG; PAM sequence: CAG
aacgtaatccatcacacaaa

SEQ ID NO: 38895 - DNA, 20 bp, Artificial Sequence
  Description of Artificial Sequence: Synthetic oligonucleotide
  Target: SCN10A; (+) strand; PAM type: NRG; PAM sequence: TAG
aaaccacgtgattatctcaa

SEQ ID NO: 38896 - DNA, 20 bp, Artificial Sequence
  Description of Artificial Sequence: Synthetic oligonucleotide
  Target: SCN10A; (+) strand; PAM type: NRG; PAM sequence: CAG
cgtgattatctcaatagatg

SEQ ID NO: 38897 - DNA, 20 bp, Artificial Sequence
  Description of Artificial Sequence: Synthetic oligonucleotide
  Target: SCN10A; (+) strand; PAM type: NRG; PAM sequence: AAG
ttatctcaatagatgcagaa

SEQ ID NO: 38898 - DNA, 20 bp, Artificial Sequence
  Description of Artificial Sequence: Synthetic oligonucleotide
  Target: SCN10A; (+) strand; PAM type: NRG; PAM sequence: AGG
tatctcaatagatgcagaaa

SEQ ID NO: 38899 - DNA, 20 bp, Artificial Sequence
  Description of Artificial Sequence: Synthetic oligonucleotide
  Target: SCN10A; (+) strand; PAM type: NRG; PAM sequence: AAG
tcaacacccattcatgctaa

SEQ ID NO: 38900 - DNA, 20 bp, Artificial Sequence
  Description of Artificial Sequence: Synthetic oligonucleotide
  Target: SCN10A; (+) strand; PAM type: NRG; PAM sequence: TAG
gctaaaagctctcaataaac

SEQ ID NO: 38901 - DNA, 20 bp, Artificial Sequence
  Description of Artificial Sequence: Synthetic oligonucleotide
  Target: SCN10A; (+) strand; PAM type: NRG; PAM sequence: AGG
ctaaaagctctcaataaact

SEQ ID NO: 38902 - DNA, 20 bp, Artificial Sequence
  Description of Artificial Sequence: Synthetic oligonucleotide
  Target: SCN10A; (+) strand; PAM type: NRG; PAM sequence: TGG
ctcaataaactaggtattga

SEQ ID NO: 38903 - DNA, 20 bp, Artificial Sequence
  Description of Artificial Sequence: Synthetic oligonucleotide
  Target: SCN10A; (+) strand; PAM type: NRG; PAM sequence: AAG
ggaatgtatctcaaaataat

SEQ ID NO: 38904 - DNA, 20 bp, Artificial Sequence
  Description of Artificial Sequence: Synthetic oligonucleotide
  Target: SCN10A; (+) strand; PAM type: NRG; PAM sequence: AAG
taataagaactatttatgac

SEQ ID NO: 38905 - DNA, 20 bp, Artificial Sequence
  Description of Artificial Sequence: Synthetic oligonucleotide
  Target: SCN10A; (+) strand; PAM type: NRG; PAM sequence: CAG
aactatttatgacaagcccc

SEQ ID NO: 38906 - DNA, 20 bp, Artificial Sequence
  Description of Artificial Sequence: Synthetic oligonucleotide
  Target: SCN10A; (+) strand; PAM type: NRG; PAM sequence: TGG
ccagccaatatcatactgaa

SEQ ID NO: 38907 - DNA, 20 bp, Artificial Sequence
  Description of Artificial Sequence: Synthetic oligonucleotide
  Target: SCN10A; (+) strand; PAM type: NRG; PAM sequence: GGG
cagccaatatcatactgaat

SEQ ID NO: 38908 - DNA, 20 bp, Artificial Sequence
  Description of Artificial Sequence: Synthetic oligonucleotide
  Target: SCN10A; (+) strand; PAM type: NRG; PAM sequence: TGG
catactgaatgggcaaaaac

SEQ ID NO: 38909 - DNA, 20 bp, Artificial Sequence
  Description of Artificial Sequence: Synthetic oligonucleotide
  Target: SCN10A; (+) strand; PAM type: NRG; PAM sequence: AAG
actgaatgggcaaaaactgg

SEQ ID NO: 38910 - DNA, 20 bp, Artificial Sequence
  Description of Artificial Sequence: Synthetic oligonucleotide
  Target: SCN10A; (+) strand; PAM type: NRG; PAM sequence: CAG
gaagcatttcctttgaaaac

SEQ ID NO: 38911 - DNA, 20 bp, Artificial Sequence
  Description of Artificial Sequence: Synthetic oligonucleotide
  Target: SCN10A; (+) strand; PAM type: NRG; PAM sequence: AAG
tttcctttgaaaaccagcac

SEQ ID NO: 38912 - DNA, 20 bp, Artificial Sequence
  Description of Artificial Sequence: Synthetic oligonucleotide
  Target: SCN10A; (+) strand; PAM type: NRG; PAM sequence: AAG
tttgaaaaccagcacaagac

SEQ ID NO: 38913 - DNA, 20 bp, Artificial Sequence
  Description of Artificial Sequence: Synthetic oligonucleotide
  Target: SCN10A; (+) strand; PAM type: NRG; PAM sequence: TAG
ctcaccactcttattcaaca

SEQ ID NO: 38914 - DNA, 20 bp, Artificial Sequence
  Description of Artificial Sequence: Synthetic oligonucleotide
  Target: SCN10A; (+) strand; PAM type: NRG; PAM sequence: TGG
actcttattcaacatagtat

SEQ ID NO: 38915 - DNA, 20 bp, Artificial Sequence
  Description of Artificial Sequence: Synthetic oligonucleotide
  Target: SCN10A; (+) strand; PAM type: NRG; PAM sequence: AAG
cttattcaacatagtattgg

SEQ ID NO: 38916 - DNA, 20 bp, Artificial Sequence
  Description of Artificial Sequence: Synthetic oligonucleotide
  Target: SCN10A; (+) strand; PAM type: NRG; PAM sequence: TGG
caacatagtattggaagttc

SEQ ID NO: 38917 - DNA, 20 bp, Artificial Sequence
  Description of Artificial Sequence: Synthetic oligonucleotide
  Target: SCN10A; (+) strand; PAM type: NRG; PAM sequence: CAG
atagtattggaagttctggc

SEQ ID NO: 38918 - DNA, 20 bp, Artificial Sequence
  Description of Artificial Sequence: Synthetic oligonucleotide
  Target: SCN10A; (+) strand; PAM type: NRG; PAM sequence: AGG
tagtattggaagttctggcc

SEQ ID NO: 38919 - DNA, 20 bp, Artificial Sequence
  Description of Artificial Sequence: Synthetic oligonucleotide
  Target: SCN10A; (+) strand; PAM type: NRG; PAM sequence: GGG
agtattggaagttctggcca

SEQ ID NO: 38920 - DNA, 20 bp, Artificial Sequence
  Description of Artificial Sequence: Synthetic oligonucleotide
  Target: SCN10A; (+) strand; PAM type: NRG; PAM sequence: CAG
gaagttctggccagggcgat

SEQ ID NO: 38921 - DNA, 20 bp, Artificial Sequence
  Description of Artificial Sequence: Synthetic oligonucleotide
  Target: SCN10A; (+) strand; PAM type: NRG; PAM sequence: AGG
aagttctggccagggcgatc

SEQ ID NO: 38922 - DNA, 20 bp, Artificial Sequence
  Description of Artificial Sequence: Synthetic oligonucleotide
  Target: SCN10A; (+) strand; PAM type: NRG; PAM sequence: AAG
tctggccagggcgatcaggc

SEQ ID NO: 38923 - DNA, 20 bp, Artificial Sequence
  Description of Artificial Sequence: Synthetic oligonucleotide
  Target: SCN10A; (+) strand; PAM type: NRG; PAM sequence: GAG
tggccagggcgatcaggcaa

SEQ ID NO: 38924 - DNA, 20 bp, Artificial Sequence
  Description of Artificial Sequence: Synthetic oligonucleotide
  Target: SCN10A; (+) strand; PAM type: NRG; PAM sequence: AAG
cagggcgatcaggcaagaga

SEQ ID NO: 38925 - DNA, 20 bp, Artificial Sequence
  Description of Artificial Sequence: Synthetic oligonucleotide
  Target: SCN10A; (+) strand; PAM type: NRG; PAM sequence: AAG
atcaggcaagagaaagaaat

SEQ ID NO: 38926 - DNA, 20 bp, Artificial Sequence
  Description of Artificial Sequence: Synthetic oligonucleotide
  Target: SCN10A; (+) strand; PAM type: NRG; PAM sequence: AGG
tcaggcaagagaaagaaata

SEQ ID NO: 38927 - DNA, 20 bp, Artificial Sequence
  Description of Artificial Sequence: Synthetic oligonucleotide
  Target: SCN10A; (+) strand; PAM type: NRG; PAM sequence: GGG
caggcaagagaaagaaataa

SEQ ID NO: 38928 - DNA, 20 bp, Artificial Sequence
  Description of Artificial Sequence: Synthetic oligonucleotide
  Target: SCN10A; (+) strand; PAM type: NRG; PAM sequence: GGG
aggcaagagaaagaaataag

SEQ ID NO: 38929 - DNA, 20 bp, Artificial Sequence
  Description of Artificial Sequence: Synthetic oligonucleotide
  Target: SCN10A; (+) strand; PAM type: NRG; PAM sequence: TAG
agaaataaggggtattcaaa

SEQ ID NO: 38930 - DNA, 20 bp, Artificial Sequence
  Description of Artificial Sequence: Synthetic oligonucleotide
  Target: SCN10A; (+) strand; PAM type: NRG; PAM sequence: AGG
gaaataaggggtattcaaat

SEQ ID NO: 38931 - DNA, 20 bp, Artificial Sequence
  Description of Artificial Sequence: Synthetic oligonucleotide
  Target: SCN10A; (+) strand; PAM type: NRG; PAM sequence: AAG
aaggggtattcaaataggaa

SEQ ID NO: 38932 - DNA, 20 bp, Artificial Sequence
  Description of Artificial Sequence: Synthetic oligonucleotide
  Target: SCN10A; (+) strand; PAM type: NRG; PAM sequence: GAG
ggggtattcaaataggaaaa

SEQ ID NO: 38933 - DNA, 20 bp, Artificial Sequence
  Description of Artificial Sequence: Synthetic oligonucleotide
  Target: SCN10A; (+) strand; PAM type: NRG; PAM sequence: AGG
gggtattcaaataggaaaag

SEQ ID NO: 38934 - DNA, 20 bp, Artificial Sequence
  Description of Artificial Sequence: Synthetic oligonucleotide
  Target: SCN10A; (+) strand; PAM type: NRG; PAM sequence: AAG
tattcaaataggaaaagagg

SEQ ID NO: 38935 - DNA, 20 bp, Artificial Sequence
  Description of Artificial Sequence: Synthetic oligonucleotide
  Target: SCN10A; (+) strand; PAM type: NRG; PAM sequence: CAG
agtcaaattgtctctgtttg

SEQ ID NO: 38936 - DNA, 20 bp, Artificial Sequence
  Description of Artificial Sequence: Synthetic oligonucleotide
  Target: SCN10A; (+) strand; PAM type: NRG; PAM sequence: TAG
agatgacatgactgtatatt

SEQ ID NO: 38937 - DNA, 20 bp, Artificial Sequence
  Description of Artificial Sequence: Synthetic oligonucleotide
  Target: SCN10A; (+) strand; PAM type: NRG; PAM sequence: CAG
tttagaaaaccccatcatct

SEQ ID NO: 38938 - DNA, 20 bp, Artificial Sequence
  Description of Artificial Sequence: Synthetic oligonucleotide
  Target: SCN10A; (+) strand; PAM type: NRG; PAM sequence: AAG
tctcagcccaaaatctcctt

SEQ ID NO: 38939 - DNA, 20 bp, Artificial Sequence
  Description of Artificial Sequence: Synthetic oligonucleotide
  Target: SCN10A; (+) strand; PAM type: NRG; PAM sequence: AAG
caaaatctccttaagctgat

SEQ ID NO: 38940 - DNA, 20 bp, Artificial Sequence
  Description of Artificial Sequence: Synthetic oligonucleotide
  Target: SCN10A; (+) strand; PAM type: NRG; PAM sequence: CAG
cttaagctgataagcaactt

SEQ ID NO: 38941 - DNA, 20 bp, Artificial Sequence
  Description of Artificial Sequence: Synthetic oligonucleotide
  Target: SCN10A; (+) strand; PAM type: NRG; PAM sequence: AAG
gctgataagcaacttcagca

SEQ ID NO: 38942 - DNA, 20 bp, Artificial Sequence
  Description of Artificial Sequence: Synthetic oligonucleotide
  Target: SCN10A; (+) strand; PAM type: NRG; PAM sequence: CAG
aagcaacttcagcaaagtct

SEQ ID NO: 38943 - DNA, 20 bp, Artificial Sequence
  Description of Artificial Sequence: Synthetic oligonucleotide
  Target: SCN10A; (+) strand; PAM type: NRG; PAM sequence: AGG
agcaacttcagcaaagtctc

SEQ ID NO: 38944 - DNA, 20 bp, Artificial Sequence
  Description of Artificial Sequence: Synthetic oligonucleotide
  Target: SCN10A; (+) strand; PAM type: NRG; PAM sequence: AAG
aatcaatgtgcaaaaatcac

SEQ ID NO: 38945 - DNA, 20 bp, Artificial Sequence
  Description of Artificial Sequence: Synthetic oligonucleotide
  Target: SCN10A; (+) strand; PAM type: NRG; PAM sequence: CAG
gcattcccatacaccaataa

SEQ ID NO: 38946 - DNA, 20 bp, Artificial Sequence
  Description of Artificial Sequence: Synthetic oligonucleotide
  Target: SCN10A; (+) strand; PAM type: NRG; PAM sequence: GAG
acaccaataacagacaaacc

SEQ ID NO: 38947 - DNA, 20 bp, Artificial Sequence
  Description of Artificial Sequence: Synthetic oligonucleotide
  Target: SCN10A; (+) strand; PAM type: NRG; PAM sequence: GAG
accaataacagacaaaccga

SEQ ID NO: 38948 - DNA, 20 bp, Artificial Sequence
  Description of Artificial Sequence: Synthetic oligonucleotide
  Target: SCN10A; (+) strand; PAM type: NRG; PAM sequence: GAG
caaaccgagagccaaatcat

SEQ ID NO: 38949 - DNA, 20 bp, Artificial Sequence
  Description of Artificial Sequence: Synthetic oligonucleotide
  Target: SCN10A; (+) strand; PAM type: NRG; PAM sequence: AAG
tcccattcacaattgcaaca

SEQ ID NO: 38950 - DNA, 20 bp, Artificial Sequence
  Description of Artificial Sequence: Synthetic oligonucleotide
  Target: SCN10A; (+) strand; PAM type: NRG; PAM sequence: GAG
ccattcacaattgcaacaaa

SEQ ID NO: 38951 - DNA, 20 bp, Artificial Sequence
  Description of Artificial Sequence: Synthetic oligonucleotide
  Target: SCN10A; (+) strand; PAM type: NRG; PAM sequence: TAG
aacaaagagaataaaatatc

SEQ ID NO: 38952 - DNA, 20 bp, Artificial Sequence
  Description of Artificial Sequence: Synthetic oligonucleotide
  Target: SCN10A; (+) strand; PAM type: NRG; PAM sequence: AAG
tatctagaaatacaacttac

SEQ ID NO: 38953 - DNA, 20 bp, Artificial Sequence
  Description of Artificial Sequence: Synthetic oligonucleotide
  Target: SCN10A; (+) strand; PAM type: NRG; PAM sequence: AGG
atctagaaatacaacttaca

SEQ ID NO: 38954 - DNA, 20 bp, Artificial Sequence
  Description of Artificial Sequence: Synthetic oligonucleotide
  Target: SCN10A; (+) strand; PAM type: NRG; PAM sequence: GGG
tctagaaatacaacttacaa

SEQ ID NO: 38955 - DNA, 20 bp, Artificial Sequence
  Description of Artificial Sequence: Synthetic oligonucleotide
  Target: SCN10A; (+) strand; PAM type: NRG; PAM sequence: AAG
tacaacttacaagggatgtg

SEQ ID NO: 38956 - DNA, 20 bp, Artificial Sequence
  Description of Artificial Sequence: Synthetic oligonucleotide
  Target: SCN10A; (+) strand; PAM type: NRG; PAM sequence: AGG
acaacttacaagggatgtga

SEQ ID NO: 38957 - DNA, 20 bp, Artificial Sequence
  Description of Artificial Sequence: Synthetic oligonucleotide
  Target: SCN10A; (+) strand; PAM type: NRG; PAM sequence: AAG
gggatgtgaaggacctcttc

SEQ ID NO: 38958 - DNA, 20 bp, Artificial Sequence
  Description of Artificial Sequence: Synthetic oligonucleotide
  Target: SCN10A; (+) strand; PAM type: NRG; PAM sequence: AGG
ggatgtgaaggacctcttca

SEQ ID NO: 38959 - DNA, 20 bp, Artificial Sequence
  Description of Artificial Sequence: Synthetic oligonucleotide
  Target: SCN10A; (+) strand; PAM type: NRG; PAM sequence: GAG
atgtgaaggacctcttcaag

SEQ ID NO: 38960 - DNA, 20 bp, Artificial Sequence
  Description of Artificial Sequence: Synthetic oligonucleotide
  Target: SCN10A; (+) strand; PAM type: NRG; PAM sequence: AAG
agaactaaaaatcactgctc

SEQ ID NO: 38961 - DNA, 20 bp, Artificial Sequence
  Description of Artificial Sequence: Synthetic oligonucleotide
  Target: SCN10A; (+) strand; PAM type: NRG; PAM sequence: AGG
gaactaaaaatcactgctca

SEQ ID NO: 38962 - DNA, 20 bp, Artificial Sequence
  Description of Artificial Sequence: Synthetic oligonucleotide
  Target: SCN10A; (+) strand; PAM type: NRG; PAM sequence: AAG
aaatcactgctcaaggaaat

SEQ ID NO: 38963 - DNA, 20 bp, Artificial Sequence
  Description of Artificial Sequence: Synthetic oligonucleotide
  Target: SCN10A; (+) strand; PAM type: NRG; PAM sequence: GAG
atcactgctcaaggaaataa

SEQ ID NO: 38964 - DNA, 20 bp, Artificial Sequence
  Description of Artificial Sequence: Synthetic oligonucleotide
  Target: SCN10A; (+) strand; PAM type: NRG; PAM sequence: GAG
cactgctcaaggaaataaga

SEQ ID NO: 38965 - DNA, 20 bp, Artificial Sequence
  Description of Artificial Sequence: Synthetic oligonucleotide
  Target: SCN10A; (+) strand; PAM type: NRG; PAM sequence: AGG
actgctcaaggaaataagag

SEQ ID NO: 38966 - DNA, 20 bp, Artificial Sequence
  Description of Artificial Sequence: Synthetic oligonucleotide
  Target: SCN10A; (+) strand; PAM type: NRG; PAM sequence: TGG
taagagaggacacaaataaa

SEQ ID NO: 38967 - DNA, 20 bp, Artificial Sequence
  Description of Artificial Sequence: Synthetic oligonucleotide
  Target: SCN10A; (+) strand; PAM type: NRG; PAM sequence: TGG
ggaaaaacattccatgctca

SEQ ID NO: 38968 - DNA, 20 bp, Artificial Sequence
  Description of Artificial Sequence: Synthetic oligonucleotide
  Target: SCN10A; (+) strand; PAM type: NRG; PAM sequence: TAG
aaacattccatgctcatgga

SEQ ID NO: 38969 - DNA, 20 bp, Artificial Sequence
  Description of Artificial Sequence: Synthetic oligonucleotide
  Target: SCN10A; (+) strand; PAM type: NRG; PAM sequence: AGG
aacattccatgctcatggat

SEQ ID NO: 38970 - DNA, 20 bp, Artificial Sequence
  Description of Artificial Sequence: Synthetic oligonucleotide
  Target: SCN10A; (+) strand; PAM type: NRG; PAM sequence: TGG
aaaaatcaatattgtgaaaa

SEQ ID NO: 38971 - DNA, 20 bp, Artificial Sequence
  Description of Artificial Sequence: Synthetic oligonucleotide
  Target: SCN10A; (+) strand; PAM type: NRG; PAM sequence: AAG
gaaaatggccatactgccca

SEQ ID NO: 38972 - DNA, 20 bp, Artificial Sequence
  Description of Artificial Sequence: Synthetic oligonucleotide
  Target: SCN10A; (+) strand; PAM type: NRG; PAM sequence: TAG
atactgcccaaagtaattta

SEQ ID NO: 38973 - DNA, 20 bp, Artificial Sequence
  Description of Artificial Sequence: Synthetic oligonucleotide
  Target: SCN10A; (+) strand; PAM type: NRG; PAM sequence: AAG
gattcaatgttatccccatc

SEQ ID NO: 38974 - DNA, 20 bp, Artificial Sequence
  Description of Artificial Sequence: Synthetic oligonucleotide
  Target: SCN10A; (+) strand; PAM type: NRG; PAM sequence: CAG
gctaccactgactttcttca

SEQ ID NO: 38975 - DNA, 20 bp, Artificial Sequence
  Description of Artificial Sequence: Synthetic oligonucleotide
  Target: SCN10A; (+) strand; PAM type: NRG; PAM sequence: TAG
actgactttcttcacagaat

SEQ ID NO: 38976 - DNA, 20 bp, Artificial Sequence
  Description of Artificial Sequence: Synthetic oligonucleotide
  Target: SCN10A; (+) strand; PAM type: NRG; PAM sequence: TGG
aatctactttaaatttcatg

SEQ ID NO: 38977 - DNA, 20 bp, Artificial Sequence
  Description of Artificial Sequence: Synthetic oligonucleotide
  Target: SCN10A; (+) strand; PAM type: NRG; PAM sequence: AAG
aaatttcatgtggaacaaaa

SEQ ID NO: 38978 - DNA, 20 bp, Artificial Sequence
  Description of Artificial Sequence: Synthetic oligonucleotide
  Target: SCN10A; (+) strand; PAM type: NRG; PAM sequence: GAG
atttcatgtggaacaaaaaa

SEQ ID NO: 38979 - DNA, 20 bp, Artificial Sequence
  Description of Artificial Sequence: Synthetic oligonucleotide
  Target: SCN10A; (+) strand; PAM type: NRG; PAM sequence: TAG
ggaacaaaaaagagcccgca

SEQ ID NO: 38980 - DNA, 20 bp, Artificial Sequence
  Description of Artificial Sequence: Synthetic oligonucleotide
  Target: SCN10A; (+) strand; PAM type: NRG; PAM sequence: AAG
aaaaaagagcccgcatagtc

SEQ ID NO: 38981 - DNA, 20 bp, Artificial Sequence
  Description of Artificial Sequence: Synthetic oligonucleotide
  Target: SCN10A; (+) strand; PAM type: NRG; PAM sequence: AAG
cgcatagtcaagacaattct

SEQ ID NO: 38982 - DNA, 20 bp, Artificial Sequence
  Description of Artificial Sequence: Synthetic oligonucleotide
  Target: SCN10A; (+) strand; PAM type: NRG; PAM sequence: AAG
tcaagacaattctaagcaaa

SEQ ID NO: 38983 - DNA, 20 bp, Artificial Sequence
  Description of Artificial Sequence: Synthetic oligonucleotide
  Target: SCN10A; (+) strand; PAM type: NRG; PAM sequence: AAG
agacaattctaagcaaaaag

SEQ ID NO: 38984 - DNA, 20 bp, Artificial Sequence
  Description of Artificial Sequence: Synthetic oligonucleotide
  Target: SCN10A; (+) strand; PAM type: NRG; PAM sequence: AAG
aattctaagcaaaaagaaga

SEQ ID NO: 38985 - DNA, 20 bp, Artificial Sequence
  Description of Artificial Sequence: Synthetic oligonucleotide
  Target: SCN10A; (+) strand; PAM type: NRG; PAM sequence: TGG
ctaagcaaaaagaagaaagt

SEQ ID NO: 38986 - DNA, 20 bp, Artificial Sequence
  Description of Artificial Sequence: Synthetic oligonucleotide
  Target: SCN10A; (+) strand; PAM type: NRG; PAM sequence: GAG
aagcaaaaagaagaaagttg

SEQ ID NO: 38987 - DNA, 20 bp, Artificial Sequence
  Description of Artificial Sequence: Synthetic oligonucleotide
  Target: SCN10A; (+) strand; PAM type: NRG; PAM sequence: AGG
agcaaaaagaagaaagttgg

SEQ ID NO: 38988 - DNA, 20 bp, Artificial Sequence
  Description of Artificial Sequence: Synthetic oligonucleotide
  Target: SCN10A; (+) strand; PAM type: NRG; PAM sequence: AAG
gcatcacgctacctgacttc

SEQ ID NO: 38989 - DNA, 20 bp, Artificial Sequence
  Description of Artificial Sequence: Synthetic oligonucleotide
  Target: SCN10A; (+) strand; PAM type: NRG; PAM sequence: AAG
tgacttcaagctatactaca

SEQ ID NO: 38990 - DNA, 20 bp, Artificial Sequence
  Description of Artificial Sequence: Synthetic oligonucleotide
  Target: SCN10A; (+) strand; PAM type: NRG; PAM sequence: CAG
caagctatactacaaagcta

SEQ ID NO: 38991 - DNA, 20 bp, Artificial Sequence
  Description of Artificial Sequence: Synthetic oligonucleotide
  Target: SCN10A; (+) strand; PAM type: NRG; PAM sequence: CAG
caaagctacagtaaccaaaa

SEQ ID NO: 38992 - DNA, 20 bp, Artificial Sequence
  Description of Artificial Sequence: Synthetic oligonucleotide
  Target: SCN10A; (+) strand; PAM type: NRG; PAM sequence: GAG
gctacagtaaccaaaacagc

SEQ ID NO: 38993 - DNA, 20 bp, Artificial Sequence
  Description of Artificial Sequence: Synthetic oligonucleotide
  Target: SCN10A; (+) strand; PAM type: NRG; PAM sequence: AGG
ctacagtaaccaaaacagcg

SEQ ID NO: 38994 - DNA, 20 bp, Artificial Sequence
  Description of Artificial Sequence: Synthetic oligonucleotide
  Target: SCN10A; (+) strand; PAM type: NRG; PAM sequence: TGG
taaccaaaacagcgaggtac

SEQ ID NO: 38995 - DNA, 20 bp, Artificial Sequence
  Description of Artificial Sequence: Synthetic oligonucleotide
  Target: SCN10A; (+) strand; PAM type: NRG; PAM sequence: CAG
gcgaggtactggtaccaaaa

SEQ ID NO: 38996 - DNA, 20 bp, Artificial Sequence
  Description of Artificial Sequence: Synthetic oligonucleotide
  Target: SCN10A; (+) strand; PAM type: NRG; PAM sequence: TAG
ctggtaccaaaacagatatc

SEQ ID NO: 38997 - DNA, 20 bp, Artificial Sequence
  Description of Artificial Sequence: Synthetic oligonucleotide
  Target: SCN10A; (+) strand; PAM type: NRG; PAM sequence: TGG
aaaacagatatctagaccaa

SEQ ID NO: 38998 - DNA, 20 bp, Artificial Sequence
  Description of Artificial Sequence: Synthetic oligonucleotide
  Target: SCN10A; (+) strand; PAM type: NRG; PAM sequence: CAG
agatatctagaccaatggaa

SEQ ID NO: 38999 - DNA, 20 bp, Artificial Sequence
  Description of Artificial Sequence: Synthetic oligonucleotide
  Target: SCN10A; (+) strand; PAM type: NRG; PAM sequence: CAG
tctagaccaatggaacagaa

SEQ ID NO: 39000 - DNA, 20 bp, Artificial Sequence
  Description of Artificial Sequence: Synthetic oligonucleotide
  Target: SCN10A; (+) strand; PAM type: NRG; PAM sequence: GAG
tagaccaatggaacagaaca

SEQ ID NO: 39001 - DNA, 20 bp, Artificial Sequence
  Description of Artificial Sequence: Synthetic oligonucleotide
  Target: SCN10A; (+) strand; PAM type: NRG; PAM sequence: AGG
agaccaatggaacagaacag

SEQ ID NO: 39002 - DNA, 20 bp, Artificial Sequence
  Description of Artificial Sequence: Synthetic oligonucleotide
  Target: SCN10A; (+) strand; PAM type: NRG; PAM sequence: CAG
atggaacagaacagaggcct

SEQ ID NO: 39003 - DNA, 20 bp, Artificial Sequence
  Description of Artificial Sequence: Synthetic oligonucleotide
  Target: SCN10A; (+) strand; PAM type: NRG; PAM sequence: AAG
gaacagaacagaggcctcag

SEQ ID NO: 39004 - DNA, 20 bp, Artificial Sequence
  Description of Artificial Sequence: Synthetic oligonucleotide
  Target: SCN10A; (+) strand; PAM type: NRG; PAM sequence: AAG
atctttgacaaacttgacaa

SEQ ID NO: 39005 - DNA, 20 bp, Artificial Sequence
  Description of Artificial Sequence: Synthetic oligonucleotide
  Target: SCN10A; (+) strand; PAM type: NRG; PAM sequence: AAG
ttgacaaacttgacaaaagc

SEQ ID NO: 39006 - DNA, 20 bp, Artificial Sequence
  Description of Artificial Sequence: Synthetic oligonucleotide
  Target: SCN10A; (+) strand; PAM type: NRG; PAM sequence: TGG
aacttgacaaaagcaagcaa

SEQ ID NO: 39007 - DNA, 20 bp, Artificial Sequence
  Description of Artificial Sequence: Synthetic oligonucleotide
  Target: SCN10A; (+) strand; PAM type: NRG; PAM sequence: GGG
acttgacaaaagcaagcaat

SEQ ID NO: 39008 - DNA, 20 bp, Artificial Sequence
  Description of Artificial Sequence: Synthetic oligonucleotide
  Target: SCN10A; (+) strand; PAM type: NRG; PAM sequence: GGG
cttgacaaaagcaagcaatg

SEQ ID NO: 39009 - DNA, 20 bp, Artificial Sequence
  Description of Artificial Sequence: Synthetic oligonucleotide
  Target: SCN10A; (+) strand; PAM type: NRG; PAM sequence: AAG
acaaaagcaagcaatgggga

SEQ ID NO: 39010 - DNA, 20 bp, Artificial Sequence
  Description of Artificial Sequence: Synthetic oligonucleotide
  Target: SCN10A; (+) strand; PAM type: NRG; PAM sequence: AGG
caaaagcaagcaatggggaa

SEQ ID NO: 39011 - DNA, 20 bp, Artificial Sequence
  Description of Artificial Sequence: Synthetic oligonucleotide
  Target: SCN10A; (+) strand; PAM type: NRG; PAM sequence: TGG
aggattccctatttaataaa

SEQ ID NO: 39012 - DNA, 20 bp, Artificial Sequence
  Description of Artificial Sequence: Synthetic oligonucleotide
  Target: SCN10A; (+) strand; PAM type: NRG; PAM sequence: TGG
tccctatttaataaatggtg

SEQ ID NO: 39013 - DNA, 20 bp, Artificial Sequence
  Description of Artificial Sequence: Synthetic oligonucleotide
  Target: SCN10A; (+) strand; PAM type: NRG; PAM sequence: GGG
ccctatttaataaatggtgt

SEQ ID NO: 39014 - DNA, 20 bp, Artificial Sequence
  Description of Artificial Sequence: Synthetic oligonucleotide
  Target: SCN10A; (+) strand; PAM type: NRG; PAM sequence: GGG
cctatttaataaatggtgtg

SEQ ID NO: 39015 - DNA, 20 bp, Artificial Sequence
  Description of Artificial Sequence: Synthetic oligonucleotide
  Target: SCN10A; (+) strand; PAM type: NRG; PAM sequence: TGG
ataaatggtgtggggaaaac

SEQ ID NO: 39016 - DNA, 20 bp, Artificial Sequence
  Description of Artificial Sequence: Synthetic oligonucleotide
  Target: SCN10A; (+) strand; PAM type: NRG; PAM sequence: TAG
atggtgtggggaaaactggc

SEQ ID NO: 39017 - DNA, 20 bp, Artificial Sequence
  Description of Artificial Sequence: Synthetic oligonucleotide
  Target: SCN10A; (+) strand; PAM type: NRG; PAM sequence: TAG
tggggaaaactggctagcct

SEQ ID NO: 39018 - DNA, 20 bp, Artificial Sequence
  Description of Artificial Sequence: Synthetic oligonucleotide
  Target: SCN10A; (+) strand; PAM type: NRG; PAM sequence: AGG
ggggaaaactggctagcctt

SEQ ID NO: 39019 - DNA, 20 bp, Artificial Sequence
  Description of Artificial Sequence: Synthetic oligonucleotide
  Target: SCN10A; (+) strand; PAM type: NRG; PAM sequence: CAG
gaaaactggctagccttagg

SEQ ID NO: 39020 - DNA, 20 bp, Artificial Sequence
  Description of Artificial Sequence: Synthetic oligonucleotide
  Target: SCN10A; (+) strand; PAM type: NRG; PAM sequence: TAG
cttaggcagaaaattgaaac

SEQ ID NO: 39021 - DNA, 20 bp, Artificial Sequence
  Description of Artificial Sequence: Synthetic oligonucleotide
  Target: SCN10A; (+) strand; PAM type: NRG; PAM sequence: AAG
ccttacacaaaaattaactc

SEQ ID NO: 39022 - DNA, 20 bp, Artificial Sequence
  Description of Artificial Sequence: Synthetic oligonucleotide
  Target: SCN10A; (+) strand; PAM type: NRG; PAM sequence: TAG
acacaaaaattaactcaaga

SEQ ID NO: 39023 - DNA, 20 bp, Artificial Sequence
  Description of Artificial Sequence: Synthetic oligonucleotide
  Target: SCN10A; (+) strand; PAM type: NRG; PAM sequence: AAG
aattaactcaagatagatta

SEQ ID NO: 39024 - DNA, 20 bp, Artificial Sequence
  Description of Artificial Sequence: Synthetic oligonucleotide
  Target: SCN10A; (+) strand; PAM type: NRG; PAM sequence: AAG
tagattaaagacttaaacat

SEQ ID NO: 39025 - DNA, 20 bp, Artificial Sequence
  Description of Artificial Sequence: Synthetic oligonucleotide
  Target: SCN10A; (+) strand; PAM type: NRG; PAM sequence: TAG
acctaaaaccataaaaaccc

SEQ ID NO: 39026 - DNA, 20 bp, Artificial Sequence
  Description of Artificial Sequence: Synthetic oligonucleotide
  Target: SCN10A; (+) strand; PAM type: NRG; PAM sequence: AAG
taaaaccataaaaaccctag

SEQ ID NO: 39027 - DNA, 20 bp, Artificial Sequence
  Description of Artificial Sequence: Synthetic oligonucleotide
  Target: SCN10A; (+) strand; PAM type: NRG; PAM sequence: TAG
aaaaaccctagaagaaaacc

SEQ ID NO: 39028 - DNA, 20 bp, Artificial Sequence
  Description of Artificial Sequence: Synthetic oligonucleotide
  Target: SCN10A; (+) strand; PAM type: NRG; PAM sequence: AGG
aaaaccctagaagaaaacct

SEQ ID NO: 39029 - DNA, 20 bp, Artificial Sequence
  Description of Artificial Sequence: Synthetic oligonucleotide
  Target: SCN10A; (+) strand; PAM type: NRG; PAM sequence: CAG
aaaacctaggcaataccctt

SEQ ID NO: 39030 - DNA, 20 bp, Artificial Sequence
  Description of Artificial Sequence: Synthetic oligonucleotide
  Target: SCN10A; (+) strand; PAM type: NRG; PAM sequence: AGG
aaacctaggcaatacccttc

SEQ ID NO: 39031 - DNA, 20 bp, Artificial Sequence
  Description of Artificial Sequence: Synthetic oligonucleotide
  Target: SCN10A; (+) strand; PAM type: NRG; PAM sequence: TAG
aggcaatacccttcaggaca

SEQ ID NO: 39032 - DNA, 20 bp, Artificial Sequence
  Description of Artificial Sequence: Synthetic oligonucleotide
  Target: SCN10A; (+) strand; PAM type: NRG; PAM sequence: AGG
ggcaatacccttcaggacat

SEQ ID NO: 39033 - DNA, 20 bp, Artificial Sequence
  Description of Artificial Sequence: Synthetic oligonucleotide
  Target: SCN10A; (+) strand; PAM type: NRG; PAM sequence: TGG
tacccttcaggacataggca

SEQ ID NO: 39034 - DNA, 20 bp, Artificial Sequence
  Description of Artificial Sequence: Synthetic oligonucleotide
  Target: SCN10A; (+) strand; PAM type: NRG; PAM sequence: GGG
acccttcaggacataggcat

SEQ ID NO: 39035 - DNA, 20 bp, Artificial Sequence
  Description of Artificial Sequence: Synthetic oligonucleotide
  Target: SCN10A; (+) strand; PAM type: NRG; PAM sequence: AAG
tcaggacataggcatgggca

SEQ ID NO: 39036 - DNA, 20 bp, Artificial Sequence
  Description of Artificial Sequence: Synthetic oligonucleotide
  Target: SCN10A; (+) strand; PAM type: NRG; PAM sequence: AGG
caggacataggcatgggcaa

SEQ ID NO: 39037 - DNA, 20 bp, Artificial Sequence
  Description of Artificial Sequence: Synthetic oligonucleotide
  Target: SCN10A; (+) strand; PAM type: NRG; PAM sequence: AAG
ctttatgactaacacatcaa

SEQ ID NO: 39038 - DNA, 20 bp, Artificial Sequence
  Description of Artificial Sequence: Synthetic oligonucleotide
  Target: SCN10A; (+) strand; PAM type: NRG; PAM sequence: TGG
gactaacacatcaaaagcaa

SEQ ID NO: 39039 - DNA, 20 bp, Artificial Sequence
  Description of Artificial Sequence: Synthetic oligonucleotide
  Target: SCN10A; (+) strand; PAM type: NRG; PAM sequence: AAG
atcaaaagcaatggtgacaa

SEQ ID NO: 39040 - DNA, 20 bp, Artificial Sequence
  Description of Artificial Sequence: Synthetic oligonucleotide
  Target: SCN10A; (+) strand; PAM type: NRG; PAM sequence: TGG
caaaagccaaaattgacaaa

SEQ ID NO: 39041 - DNA, 20 bp, Artificial Sequence
  Description of Artificial Sequence: Synthetic oligonucleotide
  Target: SCN10A; (+) strand; PAM type: NRG; PAM sequence: AAG
aatggaatccaattaaacta

SEQ ID NO: 39042 - DNA, 20 bp, Artificial Sequence
  Description of Artificial Sequence: Synthetic oligonucleotide
  Target: SCN10A; (+) strand; PAM type: NRG; PAM sequence: GAG
tggaatccaattaaactaaa

SEQ ID NO: 39043 - DNA, 20 bp, Artificial Sequence
  Description of Artificial Sequence: Synthetic oligonucleotide
  Target: SCN10A; (+) strand; PAM type: NRG; PAM sequence: CAG
taaactaaagagcttctgca

SEQ ID NO: 39044 - DNA, 20 bp, Artificial Sequence
  Description of Artificial Sequence: Synthetic oligonucleotide
  Target: SCN10A; (+) strand; PAM type: NRG; PAM sequence: AAG
aaagagcttctgcacagcaa

SEQ ID NO: 39045 - DNA, 20 bp, Artificial Sequence
  Description of Artificial Sequence: Synthetic oligonucleotide
  Target: SCN10A; (+) strand; PAM type: NRG; PAM sequence: CAG
acagcaaaagaaactatcat

SEQ ID NO: 39046 - DNA, 20 bp, Artificial Sequence
  Description of Artificial Sequence: Synthetic oligonucleotide
  Target: SCN10A; (+) strand; PAM type: NRG; PAM sequence: GAG
agcaaaagaaactatcatca

SEQ ID NO: 39047 - DNA, 20 bp, Artificial Sequence
  Description of Artificial Sequence: Synthetic oligonucleotide
  Target: SCN10A; (+) strand; PAM type: NRG; PAM sequence: TAG
gaaactatcatcagagtgaa

SEQ ID NO: 39048 - DNA, 20 bp, Artificial Sequence
  Description of Artificial Sequence: Synthetic oligonucleotide
  Target: SCN10A; (+) strand; PAM type: NRG; PAM sequence: AGG
aaactatcatcagagtgaat

SEQ ID NO: 39049 - DNA, 20 bp, Artificial Sequence
  Description of Artificial Sequence: Synthetic oligonucleotide
  Target: SCN10A; (+) strand; PAM type: NRG; PAM sequence: CAG
cagagtgaataggtaaccta

SEQ ID NO: 39050 - DNA, 20 bp, Artificial Sequence
  Description of Artificial Sequence: Synthetic oligonucleotide
  Target: SCN10A; (+) strand; PAM type: NRG; PAM sequence: TGG
tgaataggtaacctacagaa

SEQ ID NO: 39051 - DNA, 20 bp, Artificial Sequence
  Description of Artificial Sequence: Synthetic oligonucleotide
  Target: SCN10A; (+) strand; PAM type: NRG; PAM sequence: GGG
gaataggtaacctacagaat

SEQ ID NO: 39052 - DNA, 20 bp, Artificial Sequence
  Description of Artificial Sequence: Synthetic oligonucleotide
  Target: SCN10A; (+) strand; PAM type: NRG; PAM sequence: GAG
ataggtaacctacagaatgg

SEQ ID NO: 39053 - DNA, 20 bp, Artificial Sequence
  Description of Artificial Sequence: Synthetic oligonucleotide
  Target: SCN10A; (+) strand; PAM type: NRG; PAM sequence: AAG
tgcaatctatcaatctgaca

SEQ ID NO: 39054 - DNA, 20 bp, Artificial Sequence
  Description of Artificial Sequence: Synthetic oligonucleotide
  Target: SCN10A; (+) strand; PAM type: NRG; PAM sequence: AGG
gcaatctatcaatctgacaa

SEQ ID NO: 39055 - DNA, 20 bp, Artificial Sequence
  Description of Artificial Sequence: Synthetic oligonucleotide
  Target: SCN10A; (+) strand; PAM type: NRG; PAM sequence: GGG
caatctatcaatctgacaaa

SEQ ID NO: 39056 - DNA, 20 bp, Artificial Sequence
  Description of Artificial Sequence: Synthetic oligonucleotide
  Target: SCN10A; (+) strand; PAM type: NRG; PAM sequence: CAG
tctgacaaagggctaatatc

SEQ ID NO: 39057 - DNA, 20 bp, Artificial Sequence
  Description of Artificial Sequence: Synthetic oligonucleotide
  Target: SCN10A; (+) strand; PAM type: NRG; PAM sequence: AAG
aaaaacttaaacaaatttac

SEQ ID NO: 39058 - DNA, 20 bp, Artificial Sequence
  Description of Artificial Sequence: Synthetic oligonucleotide
  Target: SCN10A; (+) strand; PAM type: NRG; PAM sequence: AAG
gaaaaaacaactccatcaaa

SEQ ID NO: 39059 - DNA, 20 bp, Artificial Sequence
  Description of Artificial Sequence: Synthetic oligonucleotide
  Target: SCN10A; (+) strand; PAM type: NRG; PAM sequence: TGG
aaaacaactccatcaaaaag

SEQ ID NO: 39060 - DNA, 20 bp, Artificial Sequence
  Description of Artificial Sequence: Synthetic oligonucleotide
  Target: SCN10A; (+) strand; PAM type: NRG; PAM sequence: GGG
aaacaactccatcaaaaagt

SEQ ID NO: 39061 - DNA, 20 bp, Artificial Sequence
  Description of Artificial Sequence: Synthetic oligonucleotide
  Target: SCN10A; (+) strand; PAM type: NRG; PAM sequence: AAG
actccatcaaaaagtgggca

SEQ ID NO: 39062 - DNA, 20 bp, Artificial Sequence
  Description of Artificial Sequence: Synthetic oligonucleotide
  Target: SCN10A; (+) strand; PAM type: NRG; PAM sequence: AGG
ctccatcaaaaagtgggcaa

SEQ ID NO: 39063 - DNA, 20 bp, Artificial Sequence
  Description of Artificial Sequence: Synthetic oligonucleotide
  Target: SCN10A; (+) strand; PAM type: NRG; PAM sequence: CAG
aagtgggcaaaggatatgaa

SEQ ID NO: 39064 - DNA, 20 bp, Artificial Sequence
  Description of Artificial Sequence: Synthetic oligonucleotide
  Target: SCN10A; (+) strand; PAM type: NRG; PAM sequence: AAG
tatgaacagacacttctcaa

SEQ ID NO: 39065 - DNA, 20 bp, Artificial Sequence
  Description of Artificial Sequence: Synthetic oligonucleotide
  Target: SCN10A; (+) strand; PAM type: NRG; PAM sequence: AAG
gaacagacacttctcaaaag

SEQ ID NO: 39066 - DNA, 20 bp, Artificial Sequence
  Description of Artificial Sequence: Synthetic oligonucleotide
  Target: SCN10A; (+) strand; PAM type: NRG; PAM sequence: CAG
ctcaaaagaagacatttatg

SEQ ID NO: 39067 - DNA, 20 bp, Artificial Sequence
  Description of Artificial Sequence: Synthetic oligonucleotide
  Target: SCN10A; (+) strand; PAM type: NRG; PAM sequence: AAG
gccaataaacatatgataaa

SEQ ID NO: 39068 - DNA, 20 bp, Artificial Sequence
  Description of Artificial Sequence: Synthetic oligonucleotide
  Target: SCN10A; (+) strand; PAM type: NRG; PAM sequence: TGG
gataaaaagctcatcatcac

SEQ ID NO: 39069 - DNA, 20 bp, Artificial Sequence
  Description of Artificial Sequence: Synthetic oligonucleotide
  Target: SCN10A; (+) strand; PAM type: NRG; PAM sequence: TAG
agctcatcatcactggtcat

SEQ ID NO: 39070 - DNA, 20 bp, Artificial Sequence
  Description of Artificial Sequence: Synthetic oligonucleotide
  Target: SCN10A; (+) strand; PAM type: NRG; PAM sequence: GAG
ctcatcatcactggtcatta

SEQ ID NO: 39071 - DNA, 20 bp, Artificial Sequence
  Description of Artificial Sequence: Synthetic oligonucleotide
  Target: SCN10A; (+) strand; PAM type: NRG; PAM sequence: CAG
actggtcattagagaaatgc

SEQ ID NO: 39072 - DNA, 20 bp, Artificial Sequence
  Description of Artificial Sequence: Synthetic oligonucleotide
  Target: SCN10A; (+) strand; PAM type: NRG; PAM sequence: GAG
atgccagtcaaaaccacaat

SEQ ID NO: 39073 - DNA, 20 bp, Artificial Sequence
  Description of Artificial Sequence: Synthetic oligonucleotide
  Target: SCN10A; (+) strand; PAM type: NRG; PAM sequence: TGG
cagtcaaaaccacaatgaga

SEQ ID NO: 39074 - DNA, 20 bp, Artificial Sequence
  Description of Artificial Sequence: Synthetic oligonucleotide
  Target: SCN10A; (+) strand; PAM type: NRG; PAM sequence: GAG
gtcaaaaccacaatgagatg

SEQ ID NO: 39075 - DNA, 20 bp, Artificial Sequence
  Description of Artificial Sequence: Synthetic oligonucleotide
  Target: SCN10A; (+) strand; PAM type: NRG; PAM sequence: CAG
aatgagatggagtctcatac

SEQ ID NO: 39076 - DNA, 20 bp, Artificial Sequence
  Description of Artificial Sequence: Synthetic oligonucleotide
  Target: SCN10A; (+) strand; PAM type: NRG; PAM sequence: TAG
agatggagtctcataccagt

SEQ ID NO: 39077 - DNA, 20 bp, Artificial Sequence
  Description of Artificial Sequence: Synthetic oligonucleotide
  Target: SCN10A; (+) strand; PAM type: NRG; PAM sequence: TGG
gagtctcataccagttagaa

SEQ ID NO: 39078 - DNA, 20 bp, Artificial Sequence
  Description of Artificial Sequence: Synthetic oligonucleotide
  Target: SCN10A; (+) strand; PAM type: NRG; PAM sequence: GAG
gtctcataccagttagaatg

SEQ ID NO: 39079 - DNA, 20 bp, Artificial Sequence
  Description of Artificial Sequence: Synthetic oligonucleotide
  Target: SCN10A; (+) strand; PAM type: NRG; PAM sequence: AAG
ttagaatggagatcattaaa

SEQ ID NO: 39080 - DNA, 20 bp, Artificial Sequence
  Description of Artificial Sequence: Synthetic oligonucleotide
  Target: SCN10A; (+) strand; PAM type: NRG; PAM sequence: CAG
aatggagatcattaaaaagt

SEQ ID NO: 39081 - DNA, 20 bp, Artificial Sequence
  Description of Artificial Sequence: Synthetic oligonucleotide
  Target: SCN10A; (+) strand; PAM type: NRG; PAM sequence: AGG
atggagatcattaaaaagtc

SEQ ID NO: 39082 - DNA, 20 bp, Artificial Sequence
  Description of Artificial Sequence: Synthetic oligonucleotide
  Target: SCN10A; (+) strand; PAM type: NRG; PAM sequence: CAG
attaaaaagtcaggaaacaa

SEQ ID NO: 39083 - DNA, 20 bp, Artificial Sequence
  Description of Artificial Sequence: Synthetic oligonucleotide
  Target: SCN10A; (+) strand; PAM type: NRG; PAM sequence: TGG
agtcaggaaacaacagatgc

SEQ ID NO: 39084 - DNA, 20 bp, Artificial Sequence
  Description of Artificial Sequence: Synthetic oligonucleotide
  Target: SCN10A; (+) strand; PAM type: NRG; PAM sequence: GAG
tcaggaaacaacagatgctg

SEQ ID NO: 39085 - DNA, 20 bp, Artificial Sequence
  Description of Artificial Sequence: Synthetic oligonucleotide
  Target: SCN10A; (+) strand; PAM type: NRG; PAM sequence: GAG
aggaaacaacagatgctgga

SEQ ID NO: 39086 - DNA, 20 bp, Artificial Sequence
  Description of Artificial Sequence: Synthetic oligonucleotide
  Target: SCN10A; (+) strand; PAM type: NRG; PAM sequence: AGG
ggaaacaacagatgctggag

SEQ ID NO: 39087 - DNA, 20 bp, Artificial Sequence
  Description of Artificial Sequence: Synthetic oligonucleotide
  Target: SCN10A; (+) strand; PAM type: NRG; PAM sequence: TGG
aacagatgctggagaggatg

SEQ ID NO: 39088 - DNA, 20 bp, Artificial Sequence
  Description of Artificial Sequence: Synthetic oligonucleotide
  Target: SCN10A; (+) strand; PAM type: NRG; PAM sequence: GAG
cagatgctggagaggatgtg

SEQ ID NO: 39089 - DNA, 20 bp, Artificial Sequence
  Description of Artificial Sequence: Synthetic oligonucleotide
  Target: SCN10A; (+) strand; PAM type: NRG; PAM sequence: GAG
gatgctggagaggatgtgga

SEQ ID NO: 39090 - DNA, 20 bp, Artificial Sequence
  Description of Artificial Sequence: Synthetic oligonucleotide
  Target: SCN10A; (+) strand; PAM type: NRG; PAM sequence: TAG
ctggagaggatgtggagaga

SEQ ID NO: 39091 - DNA, 20 bp, Artificial Sequence
  Description of Artificial Sequence: Synthetic oligonucleotide
  Target: SCN10A; (+) strand; PAM type: NRG; PAM sequence: AGG
tggagaggatgtggagagat

SEQ ID NO: 39092 - DNA, 20 bp, Artificial Sequence
  Description of Artificial Sequence: Synthetic oligonucleotide
  Target: SCN10A; (+) strand; PAM type: NRG; PAM sequence: TGG
taggaatgcttttacactgt

SEQ ID NO: 39093 - DNA, 20 bp, Artificial Sequence
  Description of Artificial Sequence: Synthetic oligonucleotide
  Target: SCN10A; (+) strand; PAM type: NRG; PAM sequence: TGG
gaatgcttttacactgttgg

SEQ ID NO: 39094 - DNA, 20 bp, Artificial Sequence
  Description of Artificial Sequence: Synthetic oligonucleotide
  Target: SCN10A; (+) strand; PAM type: NRG; PAM sequence: GGG
aatgcttttacactgttggt

SEQ ID NO: 39095 - DNA, 20 bp, Artificial Sequence
  Description of Artificial Sequence: Synthetic oligonucleotide
  Target: SCN10A; (+) strand; PAM type: NRG; PAM sequence: GAG
tgcttttacactgttggtgg

SEQ ID NO: 39096 - DNA, 20 bp, Artificial Sequence
  Description of Artificial Sequence: Synthetic oligonucleotide
  Target: SCN10A; (+) strand; PAM type: NRG; PAM sequence: TAG
ctgttggtgggagtgtaaat

SEQ ID NO: 39097 - DNA, 20 bp, Artificial Sequence
  Description of Artificial Sequence: Synthetic oligonucleotide
  Target: SCN10A; (+) strand; PAM type: NRG; PAM sequence: TGG
gtaaattagttcaaccattg

SEQ ID NO: 39098 - DNA, 20 bp, Artificial Sequence
  Description of Artificial Sequence: Synthetic oligonucleotide
  Target: SCN10A; (+) strand; PAM type: NRG; PAM sequence: AAG
aattagttcaaccattgtgg

SEQ ID NO: 39099 - DNA, 20 bp, Artificial Sequence
  Description of Artificial Sequence: Synthetic oligonucleotide
  Target: SCN10A; (+) strand; PAM type: NRG; PAM sequence: CAG
agttcaaccattgtggaaga

SEQ ID NO: 39100 - DNA, 20 bp, Artificial Sequence
  Description of Artificial Sequence: Synthetic oligonucleotide
  Target: SCN10A; (+) strand; PAM type: NRG; PAM sequence: TGG
aaccattgtggaagacagtg

SEQ ID NO: 39101 - DNA, 20 bp, Artificial Sequence
  Description of Artificial Sequence: Synthetic oligonucleotide
  Target: SCN10A; (+) strand; PAM type: NRG; PAM sequence: AAG
agacagtgtggtgattcctc

SEQ ID NO: 39102 - DNA, 20 bp, Artificial Sequence
  Description of Artificial Sequence: Synthetic oligonucleotide
  Target: SCN10A; (+) strand; PAM type: NRG; PAM sequence: AGG
gacagtgtggtgattcctca

SEQ ID NO: 39103 - DNA, 20 bp, Artificial Sequence
  Description of Artificial Sequence: Synthetic oligonucleotide
  Target: SCN10A; (+) strand; PAM type: NRG; PAM sequence: TAG
gtggtgattcctcaaggatc

SEQ ID NO: 39104 - DNA, 20 bp, Artificial Sequence
  Description of Artificial Sequence: Synthetic oligonucleotide
  Target: SCN10A; (+) strand; PAM type: NRG; PAM sequence: CAG
attcctcaaggatctagaac

SEQ ID NO: 39105 - DNA, 20 bp, Artificial Sequence
  Description of Artificial Sequence: Synthetic oligonucleotide
  Target: SCN10A; (+) strand; PAM type: NRG; PAM sequence: CAG
accagaaacaccatttgacc

SEQ ID NO: 39106 - DNA, 20 bp, Artificial Sequence
  Description of Artificial Sequence: Synthetic oligonucleotide
  Target: SCN10A; (+) strand; PAM type: NRG; PAM sequence: TGG
tgacccagcaattccattac

SEQ ID NO: 39107 - DNA, 20 bp, Artificial Sequence
  Description of Artificial Sequence: Synthetic oligonucleotide
  Target: SCN10A; (+) strand; PAM type: NRG; PAM sequence: GGG
gacccagcaattccattact

SEQ ID NO: 39108 - DNA, 20 bp, Artificial Sequence
  Description of Artificial Sequence: Synthetic oligonucleotide
  Target: SCN10A; (+) strand; PAM type: NRG; PAM sequence: AAG
cattactgggtatataccca

SEQ ID NO: 39109 - DNA, 20 bp, Artificial Sequence
  Description of Artificial Sequence: Synthetic oligonucleotide
  Target: SCN10A; (+) strand; PAM type: NRG; PAM sequence: AGG
attactgggtatatacccaa

SEQ ID NO: 39110 - DNA, 20 bp, Artificial Sequence
  Description of Artificial Sequence: Synthetic oligonucleotide
  Target: SCN10A; (+) strand; PAM type: NRG; PAM sequence: AAG
ttataaattattctactata

SEQ ID NO: 39111 - DNA, 20 bp, Artificial Sequence
  Description of Artificial Sequence: Synthetic oligonucleotide
  Target: SCN10A; (+) strand; PAM type: NRG; PAM sequence: AAG
ttattctactataaagatac

SEQ ID NO: 39112 - DNA, 20 bp, Artificial Sequence
  Description of Artificial Sequence: Synthetic oligonucleotide
  Target: SCN10A; (+) strand; PAM type: NRG; PAM sequence: TGG
aagcatgcgtatgtttattg

SEQ ID NO: 39113 - DNA, 20 bp, Artificial Sequence
  Description of Artificial Sequence: Synthetic oligonucleotide
  Target: SCN10A; (+) strand; PAM type: NRG; PAM sequence: TAG
tattgtggcactattgacaa

SEQ ID NO: 39114 - DNA, 20 bp, Artificial Sequence
  Description of Artificial Sequence: Synthetic oligonucleotide
  Target: SCN10A; (+) strand; PAM type: NRG; PAM sequence: AAG
tggcactattgacaatagca

SEQ ID NO: 39115 - DNA, 20 bp, Artificial Sequence
  Description of Artificial Sequence: Synthetic oligonucleotide
  Target: SCN10A; (+) strand; PAM type: NRG; PAM sequence: TGG
tattgacaatagcaaagact

SEQ ID NO: 39116 - DNA, 20 bp, Artificial Sequence
  Description of Artificial Sequence: Synthetic oligonucleotide
  Target: SCN10A; (+) strand; PAM type: NRG; PAM sequence: CAG
gaactaacccaaacgcccat

SEQ ID NO: 39117 - DNA, 20 bp, Artificial Sequence
  Description of Artificial Sequence: Synthetic oligonucleotide
  Target: SCN10A; (+) strand; PAM type: NRG; PAM sequence: TAG
acccaaacgcccatcagtga

SEQ ID NO: 39118 - DNA, 20 bp, Artificial Sequence
  Description of Artificial Sequence: Synthetic oligonucleotide
  Target: SCN10A; (+) strand; PAM type: NRG; PAM sequence: TGG
aacgcccatcagtgatagac

SEQ ID NO: 39119 - DNA, 20 bp, Artificial Sequence
  Description of Artificial Sequence: Synthetic oligonucleotide
  Target: SCN10A; (+) strand; PAM type: NRG; PAM sequence: AAG
catcagtgatagactggata

SEQ ID NO: 39120 - DNA, 20 bp, Artificial Sequence
  Description of Artificial Sequence: Synthetic oligonucleotide
  Target: SCN10A; (+) strand; PAM type: NRG; PAM sequence: TGG
tagactggataaagaaaata

SEQ ID NO: 39121 - DNA, 20 bp, Artificial Sequence
  Description of Artificial Sequence: Synthetic oligonucleotide
  Target: SCN10A; (+) strand; PAM type: NRG; PAM sequence: TGG
aatatggcacatatacacca

SEQ ID NO: 39122 - DNA, 20 bp, Artificial Sequence
  Description of Artificial Sequence: Synthetic oligonucleotide
  Target: SCN10A; (+) strand; PAM type: NRG; PAM sequence: CAG
atacaccatggaatactatg

SEQ ID NO: 39123 - DNA, 20 bp, Artificial Sequence
  Description of Artificial Sequence: Synthetic oligonucleotide
  Target: SCN10A; (+) strand; PAM type: NRG; PAM sequence: AAG
aatactatgcagccataaaa

SEQ ID NO: 39124 - DNA, 20 bp, Artificial Sequence
  Description of Artificial Sequence: Synthetic oligonucleotide
  Target: SCN10A; (+) strand; PAM type: NRG; PAM sequence: AGG
atactatgcagccataaaaa

SEQ ID NO: 39125 - DNA, 20 bp, Artificial Sequence
  Description of Artificial Sequence: Synthetic oligonucleotide
  Target: SCN10A; (+) strand; PAM type: NRG; PAM sequence: GGG
tactatgcagccataaaaaa

SEQ ID NO: 39126 - DNA, 20 bp, Artificial Sequence
  Description of Artificial Sequence: Synthetic oligonucleotide
  Target: SCN10A; (+) strand; PAM type: NRG; PAM sequence: GAG
atgcagccataaaaaagggt

SEQ ID NO: 39127 - DNA, 20 bp, Artificial Sequence
  Description of Artificial Sequence: Synthetic oligonucleotide
  Target: SCN10A; (+) strand; PAM type: NRG; PAM sequence: CAG
gggtgagttcatgttctttg

SEQ ID NO: 39128 - DNA, 20 bp, Artificial Sequence
  Description of Artificial Sequence: Synthetic oligonucleotide
  Target: SCN10A; (+) strand; PAM type: NRG; PAM sequence: AGG
ggtgagttcatgttctttgc

SEQ ID NO: 39129 - DNA, 20 bp, Artificial Sequence
  Description of Artificial Sequence: Synthetic oligonucleotide
  Target: SCN10A; (+) strand; PAM type: NRG; PAM sequence: GGG
gtgagttcatgttctttgca

SEQ ID NO: 39130 - DNA, 20 bp, Artificial Sequence
  Description of Artificial Sequence: Synthetic oligonucleotide
  Target: SCN10A; (+) strand; PAM type: NRG; PAM sequence: TGG
tcatgttctttgcagggaca

SEQ ID NO: 39131 - DNA, 20 bp, Artificial Sequence
  Description of Artificial Sequence: Synthetic oligonucleotide
  Target: SCN10A; (+) strand; PAM type: NRG; PAM sequence: AAG
tctttgcagggacatggatg

SEQ ID NO: 39132 - DNA, 20 bp, Artificial Sequence
  Description of Artificial Sequence: Synthetic oligonucleotide
  Target: SCN10A; (+) strand; PAM type: NRG; PAM sequence: TGG
tgcagggacatggatgaagc

SEQ ID NO: 39133 - DNA, 20 bp, Artificial Sequence
  Description of Artificial Sequence: Synthetic oligonucleotide
  Target: SCN10A; (+) strand; PAM type: NRG; PAM sequence: CAG
aagctggaaaccatcattct

SEQ ID NO: 39134 - DNA, 20 bp, Artificial Sequence
  Description of Artificial Sequence: Synthetic oligonucleotide
  Target: SCN10A; (+) strand; PAM type: NRG; PAM sequence: AAG
cattctcagcaaactgacat

SEQ ID NO: 39135 - DNA, 20 bp, Artificial Sequence
  Description of Artificial Sequence: Synthetic oligonucleotide
  Target: SCN10A; (+) strand; PAM type: NRG; PAM sequence: CAG
tcagcaaactgacataagaa

SEQ ID NO: 39136 - DNA, 20 bp, Artificial Sequence
  Description of Artificial Sequence: Synthetic oligonucleotide
  Target: SCN10A; (+) strand; PAM type: NRG; PAM sequence: TAG
acaccgcatgttctcactca

SEQ ID NO: 39137 - DNA, 20 bp, Artificial Sequence
  Description of Artificial Sequence: Synthetic oligonucleotide
  Target: SCN10A; (+) strand; PAM type: NRG; PAM sequence: AGG
caccgcatgttctcactcat

SEQ ID NO: 39138 - DNA, 20 bp, Artificial Sequence
  Description of Artificial Sequence: Synthetic oligonucleotide
  Target: SCN10A; (+) strand; PAM type: NRG; PAM sequence: TGG
cgcatgttctcactcatagg

SEQ ID NO: 39139 - DNA, 20 bp, Artificial Sequence
  Description of Artificial Sequence: Synthetic oligonucleotide
  Target: SCN10A; (+) strand; PAM type: NRG; PAM sequence: GGG
gcatgttctcactcataggt

SEQ ID NO: 39140 - DNA, 20 bp, Artificial Sequence
  Description of Artificial Sequence: Synthetic oligonucleotide
  Target: SCN10A; (+) strand; PAM type: NRG; PAM sequence: GAG
atgttctcactcataggtgg

SEQ ID NO: 39141 - DNA, 20 bp, Artificial Sequence
  Description of Artificial Sequence: Synthetic oligonucleotide
  Target: SCN10A; (+) strand; PAM type: NRG; PAM sequence: GAG
ataggtgggagatgaacaat

SEQ ID NO: 39142 - DNA, 20 bp, Artificial Sequence
  Description of Artificial Sequence: Synthetic oligonucleotide
  Target: SCN10A; (+) strand; PAM type: NRG; PAM sequence: GAG
aggtgggagatgaacaatga

SEQ ID NO: 39143 - DNA, 20 bp, Artificial Sequence
  Description of Artificial Sequence: Synthetic oligonucleotide
  Target: SCN10A; (+) strand; PAM type: NRG; PAM sequence: TGG
agatgaacaatgagagcacg

SEQ ID NO: 39144 - DNA, 20 bp, Artificial Sequence
  Description of Artificial Sequence: Synthetic oligonucleotide
  Target: SCN10A; (+) strand; PAM type: NRG; PAM sequence: CAG
acaatgagagcacgtggata

SEQ ID NO: 39145 - DNA, 20 bp, Artificial Sequence
  Description of Artificial Sequence: Synthetic oligonucleotide
  Target: SCN10A; (+) strand; PAM type: NRG; PAM sequence: AGG
caatgagagcacgtggatac

SEQ ID NO: 39146 - DNA, 20 bp, Artificial Sequence
  Description of Artificial Sequence: Synthetic oligonucleotide
  Target: SCN10A; (+) strand; PAM type: NRG; PAM sequence: GGG
aatgagagcacgtggataca

SEQ ID NO: 39147 - DNA, 20 bp, Artificial Sequence
  Description of Artificial Sequence: Synthetic oligonucleotide
  Target: SCN10A; (+) strand; PAM type: NRG; PAM sequence: GAG
tgagagcacgtggatacagg

SEQ ID NO: 39148 - DNA, 20 bp, Artificial Sequence
  Description of Artificial Sequence: Synthetic oligonucleotide
  Target: SCN10A; (+) strand; PAM type: NRG; PAM sequence: AGG
gagagcacgtggatacaggg

SEQ ID NO: 39149 - DNA, 20 bp, Artificial Sequence
  Description of Artificial Sequence: Synthetic oligonucleotide
  Target: SCN10A; (+) strand; PAM type: NRG; PAM sequence: GGG
agagcacgtggatacaggga

SEQ ID NO: 39150 - DNA, 20 bp, Artificial Sequence
  Description of Artificial Sequence: Synthetic oligonucleotide
  Target: SCN10A; (+) strand; PAM type: NRG; PAM sequence: GGG
gagcacgtggatacagggag

SEQ ID NO: 39151 - DNA, 20 bp, Artificial Sequence
  Description of Artificial Sequence: Synthetic oligonucleotide
  Target: SCN10A; (+) strand; PAM type: NRG; PAM sequence: GGG
agcacgtggatacagggagg

SEQ ID NO: 39152 - DNA, 20 bp, Artificial Sequence
  Description of Artificial Sequence: Synthetic oligonucleotide
  Target: SCN10A; (+) strand; PAM type: NRG; PAM sequence: CAG
gggagggggacatcacacac

SEQ ID NO: 39153 - DNA, 20 bp, Artificial Sequence
  Description of Artificial Sequence: Synthetic oligonucleotide
  Target: SCN10A; (+) strand; PAM type: NRG; PAM sequence: AGG
ggagggggacatcacacacc

SEQ ID NO: 39154 - DNA, 20 bp, Artificial Sequence
  Description of Artificial Sequence: Synthetic oligonucleotide
  Target: SCN10A; (+) strand; PAM type: NRG; PAM sequence: GGG
gagggggacatcacacacca

SEQ ID NO: 39155 - DNA, 20 bp, Artificial Sequence
  Description of Artificial Sequence: Synthetic oligonucleotide
  Target: SCN10A; (+) strand; PAM type: NRG; PAM sequence: GAG
atcacacaccagggcctgtt

SEQ ID NO: 39156 - DNA, 20 bp, Artificial Sequence
  Description of Artificial Sequence: Synthetic oligonucleotide
  Target: SCN10A; (+) strand; PAM type: NRG; PAM sequence: AGG
tcacacaccagggcctgttg

SEQ ID NO: 39157 - DNA, 20 bp, Artificial Sequence
  Description of Artificial Sequence: Synthetic oligonucleotide
  Target: SCN10A; (+) strand; PAM type: NRG; PAM sequence: GGG
cacacaccagggcctgttga

SEQ ID NO: 39158 - DNA, 20 bp, Artificial Sequence
  Description of Artificial Sequence: Synthetic oligonucleotide
  Target: SCN10A; (+) strand; PAM type: NRG; PAM sequence: GGG
acacaccagggcctgttgag

SEQ ID NO: 39159 - DNA, 20 bp, Artificial Sequence
  Description of Artificial Sequence: Synthetic oligonucleotide
  Target: SCN10A; (+) strand; PAM type: NRG; PAM sequence: TGG
accagggcctgttgaggggt

SEQ ID NO: 39160 - DNA, 20 bp, Artificial Sequence
  Description of Artificial Sequence: Synthetic oligonucleotide
  Target: SCN10A; (+) strand; PAM type: NRG; PAM sequence: GGG
ccagggcctgttgaggggtt

SEQ ID NO: 39161 - DNA, 20 bp, Artificial Sequence
  Description of Artificial Sequence: Synthetic oligonucleotide
  Target: SCN10A; (+) strand; PAM type: NRG; PAM sequence: GGG
cagggcctgttgaggggttg

SEQ ID NO: 39162 - DNA, 20 bp, Artificial Sequence
  Description of Artificial Sequence: Synthetic oligonucleotide
  Target: SCN10A; (+) strand; PAM type: NRG; PAM sequence: GGG
agggcctgttgaggggttgg

SEQ ID NO: 39163 - DNA, 20 bp, Artificial Sequence
  Description of Artificial Sequence: Synthetic oligonucleotide
  Target: SCN10A; (+) strand; PAM type: NRG; PAM sequence: TAG
cctgttgaggggttgggggc

SEQ ID NO: 39164 - DNA, 20 bp, Artificial Sequence
  Description of Artificial Sequence: Synthetic oligonucleotide
  Target: SCN10A; (+) strand; PAM type: NRG; PAM sequence: AGG
ctgttgaggggttgggggct

SEQ ID NO: 39165 - DNA, 20 bp, Artificial Sequence
  Description of Artificial Sequence: Synthetic oligonucleotide
  Target: SCN10A; (+) strand; PAM type: NRG; PAM sequence: GGG
tgttgaggggttgggggcta

SEQ ID NO: 39166 - DNA, 20 bp, Artificial Sequence
  Description of Artificial Sequence: Synthetic oligonucleotide
  Target: SCN10A; (+) strand; PAM type: NRG; PAM sequence: GGG
gttgaggggttgggggctag

SEQ ID NO: 39167 - DNA, 20 bp, Artificial Sequence
  Description of Artificial Sequence: Synthetic oligonucleotide
  Target: SCN10A; (+) strand; PAM type: NRG; PAM sequence: GAG
tgaggggttgggggctaggg

SEQ ID NO: 39168 - DNA, 20 bp, Artificial Sequence
  Description of Artificial Sequence: Synthetic oligonucleotide
  Target: SCN10A; (+) strand; PAM type: NRG; PAM sequence: AGG
gaggggttgggggctagggg

SEQ ID NO: 39169 - DNA, 20 bp, Artificial Sequence
  Description of Artificial Sequence: Synthetic oligonucleotide
  Target: SCN10A; (+) strand; PAM type: NRG; PAM sequence: GGG
aggggttgggggctagggga

SEQ ID NO: 39170 - DNA, 20 bp, Artificial Sequence
  Description of Artificial Sequence: Synthetic oligonucleotide
  Target: SCN10A; (+) strand; PAM type: NRG; PAM sequence: TAG
gttgggggctaggggaggga

SEQ ID NO: 39171 - DNA, 20 bp, Artificial Sequence
  Description of Artificial Sequence: Synthetic oligonucleotide
  Target: SCN10A; (+) strand; PAM type: NRG; PAM sequence: TAG
ggctaggggagggatagcat

SEQ ID NO: 39172 - DNA, 20 bp, Artificial Sequence
  Description of Artificial Sequence: Synthetic oligonucleotide
  Target: SCN10A; (+) strand; PAM type: NRG; PAM sequence: AGG
gctaggggagggatagcatt

SEQ ID NO: 39173 - DNA, 20 bp, Artificial Sequence
  Description of Artificial Sequence: Synthetic oligonucleotide
  Target: SCN10A; (+) strand; PAM type: NRG; PAM sequence: GAG
taggggagggatagcattag

SEQ ID NO: 39174 - DNA, 20 bp, Artificial Sequence
  Description of Artificial Sequence: Synthetic oligonucleotide
  Target: SCN10A; (+) strand; PAM type: NRG; PAM sequence: TAG
attaggagaaatacctaatg

SEQ ID NO: 39175 - DNA, 20 bp, Artificial Sequence
  Description of Artificial Sequence: Synthetic oligonucleotide
  Target: SCN10A; (+) strand; PAM type: NRG; PAM sequence: TGG
gaaatacctaatgtagatga

SEQ ID NO: 39176 - DNA, 20 bp, Artificial Sequence
  Description of Artificial Sequence: Synthetic oligonucleotide
  Target: SCN10A; (+) strand; PAM type: NRG; PAM sequence: GGG
aaatacctaatgtagatgat

SEQ ID NO: 39177 - DNA, 20 bp, Artificial Sequence
  Description of Artificial Sequence: Synthetic oligonucleotide
  Target: SCN10A; (+) strand; PAM type: NRG; PAM sequence: TGG
taatgtagatgatgggttga

SEQ ID NO: 39178 - DNA, 20 bp, Artificial Sequence
  Description of Artificial Sequence: Synthetic oligonucleotide
  Target: SCN10A; (+) strand; PAM type: NRG; PAM sequence: GGG
aatgtagatgatgggttgat

SEQ ID NO: 39179 - DNA, 20 bp, Artificial Sequence
  Description of Artificial Sequence: Synthetic oligonucleotide
  Target: SCN10A; (+) strand; PAM type: NRG; PAM sequence: CAG
agatgatgggttgatgggtg

SEQ ID NO: 39180 - DNA, 20 bp, Artificial Sequence
  Description of Artificial Sequence: Synthetic oligonucleotide
  Target: SCN10A; (+) strand; PAM type: NRG; PAM sequence: CAG
cactttctgcacatgtaccc

SEQ ID NO: 39181 - DNA, 20 bp, Artificial Sequence
  Description of Artificial Sequence: Synthetic oligonucleotide
  Target: SCN10A; (+) strand; PAM type: NRG; PAM sequence: AAG
cacatgtaccccagaactta

SEQ ID NO: 39182 - DNA, 20 bp, Artificial Sequence
  Description of Artificial Sequence: Synthetic oligonucleotide
  Target: SCN10A; (+) strand; PAM type: NRG; PAM sequence: AAG
acttaaagtaaaatttaaaa

SEQ ID NO: 39183 - DNA, 20 bp, Artificial Sequence
  Description of Artificial Sequence: Synthetic oligonucleotide
  Target: SCN10A; (+) strand; PAM type: NRG; PAM sequence: AGG
cttaaagtaaaatttaaaaa

SEQ ID NO: 39184 - DNA, 20 bp, Artificial Sequence
  Description of Artificial Sequence: Synthetic oligonucleotide
  Target: SCN10A; (+) strand; PAM type: NRG; PAM sequence: GGG
ttaaagtaaaatttaaaaaa

SEQ ID NO: 39185 - DNA, 20 bp, Artificial Sequence
  Description of Artificial Sequence: Synthetic oligonucleotide
  Target: SCN10A; (+) strand; PAM type: NRG; PAM sequence: AAG
ttatatatttgcatttcaca

SEQ ID NO: 39186 - DNA, 20 bp, Artificial Sequence
  Description of Artificial Sequence: Synthetic oligonucleotide
  Target: SCN10A; (+) strand; PAM type: NRG; PAM sequence: AAG
atatttgcatttcacaaagc

SEQ ID NO: 39187 - DNA, 20 bp, Artificial Sequence
  Description of Artificial Sequence: Synthetic oligonucleotide
  Target: SCN10A; (+) strand; PAM type: NRG; PAM sequence: GAG
ttgcatttcacaaagcaagt

SEQ ID NO: 39188 - DNA, 20 bp, Artificial Sequence
  Description of Artificial Sequence: Synthetic oligonucleotide
  Target: SCN10A; (+) strand; PAM type: NRG; PAM sequence: AGG
tgcatttcacaaagcaagtg

SEQ ID NO: 39189 - DNA, 20 bp, Artificial Sequence
  Description of Artificial Sequence: Synthetic oligonucleotide
  Target: SCN10A; (+) strand; PAM type: NRG; PAM sequence: TAG
aagtgaggtgttgatccacc

SEQ ID NO: 39190 - DNA, 20 bp, Artificial Sequence
  Description of Artificial Sequence: Synthetic oligonucleotide
  Target: SCN10A; (+) strand; PAM type: NRG; PAM sequence: TGG
ctagaattgattcttgtgtg

SEQ ID NO: 39191 - DNA, 20 bp, Artificial Sequence
  Description of Artificial Sequence: Synthetic oligonucleotide
  Target: SCN10A; (+) strand; PAM type: NRG; PAM sequence: AAG
tgattcttgtgtgtggtgca

SEQ ID NO: 39192 - DNA, 20 bp, Artificial Sequence
  Description of Artificial Sequence: Synthetic oligonucleotide
  Target: SCN10A; (+) strand; PAM type: NRG; PAM sequence: TGG
tcttgtgtgtggtgcaaagt

SEQ ID NO: 39193 - DNA, 20 bp, Artificial Sequence
  Description of Artificial Sequence: Synthetic oligonucleotide
  Target: SCN10A; (+) strand; PAM type: NRG; PAM sequence: TAG
gcaaagttggatgtttaatg

SEQ ID NO: 39194 - DNA, 20 bp, Artificial Sequence
  Description of Artificial Sequence: Synthetic oligonucleotide
  Target: SCN10A; (+) strand; PAM type: NRG; PAM sequence: CAG
gatgtttaatgtagtttttc

SEQ ID NO: 39195 - DNA, 20 bp, Artificial Sequence
  Description of Artificial Sequence: Synthetic oligonucleotide
  Target: SCN10A; (+) strand; PAM type: NRG; PAM sequence: GAG
tttaatgtagtttttccagt

SEQ ID NO: 39196 - DNA, 20 bp, Artificial Sequence
  Description of Artificial Sequence: Synthetic oligonucleotide
  Target: SCN10A; (+) strand; PAM type: NRG; PAM sequence: CAG
cagtgagattcctaattctt

SEQ ID NO: 39197 - DNA, 20 bp, Artificial Sequence
  Description of Artificial Sequence: Synthetic oligonucleotide
  Target: SCN10A; (+) strand; PAM type: NRG; PAM sequence: AAG
ttcttcagcatcattttttg

SEQ ID NO: 39198 - DNA, 20 bp, Artificial Sequence
  Description of Artificial Sequence: Synthetic oligonucleotide
  Target: SCN10A; (+) strand; PAM type: NRG; PAM sequence: TGG
ccgccttttccctgctgttc

SEQ ID NO: 39199 - DNA, 20 bp, Artificial Sequence
  Description of Artificial Sequence: Synthetic oligonucleotide
  Target: SCN10A; (+) strand; PAM type: NRG; PAM sequence: GGG
cgccttttccctgctgttct

SEQ ID NO: 39200 - DNA, 20 bp, Artificial Sequence
  Description of Artificial Sequence: Synthetic oligonucleotide
  Target: SCN10A; (+) strand; PAM type: NRG; PAM sequence: GGG
gccttttccctgctgttctg

SEQ ID NO: 39201 - DNA, 20 bp, Artificial Sequence
  Description of Artificial Sequence: Synthetic oligonucleotide
  Target: SCN10A; (+) strand; PAM type: NRG; PAM sequence: TAG
ggtgccaccttttcacacat

SEQ ID NO: 39202 - DNA, 20 bp, Artificial Sequence
  Description of Artificial Sequence: Synthetic oligonucleotide
  Target: SCN10A; (+) strand; PAM type: NRG; PAM sequence: TGG
ttagatgtttacatatgtgt

SEQ ID NO: 39203 - DNA, 20 bp, Artificial Sequence
  Description of Artificial Sequence: Synthetic oligonucleotide
  Target: SCN10A; (+) strand; PAM type: NRG; PAM sequence: TGG
catatgtgttggtctgttta

SEQ ID NO: 39204 - DNA, 20 bp, Artificial Sequence
  Description of Artificial Sequence: Synthetic oligonucleotide
  Target: SCN10A; (+) strand; PAM type: NRG; PAM sequence: TGG
tctgaccaatcttacaccaa

SEQ ID NO: 39205 - DNA, 20 bp, Artificial Sequence
  Description of Artificial Sequence: Synthetic oligonucleotide
  Target: SCN10A; (+) strand; PAM type: NRG; PAM sequence: TAG
caatggcacactgcttcaat

SEQ ID NO: 39206 - DNA, 20 bp, Artificial Sequence
  Description of Artificial Sequence: Synthetic oligonucleotide
  Target: SCN10A; (+) strand; PAM type: NRG; PAM sequence: GAG
atggcacactgcttcaatta

SEQ ID NO: 39207 - DNA, 20 bp, Artificial Sequence
  Description of Artificial Sequence: Synthetic oligonucleotide
  Target: SCN10A; (+) strand; PAM type: NRG; PAM sequence: TAG
ctgcttcaattagagcttta

SEQ ID NO: 39208 - DNA, 20 bp, Artificial Sequence
  Description of Artificial Sequence: Synthetic oligonucleotide
  Target: SCN10A; (+) strand; PAM type: NRG; PAM sequence: CAG
ttatagtaaatctcgacatc

SEQ ID NO: 39209 - DNA, 20 bp, Artificial Sequence
  Description of Artificial Sequence: Synthetic oligonucleotide
  Target: SCN10A; (+) strand; PAM type: NRG; PAM sequence: TAG
tagtaaatctcgacatccag

SEQ ID NO: 39210 - DNA, 20 bp, Artificial Sequence
  Description of Artificial Sequence: Synthetic oligonucleotide
  Target: SCN10A; (+) strand; PAM type: NRG; PAM sequence: GAG
atctcgacatccagtagaat

SEQ ID NO: 39211 - DNA, 20 bp, Artificial Sequence
  Description of Artificial Sequence: Synthetic oligonucleotide
  Target: SCN10A; (+) strand; PAM type: NRG; PAM sequence: AAG
actttgtatttcttcctcaa

SEQ ID NO: 39212 - DNA, 20 bp, Artificial Sequence
  Description of Artificial Sequence: Synthetic oligonucleotide
  Target: SCN10A; (+) strand; PAM type: NRG; PAM sequence: TGG
tttcttcctcaaaagtttct

SEQ ID NO: 39213 - DNA, 20 bp, Artificial Sequence
  Description of Artificial Sequence: Synthetic oligonucleotide
  Target: SCN10A; (+) strand; PAM type: NRG; PAM sequence: GAG
aaaatttcatgtaaactttt

SEQ ID NO: 39214 - DNA, 20 bp, Artificial Sequence
  Description of Artificial Sequence: Synthetic oligonucleotide
  Target: SCN10A; (+) strand; PAM type: NRG; PAM sequence: AGG
aaatttcatgtaaacttttg

SEQ ID NO: 39215 - DNA, 20 bp, Artificial Sequence
  Description of Artificial Sequence: Synthetic oligonucleotide
  Target: SCN10A; (+) strand; PAM type: NRG; PAM sequence: AAG
tttcatgtaaacttttgagg

SEQ ID NO: 39216 - DNA, 20 bp, Artificial Sequence
  Description of Artificial Sequence: Synthetic oligonucleotide
  Target: SCN10A; (+) strand; PAM type: NRG; PAM sequence: AAG
cttttgaggaagaaaattta

SEQ ID NO: 39217 - DNA, 20 bp, Artificial Sequence
  Description of Artificial Sequence: Synthetic oligonucleotide
  Target: SCN10A; (+) strand; PAM type: NRG; PAM sequence: AAG
ggaagaaaatttaaagttta

SEQ ID NO: 39218 - DNA, 20 bp, Artificial Sequence
  Description of Artificial Sequence: Synthetic oligonucleotide
  Target: SCN10A; (+) strand; PAM type: NRG; PAM sequence: AAG
tttaaagtttaaagtttgtc

SEQ ID NO: 39219 - DNA, 20 bp, Artificial Sequence
  Description of Artificial Sequence: Synthetic oligonucleotide
  Target: SCN10A; (+) strand; PAM type: NRG; PAM sequence: AAG
agtttgtcaagtaataccaa

SEQ ID NO: 39220 - DNA, 20 bp, Artificial Sequence
  Description of Artificial Sequence: Synthetic oligonucleotide
  Target: SCN10A; (+) strand; PAM type: NRG; PAM sequence: AAG
ttgtcaagtaataccaaaag

SEQ ID NO: 39221 - DNA, 20 bp, Artificial Sequence
  Description of Artificial Sequence: Synthetic oligonucleotide
  Target: SCN10A; (+) strand; PAM type: NRG; PAM sequence: GAG
gcctgttgaaatattgattt

SEQ ID NO: 39222 - DNA, 20 bp, Artificial Sequence
  Description of Artificial Sequence: Synthetic oligonucleotide
  Target: SCN10A; (+) strand; PAM type: NRG; PAM sequence: AGG
cctgttgaaatattgatttg

SEQ ID NO: 39223 - DNA, 20 bp, Artificial Sequence
  Description of Artificial Sequence: Synthetic oligonucleotide
  Target: SCN10A; (+) strand; PAM type: NRG; PAM sequence: TGG
ttaaatttattaatcatttt

SEQ ID NO: 39224 - DNA, 20 bp, Artificial Sequence
  Description of Artificial Sequence: Synthetic oligonucleotide
  Target: SCN10A; (+) strand; PAM type: NRG; PAM sequence: GGG
taaatttattaatcattttt

SEQ ID NO: 39225 - DNA, 20 bp, Artificial Sequence
  Description of Artificial Sequence: Synthetic oligonucleotide
  Target: SCN10A; (+) strand; PAM type: NRG; PAM sequence: GAG
aatttattaatcatttttgg

SEQ ID NO: 39226 - DNA, 20 bp, Artificial Sequence
  Description of Artificial Sequence: Synthetic oligonucleotide
  Target: SCN10A; (+) strand; PAM type: NRG; PAM sequence: GAG
ttgggagtctttacaatatt

SEQ ID NO: 39227 - DNA, 20 bp, Artificial Sequence
  Description of Artificial Sequence: Synthetic oligonucleotide
  Target: SCN10A; (+) strand; PAM type: NRG; PAM sequence: GAG
aatattgagactttgaatct

SEQ ID NO: 39228 - DNA, 20 bp, Artificial Sequence
  Description of Artificial Sequence: Synthetic oligonucleotide
  Target: SCN10A; (+) strand; PAM type: NRG; PAM sequence: TGG
aacatgtctccccactgatt

SEQ ID NO: 39229 - DNA, 20 bp, Artificial Sequence
  Description of Artificial Sequence: Synthetic oligonucleotide
  Target: SCN10A; (+) strand; PAM type: NRG; PAM sequence: TAG
acttattataattttcctta

SEQ ID NO: 39230 - DNA, 20 bp, Artificial Sequence
  Description of Artificial Sequence: Synthetic oligonucleotide
  Target: SCN10A; (+) strand; PAM type: NRG; PAM sequence: GAG
ttattataattttccttata

SEQ ID NO: 39231 - DNA, 20 bp, Artificial Sequence
  Description of Artificial Sequence: Synthetic oligonucleotide
  Target: SCN10A; (+) strand; PAM type: NRG; PAM sequence: TAG
tactttgataatcttattcc

SEQ ID NO: 39232 - DNA, 20 bp, Artificial Sequence
  Description of Artificial Sequence: Synthetic oligonucleotide
  Target: SCN10A; (+) strand; PAM type: NRG; PAM sequence: CAG
tacttgacattttaaaatgc

SEQ ID NO: 39233 - DNA, 20 bp, Artificial Sequence
  Description of Artificial Sequence: Synthetic oligonucleotide
  Target: SCN10A; (+) strand; PAM type: NRG; PAM sequence: TGG
ttttaaaatgccagtgtaaa

SEQ ID NO: 39234 - DNA, 20 bp, Artificial Sequence
  Description of Artificial Sequence: Synthetic oligonucleotide
  Target: SCN10A; (+) strand; PAM type: NRG; PAM sequence: TAG
aactattttctgtttgttgc

SEQ ID NO: 39235 - DNA, 20 bp, Artificial Sequence
  Description of Artificial Sequence: Synthetic oligonucleotide
  Target: SCN10A; (+) strand; PAM type: NRG; PAM sequence: CAG
tatgtatgttaatttgtacc

SEQ ID NO: 39236 - DNA, 20 bp, Artificial Sequence
  Description of Artificial Sequence: Synthetic oligonucleotide
  Target: SCN10A; (+) strand; PAM type: NRG; PAM sequence: TAG
taattcttactgtttatctc

SEQ ID NO: 39237 - DNA, 20 bp, Artificial Sequence
  Description of Artificial Sequence: Synthetic oligonucleotide
  Target: SCN10A; (+) strand; PAM type: NRG; PAM sequence: AGG
aattcttactgtttatctct

SEQ ID NO: 39238 - DNA, 20 bp, Artificial Sequence
  Description of Artificial Sequence: Synthetic oligonucleotide
  Target: SCN10A; (+) strand; PAM type: NRG; PAM sequence: TGG
tgtttatctctaggttatgt

SEQ ID NO: 39239 - DNA, 20 bp, Artificial Sequence
  Description of Artificial Sequence: Synthetic oligonucleotide
  Target: SCN10A; (+) strand; PAM type: NRG; PAM sequence: CGG
ttatctgtaaattacatctt

SEQ ID NO: 39240 - DNA, 20 bp, Artificial Sequence
  Description of Artificial Sequence: Synthetic oligonucleotide
  Target: SCN10A; (+) strand; PAM type: NRG; PAM sequence: TGG
ttttctttgctttactatgc

SEQ ID NO: 39241 - DNA, 20 bp, Artificial Sequence
  Description of Artificial Sequence: Synthetic oligonucleotide
  Target: SCN10A; (+) strand; PAM type: NRG; PAM sequence: GAG
tttgctttactatgctggct

SEQ ID NO: 39242 - DNA, 20 bp, Artificial Sequence
  Description of Artificial Sequence: Synthetic oligonucleotide
  Target: SCN10A; (+) strand; PAM type: NRG; PAM sequence: AAG
tggctgagacctcctttaca

SEQ ID NO: 39243 - DNA, 20 bp, Artificial Sequence
  Description of Artificial Sequence: Synthetic oligonucleotide
  Target: SCN10A; (+) strand; PAM type: NRG; PAM sequence: TGG
ctgagacctcctttacaaag

SEQ ID NO: 39244 - DNA, 20 bp, Artificial Sequence
  Description of Artificial Sequence: Synthetic oligonucleotide
  Target: SCN10A; (+) strand; PAM type: NRG; PAM sequence: GAG
ctcctttacaaagtggaact

SEQ ID NO: 39245 - DNA, 20 bp, Artificial Sequence
  Description of Artificial Sequence: Synthetic oligonucleotide
  Target: SCN10A; (+) strand; PAM type: NRG; PAM sequence: AAG
ctttacaaagtggaactgag

SEQ ID NO: 39246 - DNA, 20 bp, Artificial Sequence
  Description of Artificial Sequence: Synthetic oligonucleotide
  Target: SCN10A; (+) strand; PAM type: NRG; PAM sequence: CAG
caaagtggaactgagaagaa

SEQ ID NO: 39247 - DNA, 20 bp, Artificial Sequence
  Description of Artificial Sequence: Synthetic oligonucleotide
  Target: SCN10A; (+) strand; PAM type: NRG; PAM sequence: TGG
ctgagaagaacagacatctt

SEQ ID NO: 39248 - DNA, 20 bp, Artificial Sequence
  Description of Artificial Sequence: Synthetic oligonucleotide
  Target: SCN10A; (+) strand; PAM type: NRG; PAM sequence: AAG
ttttttttcttttgatctca

SEQ ID NO: 39249 - DNA, 20 bp, Artificial Sequence
  Description of Artificial Sequence: Synthetic oligonucleotide
  Target: SCN10A; (+) strand; PAM type: NRG; PAM sequence: AGG
tttttttcttttgatctcaa

SEQ ID NO: 39250 - DNA, 20 bp, Artificial Sequence
  Description of Artificial Sequence: Synthetic oligonucleotide
  Target: SCN10A; (+) strand; PAM type: NRG; PAM sequence: GGG
ttttttcttttgatctcaaa

SEQ ID NO: 39251 - DNA, 20 bp, Artificial Sequence
  Description of Artificial Sequence: Synthetic oligonucleotide
  Target: SCN10A; (+) strand; PAM type: NRG; PAM sequence: AAG
ttcttttgatctcaaaggga

SEQ ID NO: 39252 - DNA, 20 bp, Artificial Sequence
  Description of Artificial Sequence: Synthetic oligonucleotide
  Target: SCN10A; (+) strand; PAM type: NRG; PAM sequence: AAG
agctttccatgttcacaatt

SEQ ID NO: 39253 - DNA, 20 bp, Artificial Sequence
  Description of Artificial Sequence: Synthetic oligonucleotide
  Target: SCN10A; (+) strand; PAM type: NRG; PAM sequence: CAG
aaacaatgaataccctttat

SEQ ID NO: 39254 - DNA, 20 bp, Artificial Sequence
  Description of Artificial Sequence: Synthetic oligonucleotide
  Target: SCN10A; (+) strand; PAM type: NRG; PAM sequence: GAG
acaatgaataccctttatca

SEQ ID NO: 39255 - DNA, 20 bp, Artificial Sequence
  Description of Artificial Sequence: Synthetic oligonucleotide
  Target: SCN10A; (+) strand; PAM type: NRG; PAM sequence: AAG
ttttaaaattattatacttt

SEQ ID NO: 39256 - DNA, 20 bp, Artificial Sequence
  Description of Artificial Sequence: Synthetic oligonucleotide
  Target: SCN10A; (+) strand; PAM type: NRG; PAM sequence: TGG
aattattatactttaagttc

SEQ ID NO: 39257 - DNA, 20 bp, Artificial Sequence
  Description of Artificial Sequence: Synthetic oligonucleotide
  Target: SCN10A; (+) strand; PAM type: NRG; PAM sequence: GGG
attattatactttaagttct

SEQ ID NO: 39258 - DNA, 20 bp, Artificial Sequence
  Description of Artificial Sequence: Synthetic oligonucleotide
  Target: SCN10A; (+) strand; PAM type: NRG; PAM sequence: GGG
ttattatactttaagttctg

SEQ ID NO: 39259 - DNA, 20 bp, Artificial Sequence
  Description of Artificial Sequence: Synthetic oligonucleotide
  Target: SCN10A; (+) strand; PAM type: NRG; PAM sequence: CAG
taagttctggggtacatgtg

SEQ ID NO: 39260 - DNA, 20 bp, Artificial Sequence
  Description of Artificial Sequence: Synthetic oligonucleotide
  Target: SCN10A; (+) strand; PAM type: NRG; PAM sequence: CGG
ggtacatgtgcagaacgtgc

SEQ ID NO: 39261 - DNA, 20 bp, Artificial Sequence
  Description of Artificial Sequence: Synthetic oligonucleotide
  Target: SCN10A; (+) strand; PAM type: NRG; PAM sequence: TAG
gaacgtgccggtttgttaca

SEQ ID NO: 39262 - DNA, 20 bp, Artificial Sequence
  Description of Artificial Sequence: Synthetic oligonucleotide
  Target: SCN10A; (+) strand; PAM type: NRG; PAM sequence: AGG
aacgtgccggtttgttacat

SEQ ID NO: 39263 - DNA, 20 bp, Artificial Sequence
  Description of Artificial Sequence: Synthetic oligonucleotide
  Target: SCN10A; (+) strand; PAM type: NRG; PAM sequence: TGG
acataggtgtacccgtgcca

SEQ ID NO: 39264 - DNA, 20 bp, Artificial Sequence
  Description of Artificial Sequence: Synthetic oligonucleotide
  Target: SCN10A; (+) strand; PAM type: NRG; PAM sequence: TGG
taggtgtacccgtgccatgg

SEQ ID NO: 39265 - DNA, 20 bp, Artificial Sequence
  Description of Artificial Sequence: Synthetic oligonucleotide
  Target: SCN10A; (+) strand; PAM type: NRG; PAM sequence: TAG
cttcaacccgtcatttacat

SEQ ID NO: 39266 - DNA, 20 bp, Artificial Sequence
  Description of Artificial Sequence: Synthetic oligonucleotide
  Target: SCN10A; (+) strand; PAM type: NRG; PAM sequence: AGG
ttcaacccgtcatttacatt

SEQ ID NO: 39267 - DNA, 20 bp, Artificial Sequence
  Description of Artificial Sequence: Synthetic oligonucleotide
  Target: SCN10A; (+) strand; PAM type: NRG; PAM sequence: TAG
tcctaatgctatccctcccc

SEQ ID NO: 39268 - DNA, 20 bp, Artificial Sequence
  Description of Artificial Sequence: Synthetic oligonucleotide
  Target: SCN10A; (+) strand; PAM type: NRG; PAM sequence: CAG
cctagccccccacccctcaa

SEQ ID NO: 39269 - DNA, 20 bp, Artificial Sequence
  Description of Artificial Sequence: Synthetic oligonucleotide
  Target: SCN10A; (+) strand; PAM type: NRG; PAM sequence: AGG
ctagccccccacccctcaac

SEQ ID NO: 39270 - DNA, 20 bp, Artificial Sequence
  Description of Artificial Sequence: Synthetic oligonucleotide
  Target: SCN10A; (+) strand; PAM type: NRG; PAM sequence: CAG
ccccacccctcaacaggccc

SEQ ID NO: 39271 - DNA, 20 bp, Artificial Sequence
  Description of Artificial Sequence: Synthetic oligonucleotide
  Target: SCN10A; (+) strand; PAM type: NRG; PAM sequence: GAG
attgttcaactcccacttat

SEQ ID NO: 39272 - DNA, 20 bp, Artificial Sequence
  Description of Artificial Sequence: Synthetic oligonucleotide
  Target: SCN10A; (+) strand; PAM type: NRG; PAM sequence: GAG
ttcaactcccacttatgagt

SEQ ID NO: 39273 - DNA, 20 bp, Artificial Sequence
  Description of Artificial Sequence: Synthetic oligonucleotide
  Target: SCN10A; (+) strand; PAM type: NRG; PAM sequence: CGG
cacttatgagtgagaacata

SEQ ID NO: 39274 - DNA, 20 bp, Artificial Sequence
  Description of Artificial Sequence: Synthetic oligonucleotide
  Target: SCN10A; (+) strand; PAM type: NRG; PAM sequence: TGG
gagtgagaacatacggtgtt

SEQ ID NO: 39275 - DNA, 20 bp, Artificial Sequence
  Description of Artificial Sequence: Synthetic oligonucleotide
  Target: SCN10A; (+) strand; PAM type: NRG; PAM sequence: TAG
ttggttttctgttcttgtgt

SEQ ID NO: 39276 - DNA, 20 bp, Artificial Sequence
  Description of Artificial Sequence: Synthetic oligonucleotide
  Target: SCN10A; (+) strand; PAM type: NRG; PAM sequence: GAG
tgttcttgtgttagtttgct

SEQ ID NO: 39277 - DNA, 20 bp, Artificial Sequence
  Description of Artificial Sequence: Synthetic oligonucleotide
  Target: SCN10A; (+) strand; PAM type: NRG; PAM sequence: TGG
tgttagtttgctgagaatga

SEQ ID NO: 39278 - DNA, 20 bp, Artificial Sequence
  Description of Artificial Sequence: Synthetic oligonucleotide
  Target: SCN10A; (+) strand; PAM type: NRG; PAM sequence: CAG
ttgctgagaatgatggtttc

SEQ ID NO: 39279 - DNA, 20 bp, Artificial Sequence
  Description of Artificial Sequence: Synthetic oligonucleotide
  Target: SCN10A; (+) strand; PAM type: NRG; PAM sequence: AAG
gcttcatccatgtccctgca

SEQ ID NO: 39280 - DNA, 20 bp, Artificial Sequence
  Description of Artificial Sequence: Synthetic oligonucleotide
  Target: SCN10A; (+) strand; PAM type: NRG; PAM sequence: AGG
cttcatccatgtccctgcaa

SEQ ID NO: 39281 - DNA, 20 bp, Artificial Sequence
  Description of Artificial Sequence: Synthetic oligonucleotide
  Target: SCN10A; (+) strand; PAM type: NRG; PAM sequence: TAG
catccttttttatgactgca

SEQ ID NO: 39282 - DNA, 20 bp, Artificial Sequence
  Description of Artificial Sequence: Synthetic oligonucleotide
  Target: SCN10A; (+) strand; PAM type: NRG; PAM sequence: TGG
tatgactgcatagcattcca

SEQ ID NO: 39283 - DNA, 20 bp, Artificial Sequence
  Description of Artificial Sequence: Synthetic oligonucleotide
  Target: SCN10A; (+) strand; PAM type: NRG; PAM sequence: AAG
ccttctatttcaacttttct

SEQ ID NO: 39284 - DNA, 20 bp, Artificial Sequence
  Description of Artificial Sequence: Synthetic oligonucleotide
  Target: SCN10A; (+) strand; PAM type: NRG; PAM sequence: TGG
taagaatttaaaattataaa

SEQ ID NO: 39285 - DNA, 20 bp, Artificial Sequence
  Description of Artificial Sequence: Synthetic oligonucleotide
  Target: SCN10A; (+) strand; PAM type: NRG; PAM sequence: TAG
taaactttatcaaatgattt

SEQ ID NO: 39286 - DNA, 20 bp, Artificial Sequence
  Description of Artificial Sequence: Synthetic oligonucleotide
  Target: SCN10A; (+) strand; PAM type: NRG; PAM sequence: AAG
aaatgattttagcatcaatt

SEQ ID NO: 39287 - DNA, 20 bp, Artificial Sequence
  Description of Artificial Sequence: Synthetic oligonucleotide
  Target: SCN10A; (+) strand; PAM type: NRG; PAM sequence: AAG
tgattttagcatcaattaag

SEQ ID NO: 39288 - DNA, 20 bp, Artificial Sequence
  Description of Artificial Sequence: Synthetic oligonucleotide
  Target: SCN10A; (+) strand; PAM type: NRG; PAM sequence: TGG
atataacgtattttctgttg

SEQ ID NO: 39289 - DNA, 20 bp, Artificial Sequence
  Description of Artificial Sequence: Synthetic oligonucleotide
  Target: SCN10A; (+) strand; PAM type: NRG; PAM sequence: TAG
gcatgcattactgttatgat

SEQ ID NO: 39290 - DNA, 20 bp, Artificial Sequence
  Description of Artificial Sequence: Synthetic oligonucleotide
  Target: SCN10A; (+) strand; PAM type: NRG; PAM sequence: AAG
aaaaaaaaaaaaaaaaaaaa

SEQ ID NO: 39291 - DNA, 20 bp, Artificial Sequence
  Description of Artificial Sequence: Synthetic oligonucleotide
  Target: SCN10A; (+) strand; PAM type: NRG; PAM sequence: AAG
aaaaaaaaaaaaaaaaaaga

SEQ ID NO: 39292 - DNA, 20 bp, Artificial Sequence
  Description of Artificial Sequence: Synthetic oligonucleotide
  Target: SCN10A; (+) strand; PAM type: NRG; PAM sequence: AAG
aaaaaaaagaaagctctgca

SEQ ID NO: 39293 - DNA, 20 bp, Artificial Sequence
  Description of Artificial Sequence: Synthetic oligonucleotide
  Target: SCN10A; (+) strand; PAM type: NRG; PAM sequence: AAG
agcacctgttattataacca

SEQ ID NO: 39294 - DNA, 20 bp, Artificial Sequence
  Description of Artificial Sequence: Synthetic oligonucleotide
  Target: SCN10A; (+) strand; PAM type: NRG; PAM sequence: AGG
gcacctgttattataaccaa

SEQ ID NO: 39295 - DNA, 20 bp, Artificial Sequence
  Description of Artificial Sequence: Synthetic oligonucleotide
  Target: SCN10A; (+) strand; PAM type: NRG; PAM sequence: TAG
tattataaccaaaggtatgt

SEQ ID NO: 39296 - DNA, 20 bp, Artificial Sequence
  Description of Artificial Sequence: Synthetic oligonucleotide
  Target: SCN10A; (+) strand; PAM type: NRG; PAM sequence: AGG
attataaccaaaggtatgtt

SEQ ID NO: 39297 - DNA, 20 bp, Artificial Sequence
  Description of Artificial Sequence: Synthetic oligonucleotide
  Target: SCN10A; (+) strand; PAM type: NRG; PAM sequence: AAG
accaaaggtatgttaggttc

SEQ ID NO: 39298 - DNA, 20 bp, Artificial Sequence
  Description of Artificial Sequence: Synthetic oligonucleotide
  Target: SCN10A; (+) strand; PAM type: NRG; PAM sequence: TGG
aaggtatgttaggttcaagc

SEQ ID NO: 39299 - DNA, 20 bp, Artificial Sequence
  Description of Artificial Sequence: Synthetic oligonucleotide
  Target: SCN10A; (+) strand; PAM type: NRG; PAM sequence: GAG
ggtatgttaggttcaagctg

SEQ ID NO: 39300 - DNA, 20 bp, Artificial Sequence
  Description of Artificial Sequence: Synthetic oligonucleotide
  Target: SCN10A; (+) strand; PAM type: NRG; PAM sequence: TGG
atgttaggttcaagctggag

SEQ ID NO: 39301 - DNA, 20 bp, Artificial Sequence
  Description of Artificial Sequence: Synthetic oligonucleotide
  Target: SCN10A; (+) strand; PAM type: NRG; PAM sequence: AAG
ttaggttcaagctggagtgg

SEQ ID NO: 39302 - DNA, 20 bp, Artificial Sequence
  Description of Artificial Sequence: Synthetic oligonucleotide
  Target: SCN10A; (+) strand; PAM type: NRG; PAM sequence: CAG
tggagtggaagcatccctcc

SEQ ID NO: 39303 - DNA, 20 bp, Artificial Sequence
  Description of Artificial Sequence: Synthetic oligonucleotide
  Target: SCN10A; (+) strand; PAM type: NRG; PAM sequence: TGG
aagcatccctcccagatgtg

SEQ ID NO: 39304 - DNA, 20 bp, Artificial Sequence
  Description of Artificial Sequence: Synthetic oligonucleotide
  Target: SCN10A; (+) strand; PAM type: NRG; PAM sequence: TGG
ccctcccagatgtgtggata

SEQ ID NO: 39305 - DNA, 20 bp, Artificial Sequence
  Description of Artificial Sequence: Synthetic oligonucleotide
  Target: SCN10A; (+) strand; PAM type: NRG; PAM sequence: TGG
gtgtggatatggaatgtttt

SEQ ID NO: 39306 - DNA, 20 bp, Artificial Sequence
  Description of Artificial Sequence: Synthetic oligonucleotide
  Target: SCN10A; (+) strand; PAM type: NRG; PAM sequence: CAG
gaatgtttttggaaaactcc

SEQ ID NO: 39307 - DNA, 20 bp, Artificial Sequence
  Description of Artificial Sequence: Synthetic oligonucleotide
  Target: SCN10A; (+) strand; PAM type: NRG; PAM sequence: TAG
actcccagattctgaaacta

SEQ ID NO: 39308 - DNA, 20 bp, Artificial Sequence
  Description of Artificial Sequence: Synthetic oligonucleotide
  Target: SCN10A; (+) strand; PAM type: NRG; PAM sequence: AGG
ctcccagattctgaaactat

SEQ ID NO: 39309 - DNA, 20 bp, Artificial Sequence
  Description of Artificial Sequence: Synthetic oligonucleotide
  Target: SCN10A; (+) strand; PAM type: NRG; PAM sequence: GGG
tcccagattctgaaactata

SEQ ID NO: 39310 - DNA, 20 bp, Artificial Sequence
  Description of Artificial Sequence: Synthetic oligonucleotide
  Target: SCN10A; (+) strand; PAM type: NRG; PAM sequence: GGG
cccagattctgaaactatag

SEQ ID NO: 39311 - DNA, 20 bp, Artificial Sequence
  Description of Artificial Sequence: Synthetic oligonucleotide
  Target: SCN10A; (+) strand; PAM type: NRG; PAM sequence: TAG
aggggtttcacccactaacc

SEQ ID NO: 39312 - DNA, 20 bp, Artificial Sequence
  Description of Artificial Sequence: Synthetic oligonucleotide
  Target: SCN10A; (+) strand; PAM type: NRG; PAM sequence: AGG
ggggtttcacccactaacct

SEQ ID NO: 39313 - DNA, 20 bp, Artificial Sequence
  Description of Artificial Sequence: Synthetic oligonucleotide
  Target: SCN10A; (+) strand; PAM type: NRG; PAM sequence: GGG
gggtttcacccactaaccta

SEQ ID NO: 39314 - DNA, 20 bp, Artificial Sequence
  Description of Artificial Sequence: Synthetic oligonucleotide
  Target: SCN10A; (+) strand; PAM type: NRG; PAM sequence: TAG
cacccactaacctagggaaa

SEQ ID NO: 39315 - DNA, 20 bp, Artificial Sequence
  Description of Artificial Sequence: Synthetic oligonucleotide
  Target: SCN10A; (+) strand; PAM type: NRG; PAM sequence: CAG
ctagggaaatagaataactt

SEQ ID NO: 39316 - DNA, 20 bp, Artificial Sequence
  Description of Artificial Sequence: Synthetic oligonucleotide
  Target: SCN10A; (+) strand; PAM type: NRG; PAM sequence: AGG
tagggaaatagaataacttc

SEQ ID NO: 39317 - DNA, 20 bp, Artificial Sequence
  Description of Artificial Sequence: Synthetic oligonucleotide
  Target: SCN10A; (+) strand; PAM type: NRG; PAM sequence: AAG
agaataacttcaggaatact

SEQ ID NO: 39318 - DNA, 20 bp, Artificial Sequence
  Description of Artificial Sequence: Synthetic oligonucleotide
  Target: SCN10A; (+) strand; PAM type: NRG; PAM sequence: AGG
gaataacttcaggaatacta

SEQ ID NO: 39319 - DNA, 20 bp, Artificial Sequence
  Description of Artificial Sequence: Synthetic oligonucleotide
  Target: SCN10A; (+) strand; PAM type: NRG; PAM sequence: GAG
aggaatactaaggttacttt

SEQ ID NO: 39320 - DNA, 20 bp, Artificial Sequence
  Description of Artificial Sequence: Synthetic oligonucleotide
  Target: SCN10A; (+) strand; PAM type: NRG; PAM sequence: AGG
ggaatactaaggttactttg

SEQ ID NO: 39321 - DNA, 20 bp, Artificial Sequence
  Description of Artificial Sequence: Synthetic oligonucleotide
  Target: SCN10A; (+) strand; PAM type: NRG; PAM sequence: AAG
aggttactttgaggcatatg

SEQ ID NO: 39322 - DNA, 20 bp, Artificial Sequence
  Description of Artificial Sequence: Synthetic oligonucleotide
  Target: SCN10A; (+) strand; PAM type: NRG; PAM sequence: CAG
atgaagcatgataacttaaa

SEQ ID NO: 39323 - DNA, 20 bp, Artificial Sequence
  Description of Artificial Sequence: Synthetic oligonucleotide
  Target: SCN10A; (+) strand; PAM type: NRG; PAM sequence: GAG
acttaaacagcttcatttat

SEQ ID NO: 39324 - DNA, 20 bp, Artificial Sequence
  Description of Artificial Sequence: Synthetic oligonucleotide
  Target: SCN10A; (+) strand; PAM type: NRG; PAM sequence: CAG
gttattttctaaatatactc

SEQ ID NO: 39325 - DNA, 20 bp, Artificial Sequence
  Description of Artificial Sequence: Synthetic oligonucleotide
  Target: SCN10A; (+) strand; PAM type: NRG; PAM sequence: GAG
tattttctaaatatactcca

SEQ ID NO: 39326 - DNA, 20 bp, Artificial Sequence
  Description of Artificial Sequence: Synthetic oligonucleotide
  Target: SCN10A; (+) strand; PAM type: NRG; PAM sequence: TAG
actccagagccatttgttct

SEQ ID NO: 39327 - DNA, 20 bp, Artificial Sequence
  Description of Artificial Sequence: Synthetic oligonucleotide
  Target: SCN10A; (+) strand; PAM type: NRG; PAM sequence: CAG
atttgttcttagttctgtct

SEQ ID NO: 39328 - DNA, 20 bp, Artificial Sequence
  Description of Artificial Sequence: Synthetic oligonucleotide
  Target: SCN10A; (+) strand; PAM type: NRG; PAM sequence: TAG
ttgctcctgtctctctttca

SEQ ID NO: 39329 - DNA, 20 bp, Artificial Sequence
  Description of Artificial Sequence: Synthetic oligonucleotide
  Target: SCN10A; (+) strand; PAM type: NRG; PAM sequence: CAG
ctcctgtctctctttcatag

SEQ ID NO: 39330 - DNA, 20 bp, Artificial Sequence
  Description of Artificial Sequence: Synthetic oligonucleotide
  Target: SCN10A; (+) strand; PAM type: NRG; PAM sequence: AGG
tcctgtctctctttcatagc

SEQ ID NO: 39331 - DNA, 20 bp, Artificial Sequence
  Description of Artificial Sequence: Synthetic oligonucleotide
  Target: SCN10A; (+) strand; PAM type: NRG; PAM sequence: AAG
ttcatagcaggccttctcaa

SEQ ID NO: 39332 - DNA, 20 bp, Artificial Sequence
  Description of Artificial Sequence: Synthetic oligonucleotide
  Target: SCN10A; (+) strand; PAM type: NRG; PAM sequence: AAG
ctcaaaagcataccttctct

SEQ ID NO: 39333 - DNA, 20 bp, Artificial Sequence
  Description of Artificial Sequence: Synthetic oligonucleotide
  Target: SCN10A; (+) strand; PAM type: NRG; PAM sequence: AGG
tcaaaagcataccttctcta

SEQ ID NO: 39334 - DNA, 20 bp, Artificial Sequence
  Description of Artificial Sequence: Synthetic oligonucleotide
  Target: SCN10A; (+) strand; PAM type: NRG; PAM sequence: TAG
catacatttgtgtgtgcatc

SEQ ID NO: 39335 - DNA, 20 bp, Artificial Sequence
  Description of Artificial Sequence: Synthetic oligonucleotide
  Target: SCN10A; (+) strand; PAM type: NRG; PAM sequence: CAG
acatttgtgtgtgcatctag

SEQ ID NO: 39336 - DNA, 20 bp, Artificial Sequence
  Description of Artificial Sequence: Synthetic oligonucleotide
  Target: SCN10A; (+) strand; PAM type: NRG; PAM sequence: AGG
catttgtgtgtgcatctagc

SEQ ID NO: 39337 - DNA, 20 bp, Artificial Sequence
  Description of Artificial Sequence: Synthetic oligonucleotide
  Target: SCN10A; (+) strand; PAM type: NRG; PAM sequence: GAG
tgtgtgtgcatctagcaggt

SEQ ID NO: 39338 - DNA, 20 bp, Artificial Sequence
  Description of Artificial Sequence: Synthetic oligonucleotide
  Target: SCN10A; (+) strand; PAM type: NRG; PAM sequence: GAG
tgtgcatctagcaggtgagt

SEQ ID NO: 39339 - DNA, 20 bp, Artificial Sequence
  Description of Artificial Sequence: Synthetic oligonucleotide
  Target: SCN10A; (+) strand; PAM type: NRG; PAM sequence: TGG
gtgagtgagtgtgtgtgtgt

SEQ ID NO: 39340 - DNA, 20 bp, Artificial Sequence
  Description of Artificial Sequence: Synthetic oligonucleotide
  Target: SCN10A; (+) strand; PAM type: NRG; PAM sequence: GGG
tgagtgagtgtgtgtgtgtt

SEQ ID NO: 39341 - DNA, 20 bp, Artificial Sequence
  Description of Artificial Sequence: Synthetic oligonucleotide
  Target: SCN10A; (+) strand; PAM type: NRG; PAM sequence: GGG
gagtgagtgtgtgtgtgttg

SEQ ID NO: 39342 - DNA, 20 bp, Artificial Sequence
  Description of Artificial Sequence: Synthetic oligonucleotide
  Target: SCN10A; (+) strand; PAM type: NRG; PAM sequence: GGG
agtgagtgtgtgtgtgttgg

SEQ ID NO: 39343 - DNA, 20 bp, Artificial Sequence
  Description of Artificial Sequence: Synthetic oligonucleotide
  Target: SCN10A; (+) strand; PAM type: NRG; PAM sequence: GGG
gtgagtgtgtgtgtgttggg

SEQ ID NO: 39344 - DNA, 20 bp, Artificial Sequence
  Description of Artificial Sequence: Synthetic oligonucleotide
  Target: SCN10A; (+) strand; PAM type: NRG; PAM sequence: GGG
tgagtgtgtgtgtgttgggg

SEQ ID NO: 39345 - DNA, 20 bp, Artificial Sequence
  Description of Artificial Sequence: Synthetic oligonucleotide
  Target: SCN10A; (+) strand; PAM type: NRG; PAM sequence: GGG
gagtgtgtgtgtgttggggg

SEQ ID NO: 39346 - DNA, 20 bp, Artificial Sequence
  Description of Artificial Sequence: Synthetic oligonucleotide
  Target: SCN10A; (+) strand; PAM type: NRG; PAM sequence: GGG
agtgtgtgtgtgttgggggg

SEQ ID NO: 39347 - DNA, 20 bp, Artificial Sequence
  Description of Artificial Sequence: Synthetic oligonucleotide
  Target: SCN10A; (+) strand; PAM type: NRG; PAM sequence: TGG
gtgtgtgtgttggggggggg

SEQ ID NO: 39348 - DNA, 20 bp, Artificial Sequence
  Description of Artificial Sequence: Synthetic oligonucleotide
  Target: SCN10A; (+) strand; PAM type: NRG; PAM sequence: GGG
tgtgtgtgttgggggggggt

SEQ ID NO: 39349 - DNA, 20 bp, Artificial Sequence
  Description of Artificial Sequence: Synthetic oligonucleotide
  Target: SCN10A; (+) strand; PAM type: NRG; PAM sequence: GGG
gtgtgtgttgggggggggtg

SEQ ID NO: 39350 - DNA, 20 bp, Artificial Sequence
  Description of Artificial Sequence: Synthetic oligonucleotide
  Target: SCN10A; (+) strand; PAM type: NRG; PAM sequence: GGG
tgtgtgttgggggggggtgg

SEQ ID NO: 39351 - DNA, 20 bp, Artificial Sequence
  Description of Artificial Sequence: Synthetic oligonucleotide
  Target: SCN10A; (+) strand; PAM type: NRG; PAM sequence: GAG
tgttgggggggggtgggggc

SEQ ID NO: 39352 - DNA, 20 bp, Artificial Sequence
  Description of Artificial Sequence: Synthetic oligonucleotide
  Target: SCN10A; (+) strand; PAM type: NRG; PAM sequence: AGG
gttgggggggggtgggggcg

SEQ ID NO: 39353 - DNA, 20 bp, Artificial Sequence
  Description of Artificial Sequence: Synthetic oligonucleotide
  Target: SCN10A; (+) strand; PAM type: NRG; PAM sequence: GAG
tgggggggggtgggggcgag

SEQ ID NO: 39354 - DNA, 20 bp, Artificial Sequence
  Description of Artificial Sequence: Synthetic oligonucleotide
  Target: SCN10A; (+) strand; PAM type: NRG; PAM sequence: CAG
ggcgaggagactcatcttcc

SEQ ID NO: 39355 - DNA, 20 bp, Artificial Sequence
  Description of Artificial Sequence: Synthetic oligonucleotide
  Target: SCN10A; (+) strand; PAM type: NRG; PAM sequence: AGG
gcgaggagactcatcttccc

SEQ ID NO: 39356 - DNA, 20 bp, Artificial Sequence
  Description of Artificial Sequence: Synthetic oligonucleotide
  Target: SCN10A; (+) strand; PAM type: NRG; PAM sequence: TAG
ctcatcttcccaggccacct

SEQ ID NO: 39357 - DNA, 20 bp, Artificial Sequence
  Description of Artificial Sequence: Synthetic oligonucleotide
  Target: SCN10A; (+) strand; PAM type: NRG; PAM sequence: TGG
ccaggccaccttagactttc

SEQ ID NO: 39358 - DNA, 20 bp, Artificial Sequence
  Description of Artificial Sequence: Synthetic oligonucleotide
  Target: SCN10A; (+) strand; PAM type: NRG; PAM sequence: GGG
caggccaccttagactttct

SEQ ID NO: 39359 - DNA, 20 bp, Artificial Sequence
  Description of Artificial Sequence: Synthetic oligonucleotide
  Target: SCN10A; (+) strand; PAM type: NRG; PAM sequence: GGG
aggccaccttagactttctg

SEQ ID NO: 39360 - DNA, 20 bp, Artificial Sequence
  Description of Artificial Sequence: Synthetic oligonucleotide
  Target: SCN10A; (+) strand; PAM type: NRG; PAM sequence: TGG
caccttagactttctggggc

SEQ ID NO: 39361 - DNA, 20 bp, Artificial Sequence
  Description of Artificial Sequence: Synthetic oligonucleotide
  Target: SCN10A; (+) strand; PAM type: NRG; PAM sequence: GGG
accttagactttctggggct

SEQ ID NO: 39362 - DNA, 20 bp, Artificial Sequence
  Description of Artificial Sequence: Synthetic oligonucleotide
  Target: SCN10A; (+) strand; PAM type: NRG; PAM sequence: CAG
gactttctggggctgggact

SEQ ID NO: 39363 - DNA, 20 bp, Artificial Sequence
  Description of Artificial Sequence: Synthetic oligonucleotide
  Target: SCN10A; (+) strand; PAM type: NRG; PAM sequence: AGG
actttctggggctgggactc

SEQ ID NO: 39364 - DNA, 20 bp, Artificial Sequence
  Description of Artificial Sequence: Synthetic oligonucleotide
  Target: SCN10A; (+) strand; PAM type: NRG; PAM sequence: CAG
tccccaaaaattgcaatatg

SEQ ID NO: 39365 - DNA, 20 bp, Artificial Sequence
  Description of Artificial Sequence: Synthetic oligonucleotide
  Target: SCN10A; (+) strand; PAM type: NRG; PAM sequence: AAG
aaaattgcaatatgcagcca

SEQ ID NO: 39366 - DNA, 20 bp, Artificial Sequence
  Description of Artificial Sequence: Synthetic oligonucleotide
  Target: SCN10A; (+) strand; PAM type: NRG; PAM sequence: GAG
tgcaatatgcagccaaagtt

SEQ ID NO: 39367 - DNA, 20 bp, Artificial Sequence
  Description of Artificial Sequence: Synthetic oligonucleotide
  Target: SCN10A; (+) strand; PAM type: NRG; PAM sequence: CAG
tgtttatgaaacaaatctca

SEQ ID NO: 39368 - DNA, 20 bp, Artificial Sequence
  Description of Artificial Sequence: Synthetic oligonucleotide
  Target: SCN10A; (+) strand; PAM type: NRG; PAM sequence: AAG
ttatgaaacaaatctcacag

SEQ ID NO: 39369 - DNA, 20 bp, Artificial Sequence
  Description of Artificial Sequence: Synthetic oligonucleotide
  Target: SCN10A; (+) strand; PAM type: NRG; PAM sequence: AGG
tatgaaacaaatctcacaga

SEQ ID NO: 39370 - DNA, 20 bp, Artificial Sequence
  Description of Artificial Sequence: Synthetic oligonucleotide
  Target: SCN10A; (+) strand; PAM type: NRG; PAM sequence: GAG
tgaaacaaatctcacagaag

SEQ ID NO: 39371 - DNA, 20 bp, Artificial Sequence
  Description of Artificial Sequence: Synthetic oligonucleotide
  Target: SCN10A; (+) strand; PAM type: NRG; PAM sequence: GAG
aaacaaatctcacagaagga

SEQ ID NO: 39372 - DNA, 20 bp, Artificial Sequence
  Description of Artificial Sequence: Synthetic oligonucleotide
  Target: SCN10A; (+) strand; PAM type: NRG; PAM sequence: TGG
atctcacagaaggagagacc

SEQ ID NO: 39373 - DNA, 20 bp, Artificial Sequence
  Description of Artificial Sequence: Synthetic oligonucleotide
  Target: SCN10A; (+) strand; PAM type: NRG; PAM sequence: AAG
ggagagacctggttattaca

SEQ ID NO: 39374 - DNA, 20 bp, Artificial Sequence
  Description of Artificial Sequence: Synthetic oligonucleotide
  Target: SCN10A; (+) strand; PAM type: NRG; PAM sequence: TAG
ctggttattacaaagacata

SEQ ID NO: 39375 - DNA, 20 bp, Artificial Sequence
  Description of Artificial Sequence: Synthetic oligonucleotide
  Target: SCN10A; (+) strand; PAM type: NRG; PAM sequence: GAG
tacaaagacatatagacaat

SEQ ID NO: 39376 - DNA, 20 bp, Artificial Sequence
  Description of Artificial Sequence: Synthetic oligonucleotide
  Target: SCN10A; (+) strand; PAM type: NRG; PAM sequence: CAG
gacatatagacaatgagatt

SEQ ID NO: 39377 - DNA, 20 bp, Artificial Sequence
  Description of Artificial Sequence: Synthetic oligonucleotide
  Target: SCN10A; (+) strand; PAM type: NRG; PAM sequence: GAG
agattcagcattacccacat

SEQ ID NO: 39378 - DNA, 20 bp, Artificial Sequence
  Description of Artificial Sequence: Synthetic oligonucleotide
  Target: SCN10A; (+) strand; PAM type: NRG; PAM sequence: AGG
gattcagcattacccacatg

SEQ ID NO: 39379 - DNA, 20 bp, Artificial Sequence
  Description of Artificial Sequence: Synthetic oligonucleotide
  Target: SCN10A; (+) strand; PAM type: NRG; PAM sequence: TGG
agcattacccacatgaggca

SEQ ID NO: 39380 - DNA, 20 bp, Artificial Sequence
  Description of Artificial Sequence: Synthetic oligonucleotide
  Target: SCN10A; (+) strand; PAM type: NRG; PAM sequence: CAG
attacccacatgaggcatgg

SEQ ID NO: 39381 - DNA, 20 bp, Artificial Sequence
  Description of Artificial Sequence: Synthetic oligonucleotide
  Target: SCN10A; (+) strand; PAM type: NRG; PAM sequence: AGG
ttacccacatgaggcatggc

SEQ ID NO: 39382 - DNA, 20 bp, Artificial Sequence
  Description of Artificial Sequence: Synthetic oligonucleotide
  Target: SCN10A; (+) strand; PAM type: NRG; PAM sequence: AAG
aggcatggcaggataaataa

SEQ ID NO: 39383 - DNA, 20 bp, Artificial Sequence
  Description of Artificial Sequence: Synthetic oligonucleotide
  Target: SCN10A; (+) strand; PAM type: NRG; PAM sequence: AAG
ggcaggataaataaaagaca

SEQ ID NO: 39384 - DNA, 20 bp, Artificial Sequence
  Description of Artificial Sequence: Synthetic oligonucleotide
  Target: SCN10A; (+) strand; PAM type: NRG; PAM sequence: AAG
aataaaagacaaagactgcc

SEQ ID NO: 39385 - DNA, 20 bp, Artificial Sequence
  Description of Artificial Sequence: Synthetic oligonucleotide
  Target: SCN10A; (+) strand; PAM type: NRG; PAM sequence: AAG
aagacaaagactgccaagtg

SEQ ID NO: 39386 - DNA, 20 bp, Artificial Sequence
  Description of Artificial Sequence: Synthetic oligonucleotide
  Target: SCN10A; (+) strand; PAM type: NRG; PAM sequence: AGG
agacaaagactgccaagtga

SEQ ID NO: 39387 - DNA, 20 bp, Artificial Sequence
  Description of Artificial Sequence: Synthetic oligonucleotide
  Target: SCN10A; (+) strand; PAM type: NRG; PAM sequence: AAG
caaagactgccaagtgaagg

SEQ ID NO: 39388 - DNA, 20 bp, Artificial Sequence
  Description of Artificial Sequence: Synthetic oligonucleotide
  Target: SCN10A; (+) strand; PAM type: NRG; PAM sequence: AAG
actgccaagtgaaggaagaa

SEQ ID NO: 39389 - DNA, 20 bp, Artificial Sequence
  Description of Artificial Sequence: Synthetic oligonucleotide
  Target: SCN10A; (+) strand; PAM type: NRG; PAM sequence: AAG
ccaagtgaaggaagaaaaga

SEQ ID NO: 39390 - DNA, 20 bp, Artificial Sequence
  Description of Artificial Sequence: Synthetic oligonucleotide
  Target: SCN10A; (+) strand; PAM type: NRG; PAM sequence: AAG
aaggaagaaaagaaagcaaa

SEQ ID NO: 39391 - DNA, 20 bp, Artificial Sequence
  Description of Artificial Sequence: Synthetic oligonucleotide
  Target: SCN10A; (+) strand; PAM type: NRG; PAM sequence: GAG
ggaagaaaagaaagcaaaaa

SEQ ID NO: 39392 - DNA, 20 bp, Artificial Sequence
  Description of Artificial Sequence: Synthetic oligonucleotide
  Target: SCN10A; (+) strand; PAM type: NRG; PAM sequence: TGG
gaaaagaaagcaaaaagaga

SEQ ID NO: 39393 - DNA, 20 bp, Artificial Sequence
  Description of Artificial Sequence: Synthetic oligonucleotide
  Target: SCN10A; (+) strand; PAM type: NRG; PAM sequence: TAG
aagagatggtacaataatga

SEQ ID NO: 39394 - DNA, 20 bp, Artificial Sequence
  Description of Artificial Sequence: Synthetic oligonucleotide
  Target: SCN10A; (+) strand; PAM type: NRG; PAM sequence: TGG
tctactcactcaattttctc

SEQ ID NO: 39395 - DNA, 20 bp, Artificial Sequence
  Description of Artificial Sequence: Synthetic oligonucleotide
  Target: SCN10A; (+) strand; PAM type: NRG; PAM sequence: AAG
actcactcaattttctctgg

SEQ ID NO: 39396 - DNA, 20 bp, Artificial Sequence
  Description of Artificial Sequence: Synthetic oligonucleotide
  Target: SCN10A; (+) strand; PAM type: NRG; PAM sequence: AGG
ctcactcaattttctctgga

SEQ ID NO: 39397 - DNA, 20 bp, Artificial Sequence
  Description of Artificial Sequence: Synthetic oligonucleotide
  Target: SCN10A; (+) strand; PAM type: NRG; PAM sequence: CAG
ctcaattttctctggaaggt

SEQ ID NO: 39398 - DNA, 20 bp, Artificial Sequence
  Description of Artificial Sequence: Synthetic oligonucleotide
  Target: SCN10A; (+) strand; PAM type: NRG; PAM sequence: CGG
ttttctctggaaggtcagtt

SEQ ID NO: 39399 - DNA, 20 bp, Artificial Sequence
  Description of Artificial Sequence: Synthetic oligonucleotide
  Target: SCN10A; (+) strand; PAM type: NRG; PAM sequence: GGG
tttctctggaaggtcagttc

SEQ ID NO: 39400 - DNA, 20 bp, Artificial Sequence
  Description of Artificial Sequence: Synthetic oligonucleotide
  Target: SCN10A; (+) strand; PAM type: NRG; PAM sequence: TAG
gcacacacaattaaccaaaa

SEQ ID NO: 39401 - DNA, 20 bp, Artificial Sequence
  Description of Artificial Sequence: Synthetic oligonucleotide
  Target: SCN10A; (+) strand; PAM type: NRG; PAM sequence: AAG
aaataaactgaaccacctga

SEQ ID NO: 39402 - DNA, 20 bp, Artificial Sequence
  Description of Artificial Sequence: Synthetic oligonucleotide
  Target: SCN10A; (+) strand; PAM type: NRG; PAM sequence: AGG
aataaactgaaccacctgaa

SEQ ID NO: 39403 - DNA, 20 bp, Artificial Sequence
  Description of Artificial Sequence: Synthetic oligonucleotide
  Target: SCN10A; (+) strand; PAM type: NRG; PAM sequence: AAG
ccacctgaaaggcctgtgtt

SEQ ID NO: 39404 - DNA, 20 bp, Artificial Sequence
  Description of Artificial Sequence: Synthetic oligonucleotide
  Target: SCN10A; (+) strand; PAM type: NRG; PAM sequence: AGG
cacctgaaaggcctgtgtta

SEQ ID NO: 39405 - DNA, 20 bp, Artificial Sequence
  Description of Artificial Sequence: Synthetic oligonucleotide
  Target: SCN10A; (+) strand; PAM type: NRG; PAM sequence: AAG
gaaaggcctgtgttaaggaa

SEQ ID NO: 39406 - DNA, 20 bp, Artificial Sequence
  Description of Artificial Sequence: Synthetic oligonucleotide
  Target: SCN10A; (+) strand; PAM type: NRG; PAM sequence: GAG
gcctgtgttaaggaaaagct

SEQ ID NO: 39407 - DNA, 20 bp, Artificial Sequence
  Description of Artificial Sequence: Synthetic oligonucleotide
  Target: SCN10A; (+) strand; PAM type: NRG; PAM sequence: AAG
aaggaaaagctgagatcacc

SEQ ID NO: 39408 - DNA, 20 bp, Artificial Sequence
  Description of Artificial Sequence: Synthetic oligonucleotide
  Target: SCN10A; (+) strand; PAM type: NRG; PAM sequence: TAG
caagtctctgtgatgtcatc

SEQ ID NO: 39409 - DNA, 20 bp, Artificial Sequence
  Description of Artificial Sequence: Synthetic oligonucleotide
  Target: SCN10A; (+) strand; PAM type: NRG; PAM sequence: AGG
aagtctctgtgatgtcatct

SEQ ID NO: 39410 - DNA, 20 bp, Artificial Sequence
  Description of Artificial Sequence: Synthetic oligonucleotide
  Target: SCN10A; (+) strand; PAM type: NRG; PAM sequence: TAG
atgattacattcataaatct

SEQ ID NO: 39411 - DNA, 20 bp, Artificial Sequence
  Description of Artificial Sequence: Synthetic oligonucleotide
  Target: SCN10A; (+) strand; PAM type: NRG; PAM sequence: TAG
tcataaatcttagccaatat

SEQ ID NO: 39412 - DNA, 20 bp, Artificial Sequence
  Description of Artificial Sequence: Synthetic oligonucleotide
  Target: SCN10A; (+) strand; PAM type: NRG; PAM sequence: GAG
aataaccactaacatttact

SEQ ID NO: 39413 - DNA, 20 bp, Artificial Sequence
  Description of Artificial Sequence: Synthetic oligonucleotide
  Target: SCN10A; (+) strand; PAM type: NRG; PAM sequence: AAG
ctaacatttactgagtgcct

SEQ ID NO: 39414 - DNA, 20 bp, Artificial Sequence
  Description of Artificial Sequence: Synthetic oligonucleotide
  Target: SCN10A; (+) strand; PAM type: NRG; PAM sequence: TAG
catttactgagtgcctaagc

SEQ ID NO: 39415 - DNA, 20 bp, Artificial Sequence
  Description of Artificial Sequence: Synthetic oligonucleotide
  Target: SCN10A; (+) strand; PAM type: NRG; PAM sequence: AGG
atttactgagtgcctaagct

SEQ ID NO: 39416 - DNA, 20 bp, Artificial Sequence
  Description of Artificial Sequence: Synthetic oligonucleotide
  Target: SCN10A; (+) strand; PAM type: NRG; PAM sequence: GAG
ctgagtgcctaagctaggct

SEQ ID NO: 39417 - DNA, 20 bp, Artificial Sequence
  Description of Artificial Sequence: Synthetic oligonucleotide
  Target: SCN10A; (+) strand; PAM type: NRG; PAM sequence: CAG
cttctaatacaactgatcta

SEQ ID NO: 39418 - DNA, 20 bp, Artificial Sequence
  Description of Artificial Sequence: Synthetic oligonucleotide
  Target: SCN10A; (+) strand; PAM type: NRG; PAM sequence: AGG
ttctaatacaactgatctac

SEQ ID NO: 39419 - DNA, 20 bp, Artificial Sequence
  Description of Artificial Sequence: Synthetic oligonucleotide
  Target: SCN10A; (+) strand; PAM type: NRG; PAM sequence: TGG
taatacaactgatctacagg

SEQ ID NO: 39420 - DNA, 20 bp, Artificial Sequence
  Description of Artificial Sequence: Synthetic oligonucleotide
  Target: SCN10A; (+) strand; PAM type: NRG; PAM sequence: GGG
aatacaactgatctacaggt

SEQ ID NO: 39421 - DNA, 20 bp, Artificial Sequence
  Description of Artificial Sequence: Synthetic oligonucleotide
  Target: SCN10A; (+) strand; PAM type: NRG; PAM sequence: AAG
gtataaatatctacattttg

SEQ ID NO: 39422 - DNA, 20 bp, Artificial Sequence
  Description of Artificial Sequence: Synthetic oligonucleotide
  Target: SCN10A; (+) strand; PAM type: NRG; PAM sequence: GAG
aatatctacattttgaagct

SEQ ID NO: 39423 - DNA, 20 bp, Artificial Sequence
  Description of Artificial Sequence: Synthetic oligonucleotide
  Target: SCN10A; (+) strand; PAM type: NRG; PAM sequence: CAG
tacattttgaagctgagaaa

SEQ ID NO: 39424 - DNA, 20 bp, Artificial Sequence
  Description of Artificial Sequence: Synthetic oligonucleotide
  Target: SCN10A; (+) strand; PAM type: NRG; PAM sequence: AGG
acattttgaagctgagaaac

SEQ ID NO: 39425 - DNA, 20 bp, Artificial Sequence
  Description of Artificial Sequence: Synthetic oligonucleotide
  Target: SCN10A; (+) strand; PAM type: NRG; PAM sequence: AAG
aacaggctgacaaaaaataa

SEQ ID NO: 39426 - DNA, 20 bp, Artificial Sequence
  Description of Artificial Sequence: Synthetic oligonucleotide
  Target: SCN10A; (+) strand; PAM type: NRG; PAM sequence: CAG
aaaagttaaataacttttct

SEQ ID NO: 39427 - DNA, 20 bp, Artificial Sequence
  Description of Artificial Sequence: Synthetic oligonucleotide
  Target: SCN10A; (+) strand; PAM type: NRG; PAM sequence: AGG
aaagttaaataacttttctc

SEQ ID NO: 39428 - DNA, 20 bp, Artificial Sequence
  Description of Artificial Sequence: Synthetic oligonucleotide
  Target: SCN10A; (+) strand; PAM type: NRG; PAM sequence: CAG
ataacttttctcaggtcatg

SEQ ID NO: 39429 - DNA, 20 bp, Artificial Sequence
  Description of Artificial Sequence: Synthetic oligonucleotide
  Target: SCN10A; (+) strand; PAM type: NRG; PAM sequence: TAG
cttttctcaggtcatgcagc

SEQ ID NO: 39430 - DNA, 20 bp, Artificial Sequence
  Description of Artificial Sequence: Synthetic oligonucleotide
  Target: SCN10A; (+) strand; PAM type: NRG; PAM sequence: CAG
gcagctagtcaaccatgctg

SEQ ID NO: 39431 - DNA, 20 bp, Artificial Sequence
  Description of Artificial Sequence: Synthetic oligonucleotide
  Target: SCN10A; (+) strand; PAM type: NRG; PAM sequence: GAG
agctagtcaaccatgctgca

SEQ ID NO: 39432 - DNA, 20 bp, Artificial Sequence
  Description of Artificial Sequence: Synthetic oligonucleotide
  Target: SCN10A; (+) strand; PAM type: NRG; PAM sequence: GAG
tctgtttgataacaaactct

SEQ ID NO: 39433 - DNA, 20 bp, Artificial Sequence
  Description of Artificial Sequence: Synthetic oligonucleotide
  Target: SCN10A; (+) strand; PAM type: NRG; PAM sequence: AAG
tttgataacaaactctgagc

SEQ ID NO: 39434 - DNA, 20 bp, Artificial Sequence
  Description of Artificial Sequence: Synthetic oligonucleotide
  Target: SCN10A; (+) strand; PAM type: NRG; PAM sequence: TAG
ataacaaactctgagcaaga

SEQ ID NO: 39435 - DNA, 20 bp, Artificial Sequence
  Description of Artificial Sequence: Synthetic oligonucleotide
  Target: SCN10A; (+) strand; PAM type: NRG; PAM sequence: AAG
acaaactctgagcaagatag

SEQ ID NO: 39436 - DNA, 20 bp, Artificial Sequence
  Description of Artificial Sequence: Synthetic oligonucleotide
  Target: SCN10A; (+) strand; PAM type: NRG; PAM sequence: AGG
caaactctgagcaagataga

SEQ ID NO: 39437 - DNA, 20 bp, Artificial Sequence
  Description of Artificial Sequence: Synthetic oligonucleotide
  Target: SCN10A; (+) strand; PAM type: NRG; PAM sequence: CAG
ctgagcaagatagaaggaaa

SEQ ID NO: 39438 - DNA, 20 bp, Artificial Sequence
  Description of Artificial Sequence: Synthetic oligonucleotide
  Target: SCN10A; (+) strand; PAM type: NRG; PAM sequence: AAG
caaaatgtccttctgccccg

SEQ ID NO: 39439 - DNA, 20 bp, Artificial Sequence
  Description of Artificial Sequence: Synthetic oligonucleotide
  Target: SCN10A; (+) strand; PAM type: NRG; PAM sequence: CAG
ctgccccgaagccttcattt

SEQ ID NO: 39440 - DNA, 20 bp, Artificial Sequence
  Description of Artificial Sequence: Synthetic oligonucleotide
  Target: SCN10A; (+) strand; PAM type: NRG; PAM sequence: TGG
cttcatttcagtatacaaaa

SEQ ID NO: 39441 - DNA, 20 bp, Artificial Sequence
  Description of Artificial Sequence: Synthetic oligonucleotide
  Target: SCN10A; (+) strand; PAM type: NRG; PAM sequence: TGG
aaatggcctgaaatttcatc

SEQ ID NO: 39442 - DNA, 20 bp, Artificial Sequence
  Description of Artificial Sequence: Synthetic oligonucleotide
  Target: SCN10A; (+) strand; PAM type: NRG; PAM sequence: AAG
aaatgtcttttttattctaa

SEQ ID NO: 39443 - DNA, 20 bp, Artificial Sequence
  Description of Artificial Sequence: Synthetic oligonucleotide
  Target: SCN10A; (+) strand; PAM type: NRG; PAM sequence: AAG
cttttttattctaaaagaca

SEQ ID NO: 39444 - DNA, 20 bp, Artificial Sequence
  Description of Artificial Sequence: Synthetic oligonucleotide
  Target: SCN10A; (+) strand; PAM type: NRG; PAM sequence: AAG
ttattctaaaagacaaagaa

SEQ ID NO: 39445 - DNA, 20 bp, Artificial Sequence
  Description of Artificial Sequence: Synthetic oligonucleotide
  Target: SCN10A; (+) strand; PAM type: NRG; PAM sequence: TAG
tctaaaagacaaagaaaagt

SEQ ID NO: 39446 - DNA, 20 bp, Artificial Sequence
  Description of Artificial Sequence: Synthetic oligonucleotide
  Target: SCN10A; (+) strand; PAM type: NRG; PAM sequence: TGG
acaaagaaaagttagaaact

SEQ ID NO: 39447 - DNA, 20 bp, Artificial Sequence
  Description of Artificial Sequence: Synthetic oligonucleotide
  Target: SCN10A; (+) strand; PAM type: NRG; PAM sequence: GAG
aaagaaaagttagaaacttg

SEQ ID NO: 39448 - DNA, 20 bp, Artificial Sequence
  Description of Artificial Sequence: Synthetic oligonucleotide
  Target: SCN10A; (+) strand; PAM type: NRG; PAM sequence: AAG
aaagttagaaacttggagat

SEQ ID NO: 39449 - DNA, 20 bp, Artificial Sequence
  Description of Artificial Sequence: Synthetic oligonucleotide
  Target: SCN10A; (+) strand; PAM type: NRG; PAM sequence: AAG
tagaaacttggagataagtg

SEQ ID NO: 39450 - DNA, 20 bp, Artificial Sequence
  Description of Artificial Sequence: Synthetic oligonucleotide
  Target: SCN10A; (+) strand; PAM type: NRG; PAM sequence: GAG
gaaacttggagataagtgaa

SEQ ID NO: 39451 - DNA, 20 bp, Artificial Sequence
  Description of Artificial Sequence: Synthetic oligonucleotide
  Target: SCN10A; (+) strand; PAM type: NRG; PAM sequence: AGG
aaacttggagataagtgaag

SEQ ID NO: 39452 - DNA, 20 bp, Artificial Sequence
  Description of Artificial Sequence: Synthetic oligonucleotide
  Target: SCN10A; (+) strand; PAM type: NRG; PAM sequence: TGG
tgaagaggtacaaactttca

SEQ ID NO: 39453 - DNA, 20 bp, Artificial Sequence
  Description of Artificial Sequence: Synthetic oligonucleotide
  Target: SCN10A; (+) strand; PAM type: NRG; PAM sequence: GGG
gaagaggtacaaactttcat

SEQ ID NO: 39454 - DNA, 20 bp, Artificial Sequence
  Description of Artificial Sequence: Synthetic oligonucleotide
  Target: SCN10A; (+) strand; PAM type: NRG; PAM sequence: TAG
gtacaaactttcatgggaat

SEQ ID NO: 39455 - DNA, 20 bp, Artificial Sequence
  Description of Artificial Sequence: Synthetic oligonucleotide
  Target: SCN10A; (+) strand; PAM type: NRG; PAM sequence: CAG
ttcatgggaattagtttcat

SEQ ID NO: 39456 - DNA, 20 bp, Artificial Sequence
  Description of Artificial Sequence: Synthetic oligonucleotide
  Target: SCN10A; (+) strand; PAM type: NRG; PAM sequence: TGG
attagtttcatcagattgtt

SEQ ID NO: 39457 - DNA, 20 bp, Artificial Sequence
  Description of Artificial Sequence: Synthetic oligonucleotide
  Target: SCN10A; (+) strand; PAM type: NRG; PAM sequence: GGG
ttagtttcatcagattgttt

SEQ ID NO: 39458 - DNA, 20 bp, Artificial Sequence
  Description of Artificial Sequence: Synthetic oligonucleotide
  Target: SCN10A; (+) strand; PAM type: NRG; PAM sequence: TAG
atcagattgtttgggtaact

SEQ ID NO: 39459 - DNA, 20 bp, Artificial Sequence
  Description of Artificial Sequence: Synthetic oligonucleotide
  Target: SCN10A; (+) strand; PAM type: NRG; PAM sequence: GAG
attgtttgggtaacttagtt

SEQ ID NO: 39460 - DNA, 20 bp, Artificial Sequence
  Description of Artificial Sequence: Synthetic oligonucleotide
  Target: SCN10A; (+) strand; PAM type: NRG; PAM sequence: CAG
ttgggtaacttagttgagat

SEQ ID NO: 39461 - DNA, 20 bp, Artificial Sequence
  Description of Artificial Sequence: Synthetic oligonucleotide
  Target: SCN10A; (+) strand; PAM type: NRG; PAM sequence: GAG
tagttgagatcagttccacc

SEQ ID NO: 39462 - DNA, 20 bp, Artificial Sequence
  Description of Artificial Sequence: Synthetic oligonucleotide
  Target: SCN10A; (+) strand; PAM type: NRG; PAM sequence: AGG
agttgagatcagttccaccg

SEQ ID NO: 39463 - DNA, 20 bp, Artificial Sequence
  Description of Artificial Sequence: Synthetic oligonucleotide
  Target: SCN10A; (+) strand; PAM type: NRG; PAM sequence: TGG
gatcagttccaccgaggaaa

SEQ ID NO: 39464 - DNA, 20 bp, Artificial Sequence
  Description of Artificial Sequence: Synthetic oligonucleotide
  Target: SCN10A; (+) strand; PAM type: NRG; PAM sequence: TGG
ccaccgaggaaatggtcttc

SEQ ID NO: 39465 - DNA, 20 bp, Artificial Sequence
  Description of Artificial Sequence: Synthetic oligonucleotide
  Target: SCN10A; (+) strand; PAM type: NRG; PAM sequence: GGG
caccgaggaaatggtcttct

SEQ ID NO: 39466 - DNA, 20 bp, Artificial Sequence
  Description of Artificial Sequence: Synthetic oligonucleotide
  Target: SCN10A; (+) strand; PAM type: NRG; PAM sequence: TAG
cgaggaaatggtcttctggg

SEQ ID NO: 39467 - DNA, 20 bp, Artificial Sequence
  Description of Artificial Sequence: Synthetic oligonucleotide
  Target: SCN10A; (+) strand; PAM type: NRG; PAM sequence: AGG
gaggaaatggtcttctgggt

SEQ ID NO: 39468 - DNA, 20 bp, Artificial Sequence
  Description of Artificial Sequence: Synthetic oligonucleotide
  Target: SCN10A; (+) strand; PAM type: NRG; PAM sequence: CGG
aatggtcttctgggtaggaa

SEQ ID NO: 39469 - DNA, 20 bp, Artificial Sequence
  Description of Artificial Sequence: Synthetic oligonucleotide
  Target: SCN10A; (+) strand; PAM type: NRG; PAM sequence: TGG
ggtcttctgggtaggaacgg

SEQ ID NO: 39470 - DNA, 20 bp, Artificial Sequence
  Description of Artificial Sequence: Synthetic oligonucleotide
  Target: SCN10A; (+) strand; PAM type: NRG; PAM sequence: GAG
tcttctgggtaggaacggtg

SEQ ID NO: 39471 - DNA, 20 bp, Artificial Sequence
  Description of Artificial Sequence: Synthetic oligonucleotide
  Target: SCN10A; (+) strand; PAM type: NRG; PAM sequence: AGG
cttctgggtaggaacggtgg

SEQ ID NO: 39472 - DNA, 20 bp, Artificial Sequence
  Description of Artificial Sequence: Synthetic oligonucleotide
  Target: SCN10A; (+) strand; PAM type: NRG; PAM sequence: CAG
ctgggtaggaacggtggagg

SEQ ID NO: 39473 - DNA, 20 bp, Artificial Sequence
  Description of Artificial Sequence: Synthetic oligonucleotide
  Target: SCN10A; (+) strand; PAM type: NRG; PAM sequence: AGG
tgggtaggaacggtggaggc

SEQ ID NO: 39474 - DNA, 20 bp, Artificial Sequence
  Description of Artificial Sequence: Synthetic oligonucleotide
  Target: SCN10A; (+) strand; PAM type: NRG; PAM sequence: CAG
aggaacggtggaggcaggca

SEQ ID NO: 39475 - DNA, 20 bp, Artificial Sequence
  Description of Artificial Sequence: Synthetic oligonucleotide
  Target: SCN10A; (+) strand; PAM type: NRG; PAM sequence: AGG
ggaacggtggaggcaggcac

SEQ ID NO: 39476 - DNA, 20 bp, Artificial Sequence
  Description of Artificial Sequence: Synthetic oligonucleotide
  Target: SCN10A; (+) strand; PAM type: NRG; PAM sequence: GGG
gaacggtggaggcaggcaca

SEQ ID NO: 39477 - DNA, 20 bp, Artificial Sequence
  Description of Artificial Sequence: Synthetic oligonucleotide
  Target: SCN10A; (+) strand; PAM type: NRG; PAM sequence: TGG
ggcacagggaaatgaaatac

SEQ ID NO: 39478 - DNA, 20 bp, Artificial Sequence
  Description of Artificial Sequence: Synthetic oligonucleotide
  Target: SCN10A; (+) strand; PAM type: NRG; PAM sequence: CAG
agggaaatgaaatactggct

SEQ ID NO: 39479 - DNA, 20 bp, Artificial Sequence
  Description of Artificial Sequence: Synthetic oligonucleotide
  Target: SCN10A; (+) strand; PAM type: NRG; PAM sequence: AGG
gggaaatgaaatactggctc

SEQ ID NO: 39480 - DNA, 20 bp, Artificial Sequence
  Description of Artificial Sequence: Synthetic oligonucleotide
  Target: SCN10A; (+) strand; PAM type: NRG; PAM sequence: AAG
aaatgaaatactggctcagg

SEQ ID NO: 39481 - DNA, 20 bp, Artificial Sequence
  Description of Artificial Sequence: Synthetic oligonucleotide
  Target: SCN10A; (+) strand; PAM type: NRG; PAM sequence: AAG
tggctcaggaagaaaacccc

SEQ ID NO: 39482 - DNA, 20 bp, Artificial Sequence
  Description of Artificial Sequence: Synthetic oligonucleotide
  Target: SCN10A; (+) strand; PAM type: NRG; PAM sequence: TAG
ctcaggaagaaaaccccaag

SEQ ID NO: 39483 - DNA, 20 bp, Artificial Sequence
  Description of Artificial Sequence: Synthetic oligonucleotide
  Target: SCN10A; (+) strand; PAM type: NRG; PAM sequence: AGG
tcaggaagaaaaccccaagt

SEQ ID NO: 39484 - DNA, 20 bp, Artificial Sequence
  Description of Artificial Sequence: Synthetic oligonucleotide
  Target: SCN10A; (+) strand; PAM type: NRG; PAM sequence: TAG
aagaaaaccccaagtaggat

SEQ ID NO: 39485 - DNA, 20 bp, Artificial Sequence
  Description of Artificial Sequence: Synthetic oligonucleotide
  Target: SCN10A; (+) strand; PAM type: NRG; PAM sequence: AGG
agaaaaccccaagtaggatt

SEQ ID NO: 39486 - DNA, 20 bp, Artificial Sequence
  Description of Artificial Sequence: Synthetic oligonucleotide
  Target: SCN10A; (+) strand; PAM type: NRG; PAM sequence: TGG
aaccccaagtaggattaggc

SEQ ID NO: 39487 - DNA, 20 bp, Artificial Sequence
  Description of Artificial Sequence: Synthetic oligonucleotide
  Target: SCN10A; (+) strand; PAM type: NRG; PAM sequence: GAG
ccccaagtaggattaggctg

SEQ ID NO: 39488 - DNA, 20 bp, Artificial Sequence
  Description of Artificial Sequence: Synthetic oligonucleotide
  Target: SCN10A; (+) strand; PAM type: NRG; PAM sequence: TGG
caagtaggattaggctggag

SEQ ID NO: 39489 - DNA, 20 bp, Artificial Sequence
  Description of Artificial Sequence: Synthetic oligonucleotide
  Target: SCN10A; (+) strand; PAM type: NRG; PAM sequence: GAG
agtaggattaggctggagtg

SEQ ID NO: 39490 - DNA, 20 bp, Artificial Sequence
  Description of Artificial Sequence: Synthetic oligonucleotide
  Target: SCN10A; (+) strand; PAM type: NRG; PAM sequence: TAG
ctggagtggagaactctgaa

SEQ ID NO: 39491 - DNA, 20 bp, Artificial Sequence
  Description of Artificial Sequence: Synthetic oligonucleotide
  Target: SCN10A; (+) strand; PAM type: NRG; PAM sequence: TAG
agtggagaactctgaatagc

SEQ ID NO: 39492 - DNA, 20 bp, Artificial Sequence
  Description of Artificial Sequence: Synthetic oligonucleotide
  Target: SCN10A; (+) strand; PAM type: NRG; PAM sequence: GAG
tggagaactctgaatagcta

SEQ ID NO: 39493 - DNA, 20 bp, Artificial Sequence
  Description of Artificial Sequence: Synthetic oligonucleotide
  Target: SCN10A; (+) strand; PAM type: NRG; PAM sequence: TGG
agaactctgaatagctagag

SEQ ID NO: 39494 - DNA, 20 bp, Artificial Sequence
  Description of Artificial Sequence: Synthetic oligonucleotide
  Target: SCN10A; (+) strand; PAM type: NRG; PAM sequence: GAG
aactctgaatagctagagtg

SEQ ID NO: 39495 - DNA, 20 bp, Artificial Sequence
  Description of Artificial Sequence: Synthetic oligonucleotide
  Target: SCN10A; (+) strand; PAM type: NRG; PAM sequence: CAG
gctagagtggagaatattga

SEQ ID NO: 39496 - DNA, 20 bp, Artificial Sequence
  Description of Artificial Sequence: Synthetic oligonucleotide
  Target: SCN10A; (+) strand; PAM type: NRG; PAM sequence: CAG
agagtggagaatattgacag

SEQ ID NO: 39497 - DNA, 20 bp, Artificial Sequence
  Description of Artificial Sequence: Synthetic oligonucleotide
  Target: SCN10A; (+) strand; PAM type: NRG; PAM sequence: TGG
agaatattgacagcagacta

SEQ ID NO: 39498 - DNA, 20 bp, Artificial Sequence
  Description of Artificial Sequence: Synthetic oligonucleotide
  Target: SCN10A; (+) strand; PAM type: NRG; PAM sequence: GGG
gaatattgacagcagactat

SEQ ID NO: 39499 - DNA, 20 bp, Artificial Sequence
  Description of Artificial Sequence: Synthetic oligonucleotide
  Target: SCN10A; (+) strand; PAM type: NRG; PAM sequence: AAG
ttgacagcagactatgggca

SEQ ID NO: 39500 - DNA, 20 bp, Artificial Sequence
  Description of Artificial Sequence: Synthetic oligonucleotide
  Target: SCN10A; (+) strand; PAM type: NRG; PAM sequence: AGG
tgacagcagactatgggcaa

SEQ ID NO: 39501 - DNA, 20 bp, Artificial Sequence
  Description of Artificial Sequence: Synthetic oligonucleotide
  Target: SCN10A; (+) strand; PAM type: NRG; PAM sequence: GGG
gacagcagactatgggcaaa

SEQ ID NO: 39502 - DNA, 20 bp, Artificial Sequence
  Description of Artificial Sequence: Synthetic oligonucleotide
  Target: SCN10A; (+) strand; PAM type: NRG; PAM sequence: AAG
atgggcaaagggattatcaa

SEQ ID NO: 39503 - DNA, 20 bp, Artificial Sequence
  Description of Artificial Sequence: Synthetic oligonucleotide
  Target: SCN10A; (+) strand; PAM type: NRG; PAM sequence: AGG
tgggcaaagggattatcaaa

SEQ ID NO: 39504 - DNA, 20 bp, Artificial Sequence
  Description of Artificial Sequence: Synthetic oligonucleotide
  Target: SCN10A; (+) strand; PAM type: NRG; PAM sequence: GGG
gggcaaagggattatcaaaa

SEQ ID NO: 39505 - DNA, 20 bp, Artificial Sequence
  Description of Artificial Sequence: Synthetic oligonucleotide
  Target: SCN10A; (+) strand; PAM type: NRG; PAM sequence: GGG
ggcaaagggattatcaaaag

SEQ ID NO: 39506 - DNA, 20 bp, Artificial Sequence
  Description of Artificial Sequence: Synthetic oligonucleotide
  Target: SCN10A; (+) strand; PAM type: NRG; PAM sequence: GAG
caaagggattatcaaaaggg

SEQ ID NO: 39507 - DNA, 20 bp, Artificial Sequence
  Description of Artificial Sequence: Synthetic oligonucleotide
  Target: SCN10A; (+) strand; PAM type: NRG; PAM sequence: AGG
aaagggattatcaaaagggg

SEQ ID NO: 39508 - DNA, 20 bp, Artificial Sequence
  Description of Artificial Sequence: Synthetic oligonucleotide
  Target: SCN10A; (+) strand; PAM type: NRG; PAM sequence: GGG
aagggattatcaaaagggga

SEQ ID NO: 39509 - DNA, 20 bp, Artificial Sequence
  Description of Artificial Sequence: Synthetic oligonucleotide
  Target: SCN10A; (+) strand; PAM type: NRG; PAM sequence: GAG
gggattatcaaaaggggagg

SEQ ID NO: 39510 - DNA, 20 bp, Artificial Sequence
  Description of Artificial Sequence: Synthetic oligonucleotide
  Target: SCN10A; (+) strand; PAM type: NRG; PAM sequence: AAG
aaaggggagggagacattga

SEQ ID NO: 39511 - DNA, 20 bp, Artificial Sequence
  Description of Artificial Sequence: Synthetic oligonucleotide
  Target: SCN10A; (+) strand; PAM type: NRG; PAM sequence: AGG
aaggggagggagacattgaa

SEQ ID NO: 39512 - DNA, 20 bp, Artificial Sequence
  Description of Artificial Sequence: Synthetic oligonucleotide
  Target: SCN10A; (+) strand; PAM type: NRG; PAM sequence: AAG
gggagggagacattgaaagg

SEQ ID NO: 39513 - DNA, 20 bp, Artificial Sequence
  Description of Artificial Sequence: Synthetic oligonucleotide
  Target: SCN10A; (+) strand; PAM type: NRG; PAM sequence: AGG
ggagggagacattgaaagga

SEQ ID NO: 39514 - DNA, 20 bp, Artificial Sequence
  Description of Artificial Sequence: Synthetic oligonucleotide
  Target: SCN10A; (+) strand; PAM type: NRG; PAM sequence: TGG
gggagacattgaaaggaagg

SEQ ID NO: 39515 - DNA, 20 bp, Artificial Sequence
  Description of Artificial Sequence: Synthetic oligonucleotide
  Target: SCN10A; (+) strand; PAM type: NRG; PAM sequence: GGG
ggagacattgaaaggaaggt

SEQ ID NO: 39516 - DNA, 20 bp, Artificial Sequence
  Description of Artificial Sequence: Synthetic oligonucleotide
  Target: SCN10A; (+) strand; PAM type: NRG; PAM sequence: TGG
gacattgaaaggaaggtggg

SEQ ID NO: 39517 - DNA, 20 bp, Artificial Sequence
  Description of Artificial Sequence: Synthetic oligonucleotide
  Target: SCN10A; (+) strand; PAM type: NRG; PAM sequence: AAG
attgaaaggaaggtgggtgg

SEQ ID NO: 39518 - DNA, 20 bp, Artificial Sequence
  Description of Artificial Sequence: Synthetic oligonucleotide
  Target: SCN10A; (+) strand; PAM type: NRG; PAM sequence: AGG
ttgaaaggaaggtgggtgga

SEQ ID NO: 39519 - DNA, 20 bp, Artificial Sequence
  Description of Artificial Sequence: Synthetic oligonucleotide
  Target: SCN10A; (+) strand; PAM type: NRG; PAM sequence: GGG
tgaaaggaaggtgggtggaa

SEQ ID NO: 39520 - DNA, 20 bp, Artificial Sequence
  Description of Artificial Sequence: Synthetic oligonucleotide
  Target: SCN10A; (+) strand; PAM type: NRG; PAM sequence: GGG
gaaaggaaggtgggtggaag

SEQ ID NO: 39521 - DNA, 20 bp, Artificial Sequence
  Description of Artificial Sequence: Synthetic oligonucleotide
  Target: SCN10A; (+) strand; PAM type: NRG; PAM sequence: TAG
aggtgggtggaaggggaaaa

SEQ ID NO: 39522 - DNA, 20 bp, Artificial Sequence
  Description of Artificial Sequence: Synthetic oligonucleotide
  Target: SCN10A; (+) strand; PAM type: NRG; PAM sequence: AAG
tgggtggaaggggaaaatag

SEQ ID NO: 39523 - DNA, 20 bp, Artificial Sequence
  Description of Artificial Sequence: Synthetic oligonucleotide
  Target: SCN10A; (+) strand; PAM type: NRG; PAM sequence: AGG
gggtggaaggggaaaataga

SEQ ID NO: 39524 - DNA, 20 bp, Artificial Sequence
  Description of Artificial Sequence: Synthetic oligonucleotide
  Target: SCN10A; (+) strand; PAM type: NRG; PAM sequence: GGG
ggtggaaggggaaaatagaa

SEQ ID NO: 39525 - DNA, 20 bp, Artificial Sequence
  Description of Artificial Sequence: Synthetic oligonucleotide
  Target: SCN10A; (+) strand; PAM type: NRG; PAM sequence: AAG
ggaaggggaaaatagaaggg

SEQ ID NO: 39526 - DNA, 20 bp, Artificial Sequence
  Description of Artificial Sequence: Synthetic oligonucleotide
  Target: SCN10A; (+) strand; PAM type: NRG; PAM sequence: TGG
aaatagaagggaagaaatgt

SEQ ID NO: 39527 - DNA, 20 bp, Artificial Sequence
  Description of Artificial Sequence: Synthetic oligonucleotide
  Target: SCN10A; (+) strand; PAM type: NRG; PAM sequence: TGG
tagaagggaagaaatgttgg

SEQ ID NO: 39528 - DNA, 20 bp, Artificial Sequence
  Description of Artificial Sequence: Synthetic oligonucleotide
  Target: SCN10A; (+) strand; PAM type: NRG; PAM sequence: GGG
agaagggaagaaatgttggt

SEQ ID NO: 39529 - DNA, 20 bp, Artificial Sequence
  Description of Artificial Sequence: Synthetic oligonucleotide
  Target: SCN10A; (+) strand; PAM type: NRG; PAM sequence: GGG
gaagggaagaaatgttggtg

SEQ ID NO: 39530 - DNA, 20 bp, Artificial Sequence
  Description of Artificial Sequence: Synthetic oligonucleotide
  Target: SCN10A; (+) strand; PAM type: NRG; PAM sequence: GAG
agggaagaaatgttggtggg

SEQ ID NO: 39531 - DNA, 20 bp, Artificial Sequence
  Description of Artificial Sequence: Synthetic oligonucleotide
  Target: SCN10A; (+) strand; PAM type: NRG; PAM sequence: AAG
atgttggtggggagaatcta

SEQ ID NO: 39532 - DNA, 20 bp, Artificial Sequence
  Description of Artificial Sequence: Synthetic oligonucleotide
  Target: SCN10A; (+) strand; PAM type: NRG; PAM sequence: AGG
tgttggtggggagaatctaa

SEQ ID NO: 39533 - DNA, 20 bp, Artificial Sequence
  Description of Artificial Sequence: Synthetic oligonucleotide
  Target: SCN10A; (+) strand; PAM type: NRG; PAM sequence: TGG
aaaggtaaattgttcccact

SEQ ID NO: 39534 - DNA, 20 bp, Artificial Sequence
  Description of Artificial Sequence: Synthetic oligonucleotide
  Target: SCN10A; (+) strand; PAM type: NRG; PAM sequence: TAG
tcccacttggacatttttct

SEQ ID NO: 39535 - DNA, 20 bp, Artificial Sequence
  Description of Artificial Sequence: Synthetic oligonucleotide
  Target: SCN10A; (+) strand; PAM type: NRG; PAM sequence: AGG
cccacttggacatttttctt

SEQ ID NO: 39536 - DNA, 20 bp, Artificial Sequence
  Description of Artificial Sequence: Synthetic oligonucleotide
  Target: SCN10A; (+) strand; PAM type: NRG; PAM sequence: TAG
ttggacatttttcttaggaa

SEQ ID NO: 39537 - DNA, 20 bp, Artificial Sequence
  Description of Artificial Sequence: Synthetic oligonucleotide
  Target: SCN10A; (+) strand; PAM type: NRG; PAM sequence: TGG
acatttttcttaggaatagc

SEQ ID NO: 39538 - DNA, 20 bp, Artificial Sequence
  Description of Artificial Sequence: Synthetic oligonucleotide
  Target: SCN10A; (+) strand; PAM type: NRG; PAM sequence: GGG
catttttcttaggaatagct

SEQ ID NO: 39539 - DNA, 20 bp, Artificial Sequence
  Description of Artificial Sequence: Synthetic oligonucleotide
  Target: SCN10A; (+) strand; PAM type: NRG; PAM sequence: CAG
aggaatagctgggctcccaa

SEQ ID NO: 39540 - DNA, 20 bp, Artificial Sequence
  Description of Artificial Sequence: Synthetic oligonucleotide
  Target: SCN10A; (+) strand; PAM type: NRG; PAM sequence: AAG
ggctcccaacagtgcttcct

SEQ ID NO: 39541 - DNA, 20 bp, Artificial Sequence
  Description of Artificial Sequence: Synthetic oligonucleotide
  Target: SCN10A; (+) strand; PAM type: NRG; PAM sequence: AGG
gctcccaacagtgcttccta

SEQ ID NO: 39542 - DNA, 20 bp, Artificial Sequence
  Description of Artificial Sequence: Synthetic oligonucleotide
  Target: SCN10A; (+) strand; PAM type: NRG; PAM sequence: AAG
ctaaggaaaaataaaacttg

SEQ ID NO: 39543 - DNA, 20 bp, Artificial Sequence
  Description of Artificial Sequence: Synthetic oligonucleotide
  Target: SCN10A; (+) strand; PAM type: NRG; PAM sequence: CAG
ttgaagataaacttgaccta

SEQ ID NO: 39544 - DNA, 20 bp, Artificial Sequence
  Description of Artificial Sequence: Synthetic oligonucleotide
  Target: SCN10A; (+) strand; PAM type: NRG; PAM sequence: GAG
gaagataaacttgacctaca

SEQ ID NO: 39545 - DNA, 20 bp, Artificial Sequence
  Description of Artificial Sequence: Synthetic oligonucleotide
  Target: SCN10A; (+) strand; PAM type: NRG; PAM sequence: GAG
agataaacttgacctacaga

SEQ ID NO: 39546 - DNA, 20 bp, Artificial Sequence
  Description of Artificial Sequence: Synthetic oligonucleotide
  Target: SCN10A; (+) strand; PAM type: NRG; PAM sequence: GAG
ataaacttgacctacagaga

SEQ ID NO: 39547 - DNA, 20 bp, Artificial Sequence
  Description of Artificial Sequence: Synthetic oligonucleotide
  Target: SCN10A; (+) strand; PAM type: NRG; PAM sequence: GAG
caacactcatttttcaattt

SEQ ID NO: 39548 - DNA, 20 bp, Artificial Sequence
  Description of Artificial Sequence: Synthetic oligonucleotide
  Target: SCN10A; (+) strand; PAM type: NRG; PAM sequence: CAG
cactcatttttcaatttgag

SEQ ID NO: 39549 - DNA, 20 bp, Artificial Sequence
  Description of Artificial Sequence: Synthetic oligonucleotide
  Target: SCN10A; (+) strand; PAM type: NRG; PAM sequence: AAG
tcatttttcaatttgagcag

SEQ ID NO: 39550 - DNA, 20 bp, Artificial Sequence
  Description of Artificial Sequence: Synthetic oligonucleotide
  Target: SCN10A; (+) strand; PAM type: NRG; PAM sequence: TAG
agaagtatttaaatgtattt

SEQ ID NO: 39551 - DNA, 20 bp, Artificial Sequence
  Description of Artificial Sequence: Synthetic oligonucleotide
  Target: SCN10A; (+) strand; PAM type: NRG; PAM sequence: TAG
tgtaaatgccttgatgtgtc

SEQ ID NO: 39552 - DNA, 20 bp, Artificial Sequence
  Description of Artificial Sequence: Synthetic oligonucleotide
  Target: SCN10A; (+) strand; PAM type: NRG; PAM sequence: CAG
ccttgatgtgtctagtttta

SEQ ID NO: 39553 - DNA, 20 bp, Artificial Sequence
  Description of Artificial Sequence: Synthetic oligonucleotide
  Target: SCN10A; (+) strand; PAM type: NRG; PAM sequence: TAG
tgtctagttttacagttact

SEQ ID NO: 39554 - DNA, 20 bp, Artificial Sequence
  Description of Artificial Sequence: Synthetic oligonucleotide
  Target: SCN10A; (+) strand; PAM type: NRG; PAM sequence: AGG
gtctagttttacagttactt

SEQ ID NO: 39555 - DNA, 20 bp, Artificial Sequence
  Description of Artificial Sequence: Synthetic oligonucleotide
  Target: SCN10A; (+) strand; PAM type: NRG; PAM sequence: AAG
aggaacacatctattatgaa

SEQ ID NO: 39556 - DNA, 20 bp, Artificial Sequence
  Description of Artificial Sequence: Synthetic oligonucleotide
  Target: SCN10A; (+) strand; PAM type: NRG; PAM sequence: AGG
ggaacacatctattatgaaa

SEQ ID NO: 39557 - DNA, 20 bp, Artificial Sequence
  Description of Artificial Sequence: Synthetic oligonucleotide
  Target: SCN10A; (+) strand; PAM type: NRG; PAM sequence: AAG
tgctgacttacaattaaatt

SEQ ID NO: 39558 - DNA, 20 bp, Artificial Sequence
  Description of Artificial Sequence: Synthetic oligonucleotide
  Target: SCN10A; (+) strand; PAM type: NRG; PAM sequence: TGG
aattaagaaatatgctcaca

SEQ ID NO: 39559 - DNA, 20 bp, Artificial Sequence
  Description of Artificial Sequence: Synthetic oligonucleotide
  Target: SCN10A; (+) strand; PAM type: NRG; PAM sequence: GGG
attaagaaatatgctcacat

SEQ ID NO: 39560 - DNA, 20 bp, Artificial Sequence
  Description of Artificial Sequence: Synthetic oligonucleotide
  Target: SCN10A; (+) strand; PAM type: NRG; PAM sequence: GGG
ttaagaaatatgctcacatg

SEQ ID NO: 39561 - DNA, 20 bp, Artificial Sequence
  Description of Artificial Sequence: Synthetic oligonucleotide
  Target: SCN10A; (+) strand; PAM type: NRG; PAM sequence: GGG
taagaaatatgctcacatgg

SEQ ID NO: 39562 - DNA, 20 bp, Artificial Sequence
  Description of Artificial Sequence: Synthetic oligonucleotide
  Target: SCN10A; (+) strand; PAM type: NRG; PAM sequence: GGG
aagaaatatgctcacatggg

SEQ ID NO: 39563 - DNA, 20 bp, Artificial Sequence
  Description of Artificial Sequence: Synthetic oligonucleotide
  Target: SCN10A; (+) strand; PAM type: NRG; PAM sequence: AAG
atggggggaaatgttaatcc

SEQ ID NO: 39564 - DNA, 20 bp, Artificial Sequence
  Description of Artificial Sequence: Synthetic oligonucleotide
  Target: SCN10A; (+) strand; PAM type: NRG; PAM sequence: AGG
tggggggaaatgttaatcca

SEQ ID NO: 39565 - DNA, 20 bp, Artificial Sequence
  Description of Artificial Sequence: Synthetic oligonucleotide
  Target: SCN10A; (+) strand; PAM type: NRG; PAM sequence: AAG
ccaattctacaaatatttaa

SEQ ID NO: 39566 - DNA, 20 bp, Artificial Sequence
  Description of Artificial Sequence: Synthetic oligonucleotide
  Target: SCN10A; (+) strand; PAM type: NRG; PAM sequence: TAG
atatatcttatgtataatat

SEQ ID NO: 39567 - DNA, 20 bp, Artificial Sequence
  Description of Artificial Sequence: Synthetic oligonucleotide
  Target: SCN10A; (+) strand; PAM type: NRG; PAM sequence: TAG
attagttatgaaaacattca

SEQ ID NO: 39568 - DNA, 20 bp, Artificial Sequence
  Description of Artificial Sequence: Synthetic oligonucleotide
  Target: SCN10A; (+) strand; PAM type: NRG; PAM sequence: TAG
acattcatagcaaatgtgat

SEQ ID NO: 39569 - DNA, 20 bp, Artificial Sequence
  Description of Artificial Sequence: Synthetic oligonucleotide
  Target: SCN10A; (+) strand; PAM type: NRG; PAM sequence: TGG
tgtgattagaattatatttt

SEQ ID NO: 39570 - DNA, 20 bp, Artificial Sequence
  Description of Artificial Sequence: Synthetic oligonucleotide
  Target: SCN10A; (+) strand; PAM type: NRG; PAM sequence: TAG
ttttggtgaaatattaataa

SEQ ID NO: 39571 - DNA, 20 bp, Artificial Sequence
  Description of Artificial Sequence: Synthetic oligonucleotide
  Target: SCN10A; (+) strand; PAM type: NRG; PAM sequence: AGG
tttggtgaaatattaataat

SEQ ID NO: 39572 - DNA, 20 bp, Artificial Sequence
  Description of Artificial Sequence: Synthetic oligonucleotide
  Target: SCN10A; (+) strand; PAM type: NRG; PAM sequence: GGG
ttggtgaaatattaataata

SEQ ID NO: 39573 - DNA, 20 bp, Artificial Sequence
  Description of Artificial Sequence: Synthetic oligonucleotide
  Target: SCN10A; (+) strand; PAM type: NRG; PAM sequence: GAG
aatattaataatagggccct

SEQ ID NO: 39574 - DNA, 20 bp, Artificial Sequence
  Description of Artificial Sequence: Synthetic oligonucleotide
  Target: SCN10A; (+) strand; PAM type: NRG; PAM sequence: TAG
taatagggccctgagaattc

SEQ ID NO: 39575 - DNA, 20 bp, Artificial Sequence
  Description of Artificial Sequence: Synthetic oligonucleotide
  Target: SCN10A; (+) strand; PAM type: NRG; PAM sequence: TGG
ctgagaattctagtatcttt

SEQ ID NO: 39576 - DNA, 20 bp, Artificial Sequence
  Description of Artificial Sequence: Synthetic oligonucleotide
  Target: SCN10A; (+) strand; PAM type: NRG; PAM sequence: GGG
tgagaattctagtatctttt

SEQ ID NO: 39577 - DNA, 20 bp, Artificial Sequence
  Description of Artificial Sequence: Synthetic oligonucleotide
  Target: SCN10A; (+) strand; PAM type: NRG; PAM sequence: GGG
gagaattctagtatcttttg

SEQ ID NO: 39578 - DNA, 20 bp, Artificial Sequence
  Description of Artificial Sequence: Synthetic oligonucleotide
  Target: SCN10A; (+) strand; PAM type: NRG; PAM sequence: TGG
attctagtatcttttggggc

SEQ ID NO: 39579 - DNA, 20 bp, Artificial Sequence
  Description of Artificial Sequence: Synthetic oligonucleotide
  Target: SCN10A; (+) strand; PAM type: NRG; PAM sequence: GAG
tctagtatcttttggggctg

SEQ ID NO: 39580 - DNA, 20 bp, Artificial Sequence
  Description of Artificial Sequence: Synthetic oligonucleotide
  Target: SCN10A; (+) strand; PAM type: NRG; PAM sequence: GAG
gctggagttaccaaatttat

SEQ ID NO: 39581 - DNA, 20 bp, Artificial Sequence
  Description of Artificial Sequence: Synthetic oligonucleotide
  Target: SCN10A; (+) strand; PAM type: NRG; PAM sequence: CAG
aaatttatgagatttaaatg

SEQ ID NO: 39582 - DNA, 20 bp, Artificial Sequence
  Description of Artificial Sequence: Synthetic oligonucleotide
  Target: SCN10A; (+) strand; PAM type: NRG; PAM sequence: GAG
atttaaatgcagacttttgt

SEQ ID NO: 39583 - DNA, 20 bp, Artificial Sequence
  Description of Artificial Sequence: Synthetic oligonucleotide
  Target: SCN10A; (+) strand; PAM type: NRG; PAM sequence: AGG
tttaaatgcagacttttgtg

SEQ ID NO: 39584 - DNA, 20 bp, Artificial Sequence
  Description of Artificial Sequence: Synthetic oligonucleotide
  Target: SCN10A; (+) strand; PAM type: NRG; PAM sequence: AAG
aaatgcagacttttgtgagg

SEQ ID NO: 39585 - DNA, 20 bp, Artificial Sequence
  Description of Artificial Sequence: Synthetic oligonucleotide
  Target: SCN10A; (+) strand; PAM type: NRG; PAM sequence: GAG
atgcagacttttgtgaggaa

SEQ ID NO: 39586 - DNA, 20 bp, Artificial Sequence
  Description of Artificial Sequence: Synthetic oligonucleotide
  Target: SCN10A; (+) strand; PAM type: NRG; PAM sequence: CAG
tgaggaagagaccccctcaa

SEQ ID NO: 39587 - DNA, 20 bp, Artificial Sequence
  Description of Artificial Sequence: Synthetic oligonucleotide
  Target: SCN10A; (+) strand; PAM type: NRG; PAM sequence: CAG
ccctcaacagcttttctgtc

SEQ ID NO: 39588 - DNA, 20 bp, Artificial Sequence
  Description of Artificial Sequence: Synthetic oligonucleotide
  Target: SCN10A; (+) strand; PAM type: NRG; PAM sequence: AAG
tgtccagctgtgactctacc

SEQ ID NO: 39589 - DNA, 20 bp, Artificial Sequence
  Description of Artificial Sequence: Synthetic oligonucleotide
  Target: SCN10A; (+) strand; PAM type: NRG; PAM sequence: AAG
ttatttactcatcaaatctc

SEQ ID NO: 39590 - DNA, 20 bp, Artificial Sequence
  Description of Artificial Sequence: Synthetic oligonucleotide
  Target: SCN10A; (+) strand; PAM type: NRG; PAM sequence: AAG
actcatcaaatctcaagatg

SEQ ID NO: 39591 - DNA, 20 bp, Artificial Sequence
  Description of Artificial Sequence: Synthetic oligonucleotide
  Target: SCN10A; (+) strand; PAM type: NRG; PAM sequence: GAG
tcatcaaatctcaagatgaa

SEQ ID NO: 39592 - DNA, 20 bp, Artificial Sequence
  Description of Artificial Sequence: Synthetic oligonucleotide
  Target: SCN10A; (+) strand; PAM type: NRG; PAM sequence: TGG
aagatgaagagaatattcac

SEQ ID NO: 39593 - DNA, 20 bp, Artificial Sequence
  Description of Artificial Sequence: Synthetic oligonucleotide
  Target: SCN10A; (+) strand; PAM type: NRG; PAM sequence: TGG
gagaatattcactggtcact

SEQ ID NO: 39594 - DNA, 20 bp, Artificial Sequence
  Description of Artificial Sequence: Synthetic oligonucleotide
  Target: SCN10A; (+) strand; PAM type: NRG; PAM sequence: TAG
actggtcacttggttctttt

SEQ ID NO: 39595 - DNA, 20 bp, Artificial Sequence
  Description of Artificial Sequence: Synthetic oligonucleotide
  Target: SCN10A; (+) strand; PAM type: NRG; PAM sequence: AGG
ctggtcacttggttcttttt

SEQ ID NO: 39596 - DNA, 20 bp, Artificial Sequence
  Description of Artificial Sequence: Synthetic oligonucleotide
  Target: SCN10A; (+) strand; PAM type: NRG; PAM sequence: GGG
tggtcacttggttcttttta

SEQ ID NO: 39597 - DNA, 20 bp, Artificial Sequence
  Description of Artificial Sequence: Synthetic oligonucleotide
  Target: SCN10A; (+) strand; PAM type: NRG; PAM sequence: GGG
ggtcacttggttctttttag

SEQ ID NO: 39598 - DNA, 20 bp, Artificial Sequence
  Description of Artificial Sequence: Synthetic oligonucleotide
  Target: SCN10A; (+) strand; PAM type: NRG; PAM sequence: TAG
taggggattttatttctaat

SEQ ID NO: 39599 - DNA, 20 bp, Artificial Sequence
  Description of Artificial Sequence: Synthetic oligonucleotide
  Target: SCN10A; (+) strand; PAM type: NRG; PAM sequence: CAG
ttagctgtttcttacttatc

SEQ ID NO: 39600 - DNA, 20 bp, Artificial Sequence
  Description of Artificial Sequence: Synthetic oligonucleotide
  Target: SCN10A; (+) strand; PAM type: NRG; PAM sequence: CAG
ttatccagatgtaattcaac

SEQ ID NO: 39601 - DNA, 20 bp, Artificial Sequence
  Description of Artificial Sequence: Synthetic oligonucleotide
  Target: SCN10A; (+) strand; PAM type: NRG; PAM sequence: AAG
taattcaaccagaatccata

SEQ ID NO: 39602 - DNA, 20 bp, Artificial Sequence
  Description of Artificial Sequence: Synthetic oligonucleotide
  Target: SCN10A; (+) strand; PAM type: NRG; PAM sequence: GAG
attcaaccagaatccataaa

SEQ ID NO: 39603 - DNA, 20 bp, Artificial Sequence
  Description of Artificial Sequence: Synthetic oligonucleotide
  Target: SCN10A; (+) strand; PAM type: NRG; PAM sequence: AGG
ttcaaccagaatccataaag

SEQ ID NO: 39604 - DNA, 20 bp, Artificial Sequence
  Description of Artificial Sequence: Synthetic oligonucleotide
  Target: SCN10A; (+) strand; PAM type: NRG; PAM sequence: GAG
caaccagaatccataaagag

SEQ ID NO: 39605 - DNA, 20 bp, Artificial Sequence
  Description of Artificial Sequence: Synthetic oligonucleotide
  Target: SCN10A; (+) strand; PAM type: NRG; PAM sequence: AAG
taattgtatatattttgaaa

SEQ ID NO: 39606 - DNA, 20 bp, Artificial Sequence
  Description of Artificial Sequence: Synthetic oligonucleotide
  Target: SCN10A; (+) strand; PAM type: NRG; PAM sequence: AAG
tgaaaaagcaacaactaccc

SEQ ID NO: 39607 - DNA, 20 bp, Artificial Sequence
  Description of Artificial Sequence: Synthetic oligonucleotide
  Target: SCN10A; (+) strand; PAM type: NRG; PAM sequence: CAG
aaaagcaacaactacccaag

SEQ ID NO: 39608 - DNA, 20 bp, Artificial Sequence
  Description of Artificial Sequence: Synthetic oligonucleotide
  Target: SCN10A; (+) strand; PAM type: NRG; PAM sequence: GAG
aagcaacaactacccaagca

SEQ ID NO: 39609 - DNA, 20 bp, Artificial Sequence
  Description of Artificial Sequence: Synthetic oligonucleotide
  Target: SCN10A; (+) strand; PAM type: NRG; PAM sequence: GAG
ccaagcagagacgacacatt

SEQ ID NO: 39610 - DNA, 20 bp, Artificial Sequence
  Description of Artificial Sequence: Synthetic oligonucleotide
  Target: SCN10A; (+) strand; PAM type: NRG; PAM sequence: GAG
aagcagagacgacacattga

SEQ ID NO: 39611 - DNA, 20 bp, Artificial Sequence
  Description of Artificial Sequence: Synthetic oligonucleotide
  Target: SCN10A; (+) strand; PAM type: NRG; PAM sequence: TAG
tccaccctacttcctcactg

SEQ ID NO: 39612 - DNA, 20 bp, Artificial Sequence
  Description of Artificial Sequence: Synthetic oligonucleotide
  Target: SCN10A; (+) strand; PAM type: NRG; PAM sequence: CAG
actgtagatactgctctacg

SEQ ID NO: 39613 - DNA, 20 bp, Artificial Sequence
  Description of Artificial Sequence: Synthetic oligonucleotide
  Target: SCN10A; (+) strand; PAM type: NRG; PAM sequence: AGG
ctgtagatactgctctacgc

SEQ ID NO: 39614 - DNA, 20 bp, Artificial Sequence
  Description of Artificial Sequence: Synthetic oligonucleotide
  Target: SCN10A; (+) strand; PAM type: NRG; PAM sequence: CAG
atactgctctacgcaggatg

SEQ ID NO: 39615 - DNA, 20 bp, Artificial Sequence
  Description of Artificial Sequence: Synthetic oligonucleotide
  Target: SCN10A; (+) strand; PAM type: NRG; PAM sequence: AGG
tactgctctacgcaggatgc

SEQ ID NO: 39616 - DNA, 20 bp, Artificial Sequence
  Description of Artificial Sequence: Synthetic oligonucleotide
  Target: SCN10A; (+) strand; PAM type: NRG; PAM sequence: TGG
gctctacgcaggatgcaggc

SEQ ID NO: 39617 - DNA, 20 bp, Artificial Sequence
  Description of Artificial Sequence: Synthetic oligonucleotide
  Target: SCN10A; (+) strand; PAM type: NRG; PAM sequence: TAG
tgcaggctggacttcttaac

SEQ ID NO: 39618 - DNA, 20 bp, Artificial Sequence
  Description of Artificial Sequence: Synthetic oligonucleotide
  Target: SCN10A; (+) strand; PAM type: NRG; PAM sequence: TGG
ggacttcttaactagctaca

SEQ ID NO: 39619 - DNA, 20 bp, Artificial Sequence
  Description of Artificial Sequence: Synthetic oligonucleotide
  Target: SCN10A; (+) strand; PAM type: NRG; PAM sequence: TGG
cttaactagctacatggtct

SEQ ID NO: 39620 - DNA, 20 bp, Artificial Sequence
  Description of Artificial Sequence: Synthetic oligonucleotide
  Target: SCN10A; (+) strand; PAM type: NRG; PAM sequence: CAG
tacttaatgcctctgtgtgt

SEQ ID NO: 39621 - DNA, 20 bp, Artificial Sequence
  Description of Artificial Sequence: Synthetic oligonucleotide
  Target: SCN10A; (+) strand; PAM type: NRG; PAM sequence: TGG
cagtttcattatctgtaaaa

SEQ ID NO: 39622 - DNA, 20 bp, Artificial Sequence
  Description of Artificial Sequence: Synthetic oligonucleotide
  Target: SCN10A; (+) strand; PAM type: NRG; PAM sequence: GGG
agtttcattatctgtaaaat

SEQ ID NO: 39623 - DNA, 20 bp, Artificial Sequence
  Description of Artificial Sequence: Synthetic oligonucleotide
  Target: SCN10A; (+) strand; PAM type: NRG; PAM sequence: GGG
gtttcattatctgtaaaatg

SEQ ID NO: 39624 - DNA, 20 bp, Artificial Sequence
  Description of Artificial Sequence: Synthetic oligonucleotide
  Target: SCN10A; (+) strand; PAM type: NRG; PAM sequence: TGG
cattatctgtaaaatgggga

SEQ ID NO: 39625 - DNA, 20 bp, Artificial Sequence
  Description of Artificial Sequence: Synthetic oligonucleotide
  Target: SCN10A; (+) strand; PAM type: NRG; PAM sequence: CAG
ggggatggtaatctctactt

SEQ ID NO: 39626 - DNA, 20 bp, Artificial Sequence
  Description of Artificial Sequence: Synthetic oligonucleotide
  Target: SCN10A; (+) strand; PAM type: NRG; PAM sequence: GAG
ggatggtaatctctacttca

SEQ ID NO: 39627 - DNA, 20 bp, Artificial Sequence
  Description of Artificial Sequence: Synthetic oligonucleotide
  Target: SCN10A; (+) strand; PAM type: NRG; PAM sequence: AGG
gatggtaatctctacttcag

SEQ ID NO: 39628 - DNA, 20 bp, Artificial Sequence
  Description of Artificial Sequence: Synthetic oligonucleotide
  Target: SCN10A; (+) strand; PAM type: NRG; PAM sequence: TGG
agaggcttttgaactgatga

SEQ ID NO: 39629 - DNA, 20 bp, Artificial Sequence
  Description of Artificial Sequence: Synthetic oligonucleotide
  Target: SCN10A; (+) strand; PAM type: NRG; PAM sequence: TAG
ctgatgatggtattgacact

SEQ ID NO: 39630 - DNA, 20 bp, Artificial Sequence
  Description of Artificial Sequence: Synthetic oligonucleotide
  Target: SCN10A; (+) strand; PAM type: NRG; PAM sequence: AGG
tgatgatggtattgacactt

SEQ ID NO: 39631 - DNA, 20 bp, Artificial Sequence
  Description of Artificial Sequence: Synthetic oligonucleotide
  Target: SCN10A; (+) strand; PAM type: NRG; PAM sequence: AAG
tgatggtattgacacttagg

SEQ ID NO: 39632 - DNA, 20 bp, Artificial Sequence
  Description of Artificial Sequence: Synthetic oligonucleotide
  Target: SCN10A; (+) strand; PAM type: NRG; PAM sequence: TAG
attgacacttaggaagtatt

SEQ ID NO: 39633 - DNA, 20 bp, Artificial Sequence
  Description of Artificial Sequence: Synthetic oligonucleotide
  Target: SCN10A; (+) strand; PAM type: NRG; PAM sequence: AAG
acacttaggaagtatttagc

SEQ ID NO: 39634 - DNA, 20 bp, Artificial Sequence
  Description of Artificial Sequence: Synthetic oligonucleotide
  Target: SCN10A; (+) strand; PAM type: NRG; PAM sequence: GAG
ttaggaagtatttagcaagt

SEQ ID NO: 39635 - DNA, 20 bp, Artificial Sequence
  Description of Artificial Sequence: Synthetic oligonucleotide
  Target: SCN10A; (+) strand; PAM type: NRG; PAM sequence: GAG
aggaagtatttagcaagtga

SEQ ID NO: 39636 - DNA, 20 bp, Artificial Sequence
  Description of Artificial Sequence: Synthetic oligonucleotide
  Target: SCN10A; (+) strand; PAM type: NRG; PAM sequence: TAG
tgtcattaaatatccttctg

SEQ ID NO: 39637 - DNA, 20 bp, Artificial Sequence
  Description of Artificial Sequence: Synthetic oligonucleotide
  Target: SCN10A; (+) strand; PAM type: NRG; PAM sequence: AAG
tctgtagaatctgaaaattc

SEQ ID NO: 39638 - DNA, 20 bp, Artificial Sequence
  Description of Artificial Sequence: Synthetic oligonucleotide
  Target: SCN10A; (+) strand; PAM type: NRG; PAM sequence: CAG
gaatctgaaaattcaagatt

SEQ ID NO: 39639 - DNA, 20 bp, Artificial Sequence
  Description of Artificial Sequence: Synthetic oligonucleotide
  Target: SCN10A; (+) strand; PAM type: NRG; PAM sequence: CAG
tgaaaattcaagattcagct

SEQ ID NO: 39640 - DNA, 20 bp, Artificial Sequence
  Description of Artificial Sequence: Synthetic oligonucleotide
  Target: SCN10A; (+) strand; PAM type: NRG; PAM sequence: TGG
tcagaaaacgtaattcttgc

SEQ ID NO: 39641 - DNA, 20 bp, Artificial Sequence
  Description of Artificial Sequence: Synthetic oligonucleotide
  Target: SCN10A; (+) strand; PAM type: NRG; PAM sequence: CAG
aaaacgtaattcttgctggc

SEQ ID NO: 39642 - DNA, 20 bp, Artificial Sequence
  Description of Artificial Sequence: Synthetic oligonucleotide
  Target: SCN10A; (+) strand; PAM type: NRG; PAM sequence: CAG
cgtaattcttgctggccagc

SEQ ID NO: 39643 - DNA, 20 bp, Artificial Sequence
  Description of Artificial Sequence: Synthetic oligonucleotide
  Target: SCN10A; (+) strand; PAM type: NRG; PAM sequence: AAG
attcttgctggccagccaga

SEQ ID NO: 39644 - DNA, 20 bp, Artificial Sequence
  Description of Artificial Sequence: Synthetic oligonucleotide
  Target: SCN10A; (+) strand; PAM type: NRG; PAM sequence: AAG
cagaaagaaaaaaatgtaaa

SEQ ID NO: 39645 - DNA, 20 bp, Artificial Sequence
  Description of Artificial Sequence: Synthetic oligonucleotide
  Target: SCN10A; (+) strand; PAM type: NRG; PAM sequence: GAG
gaaagaaaaaaatgtaaaaa

SEQ ID NO: 39646 - DNA, 20 bp, Artificial Sequence
  Description of Artificial Sequence: Synthetic oligonucleotide
  Target: SCN10A; (+) strand; PAM type: NRG; PAM sequence: AAG
aaacgtaatgcaacttcatc

SEQ ID NO: 39647 - DNA, 20 bp, Artificial Sequence
  Description of Artificial Sequence: Synthetic oligonucleotide
  Target: SCN10A; (+) strand; PAM type: NRG; PAM sequence: CAG
tgcaacttcatcaagctgtg

SEQ ID NO: 39648 - DNA, 20 bp, Artificial Sequence
  Description of Artificial Sequence: Synthetic oligonucleotide
  Target: SCN10A; (+) strand; PAM type: NRG; PAM sequence: GAG
aagctgtgcagcttcatgtt

SEQ ID NO: 39649 - DNA, 20 bp, Artificial Sequence
  Description of Artificial Sequence: Synthetic oligonucleotide
  Target: SCN10A; (+) strand; PAM type: NRG; PAM sequence: CAG
gcagcttcatgttgagtgtg

SEQ ID NO: 39650 - DNA, 20 bp, Artificial Sequence
  Description of Artificial Sequence: Synthetic oligonucleotide
  Target: SCN10A; (+) strand; PAM type: NRG; PAM sequence: TAG
cttcatgttgagtgtgcaga

SEQ ID NO: 39651 - DNA, 20 bp, Artificial Sequence
  Description of Artificial Sequence: Synthetic oligonucleotide
  Target: SCN10A; (+) strand; PAM type: NRG; PAM sequence: AAG
tgcagatagatgactgtgcc

SEQ ID NO: 39652 - DNA, 20 bp, Artificial Sequence
  Description of Artificial Sequence: Synthetic oligonucleotide
  Target: SCN10A; (+) strand; PAM type: NRG; PAM sequence: AGG
gcagatagatgactgtgcca

SEQ ID NO: 39653 - DNA, 20 bp, Artificial Sequence
  Description of Artificial Sequence: Synthetic oligonucleotide
  Target: SCN10A; (+) strand; PAM type: NRG; PAM sequence: CAG
gatgactgtgccaaggttac

SEQ ID NO: 39654 - DNA, 20 bp, Artificial Sequence
  Description of Artificial Sequence: Synthetic oligonucleotide
  Target: SCN10A; (+) strand; PAM type: NRG; PAM sequence: CAG
ccagctcaatgacaactgtc

SEQ ID NO: 39655 - DNA, 20 bp, Artificial Sequence
  Description of Artificial Sequence: Synthetic oligonucleotide
  Target: SCN10A; (+) strand; PAM type: NRG; PAM sequence: CAG
agaaatccaacaatctgcct

SEQ ID NO: 39656 - DNA, 20 bp, Artificial Sequence
  Description of Artificial Sequence: Synthetic oligonucleotide
  Target: SCN10A; (+) strand; PAM type: NRG; PAM sequence: GAG
aaatccaacaatctgcctca

SEQ ID NO: 39657 - DNA, 20 bp, Artificial Sequence
  Description of Artificial Sequence: Synthetic oligonucleotide
  Target: SCN10A; (+) strand; PAM type: NRG; PAM sequence: TAG
ccaacaatctgcctcagagt

SEQ ID NO: 39658 - DNA, 20 bp, Artificial Sequence
  Description of Artificial Sequence: Synthetic oligonucleotide
  Target: SCN10A; (+) strand; PAM type: NRG; PAM sequence: AGG
caacaatctgcctcagagtt

SEQ ID NO: 39659 - DNA, 20 bp, Artificial Sequence
  Description of Artificial Sequence: Synthetic oligonucleotide
  Target: SCN10A; (+) strand; PAM type: NRG; PAM sequence: GGG
aacaatctgcctcagagtta

SEQ ID NO: 39660 - DNA, 20 bp, Artificial Sequence
  Description of Artificial Sequence: Synthetic oligonucleotide
  Target: SCN10A; (+) strand; PAM type: NRG; PAM sequence: GAG
caatctgcctcagagttagg

SEQ ID NO: 39661 - DNA, 20 bp, Artificial Sequence
  Description of Artificial Sequence: Synthetic oligonucleotide
  Target: SCN10A; (+) strand; PAM type: NRG; PAM sequence: CAG
tctgcctcagagttagggag

SEQ ID NO: 39662 - DNA, 20 bp, Artificial Sequence
  Description of Artificial Sequence: Synthetic oligonucleotide
  Target: SCN10A; (+) strand; PAM type: NRG; PAM sequence: AGG
ctgcctcagagttagggagc

SEQ ID NO: 39663 - DNA, 20 bp, Artificial Sequence
  Description of Artificial Sequence: Synthetic oligonucleotide
  Target: SCN10A; (+) strand; PAM type: NRG; PAM sequence: GGG
tgcctcagagttagggagca

SEQ ID NO: 39664 - DNA, 20 bp, Artificial Sequence
  Description of Artificial Sequence: Synthetic oligonucleotide
  Target: SCN10A; (+) strand; PAM type: NRG; PAM sequence: TAG
ctcagagttagggagcaggg

SEQ ID NO: 39665 - DNA, 20 bp, Artificial Sequence
  Description of Artificial Sequence: Synthetic oligonucleotide
  Target: SCN10A; (+) strand; PAM type: NRG; PAM sequence: AAG
ggtagaactcttttttactg

SEQ ID NO: 39666 - DNA, 20 bp, Artificial Sequence
  Description of Artificial Sequence: Synthetic oligonucleotide
  Target: SCN10A; (+) strand; PAM type: NRG; PAM sequence: AAG
cttttttactgaagccttct

SEQ ID NO: 39667 - DNA, 20 bp, Artificial Sequence
  Description of Artificial Sequence: Synthetic oligonucleotide
  Target: SCN10A; (+) strand; PAM type: NRG; PAM sequence: AAG
ttactgaagccttctaagaa

SEQ ID NO: 39668 - DNA, 20 bp, Artificial Sequence
  Description of Artificial Sequence: Synthetic oligonucleotide
  Target: SCN10A; (+) strand; PAM type: NRG; PAM sequence: AGG
tactgaagccttctaagaaa

SEQ ID NO: 39669 - DNA, 20 bp, Artificial Sequence
  Description of Artificial Sequence: Synthetic oligonucleotide
  Target: SCN10A; (+) strand; PAM type: NRG; PAM sequence: TGG
gaagccttctaagaaaaggc

SEQ ID NO: 39670 - DNA, 20 bp, Artificial Sequence
  Description of Artificial Sequence: Synthetic oligonucleotide
  Target: SCN10A; (+) strand; PAM type: NRG; PAM sequence: CAG
aaaggctggttaccatttgt

SEQ ID NO: 39671 - DNA, 20 bp, Artificial Sequence
  Description of Artificial Sequence: Synthetic oligonucleotide
  Target: SCN10A; (+) strand; PAM type: NRG; PAM sequence: AGG
aaggctggttaccatttgtc

SEQ ID NO: 39672 - DNA, 20 bp, Artificial Sequence
  Description of Artificial Sequence: Synthetic oligonucleotide
  Target: SCN10A; (+) strand; PAM type: NRG; PAM sequence: GAG
ttaccatttgtcaggcaact

SEQ ID NO: 39673 - DNA, 20 bp, Artificial Sequence
  Description of Artificial Sequence: Synthetic oligonucleotide
  Target: SCN10A; (+) strand; PAM type: NRG; PAM sequence: AGG
taccatttgtcaggcaactg

SEQ ID NO: 39674 - DNA, 20 bp, Artificial Sequence
  Description of Artificial Sequence: Synthetic oligonucleotide
  Target: SCN10A; (+) strand; PAM type: NRG; PAM sequence: CAG
catttgtcaggcaactgagg

SEQ ID NO: 39675 - DNA, 20 bp, Artificial Sequence
  Description of Artificial Sequence: Synthetic oligonucleotide
  Target: SCN10A; (+) strand; PAM type: NRG; PAM sequence: AGG
atttgtcaggcaactgaggc

SEQ ID NO: 39676 - DNA, 20 bp, Artificial Sequence
  Description of Artificial Sequence: Synthetic oligonucleotide
  Target: SCN10A; (+) strand; PAM type: NRG; PAM sequence: AAG
cttgtacatcaacctcctgc

SEQ ID NO: 39677 - DNA, 20 bp, Artificial Sequence
  Description of Artificial Sequence: Synthetic oligonucleotide
  Target: SCN10A; (+) strand; PAM type: NRG; PAM sequence: CAG
tacatcaacctcctgcaagc

SEQ ID NO: 39678 - DNA, 20 bp, Artificial Sequence
  Description of Artificial Sequence: Synthetic oligonucleotide
  Target: SCN10A; (+) strand; PAM type: NRG; PAM sequence: AGG
acatcaacctcctgcaagcc

SEQ ID NO: 39679 - DNA, 20 bp, Artificial Sequence
  Description of Artificial Sequence: Synthetic oligonucleotide
  Target: SCN10A; (+) strand; PAM type: NRG; PAM sequence: GGG
catcaacctcctgcaagcca

SEQ ID NO: 39680 - DNA, 20 bp, Artificial Sequence
  Description of Artificial Sequence: Synthetic oligonucleotide
  Target: SCN10A; (+) strand; PAM type: NRG; PAM sequence: AAG
ccagggctaaatttgtcata

SEQ ID NO: 39681 - DNA, 20 bp, Artificial Sequence
  Description of Artificial Sequence: Synthetic oligonucleotide
  Target: SCN10A; (+) strand; PAM type: NRG; PAM sequence: AAG
ttccaatccttccgatgacc

SEQ ID NO: 39682 - DNA, 20 bp, Artificial Sequence
  Description of Artificial Sequence: Synthetic oligonucleotide
  Target: SCN10A; (+) strand; PAM type: NRG; PAM sequence: AGG
tccaatccttccgatgacca

SEQ ID NO: 39683 - DNA, 20 bp, Artificial Sequence
  Description of Artificial Sequence: Synthetic oligonucleotide
  Target: SCN10A; (+) strand; PAM type: NRG; PAM sequence: TAG
cttccgatgaccaaggatct

SEQ ID NO: 39684 - DNA, 20 bp, Artificial Sequence
  Description of Artificial Sequence: Synthetic oligonucleotide
  Target: SCN10A; (+) strand; PAM type: NRG; PAM sequence: AGG
ttccgatgaccaaggatctt

SEQ ID NO: 39685 - DNA, 20 bp, Artificial Sequence
  Description of Artificial Sequence: Synthetic oligonucleotide
  Target: SCN10A; (+) strand; PAM type: NRG; PAM sequence: TAG
gaccaaggatcttaggtcat

SEQ ID NO: 39686 - DNA, 20 bp, Artificial Sequence
  Description of Artificial Sequence: Synthetic oligonucleotide
  Target: SCN10A; (+) strand; PAM type: NRG; PAM sequence: AGG
accaaggatcttaggtcatt

SEQ ID NO: 39687 - DNA, 20 bp, Artificial Sequence
  Description of Artificial Sequence: Synthetic oligonucleotide
  Target: SCN10A; (+) strand; PAM type: NRG; PAM sequence: TAG
ggtcattaggatctttccat

SEQ ID NO: 39688 - DNA, 20 bp, Artificial Sequence
  Description of Artificial Sequence: Synthetic oligonucleotide
  Target: SCN10A; (+) strand; PAM type: NRG; PAM sequence: AGG
gtcattaggatctttccatt

SEQ ID NO: 39689 - DNA, 20 bp, Artificial Sequence
  Description of Artificial Sequence: Synthetic oligonucleotide
  Target: SCN10A; (+) strand; PAM type: NRG; PAM sequence: CAG
atctttccattaggatcacc

SEQ ID NO: 39690 - DNA, 20 bp, Artificial Sequence
  Description of Artificial Sequence: Synthetic oligonucleotide
  Target: SCN10A; (+) strand; PAM type: NRG; PAM sequence: AGG
tctttccattaggatcaccc

SEQ ID NO: 39691 - DNA, 20 bp, Artificial Sequence
  Description of Artificial Sequence: Synthetic oligonucleotide
  Target: SCN10A; (+) strand; PAM type: NRG; PAM sequence: AAG
ttccattaggatcacccagg

SEQ ID NO: 39692 - DNA, 20 bp, Artificial Sequence
  Description of Artificial Sequence: Synthetic oligonucleotide
  Target: SCN10A; (+) strand; PAM type: NRG; PAM sequence: TAG
aggatcacccaggaagatct

SEQ ID NO: 39693 - DNA, 20 bp, Artificial Sequence
  Description of Artificial Sequence: Synthetic oligonucleotide
  Target: SCN10A; (+) strand; PAM type: NRG; PAM sequence: AGG
ggatcacccaggaagatctt

SEQ ID NO: 39694 - DNA, 20 bp, Artificial Sequence
  Description of Artificial Sequence: Synthetic oligonucleotide
  Target: SCN10A; (+) strand; PAM type: NRG; PAM sequence: AAG
gatcttaggaaaccaaacca

SEQ ID NO: 39695 - DNA, 20 bp, Artificial Sequence
  Description of Artificial Sequence: Synthetic oligonucleotide
  Target: SCN10A; (+) strand; PAM type: NRG; PAM sequence: TAG
ccaaagtatcttttttctac

SEQ ID NO: 39696 - DNA, 20 bp, Artificial Sequence
  Description of Artificial Sequence: Synthetic oligonucleotide
  Target: SCN10A; (+) strand; PAM type: NRG; PAM sequence: TGG
gtatcttttttctactagtt

SEQ ID NO: 39697 - DNA, 20 bp, Artificial Sequence
  Description of Artificial Sequence: Synthetic oligonucleotide
  Target: SCN10A; (+) strand; PAM type: NRG; PAM sequence: AAG
tgccttgcaaaatcccctga

SEQ ID NO: 39698 - DNA, 20 bp, Artificial Sequence
  Description of Artificial Sequence: Synthetic oligonucleotide
  Target: SCN10A; (+) strand; PAM type: NRG; PAM sequence: CAG
cttgcaaaatcccctgaaag

SEQ ID NO: 39699 - DNA, 20 bp, Artificial Sequence
  Description of Artificial Sequence: Synthetic oligonucleotide
  Target: SCN10A; (+) strand; PAM type: NRG; PAM sequence: TAG
attacctaaaacaattcata

SEQ ID NO: 39700 - DNA, 20 bp, Artificial Sequence
  Description of Artificial Sequence: Synthetic oligonucleotide
  Target: SCN10A; (+) strand; PAM type: NRG; PAM sequence: TAG
acctaaaacaattcatatag

SEQ ID NO: 39701 - DNA, 20 bp, Artificial Sequence
  Description of Artificial Sequence: Synthetic oligonucleotide
  Target: SCN10A; (+) strand; PAM type: NRG; PAM sequence: CAG
caatgtgtctctaatcatta

SEQ ID NO: 39702 - DNA, 20 bp, Artificial Sequence
  Description of Artificial Sequence: Synthetic oligonucleotide
  Target: SCN10A; (+) strand; PAM type: NRG; PAM sequence: TGG
ctaatcattacagtcttgta

SEQ ID NO: 39703 - DNA, 20 bp, Artificial Sequence
  Description of Artificial Sequence: Synthetic oligonucleotide
  Target: SCN10A; (+) strand; PAM type: NRG; PAM sequence: CAG
gtcttgtatggcatgaacat

SEQ ID NO: 39704 - DNA, 20 bp, Artificial Sequence
  Description of Artificial Sequence: Synthetic oligonucleotide
  Target: SCN10A; (+) strand; PAM type: NRG; PAM sequence: TAG
tattgacattttaaacctgc

SEQ ID NO: 39705 - DNA, 20 bp, Artificial Sequence
  Description of Artificial Sequence: Synthetic oligonucleotide
  Target: SCN10A; (+) strand; PAM type: NRG; PAM sequence: TAG
tgacattttaaacctgctag

SEQ ID NO: 39706 - DNA, 20 bp, Artificial Sequence
  Description of Artificial Sequence: Synthetic oligonucleotide
  Target: SCN10A; (+) strand; PAM type: NRG; PAM sequence: GAG
taaacctgctagtagttttt

SEQ ID NO: 39707 - DNA, 20 bp, Artificial Sequence
  Description of Artificial Sequence: Synthetic oligonucleotide
  Target: SCN10A; (+) strand; PAM type: NRG; PAM sequence: CAG
tgagtaatttgtgatgttaa

SEQ ID NO: 39708 - DNA, 20 bp, Artificial Sequence
  Description of Artificial Sequence: Synthetic oligonucleotide
  Target: SCN10A; (+) strand; PAM type: NRG; PAM sequence: GAG
aacagtgccccatgaccaat

SEQ ID NO: 39709 - DNA, 20 bp, Artificial Sequence
  Description of Artificial Sequence: Synthetic oligonucleotide
  Target: SCN10A; (+) strand; PAM type: NRG; PAM sequence: AGG
acagtgccccatgaccaatg

SEQ ID NO: 39710 - DNA, 20 bp, Artificial Sequence
  Description of Artificial Sequence: Synthetic oligonucleotide
  Target: SCN10A; (+) strand; PAM type: NRG; PAM sequence: GAG
atgaccaatgaggtcccatt

SEQ ID NO: 39711 - DNA, 20 bp, Artificial Sequence
  Description of Artificial Sequence: Synthetic oligonucleotide
  Target: SCN10A; (+) strand; PAM type: NRG; PAM sequence: TGG
tatgtgtgctcttcccatca

SEQ ID NO: 39712 - DNA, 20 bp, Artificial Sequence
  Description of Artificial Sequence: Synthetic oligonucleotide
  Target: SCN10A; (+) strand; PAM type: NRG; PAM sequence: TGG
ggtctgttttccttgccctc

SEQ ID NO: 39713 - DNA, 20 bp, Artificial Sequence
  Description of Artificial Sequence: Synthetic oligonucleotide
  Target: SCN10A; (+) strand; PAM type: NRG; PAM sequence: GGG
gtctgttttccttgccctct

SEQ ID NO: 39714 - DNA, 20 bp, Artificial Sequence
  Description of Artificial Sequence: Synthetic oligonucleotide
  Target: SCN10A; (+) strand; PAM type: NRG; PAM sequence: GAG
ctgttttccttgccctctgg

SEQ ID NO: 39715 - DNA, 20 bp, Artificial Sequence
  Description of Artificial Sequence: Synthetic oligonucleotide
  Target: SCN10A; (+) strand; PAM type: NRG; PAM sequence: AGG
tgttttccttgccctctggg

SEQ ID NO: 39716 - DNA, 20 bp, Artificial Sequence
  Description of Artificial Sequence: Synthetic oligonucleotide
  Target: SCN10A; (+) strand; PAM type: NRG; PAM sequence: CAG
ggaggtgctgctcttttgcc

SEQ ID NO: 39717 - DNA, 20 bp, Artificial Sequence
  Description of Artificial Sequence: Synthetic oligonucleotide
  Target: SCN10A; (+) strand; PAM type: NRG; PAM sequence: AAG
gtgctgctcttttgcccagt

SEQ ID NO: 39718 - DNA, 20 bp, Artificial Sequence
  Description of Artificial Sequence: Synthetic oligonucleotide
  Target: SCN10A; (+) strand; PAM type: NRG; PAM sequence: CAG
ctgctcttttgcccagtaag

SEQ ID NO: 39719 - DNA, 20 bp, Artificial Sequence
  Description of Artificial Sequence: Synthetic oligonucleotide
  Target: SCN10A; (+) strand; PAM type: NRG; PAM sequence: CAG
cccagtaagcagccacttct

SEQ ID NO: 39720 - DNA, 20 bp, Artificial Sequence
  Description of Artificial Sequence: Synthetic oligonucleotide
  Target: SCN10A; (+) strand; PAM type: NRG; PAM sequence: TGG
taagcagccacttctcagca

SEQ ID NO: 39721 - DNA, 20 bp, Artificial Sequence
  Description of Artificial Sequence: Synthetic oligonucleotide
  Target: SCN10A; (+) strand; PAM type: NRG; PAM sequence: TGG
gccacttctcagcatggcta

SEQ ID NO: 39722 - DNA, 20 bp, Artificial Sequence
  Description of Artificial Sequence: Synthetic oligonucleotide
  Target: SCN10A; (+) strand; PAM type: NRG; PAM sequence: CAG
ttctcagcatggctatggca

SEQ ID NO: 39723 - DNA, 20 bp, Artificial Sequence
  Description of Artificial Sequence: Synthetic oligonucleotide
  Target: SCN10A; (+) strand; PAM type: NRG; PAM sequence: GAG
ctcagcatggctatggcaca

SEQ ID NO: 39724 - DNA, 20 bp, Artificial Sequence
  Description of Artificial Sequence: Synthetic oligonucleotide
  Target: SCN10A; (+) strand; PAM type: NRG; PAM sequence: AAG
atgcctatctcatctgccca

SEQ ID NO: 39725 - DNA, 20 bp, Artificial Sequence
  Description of Artificial Sequence: Synthetic oligonucleotide
  Target: SCN10A; (+) strand; PAM type: NRG; PAM sequence: AAG
cctatctcatctgcccaaag

SEQ ID NO: 39726 - DNA, 20 bp, Artificial Sequence
  Description of Artificial Sequence: Synthetic oligonucleotide
  Target: SCN10A; (+) strand; PAM type: NRG; PAM sequence: AGG
ctatctcatctgcccaaaga

SEQ ID NO: 39727 - DNA, 20 bp, Artificial Sequence
  Description of Artificial Sequence: Synthetic oligonucleotide
  Target: SCN10A; (+) strand; PAM type: NRG; PAM sequence: TGG
tcatctgcccaaagaaggct

SEQ ID NO: 39728 - DNA, 20 bp, Artificial Sequence
  Description of Artificial Sequence: Synthetic oligonucleotide
  Target: SCN10A; (+) strand; PAM type: NRG; PAM sequence: GGG
catctgcccaaagaaggctt

SEQ ID NO: 39729 - DNA, 20 bp, Artificial Sequence
  Description of Artificial Sequence: Synthetic oligonucleotide
  Target: SCN10A; (+) strand; PAM type: NRG; PAM sequence: TGG
tcttactgcctgttgtgttg

SEQ ID NO: 39730 - DNA, 20 bp, Artificial Sequence
  Description of Artificial Sequence: Synthetic oligonucleotide
  Target: SCN10A; (+) strand; PAM type: NRG; PAM sequence: GGG
cttactgcctgttgtgttgt

SEQ ID NO: 39731 - DNA, 20 bp, Artificial Sequence
  Description of Artificial Sequence: Synthetic oligonucleotide
  Target: SCN10A; (+) strand; PAM type: NRG; PAM sequence: GGG
ttactgcctgttgtgttgtg

SEQ ID NO: 39732 - DNA, 20 bp, Artificial Sequence
  Description of Artificial Sequence: Synthetic oligonucleotide
  Target: SCN10A; (+) strand; PAM type: NRG; PAM sequence: AAG
tgcctgttgtgttgtgggga

SEQ ID NO: 39733 - DNA, 20 bp, Artificial Sequence
  Description of Artificial Sequence: Synthetic oligonucleotide
  Target: SCN10A; (+) strand; PAM type: NRG; PAM sequence: CGG
ctgttgtgttgtggggaaag

SEQ ID NO: 39734 - DNA, 20 bp, Artificial Sequence
  Description of Artificial Sequence: Synthetic oligonucleotide
  Target: SCN10A; (+) strand; PAM type: NRG; PAM sequence: TGG
ggaaagcggaccacacaccg

SEQ ID NO: 39735 - DNA, 20 bp, Artificial Sequence
  Description of Artificial Sequence: Synthetic oligonucleotide
  Target: SCN10A; (+) strand; PAM type: NRG; PAM sequence: GAG
agcggaccacacaccgtggt

SEQ ID NO: 39736 - DNA, 20 bp, Artificial Sequence
  Description of Artificial Sequence: Synthetic oligonucleotide
  Target: SCN10A; (+) strand; PAM type: NRG; PAM sequence: TGG
caccgtggtgagaatgtgtc

SEQ ID NO: 39737 - DNA, 20 bp, Artificial Sequence
  Description of Artificial Sequence: Synthetic oligonucleotide
  Target: SCN10A; (+) strand; PAM type: NRG; PAM sequence: GGG
accgtggtgagaatgtgtct

SEQ ID NO: 39738 - DNA, 20 bp, Artificial Sequence
  Description of Artificial Sequence: Synthetic oligonucleotide
  Target: SCN10A; (+) strand; PAM type: NRG; PAM sequence: GGG
ccgtggtgagaatgtgtctg

SEQ ID NO: 39739 - DNA, 20 bp, Artificial Sequence
  Description of Artificial Sequence: Synthetic oligonucleotide
  Target: SCN10A; (+) strand; PAM type: NRG; PAM sequence: GGG
cgtggtgagaatgtgtctgg

SEQ ID NO: 39740 - DNA, 20 bp, Artificial Sequence
  Description of Artificial Sequence: Synthetic oligonucleotide
  Target: SCN10A; (+) strand; PAM type: NRG; PAM sequence: CAG
gagaatgtgtctgggggcat

SEQ ID NO: 39741 - DNA, 20 bp, Artificial Sequence
  Description of Artificial Sequence: Synthetic oligonucleotide
  Target: SCN10A; (+) strand; PAM type: NRG; PAM sequence: AAG
tcagcaaacctcccctcata

SEQ ID NO: 39742 - DNA, 20 bp, Artificial Sequence
  Description of Artificial Sequence: Synthetic oligonucleotide
  Target: SCN10A; (+) strand; PAM type: NRG; PAM sequence: GAG
agcaaacctcccctcataaa

SEQ ID NO: 39743 - DNA, 20 bp, Artificial Sequence
  Description of Artificial Sequence: Synthetic oligonucleotide
  Target: SCN10A; (+) strand; PAM type: NRG; PAM sequence: AGG
gcaaacctcccctcataaag

SEQ ID NO: 39744 - DNA, 20 bp, Artificial Sequence
  Description of Artificial Sequence: Synthetic oligonucleotide
  Target: SCN10A; (+) strand; PAM type: NRG; PAM sequence: AAG
tcataaagaggatgtttttc

SEQ ID NO: 39745 - DNA, 20 bp, Artificial Sequence
  Description of Artificial Sequence: Synthetic oligonucleotide
  Target: SCN10A; (+) strand; PAM type: NRG; PAM sequence: CAG
tttttcaagttgtgcatcca

SEQ ID NO: 39746 - DNA, 20 bp, Artificial Sequence
  Description of Artificial Sequence: Synthetic oligonucleotide
  Target: SCN10A; (+) strand; PAM type: NRG; PAM sequence: AGG
ttttcaagttgtgcatccac

SEQ ID NO: 39747 - DNA, 20 bp, Artificial Sequence
  Description of Artificial Sequence: Synthetic oligonucleotide
  Target: SCN10A; (+) strand; PAM type: NRG; PAM sequence: TAG
tgtgcatccacaggtgtgtc

SEQ ID NO: 39748 - DNA, 20 bp, Artificial Sequence
  Description of Artificial Sequence: Synthetic oligonucleotide
  Target: SCN10A; (+) strand; PAM type: NRG; PAM sequence: TAG
atccacaggtgtgtctagat

SEQ ID NO: 39749 - DNA, 20 bp, Artificial Sequence
  Description of Artificial Sequence: Synthetic oligonucleotide
  Target: SCN10A; (+) strand; PAM type: NRG; PAM sequence: GAG
aggtgtgtctagattagtct

SEQ ID NO: 39750 - DNA, 20 bp, Artificial Sequence
  Description of Artificial Sequence: Synthetic oligonucleotide
  Target: SCN10A; (+) strand; PAM type: NRG; PAM sequence: AGG
ggtgtgtctagattagtctg

SEQ ID NO: 39751 - DNA, 20 bp, Artificial Sequence
  Description of Artificial Sequence: Synthetic oligonucleotide
  Target: SCN10A; (+) strand; PAM type: NRG; PAM sequence: TGG
taaacacttcttctgtgtct

SEQ ID NO: 39752 - DNA, 20 bp, Artificial Sequence
  Description of Artificial Sequence: Synthetic oligonucleotide
  Target: SCN10A; (+) strand; PAM type: NRG; PAM sequence: GGG
aaacacttcttctgtgtctt

SEQ ID NO: 39753 - DNA, 20 bp, Artificial Sequence
  Description of Artificial Sequence: Synthetic oligonucleotide
  Target: SCN10A; (+) strand; PAM type: NRG; PAM sequence: TGG
tctgtgtcttgggactgctt

SEQ ID NO: 39754 - DNA, 20 bp, Artificial Sequence
  Description of Artificial Sequence: Synthetic oligonucleotide
  Target: SCN10A; (+) strand; PAM type: NRG; PAM sequence: GGG
ctgtgtcttgggactgcttt

SEQ ID NO: 39755 - DNA, 20 bp, Artificial Sequence
  Description of Artificial Sequence: Synthetic oligonucleotide
  Target: SCN10A; (+) strand; PAM type: NRG; PAM sequence: GGG
tgtgtcttgggactgctttg

SEQ ID NO: 39756 - DNA, 20 bp, Artificial Sequence
  Description of Artificial Sequence: Synthetic oligonucleotide
  Target: SCN10A; (+) strand; PAM type: NRG; PAM sequence: TGG
cttgggactgctttggggtg

SEQ ID NO: 39757 - DNA, 20 bp, Artificial Sequence
  Description of Artificial Sequence: Synthetic oligonucleotide
  Target: SCN10A; (+) strand; PAM type: NRG; PAM sequence: GGG
ttgggactgctttggggtgt

SEQ ID NO: 39758 - DNA, 20 bp, Artificial Sequence
  Description of Artificial Sequence: Synthetic oligonucleotide
  Target: SCN10A; (+) strand; PAM type: NRG; PAM sequence: AAG
ttggggtgtgggacacatta

SEQ ID NO: 39759 - DNA, 20 bp, Artificial Sequence
  Description of Artificial Sequence: Synthetic oligonucleotide
  Target: SCN10A; (+) strand; PAM type: NRG; PAM sequence: AGG
tggggtgtgggacacattaa

SEQ ID NO: 39760 - DNA, 20 bp, Artificial Sequence
  Description of Artificial Sequence: Synthetic oligonucleotide
  Target: SCN10A; (+) strand; PAM type: NRG; PAM sequence: AAG
gtgggacacattaaaggccc

SEQ ID NO: 39761 - DNA, 20 bp, Artificial Sequence
  Description of Artificial Sequence: Synthetic oligonucleotide
  Target: SCN10A; (+) strand; PAM type: NRG; PAM sequence: TGG
taatgacctcattgtacttt

SEQ ID NO: 39762 - DNA, 20 bp, Artificial Sequence
  Description of Artificial Sequence: Synthetic oligonucleotide
  Target: SCN10A; (+) strand; PAM type: NRG; PAM sequence: GGG
aatgacctcattgtactttt

SEQ ID NO: 39763 - DNA, 20 bp, Artificial Sequence
  Description of Artificial Sequence: Synthetic oligonucleotide
  Target: SCN10A; (+) strand; PAM type: NRG; PAM sequence: TGG
ttgtacttttgggattcaat

SEQ ID NO: 39764 - DNA, 20 bp, Artificial Sequence
  Description of Artificial Sequence: Synthetic oligonucleotide
  Target: SCN10A; (+) strand; PAM type: NRG; PAM sequence: AAG
cttttgggattcaattggat

SEQ ID NO: 39765 - DNA, 20 bp, Artificial Sequence
  Description of Artificial Sequence: Synthetic oligonucleotide
  Target: SCN10A; (+) strand; PAM type: NRG; PAM sequence: AGG
ttttgggattcaattggata

SEQ ID NO: 39766 - DNA, 20 bp, Artificial Sequence
  Description of Artificial Sequence: Synthetic oligonucleotide
  Target: SCN10A; (+) strand; PAM type: NRG; PAM sequence: GGG
tttgggattcaattggataa

SEQ ID NO: 39767 - DNA, 20 bp, Artificial Sequence
  Description of Artificial Sequence: Synthetic oligonucleotide
  Target: SCN10A; (+) strand; PAM type: NRG; PAM sequence: AAG
ggctctgttgctaacctcta

SEQ ID NO: 39768 - DNA, 20 bp, Artificial Sequence
  Description of Artificial Sequence: Synthetic oligonucleotide
  Target: SCN10A; (+) strand; PAM type: NRG; PAM sequence: AAG
tctgttgctaacctctaaag

SEQ ID NO: 39769 - DNA, 20 bp, Artificial Sequence
  Description of Artificial Sequence: Synthetic oligonucleotide
  Target: SCN10A; (+) strand; PAM type: NRG; PAM sequence: AGG
ctgttgctaacctctaaaga

SEQ ID NO: 39770 - DNA, 20 bp, Artificial Sequence
  Description of Artificial Sequence: Synthetic oligonucleotide
  Target: SCN10A; (+) strand; PAM type: NRG; PAM sequence: TGG
ctaacctctaaagaaggtac

SEQ ID NO: 39771 - DNA, 20 bp, Artificial Sequence
  Description of Artificial Sequence: Synthetic oligonucleotide
  Target: SCN10A; (+) strand; PAM type: NRG; PAM sequence: CAG
tctaaagaaggtactggaca

SEQ ID NO: 39772 - DNA, 20 bp, Artificial Sequence
  Description of Artificial Sequence: Synthetic oligonucleotide
  Target: SCN10A; (+) strand; PAM type: NRG; PAM sequence: TAG
aaagaaggtactggacacag

SEQ ID NO: 39773 - DNA, 20 bp, Artificial Sequence
  Description of Artificial Sequence: Synthetic oligonucleotide
  Target: SCN10A; (+) strand; PAM type: NRG; PAM sequence: AGG
aagaaggtactggacacagt

SEQ ID NO: 39774 - DNA, 20 bp, Artificial Sequence
  Description of Artificial Sequence: Synthetic oligonucleotide
  Target: SCN10A; (+) strand; PAM type: NRG; PAM sequence: AAG
aggtactggacacagtaggc

SEQ ID NO: 39775 - DNA, 20 bp, Artificial Sequence
  Description of Artificial Sequence: Synthetic oligonucleotide
  Target: SCN10A; (+) strand; PAM type: NRG; PAM sequence: AGG
ggtactggacacagtaggca

SEQ ID NO: 39776 - DNA, 20 bp, Artificial Sequence
  Description of Artificial Sequence: Synthetic oligonucleotide
  Target: SCN10A; (+) strand; PAM type: NRG; PAM sequence: TGG
caaggtctaattgtaacacg

SEQ ID NO: 39777 - DNA, 20 bp, Artificial Sequence
  Description of Artificial Sequence: Synthetic oligonucleotide
  Target: SCN10A; (+) strand; PAM type: NRG; PAM sequence: AAG
ggtctaattgtaacacgtgg

SEQ ID NO: 39778 - DNA, 20 bp, Artificial Sequence
  Description of Artificial Sequence: Synthetic oligonucleotide
  Target: SCN10A; (+) strand; PAM type: NRG; PAM sequence: GAG
tctaattgtaacacgtggaa

SEQ ID NO: 39779 - DNA, 20 bp, Artificial Sequence
  Description of Artificial Sequence: Synthetic oligonucleotide
  Target: SCN10A; (+) strand; PAM type: NRG; PAM sequence: AGG
ctaattgtaacacgtggaag

SEQ ID NO: 39780 - DNA, 20 bp, Artificial Sequence
  Description of Artificial Sequence: Synthetic oligonucleotide
  Target: SCN10A; (+) strand; PAM type: NRG; PAM sequence: AAG
gtggaagaggcaatcgtgca

SEQ ID NO: 39781 - DNA, 20 bp, Artificial Sequence
  Description of Artificial Sequence: Synthetic oligonucleotide
  Target: SCN10A; (+) strand; PAM type: NRG; PAM sequence: AGG
tggaagaggcaatcgtgcaa

SEQ ID NO: 39782 - DNA, 20 bp, Artificial Sequence
  Description of Artificial Sequence: Synthetic oligonucleotide
  Target: SCN10A; (+) strand; PAM type: NRG; PAM sequence: GAG
ggcaatcgtgcaaaggatat

SEQ ID NO: 39783 - DNA, 20 bp, Artificial Sequence
  Description of Artificial Sequence: Synthetic oligonucleotide
  Target: SCN10A; (+) strand; PAM type: NRG; PAM sequence: TGG
aatcgtgcaaaggatatgag

SEQ ID NO: 39784 - DNA, 20 bp, Artificial Sequence
  Description of Artificial Sequence: Synthetic oligonucleotide
  Target: SCN10A; (+) strand; PAM type: NRG; PAM sequence: CAG
gtgcaaaggatatgagtgga

SEQ ID NO: 39785 - DNA, 20 bp, Artificial Sequence
  Description of Artificial Sequence: Synthetic oligonucleotide
  Target: SCN10A; (+) strand; PAM type: NRG; PAM sequence: TGG
tgagtggacagacactttga

SEQ ID NO: 39786 - DNA, 20 bp, Artificial Sequence
  Description of Artificial Sequence: Synthetic oligonucleotide
  Target: SCN10A; (+) strand; PAM type: NRG; PAM sequence: CAG
ttgatggccgttcttctgat

SEQ ID NO: 39787 - DNA, 20 bp, Artificial Sequence
  Description of Artificial Sequence: Synthetic oligonucleotide
  Target: SCN10A; (+) strand; PAM type: NRG; PAM sequence: AGG
tgatggccgttcttctgatc

SEQ ID NO: 39788 - DNA, 20 bp, Artificial Sequence
  Description of Artificial Sequence: Synthetic oligonucleotide
  Target: SCN10A; (+) strand; PAM type: NRG; PAM sequence: AAG
cgttcttctgatcaggttga

SEQ ID NO: 39789 - DNA, 20 bp, Artificial Sequence
  Description of Artificial Sequence: Synthetic oligonucleotide
  Target: SCN10A; (+) strand; PAM type: NRG; PAM sequence: AGG
gttcttctgatcaggttgaa

SEQ ID NO: 39790 - DNA, 20 bp, Artificial Sequence
  Description of Artificial Sequence: Synthetic oligonucleotide
  Target: SCN10A; (+) strand; PAM type: NRG; PAM sequence: TAG
atcaggttgaaaggactgaa

SEQ ID NO: 39791 - DNA, 20 bp, Artificial Sequence
  Description of Artificial Sequence: Synthetic oligonucleotide
  Target: SCN10A; (+) strand; PAM type: NRG; PAM sequence: CAG
ttgaaaggactgaatagcca

SEQ ID NO: 39792 - DNA, 20 bp, Artificial Sequence
  Description of Artificial Sequence: Synthetic oligonucleotide
  Target: SCN10A; (+) strand; PAM type: NRG; PAM sequence: AGG
tgaaaggactgaatagccac

SEQ ID NO: 39793 - DNA, 20 bp, Artificial Sequence
  Description of Artificial Sequence: Synthetic oligonucleotide
  Target: SCN10A; (+) strand; PAM type: NRG; PAM sequence: GGG
gaaaggactgaatagccaca

SEQ ID NO: 39794 - DNA, 20 bp, Artificial Sequence
  Description of Artificial Sequence: Synthetic oligonucleotide
  Target: SCN10A; (+) strand; PAM type: NRG; PAM sequence: GAG
actgaatagccacagggccc

SEQ ID NO: 39795 - DNA, 20 bp, Artificial Sequence
  Description of Artificial Sequence: Synthetic oligonucleotide
  Target: SCN10A; (+) strand; PAM type: NRG; PAM sequence: TGG
gaatagccacagggcccgag

SEQ ID NO: 39796 - DNA, 20 bp, Artificial Sequence
  Description of Artificial Sequence: Synthetic oligonucleotide
  Target: SCN10A; (+) strand; PAM type: NRG; PAM sequence: CGG
gggcccgagtggcactaaac

SEQ ID NO: 39797 - DNA, 20 bp, Artificial Sequence
  Description of Artificial Sequence: Synthetic oligonucleotide
  Target: SCN10A; (+) strand; PAM type: NRG; PAM sequence: GGG
ggcccgagtggcactaaacc

SEQ ID NO: 39798 - DNA, 20 bp, Artificial Sequence
  Description of Artificial Sequence: Synthetic oligonucleotide
  Target: SCN10A; (+) strand; PAM type: NRG; PAM sequence: TGG
agtggcactaaaccgggaaa

SEQ ID NO: 39799 - DNA, 20 bp, Artificial Sequence
  Description of Artificial Sequence: Synthetic oligonucleotide
  Target: SCN10A; (+) strand; PAM type: NRG; PAM sequence: CAG
gaaatggtcctccctttgtt

SEQ ID NO: 39800 - DNA, 20 bp, Artificial Sequence
  Description of Artificial Sequence: Synthetic oligonucleotide
  Target: SCN10A; (+) strand; PAM type: NRG; PAM sequence: CAG
atgtctgaaacaaaacaaaa

SEQ ID NO: 39801 - DNA, 20 bp, Artificial Sequence
  Description of Artificial Sequence: Synthetic oligonucleotide
  Target: SCN10A; (+) strand; PAM type: NRG; PAM sequence: AAG
ctgaaacaaaacaaaacaga

SEQ ID NO: 39802 - DNA, 20 bp, Artificial Sequence
  Description of Artificial Sequence: Synthetic oligonucleotide
  Target: SCN10A; (+) strand; PAM type: NRG; PAM sequence: TGG
aaacaaaacaaaacagaaag

SEQ ID NO: 39803 - DNA, 20 bp, Artificial Sequence
  Description of Artificial Sequence: Synthetic oligonucleotide
  Target: SCN10A; (+) strand; PAM type: NRG; PAM sequence: GAG
acagaaagtggacctccaat

SEQ ID NO: 39804 - DNA, 20 bp, Artificial Sequence
  Description of Artificial Sequence: Synthetic oligonucleotide
  Target: SCN10A; (+) strand; PAM type: NRG; PAM sequence: AAG
gtggacctccaatgagaaac

SEQ ID NO: 39805 - DNA, 20 bp, Artificial Sequence
  Description of Artificial Sequence: Synthetic oligonucleotide
  Target: SCN10A; (+) strand; PAM type: NRG; PAM sequence: GAG
acaaccatgtttttaaacat

SEQ ID NO: 39806 - DNA, 20 bp, Artificial Sequence
  Description of Artificial Sequence: Synthetic oligonucleotide
  Target: SCN10A; (+) strand; PAM type: NRG; PAM sequence: GAG
aaccatgtttttaaacatga

SEQ ID NO: 39807 - DNA, 20 bp, Artificial Sequence
  Description of Artificial Sequence: Synthetic oligonucleotide
  Target: SCN10A; (+) strand; PAM type: NRG; PAM sequence: AGG
accatgtttttaaacatgag

SEQ ID NO: 39808 - DNA, 20 bp, Artificial Sequence
  Description of Artificial Sequence: Synthetic oligonucleotide
  Target: SCN10A; (+) strand; PAM type: NRG; PAM sequence: CAG
aaacatgagaggcattatct

SEQ ID NO: 39809 - DNA, 20 bp, Artificial Sequence
  Description of Artificial Sequence: Synthetic oligonucleotide
  Target: SCN10A; (+) strand; PAM type: NRG; PAM sequence: AGG
aacatgagaggcattatctc

SEQ ID NO: 39810 - DNA, 20 bp, Artificial Sequence
  Description of Artificial Sequence: Synthetic oligonucleotide
  Target: SCN10A; (+) strand; PAM type: NRG; PAM sequence: GAG
aggcattatctcaggcttat

SEQ ID NO: 39811 - DNA, 20 bp, Artificial Sequence
  Description of Artificial Sequence: Synthetic oligonucleotide
  Target: SCN10A; (+) strand; PAM type: NRG; PAM sequence: AAG
attatctcaggcttatgagc

SEQ ID NO: 39812 - DNA, 20 bp, Artificial Sequence
  Description of Artificial Sequence: Synthetic oligonucleotide
  Target: SCN10A; (+) strand; PAM type: NRG; PAM sequence: AAG
atctcaggcttatgagcaag

SEQ ID NO: 39813 - DNA, 20 bp, Artificial Sequence
  Description of Artificial Sequence: Synthetic oligonucleotide
  Target: SCN10A; (+) strand; PAM type: NRG; PAM sequence: AGG
tctcaggcttatgagcaaga

SEQ ID NO: 39814 - DNA, 20 bp, Artificial Sequence
  Description of Artificial Sequence: Synthetic oligonucleotide
  Target: SCN10A; (+) strand; PAM type: NRG; PAM sequence: GGG
ctcaggcttatgagcaagaa

SEQ ID NO: 39815 - DNA, 20 bp, Artificial Sequence
  Description of Artificial Sequence: Synthetic oligonucleotide
  Target: SCN10A; (+) strand; PAM type: NRG; PAM sequence: TGG
cttatgagcaagaagggctc

SEQ ID NO: 39816 - DNA, 20 bp, Artificial Sequence
  Description of Artificial Sequence: Synthetic oligonucleotide
  Target: SCN10A; (+) strand; PAM type: NRG; PAM sequence: GGG
ttatgagcaagaagggctct

SEQ ID NO: 39817 - DNA, 20 bp, Artificial Sequence
  Description of Artificial Sequence: Synthetic oligonucleotide
  Target: SCN10A; (+) strand; PAM type: NRG; PAM sequence: CAG
aagaagggctctgggaacta

SEQ ID NO: 39818 - DNA, 20 bp, Artificial Sequence
  Description of Artificial Sequence: Synthetic oligonucleotide
  Target: SCN10A; (+) strand; PAM type: NRG; PAM sequence: AGG
agaagggctctgggaactac

SEQ ID NO: 39819 - DNA, 20 bp, Artificial Sequence
  Description of Artificial Sequence: Synthetic oligonucleotide
  Target: SCN10A; (+) strand; PAM type: NRG; PAM sequence: GAG
tctgggaactacaggtcaat

SEQ ID NO: 39820 - DNA, 20 bp, Artificial Sequence
  Description of Artificial Sequence: Synthetic oligonucleotide
  Target: SCN10A; (+) strand; PAM type: NRG; PAM sequence: GAG
tgggaactacaggtcaatga

SEQ ID NO: 39821 - DNA, 20 bp, Artificial Sequence
  Description of Artificial Sequence: Synthetic oligonucleotide
  Target: SCN10A; (+) strand; PAM type: NRG; PAM sequence: CAG
aggtcaatgagagtcaaatg

SEQ ID NO: 39822 - DNA, 20 bp, Artificial Sequence
  Description of Artificial Sequence: Synthetic oligonucleotide
  Target: SCN10A; (+) strand; PAM type: NRG; PAM sequence: AGG
ggtcaatgagagtcaaatgc

SEQ ID NO: 39823 - DNA, 20 bp, Artificial Sequence
  Description of Artificial Sequence: Synthetic oligonucleotide
  Target: SCN10A; (+) strand; PAM type: NRG; PAM sequence: CAG
atgagagtcaaatgcaggta

SEQ ID NO: 39824 - DNA, 20 bp, Artificial Sequence
  Description of Artificial Sequence: Synthetic oligonucleotide
  Target: SCN10A; (+) strand; PAM type: NRG; PAM sequence: GAG
gagagtcaaatgcaggtaca

SEQ ID NO: 39825 - DNA, 20 bp, Artificial Sequence
  Description of Artificial Sequence: Synthetic oligonucleotide
  Target: SCN10A; (+) strand; PAM type: NRG; PAM sequence: GAG
gagtcaaatgcaggtacaga

SEQ ID NO: 39826 - DNA, 20 bp, Artificial Sequence
  Description of Artificial Sequence: Synthetic oligonucleotide
  Target: SCN10A; (+) strand; PAM type: NRG; PAM sequence: AGG
agtcaaatgcaggtacagag

SEQ ID NO: 39827 - DNA, 20 bp, Artificial Sequence
  Description of Artificial Sequence: Synthetic oligonucleotide
  Target: SCN10A; (+) strand; PAM type: NRG; PAM sequence: CAG
caaatgcaggtacagagagg

SEQ ID NO: 39828 - DNA, 20 bp, Artificial Sequence
  Description of Artificial Sequence: Synthetic oligonucleotide
  Target: SCN10A; (+) strand; PAM type: NRG; PAM sequence: GAG
aatgcaggtacagagaggca

SEQ ID NO: 39829 - DNA, 20 bp, Artificial Sequence
  Description of Artificial Sequence: Synthetic oligonucleotide
  Target: SCN10A; (+) strand; PAM type: NRG; PAM sequence: GAG
tgcaggtacagagaggcaga

SEQ ID NO: 39830 - DNA, 20 bp, Artificial Sequence
  Description of Artificial Sequence: Synthetic oligonucleotide
  Target: SCN10A; (+) strand; PAM type: NRG; PAM sequence: AGG
gcaggtacagagaggcagag

SEQ ID NO: 39831 - DNA, 20 bp, Artificial Sequence
  Description of Artificial Sequence: Synthetic oligonucleotide
  Target: SCN10A; (+) strand; PAM type: NRG; PAM sequence: AAG
acagagaggcagagaggatc

SEQ ID NO: 39832 - DNA, 20 bp, Artificial Sequence
  Description of Artificial Sequence: Synthetic oligonucleotide
  Target: SCN10A; (+) strand; PAM type: NRG; PAM sequence: AGG
cagagaggcagagaggatca

SEQ ID NO: 39833 - DNA, 20 bp, Artificial Sequence
  Description of Artificial Sequence: Synthetic oligonucleotide
  Target: SCN10A; (+) strand; PAM type: NRG; PAM sequence: AAG
cagagaggatcaaggactaa

SEQ ID NO: 39834 - DNA, 20 bp, Artificial Sequence
  Description of Artificial Sequence: Synthetic oligonucleotide
  Target: SCN10A; (+) strand; PAM type: NRG; PAM sequence: CAG
aagccatatcctcaccctct

SEQ ID NO: 39835 - DNA, 20 bp, Artificial Sequence
  Description of Artificial Sequence: Synthetic oligonucleotide
  Target: SCN10A; (+) strand; PAM type: NRG; PAM sequence: AAG
catatcctcaccctctcagc

SEQ ID NO: 39836 - DNA, 20 bp, Artificial Sequence
  Description of Artificial Sequence: Synthetic oligonucleotide
  Target: SCN10A; (+) strand; PAM type: NRG; PAM sequence: TGG
ctcagcaagatcctcatctc

SEQ ID NO: 39837 - DNA, 20 bp, Artificial Sequence
  Description of Artificial Sequence: Synthetic oligonucleotide
  Target: SCN10A; (+) strand; PAM type: NRG; PAM sequence: GGG
tcagcaagatcctcatctct

SEQ ID NO: 39838 - DNA, 20 bp, Artificial Sequence
  Description of Artificial Sequence: Synthetic oligonucleotide
  Target: SCN10A; (+) strand; PAM type: NRG; PAM sequence: CAG
atcctcatctctgggactga

SEQ ID NO: 39839 - DNA, 20 bp, Artificial Sequence
  Description of Artificial Sequence: Synthetic oligonucleotide
  Target: SCN10A; (+) strand; PAM type: NRG; PAM sequence: AAG
tctgggactgacagtgcacc

SEQ ID NO: 39840 - DNA, 20 bp, Artificial Sequence
  Description of Artificial Sequence: Synthetic oligonucleotide
  Target: SCN10A; (+) strand; PAM type: NRG; PAM sequence: GAG
gactgacagtgcaccaagat

SEQ ID NO: 39841 - DNA, 20 bp, Artificial Sequence
  Description of Artificial Sequence: Synthetic oligonucleotide
  Target: SCN10A; (+) strand; PAM type: NRG; PAM sequence: GAG
tgcaccaagatgagcccact

SEQ ID NO: 39842 - DNA, 20 bp, Artificial Sequence
  Description of Artificial Sequence: Synthetic oligonucleotide
  Target: SCN10A; (+) strand; PAM type: NRG; PAM sequence: AGG
gcaccaagatgagcccactg

SEQ ID NO: 39843 - DNA, 20 bp, Artificial Sequence
  Description of Artificial Sequence: Synthetic oligonucleotide
  Target: SCN10A; (+) strand; PAM type: NRG; PAM sequence: GGG
caccaagatgagcccactga

SEQ ID NO: 39844 - DNA, 20 bp, Artificial Sequence
  Description of Artificial Sequence: Synthetic oligonucleotide
  Target: SCN10A; (+) strand; PAM type: NRG; PAM sequence: TGG
gcccactgagggtactttaa

SEQ ID NO: 39845 - DNA, 20 bp, Artificial Sequence
  Description of Artificial Sequence: Synthetic oligonucleotide
  Target: SCN10A; (+) strand; PAM type: NRG; PAM sequence: CAG
actgagggtactttaatgga

SEQ ID NO: 39846 - DNA, 20 bp, Artificial Sequence
  Description of Artificial Sequence: Synthetic oligonucleotide
  Target: SCN10A; (+) strand; PAM type: NRG; PAM sequence: CAG
agggtactttaatggacaga

SEQ ID NO: 39847 - DNA, 20 bp, Artificial Sequence
  Description of Artificial Sequence: Synthetic oligonucleotide
  Target: SCN10A; (+) strand; PAM type: NRG; PAM sequence: CAG
atggacagacagccaatcct

SEQ ID NO: 39848 - DNA, 20 bp, Artificial Sequence
  Description of Artificial Sequence: Synthetic oligonucleotide
  Target: SCN10A; (+) strand; PAM type: NRG; PAM sequence: AGG
tggacagacagccaatcctc

SEQ ID NO: 39849 - DNA, 20 bp, Artificial Sequence
  Description of Artificial Sequence: Synthetic oligonucleotide
  Target: SCN10A; (+) strand; PAM type: NRG; PAM sequence: TGG
cagacagccaatcctcaggc

SEQ ID NO: 39850 - DNA, 20 bp, Artificial Sequence
  Description of Artificial Sequence: Synthetic oligonucleotide
  Target: SCN10A; (+) strand; PAM type: NRG; PAM sequence: AAG
cagccaatcctcaggctggt

SEQ ID NO: 39851 - DNA, 20 bp, Artificial Sequence
  Description of Artificial Sequence: Synthetic oligonucleotide
  Target: SCN10A; (+) strand; PAM type: NRG; PAM sequence: GAG
gccaatcctcaggctggtaa

SEQ ID NO: 39852 - DNA, 20 bp, Artificial Sequence
  Description of Artificial Sequence: Synthetic oligonucleotide
  Target: SCN10A; (+) strand; PAM type: NRG; PAM sequence: AGG
ccaatcctcaggctggtaag

SEQ ID NO: 39853 - DNA, 20 bp, Artificial Sequence
  Description of Artificial Sequence: Synthetic oligonucleotide
  Target: SCN10A; (+) strand; PAM type: NRG; PAM sequence: CAG
ctggtaagaggtgttatgcc

SEQ ID NO: 39854 - DNA, 20 bp, Artificial Sequence
  Description of Artificial Sequence: Synthetic oligonucleotide
  Target: SCN10A; (+) strand; PAM type: NRG; PAM sequence: AGG
tggtaagaggtgttatgccc

SEQ ID NO: 39855 - DNA, 20 bp, Artificial Sequence
  Description of Artificial Sequence: Synthetic oligonucleotide
  Target: SCN10A; (+) strand; PAM type: NRG; PAM sequence: GGG
ggtaagaggtgttatgccca

SEQ ID NO: 39856 - DNA, 20 bp, Artificial Sequence
  Description of Artificial Sequence: Synthetic oligonucleotide
  Target: SCN10A; (+) strand; PAM type: NRG; PAM sequence: GGG
gtaagaggtgttatgcccag

SEQ ID NO: 39857 - DNA, 20 bp, Artificial Sequence
  Description of Artificial Sequence: Synthetic oligonucleotide
  Target: SCN10A; (+) strand; PAM type: NRG; PAM sequence: GAG
aagaggtgttatgcccaggg

SEQ ID NO: 39858 - DNA, 20 bp, Artificial Sequence
  Description of Artificial Sequence: Synthetic oligonucleotide
  Target: SCN10A; (+) strand; PAM type: NRG; PAM sequence: AGG
agaggtgttatgcccagggg

SEQ ID NO: 39859 - DNA, 20 bp, Artificial Sequence
  Description of Artificial Sequence: Synthetic oligonucleotide
  Target: SCN10A; (+) strand; PAM type: NRG; PAM sequence: TGG
ttatgcccaggggaggactc

SEQ ID NO: 39860 - DNA, 20 bp, Artificial Sequence
  Description of Artificial Sequence: Synthetic oligonucleotide
  Target: SCN10A; (+) strand; PAM type: NRG; PAM sequence: CAG
ccaggggaggactctggcaa

SEQ ID NO: 39861 - DNA, 20 bp, Artificial Sequence
  Description of Artificial Sequence: Synthetic oligonucleotide
  Target: SCN10A; (+) strand; PAM type: NRG; PAM sequence: AGG
caggggaggactctggcaac

SEQ ID NO: 39862 - DNA, 20 bp, Artificial Sequence
  Description of Artificial Sequence: Synthetic oligonucleotide
  Target: SCN10A; (+) strand; PAM type: NRG; PAM sequence: TGG
ggaggactctggcaacagga

SEQ ID NO: 39863 - DNA, 20 bp, Artificial Sequence
  Description of Artificial Sequence: Synthetic oligonucleotide
  Target: SCN10A; (+) strand; PAM type: NRG; PAM sequence: AAG
actctggcaacaggatggtg

SEQ ID NO: 39864 - DNA, 20 bp, Artificial Sequence
  Description of Artificial Sequence: Synthetic oligonucleotide
  Target: SCN10A; (+) strand; PAM type: NRG; PAM sequence: TGG
gcaacaggatggtgaagtta

SEQ ID NO: 39865 - DNA, 20 bp, Artificial Sequence
  Description of Artificial Sequence: Synthetic oligonucleotide
  Target: SCN10A; (+) strand; PAM type: NRG; PAM sequence: AAG
catttaatttctcttctgac

SEQ ID NO: 39866 - DNA, 20 bp, Artificial Sequence
  Description of Artificial Sequence: Synthetic oligonucleotide
  Target: SCN10A; (+) strand; PAM type: NRG; PAM sequence: GAG
tttaatttctcttctgacaa

SEQ ID NO: 39867 - DNA, 20 bp, Artificial Sequence
  Description of Artificial Sequence: Synthetic oligonucleotide
  Target: SCN10A; (+) strand; PAM type: NRG; PAM sequence: TGG
ctgtctcttaaatcctctcc

SEQ ID NO: 39868 - DNA, 20 bp, Artificial Sequence
  Description of Artificial Sequence: Synthetic oligonucleotide
  Target: SCN10A; (+) strand; PAM type: NRG; PAM sequence: GAG
ctctcctggtttctccctct

SEQ ID NO: 39869 - DNA, 20 bp, Artificial Sequence
  Description of Artificial Sequence: Synthetic oligonucleotide
  Target: SCN10A; (+) strand; PAM type: NRG; PAM sequence: AGG
tctcctggtttctccctctg

SEQ ID NO: 39870 - DNA, 20 bp, Artificial Sequence
  Description of Artificial Sequence: Synthetic oligonucleotide
  Target: SCN10A; (+) strand; PAM type: NRG; PAM sequence: TAG
ggtttctccctctgaggatt

SEQ ID NO: 39871 - DNA, 20 bp, Artificial Sequence
  Description of Artificial Sequence: Synthetic oligonucleotide
  Target: SCN10A; (+) strand; PAM type: NRG; PAM sequence: AGG
gtttctccctctgaggattt

SEQ ID NO: 39872 - DNA, 20 bp, Artificial Sequence
  Description of Artificial Sequence: Synthetic oligonucleotide
  Target: SCN10A; (+) strand; PAM type: NRG; PAM sequence: GAG
ttctccctctgaggatttag

SEQ ID NO: 39873 - DNA, 20 bp, Artificial Sequence
  Description of Artificial Sequence: Synthetic oligonucleotide
  Target: SCN10A; (+) strand; PAM type: NRG; PAM sequence: AGG
tctccctctgaggatttagg

SEQ ID NO: 39874 - DNA, 20 bp, Artificial Sequence
  Description of Artificial Sequence: Synthetic oligonucleotide
  Target: SCN10A; (+) strand; PAM type: NRG; PAM sequence: TGG
tttaggaggatatgaactct

SEQ ID NO: 39875 - DNA, 20 bp, Artificial Sequence
  Description of Artificial Sequence: Synthetic oligonucleotide
  Target: SCN10A; (+) strand; PAM type: NRG; PAM sequence: TGG
gaggatatgaactcttggca

SEQ ID NO: 39876 - DNA, 20 bp, Artificial Sequence
  Description of Artificial Sequence: Synthetic oligonucleotide
  Target: SCN10A; (+) strand; PAM type: NRG; PAM sequence: GGG
aggatatgaactcttggcat

SEQ ID NO: 39877 - DNA, 20 bp, Artificial Sequence
  Description of Artificial Sequence: Synthetic oligonucleotide
  Target: SCN10A; (+) strand; PAM type: NRG; PAM sequence: GAG
gatatgaactcttggcatgg

SEQ ID NO: 39878 - DNA, 20 bp, Artificial Sequence
  Description of Artificial Sequence: Synthetic oligonucleotide
  Target: SCN10A; (+) strand; PAM type: NRG; PAM sequence: GAG
tatgaactcttggcatggga

SEQ ID NO: 39879 - DNA, 20 bp, Artificial Sequence
  Description of Artificial Sequence: Synthetic oligonucleotide
  Target: SCN10A; (+) strand; PAM type: NRG; PAM sequence: AGG
atgaactcttggcatgggag

SEQ ID NO: 39880 - DNA, 20 bp, Artificial Sequence
  Description of Artificial Sequence: Synthetic oligonucleotide
  Target: SCN10A; (+) strand; PAM type: NRG; PAM sequence: GAG
gaactcttggcatgggagag

SEQ ID NO: 39881 - DNA, 20 bp, Artificial Sequence
  Description of Artificial Sequence: Synthetic oligonucleotide
  Target: SCN10A; (+) strand; PAM type: NRG; PAM sequence: AGG
aactcttggcatgggagagg

SEQ ID NO: 39882 - DNA, 20 bp, Artificial Sequence
  Description of Artificial Sequence: Synthetic oligonucleotide
  Target: SCN10A; (+) strand; PAM type: NRG; PAM sequence: AAG
tcttggcatgggagaggagg

SEQ ID NO: 39883 - DNA, 20 bp, Artificial Sequence
  Description of Artificial Sequence: Synthetic oligonucleotide
  Target: SCN10A; (+) strand; PAM type: NRG; PAM sequence: AAG
ggcatgggagaggaggaaga

SEQ ID NO: 39884 - DNA, 20 bp, Artificial Sequence
  Description of Artificial Sequence: Synthetic oligonucleotide
  Target: SCN10A; (+) strand; PAM type: NRG; PAM sequence: CAG
agaggaggaagaaagatatt

SEQ ID NO: 39885 - DNA, 20 bp, Artificial Sequence
  Description of Artificial Sequence: Synthetic oligonucleotide
  Target: SCN10A; (+) strand; PAM type: NRG; PAM sequence: TAG
tgcctttttatttactctgc

SEQ ID NO: 39886 - DNA, 20 bp, Artificial Sequence
  Description of Artificial Sequence: Synthetic oligonucleotide
  Target: SCN10A; (+) strand; PAM type: NRG; PAM sequence: GAG
ttactctgctagccatattt

SEQ ID NO: 39887 - DNA, 20 bp, Artificial Sequence
  Description of Artificial Sequence: Synthetic oligonucleotide
  Target: SCN10A; (+) strand; PAM type: NRG; PAM sequence: TGG
tctgctagccatatttgaga

SEQ ID NO: 39888 - DNA, 20 bp, Artificial Sequence
  Description of Artificial Sequence: Synthetic oligonucleotide
  Target: SCN10A; (+) strand; PAM type: NRG; PAM sequence: TGG
aacatgcattcaccattttt

SEQ ID NO: 39889 - DNA, 20 bp, Artificial Sequence
  Description of Artificial Sequence: Synthetic oligonucleotide
  Target: SCN10A; (+) strand; PAM type: NRG; PAM sequence: TAG
attcaccattttttggctcg

SEQ ID NO: 39890 - DNA, 20 bp, Artificial Sequence
  Description of Artificial Sequence: Synthetic oligonucleotide
  Target: SCN10A; (+) strand; PAM type: NRG; PAM sequence: CAG
agaacatcaaaaatacaaca

SEQ ID NO: 39891 - DNA, 20 bp, Artificial Sequence
  Description of Artificial Sequence: Synthetic oligonucleotide
  Target: SCN10A; (+) strand; PAM type: NRG; PAM sequence: AGG
gaacatcaaaaatacaacac

SEQ ID NO: 39892 - DNA, 20 bp, Artificial Sequence
  Description of Artificial Sequence: Synthetic oligonucleotide
  Target: SCN10A; (+) strand; PAM type: NRG; PAM sequence: GAG
atcaaaaatacaacacaggt

SEQ ID NO: 39893 - DNA, 20 bp, Artificial Sequence
  Description of Artificial Sequence: Synthetic oligonucleotide
  Target: SCN10A; (+) strand; PAM type: NRG; PAM sequence: AAG
caggtgagataattgtcatg

SEQ ID NO: 39894 - DNA, 20 bp, Artificial Sequence
  Description of Artificial Sequence: Synthetic oligonucleotide
  Target: SCN10A; (+) strand; PAM type: NRG; PAM sequence: AAG
gtgagataattgtcatgaag

SEQ ID NO: 39895 - DNA, 20 bp, Artificial Sequence
  Description of Artificial Sequence: Synthetic oligonucleotide
  Target: SCN10A; (+) strand; PAM type: NRG; PAM sequence: CAG
attctcaaactttttgattt

SEQ ID NO: 39896 - DNA, 20 bp, Artificial Sequence
  Description of Artificial Sequence: Synthetic oligonucleotide
  Target: SCN10A; (+) strand; PAM type: NRG; PAM sequence: AGG
ttctcaaactttttgatttc

SEQ ID NO: 39897 - DNA, 20 bp, Artificial Sequence
  Description of Artificial Sequence: Synthetic oligonucleotide
  Target: SCN10A; (+) strand; PAM type: NRG; PAM sequence: GGG
tctcaaactttttgatttca

SEQ ID NO: 39898 - DNA, 20 bp, Artificial Sequence
  Description of Artificial Sequence: Synthetic oligonucleotide
  Target: SCN10A; (+) strand; PAM type: NRG; PAM sequence: GAG
tattactctcaaaccttatt

SEQ ID NO: 39899 - DNA, 20 bp, Artificial Sequence
  Description of Artificial Sequence: Synthetic oligonucleotide
  Target: SCN10A; (+) strand; PAM type: NRG; PAM sequence: AGG
attactctcaaaccttattg

SEQ ID NO: 39900 - DNA, 20 bp, Artificial Sequence
  Description of Artificial Sequence: Synthetic oligonucleotide
  Target: SCN10A; (+) strand; PAM type: NRG; PAM sequence: CAG
tgatacctttttgtttatgc

SEQ ID NO: 39901 - DNA, 20 bp, Artificial Sequence
  Description of Artificial Sequence: Synthetic oligonucleotide
  Target: SCN10A; (+) strand; PAM type: NRG; PAM sequence: TAG
cagatatatgtatatcatat

SEQ ID NO: 39902 - DNA, 20 bp, Artificial Sequence
  Description of Artificial Sequence: Synthetic oligonucleotide
  Target: SCN10A; (+) strand; PAM type: NRG; PAM sequence: TAG
tatacctatatatacataac

SEQ ID NO: 39903 - DNA, 20 bp, Artificial Sequence
  Description of Artificial Sequence: Synthetic oligonucleotide
  Target: SCN10A; (+) strand; PAM type: NRG; PAM sequence: TGG
tatatacataactagctaca

SEQ ID NO: 39904 - DNA, 20 bp, Artificial Sequence
  Description of Artificial Sequence: Synthetic oligonucleotide
  Target: SCN10A; (+) strand; PAM type: NRG; PAM sequence: TAG
acataactagctacatggtc

SEQ ID NO: 39905 - DNA, 20 bp, Artificial Sequence
  Description of Artificial Sequence: Synthetic oligonucleotide
  Target: SCN10A; (+) strand; PAM type: NRG; PAM sequence: TAG
tctagttgtatgtatataca

SEQ ID NO: 39906 - DNA, 20 bp, Artificial Sequence
  Description of Artificial Sequence: Synthetic oligonucleotide
  Target: SCN10A; (+) strand; PAM type: NRG; PAM sequence: TAG
catagttgtatgtatatata

SEQ ID NO: 39907 - DNA, 20 bp, Artificial Sequence
  Description of Artificial Sequence: Synthetic oligonucleotide
  Target: SCN10A; (+) strand; PAM type: NRG; PAM sequence: TAG
gtatgtatatatatagtgta

SEQ ID NO: 39908 - DNA, 20 bp, Artificial Sequence
  Description of Artificial Sequence: Synthetic oligonucleotide
  Target: SCN10A; (+) strand; PAM type: NRG; PAM sequence: TAG
tgtgtatatatatctcatat

SEQ ID NO: 39909 - DNA, 20 bp, Artificial Sequence
  Description of Artificial Sequence: Synthetic oligonucleotide
  Target: SCN10A; (+) strand; PAM type: NRG; PAM sequence: CAG
catattagaaattcaaaact

SEQ ID NO: 39910 - DNA, 20 bp, Artificial Sequence
  Description of Artificial Sequence: Synthetic oligonucleotide
  Target: SCN10A; (+) strand; PAM type: NRG; PAM sequence: AGG
atattagaaattcaaaactc

SEQ ID NO: 39911 - DNA, 20 bp, Artificial Sequence
  Description of Artificial Sequence: Synthetic oligonucleotide
  Target: SCN10A; (+) strand; PAM type: NRG; PAM sequence: CGG
actcaggaaattttaaaaca

SEQ ID NO: 39912 - DNA, 20 bp, Artificial Sequence
  Description of Artificial Sequence: Synthetic oligonucleotide
  Target: SCN10A; (+) strand; PAM type: NRG; PAM sequence: GGG
ctcaggaaattttaaaacac

SEQ ID NO: 39913 - DNA, 20 bp, Artificial Sequence
  Description of Artificial Sequence: Synthetic oligonucleotide
  Target: SCN10A; (+) strand; PAM type: NRG; PAM sequence: CAG
ttttaaaacacgggaatata

SEQ ID NO: 39914 - DNA, 20 bp, Artificial Sequence
  Description of Artificial Sequence: Synthetic oligonucleotide
  Target: SCN10A; (+) strand; PAM type: NRG; PAM sequence: AGG
tttaaaacacgggaatatac

SEQ ID NO: 39915 - DNA, 20 bp, Artificial Sequence
  Description of Artificial Sequence: Synthetic oligonucleotide
  Target: SCN10A; (+) strand; PAM type: NRG; PAM sequence: CAG
gaatatacaggcacacattc

SEQ ID NO: 39916 - DNA, 20 bp, Artificial Sequence
  Description of Artificial Sequence: Synthetic oligonucleotide
  Target: SCN10A; (+) strand; PAM type: NRG; PAM sequence: TAG
tatacaggcacacattccag

SEQ ID NO: 39917 - DNA, 20 bp, Artificial Sequence
  Description of Artificial Sequence: Synthetic oligonucleotide
  Target: SCN10A; (+) strand; PAM type: NRG; PAM sequence: TAG
gcacacattccagtagcttt

SEQ ID NO: 39918 - DNA, 20 bp, Artificial Sequence
  Description of Artificial Sequence: Synthetic oligonucleotide
  Target: SCN10A; (+) strand; PAM type: NRG; PAM sequence: GAG
acacattccagtagctttta

SEQ ID NO: 39919 - DNA, 20 bp, Artificial Sequence
  Description of Artificial Sequence: Synthetic oligonucleotide
  Target: SCN10A; (+) strand; PAM type: NRG; PAM sequence: TAG
atgacatcatcccccatcaa

SEQ ID NO: 39920 - DNA, 20 bp, Artificial Sequence
  Description of Artificial Sequence: Synthetic oligonucleotide
  Target: SCN10A; (+) strand; PAM type: NRG; PAM sequence: AAG
attcaccaatgtatgatcat

SEQ ID NO: 39921 - DNA, 20 bp, Artificial Sequence
  Description of Artificial Sequence: Synthetic oligonucleotide
  Target: SCN10A; (+) strand; PAM type: NRG; PAM sequence: GAG
tcaccaatgtatgatcataa

SEQ ID NO: 39922 - DNA, 20 bp, Artificial Sequence
  Description of Artificial Sequence: Synthetic oligonucleotide
  Target: SCN10A; (+) strand; PAM type: NRG; PAM sequence: AAG
caatgtatgatcataagaga

SEQ ID NO: 39923 - DNA, 20 bp, Artificial Sequence
  Description of Artificial Sequence: Synthetic oligonucleotide
  Target: SCN10A; (+) strand; PAM type: NRG; PAM sequence: AAG
ataagagaaagtgtgtgaaa

SEQ ID NO: 39924 - DNA, 20 bp, Artificial Sequence
  Description of Artificial Sequence: Synthetic oligonucleotide
  Target: SCN10A; (+) strand; PAM type: NRG; PAM sequence: AAG
gaaaaagacaaattacatcc

SEQ ID NO: 39925 - DNA, 20 bp, Artificial Sequence
  Description of Artificial Sequence: Synthetic oligonucleotide
  Target: SCN10A; (+) strand; PAM type: NRG; PAM sequence: TAG
atccaagtattgttatacaa

SEQ ID NO: 39926 - DNA, 20 bp, Artificial Sequence
  Description of Artificial Sequence: Synthetic oligonucleotide
  Target: SCN10A; (+) strand; PAM type: NRG; PAM sequence: CAG
attttataaacccactaaaa

SEQ ID NO: 39927 - DNA, 20 bp, Artificial Sequence
  Description of Artificial Sequence: Synthetic oligonucleotide
  Target: SCN10A; (+) strand; PAM type: NRG; PAM sequence: TGG
taaacccactaaaacagttt

SEQ ID NO: 39928 - DNA, 20 bp, Artificial Sequence
  Description of Artificial Sequence: Synthetic oligonucleotide
  Target: SCN10A; (+) strand; PAM type: NRG; PAM sequence: GGG
aaacccactaaaacagtttt

SEQ ID NO: 39929 - DNA, 20 bp, Artificial Sequence
  Description of Artificial Sequence: Synthetic oligonucleotide
  Target: SCN10A; (+) strand; PAM type: NRG; PAM sequence: GGG
aacccactaaaacagttttg

SEQ ID NO: 39930 - DNA, 20 bp, Artificial Sequence
  Description of Artificial Sequence: Synthetic oligonucleotide
  Target: SCN10A; (+) strand; PAM type: NRG; PAM sequence: CAG
taaaacagttttggggacac

SEQ ID NO: 39931 - DNA, 20 bp, Artificial Sequence
  Description of Artificial Sequence: Synthetic oligonucleotide
  Target: SCN10A; (+) strand; PAM type: NRG; PAM sequence: AGG
aaaacagttttggggacacc

SEQ ID NO: 39932 - DNA, 20 bp, Artificial Sequence
  Description of Artificial Sequence: Synthetic oligonucleotide
  Target: SCN10A; (+) strand; PAM type: NRG; PAM sequence: GGG
aaacagttttggggacacca

SEQ ID NO: 39933 - DNA, 20 bp, Artificial Sequence
  Description of Artificial Sequence: Synthetic oligonucleotide
  Target: SCN10A; (+) strand; PAM type: NRG; PAM sequence: GGG
aacagttttggggacaccag

SEQ ID NO: 39934 - DNA, 20 bp, Artificial Sequence
  Description of Artificial Sequence: Synthetic oligonucleotide
  Target: SCN10A; (+) strand; PAM type: NRG; PAM sequence: AAG
ttggggacaccaggggttcc

SEQ ID NO: 39935 - DNA, 20 bp, Artificial Sequence
  Description of Artificial Sequence: Synthetic oligonucleotide
  Target: SCN10A; (+) strand; PAM type: NRG; PAM sequence: TAG
caccaggggttccaagatca

SEQ ID NO: 39936 - DNA, 20 bp, Artificial Sequence
  Description of Artificial Sequence: Synthetic oligonucleotide
  Target: SCN10A; (+) strand; PAM type: NRG; PAM sequence: GAG
ggggttccaagatcatagtt

SEQ ID NO: 39937 - DNA, 20 bp, Artificial Sequence
  Description of Artificial Sequence: Synthetic oligonucleotide
  Target: SCN10A; (+) strand; PAM type: NRG; PAM sequence: AGG
gggttccaagatcatagttg

SEQ ID NO: 39938 - DNA, 20 bp, Artificial Sequence
  Description of Artificial Sequence: Synthetic oligonucleotide
  Target: SCN10A; (+) strand; PAM type: NRG; PAM sequence: TGG
agatcatagttgaggaccac

SEQ ID NO: 39939 - DNA, 20 bp, Artificial Sequence
  Description of Artificial Sequence: Synthetic oligonucleotide
  Target: SCN10A; (+) strand; PAM type: NRG; PAM sequence: AAG
catgctcctcccccaacctc

SEQ ID NO: 39940 - DNA, 20 bp, Artificial Sequence
  Description of Artificial Sequence: Synthetic oligonucleotide
  Target: SCN10A; (+) strand; PAM type: NRG; PAM sequence: AAG
atgtctgctctccacctgca

SEQ ID NO: 39941 - DNA, 20 bp, Artificial Sequence
  Description of Artificial Sequence: Synthetic oligonucleotide
  Target: SCN10A; (+) strand; PAM type: NRG; PAM sequence: GAG
gtctgctctccacctgcaaa

SEQ ID NO: 39942 - DNA, 20 bp, Artificial Sequence
  Description of Artificial Sequence: Synthetic oligonucleotide
  Target: SCN10A; (+) strand; PAM type: NRG; PAM sequence: TGG
gcaaagagacccaactcctc

SEQ ID NO: 39943 - DNA, 20 bp, Artificial Sequence
  Description of Artificial Sequence: Synthetic oligonucleotide
  Target: SCN10A; (+) strand; PAM type: NRG; PAM sequence: GAG
aaagagacccaactcctctg

SEQ ID NO: 39944 - DNA, 20 bp, Artificial Sequence
  Description of Artificial Sequence: Synthetic oligonucleotide
  Target: SCN10A; (+) strand; PAM type: NRG; PAM sequence: AGG
aagagacccaactcctctgg

SEQ ID NO: 39945 - DNA, 20 bp, Artificial Sequence
  Description of Artificial Sequence: Synthetic oligonucleotide
  Target: SCN10A; (+) strand; PAM type: NRG; PAM sequence: CAG
cccaactcctctggaggccc

SEQ ID NO: 39946 - DNA, 20 bp, Artificial Sequence
  Description of Artificial Sequence: Synthetic oligonucleotide
  Target: SCN10A; (+) strand; PAM type: NRG; PAM sequence: AGG
ccaactcctctggaggcccc

SEQ ID NO: 39947 - DNA, 20 bp, Artificial Sequence
  Description of Artificial Sequence: Synthetic oligonucleotide
  Target: SCN10A; (+) strand; PAM type: NRG; PAM sequence: CAG
ctcctctggaggccccaggc

SEQ ID NO: 39948 - DNA, 20 bp, Artificial Sequence
  Description of Artificial Sequence: Synthetic oligonucleotide
  Target: SCN10A; (+) strand; PAM type: NRG; PAM sequence: GAG
cctctggaggccccaggcca

SEQ ID NO: 39949 - DNA, 20 bp, Artificial Sequence
  Description of Artificial Sequence: Synthetic oligonucleotide
  Target: SCN10A; (+) strand; PAM type: NRG; PAM sequence: AGG
ctctggaggccccaggccag

SEQ ID NO: 39950 - DNA, 20 bp, Artificial Sequence
  Description of Artificial Sequence: Synthetic oligonucleotide
  Target: SCN10A; (+) strand; PAM type: NRG; PAM sequence: AAG
ccccaggccagaggtcatcc

SEQ ID NO: 39951 - DNA, 20 bp, Artificial Sequence
  Description of Artificial Sequence: Synthetic oligonucleotide
  Target: SCN10A; (+) strand; PAM type: NRG; PAM sequence: AGG
cccaggccagaggtcatcca

SEQ ID NO: 39952 - DNA, 20 bp, Artificial Sequence
  Description of Artificial Sequence: Synthetic oligonucleotide
  Target: SCN10A; (+) strand; PAM type: NRG; PAM sequence: GGG
ccaggccagaggtcatccaa

SEQ ID NO: 39953 - DNA, 20 bp, Artificial Sequence
  Description of Artificial Sequence: Synthetic oligonucleotide
  Target: SCN10A; (+) strand; PAM type: NRG; PAM sequence: CAG
ccagaggtcatccaagggaa

SEQ ID NO: 39954 - DNA, 20 bp, Artificial Sequence
  Description of Artificial Sequence: Synthetic oligonucleotide
  Target: SCN10A; (+) strand; PAM type: NRG; PAM sequence: AAG
gaacagccaactttccctga

SEQ ID NO: 39955 - DNA, 20 bp, Artificial Sequence
  Description of Artificial Sequence: Synthetic oligonucleotide
  Target: SCN10A; (+) strand; PAM type: NRG; PAM sequence: CAG
aactttccctgaaagctctg

SEQ ID NO: 39956 - DNA, 20 bp, Artificial Sequence
  Description of Artificial Sequence: Synthetic oligonucleotide
  Target: SCN10A; (+) strand; PAM type: NRG; PAM sequence: CAG
tttccctgaaagctctgcag

SEQ ID NO: 39957 - DNA, 20 bp, Artificial Sequence
  Description of Artificial Sequence: Synthetic oligonucleotide
  Target: SCN10A; (+) strand; PAM type: NRG; PAM sequence: AAG
gcagcagttatctgcttttg

SEQ ID NO: 39958 - DNA, 20 bp, Artificial Sequence
  Description of Artificial Sequence: Synthetic oligonucleotide
  Target: SCN10A; (+) strand; PAM type: NRG; PAM sequence: TGG
gttatctgcttttgaagatg

SEQ ID NO: 39959 - DNA, 20 bp, Artificial Sequence
  Description of Artificial Sequence: Synthetic oligonucleotide
  Target: SCN10A; (+) strand; PAM type: NRG; PAM sequence: GGG
ttatctgcttttgaagatgt

SEQ ID NO: 39960 - DNA, 20 bp, Artificial Sequence
  Description of Artificial Sequence: Synthetic oligonucleotide
  Target: SCN10A; (+) strand; PAM type: NRG; PAM sequence: TAG
tgcttttgaagatgtgggtt

SEQ ID NO: 39961 - DNA, 20 bp, Artificial Sequence
  Description of Artificial Sequence: Synthetic oligonucleotide
  Target: SCN10A; (+) strand; PAM type: NRG; PAM sequence: TAG
tttgaagatgtgggtttagt

SEQ ID NO: 39962 - DNA, 20 bp, Artificial Sequence
  Description of Artificial Sequence: Synthetic oligonucleotide
  Target: SCN10A; (+) strand; PAM type: NRG; PAM sequence: AAG
ataaatgtcataaaaattca

SEQ ID NO: 39963 - DNA, 20 bp, Artificial Sequence
  Description of Artificial Sequence: Synthetic oligonucleotide
  Target: SCN10A; (+) strand; PAM type: NRG; PAM sequence: GAG
aaatgtcataaaaattcaaa

SEQ ID NO: 39964 - DNA, 20 bp, Artificial Sequence
  Description of Artificial Sequence: Synthetic oligonucleotide
  Target: SCN10A; (+) strand; PAM type: NRG; PAM sequence: AAG
attcaaagagatcatcaaat

SEQ ID NO: 39965 - DNA, 20 bp, Artificial Sequence
  Description of Artificial Sequence: Synthetic oligonucleotide
  Target: SCN10A; (+) strand; PAM type: NRG; PAM sequence: TAG
aaagagatcatcaaataagt

SEQ ID NO: 39966 - DNA, 20 bp, Artificial Sequence
  Description of Artificial Sequence: Synthetic oligonucleotide
  Target: SCN10A; (+) strand; PAM type: NRG; PAM sequence: GAG
agagatcatcaaataagtta

SEQ ID NO: 39967 - DNA, 20 bp, Artificial Sequence
  Description of Artificial Sequence: Synthetic oligonucleotide
  Target: SCN10A; (+) strand; PAM type: NRG; PAM sequence: TGG
atatatatatatattttttt

SEQ ID NO: 39968 - DNA, 20 bp, Artificial Sequence
  Description of Artificial Sequence: Synthetic oligonucleotide
  Target: SCN10A; (+) strand; PAM type: NRG; PAM sequence: CGG
atattttttttggttgttaa

SEQ ID NO: 39969 - DNA, 20 bp, Artificial Sequence
  Description of Artificial Sequence: Synthetic oligonucleotide
  Target: SCN10A; (+) strand; PAM type: NRG; PAM sequence: TAG
ttggttgttaacggaatctt

SEQ ID NO: 39970 - DNA, 20 bp, Artificial Sequence
  Description of Artificial Sequence: Synthetic oligonucleotide
  Target: SCN10A; (+) strand; PAM type: NRG; PAM sequence: CAG
gttgttaacggaatctttag

SEQ ID NO: 39971 - DNA, 20 bp, Artificial Sequence
  Description of Artificial Sequence: Synthetic oligonucleotide
  Target: SCN10A; (+) strand; PAM type: NRG; PAM sequence: CAG
tagcagactgccacatcacc

SEQ ID NO: 39972 - DNA, 20 bp, Artificial Sequence
  Description of Artificial Sequence: Synthetic oligonucleotide
  Target: SCN10A; (+) strand; PAM type: NRG; PAM sequence: AGG
agcagactgccacatcaccc

SEQ ID NO: 39973 - DNA, 20 bp, Artificial Sequence
  Description of Artificial Sequence: Synthetic oligonucleotide
  Target: SCN10A; (+) strand; PAM type: NRG; PAM sequence: GGG
gcagactgccacatcaccca

SEQ ID NO: 39974 - DNA, 20 bp, Artificial Sequence
  Description of Artificial Sequence: Synthetic oligonucleotide
  Target: SCN10A; (+) strand; PAM type: NRG; PAM sequence: AAG
ctgccacatcacccagggcc

SEQ ID NO: 39975 - DNA, 20 bp, Artificial Sequence
  Description of Artificial Sequence: Synthetic oligonucleotide
  Target: SCN10A; (+) strand; PAM type: NRG; PAM sequence: AGG
tgccacatcacccagggcca

SEQ ID NO: 39976 - DNA, 20 bp, Artificial Sequence
  Description of Artificial Sequence: Synthetic oligonucleotide
  Target: SCN10A; (+) strand; PAM type: NRG; PAM sequence: GAG
ccacatcacccagggccaag

SEQ ID NO: 39977 - DNA, 20 bp, Artificial Sequence
  Description of Artificial Sequence: Synthetic oligonucleotide
  Target: SCN10A; (+) strand; PAM type: NRG; PAM sequence: AGG
cacatcacccagggccaagg

SEQ ID NO: 39978 - DNA, 20 bp, Artificial Sequence
  Description of Artificial Sequence: Synthetic oligonucleotide
  Target: SCN10A; (+) strand; PAM type: NRG; PAM sequence: TGG
cagggccaaggaggactttc

SEQ ID NO: 39979 - DNA, 20 bp, Artificial Sequence
  Description of Artificial Sequence: Synthetic oligonucleotide
  Target: SCN10A; (+) strand; PAM type: NRG; PAM sequence: GGG
agggccaaggaggactttct

SEQ ID NO: 39980 - DNA, 20 bp, Artificial Sequence
  Description of Artificial Sequence: Synthetic oligonucleotide
  Target: SCN10A; (+) strand; PAM type: NRG; PAM sequence: TGG
ccaaggaggactttctgggc

SEQ ID NO: 39981 - DNA, 20 bp, Artificial Sequence
  Description of Artificial Sequence: Synthetic oligonucleotide
  Target: SCN10A; (+) strand; PAM type: NRG; PAM sequence: GGG
caaggaggactttctgggct

SEQ ID NO: 39982 - DNA, 20 bp, Artificial Sequence
  Description of Artificial Sequence: Synthetic oligonucleotide
  Target: SCN10A; (+) strand; PAM type: NRG; PAM sequence: TGG
ggaggactttctgggctggg

SEQ ID NO: 39983 - DNA, 20 bp, Artificial Sequence
  Description of Artificial Sequence: Synthetic oligonucleotide
  Target: SCN10A; (+) strand; PAM type: NRG; PAM sequence: GGG
gaggactttctgggctgggt

SEQ ID NO: 39984 - DNA, 20 bp, Artificial Sequence
  Description of Artificial Sequence: Synthetic oligonucleotide
  Target: SCN10A; (+) strand; PAM type: NRG; PAM sequence: GAG
tttctgggctgggtgggacc

SEQ ID NO: 39985 - DNA, 20 bp, Artificial Sequence
  Description of Artificial Sequence: Synthetic oligonucleotide
  Target: SCN10A; (+) strand; PAM type: NRG; PAM sequence: AAG
gggaccgagacttcctctcc

SEQ ID NO: 39986 - DNA, 20 bp, Artificial Sequence
  Description of Artificial Sequence: Synthetic oligonucleotide
  Target: SCN10A; (+) strand; PAM type: NRG; PAM sequence: GAG
gaccgagacttcctctccaa

SEQ ID NO: 39987 - DNA, 20 bp, Artificial Sequence
  Description of Artificial Sequence: Synthetic oligonucleotide
  Target: SCN10A; (+) strand; PAM type: NRG; PAM sequence: GAG
agacttcctctccaagagct

SEQ ID NO: 39988 - DNA, 20 bp, Artificial Sequence
  Description of Artificial Sequence: Synthetic oligonucleotide
  Target: SCN10A; (+) strand; PAM type: NRG; PAM sequence: GAG
acttcctctccaagagctga

SEQ ID NO: 39989 - DNA, 20 bp, Artificial Sequence
  Description of Artificial Sequence: Synthetic oligonucleotide
  Target: SCN10A; (+) strand; PAM type: NRG; PAM sequence: CAG
tcctctccaagagctgagag

SEQ ID NO: 39990 - DNA, 20 bp, Artificial Sequence
  Description of Artificial Sequence: Synthetic oligonucleotide
  Target: SCN10A; (+) strand; PAM type: NRG; PAM sequence: TAG
ctgagagcagacattcctac

SEQ ID NO: 39991 - DNA, 20 bp, Artificial Sequence
  Description of Artificial Sequence: Synthetic oligonucleotide
  Target: SCN10A; (+) strand; PAM type: NRG; PAM sequence: TAG
agagcagacattcctactag

SEQ ID NO: 39992 - DNA, 20 bp, Artificial Sequence
  Description of Artificial Sequence: Synthetic oligonucleotide
  Target: SCN10A; (+) strand; PAM type: NRG; PAM sequence: CGG
tcctactagtagctcttacc

SEQ ID NO: 39993 - DNA, 20 bp, Artificial Sequence
  Description of Artificial Sequence: Synthetic oligonucleotide
  Target: SCN10A; (+) strand; PAM type: NRG; PAM sequence: TAG
ctcttacccggtgtgtgctg

SEQ ID NO: 39994 - DNA, 20 bp, Artificial Sequence
  Description of Artificial Sequence: Synthetic oligonucleotide
  Target: SCN10A; (+) strand; PAM type: NRG; PAM sequence: CGG
acccggtgtgtgctgtagaa

SEQ ID NO: 39995 - DNA, 20 bp, Artificial Sequence
  Description of Artificial Sequence: Synthetic oligonucleotide
  Target: SCN10A; (+) strand; PAM type: NRG; PAM sequence: TAG
tgtgtgctgtagaacggatc

SEQ ID NO: 39996 - DNA, 20 bp, Artificial Sequence
  Description of Artificial Sequence: Synthetic oligonucleotide
  Target: SCN10A; (+) strand; PAM type: NRG; PAM sequence: CAG
tagaacggatctagatcctc

SEQ ID NO: 39997 - DNA, 20 bp, Artificial Sequence
  Description of Artificial Sequence: Synthetic oligonucleotide
  Target: SCN10A; (+) strand; PAM type: NRG; PAM sequence: AGG
agaacggatctagatcctcc

SEQ ID NO: 39998 - DNA, 20 bp, Artificial Sequence
  Description of Artificial Sequence: Synthetic oligonucleotide
  Target: SCN10A; (+) strand; PAM type: NRG; PAM sequence: GGG
gaacggatctagatcctcca

SEQ ID NO: 39999 - DNA, 20 bp, Artificial Sequence
  Description of Artificial Sequence: Synthetic oligonucleotide
  Target: SCN10A; (+) strand; PAM type: NRG; PAM sequence: GGG
aacggatctagatcctccag

SEQ ID NO: 40000 - DNA, 20 bp, Artificial Sequence
  Description of Artificial Sequence: Synthetic oligonucleotide
  Target: SCN10A; (+) strand; PAM type: NRG; PAM sequence: CAG
tcctccaggggctccccgat

SEQ ID NO: 40001 - DNA, 20 bp, Artificial Sequence
  Description of Artificial Sequence: Synthetic oligonucleotide
  Target: SCN10A; (+) strand; PAM type: NRG; PAM sequence: TGG
ggctccccgatcagttctgc

SEQ ID NO: 40002 - DNA, 20 bp, Artificial Sequence
  Description of Artificial Sequence: Synthetic oligonucleotide
  Target: SCN10A; (+) strand; PAM type: NRG; PAM sequence: GGG
gctccccgatcagttctgct

SEQ ID NO: 40003 - DNA, 20 bp, Artificial Sequence
  Description of Artificial Sequence: Synthetic oligonucleotide
  Target: SCN10A; (+) strand; PAM type: NRG; PAM sequence: GAG
tccccgatcagttctgctgg

SEQ ID NO: 40004 - DNA, 20 bp, Artificial Sequence
  Description of Artificial Sequence: Synthetic oligonucleotide
  Target: SCN10A; (+) strand; PAM type: NRG; PAM sequence: TAG
gttctgctgggagctcacca

SEQ ID NO: 40005 - DNA, 20 bp, Artificial Sequence
  Description of Artificial Sequence: Synthetic oligonucleotide
  Target: SCN10A; (+) strand; PAM type: NRG; PAM sequence: TGG
tgggagctcaccatagaact

SEQ ID NO: 40006 - DNA, 20 bp, Artificial Sequence
  Description of Artificial Sequence: Synthetic oligonucleotide
  Target: SCN10A; (+) strand; PAM type: NRG; PAM sequence: GGG
gggagctcaccatagaactt

SEQ ID NO: 40007 - DNA, 20 bp, Artificial Sequence
  Description of Artificial Sequence: Synthetic oligonucleotide
  Target: SCN10A; (+) strand; PAM type: NRG; PAM sequence: CAG
agctcaccatagaacttggg

SEQ ID NO: 40008 - DNA, 20 bp, Artificial Sequence
  Description of Artificial Sequence: Synthetic oligonucleotide
  Target: SCN10A; (+) strand; PAM type: NRG; PAM sequence: TGG
caccatagaacttgggcagc

SEQ ID NO: 40009 - DNA, 20 bp, Artificial Sequence
  Description of Artificial Sequence: Synthetic oligonucleotide
  Target: SCN10A; (+) strand; PAM type: NRG; PAM sequence: CAG
agaacttgggcagctggttg

SEQ ID NO: 40010 - DNA, 20 bp, Artificial Sequence
  Description of Artificial Sequence: Synthetic oligonucleotide
  Target: SCN10A; (+) strand; PAM type: NRG; PAM sequence: AGG
gaacttgggcagctggttgc

SEQ ID NO: 40011 - DNA, 20 bp, Artificial Sequence
  Description of Artificial Sequence: Synthetic oligonucleotide
  Target: SCN10A; (+) strand; PAM type: NRG; PAM sequence: AAG
gcagctggttgcaggctttc

SEQ ID NO: 40012 - DNA, 20 bp, Artificial Sequence
  Description of Artificial Sequence: Synthetic oligonucleotide
  Target: SCN10A; (+) strand; PAM type: NRG; PAM sequence: CAG
tggttgcaggctttcaagtc

SEQ ID NO: 40013 - DNA, 20 bp, Artificial Sequence
  Description of Artificial Sequence: Synthetic oligonucleotide
  Target: SCN10A; (+) strand; PAM type: NRG; PAM sequence: TGG
tgcaggctttcaagtccagc

SEQ ID NO: 40014 - DNA, 20 bp, Artificial Sequence
  Description of Artificial Sequence: Synthetic oligonucleotide
  Target: SCN10A; (+) strand; PAM type: NRG; PAM sequence: GGG
gcaggctttcaagtccagct

SEQ ID NO: 40015 - DNA, 20 bp, Artificial Sequence
  Description of Artificial Sequence: Synthetic oligonucleotide
  Target: SCN10A; (+) strand; PAM type: NRG; PAM sequence: GGG
caggctttcaagtccagctg

SEQ ID NO: 40016 - DNA, 20 bp, Artificial Sequence
  Description of Artificial Sequence: Synthetic oligonucleotide
  Target: SCN10A; (+) strand; PAM type: NRG; PAM sequence: GAG
tttcaagtccagctggggcc

SEQ ID NO: 40017 - DNA, 20 bp, Artificial Sequence
  Description of Artificial Sequence: Synthetic oligonucleotide
  Target: SCN10A; (+) strand; PAM type: NRG; PAM sequence: AGG
ttcaagtccagctggggccg

SEQ ID NO: 40018 - DNA, 20 bp, Artificial Sequence
  Description of Artificial Sequence: Synthetic oligonucleotide
  Target: SCN10A; (+) strand; PAM type: NRG; PAM sequence: TGG
ggggccgaggcttctcttct

SEQ ID NO: 40019 - DNA, 20 bp, Artificial Sequence
  Description of Artificial Sequence: Synthetic oligonucleotide
  Target: SCN10A; (+) strand; PAM type: NRG; PAM sequence: TGG
ctgctccctatgcttctctc

SEQ ID NO: 40020 - DNA, 20 bp, Artificial Sequence
  Description of Artificial Sequence: Synthetic oligonucleotide
  Target: SCN10A; (+) strand; PAM type: NRG; PAM sequence: TGG
ggctttctttgttccctgct

SEQ ID NO: 40021 - DNA, 20 bp, Artificial Sequence
  Description of Artificial Sequence: Synthetic oligonucleotide
  Target: SCN10A; (+) strand; PAM type: NRG; PAM sequence: CAG
tttctttgttccctgcttgg

SEQ ID NO: 40022 - DNA, 20 bp, Artificial Sequence
  Description of Artificial Sequence: Synthetic oligonucleotide
  Target: SCN10A; (+) strand; PAM type: NRG; PAM sequence: CAG
atttgcttctctatctccac

SEQ ID NO: 40023 - DNA, 20 bp, Artificial Sequence
  Description of Artificial Sequence: Synthetic oligonucleotide
  Target: SCN10A; (+) strand; PAM type: NRG; PAM sequence: CGG
tctatctccaccagtgactc

SEQ ID NO: 40024 - DNA, 20 bp, Artificial Sequence
  Description of Artificial Sequence: Synthetic oligonucleotide
  Target: SCN10A; (+) strand; PAM type: NRG; PAM sequence: GAG
tatctccaccagtgactccg

SEQ ID NO: 40025 - DNA, 20 bp, Artificial Sequence
  Description of Artificial Sequence: Synthetic oligonucleotide
  Target: SCN10A; (+) strand; PAM type: NRG; PAM sequence: AAG
ccaccagtgactccggagta

SEQ ID NO: 40026 - DNA, 20 bp, Artificial Sequence
  Description of Artificial Sequence: Synthetic oligonucleotide
  Target: SCN10A; (+) strand; PAM type: NRG; PAM sequence: CGG
gtgactccggagtaaagcga

SEQ ID NO: 40027 - DNA, 20 bp, Artificial Sequence
  Description of Artificial Sequence: Synthetic oligonucleotide
  Target: SCN10A; (+) strand; PAM type: NRG; PAM sequence: AAG
actccggagtaaagcgacgg

SEQ ID NO: 40028 - DNA, 20 bp, Artificial Sequence
  Description of Artificial Sequence: Synthetic oligonucleotide
  Target: SCN10A; (+) strand; PAM type: NRG; PAM sequence: TAG
agtaaagcgacggaagttgt

SEQ ID NO: 40029 - DNA, 20 bp, Artificial Sequence
  Description of Artificial Sequence: Synthetic oligonucleotide
  Target: SCN10A; (+) strand; PAM type: NRG; PAM sequence: GAG
cgacggaagttgttagtttc

SEQ ID NO: 40030 - DNA, 20 bp, Artificial Sequence
  Description of Artificial Sequence: Synthetic oligonucleotide
  Target: SCN10A; (+) strand; PAM type: NRG; PAM sequence: AGG
gacggaagttgttagtttcg

SEQ ID NO: 40031 - DNA, 20 bp, Artificial Sequence
  Description of Artificial Sequence: Synthetic oligonucleotide
  Target: SCN10A; (+) strand; PAM type: NRG; PAM sequence: GGG
acggaagttgttagtttcga

SEQ ID NO: 40032 - DNA, 20 bp, Artificial Sequence
  Description of Artificial Sequence: Synthetic oligonucleotide
  Target: SCN10A; (+) strand; PAM type: NRG; PAM sequence: TGG
gttagtttcgagggatccaa

SEQ ID NO: 40033 - DNA, 20 bp, Artificial Sequence
  Description of Artificial Sequence: Synthetic oligonucleotide
  Target: SCN10A; (+) strand; PAM type: NRG; PAM sequence: GGG
ttagtttcgagggatccaat

SEQ ID NO: 40034 - DNA, 20 bp, Artificial Sequence
  Description of Artificial Sequence: Synthetic oligonucleotide
  Target: SCN10A; (+) strand; PAM type: NRG; PAM sequence: GGG
tagtttcgagggatccaatg

SEQ ID NO: 40035 - DNA, 20 bp, Artificial Sequence
  Description of Artificial Sequence: Synthetic oligonucleotide
  Target: SCN10A; (+) strand; PAM type: NRG; PAM sequence: CAG
tccatcttctcattcttctt

SEQ ID NO: 40036 - DNA, 20 bp, Artificial Sequence
  Description of Artificial Sequence: Synthetic oligonucleotide
  Target: SCN10A; (+) strand; PAM type: NRG; PAM sequence: AGG
ccatcttctcattcttcttc

SEQ ID NO: 40037 - DNA, 20 bp, Artificial Sequence
  Description of Artificial Sequence: Synthetic oligonucleotide
  Target: SCN10A; (+) strand; PAM type: NRG; PAM sequence: AAG
tcttctcattcttcttcagg

SEQ ID NO: 40038 - DNA, 20 bp, Artificial Sequence
  Description of Artificial Sequence: Synthetic oligonucleotide
  Target: SCN10A; (+) strand; PAM type: NRG; PAM sequence: AAG
ggaagtatttatactcttat

SEQ ID NO: 40039 - DNA, 20 bp, Artificial Sequence
  Description of Artificial Sequence: Synthetic oligonucleotide
  Target: SCN10A; (+) strand; PAM type: NRG; PAM sequence: GAG
aagtatttatactcttataa

SEQ ID NO: 40040 - DNA, 20 bp, Artificial Sequence
  Description of Artificial Sequence: Synthetic oligonucleotide
  Target: SCN10A; (+) strand; PAM type: NRG; PAM sequence: TGG
tatttatactcttataagag

SEQ ID NO: 40041 - DNA, 20 bp, Artificial Sequence
  Description of Artificial Sequence: Synthetic oligonucleotide
  Target: SCN10A; (+) strand; PAM type: NRG; PAM sequence: CAG
tataagagtggacataacca

SEQ ID NO: 40042 - DNA, 20 bp, Artificial Sequence
  Description of Artificial Sequence: Synthetic oligonucleotide
  Target: SCN10A; (+) strand; PAM type: NRG; PAM sequence: GAG
taagagtggacataaccaca

SEQ ID NO: 40043 - DNA, 20 bp, Artificial Sequence
  Description of Artificial Sequence: Synthetic oligonucleotide
  Target: SCN10A; (+) strand; PAM type: NRG; PAM sequence: GAG
agagtggacataaccacaga

SEQ ID NO: 40044 - DNA, 20 bp, Artificial Sequence
  Description of Artificial Sequence: Synthetic oligonucleotide
  Target: SCN10A; (+) strand; PAM type: NRG; PAM sequence: AGG
gagtggacataaccacagag

SEQ ID NO: 40045 - DNA, 20 bp, Artificial Sequence
  Description of Artificial Sequence: Synthetic oligonucleotide
  Target: SCN10A; (+) strand; PAM type: NRG; PAM sequence: CAG
acataaccacagagaggtga

SEQ ID NO: 40046 - DNA, 20 bp, Artificial Sequence
  Description of Artificial Sequence: Synthetic oligonucleotide
  Target: SCN10A; (+) strand; PAM type: NRG; PAM sequence: TGG
agaggtgacagcttgcccac

SEQ ID NO: 40047 - DNA, 20 bp, Artificial Sequence
  Description of Artificial Sequence: Synthetic oligonucleotide
  Target: SCN10A; (+) strand; PAM type: NRG; PAM sequence: CAG
atctgtcccatcttgattgt

SEQ ID NO: 40048 - DNA, 20 bp, Artificial Sequence
  Description of Artificial Sequence: Synthetic oligonucleotide
  Target: SCN10A; (+) strand; PAM type: NRG; PAM sequence: CAG
tcccatcttgattgtcagaa

SEQ ID NO: 40049 - DNA, 20 bp, Artificial Sequence
  Description of Artificial Sequence: Synthetic oligonucleotide
  Target: SCN10A; (+) strand; PAM type: NRG; PAM sequence: TGG
ccttctcccaccctcatatc

SEQ ID NO: 40050 - DNA, 20 bp, Artificial Sequence
  Description of Artificial Sequence: Synthetic oligonucleotide
  Target: SCN10A; (+) strand; PAM type: NRG; PAM sequence: TGG
cccctccctgaactcacact

SEQ ID NO: 40051 - DNA, 20 bp, Artificial Sequence
  Description of Artificial Sequence: Synthetic oligonucleotide
  Target: SCN10A; (+) strand; PAM type: NRG; PAM sequence: CAG
aactcacacttggctcctcc

SEQ ID NO: 40052 - DNA, 20 bp, Artificial Sequence
  Description of Artificial Sequence: Synthetic oligonucleotide
  Target: SCN10A; (+) strand; PAM type: NRG; PAM sequence: AGG
actcacacttggctcctccc

SEQ ID NO: 40053 - DNA, 20 bp, Artificial Sequence
  Description of Artificial Sequence: Synthetic oligonucleotide
  Target: SCN10A; (+) strand; PAM type: NRG; PAM sequence: AAG
ccaggaacccattcccctgc

SEQ ID NO: 40054 - DNA, 20 bp, Artificial Sequence
  Description of Artificial Sequence: Synthetic oligonucleotide
  Target: SCN10A; (+) strand; PAM type: NRG; PAM sequence: AGG
caggaacccattcccctgca

SEQ ID NO: 40055 - DNA, 20 bp, Artificial Sequence
  Description of Artificial Sequence: Synthetic oligonucleotide
  Target: SCN10A; (+) strand; PAM type: NRG; PAM sequence: CAG
ccattcccctgcaaggcatt

SEQ ID NO: 40056 - DNA, 20 bp, Artificial Sequence
  Description of Artificial Sequence: Synthetic oligonucleotide
  Target: SCN10A; (+) strand; PAM type: NRG; PAM sequence: AGG
cattcccctgcaaggcattc

SEQ ID NO: 40057 - DNA, 20 bp, Artificial Sequence
  Description of Artificial Sequence: Synthetic oligonucleotide
  Target: SCN10A; (+) strand; PAM type: NRG; PAM sequence: GGG
attcccctgcaaggcattca

SEQ ID NO: 40058 - DNA, 20 bp, Artificial Sequence
  Description of Artificial Sequence: Synthetic oligonucleotide
  Target: SCN10A; (+) strand; PAM type: NRG; PAM sequence: GGG
ttcccctgcaaggcattcag

SEQ ID NO: 40059 - DNA, 20 bp, Artificial Sequence
  Description of Artificial Sequence: Synthetic oligonucleotide
  Target: SCN10A; (+) strand; PAM type: NRG; PAM sequence: GAG
cccctgcaaggcattcaggg

SEQ ID NO: 40060 - DNA, 20 bp, Artificial Sequence
  Description of Artificial Sequence: Synthetic oligonucleotide
  Target: SCN10A; (+) strand; PAM type: NRG; PAM sequence: AGG
ccctgcaaggcattcagggg

SEQ ID NO: 40061 - DNA, 20 bp, Artificial Sequence
  Description of Artificial Sequence: Synthetic oligonucleotide
  Target: SCN10A; (+) strand; PAM type: NRG; PAM sequence: CAG
ctgtttattcaaccctcctc

SEQ ID NO: 40062 - DNA, 20 bp, Artificial Sequence
  Description of Artificial Sequence: Synthetic oligonucleotide
  Target: SCN10A; (+) strand; PAM type: NRG; PAM sequence: AGG
tgtttattcaaccctcctcc

SEQ ID NO: 40063 - DNA, 20 bp, Artificial Sequence
  Description of Artificial Sequence: Synthetic oligonucleotide
  Target: SCN10A; (+) strand; PAM type: NRG; PAM sequence: CAG
caaccctcctccaggtgcct

SEQ ID NO: 40064 - DNA, 20 bp, Artificial Sequence
  Description of Artificial Sequence: Synthetic oligonucleotide
  Target: SCN10A; (+) strand; PAM type: NRG; PAM sequence: AGG
aaccctcctccaggtgcctc

SEQ ID NO: 40065 - DNA, 20 bp, Artificial Sequence
  Description of Artificial Sequence: Synthetic oligonucleotide
  Target: SCN10A; (+) strand; PAM type: NRG; PAM sequence: GGG
accctcctccaggtgcctca

SEQ ID NO: 40066 - DNA, 20 bp, Artificial Sequence
  Description of Artificial Sequence: Synthetic oligonucleotide
  Target: SCN10A; (+) strand; PAM type: NRG; PAM sequence: CAG
taccatcctaccaccaccac

SEQ ID NO: 40067 - DNA, 20 bp, Artificial Sequence
  Description of Artificial Sequence: Synthetic oligonucleotide
  Target: SCN10A; (+) strand; PAM type: NRG; PAM sequence: TAG
cctaccaccaccaccagatt

SEQ ID NO: 40068 - DNA, 20 bp, Artificial Sequence
  Description of Artificial Sequence: Synthetic oligonucleotide
  Target: SCN10A; (+) strand; PAM type: NRG; PAM sequence: CAG
ctgccctctctcctcatttc

SEQ ID NO: 40069 - DNA, 20 bp, Artificial Sequence
  Description of Artificial Sequence: Synthetic oligonucleotide
  Target: SCN10A; (+) strand; PAM type: NRG; PAM sequence: AGG
tgccctctctcctcatttcc

SEQ ID NO: 40070 - DNA, 20 bp, Artificial Sequence
  Description of Artificial Sequence: Synthetic oligonucleotide
  Target: SCN10A; (+) strand; PAM type: NRG; PAM sequence: GAG
tcctcatttccaggaccact

SEQ ID NO: 40071 - DNA, 20 bp, Artificial Sequence
  Description of Artificial Sequence: Synthetic oligonucleotide
  Target: SCN10A; (+) strand; PAM type: NRG; PAM sequence: CAG
tttccaggaccactgagttc

SEQ ID NO: 40072 - DNA, 20 bp, Artificial Sequence
  Description of Artificial Sequence: Synthetic oligonucleotide
  Target: SCN10A; (+) strand; PAM type: NRG; PAM sequence: AGG
ttccaggaccactgagttcc

SEQ ID NO: 40073 - DNA, 20 bp, Artificial Sequence
  Description of Artificial Sequence: Synthetic oligonucleotide
  Target: SCN10A; (+) strand; PAM type: NRG; PAM sequence: AAG
gcactctcccatattcatca

SEQ ID NO: 40074 - DNA, 20 bp, Artificial Sequence
  Description of Artificial Sequence: Synthetic oligonucleotide
  Target: SCN10A; (+) strand; PAM type: NRG; PAM sequence: TGG
cccatattcatcaaagactt

SEQ ID NO: 40075 - DNA, 20 bp, Artificial Sequence
  Description of Artificial Sequence: Synthetic oligonucleotide
  Target: SCN10A; (+) strand; PAM type: NRG; PAM sequence: TAG
tcatcaaagactttggttta

SEQ ID NO: 40076 - DNA, 20 bp, Artificial Sequence
  Description of Artificial Sequence: Synthetic oligonucleotide
  Target: SCN10A; (+) strand; PAM type: NRG; PAM sequence: AAG
tttatagtctactttatctt

SEQ ID NO: 40077 - DNA, 20 bp, Artificial Sequence
  Description of Artificial Sequence: Synthetic oligonucleotide
  Target: SCN10A; (+) strand; PAM type: NRG; PAM sequence: TGG
ccacctgtttgaatttcatt

SEQ ID NO: 40078 - DNA, 20 bp, Artificial Sequence
  Description of Artificial Sequence: Synthetic oligonucleotide
  Target: SCN10A; (+) strand; PAM type: NRG; PAM sequence: AAG
tgaatttcatttggacctcc

SEQ ID NO: 40079 - DNA, 20 bp, Artificial Sequence
  Description of Artificial Sequence: Synthetic oligonucleotide
  Target: SCN10A; (+) strand; PAM type: NRG; PAM sequence: TGG
catttggacctccaagttac

SEQ ID NO: 40080 - DNA, 20 bp, Artificial Sequence
  Description of Artificial Sequence: Synthetic oligonucleotide
  Target: SCN10A; (+) strand; PAM type: NRG; PAM sequence: GAG
tttggacctccaagttactg

SEQ ID NO: 40081 - DNA, 20 bp, Artificial Sequence
  Description of Artificial Sequence: Synthetic oligonucleotide
  Target: SCN10A; (+) strand; PAM type: NRG; PAM sequence: CAG
tccaagttactggagaactc

SEQ ID NO: 40082 - DNA, 20 bp, Artificial Sequence
  Description of Artificial Sequence: Synthetic oligonucleotide
  Target: SCN10A; (+) strand; PAM type: NRG; PAM sequence: TGG
actggagaactccagattat

SEQ ID NO: 40083 - DNA, 20 bp, Artificial Sequence
  Description of Artificial Sequence: Synthetic oligonucleotide
  Target: SCN10A; (+) strand; PAM type: NRG; PAM sequence: GAG
tggagaactccagattattg

SEQ ID NO: 40084 - DNA, 20 bp, Artificial Sequence
  Description of Artificial Sequence: Synthetic oligonucleotide
  Target: SCN10A; (+) strand; PAM type: NRG; PAM sequence: TGG
agattattggagaatttcat

SEQ ID NO: 40085 - DNA, 20 bp, Artificial Sequence
  Description of Artificial Sequence: Synthetic oligonucleotide
  Target: SCN10A; (+) strand; PAM type: NRG; PAM sequence: GGG
gattattggagaatttcatt

SEQ ID NO: 40086 - DNA, 20 bp, Artificial Sequence
  Description of Artificial Sequence: Synthetic oligonucleotide
  Target: SCN10A; (+) strand; PAM type: NRG; PAM sequence: TGG
attgggacctccaatttctc

SEQ ID NO: 40087 - DNA, 20 bp, Artificial Sequence
  Description of Artificial Sequence: Synthetic oligonucleotide
  Target: SCN10A; (+) strand; PAM type: NRG; PAM sequence: GGG
ttgggacctccaatttctct

SEQ ID NO: 40088 - DNA, 20 bp, Artificial Sequence
  Description of Artificial Sequence: Synthetic oligonucleotide
  Target: SCN10A; (+) strand; PAM type: NRG; PAM sequence: CAG
tccaatttctctgggacctc

SEQ ID NO: 40089 - DNA, 20 bp, Artificial Sequence
  Description of Artificial Sequence: Synthetic oligonucleotide
  Target: SCN10A; (+) strand; PAM type: NRG; PAM sequence: AGG
ccaatttctctgggacctcc

SEQ ID NO: 40090 - DNA, 20 bp, Artificial Sequence
  Description of Artificial Sequence: Synthetic oligonucleotide
  Target: SCN10A; (+) strand; PAM type: NRG; PAM sequence: CAG
ttctctgggacctccaggtt

SEQ ID NO: 40091 - DNA, 20 bp, Artificial Sequence
  Description of Artificial Sequence: Synthetic oligonucleotide
  Target: SCN10A; (+) strand; PAM type: NRG; PAM sequence: TGG
ggacctccaggttcagtctg

SEQ ID NO: 40092 - DNA, 20 bp, Artificial Sequence
  Description of Artificial Sequence: Synthetic oligonucleotide
  Target: SCN10A; (+) strand; PAM type: NRG; PAM sequence: CAG
tgaacacttttccccataac

SEQ ID NO: 40093 - DNA, 20 bp, Artificial Sequence
  Description of Artificial Sequence: Synthetic oligonucleotide
  Target: SCN10A; (+) strand; PAM type: NRG; PAM sequence: TAG
acttttccccataaccagat

SEQ ID NO: 40094 - DNA, 20 bp, Artificial Sequence
  Description of Artificial Sequence: Synthetic oligonucleotide
  Target: SCN10A; (+) strand; PAM type: NRG; PAM sequence: TGG
ccataaccagattagacctg

SEQ ID NO: 40095 - DNA, 20 bp, Artificial Sequence
  Description of Artificial Sequence: Synthetic oligonucleotide
  Target: SCN10A; (+) strand; PAM type: NRG; PAM sequence: AAG
tcacccttatcctaaatccc

SEQ ID NO: 40096 - DNA, 20 bp, Artificial Sequence
  Description of Artificial Sequence: Synthetic oligonucleotide
  Target: SCN10A; (+) strand; PAM type: NRG; PAM sequence: AGG
cacccttatcctaaatccca

SEQ ID NO: 40097 - DNA, 20 bp, Artificial Sequence
  Description of Artificial Sequence: Synthetic oligonucleotide
  Target: SCN10A; (+) strand; PAM type: NRG; PAM sequence: AAG
ttatcctaaatcccaaggct

SEQ ID NO: 40098 - DNA, 20 bp, Artificial Sequence
  Description of Artificial Sequence: Synthetic oligonucleotide
  Target: SCN10A; (+) strand; PAM type: NRG; PAM sequence: TAG
atcccaaggctaagtcaatc

SEQ ID NO: 40099 - DNA, 20 bp, Artificial Sequence
  Description of Artificial Sequence: Synthetic oligonucleotide
  Target: SCN10A; (+) strand; PAM type: NRG; PAM sequence: CAG
aaggctaagtcaatctagaa

SEQ ID NO: 40100 - DNA, 20 bp, Artificial Sequence
  Description of Artificial Sequence: Synthetic oligonucleotide
  Target: SCN10A; (+) strand; PAM type: NRG; PAM sequence: GAG
aacagttcccctgaactgct

SEQ ID NO: 40101 - DNA, 20 bp, Artificial Sequence
  Description of Artificial Sequence: Synthetic oligonucleotide
  Target: SCN10A; (+) strand; PAM type: NRG; PAM sequence: AGG
acagttcccctgaactgctg

SEQ ID NO: 40102 - DNA, 20 bp, Artificial Sequence
  Description of Artificial Sequence: Synthetic oligonucleotide
  Target: SCN10A; (+) strand; PAM type: NRG; PAM sequence: GGG
cagttcccctgaactgctga

SEQ ID NO: 40103 - DNA, 20 bp, Artificial Sequence
  Description of Artificial Sequence: Synthetic oligonucleotide
  Target: SCN10A; (+) strand; PAM type: NRG; PAM sequence: GGG
agttcccctgaactgctgag

SEQ ID NO: 40104 - DNA, 20 bp, Artificial Sequence
  Description of Artificial Sequence: Synthetic oligonucleotide
  Target: SCN10A; (+) strand; PAM type: NRG; PAM sequence: TGG
cctgaactgctgaggggtta

SEQ ID NO: 40105 - DNA, 20 bp, Artificial Sequence
  Description of Artificial Sequence: Synthetic oligonucleotide
  Target: SCN10A; (+) strand; PAM type: NRG; PAM sequence: GGG
ctgaactgctgaggggttat

SEQ ID NO: 40106 - DNA, 20 bp, Artificial Sequence
  Description of Artificial Sequence: Synthetic oligonucleotide
  Target: SCN10A; (+) strand; PAM type: NRG; PAM sequence: GGG
tgaactgctgaggggttatg

SEQ ID NO: 40107 - DNA, 20 bp, Artificial Sequence
  Description of Artificial Sequence: Synthetic oligonucleotide
  Target: SCN10A; (+) strand; PAM type: NRG; PAM sequence: CAG
tgaggggttatggggaacct

SEQ ID NO: 40108 - DNA, 20 bp, Artificial Sequence
  Description of Artificial Sequence: Synthetic oligonucleotide
  Target: SCN10A; (+) strand; PAM type: NRG; PAM sequence: TGG
tggggaacctcagtattgcc

SEQ ID NO: 40109 - DNA, 20 bp, Artificial Sequence
  Description of Artificial Sequence: Synthetic oligonucleotide
  Target: SCN10A; (+) strand; PAM type: NRG; PAM sequence: GGG
ggggaacctcagtattgcct

SEQ ID NO: 40110 - DNA, 20 bp, Artificial Sequence
  Description of Artificial Sequence: Synthetic oligonucleotide
  Target: SCN10A; (+) strand; PAM type: NRG; PAM sequence: TGG
agtattgcctgggaatcata

SEQ ID NO: 40111 - DNA, 20 bp, Artificial Sequence
  Description of Artificial Sequence: Synthetic oligonucleotide
  Target: SCN10A; (+) strand; PAM type: NRG; PAM sequence: TAG
tgggaatcatatggtatccc

SEQ ID NO: 40112 - DNA, 20 bp, Artificial Sequence
  Description of Artificial Sequence: Synthetic oligonucleotide
  Target: SCN10A; (+) strand; PAM type: NRG; PAM sequence: CAG
aatcatatggtatccctagt

SEQ ID NO: 40113 - DNA, 20 bp, Artificial Sequence
  Description of Artificial Sequence: Synthetic oligonucleotide
  Target: SCN10A; (+) strand; PAM type: NRG; PAM sequence: CAG
catatggtatccctagtcag

SEQ ID NO: 40114 - DNA, 20 bp, Artificial Sequence
  Description of Artificial Sequence: Synthetic oligonucleotide
  Target: SCN10A; (+) strand; PAM type: NRG; PAM sequence: TAG
ccctagtcagcagtttcttc

SEQ ID NO: 40115 - DNA, 20 bp, Artificial Sequence
  Description of Artificial Sequence: Synthetic oligonucleotide
  Target: SCN10A; (+) strand; PAM type: NRG; PAM sequence: GAG
tcagcagtttcttctagtct

SEQ ID NO: 40116 - DNA, 20 bp, Artificial Sequence
  Description of Artificial Sequence: Synthetic oligonucleotide
  Target: SCN10A; (+) strand; PAM type: NRG; PAM sequence: AGG
cagcagtttcttctagtctg

SEQ ID NO: 40117 - DNA, 20 bp, Artificial Sequence
  Description of Artificial Sequence: Synthetic oligonucleotide
  Target: SCN10A; (+) strand; PAM type: NRG; PAM sequence: CAG
ctattccctgtcttcccttg

SEQ ID NO: 40118 - DNA, 20 bp, Artificial Sequence
  Description of Artificial Sequence: Synthetic oligonucleotide
  Target: SCN10A; (+) strand; PAM type: NRG; PAM sequence: AAG
tccctgtcttcccttgcagt

SEQ ID NO: 40119 - DNA, 20 bp, Artificial Sequence
  Description of Artificial Sequence: Synthetic oligonucleotide
  Target: SCN10A; (+) strand; PAM type: NRG; PAM sequence: TAG
aagccaatgaccatatttcc

SEQ ID NO: 40120 - DNA, 20 bp, Artificial Sequence
  Description of Artificial Sequence: Synthetic oligonucleotide
  Target: SCN10A; (+) strand; PAM type: NRG; PAM sequence: TGG
tgaccatatttcctagttca

SEQ ID NO: 40121 - DNA, 20 bp, Artificial Sequence
  Description of Artificial Sequence: Synthetic oligonucleotide
  Target: SCN10A; (+) strand; PAM type: NRG; PAM sequence: GAG
accatatttcctagttcatg

SEQ ID NO: 40122 - DNA, 20 bp, Artificial Sequence
  Description of Artificial Sequence: Synthetic oligonucleotide
  Target: SCN10A; (+) strand; PAM type: NRG; PAM sequence: CAG
tcctagttcatggagaaaaa

SEQ ID NO: 40123 - DNA, 20 bp, Artificial Sequence
  Description of Artificial Sequence: Synthetic oligonucleotide
  Target: SCN10A; (+) strand; PAM type: NRG; PAM sequence: CAG
ctccaactcacctgtgtctg

SEQ ID NO: 40124 - DNA, 20 bp, Artificial Sequence
  Description of Artificial Sequence: Synthetic oligonucleotide
  Target: SCN10A; (+) strand; PAM type: NRG; PAM sequence: GAG
cttcccttctcttacaacat

SEQ ID NO: 40125 - DNA, 20 bp, Artificial Sequence
  Description of Artificial Sequence: Synthetic oligonucleotide
  Target: SCN10A; (+) strand; PAM type: NRG; PAM sequence: GAG
tcccttctcttacaacatga

SEQ ID NO: 40126 - DNA, 20 bp, Artificial Sequence
  Description of Artificial Sequence: Synthetic oligonucleotide
  Target: SCN10A; (+) strand; PAM type: NRG; PAM sequence: AGG
cccttctcttacaacatgag

SEQ ID NO: 40127 - DNA, 20 bp, Artificial Sequence
  Description of Artificial Sequence: Synthetic oligonucleotide
  Target: SCN10A; (+) strand; PAM type: NRG; PAM sequence: AAG
gaggtatcttcctacattct

SEQ ID NO: 40128 - DNA, 20 bp, Artificial Sequence
  Description of Artificial Sequence: Synthetic oligonucleotide
  Target: SCN10A; (+) strand; PAM type: NRG; PAM sequence: AGG
aggtatcttcctacattcta

SEQ ID NO: 40129 - DNA, 20 bp, Artificial Sequence
  Description of Artificial Sequence: Synthetic oligonucleotide
  Target: SCN10A; (+) strand; PAM type: NRG; PAM sequence: TAG
accattcctttccctctgct

SEQ ID NO: 40130 - DNA, 20 bp, Artificial Sequence
  Description of Artificial Sequence: Synthetic oligonucleotide
  Target: SCN10A; (+) strand; PAM type: NRG; PAM sequence: AGG
ccattcctttccctctgctt

SEQ ID NO: 40131 - DNA, 20 bp, Artificial Sequence
  Description of Artificial Sequence: Synthetic oligonucleotide
  Target: SCN10A; (+) strand; PAM type: NRG; PAM sequence: CAG
ttttctctctccttgtctgc

SEQ ID NO: 40132 - DNA, 20 bp, Artificial Sequence
  Description of Artificial Sequence: Synthetic oligonucleotide
  Target: SCN10A; (+) strand; PAM type: NRG; PAM sequence: CAG
gtctgccagctctttcctat

SEQ ID NO: 40133 - DNA, 20 bp, Artificial Sequence
  Description of Artificial Sequence: Synthetic oligonucleotide
  Target: SCN10A; (+) strand; PAM type: NRG; PAM sequence: AAG
ctctttcctatcagcattta

SEQ ID NO: 40134 - DNA, 20 bp, Artificial Sequence
  Description of Artificial Sequence: Synthetic oligonucleotide
  Target: SCN10A; (+) strand; PAM type: NRG; PAM sequence: CAG
ttaaaaactttcccttgatg

SEQ ID NO: 40135 - DNA, 20 bp, Artificial Sequence
  Description of Artificial Sequence: Synthetic oligonucleotide
  Target: SCN10A; (+) strand; PAM type: NRG; PAM sequence: GAG
aaaaactttcccttgatgca

SEQ ID NO: 40136 - DNA, 20 bp, Artificial Sequence
  Description of Artificial Sequence: Synthetic oligonucleotide
  Target: SCN10A; (+) strand; PAM type: NRG; PAM sequence: CAG
cccttgatgcagagcccatc

SEQ ID NO: 40137 - DNA, 20 bp, Artificial Sequence
  Description of Artificial Sequence: Synthetic oligonucleotide
  Target: SCN10A; (+) strand; PAM type: NRG; PAM sequence: AGG
ccttgatgcagagcccatcc

SEQ ID NO: 40138 - DNA, 20 bp, Artificial Sequence
  Description of Artificial Sequence: Synthetic oligonucleotide
  Target: SCN10A; (+) strand; PAM type: NRG; PAM sequence: TGG
tcctctctcctgttctctat

SEQ ID NO: 40139 - DNA, 20 bp, Artificial Sequence
  Description of Artificial Sequence: Synthetic oligonucleotide
  Target: SCN10A; (+) strand; PAM type: NRG; PAM sequence: AAG
ttctctattggcttttaata

SEQ ID NO: 40140 - DNA, 20 bp, Artificial Sequence
  Description of Artificial Sequence: Synthetic oligonucleotide
  Target: SCN10A; (+) strand; PAM type: NRG; PAM sequence: AGG
tctctattggcttttaataa

SEQ ID NO: 40141 - DNA, 20 bp, Artificial Sequence
  Description of Artificial Sequence: Synthetic oligonucleotide
  Target: SCN10A; (+) strand; PAM type: NRG; PAM sequence: CAG
ttacttctactcactgtttc

SEQ ID NO: 40142 - DNA, 20 bp, Artificial Sequence
  Description of Artificial Sequence: Synthetic oligonucleotide
  Target: SCN10A; (+) strand; PAM type: NRG; PAM sequence: CAG
cactgtttccagtcactttt

SEQ ID NO: 40143 - DNA, 20 bp, Artificial Sequence
  Description of Artificial Sequence: Synthetic oligonucleotide
  Target: SCN10A; (+) strand; PAM type: NRG; PAM sequence: AAG
cagtcacttttcagtctttg

SEQ ID NO: 40144 - DNA, 20 bp, Artificial Sequence
  Description of Artificial Sequence: Synthetic oligonucleotide
  Target: SCN10A; (+) strand; PAM type: NRG; PAM sequence: TGG
acttttcagtctttgaagct

SEQ ID NO: 40145 - DNA, 20 bp, Artificial Sequence
  Description of Artificial Sequence: Synthetic oligonucleotide
  Target: SCN10A; (+) strand; PAM type: NRG; PAM sequence: CAG
ctcactaaaatgcttccttg

SEQ ID NO: 40146 - DNA, 20 bp, Artificial Sequence
  Description of Artificial Sequence: Synthetic oligonucleotide
  Target: SCN10A; (+) strand; PAM type: NRG; PAM sequence: AGG
tcactaaaatgcttccttgc

SEQ ID NO: 40147 - DNA, 20 bp, Artificial Sequence
  Description of Artificial Sequence: Synthetic oligonucleotide
  Target: SCN10A; (+) strand; PAM type: NRG; PAM sequence: GGG
cactaaaatgcttccttgca

SEQ ID NO: 40148 - DNA, 20 bp, Artificial Sequence
  Description of Artificial Sequence: Synthetic oligonucleotide
  Target: SCN10A; (+) strand; PAM type: NRG; PAM sequence: AAG
atgcttccttgcagggatac

SEQ ID NO: 40149 - DNA, 20 bp, Artificial Sequence
  Description of Artificial Sequence: Synthetic oligonucleotide
  Target: SCN10A; (+) strand; PAM type: NRG; PAM sequence: GAG
gcttccttgcagggatacaa

SEQ ID NO: 40150 - DNA, 20 bp, Artificial Sequence
  Description of Artificial Sequence: Synthetic oligonucleotide
  Target: SCN10A; (+) strand; PAM type: NRG; PAM sequence: TGG
ggatacaagagattgccttg

SEQ ID NO: 40151 - DNA, 20 bp, Artificial Sequence
  Description of Artificial Sequence: Synthetic oligonucleotide
  Target: SCN10A; (+) strand; PAM type: NRG; PAM sequence: AAG
aagagattgccttgtggcta

SEQ ID NO: 40152 - DNA, 20 bp, Artificial Sequence
  Description of Artificial Sequence: Synthetic oligonucleotide
  Target: SCN10A; (+) strand; PAM type: NRG; PAM sequence: CAG
gattgccttgtggctaaagt

SEQ ID NO: 40153 - DNA, 20 bp, Artificial Sequence
  Description of Artificial Sequence: Synthetic oligonucleotide
  Target: SCN10A; (+) strand; PAM type: NRG; PAM sequence: AGG
attgccttgtggctaaagtc

SEQ ID NO: 40154 - DNA, 20 bp, Artificial Sequence
  Description of Artificial Sequence: Synthetic oligonucleotide
  Target: SCN10A; (+) strand; PAM type: NRG; PAM sequence: GGG
ttgccttgtggctaaagtca

SEQ ID NO: 40155 - DNA, 20 bp, Artificial Sequence
  Description of Artificial Sequence: Synthetic oligonucleotide
  Target: SCN10A; (+) strand; PAM type: NRG; PAM sequence: GGG
tgccttgtggctaaagtcag

SEQ ID NO: 40156 - DNA, 20 bp, Artificial Sequence
  Description of Artificial Sequence: Synthetic oligonucleotide
  Target: SCN10A; (+) strand; PAM type: NRG; PAM sequence: GGG
gccttgtggctaaagtcagg

SEQ ID NO: 40157 - DNA, 20 bp, Artificial Sequence
  Description of Artificial Sequence: Synthetic oligonucleotide
  Target: SCN10A; (+) strand; PAM type: NRG; PAM sequence: CAG
taaagtcagggggcccttct

SEQ ID NO: 40158 - DNA, 20 bp, Artificial Sequence
  Description of Artificial Sequence: Synthetic oligonucleotide
  Target: SCN10A; (+) strand; PAM type: NRG; PAM sequence: GAG
ctttttcttttttttttttt

SEQ ID NO: 40159 - DNA, 20 bp, Artificial Sequence
  Description of Artificial Sequence: Synthetic oligonucleotide
  Target: SCN10A; (+) strand; PAM type: NRG; PAM sequence: CAG
ttctttttttttttttgaga

SEQ ID NO: 40160 - DNA, 20 bp, Artificial Sequence
  Description of Artificial Sequence: Synthetic oligonucleotide
  Target: SCN10A; (+) strand; PAM type: NRG; PAM sequence: AGG
tctttttttttttttgagac

SEQ ID NO: 40161 - DNA, 20 bp, Artificial Sequence
  Description of Artificial Sequence: Synthetic oligonucleotide
  Target: SCN10A; (+) strand; PAM type: NRG; PAM sequence: GGG
ctttttttttttttgagaca

SEQ ID NO: 40162 - DNA, 20 bp, Artificial Sequence
  Description of Artificial Sequence: Synthetic oligonucleotide
  Target: SCN10A; (+) strand; PAM type: NRG; PAM sequence: CGG
gacagggtatcactgtcacc

SEQ ID NO: 40163 - DNA, 20 bp, Artificial Sequence
  Description of Artificial Sequence: Synthetic oligonucleotide
  Target: SCN10A; (+) strand; PAM type: NRG; PAM sequence: TAG
ggtatcactgtcacccggac

SEQ ID NO: 40164 - DNA, 20 bp, Artificial Sequence
  Description of Artificial Sequence: Synthetic oligonucleotide
  Target: SCN10A; (+) strand; PAM type: NRG; PAM sequence: GAG
tatcactgtcacccggacta

SEQ ID NO: 40165 - DNA, 20 bp, Artificial Sequence
  Description of Artificial Sequence: Synthetic oligonucleotide
  Target: SCN10A; (+) strand; PAM type: NRG; PAM sequence: CAG
ctgtcacccggactagagtg

SEQ ID NO: 40166 - DNA, 20 bp, Artificial Sequence
  Description of Artificial Sequence: Synthetic oligonucleotide
  Target: SCN10A; (+) strand; PAM type: NRG; PAM sequence: TGG
tcacccggactagagtgcag

SEQ ID NO: 40167 - DNA, 20 bp, Artificial Sequence
  Description of Artificial Sequence: Synthetic oligonucleotide
  Target: SCN10A; (+) strand; PAM type: NRG; PAM sequence: TGG
tcactgcaacctctgtctcc

SEQ ID NO: 40168 - DNA, 20 bp, Artificial Sequence
  Description of Artificial Sequence: Synthetic oligonucleotide
  Target: SCN10A; (+) strand; PAM type: NRG; PAM sequence: GGG
cactgcaacctctgtctcct

SEQ ID NO: 40169 - DNA, 20 bp, Artificial Sequence
  Description of Artificial Sequence: Synthetic oligonucleotide
  Target: SCN10A; (+) strand; PAM type: NRG; PAM sequence: AAG
aacctctgtctcctgggctc

SEQ ID NO: 40170 - DNA, 20 bp, Artificial Sequence
  Description of Artificial Sequence: Synthetic oligonucleotide
  Target: SCN10A; (+) strand; PAM type: NRG; PAM sequence: CAG
ctcaagcaattctcccacct

SEQ ID NO: 40171 - DNA, 20 bp, Artificial Sequence
  Description of Artificial Sequence: Synthetic oligonucleotide
  Target: SCN10A; (+) strand; PAM type: NRG; PAM sequence: TAG
tcccacctcagcctcccgaa

SEQ ID NO: 40172 - DNA, 20 bp, Artificial Sequence
  Description of Artificial Sequence: Synthetic oligonucleotide
  Target: SCN10A; (+) strand; PAM type: NRG; PAM sequence: TGG
acctcagcctcccgaatagc

SEQ ID NO: 40173 - DNA, 20 bp, Artificial Sequence
  Description of Artificial Sequence: Synthetic oligonucleotide
  Target: SCN10A; (+) strand; PAM type: NRG; PAM sequence: GGG
cctcagcctcccgaatagct

SEQ ID NO: 40174 - DNA, 20 bp, Artificial Sequence
  Description of Artificial Sequence: Synthetic oligonucleotide
  Target: SCN10A; (+) strand; PAM type: NRG; PAM sequence: TAG
cctcccgaatagctgggcta

SEQ ID NO: 40175 - DNA, 20 bp, Artificial Sequence
  Description of Artificial Sequence: Synthetic oligonucleotide
  Target: SCN10A; (+) strand; PAM type: NRG; PAM sequence: AGG
ctcccgaatagctgggctat

SEQ ID NO: 40176 - DNA, 20 bp, Artificial Sequence
  Description of Artificial Sequence: Synthetic oligonucleotide
  Target: SCN10A; (+) strand; PAM type: NRG; PAM sequence: CGG
taggcacatgtcaccacact

SEQ ID NO: 40177 - DNA, 20 bp, Artificial Sequence
  Description of Artificial Sequence: Synthetic oligonucleotide
  Target: SCN10A; (+) strand; PAM type: NRG; PAM sequence: TAG
cacatgtcaccacactcggc

SEQ ID NO: 40178 - DNA, 20 bp, Artificial Sequence
  Description of Artificial Sequence: Synthetic oligonucleotide
  Target: SCN10A; (+) strand; PAM type: NRG; PAM sequence: TAG
gttttgaaaaaatttttttg

SEQ ID NO: 40179 - DNA, 20 bp, Artificial Sequence
  Description of Artificial Sequence: Synthetic oligonucleotide
  Target: SCN10A; (+) strand; PAM type: NRG; PAM sequence: AGG
ttttgaaaaaatttttttgt

SEQ ID NO: 40180 - DNA, 20 bp, Artificial Sequence
  Description of Artificial Sequence: Synthetic oligonucleotide
  Target: SCN10A; (+) strand; PAM type: NRG; PAM sequence: CAG
tgaaaaaatttttttgtagg

SEQ ID NO: 40181 - DNA, 20 bp, Artificial Sequence
  Description of Artificial Sequence: Synthetic oligonucleotide
  Target: SCN10A; (+) strand; PAM type: NRG; PAM sequence: CAG
cagtgtaccactatattgtc

SEQ ID NO: 40182 - DNA, 20 bp, Artificial Sequence
  Description of Artificial Sequence: Synthetic oligonucleotide
  Target: SCN10A; (+) strand; PAM type: NRG; PAM sequence: AGG
agtgtaccactatattgtcc

SEQ ID NO: 40183 - DNA, 20 bp, Artificial Sequence
  Description of Artificial Sequence: Synthetic oligonucleotide
  Target: SCN10A; (+) strand; PAM type: NRG; PAM sequence: CAG
tatattgtccaggcccatct

SEQ ID NO: 40184 - DNA, 20 bp, Artificial Sequence
  Description of Artificial Sequence: Synthetic oligonucleotide
  Target: SCN10A; (+) strand; PAM type: NRG; PAM sequence: TGG
catctcagttcttatcttga

SEQ ID NO: 40185 - DNA, 20 bp, Artificial Sequence
  Description of Artificial Sequence: Synthetic oligonucleotide
  Target: SCN10A; (+) strand; PAM type: NRG; PAM sequence: TGG
tcttatcttgatggtcctat

SEQ ID NO: 40186 - DNA, 20 bp, Artificial Sequence
  Description of Artificial Sequence: Synthetic oligonucleotide
  Target: SCN10A; (+) strand; PAM type: NRG; PAM sequence: TGG
ccttaaaatactgtatattt

SEQ ID NO: 40187 - DNA, 20 bp, Artificial Sequence
  Description of Artificial Sequence: Synthetic oligonucleotide
  Target: SCN10A; (+) strand; PAM type: NRG; PAM sequence: TGG
tggctaccatgacactctct

SEQ ID NO: 40188 - DNA, 20 bp, Artificial Sequence
  Description of Artificial Sequence: Synthetic oligonucleotide
  Target: SCN10A; (+) strand; PAM type: NRG; PAM sequence: CAG
actttctctcttctccttct

SEQ ID NO: 40189 - DNA, 20 bp, Artificial Sequence
  Description of Artificial Sequence: Synthetic oligonucleotide
  Target: SCN10A; (+) strand; PAM type: NRG; PAM sequence: CAG
cttctcagtctctcctttct

SEQ ID NO: 40190 - DNA, 20 bp, Artificial Sequence
  Description of Artificial Sequence: Synthetic oligonucleotide
  Target: SCN10A; (+) strand; PAM type: NRG; PAM sequence: TGG
ccatacatgattgtgaataa

SEQ ID NO: 40191 - DNA, 20 bp, Artificial Sequence
  Description of Artificial Sequence: Synthetic oligonucleotide
  Target: SCN10A; (+) strand; PAM type: NRG; PAM sequence: CAG
ggcactctatcttttgtttt

SEQ ID NO: 40192 - DNA, 20 bp, Artificial Sequence
  Description of Artificial Sequence: Synthetic oligonucleotide
  Target: SCN10A; (+) strand; PAM type: NRG; PAM sequence: TAG
tgttttcagaataataacaa

SEQ ID NO: 40193 - DNA, 20 bp, Artificial Sequence
  Description of Artificial Sequence: Synthetic oligonucleotide
  Target: SCN10A; (+) strand; PAM type: NRG; PAM sequence: CAG
aacaatagtaacaacttcaa

SEQ ID NO: 40194 - DNA, 20 bp, Artificial Sequence
  Description of Artificial Sequence: Synthetic oligonucleotide
  Target: SCN10A; (+) strand; PAM type: NRG; PAM sequence: TAG
agtaacaacttcaacagcgc

SEQ ID NO: 40195 - DNA, 20 bp, Artificial Sequence
  Description of Artificial Sequence: Synthetic oligonucleotide
  Target: SCN10A; (+) strand; PAM type: NRG; PAM sequence: GAG
caacagcgctagcatttact

SEQ ID NO: 40196 - DNA, 20 bp, Artificial Sequence
  Description of Artificial Sequence: Synthetic oligonucleotide
  Target: SCN10A; (+) strand; PAM type: NRG; PAM sequence: CAG
actgagattccactgtattt

SEQ ID NO: 40197 - DNA, 20 bp, Artificial Sequence
  Description of Artificial Sequence: Synthetic oligonucleotide
  Target: SCN10A; (+) strand; PAM type: NRG; PAM sequence: TGG
ttccactgtatttcagactc

SEQ ID NO: 40198 - DNA, 20 bp, Artificial Sequence
  Description of Artificial Sequence: Synthetic oligonucleotide
  Target: SCN10A; (+) strand; PAM type: NRG; PAM sequence: AAG
tgtatttcagactctggatt

SEQ ID NO: 40199 - DNA, 20 bp, Artificial Sequence
  Description of Artificial Sequence: Synthetic oligonucleotide
  Target: SCN10A; (+) strand; PAM type: NRG; PAM sequence: AAG
taactatcactgtacctgtg

SEQ ID NO: 40200 - DNA, 20 bp, Artificial Sequence
  Description of Artificial Sequence: Synthetic oligonucleotide
  Target: SCN10A; (+) strand; PAM type: NRG; PAM sequence: AAG
attatctctaatatataaat

SEQ ID NO: 40201 - DNA, 20 bp, Artificial Sequence
  Description of Artificial Sequence: Synthetic oligonucleotide
  Target: SCN10A; (+) strand; PAM type: NRG; PAM sequence: CAG
ctaatatataaataagatac

SEQ ID NO: 40202 - DNA, 20 bp, Artificial Sequence
  Description of Artificial Sequence: Synthetic oligonucleotide
  Target: SCN10A; (+) strand; PAM type: NRG; PAM sequence: GAG
aatatataaataagatacca

SEQ ID NO: 40203 - DNA, 20 bp, Artificial Sequence
  Description of Artificial Sequence: Synthetic oligonucleotide
  Target: SCN10A; (+) strand; PAM type: NRG; PAM sequence: CAG
atataaataagataccagag

SEQ ID NO: 40204 - DNA, 20 bp, Artificial Sequence
  Description of Artificial Sequence: Synthetic oligonucleotide
  Target: SCN10A; (+) strand; PAM type: NRG; PAM sequence: AAG
aataagataccagagcagca

SEQ ID NO: 40205 - DNA, 20 bp, Artificial Sequence
  Description of Artificial Sequence: Synthetic oligonucleotide
  Target: SCN10A; (+) strand; PAM type: NRG; PAM sequence: AAG
gcagcaaagttaaaatttcc

SEQ ID NO: 40206 - DNA, 20 bp, Artificial Sequence
  Description of Artificial Sequence: Synthetic oligonucleotide
  Target: SCN10A; (+) strand; PAM type: NRG; PAM sequence: GAG
tccaagatcacattactaat

SEQ ID NO: 40207 - DNA, 20 bp, Artificial Sequence
  Description of Artificial Sequence: Synthetic oligonucleotide
  Target: SCN10A; (+) strand; PAM type: NRG; PAM sequence: TGG
aagatcacattactaatgag

SEQ ID NO: 40208 - DNA, 20 bp, Artificial Sequence
  Description of Artificial Sequence: Synthetic oligonucleotide
  Target: SCN10A; (+) strand; PAM type: NRG; PAM sequence: CAG
atcacattactaatgagtgg

SEQ ID NO: 40209 - DNA, 20 bp, Artificial Sequence
  Description of Artificial Sequence: Synthetic oligonucleotide
  Target: SCN10A; (+) strand; PAM type: NRG; PAM sequence: CGG
attactaatgagtggcagaa

SEQ ID NO: 40210 - DNA, 20 bp, Artificial Sequence
  Description of Artificial Sequence: Synthetic oligonucleotide
  Target: SCN10A; (+) strand; PAM type: NRG; PAM sequence: CAG
ggcagaacggtacttaaact

SEQ ID NO: 40211 - DNA, 20 bp, Artificial Sequence
  Description of Artificial Sequence: Synthetic oligonucleotide
  Target: SCN10A; (+) strand; PAM type: NRG; PAM sequence: AGG
gcagaacggtacttaaactc

SEQ ID NO: 40212 - DNA, 20 bp, Artificial Sequence
  Description of Artificial Sequence: Synthetic oligonucleotide
  Target: SCN10A; (+) strand; PAM type: NRG; PAM sequence: TGG
gtatgtttgccacaatctct

SEQ ID NO: 40213 - DNA, 20 bp, Artificial Sequence
  Description of Artificial Sequence: Synthetic oligonucleotide
  Target: SCN10A; (+) strand; PAM type: NRG; PAM sequence: CAG
cttcacttctcatttatatg

SEQ ID NO: 40214 - DNA, 20 bp, Artificial Sequence
  Description of Artificial Sequence: Synthetic oligonucleotide
  Target: SCN10A; (+) strand; PAM type: NRG; PAM sequence: GAG
tcatttatatgcagatgact

SEQ ID NO: 40215 - DNA, 20 bp, Artificial Sequence
  Description of Artificial Sequence: Synthetic oligonucleotide
  Target: SCN10A; (+) strand; PAM type: NRG; PAM sequence: TAG
gatgactgagtctttatctg

SEQ ID NO: 40216 - DNA, 20 bp, Artificial Sequence
  Description of Artificial Sequence: Synthetic oligonucleotide
  Target: SCN10A; (+) strand; PAM type: NRG; PAM sequence: CAG
gagtctttatctgtagctct

SEQ ID NO: 40217 - DNA, 20 bp, Artificial Sequence
  Description of Artificial Sequence: Synthetic oligonucleotide
  Target: SCN10A; (+) strand; PAM type: NRG; PAM sequence: AAG
tctttatctgtagctctcag

SEQ ID NO: 40218 - DNA, 20 bp, Artificial Sequence
  Description of Artificial Sequence: Synthetic oligonucleotide
  Target: SCN10A; (+) strand; PAM type: NRG; PAM sequence: TGG
ctgtagctctcagaagtcca

SEQ ID NO: 40219 - DNA, 20 bp, Artificial Sequence
  Description of Artificial Sequence: Synthetic oligonucleotide
  Target: SCN10A; (+) strand; PAM type: NRG; PAM sequence: GGG
tgtagctctcagaagtccat

SEQ ID NO: 40220 - DNA, 20 bp, Artificial Sequence
  Description of Artificial Sequence: Synthetic oligonucleotide
  Target: SCN10A; (+) strand; PAM type: NRG; PAM sequence: GGG
gtagctctcagaagtccatg

SEQ ID NO: 40221 - DNA, 20 bp, Artificial Sequence
  Description of Artificial Sequence: Synthetic oligonucleotide
  Target: SCN10A; (+) strand; PAM type: NRG; PAM sequence: CAG
tctcagaagtccatggggct

SEQ ID NO: 40222 - DNA, 20 bp, Artificial Sequence
  Description of Artificial Sequence: Synthetic oligonucleotide
  Target: SCN10A; (+) strand; PAM type: NRG; PAM sequence: CAG
ttcatttgatctctccactt

SEQ ID NO: 40223 - DNA, 20 bp, Artificial Sequence
  Description of Artificial Sequence: Synthetic oligonucleotide
  Target: SCN10A; (+) strand; PAM type: NRG; PAM sequence: GAG
tctccacttcagtgtctcat

SEQ ID NO: 40224 - DNA, 20 bp, Artificial Sequence
  Description of Artificial Sequence: Synthetic oligonucleotide
  Target: SCN10A; (+) strand; PAM type: NRG; PAM sequence: AAG
cagtgtctcatgagcacctc

SEQ ID NO: 40225 - DNA, 20 bp, Artificial Sequence
  Description of Artificial Sequence: Synthetic oligonucleotide
  Target: SCN10A; (+) strand; PAM type: NRG; PAM sequence: CAG
tctcatgagcacctcaagct

SEQ ID NO: 40226 - DNA, 20 bp, Artificial Sequence
  Description of Artificial Sequence: Synthetic oligonucleotide
  Target: SCN10A; (+) strand; PAM type: NRG; PAM sequence: TAG
ctatgtctttttactgccat

SEQ ID NO: 40227 - DNA, 20 bp, Artificial Sequence
  Description of Artificial Sequence: Synthetic oligonucleotide
  Target: SCN10A; (+) strand; PAM type: NRG; PAM sequence: TAG
ttactgccattagccccaaa

SEQ ID NO: 40228 - DNA, 20 bp, Artificial Sequence
  Description of Artificial Sequence: Synthetic oligonucleotide
  Target: SCN10A; (+) strand; PAM type: NRG; PAM sequence: TGG
ttctgtgtctgtccacaacc

SEQ ID NO: 40229 - DNA, 20 bp, Artificial Sequence
  Description of Artificial Sequence: Synthetic oligonucleotide
  Target: SCN10A; (+) strand; PAM type: NRG; PAM sequence: GGG
tctgtgtctgtccacaacct

SEQ ID NO: 40230 - DNA, 20 bp, Artificial Sequence
  Description of Artificial Sequence: Synthetic oligonucleotide
  Target: SCN10A; (+) strand; PAM type: NRG; PAM sequence: TAG
tccacatacaatcaaacatc

SEQ ID NO: 40231 - DNA, 20 bp, Artificial Sequence
  Description of Artificial Sequence: Synthetic oligonucleotide
  Target: SCN10A; (+) strand; PAM type: NRG; PAM sequence: TGG
taacctctccatcatactgc

SEQ ID NO: 40232 - DNA, 20 bp, Artificial Sequence
  Description of Artificial Sequence: Synthetic oligonucleotide
  Target: SCN10A; (+) strand; PAM type: NRG; PAM sequence: TGG
tccaatcactgtcatctcac

SEQ ID NO: 40233 - DNA, 20 bp, Artificial Sequence
  Description of Artificial Sequence: Synthetic oligonucleotide
  Target: SCN10A; (+) strand; PAM type: NRG; PAM sequence: TAG
gtgtcattttgattcccctt

SEQ ID NO: 40234 - DNA, 20 bp, Artificial Sequence
  Description of Artificial Sequence: Synthetic oligonucleotide
  Target: SCN10A; (+) strand; PAM type: NRG; PAM sequence: CAG
ctttctaacctattctccaa

SEQ ID NO: 40235 - DNA, 20 bp, Artificial Sequence
  Description of Artificial Sequence: Synthetic oligonucleotide
  Target: SCN10A; (+) strand; PAM type: NRG; PAM sequence: TGG
tctaacctattctccaacag

SEQ ID NO: 40236 - DNA, 20 bp, Artificial Sequence
  Description of Artificial Sequence: Synthetic oligonucleotide
  Target: SCN10A; (+) strand; PAM type: NRG; PAM sequence: TGG
atatttctaaaatgaaaatc

SEQ ID NO: 40237 - DNA, 20 bp, Artificial Sequence
  Description of Artificial Sequence: Synthetic oligonucleotide
  Target: SCN10A; (+) strand; PAM type: NRG; PAM sequence: AAG
ctttatttaaaatcattcta

SEQ ID NO: 40238 - DNA, 20 bp, Artificial Sequence
  Description of Artificial Sequence: Synthetic oligonucleotide
  Target: SCN10A; (+) strand; PAM type: NRG; PAM sequence: TAG
aatcattctaaagctctcca

SEQ ID NO: 40239 - DNA, 20 bp, Artificial Sequence
  Description of Artificial Sequence: Synthetic oligonucleotide
  Target: SCN10A; (+) strand; PAM type: NRG; PAM sequence: AAG
taaagctctccatagcactc

SEQ ID NO: 40240 - DNA, 20 bp, Artificial Sequence
  Description of Artificial Sequence: Synthetic oligonucleotide
  Target: SCN10A; (+) strand; PAM type: NRG; PAM sequence: CAG
aaactgtgcgctgacctctc

SEQ ID NO: 40241 - DNA, 20 bp, Artificial Sequence
  Description of Artificial Sequence: Synthetic oligonucleotide
  Target: SCN10A; (+) strand; PAM type: NRG; PAM sequence: TGG
gtgcgctgacctctccagca

SEQ ID NO: 40242 - DNA, 20 bp, Artificial Sequence
  Description of Artificial Sequence: Synthetic oligonucleotide
  Target: SCN10A; (+) strand; PAM type: NRG; PAM sequence: TAG
cgctgacctctccagcatgg

SEQ ID NO: 40243 - DNA, 20 bp, Artificial Sequence
  Description of Artificial Sequence: Synthetic oligonucleotide
  Target: SCN10A; (+) strand; PAM type: NRG; PAM sequence: CAG
ctctccagcatggtagtccc

SEQ ID NO: 40244 - DNA, 20 bp, Artificial Sequence
  Description of Artificial Sequence: Synthetic oligonucleotide
  Target: SCN10A; (+) strand; PAM type: NRG; PAM sequence: AAG
cccagccacactacttttat

SEQ ID NO: 40245 - DNA, 20 bp, Artificial Sequence
  Description of Artificial Sequence: Synthetic oligonucleotide
  Target: SCN10A; (+) strand; PAM type: NRG; PAM sequence: AAG
gacccattcttttttatgtt

SEQ ID NO: 40246 - DNA, 20 bp, Artificial Sequence
  Description of Artificial Sequence: Synthetic oligonucleotide
  Target: SCN10A; (+) strand; PAM type: NRG; PAM sequence: AGG
acccattcttttttatgtta

SEQ ID NO: 40247 - DNA, 20 bp, Artificial Sequence
  Description of Artificial Sequence: Synthetic oligonucleotide
  Target: SCN10A; (+) strand; PAM type: NRG; PAM sequence: TGG
tctttccactttattttgtc

SEQ ID NO: 40248 - DNA, 20 bp, Artificial Sequence
  Description of Artificial Sequence: Synthetic oligonucleotide
  Target: SCN10A; (+) strand; PAM type: NRG; PAM sequence: TGG
ctctcttattcttgtactct

SEQ ID NO: 40249 - DNA, 20 bp, Artificial Sequence
  Description of Artificial Sequence: Synthetic oligonucleotide
  Target: SCN10A; (+) strand; PAM type: NRG; PAM sequence: GAG
attcttgtactcttggcttt

SEQ ID NO: 40250 - DNA, 20 bp, Artificial Sequence
  Description of Artificial Sequence: Synthetic oligonucleotide
  Target: SCN10A; (+) strand; PAM type: NRG; PAM sequence: AAG
ttccatttctgacctatatg

SEQ ID NO: 40251 - DNA, 20 bp, Artificial Sequence
  Description of Artificial Sequence: Synthetic oligonucleotide
  Target: SCN10A; (+) strand; PAM type: NRG; PAM sequence: TAG
gacctatatgaagtctatgt

SEQ ID NO: 40252 - DNA, 20 bp, Artificial Sequence
  Description of Artificial Sequence: Synthetic oligonucleotide
  Target: SCN10A; (+) strand; PAM type: NRG; PAM sequence: AGG
acctatatgaagtctatgtt

SEQ ID NO: 40253 - DNA, 20 bp, Artificial Sequence
  Description of Artificial Sequence: Synthetic oligonucleotide
  Target: SCN10A; (+) strand; PAM type: NRG; PAM sequence: AAG
tattgtttctaccaaattgt

SEQ ID NO: 40254 - DNA, 20 bp, Artificial Sequence
  Description of Artificial Sequence: Synthetic oligonucleotide
  Target: SCN10A; (+) strand; PAM type: NRG; PAM sequence: CAG
tttctaccaaattgtaagct

SEQ ID NO: 40255 - DNA, 20 bp, Artificial Sequence
  Description of Artificial Sequence: Synthetic oligonucleotide
  Target: SCN10A; (+) strand; PAM type: NRG; PAM sequence: GAG
taccaaattgtaagctcagt

SEQ ID NO: 40256 - DNA, 20 bp, Artificial Sequence
  Description of Artificial Sequence: Synthetic oligonucleotide
  Target: SCN10A; (+) strand; PAM type: NRG; PAM sequence: GAG
ccaaattgtaagctcagtga

SEQ ID NO: 40257 - DNA, 20 bp, Artificial Sequence
  Description of Artificial Sequence: Synthetic oligonucleotide
  Target: SCN10A; (+) strand; PAM type: NRG; PAM sequence: TGG
attgtaagctcagtgagagc

SEQ ID NO: 40258 - DNA, 20 bp, Artificial Sequence
  Description of Artificial Sequence: Synthetic oligonucleotide
  Target: SCN10A; (+) strand; PAM type: NRG; PAM sequence: CAG
ggactcacatctattttgtt

SEQ ID NO: 40259 - DNA, 20 bp, Artificial Sequence
  Description of Artificial Sequence: Synthetic oligonucleotide
  Target: SCN10A; (+) strand; PAM type: NRG; PAM sequence: CAG
tttgttcagcattgattttc

SEQ ID NO: 40260 - DNA, 20 bp, Artificial Sequence
  Description of Artificial Sequence: Synthetic oligonucleotide
  Target: SCN10A; (+) strand; PAM type: NRG; PAM sequence: TAG
agcattgattttccagaacc

SEQ ID NO: 40261 - DNA, 20 bp, Artificial Sequence
  Description of Artificial Sequence: Synthetic oligonucleotide
  Target: SCN10A; (+) strand; PAM type: NRG; PAM sequence: CAG
tgattttccagaacctagta

SEQ ID NO: 40262 - DNA, 20 bp, Artificial Sequence
  Description of Artificial Sequence: Synthetic oligonucleotide
  Target: SCN10A; (+) strand; PAM type: NRG; PAM sequence: TGG
ccagaacctagtacagtgcc

SEQ ID NO: 40263 - DNA, 20 bp, Artificial Sequence
  Description of Artificial Sequence: Synthetic oligonucleotide
  Target: SCN10A; (+) strand; PAM type: NRG; PAM sequence: TAG
gtacagtgcctggaactaac

SEQ ID NO: 40264 - DNA, 20 bp, Artificial Sequence
  Description of Artificial Sequence: Synthetic oligonucleotide
  Target: SCN10A; (+) strand; PAM type: NRG; PAM sequence: CAG
tgcctggaactaactagata

SEQ ID NO: 40265 - DNA, 20 bp, Artificial Sequence
  Description of Artificial Sequence: Synthetic oligonucleotide
  Target: SCN10A; (+) strand; PAM type: NRG; PAM sequence: TAG
ggaactaactagatacagaa

SEQ ID NO: 40266 - DNA, 20 bp, Artificial Sequence
  Description of Artificial Sequence: Synthetic oligonucleotide
  Target: SCN10A; (+) strand; PAM type: NRG; PAM sequence: TAG
ctaactagatacagaataga

SEQ ID NO: 40267 - DNA, 20 bp, Artificial Sequence
  Description of Artificial Sequence: Synthetic oligonucleotide
  Target: SCN10A; (+) strand; PAM type: NRG; PAM sequence: TAG
atagatagttgttgcatgaa

SEQ ID NO: 40268 - DNA, 20 bp, Artificial Sequence
  Description of Artificial Sequence: Synthetic oligonucleotide
  Target: SCN10A; (+) strand; PAM type: NRG; PAM sequence: GAG
agatagttgttgcatgaata

SEQ ID NO: 40269 - DNA, 20 bp, Artificial Sequence
  Description of Artificial Sequence: Synthetic oligonucleotide
  Target: SCN10A; (+) strand; PAM type: NRG; PAM sequence: TGG
tgttgcatgaatagagataa

SEQ ID NO: 40270 - DNA, 20 bp, Artificial Sequence
  Description of Artificial Sequence: Synthetic oligonucleotide
  Target: SCN10A; (+) strand; PAM type: NRG; PAM sequence: TAG
gagataatggcgaaacttaa

SEQ ID NO: 40271 - DNA, 20 bp, Artificial Sequence
  Description of Artificial Sequence: Synthetic oligonucleotide
  Target: SCN10A; (+) strand; PAM type: NRG; PAM sequence: AAG
acttaatagctgaaaaacta

SEQ ID NO: 40272 - DNA, 20 bp, Artificial Sequence
  Description of Artificial Sequence: Synthetic oligonucleotide
  Target: SCN10A; (+) strand; PAM type: NRG; PAM sequence: CAG
aaactaaagaacattttgtt

SEQ ID NO: 40273 - DNA, 20 bp, Artificial Sequence
  Description of Artificial Sequence: Synthetic oligonucleotide
  Target: SCN10A; (+) strand; PAM type: NRG; PAM sequence: CAG
acattttgttcagaaaaatg

SEQ ID NO: 40274 - DNA, 20 bp, Artificial Sequence
  Description of Artificial Sequence: Synthetic oligonucleotide
  Target: SCN10A; (+) strand; PAM type: NRG; PAM sequence: CAG
gaaaaatgcagcaaaaatca

SEQ ID NO: 40275 - DNA, 20 bp, Artificial Sequence
  Description of Artificial Sequence: Synthetic oligonucleotide
  Target: SCN10A; (+) strand; PAM type: NRG; PAM sequence: TAG
aaaaatcacagatccaataa

SEQ ID NO: 40276 - DNA, 20 bp, Artificial Sequence
  Description of Artificial Sequence: Synthetic oligonucleotide
  Target: SCN10A; (+) strand; PAM type: NRG; PAM sequence: AGG
aaaatcacagatccaataat

SEQ ID NO: 40277 - DNA, 20 bp, Artificial Sequence
  Description of Artificial Sequence: Synthetic oligonucleotide
  Target: SCN10A; (+) strand; PAM type: NRG; PAM sequence: AAG
agatccaataataggaatat

SEQ ID NO: 40278 - DNA, 20 bp, Artificial Sequence
  Description of Artificial Sequence: Synthetic oligonucleotide
  Target: SCN10A; (+) strand; PAM type: NRG; PAM sequence: AGG
gatccaataataggaatata

SEQ ID NO: 40279 - DNA, 20 bp, Artificial Sequence
  Description of Artificial Sequence: Synthetic oligonucleotide
  Target: SCN10A; (+) strand; PAM type: NRG; PAM sequence: AAG
aataggaatataaggaacca

SEQ ID NO: 40280 - DNA, 20 bp, Artificial Sequence
  Description of Artificial Sequence: Synthetic oligonucleotide
  Target: SCN10A; (+) strand; PAM type: NRG; PAM sequence: GAG
taggaatataaggaaccaaa

SEQ ID NO: 40281 - DNA, 20 bp, Artificial Sequence
  Description of Artificial Sequence: Synthetic oligonucleotide
  Target: SCN10A; (+) strand; PAM type: NRG; PAM sequence: GAG
aaggaaccaaagagattatt

SEQ ID NO: 40282 - DNA, 20 bp, Artificial Sequence
  Description of Artificial Sequence: Synthetic oligonucleotide
  Target: SCN10A; (+) strand; PAM type: NRG; PAM sequence: AAG
ttgagtctattgacatttta

SEQ ID NO: 40283 - DNA, 20 bp, Artificial Sequence
  Description of Artificial Sequence: Synthetic oligonucleotide
  Target: SCN10A; (+) strand; PAM type: NRG; PAM sequence: AAG
tttaaagctcacacacccca

SEQ ID NO: 40284 - DNA, 20 bp, Artificial Sequence
  Description of Artificial Sequence: Synthetic oligonucleotide
  Target: SCN10A; (+) strand; PAM type: NRG; PAM sequence: AAG
agctcacacaccccaaagtc

SEQ ID NO: 40285 - DNA, 20 bp, Artificial Sequence
  Description of Artificial Sequence: Synthetic oligonucleotide
  Target: SCN10A; (+) strand; PAM type: NRG; PAM sequence: CAG
tcacacaccccaaagtcaag

SEQ ID NO: 40286 - DNA, 20 bp, Artificial Sequence
  Description of Artificial Sequence: Synthetic oligonucleotide
  Target: SCN10A; (+) strand; PAM type: NRG; PAM sequence: TGG
acaccccaaagtcaagcaga

SEQ ID NO: 40287 - DNA, 20 bp, Artificial Sequence
  Description of Artificial Sequence: Synthetic oligonucleotide
  Target: SCN10A; (+) strand; PAM type: NRG; PAM sequence: TGG
ccccaaagtcaagcagatgg

SEQ ID NO: 40288 - DNA, 20 bp, Artificial Sequence
  Description of Artificial Sequence: Synthetic oligonucleotide
  Target: SCN10A; (+) strand; PAM type: NRG; PAM sequence: CAG
caaagtcaagcagatggtgg

SEQ ID NO: 40289 - DNA, 20 bp, Artificial Sequence
  Description of Artificial Sequence: Synthetic oligonucleotide
  Target: SCN10A; (+) strand; PAM type: NRG; PAM sequence: GAG
aagtcaagcagatggtggca

SEQ ID NO: 40290 - DNA, 20 bp, Artificial Sequence
  Description of Artificial Sequence: Synthetic oligonucleotide
  Target: SCN10A; (+) strand; PAM type: NRG; PAM sequence: AGG
agtcaagcagatggtggcag

SEQ ID NO: 40291 - DNA, 20 bp, Artificial Sequence
  Description of Artificial Sequence: Synthetic oligonucleotide
  Target: SCN10A; (+) strand; PAM type: NRG; PAM sequence: CAG
caagcagatggtggcagagg

SEQ ID NO: 40292 - DNA, 20 bp, Artificial Sequence
  Description of Artificial Sequence: Synthetic oligonucleotide
  Target: SCN10A; (+) strand; PAM type: NRG; PAM sequence: TGG
taaatcaaatacccctatga

SEQ ID NO: 40293 - DNA, 20 bp, Artificial Sequence
  Description of Artificial Sequence: Synthetic oligonucleotide
  Target: SCN10A; (+) strand; PAM type: NRG; PAM sequence: GAG
aatcaaatacccctatgatg

SEQ ID NO: 40294 - DNA, 20 bp, Artificial Sequence
  Description of Artificial Sequence: Synthetic oligonucleotide
  Target: SCN10A; (+) strand; PAM type: NRG; PAM sequence: TAG
ctgcttgctcccaccatacc

SEQ ID NO: 40295 - DNA, 20 bp, Artificial Sequence
  Description of Artificial Sequence: Synthetic oligonucleotide
  Target: SCN10A; (+) strand; PAM type: NRG; PAM sequence: GAG
gcttgctcccaccataccta

SEQ ID NO: 40296 - DNA, 20 bp, Artificial Sequence
  Description of Artificial Sequence: Synthetic oligonucleotide
  Target: SCN10A; (+) strand; PAM type: NRG; PAM sequence: AGG
cttgctcccaccatacctag

SEQ ID NO: 40297 - DNA, 20 bp, Artificial Sequence
  Description of Artificial Sequence: Synthetic oligonucleotide
  Target: SCN10A; (+) strand; PAM type: NRG; PAM sequence: TAG
aatccaatacctctgtgata

SEQ ID NO: 40298 - DNA, 20 bp, Artificial Sequence
  Description of Artificial Sequence: Synthetic oligonucleotide
  Target: SCN10A; (+) strand; PAM type: NRG; PAM sequence: CAG
tagacactgcttattgtcac

SEQ ID NO: 40299 - DNA, 20 bp, Artificial Sequence
  Description of Artificial Sequence: Synthetic oligonucleotide
  Target: SCN10A; (+) strand; PAM type: NRG; PAM sequence: TAG
ctgcttattgtcaccagccc

SEQ ID NO: 40300 - DNA, 20 bp, Artificial Sequence
  Description of Artificial Sequence: Synthetic oligonucleotide
  Target: SCN10A; (+) strand; PAM type: NRG; PAM sequence: GAG
gcttattgtcaccagcccta

SEQ ID NO: 40301 - DNA, 20 bp, Artificial Sequence
  Description of Artificial Sequence: Synthetic oligonucleotide
  Target: SCN10A; (+) strand; PAM type: NRG; PAM sequence: AGG
cttattgtcaccagccctag

SEQ ID NO: 40302 - DNA, 20 bp, Artificial Sequence
  Description of Artificial Sequence: Synthetic oligonucleotide
  Target: SCN10A; (+) strand; PAM type: NRG; PAM sequence: CAG
attgtcaccagccctagagg

SEQ ID NO: 40303 - DNA, 20 bp, Artificial Sequence
  Description of Artificial Sequence: Synthetic oligonucleotide
  Target: SCN10A; (+) strand; PAM type: NRG; PAM sequence: TGG
accagccctagaggcagctc

SEQ ID NO: 40304 - DNA, 20 bp, Artificial Sequence
  Description of Artificial Sequence: Synthetic oligonucleotide
  Target: SCN10A; (+) strand; PAM type: NRG; PAM sequence: TAG
tggtacccaatacccatatg

SEQ ID NO: 40305 - DNA, 20 bp, Artificial Sequence
  Description of Artificial Sequence: Synthetic oligonucleotide
  Target: SCN10A; (+) strand; PAM type: NRG; PAM sequence: AGG
ggtacccaatacccatatgt

SEQ ID NO: 40306 - DNA, 20 bp, Artificial Sequence
  Description of Artificial Sequence: Synthetic oligonucleotide
  Target: SCN10A; (+) strand; PAM type: NRG; PAM sequence: GAG
tacccaatacccatatgtag

SEQ ID NO: 40307 - DNA, 20 bp, Artificial Sequence
  Description of Artificial Sequence: Synthetic oligonucleotide
  Target: SCN10A; (+) strand; PAM type: NRG; PAM sequence: AGG
acccaatacccatatgtagg

SEQ ID NO: 40308 - DNA, 20 bp, Artificial Sequence
  Description of Artificial Sequence: Synthetic oligonucleotide
  Target: SCN10A; (+) strand; PAM type: NRG; PAM sequence: TGG
ccatatgtaggaggctctgc

SEQ ID NO: 40309 - DNA, 20 bp, Artificial Sequence
  Description of Artificial Sequence: Synthetic oligonucleotide
  Target: SCN10A; (+) strand; PAM type: NRG; PAM sequence: CAG
gaggctctgctggttgtcac

SEQ ID NO: 40310 - DNA, 20 bp, Artificial Sequence
  Description of Artificial Sequence: Synthetic oligonucleotide
  Target: SCN10A; (+) strand; PAM type: NRG; PAM sequence: AAG
accagtccttccatgcattg

SEQ ID NO: 40311 - DNA, 20 bp, Artificial Sequence
  Description of Artificial Sequence: Synthetic oligonucleotide
  Target: SCN10A; (+) strand; PAM type: NRG; PAM sequence: TGG
ccttccatgcattgaagtcc

SEQ ID NO: 40312 - DNA, 20 bp, Artificial Sequence
  Description of Artificial Sequence: Synthetic oligonucleotide
  Target: SCN10A; (+) strand; PAM type: NRG; PAM sequence: GGG
cttccatgcattgaagtcct

SEQ ID NO: 40313 - DNA, 20 bp, Artificial Sequence
  Description of Artificial Sequence: Synthetic oligonucleotide
  Target: SCN10A; (+) strand; PAM type: NRG; PAM sequence: GAG
tccatgcattgaagtcctgg

SEQ ID NO: 40314 - DNA, 20 bp, Artificial Sequence
  Description of Artificial Sequence: Synthetic oligonucleotide
  Target: SCN10A; (+) strand; PAM type: NRG; PAM sequence: AGG
ccatgcattgaagtcctggg

SEQ ID NO: 40315 - DNA, 20 bp, Artificial Sequence
  Description of Artificial Sequence: Synthetic oligonucleotide
  Target: SCN10A; (+) strand; PAM type: NRG; PAM sequence: GAG
atgcattgaagtcctgggag

SEQ ID NO: 40316 - DNA, 20 bp, Artificial Sequence
  Description of Artificial Sequence: Synthetic oligonucleotide
  Target: SCN10A; (+) strand; PAM type: NRG; PAM sequence: GAG
gtcctccattactttcttct

SEQ ID NO: 40317 - DNA, 20 bp, Artificial Sequence
  Description of Artificial Sequence: Synthetic oligonucleotide
  Target: SCN10A; (+) strand; PAM type: NRG; PAM sequence: GAG
cctccattactttcttctga

SEQ ID NO: 40318 - DNA, 20 bp, Artificial Sequence
  Description of Artificial Sequence: Synthetic oligonucleotide
  Target: SCN10A; (+) strand; PAM type: NRG; PAM sequence: TAG
cctctcctcctgcctatttg

SEQ ID NO: 40319 - DNA, 20 bp, Artificial Sequence
  Description of Artificial Sequence: Synthetic oligonucleotide
  Target: SCN10A; (+) strand; PAM type: NRG; PAM sequence: CGG
tgtagttgatctgtttctta

SEQ ID NO: 40320 - DNA, 20 bp, Artificial Sequence
  Description of Artificial Sequence: Synthetic oligonucleotide
  Target: SCN10A; (+) strand; PAM type: NRG; PAM sequence: AAG
gtttcttacggaacttttca

SEQ ID NO: 40321 - DNA, 20 bp, Artificial Sequence
  Description of Artificial Sequence: Synthetic oligonucleotide
  Target: SCN10A; (+) strand; PAM type: NRG; PAM sequence: TAG
tcttctattttcttctaact

SEQ ID NO: 40322 - DNA, 20 bp, Artificial Sequence
  Description of Artificial Sequence: Synthetic oligonucleotide
  Target: SCN10A; (+) strand; PAM type: NRG; PAM sequence: AAG
tctattttcttctaacttag

SEQ ID NO: 40323 - DNA, 20 bp, Artificial Sequence
  Description of Artificial Sequence: Synthetic oligonucleotide
  Target: SCN10A; (+) strand; PAM type: NRG; PAM sequence: TGG
tgcccaaattctgattaaca

SEQ ID NO: 40324 - DNA, 20 bp, Artificial Sequence
  Description of Artificial Sequence: Synthetic oligonucleotide
  Target: SCN10A; (+) strand; PAM type: NRG; PAM sequence: CAG
cattcaaacactgttgactt

SEQ ID NO: 40325 - DNA, 20 bp, Artificial Sequence
  Description of Artificial Sequence: Synthetic oligonucleotide
  Target: SCN10A; (+) strand; PAM type: NRG; PAM sequence: GAG
gtctttaattcttcccttct

SEQ ID NO: 40326 - DNA, 20 bp, Artificial Sequence
  Description of Artificial Sequence: Synthetic oligonucleotide
  Target: SCN10A; (+) strand; PAM type: NRG; PAM sequence: AAG
ttcttcccttctgagaaaca

SEQ ID NO: 40327 - DNA, 20 bp, Artificial Sequence
  Description of Artificial Sequence: Synthetic oligonucleotide
  Target: SCN10A; (+) strand; PAM type: NRG; PAM sequence: AAG
ccttctgagaaacaaagatt

SEQ ID NO: 40328 - DNA, 20 bp, Artificial Sequence
  Description of Artificial Sequence: Synthetic oligonucleotide
  Target: SCN10A; (+) strand; PAM type: NRG; PAM sequence: TAG
ttaactttctcttccttgtc

SEQ ID NO: 40329 - DNA, 20 bp, Artificial Sequence
  Description of Artificial Sequence: Synthetic oligonucleotide
  Target: SCN10A; (+) strand; PAM type: NRG; PAM sequence: AGG
taactttctcttccttgtct

SEQ ID NO: 40330 - DNA, 20 bp, Artificial Sequence
  Description of Artificial Sequence: Synthetic oligonucleotide
  Target: SCN10A; (+) strand; PAM type: NRG; PAM sequence: GGG
aactttctcttccttgtcta

SEQ ID NO: 40331 - DNA, 20 bp, Artificial Sequence
  Description of Artificial Sequence: Synthetic oligonucleotide
  Target: SCN10A; (+) strand; PAM type: NRG; PAM sequence: GGG
actttctcttccttgtctag

SEQ ID NO: 40332 - DNA, 20 bp, Artificial Sequence
  Description of Artificial Sequence: Synthetic oligonucleotide
  Target: SCN10A; (+) strand; PAM type: NRG; PAM sequence: GAG
tttctcttccttgtctaggg

SEQ ID NO: 40333 - DNA, 20 bp, Artificial Sequence
  Description of Artificial Sequence: Synthetic oligonucleotide
  Target: SCN10A; (+) strand; PAM type: NRG; PAM sequence: AAG
ctcttccttgtctaggggag

SEQ ID NO: 40334 - DNA, 20 bp, Artificial Sequence
  Description of Artificial Sequence: Synthetic oligonucleotide
  Target: SCN10A; (+) strand; PAM type: NRG; PAM sequence: GAG
cttccttgtctaggggagaa

SEQ ID NO: 40335 - DNA, 20 bp, Artificial Sequence
  Description of Artificial Sequence: Synthetic oligonucleotide
  Target: SCN10A; (+) strand; PAM type: NRG; PAM sequence: TAG
taggggagaagagatactta

SEQ ID NO: 40336 - DNA, 20 bp, Artificial Sequence
  Description of Artificial Sequence: Synthetic oligonucleotide
  Target: SCN10A; (+) strand; PAM type: NRG; PAM sequence: TGG
gagaagagatacttatagtt

SEQ ID NO: 40337 - DNA, 20 bp, Artificial Sequence
  Description of Artificial Sequence: Synthetic oligonucleotide
  Target: SCN10A; (+) strand; PAM type: NRG; PAM sequence: CAG
ttggaaccaaatttgaatcc

SEQ ID NO: 40338 - DNA, 20 bp, Artificial Sequence
  Description of Artificial Sequence: Synthetic oligonucleotide
  Target: SCN10A; (+) strand; PAM type: NRG; PAM sequence: AGG
tggaaccaaatttgaatccc

SEQ ID NO: 40339 - DNA, 20 bp, Artificial Sequence
  Description of Artificial Sequence: Synthetic oligonucleotide
  Target: SCN10A; (+) strand; PAM type: NRG; PAM sequence: CAG
caaatttgaatcccaggact

SEQ ID NO: 40340 - DNA, 20 bp, Artificial Sequence
  Description of Artificial Sequence: Synthetic oligonucleotide
  Target: SCN10A; (+) strand; PAM type: NRG; PAM sequence: TAG
aatcccaggactcagttgtt

SEQ ID NO: 40341 - DNA, 20 bp, Artificial Sequence
  Description of Artificial Sequence: Synthetic oligonucleotide
  Target: SCN10A; (+) strand; PAM type: NRG; PAM sequence: AAG
cagttgtttagtaacaatgc

SEQ ID NO: 40342 - DNA, 20 bp, Artificial Sequence
  Description of Artificial Sequence: Synthetic oligonucleotide
  Target: SCN10A; (+) strand; PAM type: NRG; PAM sequence: CAG
taacaatgcaagaattctct

SEQ ID NO: 40343 - DNA, 20 bp, Artificial Sequence
  Description of Artificial Sequence: Synthetic oligonucleotide
  Target: SCN10A; (+) strand; PAM type: NRG; PAM sequence: TGG
aagaattctctcagtgacac

SEQ ID NO: 40344 - DNA, 20 bp, Artificial Sequence
  Description of Artificial Sequence: Synthetic oligonucleotide
  Target: SCN10A; (+) strand; PAM type: NRG; PAM sequence: GAG
tgacactggaatgcaatgtt

SEQ ID NO: 40345 - DNA, 20 bp, Artificial Sequence
  Description of Artificial Sequence: Synthetic oligonucleotide
  Target: SCN10A; (+) strand; PAM type: NRG; PAM sequence: AGG
gacactggaatgcaatgttg

SEQ ID NO: 40346 - DNA, 20 bp, Artificial Sequence
  Description of Artificial Sequence: Synthetic oligonucleotide
  Target: SCN10A; (+) strand; PAM type: NRG; PAM sequence: GAG
ggaatgcaatgttgaggatt

SEQ ID NO: 40347 - DNA, 20 bp, Artificial Sequence
  Description of Artificial Sequence: Synthetic oligonucleotide
  Target: SCN10A; (+) strand; PAM type: NRG; PAM sequence: CAG
gcaatgttgaggattgagaa

SEQ ID NO: 40348 - DNA, 20 bp, Artificial Sequence
  Description of Artificial Sequence: Synthetic oligonucleotide
  Target: SCN10A; (+) strand; PAM type: NRG; PAM sequence: AGG
caatgttgaggattgagaac

SEQ ID NO: 40349 - DNA, 20 bp, Artificial Sequence
  Description of Artificial Sequence: Synthetic oligonucleotide
  Target: SCN10A; (+) strand; PAM type: NRG; PAM sequence: AAG
tgaggattgagaacaggact

SEQ ID NO: 40350 - DNA, 20 bp, Artificial Sequence
  Description of Artificial Sequence: Synthetic oligonucleotide
  Target: SCN10A; (+) strand; PAM type: NRG; PAM sequence: CAG
gattgagaacaggactaagc

SEQ ID NO: 40351 - DNA, 20 bp, Artificial Sequence
  Description of Artificial Sequence: Synthetic oligonucleotide
  Target: SCN10A; (+) strand; PAM type: NRG; PAM sequence: CAG
acaggactaagccagaattc

SEQ ID NO: 40352 - DNA, 20 bp, Artificial Sequence
  Description of Artificial Sequence: Synthetic oligonucleotide
  Target: SCN10A; (+) strand; PAM type: NRG; PAM sequence: AGG
caggactaagccagaattcc

SEQ ID NO: 40353 - DNA, 20 bp, Artificial Sequence
  Description of Artificial Sequence: Synthetic oligonucleotide
  Target: SCN10A; (+) strand; PAM type: NRG; PAM sequence: TGG
taagccagaattccaggtcc

SEQ ID NO: 40354 - DNA, 20 bp, Artificial Sequence
  Description of Artificial Sequence: Synthetic oligonucleotide
  Target: SCN10A; (+) strand; PAM type: NRG; PAM sequence: GAG
agccagaattccaggtcctg

SEQ ID NO: 40355 - DNA, 20 bp, Artificial Sequence
  Description of Artificial Sequence: Synthetic oligonucleotide
  Target: SCN10A; (+) strand; PAM type: NRG; PAM sequence: TGG
agaattccaggtcctggagc

SEQ ID NO: 40356 - DNA, 20 bp, Artificial Sequence
  Description of Artificial Sequence: Synthetic oligonucleotide
  Target: SCN10A; (+) strand; PAM type: NRG; PAM sequence: GAG
aattccaggtcctggagctg

SEQ ID NO: 40357 - DNA, 20 bp, Artificial Sequence
  Description of Artificial Sequence: Synthetic oligonucleotide
  Target: SCN10A; (+) strand; PAM type: NRG; PAM sequence: GAG
aggtcctggagctggagctt

SEQ ID NO: 40358 - DNA, 20 bp, Artificial Sequence
  Description of Artificial Sequence: Synthetic oligonucleotide
  Target: SCN10A; (+) strand; PAM type: NRG; PAM sequence: AGG
ggtcctggagctggagcttg

SEQ ID NO: 40359 - DNA, 20 bp, Artificial Sequence
  Description of Artificial Sequence: Synthetic oligonucleotide
  Target: SCN10A; (+) strand; PAM type: NRG; PAM sequence: AAG
ggagctggagcttgaggtca

SEQ ID NO: 40360 - DNA, 20 bp, Artificial Sequence
  Description of Artificial Sequence: Synthetic oligonucleotide
  Target: SCN10A; (+) strand; PAM type: NRG; PAM sequence: CAG
gctggagcttgaggtcaaag

SEQ ID NO: 40361 - DNA, 20 bp, Artificial Sequence
  Description of Artificial Sequence: Synthetic oligonucleotide
  Target: SCN10A; (+) strand; PAM type: NRG; PAM sequence: CAG
gcttgaggtcaaagcagact

SEQ ID NO: 40362 - DNA, 20 bp, Artificial Sequence
  Description of Artificial Sequence: Synthetic oligonucleotide
  Target: SCN10A; (+) strand; PAM type: NRG; PAM sequence: GAG
gtcaaagcagactcagctat

SEQ ID NO: 40363 - DNA, 20 bp, Artificial Sequence
  Description of Artificial Sequence: Synthetic oligonucleotide
  Target: SCN10A; (+) strand; PAM type: NRG; PAM sequence: TGG
ccaaatgaccataattattc

SEQ ID NO: 40364 - DNA, 20 bp, Artificial Sequence
  Description of Artificial Sequence: Synthetic oligonucleotide
  Target: SCN10A; (+) strand; PAM type: NRG; PAM sequence: GGG
caaatgaccataattattct

SEQ ID NO: 40365 - DNA, 20 bp, Artificial Sequence
  Description of Artificial Sequence: Synthetic oligonucleotide
  Target: SCN10A; (+) strand; PAM type: NRG; PAM sequence: CAG
tgggctaccataaatccctc

SEQ ID NO: 40366 - DNA, 20 bp, Artificial Sequence
  Description of Artificial Sequence: Synthetic oligonucleotide
  Target: SCN10A; (+) strand; PAM type: NRG; PAM sequence: AAG
taccataaatccctccagct

SEQ ID NO: 40367 - DNA, 20 bp, Artificial Sequence
  Description of Artificial Sequence: Synthetic oligonucleotide
  Target: SCN10A; (+) strand; PAM type: NRG; PAM sequence: AGG
accataaatccctccagcta

SEQ ID NO: 40368 - DNA, 20 bp, Artificial Sequence
  Description of Artificial Sequence: Synthetic oligonucleotide
  Target: SCN10A; (+) strand; PAM type: NRG; PAM sequence: TGG
gacaaaattgttttcaacat

SEQ ID NO: 40369 - DNA, 20 bp, Artificial Sequence
  Description of Artificial Sequence: Synthetic oligonucleotide
  Target: SCN10A; (+) strand; PAM type: NRG; PAM sequence: GGG
acaaaattgttttcaacatt

SEQ ID NO: 40370 - DNA, 20 bp, Artificial Sequence
  Description of Artificial Sequence: Synthetic oligonucleotide
  Target: SCN10A; (+) strand; PAM type: NRG; PAM sequence: GGG
caaaattgttttcaacattg

SEQ ID NO: 40371 - DNA, 20 bp, Artificial Sequence
  Description of Artificial Sequence: Synthetic oligonucleotide
  Target: SCN10A; (+) strand; PAM type: NRG; PAM sequence: TGG
aattgttttcaacattgggg

SEQ ID NO: 40372 - DNA, 20 bp, Artificial Sequence
  Description of Artificial Sequence: Synthetic oligonucleotide
  Target: SCN10A; (+) strand; PAM type: NRG; PAM sequence: GGG
attgttttcaacattggggt

SEQ ID NO: 40373 - DNA, 20 bp, Artificial Sequence
  Description of Artificial Sequence: Synthetic oligonucleotide
  Target: SCN10A; (+) strand; PAM type: NRG; PAM sequence: TAG
aacattggggtgggaatttg

SEQ ID NO: 40374 - DNA, 20 bp, Artificial Sequence
  Description of Artificial Sequence: Synthetic oligonucleotide
  Target: SCN10A; (+) strand; PAM type: NRG; PAM sequence: TAG
gaatttgtagtgatgtgatg

SEQ ID NO: 40375 - DNA, 20 bp, Artificial Sequence
  Description of Artificial Sequence: Synthetic oligonucleotide
  Target: SCN10A; (+) strand; PAM type: NRG; PAM sequence: AGG
aatttgtagtgatgtgatgt

SEQ ID NO: 40376 - DNA, 20 bp, Artificial Sequence
  Description of Artificial Sequence: Synthetic oligonucleotide
  Target: SCN10A; (+) strand; PAM type: NRG; PAM sequence: GAG
tagtgatgtgatgtaggtat

SEQ ID NO: 40377 - DNA, 20 bp, Artificial Sequence
  Description of Artificial Sequence: Synthetic oligonucleotide
  Target: SCN10A; (+) strand; PAM type: NRG; PAM sequence: AGG
agtgatgtgatgtaggtatg

SEQ ID NO: 40378 - DNA, 20 bp, Artificial Sequence
  Description of Artificial Sequence: Synthetic oligonucleotide
  Target: SCN10A; (+) strand; PAM type: NRG; PAM sequence: GGG
gtgatgtgatgtaggtatga

SEQ ID NO: 40379 - DNA, 20 bp, Artificial Sequence
  Description of Artificial Sequence: Synthetic oligonucleotide
  Target: SCN10A; (+) strand; PAM type: NRG; PAM sequence: CAG
gtgatgtaggtatgagggac

SEQ ID NO: 40380 - DNA, 20 bp, Artificial Sequence
  Description of Artificial Sequence: Synthetic oligonucleotide
  Target: SCN10A; (+) strand; PAM type: NRG; PAM sequence: AAG
gagggaccagtccttctttt

SEQ ID NO: 40381 - DNA, 20 bp, Artificial Sequence
  Description of Artificial Sequence: Synthetic oligonucleotide
  Target: SCN10A; (+) strand; PAM type: NRG; PAM sequence: CAG
ttcttttaagactttcccat

SEQ ID NO: 40382 - DNA, 20 bp, Artificial Sequence
  Description of Artificial Sequence: Synthetic oligonucleotide
  Target: SCN10A; (+) strand; PAM type: NRG; PAM sequence: AAG
ttttaagactttcccatcag

SEQ ID NO: 40383 - DNA, 20 bp, Artificial Sequence
  Description of Artificial Sequence: Synthetic oligonucleotide
  Target: SCN10A; (+) strand; PAM type: NRG; PAM sequence: TAG
gactttcccatcagaagtga

SEQ ID NO: 40384 - DNA, 20 bp, Artificial Sequence
  Description of Artificial Sequence: Synthetic oligonucleotide
  Target: SCN10A; (+) strand; PAM type: NRG; PAM sequence: TGG
cccatcagaagtgatagctc

SEQ ID NO: 40385 - DNA, 20 bp, Artificial Sequence
  Description of Artificial Sequence: Synthetic oligonucleotide
  Target: SCN10A; (+) strand; PAM type: NRG; PAM sequence: TGG
agaagtgatagctctggact

SEQ ID NO: 40386 - DNA, 20 bp, Artificial Sequence
  Description of Artificial Sequence: Synthetic oligonucleotide
  Target: SCN10A; (+) strand; PAM type: NRG; PAM sequence: GGG
gaagtgatagctctggactt

SEQ ID NO: 40387 - DNA, 20 bp, Artificial Sequence
  Description of Artificial Sequence: Synthetic oligonucleotide
  Target: SCN10A; (+) strand; PAM type: NRG; PAM sequence: AAG
gacttgggatcccttgattg

SEQ ID NO: 40388 - DNA, 20 bp, Artificial Sequence
  Description of Artificial Sequence: Synthetic oligonucleotide
  Target: SCN10A; (+) strand; PAM type: NRG; PAM sequence: TGG
ttgggatcccttgattgaag

SEQ ID NO: 40389 - DNA, 20 bp, Artificial Sequence
  Description of Artificial Sequence: Synthetic oligonucleotide
  Target: SCN10A; (+) strand; PAM type: NRG; PAM sequence: CAG
ctatattcccatctattacc

SEQ ID NO: 40390 - DNA, 20 bp, Artificial Sequence
  Description of Artificial Sequence: Synthetic oligonucleotide
  Target: SCN10A; (+) strand; PAM type: NRG; PAM sequence: GAG
gtgtctttacatgacattct

SEQ ID NO: 40391 - DNA, 20 bp, Artificial Sequence
  Description of Artificial Sequence: Synthetic oligonucleotide
  Target: SCN10A; (+) strand; PAM type: NRG; PAM sequence: TGG
tgacattctgagaaaactat

SEQ ID NO: 40392 - DNA, 20 bp, Artificial Sequence
  Description of Artificial Sequence: Synthetic oligonucleotide
  Target: SCN10A; (+) strand; PAM type: NRG; PAM sequence: GGG
gacattctgagaaaactatt

SEQ ID NO: 40393 - DNA, 20 bp, Artificial Sequence
  Description of Artificial Sequence: Synthetic oligonucleotide
  Target: SCN10A; (+) strand; PAM type: NRG; PAM sequence: GGG
acattctgagaaaactattg

SEQ ID NO: 40394 - DNA, 20 bp, Artificial Sequence
  Description of Artificial Sequence: Synthetic oligonucleotide
  Target: SCN10A; (+) strand; PAM type: NRG; PAM sequence: AAG
tgagaaaactattggggtgc

SEQ ID NO: 40395 - DNA, 20 bp, Artificial Sequence
  Description of Artificial Sequence: Synthetic oligonucleotide
  Target: SCN10A; (+) strand; PAM type: NRG; PAM sequence: TAG
gaaaactattggggtgcaag

SEQ ID NO: 40396 - DNA, 20 bp, Artificial Sequence
  Description of Artificial Sequence: Synthetic oligonucleotide
  Target: SCN10A; (+) strand; PAM type: NRG; PAM sequence: GAG
ggggtgcaagtagtttatct

SEQ ID NO: 40397 - DNA, 20 bp, Artificial Sequence
  Description of Artificial Sequence: Synthetic oligonucleotide
  Target: SCN10A; (+) strand; PAM type: NRG; PAM sequence: GAG
ggtgcaagtagtttatctga

SEQ ID NO: 40398 - DNA, 20 bp, Artificial Sequence
  Description of Artificial Sequence: Synthetic oligonucleotide
  Target: SCN10A; (+) strand; PAM type: NRG; PAM sequence: TAG
gtttatctgagagctatttc

SEQ ID NO: 40399 - DNA, 20 bp, Artificial Sequence
  Description of Artificial Sequence: Synthetic oligonucleotide
  Target: SCN10A; (+) strand; PAM type: NRG; PAM sequence: AGG
tttatctgagagctatttct

SEQ ID NO: 40400 - DNA, 20 bp, Artificial Sequence
  Description of Artificial Sequence: Synthetic oligonucleotide
  Target: SCN10A; (+) strand; PAM type: NRG; PAM sequence: TAG
agctatttctaggaatgtca

SEQ ID NO: 40401 - DNA, 20 bp, Artificial Sequence
  Description of Artificial Sequence: Synthetic oligonucleotide
  Target: SCN10A; (+) strand; PAM type: NRG; PAM sequence: AAG
tatttctaggaatgtcatag

SEQ ID NO: 40402 - DNA, 20 bp, Artificial Sequence
  Description of Artificial Sequence: Synthetic oligonucleotide
  Target: SCN10A; (+) strand; PAM type: NRG; PAM sequence: GAG
tttctaggaatgtcatagaa

SEQ ID NO: 40403 - DNA, 20 bp, Artificial Sequence
  Description of Artificial Sequence: Synthetic oligonucleotide
  Target: SCN10A; (+) strand; PAM type: NRG; PAM sequence: GAG
tctaggaatgtcatagaaga

SEQ ID NO: 40404 - DNA, 20 bp, Artificial Sequence
  Description of Artificial Sequence: Synthetic oligonucleotide
  Target: SCN10A; (+) strand; PAM type: NRG; PAM sequence: AGG
ctaggaatgtcatagaagag

SEQ ID NO: 40405 - DNA, 20 bp, Artificial Sequence
  Description of Artificial Sequence: Synthetic oligonucleotide
  Target: SCN10A; (+) strand; PAM type: NRG; PAM sequence: AAG
aatgtcatagaagagaggaa

SEQ ID NO: 40406 - DNA, 20 bp, Artificial Sequence
  Description of Artificial Sequence: Synthetic oligonucleotide
  Target: SCN10A; (+) strand; PAM type: NRG; PAM sequence: AAG
gaagagaggaaaagtaacat

SEQ ID NO: 40407 - DNA, 20 bp, Artificial Sequence
  Description of Artificial Sequence: Synthetic oligonucleotide
  Target: SCN10A; (+) strand; PAM type: NRG; PAM sequence: AAG
gagaggaaaagtaacataag

SEQ ID NO: 40408 - DNA, 20 bp, Artificial Sequence
  Description of Artificial Sequence: Synthetic oligonucleotide
  Target: SCN10A; (+) strand; PAM type: NRG; PAM sequence: AAG
aggaaaagtaacataagaag

SEQ ID NO: 40409 - DNA, 20 bp, Artificial Sequence
  Description of Artificial Sequence: Synthetic oligonucleotide
  Target: SCN10A; (+) strand; PAM type: NRG; PAM sequence: AAG
aaagtaacataagaagaaga

SEQ ID NO: 40410 - DNA, 20 bp, Artificial Sequence
  Description of Artificial Sequence: Synthetic oligonucleotide
  Target: SCN10A; (+) strand; PAM type: NRG; PAM sequence: CAG
gtaacataagaagaagaaag

SEQ ID NO: 40411 - DNA, 20 bp, Artificial Sequence
  Description of Artificial Sequence: Synthetic oligonucleotide
  Target: SCN10A; (+) strand; PAM type: NRG; PAM sequence: GAG
gaagaaagcagtatttttat

SEQ ID NO: 40412 - DNA, 20 bp, Artificial Sequence
  Description of Artificial Sequence: Synthetic oligonucleotide
  Target: SCN10A; (+) strand; PAM type: NRG; PAM sequence: TGG
ttatgagccatttactctta

SEQ ID NO: 40413 - DNA, 20 bp, Artificial Sequence
  Description of Artificial Sequence: Synthetic oligonucleotide
  Target: SCN10A; (+) strand; PAM type: NRG; PAM sequence: GGG
tatgagccatttactcttat

SEQ ID NO: 40414 - DNA, 20 bp, Artificial Sequence
  Description of Artificial Sequence: Synthetic oligonucleotide
  Target: SCN10A; (+) strand; PAM type: NRG; PAM sequence: TGG
atttactcttatgggcaaac

SEQ ID NO: 40415 - DNA, 20 bp, Artificial Sequence
  Description of Artificial Sequence: Synthetic oligonucleotide
  Target: SCN10A; (+) strand; PAM type: NRG; PAM sequence: GGG
tttactcttatgggcaaact

SEQ ID NO: 40416 - DNA, 20 bp, Artificial Sequence
  Description of Artificial Sequence: Synthetic oligonucleotide
  Target: SCN10A; (+) strand; PAM type: NRG; PAM sequence: CAG
tcttatgggcaaactgggct

SEQ ID NO: 40417 - DNA, 20 bp, Artificial Sequence
  Description of Artificial Sequence: Synthetic oligonucleotide
  Target: SCN10A; (+) strand; PAM type: NRG; PAM sequence: GAG
gggctcagaattgtttcact

SEQ ID NO: 40418 - DNA, 20 bp, Artificial Sequence
  Description of Artificial Sequence: Synthetic oligonucleotide
  Target: SCN10A; (+) strand; PAM type: NRG; PAM sequence: AGG
ggctcagaattgtttcactg

SEQ ID NO: 40419 - DNA, 20 bp, Artificial Sequence
  Description of Artificial Sequence: Synthetic oligonucleotide
  Target: SCN10A; (+) strand; PAM type: NRG; PAM sequence: GGG
gctcagaattgtttcactga

SEQ ID NO: 40420 - DNA, 20 bp, Artificial Sequence
  Description of Artificial Sequence: Synthetic oligonucleotide
  Target: SCN10A; (+) strand; PAM type: NRG; PAM sequence: GGG
ctcagaattgtttcactgag

SEQ ID NO: 40421 - DNA, 20 bp, Artificial Sequence
  Description of Artificial Sequence: Synthetic oligonucleotide
  Target: SCN10A; (+) strand; PAM type: NRG; PAM sequence: AAG
gaattgtttcactgaggggt

SEQ ID NO: 40422 - DNA, 20 bp, Artificial Sequence
  Description of Artificial Sequence: Synthetic oligonucleotide
  Target: SCN10A; (+) strand; PAM type: NRG; PAM sequence: AGG
aattgtttcactgaggggta

SEQ ID NO: 40423 - DNA, 20 bp, Artificial Sequence
  Description of Artificial Sequence: Synthetic oligonucleotide
  Target: SCN10A; (+) strand; PAM type: NRG; PAM sequence: TAG
tcactgaggggtaaggatac

SEQ ID NO: 40424 - DNA, 20 bp, Artificial Sequence
  Description of Artificial Sequence: Synthetic oligonucleotide
  Target: SCN10A; (+) strand; PAM type: NRG; PAM sequence: AGG
cactgaggggtaaggatact

SEQ ID NO: 40425 - DNA, 20 bp, Artificial Sequence
  Description of Artificial Sequence: Synthetic oligonucleotide
  Target: SCN10A; (+) strand; PAM type: NRG; PAM sequence: GGG
actgaggggtaaggatacta

SEQ ID NO: 40426 - DNA, 20 bp, Artificial Sequence
  Description of Artificial Sequence: Synthetic oligonucleotide
  Target: SCN10A; (+) strand; PAM type: NRG; PAM sequence: CAG
gatactagggttttatctac

SEQ ID NO: 40427 - DNA, 20 bp, Artificial Sequence
  Description of Artificial Sequence: Synthetic oligonucleotide
  Target: SCN10A; (+) strand; PAM type: NRG; PAM sequence: TGG
ctaccagtcctgtcccttat

SEQ ID NO: 40428 - DNA, 20 bp, Artificial Sequence
  Description of Artificial Sequence: Synthetic oligonucleotide
  Target: SCN10A; (+) strand; PAM type: NRG; PAM sequence: CGG
tcctgtcccttattggttga

SEQ ID NO: 40429 - DNA, 20 bp, Artificial Sequence
  Description of Artificial Sequence: Synthetic oligonucleotide
  Target: SCN10A; (+) strand; PAM type: NRG; PAM sequence: TGG
ttattggttgacggttgtcc

SEQ ID NO: 40430 - DNA, 20 bp, Artificial Sequence
  Description of Artificial Sequence: Synthetic oligonucleotide
  Target: SCN10A; (+) strand; PAM type: NRG; PAM sequence: GGG
tattggttgacggttgtcct

SEQ ID NO: 40431 - DNA, 20 bp, Artificial Sequence
  Description of Artificial Sequence: Synthetic oligonucleotide
  Target: SCN10A; (+) strand; PAM type: NRG; PAM sequence: CAG
gtcctgggattttaactcta

SEQ ID NO: 40432 - DNA, 20 bp, Artificial Sequence
  Description of Artificial Sequence: Synthetic oligonucleotide
  Target: SCN10A; (+) strand; PAM type: NRG; PAM sequence: CAG
taactctacagaacttactt

SEQ ID NO: 40433 - DNA, 20 bp, Artificial Sequence
  Description of Artificial Sequence: Synthetic oligonucleotide
  Target: SCN10A; (+) strand; PAM type: NRG; PAM sequence: TGG
ctctacagaacttacttcag

SEQ ID NO: 40434 - DNA, 20 bp, Artificial Sequence
  Description of Artificial Sequence: Synthetic oligonucleotide
  Target: SCN10A; (+) strand; PAM type: NRG; PAM sequence: CAG
acagaacttacttcagtggc

SEQ ID NO: 40435 - DNA, 20 bp, Artificial Sequence
  Description of Artificial Sequence: Synthetic oligonucleotide
  Target: SCN10A; (+) strand; PAM type: NRG; PAM sequence: GAG
agaacttacttcagtggcca

SEQ ID NO: 40436 - DNA, 20 bp, Artificial Sequence
  Description of Artificial Sequence: Synthetic oligonucleotide
  Target: SCN10A; (+) strand; PAM type: NRG; PAM sequence: AAG
cttacttcagtggccagaga

SEQ ID NO: 40437 - DNA, 20 bp, Artificial Sequence
  Description of Artificial Sequence: Synthetic oligonucleotide
  Target: SCN10A; (+) strand; PAM type: NRG; PAM sequence: TGG
tcagtggccagagaaagccc

SEQ ID NO: 40438 - DNA, 20 bp, Artificial Sequence
  Description of Artificial Sequence: Synthetic oligonucleotide
  Target: SCN10A; (+) strand; PAM type: NRG; PAM sequence: GGG
cagtggccagagaaagccct

SEQ ID NO: 40439 - DNA, 20 bp, Artificial Sequence
  Description of Artificial Sequence: Synthetic oligonucleotide
  Target: SCN10A; (+) strand; PAM type: NRG; PAM sequence: CAG
tggccagagaaagccctggg

SEQ ID NO: 40440 - DNA, 20 bp, Artificial Sequence
  Description of Artificial Sequence: Synthetic oligonucleotide
  Target: SCN10A; (+) strand; PAM type: NRG; PAM sequence: CAG
cagagaaagccctgggcaga

SEQ ID NO: 40441 - DNA, 20 bp, Artificial Sequence
  Description of Artificial Sequence: Synthetic oligonucleotide
  Target: SCN10A; (+) strand; PAM type: NRG; PAM sequence: GAG
gagaaagccctgggcagaca

SEQ ID NO: 40442 - DNA, 20 bp, Artificial Sequence
  Description of Artificial Sequence: Synthetic oligonucleotide
  Target: SCN10A; (+) strand; PAM type: NRG; PAM sequence: AGG
agaaagccctgggcagacag

SEQ ID NO: 40443 - DNA, 20 bp, Artificial Sequence
  Description of Artificial Sequence: Synthetic oligonucleotide
  Target: SCN10A; (+) strand; PAM type: NRG; PAM sequence: CAG
aagccctgggcagacagagg

SEQ ID NO: 40444 - DNA, 20 bp, Artificial Sequence
  Description of Artificial Sequence: Synthetic oligonucleotide
  Target: SCN10A; (+) strand; PAM type: NRG; PAM sequence: AGG
agccctgggcagacagaggc

SEQ ID NO: 40445 - DNA, 20 bp, Artificial Sequence
  Description of Artificial Sequence: Synthetic oligonucleotide
  Target: SCN10A; (+) strand; PAM type: NRG; PAM sequence: AAG
cctgggcagacagaggcagg

SEQ ID NO: 40446 - DNA, 20 bp, Artificial Sequence
  Description of Artificial Sequence: Synthetic oligonucleotide
  Target: SCN10A; (+) strand; PAM type: NRG; PAM sequence: TAG
cagaggcaggaagtcacatg

SEQ ID NO: 40447 - DNA, 20 bp, Artificial Sequence
  Description of Artificial Sequence: Synthetic oligonucleotide
  Target: SCN10A; (+) strand; PAM type: NRG; PAM sequence: AGG
agaggcaggaagtcacatgt

SEQ ID NO: 40448 - DNA, 20 bp, Artificial Sequence
  Description of Artificial Sequence: Synthetic oligonucleotide
  Target: SCN10A; (+) strand; PAM type: NRG; PAM sequence: AAG
ggcaggaagtcacatgtagg

SEQ ID NO: 40449 - DNA, 20 bp, Artificial Sequence
  Description of Artificial Sequence: Synthetic oligonucleotide
  Target: SCN10A; (+) strand; PAM type: NRG; PAM sequence: TGG
cacatgtaggaagtgtctgc

SEQ ID NO: 40450 - DNA, 20 bp, Artificial Sequence
  Description of Artificial Sequence: Synthetic oligonucleotide
  Target: SCN10A; (+) strand; PAM type: NRG; PAM sequence: TGG
aagtgtctgctggtgacctc

SEQ ID NO: 40451 - DNA, 20 bp, Artificial Sequence
  Description of Artificial Sequence: Synthetic oligonucleotide
  Target: SCN10A; (+) strand; PAM type: NRG; PAM sequence: TAG
tctgctggtgacctctggtc

SEQ ID NO: 40452 - DNA, 20 bp, Artificial Sequence
  Description of Artificial Sequence: Synthetic oligonucleotide
  Target: SCN10A; (+) strand; PAM type: NRG; PAM sequence: TGG
tgacctctggtctagatccc

SEQ ID NO: 40453 - DNA, 20 bp, Artificial Sequence
  Description of Artificial Sequence: Synthetic oligonucleotide
  Target: SCN10A; (+) strand; PAM type: NRG; PAM sequence: GGG
gacctctggtctagatccct

SEQ ID NO: 40454 - DNA, 20 bp, Artificial Sequence
  Description of Artificial Sequence: Synthetic oligonucleotide
  Target: SCN10A; (+) strand; PAM type: NRG; PAM sequence: GAG
ggtctagatccctgggaaat

SEQ ID NO: 40455 - DNA, 20 bp, Artificial Sequence
  Description of Artificial Sequence: Synthetic oligonucleotide
  Target: SCN10A; (+) strand; PAM type: NRG; PAM sequence: AAG
tagatccctgggaaatgagc

SEQ ID NO: 40456 - DNA, 20 bp, Artificial Sequence
  Description of Artificial Sequence: Synthetic oligonucleotide
  Target: SCN10A; (+) strand; PAM type: NRG; PAM sequence: AGG
agatccctgggaaatgagca

SEQ ID NO: 40457 - DNA, 20 bp, Artificial Sequence
  Description of Artificial Sequence: Synthetic oligonucleotide
  Target: SCN10A; (+) strand; PAM type: NRG; PAM sequence: CAG
cctgggaaatgagcaaggtg

SEQ ID NO: 40458 - DNA, 20 bp, Artificial Sequence
  Description of Artificial Sequence: Synthetic oligonucleotide
  Target: SCN10A; (+) strand; PAM type: NRG; PAM sequence: TAG
ggaaatgagcaaggtgcaga

SEQ ID NO: 40459 - DNA, 20 bp, Artificial Sequence
  Description of Artificial Sequence: Synthetic oligonucleotide
  Target: SCN10A; (+) strand; PAM type: NRG; PAM sequence: CGG
gagcaaggtgcagatagtga

SEQ ID NO: 40460 - DNA, 20 bp, Artificial Sequence
  Description of Artificial Sequence: Synthetic oligonucleotide
  Target: SCN10A; (+) strand; PAM type: NRG; PAM sequence: TAG
ggtgcagatagtgacggcta

SEQ ID NO: 40461 - DNA, 20 bp, Artificial Sequence
  Description of Artificial Sequence: Synthetic oligonucleotide
  Target: SCN10A; (+) strand; PAM type: NRG; PAM sequence: TGG
atagtccttgcaaccttaat

SEQ ID NO: 40462 - DNA, 20 bp, Artificial Sequence
  Description of Artificial Sequence: Synthetic oligonucleotide
  Target: SCN10A; (+) strand; PAM type: NRG; PAM sequence: GGG
tagtccttgcaaccttaatt

SEQ ID NO: 40463 - DNA, 20 bp, Artificial Sequence
  Description of Artificial Sequence: Synthetic oligonucleotide
  Target: SCN10A; (+) strand; PAM type: NRG; PAM sequence: TAG
ttaattgggaatccctattt

SEQ ID NO: 40464 - DNA, 20 bp, Artificial Sequence
  Description of Artificial Sequence: Synthetic oligonucleotide
  Target: SCN10A; (+) strand; PAM type: NRG; PAM sequence: GAG
aattgggaatccctatttta

SEQ ID NO: 40465 - DNA, 20 bp, Artificial Sequence
  Description of Artificial Sequence: Synthetic oligonucleotide
  Target: SCN10A; (+) strand; PAM type: NRG; PAM sequence: TAG
ggaatccctattttagagtc

SEQ ID NO: 40466 - DNA, 20 bp, Artificial Sequence
  Description of Artificial Sequence: Synthetic oligonucleotide
  Target: SCN10A; (+) strand; PAM type: NRG; PAM sequence: TAG
ttttagagtctagttgaatg

SEQ ID NO: 40467 - DNA, 20 bp, Artificial Sequence
  Description of Artificial Sequence: Synthetic oligonucleotide
  Target: SCN10A; (+) strand; PAM type: NRG; PAM sequence: TGG
tagagtctagttgaatgtag

SEQ ID NO: 40468 - DNA, 20 bp, Artificial Sequence
  Description of Artificial Sequence: Synthetic oligonucleotide
  Target: SCN10A; (+) strand; PAM type: NRG; PAM sequence: GGG
agagtctagttgaatgtagt

SEQ ID NO: 40469 - DNA, 20 bp, Artificial Sequence
  Description of Artificial Sequence: Synthetic oligonucleotide
  Target: SCN10A; (+) strand; PAM type: NRG; PAM sequence: GGG
gagtctagttgaatgtagtg

SEQ ID NO: 40470 - DNA, 20 bp, Artificial Sequence
  Description of Artificial Sequence: Synthetic oligonucleotide
  Target: SCN10A; (+) strand; PAM type: NRG; PAM sequence: AAG
ctagttgaatgtagtgggga

SEQ ID NO: 40471 - DNA, 20 bp, Artificial Sequence
  Description of Artificial Sequence: Synthetic oligonucleotide
  Target: SCN10A; (+) strand; PAM type: NRG; PAM sequence: GAG
ggggaaagcacatcctttgt

SEQ ID NO: 40472 - DNA, 20 bp, Artificial Sequence
  Description of Artificial Sequence: Synthetic oligonucleotide
  Target: SCN10A; (+) strand; PAM type: NRG; PAM sequence: AGG
gggaaagcacatcctttgtg

SEQ ID NO: 40473 - DNA, 20 bp, Artificial Sequence
  Description of Artificial Sequence: Synthetic oligonucleotide
  Target: SCN10A; (+) strand; PAM type: NRG; PAM sequence: TAG
aaagcacatcctttgtgagg

SEQ ID NO: 40474 - DNA, 20 bp, Artificial Sequence
  Description of Artificial Sequence: Synthetic oligonucleotide
  Target: SCN10A; (+) strand; PAM type: NRG; PAM sequence: TAG
catatcaaatgtatgtgtta

SEQ ID NO: 40475 - DNA, 20 bp, Artificial Sequence
  Description of Artificial Sequence: Synthetic oligonucleotide
  Target: SCN10A; (+) strand; PAM type: NRG; PAM sequence: AGG
atatcaaatgtatgtgttat

SEQ ID NO: 40476 - DNA, 20 bp, Artificial Sequence
  Description of Artificial Sequence: Synthetic oligonucleotide
  Target: SCN10A; (+) strand; PAM type: NRG; PAM sequence: TAG
aaatgtatgtgttataggat

SEQ ID NO: 40477 - DNA, 20 bp, Artificial Sequence
  Description of Artificial Sequence: Synthetic oligonucleotide
  Target: SCN10A; (+) strand; PAM type: NRG; PAM sequence: TGG
tatgtgttataggattagtc

SEQ ID NO: 40478 - DNA, 20 bp, Artificial Sequence
  Description of Artificial Sequence: Synthetic oligonucleotide
  Target: SCN10A; (+) strand; PAM type: NRG; PAM sequence: GGG
atgtgttataggattagtct

SEQ ID NO: 40479 - DNA, 20 bp, Artificial Sequence
  Description of Artificial Sequence: Synthetic oligonucleotide
  Target: SCN10A; (+) strand; PAM type: NRG; PAM sequence: TGG
tgggcctgatactcacttct

SEQ ID NO: 40480 - DNA, 20 bp, Artificial Sequence
  Description of Artificial Sequence: Synthetic oligonucleotide
  Target: SCN10A; (+) strand; PAM type: NRG; PAM sequence: TGG
atactcacttcttggattaa

SEQ ID NO: 40481 - DNA, 20 bp, Artificial Sequence
  Description of Artificial Sequence: Synthetic oligonucleotide
  Target: SCN10A; (+) strand; PAM type: NRG; PAM sequence: GAG
cacttcttggattaatggct

SEQ ID NO: 40482 - DNA, 20 bp, Artificial Sequence
  Description of Artificial Sequence: Synthetic oligonucleotide
  Target: SCN10A; (+) strand; PAM type: NRG; PAM sequence: AGG
acttcttggattaatggctg

SEQ ID NO: 40483 - DNA, 20 bp, Artificial Sequence
  Description of Artificial Sequence: Synthetic oligonucleotide
  Target: SCN10A; (+) strand; PAM type: NRG; PAM sequence: GAG
ttcttggattaatggctgag

SEQ ID NO: 40484 - DNA, 20 bp, Artificial Sequence
  Description of Artificial Sequence: Synthetic oligonucleotide
  Target: SCN10A; (+) strand; PAM type: NRG; PAM sequence: AGG
tcttggattaatggctgagg

SEQ ID NO: 40485 - DNA, 20 bp, Artificial Sequence
  Description of Artificial Sequence: Synthetic oligonucleotide
  Target: SCN10A; (+) strand; PAM type: NRG; PAM sequence: GAG
ttggattaatggctgaggag

SEQ ID NO: 40486 - DNA, 20 bp, Artificial Sequence
  Description of Artificial Sequence: Synthetic oligonucleotide
  Target: SCN10A; (+) strand; PAM type: NRG; PAM sequence: AAG
ggctgaggaggagacaatcc

SEQ ID NO: 40487 - DNA, 20 bp, Artificial Sequence
  Description of Artificial Sequence: Synthetic oligonucleotide
  Target: SCN10A; (+) strand; PAM type: NRG; PAM sequence: TAG
aatccaagaaatatctattc

SEQ ID NO: 40488 - DNA, 20 bp, Artificial Sequence
  Description of Artificial Sequence: Synthetic oligonucleotide
  Target: SCN10A; (+) strand; PAM type: NRG; PAM sequence: TAG
aagaaatatctattctagtt

SEQ ID NO: 40489 - DNA, 20 bp, Artificial Sequence
  Description of Artificial Sequence: Synthetic oligonucleotide
  Target: SCN10A; (+) strand; PAM type: NRG; PAM sequence: AAG
atctattctagtttagctcc

SEQ ID NO: 40490 - DNA, 20 bp, Artificial Sequence
  Description of Artificial Sequence: Synthetic oligonucleotide
  Target: SCN10A; (+) strand; PAM type: NRG; PAM sequence: CGG
ttctagtttagctccaagct

SEQ ID NO: 40491 - DNA, 20 bp, Artificial Sequence
  Description of Artificial Sequence: Synthetic oligonucleotide
  Target: SCN10A; (+) strand; PAM type: NRG; PAM sequence: TGG
tttagctccaagctcggccc

SEQ ID NO: 40492 - DNA, 20 bp, Artificial Sequence
  Description of Artificial Sequence: Synthetic oligonucleotide
  Target: SCN10A; (+) strand; PAM type: NRG; PAM sequence: CAG
gctcggccctggctttcaaa

SEQ ID NO: 40493 - DNA, 20 bp, Artificial Sequence
  Description of Artificial Sequence: Synthetic oligonucleotide
  Target: SCN10A; (+) strand; PAM type: NRG; PAM sequence: GAG
ggctttcaaacagtctgcat

SEQ ID NO: 40494 - DNA, 20 bp, Artificial Sequence
  Description of Artificial Sequence: Synthetic oligonucleotide
  Target: SCN10A; (+) strand; PAM type: NRG; PAM sequence: CAG
acagtctgcatgagtttttg

SEQ ID NO: 40495 - DNA, 20 bp, Artificial Sequence
  Description of Artificial Sequence: Synthetic oligonucleotide
  Target: SCN10A; (+) strand; PAM type: NRG; PAM sequence: AGG
cagtctgcatgagtttttgc

SEQ ID NO: 40496 - DNA, 20 bp, Artificial Sequence
  Description of Artificial Sequence: Synthetic oligonucleotide
  Target: SCN10A; (+) strand; PAM type: NRG; PAM sequence: AAG
ttttgcaggtatattccctt

SEQ ID NO: 40497 - DNA, 20 bp, Artificial Sequence
  Description of Artificial Sequence: Synthetic oligonucleotide
  Target: SCN10A; (+) strand; PAM type: NRG; PAM sequence: TAG
gtatattcccttaagtttaa

SEQ ID NO: 40498 - DNA, 20 bp, Artificial Sequence
  Description of Artificial Sequence: Synthetic oligonucleotide
  Target: SCN10A; (+) strand; PAM type: NRG; PAM sequence: AAG
gtttaatagctgttcctgct

SEQ ID NO: 40499 - DNA, 20 bp, Artificial Sequence
  Description of Artificial Sequence: Synthetic oligonucleotide
  Target: SCN10A; (+) strand; PAM type: NRG; PAM sequence: AAG
aatagctgttcctgctaagc

SEQ ID NO: 40500 - DNA, 20 bp, Artificial Sequence
  Description of Artificial Sequence: Synthetic oligonucleotide
  Target: SCN10A; (+) strand; PAM type: NRG; PAM sequence: CGG
gctaagcaagcctttctatt

SEQ ID NO: 40501 - DNA, 20 bp, Artificial Sequence
  Description of Artificial Sequence: Synthetic oligonucleotide
  Target: SCN10A; (+) strand; PAM type: NRG; PAM sequence: TGG
aagcaagcctttctattcgg

SEQ ID NO: 40502 - DNA, 20 bp, Artificial Sequence
  Description of Artificial Sequence: Synthetic oligonucleotide
  Target: SCN10A; (+) strand; PAM type: NRG; PAM sequence: GGG
agcaagcctttctattcggt

SEQ ID NO: 40503 - DNA, 20 bp, Artificial Sequence
  Description of Artificial Sequence: Synthetic oligonucleotide
  Target: SCN10A; (+) strand; PAM type: NRG; PAM sequence: CAG
ctttctattcggtgggcatt

SEQ ID NO: 40504 - DNA, 20 bp, Artificial Sequence
  Description of Artificial Sequence: Synthetic oligonucleotide
  Target: SCN10A; (+) strand; PAM type: NRG; PAM sequence: AAG
ggtgggcattcagccctccc

SEQ ID NO: 40505 - DNA, 20 bp, Artificial Sequence
  Description of Artificial Sequence: Synthetic oligonucleotide
  Target: SCN10A; (+) strand; PAM type: NRG; PAM sequence: CAG
gccctcccaagatgaaccaa

SEQ ID NO: 40506 - DNA, 20 bp, Artificial Sequence
  Description of Artificial Sequence: Synthetic oligonucleotide
  Target: SCN10A; (+) strand; PAM type: NRG; PAM sequence: TGG
gatgaaccaacagcgatatt

SEQ ID NO: 40507 - DNA, 20 bp, Artificial Sequence
  Description of Artificial Sequence: Synthetic oligonucleotide
  Target: SCN10A; (+) strand; PAM type: NRG; PAM sequence: GAG
tttttttttttttttttttt

SEQ ID NO: 40508 - DNA, 20 bp, Artificial Sequence
  Description of Artificial Sequence: Synthetic oligonucleotide
  Target: SCN10A; (+) strand; PAM type: NRG; PAM sequence: AAG
tttttttttttttttgagac

SEQ ID NO: 40509 - DNA, 20 bp, Artificial Sequence
  Description of Artificial Sequence: Synthetic oligonucleotide
  Target: SCN10A; (+) strand; PAM type: NRG; PAM sequence: CAG
caagttctcactctgttgtc

SEQ ID NO: 40510 - DNA, 20 bp, Artificial Sequence
  Description of Artificial Sequence: Synthetic oligonucleotide
  Target: SCN10A; (+) strand; PAM type: NRG; PAM sequence: AGG
aagttctcactctgttgtcc

SEQ ID NO: 40511 - DNA, 20 bp, Artificial Sequence
  Description of Artificial Sequence: Synthetic oligonucleotide
  Target: SCN10A; (+) strand; PAM type: NRG; PAM sequence: TGG
tctcactctgttgtccaggc

SEQ ID NO: 40512 - DNA, 20 bp, Artificial Sequence
  Description of Artificial Sequence: Synthetic oligonucleotide
  Target: SCN10A; (+) strand; PAM type: NRG; PAM sequence: GAG
tcactctgttgtccaggctg

SEQ ID NO: 40513 - DNA, 20 bp, Artificial Sequence
  Description of Artificial Sequence: Synthetic oligonucleotide
  Target: SCN10A; (+) strand; PAM type: NRG; PAM sequence: CAG
ctgttgtccaggctggagtg

SEQ ID NO: 40514 - DNA, 20 bp, Artificial Sequence
  Description of Artificial Sequence: Synthetic oligonucleotide
  Target: SCN10A; (+) strand; PAM type: NRG; PAM sequence: TGG
ttgtccaggctggagtgcag

SEQ ID NO: 40515 - DNA, 20 bp, Artificial Sequence
  Description of Artificial Sequence: Synthetic oligonucleotide
  Target: SCN10A; (+) strand; PAM type: NRG; PAM sequence: CAG
ggagtgcagtggcacaatca

SEQ ID NO: 40516 - DNA, 20 bp, Artificial Sequence
  Description of Artificial Sequence: Synthetic oligonucleotide
  Target: SCN10A; (+) strand; PAM type: NRG; PAM sequence: CAG
ggcacaatcacagctcattg

SEQ ID NO: 40517 - DNA, 20 bp, Artificial Sequence
  Description of Artificial Sequence: Synthetic oligonucleotide
  Target: SCN10A; (+) strand; PAM type: NRG; PAM sequence: AAG
agccttgacctcccatgttc

SEQ ID NO: 40518 - DNA, 20 bp, Artificial Sequence
  Description of Artificial Sequence: Synthetic oligonucleotide
  Target: SCN10A; (+) strand; PAM type: NRG; PAM sequence: CAG
ttcaagtgatcctcccacct

SEQ ID NO: 40519 - DNA, 20 bp, Artificial Sequence
  Description of Artificial Sequence: Synthetic oligonucleotide
  Target: SCN10A; (+) strand; PAM type: NRG; PAM sequence: AAG
tcctcccacctcagcctccc

SEQ ID NO: 40520 - DNA, 20 bp, Artificial Sequence
  Description of Artificial Sequence: Synthetic oligonucleotide
  Target: SCN10A; (+) strand; PAM type: NRG; PAM sequence: TAG
tcccacctcagcctcccaag

SEQ ID NO: 40521 - DNA, 20 bp, Artificial Sequence
  Description of Artificial Sequence: Synthetic oligonucleotide
  Target: SCN10A; (+) strand; PAM type: NRG; PAM sequence: TGG
cacctcagcctcccaagtag

SEQ ID NO: 40522 - DNA, 20 bp, Artificial Sequence
  Description of Artificial Sequence: Synthetic oligonucleotide
  Target: SCN10A; (+) strand; PAM type: NRG; PAM sequence: CAG
cctcccaagtagtggaacta

SEQ ID NO: 40523 - DNA, 20 bp, Artificial Sequence
  Description of Artificial Sequence: Synthetic oligonucleotide
  Target: SCN10A; (+) strand; PAM type: NRG; PAM sequence: AGG
ctcccaagtagtggaactac

SEQ ID NO: 40524 - DNA, 20 bp, Artificial Sequence
  Description of Artificial Sequence: Synthetic oligonucleotide
  Target: SCN10A; (+) strand; PAM type: NRG; PAM sequence: TGG
caggtatgtgccaccacgcc

SEQ ID NO: 40525 - DNA, 20 bp, Artificial Sequence
  Description of Artificial Sequence: Synthetic oligonucleotide
  Target: SCN10A; (+) strand; PAM type: NRG; PAM sequence: TGG
gctaatcttcatatttttga

SEQ ID NO: 40526 - DNA, 20 bp, Artificial Sequence
  Description of Artificial Sequence: Synthetic oligonucleotide
  Target: SCN10A; (+) strand; PAM type: NRG; PAM sequence: GGG
ctaatcttcatatttttgat

SEQ ID NO: 40527 - DNA, 20 bp, Artificial Sequence
  Description of Artificial Sequence: Synthetic oligonucleotide
  Target: SCN10A; (+) strand; PAM type: NRG; PAM sequence: GGG
taatcttcatatttttgatg

SEQ ID NO: 40528 - DNA, 20 bp, Artificial Sequence
  Description of Artificial Sequence: Synthetic oligonucleotide
  Target: SCN10A; (+) strand; PAM type: NRG; PAM sequence: CAG
tggggtttttccatgttccc

SEQ ID NO: 40529 - DNA, 20 bp, Artificial Sequence
  Description of Artificial Sequence: Synthetic oligonucleotide
  Target: SCN10A; (+) strand; PAM type: NRG; PAM sequence: AGG
ggggtttttccatgttcccc

SEQ ID NO: 40530 - DNA, 20 bp, Artificial Sequence
  Description of Artificial Sequence: Synthetic oligonucleotide
  Target: SCN10A; (+) strand; PAM type: NRG; PAM sequence: TGG
tttttccatgttccccaggc

SEQ ID NO: 40531 - DNA, 20 bp, Artificial Sequence
  Description of Artificial Sequence: Synthetic oligonucleotide
  Target: SCN10A; (-) strand; PAM type: YTN; PAM sequence: CTG
gccatagaataaaattcaaa

SEQ ID NO: 40532 - DNA, 20 bp, Artificial Sequence
  Description of Artificial Sequence: Synthetic oligonucleotide
  Target: SCN10A; (-) strand; PAM type: YTN; PAM sequence: TTA
caaaaatagtccgtatgcct

SEQ ID NO: 40533 - DNA, 20 bp, Artificial Sequence
  Description of Artificial Sequence: Synthetic oligonucleotide
  Target: SCN10A; (-) strand; PAM type: YTN; PAM sequence: TTT
acaaaaatagtccgtatgcc

SEQ ID NO: 40534 - DNA, 20 bp, Artificial Sequence
  Description of Artificial Sequence: Synthetic oligonucleotide
  Target: SCN10A; (-) strand; PAM type: YTN; PAM sequence: TTA
ccaaaagggtacaaatacaa

SEQ ID NO: 40535 - DNA, 20 bp, Artificial Sequence
  Description of Artificial Sequence: Synthetic oligonucleotide
  Target: SCN10A; (-) strand; PAM type: YTN; PAM sequence: CTA
aggttaccaaaagggtacaa

SEQ ID NO: 40536 - DNA, 20 bp, Artificial Sequence
  Description of Artificial Sequence: Synthetic oligonucleotide
  Target: SCN10A; (-) strand; PAM type: YTN; PAM sequence: TTA
cagaaagccacacaaaacct

SEQ ID NO: 40537 - DNA, 20 bp, Artificial Sequence
  Description of Artificial Sequence: Synthetic oligonucleotide
  Target: SCN10A; (-) strand; PAM type: YTN; PAM sequence: TTT
acagaaagccacacaaaacc

SEQ ID NO: 40538 - DNA, 20 bp, Artificial Sequence
  Description of Artificial Sequence: Synthetic oligonucleotide
  Target: SCN10A; (-) strand; PAM type: YTN; PAM sequence: CTG
tttacagaaagccacacaaa

SEQ ID NO: 40539 - DNA, 20 bp, Artificial Sequence
  Description of Artificial Sequence: Synthetic oligonucleotide
  Target: SCN10A; (-) strand; PAM type: YTN; PAM sequence: TTC
tgtttacagaaagccacaca

SEQ ID NO: 40540 - DNA, 20 bp, Artificial Sequence
  Description of Artificial Sequence: Synthetic oligonucleotide
  Target: SCN10A; (-) strand; PAM type: YTN; PAM sequence: TTC
aaataaattctgtttacaga

SEQ ID NO: 40541 - DNA, 20 bp, Artificial Sequence
  Description of Artificial Sequence: Synthetic oligonucleotide
  Target: SCN10A; (-) strand; PAM type: YTN; PAM sequence: TTA
aaaattcaaataaattctgt

SEQ ID NO: 40542 - DNA, 20 bp, Artificial Sequence
  Description of Artificial Sequence: Synthetic oligonucleotide
  Target: SCN10A; (-) strand; PAM type: YTN; PAM sequence: TTT
aaaaattcaaataaattctg

SEQ ID NO: 40543 - DNA, 20 bp, Artificial Sequence
  Description of Artificial Sequence: Synthetic oligonucleotide
  Target: SCN10A; (-) strand; PAM type: YTN; PAM sequence: TTT
taaaaattcaaataaattct

SEQ ID NO: 40544 - DNA, 20 bp, Artificial Sequence
  Description of Artificial Sequence: Synthetic oligonucleotide
  Target: SCN10A; (-) strand; PAM type: YTN; PAM sequence: TTT
ttaaaaattcaaataaattc

SEQ ID NO: 40545 - DNA, 20 bp, Artificial Sequence
  Description of Artificial Sequence: Synthetic oligonucleotide
  Target: SCN10A; (-) strand; PAM type: YTN; PAM sequence: CTG
ggaaaaagagtgtcagtcaa

SEQ ID NO: 40546 - DNA, 20 bp, Artificial Sequence
  Description of Artificial Sequence: Synthetic oligonucleotide
  Target: SCN10A; (-) strand; PAM type: YTN; PAM sequence: CTC
tgggaaaaagagtgtcagtc

SEQ ID NO: 40547 - DNA, 20 bp, Artificial Sequence
  Description of Artificial Sequence: Synthetic oligonucleotide
  Target: SCN10A; (-) strand; PAM type: YTN; PAM sequence: TTA
aatggactctgggaaaaaga

SEQ ID NO: 40548 - DNA, 20 bp, Artificial Sequence
  Description of Artificial Sequence: Synthetic oligonucleotide
  Target: SCN10A; (-) strand; PAM type: YTN; PAM sequence: TTT
aaatggactctgggaaaaag

SEQ ID NO: 40549 - DNA, 20 bp, Artificial Sequence
  Description of Artificial Sequence: Synthetic oligonucleotide
  Target: SCN10A; (-) strand; PAM type: YTN; PAM sequence: TTA
aatttaaatggactctggga

SEQ ID NO: 40550 - DNA, 20 bp, Artificial Sequence
  Description of Artificial Sequence: Synthetic oligonucleotide
  Target: SCN10A; (-) strand; PAM type: YTN; PAM sequence: TTA
cattaaatttaaatggactc

SEQ ID NO: 40551 - DNA, 20 bp, Artificial Sequence
  Description of Artificial Sequence: Synthetic oligonucleotide
  Target: SCN10A; (-) strand; PAM type: YTN; PAM sequence: TTC
ataaattacattaaatttaa

SEQ ID NO: 40552 - DNA, 20 bp, Artificial Sequence
  Description of Artificial Sequence: Synthetic oligonucleotide
  Target: SCN10A; (-) strand; PAM type: YTN; PAM sequence: TTC
aaaaacaaaaatattcataa

SEQ ID NO: 40553 - DNA, 20 bp, Artificial Sequence
  Description of Artificial Sequence: Synthetic oligonucleotide
  Target: SCN10A; (-) strand; PAM type: YTN; PAM sequence: TTA
aaaaaacccgggatatagag

SEQ ID NO: 40554 - DNA, 20 bp, Artificial Sequence
  Description of Artificial Sequence: Synthetic oligonucleotide
  Target: SCN10A; (-) strand; PAM type: YTN; PAM sequence: TTA
aagtataataataattaaaa

SEQ ID NO: 40555 - DNA, 20 bp, Artificial Sequence
  Description of Artificial Sequence: Synthetic oligonucleotide
  Target: SCN10A; (-) strand; PAM type: YTN; PAM sequence: CTT
aaagtataataataattaaa

SEQ ID NO: 40556 - DNA, 20 bp, Artificial Sequence
  Description of Artificial Sequence: Synthetic oligonucleotide
  Target: SCN10A; (-) strand; PAM type: YTN; PAM sequence: CTA
aaacttaaagtataataata

SEQ ID NO: 40557 - DNA, 20 bp, Artificial Sequence
  Description of Artificial Sequence: Synthetic oligonucleotide
  Target: SCN10A; (-) strand; PAM type: YTN; PAM sequence: CTC
atgtatcctaaaacttaaag

SEQ ID NO: 40558 - DNA, 20 bp, Artificial Sequence
  Description of Artificial Sequence: Synthetic oligonucleotide
  Target: SCN10A; (-) strand; PAM type: YTN; PAM sequence: TTG
tgctcatgtatcctaaaact

SEQ ID NO: 40559 - DNA, 20 bp, Artificial Sequence
  Description of Artificial Sequence: Synthetic oligonucleotide
  Target: SCN10A; (-) strand; PAM type: YTN; PAM sequence: CTG
cacgttgtgctcatgtatcc

SEQ ID NO: 40560 - DNA, 20 bp, Artificial Sequence
  Description of Artificial Sequence: Synthetic oligonucleotide
  Target: SCN10A; (-) strand; PAM type: YTN; PAM sequence: TTA
atgggtgcagcacaccaaca

SEQ ID NO: 40561 - DNA, 20 bp, Artificial Sequence
  Description of Artificial Sequence: Synthetic oligonucleotide
  Target: SCN10A; (-) strand; PAM type: YTN; PAM sequence: CTA
atgtaaatgacaagttaatg

SEQ ID NO: 40562 - DNA, 20 bp, Artificial Sequence
  Description of Artificial Sequence: Synthetic oligonucleotide
  Target: SCN10A; (-) strand; PAM type: YTN; PAM sequence: TTA
ggagatatacctaatgtaaa

SEQ ID NO: 40563 - DNA, 20 bp, Artificial Sequence
  Description of Artificial Sequence: Synthetic oligonucleotide
  Target: SCN10A; (-) strand; PAM type: YTN; PAM sequence: TTG
tggggtggagggagggggga

SEQ ID NO: 40564 - DNA, 20 bp, Artificial Sequence
  Description of Artificial Sequence: Synthetic oligonucleotide
  Target: SCN10A; (-) strand; PAM type: YTN; PAM sequence: TTG
aacaataagaacacatggac

SEQ ID NO: 40565 - DNA, 20 bp, Artificial Sequence
  Description of Artificial Sequence: Synthetic oligonucleotide
  Target: SCN10A; (-) strand; PAM type: YTN; PAM sequence: CTC
ataggtgggaattgaacaat

SEQ ID NO: 40566 - DNA, 20 bp, Artificial Sequence
  Description of Artificial Sequence: Synthetic oligonucleotide
  Target: SCN10A; (-) strand; PAM type: YTN; PAM sequence: CTC
actcataggtgggaattgaa

SEQ ID NO: 40567 - DNA, 20 bp, Artificial Sequence
  Description of Artificial Sequence: Synthetic oligonucleotide
  Target: SCN10A; (-) strand; PAM type: YTN; PAM sequence: TTC
tcactcataggtgggaattg

SEQ ID NO: 40568 - DNA, 20 bp, Artificial Sequence
  Description of Artificial Sequence: Synthetic oligonucleotide
  Target: SCN10A; (-) strand; PAM type: YTN; PAM sequence: CTA
tcgcaaggacaaaaaaaacc

SEQ ID NO: 40569 - DNA, 20 bp, Artificial Sequence
  Description of Artificial Sequence: Synthetic oligonucleotide
  Target: SCN10A; (-) strand; PAM type: YTN; PAM sequence: CTC
agcaaactatcgcaaggaca

SEQ ID NO: 40570 - DNA, 20 bp, Artificial Sequence
  Description of Artificial Sequence: Synthetic oligonucleotide
  Target: SCN10A; (-) strand; PAM type: YTN; PAM sequence: TTC
tcagcaaactatcgcaagga

SEQ ID NO: 40571 - DNA, 20 bp, Artificial Sequence
  Description of Artificial Sequence: Synthetic oligonucleotide
  Target: SCN10A; (-) strand; PAM type: YTN; PAM sequence: CTG
gaaaccatcattctcagcaa

SEQ ID NO: 40572 - DNA, 20 bp, Artificial Sequence
  Description of Artificial Sequence: Synthetic oligonucleotide
  Target: SCN10A; (-) strand; PAM type: YTN; PAM sequence: TTG
cagggacatggatgaagctg

SEQ ID NO: 40573 - DNA, 20 bp, Artificial Sequence
  Description of Artificial Sequence: Synthetic oligonucleotide
  Target: SCN10A; (-) strand; PAM type: YTN; PAM sequence: TTT
gcagggacatggatgaagct

SEQ ID NO: 40574 - DNA, 20 bp, Artificial Sequence
  Description of Artificial Sequence: Synthetic oligonucleotide
  Target: SCN10A; (-) strand; PAM type: YTN; PAM sequence: CTT
tgcagggacatggatgaagc

SEQ ID NO: 40575 - DNA, 20 bp, Artificial Sequence
  Description of Artificial Sequence: Synthetic oligonucleotide
  Target: SCN10A; (-) strand; PAM type: YTN; PAM sequence: TTC
atgtcctttgcagggacatg

SEQ ID NO: 40576 - DNA, 20 bp, Artificial Sequence
  Description of Artificial Sequence: Synthetic oligonucleotide
  Target: SCN10A; (-) strand; PAM type: YTN; PAM sequence: CTA
tgcagccataaaaaatgatg

SEQ ID NO: 40577 - DNA, 20 bp, Artificial Sequence
  Description of Artificial Sequence: Synthetic oligonucleotide
  Target: SCN10A; (-) strand; PAM type: YTN; PAM sequence: TTA
agaaaatgtggcacatatac

SEQ ID NO: 40578 - DNA, 20 bp, Artificial Sequence
  Description of Artificial Sequence: Synthetic oligonucleotide
  Target: SCN10A; (-) strand; PAM type: YTN; PAM sequence: CTG
gattaagaaaatgtggcaca

SEQ ID NO: 40579 - DNA, 20 bp, Artificial Sequence
  Description of Artificial Sequence: Synthetic oligonucleotide
  Target: SCN10A; (-) strand; PAM type: YTN; PAM sequence: TTG
gaaccaacccaaatgtccaa

SEQ ID NO: 40580 - DNA, 20 bp, Artificial Sequence
  Description of Artificial Sequence: Synthetic oligonucleotide
  Target: SCN10A; (-) strand; PAM type: YTN; PAM sequence: CTT
ggaaccaacccaaatgtcca

SEQ ID NO: 40581 - DNA, 20 bp, Artificial Sequence
  Description of Artificial Sequence: Synthetic oligonucleotide
  Target: SCN10A; (-) strand; PAM type: YTN; PAM sequence: TTC
acaatagcaaagacttggaa

SEQ ID NO: 40582 - DNA, 20 bp, Artificial Sequence
  Description of Artificial Sequence: Synthetic oligonucleotide
  Target: SCN10A; (-) strand; PAM type: YTN; PAM sequence: CTA
ttcacaatagcaaagacttg

SEQ ID NO: 40583 - DNA, 20 bp, Artificial Sequence
  Description of Artificial Sequence: Synthetic oligonucleotide
  Target: SCN10A; (-) strand; PAM type: YTN; PAM sequence: TTG
tggcactattcacaatagca

SEQ ID NO: 40584 - DNA, 20 bp, Artificial Sequence
  Description of Artificial Sequence: Synthetic oligonucleotide
  Target: SCN10A; (-) strand; PAM type: YTN; PAM sequence: TTA
ttgtggcactattcacaata

SEQ ID NO: 40585 - DNA, 20 bp, Artificial Sequence
  Description of Artificial Sequence: Synthetic oligonucleotide
  Target: SCN10A; (-) strand; PAM type: YTN; PAM sequence: TTT
attgtggcactattcacaat

SEQ ID NO: 40586 - DNA, 20 bp, Artificial Sequence
  Description of Artificial Sequence: Synthetic oligonucleotide
  Target: SCN10A; (-) strand; PAM type: YTN; PAM sequence: CTA
taaagacacatgcacacgta

SEQ ID NO: 40587 - DNA, 20 bp, Artificial Sequence
  Description of Artificial Sequence: Synthetic oligonucleotide
  Target: SCN10A; (-) strand; PAM type: YTN; PAM sequence: CTG
ctataaagacacatgcacac

SEQ ID NO: 40588 - DNA, 20 bp, Artificial Sequence
  Description of Artificial Sequence: Synthetic oligonucleotide
  Target: SCN10A; (-) strand; PAM type: YTN; PAM sequence: TTA
taaatcatactgctataaag

SEQ ID NO: 40589 - DNA, 20 bp, Artificial Sequence
  Description of Artificial Sequence: Synthetic oligonucleotide
  Target: SCN10A; (-) strand; PAM type: YTN; PAM sequence: CTG
ggtatatacccaaaggatta

SEQ ID NO: 40590 - DNA, 20 bp, Artificial Sequence
  Description of Artificial Sequence: Synthetic oligonucleotide
  Target: SCN10A; (-) strand; PAM type: YTN; PAM sequence: TTA
ctgggtatatacccaaagga

SEQ ID NO: 40591 - DNA, 20 bp, Artificial Sequence
  Description of Artificial Sequence: Synthetic oligonucleotide
  Target: SCN10A; (-) strand; PAM type: YTN; PAM sequence: TTG
acccagccatcccattactg

SEQ ID NO: 40592 - DNA, 20 bp, Artificial Sequence
  Description of Artificial Sequence: Synthetic oligonucleotide
  Target: SCN10A; (-) strand; PAM type: YTN; PAM sequence: TTT
gacccagccatcccattact

SEQ ID NO: 40593 - DNA, 20 bp, Artificial Sequence
  Description of Artificial Sequence: Synthetic oligonucleotide
  Target: SCN10A; (-) strand; PAM type: YTN; PAM sequence: CTA
gaaccagaaataccatttga

SEQ ID NO: 40594 - DNA, 20 bp, Artificial Sequence
  Description of Artificial Sequence: Synthetic oligonucleotide
  Target: SCN10A; (-) strand; PAM type: YTN; PAM sequence: CTC
agggatctagaaccagaaat

SEQ ID NO: 40595 - DNA, 20 bp, Artificial Sequence
  Description of Artificial Sequence: Synthetic oligonucleotide
  Target: SCN10A; (-) strand; PAM type: YTN; PAM sequence: TTC
ctcagggatctagaaccaga

SEQ ID NO: 40596 - DNA, 20 bp, Artificial Sequence
  Description of Artificial Sequence: Synthetic oligonucleotide
  Target: SCN10A; (-) strand; PAM type: YTN; PAM sequence: TTG
tggaagtcggtgtggcaatt

SEQ ID NO: 40597 - DNA, 20 bp, Artificial Sequence
  Description of Artificial Sequence: Synthetic oligonucleotide
  Target: SCN10A; (-) strand; PAM type: YTN; PAM sequence: TTC
aatcattgtggaagtcggtg

SEQ ID NO: 40598 - DNA, 20 bp, Artificial Sequence
  Description of Artificial Sequence: Synthetic oligonucleotide
  Target: SCN10A; (-) strand; PAM type: YTN; PAM sequence: CTA
gttcaatcattgtggaagtc

SEQ ID NO: 40599 - DNA, 20 bp, Artificial Sequence
  Description of Artificial Sequence: Synthetic oligonucleotide
  Target: SCN10A; (-) strand; PAM type: YTN; PAM sequence: CTG
taaactagttcaatcattgt

SEQ ID NO: 40600 - DNA, 20 bp, Artificial Sequence
  Description of Artificial Sequence: Synthetic oligonucleotide
  Target: SCN10A; (-) strand; PAM type: YTN; PAM sequence: TTG
gtgggtctgtaaactagttc

SEQ ID NO: 40601 - DNA, 20 bp, Artificial Sequence
  Description of Artificial Sequence: Synthetic oligonucleotide
  Target: SCN10A; (-) strand; PAM type: YTN; PAM sequence: CTG
ttggtgggtctgtaaactag

SEQ ID NO: 40602 - DNA, 20 bp, Artificial Sequence
  Description of Artificial Sequence: Synthetic oligonucleotide
  Target: SCN10A; (-) strand; PAM type: YTN; PAM sequence: TTA
cactgttggtgggtctgtaa

SEQ ID NO: 40603 - DNA, 20 bp, Artificial Sequence
  Description of Artificial Sequence: Synthetic oligonucleotide
  Target: SCN10A; (-) strand; PAM type: YTN; PAM sequence: TTT
acactgttggtgggtctgta

SEQ ID NO: 40604 - DNA, 20 bp, Artificial Sequence
  Description of Artificial Sequence: Synthetic oligonucleotide
  Target: SCN10A; (-) strand; PAM type: YTN; PAM sequence: TTT
tacactgttggtgggtctgt

SEQ ID NO: 40605 - DNA, 20 bp, Artificial Sequence
  Description of Artificial Sequence: Synthetic oligonucleotide
  Target: SCN10A; (-) strand; PAM type: YTN; PAM sequence: CTT
ttacactgttggtgggtctg

SEQ ID NO: 40606 - DNA, 20 bp, Artificial Sequence
  Description of Artificial Sequence: Synthetic oligonucleotide
  Target: SCN10A; (-) strand; PAM type: YTN; PAM sequence: CTG
gagaggatgtggagaaatag

SEQ ID NO: 40607 - DNA, 20 bp, Artificial Sequence
  Description of Artificial Sequence: Synthetic oligonucleotide
  Target: SCN10A; (-) strand; PAM type: YTN; PAM sequence: TTA
aaaagtcaggaaacaacagg

SEQ ID NO: 40608 - DNA, 20 bp, Artificial Sequence
  Description of Artificial Sequence: Synthetic oligonucleotide
  Target: SCN10A; (-) strand; PAM type: YTN; PAM sequence: TTA
gaatggcgatcattaaaaag

SEQ ID NO: 40609 - DNA, 20 bp, Artificial Sequence
  Description of Artificial Sequence: Synthetic oligonucleotide
  Target: SCN10A; (-) strand; PAM type: YTN; PAM sequence: CTC
acaccagttagaatggcgat

SEQ ID NO: 40610 - DNA, 20 bp, Artificial Sequence
  Description of Artificial Sequence: Synthetic oligonucleotide
  Target: SCN10A; (-) strand; PAM type: YTN; PAM sequence: CTG
gccatcagagaaatgcaaat

SEQ ID NO: 40611 - DNA, 20 bp, Artificial Sequence
  Description of Artificial Sequence: Synthetic oligonucleotide
  Target: SCN10A; (-) strand; PAM type: YTN; PAM sequence: CTC
atcatcactggccatcagag

SEQ ID NO: 40612 - DNA, 20 bp, Artificial Sequence
  Description of Artificial Sequence: Synthetic oligonucleotide
  Target: SCN10A; (-) strand; PAM type: YTN; PAM sequence: TTA
tgcagccaaaaaacacatga

SEQ ID NO: 40613 - DNA, 20 bp, Artificial Sequence
  Description of Artificial Sequence: Synthetic oligonucleotide
  Target: SCN10A; (-) strand; PAM type: YTN; PAM sequence: TTT
atgcagccaaaaaacacatg

SEQ ID NO: 40614 - DNA, 20 bp, Artificial Sequence
  Description of Artificial Sequence: Synthetic oligonucleotide
  Target: SCN10A; (-) strand; PAM type: YTN; PAM sequence: CTC
aaaagaagacatttatgcag

SEQ ID NO: 40615 - DNA, 20 bp, Artificial Sequence
  Description of Artificial Sequence: Synthetic oligonucleotide
  Target: SCN10A; (-) strand; PAM type: YTN; PAM sequence: TTC
tcaaaagaagacatttatgc

SEQ ID NO: 40616 - DNA, 20 bp, Artificial Sequence
  Description of Artificial Sequence: Synthetic oligonucleotide
  Target: SCN10A; (-) strand; PAM type: YTN; PAM sequence: CTT
ctcaaaagaagacatttatg

SEQ ID NO: 40617 - DNA, 20 bp, Artificial Sequence
  Description of Artificial Sequence: Synthetic oligonucleotide
  Target: SCN10A; (-) strand; PAM type: YTN; PAM sequence: TTA
caaggaaaaaaatcccatca

SEQ ID NO: 40618 - DNA, 20 bp, Artificial Sequence
  Description of Artificial Sequence: Synthetic oligonucleotide
  Target: SCN10A; (-) strand; PAM type: YTN; PAM sequence: TTT
acaaggaaaaaaatcccatc

SEQ ID NO: 40619 - DNA, 20 bp, Artificial Sequence
  Description of Artificial Sequence: Synthetic oligonucleotide
  Target: SCN10A; (-) strand; PAM type: YTN; PAM sequence: CTC
aaacaaatttacaaggaaaa

SEQ ID NO: 40620 - DNA, 20 bp, Artificial Sequence
  Description of Artificial Sequence: Synthetic oligonucleotide
  Target: SCN10A; (-) strand; PAM type: YTN; PAM sequence: CTA
caatgaactcaaacaaattt

SEQ ID NO: 40621 - DNA, 20 bp, Artificial Sequence
  Description of Artificial Sequence: Synthetic oligonucleotide
  Target: SCN10A; (-) strand; PAM type: YTN; PAM sequence: CTA
atatccagaatctacaatga

SEQ ID NO: 40622 - DNA, 20 bp, Artificial Sequence
  Description of Artificial Sequence: Synthetic oligonucleotide
  Target: SCN10A; (-) strand; PAM type: YTN; PAM sequence: CTG
acgaagggctaatatccaga

SEQ ID NO: 40623 - DNA, 20 bp, Artificial Sequence
  Description of Artificial Sequence: Synthetic oligonucleotide
  Target: SCN10A; (-) strand; PAM type: YTN; PAM sequence: CTC
atctgacgaagggctaatat

SEQ ID NO: 40624 - DNA, 20 bp, Artificial Sequence
  Description of Artificial Sequence: Synthetic oligonucleotide
  Target: SCN10A; (-) strand; PAM type: YTN; PAM sequence: CTA
ctcatctgacgaagggctaa

SEQ ID NO: 40625 - DNA, 20 bp, Artificial Sequence
  Description of Artificial Sequence: Synthetic oligonucleotide
  Target: SCN10A; (-) strand; PAM type: YTN; PAM sequence: TTG
caacctactcatctgacgaa

SEQ ID NO: 40626 - DNA, 20 bp, Artificial Sequence
  Description of Artificial Sequence: Synthetic oligonucleotide
  Target: SCN10A; (-) strand; PAM type: YTN; PAM sequence: TTT
gcaacctactcatctgacga

SEQ ID NO: 40627 - DNA, 20 bp, Artificial Sequence
  Description of Artificial Sequence: Synthetic oligonucleotide
  Target: SCN10A; (-) strand; PAM type: YTN; PAM sequence: TTT
tgcaacctactcatctgacg

SEQ ID NO: 40628 - DNA, 20 bp, Artificial Sequence
  Description of Artificial Sequence: Synthetic oligonucleotide
  Target: SCN10A; (-) strand; PAM type: YTN; PAM sequence: TTT
ttgcaacctactcatctgac

SEQ ID NO: 40629 - DNA, 20 bp, Artificial Sequence
  Description of Artificial Sequence: Synthetic oligonucleotide
  Target: SCN10A; (-) strand; PAM type: YTN; PAM sequence: CTA
caggatgggagaaaattttt

SEQ ID NO: 40630 - DNA, 20 bp, Artificial Sequence
  Description of Artificial Sequence: Synthetic oligonucleotide
  Target: SCN10A; (-) strand; PAM type: YTN; PAM sequence: CTG
agcagcaaaagaaaccacca

SEQ ID NO: 40631 - DNA, 20 bp, Artificial Sequence
  Description of Artificial Sequence: Synthetic oligonucleotide
  Target: SCN10A; (-) strand; PAM type: YTN; PAM sequence: TTC
tgagcagcaaaagaaaccac

SEQ ID NO: 40632 - DNA, 20 bp, Artificial Sequence
  Description of Artificial Sequence: Synthetic oligonucleotide
  Target: SCN10A; (-) strand; PAM type: YTN; PAM sequence: CTT
ctgagcagcaaaagaaacca

SEQ ID NO: 40633 - DNA, 20 bp, Artificial Sequence
  Description of Artificial Sequence: Synthetic oligonucleotide
  Target: SCN10A; (-) strand; PAM type: YTN; PAM sequence: CTA
aagagcttctgagcagcaaa

SEQ ID NO: 40634 - DNA, 20 bp, Artificial Sequence
  Description of Artificial Sequence: Synthetic oligonucleotide
  Target: SCN10A; (-) strand; PAM type: YTN; PAM sequence: TTA
aactaaagagcttctgagca

SEQ ID NO: 40635 - DNA, 20 bp, Artificial Sequence
  Description of Artificial Sequence: Synthetic oligonucleotide
  Target: SCN10A; (-) strand; PAM type: YTN; PAM sequence: CTC
attaaactaaagagcttctg

SEQ ID NO: 40636 - DNA, 20 bp, Artificial Sequence
  Description of Artificial Sequence: Synthetic oligonucleotide
  Target: SCN10A; (-) strand; PAM type: YTN; PAM sequence: TTG
acaaatgggatctcattaaa

SEQ ID NO: 40637 - DNA, 20 bp, Artificial Sequence
  Description of Artificial Sequence: Synthetic oligonucleotide
  Target: SCN10A; (-) strand; PAM type: YTN; PAM sequence: CTA
aaacaccaaaagcaatggca

SEQ ID NO: 40638 - DNA, 20 bp, Artificial Sequence
  Description of Artificial Sequence: Synthetic oligonucleotide
  Target: SCN10A; (-) strand; PAM type: YTN; PAM sequence: TTC
atgtctaaaacaccaaaagc

SEQ ID NO: 40639 - DNA, 20 bp, Artificial Sequence
  Description of Artificial Sequence: Synthetic oligonucleotide
  Target: SCN10A; (-) strand; PAM type: YTN; PAM sequence: CTT
catgtctaaaacaccaaaag

SEQ ID NO: 40640 - DNA, 20 bp, Artificial Sequence
  Description of Artificial Sequence: Synthetic oligonucleotide
  Target: SCN10A; (-) strand; PAM type: YTN; PAM sequence: TTC
aggacataggcatgggcaag

SEQ ID NO: 40641 - DNA, 20 bp, Artificial Sequence
  Description of Artificial Sequence: Synthetic oligonucleotide
  Target: SCN10A; (-) strand; PAM type: YTN; PAM sequence: CTA
ggcaataccattcaggacat

SEQ ID NO: 40642 - DNA, 20 bp, Artificial Sequence
  Description of Artificial Sequence: Synthetic oligonucleotide
  Target: SCN10A; (-) strand; PAM type: YTN; PAM sequence: CTA
gaagagaacctaggcaatac

SEQ ID NO: 40643 - DNA, 20 bp, Artificial Sequence
  Description of Artificial Sequence: Synthetic oligonucleotide
  Target: SCN10A; (-) strand; PAM type: YTN; PAM sequence: CTA
aaaccataaaaaccctagaa

SEQ ID NO: 40644 - DNA, 20 bp, Artificial Sequence
  Description of Artificial Sequence: Synthetic oligonucleotide
  Target: SCN10A; (-) strand; PAM type: YTN; PAM sequence: TTA
gacctaaaaccataaaaacc

SEQ ID NO: 40645 - DNA, 20 bp, Artificial Sequence
  Description of Artificial Sequence: Synthetic oligonucleotide
  Target: SCN10A; (-) strand; PAM type: YTN; PAM sequence: TTA
aatgttagacctaaaaccat

SEQ ID NO: 40646 - DNA, 20 bp, Artificial Sequence
  Description of Artificial Sequence: Synthetic oligonucleotide
  Target: SCN10A; (-) strand; PAM type: YTN; PAM sequence: CTT
aaatgttagacctaaaacca

SEQ ID NO: 40647 - DNA, 20 bp, Artificial Sequence
  Description of Artificial Sequence: Synthetic oligonucleotide
  Target: SCN10A; (-) strand; PAM type: YTN; PAM sequence: TTA
aagacttaaatgttagacct

SEQ ID NO: 40648 - DNA, 20 bp, Artificial Sequence
  Description of Artificial Sequence: Synthetic oligonucleotide
  Target: SCN10A; (-) strand; PAM type: YTN; PAM sequence: TTC
aagatggattaaagacttaa

SEQ ID NO: 40649 - DNA, 20 bp, Artificial Sequence
  Description of Artificial Sequence: Synthetic oligonucleotide
  Target: SCN10A; (-) strand; PAM type: YTN; PAM sequence: TTA
attcaagatggattaaagac

SEQ ID NO: 40650 - DNA, 20 bp, Artificial Sequence
  Description of Artificial Sequence: Synthetic oligonucleotide
  Target: SCN10A; (-) strand; PAM type: YTN; PAM sequence: TTA
tacaaaaattaattcaagat

SEQ ID NO: 40651 - DNA, 20 bp, Artificial Sequence
  Description of Artificial Sequence: Synthetic oligonucleotide
  Target: SCN10A; (-) strand; PAM type: YTN; PAM sequence: CTT
atacaaaaattaattcaaga

SEQ ID NO: 40652 - DNA, 20 bp, Artificial Sequence
  Description of Artificial Sequence: Synthetic oligonucleotide
  Target: SCN10A; (-) strand; PAM type: YTN; PAM sequence: TTA
caccttatacaaaaattaat

SEQ ID NO: 40653 - DNA, 20 bp, Artificial Sequence
  Description of Artificial Sequence: Synthetic oligonucleotide
  Target: SCN10A; (-) strand; PAM type: YTN; PAM sequence: CTT
acaccttatacaaaaattaa

SEQ ID NO: 40654 - DNA, 20 bp, Artificial Sequence
  Description of Artificial Sequence: Synthetic oligonucleotide
  Target: SCN10A; (-) strand; PAM type: YTN; PAM sequence: TTC
cttacaccttatacaaaaat

SEQ ID NO: 40655 - DNA, 20 bp, Artificial Sequence
  Description of Artificial Sequence: Synthetic oligonucleotide
  Target: SCN10A; (-) strand; PAM type: YTN; PAM sequence: CTT
ccttacaccttatacaaaaa

SEQ ID NO: 40656 - DNA, 20 bp, Artificial Sequence
  Description of Artificial Sequence: Synthetic oligonucleotide
  Target: SCN10A; (-) strand; PAM type: YTN; PAM sequence: CTG
gatcccttccttacacctta

SEQ ID NO: 40657 - DNA, 20 bp, Artificial Sequence
  Description of Artificial Sequence: Synthetic oligonucleotide
  Target: SCN10A; (-) strand; PAM type: YTN; PAM sequence: CTG
aaactggatcccttccttac

SEQ ID NO: 40658 - DNA, 20 bp, Artificial Sequence
  Description of Artificial Sequence: Synthetic oligonucleotide
  Target: SCN10A; (-) strand; PAM type: YTN; PAM sequence: CTA
gccatatggagaaagctgaa

SEQ ID NO: 40659 - DNA, 20 bp, Artificial Sequence
  Description of Artificial Sequence: Synthetic oligonucleotide
  Target: SCN10A; (-) strand; PAM type: YTN; PAM sequence: CTG
gctagccatatggagaaagc

SEQ ID NO: 40660 - DNA, 20 bp, Artificial Sequence
  Description of Artificial Sequence: Synthetic oligonucleotide
  Target: SCN10A; (-) strand; PAM type: YTN; PAM sequence: CTG
ggaaaactggctagccatat

SEQ ID NO: 40661 - DNA, 20 bp, Artificial Sequence
  Description of Artificial Sequence: Synthetic oligonucleotide
  Target: SCN10A; (-) strand; PAM type: YTN; PAM sequence: TTA
ataaatggtgctgggaaaac

SEQ ID NO: 40662 - DNA, 20 bp, Artificial Sequence
  Description of Artificial Sequence: Synthetic oligonucleotide
  Target: SCN10A; (-) strand; PAM type: YTN; PAM sequence: TTT
aataaatggtgctgggaaaa

SEQ ID NO: 40663 - DNA, 20 bp, Artificial Sequence
  Description of Artificial Sequence: Synthetic oligonucleotide
  Target: SCN10A; (-) strand; PAM type: YTN; PAM sequence: CTA
tttaataaatggtgctggga

SEQ ID NO: 40664 - DNA, 20 bp, Artificial Sequence
  Description of Artificial Sequence: Synthetic oligonucleotide
  Target: SCN10A; (-) strand; PAM type: YTN; PAM sequence: TTC
cctatttaataaatggtgct

SEQ ID NO: 40665 - DNA, 20 bp, Artificial Sequence
  Description of Artificial Sequence: Synthetic oligonucleotide
  Target: SCN10A; (-) strand; PAM type: YTN; PAM sequence: CTG
acaaaaacaagaaatgggga

SEQ ID NO: 40666 - DNA, 20 bp, Artificial Sequence
  Description of Artificial Sequence: Synthetic oligonucleotide
  Target: SCN10A; (-) strand; PAM type: YTN; PAM sequence: TTG
acaaacctgacaaaaacaag

SEQ ID NO: 40667 - DNA, 20 bp, Artificial Sequence
  Description of Artificial Sequence: Synthetic oligonucleotide
  Target: SCN10A; (-) strand; PAM type: YTN; PAM sequence: TTT
gacaaacctgacaaaaacaa

SEQ ID NO: 40668 - DNA, 20 bp, Artificial Sequence
  Description of Artificial Sequence: Synthetic oligonucleotide
  Target: SCN10A; (-) strand; PAM type: YTN; PAM sequence: CTT
tgacaaacctgacaaaaaca

SEQ ID NO: 40669 - DNA, 20 bp, Artificial Sequence
  Description of Artificial Sequence: Synthetic oligonucleotide
  Target: SCN10A; (-) strand; PAM type: YTN; PAM sequence: CTG
atctttgacaaacctgacaa

SEQ ID NO: 40670 - DNA, 20 bp, Artificial Sequence
  Description of Artificial Sequence: Synthetic oligonucleotide
  Target: SCN10A; (-) strand; PAM type: YTN; PAM sequence: CTA
tctgatctttgacaaacctg

SEQ ID NO: 40671 - DNA, 20 bp, Artificial Sequence
  Description of Artificial Sequence: Synthetic oligonucleotide
  Target: SCN10A; (-) strand; PAM type: YTN; PAM sequence: CTA
caactatctgatctttgaca

SEQ ID NO: 40672 - DNA, 20 bp, Artificial Sequence
  Description of Artificial Sequence: Synthetic oligonucleotide
  Target: SCN10A; (-) strand; PAM type: YTN; PAM sequence: CTC
agaaataatgccgcatatct

SEQ ID NO: 40673 - DNA, 20 bp, Artificial Sequence
  Description of Artificial Sequence: Synthetic oligonucleotide
  Target: SCN10A; (-) strand; PAM type: YTN; PAM sequence: CTG
gtaccaaaacagagatatag

SEQ ID NO: 40674 - DNA, 20 bp, Artificial Sequence
  Description of Artificial Sequence: Synthetic oligonucleotide
  Target: SCN10A; (-) strand; PAM type: YTN; PAM sequence: CTA
cagtaaccaaaacagcatgg

SEQ ID NO: 40675 - DNA, 20 bp, Artificial Sequence
  Description of Artificial Sequence: Synthetic oligonucleotide
  Target: SCN10A; (-) strand; PAM type: YTN; PAM sequence: TTA
caaggctacagtaaccaaaa

SEQ ID NO: 40676 - DNA, 20 bp, Artificial Sequence
  Description of Artificial Sequence: Synthetic oligonucleotide
  Target: SCN10A; (-) strand; PAM type: YTN; PAM sequence: CTA
tattacaaggctacagtaac

SEQ ID NO: 40677 - DNA, 20 bp, Artificial Sequence
  Description of Artificial Sequence: Synthetic oligonucleotide
  Target: SCN10A; (-) strand; PAM type: YTN; PAM sequence: TTC
aaactatattacaaggctac

SEQ ID NO: 40678 - DNA, 20 bp, Artificial Sequence
  Description of Artificial Sequence: Synthetic oligonucleotide
  Target: SCN10A; (-) strand; PAM type: YTN; PAM sequence: CTT
caaactatattacaaggcta

SEQ ID NO: 40679 - DNA, 20 bp, Artificial Sequence
  Description of Artificial Sequence: Synthetic oligonucleotide
  Target: SCN10A; (-) strand; PAM type: YTN; PAM sequence: CTG
acttcaaactatattacaag

SEQ ID NO: 40680 - DNA, 20 bp, Artificial Sequence
  Description of Artificial Sequence: Synthetic oligonucleotide
  Target: SCN10A; (-) strand; PAM type: YTN; PAM sequence: CTA
cctgacttcaaactatatta

SEQ ID NO: 40681 - DNA, 20 bp, Artificial Sequence
  Description of Artificial Sequence: Synthetic oligonucleotide
  Target: SCN10A; (-) strand; PAM type: YTN; PAM sequence: CTG
gaggcatcacgctacctgac

SEQ ID NO: 40682 - DNA, 20 bp, Artificial Sequence
  Description of Artificial Sequence: Synthetic oligonucleotide
  Target: SCN10A; (-) strand; PAM type: YTN; PAM sequence: TTG
gtgtataacaaagctggagg

SEQ ID NO: 40683 - DNA, 20 bp, Artificial Sequence
  Description of Artificial Sequence: Synthetic oligonucleotide
  Target: SCN10A; (-) strand; PAM type: YTN; PAM sequence: TTA
ttggtgtataacaaagctgg

SEQ ID NO: 40684 - DNA, 20 bp, Artificial Sequence
  Description of Artificial Sequence: Synthetic oligonucleotide
  Target: SCN10A; (-) strand; PAM type: YTN; PAM sequence: CTG
ttattggtgtataacaaagc

SEQ ID NO: 40685 - DNA, 20 bp, Artificial Sequence
  Description of Artificial Sequence: Synthetic oligonucleotide
  Target: SCN10A; (-) strand; PAM type: YTN; PAM sequence: TTG
tctgttattggtgtataaca

SEQ ID NO: 40686 - DNA, 20 bp, Artificial Sequence
  Description of Artificial Sequence: Synthetic oligonucleotide
  Target: SCN10A; (-) strand; PAM type: YTN; PAM sequence: TTT
gtctgttattggtgtataac

SEQ ID NO: 40687 - DNA, 20 bp, Artificial Sequence
  Description of Artificial Sequence: Synthetic oligonucleotide
  Target: SCN10A; (-) strand; PAM type: YTN; PAM sequence: CTG
tttgtctgttattggtgtat

SEQ ID NO: 40688 - DNA, 20 bp, Artificial Sequence
  Description of Artificial Sequence: Synthetic oligonucleotide
  Target: SCN10A; (-) strand; PAM type: YTN; PAM sequence: CTC
tgtttgtctgttattggtgt

SEQ ID NO: 40689 - DNA, 20 bp, Artificial Sequence
  Description of Artificial Sequence: Synthetic oligonucleotide
  Target: SCN10A; (-) strand; PAM type: YTN; PAM sequence: CTC
tctgtttgtctgttattggt

SEQ ID NO: 40690 - DNA, 20 bp, Artificial Sequence
  Description of Artificial Sequence: Synthetic oligonucleotide
  Target: SCN10A; (-) strand; PAM type: YTN; PAM sequence: TTG
gctctctgtttgtctgttat

SEQ ID NO: 40691 - DNA, 20 bp, Artificial Sequence
  Description of Artificial Sequence: Synthetic oligonucleotide
  Target: SCN10A; (-) strand; PAM type: YTN; PAM sequence: TTT
ggctctctgtttgtctgtta

SEQ ID NO: 40692 - DNA, 20 bp, Artificial Sequence
  Description of Artificial Sequence: Synthetic oligonucleotide
  Target: SCN10A; (-) strand; PAM type: YTN; PAM sequence: CTC
atgatttggctctctgtttg

SEQ ID NO: 40693 - DNA, 20 bp, Artificial Sequence
  Description of Artificial Sequence: Synthetic oligonucleotide
  Target: SCN10A; (-) strand; PAM type: YTN; PAM sequence: TTC
actcatgatttggctctctg

SEQ ID NO: 40694 - DNA, 20 bp, Artificial Sequence
  Description of Artificial Sequence: Synthetic oligonucleotide
  Target: SCN10A; (-) strand; PAM type: YTN; PAM sequence: TTG
tgaatgggagttcactcatg

SEQ ID NO: 40695 - DNA, 20 bp, Artificial Sequence
  Description of Artificial Sequence: Synthetic oligonucleotide
  Target: SCN10A; (-) strand; PAM type: YTN; PAM sequence: TTG
aagcaattgtgaatgggagt

SEQ ID NO: 40696 - DNA, 20 bp, Artificial Sequence
  Description of Artificial Sequence: Synthetic oligonucleotide
  Target: SCN10A; (-) strand; PAM type: YTN; PAM sequence: TTT
gaagcaattgtgaatgggag

SEQ ID NO: 40697 - DNA, 20 bp, Artificial Sequence
  Description of Artificial Sequence: Synthetic oligonucleotide
  Target: SCN10A; (-) strand; PAM type: YTN; PAM sequence: CTT
tgaagcaattgtgaatggga

SEQ ID NO: 40698 - DNA, 20 bp, Artificial Sequence
  Description of Artificial Sequence: Synthetic oligonucleotide
  Target: SCN10A; (-) strand; PAM type: YTN; PAM sequence: CTC
tttgaagcaattgtgaatgg

SEQ ID NO: 40699 - DNA, 20 bp, Artificial Sequence
  Description of Artificial Sequence: Synthetic oligonucleotide
  Target: SCN10A; (-) strand; PAM type: YTN; PAM sequence: TTC
tctttgaagcaattgtgaat

SEQ ID NO: 40700 - DNA, 20 bp, Artificial Sequence
  Description of Artificial Sequence: Synthetic oligonucleotide
  Target: SCN10A; (-) strand; PAM type: YTN; PAM sequence: TTA
ttctctttgaagcaattgtg

SEQ ID NO: 40701 - DNA, 20 bp, Artificial Sequence
  Description of Artificial Sequence: Synthetic oligonucleotide
  Target: SCN10A; (-) strand; PAM type: YTN; PAM sequence: TTT
attctctttgaagcaattgt

SEQ ID NO: 40702 - DNA, 20 bp, Artificial Sequence
  Description of Artificial Sequence: Synthetic oligonucleotide
  Target: SCN10A; (-) strand; PAM type: YTN; PAM sequence: TTT
tattctctttgaagcaattg

SEQ ID NO: 40703 - DNA, 20 bp, Artificial Sequence
  Description of Artificial Sequence: Synthetic oligonucleotide
  Target: SCN10A; (-) strand; PAM type: YTN; PAM sequence: CTA
ggtattttattctctttgaa

SEQ ID NO: 40704 - DNA, 20 bp, Artificial Sequence
  Description of Artificial Sequence: Synthetic oligonucleotide
  Target: SCN10A; (-) strand; PAM type: YTN; PAM sequence: TTC
ctaggtattttattctcttt

SEQ ID NO: 40705 - DNA, 20 bp, Artificial Sequence
  Description of Artificial Sequence: Synthetic oligonucleotide
  Target: SCN10A; (-) strand; PAM type: YTN; PAM sequence: TTG
cattcctaggtattttattc

SEQ ID NO: 40706 - DNA, 20 bp, Artificial Sequence
  Description of Artificial Sequence: Synthetic oligonucleotide
  Target: SCN10A; (-) strand; PAM type: YTN; PAM sequence: TTG
taagttgcattcctaggtat

SEQ ID NO: 40707 - DNA, 20 bp, Artificial Sequence
  Description of Artificial Sequence: Synthetic oligonucleotide
  Target: SCN10A; (-) strand; PAM type: YTN; PAM sequence: CTT
gtaagttgcattcctaggta

SEQ ID NO: 40708 - DNA, 20 bp, Artificial Sequence
  Description of Artificial Sequence: Synthetic oligonucleotide
  Target: SCN10A; (-) strand; PAM type: YTN; PAM sequence: TTC
acatcccttgtaagttgcat

SEQ ID NO: 40709 - DNA, 20 bp, Artificial Sequence
  Description of Artificial Sequence: Synthetic oligonucleotide
  Target: SCN10A; (-) strand; PAM type: YTN; PAM sequence: CTT
cacatcccttgtaagttgca

SEQ ID NO: 40710 - DNA, 20 bp, Artificial Sequence
  Description of Artificial Sequence: Synthetic oligonucleotide
  Target: SCN10A; (-) strand; PAM type: YTN; PAM sequence: TTG
aagaggtccttcacatccct

SEQ ID NO: 40711 - DNA, 20 bp, Artificial Sequence
  Description of Artificial Sequence: Synthetic oligonucleotide
  Target: SCN10A; (-) strand; PAM type: YTN; PAM sequence: CTT
gaagaggtccttcacatccc

SEQ ID NO: 40712 - DNA, 20 bp, Artificial Sequence
  Description of Artificial Sequence: Synthetic oligonucleotide
  Target: SCN10A; (-) strand; PAM type: YTN; PAM sequence: CTC
cttgaagaggtccttcacat

SEQ ID NO: 40713 - DNA, 20 bp, Artificial Sequence
  Description of Artificial Sequence: Synthetic oligonucleotide
  Target: SCN10A; (-) strand; PAM type: YTN; PAM sequence: TTC
tccttgaagaggtccttcac

SEQ ID NO: 40714 - DNA, 20 bp, Artificial Sequence
  Description of Artificial Sequence: Synthetic oligonucleotide
  Target: SCN10A; (-) strand; PAM type: YTN; PAM sequence: TTG
tagttctccttgaagaggtc

SEQ ID NO: 40715 - DNA, 20 bp, Artificial Sequence
  Description of Artificial Sequence: Synthetic oligonucleotide
  Target: SCN10A; (-) strand; PAM type: YTN; PAM sequence: TTT
gtagttctccttgaagaggt

SEQ ID NO: 40716 - DNA, 20 bp, Artificial Sequence
  Description of Artificial Sequence: Synthetic oligonucleotide
  Target: SCN10A; (-) strand; PAM type: YTN; PAM sequence: CTG
agcagtggtttgtagttctc

SEQ ID NO: 40717 - DNA, 20 bp, Artificial Sequence
  Description of Artificial Sequence: Synthetic oligonucleotide
  Target: SCN10A; (-) strand; PAM type: YTN; PAM sequence: TTC
actgagcagtggtttgtagt

SEQ ID NO: 40718 - DNA, 20 bp, Artificial Sequence
  Description of Artificial Sequence: Synthetic oligonucleotide
  Target: SCN10A; (-) strand; PAM type: YTN; PAM sequence: TTT
cactgagcagtggtttgtag

SEQ ID NO: 40719 - DNA, 20 bp, Artificial Sequence
  Description of Artificial Sequence: Synthetic oligonucleotide
  Target: SCN10A; (-) strand; PAM type: YTN; PAM sequence: TTA
tttcactgagcagtggtttg

SEQ ID NO: 40720 - DNA, 20 bp, Artificial Sequence
  Description of Artificial Sequence: Synthetic oligonucleotide
  Target: SCN10A; (-) strand; PAM type: YTN; PAM sequence: TTT
atttcactgagcagtggttt

SEQ ID NO: 40721 - DNA, 20 bp, Artificial Sequence
  Description of Artificial Sequence: Synthetic oligonucleotide
  Target: SCN10A; (-) strand; PAM type: YTN; PAM sequence: TTT
tatttcactgagcagtggtt

SEQ ID NO: 40722 - DNA, 20 bp, Artificial Sequence
  Description of Artificial Sequence: Synthetic oligonucleotide
  Target: SCN10A; (-) strand; PAM type: YTN; PAM sequence: CTT
ttatttcactgagcagtggt

SEQ ID NO: 40723 - DNA, 20 bp, Artificial Sequence
  Description of Artificial Sequence: Synthetic oligonucleotide
  Target: SCN10A; (-) strand; PAM type: YTN; PAM sequence: CTC
ttttatttcactgagcagtg

SEQ ID NO: 40724 - DNA, 20 bp, Artificial Sequence
  Description of Artificial Sequence: Synthetic oligonucleotide
  Target: SCN10A; (-) strand; PAM type: YTN; PAM sequence: TTG
tatcctcttttatttcactg

SEQ ID NO: 40725 - DNA, 20 bp, Artificial Sequence
  Description of Artificial Sequence: Synthetic oligonucleotide
  Target: SCN10A; (-) strand; PAM type: YTN; PAM sequence: TTT
gtatcctcttttatttcact

SEQ ID NO: 40726 - DNA, 20 bp, Artificial Sequence
  Description of Artificial Sequence: Synthetic oligonucleotide
  Target: SCN10A; (-) strand; PAM type: YTN; PAM sequence: TTG
tttgtatcctcttttatttc

SEQ ID NO: 40727 - DNA, 20 bp, Artificial Sequence
  Description of Artificial Sequence: Synthetic oligonucleotide
  Target: SCN10A; (-) strand; PAM type: YTN; PAM sequence: TTT
gtttgtatcctcttttattt

SEQ ID NO: 40728 - DNA, 20 bp, Artificial Sequence
  Description of Artificial Sequence: Synthetic oligonucleotide
  Target: SCN10A; (-) strand; PAM type: YTN; PAM sequence: TTC
catttgtttgtatcctcttt

SEQ ID NO: 40729 - DNA, 20 bp, Artificial Sequence
  Description of Artificial Sequence: Synthetic oligonucleotide
  Target: SCN10A; (-) strand; PAM type: YTN; PAM sequence: CTT
ccatttgtttgtatcctctt

SEQ ID NO: 40730 - DNA, 20 bp, Artificial Sequence
  Description of Artificial Sequence: Synthetic oligonucleotide
  Target: SCN10A; (-) strand; PAM type: YTN; PAM sequence: TTC
ttccatttgtttgtatcctc

SEQ ID NO: 40731 - DNA, 20 bp, Artificial Sequence
  Description of Artificial Sequence: Synthetic oligonucleotide
  Target: SCN10A; (-) strand; PAM type: YTN; PAM sequence: CTA
cccatgagcatggagtattc

SEQ ID NO: 40732 - DNA, 20 bp, Artificial Sequence
  Description of Artificial Sequence: Synthetic oligonucleotide
  Target: SCN10A; (-) strand; PAM type: YTN; PAM sequence: TTC
ctacccatgagcatggagta

SEQ ID NO: 40733 - DNA, 20 bp, Artificial Sequence
  Description of Artificial Sequence: Synthetic oligonucleotide
  Target: SCN10A; (-) strand; PAM type: YTN; PAM sequence: CTT
cctacccatgagcatggagt

SEQ ID NO: 40734 - DNA, 20 bp, Artificial Sequence
  Description of Artificial Sequence: Synthetic oligonucleotide
  Target: SCN10A; (-) strand; PAM type: YTN; PAM sequence: TTC
ttcctacccatgagcatgga

SEQ ID NO: 40735 - DNA, 20 bp, Artificial Sequence
  Description of Artificial Sequence: Synthetic oligonucleotide
  Target: SCN10A; (-) strand; PAM type: YTN; PAM sequence: TTG
attcttcctacccatgagca

SEQ ID NO: 40736 - DNA, 20 bp, Artificial Sequence
  Description of Artificial Sequence: Synthetic oligonucleotide
  Target: SCN10A; (-) strand; PAM type: YTN; PAM sequence: TTC
aagatattgattcttcctac

SEQ ID NO: 40737 - DNA, 20 bp, Artificial Sequence
  Description of Artificial Sequence: Synthetic oligonucleotide
  Target: SCN10A; (-) strand; PAM type: YTN; PAM sequence: TTT
caagatattgattcttccta

SEQ ID NO: 40738 - DNA, 20 bp, Artificial Sequence
  Description of Artificial Sequence: Synthetic oligonucleotide
  Target: SCN10A; (-) strand; PAM type: YTN; PAM sequence: TTT
tcaagatattgattcttcct

SEQ ID NO: 40739 - DNA, 20 bp, Artificial Sequence
  Description of Artificial Sequence: Synthetic oligonucleotide
  Target: SCN10A; (-) strand; PAM type: YTN; PAM sequence: TTG
ggcagtatggccattttcaa

SEQ ID NO: 40740 - DNA, 20 bp, Artificial Sequence
  Description of Artificial Sequence: Synthetic oligonucleotide
  Target: SCN10A; (-) strand; PAM type: YTN; PAM sequence: CTT
gggcagtatggccattttca

SEQ ID NO: 40741 - DNA, 20 bp, Artificial Sequence
  Description of Artificial Sequence: Synthetic oligonucleotide
  Target: SCN10A; (-) strand; PAM type: YTN; PAM sequence: TTA
ccttgggcagtatggccatt

SEQ ID NO: 40742 - DNA, 20 bp, Artificial Sequence
  Description of Artificial Sequence: Synthetic oligonucleotide
  Target: SCN10A; (-) strand; PAM type: YTN; PAM sequence: CTA
taaattaccttgggcagtat

SEQ ID NO: 40743 - DNA, 20 bp, Artificial Sequence
  Description of Artificial Sequence: Synthetic oligonucleotide
  Target: SCN10A; (-) strand; PAM type: YTN; PAM sequence: TTG
aatctataaattaccttggg

SEQ ID NO: 40744 - DNA, 20 bp, Artificial Sequence
  Description of Artificial Sequence: Synthetic oligonucleotide
  Target: SCN10A; (-) strand; PAM type: YTN; PAM sequence: TTG
atggggatggcattgaatct

SEQ ID NO: 40745 - DNA, 20 bp, Artificial Sequence
  Description of Artificial Sequence: Synthetic oligonucleotide
  Target: SCN10A; (-) strand; PAM type: YTN; PAM sequence: CTT
gatggggatggcattgaatc

SEQ ID NO: 40746 - DNA, 20 bp, Artificial Sequence
  Description of Artificial Sequence: Synthetic oligonucleotide
  Target: SCN10A; (-) strand; PAM type: YTN; PAM sequence: TTG
gtagcttgatggggatggca

SEQ ID NO: 40747 - DNA, 20 bp, Artificial Sequence
  Description of Artificial Sequence: Synthetic oligonucleotide
  Target: SCN10A; (-) strand; PAM type: YTN; PAM sequence: CTG
agaagaaagtcattggtagc

SEQ ID NO: 40748 - DNA, 20 bp, Artificial Sequence
  Description of Artificial Sequence: Synthetic oligonucleotide
  Target: SCN10A; (-) strand; PAM type: YTN; PAM sequence: TTC
tgagaagaaagtcattggta

SEQ ID NO: 40749 - DNA, 20 bp, Artificial Sequence
  Description of Artificial Sequence: Synthetic oligonucleotide
  Target: SCN10A; (-) strand; PAM type: YTN; PAM sequence: TTC
caattctgagaagaaagtca

SEQ ID NO: 40750 - DNA, 20 bp, Artificial Sequence
  Description of Artificial Sequence: Synthetic oligonucleotide
  Target: SCN10A; (-) strand; PAM type: YTN; PAM sequence: TTT
ccaattctgagaagaaagtc

SEQ ID NO: 40751 - DNA, 20 bp, Artificial Sequence
  Description of Artificial Sequence: Synthetic oligonucleotide
  Target: SCN10A; (-) strand; PAM type: YTN; PAM sequence: TTT
tccaattctgagaagaaagt

SEQ ID NO: 40752 - DNA, 20 bp, Artificial Sequence
  Description of Artificial Sequence: Synthetic oligonucleotide
  Target: SCN10A; (-) strand; PAM type: YTN; PAM sequence: TTT
ttccaattctgagaagaaag

SEQ ID NO: 40753 - DNA, 20 bp, Artificial Sequence
  Description of Artificial Sequence: Synthetic oligonucleotide
  Target: SCN10A; (-) strand; PAM type: YTN; PAM sequence: TTT
tttccaattctgagaagaaa

SEQ ID NO: 40754 - DNA, 20 bp, Artificial Sequence
  Description of Artificial Sequence: Synthetic oligonucleotide
  Target: SCN10A; (-) strand; PAM type: YTN; PAM sequence: TTA
aagtagttttttccaattct

SEQ ID NO: 40755 - DNA, 20 bp, Artificial Sequence
  Description of Artificial Sequence: Synthetic oligonucleotide
  Target: SCN10A; (-) strand; PAM type: YTN; PAM sequence: TTT
aaagtagttttttccaattc

SEQ ID NO: 40756 - DNA, 20 bp, Artificial Sequence
  Description of Artificial Sequence: Synthetic oligonucleotide
  Target: SCN10A; (-) strand; PAM type: YTN; PAM sequence: CTT
taaagtagttttttccaatt

SEQ ID NO: 40757 - DNA, 20 bp, Artificial Sequence
  Description of Artificial Sequence: Synthetic oligonucleotide
  Target: SCN10A; (-) strand; PAM type: YTN; PAM sequence: TTC
cgtatgaactttaaagtagt

SEQ ID NO: 40758 - DNA, 20 bp, Artificial Sequence
  Description of Artificial Sequence: Synthetic oligonucleotide
  Target: SCN10A; (-) strand; PAM type: YTN; PAM sequence: TTG
gttccgtatgaactttaaag

SEQ ID NO: 40759 - DNA, 20 bp, Artificial Sequence
  Description of Artificial Sequence: Synthetic oligonucleotide
  Target: SCN10A; (-) strand; PAM type: YTN; PAM sequence: TTT
ggttccgtatgaactttaaa

SEQ ID NO: 40760 - DNA, 20 bp, Artificial Sequence
  Description of Artificial Sequence: Synthetic oligonucleotide
  Target: SCN10A; (-) strand; PAM type: YTN; PAM sequence: TTT
tggttccgtatgaactttaa

SEQ ID NO: 40761 - DNA, 20 bp, Artificial Sequence
  Description of Artificial Sequence: Synthetic oligonucleotide
  Target: SCN10A; (-) strand; PAM type: YTN; PAM sequence: TTT
ttggttccgtatgaacttta

SEQ ID NO: 40762 - DNA, 20 bp, Artificial Sequence
  Description of Artificial Sequence: Synthetic oligonucleotide
  Target: SCN10A; (-) strand; PAM type: YTN; PAM sequence: TTT
tttggttccgtatgaacttt

SEQ ID NO: 40763 - DNA, 20 bp, Artificial Sequence
  Description of Artificial Sequence: Synthetic oligonucleotide
  Target: SCN10A; (-) strand; PAM type: YTN; PAM sequence: CTT
ttttggttccgtatgaactt

SEQ ID NO: 40764 - DNA, 20 bp, Artificial Sequence
  Description of Artificial Sequence: Synthetic oligonucleotide
  Target: SCN10A; (-) strand; PAM type: YTN; PAM sequence: CTC
ttttttggttccgtatgaac

SEQ ID NO: 40765 - DNA, 20 bp, Artificial Sequence
  Description of Artificial Sequence: Synthetic oligonucleotide
  Target: SCN10A; (-) strand; PAM type: YTN; PAM sequence: TTG
gcaatgtgggctcttttttg

SEQ ID NO: 40766 - DNA, 20 bp, Artificial Sequence
  Description of Artificial Sequence: Synthetic oligonucleotide
  Target: SCN10A; (-) strand; PAM type: YTN; PAM sequence: CTT
ggcaatgtgggctctttttt

SEQ ID NO: 40767 - DNA, 20 bp, Artificial Sequence
  Description of Artificial Sequence: Synthetic oligonucleotide
  Target: SCN10A; (-) strand; PAM type: YTN; PAM sequence: TTG
acttggcaatgtgggctctt

SEQ ID NO: 40768 - DNA, 20 bp, Artificial Sequence
  Description of Artificial Sequence: Synthetic oligonucleotide
  Target: SCN10A; (-) strand; PAM type: YTN; PAM sequence: TTA
ggattgacttggcaatgtgg

SEQ ID NO: 40769 - DNA, 20 bp, Artificial Sequence
  Description of Artificial Sequence: Synthetic oligonucleotide
  Target: SCN10A; (-) strand; PAM type: YTN; PAM sequence: TTA
aaaaaaaaacaggattagga

SEQ ID NO: 40770 - DNA, 20 bp, Artificial Sequence
  Description of Artificial Sequence: Synthetic oligonucleotide
  Target: SCN10A; (-) strand; PAM type: YTN; PAM sequence: TTA
gccaatcaaaaaagtaaggt

SEQ ID NO: 40771 - DNA, 20 bp, Artificial Sequence
  Description of Artificial Sequence: Synthetic oligonucleotide
  Target: SCN10A; (-) strand; PAM type: YTN; PAM sequence: CTA
agaaacaattagccaatcaa

SEQ ID NO: 40772 - DNA, 20 bp, Artificial Sequence
  Description of Artificial Sequence: Synthetic oligonucleotide
  Target: SCN10A; (-) strand; PAM type: YTN; PAM sequence: CTA
tgctaagaaacaattagcca

SEQ ID NO: 40773 - DNA, 20 bp, Artificial Sequence
  Description of Artificial Sequence: Synthetic oligonucleotide
  Target: SCN10A; (-) strand; PAM type: YTN; PAM sequence: TTC
caaagtaggacaagggggaa

SEQ ID NO: 40774 - DNA, 20 bp, Artificial Sequence
  Description of Artificial Sequence: Synthetic oligonucleotide
  Target: SCN10A; (-) strand; PAM type: YTN; PAM sequence: TTT
ccaaagtaggacaaggggga

SEQ ID NO: 40775 - DNA, 20 bp, Artificial Sequence
  Description of Artificial Sequence: Synthetic oligonucleotide
  Target: SCN10A; (-) strand; PAM type: YTN; PAM sequence: TTG
ccagtaacaaatcagaaata

SEQ ID NO: 40776 - DNA, 20 bp, Artificial Sequence
  Description of Artificial Sequence: Synthetic oligonucleotide
  Target: SCN10A; (-) strand; PAM type: YTN; PAM sequence: TTA
gggttgccagtaacaaatca

SEQ ID NO: 40777 - DNA, 20 bp, Artificial Sequence
  Description of Artificial Sequence: Synthetic oligonucleotide
  Target: SCN10A; (-) strand; PAM type: YTN; PAM sequence: TTA
ttagggttgccagtaacaaa

SEQ ID NO: 40778 - DNA, 20 bp, Artificial Sequence
  Description of Artificial Sequence: Synthetic oligonucleotide
  Target: SCN10A; (-) strand; PAM type: YTN; PAM sequence: TTA
attattagggttgccagtaa

SEQ ID NO: 40779 - DNA, 20 bp, Artificial Sequence
  Description of Artificial Sequence: Synthetic oligonucleotide
  Target: SCN10A; (-) strand; PAM type: YTN; PAM sequence: CTT
aattattagggttgccagta

SEQ ID NO: 40780 - DNA, 20 bp, Artificial Sequence
  Description of Artificial Sequence: Synthetic oligonucleotide
  Target: SCN10A; (-) strand; PAM type: YTN; PAM sequence: TTA
agaatgaatgacttaattat

SEQ ID NO: 40781 - DNA, 20 bp, Artificial Sequence
  Description of Artificial Sequence: Synthetic oligonucleotide
  Target: SCN10A; (-) strand; PAM type: YTN; PAM sequence: CTT
aagaatgaatgacttaatta

SEQ ID NO: 40782 - DNA, 20 bp, Artificial Sequence
  Description of Artificial Sequence: Synthetic oligonucleotide
  Target: SCN10A; (-) strand; PAM type: YTN; PAM sequence: CTG
tgtaacttaagaatgaatga

SEQ ID NO: 40783 - DNA, 20 bp, Artificial Sequence
  Description of Artificial Sequence: Synthetic oligonucleotide
  Target: SCN10A; (-) strand; PAM type: YTN; PAM sequence: TTA
gactgtgtaacttaagaatg

SEQ ID NO: 40784 - DNA, 20 bp, Artificial Sequence
  Description of Artificial Sequence: Synthetic oligonucleotide
  Target: SCN10A; (-) strand; PAM type: YTN; PAM sequence: TTA
tcattagactgtgtaactta

SEQ ID NO: 40785 - DNA, 20 bp, Artificial Sequence
  Description of Artificial Sequence: Synthetic oligonucleotide
  Target: SCN10A; (-) strand; PAM type: YTN; PAM sequence: TTA
ttatcattagactgtgtaac

SEQ ID NO: 40786 - DNA, 20 bp, Artificial Sequence
  Description of Artificial Sequence: Synthetic oligonucleotide
  Target: SCN10A; (-) strand; PAM type: YTN; PAM sequence: TTT
attatcattagactgtgtaa

SEQ ID NO: 40787 - DNA, 20 bp, Artificial Sequence
  Description of Artificial Sequence: Synthetic oligonucleotide
  Target: SCN10A; (-) strand; PAM type: YTN; PAM sequence: TTT
tattatcattagactgtgta

SEQ ID NO: 40788 - DNA, 20 bp, Artificial Sequence
  Description of Artificial Sequence: Synthetic oligonucleotide
  Target: SCN10A; (-) strand; PAM type: YTN; PAM sequence: TTT
ttattatcattagactgtgt

SEQ ID NO: 40789 - DNA, 20 bp, Artificial Sequence
  Description of Artificial Sequence: Synthetic oligonucleotide
  Target: SCN10A; (-) strand; PAM type: YTN; PAM sequence: CTA
aaaagtaaaaaaaagtaaag

SEQ ID NO: 40790 - DNA, 20 bp, Artificial Sequence
  Description of Artificial Sequence: Synthetic oligonucleotide
  Target: SCN10A; (-) strand; PAM type: YTN; PAM sequence: CTA
atgctaaaaagtaaaaaaaa

SEQ ID NO: 40791 - DNA, 20 bp, Artificial Sequence
  Description of Artificial Sequence: Synthetic oligonucleotide
  Target: SCN10A; (-) strand; PAM type: YTN; PAM sequence: CTC
ctaatgctaaaaagtaaaaa

SEQ ID NO: 40792 - DNA, 20 bp, Artificial Sequence
  Description of Artificial Sequence: Synthetic oligonucleotide
  Target: SCN10A; (-) strand; PAM type: YTN; PAM sequence: TTC
tcctaatgctaaaaagtaaa

SEQ ID NO: 40793 - DNA, 20 bp, Artificial Sequence
  Description of Artificial Sequence: Synthetic oligonucleotide
  Target: SCN10A; (-) strand; PAM type: YTN; PAM sequence: TTT
ctcctaatgctaaaaagtaa

SEQ ID NO: 40794 - DNA, 20 bp, Artificial Sequence
  Description of Artificial Sequence: Synthetic oligonucleotide
  Target: SCN10A; (-) strand; PAM type: YTN; PAM sequence: TTA
ggtatttctcctaatgctaa

SEQ ID NO: 40795 - DNA, 20 bp, Artificial Sequence
  Description of Artificial Sequence: Synthetic oligonucleotide
  Target: SCN10A; (-) strand; PAM type: YTN; PAM sequence: CTA
cattaggtatttctcctaat

SEQ ID NO: 40796 - DNA, 20 bp, Artificial Sequence
  Description of Artificial Sequence: Synthetic oligonucleotide
  Target: SCN10A; (-) strand; PAM type: YTN; PAM sequence: CTG
cacccatcaacccgtcatct

SEQ ID NO: 40797 - DNA, 20 bp, Artificial Sequence
  Description of Artificial Sequence: Synthetic oligonucleotide
  Target: SCN10A; (-) strand; PAM type: YTN; PAM sequence: TTG
ctgcacccatcaacccgtca

SEQ ID NO: 40798 - DNA, 20 bp, Artificial Sequence
  Description of Artificial Sequence: Synthetic oligonucleotide
  Target: SCN10A; (-) strand; PAM type: YTN; PAM sequence: TTT
gctgcacccatcaacccgtc

SEQ ID NO: 40799 - DNA, 20 bp, Artificial Sequence
  Description of Artificial Sequence: Synthetic oligonucleotide
  Target: SCN10A; (-) strand; PAM type: YTN; PAM sequence: TTG
gtttgctgcacccatcaacc

SEQ ID NO: 40800 - DNA, 20 bp, Artificial Sequence
  Description of Artificial Sequence: Synthetic oligonucleotide
  Target: SCN10A; (-) strand; PAM type: YTN; PAM sequence: TTA
tataggtatacatgtgccat

SEQ ID NO: 40801 - DNA, 20 bp, Artificial Sequence
  Description of Artificial Sequence: Synthetic oligonucleotide
  Target: SCN10A; (-) strand; PAM type: YTN; PAM sequence: TTG
ttatataggtatacatgtgc

SEQ ID NO: 40802 - DNA, 20 bp, Artificial Sequence
  Description of Artificial Sequence: Synthetic oligonucleotide
  Target: SCN10A; (-) strand; PAM type: YTN; PAM sequence: TTT
gttatataggtatacatgtg

SEQ ID NO: 40803 - DNA, 20 bp, Artificial Sequence
  Description of Artificial Sequence: Synthetic oligonucleotide
  Target: SCN10A; (-) strand; PAM type: YTN; PAM sequence: CTA
gggtacatgtgcacaatgta

SEQ ID NO: 40804 - DNA, 20 bp, Artificial Sequence
  Description of Artificial Sequence: Synthetic oligonucleotide
  Target: SCN10A; (-) strand; PAM type: YTN; PAM sequence: TTC
tagggtacatgtgcacaatg

SEQ ID NO: 40805 - DNA, 20 bp, Artificial Sequence
  Description of Artificial Sequence: Synthetic oligonucleotide
  Target: SCN10A; (-) strand; PAM type: YTN; PAM sequence: TTA
aattctagggtacatgtgca

SEQ ID NO: 40806 - DNA, 20 bp, Artificial Sequence
  Description of Artificial Sequence: Synthetic oligonucleotide
  Target: SCN10A; (-) strand; PAM type: YTN; PAM sequence: TTT
aaattctagggtacatgtgc

SEQ ID NO: 40807 - DNA, 20 bp, Artificial Sequence
  Description of Artificial Sequence: Synthetic oligonucleotide
  Target: SCN10A; (-) strand; PAM type: YTN; PAM sequence: CTT
taaattctagggtacatgtg

SEQ ID NO: 40808 - DNA, 20 bp, Artificial Sequence
  Description of Artificial Sequence: Synthetic oligonucleotide
  Target: SCN10A; (-) strand; PAM type: YTN; PAM sequence: TTA
tactttaaattctagggtac

SEQ ID NO: 40809 - DNA, 20 bp, Artificial Sequence
  Description of Artificial Sequence: Synthetic oligonucleotide
  Target: SCN10A; (-) strand; PAM type: YTN; PAM sequence: TTA
aaattatactttaaattcta

SEQ ID NO: 40810 - DNA, 20 bp, Artificial Sequence
  Description of Artificial Sequence: Synthetic oligonucleotide
  Target: SCN10A; (-) strand; PAM type: YTN; PAM sequence: TTT
aaaattatactttaaattct

SEQ ID NO: 40811 - DNA, 20 bp, Artificial Sequence
  Description of Artificial Sequence: Synthetic oligonucleotide
  Target: SCN10A; (-) strand; PAM type: YTN; PAM sequence: TTT
taaaattatactttaaattc

SEQ ID NO: 40812 - DNA, 20 bp, Artificial Sequence
  Description of Artificial Sequence: Synthetic oligonucleotide
  Target: SCN10A; (-) strand; PAM type: YTN; PAM sequence: TTT
ttaaaattatactttaaatt

SEQ ID NO: 40813 - DNA, 20 bp, Artificial Sequence
  Description of Artificial Sequence: Synthetic oligonucleotide
  Target: SCN10A; (-) strand; PAM type: YTN; PAM sequence: TTT
tttaaaattatactttaaat

SEQ ID NO: 40814 - DNA, 20 bp, Artificial Sequence
  Description of Artificial Sequence: Synthetic oligonucleotide
  Target: SCN10A; (-) strand; PAM type: YTN; PAM sequence: TTT
ttttaaaattatactttaaa

SEQ ID NO: 40815 - DNA, 20 bp, Artificial Sequence
  Description of Artificial Sequence: Synthetic oligonucleotide
  Target: SCN10A; (-) strand; PAM type: YTN; PAM sequence: CTT
tttttaaaattatactttaa

SEQ ID NO: 40816 - DNA, 20 bp, Artificial Sequence
  Description of Artificial Sequence: Synthetic oligonucleotide
  Target: SCN10A; (-) strand; PAM type: YTN; PAM sequence: TTC
tttttttaaaattatacttt

SEQ ID NO: 40817 - DNA, 20 bp, Artificial Sequence
  Description of Artificial Sequence: Synthetic oligonucleotide
  Target: SCN10A; (-) strand; PAM type: YTN; PAM sequence: TTT
ctttttttaaaattatactt

SEQ ID NO: 40818 - DNA, 20 bp, Artificial Sequence
  Description of Artificial Sequence: Synthetic oligonucleotide
  Target: SCN10A; (-) strand; PAM type: YTN; PAM sequence: TTT
tctttttttaaaattatact

SEQ ID NO: 40819 - DNA, 20 bp, Artificial Sequence
  Description of Artificial Sequence: Synthetic oligonucleotide
  Target: SCN10A; (-) strand; PAM type: YTN; PAM sequence: TTT
ttctttttttaaaattatac

SEQ ID NO: 40820 - DNA, 20 bp, Artificial Sequence
  Description of Artificial Sequence: Synthetic oligonucleotide
  Target: SCN10A; (-) strand; PAM type: YTN; PAM sequence: TTT
tttctttttttaaaattata

SEQ ID NO: 40821 - DNA, 20 bp, Artificial Sequence
  Description of Artificial Sequence: Synthetic oligonucleotide
  Target: SCN10A; (-) strand; PAM type: YTN; PAM sequence: TTT
ttttctttttttaaaattat

SEQ ID NO: 40822 - DNA, 20 bp, Artificial Sequence
  Description of Artificial Sequence: Synthetic oligonucleotide
  Target: SCN10A; (-) strand; PAM type: YTN; PAM sequence: TTT
tttttctttttttaaaatta

SEQ ID NO: 40823 - DNA, 20 bp, Artificial Sequence
  Description of Artificial Sequence: Synthetic oligonucleotide
  Target: SCN10A; (-) strand; PAM type: YTN; PAM sequence: CTT
ttttttctttttttaaaatt

SEQ ID NO: 40824 - DNA, 20 bp, Artificial Sequence
  Description of Artificial Sequence: Synthetic oligonucleotide
  Target: SCN10A; (-) strand; PAM type: YTN; PAM sequence: TTC
cttttttttctttttttaaa

SEQ ID NO: 40825 - DNA, 20 bp, Artificial Sequence
  Description of Artificial Sequence: Synthetic oligonucleotide
  Target: SCN10A; (-) strand; PAM type: YTN; PAM sequence: TTA
aaaagacaattccttttttt

SEQ ID NO: 40826 - DNA, 20 bp, Artificial Sequence
  Description of Artificial Sequence: Synthetic oligonucleotide
  Target: SCN10A; (-) strand; PAM type: YTN; PAM sequence: TTA
caaataaattaaaaagacaa

SEQ ID NO: 40827 - DNA, 20 bp, Artificial Sequence
  Description of Artificial Sequence: Synthetic oligonucleotide
  Target: SCN10A; (-) strand; PAM type: YTN; PAM sequence: TTT
acaaataaattaaaaagaca

SEQ ID NO: 40828 - DNA, 20 bp, Artificial Sequence
  Description of Artificial Sequence: Synthetic oligonucleotide
  Target: SCN10A; (-) strand; PAM type: YTN; PAM sequence: CTG
aaggtttacaaataaattaa

SEQ ID NO: 40829 - DNA, 20 bp, Artificial Sequence
  Description of Artificial Sequence: Synthetic oligonucleotide
  Target: SCN10A; (-) strand; PAM type: YTN; PAM sequence: CTG
aacacaggctgaaggtttac

SEQ ID NO: 40830 - DNA, 20 bp, Artificial Sequence
  Description of Artificial Sequence: Synthetic oligonucleotide
  Target: SCN10A; (-) strand; PAM type: YTN; PAM sequence: CTG
gagctgaacacaggctgaag

SEQ ID NO: 40831 - DNA, 20 bp, Artificial Sequence
  Description of Artificial Sequence: Synthetic oligonucleotide
  Target: SCN10A; (-) strand; PAM type: YTN; PAM sequence: TTC
agtctggagctgaacacagg

SEQ ID NO: 40832 - DNA, 20 bp, Artificial Sequence
  Description of Artificial Sequence: Synthetic oligonucleotide
  Target: SCN10A; (-) strand; PAM type: YTN; PAM sequence: CTT
cagtctggagctgaacacag

SEQ ID NO: 40833 - DNA, 20 bp, Artificial Sequence
  Description of Artificial Sequence: Synthetic oligonucleotide
  Target: SCN10A; (-) strand; PAM type: YTN; PAM sequence: TTA
gggatgcaagataagacaga

SEQ ID NO: 40834 - DNA, 20 bp, Artificial Sequence
  Description of Artificial Sequence: Synthetic oligonucleotide
  Target: SCN10A; (-) strand; PAM type: YTN; PAM sequence: CTA
agtgttagggatgcaagata

SEQ ID NO: 40835 - DNA, 20 bp, Artificial Sequence
  Description of Artificial Sequence: Synthetic oligonucleotide
  Target: SCN10A; (-) strand; PAM type: YTN; PAM sequence: TTC
ctaagtgttagggatgcaag

SEQ ID NO: 40836 - DNA, 20 bp, Artificial Sequence
  Description of Artificial Sequence: Synthetic oligonucleotide
  Target: SCN10A; (-) strand; PAM type: YTN; PAM sequence: TTT
cctaagtgttagggatgcaa

SEQ ID NO: 40837 - DNA, 20 bp, Artificial Sequence
  Description of Artificial Sequence: Synthetic oligonucleotide
  Target: SCN10A; (-) strand; PAM type: YTN; PAM sequence: CTT
tcctaagtgttagggatgca

SEQ ID NO: 40838 - DNA, 20 bp, Artificial Sequence
  Description of Artificial Sequence: Synthetic oligonucleotide
  Target: SCN10A; (-) strand; PAM type: YTN; PAM sequence: TTA
agacaaaagtgaagtcactt

SEQ ID NO: 40839 - DNA, 20 bp, Artificial Sequence
  Description of Artificial Sequence: Synthetic oligonucleotide
  Target: SCN10A; (-) strand; PAM type: YTN; PAM sequence: CTT
aagacaaaagtgaagtcact

SEQ ID NO: 40840 - DNA, 20 bp, Artificial Sequence
  Description of Artificial Sequence: Synthetic oligonucleotide
  Target: SCN10A; (-) strand; PAM type: YTN; PAM sequence: TTG
cttaagacaaaagtgaagtc

SEQ ID NO: 40841 - DNA, 20 bp, Artificial Sequence
  Description of Artificial Sequence: Synthetic oligonucleotide
  Target: SCN10A; (-) strand; PAM type: YTN; PAM sequence: TTT
gcttaagacaaaagtgaagt

SEQ ID NO: 40842 - DNA, 20 bp, Artificial Sequence
  Description of Artificial Sequence: Synthetic oligonucleotide
  Target: SCN10A; (-) strand; PAM type: YTN; PAM sequence: CTG
gagcatttgcttaagacaaa

SEQ ID NO: 40843 - DNA, 20 bp, Artificial Sequence
  Description of Artificial Sequence: Synthetic oligonucleotide
  Target: SCN10A; (-) strand; PAM type: YTN; PAM sequence: CTG
gtgtgctggagcatttgctt

SEQ ID NO: 40844 - DNA, 20 bp, Artificial Sequence
  Description of Artificial Sequence: Synthetic oligonucleotide
  Target: SCN10A; (-) strand; PAM type: YTN; PAM sequence: TTA
acacagaatagtaggtatcg

SEQ ID NO: 40845 - DNA, 20 bp, Artificial Sequence
  Description of Artificial Sequence: Synthetic oligonucleotide
  Target: SCN10A; (-) strand; PAM type: YTN; PAM sequence: CTT
aacacagaatagtaggtatc

SEQ ID NO: 40846 - DNA, 20 bp, Artificial Sequence
  Description of Artificial Sequence: Synthetic oligonucleotide
  Target: SCN10A; (-) strand; PAM type: YTN; PAM sequence: TTC
agaacatccacttaacacag

SEQ ID NO: 40847 - DNA, 20 bp, Artificial Sequence
  Description of Artificial Sequence: Synthetic oligonucleotide
  Target: SCN10A; (-) strand; PAM type: YTN; PAM sequence: CTG
cataacacatagacacagat

SEQ ID NO: 40848 - DNA, 20 bp, Artificial Sequence
  Description of Artificial Sequence: Synthetic oligonucleotide
  Target: SCN10A; (-) strand; PAM type: YTN; PAM sequence: TTA
aactgcataacacatagaca

SEQ ID NO: 40849 - DNA, 20 bp, Artificial Sequence
  Description of Artificial Sequence: Synthetic oligonucleotide
  Target: SCN10A; (-) strand; PAM type: YTN; PAM sequence: TTA
taccattaaactgcataaca

SEQ ID NO: 40850 - DNA, 20 bp, Artificial Sequence
  Description of Artificial Sequence: Synthetic oligonucleotide
  Target: SCN10A; (-) strand; PAM type: YTN; PAM sequence: TTT
ataccattaaactgcataac

SEQ ID NO: 40851 - DNA, 20 bp, Artificial Sequence
  Description of Artificial Sequence: Synthetic oligonucleotide
  Target: SCN10A; (-) strand; PAM type: YTN; PAM sequence: TTT
tataccattaaactgcataa

SEQ ID NO: 40852 - DNA, 20 bp, Artificial Sequence
  Description of Artificial Sequence: Synthetic oligonucleotide
  Target: SCN10A; (-) strand; PAM type: YTN; PAM sequence: TTT
ttataccattaaactgcata

SEQ ID NO: 40853 - DNA, 20 bp, Artificial Sequence
  Description of Artificial Sequence: Synthetic oligonucleotide
  Target: SCN10A; (-) strand; PAM type: YTN; PAM sequence: CTT
tttataccattaaactgcat

SEQ ID NO: 40854 - DNA, 20 bp, Artificial Sequence
  Description of Artificial Sequence: Synthetic oligonucleotide
  Target: SCN10A; (-) strand; PAM type: YTN; PAM sequence: CTA
actttttataccattaaact

SEQ ID NO: 40855 - DNA, 20 bp, Artificial Sequence
  Description of Artificial Sequence: Synthetic oligonucleotide
  Target: SCN10A; (-) strand; PAM type: YTN; PAM sequence: CTC
caccataaacaccgccctaa

SEQ ID NO: 40856 - DNA, 20 bp, Artificial Sequence
  Description of Artificial Sequence: Synthetic oligonucleotide
  Target: SCN10A; (-) strand; PAM type: YTN; PAM sequence: CTC
aaaagtatgcctccaccata

SEQ ID NO: 40857 - DNA, 20 bp, Artificial Sequence
  Description of Artificial Sequence: Synthetic oligonucleotide
  Target: SCN10A; (-) strand; PAM type: YTN; PAM sequence: TTC
tcaaaagtatgcctccacca

SEQ ID NO: 40858 - DNA, 20 bp, Artificial Sequence
  Description of Artificial Sequence: Synthetic oligonucleotide
  Target: SCN10A; (-) strand; PAM type: YTN; PAM sequence: CTG
caagttctcaaaagtatgcc

SEQ ID NO: 40859 - DNA, 20 bp, Artificial Sequence
  Description of Artificial Sequence: Synthetic oligonucleotide
  Target: SCN10A; (-) strand; PAM type: YTN; PAM sequence: CTG
gaacctgcaagttctcaaaa

SEQ ID NO: 40860 - DNA, 20 bp, Artificial Sequence
  Description of Artificial Sequence: Synthetic oligonucleotide
  Target: SCN10A; (-) strand; PAM type: YTN; PAM sequence: CTG
tacaaatatctggaacctgc

SEQ ID NO: 40861 - DNA, 20 bp, Artificial Sequence
  Description of Artificial Sequence: Synthetic oligonucleotide
  Target: SCN10A; (-) strand; PAM type: YTN; PAM sequence: CTG
actgtacaaatatctggaac

SEQ ID NO: 40862 - DNA, 20 bp, Artificial Sequence
  Description of Artificial Sequence: Synthetic oligonucleotide
  Target: SCN10A; (-) strand; PAM type: YTN; PAM sequence: CTG
aagggagataagagacagga

SEQ ID NO: 40863 - DNA, 20 bp, Artificial Sequence
  Description of Artificial Sequence: Synthetic oligonucleotide
  Target: SCN10A; (-) strand; PAM type: YTN; PAM sequence: TTA
gcactgaagggagataagag

SEQ ID NO: 40864 - DNA, 20 bp, Artificial Sequence
  Description of Artificial Sequence: Synthetic oligonucleotide
  Target: SCN10A; (-) strand; PAM type: YTN; PAM sequence: CTT
agcactgaagggagataaga

SEQ ID NO: 40865 - DNA, 20 bp, Artificial Sequence
  Description of Artificial Sequence: Synthetic oligonucleotide
  Target: SCN10A; (-) strand; PAM type: YTN; PAM sequence: CTG
gcccagaatgtgaggatacc

SEQ ID NO: 40866 - DNA, 20 bp, Artificial Sequence
  Description of Artificial Sequence: Synthetic oligonucleotide
  Target: SCN10A; (-) strand; PAM type: YTN; PAM sequence: CTC
tggcccagaatgtgaggata

SEQ ID NO: 40867 - DNA, 20 bp, Artificial Sequence
  Description of Artificial Sequence: Synthetic oligonucleotide
  Target: SCN10A; (-) strand; PAM type: YTN; PAM sequence: CTC
tctggcccagaatgtgagga

SEQ ID NO: 40868 - DNA, 20 bp, Artificial Sequence
  Description of Artificial Sequence: Synthetic oligonucleotide
  Target: SCN10A; (-) strand; PAM type: YTN; PAM sequence: CTA
gaatctctctggcccagaat

SEQ ID NO: 40869 - DNA, 20 bp, Artificial Sequence
  Description of Artificial Sequence: Synthetic oligonucleotide
  Target: SCN10A; (-) strand; PAM type: YTN; PAM sequence: CTC
aaccccacccacaagaggta

SEQ ID NO: 40870 - DNA, 20 bp, Artificial Sequence
  Description of Artificial Sequence: Synthetic oligonucleotide
  Target: SCN10A; (-) strand; PAM type: YTN; PAM sequence: TTC
tcaaccccacccacaagagg

SEQ ID NO: 40871 - DNA, 20 bp, Artificial Sequence
  Description of Artificial Sequence: Synthetic oligonucleotide
  Target: SCN10A; (-) strand; PAM type: YTN; PAM sequence: CTT
ctcaaccccacccacaagag

SEQ ID NO: 40872 - DNA, 20 bp, Artificial Sequence
  Description of Artificial Sequence: Synthetic oligonucleotide
  Target: SCN10A; (-) strand; PAM type: YTN; PAM sequence: CTA
ccttctcaaccccacccaca

SEQ ID NO: 40873 - DNA, 20 bp, Artificial Sequence
  Description of Artificial Sequence: Synthetic oligonucleotide
  Target: SCN10A; (-) strand; PAM type: YTN; PAM sequence: CTG
agaaccagagctaccttctc

SEQ ID NO: 40874 - DNA, 20 bp, Artificial Sequence
  Description of Artificial Sequence: Synthetic oligonucleotide
  Target: SCN10A; (-) strand; PAM type: YTN; PAM sequence: TTC
catgggagccaacctgagaa

SEQ ID NO: 40875 - DNA, 20 bp, Artificial Sequence
  Description of Artificial Sequence: Synthetic oligonucleotide
  Target: SCN10A; (-) strand; PAM type: YTN; PAM sequence: TTT
ccatgggagccaacctgaga

SEQ ID NO: 40876 - DNA, 20 bp, Artificial Sequence
  Description of Artificial Sequence: Synthetic oligonucleotide
  Target: SCN10A; (-) strand; PAM type: YTN; PAM sequence: CTA
gatttccatgggagccaacc

SEQ ID NO: 40877 - DNA, 20 bp, Artificial Sequence
  Description of Artificial Sequence: Synthetic oligonucleotide
  Target: SCN10A; (-) strand; PAM type: YTN; PAM sequence: TTA
caaggtagaaactagatttc

SEQ ID NO: 40878 - DNA, 20 bp, Artificial Sequence
  Description of Artificial Sequence: Synthetic oligonucleotide
  Target: SCN10A; (-) strand; PAM type: YTN; PAM sequence: CTG
gtggtacaattacaaggtag

SEQ ID NO: 40879 - DNA, 20 bp, Artificial Sequence
  Description of Artificial Sequence: Synthetic oligonucleotide
  Target: SCN10A; (-) strand; PAM type: YTN; PAM sequence: TTC
acctggtggtacaattacaa

SEQ ID NO: 40880 - DNA, 20 bp, Artificial Sequence
  Description of Artificial Sequence: Synthetic oligonucleotide
  Target: SCN10A; (-) strand; PAM type: YTN; PAM sequence: TTC
caagttcacctggtggtaca

SEQ ID NO: 40881 - DNA, 20 bp, Artificial Sequence
  Description of Artificial Sequence: Synthetic oligonucleotide
  Target: SCN10A; (-) strand; PAM type: YTN; PAM sequence: TTT
ccaagttcacctggtggtac

SEQ ID NO: 40882 - DNA, 20 bp, Artificial Sequence
  Description of Artificial Sequence: Synthetic oligonucleotide
  Target: SCN10A; (-) strand; PAM type: YTN; PAM sequence: CTA
gagccagtttccaagttcac

SEQ ID NO: 40883 - DNA, 20 bp, Artificial Sequence
  Description of Artificial Sequence: Synthetic oligonucleotide
  Target: SCN10A; (-) strand; PAM type: YTN; PAM sequence: TTC
actagagccagtttccaagt

SEQ ID NO: 40884 - DNA, 20 bp, Artificial Sequence
  Description of Artificial Sequence: Synthetic oligonucleotide
  Target: SCN10A; (-) strand; PAM type: YTN; PAM sequence: TTT
cactagagccagtttccaag

SEQ ID NO: 40885 - DNA, 20 bp, Artificial Sequence
  Description of Artificial Sequence: Synthetic oligonucleotide
  Target: SCN10A; (-) strand; PAM type: YTN; PAM sequence: TTG
aaaatttcactagagccagt

SEQ ID NO: 40886 - DNA, 20 bp, Artificial Sequence
  Description of Artificial Sequence: Synthetic oligonucleotide
  Target: SCN10A; (-) strand; PAM type: YTN; PAM sequence: TTT
gaaaatttcactagagccag

SEQ ID NO: 40887 - DNA, 20 bp, Artificial Sequence
  Description of Artificial Sequence: Synthetic oligonucleotide
  Target: SCN10A; (-) strand; PAM type: YTN; PAM sequence: TTT
tgaaaatttcactagagcca

SEQ ID NO: 40888 - DNA, 20 bp, Artificial Sequence
  Description of Artificial Sequence: Synthetic oligonucleotide
  Target: SCN10A; (-) strand; PAM type: YTN; PAM sequence: CTT
ttgaaaatttcactagagcc

SEQ ID NO: 40889 - DNA, 20 bp, Artificial Sequence
  Description of Artificial Sequence: Synthetic oligonucleotide
  Target: SCN10A; (-) strand; PAM type: YTN; PAM sequence: TTA
tcttttgaaaatttcactag

SEQ ID NO: 40890 - DNA, 20 bp, Artificial Sequence
  Description of Artificial Sequence: Synthetic oligonucleotide
  Target: SCN10A; (-) strand; PAM type: YTN; PAM sequence: TTG
gaaatgtatccaaatgcaag

SEQ ID NO: 40891 - DNA, 20 bp, Artificial Sequence
  Description of Artificial Sequence: Synthetic oligonucleotide
  Target: SCN10A; (-) strand; PAM type: YTN; PAM sequence: TTT
ggaaatgtatccaaatgcaa

SEQ ID NO: 40892 - DNA, 20 bp, Artificial Sequence
  Description of Artificial Sequence: Synthetic oligonucleotide
  Target: SCN10A; (-) strand; PAM type: YTN; PAM sequence: TTT
tggaaatgtatccaaatgca

SEQ ID NO: 40893 - DNA, 20 bp, Artificial Sequence
  Description of Artificial Sequence: Synthetic oligonucleotide
  Target: SCN10A; (-) strand; PAM type: YTN; PAM sequence: TTT
ttggaaatgtatccaaatgc

SEQ ID NO: 40894 - DNA, 20 bp, Artificial Sequence
  Description of Artificial Sequence: Synthetic oligonucleotide
  Target: SCN10A; (-) strand; PAM type: YTN; PAM sequence: TTG
catgacacggagtttttgga

SEQ ID NO: 40895 - DNA, 20 bp, Artificial Sequence
  Description of Artificial Sequence: Synthetic oligonucleotide
  Target: SCN10A; (-) strand; PAM type: YTN; PAM sequence: CTT
gcatgacacggagtttttgg

SEQ ID NO: 40896 - DNA, 20 bp, Artificial Sequence
  Description of Artificial Sequence: Synthetic oligonucleotide
  Target: SCN10A; (-) strand; PAM type: YTN; PAM sequence: TTG
gaaaagggatgcaatataca

SEQ ID NO: 40897 - DNA, 20 bp, Artificial Sequence
  Description of Artificial Sequence: Synthetic oligonucleotide
  Target: SCN10A; (-) strand; PAM type: YTN; PAM sequence: TTG
taatgggaaacattggaaaa

SEQ ID NO: 40898 - DNA, 20 bp, Artificial Sequence
  Description of Artificial Sequence: Synthetic oligonucleotide
  Target: SCN10A; (-) strand; PAM type: YTN; PAM sequence: CTA
aattgtaatgggaaacattg

SEQ ID NO: 40899 - DNA, 20 bp, Artificial Sequence
  Description of Artificial Sequence: Synthetic oligonucleotide
  Target: SCN10A; (-) strand; PAM type: YTN; PAM sequence: TTC
ctaaattgtaatgggaaaca

SEQ ID NO: 40900 - DNA, 20 bp, Artificial Sequence
  Description of Artificial Sequence: Synthetic oligonucleotide
  Target: SCN10A; (-) strand; PAM type: YTN; PAM sequence: TTT
cctaaattgtaatgggaaac

SEQ ID NO: 40901 - DNA, 20 bp, Artificial Sequence
  Description of Artificial Sequence: Synthetic oligonucleotide
  Target: SCN10A; (-) strand; PAM type: YTN; PAM sequence: CTG
cacaaatgcatttcctaaat

SEQ ID NO: 40902 - DNA, 20 bp, Artificial Sequence
  Description of Artificial Sequence: Synthetic oligonucleotide
  Target: SCN10A; (-) strand; PAM type: YTN; PAM sequence: TTC
tgcacaaatgcatttcctaa

SEQ ID NO: 40903 - DNA, 20 bp, Artificial Sequence
  Description of Artificial Sequence: Synthetic oligonucleotide
  Target: SCN10A; (-) strand; PAM type: YTN; PAM sequence: TTT
ctgcacaaatgcatttccta

SEQ ID NO: 40904 - DNA, 20 bp, Artificial Sequence
  Description of Artificial Sequence: Synthetic oligonucleotide
  Target: SCN10A; (-) strand; PAM type: YTN; PAM sequence: TTT
tctgcacaaatgcatttcct

SEQ ID NO: 40905 - DNA, 20 bp, Artificial Sequence
  Description of Artificial Sequence: Synthetic oligonucleotide
  Target: SCN10A; (-) strand; PAM type: YTN; PAM sequence: TTT
ttctgcacaaatgcatttcc

SEQ ID NO: 40906 - DNA, 20 bp, Artificial Sequence
  Description of Artificial Sequence: Synthetic oligonucleotide
  Target: SCN10A; (-) strand; PAM type: YTN; PAM sequence: TTT
tttctgcacaaatgcatttc

SEQ ID NO: 40907 - DNA, 20 bp, Artificial Sequence
  Description of Artificial Sequence: Synthetic oligonucleotide
  Target: SCN10A; (-) strand; PAM type: YTN; PAM sequence: CTC
attttttctgcacaaatgca

SEQ ID NO: 40908 - DNA, 20 bp, Artificial Sequence
  Description of Artificial Sequence: Synthetic oligonucleotide
  Target: SCN10A; (-) strand; PAM type: YTN; PAM sequence: TTC
tcattttttctgcacaaatg

SEQ ID NO: 40909 - DNA, 20 bp, Artificial Sequence
  Description of Artificial Sequence: Synthetic oligonucleotide
  Target: SCN10A; (-) strand; PAM type: YTN; PAM sequence: TTT
ctcattttttctgcacaaat

SEQ ID NO: 40910 - DNA, 20 bp, Artificial Sequence
  Description of Artificial Sequence: Synthetic oligonucleotide
  Target: SCN10A; (-) strand; PAM type: YTN; PAM sequence: CTA
atccatttctcattttttct

SEQ ID NO: 40911 - DNA, 20 bp, Artificial Sequence
  Description of Artificial Sequence: Synthetic oligonucleotide
  Target: SCN10A; (-) strand; PAM type: YTN; PAM sequence: TTA
cagcatcccagggaaactaa

SEQ ID NO: 40912 - DNA, 20 bp, Artificial Sequence
  Description of Artificial Sequence: Synthetic oligonucleotide
  Target: SCN10A; (-) strand; PAM type: YTN; PAM sequence: TTG
ttacagcatcccagggaaac

SEQ ID NO: 40913 - DNA, 20 bp, Artificial Sequence
  Description of Artificial Sequence: Synthetic oligonucleotide
  Target: SCN10A; (-) strand; PAM type: YTN; PAM sequence: TTT
gttacagcatcccagggaaa

SEQ ID NO: 40914 - DNA, 20 bp, Artificial Sequence
  Description of Artificial Sequence: Synthetic oligonucleotide
  Target: SCN10A; (-) strand; PAM type: YTN; PAM sequence: CTG
gtaatttgttacagcatccc

SEQ ID NO: 40915 - DNA, 20 bp, Artificial Sequence
  Description of Artificial Sequence: Synthetic oligonucleotide
  Target: SCN10A; (-) strand; PAM type: YTN; PAM sequence: TTC
tggtaatttgttacagcatc

SEQ ID NO: 40916 - DNA, 20 bp, Artificial Sequence
  Description of Artificial Sequence: Synthetic oligonucleotide
  Target: SCN10A; (-) strand; PAM type: YTN; PAM sequence: TTT
ctggtaatttgttacagcat

SEQ ID NO: 40917 - DNA, 20 bp, Artificial Sequence
  Description of Artificial Sequence: Synthetic oligonucleotide
  Target: SCN10A; (-) strand; PAM type: YTN; PAM sequence: CTA
gtttctggtaatttgttaca

SEQ ID NO: 40918 - DNA, 20 bp, Artificial Sequence
  Description of Artificial Sequence: Synthetic oligonucleotide
  Target: SCN10A; (-) strand; PAM type: YTN; PAM sequence: CTA
cctagtttctggtaatttgt

SEQ ID NO: 40919 - DNA, 20 bp, Artificial Sequence
  Description of Artificial Sequence: Synthetic oligonucleotide
  Target: SCN10A; (-) strand; PAM type: YTN; PAM sequence: TTG
tcatctacctagtttctggt

SEQ ID NO: 40920 - DNA, 20 bp, Artificial Sequence
  Description of Artificial Sequence: Synthetic oligonucleotide
  Target: SCN10A; (-) strand; PAM type: YTN; PAM sequence: TTA
ttgtcatctacctagtttct

SEQ ID NO: 40921 - DNA, 20 bp, Artificial Sequence
  Description of Artificial Sequence: Synthetic oligonucleotide
  Target: SCN10A; (-) strand; PAM type: YTN; PAM sequence: CTA
ttattgtcatctacctagtt

SEQ ID NO: 40922 - DNA, 20 bp, Artificial Sequence
  Description of Artificial Sequence: Synthetic oligonucleotide
  Target: SCN10A; (-) strand; PAM type: YTN; PAM sequence: TTC
tattattgtcatctacctag

SEQ ID NO: 40923 - DNA, 20 bp, Artificial Sequence
  Description of Artificial Sequence: Synthetic oligonucleotide
  Target: SCN10A; (-) strand; PAM type: YTN; PAM sequence: TTT
ctattattgtcatctaccta

SEQ ID NO: 40924 - DNA, 20 bp, Artificial Sequence
  Description of Artificial Sequence: Synthetic oligonucleotide
  Target: SCN10A; (-) strand; PAM type: YTN; PAM sequence: CTC
agaagtgtaagagaataaat

SEQ ID NO: 40925 - DNA, 20 bp, Artificial Sequence
  Description of Artificial Sequence: Synthetic oligonucleotide
  Target: SCN10A; (-) strand; PAM type: YTN; PAM sequence: CTA
gcctcagaagtgtaagagaa

SEQ ID NO: 40926 - DNA, 20 bp, Artificial Sequence
  Description of Artificial Sequence: Synthetic oligonucleotide
  Target: SCN10A; (-) strand; PAM type: YTN; PAM sequence: TTA
gacatctagcctcagaagtg

SEQ ID NO: 40927 - DNA, 20 bp, Artificial Sequence
  Description of Artificial Sequence: Synthetic oligonucleotide
  Target: SCN10A; (-) strand; PAM type: YTN; PAM sequence: TTT
agacatctagcctcagaagt

SEQ ID NO: 40928 - DNA, 20 bp, Artificial Sequence
  Description of Artificial Sequence: Synthetic oligonucleotide
  Target: SCN10A; (-) strand; PAM type: YTN; PAM sequence: TTT
tagacatctagcctcagaag

SEQ ID NO: 40929 - DNA, 20 bp, Artificial Sequence
  Description of Artificial Sequence: Synthetic oligonucleotide
  Target: SCN10A; (-) strand; PAM type: YTN; PAM sequence: TTG
attttagacatctagcctca

SEQ ID NO: 40930 - DNA, 20 bp, Artificial Sequence
  Description of Artificial Sequence: Synthetic oligonucleotide
  Target: SCN10A; (-) strand; PAM type: YTN; PAM sequence: CTT
gattttagacatctagcctc

SEQ ID NO: 40931 - DNA, 20 bp, Artificial Sequence
  Description of Artificial Sequence: Synthetic oligonucleotide
  Target: SCN10A; (-) strand; PAM type: YTN; PAM sequence: CTG
ccaataccttgattttagac

SEQ ID NO: 40932 - DNA, 20 bp, Artificial Sequence
  Description of Artificial Sequence: Synthetic oligonucleotide
  Target: SCN10A; (-) strand; PAM type: YTN; PAM sequence: CTC
tgccaataccttgattttag

SEQ ID NO: 40933 - DNA, 20 bp, Artificial Sequence
  Description of Artificial Sequence: Synthetic oligonucleotide
  Target: SCN10A; (-) strand; PAM type: YTN; PAM sequence: TTC
agagggaacatggctctgcc

SEQ ID NO: 40934 - DNA, 20 bp, Artificial Sequence
  Description of Artificial Sequence: Synthetic oligonucleotide
  Target: SCN10A; (-) strand; PAM type: YTN; PAM sequence: CTT
cagagggaacatggctctgc

SEQ ID NO: 40935 - DNA, 20 bp, Artificial Sequence
  Description of Artificial Sequence: Synthetic oligonucleotide
  Target: SCN10A; (-) strand; PAM type: YTN; PAM sequence: CTG
cgggcttcagagggaacatg

SEQ ID NO: 40936 - DNA, 20 bp, Artificial Sequence
  Description of Artificial Sequence: Synthetic oligonucleotide
  Target: SCN10A; (-) strand; PAM type: YTN; PAM sequence: CTC
acctgcgggcttcagaggga

SEQ ID NO: 40937 - DNA, 20 bp, Artificial Sequence
  Description of Artificial Sequence: Synthetic oligonucleotide
  Target: SCN10A; (-) strand; PAM type: YTN; PAM sequence: TTC
tcacctgcgggcttcagagg

SEQ ID NO: 40938 - DNA, 20 bp, Artificial Sequence
  Description of Artificial Sequence: Synthetic oligonucleotide
  Target: SCN10A; (-) strand; PAM type: YTN; PAM sequence: CTA
ggaggagacatggaaggcaa

SEQ ID NO: 40939 - DNA, 20 bp, Artificial Sequence
  Description of Artificial Sequence: Synthetic oligonucleotide
  Target: SCN10A; (-) strand; PAM type: YTN; PAM sequence: CTG
aagctaggaggagacatgga

SEQ ID NO: 40940 - DNA, 20 bp, Artificial Sequence
  Description of Artificial Sequence: Synthetic oligonucleotide
  Target: SCN10A; (-) strand; PAM type: YTN; PAM sequence: TTG
ctgaagctaggaggagacat

SEQ ID NO: 40941 - DNA, 20 bp, Artificial Sequence
  Description of Artificial Sequence: Synthetic oligonucleotide
  Target: SCN10A; (-) strand; PAM type: YTN; PAM sequence: CTG
tatggagacacaggaagaaa

SEQ ID NO: 40942 - DNA, 20 bp, Artificial Sequence
  Description of Artificial Sequence: Synthetic oligonucleotide
  Target: SCN10A; (-) strand; PAM type: YTN; PAM sequence: TTG
aacagagacacacagagagg

SEQ ID NO: 40943 - DNA, 20 bp, Artificial Sequence
  Description of Artificial Sequence: Synthetic oligonucleotide
  Target: SCN10A; (-) strand; PAM type: YTN; PAM sequence: TTT
gaacagagacacacagagag

SEQ ID NO: 40944 - DNA, 20 bp, Artificial Sequence
  Description of Artificial Sequence: Synthetic oligonucleotide
  Target: SCN10A; (-) strand; PAM type: YTN; PAM sequence: CTA
aaatatgaggggaatttgaa

SEQ ID NO: 40945 - DNA, 20 bp, Artificial Sequence
  Description of Artificial Sequence: Synthetic oligonucleotide
  Target: SCN10A; (-) strand; PAM type: YTN; PAM sequence: TTG
ctaaaatatgaggggaattt

SEQ ID NO: 40946 - DNA, 20 bp, Artificial Sequence
  Description of Artificial Sequence: Synthetic oligonucleotide
  Target: SCN10A; (-) strand; PAM type: YTN; PAM sequence: CTG
gtgttgctaaaatatgaggg

SEQ ID NO: 40947 - DNA, 20 bp, Artificial Sequence
  Description of Artificial Sequence: Synthetic oligonucleotide
  Target: SCN10A; (-) strand; PAM type: YTN; PAM sequence: CTA
atccaatgactggtgttgct

SEQ ID NO: 40948 - DNA, 20 bp, Artificial Sequence
  Description of Artificial Sequence: Synthetic oligonucleotide
  Target: SCN10A; (-) strand; PAM type: YTN; PAM sequence: TTC
agatgaaggtgagccctaat

SEQ ID NO: 40949 - DNA, 20 bp, Artificial Sequence
  Description of Artificial Sequence: Synthetic oligonucleotide
  Target: SCN10A; (-) strand; PAM type: YTN; PAM sequence: TTG
cagatgtaaacaaattcaga

SEQ ID NO: 40950 - DNA, 20 bp, Artificial Sequence
  Description of Artificial Sequence: Synthetic oligonucleotide
  Target: SCN10A; (-) strand; PAM type: YTN; PAM sequence: TTT
gcagatgtaaacaaattcag

SEQ ID NO: 40951 - DNA, 20 bp, Artificial Sequence
  Description of Artificial Sequence: Synthetic oligonucleotide
  Target: SCN10A; (-) strand; PAM type: YTN; PAM sequence: TTT
tgcagatgtaaacaaattca

SEQ ID NO: 40952 - DNA, 20 bp, Artificial Sequence
  Description of Artificial Sequence: Synthetic oligonucleotide
  Target: SCN10A; (-) strand; PAM type: YTN; PAM sequence: TTT
ttgcagatgtaaacaaattc

SEQ ID NO: 40953 - DNA, 20 bp, Artificial Sequence
  Description of Artificial Sequence: Synthetic oligonucleotide
  Target: SCN10A; (-) strand; PAM type: YTN; PAM sequence: TTA
aggtttttgcagatgtaaac

SEQ ID NO: 40954 - DNA, 20 bp, Artificial Sequence
  Description of Artificial Sequence: Synthetic oligonucleotide
  Target: SCN10A; (-) strand; PAM type: YTN; PAM sequence: TTG
acattaaggtttttgcagat

SEQ ID NO: 40955 - DNA, 20 bp, Artificial Sequence
  Description of Artificial Sequence: Synthetic oligonucleotide
  Target: SCN10A; (-) strand; PAM type: YTN; PAM sequence: TTT
gacattaaggtttttgcaga

SEQ ID NO: 40956 - DNA, 20 bp, Artificial Sequence
  Description of Artificial Sequence: Synthetic oligonucleotide
  Target: SCN10A; (-) strand; PAM type: YTN; PAM sequence: TTA
tttgacattaaggtttttgc

SEQ ID NO: 40957 - DNA, 20 bp, Artificial Sequence
  Description of Artificial Sequence: Synthetic oligonucleotide
  Target: SCN10A; (-) strand; PAM type: YTN; PAM sequence: CTT
atttgacattaaggtttttg

SEQ ID NO: 40958 - DNA, 20 bp, Artificial Sequence
  Description of Artificial Sequence: Synthetic oligonucleotide
  Target: SCN10A; (-) strand; PAM type: YTN; PAM sequence: TTG
tgaccttatttgacattaag

SEQ ID NO: 40959 - DNA, 20 bp, Artificial Sequence
  Description of Artificial Sequence: Synthetic oligonucleotide
  Target: SCN10A; (-) strand; PAM type: YTN; PAM sequence: CTG
tgattgtgaccttatttgac

SEQ ID NO: 40960 - DNA, 20 bp, Artificial Sequence
  Description of Artificial Sequence: Synthetic oligonucleotide
  Target: SCN10A; (-) strand; PAM type: YTN; PAM sequence: CTA
accaatagtacctgtgattg

SEQ ID NO: 40961 - DNA, 20 bp, Artificial Sequence
  Description of Artificial Sequence: Synthetic oligonucleotide
  Target: SCN10A; (-) strand; PAM type: YTN; PAM sequence: TTC
taaccaatagtacctgtgat

SEQ ID NO: 40962 - DNA, 20 bp, Artificial Sequence
  Description of Artificial Sequence: Synthetic oligonucleotide
  Target: SCN10A; (-) strand; PAM type: YTN; PAM sequence: TTG
aagttctaaccaatagtacc

SEQ ID NO: 40963 - DNA, 20 bp, Artificial Sequence
  Description of Artificial Sequence: Synthetic oligonucleotide
  Target: SCN10A; (-) strand; PAM type: YTN; PAM sequence: CTA
aaagggtatgttgaagttct

SEQ ID NO: 40964 - DNA, 20 bp, Artificial Sequence
  Description of Artificial Sequence: Synthetic oligonucleotide
  Target: SCN10A; (-) strand; PAM type: YTN; PAM sequence: TTC
cctaaaagggtatgttgaag

SEQ ID NO: 40965 - DNA, 20 bp, Artificial Sequence
  Description of Artificial Sequence: Synthetic oligonucleotide
  Target: SCN10A; (-) strand; PAM type: YTN; PAM sequence: TTG
aataatgttccctaaaaggg

SEQ ID NO: 40966 - DNA, 20 bp, Artificial Sequence
  Description of Artificial Sequence: Synthetic oligonucleotide
  Target: SCN10A; (-) strand; PAM type: YTN; PAM sequence: TTG
ggttgaataatgttccctaa

SEQ ID NO: 40967 - DNA, 20 bp, Artificial Sequence
  Description of Artificial Sequence: Synthetic oligonucleotide
  Target: SCN10A; (-) strand; PAM type: YTN; PAM sequence: TTT
gggttgaataatgttcccta

SEQ ID NO: 40968 - DNA, 20 bp, Artificial Sequence
  Description of Artificial Sequence: Synthetic oligonucleotide
  Target: SCN10A; (-) strand; PAM type: YTN; PAM sequence: CTT
tgggttgaataatgttccct

SEQ ID NO: 40969 - DNA, 20 bp, Artificial Sequence
  Description of Artificial Sequence: Synthetic oligonucleotide
  Target: SCN10A; (-) strand; PAM type: YTN; PAM sequence: TTA
tgctttgggttgaataatgt

SEQ ID NO: 40970 - DNA, 20 bp, Artificial Sequence
  Description of Artificial Sequence: Synthetic oligonucleotide
  Target: SCN10A; (-) strand; PAM type: YTN; PAM sequence: TTG
aattatgctttgggttgaat

SEQ ID NO: 40971 - DNA, 20 bp, Artificial Sequence
  Description of Artificial Sequence: Synthetic oligonucleotide
  Target: SCN10A; (-) strand; PAM type: YTN; PAM sequence: TTA
tgttgaattatgctttgggt

SEQ ID NO: 40972 - DNA, 20 bp, Artificial Sequence
  Description of Artificial Sequence: Synthetic oligonucleotide
  Target: SCN10A; (-) strand; PAM type: YTN; PAM sequence: TTT
atgttgaattatgctttggg

SEQ ID NO: 40973 - DNA, 20 bp, Artificial Sequence
  Description of Artificial Sequence: Synthetic oligonucleotide
  Target: SCN10A; (-) strand; PAM type: YTN; PAM sequence: CTT
tatgttgaattatgctttgg

SEQ ID NO: 40974 - DNA, 20 bp, Artificial Sequence
  Description of Artificial Sequence: Synthetic oligonucleotide
  Target: SCN10A; (-) strand; PAM type: YTN; PAM sequence: TTC
aactttatgttgaattatgc

SEQ ID NO: 40975 - DNA, 20 bp, Artificial Sequence
  Description of Artificial Sequence: Synthetic oligonucleotide
  Target: SCN10A; (-) strand; PAM type: YTN; PAM sequence: CTA
aacataggaacataattcaa

SEQ ID NO: 40976 - DNA, 20 bp, Artificial Sequence
  Description of Artificial Sequence: Synthetic oligonucleotide
  Target: SCN10A; (-) strand; PAM type: YTN; PAM sequence: CTC
cctaaacataggaacataat

SEQ ID NO: 40977 - DNA, 20 bp, Artificial Sequence
  Description of Artificial Sequence: Synthetic oligonucleotide
  Target: SCN10A; (-) strand; PAM type: YTN; PAM sequence: TTA
tgctccctaaacataggaac

SEQ ID NO: 40978 - DNA, 20 bp, Artificial Sequence
  Description of Artificial Sequence: Synthetic oligonucleotide
  Target: SCN10A; (-) strand; PAM type: YTN; PAM sequence: TTG
aattatgctccctaaacata

SEQ ID NO: 40979 - DNA, 20 bp, Artificial Sequence
  Description of Artificial Sequence: Synthetic oligonucleotide
  Target: SCN10A; (-) strand; PAM type: YTN; PAM sequence: TTG
agttgaattatgctccctaa

SEQ ID NO: 40980 - DNA, 20 bp, Artificial Sequence
  Description of Artificial Sequence: Synthetic oligonucleotide
  Target: SCN10A; (-) strand; PAM type: YTN; PAM sequence: TTT
gagttgaattatgctcccta

SEQ ID NO: 40981 - DNA, 20 bp, Artificial Sequence
  Description of Artificial Sequence: Synthetic oligonucleotide
  Target: SCN10A; (-) strand; PAM type: YTN; PAM sequence: CTT
tgagttgaattatgctccct

SEQ ID NO: 40982 - DNA, 20 bp, Artificial Sequence
  Description of Artificial Sequence: Synthetic oligonucleotide
  Target: SCN10A; (-) strand; PAM type: YTN; PAM sequence: TTA
ctttgagttgaattatgctc

SEQ ID NO: 40983 - DNA, 20 bp, Artificial Sequence
  Description of Artificial Sequence: Synthetic oligonucleotide
  Target: SCN10A; (-) strand; PAM type: YTN; PAM sequence: TTT
actttgagttgaattatgct

SEQ ID NO: 40984 - DNA, 20 bp, Artificial Sequence
  Description of Artificial Sequence: Synthetic oligonucleotide
  Target: SCN10A; (-) strand; PAM type: YTN; PAM sequence: TTT
tactttgagttgaattatgc

SEQ ID NO: 40985 - DNA, 20 bp, Artificial Sequence
  Description of Artificial Sequence: Synthetic oligonucleotide
  Target: SCN10A; (-) strand; PAM type: YTN; PAM sequence: TTT
ttactttgagttgaattatg

SEQ ID NO: 40986 - DNA, 20 bp, Artificial Sequence
  Description of Artificial Sequence: Synthetic oligonucleotide
  Target: SCN10A; (-) strand; PAM type: YTN; PAM sequence: CTC
aaaagtatttttactttgag

SEQ ID NO: 40987 - DNA, 20 bp, Artificial Sequence
  Description of Artificial Sequence: Synthetic oligonucleotide
  Target: SCN10A; (-) strand; PAM type: YTN; PAM sequence: TTC
tcaaaagtatttttactttg

SEQ ID NO: 40988 - DNA, 20 bp, Artificial Sequence
  Description of Artificial Sequence: Synthetic oligonucleotide
  Target: SCN10A; (-) strand; PAM type: YTN; PAM sequence: CTA
ttctcaaaagtatttttact

SEQ ID NO: 40989 - DNA, 20 bp, Artificial Sequence
  Description of Artificial Sequence: Synthetic oligonucleotide
  Target: SCN10A; (-) strand; PAM type: YTN; PAM sequence: TTA
aagcagatgatactattctc

SEQ ID NO: 40990 - DNA, 20 bp, Artificial Sequence
  Description of Artificial Sequence: Synthetic oligonucleotide
  Target: SCN10A; (-) strand; PAM type: YTN; PAM sequence: CTA
ttaaagcagatgatactatt

SEQ ID NO: 40991 - DNA, 20 bp, Artificial Sequence
  Description of Artificial Sequence: Synthetic oligonucleotide
  Target: SCN10A; (-) strand; PAM type: YTN; PAM sequence: TTC
tattaaagcagatgatacta

SEQ ID NO: 40992 - DNA, 20 bp, Artificial Sequence
  Description of Artificial Sequence: Synthetic oligonucleotide
  Target: SCN10A; (-) strand; PAM type: YTN; PAM sequence: CTG
gttctattaaagcagatgat

SEQ ID NO: 40993 - DNA, 20 bp, Artificial Sequence
  Description of Artificial Sequence: Synthetic oligonucleotide
  Target: SCN10A; (-) strand; PAM type: YTN; PAM sequence: TTA
agtgtgccaaaccatcagac

SEQ ID NO: 40994 - DNA, 20 bp, Artificial Sequence
  Description of Artificial Sequence: Synthetic oligonucleotide
  Target: SCN10A; (-) strand; PAM type: YTN; PAM sequence: TTA
caatgatatgtgaaagaatt

SEQ ID NO: 40995 - DNA, 20 bp, Artificial Sequence
  Description of Artificial Sequence: Synthetic oligonucleotide
  Target: SCN10A; (-) strand; PAM type: YTN; PAM sequence: TTT
acaatgatatgtgaaagaat

SEQ ID NO: 40996 - DNA, 20 bp, Artificial Sequence
  Description of Artificial Sequence: Synthetic oligonucleotide
  Target: SCN10A; (-) strand; PAM type: YTN; PAM sequence: TTT
tacaatgatatgtgaaagaa

SEQ ID NO: 40997 - DNA, 20 bp, Artificial Sequence
  Description of Artificial Sequence: Synthetic oligonucleotide
  Target: SCN10A; (-) strand; PAM type: YTN; PAM sequence: TTT
ttacaatgatatgtgaaaga

SEQ ID NO: 40998 - DNA, 20 bp, Artificial Sequence
  Description of Artificial Sequence: Synthetic oligonucleotide
  Target: SCN10A; (-) strand; PAM type: YTN; PAM sequence: TTA
tttttacaatgatatgtgaa

SEQ ID NO: 40999 - DNA, 20 bp, Artificial Sequence
  Description of Artificial Sequence: Synthetic oligonucleotide
  Target: SCN10A; (-) strand; PAM type: YTN; PAM sequence: TTT
atttttacaatgatatgtga

SEQ ID NO: 41000 - DNA, 20 bp, Artificial Sequence
  Description of Artificial Sequence: Synthetic oligonucleotide
  Target: SCN10A; (-) strand; PAM type: YTN; PAM sequence: TTG
ggcacaggtttatttttaca

SEQ ID NO: 41001 - DNA, 20 bp, Artificial Sequence
  Description of Artificial Sequence: Synthetic oligonucleotide
  Target: SCN10A; (-) strand; PAM type: YTN; PAM sequence: TTT
gggcacaggtttatttttac

SEQ ID NO: 41002 - DNA, 20 bp, Artificial Sequence
  Description of Artificial Sequence: Synthetic oligonucleotide
  Target: SCN10A; (-) strand; PAM type: YTN; PAM sequence: CTA
agtggacagagagtttgggc

SEQ ID NO: 41003 - DNA, 20 bp, Artificial Sequence
  Description of Artificial Sequence: Synthetic oligonucleotide
  Target: SCN10A; (-) strand; PAM type: YTN; PAM sequence: TTA
taagacagctaagtggacag

SEQ ID NO: 41004 - DNA, 20 bp, Artificial Sequence
  Description of Artificial Sequence: Synthetic oligonucleotide
  Target: SCN10A; (-) strand; PAM type: YTN; PAM sequence: TTT
ataagacagctaagtggaca

SEQ ID NO: 41005 - DNA, 20 bp, Artificial Sequence
  Description of Artificial Sequence: Synthetic oligonucleotide
  Target: SCN10A; (-) strand; PAM type: YTN; PAM sequence: CTA
gcccaagtgtttataagaca

SEQ ID NO: 41006 - DNA, 20 bp, Artificial Sequence
  Description of Artificial Sequence: Synthetic oligonucleotide
  Target: SCN10A; (-) strand; PAM type: YTN; PAM sequence: CTG
agatactagcccaagtgttt

SEQ ID NO: 41007 - DNA, 20 bp, Artificial Sequence
  Description of Artificial Sequence: Synthetic oligonucleotide
  Target: SCN10A; (-) strand; PAM type: YTN; PAM sequence: CTA
aatcccatgtggatgatgaa

SEQ ID NO: 41008 - DNA, 20 bp, Artificial Sequence
  Description of Artificial Sequence: Synthetic oligonucleotide
  Target: SCN10A; (-) strand; PAM type: YTN; PAM sequence: TTC
aacgtctaaatcccatgtgg

SEQ ID NO: 41009 - DNA, 20 bp, Artificial Sequence
  Description of Artificial Sequence: Synthetic oligonucleotide
  Target: SCN10A; (-) strand; PAM type: YTN; PAM sequence: CTT
caacgtctaaatcccatgtg

SEQ ID NO: 41010 - DNA, 20 bp, Artificial Sequence
  Description of Artificial Sequence: Synthetic oligonucleotide
  Target: SCN10A; (-) strand; PAM type: YTN; PAM sequence: TTC
ttcaacgtctaaatcccatg

SEQ ID NO: 41011 - DNA, 20 bp, Artificial Sequence
  Description of Artificial Sequence: Synthetic oligonucleotide
  Target: SCN10A; (-) strand; PAM type: YTN; PAM sequence: CTT
cttcaacgtctaaatcccat

SEQ ID NO: 41012 - DNA, 20 bp, Artificial Sequence
  Description of Artificial Sequence: Synthetic oligonucleotide
  Target: SCN10A; (-) strand; PAM type: YTN; PAM sequence: CTG
tgcagcttcttcaacgtcta

SEQ ID NO: 41013 - DNA, 20 bp, Artificial Sequence
  Description of Artificial Sequence: Synthetic oligonucleotide
  Target: SCN10A; (-) strand; PAM type: YTN; PAM sequence: CTG
actgtgcagcttcttcaacg

SEQ ID NO: 41014 - DNA, 20 bp, Artificial Sequence
  Description of Artificial Sequence: Synthetic oligonucleotide
  Target: SCN10A; (-) strand; PAM type: YTN; PAM sequence: CTG
aacccgggagcacagatact

SEQ ID NO: 41015 - DNA, 20 bp, Artificial Sequence
  Description of Artificial Sequence: Synthetic oligonucleotide
  Target: SCN10A; (-) strand; PAM type: YTN; PAM sequence: CTC
gtaccactgaacccgggagc

SEQ ID NO: 41016 - DNA, 20 bp, Artificial Sequence
  Description of Artificial Sequence: Synthetic oligonucleotide
  Target: SCN10A; (-) strand; PAM type: YTN; PAM sequence: CTC
tcgtaccactgaacccggga

SEQ ID NO: 41017 - DNA, 20 bp, Artificial Sequence
  Description of Artificial Sequence: Synthetic oligonucleotide
  Target: SCN10A; (-) strand; PAM type: YTN; PAM sequence: CTC
tctcgtaccactgaacccgg

SEQ ID NO: 41018 - DNA, 20 bp, Artificial Sequence
  Description of Artificial Sequence: Synthetic oligonucleotide
  Target: SCN10A; (-) strand; PAM type: YTN; PAM sequence: TTC
ctctctcgtaccactgaacc

SEQ ID NO: 41019 - DNA, 20 bp, Artificial Sequence
  Description of Artificial Sequence: Synthetic oligonucleotide
  Target: SCN10A; (-) strand; PAM type: YTN; PAM sequence: CTT
cctctctcgtaccactgaac

SEQ ID NO: 41020 - DNA, 20 bp, Artificial Sequence
  Description of Artificial Sequence: Synthetic oligonucleotide
  Target: SCN10A; (-) strand; PAM type: YTN; PAM sequence: CTC
ttcctctctcgtaccactga

SEQ ID NO: 41021 - DNA, 20 bp, Artificial Sequence
  Description of Artificial Sequence: Synthetic oligonucleotide
  Target: SCN10A; (-) strand; PAM type: YTN; PAM sequence: TTC
aaccaaataactcttcctct

SEQ ID NO: 41022 - DNA, 20 bp, Artificial Sequence
  Description of Artificial Sequence: Synthetic oligonucleotide
  Target: SCN10A; (-) strand; PAM type: YTN; PAM sequence: CTA
aaagatgagttcaaccaaat

SEQ ID NO: 41023 - DNA, 20 bp, Artificial Sequence
  Description of Artificial Sequence: Synthetic oligonucleotide
  Target: SCN10A; (-) strand; PAM type: YTN; PAM sequence: TTC
taaaagatgagttcaaccaa

SEQ ID NO: 41024 - DNA, 20 bp, Artificial Sequence
  Description of Artificial Sequence: Synthetic oligonucleotide
  Target: SCN10A; (-) strand; PAM type: YTN; PAM sequence: TTA
ttctaaaagatgagttcaac

SEQ ID NO: 41025 - DNA, 20 bp, Artificial Sequence
  Description of Artificial Sequence: Synthetic oligonucleotide
  Target: SCN10A; (-) strand; PAM type: YTN; PAM sequence: TTT
attctaaaagatgagttcaa

SEQ ID NO: 41026 - DNA, 20 bp, Artificial Sequence
  Description of Artificial Sequence: Synthetic oligonucleotide
  Target: SCN10A; (-) strand; PAM type: YTN; PAM sequence: CTG
atttattctaaaagatgagt

SEQ ID NO: 41027 - DNA, 20 bp, Artificial Sequence
  Description of Artificial Sequence: Synthetic oligonucleotide
  Target: SCN10A; (-) strand; PAM type: YTN; PAM sequence: CTG
aatgcctgatttattctaaa

SEQ ID NO: 41028 - DNA, 20 bp, Artificial Sequence
  Description of Artificial Sequence: Synthetic oligonucleotide
  Target: SCN10A; (-) strand; PAM type: YTN; PAM sequence: CTC
tgaatgcctgatttattcta

SEQ ID NO: 41029 - DNA, 20 bp, Artificial Sequence
  Description of Artificial Sequence: Synthetic oligonucleotide
  Target: SCN10A; (-) strand; PAM type: YTN; PAM sequence: TTC
tctgaatgcctgatttattc

SEQ ID NO: 41030 - DNA, 20 bp, Artificial Sequence
  Description of Artificial Sequence: Synthetic oligonucleotide
  Target: SCN10A; (-) strand; PAM type: YTN; PAM sequence: CTA
ttctctgaatgcctgattta

SEQ ID NO: 41031 - DNA, 20 bp, Artificial Sequence
  Description of Artificial Sequence: Synthetic oligonucleotide
  Target: SCN10A; (-) strand; PAM type: YTN; PAM sequence: CTC
aaatcagctattctctgaat

SEQ ID NO: 41032 - DNA, 20 bp, Artificial Sequence
  Description of Artificial Sequence: Synthetic oligonucleotide
  Target: SCN10A; (-) strand; PAM type: YTN; PAM sequence: TTA
ataagatgatgatgggatag

SEQ ID NO: 41033 - DNA, 20 bp, Artificial Sequence
  Description of Artificial Sequence: Synthetic oligonucleotide
  Target: SCN10A; (-) strand; PAM type: YTN; PAM sequence: TTG
gcagcatccacagatgcagg

SEQ ID NO: 41034 - DNA, 20 bp, Artificial Sequence
  Description of Artificial Sequence: Synthetic oligonucleotide
  Target: SCN10A; (-) strand; PAM type: YTN; PAM sequence: CTG
ggagttggcagcatccacag

SEQ ID NO: 41035 - DNA, 20 bp, Artificial Sequence
  Description of Artificial Sequence: Synthetic oligonucleotide
  Target: SCN10A; (-) strand; PAM type: YTN; PAM sequence: TTA
ctgggagttggcagcatcca

SEQ ID NO: 41036 - DNA, 20 bp, Artificial Sequence
  Description of Artificial Sequence: Synthetic oligonucleotide
  Target: SCN10A; (-) strand; PAM type: YTN; PAM sequence: CTT
actgggagttggcagcatcc

SEQ ID NO: 41037 - DNA, 20 bp, Artificial Sequence
  Description of Artificial Sequence: Synthetic oligonucleotide
  Target: SCN10A; (-) strand; PAM type: YTN; PAM sequence: CTC
aagatgcttactgggagttg

SEQ ID NO: 41038 - DNA, 20 bp, Artificial Sequence
  Description of Artificial Sequence: Synthetic oligonucleotide
  Target: SCN10A; (-) strand; PAM type: YTN; PAM sequence: CTC
tcaagatgcttactgggagt

SEQ ID NO: 41039 - DNA, 20 bp, Artificial Sequence
  Description of Artificial Sequence: Synthetic oligonucleotide
  Target: SCN10A; (-) strand; PAM type: YTN; PAM sequence: TTA
gcccataagaagtcaaagag

SEQ ID NO: 41040 - DNA, 20 bp, Artificial Sequence
  Description of Artificial Sequence: Synthetic oligonucleotide
  Target: SCN10A; (-) strand; PAM type: YTN; PAM sequence: CTA
ttagcccataagaagtcaaa

SEQ ID NO: 41041 - DNA, 20 bp, Artificial Sequence
  Description of Artificial Sequence: Synthetic oligonucleotide
  Target: SCN10A; (-) strand; PAM type: YTN; PAM sequence: CTG
tcactattagcccataagaa

SEQ ID NO: 41042 - DNA, 20 bp, Artificial Sequence
  Description of Artificial Sequence: Synthetic oligonucleotide
  Target: SCN10A; (-) strand; PAM type: YTN; PAM sequence: TTC
tgtcactattagcccataag

SEQ ID NO: 41043 - DNA, 20 bp, Artificial Sequence
  Description of Artificial Sequence: Synthetic oligonucleotide
  Target: SCN10A; (-) strand; PAM type: YTN; PAM sequence: TTT
ctgtcactattagcccataa

SEQ ID NO: 41044 - DNA, 20 bp, Artificial Sequence
  Description of Artificial Sequence: Synthetic oligonucleotide
  Target: SCN10A; (-) strand; PAM type: YTN; PAM sequence: TTT
tctgtcactattagcccata

SEQ ID NO: 41045 - DNA, 20 bp, Artificial Sequence
  Description of Artificial Sequence: Synthetic oligonucleotide
  Target: SCN10A; (-) strand; PAM type: YTN; PAM sequence: CTT
ttctgtcactattagcccat

SEQ ID NO: 41046 - DNA, 20 bp, Artificial Sequence
  Description of Artificial Sequence: Synthetic oligonucleotide
  Target: SCN10A; (-) strand; PAM type: YTN; PAM sequence: CTC
ccttttctgtcactattagc

SEQ ID NO: 41047 - DNA, 20 bp, Artificial Sequence
  Description of Artificial Sequence: Synthetic oligonucleotide
  Target: SCN10A; (-) strand; PAM type: YTN; PAM sequence: CTC
tcccttttctgtcactatta

SEQ ID NO: 41048 - DNA, 20 bp, Artificial Sequence
  Description of Artificial Sequence: Synthetic oligonucleotide
  Target: SCN10A; (-) strand; PAM type: YTN; PAM sequence: TTG
ctctcccttttctgtcacta

SEQ ID NO: 41049 - DNA, 20 bp, Artificial Sequence
  Description of Artificial Sequence: Synthetic oligonucleotide
  Target: SCN10A; (-) strand; PAM type: YTN; PAM sequence: CTT
gctctcccttttctgtcact

SEQ ID NO: 41050 - DNA, 20 bp, Artificial Sequence
  Description of Artificial Sequence: Synthetic oligonucleotide
  Target: SCN10A; (-) strand; PAM type: YTN; PAM sequence: TTG
ccgaggccttgctctccctt

SEQ ID NO: 41051 - DNA, 20 bp, Artificial Sequence
  Description of Artificial Sequence: Synthetic oligonucleotide
  Target: SCN10A; (-) strand; PAM type: YTN; PAM sequence: TTT
gccgaggccttgctctccct

SEQ ID NO: 41052 - DNA, 20 bp, Artificial Sequence
  Description of Artificial Sequence: Synthetic oligonucleotide
  Target: SCN10A; (-) strand; PAM type: YTN; PAM sequence: CTC
aagaatacagatttgccgag

SEQ ID NO: 41053 - DNA, 20 bp, Artificial Sequence
  Description of Artificial Sequence: Synthetic oligonucleotide
  Target: SCN10A; (-) strand; PAM type: YTN; PAM sequence: CTC
acatgcctcaagaatacaga

SEQ ID NO: 41054 - DNA, 20 bp, Artificial Sequence
  Description of Artificial Sequence: Synthetic oligonucleotide
  Target: SCN10A; (-) strand; PAM type: YTN; PAM sequence: CTG
atacatctcacatgcctcaa

SEQ ID NO: 41055 - DNA, 20 bp, Artificial Sequence
  Description of Artificial Sequence: Synthetic oligonucleotide
  Target: SCN10A; (-) strand; PAM type: YTN; PAM sequence: TTA
caaagcacagtggctgatac

SEQ ID NO: 41056 - DNA, 20 bp, Artificial Sequence
  Description of Artificial Sequence: Synthetic oligonucleotide
  Target: SCN10A; (-) strand; PAM type: YTN; PAM sequence: TTG
tataattacaaagcacagtg

SEQ ID NO: 41057 - DNA, 20 bp, Artificial Sequence
  Description of Artificial Sequence: Synthetic oligonucleotide
  Target: SCN10A; (-) strand; PAM type: YTN; PAM sequence: TTT
gtataattacaaagcacagt

SEQ ID NO: 41058 - DNA, 20 bp, Artificial Sequence
  Description of Artificial Sequence: Synthetic oligonucleotide
  Target: SCN10A; (-) strand; PAM type: YTN; PAM sequence: TTC
catttgtataattacaaagc

SEQ ID NO: 41059 - DNA, 20 bp, Artificial Sequence
  Description of Artificial Sequence: Synthetic oligonucleotide
  Target: SCN10A; (-) strand; PAM type: YTN; PAM sequence: TTT
ccatttgtataattacaaag

SEQ ID NO: 41060 - DNA, 20 bp, Artificial Sequence
  Description of Artificial Sequence: Synthetic oligonucleotide
  Target: SCN10A; (-) strand; PAM type: YTN; PAM sequence: TTT
tccatttgtataattacaaa

SEQ ID NO: 41061 - DNA, 20 bp, Artificial Sequence
  Description of Artificial Sequence: Synthetic oligonucleotide
  Target: SCN10A; (-) strand; PAM type: YTN; PAM sequence: TTC
ataagattttccatttgtat

SEQ ID NO: 41062 - DNA, 20 bp, Artificial Sequence
  Description of Artificial Sequence: Synthetic oligonucleotide
  Target: SCN10A; (-) strand; PAM type: YTN; PAM sequence: TTT
cataagattttccatttgta

SEQ ID NO: 41063 - DNA, 20 bp, Artificial Sequence
  Description of Artificial Sequence: Synthetic oligonucleotide
  Target: SCN10A; (-) strand; PAM type: YTN; PAM sequence: TTG
atcatttcataagattttcc

SEQ ID NO: 41064 - DNA, 20 bp, Artificial Sequence
  Description of Artificial Sequence: Synthetic oligonucleotide
  Target: SCN10A; (-) strand; PAM type: YTN; PAM sequence: TTT
gatcatttcataagattttc

SEQ ID NO: 41065 - DNA, 20 bp, Artificial Sequence
  Description of Artificial Sequence: Synthetic oligonucleotide
  Target: SCN10A; (-) strand; PAM type: YTN; PAM sequence: CTA
tatatttgatcatttcataa

SEQ ID NO: 41066 - DNA, 20 bp, Artificial Sequence
  Description of Artificial Sequence: Synthetic oligonucleotide
  Target: SCN10A; (-) strand; PAM type: YTN; PAM sequence: TTG
tctatatatttgatcatttc

SEQ ID NO: 41067 - DNA, 20 bp, Artificial Sequence
  Description of Artificial Sequence: Synthetic oligonucleotide
  Target: SCN10A; (-) strand; PAM type: YTN; PAM sequence: TTC
attgtctatatatttgatca

SEQ ID NO: 41068 - DNA, 20 bp, Artificial Sequence
  Description of Artificial Sequence: Synthetic oligonucleotide
  Target: SCN10A; (-) strand; PAM type: YTN; PAM sequence: TTC
aaatatatagccaattcatt

SEQ ID NO: 41069 - DNA, 20 bp, Artificial Sequence
  Description of Artificial Sequence: Synthetic oligonucleotide
  Target: SCN10A; (-) strand; PAM type: YTN; PAM sequence: TTC
ccagccacaatcacaaagat

SEQ ID NO: 41070 - DNA, 20 bp, Artificial Sequence
  Description of Artificial Sequence: Synthetic oligonucleotide
  Target: SCN10A; (-) strand; PAM type: YTN; PAM sequence: TTG
gcccattcccagccacaatc

SEQ ID NO: 41071 - DNA, 20 bp, Artificial Sequence
  Description of Artificial Sequence: Synthetic oligonucleotide
  Target: SCN10A; (-) strand; PAM type: YTN; PAM sequence: CTT
ggcccattcccagccacaat

SEQ ID NO: 41072 - DNA, 20 bp, Artificial Sequence
  Description of Artificial Sequence: Synthetic oligonucleotide
  Target: SCN10A; (-) strand; PAM type: YTN; PAM sequence: CTC
ttggcccattcccagccaca

SEQ ID NO: 41073 - DNA, 20 bp, Artificial Sequence
  Description of Artificial Sequence: Synthetic oligonucleotide
  Target: SCN10A; (-) strand; PAM type: YTN; PAM sequence: TTA
actcttggcccattcccagc

SEQ ID NO: 41074 - DNA, 20 bp, Artificial Sequence
  Description of Artificial Sequence: Synthetic oligonucleotide
  Target: SCN10A; (-) strand; PAM type: YTN; PAM sequence: TTC
cattaactcttggcccattc

SEQ ID NO: 41075 - DNA, 20 bp, Artificial Sequence
  Description of Artificial Sequence: Synthetic oligonucleotide
  Target: SCN10A; (-) strand; PAM type: YTN; PAM sequence: CTT
ccattaactcttggcccatt

SEQ ID NO: 41076 - DNA, 20 bp, Artificial Sequence
  Description of Artificial Sequence: Synthetic oligonucleotide
  Target: SCN10A; (-) strand; PAM type: YTN; PAM sequence: TTG
taatgacagtcatgatcttc

SEQ ID NO: 41077 - DNA, 20 bp, Artificial Sequence
  Description of Artificial Sequence: Synthetic oligonucleotide
  Target: SCN10A; (-) strand; PAM type: YTN; PAM sequence: CTA
taacaacataggacataggg

SEQ ID NO: 41078 - DNA, 20 bp, Artificial Sequence
  Description of Artificial Sequence: Synthetic oligonucleotide
  Target: SCN10A; (-) strand; PAM type: YTN; PAM sequence: CTC
cctataacaacataggacat

SEQ ID NO: 41079 - DNA, 20 bp, Artificial Sequence
  Description of Artificial Sequence: Synthetic oligonucleotide
  Target: SCN10A; (-) strand; PAM type: YTN; PAM sequence: TTG
agatgaagaaaagcaaagac

SEQ ID NO: 41080 - DNA, 20 bp, Artificial Sequence
  Description of Artificial Sequence: Synthetic oligonucleotide
  Target: SCN10A; (-) strand; PAM type: YTN; PAM sequence: TTT
gagatgaagaaaagcaaaga

SEQ ID NO: 41081 - DNA, 20 bp, Artificial Sequence
  Description of Artificial Sequence: Synthetic oligonucleotide
  Target: SCN10A; (-) strand; PAM type: YTN; PAM sequence: TTT
tgagatgaagaaaagcaaag

SEQ ID NO: 41082 - DNA, 20 bp, Artificial Sequence
  Description of Artificial Sequence: Synthetic oligonucleotide
  Target: SCN10A; (-) strand; PAM type: YTN; PAM sequence: TTG
cagattttgagatgaagaaa

SEQ ID NO: 41083 - DNA, 20 bp, Artificial Sequence
  Description of Artificial Sequence: Synthetic oligonucleotide
  Target: SCN10A; (-) strand; PAM type: YTN; PAM sequence: TTA
ggccaaaggcatgttgcaga

SEQ ID NO: 41084 - DNA, 20 bp, Artificial Sequence
  Description of Artificial Sequence: Synthetic oligonucleotide
  Target: SCN10A; (-) strand; PAM type: YTN; PAM sequence: TTT
aggccaaaggcatgttgcag

SEQ ID NO: 41085 - DNA, 20 bp, Artificial Sequence
  Description of Artificial Sequence: Synthetic oligonucleotide
  Target: SCN10A; (-) strand; PAM type: YTN; PAM sequence: TTA
tttaggccaaaggcatgttg

SEQ ID NO: 41086 - DNA, 20 bp, Artificial Sequence
  Description of Artificial Sequence: Synthetic oligonucleotide
  Target: SCN10A; (-) strand; PAM type: YTN; PAM sequence: TTT
atttaggccaaaggcatgtt

SEQ ID NO: 41087 - DNA, 20 bp, Artificial Sequence
  Description of Artificial Sequence: Synthetic oligonucleotide
  Target: SCN10A; (-) strand; PAM type: YTN; PAM sequence: TTG
tcagaggagtttatttaggc

SEQ ID NO: 41088 - DNA, 20 bp, Artificial Sequence
  Description of Artificial Sequence: Synthetic oligonucleotide
  Target: SCN10A; (-) strand; PAM type: YTN; PAM sequence: CTG
aatggagtaagaattgtcag

SEQ ID NO: 41089 - DNA, 20 bp, Artificial Sequence
  Description of Artificial Sequence: Synthetic oligonucleotide
  Target: SCN10A; (-) strand; PAM type: YTN; PAM sequence: TTG
tatgaactgaatggagtaag

SEQ ID NO: 41090 - DNA, 20 bp, Artificial Sequence
  Description of Artificial Sequence: Synthetic oligonucleotide
  Target: SCN10A; (-) strand; PAM type: YTN; PAM sequence: TTA
attgtatgaactgaatggag

SEQ ID NO: 41091 - DNA, 20 bp, Artificial Sequence
  Description of Artificial Sequence: Synthetic oligonucleotide
  Target: SCN10A; (-) strand; PAM type: YTN; PAM sequence: TTA
agcccccaaaagattaattg

SEQ ID NO: 41092 - DNA, 20 bp, Artificial Sequence
  Description of Artificial Sequence: Synthetic oligonucleotide
  Target: SCN10A; (-) strand; PAM type: YTN; PAM sequence: CTC
caagaacaagagataaaata

SEQ ID NO: 41093 - DNA, 20 bp, Artificial Sequence
  Description of Artificial Sequence: Synthetic oligonucleotide
  Target: SCN10A; (-) strand; PAM type: YTN; PAM sequence: CTG
ctccaagaacaagagataaa

SEQ ID NO: 41094 - DNA, 20 bp, Artificial Sequence
  Description of Artificial Sequence: Synthetic oligonucleotide
  Target: SCN10A; (-) strand; PAM type: YTN; PAM sequence: CTA
tatgatgggcactgctccaa

SEQ ID NO: 41095 - DNA, 20 bp, Artificial Sequence
  Description of Artificial Sequence: Synthetic oligonucleotide
  Target: SCN10A; (-) strand; PAM type: YTN; PAM sequence: TTA
cgtactatatgatgggcact

SEQ ID NO: 41096 - DNA, 20 bp, Artificial Sequence
  Description of Artificial Sequence: Synthetic oligonucleotide
  Target: SCN10A; (-) strand; PAM type: YTN; PAM sequence: TTA
attacgtactatatgatggg

SEQ ID NO: 41097 - DNA, 20 bp, Artificial Sequence
  Description of Artificial Sequence: Synthetic oligonucleotide
  Target: SCN10A; (-) strand; PAM type: YTN; PAM sequence: TTA
ttaattacgtactatatgat

SEQ ID NO: 41098 - DNA, 20 bp, Artificial Sequence
  Description of Artificial Sequence: Synthetic oligonucleotide
  Target: SCN10A; (-) strand; PAM type: YTN; PAM sequence: CTG
caaatgttattaattacgta

SEQ ID NO: 41099 - DNA, 20 bp, Artificial Sequence
  Description of Artificial Sequence: Synthetic oligonucleotide
  Target: SCN10A; (-) strand; PAM type: YTN; PAM sequence: TTC
atcctgcaaatgttattaat

SEQ ID NO: 41100 - DNA, 20 bp, Artificial Sequence
  Description of Artificial Sequence: Synthetic oligonucleotide
  Target: SCN10A; (-) strand; PAM type: YTN; PAM sequence: TTC
attcatcctgcaaatgttat

SEQ ID NO: 41101 - DNA, 20 bp, Artificial Sequence
  Description of Artificial Sequence: Synthetic oligonucleotide
  Target: SCN10A; (-) strand; PAM type: YTN; PAM sequence: TTT
cattcatcctgcaaatgtta

SEQ ID NO: 41102 - DNA, 20 bp, Artificial Sequence
  Description of Artificial Sequence: Synthetic oligonucleotide
  Target: SCN10A; (-) strand; PAM type: YTN; PAM sequence: CTT
tcattcatcctgcaaatgtt

SEQ ID NO: 41103 - DNA, 20 bp, Artificial Sequence
  Description of Artificial Sequence: Synthetic oligonucleotide
  Target: SCN10A; (-) strand; PAM type: YTN; PAM sequence: TTC
tttcattcatcctgcaaatg

SEQ ID NO: 41104 - DNA, 20 bp, Artificial Sequence
  Description of Artificial Sequence: Synthetic oligonucleotide
  Target: SCN10A; (-) strand; PAM type: YTN; PAM sequence: TTT
ctttcattcatcctgcaaat

SEQ ID NO: 41105 - DNA, 20 bp, Artificial Sequence
  Description of Artificial Sequence: Synthetic oligonucleotide
  Target: SCN10A; (-) strand; PAM type: YTN; PAM sequence: TTA
atataatcagaagaaaaagt

SEQ ID NO: 41106 - DNA, 20 bp, Artificial Sequence
  Description of Artificial Sequence: Synthetic oligonucleotide
  Target: SCN10A; (-) strand; PAM type: YTN; PAM sequence: CTC
catagttaatataatcagaa

SEQ ID NO: 41107 - DNA, 20 bp, Artificial Sequence
  Description of Artificial Sequence: Synthetic oligonucleotide
  Target: SCN10A; (-) strand; PAM type: YTN; PAM sequence: CTG
gcgtccagaactccatagtt

SEQ ID NO: 41108 - DNA, 20 bp, Artificial Sequence
  Description of Artificial Sequence: Synthetic oligonucleotide
  Target: SCN10A; (-) strand; PAM type: YTN; PAM sequence: TTA
cctggcgtccagaactccat

SEQ ID NO: 41109 - DNA, 20 bp, Artificial Sequence
  Description of Artificial Sequence: Synthetic oligonucleotide
  Target: SCN10A; (-) strand; PAM type: YTN; PAM sequence: TTA
cattacctggcgtccagaac

SEQ ID NO: 41110 - DNA, 20 bp, Artificial Sequence
  Description of Artificial Sequence: Synthetic oligonucleotide
  Target: SCN10A; (-) strand; PAM type: YTN; PAM sequence: TTT
acattacctggcgtccagaa

SEQ ID NO: 41111 - DNA, 20 bp, Artificial Sequence
  Description of Artificial Sequence: Synthetic oligonucleotide
  Target: SCN10A; (-) strand; PAM type: YTN; PAM sequence: TTT
tacattacctggcgtccaga

SEQ ID NO: 41112 - DNA, 20 bp, Artificial Sequence
  Description of Artificial Sequence: Synthetic oligonucleotide
  Target: SCN10A; (-) strand; PAM type: YTN; PAM sequence: TTT
ttacattacctggcgtccag

SEQ ID NO: 41113 - DNA, 20 bp, Artificial Sequence
  Description of Artificial Sequence: Synthetic oligonucleotide
  Target: SCN10A; (-) strand; PAM type: YTN; PAM sequence: TTA
aggaggagagtttttacatt

SEQ ID NO: 41114 - DNA, 20 bp, Artificial Sequence
  Description of Artificial Sequence: Synthetic oligonucleotide
  Target: SCN10A; (-) strand; PAM type: YTN; PAM sequence: CTC
ataatcagacattaaggagg

SEQ ID NO: 41115 - DNA, 20 bp, Artificial Sequence
  Description of Artificial Sequence: Synthetic oligonucleotide
  Target: SCN10A; (-) strand; PAM type: YTN; PAM sequence: TTC
acatctcataatcagacatt

SEQ ID NO: 41116 - DNA, 20 bp, Artificial Sequence
  Description of Artificial Sequence: Synthetic oligonucleotide
  Target: SCN10A; (-) strand; PAM type: YTN; PAM sequence: CTG
ttcacatctcataatcagac

SEQ ID NO: 41117 - DNA, 20 bp, Artificial Sequence
  Description of Artificial Sequence: Synthetic oligonucleotide
  Target: SCN10A; (-) strand; PAM type: YTN; PAM sequence: TTC
cagagtctgttcacatctca

SEQ ID NO: 41118 - DNA, 20 bp, Artificial Sequence
  Description of Artificial Sequence: Synthetic oligonucleotide
  Target: SCN10A; (-) strand; PAM type: YTN; PAM sequence: TTG
aatacattccagagtctgtt

SEQ ID NO: 41119 - DNA, 20 bp, Artificial Sequence
  Description of Artificial Sequence: Synthetic oligonucleotide
  Target: SCN10A; (-) strand; PAM type: YTN; PAM sequence: TTT
gaatacattccagagtctgt

SEQ ID NO: 41120 - DNA, 20 bp, Artificial Sequence
  Description of Artificial Sequence: Synthetic oligonucleotide
  Target: SCN10A; (-) strand; PAM type: YTN; PAM sequence: TTT
tgaatacattccagagtctg

SEQ ID NO: 41121 - DNA, 20 bp, Artificial Sequence
  Description of Artificial Sequence: Synthetic oligonucleotide
  Target: SCN10A; (-) strand; PAM type: YTN; PAM sequence: CTT
ttgaatacattccagagtct

SEQ ID NO: 41122 - DNA, 20 bp, Artificial Sequence
  Description of Artificial Sequence: Synthetic oligonucleotide
  Target: SCN10A; (-) strand; PAM type: YTN; PAM sequence: CTA
aagaggcagcttttgaatac

SEQ ID NO: 41123 - DNA, 20 bp, Artificial Sequence
  Description of Artificial Sequence: Synthetic oligonucleotide
  Target: SCN10A; (-) strand; PAM type: YTN; PAM sequence: TTG
tgtagctaaagaggcagctt

SEQ ID NO: 41124 - DNA, 20 bp, Artificial Sequence
  Description of Artificial Sequence: Synthetic oligonucleotide
  Target: SCN10A; (-) strand; PAM type: YTN; PAM sequence: CTG
ttgtgtagctaaagaggcag

SEQ ID NO: 41125 - DNA, 20 bp, Artificial Sequence
  Description of Artificial Sequence: Synthetic oligonucleotide
  Target: SCN10A; (-) strand; PAM type: YTN; PAM sequence: TTC
tgttgtgtagctaaagaggc

SEQ ID NO: 41126 - DNA, 20 bp, Artificial Sequence
  Description of Artificial Sequence: Synthetic oligonucleotide
  Target: SCN10A; (-) strand; PAM type: YTN; PAM sequence: TTT
ctgttgtgtagctaaagagg

SEQ ID NO: 41127 - DNA, 20 bp, Artificial Sequence
  Description of Artificial Sequence: Synthetic oligonucleotide
  Target: SCN10A; (-) strand; PAM type: YTN; PAM sequence: CTT
tctgttgtgtagctaaagag

SEQ ID NO: 41128 - DNA, 20 bp, Artificial Sequence
  Description of Artificial Sequence: Synthetic oligonucleotide
  Target: SCN10A; (-) strand; PAM type: YTN; PAM sequence: CTG
gacctttctgttgtgtagct

SEQ ID NO: 41129 - DNA, 20 bp, Artificial Sequence
  Description of Artificial Sequence: Synthetic oligonucleotide
  Target: SCN10A; (-) strand; PAM type: YTN; PAM sequence: CTG
aaatggctggacctttctgt

SEQ ID NO: 41130 - DNA, 20 bp, Artificial Sequence
  Description of Artificial Sequence: Synthetic oligonucleotide
  Target: SCN10A; (-) strand; PAM type: YTN; PAM sequence: CTG
aggctgaaatggctggacct

SEQ ID NO: 41131 - DNA, 20 bp, Artificial Sequence
  Description of Artificial Sequence: Synthetic oligonucleotide
  Target: SCN10A; (-) strand; PAM type: YTN; PAM sequence: TTC
tgaggctgaaatggctggac

SEQ ID NO: 41132 - DNA, 20 bp, Artificial Sequence
  Description of Artificial Sequence: Synthetic oligonucleotide
  Target: SCN10A; (-) strand; PAM type: YTN; PAM sequence: TTT
ctgaggctgaaatggctgga

SEQ ID NO: 41133 - DNA, 20 bp, Artificial Sequence
  Description of Artificial Sequence: Synthetic oligonucleotide
  Target: SCN10A; (-) strand; PAM type: YTN; PAM sequence: TTT
tctgaggctgaaatggctgg

SEQ ID NO: 41134 - DNA, 20 bp, Artificial Sequence
  Description of Artificial Sequence: Synthetic oligonucleotide
  Target: SCN10A; (-) strand; PAM type: YTN; PAM sequence: CTT
ttctgaggctgaaatggctg

SEQ ID NO: 41135 - DNA, 20 bp, Artificial Sequence
  Description of Artificial Sequence: Synthetic oligonucleotide
  Target: SCN10A; (-) strand; PAM type: YTN; PAM sequence: CTC
ttttctgaggctgaaatggc

SEQ ID NO: 41136 - DNA, 20 bp, Artificial Sequence
  Description of Artificial Sequence: Synthetic oligonucleotide
  Target: SCN10A; (-) strand; PAM type: YTN; PAM sequence: TTA
tatgggaaaagcactctttt

SEQ ID NO: 41137 - DNA, 20 bp, Artificial Sequence
  Description of Artificial Sequence: Synthetic oligonucleotide
  Target: SCN10A; (-) strand; PAM type: YTN; PAM sequence: TTT
atatgggaaaagcactcttt

SEQ ID NO: 41138 - DNA, 20 bp, Artificial Sequence
  Description of Artificial Sequence: Synthetic oligonucleotide
  Target: SCN10A; (-) strand; PAM type: YTN; PAM sequence: CTG
ccccatttatatgggaaaag

SEQ ID NO: 41139 - DNA, 20 bp, Artificial Sequence
  Description of Artificial Sequence: Synthetic oligonucleotide
  Target: SCN10A; (-) strand; PAM type: YTN; PAM sequence: CTC
catggtgcctgccccattta

SEQ ID NO: 41140 - DNA, 20 bp, Artificial Sequence
  Description of Artificial Sequence: Synthetic oligonucleotide
  Target: SCN10A; (-) strand; PAM type: YTN; PAM sequence: CTG
tagaactccatggtgcctgc

SEQ ID NO: 41141 - DNA, 20 bp, Artificial Sequence
  Description of Artificial Sequence: Synthetic oligonucleotide
  Target: SCN10A; (-) strand; PAM type: YTN; PAM sequence: CTC
gtgctgtagaactccatggt

SEQ ID NO: 41142 - DNA, 20 bp, Artificial Sequence
  Description of Artificial Sequence: Synthetic oligonucleotide
  Target: SCN10A; (-) strand; PAM type: YTN; PAM sequence: TTC
gcatctcgtgctgtagaact

SEQ ID NO: 41143 - DNA, 20 bp, Artificial Sequence
  Description of Artificial Sequence: Synthetic oligonucleotide
  Target: SCN10A; (-) strand; PAM type: YTN; PAM sequence: CTT
cgcatctcgtgctgtagaac

SEQ ID NO: 41144 - DNA, 20 bp, Artificial Sequence
  Description of Artificial Sequence: Synthetic oligonucleotide
  Target: SCN10A; (-) strand; PAM type: YTN; PAM sequence: CTA
tagacttcgcatctcgtgct

SEQ ID NO: 41145 - DNA, 20 bp, Artificial Sequence
  Description of Artificial Sequence: Synthetic oligonucleotide
  Target: SCN10A; (-) strand; PAM type: YTN; PAM sequence: TTC
tatagacttcgcatctcgtg

SEQ ID NO: 41146 - DNA, 20 bp, Artificial Sequence
  Description of Artificial Sequence: Synthetic oligonucleotide
  Target: SCN10A; (-) strand; PAM type: YTN; PAM sequence: TTT
ctatagacttcgcatctcgt

SEQ ID NO: 41147 - DNA, 20 bp, Artificial Sequence
  Description of Artificial Sequence: Synthetic oligonucleotide
  Target: SCN10A; (-) strand; PAM type: YTN; PAM sequence: CTT
tctatagacttcgcatctcg

SEQ ID NO: 41148 - DNA, 20 bp, Artificial Sequence
  Description of Artificial Sequence: Synthetic oligonucleotide
  Target: SCN10A; (-) strand; PAM type: YTN; PAM sequence: TTG
gtgggaagggaagaaaatga

SEQ ID NO: 41149 - DNA, 20 bp, Artificial Sequence
  Description of Artificial Sequence: Synthetic oligonucleotide
  Target: SCN10A; (-) strand; PAM type: YTN; PAM sequence: TTG
taaaattggtgggaagggaa

SEQ ID NO: 41150 - DNA, 20 bp, Artificial Sequence
  Description of Artificial Sequence: Synthetic oligonucleotide
  Target: SCN10A; (-) strand; PAM type: YTN; PAM sequence: CTT
gtaaaattggtgggaaggga

SEQ ID NO: 41151 - DNA, 20 bp, Artificial Sequence
  Description of Artificial Sequence: Synthetic oligonucleotide
  Target: SCN10A; (-) strand; PAM type: YTN; PAM sequence: CTC
acttgtaaaattggtgggaa

SEQ ID NO: 41152 - DNA, 20 bp, Artificial Sequence
  Description of Artificial Sequence: Synthetic oligonucleotide
  Target: SCN10A; (-) strand; PAM type: YTN; PAM sequence: TTC
ctcacttgtaaaattggtgg

SEQ ID NO: 41153 - DNA, 20 bp, Artificial Sequence
  Description of Artificial Sequence: Synthetic oligonucleotide
  Target: SCN10A; (-) strand; PAM type: YTN; PAM sequence: TTT
cctcacttgtaaaattggtg

SEQ ID NO: 41154 - DNA, 20 bp, Artificial Sequence
  Description of Artificial Sequence: Synthetic oligonucleotide
  Target: SCN10A; (-) strand; PAM type: YTN; PAM sequence: TTC
aatttcctcacttgtaaaat

SEQ ID NO: 41155 - DNA, 20 bp, Artificial Sequence
  Description of Artificial Sequence: Synthetic oligonucleotide
  Target: SCN10A; (-) strand; PAM type: YTN; PAM sequence: CTT
caatttcctcacttgtaaaa

SEQ ID NO: 41156 - DNA, 20 bp, Artificial Sequence
  Description of Artificial Sequence: Synthetic oligonucleotide
  Target: SCN10A; (-) strand; PAM type: YTN; PAM sequence: TTA
acttcaatttcctcacttgt

SEQ ID NO: 41157 - DNA, 20 bp, Artificial Sequence
  Description of Artificial Sequence: Synthetic oligonucleotide
  Target: SCN10A; (-) strand; PAM type: YTN; PAM sequence: CTT
aacttcaatttcctcacttg

SEQ ID NO: 41158 - DNA, 20 bp, Artificial Sequence
  Description of Artificial Sequence: Synthetic oligonucleotide
  Target: SCN10A; (-) strand; PAM type: YTN; PAM sequence: CTC
ttaacttcaatttcctcact

SEQ ID NO: 41159 - DNA, 20 bp, Artificial Sequence
  Description of Artificial Sequence: Synthetic oligonucleotide
  Target: SCN10A; (-) strand; PAM type: YTN; PAM sequence: TTC
ccctcttaacttcaatttcc

SEQ ID NO: 41160 - DNA, 20 bp, Artificial Sequence
  Description of Artificial Sequence: Synthetic oligonucleotide
  Target: SCN10A; (-) strand; PAM type: YTN; PAM sequence: TTT
cccctcttaacttcaatttc

SEQ ID NO: 41161 - DNA, 20 bp, Artificial Sequence
  Description of Artificial Sequence: Synthetic oligonucleotide
  Target: SCN10A; (-) strand; PAM type: YTN; PAM sequence: CTT
tcccctcttaacttcaattt

SEQ ID NO: 41162 - DNA, 20 bp, Artificial Sequence
  Description of Artificial Sequence: Synthetic oligonucleotide
  Target: SCN10A; (-) strand; PAM type: YTN; PAM sequence: CTA
aagtctttcccctcttaact

SEQ ID NO: 41163 - DNA, 20 bp, Artificial Sequence
  Description of Artificial Sequence: Synthetic oligonucleotide
  Target: SCN10A; (-) strand; PAM type: YTN; PAM sequence: CTG
accagggctaaagtctttcc

SEQ ID NO: 41164 - DNA, 20 bp, Artificial Sequence
  Description of Artificial Sequence: Synthetic oligonucleotide
  Target: SCN10A; (-) strand; PAM type: YTN; PAM sequence: CTG
gctgaccagggctaaagtct
